United States Patent 11,421,016 (CANCER NEOEPITOPES) - sequence listing, part 12

SEQ ID NO: 509044 - protein, 9 aa, Homo Sapiens
ARLEELPHE

SEQ ID NO: 509045 - protein, 9 aa, Homo Sapiens
SLKAVKRKI

SEQ ID NO: 509046 - protein, 9 aa, Homo Sapiens
KQACGFDYT

SEQ ID NO: 509047 - protein, 9 aa, Homo Sapiens
SSDSSFEVS

SEQ ID NO: 509048 - protein, 9 aa, Homo Sapiens
PLSEITKQE

SEQ ID NO: 509049 - protein, 9 aa, Homo Sapiens
EEGPFHFLP

SEQ ID NO: 509050 - protein, 9 aa, Homo Sapiens
KPGRGPLEH

SEQ ID NO: 509051 - protein, 9 aa, Homo Sapiens
LTMKPEEIL

SEQ ID NO: 509052 - protein, 9 aa, Homo Sapiens
APTPAPSLA

SEQ ID NO: 509053 - protein, 9 aa, Homo Sapiens
LKTSEFQAK

SEQ ID NO: 509054 - protein, 9 aa, Homo Sapiens
EEILRLREE

SEQ ID NO: 509055 - protein, 9 aa, Homo Sapiens
EQAIKRKHT

SEQ ID NO: 509056 - protein, 9 aa, Homo Sapiens
PMDQEDLES

SEQ ID NO: 509057 - protein, 9 aa, Homo Sapiens
AARRHAASQ

SEQ ID NO: 509058 - protein, 9 aa, Homo Sapiens
ELSSLKHLE

SEQ ID NO: 509059 - protein, 9 aa, Homo Sapiens
KLKLMRTLP

SEQ ID NO: 509060 - protein, 9 aa, Homo Sapiens
LKQHTQKSV

SEQ ID NO: 509061 - protein, 9 aa, Homo Sapiens
GPNLLHKHK

SEQ ID NO: 509062 - protein, 9 aa, Homo Sapiens
KKVPAQEGV

SEQ ID NO: 509063 - protein, 9 aa, Homo Sapiens
VVPEVECPS

SEQ ID NO: 509064 - protein, 9 aa, Homo Sapiens
NSKINCELQ

SEQ ID NO: 509065 - protein, 9 aa, Homo Sapiens
AGIAKVMVA

SEQ ID NO: 509066 - protein, 9 aa, Homo Sapiens
FHGARDSNV

SEQ ID NO: 509067 - protein, 9 aa, Homo Sapiens
TSERKKWIH

SEQ ID NO: 509068 - protein, 9 aa, Homo Sapiens
HAASQSCCP

SEQ ID NO: 509069 - protein, 9 aa, Homo Sapiens
CVLNSDVLQ

SEQ ID NO: 509070 - protein, 9 aa, Homo Sapiens
LRRAQGPNG

SEQ ID NO: 509071 - protein, 9 aa, Homo Sapiens
VWLEWRHVQ

SEQ ID NO: 509072 - protein, 9 aa, Homo Sapiens
ANGMILGGP

SEQ ID NO: 509073 - protein, 9 aa, Homo Sapiens
PPRLPRLWS

SEQ ID NO: 509074 - protein, 9 aa, Homo Sapiens
NYAQFAIIN

SEQ ID NO: 509075 - protein, 9 aa, Homo Sapiens
KTSEFQAKV

SEQ ID NO: 509076 - protein, 9 aa, Homo Sapiens
EPWCYTTDP

SEQ ID NO: 509077 - protein, 9 aa, Homo Sapiens
LETQITSHG

SEQ ID NO: 509078 - protein, 9 aa, Homo Sapiens
PNTKDQGYT

SEQ ID NO: 509079 - protein, 9 aa, Homo Sapiens
ETQINKMLC

SEQ ID NO: 509080 - protein, 9 aa, Homo Sapiens
HTGKTPYKC

SEQ ID NO: 509081 - protein, 9 aa, Homo Sapiens
DNQLKSMWF

SEQ ID NO: 509082 - protein, 9 aa, Homo Sapiens
KLIDIQQKI

SEQ ID NO: 509083 - protein, 9 aa, Homo Sapiens
CAHEAQKKT

SEQ ID NO: 509084 - protein, 9 aa, Homo Sapiens
KHGNPLTSR

SEQ ID NO: 509085 - protein, 9 aa, Homo Sapiens
QESFMSHIV

SEQ ID NO: 509086 - protein, 9 aa, Homo Sapiens
DGTAFLALA

SEQ ID NO: 509087 - protein, 9 aa, Homo Sapiens
QDNSDKIEF

SEQ ID NO: 509088 - protein, 9 aa, Homo Sapiens
QHKYRYRYP

SEQ ID NO: 509089 - protein, 9 aa, Homo Sapiens
HHPTVAKYA

SEQ ID NO: 509090 - protein, 9 aa, Homo Sapiens
VFPDACKKF

SEQ ID NO: 509091 - protein, 9 aa, Homo Sapiens
SKMIDRNPR

SEQ ID NO: 509092 - protein, 9 aa, Homo Sapiens
SNSNEATTG

SEQ ID NO: 509093 - protein, 9 aa, Homo Sapiens
YHDKHGNPL

SEQ ID NO: 509094 - protein, 9 aa, Homo Sapiens
GLVEQKVLC

SEQ ID NO: 509095 - protein, 9 aa, Homo Sapiens
DGLPEKVDD

SEQ ID NO: 509096 - protein, 9 aa, Homo Sapiens
LAKWAEDRT

SEQ ID NO: 509097 - protein, 9 aa, Homo Sapiens
HPMLENVET

SEQ ID NO: 509098 - protein, 9 aa, Homo Sapiens
PETHTSFGM

SEQ ID NO: 509099 - protein, 9 aa, Homo Sapiens
TVAGEEINK

SEQ ID NO: 509100 - protein, 9 aa, Homo Sapiens
AKGSWPLEF

SEQ ID NO: 509101 - protein, 9 aa, Homo Sapiens
GLRRAQGPN

SEQ ID NO: 509102 - protein, 9 aa, Homo Sapiens
VSPYQTQNQ

SEQ ID NO: 509103 - protein, 9 aa, Homo Sapiens
SQASGLKAS

SEQ ID NO: 509104 - protein, 9 aa, Homo Sapiens
KPNTKDQGY

SEQ ID NO: 509105 - protein, 9 aa, Homo Sapiens
AYLPGHPDI

SEQ ID NO: 509106 - protein, 9 aa, Homo Sapiens
KGNNQILQH

SEQ ID NO: 509107 - protein, 9 aa, Homo Sapiens
GTAFLALAR

SEQ ID NO: 509108 - protein, 9 aa, Homo Sapiens
SGLGLLETQ

SEQ ID NO: 509109 - protein, 9 aa, Homo Sapiens
RNISGTLYM

SEQ ID NO: 509110 - protein, 9 aa, Homo Sapiens
SQLAFTVNV

SEQ ID NO: 509111 - protein, 9 aa, Homo Sapiens
LVTGSAPGW

SEQ ID NO: 509112 - protein, 9 aa, Homo Sapiens
QASGLKASA

SEQ ID NO: 509113 - protein, 9 aa, Homo Sapiens
SGHTTPIPV

SEQ ID NO: 509114 - protein, 9 aa, Homo Sapiens
NPHLEGQPL

SEQ ID NO: 509115 - protein, 9 aa, Homo Sapiens
EEITHIPEE

SEQ ID NO: 509116 - protein, 9 aa, Homo Sapiens
FDVGGQTSE

SEQ ID NO: 509117 - protein, 9 aa, Homo Sapiens
EDRTGFPWI

SEQ ID NO: 509118 - protein, 9 aa, Homo Sapiens
VEDCNIPST

SEQ ID NO: 509119 - protein, 9 aa, Homo Sapiens
SIIQRICAT

SEQ ID NO: 509120 - protein, 9 aa, Homo Sapiens
SLAPVPVSP

SEQ ID NO: 509121 - protein, 9 aa, Homo Sapiens
DRVPLYSQG

SEQ ID NO: 509122 - protein, 9 aa, Homo Sapiens
VLQHSAAQK

SEQ ID NO: 509123 - protein, 9 aa, Homo Sapiens
KVPAQEGVM

SEQ ID NO: 509124 - protein, 9 aa, Homo Sapiens
KVAGIAKVM

SEQ ID NO: 509125 - protein, 9 aa, Homo Sapiens
GIRARVPKV

SEQ ID NO: 509126 - protein, 9 aa, Homo Sapiens
IFITDGVSP

SEQ ID NO: 509127 - protein, 9 aa, Homo Sapiens
VFRMETEYG

SEQ ID NO: 509128 - protein, 9 aa, Homo Sapiens
STEETVFPK

SEQ ID NO: 509129 - protein, 9 aa, Homo Sapiens
WKTLRRRTQ

SEQ ID NO: 509130 - protein, 9 aa, Homo Sapiens
VEVLNTIEK

SEQ ID NO: 509131 - protein, 9 aa, Homo Sapiens
QVLRVKGAN

SEQ ID NO: 509132 - protein, 9 aa, Homo Sapiens
KRTIIECSS

SEQ ID NO: 509133 - protein, 9 aa, Homo Sapiens
EGGVVARAQ

SEQ ID NO: 509134 - protein, 9 aa, Homo Sapiens
PMSYCYAIR

SEQ ID NO: 509135 - protein, 9 aa, Homo Sapiens
YMNRLGSGG

SEQ ID NO: 509136 - protein, 9 aa, Homo Sapiens
PRSPPRLPR

SEQ ID NO: 509137 - protein, 9 aa, Homo Sapiens
SYCYAIRLS

SEQ ID NO: 509138 - protein, 9 aa, Homo Sapiens
EAQSLETNS

SEQ ID NO: 509139 - protein, 9 aa, Homo Sapiens
KKACNTQLN

SEQ ID NO: 509140 - protein, 9 aa, Homo Sapiens
KEKSSNTTK

SEQ ID NO: 509141 - protein, 9 aa, Homo Sapiens
EPQLTVHHR

SEQ ID NO: 509142 - protein, 9 aa, Homo Sapiens
YSKTQKVSK

SEQ ID NO: 509143 - protein, 9 aa, Homo Sapiens
EITHIPEEK

SEQ ID NO: 509144 - protein, 9 aa, Homo Sapiens
FPKIKSRSC

SEQ ID NO: 509145 - protein, 9 aa, Homo Sapiens
EEKLNLDSG

SEQ ID NO: 509146 - protein, 9 aa, Homo Sapiens
SAMNLAPVL

SEQ ID NO: 509147 - protein, 9 aa, Homo Sapiens
SLAKAGPPA

SEQ ID NO: 509148 - protein, 9 aa, Homo Sapiens
SPEVTLACL

SEQ ID NO: 509149 - protein, 9 aa, Homo Sapiens
TGDPNPRVT

SEQ ID NO: 509150 - protein, 9 aa, Homo Sapiens
FEKFFQVYE

SEQ ID NO: 509151 - protein, 9 aa, Homo Sapiens
QALGKGCEA

SEQ ID NO: 509152 - protein, 9 aa, Homo Sapiens
KVRLGQAGF

SEQ ID NO: 509153 - protein, 9 aa, Homo Sapiens
EYETQINKM

SEQ ID NO: 509154 - protein, 9 aa, Homo Sapiens
NIKTAKAQL

SEQ ID NO: 509155 - protein, 9 aa, Homo Sapiens
KGHDTDTRD

SEQ ID NO: 509156 - protein, 9 aa, Homo Sapiens
QKVSKIETL

SEQ ID NO: 509157 - protein, 9 aa, Homo Sapiens
AQGPNGGLT

SEQ ID NO: 509158 - protein, 9 aa, Homo Sapiens
PVPDDDQTT

SEQ ID NO: 509159 - protein, 9 aa, Homo Sapiens
SQTSFHFRK

SEQ ID NO: 509160 - protein, 9 aa, Homo Sapiens
LADVMDNQL

SEQ ID NO: 509161 - protein, 9 aa, Homo Sapiens
YVFRMETEY

SEQ ID NO: 509162 - protein, 9 aa, Homo Sapiens
VCQATGDPN

SEQ ID NO: 509163 - protein, 9 aa, Homo Sapiens
KTKGHDTDT

SEQ ID NO: 509164 - protein, 9 aa, Homo Sapiens
GTYVFRMET

SEQ ID NO: 509165 - protein, 9 aa, Homo Sapiens
NLLHKHKSS

SEQ ID NO: 509166 - protein, 9 aa, Homo Sapiens
AYTPETHTS

SEQ ID NO: 509167 - protein, 9 aa, Homo Sapiens
LKLKYQSYR

SEQ ID NO: 509168 - protein, 9 aa, Homo Sapiens
IIARANPTQ

SEQ ID NO: 509169 - protein, 9 aa, Homo Sapiens
GIAKVMVAQ

SEQ ID NO: 509170 - protein, 9 aa, Homo Sapiens
TESNSNEAT

SEQ ID NO: 509171 - protein, 9 aa, Homo Sapiens
GDSEQEEDD

SEQ ID NO: 509172 - protein, 9 aa, Homo Sapiens
TAKAQLAYE

SEQ ID NO: 509173 - protein, 9 aa, Homo Sapiens
SPVELERLK

SEQ ID NO: 509174 - protein, 9 aa, Homo Sapiens
AKHQKRLQQ

SEQ ID NO: 509175 - protein, 9 aa, Homo Sapiens
PVHLHVRSY

SEQ ID NO: 509176 - protein, 9 aa, Homo Sapiens
VMFGILTVM

SEQ ID NO: 509177 - protein, 9 aa, Homo Sapiens
STNFCIFIT

SEQ ID NO: 509178 - protein, 9 aa, Homo Sapiens
HQREATKIL

SEQ ID NO: 509179 - protein, 9 aa, Homo Sapiens
KVLADNGHN

SEQ ID NO: 509180 - protein, 9 aa, Homo Sapiens
GIVSKGNNQ

SEQ ID NO: 509181 - protein, 9 aa, Homo Sapiens
EAQKKTRRR

SEQ ID NO: 509182 - protein, 9 aa, Homo Sapiens
LNYLIGAAP

SEQ ID NO: 509183 - protein, 9 aa, Homo Sapiens
GENVNRVGT

SEQ ID NO: 509184 - protein, 9 aa, Homo Sapiens
KKTDICKDE

SEQ ID NO: 509185 - protein, 9 aa, Homo Sapiens
PGHPDIQWT

SEQ ID NO: 509186 - protein, 9 aa, Homo Sapiens
KQEKDFLWS

SEQ ID NO: 509187 - protein, 9 aa, Homo Sapiens
PRDHHMKDP

SEQ ID NO: 509188 - protein, 9 aa, Homo Sapiens
KVMFGILTV

SEQ ID NO: 509189 - protein, 9 aa, Homo Sapiens
KAGPPADPL

SEQ ID NO: 509190 - protein, 9 aa, Homo Sapiens
STELCPSPI

SEQ ID NO: 509191 - protein, 9 aa, Homo Sapiens
HEAQKKTRR

SEQ ID NO: 509192 - protein, 9 aa, Homo Sapiens
NWAVSPYQT

SEQ ID NO: 509193 - protein, 9 aa, Homo Sapiens
FALRDQHKY

SEQ ID NO: 509194 - protein, 9 aa, Homo Sapiens
HRTSSGTSI

SEQ ID NO: 509195 - protein, 9 aa, Homo Sapiens
TFCIVGFAD

SEQ ID NO: 509196 - protein, 9 aa, Homo Sapiens
IKQRERNNN

SEQ ID NO: 509197 - protein, 9 aa, Homo Sapiens
KELRSLPPD

SEQ ID NO: 509198 - protein, 9 aa, Homo Sapiens
PVYLNCVLN

SEQ ID NO: 509199 - protein, 9 aa, Homo Sapiens
IQEEDRKHT

SEQ ID NO: 509200 - protein, 9 aa, Homo Sapiens
RGMSPEVTL

SEQ ID NO: 509201 - protein, 9 aa, Homo Sapiens
LIVKEKCRL

SEQ ID NO: 509202 - protein, 9 aa, Homo Sapiens
LQRIGIGVS

SEQ ID NO: 509203 - protein, 9 aa, Homo Sapiens
IGKKKIKPF

SEQ ID NO: 509204 - protein, 9 aa, Homo Sapiens
RAQPGQPVH

SEQ ID NO: 509205 - protein, 9 aa, Homo Sapiens
NSNEATTGR

SEQ ID NO: 509206 - protein, 9 aa, Homo Sapiens
YVAPEILKC

SEQ ID NO: 509207 - protein, 9 aa, Homo Sapiens
ALRDQHKYR

SEQ ID NO: 509208 - protein, 9 aa, Homo Sapiens
WQDIQNYAQ

SEQ ID NO: 509209 - protein, 9 aa, Homo Sapiens
KTFHEASEH

SEQ ID NO: 509210 - protein, 9 aa, Homo Sapiens
LCHTYVLCT

SEQ ID NO: 509211 - protein, 9 aa, Homo Sapiens
YKTGQCIKP

SEQ ID NO: 509212 - protein, 9 aa, Homo Sapiens
HEASEHCIS

SEQ ID NO: 509213 - protein, 9 aa, Homo Sapiens
ARTSAWGLL

SEQ ID NO: 509214 - protein, 9 aa, Homo Sapiens
PAGDSEQEE

SEQ ID NO: 509215 - protein, 9 aa, Homo Sapiens
SMLDQTQIQ

SEQ ID NO: 509216 - protein, 9 aa, Homo Sapiens
EDDFPSSPE

SEQ ID NO: 509217 - protein, 9 aa, Homo Sapiens
PKVLADNGH

SEQ ID NO: 509218 - protein, 9 aa, Homo Sapiens
PDNDPQEPW

SEQ ID NO: 509219 - protein, 9 aa, Homo Sapiens
SYEDAVHFG

SEQ ID NO: 509220 - protein, 9 aa, Homo Sapiens
ADLAVILLR

SEQ ID NO: 509221 - protein, 9 aa, Homo Sapiens
PTVAKYAME

SEQ ID NO: 509222 - protein, 9 aa, Homo Sapiens
HMKDPSWIT

SEQ ID NO: 509223 - protein, 9 aa, Homo Sapiens
AEEGRGSQA

SEQ ID NO: 509224 - protein, 9 aa, Homo Sapiens
KESNLPWWR

SEQ ID NO: 509225 - protein, 9 aa, Homo Sapiens
DIQQKIQAL

SEQ ID NO: 509226 - protein, 9 aa, Homo Sapiens
GSQASGLKA

SEQ ID NO: 509227 - protein, 9 aa, Homo Sapiens
LAFTVNVPF

SEQ ID NO: 509228 - protein, 9 aa, Homo Sapiens
HHRTSSGTS

SEQ ID NO: 509229 - protein, 9 aa, Homo Sapiens
WLGCFWVSL

SEQ ID NO: 509230 - protein, 9 aa, Homo Sapiens
RTQEKVQEA

SEQ ID NO: 509231 - protein, 9 aa, Homo Sapiens
EWLHRFRGS

SEQ ID NO: 509232 - protein, 9 aa, Homo Sapiens
DGQEYVVQF

SEQ ID NO: 509233 - protein, 9 aa, Homo Sapiens
LTQLQLKRK

SEQ ID NO: 509234 - protein, 9 aa, Homo Sapiens
SGENVNRVG

SEQ ID NO: 509235 - protein, 9 aa, Homo Sapiens
GKRPELPSE

SEQ ID NO: 509236 - protein, 9 aa, Homo Sapiens
LATLADLSL

SEQ ID NO: 509237 - protein, 9 aa, Homo Sapiens
TPAPSLAPV

SEQ ID NO: 509238 - protein, 9 aa, Homo Sapiens
NSQRKRKHL

SEQ ID NO: 509239 - protein, 9 aa, Homo Sapiens
QLAFTVNVP

SEQ ID NO: 509240 - protein, 9 aa, Homo Sapiens
HLFIKIFTL

SEQ ID NO: 509241 - protein, 9 aa, Homo Sapiens
KKKIKPFKR

SEQ ID NO: 509242 - protein, 9 aa, Homo Sapiens
PELPSEISP

SEQ ID NO: 509243 - protein, 9 aa, Homo Sapiens
DDFPSSPEN

SEQ ID NO: 509244 - protein, 9 aa, Homo Sapiens
EKVMFGILT

SEQ ID NO: 509245 - protein, 9 aa, Homo Sapiens
QVLVVCKQL

SEQ ID NO: 509246 - protein, 9 aa, Homo Sapiens
LLQLTQLQL

SEQ ID NO: 509247 - protein, 9 aa, Homo Sapiens
PLYSQGARP

SEQ ID NO: 509248 - protein, 9 aa, Homo Sapiens
NEEITHIPE

SEQ ID NO: 509249 - protein, 9 aa, Homo Sapiens
VEAGDPPKE

SEQ ID NO: 509250 - protein, 9 aa, Homo Sapiens
KTLRRRTQE

SEQ ID NO: 509251 - protein, 9 aa, Homo Sapiens
SSSILSKHQ

SEQ ID NO: 509252 - protein, 9 aa, Homo Sapiens
IPYSIIQRI

SEQ ID NO: 509253 - protein, 9 aa, Homo Sapiens
VKALTSKAT

SEQ ID NO: 509254 - protein, 9 aa, Homo Sapiens
KPEEILRLR

SEQ ID NO: 509255 - protein, 9 aa, Homo Sapiens
PTITESNSN

SEQ ID NO: 509256 - protein, 9 aa, Homo Sapiens
RAVGDTNRA

SEQ ID NO: 509257 - protein, 9 aa, Homo Sapiens
AGDSEQEED

SEQ ID NO: 509258 - protein, 9 aa, Homo Sapiens
MYWTDWSRR

SEQ ID NO: 509259 - protein, 9 aa, Homo Sapiens
QFGKRPELP

SEQ ID NO: 509260 - protein, 9 aa, Homo Sapiens
AEQHHRTSS

SEQ ID NO: 509261 - protein, 9 aa, Homo Sapiens
ILEKVQDNS

SEQ ID NO: 509262 - protein, 9 aa, Homo Sapiens
RLEELPHED

SEQ ID NO: 509263 - protein, 9 aa, Homo Sapiens
SKEKSSNTT

SEQ ID NO: 509264 - protein, 9 aa, Homo Sapiens
ANLQESFMS

SEQ ID NO: 509265 - protein, 9 aa, Homo Sapiens
VQDNSDKIE

SEQ ID NO: 509266 - protein, 9 aa, Homo Sapiens
VHLHVRSYS

SEQ ID NO: 509267 - protein, 9 aa, Homo Sapiens
FHFRKPSVH

SEQ ID NO: 509268 - protein, 9 aa, Homo Sapiens
DTNRALSAS

SEQ ID NO: 509269 - protein, 9 aa, Homo Sapiens
ENGNKSSNS

SEQ ID NO: 509270 - protein, 9 aa, Homo Sapiens
HSAAQKHQQ

SEQ ID NO: 509271 - protein, 9 aa, Homo Sapiens
QKVLCRIHY

SEQ ID NO: 509272 - protein, 9 aa, Homo Sapiens
GEPMDQEDL

SEQ ID NO: 509273 - protein, 9 aa, Homo Sapiens
GDDVQQLCQ

SEQ ID NO: 509274 - protein, 9 aa, Homo Sapiens
VKGANGMIL

SEQ ID NO: 509275 - protein, 9 aa, Homo Sapiens
FLPDVLEEA

SEQ ID NO: 509276 - protein, 9 aa, Homo Sapiens
GHTTPIPVT

SEQ ID NO: 509277 - protein, 9 aa, Homo Sapiens
EQSGDGSRN

SEQ ID NO: 509278 - protein, 9 aa, Homo Sapiens
RSSRTSSSY

SEQ ID NO: 509279 - protein, 9 aa, Homo Sapiens
HFLPDVLEE

SEQ ID NO: 509280 - protein, 9 aa, Homo Sapiens
PSSCLPPNA

SEQ ID NO: 509281 - protein, 9 aa, Homo Sapiens
VCLQALEDG

SEQ ID NO: 509282 - protein, 9 aa, Homo Sapiens
LPDGTAFLA

SEQ ID NO: 509283 - protein, 9 aa, Homo Sapiens
MDQEDLESK

SEQ ID NO: 509284 - protein, 9 aa, Homo Sapiens
CGFDYTSKL

SEQ ID NO: 509285 - protein, 9 aa, Homo Sapiens
ADLSLHPES

SEQ ID NO: 509286 - protein, 9 aa, Homo Sapiens
HRCCRVADR

SEQ ID NO: 509287 - protein, 9 aa, Homo Sapiens
DFIRPRFWA

SEQ ID NO: 509288 - protein, 9 aa, Homo Sapiens
DEADDKDDS

SEQ ID NO: 509289 - protein, 9 aa, Homo Sapiens
LANLQESFM

SEQ ID NO: 509290 - protein, 9 aa, Homo Sapiens
TLYMNRLGS

SEQ ID NO: 509291 - protein, 9 aa, Homo Sapiens
GCGARGKPG

SEQ ID NO: 509292 - protein, 9 aa, Homo Sapiens
WRDGRDRQA

SEQ ID NO: 509293 - protein, 9 aa, Homo Sapiens
ILPEAKVRL

SEQ ID NO: 509294 - protein, 9 aa, Homo Sapiens
QHERIHTGK

SEQ ID NO: 509295 - protein, 9 aa, Homo Sapiens
PLDGIDAAG

SEQ ID NO: 509296 - protein, 9 aa, Homo Sapiens
MGGAASPEV

SEQ ID NO: 509297 - protein, 9 aa, Homo Sapiens
QQKIQALQT

SEQ ID NO: 509298 - protein, 9 aa, Homo Sapiens
KSQTSFHFR

SEQ ID NO: 509299 - protein, 9 aa, Homo Sapiens
MNLAPVLGT

SEQ ID NO: 509300 - protein, 9 aa, Homo Sapiens
AIKRKHTVL

SEQ ID NO: 509301 - protein, 9 aa, Homo Sapiens
GDPNPRVTW

SEQ ID NO: 509302 - protein, 9 aa, Homo Sapiens
NDDKTKGHD

SEQ ID NO: 509303 - protein, 9 aa, Homo Sapiens
GAEEGRGSQ

SEQ ID NO: 509304 - protein, 9 aa, Homo Sapiens
WFCIEKLPC

SEQ ID NO: 509305 - protein, 9 aa, Homo Sapiens
HKVMKAIND

SEQ ID NO: 509306 - protein, 9 aa, Homo Sapiens
LAAASSQAL

SEQ ID NO: 509307 - protein, 9 aa, Homo Sapiens
HIPEEKQDI

SEQ ID NO: 509308 - protein, 9 aa, Homo Sapiens
ATLADLSLH

SEQ ID NO: 509309 - protein, 9 aa, Homo Sapiens
SAWGLLAAV

SEQ ID NO: 509310 - protein, 9 aa, Homo Sapiens
REDKVEPGC

SEQ ID NO: 509311 - protein, 9 aa, Homo Sapiens
WLHRFRGSS

SEQ ID NO: 509312 - protein, 9 aa, Homo Sapiens
AKKVPAQEG

SEQ ID NO: 509313 - protein, 9 aa, Homo Sapiens
PGWDGGIAG

SEQ ID NO: 509314 - protein, 9 aa, Homo Sapiens
PFHFLPDVL

SEQ ID NO: 509315 - protein, 9 aa, Homo Sapiens
MAAVKALTS

SEQ ID NO: 509316 - protein, 9 aa, Homo Sapiens
EFQAKVQKD

SEQ ID NO: 509317 - protein, 9 aa, Homo Sapiens
QLNIHVARK

SEQ ID NO: 509318 - protein, 9 aa, Homo Sapiens
YVLADVMDN

SEQ ID NO: 509319 - protein, 9 aa, Homo Sapiens
LKLMRTLPR

SEQ ID NO: 509320 - protein, 9 aa, Homo Sapiens
WELSNHKVM

SEQ ID NO: 509321 - protein, 9 aa, Homo Sapiens
CDRVGTQER

SEQ ID NO: 509322 - protein, 9 aa, Homo Sapiens
LIPKVLADN

SEQ ID NO: 509323 - protein, 9 aa, Homo Sapiens
EVRGDGLPE

SEQ ID NO: 509324 - protein, 9 aa, Homo Sapiens
KLYRKLIVK

SEQ ID NO: 509325 - protein, 9 aa, Homo Sapiens
SSGHTTPIP

SEQ ID NO: 509326 - protein, 9 aa, Homo Sapiens
ESNKLRMDR

SEQ ID NO: 509327 - protein, 9 aa, Homo Sapiens
KQFNVEVLN

SEQ ID NO: 509328 - protein, 9 aa, Homo Sapiens
GQTSERKKW

SEQ ID NO: 509329 - protein, 9 aa, Homo Sapiens
ALKNGAVYL

SEQ ID NO: 509330 - protein, 9 aa, Homo Sapiens
GGQAHRCCR

SEQ ID NO: 509331 - protein, 9 aa, Homo Sapiens
DFPSSPENG

SEQ ID NO: 509332 - protein, 9 aa, Homo Sapiens
NPLRLFVKQ

SEQ ID NO: 509333 - protein, 9 aa, Homo Sapiens
KIPYSIIQR

SEQ ID NO: 509334 - protein, 9 aa, Homo Sapiens
QYLNSKINC

SEQ ID NO: 509335 - protein, 9 aa, Homo Sapiens
DPLSEITKQ

SEQ ID NO: 509336 - protein, 9 aa, Homo Sapiens
LHKHKSSDK

SEQ ID NO: 509337 - protein, 9 aa, Homo Sapiens
STSKLGTDL

SEQ ID NO: 509338 - protein, 9 aa, Homo Sapiens
ICKDEDEGD

SEQ ID NO: 509339 - protein, 9 aa, Homo Sapiens
PNGGLTAST

SEQ ID NO: 509340 - protein, 9 aa, Homo Sapiens
ISTELCPSP

SEQ ID NO: 509341 - protein, 9 aa, Homo Sapiens
HTYVLCTRS

SEQ ID NO: 509342 - protein, 9 aa, Homo Sapiens
VVAEGGTVW

SEQ ID NO: 509343 - protein, 9 aa, Homo Sapiens
NSLKAVKRK

SEQ ID NO: 509344 - protein, 9 aa, Homo Sapiens
PENGNKSSN

SEQ ID NO: 509345 - protein, 9 aa, Homo Sapiens
GSRNSGSRH

SEQ ID NO: 509346 - protein, 9 aa, Homo Sapiens
KFNQVESNK

SEQ ID NO: 509347 - protein, 9 aa, Homo Sapiens
PLDSVISTE

SEQ ID NO: 509348 - protein, 9 aa, Homo Sapiens
PNLLHKHKS

SEQ ID NO: 509349 - protein, 9 aa, Homo Sapiens
YLPGHPDIQ

SEQ ID NO: 509350 - protein, 9 aa, Homo Sapiens
DRNPREDGE

SEQ ID NO: 509351 - protein, 9 aa, Homo Sapiens
DFNDFIRPR

SEQ ID NO: 509352 - protein, 9 aa, Homo Sapiens
NIEWFCIEK

SEQ ID NO: 509353 - protein, 9 aa, Homo Sapiens
LPAAAAAAL

SEQ ID NO: 509354 - protein, 9 aa, Homo Sapiens
CQAGEEEFL

SEQ ID NO: 509355 - protein, 9 aa, Homo Sapiens
QHSAAQKHQ

SEQ ID NO: 509356 - protein, 9 aa, Homo Sapiens
DYIATYFSK

SEQ ID NO: 509357 - protein, 9 aa, Homo Sapiens
DTRSIKEAM

SEQ ID NO: 509358 - protein, 9 aa, Homo Sapiens
TSFHFRKPS

SEQ ID NO: 509359 - protein, 9 aa, Homo Sapiens
KLKYQSYRH

SEQ ID NO: 509360 - protein, 9 aa, Homo Sapiens
SNKLRMDRA

SEQ ID NO: 509361 - protein, 9 aa, Homo Sapiens
QRAVGDTNR

SEQ ID NO: 509362 - protein, 9 aa, Homo Sapiens
LAPTPAPSL

SEQ ID NO: 509363 - protein, 9 aa, Homo Sapiens
FGKRPELPS

SEQ ID NO: 509364 - protein, 9 aa, Homo Sapiens
PGQFVALLP

SEQ ID NO: 509365 - protein, 9 aa, Homo Sapiens
VTPEAKNLT

SEQ ID NO: 509366 - protein, 9 aa, Homo Sapiens
SVNFGATVD

SEQ ID NO: 509367 - protein, 9 aa, Homo Sapiens
FILKESNLP

SEQ ID NO: 509368 - protein, 9 aa, Homo Sapiens
GSAPGWDGG

SEQ ID NO: 509369 - protein, 9 aa, Homo Sapiens
GALPYAFTL

SEQ ID NO: 509370 - protein, 9 aa, Homo Sapiens
PAPSLAPVP

SEQ ID NO: 509371 - protein, 9 aa, Homo Sapiens
LDSGRTSTL

SEQ ID NO: 509372 - protein, 9 aa, Homo Sapiens
QQDNSQRKR

SEQ ID NO: 509373 - protein, 9 aa, Homo Sapiens
EDAVHFGAL

SEQ ID NO: 509374 - protein, 9 aa, Homo Sapiens
AFDYIATYF

SEQ ID NO: 509375 - protein, 9 aa, Homo Sapiens
VNIKTAKAQ

SEQ ID NO: 509376 - protein, 9 aa, Homo Sapiens
KAQLAYELQ

SEQ ID NO: 509377 - protein, 9 aa, Homo Sapiens
TDQEGPPPH

SEQ ID NO: 509378 - protein, 9 aa, Homo Sapiens
NFLRISSNS

SEQ ID NO: 509379 - protein, 9 aa, Homo Sapiens
LEGLESEAQ

SEQ ID NO: 509380 - protein, 9 aa, Homo Sapiens
EHIEVVKFL

SEQ ID NO: 509381 - protein, 9 aa, Homo Sapiens
NVPTCLNPH

SEQ ID NO: 509382 - protein, 9 aa, Homo Sapiens
DDQTTTKSQ

SEQ ID NO: 509383 - protein, 9 aa, Homo Sapiens
NGCILYKEY

SEQ ID NO: 509384 - protein, 9 aa, Homo Sapiens
QAFVLKSVF

SEQ ID NO: 509385 - protein, 9 aa, Homo Sapiens
AAALANAKS

SEQ ID NO: 509386 - protein, 9 aa, Homo Sapiens
SLPSGLGLL

SEQ ID NO: 509387 - protein, 9 aa, Homo Sapiens
KINCELQVP

SEQ ID NO: 509388 - protein, 9 aa, Homo Sapiens
EKRSKAFDY

SEQ ID NO: 509389 - protein, 9 aa, Homo Sapiens
QARQAPRLN

SEQ ID NO: 509390 - protein, 9 aa, Homo Sapiens
YMYWTDWSR

SEQ ID NO: 509391 - protein, 9 aa, Homo Sapiens
FNQVESNKL

SEQ ID NO: 509392 - protein, 9 aa, Homo Sapiens
SMPVHLHVR

SEQ ID NO: 509393 - protein, 9 aa, Homo Sapiens
GLPRDHHMK

SEQ ID NO: 509394 - protein, 9 aa, Homo Sapiens
IIECSSARS

SEQ ID NO: 509395 - protein, 9 aa, Homo Sapiens
IWWGDMATG

SEQ ID NO: 509396 - protein, 9 aa, Homo Sapiens
FMMLAALQL

SEQ ID NO: 509397 - protein, 9 aa, Homo Sapiens
INCELQVPP

SEQ ID NO: 509398 - protein, 9 aa, Homo Sapiens
FLRISSNSF

SEQ ID NO: 509399 - protein, 9 aa, Homo Sapiens
RKLIVKEKC

SEQ ID NO: 509400 - protein, 9 aa, Homo Sapiens
EQPPMGGAA

SEQ ID NO: 509401 - protein, 9 aa, Homo Sapiens
DRQALVSCR

SEQ ID NO: 509402 - protein, 9 aa, Homo Sapiens
ADECPPCFH

SEQ ID NO: 509403 - protein, 9 aa, Homo Sapiens
DRGTYVFRM

SEQ ID NO: 509404 - protein, 9 aa, Homo Sapiens
TITESNSNE

SEQ ID NO: 509405 - protein, 9 aa, Homo Sapiens
SSNTTKESR

SEQ ID NO: 509406 - protein, 9 aa, Homo Sapiens
VFDRGTYVF

SEQ ID NO: 509407 - protein, 9 aa, Homo Sapiens
QDNSQRKRK

SEQ ID NO: 509408 - protein, 9 aa, Homo Sapiens
LQPEECTET

SEQ ID NO: 509409 - protein, 9 aa, Homo Sapiens
MAGLNSLKA

SEQ ID NO: 509410 - protein, 9 aa, Homo Sapiens
SSYEEEEKE

SEQ ID NO: 509411 - protein, 9 aa, Homo Sapiens
DGIDAAGSQ

SEQ ID NO: 509412 - protein, 9 aa, Homo Sapiens
TQINKMLCS

SEQ ID NO: 509413 - protein, 9 aa, Homo Sapiens
LADLSLHPE

SEQ ID NO: 509414 - protein, 9 aa, Homo Sapiens
RRHAASQSC

SEQ ID NO: 509415 - protein, 9 aa, Homo Sapiens
DLSLHPESQ

SEQ ID NO: 509416 - protein, 9 aa, Homo Sapiens
EKVQDNSDK

SEQ ID NO: 509417 - protein, 9 aa, Homo Sapiens
AIKNAMRQR

SEQ ID NO: 509418 - protein, 9 aa, Homo Sapiens
PWRVCLQAL

SEQ ID NO: 509419 - protein, 9 aa, Homo Sapiens
KDQGYTTLA

SEQ ID NO: 509420 - protein, 9 aa, Homo Sapiens
ATVDGDFLT

SEQ ID NO: 509421 - protein, 9 aa, Homo Sapiens
VLADVMDNQ

SEQ ID NO: 509422 - protein, 9 aa, Homo Sapiens
IPSNGTGYV

SEQ ID NO: 509423 - protein, 9 aa, Homo Sapiens
QNWKNEQVL

SEQ ID NO: 509424 - protein, 9 aa, Homo Sapiens
VVSSAMNLA

SEQ ID NO: 509425 - protein, 9 aa, Homo Sapiens
NHSLKEIHQ

SEQ ID NO: 509426 - protein, 9 aa, Homo Sapiens
RSIKEAMNE

SEQ ID NO: 509427 - protein, 9 aa, Homo Sapiens
ECPPCFHGA

SEQ ID NO: 509428 - protein, 9 aa, Homo Sapiens
LTPIGLPRP

SEQ ID NO: 509429 - protein, 9 aa, Homo Sapiens
NQVESNKLR

SEQ ID NO: 509430 - protein, 9 aa, Homo Sapiens
RDPLSEITK

SEQ ID NO: 509431 - protein, 9 aa, Homo Sapiens
GATVDGDFL

SEQ ID NO: 509432 - protein, 9 aa, Homo Sapiens
GFDYTSKLQ

SEQ ID NO: 509433 - protein, 9 aa, Homo Sapiens
HTVLCQQKL

SEQ ID NO: 509434 - protein, 9 aa, Homo Sapiens
PPNAPVSDL

SEQ ID NO: 509435 - protein, 9 aa, Homo Sapiens
LLPRSPPRL

SEQ ID NO: 509436 - protein, 9 aa, Homo Sapiens
SEAQSLETN

SEQ ID NO: 509437 - protein, 9 aa, Homo Sapiens
LFRELLCCA

SEQ ID NO: 509438 - protein, 9 aa, Homo Sapiens
AGDQAFSQG

SEQ ID NO: 509439 - protein, 9 aa, Homo Sapiens
QEYVVQFDF

SEQ ID NO: 509440 - protein, 9 aa, Homo Sapiens
QYQDYMYWT

SEQ ID NO: 509441 - protein, 9 aa, Homo Sapiens
SKLGTDLAN

SEQ ID NO: 509442 - protein, 9 aa, Homo Sapiens
CIEKLPCHR

SEQ ID NO: 509443 - protein, 9 aa, Homo Sapiens
ECTETLDSS

SEQ ID NO: 509444 - protein, 9 aa, Homo Sapiens
PQSATYTPS

SEQ ID NO: 509445 - protein, 9 aa, Homo Sapiens
RDRQALVSC

SEQ ID NO: 509446 - protein, 9 aa, Homo Sapiens
INEEITHIP

SEQ ID NO: 509447 - protein, 9 aa, Homo Sapiens
IVKEKCRLE

SEQ ID NO: 509448 - protein, 9 aa, Homo Sapiens
HLEDEEKPK

SEQ ID NO: 509449 - protein, 9 aa, Homo Sapiens
SAKHQKRLQ

SEQ ID NO: 509450 - protein, 9 aa, Homo Sapiens
NLWYKTGHV

SEQ ID NO: 509451 - protein, 9 aa, Homo Sapiens
GMLLARDIR

SEQ ID NO: 509452 - protein, 9 aa, Homo Sapiens
QAIKRKHTV

SEQ ID NO: 509453 - protein, 9 aa, Homo Sapiens
NVPFCGPNK

SEQ ID NO: 509454 - protein, 9 aa, Homo Sapiens
YLLFMMLAA

SEQ ID NO: 509455 - protein, 9 aa, Homo Sapiens
SECVDNIRC

SEQ ID NO: 509456 - protein, 9 aa, Homo Sapiens
RHAASQSCC

SEQ ID NO: 509457 - protein, 9 aa, Homo Sapiens
GQHRLLFHP

SEQ ID NO: 509458 - protein, 9 aa, Homo Sapiens
SCDRVGTQE

SEQ ID NO: 509459 - protein, 9 aa, Homo Sapiens
YLNSKINCE

SEQ ID NO: 509460 - protein, 9 aa, Homo Sapiens
GQFVALLPN

SEQ ID NO: 509461 - protein, 9 aa, Homo Sapiens
NKRDTRSIK

SEQ ID NO: 509462 - protein, 9 aa, Homo Sapiens
RNNRRNAPP

SEQ ID NO: 509463 - protein, 9 aa, Homo Sapiens
EHRYLLFMM

SEQ ID NO: 509464 - protein, 9 aa, Homo Sapiens
SGRTSTLSP

SEQ ID NO: 509465 - protein, 9 aa, Homo Sapiens
LEYETQINK

SEQ ID NO: 509466 - protein, 9 aa, Homo Sapiens
FVQFRQLQL

SEQ ID NO: 509467 - protein, 9 aa, Homo Sapiens
KTESERLKQ

SEQ ID NO: 509468 - protein, 9 aa, Homo Sapiens
RWQDIQNYA

SEQ ID NO: 509469 - protein, 9 aa, Homo Sapiens
GTGYVTLLE

SEQ ID NO: 509470 - protein, 9 aa, Homo Sapiens
RFRDEDFYC

SEQ ID NO: 509471 - protein, 9 aa, Homo Sapiens
LGCFWVSLA

SEQ ID NO: 509472 - protein, 9 aa, Homo Sapiens
AAAAAALAN

SEQ ID NO: 509473 - protein, 9 aa, Homo Sapiens
EFALRDQHK

SEQ ID NO: 509474 - protein, 9 aa, Homo Sapiens
SKINCELQV

SEQ ID NO: 509475 - protein, 9 aa, Homo Sapiens
SSLKHLEDE

SEQ ID NO: 509476 - protein, 9 aa, Homo Sapiens
EQEEDDERR

SEQ ID NO: 509477 - protein, 9 aa, Homo Sapiens
VLMSSVVTI

SEQ ID NO: 509478 - protein, 9 aa, Homo Sapiens
MFGILTVMS

SEQ ID NO: 509479 - protein, 9 aa, Homo Sapiens
AAAAALANA

SEQ ID NO: 509480 - protein, 9 aa, Homo Sapiens
LKNGAVYLV

SEQ ID NO: 509481 - protein, 9 aa, Homo Sapiens
WAEDRTGFP

SEQ ID NO: 509482 - protein, 9 aa, Homo Sapiens
LESKTVSEH

SEQ ID NO: 509483 - protein, 9 aa, Homo Sapiens
PHGPPEKRI

SEQ ID NO: 509484 - protein, 9 aa, Homo Sapiens
MLENVETAC

SEQ ID NO: 509485 - protein, 9 aa, Homo Sapiens
QFNVEVLNT

SEQ ID NO: 509486 - protein, 9 aa, Homo Sapiens
KEVRGDGLP

SEQ ID NO: 509487 - protein, 9 aa, Homo Sapiens
SLKHLEDEE

SEQ ID NO: 509488 - protein, 9 aa, Homo Sapiens
VRALFTRGK

SEQ ID NO: 509489 - protein, 9 aa, Homo Sapiens
PSGLGLLET

SEQ ID NO: 509490 - protein, 9 aa, Homo Sapiens
LCTRSVSIP

SEQ ID NO: 509491 - protein, 9 aa, Homo Sapiens
CSSARSSIA

SEQ ID NO: 509492 - protein, 9 aa, Homo Sapiens
RRVRFEKVM

SEQ ID NO: 509493 - protein, 9 aa, Homo Sapiens
EMYAAMKAD

SEQ ID NO: 509494 - protein, 9 aa, Homo Sapiens
SGIVSKGNN

SEQ ID NO: 509495 - protein, 9 aa, Homo Sapiens
VHIPSNGTG

SEQ ID NO: 509496 - protein, 9 aa, Homo Sapiens
PMGGAASPE

SEQ ID NO: 509497 - protein, 9 aa, Homo Sapiens
HKHKSSDKE

SEQ ID NO: 509498 - protein, 9 aa, Homo Sapiens
YAIRLSAAE

SEQ ID NO: 509499 - protein, 9 aa, Homo Sapiens
RLKQHTQKS

SEQ ID NO: 509500 - protein, 9 aa, Homo Sapiens
KNEQVLVVC

SEQ ID NO: 509501 - protein, 9 aa, Homo Sapiens
SCLPPNAPV

SEQ ID NO: 509502 - protein, 9 aa, Homo Sapiens
REEGSPVEL

SEQ ID NO: 509503 - protein, 9 aa, Homo Sapiens
CLKLKYQSY

SEQ ID NO: 509504 - protein, 9 aa, Homo Sapiens
PMLENVETA

SEQ ID NO: 509505 - protein, 9 aa, Homo Sapiens
VNFGATVDG

SEQ ID NO: 509506 - protein, 9 aa, Homo Sapiens
IQKRKEMQQ

SEQ ID NO: 509507 - protein, 9 aa, Homo Sapiens
KLEYETQIN

SEQ ID NO: 509508 - protein, 9 aa, Homo Sapiens
QIEHHPTVA

SEQ ID NO: 509509 - protein, 9 aa, Homo Sapiens
MATGTPILR

SEQ ID NO: 509510 - protein, 9 aa, Homo Sapiens
ESNSNEATT

SEQ ID NO: 509511 - protein, 9 aa, Homo Sapiens
LCCALVRAR

SEQ ID NO: 509512 - protein, 9 aa, Homo Sapiens
AMNLAPVLG

SEQ ID NO: 509513 - protein, 9 aa, Homo Sapiens
KAFDYIATY

SEQ ID NO: 509514 - protein, 9 aa, Homo Sapiens
LIDIQQKIQ

SEQ ID NO: 509515 - protein, 9 aa, Homo Sapiens
TQERGLPPS

SEQ ID NO: 509516 - protein, 9 aa, Homo Sapiens
HKYRYRYPK

SEQ ID NO: 509517 - protein, 9 aa, Homo Sapiens
TLGSTEPQL

SEQ ID NO: 509518 - protein, 9 aa, Homo Sapiens
TMTAWRGMS

SEQ ID NO: 509519 - protein, 9 aa, Homo Sapiens
IRLSAAEDP

SEQ ID NO: 509520 - protein, 9 aa, Homo Sapiens
MTAWRGMSP

SEQ ID NO: 509521 - protein, 9 aa, Homo Sapiens
GSTEPQLTV

SEQ ID NO: 509522 - protein, 9 aa, Homo Sapiens
QRIRQEECA

SEQ ID NO: 509523 - protein, 9 aa, Homo Sapiens
ALRCQSPYG

SEQ ID NO: 509524 - protein, 9 aa, Homo Sapiens
EFGLVEQKV

SEQ ID NO: 509525 - protein, 9 aa, Homo Sapiens
FGLVEQKVL

SEQ ID NO: 509526 - protein, 9 aa, Homo Sapiens
VGFADLAVI

SEQ ID NO: 509527 - protein, 9 aa, Homo Sapiens
KTKVDKSEA

SEQ ID NO: 509528 - protein, 9 aa, Homo Sapiens
EVECPSQMD

SEQ ID NO: 509529 - protein, 9 aa, Homo Sapiens
NRALSASSS

SEQ ID NO: 509530 - protein, 9 aa, Homo Sapiens
KMIDRNPRE

SEQ ID NO: 509531 - protein, 9 aa, Homo Sapiens
MFDVGGQTS

SEQ ID NO: 509532 - protein, 9 aa, Homo Sapiens
VFNQSLTLT

SEQ ID NO: 509533 - protein, 9 aa, Homo Sapiens
LNCVLNSDV

SEQ ID NO: 509534 - protein, 9 aa, Homo Sapiens
IGIGVSPAM

SEQ ID NO: 509535 - protein, 9 aa, Homo Sapiens
GFEKFFQVY

SEQ ID NO: 509536 - protein, 9 aa, Homo Sapiens
WDGGIAGAQ

SEQ ID NO: 509537 - protein, 9 aa, Homo Sapiens
HSLKEIHQK

SEQ ID NO: 509538 - protein, 9 aa, Homo Sapiens
DMAAFMEGA

SEQ ID NO: 509539 - protein, 9 aa, Homo Sapiens
AGLNSLKAV

SEQ ID NO: 509540 - protein, 9 aa, Homo Sapiens
RGKDRDRFT

SEQ ID NO: 509541 - protein, 9 aa, Homo Sapiens
EILDRTRKG

SEQ ID NO: 509542 - protein, 9 aa, Homo Sapiens
FSLKADGKN

SEQ ID NO: 509543 - protein, 9 aa, Homo Sapiens
PPHGPPEKR

SEQ ID NO: 509544 - protein, 9 aa, Homo Sapiens
RPRNNRRNA

SEQ ID NO: 509545 - protein, 9 aa, Homo Sapiens
ALLTGPLQT

SEQ ID NO: 509546 - protein, 9 aa, Homo Sapiens
ISGTLYMNR

SEQ ID NO: 509547 - protein, 9 aa, Homo Sapiens
GPPPHGPPE

SEQ ID NO: 509548 - protein, 9 aa, Homo Sapiens
FNVEVLNTI

SEQ ID NO: 509549 - protein, 9 aa, Homo Sapiens
PGREEGSPV

SEQ ID NO: 509550 - protein, 9 aa, Homo Sapiens
YVQDRVPLY

SEQ ID NO: 509551 - protein, 9 aa, Homo Sapiens
HKSSDKEFS

SEQ ID NO: 509552 - protein, 9 aa, Homo Sapiens
INKISYPKG

SEQ ID NO: 509553 - protein, 9 aa, Homo Sapiens
YQTQNQWAR

SEQ ID NO: 509554 - protein, 9 aa, Homo Sapiens
IDIQQKIQA

SEQ ID NO: 509555 - protein, 9 aa, Homo Sapiens
VFPKIKSRS

SEQ ID NO: 509556 - protein, 9 aa, Homo Sapiens
DAVHFGALN

SEQ ID NO: 509557 - protein, 9 aa, Homo Sapiens
PAAAAAALA

SEQ ID NO: 509558 - protein, 9 aa, Homo Sapiens
TFQETCPYC

SEQ ID NO: 509559 - protein, 9 aa, Homo Sapiens
HAPGQFVAL

SEQ ID NO: 509560 - protein, 9 aa, Homo Sapiens
QTNPLCNLL

SEQ ID NO: 509561 - protein, 9 aa, Homo Sapiens
NTTKESRPP

SEQ ID NO: 509562 - protein, 9 aa, Homo Sapiens
SNTTKESRP

SEQ ID NO: 509563 - protein, 9 aa, Homo Sapiens
QSPYGARHQ

SEQ ID NO: 509564 - protein, 9 aa, Homo Sapiens
GKKKIKPFK

SEQ ID NO: 509565 - protein, 9 aa, Homo Sapiens
FPLDSVIST

SEQ ID NO: 509566 - protein, 9 aa, Homo Sapiens
DRTRKGAIL

SEQ ID NO: 509567 - protein, 9 aa, Homo Sapiens
RRTQEKVQE

SEQ ID NO: 509568 - protein, 9 aa, Homo Sapiens
SEHCISRGG

SEQ ID NO: 509569 - protein, 9 aa, Homo Sapiens
ARDIRSCLT

SEQ ID NO: 509570 - protein, 9 aa, Homo Sapiens
WSSTEETVF

SEQ ID NO: 509571 - protein, 9 aa, Homo Sapiens
LQPEPSDPY

SEQ ID NO: 509572 - protein, 9 aa, Homo Sapiens
RTIIECSSA

SEQ ID NO: 509573 - protein, 9 aa, Homo Sapiens
FITDGVSPC

SEQ ID NO: 509574 - protein, 9 aa, Homo Sapiens
KTGHVALRL

SEQ ID NO: 509575 - protein, 9 aa, Homo Sapiens
IRTGQHRLL

SEQ ID NO: 509576 - protein, 9 aa, Homo Sapiens
TYVLCTRSV

SEQ ID NO: 509577 - protein, 9 aa, Homo Sapiens
SSSVFSMLD

SEQ ID NO: 509578 - protein, 9 aa, Homo Sapiens
ARQAPRLNY

SEQ ID NO: 509579 - protein, 9 aa, Homo Sapiens
TEPQLTVHH

SEQ ID NO: 509580 - protein, 9 aa, Homo Sapiens
TCAHEAQKK

SEQ ID NO: 509581 - protein, 9 aa, Homo Sapiens
FSKVKCLPL

SEQ ID NO: 509582 - protein, 9 aa, Homo Sapiens
LPNLTVCLQ

SEQ ID NO: 509583 - protein, 9 aa, Homo Sapiens
RFRKLKLMR

SEQ ID NO: 509584 - protein, 9 aa, Homo Sapiens
APLDGIDAA

SEQ ID NO: 509585 - protein, 9 aa, Homo Sapiens
ALAKWAEDR

SEQ ID NO: 509586 - protein, 9 aa, Homo Sapiens
EASEHCISR

SEQ ID NO: 509587 - protein, 9 aa, Homo Sapiens
DICKDEDEG

SEQ ID NO: 509588 - protein, 9 aa, Homo Sapiens
LKESNLPWW

SEQ ID NO: 509589 - protein, 9 aa, Homo Sapiens
LLFHPEQLL

SEQ ID NO: 509590 - protein, 9 aa, Homo Sapiens
WGDMATGTP

SEQ ID NO: 509591 - protein, 9 aa, Homo Sapiens
TDEEDEADD

SEQ ID NO: 509592 - protein, 9 aa, Homo Sapiens
SSFEVSGAN

SEQ ID NO: 509593 - protein, 9 aa, Homo Sapiens
MVAQHDVYK

SEQ ID NO: 509594 - protein, 9 aa, Homo Sapiens
DPPKELRSL

SEQ ID NO: 509595 - protein, 9 aa, Homo Sapiens
GDTNRALSA

SEQ ID NO: 509596 - protein, 9 aa, Homo Sapiens
PCFHGARDS

SEQ ID NO: 509597 - protein, 9 aa, Homo Sapiens
GGNDSMPVH

SEQ ID NO: 509598 - protein, 9 aa, Homo Sapiens
RNIEWFCIE

SEQ ID NO: 509599 - protein, 9 aa, Homo Sapiens
LLPNLTVCL

SEQ ID NO: 509600 - protein, 9 aa, Homo Sapiens
GDEYFILKE

SEQ ID NO: 509601 - protein, 9 aa, Homo Sapiens
MIEANGCIL

SEQ ID NO: 509602 - protein, 9 aa, Homo Sapiens
ATFCIVGFA

SEQ ID NO: 509603 - protein, 9 aa, Homo Sapiens
ILSPLLNIQ

SEQ ID NO: 509604 - protein, 9 aa, Homo Sapiens
RGTYVFRME

SEQ ID NO: 509605 - protein, 9 aa, Homo Sapiens
EGLESEAQS

SEQ ID NO: 509606 - protein, 9 aa, Homo Sapiens
CMAKGSWPL

SEQ ID NO: 509607 - protein, 9 aa, Homo Sapiens
VRFEKVMFG

SEQ ID NO: 509608 - protein, 9 aa, Homo Sapiens
ALHVAAAEE

SEQ ID NO: 509609 - protein, 9 aa, Homo Sapiens
ISIMAGDQA

SEQ ID NO: 509610 - protein, 9 aa, Homo Sapiens
LESEAQSLE

SEQ ID NO: 509611 - protein, 9 aa, Homo Sapiens
RIVEDCNIP

SEQ ID NO: 509612 - protein, 9 aa, Homo Sapiens
SEQEEDDER

SEQ ID NO: 509613 - protein, 9 aa, Homo Sapiens
KLHLFIKIF

SEQ ID NO: 509614 - protein, 9 aa, Homo Sapiens
NQLKSMWFT

SEQ ID NO: 509615 - protein, 9 aa, Homo Sapiens
RIGIGVSPA

SEQ ID NO: 509616 - protein, 9 aa, Homo Sapiens
LFIKIFTLA

SEQ ID NO: 509617 - protein, 9 aa, Homo Sapiens
ECVDNIRCN

SEQ ID NO: 509618 - protein, 9 aa, Homo Sapiens
HCISRGGTL

SEQ ID NO: 509619 - protein, 9 aa, Homo Sapiens
DNGHNSDCA

SEQ ID NO: 509620 - protein, 9 aa, Homo Sapiens
PSNGTGYVT

SEQ ID NO: 509621 - protein, 9 aa, Homo Sapiens
PDDDQTTTK

SEQ ID NO: 509622 - protein, 9 aa, Homo Sapiens
VGDTNRALS

SEQ ID NO: 509623 - protein, 9 aa, Homo Sapiens
LTGPLQTNP

SEQ ID NO: 509624 - protein, 9 aa, Homo Sapiens
QPLAPSLAK

SEQ ID NO: 509625 - protein, 9 aa, Homo Sapiens
FKIPYSIIQ

SEQ ID NO: 509626 - protein, 9 aa, Homo Sapiens
RPGSEQPPM

SEQ ID NO: 509627 - protein, 9 aa, Homo Sapiens
YPPTITESN

SEQ ID NO: 509628 - protein, 9 aa, Homo Sapiens
VISTELCPS

SEQ ID NO: 509629 - protein, 9 aa, Homo Sapiens
VPLYSQGAR

SEQ ID NO: 509630 - protein, 9 aa, Homo Sapiens
DIQNYAQFA

SEQ ID NO: 509631 - protein, 9 aa, Homo Sapiens
QEEKLNLDS

SEQ ID NO: 509632 - protein, 9 aa, Homo Sapiens
TKPNTKDQG

SEQ ID NO: 509633 - protein, 9 aa, Homo Sapiens
PEEKQDIII

SEQ ID NO: 509634 - protein, 9 aa, Homo Sapiens
PRNNRRNAP

SEQ ID NO: 509635 - protein, 9 aa, Homo Sapiens
NLQESFMSH

SEQ ID NO: 509636 - protein, 9 aa, Homo Sapiens
ERIHTGKTP

SEQ ID NO: 509637 - protein, 9 aa, Homo Sapiens
FSMLDQTQI

SEQ ID NO: 509638 - protein, 9 aa, Homo Sapiens
PNLTVCLQL

SEQ ID NO: 509639 - protein, 9 aa, Homo Sapiens
IDRNPREDG

SEQ ID NO: 509640 - protein, 9 aa, Homo Sapiens
GRGSQASGL

SEQ ID NO: 509641 - protein, 9 aa, Homo Sapiens
YVVQFDFLG

SEQ ID NO: 509642 - protein, 9 aa, Homo Sapiens
GHDTDTRDD

SEQ ID NO: 509643 - protein, 9 aa, Homo Sapiens
VYLNCVLNS

SEQ ID NO: 509644 - protein, 9 aa, Homo Sapiens
RDIRSCLTE

SEQ ID NO: 509645 - protein, 9 aa, Homo Sapiens
AKNLTNQML

SEQ ID NO: 509646 - protein, 9 aa, Homo Sapiens
LLAAASSQA

SEQ ID NO: 509647 - protein, 9 aa, Homo Sapiens
TVLCQQKLE

SEQ ID NO: 509648 - protein, 9 aa, Homo Sapiens
SLKADGKNP

SEQ ID NO: 509649 - protein, 9 aa, Homo Sapiens
GRTSTLSPE

SEQ ID NO: 509650 - protein, 9 aa, Homo Sapiens
RTCAHEAQK

SEQ ID NO: 509651 - protein, 9 aa, Homo Sapiens
RVCLQALED

SEQ ID NO: 509652 - protein, 9 aa, Homo Sapiens
FRKPSVHIS

SEQ ID NO: 509653 - protein, 9 aa, Homo Sapiens
KGDEYFILK

SEQ ID NO: 509654 - protein, 9 aa, Homo Sapiens
SERLKQHTQ

SEQ ID NO: 509655 - protein, 9 aa, Homo Sapiens
KDPSWITRI

SEQ ID NO: 509656 - protein, 9 aa, Homo Sapiens
AVYLVINLG

SEQ ID NO: 509657 - protein, 9 aa, Homo Sapiens
LQTNPLCNL

SEQ ID NO: 509658 - protein, 9 aa, Homo Sapiens
EDGSPLNFL

SEQ ID NO: 509659 - protein, 9 aa, Homo Sapiens
QTSERKKWI

SEQ ID NO: 509660 - protein, 9 aa, Homo Sapiens
CIVGFADLA

SEQ ID NO: 509661 - protein, 9 aa, Homo Sapiens
EEGSPVELE

SEQ ID NO: 509662 - protein, 9 aa, Homo Sapiens
DQEDLESKT

SEQ ID NO: 509663 - protein, 9 aa, Homo Sapiens
EDEADDKDD

SEQ ID NO: 509664 - protein, 9 aa, Homo Sapiens
LPDHAPGQF

SEQ ID NO: 509665 - protein, 9 aa, Homo Sapiens
QHRLLFHPE

SEQ ID NO: 509666 - protein, 9 aa, Homo Sapiens
HRLLFHPEQ

SEQ ID NO: 509667 - protein, 9 aa, Homo Sapiens
FGPNLLHKH

SEQ ID NO: 509668 - protein, 9 aa, Homo Sapiens
VSSAMNLAP

SEQ ID NO: 509669 - protein, 9 aa, Homo Sapiens
EADREDKVE

SEQ ID NO: 509670 - protein, 9 aa, Homo Sapiens
VFSMLDQTQ

SEQ ID NO: 509671 - protein, 9 aa, Homo Sapiens
GDGLPEKVD

SEQ ID NO: 509672 - protein, 9 aa, Homo Sapiens
LFLWLGCFW

SEQ ID NO: 509673 - protein, 9 aa, Homo Sapiens
SIMAGDQAF

SEQ ID NO: 509674 - protein, 9 aa, Homo Sapiens
QEEDRKHTW

SEQ ID NO: 509675 - protein, 9 aa, Homo Sapiens
VQQLCQAGE

SEQ ID NO: 509676 - protein, 9 aa, Homo Sapiens
LTSKATRPW

SEQ ID NO: 509677 - protein, 9 aa, Homo Sapiens
NVVHSRIIN

SEQ ID NO: 509678 - protein, 9 aa, Homo Sapiens
ITDGVSPCC

SEQ ID NO: 509679 - protein, 9 aa, Homo Sapiens
YRKLIVKEK

SEQ ID NO: 509680 - protein, 9 aa, Homo Sapiens
LRLREELSH

SEQ ID NO: 509681 - protein, 9 aa, Homo Sapiens
FDRGTYVFR

SEQ ID NO: 509682 - protein, 9 aa, Homo Sapiens
TSAWGLLAA

SEQ ID NO: 509683 - protein, 9 aa, Homo Sapiens
DVQQLCQAG

SEQ ID NO: 509684 - protein, 9 aa, Homo Sapiens
AMKADPDGD

SEQ ID NO: 509685 - protein, 9 aa, Homo Sapiens
EVNIKTAKA

SEQ ID NO: 509686 - protein, 9 aa, Homo Sapiens
CILYKEYEG

SEQ ID NO: 509687 - protein, 9 aa, Homo Sapiens
YAFTLGYQN

SEQ ID NO: 509688 - protein, 9 aa, Homo Sapiens
IIQRICATF

SEQ ID NO: 509689 - protein, 9 aa, Homo Sapiens
RVPLYSQGA

SEQ ID NO: 509690 - protein, 9 aa, Homo Sapiens
ITHIPEEKQ

SEQ ID NO: 509691 - protein, 9 aa, Homo Sapiens
TESERLKQH

SEQ ID NO: 509692 - protein, 9 aa, Homo Sapiens
IGIGIQEED

SEQ ID NO: 509693 - protein, 9 aa, Homo Sapiens
YQLCHTYVL

SEQ ID NO: 509694 - protein, 9 aa, Homo Sapiens
QFDFLGKDS

SEQ ID NO: 509695 - protein, 9 aa, Homo Sapiens
NKMLCSKDS

SEQ ID NO: 509696 - protein, 9 aa, Homo Sapiens
YLPDGTAFL

SEQ ID NO: 509697 - protein, 9 aa, Homo Sapiens
SVISTELCP

SEQ ID NO: 509698 - protein, 9 aa, Homo Sapiens
VLADNGHNS

SEQ ID NO: 509699 - protein, 9 aa, Homo Sapiens
QATGDPNPR

SEQ ID NO: 509700 - protein, 9 aa, Homo Sapiens
QINKMLCSK

SEQ ID NO: 509701 - protein, 9 aa, Homo Sapiens
PPKELRSLP

SEQ ID NO: 509702 - protein, 9 aa, Homo Sapiens
EQIEHHPTV

SEQ ID NO: 509703 - protein, 9 aa, Homo Sapiens
RSKAFDYIA

SEQ ID NO: 509704 - protein, 9 aa, Homo Sapiens
VAPEILKCS

SEQ ID NO: 509705 - protein, 9 aa, Homo Sapiens
KVDKSEAKA

SEQ ID NO: 509706 - protein, 9 aa, Homo Sapiens
GAAKKVPAQ

SEQ ID NO: 509707 - protein, 9 aa, Homo Sapiens
PSLAKAGPP

SEQ ID NO: 509708 - protein, 9 aa, Homo Sapiens
QTRLQPEEC

SEQ ID NO: 509709 - protein, 9 aa, Homo Sapiens
QGPNGGLTA

SEQ ID NO: 509710 - protein, 9 aa, Homo Sapiens
EGGTVWLEW

SEQ ID NO: 509711 - protein, 9 aa, Homo Sapiens
PTPAPSLAP

SEQ ID NO: 509712 - protein, 9 aa, Homo Sapiens
TDICKDEDE

SEQ ID NO: 509713 - protein, 9 aa, Homo Sapiens
LNSLKAVKR

SEQ ID NO: 509714 - protein, 9 aa, Homo Sapiens
SPLLNIQKR

SEQ ID NO: 509715 - protein, 9 aa, Homo Sapiens
GLTLGSTEP

SEQ ID NO: 509716 - protein, 9 aa, Homo Sapiens
IPEEKQDII

SEQ ID NO: 509717 - protein, 9 aa, Homo Sapiens
ACGFDYTSK

SEQ ID NO: 509718 - protein, 9 aa, Homo Sapiens
KVQKDADKK

SEQ ID NO: 509719 - protein, 9 aa, Homo Sapiens
TSSSHHLHS

SEQ ID NO: 509720 - protein, 9 aa, Homo Sapiens
QQLCQAGEE

SEQ ID NO: 509721 - protein, 9 aa, Homo Sapiens
LKADGKNPD

SEQ ID NO: 509722 - protein, 9 aa, Homo Sapiens
DQNWKNEQV

SEQ ID NO: 509723 - protein, 9 aa, Homo Sapiens
EYVVQFDFL

SEQ ID NO: 509724 - protein, 9 aa, Homo Sapiens
LPHEDEDAN

SEQ ID NO: 509725 - protein, 9 aa, Homo Sapiens
AAVKALTSK

SEQ ID NO: 509726 - protein, 9 aa, Homo Sapiens
EGSPVELER

SEQ ID NO: 509727 - protein, 9 aa, Homo Sapiens
LSLHPESQT

SEQ ID NO: 509728 - protein, 9 aa, Homo Sapiens
IQNYAQFAI

SEQ ID NO: 509729 - protein, 9 aa, Homo Sapiens
DVGGQTSER

SEQ ID NO: 509730 - protein, 9 aa, Homo Sapiens
RIHTGKTPY

SEQ ID NO: 509731 - protein, 9 aa, Homo Sapiens
RLLPNLTVC

SEQ ID NO: 509732 - protein, 9 aa, Homo Sapiens
LNIHVARKA

SEQ ID NO: 509733 - protein, 9 aa, Homo Sapiens
LFPLDSVIS

SEQ ID NO: 509734 - protein, 9 aa, Homo Sapiens
IRSCLTEAE

SEQ ID NO: 509735 - protein, 9 aa, Homo Sapiens
GLNSLKAVK

SEQ ID NO: 509736 - protein, 9 aa, Homo Sapiens
QAPRLNYLI

SEQ ID NO: 509737 - protein, 9 aa, Homo Sapiens
RCQSPYGAR

SEQ ID NO: 509738 - protein, 9 aa, Homo Sapiens
FLALARPGL

SEQ ID NO: 509739 - protein, 9 aa, Homo Sapiens
EPMDQEDLE

SEQ ID NO: 509740 - protein, 9 aa, Homo Sapiens
VLNTIEKYV

SEQ ID NO: 509741 - protein, 9 aa, Homo Sapiens
PHEDEDANL

SEQ ID NO: 509742 - protein, 9 aa, Homo Sapiens
PYGARHQCA

SEQ ID NO: 509743 - protein, 9 aa, Homo Sapiens
EKLLAEQHH

SEQ ID NO: 509744 - protein, 9 aa, Homo Sapiens
LMIEANGCI

SEQ ID NO: 509745 - protein, 9 aa, Homo Sapiens
ALSARTSAW

SEQ ID NO: 509746 - protein, 9 aa, Homo Sapiens
DAAGSQPEP

SEQ ID NO: 509747 - protein, 9 aa, Homo Sapiens
SGDGSRNSG

SEQ ID NO: 509748 - protein, 9 aa, Homo Sapiens
DISECVDNI

SEQ ID NO: 509749 - protein, 9 aa, Homo Sapiens
KLIVKEKCR

SEQ ID NO: 509750 - protein, 9 aa, Homo Sapiens
SDKIEFNRM

SEQ ID NO: 509751 - protein, 9 aa, Homo Sapiens
VYVLMSSVV

SEQ ID NO: 509752 - protein, 9 aa, Homo Sapiens
MYAAMKADP

SEQ ID NO: 509753 - protein, 9 aa, Homo Sapiens
NNNTDTLYE

SEQ ID NO: 509754 - protein, 9 aa, Homo Sapiens
ENVNRVGTF

SEQ ID NO: 509755 - protein, 9 aa, Homo Sapiens
PYWELSNHK

SEQ ID NO: 509756 - protein, 9 aa, Homo Sapiens
DNSDKIEFN

SEQ ID NO: 509757 - protein, 9 aa, Homo Sapiens
SSRTSSSYE

SEQ ID NO: 509758 - protein, 9 aa, Homo Sapiens
LNIQKRKEM

SEQ ID NO: 509759 - protein, 9 aa, Homo Sapiens
RTSSSYEEE

SEQ ID NO: 509760 - protein, 9 aa, Homo Sapiens
SHDDKSTFQ

SEQ ID NO: 509761 - protein, 9 aa, Homo Sapiens
TPGYVAPEI

SEQ ID NO: 509762 - protein, 9 aa, Homo Sapiens
AKVQKDADK

SEQ ID NO: 509763 - protein, 9 aa, Homo Sapiens
EETVFPKIK

SEQ ID NO: 509764 - protein, 9 aa, Homo Sapiens
YQDYMYWTD

SEQ ID NO: 509765 - protein, 9 aa, Homo Sapiens
EEINKISYP

SEQ ID NO: 509766 - protein, 9 aa, Homo Sapiens
RFEKVMFGI

SEQ ID NO: 509767 - protein, 9 aa, Homo Sapiens
HSRIINPLR

SEQ ID NO: 509768 - protein, 9 aa, Homo Sapiens
MIDKTKVDK

SEQ ID NO: 509769 - protein, 9 aa, Homo Sapiens
SDFNDFIRP

SEQ ID NO: 509770 - protein, 9 aa, Homo Sapiens
CYAIRLSAA

SEQ ID NO: 509771 - protein, 9 aa, Homo Sapiens
DSGRTSTLS

SEQ ID NO: 509772 - protein, 9 aa, Homo Sapiens
SHHLHSYIG

SEQ ID NO: 509773 - protein, 9 aa, Homo Sapiens
KTQKVSKIE

SEQ ID NO: 509774 - protein, 9 aa, Homo Sapiens
IGLPRPIRL

SEQ ID NO: 509775 - protein, 9 aa, Homo Sapiens
TPETHTSFG

SEQ ID NO: 509776 - protein, 9 aa, Homo Sapiens
GSPLNFLRI

SEQ ID NO: 509777 - protein, 9 aa, Homo Sapiens
EALAKWAED

SEQ ID NO: 509778 - protein, 9 aa, Homo Sapiens
KISYPKGKC

SEQ ID NO: 509779 - protein, 9 aa, Homo Sapiens
VELERLKLE

SEQ ID NO: 509780 - protein, 9 aa, Homo Sapiens
ATKILLFAA

SEQ ID NO: 509781 - protein, 9 aa, Homo Sapiens
RDTRSIKEA

SEQ ID NO: 509782 - protein, 9 aa, Homo Sapiens
AVQASAKHQ

SEQ ID NO: 509783 - protein, 9 aa, Homo Sapiens
KLGTDLANT

SEQ ID NO: 509784 - protein, 9 aa, Homo Sapiens
GKTPYKCKE

SEQ ID NO: 509785 - protein, 9 aa, Homo Sapiens
LWYKTGHVA

SEQ ID NO: 509786 - protein, 9 aa, Homo Sapiens
ARANPTQLN

SEQ ID NO: 509787 - protein, 9 aa, Homo Sapiens
RTSAWGLLA

SEQ ID NO: 509788 - protein, 9 aa, Homo Sapiens
EEDEADDKD

SEQ ID NO: 509789 - protein, 9 aa, Homo Sapiens
KALTSKATR

SEQ ID NO: 509790 - protein, 9 aa, Homo Sapiens
VTICVIHRC

SEQ ID NO: 509791 - protein, 9 aa, Homo Sapiens
LWEWLHRFR

SEQ ID NO: 509792 - protein, 9 aa, Homo Sapiens
IARANPTQL

SEQ ID NO: 509793 - protein, 9 aa, Homo Sapiens
KVMKAINDG

SEQ ID NO: 509794 - protein, 9 aa, Homo Sapiens
IGVSPAMSY

SEQ ID NO: 509795 - protein, 9 aa, Homo Sapiens
FCIVGFADL

SEQ ID NO: 509796 - protein, 9 aa, Homo Sapiens
GIDAAGSQP

SEQ ID NO: 509797 - protein, 9 aa, Homo Sapiens
LVLTCMAKG

SEQ ID NO: 509798 - protein, 9 aa, Homo Sapiens
SNHKVMKAI

SEQ ID NO: 509799 - protein, 9 aa, Homo Sapiens
FNDFIRPRF

SEQ ID NO: 509800 - protein, 9 aa, Homo Sapiens
RALFTRGKD

SEQ ID NO: 509801 - protein, 9 aa, Homo Sapiens
NHKVMKAIN

SEQ ID NO: 509802 - protein, 9 aa, Homo Sapiens
HHMKDPSWI

SEQ ID NO: 509803 - protein, 9 aa, Homo Sapiens
RVKGANGMI

SEQ ID NO: 509804 - protein, 9 aa, Homo Sapiens
VSKGNNQIL

SEQ ID NO: 509805 - protein, 9 aa, Homo Sapiens
SYEEEEKEE

SEQ ID NO: 509806 - protein, 9 aa, Homo Sapiens
RGDGLPEKV

SEQ ID NO: 509807 - protein, 9 aa, Homo Sapiens
DEDFYCILS

SEQ ID NO: 509808 - protein, 9 aa, Homo Sapiens
EWFCIEKLP

SEQ ID NO: 509809 - protein, 9 aa, Homo Sapiens
MSPEVTLAC

SEQ ID NO: 509810 - protein, 9 aa, Homo Sapiens
TQEKVQEAK

SEQ ID NO: 509811 - protein, 9 aa, Homo Sapiens
TDVVPEVEC

SEQ ID NO: 509812 - protein, 9 aa, Homo Sapiens
HTTPIPVTD

SEQ ID NO: 509813 - protein, 9 aa, Homo Sapiens
LNLTPIGLP

SEQ ID NO: 509814 - protein, 9 aa, Homo Sapiens
NAVQASAKH

SEQ ID NO: 509815 - protein, 9 aa, Homo Sapiens
NKISYPKGK

SEQ ID NO: 509816 - protein, 9 aa, Homo Sapiens
KNGAVYLVI

SEQ ID NO: 509817 - protein, 9 aa, Homo Sapiens
TCYGGYKTG

SEQ ID NO: 509818 - protein, 9 aa, Homo Sapiens
SLQPEPSDP

SEQ ID NO: 509819 - protein, 9 aa, Homo Sapiens
GFVQFRQLQ

SEQ ID NO: 509820 - protein, 9 aa, Homo Sapiens
IVSKGNNQI

SEQ ID NO: 509821 - protein, 9 aa, Homo Sapiens
EEVNIKTAK

SEQ ID NO: 509822 - protein, 9 aa, Homo Sapiens
PTCLNPHLE

SEQ ID NO: 509823 - protein, 9 aa, Homo Sapiens
DSSFEVSGA

SEQ ID NO: 509824 - protein, 9 aa, Homo Sapiens
ALLSHMAGF

SEQ ID NO: 509825 - protein, 9 aa, Homo Sapiens
MSDISECVD

SEQ ID NO: 509826 - protein, 9 aa, Homo Sapiens
HPPLCLKLK

SEQ ID NO: 509827 - protein, 9 aa, Homo Sapiens
DQTTTKSQL

SEQ ID NO: 509828 - protein, 9 aa, Homo Sapiens
RIINPLRLF

SEQ ID NO: 509829 - protein, 9 aa, Homo Sapiens
DVVPEVECP

SEQ ID NO: 509830 - protein, 9 aa, Homo Sapiens
FTLGYQNGA

SEQ ID NO: 509831 - protein, 9 aa, Homo Sapiens
MSSVVTICV

SEQ ID NO: 509832 - protein, 9 aa, Homo Sapiens
NLTVCLQLL

SEQ ID NO: 509833 - protein, 9 aa, Homo Sapiens
CCRVADRTG

SEQ ID NO: 509834 - protein, 9 aa, Homo Sapiens
EATKILLFA

SEQ ID NO: 509835 - protein, 9 aa, Homo Sapiens
DREDKVEPG

SEQ ID NO: 509836 - protein, 9 aa, Homo Sapiens
RKLKLMRTL

SEQ ID NO: 509837 - protein, 9 aa, Homo Sapiens
TNPLCNLLS

SEQ ID NO: 509838 - protein, 9 aa, Homo Sapiens
LKSVFCELG

SEQ ID NO: 509839 - protein, 9 aa, Homo Sapiens
KKFQDAGEQ

SEQ ID NO: 509840 - protein, 9 aa, Homo Sapiens
MEGAVEKGE

SEQ ID NO: 509841 - protein, 9 aa, Homo Sapiens
NFGATVDGD

SEQ ID NO: 509842 - protein, 9 aa, Homo Sapiens
TKDQGYTTL

SEQ ID NO: 509843 - protein, 9 aa, Homo Sapiens
NVNRVGTFI

SEQ ID NO: 509844 - protein, 9 aa, Homo Sapiens
KLNLDSGRT

SEQ ID NO: 509845 - protein, 9 aa, Homo Sapiens
SILSKHQKI

SEQ ID NO: 509846 - protein, 9 aa, Homo Sapiens
KKLIDIQQK

SEQ ID NO: 509847 - protein, 9 aa, Homo Sapiens
WVSLAQGER

SEQ ID NO: 509848 - protein, 9 aa, Homo Sapiens
MSVGIIARA

SEQ ID NO: 509849 - protein, 9 aa, Homo Sapiens
SKAFDYIAT

SEQ ID NO: 509850 - protein, 9 aa, Homo Sapiens
LLRTQLNHS

SEQ ID NO: 509851 - protein, 9 aa, Homo Sapiens
RLFRELLCC

SEQ ID NO: 509852 - protein, 9 aa, Homo Sapiens
ECSSARSSI

SEQ ID NO: 509853 - protein, 9 aa, Homo Sapiens
QEKVQEAKE

SEQ ID NO: 509854 - protein, 9 aa, Homo Sapiens
YLNCVLNSD

SEQ ID NO: 509855 - protein, 9 aa, Homo Sapiens
EQALGKGCE

SEQ ID NO: 509856 - protein, 9 aa, Homo Sapiens
TVAKYAMEN

SEQ ID NO: 509857 - protein, 9 aa, Homo Sapiens
LDRTRKGAI

SEQ ID NO: 509858 - protein, 9 aa, Homo Sapiens
DQHKYRYRY

SEQ ID NO: 509859 - protein, 9 aa, Homo Sapiens
TNQMLTINP

SEQ ID NO: 509860 - protein, 9 aa, Homo Sapiens
ARTCAHEAQ

SEQ ID NO: 509861 - protein, 9 aa, Homo Sapiens
IHEAGLPLM

SEQ ID NO: 509862 - protein, 9 aa, Homo Sapiens
KCLPLISAS

SEQ ID NO: 509863 - protein, 9 aa, Homo Sapiens
YEDMAAFME

SEQ ID NO: 509864 - protein, 9 aa, Homo Sapiens
DDKSTFQET

SEQ ID NO: 509865 - protein, 9 aa, Homo Sapiens
QLTQLQLKR

SEQ ID NO: 509866 - protein, 9 aa, Homo Sapiens
ECPSQMDVE

SEQ ID NO: 509867 - protein, 9 aa, Homo Sapiens
AEGGTVWLE

SEQ ID NO: 509868 - protein, 9 aa, Homo Sapiens
EKLNLDSGR

SEQ ID NO: 509869 - protein, 9 aa, Homo Sapiens
EHCISRGGT

SEQ ID NO: 509870 - protein, 9 aa, Homo Sapiens
VNWAVSPYQ

SEQ ID NO: 509871 - protein, 9 aa, Homo Sapiens
FFQVYEKIK

SEQ ID NO: 509872 - protein, 9 aa, Homo Sapiens
QPEECTETL

SEQ ID NO: 509873 - protein, 9 aa, Homo Sapiens
SVFCELGEG

SEQ ID NO: 509874 - protein, 9 aa, Homo Sapiens
EDKVEPGCH

SEQ ID NO: 509875 - protein, 9 aa, Homo Sapiens
TRGKDRDRF

SEQ ID NO: 509876 - protein, 9 aa, Homo Sapiens
KLLAEQHHR

SEQ ID NO: 509877 - protein, 9 aa, Homo Sapiens
VVQFDFLGK

SEQ ID NO: 509878 - protein, 9 aa, Homo Sapiens
EKFFQVYEK

SEQ ID NO: 509879 - protein, 9 aa, Homo Sapiens
SSQALPGVY

SEQ ID NO: 509880 - protein, 9 aa, Homo Sapiens
EDMAAFMEG

SEQ ID NO: 509881 - protein, 9 aa, Homo Sapiens
QLQLKRKSL

SEQ ID NO: 509882 - protein, 9 aa, Homo Sapiens
NTQLNIHVA

SEQ ID NO: 509883 - protein, 9 aa, Homo Sapiens
FMEGAVEKG

SEQ ID NO: 509884 - protein, 9 aa, Homo Sapiens
LDSVISTEL

SEQ ID NO: 509885 - protein, 9 aa, Homo Sapiens
EHHPTVAKY

SEQ ID NO: 509886 - protein, 9 aa, Homo Sapiens
AHEAQKKTR

SEQ ID NO: 509887 - protein, 9 aa, Homo Sapiens
AAASSQALP

SEQ ID NO: 509888 - protein, 9 aa, Homo Sapiens
KKIKPFKRF

SEQ ID NO: 509889 - protein, 9 aa, Homo Sapiens
VSGANPWIK

SEQ ID NO: 509890 - protein, 9 aa, Homo Sapiens
ASSQALPGV

SEQ ID NO: 509891 - protein, 9 aa, Homo Sapiens
EEADREDKV

SEQ ID NO: 509892 - protein, 9 aa, Homo Sapiens
LGCGARGKP

SEQ ID NO: 509893 - protein, 9 aa, Homo Sapiens
TRLQPEECT

SEQ ID NO: 509894 - protein, 9 aa, Homo Sapiens
IPMSVGIIA

SEQ ID NO: 509895 - protein, 9 aa, Homo Sapiens
MMLAALQLM

SEQ ID NO: 509896 - protein, 9 aa, Homo Sapiens
LHSYIGLPY

SEQ ID NO: 509897 - protein, 9 aa, Homo Sapiens
SFEVSGANP

SEQ ID NO: 509898 - protein, 9 aa, Homo Sapiens
LQPHQREAT

SEQ ID NO: 509899 - protein, 9 aa, Homo Sapiens
NTIEKYVQS

SEQ ID NO: 509900 - protein, 9 aa, Homo Sapiens
LANAKSRRP

SEQ ID NO: 509901 - protein, 9 aa, Homo Sapiens
NNISSTSKL

SEQ ID NO: 509902 - protein, 9 aa, Homo Sapiens
LSARTSAWG

SEQ ID NO: 509903 - protein, 9 aa, Homo Sapiens
LLCCALVRA

SEQ ID NO: 509904 - protein, 9 aa, Homo Sapiens
GIGIQEEDR

SEQ ID NO: 509905 - protein, 9 aa, Homo Sapiens
KTPYKCKEC

SEQ ID NO: 509906 - protein, 9 aa, Homo Sapiens
HLKLHLFIK

SEQ ID NO: 509907 - protein, 9 aa, Homo Sapiens
TQLQLKRKS

SEQ ID NO: 509908 - protein, 9 aa, Homo Sapiens
NDSMPVHLH

SEQ ID NO: 509909 - protein, 9 aa, Homo Sapiens
TLRRRTQEK

SEQ ID NO: 509910 - protein, 9 aa, Homo Sapiens
SKGNNQILQ

SEQ ID NO: 509911 - protein, 9 aa, Homo Sapiens
GKKTDICKD

SEQ ID NO: 509912 - protein, 9 aa, Homo Sapiens
EEGRGSQAS

SEQ ID NO: 509913 - protein, 9 aa, Homo Sapiens
VQDRVPLYS

SEQ ID NO: 509914 - protein, 9 aa, Homo Sapiens
VHSRIINPL

SEQ ID NO: 509915 - protein, 9 aa, Homo Sapiens
NKFNQVESN

SEQ ID NO: 509916 - protein, 9 aa, Homo Sapiens
VPAQEGVME

SEQ ID NO: 509917 - protein, 9 aa, Homo Sapiens
YTPQSATYT

SEQ ID NO: 509918 - protein, 9 aa, Homo Sapiens
DIRSCLTEA

SEQ ID NO: 509919 - protein, 9 aa, Homo Sapiens
SGANPWIKF

SEQ ID NO: 509920 - protein, 9 aa, Homo Sapiens
ARIVEDCNI

SEQ ID NO: 509921 - protein, 9 aa, Homo Sapiens
KIFTLAFFP

SEQ ID NO: 509922 - protein, 9 aa, Homo Sapiens
TPLSVNFGA

SEQ ID NO: 509923 - protein, 9 aa, Homo Sapiens
NPDNDPQEP

SEQ ID NO: 509924 - protein, 9 aa, Homo Sapiens
DKVEPGCHH

SEQ ID NO: 509925 - protein, 9 aa, Homo Sapiens
EGNRVEHPM

SEQ ID NO: 509926 - protein, 9 aa, Homo Sapiens
GLGCGARGK

SEQ ID NO: 509927 - protein, 9 aa, Homo Sapiens
DYTSKLQRM

SEQ ID NO: 509928 - protein, 9 aa, Homo Sapiens
EEFGLVEQK

SEQ ID NO: 509929 - protein, 9 aa, Homo Sapiens
SVGIIARAN

SEQ ID NO: 509930 - protein, 9 aa, Homo Sapiens
DKHGNPLTS

SEQ ID NO: 509931 - protein, 9 aa, Homo Sapiens
SIKEAMNEI

SEQ ID NO: 509932 - protein, 9 aa, Homo Sapiens
TDVNLWYKT

SEQ ID NO: 509933 - protein, 9 aa, Homo Sapiens
GIRTGQHRL

SEQ ID NO: 509934 - protein, 9 aa, Homo Sapiens
IEANGCILY

SEQ ID NO: 509935 - protein, 9 aa, Homo Sapiens
SPRYTPQSA

SEQ ID NO: 509936 - protein, 9 aa, Homo Sapiens
GEEINKISY

SEQ ID NO: 509937 - protein, 9 aa, Homo Sapiens
EADDKDDSG

SEQ ID NO: 509938 - protein, 9 aa, Homo Sapiens
DPQEPWCYT

SEQ ID NO: 509939 - protein, 9 aa, Homo Sapiens
PLCLKLKYQ

SEQ ID NO: 509940 - protein, 9 aa, Homo Sapiens
QHHRTSSGT

SEQ ID NO: 509941 - protein, 9 aa, Homo Sapiens
ATYTPSSPS

SEQ ID NO: 509942 - protein, 9 aa, Homo Sapiens
TQYQDYMYW

SEQ ID NO: 509943 - protein, 9 aa, Homo Sapiens
PRYTPQSAT

SEQ ID NO: 509944 - protein, 9 aa, Homo Sapiens
KTKPNTKDQ

SEQ ID NO: 509945 - protein, 9 aa, Homo Sapiens
CKKFQDAGE

SEQ ID NO: 509946 - protein, 9 aa, Homo Sapiens
QDIQNYAQF

SEQ ID NO: 509947 - protein, 9 aa, Homo Sapiens
PREDGEKAA

SEQ ID NO: 509948 - protein, 9 aa, Homo Sapiens
EDLESKTVS

SEQ ID NO: 509949 - protein, 9 aa, Homo Sapiens
FYHDKHGNP

SEQ ID NO: 509950 - protein, 9 aa, Homo Sapiens
CYGGYKTGQ

SEQ ID NO: 509951 - protein, 9 aa, Homo Sapiens
LTVCLQLLI

SEQ ID NO: 509952 - protein, 9 aa, Homo Sapiens
KRPELPSEI

SEQ ID NO: 509953 - protein, 9 aa, Homo Sapiens
DVFPDACKK

SEQ ID NO: 509954 - protein, 9 aa, Homo Sapiens
GQEYVVQFD

SEQ ID NO: 509955 - protein, 9 aa, Homo Sapiens
VLMIEANGC

SEQ ID NO: 509956 - protein, 9 aa, Homo Sapiens
VPEVECPSQ

SEQ ID NO: 509957 - protein, 9 aa, Homo Sapiens
ELPHEDEDA

SEQ ID NO: 509958 - protein, 9 aa, Homo Sapiens
VVHSRIINP

SEQ ID NO: 509959 - protein, 9 aa, Homo Sapiens
TYVFRMETE

SEQ ID NO: 509960 - protein, 9 aa, Homo Sapiens
PMSVGIIAR

SEQ ID NO: 509961 - protein, 9 aa, Homo Sapiens
YKTGHVALR

SEQ ID NO: 509962 - protein, 9 aa, Homo Sapiens
SGPWRVCLQ

SEQ ID NO: 509963 - protein, 9 aa, Homo Sapiens
RYTPQSATY

SEQ ID NO: 509964 - protein, 9 aa, Homo Sapiens
GKDRDRFTR

SEQ ID NO: 509965 - protein, 9 aa, Homo Sapiens
MRQRIRQEE

SEQ ID NO: 509966 - protein, 9 aa, Homo Sapiens
PLQTNPLCN

SEQ ID NO: 509967 - protein, 9 aa, Homo Sapiens
LQHSAAQKH

SEQ ID NO: 509968 - protein, 9 aa, Homo Sapiens
PLAPSLAKA

SEQ ID NO: 509969 - protein, 9 aa, Homo Sapiens
AARTCAHEA

SEQ ID NO: 509970 - protein, 9 aa, Homo Sapiens
LSHMAGFVQ

SEQ ID NO: 509971 - protein, 9 aa, Homo Sapiens
EGAVEKGEE

SEQ ID NO: 509972 - protein, 9 aa, Homo Sapiens
VLNSDVLQP

SEQ ID NO: 509973 - protein, 9 aa, Homo Sapiens
LTLGSTEPQ

SEQ ID NO: 509974 - protein, 9 aa, Homo Sapiens
KRDTRSIKE

SEQ ID NO: 509975 - protein, 9 aa, Homo Sapiens
LRLFRELLC

SEQ ID NO: 509976 - protein, 9 aa, Homo Sapiens
KQRERNNNT

SEQ ID NO: 509977 - protein, 9 aa, Homo Sapiens
LHRFRGSSS

SEQ ID NO: 509978 - protein, 9 aa, Homo Sapiens
IQRICATFD

SEQ ID NO: 509979 - protein, 9 aa, Homo Sapiens
RVRFEKVMF

SEQ ID NO: 509980 - protein, 9 aa, Homo Sapiens
TAARRHAAS

SEQ ID NO: 509981 - protein, 9 aa, Homo Sapiens
KRSKAFDYI

SEQ ID NO: 509982 - protein, 9 aa, Homo Sapiens
VGIIARANP

SEQ ID NO: 509983 - protein, 9 aa, Homo Sapiens
GRDRQALVS

SEQ ID NO: 509984 - protein, 9 aa, Homo Sapiens
MLAALQLMQ

SEQ ID NO: 509985 - protein, 9 aa, Homo Sapiens
NIQKRKEMQ

SEQ ID NO: 509986 - protein, 9 aa, Homo Sapiens
NGLTLGSTE

SEQ ID NO: 509987 - protein, 9 aa, Homo Sapiens
DDVQQLCQA

SEQ ID NO: 509988 - protein, 9 aa, Homo Sapiens
TRKGAILSG

SEQ ID NO: 509989 - protein, 9 aa, Homo Sapiens
EPVPDDDQT

SEQ ID NO: 509990 - protein, 9 aa, Homo Sapiens
QPPMGGAAS

SEQ ID NO: 509991 - protein, 9 aa, Homo Sapiens
PYQTQNQWA

SEQ ID NO: 509992 - protein, 9 aa, Homo Sapiens
AASSQALPG

SEQ ID NO: 509993 - protein, 9 aa, Homo Sapiens
LPSGLGLLE

SEQ ID NO: 509994 - protein, 9 aa, Homo Sapiens
DYMYWTDWS

SEQ ID NO: 509995 - protein, 9 aa, Homo Sapiens
QVYEKIKAI

SEQ ID NO: 509996 - protein, 9 aa, Homo Sapiens
TFHEASEHC

SEQ ID NO: 509997 - protein, 9 aa, Homo Sapiens
SEQPPMGGA

SEQ ID NO: 509998 - protein, 9 aa, Homo Sapiens
HLEGQPLRM

SEQ ID NO: 509999 - protein, 9 aa, Homo Sapiens
HIPSNGTGY

SEQ ID NO: 510000 - protein, 9 aa, Homo Sapiens
MRTLPRGLS

SEQ ID NO: 510001 - protein, 9 aa, Homo Sapiens
LHLFIKIFT

SEQ ID NO: 510002 - protein, 9 aa, Homo Sapiens
LLAARIVED

SEQ ID NO: 510003 - protein, 9 aa, Homo Sapiens
QKRKEMQQE

SEQ ID NO: 510004 - protein, 9 aa, Homo Sapiens
AGFVQFRQL

SEQ ID NO: 510005 - protein, 9 aa, Homo Sapiens
WRGMSPEVT

SEQ ID NO: 510006 - protein, 9 aa, Homo Sapiens
LKHLEDEEK

SEQ ID NO: 510007 - protein, 9 aa, Homo Sapiens
FSGIVSKGN

SEQ ID NO: 510008 - protein, 9 aa, Homo Sapiens
DGSPLNFLR

SEQ ID NO: 510009 - protein, 9 aa, Homo Sapiens
GKRTIIECS

SEQ ID NO: 510010 - protein, 9 aa, Homo Sapiens
ILSKHQKIH

SEQ ID NO: 510011 - protein, 9 aa, Homo Sapiens
ALFTRGKDR

SEQ ID NO: 510012 - protein, 9 aa, Homo Sapiens
LPSEISPIK

SEQ ID NO: 510013 - protein, 9 aa, Homo Sapiens
ERNNNTDTL

SEQ ID NO: 510014 - protein, 9 aa, Homo Sapiens
LRTQLNHSL

SEQ ID NO: 510015 - protein, 9 aa, Homo Sapiens
LADNGHNSD

SEQ ID NO: 510016 - protein, 9 aa, Homo Sapiens
HEAGLPLMM

SEQ ID NO: 510017 - protein, 9 aa, Homo Sapiens
ADREDKVEP

SEQ ID NO: 510018 - protein, 9 aa, Homo Sapiens
DHHMKDPSW

SEQ ID NO: 510019 - protein, 9 aa, Homo Sapiens
PEEILRLRE

SEQ ID NO: 510020 - protein, 9 aa, Homo Sapiens
IDAAGSQPE

SEQ ID NO: 510021 - protein, 9 aa, Homo Sapiens
KFFQVYEKI

SEQ ID NO: 510022 - protein, 9 aa, Homo Sapiens
ACKKFQDAG

SEQ ID NO: 510023 - protein, 9 aa, Homo Sapiens
TGPLQTNPL

SEQ ID NO: 510024 - protein, 9 aa, Homo Sapiens
RYLLFMMLA

SEQ ID NO: 510025 - protein, 9 aa, Homo Sapiens
DKSEAKAAE

SEQ ID NO: 510026 - protein, 9 aa, Homo Sapiens
FAFYHDKHG

SEQ ID NO: 510027 - protein, 9 aa, Homo Sapiens
IQEMYAAMK

SEQ ID NO: 510028 - protein, 9 aa, Homo Sapiens
AQEGVMEEA

SEQ ID NO: 510029 - protein, 9 aa, Homo Sapiens
ALTSKATRP

SEQ ID NO: 510030 - protein, 9 aa, Homo Sapiens
YETQINKML

SEQ ID NO: 510031 - protein, 9 aa, Homo Sapiens
EQHHRTSSG

SEQ ID NO: 510032 - protein, 9 aa, Homo Sapiens
YWELSNHKV

SEQ ID NO: 510033 - protein, 9 aa, Homo Sapiens
VGGQTSERK

SEQ ID NO: 510034 - protein, 9 aa, Homo Sapiens
KVFNQSLTL

SEQ ID NO: 510035 - protein, 9 aa, Homo Sapiens
TLADLSLHP

SEQ ID NO: 510036 - protein, 9 aa, Homo Sapiens
VEHPMLENV

SEQ ID NO: 510037 - protein, 9 aa, Homo Sapiens
QASAKHQKR

SEQ ID NO: 510038 - protein, 9 aa, Homo Sapiens
NNNISSTSK

SEQ ID NO: 510039 - protein, 9 aa, Homo Sapiens
VMVAQHDVY

SEQ ID NO: 510040 - protein, 9 aa, Homo Sapiens
IDKTKVDKS

SEQ ID NO: 510041 - protein, 9 aa, Homo Sapiens
QTTTKSQLN

SEQ ID NO: 510042 - protein, 9 aa, Homo Sapiens
ELSNHKVMK

SEQ ID NO: 510043 - protein, 9 aa, Homo Sapiens
DDKDDSGAT

SEQ ID NO: 510044 - protein, 9 aa, Homo Sapiens
LLAEQHHRT

SEQ ID NO: 510045 - protein, 9 aa, Homo Sapiens
HGPPEKRIT

SEQ ID NO: 510046 - protein, 9 aa, Homo Sapiens
SDISECVDN

SEQ ID NO: 510047 - protein, 9 aa, Homo Sapiens
GIQEEDRKH

SEQ ID NO: 510048 - protein, 9 aa, Homo Sapiens
GYVAPEILK

SEQ ID NO: 510049 - protein, 9 aa, Homo Sapiens
GDPPKELRS

SEQ ID NO: 510050 - protein, 9 aa, Homo Sapiens
EAGLPLMML

SEQ ID NO: 510051 - protein, 9 aa, Homo Sapiens
QVESNKLRM

SEQ ID NO: 510052 - protein, 9 aa, Homo Sapiens
PRFWAQPCR

SEQ ID NO: 510053 - protein, 9 aa, Homo Sapiens
NSDKIEFNR

SEQ ID NO: 510054 - protein, 9 aa, Homo Sapiens
KWAEDRTGF

SEQ ID NO: 510055 - protein, 9 aa, Homo Sapiens
DPNPRVTWN

SEQ ID NO: 510056 - protein, 9 aa, Homo Sapiens
AAAALANAK

SEQ ID NO: 510057 - protein, 9 aa, Homo Sapiens
ATGALPYAF

SEQ ID NO: 510058 - protein, 9 aa, Homo Sapiens
GPLQTNPLC

SEQ ID NO: 510059 - protein, 9 aa, Homo Sapiens
QPHQREATK

SEQ ID NO: 510060 - protein, 9 aa, Homo Sapiens
SKEVRGDGL

SEQ ID NO: 510061 - protein, 9 aa, Homo Sapiens
AAEEHIEVV

SEQ ID NO: 510062 - protein, 9 aa, Homo Sapiens
RSPPRLPRL

SEQ ID NO: 510063 - protein, 9 aa, Homo Sapiens
CEADSKKKR

SEQ ID NO: 510064 - protein, 9 aa, Homo Sapiens
DFSKVKCLP

SEQ ID NO: 510065 - protein, 9 aa, Homo Sapiens
GCEADSKKK

SEQ ID NO: 510066 - protein, 9 aa, Homo Sapiens
SRTSSSYEE

SEQ ID NO: 510067 - protein, 9 aa, Homo Sapiens
AALANAKSR

SEQ ID NO: 510068 - protein, 9 aa, Homo Sapiens
ARAQPGQPV

SEQ ID NO: 510069 - protein, 9 aa, Homo Sapiens
EGPFHFLPD

SEQ ID NO: 510070 - protein, 9 aa, Homo Sapiens
VYLVINLGS

SEQ ID NO: 510071 - protein, 9 aa, Homo Sapiens
PAQEGVMEE

SEQ ID NO: 510072 - protein, 9 aa, Homo Sapiens
KHLEDEEKP

SEQ ID NO: 510073 - protein, 9 aa, Homo Sapiens
GNDSMPVHL

SEQ ID NO: 510074 - protein, 9 aa, Homo Sapiens
SSCDRVGTQ

SEQ ID NO: 510075 - protein, 9 aa, Homo Sapiens
IGIQEEDRK

SEQ ID NO: 510076 - protein, 9 aa, Homo Sapiens
SATYTPSSP

SEQ ID NO: 510077 - protein, 9 aa, Homo Sapiens
EAGDPPKEL

SEQ ID NO: 510078 - protein, 9 aa, Homo Sapiens
KFQDAGEQV

SEQ ID NO: 510079 - protein, 9 aa, Homo Sapiens
FGATVDGDF

SEQ ID NO: 510080 - protein, 9 aa, Homo Sapiens
IRARVPKVA

SEQ ID NO: 510081 - protein, 9 aa, Homo Sapiens
ELCGTPGYV

SEQ ID NO: 510082 - protein, 9 aa, Homo Sapiens
IMAGDQAFS

SEQ ID NO: 510083 - protein, 9 aa, Homo Sapiens
MKDPSWITR

SEQ ID NO: 510084 - protein, 9 aa, Homo Sapiens
RLNYLIGAA

SEQ ID NO: 510085 - protein, 9 aa, Homo Sapiens
FTRGKDRDR

SEQ ID NO: 510086 - protein, 9 aa, Homo Sapiens
KNPDILTHC

SEQ ID NO: 510087 - protein, 9 aa, Homo Sapiens
EEHIEVVKF

SEQ ID NO: 510088 - protein, 9 aa, Homo Sapiens
TVNVPFCGP

SEQ ID NO: 510089 - protein, 9 aa, Homo Sapiens
QPGQPVHAL

SEQ ID NO: 510090 - protein, 9 aa, Homo Sapiens
VNVPFCGPN

SEQ ID NO: 510091 - protein, 9 aa, Homo Sapiens
ESEAQSLET

SEQ ID NO: 510092 - protein, 9 aa, Homo Sapiens
QALPGVYLL

SEQ ID NO: 510093 - protein, 9 aa, Homo Sapiens
FLWLGCFWV

SEQ ID NO: 510094 - protein, 9 aa, Homo Sapiens
NLAPVLGTS

SEQ ID NO: 510095 - protein, 9 aa, Homo Sapiens
IVEDCNIPS

SEQ ID NO: 510096 - protein, 9 aa, Homo Sapiens
KGANGMILG

SEQ ID NO: 510097 - protein, 9 aa, Homo Sapiens
PRLNYLIGA

SEQ ID NO: 510098 - protein, 9 aa, Homo Sapiens
SSILSKHQK

SEQ ID NO: 510099 - protein, 9 aa, Homo Sapiens
GARGKPGRG

SEQ ID NO: 510100 - protein, 9 aa, Homo Sapiens
SQFGKRPEL

SEQ ID NO: 510101 - protein, 9 aa, Homo Sapiens
FRKLKLMRT

SEQ ID NO: 510102 - protein, 9 aa, Homo Sapiens
FPSSPENGN

SEQ ID NO: 510103 - protein, 9 aa, Homo Sapiens
KHTVLCQQK

SEQ ID NO: 510104 - protein, 9 aa, Homo Sapiens
LTCMAKGSW

SEQ ID NO: 510105 - protein, 9 aa, Homo Sapiens
FCIEKLPCH

SEQ ID NO: 510106 - protein, 9 aa, Homo Sapiens
AVSPYQTQN

SEQ ID NO: 510107 - protein, 9 aa, Homo Sapiens
PGYVAPEIL

SEQ ID NO: 510108 - protein, 9 aa, Homo Sapiens
LGSTEPQLT

SEQ ID NO: 510109 - protein, 9 aa, Homo Sapiens
GLGLLETQI

SEQ ID NO: 510110 - protein, 9 aa, Homo Sapiens
MLDQTQIQE

SEQ ID NO: 510111 - protein, 9 aa, Homo Sapiens
NNRRNAPPV

SEQ ID NO: 510112 - protein, 9 aa, Homo Sapiens
MAKGSWPLE

SEQ ID NO: 510113 - protein, 9 aa, Homo Sapiens
LPRDHHMKD

SEQ ID NO: 510114 - protein, 9 aa, Homo Sapiens
WAVSPYQTQ

SEQ ID NO: 510115 - protein, 9 aa, Homo Sapiens
DGMLLARDI

SEQ ID NO: 510116 - protein, 9 aa, Homo Sapiens
SHMAGFVQF

SEQ ID NO: 510117 - protein, 9 aa, Homo Sapiens
IECSSARSS

SEQ ID NO: 510118 - protein, 9 aa, Homo Sapiens
FRDEDFYCI

SEQ ID NO: 510119 - protein, 9 aa, Homo Sapiens
LPRLWSFRS

SEQ ID NO: 510120 - protein, 9 aa, Homo Sapiens
DEYFILKES

SEQ ID NO: 510121 - protein, 9 aa, Homo Sapiens
AVEAGDPPK

SEQ ID NO: 510122 - protein, 9 aa, Homo Sapiens
PFSLKADGK

SEQ ID NO: 510123 - protein, 9 aa, Homo Sapiens
STEPQLTVH

SEQ ID NO: 510124 - protein, 9 aa, Homo Sapiens
QSLETNSCS

SEQ ID NO: 510125 - protein, 9 aa, Homo Sapiens
KSSNTTKES

SEQ ID NO: 510126 - protein, 9 aa, Homo Sapiens
IKEAMNEIR

SEQ ID NO: 510127 - protein, 9 aa, Homo Sapiens
HLHSYIGLP

SEQ ID NO: 510128 - protein, 9 aa, Homo Sapiens
FYCILSLNS

SEQ ID NO: 510129 - protein, 9 aa, Homo Sapiens
LVEQKVLCR

SEQ ID NO: 510130 - protein, 9 aa, Homo Sapiens
YIATYFSKK

SEQ ID NO: 510131 - protein, 9 aa, Homo Sapiens
QRIGIGVSP

SEQ ID NO: 510132 - protein, 9 aa, Homo Sapiens
YCYAIRLSA

SEQ ID NO: 510133 - protein, 9 aa, Homo Sapiens
KNLTNQMLT

SEQ ID NO: 510134 - protein, 9 aa, Homo Sapiens
PQLNLTPIG

SEQ ID NO: 510135 - protein, 9 aa, Homo Sapiens
HRFRGSSSA

SEQ ID NO: 510136 - protein, 9 aa, Homo Sapiens
ASSGHTTPI

SEQ ID NO: 510137 - protein, 9 aa, Homo Sapiens
LKYQSYRHQ

SEQ ID NO: 510138 - protein, 9 aa, Homo Sapiens
YLVINLGSG

SEQ ID NO: 510139 - protein, 9 aa, Homo Sapiens
GGTVWLEWR

SEQ ID NO: 510140 - protein, 9 aa, Homo Sapiens
CPSQMDVEL

SEQ ID NO: 510141 - protein, 9 aa, Homo Sapiens
AFYHDKHGN

SEQ ID NO: 510142 - protein, 9 aa, Homo Sapiens
EELPHEDED

SEQ ID NO: 510143 - protein, 9 aa, Homo Sapiens
ATGDPNPRV

SEQ ID NO: 510144 - protein, 9 aa, Homo Sapiens
SSTSKLGTD

SEQ ID NO: 510145 - protein, 9 aa, Homo Sapiens
EGRGSQASG

SEQ ID NO: 510146 - protein, 9 aa, Homo Sapiens
EHPMLENVE

SEQ ID NO: 510147 - protein, 9 aa, Homo Sapiens
RNNNTDTLY

SEQ ID NO: 510148 - protein, 9 aa, Homo Sapiens
QACGFDYTS

SEQ ID NO: 510149 - protein, 9 aa, Homo Sapiens
RRRTQEKVQ

SEQ ID NO: 510150 - protein, 9 aa, Homo Sapiens
KAVKRKIQA

SEQ ID NO: 510151 - protein, 9 aa, Homo Sapiens
VVARAQPGQ

SEQ ID NO: 510152 - protein, 9 aa, Homo Sapiens
LNHSLKEIH

SEQ ID NO: 510153 - protein, 9 aa, Homo Sapiens
VTGSAPGWD

SEQ ID NO: 510154 - protein, 9 aa, Homo Sapiens
LFAFYHDKH

SEQ ID NO: 510155 - protein, 9 aa, Homo Sapiens
HDKHGNPLT

SEQ ID NO: 510156 - protein, 9 aa, Homo Sapiens
SAPGWDGGI

SEQ ID NO: 510157 - protein, 9 aa, Homo Sapiens
EGPPPHGPP

SEQ ID NO: 510158 - protein, 9 aa, Homo Sapiens
YVLCTRSVS

SEQ ID NO: 510159 - protein, 9 aa, Homo Sapiens
KRKHTVLCQ

SEQ ID NO: 510160 - protein, 9 aa, Homo Sapiens
MPVHLHVRS

SEQ ID NO: 510161 - protein, 9 aa, Homo Sapiens
KGCEADSKK

SEQ ID NO: 510162 - protein, 9 aa, Homo Sapiens
TAYTPETHT

SEQ ID NO: 510163 - protein, 9 aa, Homo Sapiens
CHTYVLCTR

SEQ ID NO: 510164 - protein, 9 aa, Homo Sapiens
GGVVARAQP

SEQ ID NO: 510165 - protein, 9 aa, Homo Sapiens
REATKILLF

SEQ ID NO: 510166 - protein, 9 aa, Homo Sapiens
IHTGKTPYK

SEQ ID NO: 510167 - protein, 9 aa, Homo Sapiens
VSPAMSYSA

SEQ ID NO: 510168 - protein, 9 aa, Homo Sapiens
HHLHSYIGL

SEQ ID NO: 510169 - protein, 9 aa, Homo Sapiens
VEQNVLQHS

SEQ ID NO: 510170 - protein, 9 aa, Homo Sapiens
NAPVSDLEK

SEQ ID NO: 510171 - protein, 9 aa, Homo Sapiens
GNRVEHPML

SEQ ID NO: 510172 - protein, 9 aa, Homo Sapiens
LKLHLFIKI

SEQ ID NO: 510173 - protein, 9 aa, Homo Sapiens
LRDQHKYRY

SEQ ID NO: 510174 - protein, 9 aa, Homo Sapiens
CQATGDPNP

SEQ ID NO: 510175 - protein, 9 aa, Homo Sapiens
FRMETEYGP

SEQ ID NO: 510176 - protein, 9 aa, Homo Sapiens
RKGAILSGQ

SEQ ID NO: 510177 - protein, 9 aa, Homo Sapiens
FADLAVILL

SEQ ID NO: 510178 - protein, 9 aa, Homo Sapiens
VEQKVLCRI

SEQ ID NO: 510179 - protein, 9 aa, Homo Sapiens
APGWDGGIA

SEQ ID NO: 510180 - protein, 9 aa, Homo Sapiens
NAMRQRIRQ

SEQ ID NO: 510181 - protein, 9 aa, Homo Sapiens
QMIDKTKVD

SEQ ID NO: 510182 - protein, 9 aa, Homo Sapiens
ITKQEKDFL

SEQ ID NO: 510183 - protein, 9 aa, Homo Sapiens
GKGCEADSK

SEQ ID NO: 510184 - protein, 9 aa, Homo Sapiens
TVCLQLLIL

SEQ ID NO: 510185 - protein, 9 aa, Homo Sapiens
RKKLIDIQQ

SEQ ID NO: 510186 - protein, 9 aa, Homo Sapiens
TCMAKGSWP

SEQ ID NO: 510187 - protein, 9 aa, Homo Sapiens
QILPEAKVR

SEQ ID NO: 510188 - protein, 9 aa, Homo Sapiens
VAEGGTVWL

SEQ ID NO: 510189 - protein, 9 aa, Homo Sapiens
AIRLSAAED

SEQ ID NO: 510190 - protein, 9 aa, Homo Sapiens
AKAQLAYEL

SEQ ID NO: 510191 - protein, 9 aa, Homo Sapiens
RPQLNLTPI

SEQ ID NO: 510192 - protein, 9 aa, Homo Sapiens
LLNIQKRKE

SEQ ID NO: 510193 - protein, 9 aa, Homo Sapiens
ASAKHQKRL

SEQ ID NO: 510194 - protein, 9 aa, Homo Sapiens
IKNAMRQRI

SEQ ID NO: 510195 - protein, 9 aa, Homo Sapiens
GPNGGLTAS

SEQ ID NO: 510196 - protein, 9 aa, Homo Sapiens
NFCIFITDG

SEQ ID NO: 510197 - protein, 9 aa, Homo Sapiens
VDKSEAKAA

SEQ ID NO: 510198 - protein, 9 aa, Homo Sapiens
NLTPIGLPR

SEQ ID NO: 510199 - protein, 9 aa, Homo Sapiens
DECPPCFHG

SEQ ID NO: 510200 - protein, 9 aa, Homo Sapiens
VFCELGEGE

SEQ ID NO: 510201 - protein, 9 aa, Homo Sapiens
PVELERLKL

SEQ ID NO: 510202 - protein, 9 aa, Homo Sapiens
PRLPRLWSF

SEQ ID NO: 510203 - protein, 9 aa, Homo Sapiens
TVFPKIKSR

SEQ ID NO: 510204 - protein, 9 aa, Homo Sapiens
GDGSRNSGS

SEQ ID NO: 510205 - protein, 9 aa, Homo Sapiens
TTPIPVTDA

SEQ ID NO: 510206 - protein, 9 aa, Homo Sapiens
EEEGPFHFL

SEQ ID NO: 510207 - protein, 9 aa, Homo Sapiens
PPLCLKLKY

SEQ ID NO: 510208 - protein, 9 aa, Homo Sapiens
FQETCPYCF

SEQ ID NO: 510209 - protein, 9 aa, Homo Sapiens
NNQILQHHV

SEQ ID NO: 510210 - protein, 9 aa, Homo Sapiens
SSVFSMLDQ

SEQ ID NO: 510211 - protein, 9 aa, Homo Sapiens
PLLNIQKRK

SEQ ID NO: 510212 - protein, 9 aa, Homo Sapiens
TVEQNVLQH

SEQ ID NO: 510213 - protein, 9 aa, Homo Sapiens
DHAPGQFVA

SEQ ID NO: 510214 - protein, 9 aa, Homo Sapiens
FHEASEHCI

SEQ ID NO: 510215 - protein, 9 aa, Homo Sapiens
VESNKLRMD

SEQ ID NO: 510216 - protein, 9 aa, Homo Sapiens
DGRDRQALV

SEQ ID NO: 510217 - protein, 9 aa, Homo Sapiens
QLCHTYVLC

SEQ ID NO: 510218 - protein, 9 aa, Homo Sapiens
FHFLPDVLE

SEQ ID NO: 510219 - protein, 9 aa, Homo Sapiens
KTGQCIKPL

SEQ ID NO: 510220 - protein, 9 aa, Homo Sapiens
VSKIETLRL

SEQ ID NO: 510221 - protein, 9 aa, Homo Sapiens
AKVMVAQHD

SEQ ID NO: 510222 - protein, 9 aa, Homo Sapiens
GDMATGTPI

SEQ ID NO: 510223 - protein, 9 aa, Homo Sapiens
GIIARANPT

SEQ ID NO: 510224 - protein, 9 aa, Homo Sapiens
YAAMKADPD

SEQ ID NO: 510225 - protein, 9 aa, Homo Sapiens
AAMKADPDG

SEQ ID NO: 510226 - protein, 9 aa, Homo Sapiens
GTAEEILDE

SEQ ID NO: 510227 - protein, 9 aa, Homo Sapiens
AAIKNAMRQ

SEQ ID NO: 510228 - protein, 9 aa, Homo Sapiens
NDPQEPWCY

SEQ ID NO: 510229 - protein, 9 aa, Homo Sapiens
RGKPGRGPL

SEQ ID NO: 510230 - protein, 9 aa, Homo Sapiens
SIQEMYAAM

SEQ ID NO: 510231 - protein, 9 aa, Homo Sapiens
TAFLALARP

SEQ ID NO: 510232 - protein, 9 aa, Homo Sapiens
NKSQTSFHF

SEQ ID NO: 510233 - protein, 9 aa, Homo Sapiens
LRVKGANGM

SEQ ID NO: 510234 - protein, 9 aa, Homo Sapiens
ELLQLTQLQ

SEQ ID NO: 510235 - protein, 9 aa, Homo Sapiens
PQEPWCYTT

SEQ ID NO: 510236 - protein, 9 aa, Homo Sapiens
GQAHRCCRV

SEQ ID NO: 510237 - protein, 9 aa, Homo Sapiens
ESERLKQHT

SEQ ID NO: 510238 - protein, 9 aa, Homo Sapiens
GSSSVFSML

SEQ ID NO: 510239 - protein, 9 aa, Homo Sapiens
PKELRSLPP

SEQ ID NO: 510240 - protein, 9 aa, Homo Sapiens
VQFDFLGKD

SEQ ID NO: 510241 - protein, 9 aa, Homo Sapiens
IEHHPTVAK

SEQ ID NO: 510242 - protein, 9 aa, Homo Sapiens
LWLGCFWVS

SEQ ID NO: 510243 - protein, 9 aa, Homo Sapiens
TGKTPYKCK

SEQ ID NO: 510244 - protein, 9 aa, Homo Sapiens
VVTICVIHR

SEQ ID NO: 510245 - protein, 9 aa, Homo Sapiens
GLTQYQDYM

SEQ ID NO: 510246 - protein, 9 aa, Homo Sapiens
GLPEKVDDF

SEQ ID NO: 510247 - protein, 9 aa, Homo Sapiens
RNSGSRHHE

SEQ ID NO: 510248 - protein, 9 aa, Homo Sapiens
RTSTLSPEH

SEQ ID NO: 510249 - protein, 9 aa, Homo Sapiens
LPRSPPRLP

SEQ ID NO: 510250 - protein, 9 aa, Homo Sapiens
AADECPPCF

SEQ ID NO: 510251 - protein, 9 aa, Homo Sapiens
NSDVLQPGA

SEQ ID NO: 510252 - protein, 9 aa, Homo Sapiens
AARIVEDCN

SEQ ID NO: 510253 - protein, 9 aa, Homo Sapiens
LLLAAASSQ

SEQ ID NO: 510254 - protein, 9 aa, Homo Sapiens
TGSAPGWDG

SEQ ID NO: 510255 - protein, 9 aa, Homo Sapiens
TDGVSPCCP

SEQ ID NO: 510256 - protein, 9 aa, Homo Sapiens
PEECTETLD

SEQ ID NO: 510257 - protein, 9 aa, Homo Sapiens
APRLNYLIG

SEQ ID NO: 510258 - protein, 9 aa, Homo Sapiens
RVADRTGHS

SEQ ID NO: 510259 - protein, 9 aa, Homo Sapiens
MSGENVNRV

SEQ ID NO: 510260 - protein, 9 aa, Homo Sapiens
PEEADREDK

SEQ ID NO: 510261 - protein, 9 aa, Homo Sapiens
PSGPWRVCL

SEQ ID NO: 510262 - protein, 9 aa, Homo Sapiens
FPDACKKFQ

SEQ ID NO: 510263 - protein, 9 aa, Homo Sapiens
NLTNQMLTI

SEQ ID NO: 510264 - protein, 9 aa, Homo Sapiens
MAAFMEGAV

SEQ ID NO: 510265 - protein, 9 aa, Homo Sapiens
GPWRVCLQA

SEQ ID NO: 510266 - protein, 9 aa, Homo Sapiens
HPTVAKYAM

SEQ ID NO: 510267 - protein, 9 aa, Homo Sapiens
LRRRTQEKV

SEQ ID NO: 510268 - protein, 9 aa, Homo Sapiens
LLTGPLQTN

SEQ ID NO: 510269 - protein, 9 aa, Homo Sapiens
KVEPGCHHI

SEQ ID NO: 510270 - protein, 9 aa, Homo Sapiens
GDIGKKKIK

SEQ ID NO: 510271 - protein, 9 aa, Homo Sapiens
TVWLEWRHV

SEQ ID NO: 510272 - protein, 9 aa, Homo Sapiens
QEDLESKTV

SEQ ID NO: 510273 - protein, 9 aa, Homo Sapiens
KVSKIETLR

SEQ ID NO: 510274 - protein, 9 aa, Homo Sapiens
RTGQHRLLF

SEQ ID NO: 510275 - protein, 9 aa, Homo Sapiens
FEILDRTRK

SEQ ID NO: 510276 - protein, 9 aa, Homo Sapiens
KEKCRLEKE

SEQ ID NO: 510277 - protein, 9 aa, Homo Sapiens
RDVHIPSNG

SEQ ID NO: 510278 - protein, 9 aa, Homo Sapiens
TSSSYEEEE

SEQ ID NO: 510279 - protein, 9 aa, Homo Sapiens
YGTAYTPET

SEQ ID NO: 510280 - protein, 9 aa, Homo Sapiens
FVLKSVFCE

SEQ ID NO: 510281 - protein, 9 aa, Homo Sapiens
KACNTQLNI

SEQ ID NO: 510282 - protein, 9 aa, Homo Sapiens
PEVECPSQM

SEQ ID NO: 510283 - protein, 9 aa, Homo Sapiens
LFMMLAALQ

SEQ ID NO: 510284 - protein, 9 aa, Homo Sapiens
DSEQEEDDE

SEQ ID NO: 510285 - protein, 9 aa, Homo Sapiens
EITKQEKDF

SEQ ID NO: 510286 - protein, 9 aa, Homo Sapiens
QSATYTPSS

SEQ ID NO: 510287 - protein, 9 aa, Homo Sapiens
GSYEDAVHF

SEQ ID NO: 510288 - protein, 9 aa, Homo Sapiens
LSKHQKIHT

SEQ ID NO: 510289 - protein, 9 aa, Homo Sapiens
NKLRMDRAI

SEQ ID NO: 510290 - protein, 9 aa, Homo Sapiens
AEEHIEVVK

SEQ ID NO: 510291 - protein, 9 aa, Homo Sapiens
PLSVNFGAT

SEQ ID NO: 510292 - protein, 9 aa, Homo Sapiens
GLLETQITS

SEQ ID NO: 510293 - protein, 9 aa, Homo Sapiens
TKGHDTDTR

SEQ ID NO: 510294 - protein, 9 aa, Homo Sapiens
LLIPKVLAD

SEQ ID NO: 510295 - protein, 9 aa, Homo Sapiens
RAVIGIGIQ

SEQ ID NO: 510296 - protein, 9 aa, Homo Sapiens
QEMYAAMKA

SEQ ID NO: 510297 - protein, 9 aa, Homo Sapiens
MSKEKSSNT

SEQ ID NO: 510298 - protein, 9 aa, Homo Sapiens
AAWMSDISE

SEQ ID NO: 510299 - protein, 9 aa, Homo Sapiens
TRSIKEAMN

SEQ ID NO: 510300 - protein, 9 aa, Homo Sapiens
MNRLGSGGR

SEQ ID NO: 510301 - protein, 9 aa, Homo Sapiens
LYIQQDNSQ

SEQ ID NO: 510302 - protein, 9 aa, Homo Sapiens
VAGIAKVMV

SEQ ID NO: 510303 - protein, 9 aa, Homo Sapiens
QNYAQFAII

SEQ ID NO: 510304 - protein, 9 aa, Homo Sapiens
RALSARTSA

SEQ ID NO: 510305 - protein, 9 aa, Homo Sapiens
KLATLADLS

SEQ ID NO: 510306 - protein, 9 aa, Homo Sapiens
EINKISYPK

SEQ ID NO: 510307 - protein, 9 aa, Homo Sapiens
ADGKNPDIL

SEQ ID NO: 510308 - protein, 9 aa, Homo Sapiens
PHLEGQPLR

SEQ ID NO: 510309 - protein, 9 aa, Homo Sapiens
RNPDNDPQE

SEQ ID NO: 510310 - protein, 9 aa, Homo Sapiens
NSGSRHHEA

SEQ ID NO: 510311 - protein, 9 aa, Homo Sapiens
QLKRKSLDT

SEQ ID NO: 510312 - protein, 9 aa, Homo Sapiens
NTKDQGYTT

SEQ ID NO: 510313 - protein, 9 aa, Homo Sapiens
AFTLGYQNG

SEQ ID NO: 510314 - protein, 9 aa, Homo Sapiens
QIKQRERNN

SEQ ID NO: 510315 - protein, 9 aa, Homo Sapiens
SPENGNKSS

SEQ ID NO: 510316 - protein, 9 aa, Homo Sapiens
ARALSARTS

SEQ ID NO: 510317 - protein, 9 aa, Homo Sapiens
KMSKEKSSN

SEQ ID NO: 510318 - protein, 9 aa, Homo Sapiens
AWMSDISEC

SEQ ID NO: 510319 - protein, 9 aa, Homo Sapiens
EVLNTIEKY

SEQ ID NO: 510320 - protein, 9 aa, Homo Sapiens
QRERNNNTD

SEQ ID NO: 510321 - protein, 9 aa, Homo Sapiens
AFMEGAVEK

SEQ ID NO: 510322 - protein, 9 aa, Homo Sapiens
VQASAKHQK

SEQ ID NO: 510323 - protein, 9 aa, Homo Sapiens
TAWRGMSPE

SEQ ID NO: 510324 - protein, 9 aa, Homo Sapiens
YCILSLNSR

SEQ ID NO: 510325 - protein, 9 aa, Homo Sapiens
GWDGGIAGA

SEQ ID NO: 510326 - protein, 9 aa, Homo Sapiens
LLARDIRSC

SEQ ID NO: 510327 - protein, 9 aa, Homo Sapiens
PPPHGPPEK

SEQ ID NO: 510328 - protein, 9 aa, Homo Sapiens
TPEAKNLTN

SEQ ID NO: 510329 - protein, 9 aa, Homo Sapiens
LNSKINCEL

SEQ ID NO: 510330 - protein, 9 aa, Homo Sapiens
LLSHMAGFV

SEQ ID NO: 510331 - protein, 9 aa, Homo Sapiens
DKTKVDKSE

SEQ ID NO: 510332 - protein, 9 aa, Homo Sapiens
YFILKESNL

SEQ ID NO: 510333 - protein, 9 aa, Homo Sapiens
AQSLETNSC

SEQ ID NO: 510334 - protein, 9 aa, Homo Sapiens
IPVTDASSV

SEQ ID NO: 510335 - protein, 9 aa, Homo Sapiens
TLAAIIHEA

SEQ ID NO: 510336 - protein, 9 aa, Homo Sapiens
HFRKPSVHI

SEQ ID NO: 510337 - protein, 9 aa, Homo Sapiens
KTAKAQLAY

SEQ ID NO: 510338 - protein, 9 aa, Homo Sapiens
RDHHMKDPS

SEQ ID NO: 510339 - protein, 9 aa, Homo Sapiens
SVNWAVSPY

SEQ ID NO: 510340 - protein, 9 aa, Homo Sapiens
LCQAGEEEF

SEQ ID NO: 510341 - protein, 9 aa, Homo Sapiens
QTSFHFRKP

SEQ ID NO: 510342 - protein, 9 aa, Homo Sapiens
EQKVLCRIH

SEQ ID NO: 510343 - protein, 9 aa, Homo Sapiens
NISSTSKLG

SEQ ID NO: 510344 - protein, 9 aa, Homo Sapiens
VISIMAGDQ

SEQ ID NO: 510345 - protein, 9 aa, Homo Sapiens
EKSSNTTKE

SEQ ID NO: 510346 - protein, 9 aa, Homo Sapiens
VAGEEINKI

SEQ ID NO: 510347 - protein, 9 aa, Homo Sapiens
PPMGGAASP

SEQ ID NO: 510348 - protein, 9 aa, Homo Sapiens
RQRIRQEEC

SEQ ID NO: 510349 - protein, 9 aa, Homo Sapiens
IKRKHTVLC

SEQ ID NO: 510350 - protein, 9 aa, Homo Sapiens
GCILYKEYE

SEQ ID NO: 510351 - protein, 9 aa, Homo Sapiens
RGSQASGLK

SEQ ID NO: 510352 - protein, 9 aa, Homo Sapiens
FSSRRPRNN

SEQ ID NO: 510353 - protein, 9 aa, Homo Sapiens
GMSPEVTLA

SEQ ID NO: 510354 - protein, 9 aa, Homo Sapiens
DKDDSGATT

SEQ ID NO: 510355 - protein, 9 aa, Homo Sapiens
NRVEHPMLE

SEQ ID NO: 510356 - protein, 9 aa, Homo Sapiens
MSHIVGPLC

SEQ ID NO: 510357 - protein, 9 aa, Homo Sapiens
APSLAKAGP

SEQ ID NO: 510358 - protein, 9 aa, Homo Sapiens
DNSQRKRKH

SEQ ID NO: 510359 - protein, 9 aa, Homo Sapiens
KGAILSGQL

SEQ ID NO: 510360 - protein, 9 aa, Homo Sapiens
DVNLWYKTG

SEQ ID NO: 510361 - protein, 9 aa, Homo Sapiens
AGEEINKIS

SEQ ID NO: 510362 - protein, 9 aa, Homo Sapiens
DDDQTTTKS

SEQ ID NO: 510363 - protein, 9 aa, Homo Sapiens
HDTDTRDDI

SEQ ID NO: 510364 - protein, 9 aa, Homo Sapiens
AKAGPPADP

SEQ ID NO: 510365 - protein, 9 aa, Homo Sapiens
RDEDFYCIL

SEQ ID NO: 510366 - protein, 9 aa, Homo Sapiens
LNFLRISSN

SEQ ID NO: 510367 - protein, 9 aa, Homo Sapiens
SGTLYMNRL

SEQ ID NO: 510368 - protein, 9 aa, Homo Sapiens
LSEITKQEK

SEQ ID NO: 510369 - protein, 9 aa, Homo Sapiens
EVSGANPWI

SEQ ID NO: 510370 - protein, 9 aa, Homo Sapiens
TPQSATYTP

SEQ ID NO: 510371 - protein, 9 aa, Homo Sapiens
FCIFITDGV

SEQ ID NO: 510372 - protein, 9 aa, Homo Sapiens
PNAPVSDLE

SEQ ID NO: 510373 - protein, 9 aa, Homo Sapiens
PYAFTLGYQ

SEQ ID NO: 510374 - protein, 9 aa, Homo Sapiens
CELQVPPTQ

SEQ ID NO: 510375 - protein, 9 aa, Homo Sapiens
CFHGARDSN

SEQ ID NO: 510376 - protein, 9 aa, Homo Sapiens
FEKVMFGIL

SEQ ID NO: 510377 - protein, 9 aa, Homo Sapiens
MGIRARVPK

SEQ ID NO: 510378 - protein, 9 aa, Homo Sapiens
ILRLREELS

SEQ ID NO: 510379 - protein, 9 aa, Homo Sapiens
KSVFCELGE

SEQ ID NO: 510380 - protein, 9 aa, Homo Sapiens
AFLALARPG

SEQ ID NO: 510381 - protein, 9 aa, Homo Sapiens
KGKKTDICK

SEQ ID NO: 510382 - protein, 9 aa, Homo Sapiens
LDFSKVKCL

SEQ ID NO: 510383 - protein, 9 aa, Homo Sapiens
LEDEEKPKI

SEQ ID NO: 510384 - protein, 9 aa, Homo Sapiens
LMRTLPRGL

SEQ ID NO: 510385 - protein, 9 aa, Homo Sapiens
GAVYLVINL

SEQ ID NO: 510386 - protein, 9 aa, Homo Sapiens
AAFMEGAVE

SEQ ID NO: 510387 - protein, 9 aa, Homo Sapiens
SQRKRKHLP

SEQ ID NO: 510388 - protein, 9 aa, Homo Sapiens
SSRRPRNNR

SEQ ID NO: 510389 - protein, 9 aa, Homo Sapiens
ELLCCALVR

SEQ ID NO: 510390 - protein, 9 aa, Homo Sapiens
TGTPILRLL

SEQ ID NO: 510391 - protein, 9 aa, Homo Sapiens
VECPSQMDV

SEQ ID NO: 510392 - protein, 9 aa, Homo Sapiens
DQILPEAKV

SEQ ID NO: 510393 - protein, 9 aa, Homo Sapiens
VLKSVFCEL

SEQ ID NO: 510394 - protein, 9 aa, Homo Sapiens
RVGTQERGL

SEQ ID NO: 510395 - protein, 9 aa, Homo Sapiens
ANGCILYKE

SEQ ID NO: 510396 - protein, 9 aa, Homo Sapiens
DQAFSQGEV

SEQ ID NO: 510397 - protein, 9 aa, Homo Sapiens
ILKESNLPW

SEQ ID NO: 510398 - protein, 9 aa, Homo Sapiens
ISECVDNIR

SEQ ID NO: 510399 - protein, 9 aa, Homo Sapiens
YEEEEKEEI

SEQ ID NO: 510400 - protein, 9 aa, Homo Sapiens
QSGDGSRNS

SEQ ID NO: 510401 - protein, 9 aa, Homo Sapiens
SSSYEEEEK

SEQ ID NO: 510402 - protein, 9 aa, Homo Sapiens
NCELQVPPT

SEQ ID NO: 510403 - protein, 9 aa, Homo Sapiens
KLKQACGFD

SEQ ID NO: 510404 - protein, 9 aa, Homo Sapiens
IINPLRLFV

SEQ ID NO: 510405 - protein, 9 aa, Homo Sapiens
CILSLNSRR

SEQ ID NO: 510406 - protein, 9 aa, Homo Sapiens
CTETLDSSY

SEQ ID NO: 510407 - protein, 9 aa, Homo Sapiens
QREATKILL

SEQ ID NO: 510408 - protein, 9 aa, Homo Sapiens
CPPCFHGAR

SEQ ID NO: 510409 - protein, 9 aa, Homo Sapiens
LPYAFTLGY

SEQ ID NO: 510410 - protein, 9 aa, Homo Sapiens
NPREDGEKA

SEQ ID NO: 510411 - protein, 9 aa, Homo Sapiens
VKEKCRLEK

SEQ ID NO: 510412 - protein, 9 aa, Homo Sapiens
NKKACNTQL

SEQ ID NO: 510413 - protein, 9 aa, Homo Sapiens
LRCQSPYGA

SEQ ID NO: 510414 - protein, 9 aa, Homo Sapiens
TGQCIKPLF

SEQ ID NO: 510415 - protein, 9 aa, Homo Sapiens
QNVLQHSAA

SEQ ID NO: 510416 - protein, 9 aa, Homo Sapiens
GVSPAMSYS

SEQ ID NO: 510417 - protein, 9 aa, Homo Sapiens
PHQREATKI

SEQ ID NO: 510418 - protein, 9 aa, Homo Sapiens
AAIIHEAGL

SEQ ID NO: 510419 - protein, 9 aa, Homo Sapiens
VHKEQKLSK

SEQ ID NO: 510420 - protein, 9 aa, Homo Sapiens
DLALASDAA

SEQ ID NO: 510421 - protein, 9 aa, Homo Sapiens
ASVSSSAPE

SEQ ID NO: 510422 - protein, 9 aa, Homo Sapiens
VAGYIGDPH

SEQ ID NO: 510423 - protein, 9 aa, Homo Sapiens
YYFILILQG

SEQ ID NO: 510424 - protein, 9 aa, Homo Sapiens
MPNVFNDLS

SEQ ID NO: 510425 - protein, 9 aa, Homo Sapiens
HSLSDKSNA

SEQ ID NO: 510426 - protein, 9 aa, Homo Sapiens
SCEFTTCEP

SEQ ID NO: 510427 - protein, 9 aa, Homo Sapiens
LAMEQTCGE

SEQ ID NO: 510428 - protein, 9 aa, Homo Sapiens
ECSIEGGGP

SEQ ID NO: 510429 - protein, 9 aa, Homo Sapiens
RASRAAGRG

SEQ ID NO: 510430 - protein, 9 aa, Homo Sapiens
TVCQPGAAH

SEQ ID NO: 510431 - protein, 9 aa, Homo Sapiens
PCVRWEYRN

SEQ ID NO: 510432 - protein, 9 aa, Homo Sapiens
KKYHIWDEV

SEQ ID NO: 510433 - protein, 9 aa, Homo Sapiens
SLSGMRSTG

SEQ ID NO: 510434 - protein, 9 aa, Homo Sapiens
RTPLPVDQR

SEQ ID NO: 510435 - protein, 9 aa, Homo Sapiens
TPPSPRSLL

SEQ ID NO: 510436 - protein, 9 aa, Homo Sapiens
LGSGPPLLT

SEQ ID NO: 510437 - protein, 9 aa, Homo Sapiens
GDLNTDHLK

SEQ ID NO: 510438 - protein, 9 aa, Homo Sapiens
VISYYKYKD

SEQ ID NO: 510439 - protein, 9 aa, Homo Sapiens
CVAWSAAGT

SEQ ID NO: 510440 - protein, 9 aa, Homo Sapiens
TVEALKDQQ

SEQ ID NO: 510441 - protein, 9 aa, Homo Sapiens
RGNGRSSQA

SEQ ID NO: 510442 - protein, 9 aa, Homo Sapiens
NCACEQFRC

SEQ ID NO: 510443 - protein, 9 aa, Homo Sapiens
TKPGICENW

SEQ ID NO: 510444 - protein, 9 aa, Homo Sapiens
DGKLKARPK

SEQ ID NO: 510445 - protein, 9 aa, Homo Sapiens
PLSVYRNIA

SEQ ID NO: 510446 - protein, 9 aa, Homo Sapiens
HSHLTRARR

SEQ ID NO: 510447 - protein, 9 aa, Homo Sapiens
QIRCRIPEE

SEQ ID NO: 510448 - protein, 9 aa, Homo Sapiens
NELFRRGQF

SEQ ID NO: 510449 - protein, 9 aa, Homo Sapiens
GSYNAVERI

SEQ ID NO: 510450 - protein, 9 aa, Homo Sapiens
QKQQLTAEL

SEQ ID NO: 510451 - protein, 9 aa, Homo Sapiens
SDKSNAHPG

SEQ ID NO: 510452 - protein, 9 aa, Homo Sapiens
KTIENHNIS

SEQ ID NO: 510453 - protein, 9 aa, Homo Sapiens
ATVCQPGAA

SEQ ID NO: 510454 - protein, 9 aa, Homo Sapiens
RRPRHSHLT

SEQ ID NO: 510455 - protein, 9 aa, Homo Sapiens
MEEGPLPGW

SEQ ID NO: 510456 - protein, 9 aa, Homo Sapiens
LIGHSFGAH

SEQ ID NO: 510457 - protein, 9 aa, Homo Sapiens
QIQEETRCR

SEQ ID NO: 510458 - protein, 9 aa, Homo Sapiens
LTAQYNSKW

SEQ ID NO: 510459 - protein, 9 aa, Homo Sapiens
PPQSPALIQ

SEQ ID NO: 510460 - protein, 9 aa, Homo Sapiens
PSSCCSRRR

SEQ ID NO: 510461 - protein, 9 aa, Homo Sapiens
DGVTLHDIK

SEQ ID NO: 510462 - protein, 9 aa, Homo Sapiens
CETRSVCSS

SEQ ID NO: 510463 - protein, 9 aa, Homo Sapiens
GLTCSMWEK

SEQ ID NO: 510464 - protein, 9 aa, Homo Sapiens
GPPLLTAQY

SEQ ID NO: 510465 - protein, 9 aa, Homo Sapiens
NSHLHSTNR

SEQ ID NO: 510466 - protein, 9 aa, Homo Sapiens
ARCMALSVN

SEQ ID NO: 510467 - protein, 9 aa, Homo Sapiens
ELRDQYRQM

SEQ ID NO: 510468 - protein, 9 aa, Homo Sapiens
HIPQLFIQR

SEQ ID NO: 510469 - protein, 9 aa, Homo Sapiens
WEGSFSFLG

SEQ ID NO: 510470 - protein, 9 aa, Homo Sapiens
ESIRVPSEL

SEQ ID NO: 510471 - protein, 9 aa, Homo Sapiens
IAAFTMIGT

SEQ ID NO: 510472 - protein, 9 aa, Homo Sapiens
LAFVDIAYS

SEQ ID NO: 510473 - protein, 9 aa, Homo Sapiens
MYSLLERKG

SEQ ID NO: 510474 - protein, 9 aa, Homo Sapiens
QLIPQLGVT

SEQ ID NO: 510475 - protein, 9 aa, Homo Sapiens
PLGAPGGSR

SEQ ID NO: 510476 - protein, 9 aa, Homo Sapiens
LCLDVSRFN

SEQ ID NO: 510477 - protein, 9 aa, Homo Sapiens
IQEETRCRL

SEQ ID NO: 510478 - protein, 9 aa, Homo Sapiens
YTLKSCGSE

SEQ ID NO: 510479 - protein, 9 aa, Homo Sapiens
PSGRTRRRR

SEQ ID NO: 510480 - protein, 9 aa, Homo Sapiens
ENRIIAAFT

SEQ ID NO: 510481 - protein, 9 aa, Homo Sapiens
YAVLMNHRV

SEQ ID NO: 510482 - protein, 9 aa, Homo Sapiens
LHFSTKNLD

SEQ ID NO: 510483 - protein, 9 aa, Homo Sapiens
PHRRQGEPF

SEQ ID NO: 510484 - protein, 9 aa, Homo Sapiens
GLGDLRNLL

SEQ ID NO: 510485 - protein, 9 aa, Homo Sapiens
AASGFGAAS

SEQ ID NO: 510486 - protein, 9 aa, Homo Sapiens
CVRWEYRNL

SEQ ID NO: 510487 - protein, 9 aa, Homo Sapiens
SIKMKCLAG

SEQ ID NO: 510488 - protein, 9 aa, Homo Sapiens
IKKKVDFEH

SEQ ID NO: 510489 - protein, 9 aa, Homo Sapiens
LLDLIRVIR

SEQ ID NO: 510490 - protein, 9 aa, Homo Sapiens
YSLLRHQYL

SEQ ID NO: 510491 - protein, 9 aa, Homo Sapiens
KSQKRPFQE

SEQ ID NO: 510492 - protein, 9 aa, Homo Sapiens
SFSSQKVLL

SEQ ID NO: 510493 - protein, 9 aa, Homo Sapiens
DLIRVIRPR

SEQ ID NO: 510494 - protein, 9 aa, Homo Sapiens
EAITLPKKD

SEQ ID NO: 510495 - protein, 9 aa, Homo Sapiens
AELDMATTK

SEQ ID NO: 510496 - protein, 9 aa, Homo Sapiens
AGGMTPTAF

SEQ ID NO: 510497 - protein, 9 aa, Homo Sapiens
IYEKAFSRS

SEQ ID NO: 510498 - protein, 9 aa, Homo Sapiens
SLLERKGHA

SEQ ID NO: 510499 - protein, 9 aa, Homo Sapiens
TRVSSLSPE

SEQ ID NO: 510500 - protein, 9 aa, Homo Sapiens
LCALCIDHF

SEQ ID NO: 510501 - protein, 9 aa, Homo Sapiens
SPVYVCRVV

SEQ ID NO: 510502 - protein, 9 aa, Homo Sapiens
VVFLLTIFW

SEQ ID NO: 510503 - protein, 9 aa, Homo Sapiens
FGAHLAGEA

SEQ ID NO: 510504 - protein, 9 aa, Homo Sapiens
WLLHCAQEC

SEQ ID NO: 510505 - protein, 9 aa, Homo Sapiens
SFHTLSLDH

SEQ ID NO: 510506 - protein, 9 aa, Homo Sapiens
TPVTYIAFE

SEQ ID NO: 510507 - protein, 9 aa, Homo Sapiens
CSRRRHRHH

SEQ ID NO: 510508 - protein, 9 aa, Homo Sapiens
LFSQKQHLL

SEQ ID NO: 510509 - protein, 9 aa, Homo Sapiens
NDDIFKIII

SEQ ID NO: 510510 - protein, 9 aa, Homo Sapiens
SDTEHWGGT

SEQ ID NO: 510511 - protein, 9 aa, Homo Sapiens
RKCQLHVLD

SEQ ID NO: 510512 - protein, 9 aa, Homo Sapiens
EILTDSNLN

SEQ ID NO: 510513 - protein, 9 aa, Homo Sapiens
RIIAAFTMI

SEQ ID NO: 510514 - protein, 9 aa, Homo Sapiens
LDICFSPTT

SEQ ID NO: 510515 - protein, 9 aa, Homo Sapiens
LKLAGWQCP

SEQ ID NO: 510516 - protein, 9 aa, Homo Sapiens
RAPAPGGRR

SEQ ID NO: 510517 - protein, 9 aa, Homo Sapiens
MKKWDPPSE

SEQ ID NO: 510518 - protein, 9 aa, Homo Sapiens
GYCVHSLVQ

SEQ ID NO: 510519 - protein, 9 aa, Homo Sapiens
KVTLNICSS

SEQ ID NO: 510520 - protein, 9 aa, Homo Sapiens
PQLFIQRST

SEQ ID NO: 510521 - protein, 9 aa, Homo Sapiens
EVDAVVNAA

SEQ ID NO: 510522 - protein, 9 aa, Homo Sapiens
RSLTSLETS

SEQ ID NO: 510523 - protein, 9 aa, Homo Sapiens
RELRSSLLH

SEQ ID NO: 510524 - protein, 9 aa, Homo Sapiens
RRRRGRARA

SEQ ID NO: 510525 - protein, 9 aa, Homo Sapiens
ENCNLTLLT

SEQ ID NO: 510526 - protein, 9 aa, Homo Sapiens
DARSAFRPL

SEQ ID NO: 510527 - protein, 9 aa, Homo Sapiens
CALCIDHFR

SEQ ID NO: 510528 - protein, 9 aa, Homo Sapiens
LHCAQECKH

SEQ ID NO: 510529 - protein, 9 aa, Homo Sapiens
AFRQASASS

SEQ ID NO: 510530 - protein, 9 aa, Homo Sapiens
VSNQDVDNC

SEQ ID NO: 510531 - protein, 9 aa, Homo Sapiens
EEQLIPQLG

SEQ ID NO: 510532 - protein, 9 aa, Homo Sapiens
YLSYLPALS

SEQ ID NO: 510533 - protein, 9 aa, Homo Sapiens
TRELYFHFP

SEQ ID NO: 510534 - protein, 9 aa, Homo Sapiens
GGRSDPVEF

SEQ ID NO: 510535 - protein, 9 aa, Homo Sapiens
ATPPSPRSL

SEQ ID NO: 510536 - protein, 9 aa, Homo Sapiens
AFTPTDGAK

SEQ ID NO: 510537 - protein, 9 aa, Homo Sapiens
VDIAYSSSV

SEQ ID NO: 510538 - protein, 9 aa, Homo Sapiens
CVSCNVSVH

SEQ ID NO: 510539 - protein, 9 aa, Homo Sapiens
QSVVCTPAG

SEQ ID NO: 510540 - protein, 9 aa, Homo Sapiens
RRDGGSWEV

SEQ ID NO: 510541 - protein, 9 aa, Homo Sapiens
SLETSDTRG

SEQ ID NO: 510542 - protein, 9 aa, Homo Sapiens
CNVSVHKEQ

SEQ ID NO: 510543 - protein, 9 aa, Homo Sapiens
SCQLCVFMG

SEQ ID NO: 510544 - protein, 9 aa, Homo Sapiens
NWRCLNTRG

SEQ ID NO: 510545 - protein, 9 aa, Homo Sapiens
DTRSSGSSG

SEQ ID NO: 510546 - protein, 9 aa, Homo Sapiens
SPRSLLAMQ

SEQ ID NO: 510547 - protein, 9 aa, Homo Sapiens
EAFRQASAS

SEQ ID NO: 510548 - protein, 9 aa, Homo Sapiens
KMYSLLERK

SEQ ID NO: 510549 - protein, 9 aa, Homo Sapiens
PSPEGEIGD

SEQ ID NO: 510550 - protein, 9 aa, Homo Sapiens
PPSPRSLLA

SEQ ID NO: 510551 - protein, 9 aa, Homo Sapiens
SDGGSPALS

SEQ ID NO: 510552 - protein, 9 aa, Homo Sapiens
VPDLALASD

SEQ ID NO: 510553 - protein, 9 aa, Homo Sapiens
NLVVFLLTI

SEQ ID NO: 510554 - protein, 9 aa, Homo Sapiens
QKDVFLHET

SEQ ID NO: 510555 - protein, 9 aa, Homo Sapiens
FAPRMCELC

SEQ ID NO: 510556 - protein, 9 aa, Homo Sapiens
FATKKRADK

SEQ ID NO: 510557 - protein, 9 aa, Homo Sapiens
GRGNGRSSQ

SEQ ID NO: 510558 - protein, 9 aa, Homo Sapiens
NGLPHTSAK

SEQ ID NO: 510559 - protein, 9 aa, Homo Sapiens
IIAAFTMIG

SEQ ID NO: 510560 - protein, 9 aa, Homo Sapiens
YSNDSTYSN

SEQ ID NO: 510561 - protein, 9 aa, Homo Sapiens
NKKLEMLLH

SEQ ID NO: 510562 - protein, 9 aa, Homo Sapiens
VRWEYRNLT

SEQ ID NO: 510563 - protein, 9 aa, Homo Sapiens
AGASIIQAG

SEQ ID NO: 510564 - protein, 9 aa, Homo Sapiens
SAAQRNDSS

SEQ ID NO: 510565 - protein, 9 aa, Homo Sapiens
PNFQIPLLL

SEQ ID NO: 510566 - protein, 9 aa, Homo Sapiens
AFVDIAYSS

SEQ ID NO: 510567 - protein, 9 aa, Homo Sapiens
TGLSAIDTD

SEQ ID NO: 510568 - protein, 9 aa, Homo Sapiens
IPQLFIQRS

SEQ ID NO: 510569 - protein, 9 aa, Homo Sapiens
FNSPITLLR

SEQ ID NO: 510570 - protein, 9 aa, Homo Sapiens
LESVFVAPT

SEQ ID NO: 510571 - protein, 9 aa, Homo Sapiens
PLSAAAHTL

SEQ ID NO: 510572 - protein, 9 aa, Homo Sapiens
SLPPHRDST

SEQ ID NO: 510573 - protein, 9 aa, Homo Sapiens
LVDVDICQR

SEQ ID NO: 510574 - protein, 9 aa, Homo Sapiens
YNKAMEGDK

SEQ ID NO: 510575 - protein, 9 aa, Homo Sapiens
AWSAAGTTK

SEQ ID NO: 510576 - protein, 9 aa, Homo Sapiens
HWLLHCAQE

SEQ ID NO: 510577 - protein, 9 aa, Homo Sapiens
LKARPKPCA

SEQ ID NO: 510578 - protein, 9 aa, Homo Sapiens
VYRNIAKLG

SEQ ID NO: 510579 - protein, 9 aa, Homo Sapiens
ESAAIISHG

SEQ ID NO: 510580 - protein, 9 aa, Homo Sapiens
GCQRFNSPI

SEQ ID NO: 510581 - protein, 9 aa, Homo Sapiens
KKWDPPSEP

SEQ ID NO: 510582 - protein, 9 aa, Homo Sapiens
LGGERGFQK

SEQ ID NO: 510583 - protein, 9 aa, Homo Sapiens
LLHCAQECK

SEQ ID NO: 510584 - protein, 9 aa, Homo Sapiens
TRAPSSCCS

SEQ ID NO: 510585 - protein, 9 aa, Homo Sapiens
STGDYSATF

SEQ ID NO: 510586 - protein, 9 aa, Homo Sapiens
PHGEARLSD

SEQ ID NO: 510587 - protein, 9 aa, Homo Sapiens
GNELFRRGQ

SEQ ID NO: 510588 - protein, 9 aa, Homo Sapiens
DQCILSGSD

SEQ ID NO: 510589 - protein, 9 aa, Homo Sapiens
EGSFSFLGD

SEQ ID NO: 510590 - protein, 9 aa, Homo Sapiens
KAYESIRVP

SEQ ID NO: 510591 - protein, 9 aa, Homo Sapiens
TRGATYNVT

SEQ ID NO: 510592 - protein, 9 aa, Homo Sapiens
LPPIWSVES

SEQ ID NO: 510593 - protein, 9 aa, Homo Sapiens
ICSSCARLQ

SEQ ID NO: 510594 - protein, 9 aa, Homo Sapiens
SGSSSCQTL

SEQ ID NO: 510595 - protein, 9 aa, Homo Sapiens
KRIAIQVII

SEQ ID NO: 510596 - protein, 9 aa, Homo Sapiens
GPETGLSAI

SEQ ID NO: 510597 - protein, 9 aa, Homo Sapiens
VLSNSLINN

SEQ ID NO: 510598 - protein, 9 aa, Homo Sapiens
VGRQSISRT

SEQ ID NO: 510599 - protein, 9 aa, Homo Sapiens
RCMALSVNA

SEQ ID NO: 510600 - protein, 9 aa, Homo Sapiens
DWLYEEELQ

SEQ ID NO: 510601 - protein, 9 aa, Homo Sapiens
GSECSIEGG

SEQ ID NO: 510602 - protein, 9 aa, Homo Sapiens
CQPGAAHRQ

SEQ ID NO: 510603 - protein, 9 aa, Homo Sapiens
DVISYYKYK

SEQ ID NO: 510604 - protein, 9 aa, Homo Sapiens
LFMVSVICI

SEQ ID NO: 510605 - protein, 9 aa, Homo Sapiens
GDSTFSWHR

SEQ ID NO: 510606 - protein, 9 aa, Homo Sapiens
FQEELPADL

SEQ ID NO: 510607 - protein, 9 aa, Homo Sapiens
IFLSVTPVT

SEQ ID NO: 510608 - protein, 9 aa, Homo Sapiens
ESLLNSSVP

SEQ ID NO: 510609 - protein, 9 aa, Homo Sapiens
TCSMWEKNM

SEQ ID NO: 510610 - protein, 9 aa, Homo Sapiens
AAASVSSSA

SEQ ID NO: 510611 - protein, 9 aa, Homo Sapiens
KAFSRSLDL

SEQ ID NO: 510612 - protein, 9 aa, Homo Sapiens
REDKHYLSY

SEQ ID NO: 510613 - protein, 9 aa, Homo Sapiens
KKGVTLKTK

SEQ ID NO: 510614 - protein, 9 aa, Homo Sapiens
AIQVIITAI

SEQ ID NO: 510615 - protein, 9 aa, Homo Sapiens
CEFTTCEPL

SEQ ID NO: 510616 - protein, 9 aa, Homo Sapiens
NIYEKAFSR

SEQ ID NO: 510617 - protein, 9 aa, Homo Sapiens
GNSADSVVT

SEQ ID NO: 510618 - protein, 9 aa, Homo Sapiens
IMMPFQFSG

SEQ ID NO: 510619 - protein, 9 aa, Homo Sapiens
VTEETIALT

SEQ ID NO: 510620 - protein, 9 aa, Homo Sapiens
HQGSRVSQD

SEQ ID NO: 510621 - protein, 9 aa, Homo Sapiens
HQYLKSCKE

SEQ ID NO: 510622 - protein, 9 aa, Homo Sapiens
RFNSPITLL

SEQ ID NO: 510623 - protein, 9 aa, Homo Sapiens
QVSYSLVER

SEQ ID NO: 510624 - protein, 9 aa, Homo Sapiens
ESVFVAPTK

SEQ ID NO: 510625 - protein, 9 aa, Homo Sapiens
EETIALTEA

SEQ ID NO: 510626 - protein, 9 aa, Homo Sapiens
TEETIALTE

SEQ ID NO: 510627 - protein, 9 aa, Homo Sapiens
DAQENAQVS

SEQ ID NO: 510628 - protein, 9 aa, Homo Sapiens
RSDPVEFSS

SEQ ID NO: 510629 - protein, 9 aa, Homo Sapiens
VPFIDSLCE

SEQ ID NO: 510630 - protein, 9 aa, Homo Sapiens
RHQYLKSCK

SEQ ID NO: 510631 - protein, 9 aa, Homo Sapiens
NSLINNTHG

SEQ ID NO: 510632 - protein, 9 aa, Homo Sapiens
STSPRPKPK

SEQ ID NO: 510633 - protein, 9 aa, Homo Sapiens
LSDKSNAHP

SEQ ID NO: 510634 - protein, 9 aa, Homo Sapiens
WARIAAGAV

SEQ ID NO: 510635 - protein, 9 aa, Homo Sapiens
LVTDDKTIE

SEQ ID NO: 510636 - protein, 9 aa, Homo Sapiens
NMKKWDPPS

SEQ ID NO: 510637 - protein, 9 aa, Homo Sapiens
TGSECSIEG

SEQ ID NO: 510638 - protein, 9 aa, Homo Sapiens
WEKNMEDLH

SEQ ID NO: 510639 - protein, 9 aa, Homo Sapiens
SVTLSESAA

SEQ ID NO: 510640 - protein, 9 aa, Homo Sapiens
IKLSCSSIY

SEQ ID NO: 510641 - protein, 9 aa, Homo Sapiens
YTPFATKKR

SEQ ID NO: 510642 - protein, 9 aa, Homo Sapiens
KILCKGLPQ

SEQ ID NO: 510643 - protein, 9 aa, Homo Sapiens
LIRVIRPRA

SEQ ID NO: 510644 - protein, 9 aa, Homo Sapiens
KNSHLHSTN

SEQ ID NO: 510645 - protein, 9 aa, Homo Sapiens
YNVTVEALK

SEQ ID NO: 510646 - protein, 9 aa, Homo Sapiens
AGYIGDPHP

SEQ ID NO: 510647 - protein, 9 aa, Homo Sapiens
DDIFKIIIA

SEQ ID NO: 510648 - protein, 9 aa, Homo Sapiens
YMSERHTRA

SEQ ID NO: 510649 - protein, 9 aa, Homo Sapiens
EHWGGTAIR

SEQ ID NO: 510650 - protein, 9 aa, Homo Sapiens
GFEREFKPE

SEQ ID NO: 510651 - protein, 9 aa, Homo Sapiens
LYEEELQHS

SEQ ID NO: 510652 - protein, 9 aa, Homo Sapiens
IKMKCLAGF

SEQ ID NO: 510653 - protein, 9 aa, Homo Sapiens
VTPVTYIAF

SEQ ID NO: 510654 - protein, 9 aa, Homo Sapiens
VCSVGRGDR

SEQ ID NO: 510655 - protein, 9 aa, Homo Sapiens
AASVSSSAP

SEQ ID NO: 510656 - protein, 9 aa, Homo Sapiens
MASCEFTTC

SEQ ID NO: 510657 - protein, 9 aa, Homo Sapiens
GQSHHGQVS

SEQ ID NO: 510658 - protein, 9 aa, Homo Sapiens
SSLSPEPPE

SEQ ID NO: 510659 - protein, 9 aa, Homo Sapiens
IDRRSLTSL

SEQ ID NO: 510660 - protein, 9 aa, Homo Sapiens
IENRIIAAF

SEQ ID NO: 510661 - protein, 9 aa, Homo Sapiens
SYYKYKDGY

SEQ ID NO: 510662 - protein, 9 aa, Homo Sapiens
QPGAAHRQP

SEQ ID NO: 510663 - protein, 9 aa, Homo Sapiens
WLYEEELQH

SEQ ID NO: 510664 - protein, 9 aa, Homo Sapiens
QNAGPIFWT

SEQ ID NO: 510665 - protein, 9 aa, Homo Sapiens
VTLKTKSLE

SEQ ID NO: 510666 - protein, 9 aa, Homo Sapiens
RKMYSLLER

SEQ ID NO: 510667 - protein, 9 aa, Homo Sapiens
QLMALEDDV

SEQ ID NO: 510668 - protein, 9 aa, Homo Sapiens
DPVEFSSDV

SEQ ID NO: 510669 - protein, 9 aa, Homo Sapiens
PFIDSLCEF

SEQ ID NO: 510670 - protein, 9 aa, Homo Sapiens
AAAASVSSS

SEQ ID NO: 510671 - protein, 9 aa, Homo Sapiens
EQKNYYTKE

SEQ ID NO: 510672 - protein, 9 aa, Homo Sapiens
TDHLKMDIL

SEQ ID NO: 510673 - protein, 9 aa, Homo Sapiens
SREDKHYLS

SEQ ID NO: 510674 - protein, 9 aa, Homo Sapiens
MRCRTAFYT

SEQ ID NO: 510675 - protein, 9 aa, Homo Sapiens
DVHHNQLTA

SEQ ID NO: 510676 - protein, 9 aa, Homo Sapiens
IIQAGTSES

SEQ ID NO: 510677 - protein, 9 aa, Homo Sapiens
RTASTRSRR

SEQ ID NO: 510678 - protein, 9 aa, Homo Sapiens
KHYLSYLPA

SEQ ID NO: 510679 - protein, 9 aa, Homo Sapiens
YLHNMKKWD

SEQ ID NO: 510680 - protein, 9 aa, Homo Sapiens
CKQIKADLD

SEQ ID NO: 510681 - protein, 9 aa, Homo Sapiens
QKVLLVIAE

SEQ ID NO: 510682 - protein, 9 aa, Homo Sapiens
RGSWRPSGR

SEQ ID NO: 510683 - protein, 9 aa, Homo Sapiens
AAAAAASVS

SEQ ID NO: 510684 - protein, 9 aa, Homo Sapiens
EQKVAGYIG

SEQ ID NO: 510685 - protein, 9 aa, Homo Sapiens
NNTHGFMNF

SEQ ID NO: 510686 - protein, 9 aa, Homo Sapiens
LFLASWMIA

SEQ ID NO: 510687 - protein, 9 aa, Homo Sapiens
GKFFSHYSS

SEQ ID NO: 510688 - protein, 9 aa, Homo Sapiens
VDNCKQIKA

SEQ ID NO: 510689 - protein, 9 aa, Homo Sapiens
RDQCILSGS

SEQ ID NO: 510690 - protein, 9 aa, Homo Sapiens
ELQHSHIAH

SEQ ID NO: 510691 - protein, 9 aa, Homo Sapiens
AANNCLREL

SEQ ID NO: 510692 - protein, 9 aa, Homo Sapiens
ARHQGPAAG

SEQ ID NO: 510693 - protein, 9 aa, Homo Sapiens
VLFLDRVYC

SEQ ID NO: 510694 - protein, 9 aa, Homo Sapiens
LHSTNRLLS

SEQ ID NO: 510695 - protein, 9 aa, Homo Sapiens
WLQCAETTL

SEQ ID NO: 510696 - protein, 9 aa, Homo Sapiens
SKAAVSSAL

SEQ ID NO: 510697 - protein, 9 aa, Homo Sapiens
KPSMPNVFN

SEQ ID NO: 510698 - protein, 9 aa, Homo Sapiens
YCIKDQTFL

SEQ ID NO: 510699 - protein, 9 aa, Homo Sapiens
TVTEETIAL

SEQ ID NO: 510700 - protein, 9 aa, Homo Sapiens
CVSVEDMAV

SEQ ID NO: 510701 - protein, 9 aa, Homo Sapiens
HPPQSPALI

SEQ ID NO: 510702 - protein, 9 aa, Homo Sapiens
MAVAWVGYC

SEQ ID NO: 510703 - protein, 9 aa, Homo Sapiens
EEELQHSHI

SEQ ID NO: 510704 - protein, 9 aa, Homo Sapiens
VFLLTIFWG

SEQ ID NO: 510705 - protein, 9 aa, Homo Sapiens
HDIKALQLV

SEQ ID NO: 510706 - protein, 9 aa, Homo Sapiens
QASLLASTS

SEQ ID NO: 510707 - protein, 9 aa, Homo Sapiens
RRTASTRSR

SEQ ID NO: 510708 - protein, 9 aa, Homo Sapiens
RVSQDSDSE

SEQ ID NO: 510709 - protein, 9 aa, Homo Sapiens
TTSAEASSP

SEQ ID NO: 510710 - protein, 9 aa, Homo Sapiens
EPGTSSNSN

SEQ ID NO: 510711 - protein, 9 aa, Homo Sapiens
CENWRCLNT

SEQ ID NO: 510712 - protein, 9 aa, Homo Sapiens
VRESETFAN

SEQ ID NO: 510713 - protein, 9 aa, Homo Sapiens
HLTRARRCP

SEQ ID NO: 510714 - protein, 9 aa, Homo Sapiens
YYKYKDGYR

SEQ ID NO: 510715 - protein, 9 aa, Homo Sapiens
QWQLEVGHP

SEQ ID NO: 510716 - protein, 9 aa, Homo Sapiens
TRSVCSSSD

SEQ ID NO: 510717 - protein, 9 aa, Homo Sapiens
AANKIPFSS

SEQ ID NO: 510718 - protein, 9 aa, Homo Sapiens
SLAEISIMT

SEQ ID NO: 510719 - protein, 9 aa, Homo Sapiens
CKVVSCKNF

SEQ ID NO: 510720 - protein, 9 aa, Homo Sapiens
ATDIANQAE

SEQ ID NO: 510721 - protein, 9 aa, Homo Sapiens
IIIAIVLFF

SEQ ID NO: 510722 - protein, 9 aa, Homo Sapiens
GDLRNLLGL

SEQ ID NO: 510723 - protein, 9 aa, Homo Sapiens
EYVHSWEPM

SEQ ID NO: 510724 - protein, 9 aa, Homo Sapiens
LVDRKCQLH

SEQ ID NO: 510725 - protein, 9 aa, Homo Sapiens
PRHSHLTRA

SEQ ID NO: 510726 - protein, 9 aa, Homo Sapiens
ALTEANIVD

SEQ ID NO: 510727 - protein, 9 aa, Homo Sapiens
GLPQCMVIV

SEQ ID NO: 510728 - protein, 9 aa, Homo Sapiens
VAEGTGDST

SEQ ID NO: 510729 - protein, 9 aa, Homo Sapiens
LLSELAAAN

SEQ ID NO: 510730 - protein, 9 aa, Homo Sapiens
ISYYKYKDG

SEQ ID NO: 510731 - protein, 9 aa, Homo Sapiens
SGRTRRRRA

SEQ ID NO: 510732 - protein, 9 aa, Homo Sapiens
EALIRLYQE

SEQ ID NO: 510733 - protein, 9 aa, Homo Sapiens
CLAGFARLC

SEQ ID NO: 510734 - protein, 9 aa, Homo Sapiens
RDVISYYKY

SEQ ID NO: 510735 - protein, 9 aa, Homo Sapiens
LCKGLPQCM

SEQ ID NO: 510736 - protein, 9 aa, Homo Sapiens
EEGPLPGWL

SEQ ID NO: 510737 - protein, 9 aa, Homo Sapiens
LPQCMVIVR

SEQ ID NO: 510738 - protein, 9 aa, Homo Sapiens
KKPPANLHQ

SEQ ID NO: 510739 - protein, 9 aa, Homo Sapiens
PLPGWLPSP

SEQ ID NO: 510740 - protein, 9 aa, Homo Sapiens
TTCEPLTQF

SEQ ID NO: 510741 - protein, 9 aa, Homo Sapiens
IDLVTDDKT

SEQ ID NO: 510742 - protein, 9 aa, Homo Sapiens
FSPTTAPKV

SEQ ID NO: 510743 - protein, 9 aa, Homo Sapiens
YSLLERKGH

SEQ ID NO: 510744 - protein, 9 aa, Homo Sapiens
SGQSHHGQV

SEQ ID NO: 510745 - protein, 9 aa, Homo Sapiens
DENGVIAFY

SEQ ID NO: 510746 - protein, 9 aa, Homo Sapiens
MDLPFPSAA

SEQ ID NO: 510747 - protein, 9 aa, Homo Sapiens
LTLLTCESL

SEQ ID NO: 510748 - protein, 9 aa, Homo Sapiens
KIPDNLHFS

SEQ ID NO: 510749 - protein, 9 aa, Homo Sapiens
SESAAIISH

SEQ ID NO: 510750 - protein, 9 aa, Homo Sapiens
YKIPDNLHF

SEQ ID NO: 510751 - protein, 9 aa, Homo Sapiens
AMEGDKTKE

SEQ ID NO: 510752 - protein, 9 aa, Homo Sapiens
VVIDSSLPQ

SEQ ID NO: 510753 - protein, 9 aa, Homo Sapiens
TSAEASSPP

SEQ ID NO: 510754 - protein, 9 aa, Homo Sapiens
TLDVHHNQL

SEQ ID NO: 510755 - protein, 9 aa, Homo Sapiens
DSTFSWHRE

SEQ ID NO: 510756 - protein, 9 aa, Homo Sapiens
PYDTRSSGS

SEQ ID NO: 510757 - protein, 9 aa, Homo Sapiens
VAWVGYCVH

SEQ ID NO: 510758 - protein, 9 aa, Homo Sapiens
ISTKTLPGS

SEQ ID NO: 510759 - protein, 9 aa, Homo Sapiens
ARGVWEGSF

SEQ ID NO: 510760 - protein, 9 aa, Homo Sapiens
SCQTLSTQL

SEQ ID NO: 510761 - protein, 9 aa, Homo Sapiens
KSNAHPGCL

SEQ ID NO: 510762 - protein, 9 aa, Homo Sapiens
PPANLHQII

SEQ ID NO: 510763 - protein, 9 aa, Homo Sapiens
NEERLPQAV

SEQ ID NO: 510764 - protein, 9 aa, Homo Sapiens
WSAAGTTKS

SEQ ID NO: 510765 - protein, 9 aa, Homo Sapiens
AAAAASVSS

SEQ ID NO: 510766 - protein, 9 aa, Homo Sapiens
VDGWVYDRV

SEQ ID NO: 510767 - protein, 9 aa, Homo Sapiens
PGAAHRQPC

SEQ ID NO: 510768 - protein, 9 aa, Homo Sapiens
LNSSVPVCE

SEQ ID NO: 510769 - protein, 9 aa, Homo Sapiens
RLFSQKQHL

SEQ ID NO: 510770 - protein, 9 aa, Homo Sapiens
HGDLNTDHL

SEQ ID NO: 510771 - protein, 9 aa, Homo Sapiens
EKMVSFHTL

SEQ ID NO: 510772 - protein, 9 aa, Homo Sapiens
IAANMMSTA

SEQ ID NO: 510773 - protein, 9 aa, Homo Sapiens
LPHTSAKTQ

SEQ ID NO: 510774 - protein, 9 aa, Homo Sapiens
MATTKTMPE

SEQ ID NO: 510775 - protein, 9 aa, Homo Sapiens
WVGYCVHSL

SEQ ID NO: 510776 - protein, 9 aa, Homo Sapiens
PANLHQIIR

SEQ ID NO: 510777 - protein, 9 aa, Homo Sapiens
KKQEATPSA

SEQ ID NO: 510778 - protein, 9 aa, Homo Sapiens
AQVSYSLVE

SEQ ID NO: 510779 - protein, 9 aa, Homo Sapiens
EDLDDLRRQ

SEQ ID NO: 510780 - protein, 9 aa, Homo Sapiens
RQSISRTFI

SEQ ID NO: 510781 - protein, 9 aa, Homo Sapiens
EYNKAMEGD

SEQ ID NO: 510782 - protein, 9 aa, Homo Sapiens
SAAAHTLPV

SEQ ID NO: 510783 - protein, 9 aa, Homo Sapiens
SGDSTGSEC

SEQ ID NO: 510784 - protein, 9 aa, Homo Sapiens
AVTPLKLAG

SEQ ID NO: 510785 - protein, 9 aa, Homo Sapiens
CGEVNQLGG

SEQ ID NO: 510786 - protein, 9 aa, Homo Sapiens
EGNSADSVV

SEQ ID NO: 510787 - protein, 9 aa, Homo Sapiens
LSVTPVTYI

SEQ ID NO: 510788 - protein, 9 aa, Homo Sapiens
YCRNRKWYI

SEQ ID NO: 510789 - protein, 9 aa, Homo Sapiens
YSDGKLKAR

SEQ ID NO: 510790 - protein, 9 aa, Homo Sapiens
AWVGYCVHS

SEQ ID NO: 510791 - protein, 9 aa, Homo Sapiens
TLNICSSCA

SEQ ID NO: 510792 - protein, 9 aa, Homo Sapiens
HSDGSGWLG

SEQ ID NO: 510793 - protein, 9 aa, Homo Sapiens
RALNLGTLS

SEQ ID NO: 510794 - protein, 9 aa, Homo Sapiens
YSQHGSASC

SEQ ID NO: 510795 - protein, 9 aa, Homo Sapiens
VAPVVLPEM

SEQ ID NO: 510796 - protein, 9 aa, Homo Sapiens
ANMMSTAAI

SEQ ID NO: 510797 - protein, 9 aa, Homo Sapiens
SWARIAAGA

SEQ ID NO: 510798 - protein, 9 aa, Homo Sapiens
DFSVKNIQT

SEQ ID NO: 510799 - protein, 9 aa, Homo Sapiens
IFWGCLGFT

SEQ ID NO: 510800 - protein, 9 aa, Homo Sapiens
PFQEELPAD

SEQ ID NO: 510801 - protein, 9 aa, Homo Sapiens
HEKLLEISV

SEQ ID NO: 510802 - protein, 9 aa, Homo Sapiens
IRVIRPRAF

SEQ ID NO: 510803 - protein, 9 aa, Homo Sapiens
RTSRHQGSR

SEQ ID NO: 510804 - protein, 9 aa, Homo Sapiens
PQCMVIVRA

SEQ ID NO: 510805 - protein, 9 aa, Homo Sapiens
QTCGEVNQL

SEQ ID NO: 510806 - protein, 9 aa, Homo Sapiens
FARGVWEGS

SEQ ID NO: 510807 - protein, 9 aa, Homo Sapiens
LQNAGPIFW

SEQ ID NO: 510808 - protein, 9 aa, Homo Sapiens
AAIISHGTT

SEQ ID NO: 510809 - protein, 9 aa, Homo Sapiens
SPRPKPKTV

SEQ ID NO: 510810 - protein, 9 aa, Homo Sapiens
PEWTIRDFS

SEQ ID NO: 510811 - protein, 9 aa, Homo Sapiens
NTPFTTSAE

SEQ ID NO: 510812 - protein, 9 aa, Homo Sapiens
PSCQLCVFM

SEQ ID NO: 510813 - protein, 9 aa, Homo Sapiens
SLVDVDICQ

SEQ ID NO: 510814 - protein, 9 aa, Homo Sapiens
KVVCSVGRG

SEQ ID NO: 510815 - protein, 9 aa, Homo Sapiens
QCMVIVRAC

SEQ ID NO: 510816 - protein, 9 aa, Homo Sapiens
MVSVICIVF

SEQ ID NO: 510817 - protein, 9 aa, Homo Sapiens
ELRSSLLHL

SEQ ID NO: 510818 - protein, 9 aa, Homo Sapiens
MEQTCGEVN

SEQ ID NO: 510819 - protein, 9 aa, Homo Sapiens
PQPPRRGAP

SEQ ID NO: 510820 - protein, 9 aa, Homo Sapiens
PLDSRSGQS

SEQ ID NO: 510821 - protein, 9 aa, Homo Sapiens
HKEQKLSKR

SEQ ID NO: 510822 - protein, 9 aa, Homo Sapiens
FWTNEMFIN

SEQ ID NO: 510823 - protein, 9 aa, Homo Sapiens
IKGLYEKPS

SEQ ID NO: 510824 - protein, 9 aa, Homo Sapiens
QGEIENRII

SEQ ID NO: 510825 - protein, 9 aa, Homo Sapiens
DAANKIPFS

SEQ ID NO: 510826 - protein, 9 aa, Homo Sapiens
LEMLLHSME

SEQ ID NO: 510827 - protein, 9 aa, Homo Sapiens
AVLARELGI

SEQ ID NO: 510828 - protein, 9 aa, Homo Sapiens
DIAYSSSVT

SEQ ID NO: 510829 - protein, 9 aa, Homo Sapiens
LAVTSPSSA

SEQ ID NO: 510830 - protein, 9 aa, Homo Sapiens
GQWQLEVGH

SEQ ID NO: 510831 - protein, 9 aa, Homo Sapiens
LLTAQYNSK

SEQ ID NO: 510832 - protein, 9 aa, Homo Sapiens
CHFSSQGRH

SEQ ID NO: 510833 - protein, 9 aa, Homo Sapiens
MEEVERQVS

SEQ ID NO: 510834 - protein, 9 aa, Homo Sapiens
FKPETISSP

SEQ ID NO: 510835 - protein, 9 aa, Homo Sapiens
DIVIKGLYE

SEQ ID NO: 510836 - protein, 9 aa, Homo Sapiens
KNFSIQRGL

SEQ ID NO: 510837 - protein, 9 aa, Homo Sapiens
IAFYCRNRK

SEQ ID NO: 510838 - protein, 9 aa, Homo Sapiens
RSILQFLER

SEQ ID NO: 510839 - protein, 9 aa, Homo Sapiens
AYESIRVPS

SEQ ID NO: 510840 - protein, 9 aa, Homo Sapiens
IAYSSSVTP

SEQ ID NO: 510841 - protein, 9 aa, Homo Sapiens
HTRAAVAGE

SEQ ID NO: 510842 - protein, 9 aa, Homo Sapiens
SQKVLLVIA

SEQ ID NO: 510843 - protein, 9 aa, Homo Sapiens
LLGLFNHTG

SEQ ID NO: 510844 - protein, 9 aa, Homo Sapiens
KNYYTKEEA

SEQ ID NO: 510845 - protein, 9 aa, Homo Sapiens
SRSGQSHHG

SEQ ID NO: 510846 - protein, 9 aa, Homo Sapiens
FIATLRQKY

SEQ ID NO: 510847 - protein, 9 aa, Homo Sapiens
GIKETVLCR

SEQ ID NO: 510848 - protein, 9 aa, Homo Sapiens
GYIGDPHPT

SEQ ID NO: 510849 - protein, 9 aa, Homo Sapiens
NAHPGCLKE

SEQ ID NO: 510850 - protein, 9 aa, Homo Sapiens
RTRRRRAPA

SEQ ID NO: 510851 - protein, 9 aa, Homo Sapiens
VEDMAVLAR

SEQ ID NO: 510852 - protein, 9 aa, Homo Sapiens
FECQEGGAA

SEQ ID NO: 510853 - protein, 9 aa, Homo Sapiens
TIFWGCLGF

SEQ ID NO: 510854 - protein, 9 aa, Homo Sapiens
HHNQLTAFP

SEQ ID NO: 510855 - protein, 9 aa, Homo Sapiens
ITLLEVDAV

SEQ ID NO: 510856 - protein, 9 aa, Homo Sapiens
KAETASPNF

SEQ ID NO: 510857 - protein, 9 aa, Homo Sapiens
HTARHQGPA

SEQ ID NO: 510858 - protein, 9 aa, Homo Sapiens
LHNMKKWDP

SEQ ID NO: 510859 - protein, 9 aa, Homo Sapiens
TESYPALPP

SEQ ID NO: 510860 - protein, 9 aa, Homo Sapiens
WPEEYNKAM

SEQ ID NO: 510861 - protein, 9 aa, Homo Sapiens
CSSIYIDEL

SEQ ID NO: 510862 - protein, 9 aa, Homo Sapiens
NTGESGDFT

SEQ ID NO: 510863 - protein, 9 aa, Homo Sapiens
NVSVHKEQK

SEQ ID NO: 510864 - protein, 9 aa, Homo Sapiens
TDDKTIENH

SEQ ID NO: 510865 - protein, 9 aa, Homo Sapiens
TGESGDFTS

SEQ ID NO: 510866 - protein, 9 aa, Homo Sapiens
GSASCHFSS

SEQ ID NO: 510867 - protein, 9 aa, Homo Sapiens
GPQAQPHGE

SEQ ID NO: 510868 - protein, 9 aa, Homo Sapiens
YDCVENEVA

SEQ ID NO: 510869 - protein, 9 aa, Homo Sapiens
RSVCSSSDT

SEQ ID NO: 510870 - protein, 9 aa, Homo Sapiens
FRRGQFAEA

SEQ ID NO: 510871 - protein, 9 aa, Homo Sapiens
MGYPGFGGE

SEQ ID NO: 510872 - protein, 9 aa, Homo Sapiens
LVAPVVLPE

SEQ ID NO: 510873 - protein, 9 aa, Homo Sapiens
CEQIRCRIP

SEQ ID NO: 510874 - protein, 9 aa, Homo Sapiens
LSESAAIIS

SEQ ID NO: 510875 - protein, 9 aa, Homo Sapiens
KAMEGDKTK

SEQ ID NO: 510876 - protein, 9 aa, Homo Sapiens
TLHDIKALQ

SEQ ID NO: 510877 - protein, 9 aa, Homo Sapiens
SCARLQGDN

SEQ ID NO: 510878 - protein, 9 aa, Homo Sapiens
EVPFIDSLC

SEQ ID NO: 510879 - protein, 9 aa, Homo Sapiens
ENEVAEGDE

SEQ ID NO: 510880 - protein, 9 aa, Homo Sapiens
GRVREKNRL

SEQ ID NO: 510881 - protein, 9 aa, Homo Sapiens
RRHRHHRPP

SEQ ID NO: 510882 - protein, 9 aa, Homo Sapiens
WLPSPEDAM

SEQ ID NO: 510883 - protein, 9 aa, Homo Sapiens
FFSHYSSLI

SEQ ID NO: 510884 - protein, 9 aa, Homo Sapiens
NKKQEATPS

SEQ ID NO: 510885 - protein, 9 aa, Homo Sapiens
EFSIKMKCL

SEQ ID NO: 510886 - protein, 9 aa, Homo Sapiens
QGSRVSQDS

SEQ ID NO: 510887 - protein, 9 aa, Homo Sapiens
WRPSGRTRR

SEQ ID NO: 510888 - protein, 9 aa, Homo Sapiens
SVFVAPTKG

SEQ ID NO: 510889 - protein, 9 aa, Homo Sapiens
ALCIDHFRA

SEQ ID NO: 510890 - protein, 9 aa, Homo Sapiens
HTSAKTQLP

SEQ ID NO: 510891 - protein, 9 aa, Homo Sapiens
LKTKSLEPI

SEQ ID NO: 510892 - protein, 9 aa, Homo Sapiens
PEEYNKAME

SEQ ID NO: 510893 - protein, 9 aa, Homo Sapiens
KWDPPSEPS

SEQ ID NO: 510894 - protein, 9 aa, Homo Sapiens
TADPEVGTP

SEQ ID NO: 510895 - protein, 9 aa, Homo Sapiens
PRSLLAMQA

SEQ ID NO: 510896 - protein, 9 aa, Homo Sapiens
AYYFILILQ

SEQ ID NO: 510897 - protein, 9 aa, Homo Sapiens
TSASLLPLL

SEQ ID NO: 510898 - protein, 9 aa, Homo Sapiens
ASKAAVSSA

SEQ ID NO: 510899 - protein, 9 aa, Homo Sapiens
AGRRHTARH

SEQ ID NO: 510900 - protein, 9 aa, Homo Sapiens
GNDDSMQNL

SEQ ID NO: 510901 - protein, 9 aa, Homo Sapiens
IPFSSASGG

SEQ ID NO: 510902 - protein, 9 aa, Homo Sapiens
DCVENEVAE

SEQ ID NO: 510903 - protein, 9 aa, Homo Sapiens
MVHAPQPLL

SEQ ID NO: 510904 - protein, 9 aa, Homo Sapiens
QDGVTLHDI

SEQ ID NO: 510905 - protein, 9 aa, Homo Sapiens
CARLFSQKQ

SEQ ID NO: 510906 - protein, 9 aa, Homo Sapiens
GAAHRQPCL

SEQ ID NO: 510907 - protein, 9 aa, Homo Sapiens
FVAPTKGIY

SEQ ID NO: 510908 - protein, 9 aa, Homo Sapiens
GMESLLNSS

SEQ ID NO: 510909 - protein, 9 aa, Homo Sapiens
IRDFSVKNI

SEQ ID NO: 510910 - protein, 9 aa, Homo Sapiens
LLTIFWGCL

SEQ ID NO: 510911 - protein, 9 aa, Homo Sapiens
VENEVAEGD

SEQ ID NO: 510912 - protein, 9 aa, Homo Sapiens
EEIHLCPGG

SEQ ID NO: 510913 - protein, 9 aa, Homo Sapiens
IPDNLHFST

SEQ ID NO: 510914 - protein, 9 aa, Homo Sapiens
QAMVHAPQP

SEQ ID NO: 510915 - protein, 9 aa, Homo Sapiens
GKSYTMIGN

SEQ ID NO: 510916 - protein, 9 aa, Homo Sapiens
RDKKGVTLK

SEQ ID NO: 510917 - protein, 9 aa, Homo Sapiens
RENSTEPSE

SEQ ID NO: 510918 - protein, 9 aa, Homo Sapiens
SAKTQLPQS

SEQ ID NO: 510919 - protein, 9 aa, Homo Sapiens
PPHRRQGEP

SEQ ID NO: 510920 - protein, 9 aa, Homo Sapiens
SHYSSLIKH

SEQ ID NO: 510921 - protein, 9 aa, Homo Sapiens
ALPPIWSVE

SEQ ID NO: 510922 - protein, 9 aa, Homo Sapiens
EVRELRDQY

SEQ ID NO: 510923 - protein, 9 aa, Homo Sapiens
AVEKMVSFH

SEQ ID NO: 510924 - protein, 9 aa, Homo Sapiens
LTEANIVDD

SEQ ID NO: 510925 - protein, 9 aa, Homo Sapiens
WIPLPFWVS

SEQ ID NO: 510926 - protein, 9 aa, Homo Sapiens
YLLDLIRVI

SEQ ID NO: 510927 - protein, 9 aa, Homo Sapiens
RELYFHFPK

SEQ ID NO: 510928 - protein, 9 aa, Homo Sapiens
SMDQEKVSS

SEQ ID NO: 510929 - protein, 9 aa, Homo Sapiens
KVLLVIAEK

SEQ ID NO: 510930 - protein, 9 aa, Homo Sapiens
AHSDGSGWL

SEQ ID NO: 510931 - protein, 9 aa, Homo Sapiens
WTNEMFINA

SEQ ID NO: 510932 - protein, 9 aa, Homo Sapiens
QSREVGRPS

SEQ ID NO: 510933 - protein, 9 aa, Homo Sapiens
LHDIKALQL

SEQ ID NO: 510934 - protein, 9 aa, Homo Sapiens
IRLYQEIEE

SEQ ID NO: 510935 - protein, 9 aa, Homo Sapiens
DMRCRTAFY

SEQ ID NO: 510936 - protein, 9 aa, Homo Sapiens
ASQGTGIKE

SEQ ID NO: 510937 - protein, 9 aa, Homo Sapiens
YEIGAWTSE

SEQ ID NO: 510938 - protein, 9 aa, Homo Sapiens
QNKKLEMLL

SEQ ID NO: 510939 - protein, 9 aa, Homo Sapiens
PSPRSLLAM

SEQ ID NO: 510940 - protein, 9 aa, Homo Sapiens
CVLALGGER

SEQ ID NO: 510941 - protein, 9 aa, Homo Sapiens
IKKMQEGNS

SEQ ID NO: 510942 - protein, 9 aa, Homo Sapiens
EDIPFTCPT

SEQ ID NO: 510943 - protein, 9 aa, Homo Sapiens
TPFTTSAEA

SEQ ID NO: 510944 - protein, 9 aa, Homo Sapiens
RRSLTSLET

SEQ ID NO: 510945 - protein, 9 aa, Homo Sapiens
SQGTGIKET

SEQ ID NO: 510946 - protein, 9 aa, Homo Sapiens
TRNKPAYYF

SEQ ID NO: 510947 - protein, 9 aa, Homo Sapiens
CCPECARLF

SEQ ID NO: 510948 - protein, 9 aa, Homo Sapiens
DLDDLRRQV

SEQ ID NO: 510949 - protein, 9 aa, Homo Sapiens
FTPTDGAKK

SEQ ID NO: 510950 - protein, 9 aa, Homo Sapiens
ELLDYPGEG

SEQ ID NO: 510951 - protein, 9 aa, Homo Sapiens
GSWRPSGRT

SEQ ID NO: 510952 - protein, 9 aa, Homo Sapiens
GCFSDTEHW

SEQ ID NO: 510953 - protein, 9 aa, Homo Sapiens
KKRADKIEK

SEQ ID NO: 510954 - protein, 9 aa, Homo Sapiens
MMPFQFSGG

SEQ ID NO: 510955 - protein, 9 aa, Homo Sapiens
LQQQHSQTP

SEQ ID NO: 510956 - protein, 9 aa, Homo Sapiens
RRSSPVYVC

SEQ ID NO: 510957 - protein, 9 aa, Homo Sapiens
RGQFAEAAG

SEQ ID NO: 510958 - protein, 9 aa, Homo Sapiens
PKSYKGNFL

SEQ ID NO: 510959 - protein, 9 aa, Homo Sapiens
IEYSGSYNA

SEQ ID NO: 510960 - protein, 9 aa, Homo Sapiens
LDLIRVIRP

SEQ ID NO: 510961 - protein, 9 aa, Homo Sapiens
VEFSSDVLL

SEQ ID NO: 510962 - protein, 9 aa, Homo Sapiens
HPAPLGAGN

SEQ ID NO: 510963 - protein, 9 aa, Homo Sapiens
LNLGTLSAL

SEQ ID NO: 510964 - protein, 9 aa, Homo Sapiens
RNKPAYYFI

SEQ ID NO: 510965 - protein, 9 aa, Homo Sapiens
PNVFNDLSQ

SEQ ID NO: 510966 - protein, 9 aa, Homo Sapiens
APAAPYDTR

SEQ ID NO: 510967 - protein, 9 aa, Homo Sapiens
AILDICFSP

SEQ ID NO: 510968 - protein, 9 aa, Homo Sapiens
CQLHVLDGE

SEQ ID NO: 510969 - protein, 9 aa, Homo Sapiens
PKTRVSSLS

SEQ ID NO: 510970 - protein, 9 aa, Homo Sapiens
GAMGAYAFE

SEQ ID NO: 510971 - protein, 9 aa, Homo Sapiens
EGPLPGWLP

SEQ ID NO: 510972 - protein, 9 aa, Homo Sapiens
VIDSSLPQL

SEQ ID NO: 510973 - protein, 9 aa, Homo Sapiens
AGWSGSSSC

SEQ ID NO: 510974 - protein, 9 aa, Homo Sapiens
FSDTEHWGG

SEQ ID NO: 510975 - protein, 9 aa, Homo Sapiens
NKAMEGDKT

SEQ ID NO: 510976 - protein, 9 aa, Homo Sapiens
DICFSPTTA

SEQ ID NO: 510977 - protein, 9 aa, Homo Sapiens
HLAFVDIAY

SEQ ID NO: 510978 - protein, 9 aa, Homo Sapiens
AGDRDQCIL

SEQ ID NO: 510979 - protein, 9 aa, Homo Sapiens
RDFSVKNIQ

SEQ ID NO: 510980 - protein, 9 aa, Homo Sapiens
RVGASDGGS

SEQ ID NO: 510981 - protein, 9 aa, Homo Sapiens
NDMTKNDPF

SEQ ID NO: 510982 - protein, 9 aa, Homo Sapiens
RGRARAART

SEQ ID NO: 510983 - protein, 9 aa, Homo Sapiens
SIRVPSELQ

SEQ ID NO: 510984 - protein, 9 aa, Homo Sapiens
STEPSERLI

SEQ ID NO: 510985 - protein, 9 aa, Homo Sapiens
TGDYSATFL

SEQ ID NO: 510986 - protein, 9 aa, Homo Sapiens
AITLPKKDE

SEQ ID NO: 510987 - protein, 9 aa, Homo Sapiens
VPMTEPPAL

SEQ ID NO: 510988 - protein, 9 aa, Homo Sapiens
TASKAAVSS

SEQ ID NO: 510989 - protein, 9 aa, Homo Sapiens
KNFDRTVEL

SEQ ID NO: 510990 - protein, 9 aa, Homo Sapiens
LGQAMVHAP

SEQ ID NO: 510991 - protein, 9 aa, Homo Sapiens
VEEIHLCPG

SEQ ID NO: 510992 - protein, 9 aa, Homo Sapiens
AGPIFWTNE

SEQ ID NO: 510993 - protein, 9 aa, Homo Sapiens
AGAVQPKAL

SEQ ID NO: 510994 - protein, 9 aa, Homo Sapiens
VAEGDEIYE

SEQ ID NO: 510995 - protein, 9 aa, Homo Sapiens
WQLEVGHPA

SEQ ID NO: 510996 - protein, 9 aa, Homo Sapiens
SITADPEVG

SEQ ID NO: 510997 - protein, 9 aa, Homo Sapiens
KKPSMPNVF

SEQ ID NO: 510998 - protein, 9 aa, Homo Sapiens
DVKNSEGGC

SEQ ID NO: 510999 - protein, 9 aa, Homo Sapiens
TRLLHEKSL

SEQ ID NO: 511000 - protein, 9 aa, Homo Sapiens
QENAQVSYS

SEQ ID NO: 511001 - protein, 9 aa, Homo Sapiens
CIKDQTFLL

SEQ ID NO: 511002 - protein, 9 aa, Homo Sapiens
VVPMTEPPA

SEQ ID NO: 511003 - protein, 9 aa, Homo Sapiens
AGPASAFTP

SEQ ID NO: 511004 - protein, 9 aa, Homo Sapiens
CHLAFVDIA

SEQ ID NO: 511005 - protein, 9 aa, Homo Sapiens
ENWRCLNTR

SEQ ID NO: 511006 - protein, 9 aa, Homo Sapiens
LDNHQAHSV

SEQ ID NO: 511007 - protein, 9 aa, Homo Sapiens
QRALNLGTL

SEQ ID NO: 511008 - protein, 9 aa, Homo Sapiens
EEPNCACEQ

SEQ ID NO: 511009 - protein, 9 aa, Homo Sapiens
YLKSCKEIL

SEQ ID NO: 511010 - protein, 9 aa, Homo Sapiens
SQKRPFQEE

SEQ ID NO: 511011 - protein, 9 aa, Homo Sapiens
CQQGLHSLS

SEQ ID NO: 511012 - protein, 9 aa, Homo Sapiens
SLPQLMALE

SEQ ID NO: 511013 - protein, 9 aa, Homo Sapiens
RAPSSCCSR

SEQ ID NO: 511014 - protein, 9 aa, Homo Sapiens
LSVYRNIAK

SEQ ID NO: 511015 - protein, 9 aa, Homo Sapiens
SIENCNLTL

SEQ ID NO: 511016 - protein, 9 aa, Homo Sapiens
AVSSALPPA

SEQ ID NO: 511017 - protein, 9 aa, Homo Sapiens
SCKNFSIQR

SEQ ID NO: 511018 - protein, 9 aa, Homo Sapiens
LSELAAANN

SEQ ID NO: 511019 - protein, 9 aa, Homo Sapiens
TGDSTFSWH

SEQ ID NO: 511020 - protein, 9 aa, Homo Sapiens
CEQFRCGNG

SEQ ID NO: 511021 - protein, 9 aa, Homo Sapiens
IANQAEEIM

SEQ ID NO: 511022 - protein, 9 aa, Homo Sapiens
ANKIPFSSA

SEQ ID NO: 511023 - protein, 9 aa, Homo Sapiens
PRWRENSTE

SEQ ID NO: 511024 - protein, 9 aa, Homo Sapiens
DKTIENHNI

SEQ ID NO: 511025 - protein, 9 aa, Homo Sapiens
EYRNLTQCS

SEQ ID NO: 511026 - protein, 9 aa, Homo Sapiens
ETRSVCSSS

SEQ ID NO: 511027 - protein, 9 aa, Homo Sapiens
MSECETRSV

SEQ ID NO: 511028 - protein, 9 aa, Homo Sapiens
DDLRRQVKL

SEQ ID NO: 511029 - protein, 9 aa, Homo Sapiens
LPVYCVNVV

SEQ ID NO: 511030 - protein, 9 aa, Homo Sapiens
FEREFKPET

SEQ ID NO: 511031 - protein, 9 aa, Homo Sapiens
IKETVLCRE

SEQ ID NO: 511032 - protein, 9 aa, Homo Sapiens
RVPSELQQT

SEQ ID NO: 511033 - protein, 9 aa, Homo Sapiens
REEQLIPQL

SEQ ID NO: 511034 - protein, 9 aa, Homo Sapiens
AAGRGSWRP

SEQ ID NO: 511035 - protein, 9 aa, Homo Sapiens
LYIGSNLEK

SEQ ID NO: 511036 - protein, 9 aa, Homo Sapiens
PALCEQIRC

SEQ ID NO: 511037 - protein, 9 aa, Homo Sapiens
ESEAFRQAS

SEQ ID NO: 511038 - protein, 9 aa, Homo Sapiens
NICSSCARL

SEQ ID NO: 511039 - protein, 9 aa, Homo Sapiens
LDPSCQLCV

SEQ ID NO: 511040 - protein, 9 aa, Homo Sapiens
LSAIDTDER

SEQ ID NO: 511041 - protein, 9 aa, Homo Sapiens
SVGRGDRPL

SEQ ID NO: 511042 - protein, 9 aa, Homo Sapiens
TKKRADKIE

SEQ ID NO: 511043 - protein, 9 aa, Homo Sapiens
YVHSWEPMD

SEQ ID NO: 511044 - protein, 9 aa, Homo Sapiens
EQLIPQLGV

SEQ ID NO: 511045 - protein, 9 aa, Homo Sapiens
FLDRVYCIK

SEQ ID NO: 511046 - protein, 9 aa, Homo Sapiens
EDKHYLSYL

SEQ ID NO: 511047 - protein, 9 aa, Homo Sapiens
QSISRTFII

SEQ ID NO: 511048 - protein, 9 aa, Homo Sapiens
EVGHPAPLG

SEQ ID NO: 511049 - protein, 9 aa, Homo Sapiens
PVYVCRVVS

SEQ ID NO: 511050 - protein, 9 aa, Homo Sapiens
DFTSRYKIS

SEQ ID NO: 511051 - protein, 9 aa, Homo Sapiens
AKATAVAGS

SEQ ID NO: 511052 - protein, 9 aa, Homo Sapiens
HYLSYLPAL

SEQ ID NO: 511053 - protein, 9 aa, Homo Sapiens
KNQRALNLG

SEQ ID NO: 511054 - protein, 9 aa, Homo Sapiens
LCEQIRCRI

SEQ ID NO: 511055 - protein, 9 aa, Homo Sapiens
SISSMDQEK

SEQ ID NO: 511056 - protein, 9 aa, Homo Sapiens
APAPGGRRR

SEQ ID NO: 511057 - protein, 9 aa, Homo Sapiens
LQTLYIGSN

SEQ ID NO: 511058 - protein, 9 aa, Homo Sapiens
SRDVISYYK

SEQ ID NO: 511059 - protein, 9 aa, Homo Sapiens
SLLRHQYLK

SEQ ID NO: 511060 - protein, 9 aa, Homo Sapiens
MLLHSMEVA

SEQ ID NO: 511061 - protein, 9 aa, Homo Sapiens
LGDLRNLLG

SEQ ID NO: 511062 - protein, 9 aa, Homo Sapiens
DSAKCKKMA

SEQ ID NO: 511063 - protein, 9 aa, Homo Sapiens
LQHSHIAHW

SEQ ID NO: 511064 - protein, 9 aa, Homo Sapiens
DIPFTCPTG

SEQ ID NO: 511065 - protein, 9 aa, Homo Sapiens
RSAFRPLRD

SEQ ID NO: 511066 - protein, 9 aa, Homo Sapiens
VKSEFLQNL

SEQ ID NO: 511067 - protein, 9 aa, Homo Sapiens
SYPALPPIW

SEQ ID NO: 511068 - protein, 9 aa, Homo Sapiens
RDNMRKRHY

SEQ ID NO: 511069 - protein, 9 aa, Homo Sapiens
SLQSREVGR

SEQ ID NO: 511070 - protein, 9 aa, Homo Sapiens
ACHICDKAF

SEQ ID NO: 511071 - protein, 9 aa, Homo Sapiens
LPFWVSNSP

SEQ ID NO: 511072 - protein, 9 aa, Homo Sapiens
DYLLDLIRV

SEQ ID NO: 511073 - protein, 9 aa, Homo Sapiens
GSELGFLLF

SEQ ID NO: 511074 - protein, 9 aa, Homo Sapiens
GICENWRCL

SEQ ID NO: 511075 - protein, 9 aa, Homo Sapiens
STGSECSIE

SEQ ID NO: 511076 - protein, 9 aa, Homo Sapiens
TGLKRTGWA

SEQ ID NO: 511077 - protein, 9 aa, Homo Sapiens
ECARLFSQK

SEQ ID NO: 511078 - protein, 9 aa, Homo Sapiens
AGMESLLNS

SEQ ID NO: 511079 - protein, 9 aa, Homo Sapiens
EGTGDSTFS

SEQ ID NO: 511080 - protein, 9 aa, Homo Sapiens
PFPSAAQRN

SEQ ID NO: 511081 - protein, 9 aa, Homo Sapiens
TEPSERLIQ

SEQ ID NO: 511082 - protein, 9 aa, Homo Sapiens
PFATKKRAD

SEQ ID NO: 511083 - protein, 9 aa, Homo Sapiens
RHQGPAAGV

SEQ ID NO: 511084 - protein, 9 aa, Homo Sapiens
DRVHDSHST

SEQ ID NO: 511085 - protein, 9 aa, Homo Sapiens
FRQASASSS

SEQ ID NO: 511086 - protein, 9 aa, Homo Sapiens
NCNLTLLTC

SEQ ID NO: 511087 - protein, 9 aa, Homo Sapiens
GVIAFYCRN

SEQ ID NO: 511088 - protein, 9 aa, Homo Sapiens
DAARELRSS

SEQ ID NO: 511089 - protein, 9 aa, Homo Sapiens
TRFIATLRQ

SEQ ID NO: 511090 - protein, 9 aa, Homo Sapiens
LIKLSCSSI

SEQ ID NO: 511091 - protein, 9 aa, Homo Sapiens
APRMCELCF

SEQ ID NO: 511092 - protein, 9 aa, Homo Sapiens
ESGDFTSRY

SEQ ID NO: 511093 - protein, 9 aa, Homo Sapiens
LASTSPRPK

SEQ ID NO: 511094 - protein, 9 aa, Homo Sapiens
IIKKKVDFE

SEQ ID NO: 511095 - protein, 9 aa, Homo Sapiens
PLDIVIKGL

SEQ ID NO: 511096 - protein, 9 aa, Homo Sapiens
TLLEVDAVV

SEQ ID NO: 511097 - protein, 9 aa, Homo Sapiens
DSNLNDGLW

SEQ ID NO: 511098 - protein, 9 aa, Homo Sapiens
GDEDASHME

SEQ ID NO: 511099 - protein, 9 aa, Homo Sapiens
GGMTPTAFS

SEQ ID NO: 511100 - protein, 9 aa, Homo Sapiens
LETSDTRGG

SEQ ID NO: 511101 - protein, 9 aa, Homo Sapiens
AMVHAPQPL

SEQ ID NO: 511102 - protein, 9 aa, Homo Sapiens
YFHFPKFSI

SEQ ID NO: 511103 - protein, 9 aa, Homo Sapiens
RRSATTRSS

SEQ ID NO: 511104 - protein, 9 aa, Homo Sapiens
LINNTHGFM

SEQ ID NO: 511105 - protein, 9 aa, Homo Sapiens
PGICENWRC

SEQ ID NO: 511106 - protein, 9 aa, Homo Sapiens
HLLGQAMVH

SEQ ID NO: 511107 - protein, 9 aa, Homo Sapiens
PDLALASDA

SEQ ID NO: 511108 - protein, 9 aa, Homo Sapiens
EYVKNFDRT

SEQ ID NO: 511109 - protein, 9 aa, Homo Sapiens
SVAEGTGDS

SEQ ID NO: 511110 - protein, 9 aa, Homo Sapiens
ETEEAITLP

SEQ ID NO: 511111 - protein, 9 aa, Homo Sapiens
KSAGASIIQ

SEQ ID NO: 511112 - protein, 9 aa, Homo Sapiens
ELCFYNEMI

SEQ ID NO: 511113 - protein, 9 aa, Homo Sapiens
VSEHWLLHC

SEQ ID NO: 511114 - protein, 9 aa, Homo Sapiens
CIDHFRAAT

SEQ ID NO: 511115 - protein, 9 aa, Homo Sapiens
ETASPNFVQ

SEQ ID NO: 511116 - protein, 9 aa, Homo Sapiens
EEYNKAMEG

SEQ ID NO: 511117 - protein, 9 aa, Homo Sapiens
SRVSQDSDS

SEQ ID NO: 511118 - protein, 9 aa, Homo Sapiens
QKRPFQEEL

SEQ ID NO: 511119 - protein, 9 aa, Homo Sapiens
ITADPEVGT

SEQ ID NO: 511120 - protein, 9 aa, Homo Sapiens
RPPPWTGLK

SEQ ID NO: 511121 - protein, 9 aa, Homo Sapiens
KNEALIRLY

SEQ ID NO: 511122 - protein, 9 aa, Homo Sapiens
QAHSVFPLV

SEQ ID NO: 511123 - protein, 9 aa, Homo Sapiens
ILDICFSPT

SEQ ID NO: 511124 - protein, 9 aa, Homo Sapiens
SSIFLSVTP

SEQ ID NO: 511125 - protein, 9 aa, Homo Sapiens
DRVYCIKDQ

SEQ ID NO: 511126 - protein, 9 aa, Homo Sapiens
YSGSYNAVE

SEQ ID NO: 511127 - protein, 9 aa, Homo Sapiens
TRGGASTFD

SEQ ID NO: 511128 - protein, 9 aa, Homo Sapiens
GILDPSCQL

SEQ ID NO: 511129 - protein, 9 aa, Homo Sapiens
DLPFPSAAQ

SEQ ID NO: 511130 - protein, 9 aa, Homo Sapiens
NITESYPAL

SEQ ID NO: 511131 - protein, 9 aa, Homo Sapiens
HSVFPLVIK

SEQ ID NO: 511132 - protein, 9 aa, Homo Sapiens
PAPGGRRRR

SEQ ID NO: 511133 - protein, 9 aa, Homo Sapiens
TLSESAAII

SEQ ID NO: 511134 - protein, 9 aa, Homo Sapiens
YSSLIKHRR

SEQ ID NO: 511135 - protein, 9 aa, Homo Sapiens
TLRQKYTQS

SEQ ID NO: 511136 - protein, 9 aa, Homo Sapiens
SSPVYVCRV

SEQ ID NO: 511137 - protein, 9 aa, Homo Sapiens
VIKGLYEKP

SEQ ID NO: 511138 - protein, 9 aa, Homo Sapiens
EESLAEISI

SEQ ID NO: 511139 - protein, 9 aa, Homo Sapiens
STGQAIPLA

SEQ ID NO: 511140 - protein, 9 aa, Homo Sapiens
ARRRTASTR

SEQ ID NO: 511141 - protein, 9 aa, Homo Sapiens
LRDQYRQMD

SEQ ID NO: 511142 - protein, 9 aa, Homo Sapiens
LRRPRHSHL

SEQ ID NO: 511143 - protein, 9 aa, Homo Sapiens
LIPQLGVTS

SEQ ID NO: 511144 - protein, 9 aa, Homo Sapiens
LFNHTGAHQ

SEQ ID NO: 511145 - protein, 9 aa, Homo Sapiens
GMRSTGDYS

SEQ ID NO: 511146 - protein, 9 aa, Homo Sapiens
QYLKSCKEI

SEQ ID NO: 511147 - protein, 9 aa, Homo Sapiens
APTKGIYSF

SEQ ID NO: 511148 - protein, 9 aa, Homo Sapiens
KCLAGFARL

SEQ ID NO: 511149 - protein, 9 aa, Homo Sapiens
LSITADPEV

SEQ ID NO: 511150 - protein, 9 aa, Homo Sapiens
ENAQVSYSL

SEQ ID NO: 511151 - protein, 9 aa, Homo Sapiens
FSGGSFKGP

SEQ ID NO: 511152 - protein, 9 aa, Homo Sapiens
SAQGTSASL

SEQ ID NO: 511153 - protein, 9 aa, Homo Sapiens
EDMAVLARE

SEQ ID NO: 511154 - protein, 9 aa, Homo Sapiens
SMPNVFNDL

SEQ ID NO: 511155 - protein, 9 aa, Homo Sapiens
FANDYTLSF

SEQ ID NO: 511156 - protein, 9 aa, Homo Sapiens
VLARELGIQ

SEQ ID NO: 511157 - protein, 9 aa, Homo Sapiens
PVTYIAFEK

SEQ ID NO: 511158 - protein, 9 aa, Homo Sapiens
HSWEPMDKA

SEQ ID NO: 511159 - protein, 9 aa, Homo Sapiens
RNLLGLVGD

SEQ ID NO: 511160 - protein, 9 aa, Homo Sapiens
DLCLDVSRF

SEQ ID NO: 511161 - protein, 9 aa, Homo Sapiens
RKLKINPKS

SEQ ID NO: 511162 - protein, 9 aa, Homo Sapiens
YPGEGVEET

SEQ ID NO: 511163 - protein, 9 aa, Homo Sapiens
SGDFTSRYK

SEQ ID NO: 511164 - protein, 9 aa, Homo Sapiens
HLKMDILFK

SEQ ID NO: 511165 - protein, 9 aa, Homo Sapiens
PPTTTRAPS

SEQ ID NO: 511166 - protein, 9 aa, Homo Sapiens
WDEVKCRVL

SEQ ID NO: 511167 - protein, 9 aa, Homo Sapiens
LTRARRCPG

SEQ ID NO: 511168 - protein, 9 aa, Homo Sapiens
AAANNCLRE

SEQ ID NO: 511169 - protein, 9 aa, Homo Sapiens
RTAFYTALG

SEQ ID NO: 511170 - protein, 9 aa, Homo Sapiens
NAGPIFWTN

SEQ ID NO: 511171 - protein, 9 aa, Homo Sapiens
SASCHFSSQ

SEQ ID NO: 511172 - protein, 9 aa, Homo Sapiens
PTKGIYSFS

SEQ ID NO: 511173 - protein, 9 aa, Homo Sapiens
VDQRVNITP

SEQ ID NO: 511174 - protein, 9 aa, Homo Sapiens
VTFTLPLSV

SEQ ID NO: 511175 - protein, 9 aa, Homo Sapiens
SKVVCSVGR

SEQ ID NO: 511176 - protein, 9 aa, Homo Sapiens
NDDSMQNLG

SEQ ID NO: 511177 - protein, 9 aa, Homo Sapiens
ELYFHFPKF

SEQ ID NO: 511178 - protein, 9 aa, Homo Sapiens
TEHWGGTAI

SEQ ID NO: 511179 - protein, 9 aa, Homo Sapiens
KARPKPCAG

SEQ ID NO: 511180 - protein, 9 aa, Homo Sapiens
NAQSVVCTP

SEQ ID NO: 511181 - protein, 9 aa, Homo Sapiens
RGGASTFDP

SEQ ID NO: 511182 - protein, 9 aa, Homo Sapiens
CFSPTTAPK

SEQ ID NO: 511183 - protein, 9 aa, Homo Sapiens
QASASSSQQ

SEQ ID NO: 511184 - protein, 9 aa, Homo Sapiens
VAPTKGIYS

SEQ ID NO: 511185 - protein, 9 aa, Homo Sapiens
NRDWDSYRS

SEQ ID NO: 511186 - protein, 9 aa, Homo Sapiens
DTRGGASTF

SEQ ID NO: 511187 - protein, 9 aa, Homo Sapiens
SWKSHGDQS

SEQ ID NO: 511188 - protein, 9 aa, Homo Sapiens
PFQFSGGSF

SEQ ID NO: 511189 - protein, 9 aa, Homo Sapiens
RARAARTGR

SEQ ID NO: 511190 - protein, 9 aa, Homo Sapiens
RPSGRTRRR

SEQ ID NO: 511191 - protein, 9 aa, Homo Sapiens
QVIITAIKY

SEQ ID NO: 511192 - protein, 9 aa, Homo Sapiens
LLNDMTKND

SEQ ID NO: 511193 - protein, 9 aa, Homo Sapiens
INPKSYKGN

SEQ ID NO: 511194 - protein, 9 aa, Homo Sapiens
TTKTMPETA

SEQ ID NO: 511195 - protein, 9 aa, Homo Sapiens
ICENWRCLN

SEQ ID NO: 511196 - protein, 9 aa, Homo Sapiens
EGIVIIKKK

SEQ ID NO: 511197 - protein, 9 aa, Homo Sapiens
RCRTAFYTA

SEQ ID NO: 511198 - protein, 9 aa, Homo Sapiens
LNICSSCAR

SEQ ID NO: 511199 - protein, 9 aa, Homo Sapiens
VAMGIDRRS

SEQ ID NO: 511200 - protein, 9 aa, Homo Sapiens
LHQIIRKAL

SEQ ID NO: 511201 - protein, 9 aa, Homo Sapiens
STYSNLSAT

SEQ ID NO: 511202 - protein, 9 aa, Homo Sapiens
DASHMEEVD

SEQ ID NO: 511203 - protein, 9 aa, Homo Sapiens
YDTRSSGSS

SEQ ID NO: 511204 - protein, 9 aa, Homo Sapiens
DRTPLPVDQ

SEQ ID NO: 511205 - protein, 9 aa, Homo Sapiens
MTEPPALGG

SEQ ID NO: 511206 - protein, 9 aa, Homo Sapiens
AWTSEVRRL

SEQ ID NO: 511207 - protein, 9 aa, Homo Sapiens
FVYSNDSTY

SEQ ID NO: 511208 - protein, 9 aa, Homo Sapiens
FLNTGESGD

SEQ ID NO: 511209 - protein, 9 aa, Homo Sapiens
VVCSVGRGD

SEQ ID NO: 511210 - protein, 9 aa, Homo Sapiens
IENCNLTLL

SEQ ID NO: 511211 - protein, 9 aa, Homo Sapiens
CFSDTEHWG

SEQ ID NO: 511212 - protein, 9 aa, Homo Sapiens
PDNLHFSTK

SEQ ID NO: 511213 - protein, 9 aa, Homo Sapiens
ENGVIAFYC

SEQ ID NO: 511214 - protein, 9 aa, Homo Sapiens
NERPFACHI

SEQ ID NO: 511215 - protein, 9 aa, Homo Sapiens
SWRPSGRTR

SEQ ID NO: 511216 - protein, 9 aa, Homo Sapiens
MRGRGNGRS

SEQ ID NO: 511217 - protein, 9 aa, Homo Sapiens
SECSIEGGG

SEQ ID NO: 511218 - protein, 9 aa, Homo Sapiens
DDSAKCKKM

SEQ ID NO: 511219 - protein, 9 aa, Homo Sapiens
LDDLRRQVK

SEQ ID NO: 511220 - protein, 9 aa, Homo Sapiens
PTTTRAPSS

SEQ ID NO: 511221 - protein, 9 aa, Homo Sapiens
SSSCQTLST

SEQ ID NO: 511222 - protein, 9 aa, Homo Sapiens
LKSCGSELG

SEQ ID NO: 511223 - protein, 9 aa, Homo Sapiens
AGGRACQQG

SEQ ID NO: 511224 - protein, 9 aa, Homo Sapiens
RRRRAPAPG

SEQ ID NO: 511225 - protein, 9 aa, Homo Sapiens
FKTDLSLRA

SEQ ID NO: 511226 - protein, 9 aa, Homo Sapiens
EISVSTLEK

SEQ ID NO: 511227 - protein, 9 aa, Homo Sapiens
RRRGRARAA

SEQ ID NO: 511228 - protein, 9 aa, Homo Sapiens
HTGAHQVLF

SEQ ID NO: 511229 - protein, 9 aa, Homo Sapiens
AAVSSALPP

SEQ ID NO: 511230 - protein, 9 aa, Homo Sapiens
IEFLKLQIQ

SEQ ID NO: 511231 - protein, 9 aa, Homo Sapiens
RIKQIMEEV

SEQ ID NO: 511232 - protein, 9 aa, Homo Sapiens
SEHWLLHCA

SEQ ID NO: 511233 - protein, 9 aa, Homo Sapiens
VITASKAAV

SEQ ID NO: 511234 - protein, 9 aa, Homo Sapiens
RPFACHICD

SEQ ID NO: 511235 - protein, 9 aa, Homo Sapiens
VGHPAPLGA

SEQ ID NO: 511236 - protein, 9 aa, Homo Sapiens
QRILQQQHS

SEQ ID NO: 511237 - protein, 9 aa, Homo Sapiens
TTAGPASAF

SEQ ID NO: 511238 - protein, 9 aa, Homo Sapiens
RMCELCFYN

SEQ ID NO: 511239 - protein, 8 aa, Homo Sapiens
KLRSKAAA

SEQ ID NO: 511240 - protein, 9 aa, Homo Sapiens
SSIYIDELL

SEQ ID NO: 511241 - protein, 9 aa, Homo Sapiens
SGGSFKGPP

SEQ ID NO: 511242 - protein, 9 aa, Homo Sapiens
LYTRNKPAY

SEQ ID NO: 511243 - protein, 9 aa, Homo Sapiens
DGSGWLGDL

SEQ ID NO: 511244 - protein, 9 aa, Homo Sapiens
LALASDAAQ

SEQ ID NO: 511245 - protein, 9 aa, Homo Sapiens
PAPQPPRRG

SEQ ID NO: 511246 - protein, 9 aa, Homo Sapiens
ARELRSSLL

SEQ ID NO: 511247 - protein, 9 aa, Homo Sapiens
PLKLAGWQC

SEQ ID NO: 511248 - protein, 9 aa, Homo Sapiens
TGILDPSCQ

SEQ ID NO: 511249 - protein, 9 aa, Homo Sapiens
LLGQAMVHA

SEQ ID NO: 511250 - protein, 9 aa, Homo Sapiens
LLSKVVCSV

SEQ ID NO: 511251 - protein, 9 aa, Homo Sapiens
TQEGIVIIK

SEQ ID NO: 511252 - protein, 9 aa, Homo Sapiens
DEDASHMEE

SEQ ID NO: 511253 - protein, 9 aa, Homo Sapiens
LSCSSIYID

SEQ ID NO: 511254 - protein, 9 aa, Homo Sapiens
ELSLMALPG

SEQ ID NO: 511255 - protein, 9 aa, Homo Sapiens
ILKKAQKDV

SEQ ID NO: 511256 - protein, 9 aa, Homo Sapiens
MVSFHTLSL

SEQ ID NO: 511257 - protein, 9 aa, Homo Sapiens
KPGICENWR

SEQ ID NO: 511258 - protein, 9 aa, Homo Sapiens
RDVKNSEGG

SEQ ID NO: 511259 - protein, 9 aa, Homo Sapiens
SLLNSSVPV

SEQ ID NO: 511260 - protein, 9 aa, Homo Sapiens
VFLHETLLD

SEQ ID NO: 511261 - protein, 9 aa, Homo Sapiens
GRWLEVTTD

SEQ ID NO: 511262 - protein, 9 aa, Homo Sapiens
PEGEIGDEF

SEQ ID NO: 511263 - protein, 9 aa, Homo Sapiens
ADAMHIPQL

SEQ ID NO: 511264 - protein, 9 aa, Homo Sapiens
ARTGRGARR

SEQ ID NO: 511265 - protein, 9 aa, Homo Sapiens
TMIGNDDSM

SEQ ID NO: 511266 - protein, 9 aa, Homo Sapiens
KAQKDVFLH

SEQ ID NO: 511267 - protein, 9 aa, Homo Sapiens
NQDVDNCKQ

SEQ ID NO: 511268 - protein, 9 aa, Homo Sapiens
SNQDVDNCK

SEQ ID NO: 511269 - protein, 9 aa, Homo Sapiens
PSSAARCMA

SEQ ID NO: 511270 - protein, 9 aa, Homo Sapiens
CELCFYNEM

SEQ ID NO: 511271 - protein, 9 aa, Homo Sapiens
AAPAAPYDT

SEQ ID NO: 511272 - protein, 9 aa, Homo Sapiens
GLSAIDTDE

SEQ ID NO: 511273 - protein, 9 aa, Homo Sapiens
IAASSIAAN

SEQ ID NO: 511274 - protein, 9 aa, Homo Sapiens
TDIANQAEE

SEQ ID NO: 511275 - protein, 9 aa, Homo Sapiens
ASCHFSSQG

SEQ ID NO: 511276 - protein, 9 aa, Homo Sapiens
ANQAEEIMK

SEQ ID NO: 511277 - protein, 9 aa, Homo Sapiens
VSFSSTIVT

SEQ ID NO: 511278 - protein, 9 aa, Homo Sapiens
QAIPLAVTS

SEQ ID NO: 511279 - protein, 9 aa, Homo Sapiens
LGGRSDPVE

SEQ ID NO: 511280 - protein, 9 aa, Homo Sapiens
RRRAPAPGG

SEQ ID NO: 511281 - protein, 9 aa, Homo Sapiens
EERLPQAVE

SEQ ID NO: 511282 - protein, 9 aa, Homo Sapiens
APVVLPEMY

SEQ ID NO: 511283 - protein, 9 aa, Homo Sapiens
EMLLHSMEV

SEQ ID NO: 511284 - protein, 9 aa, Homo Sapiens
EFKPETISS

SEQ ID NO: 511285 - protein, 9 aa, Homo Sapiens
RHQGSRVSQ

SEQ ID NO: 511286 - protein, 9 aa, Homo Sapiens
TRSRRSATT

SEQ ID NO: 511287 - protein, 9 aa, Homo Sapiens
LLFLASWMI

SEQ ID NO: 511288 - protein, 9 aa, Homo Sapiens
HAGDRDPLG

SEQ ID NO: 511289 - protein, 9 aa, Homo Sapiens
VCRVVSGMV

SEQ ID NO: 511290 - protein, 9 aa, Homo Sapiens
QEGNSADSV

SEQ ID NO: 511291 - protein, 9 aa, Homo Sapiens
GAAPPPPPL

SEQ ID NO: 511292 - protein, 9 aa, Homo Sapiens
KVAGYIGDP

SEQ ID NO: 511293 - protein, 9 aa, Homo Sapiens
GLPHTSAKT

SEQ ID NO: 511294 - protein, 9 aa, Homo Sapiens
DHLKMDILF

SEQ ID NO: 511295 - protein, 9 aa, Homo Sapiens
IAVTPLKLA

SEQ ID NO: 511296 - protein, 9 aa, Homo Sapiens
QCVAWSAAG

SEQ ID NO: 511297 - protein, 9 aa, Homo Sapiens
AARCMALSV

SEQ ID NO: 511298 - protein, 9 aa, Homo Sapiens
ARAARTGRG

SEQ ID NO: 511299 - protein, 9 aa, Homo Sapiens
STKTLPGSP

SEQ ID NO: 511300 - protein, 9 aa, Homo Sapiens
GHSFGAHLA

SEQ ID NO: 511301 - protein, 9 aa, Homo Sapiens
PHTSAKTQL

SEQ ID NO: 511302 - protein, 9 aa, Homo Sapiens
VSVICIVFG

SEQ ID NO: 511303 - protein, 9 aa, Homo Sapiens
DEQKLQTLY

SEQ ID NO: 511304 - protein, 9 aa, Homo Sapiens
SDAAQLQAA

SEQ ID NO: 511305 - protein, 9 aa, Homo Sapiens
ETIALTEAN

SEQ ID NO: 511306 - protein, 9 aa, Homo Sapiens
NSNLSSTSH

SEQ ID NO: 511307 - protein, 9 aa, Homo Sapiens
TLPLSVYRN

SEQ ID NO: 511308 - protein, 9 aa, Homo Sapiens
EKNRLLHEL

SEQ ID NO: 511309 - protein, 9 aa, Homo Sapiens
FNHTGAHQV

SEQ ID NO: 511310 - protein, 9 aa, Homo Sapiens
DRDPLGAPG

SEQ ID NO: 511311 - protein, 9 aa, Homo Sapiens
MAVHGTLVY

SEQ ID NO: 511312 - protein, 9 aa, Homo Sapiens
SSEEYDTEG

SEQ ID NO: 511313 - protein, 9 aa, Homo Sapiens
AASSIAANM

SEQ ID NO: 511314 - protein, 9 aa, Homo Sapiens
SHSTNMTPQ

SEQ ID NO: 511315 - protein, 9 aa, Homo Sapiens
ANNCLRELS

SEQ ID NO: 511316 - protein, 9 aa, Homo Sapiens
SPALIQMQL

SEQ ID NO: 511317 - protein, 9 aa, Homo Sapiens
IPSPEGEIG

SEQ ID NO: 511318 - protein, 9 aa, Homo Sapiens
SSISSMDQE

SEQ ID NO: 511319 - protein, 9 aa, Homo Sapiens
ECGKFFSHY

SEQ ID NO: 511320 - protein, 9 aa, Homo Sapiens
VRELRDQYR

SEQ ID NO: 511321 - protein, 9 aa, Homo Sapiens
CSREDKHYL

SEQ ID NO: 511322 - protein, 9 aa, Homo Sapiens
QYMSERHTR

SEQ ID NO: 511323 - protein, 9 aa, Homo Sapiens
SCGSELGFL

SEQ ID NO: 511324 - protein, 9 aa, Homo Sapiens
AGDRDPLGA

SEQ ID NO: 511325 - protein, 9 aa, Homo Sapiens
EAQFSEAPA

SEQ ID NO: 511326 - protein, 9 aa, Homo Sapiens
REKNRLLHE

SEQ ID NO: 511327 - protein, 9 aa, Homo Sapiens
ASLPPHRDS

SEQ ID NO: 511328 - protein, 9 aa, Homo Sapiens
YKKKLEDLD

SEQ ID NO: 511329 - protein, 9 aa, Homo Sapiens
YAFECQEGG

SEQ ID NO: 511330 - protein, 9 aa, Homo Sapiens
HFSTKNLDL

SEQ ID NO: 511331 - protein, 9 aa, Homo Sapiens
LDVHHNQLT

SEQ ID NO: 511332 - protein, 9 aa, Homo Sapiens
PSELQQTWT

SEQ ID NO: 511333 - protein, 9 aa, Homo Sapiens
SSLLNDMTK

SEQ ID NO: 511334 - protein, 9 aa, Homo Sapiens
VTLNICSSC

SEQ ID NO: 511335 - protein, 9 aa, Homo Sapiens
TPFATKKRA

SEQ ID NO: 511336 - protein, 9 aa, Homo Sapiens
RESEAFRQA

SEQ ID NO: 511337 - protein, 9 aa, Homo Sapiens
FTLPLSVYR

SEQ ID NO: 511338 - protein, 9 aa, Homo Sapiens
RRARRRTAS

SEQ ID NO: 511339 - protein, 9 aa, Homo Sapiens
TINDDSAKC

SEQ ID NO: 511340 - protein, 9 aa, Homo Sapiens
VSSLSPEPP

SEQ ID NO: 511341 - protein, 9 aa, Homo Sapiens
TGQAIPLAV

SEQ ID NO: 511342 - protein, 9 aa, Homo Sapiens
EGVEETFCL

SEQ ID NO: 511343 - protein, 9 aa, Homo Sapiens
WEPMDKAGG

SEQ ID NO: 511344 - protein, 9 aa, Homo Sapiens
LLDAVTYLS

SEQ ID NO: 511345 - protein, 9 aa, Homo Sapiens
AKLYEIGAW

SEQ ID NO: 511346 - protein, 9 aa, Homo Sapiens
PEKKYHIWD

SEQ ID NO: 511347 - protein, 9 aa, Homo Sapiens
KKRSILQFL

SEQ ID NO: 511348 - protein, 9 aa, Homo Sapiens
KLRIKQIME

SEQ ID NO: 511349 - protein, 9 aa, Homo Sapiens
SLCEFNILQ

SEQ ID NO: 511350 - protein, 9 aa, Homo Sapiens
PTTAPKVLL

SEQ ID NO: 511351 - protein, 9 aa, Homo Sapiens
PLAMEQTCG

SEQ ID NO: 511352 - protein, 9 aa, Homo Sapiens
ATLRQKYTQ

SEQ ID NO: 511353 - protein, 9 aa, Homo Sapiens
AQKDVFLHE

SEQ ID NO: 511354 - protein, 9 aa, Homo Sapiens
PGSPDGPPE

SEQ ID NO: 511355 - protein, 9 aa, Homo Sapiens
LFARGVWEG

SEQ ID NO: 511356 - protein, 9 aa, Homo Sapiens
LDVSRFNGP

SEQ ID NO: 511357 - protein, 9 aa, Homo Sapiens
APVVPMTEP

SEQ ID NO: 511358 - protein, 9 aa, Homo Sapiens
ASWARIAAG

SEQ ID NO: 511359 - protein, 9 aa, Homo Sapiens
DLVTDDKTI

SEQ ID NO: 511360 - protein, 9 aa, Homo Sapiens
LTDMRCRTA

SEQ ID NO: 511361 - protein, 9 aa, Homo Sapiens
PRLCGLLFL

SEQ ID NO: 511362 - protein, 9 aa, Homo Sapiens
FTTSAEASS

SEQ ID NO: 511363 - protein, 9 aa, Homo Sapiens
TSRDNMRKR

SEQ ID NO: 511364 - protein, 9 aa, Homo Sapiens
NRIIAAFTM

SEQ ID NO: 511365 - protein, 9 aa, Homo Sapiens
VDVDICQRG

SEQ ID NO: 511366 - protein, 9 aa, Homo Sapiens
LKLQIQEET

SEQ ID NO: 511367 - protein, 9 aa, Homo Sapiens
EREFKPETI

SEQ ID NO: 511368 - protein, 9 aa, Homo Sapiens
VDICQRGLT

SEQ ID NO: 511369 - protein, 9 aa, Homo Sapiens
LGLFNHTGA

SEQ ID NO: 511370 - protein, 9 aa, Homo Sapiens
VPSELQQTW

SEQ ID NO: 511371 - protein, 9 aa, Homo Sapiens
SDPLDIVIK

SEQ ID NO: 511372 - protein, 9 aa, Homo Sapiens
GDRDQCILS

SEQ ID NO: 511373 - protein, 9 aa, Homo Sapiens
SYTMIGNDD

SEQ ID NO: 511374 - protein, 9 aa, Homo Sapiens
MRSTGDYSA

SEQ ID NO: 511375 - protein, 9 aa, Homo Sapiens
VAWSAAGTT

SEQ ID NO: 511376 - protein, 9 aa, Homo Sapiens
LQSREVGRP

SEQ ID NO: 511377 - protein, 9 aa, Homo Sapiens
NLGTLSALD

SEQ ID NO: 511378 - protein, 9 aa, Homo Sapiens
LLNSSVPVC

SEQ ID NO: 511379 - protein, 9 aa, Homo Sapiens
TKTMPETAS

SEQ ID NO: 511380 - protein, 9 aa, Homo Sapiens
RRGRARAAR

SEQ ID NO: 511381 - protein, 9 aa, Homo Sapiens
VEKMVSFHT

SEQ ID NO: 511382 - protein, 9 aa, Homo Sapiens
KATAVAGSG

SEQ ID NO: 511383 - protein, 9 aa, Homo Sapiens
TLPKKDETI

SEQ ID NO: 511384 - protein, 9 aa, Homo Sapiens
GDQSSRRSD

SEQ ID NO: 511385 - protein, 9 aa, Homo Sapiens
IYIDELLIF

SEQ ID NO: 511386 - protein, 9 aa, Homo Sapiens
SAARCMALS

SEQ ID NO: 511387 - protein, 9 aa, Homo Sapiens
NHQAHSVFP

SEQ ID NO: 511388 - protein, 9 aa, Homo Sapiens
HSFGAHLAG

SEQ ID NO: 511389 - protein, 9 aa, Homo Sapiens
EEAITLPKK

SEQ ID NO: 511390 - protein, 9 aa, Homo Sapiens
RVIRPRAFS

SEQ ID NO: 511391 - protein, 9 aa, Homo Sapiens
IGVKSEFLQ

SEQ ID NO: 511392 - protein, 9 aa, Homo Sapiens
EQTCGEVNQ

SEQ ID NO: 511393 - protein, 9 aa, Homo Sapiens
TRAAVAGEN

SEQ ID NO: 511394 - protein, 9 aa, Homo Sapiens
EIGAWTSEV

SEQ ID NO: 511395 - protein, 9 aa, Homo Sapiens
SPDGPPENV

SEQ ID NO: 511396 - protein, 9 aa, Homo Sapiens
AVNAQSVVC

SEQ ID NO: 511397 - protein, 9 aa, Homo Sapiens
ELAAANNCL

SEQ ID NO: 511398 - protein, 9 aa, Homo Sapiens
RARRRTAST

SEQ ID NO: 511399 - protein, 9 aa, Homo Sapiens
AVHGTLVYI

SEQ ID NO: 511400 - protein, 9 aa, Homo Sapiens
RGDMGYPGF

SEQ ID NO: 511401 - protein, 9 aa, Homo Sapiens
EYDTEGFSE

SEQ ID NO: 511402 - protein, 9 aa, Homo Sapiens
FRGDMGYPG

SEQ ID NO: 511403 - protein, 9 aa, Homo Sapiens
SVHKEQKLS

SEQ ID NO: 511404 - protein, 9 aa, Homo Sapiens
SAEASSPPP

SEQ ID NO: 511405 - protein, 9 aa, Homo Sapiens
INDDSAKCK

SEQ ID NO: 511406 - protein, 9 aa, Homo Sapiens
AAHRQPCLS

SEQ ID NO: 511407 - protein, 9 aa, Homo Sapiens
LLVKAETAS

SEQ ID NO: 511408 - protein, 9 aa, Homo Sapiens
YDTEGFSER

SEQ ID NO: 511409 - protein, 9 aa, Homo Sapiens
RGGGPQAQP

SEQ ID NO: 511410 - protein, 9 aa, Homo Sapiens
VSRFNGPVI

SEQ ID NO: 511411 - protein, 9 aa, Homo Sapiens
EKLLEISVS

SEQ ID NO: 511412 - protein, 9 aa, Homo Sapiens
AMEQTCGEV

SEQ ID NO: 511413 - protein, 9 aa, Homo Sapiens
QLTAELSLM

SEQ ID NO: 511414 - protein, 9 aa, Homo Sapiens
QKSQKRPFQ

SEQ ID NO: 511415 - protein, 9 aa, Homo Sapiens
TGIKETVLC

SEQ ID NO: 511416 - protein, 9 aa, Homo Sapiens
KCVVLGDGA

SEQ ID NO: 511417 - protein, 9 aa, Homo Sapiens
EDASHMEEV

SEQ ID NO: 511418 - protein, 9 aa, Homo Sapiens
NVTVEALKD

SEQ ID NO: 511419 - protein, 9 aa, Homo Sapiens
ILQQQHSQT

SEQ ID NO: 511420 - protein, 9 aa, Homo Sapiens
SLIKEQKNY

SEQ ID NO: 511421 - protein, 9 aa, Homo Sapiens
KVVSCKNFS

SEQ ID NO: 511422 - protein, 9 aa, Homo Sapiens
RTRELYFHF

SEQ ID NO: 511423 - protein, 9 aa, Homo Sapiens
TFANDYTLS

SEQ ID NO: 511424 - protein, 9 aa, Homo Sapiens
NQAEEIMKL

SEQ ID NO: 511425 - protein, 9 aa, Homo Sapiens
KLKINPKSY

SEQ ID NO: 511426 - protein, 9 aa, Homo Sapiens
EGDEDASHM

SEQ ID NO: 511427 - protein, 9 aa, Homo Sapiens
NPRLCGLLF

SEQ ID NO: 511428 - protein, 9 aa, Homo Sapiens
LRQKYTQSN

SEQ ID NO: 511429 - protein, 9 aa, Homo Sapiens
ERLPQAVEL

SEQ ID NO: 511430 - protein, 9 aa, Homo Sapiens
SPEGEIGDE

SEQ ID NO: 511431 - protein, 9 aa, Homo Sapiens
RRHTARHQG

SEQ ID NO: 511432 - protein, 9 aa, Homo Sapiens
TVELVNTWT

SEQ ID NO: 511433 - protein, 9 aa, Homo Sapiens
GDMGYPGFG

SEQ ID NO: 511434 - protein, 9 aa, Homo Sapiens
EPNCACEQF

SEQ ID NO: 511435 - protein, 9 aa, Homo Sapiens
SLINNTHGF

SEQ ID NO: 511436 - protein, 9 aa, Homo Sapiens
MESLLNSSV

SEQ ID NO: 511437 - protein, 9 aa, Homo Sapiens
AGTASGGEA

SEQ ID NO: 511438 - protein, 9 aa, Homo Sapiens
DSLSGMRST

SEQ ID NO: 511439 - protein, 9 aa, Homo Sapiens
ALIRLYQEI

SEQ ID NO: 511440 - protein, 9 aa, Homo Sapiens
EKKYHIWDE

SEQ ID NO: 511441 - protein, 9 aa, Homo Sapiens
SLLHLTLQG

SEQ ID NO: 511442 - protein, 9 aa, Homo Sapiens
SILQFLERK

SEQ ID NO: 511443 - protein, 9 aa, Homo Sapiens
SECETRSVC

SEQ ID NO: 511444 - protein, 9 aa, Homo Sapiens
SERHTRAAV

SEQ ID NO: 511445 - protein, 9 aa, Homo Sapiens
LKFWIPLPF

SEQ ID NO: 511446 - protein, 9 aa, Homo Sapiens
LPLSVYRNI

SEQ ID NO: 511447 - protein, 9 aa, Homo Sapiens
SAKIQFKTD

SEQ ID NO: 511448 - protein, 9 aa, Homo Sapiens
ITASKAAVS

SEQ ID NO: 511449 - protein, 9 aa, Homo Sapiens
SGVGICSSG

SEQ ID NO: 511450 - protein, 9 aa, Homo Sapiens
SELAAANNC

SEQ ID NO: 511451 - protein, 9 aa, Homo Sapiens
AVLMNHRVC

SEQ ID NO: 511452 - protein, 9 aa, Homo Sapiens
VREKNRLLH

SEQ ID NO: 511453 - protein, 9 aa, Homo Sapiens
TYNVTVEAL

SEQ ID NO: 511454 - protein, 9 aa, Homo Sapiens
ECSREDKHY

SEQ ID NO: 511455 - protein, 9 aa, Homo Sapiens
VKNSEGGCA

SEQ ID NO: 511456 - protein, 9 aa, Homo Sapiens
LQNLGRMYL

SEQ ID NO: 511457 - protein, 9 aa, Homo Sapiens
GCVLALGGE

SEQ ID NO: 511458 - protein, 9 aa, Homo Sapiens
GFGAASGVG

SEQ ID NO: 511459 - protein, 9 aa, Homo Sapiens
CRVVSGMVN

SEQ ID NO: 511460 - protein, 9 aa, Homo Sapiens
TRSSGSSGC

SEQ ID NO: 511461 - protein, 9 aa, Homo Sapiens
AAHTLPVYC

SEQ ID NO: 511462 - protein, 9 aa, Homo Sapiens
AKTQLPQSM

SEQ ID NO: 511463 - protein, 9 aa, Homo Sapiens
DSLSSLLND

SEQ ID NO: 511464 - protein, 9 aa, Homo Sapiens
SHHGQVSYI

SEQ ID NO: 511465 - protein, 9 aa, Homo Sapiens
AVVNAANAS

SEQ ID NO: 511466 - protein, 9 aa, Homo Sapiens
VYSNDSTYS

SEQ ID NO: 511467 - protein, 9 aa, Homo Sapiens
MGIDRRSLT

SEQ ID NO: 511468 - protein, 9 aa, Homo Sapiens
MSERHTRAA

SEQ ID NO: 511469 - protein, 9 aa, Homo Sapiens
NEVAEGDEI

SEQ ID NO: 511470 - protein, 9 aa, Homo Sapiens
HGTLVYIRV

SEQ ID NO: 511471 - protein, 9 aa, Homo Sapiens
ADLDASEPQ

SEQ ID NO: 511472 - protein, 9 aa, Homo Sapiens
KGLYEKPSL

SEQ ID NO: 511473 - protein, 9 aa, Homo Sapiens
PMTEPPALG

SEQ ID NO: 511474 - protein, 9 aa, Homo Sapiens
LPFPSAAQR

SEQ ID NO: 511475 - protein, 9 aa, Homo Sapiens
TIGCQRFNS

SEQ ID NO: 511476 - protein, 9 aa, Homo Sapiens
GPLAMEQTC

SEQ ID NO: 511477 - protein, 9 aa, Homo Sapiens
KLQIQEETR

SEQ ID NO: 511478 - protein, 9 aa, Homo Sapiens
QDVDNCKQI

SEQ ID NO: 511479 - protein, 9 aa, Homo Sapiens
AEGTGDSTF

SEQ ID NO: 511480 - protein, 9 aa, Homo Sapiens
TGRGARRAR

SEQ ID NO: 511481 - protein, 9 aa, Homo Sapiens
WKSHGDQSS

SEQ ID NO: 511482 - protein, 9 aa, Homo Sapiens
AAGAVQPKA

SEQ ID NO: 511483 - protein, 9 aa, Homo Sapiens
IQAGTSESY

SEQ ID NO: 511484 - protein, 9 aa, Homo Sapiens
RVREKNRLL

SEQ ID NO: 511485 - protein, 9 aa, Homo Sapiens
SNAHPGCLK

SEQ ID NO: 511486 - protein, 9 aa, Homo Sapiens
PHRDSTEAP

SEQ ID NO: 511487 - protein, 9 aa, Homo Sapiens
KNRLLHELE

SEQ ID NO: 511488 - protein, 9 aa, Homo Sapiens
FGRWLEVTT

SEQ ID NO: 511489 - protein, 9 aa, Homo Sapiens
YVKNFDRTV

SEQ ID NO: 511490 - protein, 9 aa, Homo Sapiens
GDRDPLGAP

SEQ ID NO: 511491 - protein, 9 aa, Homo Sapiens
SEEPNCACE

SEQ ID NO: 511492 - protein, 9 aa, Homo Sapiens
WVYDRVSFS

SEQ ID NO: 511493 - protein, 9 aa, Homo Sapiens
PRPPTTTRA

SEQ ID NO: 511494 - protein, 9 aa, Homo Sapiens
DPLDIVIKG

SEQ ID NO: 511495 - protein, 9 aa, Homo Sapiens
KPPANLHQI

SEQ ID NO: 511496 - protein, 9 aa, Homo Sapiens
ISIMTTELQ

SEQ ID NO: 511497 - protein, 9 aa, Homo Sapiens
VSCNVSVHK

SEQ ID NO: 511498 - protein, 9 aa, Homo Sapiens
PQSPALIQM

SEQ ID NO: 511499 - protein, 9 aa, Homo Sapiens
NRLLSDPEL

SEQ ID NO: 511500 - protein, 9 aa, Homo Sapiens
GGRACQQGL

SEQ ID NO: 511501 - protein, 9 aa, Homo Sapiens
LQCAETTLT

SEQ ID NO: 511502 - protein, 9 aa, Homo Sapiens
VTLHDIKAL

SEQ ID NO: 511503 - protein, 9 aa, Homo Sapiens
SHLHSTNRL

SEQ ID NO: 511504 - protein, 9 aa, Homo Sapiens
LRIKQIMEE

SEQ ID NO: 511505 - protein, 9 aa, Homo Sapiens
LTASLPPHR

SEQ ID NO: 511506 - protein, 9 aa, Homo Sapiens
NFSIQRGLK

SEQ ID NO: 511507 - protein, 9 aa, Homo Sapiens
EGEIGDEFV

SEQ ID NO: 511508 - protein, 9 aa, Homo Sapiens
LPGSPDGPP

SEQ ID NO: 511509 - protein, 9 aa, Homo Sapiens
EIHLCPGGG

SEQ ID NO: 511510 - protein, 9 aa, Homo Sapiens
QSFSSQKVL

SEQ ID NO: 511511 - protein, 9 aa, Homo Sapiens
TAFSSQHTA

SEQ ID NO: 511512 - protein, 9 aa, Homo Sapiens
VSFHTLSLD

SEQ ID NO: 511513 - protein, 9 aa, Homo Sapiens
KKAQKDVFL

SEQ ID NO: 511514 - protein, 9 aa, Homo Sapiens
FSVKNIQTS

SEQ ID NO: 511515 - protein, 9 aa, Homo Sapiens
IVSEHWLLH

SEQ ID NO: 511516 - protein, 9 aa, Homo Sapiens
QRVNITPSG

SEQ ID NO: 511517 - protein, 9 aa, Homo Sapiens
TLSAKIQFK

SEQ ID NO: 511518 - protein, 9 aa, Homo Sapiens
MQEGNSADS

SEQ ID NO: 511519 - protein, 9 aa, Homo Sapiens
SRRRHRHHR

SEQ ID NO: 511520 - protein, 9 aa, Homo Sapiens
SREPGTSSN

SEQ ID NO: 511521 - protein, 9 aa, Homo Sapiens
MCELCFYNE

SEQ ID NO: 511522 - protein, 9 aa, Homo Sapiens
GVEETFCLN

SEQ ID NO: 511523 - protein, 9 aa, Homo Sapiens
GQATDIANQ

SEQ ID NO: 511524 - protein, 9 aa, Homo Sapiens
SISRTFIIQ

SEQ ID NO: 511525 - protein, 9 aa, Homo Sapiens
WRCLNTRGS

SEQ ID NO: 511526 - protein, 9 aa, Homo Sapiens
LLERKGHAY

SEQ ID NO: 511527 - protein, 9 aa, Homo Sapiens
RPFQEELPA

SEQ ID NO: 511528 - protein, 9 aa, Homo Sapiens
KFFSHYSSL

SEQ ID NO: 511529 - protein, 9 aa, Homo Sapiens
CQRFNSPIT

SEQ ID NO: 511530 - protein, 9 aa, Homo Sapiens
RAARTGRGA

SEQ ID NO: 511531 - protein, 9 aa, Homo Sapiens
RDGGSWEVI

SEQ ID NO: 511532 - protein, 9 aa, Homo Sapiens
TAFYTALGR

SEQ ID NO: 511533 - protein, 9 aa, Homo Sapiens
FGAASGVGI

SEQ ID NO: 511534 - protein, 9 aa, Homo Sapiens
MEESLAEIS

SEQ ID NO: 511535 - protein, 9 aa, Homo Sapiens
AEISIMTTE

SEQ ID NO: 511536 - protein, 9 aa, Homo Sapiens
SDTRGGAST

SEQ ID NO: 511537 - protein, 9 aa, Homo Sapiens
TAVNAQSVV

SEQ ID NO: 511538 - protein, 9 aa, Homo Sapiens
SAAGTTKSR

SEQ ID NO: 511539 - protein, 9 aa, Homo Sapiens
NGVIAFYCR

SEQ ID NO: 511540 - protein, 9 aa, Homo Sapiens
HTLPVYCVN

SEQ ID NO: 511541 - protein, 9 aa, Homo Sapiens
EETMLVEEI

SEQ ID NO: 511542 - protein, 9 aa, Homo Sapiens
HSEDIPFTC

SEQ ID NO: 511543 - protein, 9 aa, Homo Sapiens
DIFKIIIAI

SEQ ID NO: 511544 - protein, 9 aa, Homo Sapiens
ASIIQAGTS

SEQ ID NO: 511545 - protein, 9 aa, Homo Sapiens
KVHLIGHSF

SEQ ID NO: 511546 - protein, 9 aa, Homo Sapiens
LLASTSPRP

SEQ ID NO: 511547 - protein, 9 aa, Homo Sapiens
RIAIQVIIT

SEQ ID NO: 511548 - protein, 9 aa, Homo Sapiens
GESGDFTSR

SEQ ID NO: 511549 - protein, 9 aa, Homo Sapiens
IRDKKGVTL

SEQ ID NO: 511550 - protein, 9 aa, Homo Sapiens
LLDYPGEGV

SEQ ID NO: 511551 - protein, 9 aa, Homo Sapiens
TLYIGSNLE

SEQ ID NO: 511552 - protein, 9 aa, Homo Sapiens
LKINPKSYK

SEQ ID NO: 511553 - protein, 9 aa, Homo Sapiens
YTSRDNMRK

SEQ ID NO: 511554 - protein, 9 aa, Homo Sapiens
YTMIGNDDS

SEQ ID NO: 511555 - protein, 9 aa, Homo Sapiens
LSKVVCSVG

SEQ ID NO: 511556 - protein, 9 aa, Homo Sapiens
GSRVSQDSD

SEQ ID NO: 511557 - protein, 9 aa, Homo Sapiens
AAPYDTRSS

SEQ ID NO: 511558 - protein, 9 aa, Homo Sapiens
ISVSTLEKI

SEQ ID NO: 511559 - protein, 9 aa, Homo Sapiens
RAAGRGSWR

SEQ ID NO: 511560 - protein, 9 aa, Homo Sapiens
RVHDSHSTN

SEQ ID NO: 511561 - protein, 9 aa, Homo Sapiens
KSVNKKQEA

SEQ ID NO: 511562 - protein, 9 aa, Homo Sapiens
RHSHLTRAR

SEQ ID NO: 511563 - protein, 9 aa, Homo Sapiens
DVSRFNGPV

SEQ ID NO: 511564 - protein, 9 aa, Homo Sapiens
EQKRIAIQV

SEQ ID NO: 511565 - protein, 9 aa, Homo Sapiens
TLKTKSLEP

SEQ ID NO: 511566 - protein, 9 aa, Homo Sapiens
LEISVSTLE

SEQ ID NO: 511567 - protein, 9 aa, Homo Sapiens
TASPNFVQR

SEQ ID NO: 511568 - protein, 9 aa, Homo Sapiens
RDQYRQMDL

SEQ ID NO: 511569 - protein, 9 aa, Homo Sapiens
NHLRTHSED

SEQ ID NO: 511570 - protein, 9 aa, Homo Sapiens
SSCARLQGD

SEQ ID NO: 511571 - protein, 9 aa, Homo Sapiens
LNTDHLKMD

SEQ ID NO: 511572 - protein, 9 aa, Homo Sapiens
PLAVTSPSS

SEQ ID NO: 511573 - protein, 9 aa, Homo Sapiens
HICDKAFKH

SEQ ID NO: 511574 - protein, 9 aa, Homo Sapiens
KEQKNYYTK

SEQ ID NO: 511575 - protein, 9 aa, Homo Sapiens
SFPIRRDGG

SEQ ID NO: 511576 - protein, 9 aa, Homo Sapiens
DRVSFSSTI

SEQ ID NO: 511577 - protein, 9 aa, Homo Sapiens
WTSEVRRLV

SEQ ID NO: 511578 - protein, 9 aa, Homo Sapiens
DRKCQLHVL

SEQ ID NO: 511579 - protein, 9 aa, Homo Sapiens
FCCPECARL

SEQ ID NO: 511580 - protein, 9 aa, Homo Sapiens
IIAIVLFFF

SEQ ID NO: 511581 - protein, 9 aa, Homo Sapiens
AVAWVGYCV

SEQ ID NO: 511582 - protein, 9 aa, Homo Sapiens
ESYPALPPI

SEQ ID NO: 511583 - protein, 9 aa, Homo Sapiens
ATYNVTVEA

SEQ ID NO: 511584 - protein, 9 aa, Homo Sapiens
RVYCIKDQT

SEQ ID NO: 511585 - protein, 9 aa, Homo Sapiens
RTAVNAQSV

SEQ ID NO: 511586 - protein, 9 aa, Homo Sapiens
WAARASRAA

SEQ ID NO: 511587 - protein, 9 aa, Homo Sapiens
SCCSRRRHR

SEQ ID NO: 511588 - protein, 9 aa, Homo Sapiens
VSVEDMAVL

SEQ ID NO: 511589 - protein, 9 aa, Homo Sapiens
GVTLKTKSL

SEQ ID NO: 511590 - protein, 9 aa, Homo Sapiens
TVGRQSISR

SEQ ID NO: 511591 - protein, 9 aa, Homo Sapiens
EQIRCRIPE

SEQ ID NO: 511592 - protein, 9 aa, Homo Sapiens
APYDTRSSG

SEQ ID NO: 511593 - protein, 9 aa, Homo Sapiens
LDRVYCIKD

SEQ ID NO: 511594 - protein, 9 aa, Homo Sapiens
SQHGSASCH

SEQ ID NO: 511595 - protein, 9 aa, Homo Sapiens
LSSLLNDMT

SEQ ID NO: 511596 - protein, 9 aa, Homo Sapiens
PECARLFSQ

SEQ ID NO: 511597 - protein, 9 aa, Homo Sapiens
EWTIRDFSV

SEQ ID NO: 511598 - protein, 9 aa, Homo Sapiens
ICDKAFKHK

SEQ ID NO: 511599 - protein, 9 aa, Homo Sapiens
PVVPMTEPP

SEQ ID NO: 511600 - protein, 9 aa, Homo Sapiens
MIGNDDSMQ

SEQ ID NO: 511601 - protein, 9 aa, Homo Sapiens
ERHTRAAVA

SEQ ID NO: 511602 - protein, 9 aa, Homo Sapiens
AFSSQHTAG

SEQ ID NO: 511603 - protein, 9 aa, Homo Sapiens
AHLLGQAMV

SEQ ID NO: 511604 - protein, 9 aa, Homo Sapiens
VNAQSVVCT

SEQ ID NO: 511605 - protein, 9 aa, Homo Sapiens
QTLYIGSNL

SEQ ID NO: 511606 - protein, 9 aa, Homo Sapiens
QGEPFNGQM

SEQ ID NO: 511607 - protein, 9 aa, Homo Sapiens
AGRGSWRPS

SEQ ID NO: 511608 - protein, 9 aa, Homo Sapiens
SSMDQEKVS

SEQ ID NO: 511609 - protein, 9 aa, Homo Sapiens
MVRAGGRAC

SEQ ID NO: 511610 - protein, 9 aa, Homo Sapiens
LLCDYNRDW

SEQ ID NO: 511611 - protein, 9 aa, Homo Sapiens
TEPPALGGP

SEQ ID NO: 511612 - protein, 9 aa, Homo Sapiens
FDLNSSEEY

SEQ ID NO: 511613 - protein, 9 aa, Homo Sapiens
DLRNLLGLV

SEQ ID NO: 511614 - protein, 9 aa, Homo Sapiens
GRTRRRRAP

SEQ ID NO: 511615 - protein, 9 aa, Homo Sapiens
TGAHQVLFM

SEQ ID NO: 511616 - protein, 9 aa, Homo Sapiens
FPSAAQRND

SEQ ID NO: 511617 - protein, 9 aa, Homo Sapiens
TIENHNIST

SEQ ID NO: 511618 - protein, 9 aa, Homo Sapiens
AFSRSLDLN

SEQ ID NO: 511619 - protein, 9 aa, Homo Sapiens
RNLTQCSET

SEQ ID NO: 511620 - protein, 9 aa, Homo Sapiens
SRHQGSRVS

SEQ ID NO: 511621 - protein, 9 aa, Homo Sapiens
KTDLSLRAI

SEQ ID NO: 511622 - protein, 9 aa, Homo Sapiens
PGWLPSPED

SEQ ID NO: 511623 - protein, 9 aa, Homo Sapiens
DMAVLAREL

SEQ ID NO: 511624 - protein, 9 aa, Homo Sapiens
FWIPLPFWV

SEQ ID NO: 511625 - protein, 9 aa, Homo Sapiens
TSDTRGGAS

SEQ ID NO: 511626 - protein, 9 aa, Homo Sapiens
ITGILDPSC

SEQ ID NO: 511627 - protein, 9 aa, Homo Sapiens
DSLCEFNIL

SEQ ID NO: 511628 - protein, 9 aa, Homo Sapiens
GGPQAQPHG

SEQ ID NO: 511629 - protein, 9 aa, Homo Sapiens
ICFSPTTAP

SEQ ID NO: 511630 - protein, 9 aa, Homo Sapiens
QCILSGSDD

SEQ ID NO: 511631 - protein, 9 aa, Homo Sapiens
KINPKSYKG

SEQ ID NO: 511632 - protein, 9 aa, Homo Sapiens
YDRVSFSST

SEQ ID NO: 511633 - protein, 9 aa, Homo Sapiens
PIRRDGGSW

SEQ ID NO: 511634 - protein, 9 aa, Homo Sapiens
SPRWRENST

SEQ ID NO: 511635 - protein, 9 aa, Homo Sapiens
GDFTSRYKI

SEQ ID NO: 511636 - protein, 9 aa, Homo Sapiens
VHHNQLTAF

SEQ ID NO: 511637 - protein, 9 aa, Homo Sapiens
RGRVREKNR

SEQ ID NO: 511638 - protein, 9 aa, Homo Sapiens
PIFWTNEMF

SEQ ID NO: 511639 - protein, 9 aa, Homo Sapiens
FLLTIFWGC

SEQ ID NO: 511640 - protein, 9 aa, Homo Sapiens
ENMSECETR

SEQ ID NO: 511641 - protein, 9 aa, Homo Sapiens
MAVLARELG

SEQ ID NO: 511642 - protein, 9 aa, Homo Sapiens
YPGFGGEKG

SEQ ID NO: 511643 - protein, 9 aa, Homo Sapiens
CHGDLNTDH

SEQ ID NO: 511644 - protein, 9 aa, Homo Sapiens
CFYNEMIYW

SEQ ID NO: 511645 - protein, 9 aa, Homo Sapiens
KTQLPQSMK

SEQ ID NO: 511646 - protein, 9 aa, Homo Sapiens
NHSWAHSDG

SEQ ID NO: 511647 - protein, 9 aa, Homo Sapiens
NSSEEYDTE

SEQ ID NO: 511648 - protein, 9 aa, Homo Sapiens
SVTPVTYIA

SEQ ID NO: 511649 - protein, 9 aa, Homo Sapiens
NTDGPETGL

SEQ ID NO: 511650 - protein, 9 aa, Homo Sapiens
KGLPQCMVI

SEQ ID NO: 511651 - protein, 9 aa, Homo Sapiens
GRSSQALGV

SEQ ID NO: 511652 - protein, 9 aa, Homo Sapiens
HLRTHSEDI

SEQ ID NO: 511653 - protein, 9 aa, Homo Sapiens
RSLLAMQAA

SEQ ID NO: 511654 - protein, 9 aa, Homo Sapiens
RGATYNVTV

SEQ ID NO: 511655 - protein, 9 aa, Homo Sapiens
EMASCEFTT

SEQ ID NO: 511656 - protein, 9 aa, Homo Sapiens
LTIFWGCLG

SEQ ID NO: 511657 - protein, 9 aa, Homo Sapiens
TAELSLMAL

SEQ ID NO: 511658 - protein, 9 aa, Homo Sapiens
CGKFFSHYS

SEQ ID NO: 511659 - protein, 9 aa, Homo Sapiens
TIRDFSVKN

SEQ ID NO: 511660 - protein, 9 aa, Homo Sapiens
KQIMEEVER

SEQ ID NO: 511661 - protein, 9 aa, Homo Sapiens
SCSSIYIDE

SEQ ID NO: 511662 - protein, 9 aa, Homo Sapiens
ADRVHDSHS

SEQ ID NO: 511663 - protein, 9 aa, Homo Sapiens
RHTRAAVAG

SEQ ID NO: 511664 - protein, 9 aa, Homo Sapiens
TFVYSNDST

SEQ ID NO: 511665 - protein, 9 aa, Homo Sapiens
ALGGERGFQ

SEQ ID NO: 511666 - protein, 9 aa, Homo Sapiens
FETVGRQSI

SEQ ID NO: 511667 - protein, 9 aa, Homo Sapiens
DAAQLQAAG

SEQ ID NO: 511668 - protein, 9 aa, Homo Sapiens
EFLQNLGRM

SEQ ID NO: 511669 - protein, 9 aa, Homo Sapiens
DSTYSNLSA

SEQ ID NO: 511670 - protein, 9 aa, Homo Sapiens
TDDPNFQIP

SEQ ID NO: 511671 - protein, 9 aa, Homo Sapiens
EETRLLHEK

SEQ ID NO: 511672 - protein, 9 aa, Homo Sapiens
LGCFSDTEH

SEQ ID NO: 511673 - protein, 9 aa, Homo Sapiens
CILSGSDDF

SEQ ID NO: 511674 - protein, 9 aa, Homo Sapiens
AAAHTLPVY

SEQ ID NO: 511675 - protein, 9 aa, Homo Sapiens
PPPAPQPPR

SEQ ID NO: 511676 - protein, 9 aa, Homo Sapiens
FNDLSQKLY

SEQ ID NO: 511677 - protein, 9 aa, Homo Sapiens
ESWKSHGDQ

SEQ ID NO: 511678 - protein, 9 aa, Homo Sapiens
GIDRRSLTS

SEQ ID NO: 511679 - protein, 9 aa, Homo Sapiens
DTEHWGGTA

SEQ ID NO: 511680 - protein, 9 aa, Homo Sapiens
WTIRDFSVK

SEQ ID NO: 511681 - protein, 9 aa, Homo Sapiens
AEASSPPPT

SEQ ID NO: 511682 - protein, 9 aa, Homo Sapiens
ADAQENAQV

SEQ ID NO: 511683 - protein, 9 aa, Homo Sapiens
PAYYFILIL

SEQ ID NO: 511684 - protein, 9 aa, Homo Sapiens
SETFANDYT

SEQ ID NO: 511685 - protein, 9 aa, Homo Sapiens
SSAARCMAL

SEQ ID NO: 511686 - protein, 9 aa, Homo Sapiens
MGAYAFECQ

SEQ ID NO: 511687 - protein, 9 aa, Homo Sapiens
KQEATPSAQ

SEQ ID NO: 511688 - protein, 9 aa, Homo Sapiens
DQRVNITPS

SEQ ID NO: 511689 - protein, 9 aa, Homo Sapiens
ESLAEISIM

SEQ ID NO: 511690 - protein, 9 aa, Homo Sapiens
DQSSRRSDG

SEQ ID NO: 511691 - protein, 9 aa, Homo Sapiens
LIQMQLQHE

SEQ ID NO: 511692 - protein, 9 aa, Homo Sapiens
VNKKQEATP

SEQ ID NO: 511693 - protein, 9 aa, Homo Sapiens
EKNMEDLHR

SEQ ID NO: 511694 - protein, 9 aa, Homo Sapiens
NAQVSYSLV

SEQ ID NO: 511695 - protein, 9 aa, Homo Sapiens
LDIVIKGLY

SEQ ID NO: 511696 - protein, 9 aa, Homo Sapiens
SVICIVFGF

SEQ ID NO: 511697 - protein, 9 aa, Homo Sapiens
DPLGAPGGS

SEQ ID NO: 511698 - protein, 9 aa, Homo Sapiens
RTLDVHHNQ

SEQ ID NO: 511699 - protein, 9 aa, Homo Sapiens
PHAGDRDPL

SEQ ID NO: 511700 - protein, 9 aa, Homo Sapiens
FLSVTPVTY

SEQ ID NO: 511701 - protein, 9 aa, Homo Sapiens
YNRDWDSYR

SEQ ID NO: 511702 - protein, 9 aa, Homo Sapiens
AQGTSASLL

SEQ ID NO: 511703 - protein, 9 aa, Homo Sapiens
TPLPVDQRV

SEQ ID NO: 511704 - protein, 9 aa, Homo Sapiens
IGAWTSEVR

SEQ ID NO: 511705 - protein, 9 aa, Homo Sapiens
VVSCKNFSI

SEQ ID NO: 511706 - protein, 9 aa, Homo Sapiens
LYDCVENEV

SEQ ID NO: 511707 - protein, 9 aa, Homo Sapiens
KIIIAIVLF

SEQ ID NO: 511708 - protein, 9 aa, Homo Sapiens
ASTRSRRSA

SEQ ID NO: 511709 - protein, 9 aa, Homo Sapiens
ETVGRQSIS

SEQ ID NO: 511710 - protein, 9 aa, Homo Sapiens
LGAPGGSRR

SEQ ID NO: 511711 - protein, 9 aa, Homo Sapiens
LEETRLLHE

SEQ ID NO: 511712 - protein, 9 aa, Homo Sapiens
KLLEISVST

SEQ ID NO: 511713 - protein, 9 aa, Homo Sapiens
RTHSEDIPF

SEQ ID NO: 511714 - protein, 9 aa, Homo Sapiens
LSAKIQFKT

SEQ ID NO: 511715 - protein, 9 aa, Homo Sapiens
REFKPETIS

SEQ ID NO: 511716 - protein, 9 aa, Homo Sapiens
LTCSMWEKN

SEQ ID NO: 511717 - protein, 9 aa, Homo Sapiens
VHDSHSTNM

SEQ ID NO: 511718 - protein, 9 aa, Homo Sapiens
QLGVTSSGL

SEQ ID NO: 511719 - protein, 9 aa, Homo Sapiens
GRGARRARR

SEQ ID NO: 511720 - protein, 9 aa, Homo Sapiens
IKALQLVYR

SEQ ID NO: 511721 - protein, 9 aa, Homo Sapiens
VAELDMATT

SEQ ID NO: 511722 - protein, 9 aa, Homo Sapiens
FSRSLDLNS

SEQ ID NO: 511723 - protein, 9 aa, Homo Sapiens
MKCLAGFAR

SEQ ID NO: 511724 - protein, 9 aa, Homo Sapiens
TASTRSRRS

SEQ ID NO: 511725 - protein, 9 aa, Homo Sapiens
AMGAYAFEC

SEQ ID NO: 511726 - protein, 9 aa, Homo Sapiens
PQLMALEDD

SEQ ID NO: 511727 - protein, 9 aa, Homo Sapiens
PGFRGDMGY

SEQ ID NO: 511728 - protein, 9 aa, Homo Sapiens
LLSITADPE

SEQ ID NO: 511729 - protein, 9 aa, Homo Sapiens
MLKFWIPLP

SEQ ID NO: 511730 - protein, 9 aa, Homo Sapiens
PVDQRVNIT

SEQ ID NO: 511731 - protein, 9 aa, Homo Sapiens
ELFRRGQFA

SEQ ID NO: 511732 - protein, 9 aa, Homo Sapiens
EALLAWLQC

SEQ ID NO: 511733 - protein, 9 aa, Homo Sapiens
GRGRVREKN

SEQ ID NO: 511734 - protein, 9 aa, Homo Sapiens
ASGFGAASG

SEQ ID NO: 511735 - protein, 9 aa, Homo Sapiens
MALSVNASG

SEQ ID NO: 511736 - protein, 9 aa, Homo Sapiens
ETSDTRGGA

SEQ ID NO: 511737 - protein, 9 aa, Homo Sapiens
FSEAPADLD

SEQ ID NO: 511738 - protein, 9 aa, Homo Sapiens
YHIWDEVKC

SEQ ID NO: 511739 - protein, 9 aa, Homo Sapiens
RQASASSSQ

SEQ ID NO: 511740 - protein, 9 aa, Homo Sapiens
KSHGDQSSR

SEQ ID NO: 511741 - protein, 9 aa, Homo Sapiens
FKIIIAIVL

SEQ ID NO: 511742 - protein, 9 aa, Homo Sapiens
EFTTCEPLT

SEQ ID NO: 511743 - protein, 9 aa, Homo Sapiens
QQLTAELSL

SEQ ID NO: 511744 - protein, 9 aa, Homo Sapiens
GLKRTGWAA

SEQ ID NO: 511745 - protein, 9 aa, Homo Sapiens
HRDSTEAPK

SEQ ID NO: 511746 - protein, 9 aa, Homo Sapiens
GSGPPLLTA

SEQ ID NO: 511747 - protein, 9 aa, Homo Sapiens
IMEEVERQV

SEQ ID NO: 511748 - protein, 9 aa, Homo Sapiens
FAGDRDQCI

SEQ ID NO: 511749 - protein, 9 aa, Homo Sapiens
IAIQVIITA

SEQ ID NO: 511750 - protein, 9 aa, Homo Sapiens
ESETFANDY

SEQ ID NO: 511751 - protein, 9 aa, Homo Sapiens
SHLTRARRC

SEQ ID NO: 511752 - protein, 9 aa, Homo Sapiens
LQIQEETRC

SEQ ID NO: 511753 - protein, 9 aa, Homo Sapiens
EPPALGGPI

SEQ ID NO: 511754 - protein, 9 aa, Homo Sapiens
KSCGSELGF

SEQ ID NO: 511755 - protein, 9 aa, Homo Sapiens
CGSELGFLL

SEQ ID NO: 511756 - protein, 9 aa, Homo Sapiens
SHGDQSSRR

SEQ ID NO: 511757 - protein, 9 aa, Homo Sapiens
NLHFSTKNL

SEQ ID NO: 511758 - protein, 9 aa, Homo Sapiens
MPLVAPVVL

SEQ ID NO: 511759 - protein, 9 aa, Homo Sapiens
VYCIKDQTF

SEQ ID NO: 511760 - protein, 9 aa, Homo Sapiens
SLSDKSNAH

SEQ ID NO: 511761 - protein, 9 aa, Homo Sapiens
FGLGDLRNL

SEQ ID NO: 511762 - protein, 9 aa, Homo Sapiens
IDHFRAATN

SEQ ID NO: 511763 - protein, 9 aa, Homo Sapiens
QPPRRGAPR

SEQ ID NO: 511764 - protein, 9 aa, Homo Sapiens
QSSRRSDGY

SEQ ID NO: 511765 - protein, 9 aa, Homo Sapiens
LKKAQKDVF

SEQ ID NO: 511766 - protein, 9 aa, Homo Sapiens
VLAGMESLL

SEQ ID NO: 511767 - protein, 9 aa, Homo Sapiens
FDRTVELVN

SEQ ID NO: 511768 - protein, 9 aa, Homo Sapiens
SYNAVERIN

SEQ ID NO: 511769 - protein, 9 aa, Homo Sapiens
MTPTAFSSQ

SEQ ID NO: 511770 - protein, 9 aa, Homo Sapiens
LEDLDDLRR

SEQ ID NO: 511771 - protein, 9 aa, Homo Sapiens
VFENEERLP

SEQ ID NO: 511772 - protein, 9 aa, Homo Sapiens
SVYRNIAKL

SEQ ID NO: 511773 - protein, 9 aa, Homo Sapiens
CLDVSRFNG

SEQ ID NO: 511774 - protein, 9 aa, Homo Sapiens
IGHSFGAHL

SEQ ID NO: 511775 - protein, 9 aa, Homo Sapiens
FQFSGGSFK

SEQ ID NO: 511776 - protein, 9 aa, Homo Sapiens
PDYLLDLIR

SEQ ID NO: 511777 - protein, 9 aa, Homo Sapiens
LGDGAVGKT

SEQ ID NO: 511778 - protein, 9 aa, Homo Sapiens
APGGRRRRG

SEQ ID NO: 511779 - protein, 9 aa, Homo Sapiens
QEVRELRDQ

SEQ ID NO: 511780 - protein, 9 aa, Homo Sapiens
GTASGGEAG

SEQ ID NO: 511781 - protein, 9 aa, Homo Sapiens
DLNTDHLKM

SEQ ID NO: 511782 - protein, 9 aa, Homo Sapiens
AELSLMALP

SEQ ID NO: 511783 - protein, 9 aa, Homo Sapiens
EIGDEFVPR

SEQ ID NO: 511784 - protein, 9 aa, Homo Sapiens
SLLAMQAAL

SEQ ID NO: 511785 - protein, 9 aa, Homo Sapiens
SVSTLEKIV

SEQ ID NO: 511786 - protein, 9 aa, Homo Sapiens
SPEPPETGV

SEQ ID NO: 511787 - protein, 9 aa, Homo Sapiens
GAWTSEVRR

SEQ ID NO: 511788 - protein, 9 aa, Homo Sapiens
LCDYNRDWD

SEQ ID NO: 511789 - protein, 9 aa, Homo Sapiens
NDDSAKCKK

SEQ ID NO: 511790 - protein, 9 aa, Homo Sapiens
FPIRRDGGS

SEQ ID NO: 511791 - protein, 9 aa, Homo Sapiens
PLPVDQRVN

SEQ ID NO: 511792 - protein, 9 aa, Homo Sapiens
IQNKKLEML

SEQ ID NO: 511793 - protein, 9 aa, Homo Sapiens
PQLGVTSSG

SEQ ID NO: 511794 - protein, 9 aa, Homo Sapiens
EVTVQPGCY

SEQ ID NO: 511795 - protein, 9 aa, Homo Sapiens
LLEISVSTL

SEQ ID NO: 511796 - protein, 9 aa, Homo Sapiens
ETQEGIVII

SEQ ID NO: 511797 - protein, 9 aa, Homo Sapiens
DPNFQIPLL

SEQ ID NO: 511798 - protein, 9 aa, Homo Sapiens
HDSHSTNMT

SEQ ID NO: 511799 - protein, 9 aa, Homo Sapiens
ECETRSVCS

SEQ ID NO: 511800 - protein, 9 aa, Homo Sapiens
SEFLQNLGR

SEQ ID NO: 511801 - protein, 9 aa, Homo Sapiens
QKRIAIQVI

SEQ ID NO: 511802 - protein, 9 aa, Homo Sapiens
SQDAANKIP

SEQ ID NO: 511803 - protein, 9 aa, Homo Sapiens
ILCKGLPQC

SEQ ID NO: 511804 - protein, 9 aa, Homo Sapiens
GMEESLAEI

SEQ ID NO: 511805 - protein, 9 aa, Homo Sapiens
DYNRDWDSY

SEQ ID NO: 511806 - protein, 9 aa, Homo Sapiens
STFSWHRED

SEQ ID NO: 511807 - protein, 9 aa, Homo Sapiens
KSYKGNFLQ

SEQ ID NO: 511808 - protein, 9 aa, Homo Sapiens
IRVPSELQQ

SEQ ID NO: 511809 - protein, 9 aa, Homo Sapiens
TMLVEEIHL

SEQ ID NO: 511810 - protein, 9 aa, Homo Sapiens
SRAAGRGSW

SEQ ID NO: 511811 - protein, 9 aa, Homo Sapiens
PFACHICDK

SEQ ID NO: 511812 - protein, 9 aa, Homo Sapiens
MILFMVSVI

SEQ ID NO: 511813 - protein, 9 aa, Homo Sapiens
LLTASLPPH

SEQ ID NO: 511814 - protein, 9 aa, Homo Sapiens
SGSYNAVER

SEQ ID NO: 511815 - protein, 9 aa, Homo Sapiens
TKTLPGSPD

SEQ ID NO: 511816 - protein, 9 aa, Homo Sapiens
KMVSFHTLS

SEQ ID NO: 511817 - protein, 9 aa, Homo Sapiens
PLLTAQYNS

SEQ ID NO: 511818 - protein, 9 aa, Homo Sapiens
APSSCCSRR

SEQ ID NO: 511819 - protein, 9 aa, Homo Sapiens
CIPSPEGEI

SEQ ID NO: 511820 - protein, 9 aa, Homo Sapiens
RSAQGTSAS

SEQ ID NO: 511821 - protein, 9 aa, Homo Sapiens
RVAEILTDS

SEQ ID NO: 511822 - protein, 9 aa, Homo Sapiens
SEAFRQASA

SEQ ID NO: 511823 - protein, 9 aa, Homo Sapiens
HQAHSVFPL

SEQ ID NO: 511824 - protein, 9 aa, Homo Sapiens
SVVCTPAGG

SEQ ID NO: 511825 - protein, 9 aa, Homo Sapiens
KNLLSITAD

SEQ ID NO: 511826 - protein, 9 aa, Homo Sapiens
CKGLPQCMV

SEQ ID NO: 511827 - protein, 9 aa, Homo Sapiens
YIGDPHPTR

SEQ ID NO: 511828 - protein, 9 aa, Homo Sapiens
RTGWAARAS

SEQ ID NO: 511829 - protein, 9 aa, Homo Sapiens
IQVIITAIK

SEQ ID NO: 511830 - protein, 9 aa, Homo Sapiens
WEYVHSWEP

SEQ ID NO: 511831 - protein, 9 aa, Homo Sapiens
GMTPTAFSS

SEQ ID NO: 511832 - protein, 9 aa, Homo Sapiens
DRRSLTSLE

SEQ ID NO: 511833 - protein, 9 aa, Homo Sapiens
RIWQFGRWL

SEQ ID NO: 511834 - protein, 9 aa, Homo Sapiens
VIEYSGSYN

SEQ ID NO: 511835 - protein, 9 aa, Homo Sapiens
KLFARGVWE

SEQ ID NO: 511836 - protein, 9 aa, Homo Sapiens
GEFSIKMKC

SEQ ID NO: 511837 - protein, 9 aa, Homo Sapiens
IWDEVKCRV

SEQ ID NO: 511838 - protein, 9 aa, Homo Sapiens
NSTEPSERL

SEQ ID NO: 511839 - protein, 9 aa, Homo Sapiens
GNGRSSQAL

SEQ ID NO: 511840 - protein, 9 aa, Homo Sapiens
MPFQFSGGS

SEQ ID NO: 511841 - protein, 9 aa, Homo Sapiens
SVEDMAVLA

SEQ ID NO: 511842 - protein, 9 aa, Homo Sapiens
VSCKNFSIQ

SEQ ID NO: 511843 - protein, 9 aa, Homo Sapiens
SIYIDELLI

SEQ ID NO: 511844 - protein, 9 aa, Homo Sapiens
PPRRGAPRP

SEQ ID NO: 511845 - protein, 9 aa, Homo Sapiens
TVQPGCYLP

SEQ ID NO: 511846 - protein, 9 aa, Homo Sapiens
TERKMYSLL

SEQ ID NO: 511847 - protein, 9 aa, Homo Sapiens
HQGPAAGVQ

SEQ ID NO: 511848 - protein, 9 aa, Homo Sapiens
AARTGRGAR

SEQ ID NO: 511849 - protein, 9 aa, Homo Sapiens
ASLLPLLQR

SEQ ID NO: 511850 - protein, 9 aa, Homo Sapiens
SGVSGSTWA

SEQ ID NO: 511851 - protein, 9 aa, Homo Sapiens
MWEKNMEDL

SEQ ID NO: 511852 - protein, 9 aa, Homo Sapiens
VHSWEPMDK

SEQ ID NO: 511853 - protein, 9 aa, Homo Sapiens
ASPNFVQRL

SEQ ID NO: 511854 - protein, 9 aa, Homo Sapiens
GRQSISRTF

SEQ ID NO: 511855 - protein, 9 aa, Homo Sapiens
LLRHQYLKS

SEQ ID NO: 511856 - protein, 9 aa, Homo Sapiens
RHTARHQGP

SEQ ID NO: 511857 - protein, 9 aa, Homo Sapiens
IGCQRFNSP

SEQ ID NO: 511858 - protein, 9 aa, Homo Sapiens
ALCEQIRCR

SEQ ID NO: 511859 - protein, 9 aa, Homo Sapiens
DYPGEGVEE

SEQ ID NO: 511860 - protein, 9 aa, Homo Sapiens
LWKKRSILQ

SEQ ID NO: 511861 - protein, 9 aa, Homo Sapiens
QHSHIAHWW

SEQ ID NO: 511862 - protein, 9 aa, Homo Sapiens
QFGRWLEVT

SEQ ID NO: 511863 - protein, 9 aa, Homo Sapiens
PLLSKVVCS

SEQ ID NO: 511864 - protein, 9 aa, Homo Sapiens
KRTGWAARA

SEQ ID NO: 511865 - protein, 9 aa, Homo Sapiens
VLPEMYKIF

SEQ ID NO: 511866 - protein, 9 aa, Homo Sapiens
AHTLPVYCV

SEQ ID NO: 511867 - protein, 9 aa, Homo Sapiens
FACHICDKA

SEQ ID NO: 511868 - protein, 9 aa, Homo Sapiens
APQPPRRGA

SEQ ID NO: 511869 - protein, 9 aa, Homo Sapiens
HCAQECKHL

SEQ ID NO: 511870 - protein, 9 aa, Homo Sapiens
PGEGVEETF

SEQ ID NO: 511871 - protein, 9 aa, Homo Sapiens
LDYPGEGVE

SEQ ID NO: 511872 - protein, 9 aa, Homo Sapiens
KASRDVISY

SEQ ID NO: 511873 - protein, 9 aa, Homo Sapiens
SSLIKEQKN

SEQ ID NO: 511874 - protein, 9 aa, Homo Sapiens
PAAPYDTRS

SEQ ID NO: 511875 - protein, 9 aa, Homo Sapiens
YCVHSLVQI

SEQ ID NO: 511876 - protein, 9 aa, Homo Sapiens
RWRENSTEP

SEQ ID NO: 511877 - protein, 9 aa, Homo Sapiens
SDGKLKARP

SEQ ID NO: 511878 - protein, 9 aa, Homo Sapiens
NHTGAHQVL

SEQ ID NO: 511879 - protein, 9 aa, Homo Sapiens
PALPPIWSV

SEQ ID NO: 511880 - protein, 9 aa, Homo Sapiens
QATDIANQA

SEQ ID NO: 511881 - protein, 9 aa, Homo Sapiens
CSSCARLQG

SEQ ID NO: 511882 - protein, 9 aa, Homo Sapiens
AYSSSVTPV

SEQ ID NO: 511883 - protein, 9 aa, Homo Sapiens
KKMQEGNSA

SEQ ID NO: 511884 - protein, 9 aa, Homo Sapiens
LYEIGAWTS

SEQ ID NO: 511885 - protein, 9 aa, Homo Sapiens
YPALPPIWS

SEQ ID NO: 511886 - protein, 9 aa, Homo Sapiens
CMALSVNAS

SEQ ID NO: 511887 - protein, 9 aa, Homo Sapiens
VICIVFGFI

SEQ ID NO: 511888 - protein, 9 aa, Homo Sapiens
RRGAPRPPT

SEQ ID NO: 511889 - protein, 9 aa, Homo Sapiens
DHFRAATNV

SEQ ID NO: 511890 - protein, 9 aa, Homo Sapiens
RRESEAFRQ

SEQ ID NO: 511891 - protein, 9 aa, Homo Sapiens
LKRTGWAAR

SEQ ID NO: 511892 - protein, 9 aa, Homo Sapiens
DQYRQMDLQ

SEQ ID NO: 511893 - protein, 9 aa, Homo Sapiens
SSCQTLSTQ

SEQ ID NO: 511894 - protein, 9 aa, Homo Sapiens
ASLLASTSP

SEQ ID NO: 511895 - protein, 9 aa, Homo Sapiens
LQFLERKEQ

SEQ ID NO: 511896 - protein, 9 aa, Homo Sapiens
LTDDPNFQI

SEQ ID NO: 511897 - protein, 9 aa, Homo Sapiens
GRGSWRPSG

SEQ ID NO: 511898 - protein, 9 aa, Homo Sapiens
VIITAIKYI

SEQ ID NO: 511899 - protein, 9 aa, Homo Sapiens
TPTAFSSQH

SEQ ID NO: 511900 - protein, 9 aa, Homo Sapiens
AETASPNFV

SEQ ID NO: 511901 - protein, 9 aa, Homo Sapiens
KYHIWDEVK

SEQ ID NO: 511902 - protein, 9 aa, Homo Sapiens
SSNSNLSST

SEQ ID NO: 511903 - protein, 9 aa, Homo Sapiens
SSLPQLMAL

SEQ ID NO: 511904 - protein, 9 aa, Homo Sapiens
DWDSYRSPW

SEQ ID NO: 511905 - protein, 9 aa, Homo Sapiens
QVPPHRRQG

SEQ ID NO: 511906 - protein, 9 aa, Homo Sapiens
ITESYPALP

SEQ ID NO: 511907 - protein, 9 aa, Homo Sapiens
ILQFLERKE

SEQ ID NO: 511908 - protein, 9 aa, Homo Sapiens
LIKEQKNYY

SEQ ID NO: 511909 - protein, 9 aa, Homo Sapiens
DKHYLSYLP

SEQ ID NO: 511910 - protein, 9 aa, Homo Sapiens
PVVLPEMYK

SEQ ID NO: 511911 - protein, 9 aa, Homo Sapiens
YIGSNLEKE

SEQ ID NO: 511912 - protein, 9 aa, Homo Sapiens
LPQLMALED

SEQ ID NO: 511913 - protein, 9 aa, Homo Sapiens
RCRIPEEMP

SEQ ID NO: 511914 - protein, 9 aa, Homo Sapiens
NSADSVVTS

SEQ ID NO: 511915 - protein, 9 aa, Homo Sapiens
HGDQSSRRS

SEQ ID NO: 511916 - protein, 9 aa, Homo Sapiens
NTDHLKMDI

SEQ ID NO: 511917 - protein, 9 aa, Homo Sapiens
RGVWEGSFS

SEQ ID NO: 511918 - protein, 9 aa, Homo Sapiens
APADLDASE

SEQ ID NO: 511919 - protein, 9 aa, Homo Sapiens
GWSGSSSCQ

SEQ ID NO: 511920 - protein, 9 aa, Homo Sapiens
IALTEANIV

SEQ ID NO: 511921 - protein, 9 aa, Homo Sapiens
SAFTPTDGA

SEQ ID NO: 511922 - protein, 9 aa, Homo Sapiens
IRCRIPEEM

SEQ ID NO: 511923 - protein, 9 aa, Homo Sapiens
ELDMATTKT

SEQ ID NO: 511924 - protein, 9 aa, Homo Sapiens
LGVTSSGLN

SEQ ID NO: 511925 - protein, 9 aa, Homo Sapiens
HHRPPPWTG

SEQ ID NO: 511926 - protein, 9 aa, Homo Sapiens
QGNELFRRG

SEQ ID NO: 511927 - protein, 9 aa, Homo Sapiens
INNTHGFMN

SEQ ID NO: 511928 - protein, 9 aa, Homo Sapiens
LVAMGIDRR

SEQ ID NO: 511929 - protein, 9 aa, Homo Sapiens
RELRDQYRQ

SEQ ID NO: 511930 - protein, 9 aa, Homo Sapiens
IFKIIIAIV

SEQ ID NO: 511931 - protein, 9 aa, Homo Sapiens
QGTGIKETV

SEQ ID NO: 511932 - protein, 9 aa, Homo Sapiens
NEALIRLYQ

SEQ ID NO: 511933 - protein, 9 aa, Homo Sapiens
PQVPPHRRQ

SEQ ID NO: 511934 - protein, 9 aa, Homo Sapiens
GWVYDRVSF

SEQ ID NO: 511935 - protein, 9 aa, Homo Sapiens
LCEFNILQK

SEQ ID NO: 511936 - protein, 9 aa, Homo Sapiens
DGGSWEVIE

SEQ ID NO: 511937 - protein, 9 aa, Homo Sapiens
GRRRRGRAR

SEQ ID NO: 511938 - protein, 9 aa, Homo Sapiens
TKGIYSFSF

SEQ ID NO: 511939 - protein, 9 aa, Homo Sapiens
GHPAPLGAG

SEQ ID NO: 511940 - protein, 9 aa, Homo Sapiens
VFVAPTKGI

SEQ ID NO: 511941 - protein, 9 aa, Homo Sapiens
PSAAQRNDS

SEQ ID NO: 511942 - protein, 9 aa, Homo Sapiens
FIDSLCEFN

SEQ ID NO: 511943 - protein, 9 aa, Homo Sapiens
PQAQPHGEA

SEQ ID NO: 511944 - protein, 9 aa, Homo Sapiens
KQQLTAELS

SEQ ID NO: 511945 - protein, 9 aa, Homo Sapiens
ASRAAGRGS

SEQ ID NO: 511946 - protein, 9 aa, Homo Sapiens
LRTHSEDIP

SEQ ID NO: 511947 - protein, 9 aa, Homo Sapiens
EYSGSYNAV

SEQ ID NO: 511948 - protein, 9 aa, Homo Sapiens
KMKCLAGFA

SEQ ID NO: 511949 - protein, 9 aa, Homo Sapiens
QDAANKIPF

SEQ ID NO: 511950 - protein, 9 aa, Homo Sapiens
VIEFLKLQI

SEQ ID NO: 511951 - protein, 9 aa, Homo Sapiens
PEKSVNKKQ

SEQ ID NO: 511952 - protein, 9 aa, Homo Sapiens
GDSTGSECS

SEQ ID NO: 511953 - protein, 9 aa, Homo Sapiens
IDSLCEFNI

SEQ ID NO: 511954 - protein, 9 aa, Homo Sapiens
ALIQMQLQH

SEQ ID NO: 511955 - protein, 9 aa, Homo Sapiens
DPSCQLCVF

SEQ ID NO: 511956 - protein, 9 aa, Homo Sapiens
LRHQYLKSC

SEQ ID NO: 511957 - protein, 9 aa, Homo Sapiens
PSGFEREFK

SEQ ID NO: 511958 - protein, 9 aa, Homo Sapiens
SWAHSDGSG

SEQ ID NO: 511959 - protein, 9 aa, Homo Sapiens
LASDAAQLQ

SEQ ID NO: 511960 - protein, 9 aa, Homo Sapiens
TNRLLSDPE

SEQ ID NO: 511961 - protein, 9 aa, Homo Sapiens
AHSVFPLVI

SEQ ID NO: 511962 - protein, 9 aa, Homo Sapiens
TLPGSPDGP

SEQ ID NO: 511963 - protein, 9 aa, Homo Sapiens
DIANQAEEI

SEQ ID NO: 511964 - protein, 9 aa, Homo Sapiens
RRRTASTRS

SEQ ID NO: 511965 - protein, 9 aa, Homo Sapiens
TSPRPKPKT

SEQ ID NO: 511966 - protein, 9 aa, Homo Sapiens
LRSSLLHLT

SEQ ID NO: 511967 - protein, 9 aa, Homo Sapiens
SEEYDTEGF

SEQ ID NO: 511968 - protein, 9 aa, Homo Sapiens
MYTPFATKK

SEQ ID NO: 511969 - protein, 9 aa, Homo Sapiens
HRHHRPPPW

SEQ ID NO: 511970 - protein, 9 aa, Homo Sapiens
SKNLLSITA

SEQ ID NO: 511971 - protein, 9 aa, Homo Sapiens
SLSPEPPET

SEQ ID NO: 511972 - protein, 9 aa, Homo Sapiens
ETRLLHEKS

SEQ ID NO: 511973 - protein, 9 aa, Homo Sapiens
IKEQKNYYT

SEQ ID NO: 511974 - protein, 9 aa, Homo Sapiens
HRRQGEPFN

SEQ ID NO: 511975 - protein, 9 aa, Homo Sapiens
TIALTEANI

SEQ ID NO: 511976 - protein, 9 aa, Homo Sapiens
VTLSESAAI

SEQ ID NO: 511977 - protein, 9 aa, Homo Sapiens
PGAMGAYAF

SEQ ID NO: 511978 - protein, 9 aa, Homo Sapiens
STRSRRSAT

SEQ ID NO: 511979 - protein, 9 aa, Homo Sapiens
GAASGVGIC

SEQ ID NO: 511980 - protein, 9 aa, Homo Sapiens
ANHSWAHSD

SEQ ID NO: 511981 - protein, 9 aa, Homo Sapiens
GTSASLLPL

SEQ ID NO: 511982 - protein, 9 aa, Homo Sapiens
QKVAGYIGD

SEQ ID NO: 511983 - protein, 9 aa, Homo Sapiens
QFSEAPADL

SEQ ID NO: 511984 - protein, 9 aa, Homo Sapiens
RGSNLEETR

SEQ ID NO: 511985 - protein, 9 aa, Homo Sapiens
ALASDAAQL

SEQ ID NO: 511986 - protein, 9 aa, Homo Sapiens
MDQEKVSSV

SEQ ID NO: 511987 - protein, 9 aa, Homo Sapiens
RESETFAND

SEQ ID NO: 511988 - protein, 9 aa, Homo Sapiens
SSCCSRRRH

SEQ ID NO: 511989 - protein, 9 aa, Homo Sapiens
RRAPAPGGR

SEQ ID NO: 511990 - protein, 9 aa, Homo Sapiens
GSSSCQTLS

SEQ ID NO: 511991 - protein, 9 aa, Homo Sapiens
TGDARSAFR

SEQ ID NO: 511992 - protein, 9 aa, Homo Sapiens
LAWLQCAET

SEQ ID NO: 511993 - protein, 9 aa, Homo Sapiens
QQKQQLTAE

SEQ ID NO: 511994 - protein, 9 aa, Homo Sapiens
RKNEALIRL

SEQ ID NO: 511995 - protein, 9 aa, Homo Sapiens
GYTLKSCGS

SEQ ID NO: 511996 - protein, 9 aa, Homo Sapiens
GVWEGSFSF

SEQ ID NO: 511997 - protein, 9 aa, Homo Sapiens
WKKRSILQF

SEQ ID NO: 511998 - protein, 9 aa, Homo Sapiens
GDARSAFRP

SEQ ID NO: 511999 - protein, 9 aa, Homo Sapiens
TDSNLNDGL

SEQ ID NO: 512000 - protein, 9 aa, Homo Sapiens
SVFPLVIKR

SEQ ID NO: 512001 - protein, 9 aa, Homo Sapiens
DVDICQRGL

SEQ ID NO: 512002 - protein, 9 aa, Homo Sapiens
KSYTMIGND

SEQ ID NO: 512003 - protein, 9 aa, Homo Sapiens
REPGTSSNS

SEQ ID NO: 512004 - protein, 9 aa, Homo Sapiens
EQFRCGNGK

SEQ ID NO: 512005 - protein, 9 aa, Homo Sapiens
TLCALCIDH

SEQ ID NO: 512006 - protein, 9 aa, Homo Sapiens
KLSCSSIYI

SEQ ID NO: 512007 - protein, 9 aa, Homo Sapiens
EFLKLQIQE

SEQ ID NO: 512008 - protein, 9 aa, Homo Sapiens
DMGYPGFGG

SEQ ID NO: 512009 - protein, 9 aa, Homo Sapiens
CGLLFLASW

SEQ ID NO: 512010 - protein, 9 aa, Homo Sapiens
CRIPEEMPK

SEQ ID NO: 512011 - protein, 9 aa, Homo Sapiens
IVIKGLYEK

SEQ ID NO: 512012 - protein, 9 aa, Homo Sapiens
KKLEMLLHS

SEQ ID NO: 512013 - protein, 9 aa, Homo Sapiens
IKCVVLGDG

SEQ ID NO: 512014 - protein, 9 aa, Homo Sapiens
LDAVTYLSG

SEQ ID NO: 512015 - protein, 9 aa, Homo Sapiens
AIKCVVLGD

SEQ ID NO: 512016 - protein, 9 aa, Homo Sapiens
PRMCELCFY

SEQ ID NO: 512017 - protein, 9 aa, Homo Sapiens
DGWVYDRVS

SEQ ID NO: 512018 - protein, 9 aa, Homo Sapiens
RPPTTTRAP

SEQ ID NO: 512019 - protein, 9 aa, Homo Sapiens
ETGLSAIDT

SEQ ID NO: 512020 - protein, 9 aa, Homo Sapiens
LWEYVHSWE

SEQ ID NO: 512021 - protein, 9 aa, Homo Sapiens
KRSILQFLE

SEQ ID NO: 512022 - protein, 9 aa, Homo Sapiens
VIKKMQEGN

SEQ ID NO: 512023 - protein, 9 aa, Homo Sapiens
DMATTKTMP

SEQ ID NO: 512024 - protein, 9 aa, Homo Sapiens
ITLPKKDET

SEQ ID NO: 512025 - protein, 9 aa, Homo Sapiens
LEVGHPAPL

SEQ ID NO: 512026 - protein, 9 aa, Homo Sapiens
DAVTYLSGV

SEQ ID NO: 512027 - protein, 9 aa, Homo Sapiens
NFQIPLLLA

SEQ ID NO: 512028 - protein, 9 aa, Homo Sapiens
TCGEVNQLG

SEQ ID NO: 512029 - protein, 9 aa, Homo Sapiens
CACEQFRCG

SEQ ID NO: 512030 - protein, 9 aa, Homo Sapiens
IRRDGGSWE

SEQ ID NO: 512031 - protein, 9 aa, Homo Sapiens
IPLPFWVSN

SEQ ID NO: 512032 - protein, 9 aa, Homo Sapiens
RLYQEIEED

SEQ ID NO: 512033 - protein, 9 aa, Homo Sapiens
ILDPSCQLC

SEQ ID NO: 512034 - protein, 9 aa, Homo Sapiens
VQYMSERHT

SEQ ID NO: 512035 - protein, 9 aa, Homo Sapiens
HSTNMTPQH

SEQ ID NO: 512036 - protein, 9 aa, Homo Sapiens
VDRKCQLHV

SEQ ID NO: 512037 - protein, 9 aa, Homo Sapiens
RRGQFAEAA

SEQ ID NO: 512038 - protein, 9 aa, Homo Sapiens
DSHSTNMTP

SEQ ID NO: 512039 - protein, 9 aa, Homo Sapiens
GKLKARPKP

SEQ ID NO: 512040 - protein, 9 aa, Homo Sapiens
PFTTSAEAS

SEQ ID NO: 512041 - protein, 9 aa, Homo Sapiens
SSQKVLLVI

SEQ ID NO: 512042 - protein, 9 aa, Homo Sapiens
LYQEIEEDR

SEQ ID NO: 512043 - protein, 9 aa, Homo Sapiens
VHAPQPLLP

SEQ ID NO: 512044 - protein, 9 aa, Homo Sapiens
IAAGAVQPK

SEQ ID NO: 512045 - protein, 9 aa, Homo Sapiens
LSGMRSTGD

SEQ ID NO: 512046 - protein, 9 aa, Homo Sapiens
YKLRIKQIM

SEQ ID NO: 512047 - protein, 9 aa, Homo Sapiens
RAGGRACQQ

SEQ ID NO: 512048 - protein, 9 aa, Homo Sapiens
GPASAFTPT

SEQ ID NO: 512049 - protein, 9 aa, Homo Sapiens
AEILTDSNL

SEQ ID NO: 512050 - protein, 9 aa, Homo Sapiens
FLASWMIAA

SEQ ID NO: 512051 - protein, 9 aa, Homo Sapiens
PGTSSNSNL

SEQ ID NO: 512052 - protein, 9 aa, Homo Sapiens
WQFGRWLEV

SEQ ID NO: 512053 - protein, 9 aa, Homo Sapiens
PPHRDSTEA

SEQ ID NO: 512054 - protein, 9 aa, Homo Sapiens
KDVFLHETL

SEQ ID NO: 512055 - protein, 9 aa, Homo Sapiens
FRVGASDGG

SEQ ID NO: 512056 - protein, 9 aa, Homo Sapiens
EEYDTEGFS

SEQ ID NO: 512057 - protein, 9 aa, Homo Sapiens
VGYCVHSLV

SEQ ID NO: 512058 - protein, 9 aa, Homo Sapiens
SVKNIQTSE

SEQ ID NO: 512059 - protein, 9 aa, Homo Sapiens
AYAFECQEG

SEQ ID NO: 512060 - protein, 9 aa, Homo Sapiens
LSNSLINNT

SEQ ID NO: 512061 - protein, 9 aa, Homo Sapiens
MRKRHYWRL

SEQ ID NO: 512062 - protein, 9 aa, Homo Sapiens
PLVAPVVLP

SEQ ID NO: 512063 - protein, 9 aa, Homo Sapiens
DKKGVTLKT

SEQ ID NO: 512064 - protein, 9 aa, Homo Sapiens
KAAVSSALP

SEQ ID NO: 512065 - protein, 9 aa, Homo Sapiens
PPPWTGLKR

SEQ ID NO: 512066 - protein, 9 aa, Homo Sapiens
VTDDKTIEN

SEQ ID NO: 512067 - protein, 9 aa, Homo Sapiens
ASDGGSPAL

SEQ ID NO: 512068 - protein, 9 aa, Homo Sapiens
NCKQIKADL

SEQ ID NO: 512069 - protein, 9 aa, Homo Sapiens
PSMPNVFND

SEQ ID NO: 512070 - protein, 9 aa, Homo Sapiens
WRENSTEPS

SEQ ID NO: 512071 - protein, 9 aa, Homo Sapiens
NFDRTVELV

SEQ ID NO: 512072 - protein, 9 aa, Homo Sapiens
LCFYNEMIY

SEQ ID NO: 512073 - protein, 9 aa, Homo Sapiens
CEFNILQKI

SEQ ID NO: 512074 - protein, 9 aa, Homo Sapiens
KFWIPLPFW

SEQ ID NO: 512075 - protein, 9 aa, Homo Sapiens
IPLAVTSPS

SEQ ID NO: 512076 - protein, 9 aa, Homo Sapiens
IGNDDSMQN

SEQ ID NO: 512077 - protein, 9 aa, Homo Sapiens
ASSIAANMM

SEQ ID NO: 512078 - protein, 9 aa, Homo Sapiens
SMWEKNMED

SEQ ID NO: 512079 - protein, 9 aa, Homo Sapiens
SSLLHLTLQ

SEQ ID NO: 512080 - protein, 9 aa, Homo Sapiens
EFRVGASDG

SEQ ID NO: 512081 - protein, 9 aa, Homo Sapiens
KRADKIEKV

SEQ ID NO: 512082 - protein, 9 aa, Homo Sapiens
DSTGSECSI

SEQ ID NO: 512083 - protein, 9 aa, Homo Sapiens
NPKSYKGNF

SEQ ID NO: 512084 - protein, 9 aa, Homo Sapiens
ERPFACHIC

SEQ ID NO: 512085 - protein, 9 aa, Homo Sapiens
LPKKDETIQ

SEQ ID NO: 512086 - protein, 9 aa, Homo Sapiens
ANLHQIIRK

SEQ ID NO: 512087 - protein, 9 aa, Homo Sapiens
DKSNAHPGC

SEQ ID NO: 512088 - protein, 9 aa, Homo Sapiens
VLALGGERG

SEQ ID NO: 512089 - protein, 9 aa, Homo Sapiens
CHICDKAFK

SEQ ID NO: 512090 - protein, 9 aa, Homo Sapiens
GGSWEVIEG

SEQ ID NO: 512091 - protein, 9 aa, Homo Sapiens
ACQQGLHSL

SEQ ID NO: 512092 - protein, 9 aa, Homo Sapiens
SWEPMDKAG

SEQ ID NO: 512093 - protein, 9 aa, Homo Sapiens
ENEERLPQA

SEQ ID NO: 512094 - protein, 9 aa, Homo Sapiens
ETFANDYTL

SEQ ID NO: 512095 - protein, 9 aa, Homo Sapiens
SEAPADLDA

SEQ ID NO: 512096 - protein, 9 aa, Homo Sapiens
LEVDAVVNA

SEQ ID NO: 512097 - protein, 9 aa, Homo Sapiens
KKKLEDLDD

SEQ ID NO: 512098 - protein, 9 aa, Homo Sapiens
GTGIKETVL

SEQ ID NO: 512099 - protein, 9 aa, Homo Sapiens
PSQDAANKI

SEQ ID NO: 512100 - protein, 9 aa, Homo Sapiens
WSGSSSCQT

SEQ ID NO: 512101 - protein, 9 aa, Homo Sapiens
WPSGFEREF

SEQ ID NO: 512102 - protein, 9 aa, Homo Sapiens
MEGDKTKER

SEQ ID NO: 512103 - protein, 9 aa, Homo Sapiens
RLPQAVELL

SEQ ID NO: 512104 - protein, 9 aa, Homo Sapiens
CPECARLFS

SEQ ID NO: 512105 - protein, 9 aa, Homo Sapiens
RHHRPPPWT

SEQ ID NO: 512106 - protein, 9 aa, Homo Sapiens
CQTLSTQLW

SEQ ID NO: 512107 - protein, 9 aa, Homo Sapiens
LSAAAHTLP

SEQ ID NO: 512108 - protein, 9 aa, Homo Sapiens
TTRAPSSCC

SEQ ID NO: 512109 - protein, 9 aa, Homo Sapiens
LNDMTKNDP

SEQ ID NO: 512110 - protein, 9 aa, Homo Sapiens
WDPPSEPSP

SEQ ID NO: 512111 - protein, 9 aa, Homo Sapiens
PYLHNMKKW

SEQ ID NO: 512112 - protein, 9 aa, Homo Sapiens
PASAFTPTD

SEQ ID NO: 512113 - protein, 9 aa, Homo Sapiens
SLLASTSPR

SEQ ID NO: 512114 - protein, 9 aa, Homo Sapiens
EKSVNKKQE

SEQ ID NO: 512115 - protein, 9 aa, Homo Sapiens
GARRARRRT

SEQ ID NO: 512116 - protein, 9 aa, Homo Sapiens
RYAVLMNHR

SEQ ID NO: 512117 - protein, 9 aa, Homo Sapiens
KTLPGSPDG

SEQ ID NO: 512118 - protein, 9 aa, Homo Sapiens
ARIAAGAVQ

SEQ ID NO: 512119 - protein, 9 aa, Homo Sapiens
AKCKKMASM

SEQ ID NO: 512120 - protein, 9 aa, Homo Sapiens
VVLGDGAVG

SEQ ID NO: 512121 - protein, 9 aa, Homo Sapiens
EHWLLHCAQ

SEQ ID NO: 512122 - protein, 9 aa, Homo Sapiens
RLCGLLFLA

SEQ ID NO: 512123 - protein, 9 aa, Homo Sapiens
KSEFLQNLG

SEQ ID NO: 512124 - protein, 9 aa, Homo Sapiens
IWQFGRWLE

SEQ ID NO: 512125 - protein, 9 aa, Homo Sapiens
ILFMVSVIC

SEQ ID NO: 512126 - protein, 9 aa, Homo Sapiens
DDKTIENHN

SEQ ID NO: 512127 - protein, 9 aa, Homo Sapiens
GSVTLSESA

SEQ ID NO: 512128 - protein, 9 aa, Homo Sapiens
IQFKTDLSL

SEQ ID NO: 512129 - protein, 9 aa, Homo Sapiens
IKQIMEEVE

SEQ ID NO: 512130 - protein, 9 aa, Homo Sapiens
QEGIVIIKK

SEQ ID NO: 512131 - protein, 9 aa, Homo Sapiens
IATLRQKYT

SEQ ID NO: 512132 - protein, 9 aa, Homo Sapiens
GAPRPPTTT

SEQ ID NO: 512133 - protein, 9 aa, Homo Sapiens
LEGDEDASH

SEQ ID NO: 512134 - protein, 9 aa, Homo Sapiens
SRFNGPVIM

SEQ ID NO: 512135 - protein, 9 aa, Homo Sapiens
RVSFSSTIV

SEQ ID NO: 512136 - protein, 9 aa, Homo Sapiens
QKNYYTKEE

SEQ ID NO: 512137 - protein, 9 aa, Homo Sapiens
SIIQAGTSE

SEQ ID NO: 512138 - protein, 9 aa, Homo Sapiens
LIRLYQEIE

SEQ ID NO: 512139 - protein, 9 aa, Homo Sapiens
SCNVSVHKE

SEQ ID NO: 512140 - protein, 9 aa, Homo Sapiens
SGPPLLTAQ

SEQ ID NO: 512141 - protein, 9 aa, Homo Sapiens
DATPPSPRS

SEQ ID NO: 512142 - protein, 9 aa, Homo Sapiens
LALGGERGF

SEQ ID NO: 512143 - protein, 9 aa, Homo Sapiens
QYRQMDLQT

SEQ ID NO: 512144 - protein, 9 aa, Homo Sapiens
RFNGPVIML

SEQ ID NO: 512145 - protein, 9 aa, Homo Sapiens
GATYNVTVE

SEQ ID NO: 512146 - protein, 9 aa, Homo Sapiens
QLFIQRSTA

SEQ ID NO: 512147 - protein, 9 aa, Homo Sapiens
PQAVELLGK

SEQ ID NO: 512148 - protein, 9 aa, Homo Sapiens
LRNLLGLVG

SEQ ID NO: 512149 - protein, 9 aa, Homo Sapiens
HVLDGEGRT

SEQ ID NO: 512150 - protein, 9 aa, Homo Sapiens
PTAFSSQHT

SEQ ID NO: 512151 - protein, 9 aa, Homo Sapiens
TDMRCRTAF

SEQ ID NO: 512152 - protein, 9 aa, Homo Sapiens
RPKPCAGNQ

SEQ ID NO: 512153 - protein, 9 aa, Homo Sapiens
DGPETGLSA

SEQ ID NO: 512154 - protein, 9 aa, Homo Sapiens
PWTGLKRTG

SEQ ID NO: 512155 - protein, 9 aa, Homo Sapiens
SGLTCSMWE

SEQ ID NO: 512156 - protein, 9 aa, Homo Sapiens
WTGLKRTGW

SEQ ID NO: 512157 - protein, 9 aa, Homo Sapiens
AQSVVCTPA

SEQ ID NO: 512158 - protein, 9 aa, Homo Sapiens
QEELPADLK

SEQ ID NO: 512159 - protein, 9 aa, Homo Sapiens
KIPFSSASG

SEQ ID NO: 512160 - protein, 9 aa, Homo Sapiens
EISIMTTEL

SEQ ID NO: 512161 - protein, 9 aa, Homo Sapiens
AFYCRNRKW

SEQ ID NO: 512162 - protein, 9 aa, Homo Sapiens
LTIGCQRFN

SEQ ID NO: 512163 - protein, 9 aa, Homo Sapiens
TSRHQGSRV

SEQ ID NO: 512164 - protein, 9 aa, Homo Sapiens
RIAAGAVQP

SEQ ID NO: 512165 - protein, 9 aa, Homo Sapiens
SVNKKQEAT

SEQ ID NO: 512166 - protein, 9 aa, Homo Sapiens
RHRHHRPPP

SEQ ID NO: 512167 - protein, 9 aa, Homo Sapiens
CQRGLTSPH

SEQ ID NO: 512168 - protein, 9 aa, Homo Sapiens
VVNAANASL

SEQ ID NO: 512169 - protein, 9 aa, Homo Sapiens
EAPADLDAS

SEQ ID NO: 512170 - protein, 9 aa, Homo Sapiens
QSPALIQMQ

SEQ ID NO: 512171 - protein, 9 aa, Homo Sapiens
SAKCKKMAS

SEQ ID NO: 512172 - protein, 9 aa, Homo Sapiens
LVVFLLTIF

SEQ ID NO: 512173 - protein, 9 aa, Homo Sapiens
VYVCRVVSG

SEQ ID NO: 512174 - protein, 9 aa, Homo Sapiens
RSGQSHHGQ

SEQ ID NO: 512175 - protein, 9 aa, Homo Sapiens
KLQTLYIGS

SEQ ID NO: 512176 - protein, 9 aa, Homo Sapiens
LSPEPPETG

SEQ ID NO: 512177 - protein, 9 aa, Homo Sapiens
LMAVAWVGY

SEQ ID NO: 512178 - protein, 9 aa, Homo Sapiens
GRACQQGLH

SEQ ID NO: 512179 - protein, 9 aa, Homo Sapiens
CFAGDRDQC

SEQ ID NO: 512180 - protein, 9 aa, Homo Sapiens
VCQPGAAHR

SEQ ID NO: 512181 - protein, 9 aa, Homo Sapiens
AMHIPQLFI

SEQ ID NO: 512182 - protein, 9 aa, Homo Sapiens
HQIIRKALC

SEQ ID NO: 512183 - protein, 9 aa, Homo Sapiens
FTTCEPLTQ

SEQ ID NO: 512184 - protein, 9 aa, Homo Sapiens
QCAETTLTD

SEQ ID NO: 512185 - protein, 9 aa, Homo Sapiens
AQRNDSSCS

SEQ ID NO: 512186 - protein, 9 aa, Homo Sapiens
TTTRAPSSC

SEQ ID NO: 512187 - protein, 9 aa, Homo Sapiens
SYKGNFLQS

SEQ ID NO: 512188 - protein, 9 aa, Homo Sapiens
QHGSASCHF

SEQ ID NO: 512189 - protein, 9 aa, Homo Sapiens
NVFNDLSQK

SEQ ID NO: 512190 - protein, 9 aa, Homo Sapiens
SRDNMRKRH

SEQ ID NO: 512191 - protein, 9 aa, Homo Sapiens
HYSSLIKHR

SEQ ID NO: 512192 - protein, 9 aa, Homo Sapiens
TLLTCESLA

SEQ ID NO: 512193 - protein, 9 aa, Homo Sapiens
HWGGTAIRP

SEQ ID NO: 512194 - protein, 9 aa, Homo Sapiens
RQKYTQSNG

SEQ ID NO: 512195 - protein, 9 aa, Homo Sapiens
IAIVLFFFF

SEQ ID NO: 512196 - protein, 9 aa, Homo Sapiens
VLGDGAVGK

SEQ ID NO: 512197 - protein, 9 aa, Homo Sapiens
GPIFWTNEM

SEQ ID NO: 512198 - protein, 9 aa, Homo Sapiens
LKKPPANLH

SEQ ID NO: 512199 - protein, 9 aa, Homo Sapiens
LLTCESLAS

SEQ ID NO: 512200 - protein, 9 aa, Homo Sapiens
SRSLDLNSI

SEQ ID NO: 512201 - protein, 9 aa, Homo Sapiens
TSAKTQLPQ

SEQ ID NO: 512202 - protein, 9 aa, Homo Sapiens
TARHQGPAA

SEQ ID NO: 512203 - protein, 9 aa, Homo Sapiens
PGGRRRRGR

SEQ ID NO: 512204 - protein, 9 aa, Homo Sapiens
CAETTLTDK

SEQ ID NO: 512205 - protein, 9 aa, Homo Sapiens
LVEEIHLCP

SEQ ID NO: 512206 - protein, 9 aa, Homo Sapiens
FSHYSSLIK

SEQ ID NO: 512207 - protein, 9 aa, Homo Sapiens
LNTGESGDF

SEQ ID NO: 512208 - protein, 9 aa, Homo Sapiens
KCKKMASMT

SEQ ID NO: 512209 - protein, 9 aa, Homo Sapiens
RFIATLRQK

SEQ ID NO: 512210 - protein, 9 aa, Homo Sapiens
GVTLHDIKA

SEQ ID NO: 512211 - protein, 9 aa, Homo Sapiens
VVLPEMYKI

SEQ ID NO: 512212 - protein, 9 aa, Homo Sapiens
FSIQRGLKK

SEQ ID NO: 512213 - protein, 9 aa, Homo Sapiens
TFTLPLSVY

SEQ ID NO: 512214 - protein, 9 aa, Homo Sapiens
SDPVEFSSD

SEQ ID NO: 512215 - protein, 9 aa, Homo Sapiens
QLEVGHPAP

SEQ ID NO: 512216 - protein, 9 aa, Homo Sapiens
VTVEALKDQ

SEQ ID NO: 512217 - protein, 9 aa, Homo Sapiens
AWLQCAETT

SEQ ID NO: 512218 - protein, 9 aa, Homo Sapiens
VGASDGGSP

SEQ ID NO: 512219 - protein, 9 aa, Homo Sapiens
GRRHTARHQ

SEQ ID NO: 512220 - protein, 9 aa, Homo Sapiens
ASLETSDTR

SEQ ID NO: 512221 - protein, 9 aa, Homo Sapiens
QRFNSPITL

SEQ ID NO: 512222 - protein, 9 aa, Homo Sapiens
NIQNKKLEM

SEQ ID NO: 512223 - protein, 9 aa, Homo Sapiens
QPHGEARLS

SEQ ID NO: 512224 - protein, 9 aa, Homo Sapiens
LCIDHFRAA

SEQ ID NO: 512225 - protein, 9 aa, Homo Sapiens
AKIQFKTDL

SEQ ID NO: 512226 - protein, 9 aa, Homo Sapiens
LCGLLFLAS

SEQ ID NO: 512227 - protein, 9 aa, Homo Sapiens
RGRGNGRSS

SEQ ID NO: 512228 - protein, 9 aa, Homo Sapiens
GWLPSPEDA

SEQ ID NO: 512229 - protein, 9 aa, Homo Sapiens
GASDGGSPA

SEQ ID NO: 512230 - protein, 9 aa, Homo Sapiens
RRQGEPFNG

SEQ ID NO: 512231 - protein, 9 aa, Homo Sapiens
FYCRNRKWY

SEQ ID NO: 512232 - protein, 9 aa, Homo Sapiens
LADAMHIPQ

SEQ ID NO: 512233 - protein, 9 aa, Homo Sapiens
WEYRNLTQC

SEQ ID NO: 512234 - protein, 9 aa, Homo Sapiens
DVITASKAA

SEQ ID NO: 512235 - protein, 9 aa, Homo Sapiens
DRTVELVNT

SEQ ID NO: 512236 - protein, 9 aa, Homo Sapiens
ASDAAQLQA

SEQ ID NO: 512237 - protein, 9 aa, Homo Sapiens
GGRRRRGRA

SEQ ID NO: 512238 - protein, 9 aa, Homo Sapiens
MTINDDSAK

SEQ ID NO: 512239 - protein, 9 aa, Homo Sapiens
ASGVGICSS

SEQ ID NO: 512240 - protein, 9 aa, Homo Sapiens
LRTRELYFH

SEQ ID NO: 512241 - protein, 9 aa, Homo Sapiens
HLHSTNRLL

SEQ ID NO: 512242 - protein, 9 aa, Homo Sapiens
HIWDEVKCR

SEQ ID NO: 512243 - protein, 9 aa, Homo Sapiens
KLYEIGAWT

SEQ ID NO: 512244 - protein, 9 aa, Homo Sapiens
IFWTNEMFI

SEQ ID NO: 512245 - protein, 9 aa, Homo Sapiens
LAAANNCLR

SEQ ID NO: 512246 - protein, 9 aa, Homo Sapiens
LAGMESLLN

SEQ ID NO: 512247 - protein, 9 aa, Homo Sapiens
EAFGLGDLR

SEQ ID NO: 512248 - protein, 9 aa, Homo Sapiens
GERGFQKER

SEQ ID NO: 512249 - protein, 9 aa, Homo Sapiens
TPLKLAGWQ

SEQ ID NO: 512250 - protein, 9 aa, Homo Sapiens
SNSNLSSTS

SEQ ID NO: 512251 - protein, 9 aa, Homo Sapiens
CEETMLVEE

SEQ ID NO: 512252 - protein, 9 aa, Homo Sapiens
YESIRVPSE

SEQ ID NO: 512253 - protein, 9 aa, Homo Sapiens
HYTSRDNMR

SEQ ID NO: 512254 - protein, 9 aa, Homo Sapiens
VTVQPGCYL

SEQ ID NO: 512255 - protein, 9 aa, Homo Sapiens
CSVGRGDRP

SEQ ID NO: 512256 - protein, 9 aa, Homo Sapiens
NYYTKEEAK

SEQ ID NO: 512257 - protein, 9 aa, Homo Sapiens
VLLVIAEKG

SEQ ID NO: 512258 - protein, 9 aa, Homo Sapiens
QFSGGSFKG

SEQ ID NO: 512259 - protein, 9 aa, Homo Sapiens
CVENEVAEG

SEQ ID NO: 512260 - protein, 9 aa, Homo Sapiens
ASTSPRPKP

SEQ ID NO: 512261 - protein, 9 aa, Homo Sapiens
MLVEEIHLC

SEQ ID NO: 512262 - protein, 9 aa, Homo Sapiens
QKLQTLYIG

SEQ ID NO: 512263 - protein, 9 aa, Homo Sapiens
LYFHFPKFS

SEQ ID NO: 512264 - protein, 9 aa, Homo Sapiens
LDMATTKTM

SEQ ID NO: 512265 - protein, 9 aa, Homo Sapiens
LKSCKEILN

SEQ ID NO: 512266 - protein, 9 aa, Homo Sapiens
AARASRAAG

SEQ ID NO: 512267 - protein, 9 aa, Homo Sapiens
GLLFLASWM

SEQ ID NO: 512268 - protein, 9 aa, Homo Sapiens
CKNFSIQRG

SEQ ID NO: 512269 - protein, 9 aa, Homo Sapiens
LVKAETASP

SEQ ID NO: 512270 - protein, 9 aa, Homo Sapiens
ADPEVGTPT

SEQ ID NO: 512271 - protein, 9 aa, Homo Sapiens
NLHQIIRKA

SEQ ID NO: 512272 - protein, 9 aa, Homo Sapiens
HGSASCHFS

SEQ ID NO: 512273 - protein, 9 aa, Homo Sapiens
GEIGDEFVP

SEQ ID NO: 512274 - protein, 9 aa, Homo Sapiens
WITGILDPS

SEQ ID NO: 512275 - protein, 9 aa, Homo Sapiens
DNLHFSTKN

SEQ ID NO: 512276 - protein, 9 aa, Homo Sapiens
VPPHRRQGE

SEQ ID NO: 512277 - protein, 9 aa, Homo Sapiens
SLGSGPPLL

SEQ ID NO: 512278 - protein, 9 aa, Homo Sapiens
SPNFVQRLQ

SEQ ID NO: 512279 - protein, 9 aa, Homo Sapiens
LPVDQRVNI

SEQ ID NO: 512280 - protein, 9 aa, Homo Sapiens
SAAIISHGT

SEQ ID NO: 512281 - protein, 9 aa, Homo Sapiens
NGRSSQALG

SEQ ID NO: 512282 - protein, 9 aa, Homo Sapiens
LEVTTDDRL

SEQ ID NO: 512283 - protein, 9 aa, Homo Sapiens
KPAYYFILI

SEQ ID NO: 512284 - protein, 9 aa, Homo Sapiens
PLPFWVSNS

SEQ ID NO: 512285 - protein, 9 aa, Homo Sapiens
LEQKVAGYI

SEQ ID NO: 512286 - protein, 9 aa, Homo Sapiens
LLRTRELYF

SEQ ID NO: 512287 - protein, 9 aa, Homo Sapiens
LTDSNLNDG

SEQ ID NO: 512288 - protein, 9 aa, Homo Sapiens
PNCACEQFR

SEQ ID NO: 512289 - protein, 9 aa, Homo Sapiens
LLAWLQCAE

SEQ ID NO: 512290 - protein, 9 aa, Homo Sapiens
LPGWLPSPE

SEQ ID NO: 512291 - protein, 9 aa, Homo Sapiens
YNAVERINS

SEQ ID NO: 512292 - protein, 9 aa, Homo Sapiens
AQPHGEARL

SEQ ID NO: 512293 - protein, 9 aa, Homo Sapiens
AVTSPSSAS

SEQ ID NO: 512294 - protein, 9 aa, Homo Sapiens
TYSNLSATV

SEQ ID NO: 512295 - protein, 9 aa, Homo Sapiens
EIENRIIAA

SEQ ID NO: 512296 - protein, 9 aa, Homo Sapiens
AQFSEAPAD

SEQ ID NO: 512297 - protein, 9 aa, Homo Sapiens
DEMASCEFT

SEQ ID NO: 512298 - protein, 9 aa, Homo Sapiens
LRYAVLMNH

SEQ ID NO: 512299 - protein, 9 aa, Homo Sapiens
DGGSPALSS

SEQ ID NO: 512300 - protein, 9 aa, Homo Sapiens
LPPHRDSTE

SEQ ID NO: 512301 - protein, 9 aa, Homo Sapiens
AAKATAVAG

SEQ ID NO: 512302 - protein, 9 aa, Homo Sapiens
KMQEGNSAD

SEQ ID NO: 512303 - protein, 9 aa, Homo Sapiens
GPLPGWLPS

SEQ ID NO: 512304 - protein, 9 aa, Homo Sapiens
FSIKMKCLA

SEQ ID NO: 512305 - protein, 9 aa, Homo Sapiens
NMSECETRS

SEQ ID NO: 512306 - protein, 9 aa, Homo Sapiens
QLEQKVAGY

SEQ ID NO: 512307 - protein, 9 aa, Homo Sapiens
FYKIPDNLH

SEQ ID NO: 512308 - protein, 9 aa, Homo Sapiens
GAVQPKALN

SEQ ID NO: 512309 - protein, 9 aa, Homo Sapiens
IDSSLPQLM

SEQ ID NO: 512310 - protein, 9 aa, Homo Sapiens
RPRHSHLTR

SEQ ID NO: 512311 - protein, 9 aa, Homo Sapiens
AMGIDRRSL

SEQ ID NO: 512312 - protein, 9 aa, Homo Sapiens
PVEFSSDVL

SEQ ID NO: 512313 - protein, 9 aa, Homo Sapiens
AAGTTKSRR

SEQ ID NO: 512314 - protein, 9 aa, Homo Sapiens
DVDNCKQIK

SEQ ID NO: 512315 - protein, 9 aa, Homo Sapiens
NLEETRLLH

SEQ ID NO: 512316 - protein, 9 aa, Homo Sapiens
HRPPPWTGL

SEQ ID NO: 512317 - protein, 9 aa, Homo Sapiens
KMILFMVSV

SEQ ID NO: 512318 - protein, 9 aa, Homo Sapiens
FQIPLLLAF

SEQ ID NO: 512319 - protein, 9 aa, Homo Sapiens
AFECQEGGA

SEQ ID NO: 512320 - protein, 9 aa, Homo Sapiens
WLEVTTDDR

SEQ ID NO: 512321 - protein, 9 aa, Homo Sapiens
QFLERKEQI

SEQ ID NO: 512322 - protein, 9 aa, Homo Sapiens
QSHHGQVSY

SEQ ID NO: 512323 - protein, 9 aa, Homo Sapiens
DNCKQIKAD

SEQ ID NO: 512324 - protein, 9 aa, Homo Sapiens
AQENAQVSY

SEQ ID NO: 512325 - protein, 9 aa, Homo Sapiens
AARELRSSL

SEQ ID NO: 512326 - protein, 9 aa, Homo Sapiens
NLLSITADP

SEQ ID NO: 512327 - protein, 9 aa, Homo Sapiens
SDGSGWLGD

SEQ ID NO: 512328 - protein, 9 aa, Homo Sapiens
RVSSLSPEP

SEQ ID NO: 512329 - protein, 9 aa, Homo Sapiens
GTSSNSNLS

SEQ ID NO: 512330 - protein, 9 aa, Homo Sapiens
YTRNKPAYY

SEQ ID NO: 512331 - protein, 9 aa, Homo Sapiens
DAVEKMVSF

SEQ ID NO: 512332 - protein, 9 aa, Homo Sapiens
SLLRTRELY

SEQ ID NO: 512333 - protein, 9 aa, Homo Sapiens
GAHQVLFMM

SEQ ID NO: 512334 - protein, 9 aa, Homo Sapiens
NNCLRELSP

SEQ ID NO: 512335 - protein, 9 aa, Homo Sapiens
RSSPVYVCR

SEQ ID NO: 512336 - protein, 9 aa, Homo Sapiens
SASLLPLLQ

SEQ ID NO: 512337 - protein, 9 aa, Homo Sapiens
FMVSVICIV

SEQ ID NO: 512338 - protein, 9 aa, Homo Sapiens
TGWAARASR

SEQ ID NO: 512339 - protein, 9 aa, Homo Sapiens
RLRTLDVHH

SEQ ID NO: 512340 - protein, 9 aa, Homo Sapiens
VTPLKLAGW

SEQ ID NO: 512341 - protein, 9 aa, Homo Sapiens
CDYNRDWDS

SEQ ID NO: 512342 - protein, 9 aa, Homo Sapiens
VKAETASPN

SEQ ID NO: 512343 - protein, 9 aa, Homo Sapiens
VSVHKEQKL

SEQ ID NO: 512344 - protein, 9 aa, Homo Sapiens
CQCVAWSAA

SEQ ID NO: 512345 - protein, 9 aa, Homo Sapiens
RWLEVTTDD

SEQ ID NO: 512346 - protein, 9 aa, Homo Sapiens
RGQATDIAN

SEQ ID NO: 512347 - protein, 9 aa, Homo Sapiens
SAGASIIQA

SEQ ID NO: 512348 - protein, 9 aa, Homo Sapiens
SNTPFTTSA

SEQ ID NO: 512349 - protein, 9 aa, Homo Sapiens
HSWAHSDGS

SEQ ID NO: 512350 - protein, 9 aa, Homo Sapiens
LSFPIRRDG

SEQ ID NO: 512351 - protein, 9 aa, Homo Sapiens
TDGPETGLS

SEQ ID NO: 512352 - protein, 9 aa, Homo Sapiens
QMPLVAPVV

SEQ ID NO: 512353 - protein, 9 aa, Homo Sapiens
DNHQAHSVF

SEQ ID NO: 512354 - protein, 9 aa, Homo Sapiens
GVKSEFLQN

SEQ ID NO: 512355 - protein, 9 aa, Homo Sapiens
GLFNHTGAH

SEQ ID NO: 512356 - protein, 9 aa, Homo Sapiens
GGGPQAQPH

SEQ ID NO: 512357 - protein, 9 aa, Homo Sapiens
AIPLAVTSP

SEQ ID NO: 512358 - protein, 9 aa, Homo Sapiens
CSMWEKNME

SEQ ID NO: 512359 - protein, 9 aa, Homo Sapiens
AANMMSTAA

SEQ ID NO: 512360 - protein, 9 aa, Homo Sapiens
LHVLDGEGR

SEQ ID NO: 512361 - protein, 9 aa, Homo Sapiens
HSTNRLLSD

SEQ ID NO: 512362 - protein, 9 aa, Homo Sapiens
ATTKTMPET

SEQ ID NO: 512363 - protein, 9 aa, Homo Sapiens
ETMLVEEIH

SEQ ID NO: 512364 - protein, 9 aa, Homo Sapiens
RRRHRHHRP

SEQ ID NO: 512365 - protein, 9 aa, Homo Sapiens
FENEERLPQ

SEQ ID NO: 512366 - protein, 9 aa, Homo Sapiens
SIAANMMST

SEQ ID NO: 512367 - protein, 9 aa, Homo Sapiens
TSSNSNLSS

SEQ ID NO: 512368 - protein, 9 aa, Homo Sapiens
IDSLSSLLN

SEQ ID NO: 512369 - protein, 9 aa, Homo Sapiens
ARLFSQKQH

SEQ ID NO: 512370 - protein, 9 aa, Homo Sapiens
SGMRSTGDY

SEQ ID NO: 512371 - protein, 9 aa, Homo Sapiens
KKLEDLDDL

SEQ ID NO: 512372 - protein, 9 aa, Homo Sapiens
ERGFQKERR

SEQ ID NO: 512373 - protein, 9 aa, Homo Sapiens
EVAEGDEIY

SEQ ID NO: 512374 - protein, 9 aa, Homo Sapiens
LAGWQCPEC

SEQ ID NO: 512375 - protein, 9 aa, Homo Sapiens
EELQHSHIA

SEQ ID NO: 512376 - protein, 9 aa, Homo Sapiens
PKKDETIQH

SEQ ID NO: 512377 - protein, 9 aa, Homo Sapiens
GGSPALSSE

SEQ ID NO: 512378 - protein, 9 aa, Homo Sapiens
LFRRGQFAE

SEQ ID NO: 512379 - protein, 9 aa, Homo Sapiens
SQGNELFRR

SEQ ID NO: 512380 - protein, 9 aa, Homo Sapiens
SLLNDMTKN

SEQ ID NO: 512381 - protein, 9 aa, Homo Sapiens
CSIEGGGPD

SEQ ID NO: 512382 - protein, 9 aa, Homo Sapiens
SGFEREFKP

SEQ ID NO: 512383 - protein, 9 aa, Homo Sapiens
KTRVSSLSP

SEQ ID NO: 512384 - protein, 9 aa, Homo Sapiens
RTGRGARRA

SEQ ID NO: 512385 - protein, 9 aa, Homo Sapiens
GSNLEETRL

SEQ ID NO: 512386 - protein, 9 aa, Homo Sapiens
HHPPQSPAL

SEQ ID NO: 512387 - protein, 9 aa, Homo Sapiens
RSSLLHLTL

SEQ ID NO: 512388 - protein, 9 aa, Homo Sapiens
ERVAEILTD

SEQ ID NO: 512389 - protein, 9 aa, Homo Sapiens
TLKSCGSEL

SEQ ID NO: 512390 - protein, 9 aa, Homo Sapiens
QIMEEVERQ

SEQ ID NO: 512391 - protein, 9 aa, Homo Sapiens
RMLKFWIPL

SEQ ID NO: 512392 - protein, 9 aa, Homo Sapiens
MHIPQLFIQ

SEQ ID NO: 512393 - protein, 9 aa, Homo Sapiens
SIFLSVTPV

SEQ ID NO: 512394 - protein, 9 aa, Homo Sapiens
SNSLINNTH

SEQ ID NO: 512395 - protein, 9 aa, Homo Sapiens
PALIQMQLQ

SEQ ID NO: 512396 - protein, 9 aa, Homo Sapiens
LLWEYVHSW

SEQ ID NO: 512397 - protein, 9 aa, Homo Sapiens
RSRRSATTR

SEQ ID NO: 512398 - protein, 9 aa, Homo Sapiens
SRRSATTRS

SEQ ID NO: 512399 - protein, 9 aa, Homo Sapiens
SCHFSSQGR

SEQ ID NO: 512400 - protein, 9 aa, Homo Sapiens
QIGVKSEFL

SEQ ID NO: 512401 - protein, 9 aa, Homo Sapiens
AFYTALGRL

SEQ ID NO: 512402 - protein, 9 aa, Homo Sapiens
LDSRSGQSH

SEQ ID NO: 512403 - protein, 9 aa, Homo Sapiens
FVDIAYSSS

SEQ ID NO: 512404 - protein, 9 aa, Homo Sapiens
LRKNQRALN

SEQ ID NO: 512405 - protein, 9 aa, Homo Sapiens
VIMMPFQFS

SEQ ID NO: 512406 - protein, 9 aa, Homo Sapiens
GFRGDMGYP

SEQ ID NO: 512407 - protein, 9 aa, Homo Sapiens
VWEGSFSFL

SEQ ID NO: 512408 - protein, 9 aa, Homo Sapiens
LRTLDVHHN

SEQ ID NO: 512409 - protein, 9 aa, Homo Sapiens
KLKARPKPC

SEQ ID NO: 512410 - protein, 9 aa, Homo Sapiens
QAIKCVVLG

SEQ ID NO: 512411 - protein, 9 aa, Homo Sapiens
DIKALQLVY

SEQ ID NO: 512412 - protein, 9 aa, Homo Sapiens
VHYTSRDNM

SEQ ID NO: 512413 - protein, 9 aa, Homo Sapiens
AAQRNDSSC

SEQ ID NO: 512414 - protein, 9 aa, Homo Sapiens
THSEDIPFT

SEQ ID NO: 512415 - protein, 9 aa, Homo Sapiens
EQKLQTLYI

SEQ ID NO: 512416 - protein, 9 aa, Homo Sapiens
VLGGRSDPV

SEQ ID NO: 512417 - protein, 9 aa, Homo Sapiens
YEEELQHSH

SEQ ID NO: 512418 - protein, 9 aa, Homo Sapiens
VHGTLVYIR

SEQ ID NO: 512419 - protein, 9 aa, Homo Sapiens
RQGEPFNGQ

SEQ ID NO: 512420 - protein, 9 aa, Homo Sapiens
LASQGTGIK

SEQ ID NO: 512421 - protein, 9 aa, Homo Sapiens
LGYTLKSCG

SEQ ID NO: 512422 - protein, 9 aa, Homo Sapiens
NMMSTAAIA

SEQ ID NO: 512423 - protein, 9 aa, Homo Sapiens
ASCEFTTCE

SEQ ID NO: 512424 - protein, 9 aa, Homo Sapiens
FLDNHQAHS

SEQ ID NO: 512425 - protein, 9 aa, Homo Sapiens
SGFGAASGV

SEQ ID NO: 512426 - protein, 9 aa, Homo Sapiens
KLEMLLHSM

SEQ ID NO: 512427 - protein, 9 aa, Homo Sapiens
ILTDSNLND

SEQ ID NO: 512428 - protein, 9 aa, Homo Sapiens
FHTLSLDHN

SEQ ID NO: 512429 - protein, 9 aa, Homo Sapiens
DADAQENAQ

SEQ ID NO: 512430 - protein, 9 aa, Homo Sapiens
KLTIGCQRF

SEQ ID NO: 512431 - protein, 9 aa, Homo Sapiens
GYPGFGGEK

SEQ ID NO: 512432 - protein, 9 aa, Homo Sapiens
ANDYTLSFW

SEQ ID NO: 512433 - protein, 9 aa, Homo Sapiens
ARPKPCAGN

SEQ ID NO: 512434 - protein, 9 aa, Homo Sapiens
RGARRARRR

SEQ ID NO: 512435 - protein, 9 aa, Homo Sapiens
VYDRVSFSS

SEQ ID NO: 512436 - protein, 9 aa, Homo Sapiens
TASGGEAGT

SEQ ID NO: 512437 - protein, 9 aa, Homo Sapiens
LTAELSLMA

SEQ ID NO: 512438 - protein, 9 aa, Homo Sapiens
DNMRKRHYW

SEQ ID NO: 512439 - protein, 9 aa, Homo Sapiens
VAEILTDSN

SEQ ID NO: 512440 - protein, 9 aa, Homo Sapiens
SLLPLLQRF

SEQ ID NO: 512441 - protein, 9 aa, Homo Sapiens
LAEISIMTT

SEQ ID NO: 512442 - protein, 9 aa, Homo Sapiens
TASLPPHRD

SEQ ID NO: 512443 - protein, 9 aa, Homo Sapiens
TEEAITLPK

SEQ ID NO: 512444 - protein, 9 aa, Homo Sapiens
RGAPRPPTT

SEQ ID NO: 512445 - protein, 9 aa, Homo Sapiens
VRAGGRACQ

SEQ ID NO: 512446 - protein, 9 aa, Homo Sapiens
GQAMVHAPQ

SEQ ID NO: 512447 - protein, 9 aa, Homo Sapiens
RILQQQHSQ

SEQ ID NO: 512448 - protein, 9 aa, Homo Sapiens
RSLDLNSIF

SEQ ID NO: 512449 - protein, 9 aa, Homo Sapiens
AFGLGDLRN

SEQ ID NO: 512450 - protein, 9 aa, Homo Sapiens
DLNSSEEYD

SEQ ID NO: 512451 - protein, 9 aa, Homo Sapiens
IPQLGVTSS

SEQ ID NO: 512452 - protein, 9 aa, Homo Sapiens
EKAFSRSLD

SEQ ID NO: 512453 - protein, 9 aa, Homo Sapiens
TLPVYCVNV

SEQ ID NO: 512454 - protein, 9 aa, Homo Sapiens
GEIENRIIA

SEQ ID NO: 512455 - protein, 9 aa, Homo Sapiens
ASAFTPTDG

SEQ ID NO: 512456 - protein, 9 aa, Homo Sapiens
GAYAFECQE

SEQ ID NO: 512457 - protein, 9 aa, Homo Sapiens
SATVCQPGA

SEQ ID NO: 512458 - protein, 9 aa, Homo Sapiens
CNLTLLTCE

SEQ ID NO: 512459 - protein, 9 aa, Homo Sapiens
HLIGHSFGA

SEQ ID NO: 512460 - protein, 9 aa, Homo Sapiens
MAAKATAVA

SEQ ID NO: 512461 - protein, 9 aa, Homo Sapiens
PADLDASEP

SEQ ID NO: 512462 - protein, 9 aa, Homo Sapiens
DICQRGLTS

SEQ ID NO: 512463 - protein, 9 aa, Homo Sapiens
YRNLTQCSE

SEQ ID NO: 512464 - protein, 9 aa, Homo Sapiens
STNMTPQHP

SEQ ID NO: 512465 - protein, 9 aa, Homo Sapiens
DSRSGQSHH

SEQ ID NO: 512466 - protein, 9 aa, Homo Sapiens
DAMHIPQLF

SEQ ID NO: 512467 - protein, 9 aa, Homo Sapiens
VVCTPAGGL

SEQ ID NO: 512468 - protein, 9 aa, Homo Sapiens
LPQAVELLG

SEQ ID NO: 512469 - protein, 9 aa, Homo Sapiens
SSIAANMMS

SEQ ID NO: 512470 - protein, 9 aa, Homo Sapiens
RSTGDYSAT

SEQ ID NO: 512471 - protein, 9 aa, Homo Sapiens
GQAIPLAVT

SEQ ID NO: 512472 - protein, 9 aa, Homo Sapiens
LFLDRVYCI

SEQ ID NO: 512473 - protein, 9 aa, Homo Sapiens
SVSSSAPEI

SEQ ID NO: 512474 - protein, 9 aa, Homo Sapiens
VFNDLSQKL

SEQ ID NO: 512475 - protein, 9 aa, Homo Sapiens
ENSTEPSER

SEQ ID NO: 512476 - protein, 9 aa, Homo Sapiens
GGERGFQKE

SEQ ID NO: 512477 - protein, 9 aa, Homo Sapiens
SFGAHLAGE

SEQ ID NO: 512478 - protein, 9 aa, Homo Sapiens
RWEYRNLTQ

SEQ ID NO: 512479 - protein, 9 aa, Homo Sapiens
SNDSTYSNL

SEQ ID NO: 512480 - protein, 9 aa, Homo Sapiens
ICQRGLTSP

SEQ ID NO: 512481 - protein, 9 aa, Homo Sapiens
WCQCVAWSA

SEQ ID NO: 512482 - protein, 9 aa, Homo Sapiens
KGVTLKTKS

SEQ ID NO: 512483 - protein, 9 aa, Homo Sapiens
ACEQFRCGN

SEQ ID NO: 512484 - protein, 9 aa, Homo Sapiens
ISSMDQEKV

SEQ ID NO: 512485 - protein, 9 aa, Homo Sapiens
RTVELVNTW

SEQ ID NO: 512486 - protein, 9 aa, Homo Sapiens
LNSSEEYDT

SEQ ID NO: 512487 - protein, 9 aa, Homo Sapiens
RDPLGAPGG

SEQ ID NO: 512488 - protein, 9 aa, Homo Sapiens
ARSAFRPLR

SEQ ID NO: 512489 - protein, 9 aa, Homo Sapiens
ARASRAAGR

SEQ ID NO: 512490 - protein, 9 aa, Homo Sapiens
PETGLSAID

SEQ ID NO: 512491 - protein, 9 aa, Homo Sapiens
KRPFQEELP

SEQ ID NO: 512492 - protein, 9 aa, Homo Sapiens
DPCVRWEYR

SEQ ID NO: 512493 - protein, 9 aa, Homo Sapiens
RDWDSYRSP

SEQ ID NO: 512494 - protein, 9 aa, Homo Sapiens
TVIEYSGSY

SEQ ID NO: 512495 - protein, 9 aa, Homo Sapiens
SLSSLLNDM

SEQ ID NO: 512496 - protein, 9 aa, Homo Sapiens
RLLHEKSLK

SEQ ID NO: 512497 - protein, 9 aa, Homo Sapiens
WAHSDGSGW

SEQ ID NO: 512498 - protein, 9 aa, Homo Sapiens
GEGVEETFC

SEQ ID NO: 512499 - protein, 9 aa, Homo Sapiens
PPWTGLKRT

SEQ ID NO: 512500 - protein, 9 aa, Homo Sapiens
ATKKRADKI

SEQ ID NO: 512501 - protein, 9 aa, Homo Sapiens
TAGPASAFT

SEQ ID NO: 512502 - protein, 9 aa, Homo Sapiens
KLAGWQCPE

SEQ ID NO: 512503 - protein, 9 aa, Homo Sapiens
VSLVDVDIC

SEQ ID NO: 512504 - protein, 9 aa, Homo Sapiens
NKPAYYFIL

SEQ ID NO: 512505 - protein, 9 aa, Homo Sapiens
APRPPTTTR

SEQ ID NO: 512506 - protein, 9 aa, Homo Sapiens
FLKLQIQEE

SEQ ID NO: 512507 - protein, 9 aa, Homo Sapiens
IVIIKKKVD

SEQ ID NO: 512508 - protein, 9 aa, Homo Sapiens
LLVIAEKGL

SEQ ID NO: 512509 - protein, 9 aa, Homo Sapiens
ALLAWLQCA

SEQ ID NO: 512510 - protein, 9 aa, Homo Sapiens
DRDQCILSG

SEQ ID NO: 512511 - protein, 9 aa, Homo Sapiens
NPEKKYHIW

SEQ ID NO: 512512 - protein, 9 aa, Homo Sapiens
GWAARASRA

SEQ ID NO: 512513 - protein, 9 aa, Homo Sapiens
IGDEFVPRV

SEQ ID NO: 512514 - protein, 9 aa, Homo Sapiens
VIAFYCRNR

SEQ ID NO: 512515 - protein, 9 aa, Homo Sapiens
FLQNLGRMY

SEQ ID NO: 512516 - protein, 9 aa, Homo Sapiens
DIAVTPLKL

SEQ ID NO: 512517 - protein, 9 aa, Homo Sapiens
GASIIQAGT

SEQ ID NO: 512518 - protein, 9 aa, Homo Sapiens
RKNQRALNL

SEQ ID NO: 512519 - protein, 9 aa, Homo Sapiens
LVRESETFA

SEQ ID NO: 512520 - protein, 9 aa, Homo Sapiens
PAPVVPMTE

SEQ ID NO: 512521 - protein, 9 aa, Homo Sapiens
NLTLLTCES

SEQ ID NO: 512522 - protein, 9 aa, Homo Sapiens
KLEDLDDLR

SEQ ID NO: 512523 - protein, 9 aa, Homo Sapiens
PPLLTAQYN

SEQ ID NO: 512524 - protein, 9 aa, Homo Sapiens
QAGTSESYK

SEQ ID NO: 512525 - protein, 9 aa, Homo Sapiens
RACQQGLHS

SEQ ID NO: 512526 - protein, 9 aa, Homo Sapiens
ARRARRRTA

SEQ ID NO: 512527 - protein, 9 aa, Homo Sapiens
GSPDGPPEN

SEQ ID NO: 512528 - protein, 9 aa, Homo Sapiens
QGTSASLLP

SEQ ID NO: 512529 - protein, 9 aa, Homo Sapiens
RPEKSVNKK

SEQ ID NO: 512530 - protein, 9 aa, Homo Sapiens
PRRGAPRPP

SEQ ID NO: 512531 - protein, 9 aa, Homo Sapiens
YEKAFSRSL

SEQ ID NO: 512532 - protein, 9 aa, Homo Sapiens
KETVLCRES

SEQ ID NO: 512533 - protein, 9 aa, Homo Sapiens
HNMKKWDPP

SEQ ID NO: 512534 - protein, 9 aa, Homo Sapiens
KGRGRVREK

SEQ ID NO: 512535 - protein, 9 aa, Homo Sapiens
GRSDPVEFS

SEQ ID NO: 512536 - protein, 9 aa, Homo Sapiens
KCQLHVLDG

SEQ ID NO: 512537 - protein, 9 aa, Homo Sapiens
FNGPVIMLK

SEQ ID NO: 512538 - protein, 9 aa, Homo Sapiens
HFRAATNVQ

SEQ ID NO: 512539 - protein, 9 aa, Homo Sapiens
YVCRVVSGM

SEQ ID NO: 512540 - protein, 9 aa, Homo Sapiens
NKIPFSSAS

SEQ ID NO: 512541 - protein, 9 aa, Homo Sapiens
DVFLHETLL

SEQ ID NO: 512542 - protein, 9 aa, Homo Sapiens
KIQFKTDLS

SEQ ID NO: 512543 - protein, 9 aa, Homo Sapiens
HQRILQQQH

SEQ ID NO: 512544 - protein, 9 aa, Homo Sapiens
CCSRRRHRH

SEQ ID NO: 512545 - protein, 9 aa, Homo Sapiens
FSSQKVLLV

SEQ ID NO: 512546 - protein, 9 aa, Homo Sapiens
CRTAFYTAL

SEQ ID NO: 512547 - protein, 9 aa, Homo Sapiens
LPSSAARCM

SEQ ID NO: 512548 - protein, 9 aa, Homo Sapiens
GIVIIKKKV

SEQ ID NO: 512549 - protein, 9 aa, Homo Sapiens
GTGDSTFSW

SEQ ID NO: 512550 - protein, 9 aa, Homo Sapiens
DAVVNAANA

SEQ ID NO: 512551 - protein, 9 aa, Homo Sapiens
SPTTAPKVL

SEQ ID NO: 512552 - protein, 9 aa, Homo Sapiens
SRLRTLDVH

SEQ ID NO: 512553 - protein, 9 aa, Homo Sapiens
VHLIGHSFG

SEQ ID NO: 512554 - protein, 9 aa, Homo Sapiens
ASRDVISYY

SEQ ID NO: 512555 - protein, 9 aa, Homo Sapiens
DSSLPQLMA

SEQ ID NO: 512556 - protein, 9 aa, Homo Sapiens
VKNFDRTVE

SEQ ID NO: 512557 - protein, 9 aa, Homo Sapiens
QFKTDLSLR

SEQ ID NO: 512558 - protein, 9 aa, Homo Sapiens
VIIKKKVDF

SEQ ID NO: 512559 - protein, 9 aa, Homo Sapiens
TRRRRAPAP

SEQ ID NO: 512560 - protein, 9 aa, Homo Sapiens
CVVLGDGAV

SEQ ID NO: 512561 - protein, 9 aa, Homo Sapiens
NDSTYSNLS

SEQ ID NO: 512562 - protein, 9 aa, Homo Sapiens
GRARAARTG

SEQ ID NO: 512563 - protein, 9 aa, Homo Sapiens
SEDIPFTCP

SEQ ID NO: 512564 - protein, 9 aa, Homo Sapiens
ISRTFIIQS

SEQ ID NO: 512565 - protein, 9 aa, Homo Sapiens
STNRLLSDP

SEQ ID NO: 512566 - protein, 9 aa, Homo Sapiens
NTHGFMNFS

SEQ ID NO: 512567 - protein, 9 aa, Homo Sapiens
AVTYLSGVS

SEQ ID NO: 512568 - protein, 9 aa, Homo Sapiens
QAQPHGEAR

SEQ ID NO: 512569 - protein, 9 aa, Homo Sapiens
VSTLEKIVE

SEQ ID NO: 512570 - protein, 9 aa, Homo Sapiens
QLHVLDGEG

SEQ ID NO: 512571 - protein, 9 aa, Homo Sapiens
WDSYRSPWS

SEQ ID NO: 512572 - protein, 9 aa, Homo Sapiens
ITRFIATLR

SEQ ID NO: 512573 - protein, 9 aa, Homo Sapiens
DDPNFQIPL

SEQ ID NO: 512574 - protein, 9 aa, Homo Sapiens
LLEVDAVVN

SEQ ID NO: 512575 - protein, 9 aa, Homo Sapiens
SNLEETRLL

SEQ ID NO: 512576 - protein, 9 aa, Homo Sapiens
ERKMYSLLE

SEQ ID NO: 512577 - protein, 9 aa, Homo Sapiens
THSLSDKSN

SEQ ID NO: 512578 - protein, 9 aa, Homo Sapiens
NQRALNLGT

SEQ ID NO: 512579 - protein, 9 aa, Homo Sapiens
ALNLGTLSA

SEQ ID NO: 512580 - protein, 9 aa, Homo Sapiens
AASGVGICS

SEQ ID NO: 512581 - protein, 9 aa, Homo Sapiens
MQAIKCVVL

SEQ ID NO: 512582 - protein, 9 aa, Homo Sapiens
LERKGHAYK

SEQ ID NO: 512583 - protein, 9 aa, Homo Sapiens
NMRKRHYWR

SEQ ID NO: 512584 - protein, 9 aa, Homo Sapiens
DGANPWLIS

SEQ ID NO: 512585 - protein, 9 aa, Homo Sapiens
SSLPRQSKK

SEQ ID NO: 512586 - protein, 9 aa, Homo Sapiens
TNLSTLPFL

SEQ ID NO: 512587 - protein, 9 aa, Homo Sapiens
RCSLIPEKQ

SEQ ID NO: 512588 - protein, 9 aa, Homo Sapiens
KPYSPPFFS

SEQ ID NO: 512589 - protein, 9 aa, Homo Sapiens
QVTLLATAN

SEQ ID NO: 512590 - protein, 9 aa, Homo Sapiens
EATSTISPL

SEQ ID NO: 512591 - protein, 9 aa, Homo Sapiens
QSKKNASSV

SEQ ID NO: 512592 - protein, 9 aa, Homo Sapiens
TKQEKDFLW

SEQ ID NO: 512593 - protein, 9 aa, Homo Sapiens
ASLRHQQVT

SEQ ID NO: 512594 - protein, 9 aa, Homo Sapiens
NTETYTFTI

SEQ ID NO: 512595 - protein, 9 aa, Homo Sapiens
GIQDQHMDE

SEQ ID NO: 512596 - protein, 9 aa, Homo Sapiens
DRKYLGLKE

SEQ ID NO: 512597 - protein, 9 aa, Homo Sapiens
EIHDNRCSL

SEQ ID NO: 512598 - protein, 9 aa, Homo Sapiens
ALEKKHEAI

SEQ ID NO: 512599 - protein, 9 aa, Homo Sapiens
EHLRQLKGQ

SEQ ID NO: 512600 - protein, 9 aa, Homo Sapiens
HQKSMDMNN

SEQ ID NO: 512601 - protein, 9 aa, Homo Sapiens
LPFLAFKHL

SEQ ID NO: 512602 - protein, 9 aa, Homo Sapiens
NKMMPETSS

SEQ ID NO: 512603 - protein, 9 aa, Homo Sapiens
KEHQKSMDM

SEQ ID NO: 512604 - protein, 9 aa, Homo Sapiens
SASYGRHGS

SEQ ID NO: 512605 - protein, 9 aa, Homo Sapiens
NLSTLPFLA

SEQ ID NO: 512606 - protein, 9 aa, Homo Sapiens
SKKNASSVS

SEQ ID NO: 512607 - protein, 9 aa, Homo Sapiens
AMCRDVDKC

SEQ ID NO: 512608 - protein, 9 aa, Homo Sapiens
DMVELMGIQ

SEQ ID NO: 512609 - protein, 9 aa, Homo Sapiens
DKCADGQQD

SEQ ID NO: 512610 - protein, 9 aa, Homo Sapiens
KNTETYTFT

SEQ ID NO: 512611 - protein, 9 aa, Homo Sapiens
QEVVSHTSQ

SEQ ID NO: 512612 - protein, 9 aa, Homo Sapiens
QLKGQLEEK

SEQ ID NO: 512613 - protein, 9 aa, Homo Sapiens
VDKCADGQQ

SEQ ID NO: 512614 - protein, 9 aa, Homo Sapiens
SGQEVVSHT

SEQ ID NO: 512615 - protein, 9 aa, Homo Sapiens
SSQCAPAHK

SEQ ID NO: 512616 - protein, 9 aa, Homo Sapiens
PWLISSCDA

SEQ ID NO: 512617 - protein, 9 aa, Homo Sapiens
HKPYSPPFF

SEQ ID NO: 512618 - protein, 9 aa, Homo Sapiens
CSLIPEKQD

SEQ ID NO: 512619 - protein, 9 aa, Homo Sapiens
YSSLPRQSK

SEQ ID NO: 512620 - protein, 9 aa, Homo Sapiens
GHYYTLDDM

SEQ ID NO: 512621 - protein, 9 aa, Homo Sapiens
SQCAPAHKP

SEQ ID NO: 512622 - protein, 9 aa, Homo Sapiens
LRQLKGQLE

SEQ ID NO: 512623 - protein, 9 aa, Homo Sapiens
RDVDKCADG

SEQ ID NO: 512624 - protein, 9 aa, Homo Sapiens
AHKPYSPPF

SEQ ID NO: 512625 - protein, 9 aa, Homo Sapiens
LSTLPFLAF

SEQ ID NO: 512626 - protein, 9 aa, Homo Sapiens
KYLGLKELH

SEQ ID NO: 512627 - protein, 9 aa, Homo Sapiens
MCRDVDKCA

SEQ ID NO: 512628 - protein, 9 aa, Homo Sapiens
VLTWSGQEV

SEQ ID NO: 512629 - protein, 9 aa, Homo Sapiens
ETYTFTISQ

SEQ ID NO: 512630 - protein, 9 aa, Homo Sapiens
LMGIQDQHM

SEQ ID NO: 512631 - protein, 9 aa, Homo Sapiens
NRCSLIPEK

SEQ ID NO: 512632 - protein, 9 aa, Homo Sapiens
QSASYGRHG

SEQ ID NO: 512633 - protein, 9 aa, Homo Sapiens
DQRLDVLEE

SEQ ID NO: 512634 - protein, 9 aa, Homo Sapiens
AVLSAPGLH

SEQ ID NO: 512635 - protein, 9 aa, Homo Sapiens
SAPGLHGFR

SEQ ID NO: 512636 - protein, 9 aa, Homo Sapiens
GLHGFRILG

SEQ ID NO: 512637 - protein, 9 aa, Homo Sapiens
PRQSKKNAS

SEQ ID NO: 512638 - protein, 9 aa, Homo Sapiens
TDRKYLGLK

SEQ ID NO: 512639 - protein, 9 aa, Homo Sapiens
TISPLGAFG

SEQ ID NO: 512640 - protein, 9 aa, Homo Sapiens
EHQKSMDMN

SEQ ID NO: 512641 - protein, 9 aa, Homo Sapiens
QKSMDMNNP

SEQ ID NO: 512642 - protein, 9 aa, Homo Sapiens
PTTAALEKK

SEQ ID NO: 512643 - protein, 9 aa, Homo Sapiens
DPLSEITKQ

SEQ ID NO: 512644 - protein, 9 aa, Homo Sapiens
LDELIKNTE

SEQ ID NO: 512645 - protein, 9 aa, Homo Sapiens
STLPFLAFK

SEQ ID NO: 512646 - protein, 9 aa, Homo Sapiens
WLISSCDAF

SEQ ID NO: 512647 - protein, 9 aa, Homo Sapiens
LENNDQRLD

SEQ ID NO: 512648 - protein, 9 aa, Homo Sapiens
VKEHQKSMD

SEQ ID NO: 512649 - protein, 9 aa, Homo Sapiens
VADGANPWL

SEQ ID NO: 512650 - protein, 9 aa, Homo Sapiens
EEHLRQLKG

SEQ ID NO: 512651 - protein, 9 aa, Homo Sapiens
APAHKPYSP

SEQ ID NO: 512652 - protein, 9 aa, Homo Sapiens
KGQLEEKNQ

SEQ ID NO: 512653 - protein, 9 aa, Homo Sapiens
SGSGQSASY

SEQ ID NO: 512654 - protein, 9 aa, Homo Sapiens
MGIQDQHMD

SEQ ID NO: 512655 - protein, 9 aa, Homo Sapiens
KKHEAITKV

SEQ ID NO: 512656 - protein, 9 aa, Homo Sapiens
PAHKPYSPP

SEQ ID NO: 512657 - protein, 9 aa, Homo Sapiens
APGLHGFRI

SEQ ID NO: 512658 - protein, 9 aa, Homo Sapiens
NDQRLDVLE

SEQ ID NO: 512659 - protein, 9 aa, Homo Sapiens
SPLGAFGLF

SEQ ID NO: 512660 - protein, 9 aa, Homo Sapiens
VELMGIQDQ

SEQ ID NO: 512661 - protein, 9 aa, Homo Sapiens
ADGANPWLI

SEQ ID NO: 512662 - protein, 9 aa, Homo Sapiens
DELIKNTET

SEQ ID NO: 512663 - protein, 9 aa, Homo Sapiens
QCAPAHKPY

SEQ ID NO: 512664 - protein, 9 aa, Homo Sapiens
TNTNLSTLP

SEQ ID NO: 512665 - protein, 9 aa, Homo Sapiens
KTDGHYYTL

SEQ ID NO: 512666 - protein, 9 aa, Homo Sapiens
IEEHLRQLK

SEQ ID NO: 512667 - protein, 9 aa, Homo Sapiens
TLLATANGT

SEQ ID NO: 512668 - protein, 9 aa, Homo Sapiens
SLPRQSKKN

SEQ ID NO: 512669 - protein, 9 aa, Homo Sapiens
VLGGCNLEF

SEQ ID NO: 512670 - protein, 9 aa, Homo Sapiens
LSEITKQEK

SEQ ID NO: 512671 - protein, 9 aa, Homo Sapiens
IHDNRCSLI

SEQ ID NO: 512672 - protein, 9 aa, Homo Sapiens
KMMPETSSG

SEQ ID NO: 512673 - protein, 9 aa, Homo Sapiens
GSGSGQSAS

SEQ ID NO: 512674 - protein, 9 aa, Homo Sapiens
SDCQLTDRK

SEQ ID NO: 512675 - protein, 9 aa, Homo Sapiens
NTNLSTLPF

SEQ ID NO: 512676 - protein, 9 aa, Homo Sapiens
DGHYYTLDD

SEQ ID NO: 512677 - protein, 9 aa, Homo Sapiens
HDNRCSLIP

SEQ ID NO: 512678 - protein, 9 aa, Homo Sapiens
LPRQSKKNA

SEQ ID NO: 512679 - protein, 9 aa, Homo Sapiens
DCQLTDRKY

SEQ ID NO: 512680 - protein, 9 aa, Homo Sapiens
LGAFGLFSS

SEQ ID NO: 512681 - protein, 9 aa, Homo Sapiens
VTLLATANG

SEQ ID NO: 512682 - protein, 9 aa, Homo Sapiens
SNEANKMMP

SEQ ID NO: 512683 - protein, 9 aa, Homo Sapiens
GQEVVSHTS

SEQ ID NO: 512684 - protein, 9 aa, Homo Sapiens
ERDPVLGGC

SEQ ID NO: 512685 - protein, 9 aa, Homo Sapiens
PCDSNEANK

SEQ ID NO: 512686 - protein, 9 aa, Homo Sapiens
RGSGSGQSA

SEQ ID NO: 512687 - protein, 9 aa, Homo Sapiens
RDPLSEITK

SEQ ID NO: 512688 - protein, 9 aa, Homo Sapiens
LTDRKYLGL

SEQ ID NO: 512689 - protein, 9 aa, Homo Sapiens
RLDVLEEET

SEQ ID NO: 512690 - protein, 9 aa, Homo Sapiens
ATSTISPLG

SEQ ID NO: 512691 - protein, 9 aa, Homo Sapiens
LDVLEEETN

SEQ ID NO: 512692 - protein, 9 aa, Homo Sapiens
TDGHYYTLD

SEQ ID NO: 512693 - protein, 9 aa, Homo Sapiens
DVDKCADGQ

SEQ ID NO: 512694 - protein, 9 aa, Homo Sapiens
NPWLISSCD

SEQ ID NO: 512695 - protein, 9 aa, Homo Sapiens
LEKVKEHQK

SEQ ID NO: 512696 - protein, 9 aa, Homo Sapiens
WSGQEVVSH

SEQ ID NO: 512697 - protein, 9 aa, Homo Sapiens
RHQQVTLLA

SEQ ID NO: 512698 - protein, 9 aa, Homo Sapiens
DSNEANKMM

SEQ ID NO: 512699 - protein, 9 aa, Homo Sapiens
LISSCDAFL

SEQ ID NO: 512700 - protein, 9 aa, Homo Sapiens
EKKHEAITK

SEQ ID NO: 512701 - protein, 9 aa, Homo Sapiens
GSGQSASYG

SEQ ID NO: 512702 - protein, 9 aa, Homo Sapiens
EANKMMPET

SEQ ID NO: 512703 - protein, 9 aa, Homo Sapiens
ASYGRHGSG

SEQ ID NO: 512704 - protein, 9 aa, Homo Sapiens
IKNTETYTF

SEQ ID NO: 512705 - protein, 9 aa, Homo Sapiens
ENNDQRLDV

SEQ ID NO: 512706 - protein, 9 aa, Homo Sapiens
GDMVELMGI

SEQ ID NO: 512707 - protein, 9 aa, Homo Sapiens
TSTISPLGA

SEQ ID NO: 512708 - protein, 9 aa, Homo Sapiens
QLTDRKYLG

SEQ ID NO: 512709 - protein, 9 aa, Homo Sapiens
HQQVTLLAT

SEQ ID NO: 512710 - protein, 9 aa, Homo Sapiens
SEITKQEKD

SEQ ID NO: 512711 - protein, 9 aa, Homo Sapiens
LKGQLEEKN

SEQ ID NO: 512712 - protein, 9 aa, Homo Sapiens
KFMGKTDGH

SEQ ID NO: 512713 - protein, 9 aa, Homo Sapiens
CDSNEANKM

SEQ ID NO: 512714 - protein, 9 aa, Homo Sapiens
RQLKGQLEE

SEQ ID NO: 512715 - protein, 9 aa, Homo Sapiens
TTAALEKKH

SEQ ID NO: 512716 - protein, 9 aa, Homo Sapiens
YSERDPVLG

SEQ ID NO: 512717 - protein, 9 aa, Homo Sapiens
RDPVLGGCN

SEQ ID NO: 512718 - protein, 9 aa, Homo Sapiens
RKYLGLKEL

SEQ ID NO: 512719 - protein, 9 aa, Homo Sapiens
MGKTDGHYY

SEQ ID NO: 512720 - protein, 9 aa, Homo Sapiens
LHGFRILGL

SEQ ID NO: 512721 - protein, 9 aa, Homo Sapiens
KKNASSVSQ

SEQ ID NO: 512722 - protein, 9 aa, Homo Sapiens
CQLTDRKYL

SEQ ID NO: 512723 - protein, 9 aa, Homo Sapiens
TAALEKKHE

SEQ ID NO: 512724 - protein, 9 aa, Homo Sapiens
LTWSGQEVV

SEQ ID NO: 512725 - protein, 9 aa, Homo Sapiens
PLGAFGLFS

SEQ ID NO: 512726 - protein, 9 aa, Homo Sapiens
DPVLGGCNL

SEQ ID NO: 512727 - protein, 9 aa, Homo Sapiens
PLSEITKQE

SEQ ID NO: 512728 - protein, 9 aa, Homo Sapiens
STISPLGAF

SEQ ID NO: 512729 - protein, 9 aa, Homo Sapiens
GAMCRDVDK

SEQ ID NO: 512730 - protein, 9 aa, Homo Sapiens
LIKNTETYT

SEQ ID NO: 512731 - protein, 9 aa, Homo Sapiens
CRDVDKCAD

SEQ ID NO: 512732 - protein, 9 aa, Homo Sapiens
ELMGIQDQH

SEQ ID NO: 512733 - protein, 9 aa, Homo Sapiens
CAPAHKPYS

SEQ ID NO: 512734 - protein, 9 aa, Homo Sapiens
EKVKEHQKS

SEQ ID NO: 512735 - protein, 9 aa, Homo Sapiens
IQDQHMDER

SEQ ID NO: 512736 - protein, 9 aa, Homo Sapiens
KCADGQQDC

SEQ ID NO: 512737 - protein, 9 aa, Homo Sapiens
SLIPEKQDI

SEQ ID NO: 512738 - protein, 9 aa, Homo Sapiens
RQSKKNASS

SEQ ID NO: 512739 - protein, 9 aa, Homo Sapiens
NEANKMMPE

SEQ ID NO: 512740 - protein, 9 aa, Homo Sapiens
SYSERDPVL

SEQ ID NO: 512741 - protein, 9 aa, Homo Sapiens
KSMDMNNPQ

SEQ ID NO: 512742 - protein, 9 aa, Homo Sapiens
GQSASYGRH

SEQ ID NO: 512743 - protein, 9 aa, Homo Sapiens
DVLEEETNK

SEQ ID NO: 512744 - protein, 9 aa, Homo Sapiens
MVELMGIQD

SEQ ID NO: 512745 - protein, 9 aa, Homo Sapiens
VTNTNLSTL

SEQ ID NO: 512746 - protein, 9 aa, Homo Sapiens
ITKQEKDFL

SEQ ID NO: 512747 - protein, 9 aa, Homo Sapiens
LEIHDNRCS

SEQ ID NO: 512748 - protein, 9 aa, Homo Sapiens
QQVTLLATA

SEQ ID NO: 512749 - protein, 9 aa, Homo Sapiens
HLRQLKGQL

SEQ ID NO: 512750 - protein, 9 aa, Homo Sapiens
HYYTLDDMF

SEQ ID NO: 512751 - protein, 9 aa, Homo Sapiens
LRHQQVTLL

SEQ ID NO: 512752 - protein, 9 aa, Homo Sapiens
KHEAITKVK

SEQ ID NO: 512753 - protein, 9 aa, Homo Sapiens
KVKEHQKSM

SEQ ID NO: 512754 - protein, 9 aa, Homo Sapiens
HGFRILGLR

SEQ ID NO: 512755 - protein, 9 aa, Homo Sapiens
ANPWLISSC

SEQ ID NO: 512756 - protein, 9 aa, Homo Sapiens
ISPLGAFGL

SEQ ID NO: 512757 - protein, 9 aa, Homo Sapiens
LGGCNLEFD

SEQ ID NO: 512758 - protein, 9 aa, Homo Sapiens
DNRCSLIPE

SEQ ID NO: 512759 - protein, 9 aa, Homo Sapiens
PGLHGFRIL

SEQ ID NO: 512760 - protein, 9 aa, Homo Sapiens
VLSAPGLHG

SEQ ID NO: 512761 - protein, 9 aa, Homo Sapiens
QRLDVLEEE

SEQ ID NO: 512762 - protein, 9 aa, Homo Sapiens
SLRHQQVTL

SEQ ID NO: 512763 - protein, 9 aa, Homo Sapiens
TLPFLAFKH

SEQ ID NO: 512764 - protein, 9 aa, Homo Sapiens
NNDQRLDVL

SEQ ID NO: 512765 - protein, 9 aa, Homo Sapiens
EITKQEKDF

SEQ ID NO: 512766 - protein, 9 aa, Homo Sapiens
GANPWLISS

SEQ ID NO: 512767 - protein, 9 aa, Homo Sapiens
TETYTFTIS

SEQ ID NO: 512768 - protein, 9 aa, Homo Sapiens
SERDPVLGG

SEQ ID NO: 512769 - protein, 9 aa, Homo Sapiens
LSAPGLHGF

SEQ ID NO: 512770 - protein, 9 aa, Homo Sapiens
ELIKNTETY

SEQ ID NO: 512771 - protein, 9 aa, Homo Sapiens
LEKKHEAIT

SEQ ID NO: 512772 - protein, 9 aa, Homo Sapiens
FMGKTDGHY

SEQ ID NO: 512773 - protein, 9 aa, Homo Sapiens
GKTDGHYYT

SEQ ID NO: 512774 - protein, 9 aa, Homo Sapiens
KQEKDFLWS

SEQ ID NO: 512775 - protein, 9 aa, Homo Sapiens
PVLGGCNLE

SEQ ID NO: 512776 - protein, 9 aa, Homo Sapiens
AALEKKHEA

SEQ ID NO: 512777 - protein, 9 aa, Homo Sapiens
SGQSASYGR

SEQ ID NO: 512778 - protein, 9 aa, Homo Sapiens
TWSGQEVVS

SEQ ID NO: 512779 - protein, 9 aa, Homo Sapiens
ANKMMPETS

SEQ ID NO: 512780 - protein, 9 aa, Homo Sapiens
KWCGLALHF

SEQ ID NO: 512781 - protein, 9 aa, Homo Sapiens
VQYRPAVEP

SEQ ID NO: 512782 - protein, 9 aa, Homo Sapiens
FKCFSDFTN

SEQ ID NO: 512783 - protein, 9 aa, Homo Sapiens
ERDEDRERR

SEQ ID NO: 512784 - protein, 9 aa, Homo Sapiens
DFILFSILK

SEQ ID NO: 512785 - protein, 9 aa, Homo Sapiens
LRSIIFVVV

SEQ ID NO: 512786 - protein, 9 aa, Homo Sapiens
VKMVNEKLV

SEQ ID NO: 512787 - protein, 9 aa, Homo Sapiens
KRKMSPLRS

SEQ ID NO: 512788 - protein, 9 aa, Homo Sapiens
PDVCVTQHF

SEQ ID NO: 512789 - protein, 9 aa, Homo Sapiens
DLELPKRDV

SEQ ID NO: 512790 - protein, 9 aa, Homo Sapiens
CKNLFLVEV

SEQ ID NO: 512791 - protein, 9 aa, Homo Sapiens
PFDRVKLFP

SEQ ID NO: 512792 - protein, 9 aa, Homo Sapiens
VKPFMPETT

SEQ ID NO: 512793 - protein, 9 aa, Homo Sapiens
TRRDRRLYI

SEQ ID NO: 512794 - protein, 9 aa, Homo Sapiens
ASLPLPPPP

SEQ ID NO: 512795 - protein, 9 aa, Homo Sapiens
PNIEVQFPE

SEQ ID NO: 512796 - protein, 9 aa, Homo Sapiens
LFRQAISPF

SEQ ID NO: 512797 - protein, 9 aa, Homo Sapiens
LTCKTQLSL

SEQ ID NO: 512798 - protein, 9 aa, Homo Sapiens
TLKQYPCKN

SEQ ID NO: 512799 - protein, 9 aa, Homo Sapiens
LRGEDGLAT

SEQ ID NO: 512800 - protein, 9 aa, Homo Sapiens
TRAASTQHC

SEQ ID NO: 512801 - protein, 9 aa, Homo Sapiens
KTSVDAPPQ

SEQ ID NO: 512802 - protein, 9 aa, Homo Sapiens
FPSMQELVV

SEQ ID NO: 512803 - protein, 9 aa, Homo Sapiens
TLRMLFKAH

SEQ ID NO: 512804 - protein, 9 aa, Homo Sapiens
HKACTQCLN

SEQ ID NO: 512805 - protein, 9 aa, Homo Sapiens
LVQATFHRF

SEQ ID NO: 512806 - protein, 9 aa, Homo Sapiens
LLKNTERSE

SEQ ID NO: 512807 - protein, 9 aa, Homo Sapiens
RKGARKAGK

SEQ ID NO: 512808 - protein, 9 aa, Homo Sapiens
LGVGKTSIM

SEQ ID NO: 512809 - protein, 9 aa, Homo Sapiens
FRVSASKPW

SEQ ID NO: 512810 - protein, 9 aa, Homo Sapiens
ASKPWGISL

SEQ ID NO: 512811 - protein, 9 aa, Homo Sapiens
SSLDCLSNT

SEQ ID NO: 512812 - protein, 9 aa, Homo Sapiens
CLLTQLIIW

SEQ ID NO: 512813 - protein, 9 aa, Homo Sapiens
IFKHLRHLE

SEQ ID NO: 512814 - protein, 9 aa, Homo Sapiens
LEKGFECEY

SEQ ID NO: 512815 - protein, 9 aa, Homo Sapiens
VRAVRELEQ

SEQ ID NO: 512816 - protein, 9 aa, Homo Sapiens
TVGGCPGLT

SEQ ID NO: 512817 - protein, 9 aa, Homo Sapiens
SACKIKQSH

SEQ ID NO: 512818 - protein, 9 aa, Homo Sapiens
HEEAPVLND

SEQ ID NO: 512819 - protein, 9 aa, Homo Sapiens
PFKRSLLKV

SEQ ID NO: 512820 - protein, 9 aa, Homo Sapiens
LQTDDSVGS

SEQ ID NO: 512821 - protein, 9 aa, Homo Sapiens
YRTVSQMGP

SEQ ID NO: 512822 - protein, 9 aa, Homo Sapiens
LSHFPGGSP

SEQ ID NO: 512823 - protein, 9 aa, Homo Sapiens
DTVYLVGEV

SEQ ID NO: 512824 - protein, 9 aa, Homo Sapiens
IPVVKPFMP

SEQ ID NO: 512825 - protein, 9 aa, Homo Sapiens
TSGPVTLVA

SEQ ID NO: 512826 - protein, 9 aa, Homo Sapiens
LLQLHTPVN

SEQ ID NO: 512827 - protein, 9 aa, Homo Sapiens
IMQSKSACK

SEQ ID NO: 512828 - protein, 9 aa, Homo Sapiens
NIEVQFPET

SEQ ID NO: 512829 - protein, 9 aa, Homo Sapiens
IIKVNIFKH

SEQ ID NO: 512830 - protein, 9 aa, Homo Sapiens
GKSFKCNSR

SEQ ID NO: 512831 - protein, 9 aa, Homo Sapiens
GFHGMQRDV

SEQ ID NO: 512832 - protein, 9 aa, Homo Sapiens
LAGRRMPPH

SEQ ID NO: 512833 - protein, 9 aa, Homo Sapiens
CNSRLVQHK

SEQ ID NO: 512834 - protein, 9 aa, Homo Sapiens
NDENNWGLS

SEQ ID NO: 512835 - protein, 9 aa, Homo Sapiens
ESPEPQRAD

SEQ ID NO: 512836 - protein, 9 aa, Homo Sapiens
GFSSQNGET

SEQ ID NO: 512837 - protein, 9 aa, Homo Sapiens
RKAGKTTYS

SEQ ID NO: 512838 - protein, 9 aa, Homo Sapiens
CGGDGIVGW

SEQ ID NO: 512839 - protein, 9 aa, Homo Sapiens
LEAEYDSFK

SEQ ID NO: 512840 - protein, 9 aa, Homo Sapiens
NASETAWMI

SEQ ID NO: 512841 - protein, 9 aa, Homo Sapiens
STFSWLHTV

SEQ ID NO: 512842 - protein, 9 aa, Homo Sapiens
FSWLHTVTV

SEQ ID NO: 512843 - protein, 9 aa, Homo Sapiens
PWPNRLMSL

SEQ ID NO: 512844 - protein, 9 aa, Homo Sapiens
PSAPMLGGS

SEQ ID NO: 512845 - protein, 9 aa, Homo Sapiens
EEAPVLNDK

SEQ ID NO: 512846 - protein, 9 aa, Homo Sapiens
RVIPDVCVT

SEQ ID NO: 512847 - protein, 9 aa, Homo Sapiens
SPGLMRSPG

SEQ ID NO: 512848 - protein, 9 aa, Homo Sapiens
RVTLKQYPC

SEQ ID NO: 512849 - protein, 9 aa, Homo Sapiens
LISCDFILF

SEQ ID NO: 512850 - protein, 9 aa, Homo Sapiens
FDVNDENNW

SEQ ID NO: 512851 - protein, 9 aa, Homo Sapiens
PMLGGSGPV

SEQ ID NO: 512852 - protein, 9 aa, Homo Sapiens
VEDISVGGM

SEQ ID NO: 512853 - protein, 9 aa, Homo Sapiens
PSLLMMMKE

SEQ ID NO: 512854 - protein, 9 aa, Homo Sapiens
EKPSLLMMM

SEQ ID NO: 512855 - protein, 9 aa, Homo Sapiens
GGDGIVGWV

SEQ ID NO: 512856 - protein, 9 aa, Homo Sapiens
YRCRQWFHK

SEQ ID NO: 512857 - protein, 9 aa, Homo Sapiens
RDTPPFKRS

SEQ ID NO: 512858 - protein, 9 aa, Homo Sapiens
LIVSTQLDR

SEQ ID NO: 512859 - protein, 9 aa, Homo Sapiens
LACGGDGIV

SEQ ID NO: 512860 - protein, 9 aa, Homo Sapiens
RLGEQEVSI

SEQ ID NO: 512861 - protein, 9 aa, Homo Sapiens
LATGCTLRS

SEQ ID NO: 512862 - protein, 9 aa, Homo Sapiens
CLSNTVDRI

SEQ ID NO: 512863 - protein, 9 aa, Homo Sapiens
SFKQELEQL

SEQ ID NO: 512864 - protein, 9 aa, Homo Sapiens
RTKFSCHNV

SEQ ID NO: 512865 - protein, 9 aa, Homo Sapiens
SHEEAPVLN

SEQ ID NO: 512866 - protein, 9 aa, Homo Sapiens
GGSIVRGAP

SEQ ID NO: 512867 - protein, 9 aa, Homo Sapiens
QALVANNAS

SEQ ID NO: 512868 - protein, 9 aa, Homo Sapiens
YYYSVEDIS

SEQ ID NO: 512869 - protein, 9 aa, Homo Sapiens
DGGAVAKPL

SEQ ID NO: 512870 - protein, 9 aa, Homo Sapiens
HQQEAVWKL

SEQ ID NO: 512871 - protein, 9 aa, Homo Sapiens
TVYLVGEVH

SEQ ID NO: 512872 - protein, 9 aa, Homo Sapiens
IRAIGFYPS

SEQ ID NO: 512873 - protein, 9 aa, Homo Sapiens
ILSPGLMRS

SEQ ID NO: 512874 - protein, 9 aa, Homo Sapiens
LVANNASET

SEQ ID NO: 512875 - protein, 9 aa, Homo Sapiens
PGLMRSPGS

SEQ ID NO: 512876 - protein, 9 aa, Homo Sapiens
IIFVVVGDT

SEQ ID NO: 512877 - protein, 9 aa, Homo Sapiens
QKDCNLKKV

SEQ ID NO: 512878 - protein, 9 aa, Homo Sapiens
DSFKQELEQ

SEQ ID NO: 512879 - protein, 9 aa, Homo Sapiens
CRQWFHKAC

SEQ ID NO: 512880 - protein, 9 aa, Homo Sapiens
LRMLFKAHM

SEQ ID NO: 512881 - protein, 9 aa, Homo Sapiens
LVVHSKLHY

SEQ ID NO: 512882 - protein, 9 aa, Homo Sapiens
PGQPEAIIV

SEQ ID NO: 512883 - protein, 9 aa, Homo Sapiens
CKTQLSLER

SEQ ID NO: 512884 - protein, 9 aa, Homo Sapiens
PPVTTATSG

SEQ ID NO: 512885 - protein, 9 aa, Homo Sapiens
GGAVAKPLG

SEQ ID NO: 512886 - protein, 9 aa, Homo Sapiens
WEAQTFSRM

SEQ ID NO: 512887 - protein, 9 aa, Homo Sapiens
NRLMSLVSG

SEQ ID NO: 512888 - protein, 9 aa, Homo Sapiens
LQTRRDRRL

SEQ ID NO: 512889 - protein, 9 aa, Homo Sapiens
TGILIVSTQ

SEQ ID NO: 512890 - protein, 9 aa, Homo Sapiens
IEKPSLLMM

SEQ ID NO: 512891 - protein, 9 aa, Homo Sapiens
VGGCPGLTE

SEQ ID NO: 512892 - protein, 9 aa, Homo Sapiens
MGEYEPNIE

SEQ ID NO: 512893 - protein, 9 aa, Homo Sapiens
VVTACLLTQ

SEQ ID NO: 512894 - protein, 9 aa, Homo Sapiens
LVQLIVQYR

SEQ ID NO: 512895 - protein, 9 aa, Homo Sapiens
AVWKLLHTE

SEQ ID NO: 512896 - protein, 9 aa, Homo Sapiens
TLTCKTQLS

SEQ ID NO: 512897 - protein, 9 aa, Homo Sapiens
FVVVGDTVY

SEQ ID NO: 512898 - protein, 9 aa, Homo Sapiens
GAPGGTPQG

SEQ ID NO: 512899 - protein, 9 aa, Homo Sapiens
GEDGLATGC

SEQ ID NO: 512900 - protein, 9 aa, Homo Sapiens
YECPKGFSS

SEQ ID NO: 512901 - protein, 9 aa, Homo Sapiens
KERLGEQEV

SEQ ID NO: 512902 - protein, 9 aa, Homo Sapiens
VHSKLHYKP

SEQ ID NO: 512903 - protein, 9 aa, Homo Sapiens
FTLRMLFKA

SEQ ID NO: 512904 - protein, 9 aa, Homo Sapiens
NNWGLSVYA

SEQ ID NO: 512905 - protein, 9 aa, Homo Sapiens
VRELEQELQ

SEQ ID NO: 512906 - protein, 9 aa, Homo Sapiens
ESEVSPSRK

SEQ ID NO: 512907 - protein, 9 aa, Homo Sapiens
APMLGGSGP

SEQ ID NO: 512908 - protein, 9 aa, Homo Sapiens
RMLFKAHMG

SEQ ID NO: 512909 - protein, 9 aa, Homo Sapiens
DVCVTQHFA

SEQ ID NO: 512910 - protein, 9 aa, Homo Sapiens
FKQELEQLK

SEQ ID NO: 512911 - protein, 9 aa, Homo Sapiens
QATFHRFHW

SEQ ID NO: 512912 - protein, 9 aa, Homo Sapiens
EFSLKKLGV

SEQ ID NO: 512913 - protein, 9 aa, Homo Sapiens
DVSDRIFNR

SEQ ID NO: 512914 - protein, 9 aa, Homo Sapiens
KVETPPKTS

SEQ ID NO: 512915 - protein, 9 aa, Homo Sapiens
AIQALVANN

SEQ ID NO: 512916 - protein, 9 aa, Homo Sapiens
LMMMKENFP

SEQ ID NO: 512917 - protein, 9 aa, Homo Sapiens
TADDKKLEF

SEQ ID NO: 512918 - protein, 9 aa, Homo Sapiens
AMCDNLLNV

SEQ ID NO: 512919 - protein, 9 aa, Homo Sapiens
YVYELLQKD

SEQ ID NO: 512920 - protein, 9 aa, Homo Sapiens
EPNIEVQFP

SEQ ID NO: 512921 - protein, 9 aa, Homo Sapiens
TFHRFHWSR

SEQ ID NO: 512922 - protein, 9 aa, Homo Sapiens
GMQRDVQDP

SEQ ID NO: 512923 - protein, 9 aa, Homo Sapiens
LALLELEED

SEQ ID NO: 512924 - protein, 9 aa, Homo Sapiens
MGGFHGMQR

SEQ ID NO: 512925 - protein, 9 aa, Homo Sapiens
GGGEAQPAR

SEQ ID NO: 512926 - protein, 9 aa, Homo Sapiens
AVAKPLGPR

SEQ ID NO: 512927 - protein, 9 aa, Homo Sapiens
IKVNIFKHL

SEQ ID NO: 512928 - protein, 9 aa, Homo Sapiens
ALHFLNHLT

SEQ ID NO: 512929 - protein, 9 aa, Homo Sapiens
LDSVTGILI

SEQ ID NO: 512930 - protein, 9 aa, Homo Sapiens
KPGASRDKV

SEQ ID NO: 512931 - protein, 9 aa, Homo Sapiens
ALAGRRMPP

SEQ ID NO: 512932 - protein, 9 aa, Homo Sapiens
LSNTVDRIT

SEQ ID NO: 512933 - protein, 9 aa, Homo Sapiens
SSSSSHEEA

SEQ ID NO: 512934 - protein, 9 aa, Homo Sapiens
ASTQHCTDL

SEQ ID NO: 512935 - protein, 9 aa, Homo Sapiens
SMGTKEQEG

SEQ ID NO: 512936 - protein, 9 aa, Homo Sapiens
KERKGARKA

SEQ ID NO: 512937 - protein, 9 aa, Homo Sapiens
HLPESPEPQ

SEQ ID NO: 512938 - protein, 9 aa, Homo Sapiens
QLIVQYRPA

SEQ ID NO: 512939 - protein, 9 aa, Homo Sapiens
ILKERLGEQ

SEQ ID NO: 512940 - protein, 9 aa, Homo Sapiens
RELEQELQR

SEQ ID NO: 512941 - protein, 9 aa, Homo Sapiens
LEQELQRQR

SEQ ID NO: 512942 - protein, 9 aa, Homo Sapiens
ISCDFILFS

SEQ ID NO: 512943 - protein, 9 aa, Homo Sapiens
EYDSFKQEL

SEQ ID NO: 512944 - protein, 9 aa, Homo Sapiens
KKLEFSLKK

SEQ ID NO: 512945 - protein, 9 aa, Homo Sapiens
TKYVYELLQ

SEQ ID NO: 512946 - protein, 9 aa, Homo Sapiens
TVDRITSSE

SEQ ID NO: 512947 - protein, 9 aa, Homo Sapiens
AVRELEQEL

SEQ ID NO: 512948 - protein, 9 aa, Homo Sapiens
PPLYPSAPM

SEQ ID NO: 512949 - protein, 9 aa, Homo Sapiens
GPVTLVAPG

SEQ ID NO: 512950 - protein, 9 aa, Homo Sapiens
SEVSPSRKR

SEQ ID NO: 512951 - protein, 9 aa, Homo Sapiens
YKWDVSDRI

SEQ ID NO: 512952 - protein, 9 aa, Homo Sapiens
TSIMKRYVH

SEQ ID NO: 512953 - protein, 9 aa, Homo Sapiens
ANNASETAW

SEQ ID NO: 512954 - protein, 9 aa, Homo Sapiens
QGGGEAQPA

SEQ ID NO: 512955 - protein, 9 aa, Homo Sapiens
IQALVANNA

SEQ ID NO: 512956 - protein, 9 aa, Homo Sapiens
TFSWLHTVT

SEQ ID NO: 512957 - protein, 9 aa, Homo Sapiens
ARKAGKTTY

SEQ ID NO: 512958 - protein, 9 aa, Homo Sapiens
KGREKERKG

SEQ ID NO: 512959 - protein, 9 aa, Homo Sapiens
PPFKRSLLK

SEQ ID NO: 512960 - protein, 9 aa, Homo Sapiens
CDPPGQPEA

SEQ ID NO: 512961 - protein, 9 aa, Homo Sapiens
GLAPPQHLT

SEQ ID NO: 512962 - protein, 9 aa, Homo Sapiens
DGLATGCTL

SEQ ID NO: 512963 - protein, 9 aa, Homo Sapiens
GVGKTSIMK

SEQ ID NO: 512964 - protein, 9 aa, Homo Sapiens
GLGGVPIQP

SEQ ID NO: 512965 - protein, 9 aa, Homo Sapiens
QLIIWTLLG

SEQ ID NO: 512966 - protein, 9 aa, Homo Sapiens
GPILSPGLM

SEQ ID NO: 512967 - protein, 9 aa, Homo Sapiens
SLTKGELTH

SEQ ID NO: 512968 - protein, 9 aa, Homo Sapiens
GFECEYRLA

SEQ ID NO: 512969 - protein, 9 aa, Homo Sapiens
GAVAKPLGP

SEQ ID NO: 512970 - protein, 9 aa, Homo Sapiens
VAKPLGPRA

SEQ ID NO: 512971 - protein, 9 aa, Homo Sapiens
SEPPLEAIP

SEQ ID NO: 512972 - protein, 9 aa, Homo Sapiens
ALSSSCQPP

SEQ ID NO: 512973 - protein, 9 aa, Homo Sapiens
GNPVTLTCK

SEQ ID NO: 512974 - protein, 9 aa, Homo Sapiens
FSCHNVLHL

SEQ ID NO: 512975 - protein, 9 aa, Homo Sapiens
KDEDSERDE

SEQ ID NO: 512976 - protein, 9 aa, Homo Sapiens
LHLQTDDSV

SEQ ID NO: 512977 - protein, 9 aa, Homo Sapiens
KNTERSEET

SEQ ID NO: 512978 - protein, 9 aa, Homo Sapiens
FSSQNGETD

SEQ ID NO: 512979 - protein, 9 aa, Homo Sapiens
GVMGEYEPN

SEQ ID NO: 512980 - protein, 9 aa, Homo Sapiens
KLEFSLKKL

SEQ ID NO: 512981 - protein, 9 aa, Homo Sapiens
ANIYLQTRR

SEQ ID NO: 512982 - protein, 9 aa, Homo Sapiens
QSKSACKIK

SEQ ID NO: 512983 - protein, 9 aa, Homo Sapiens
TPPFKRSLL

SEQ ID NO: 512984 - protein, 9 aa, Homo Sapiens
PGPILSPGL

SEQ ID NO: 512985 - protein, 9 aa, Homo Sapiens
ELPKRDVSY

SEQ ID NO: 512986 - protein, 9 aa, Homo Sapiens
VYLVGEVHC

SEQ ID NO: 512987 - protein, 9 aa, Homo Sapiens
LEAIPCYVN

SEQ ID NO: 512988 - protein, 9 aa, Homo Sapiens
VNEKLVLAC

SEQ ID NO: 512989 - protein, 9 aa, Homo Sapiens
YYSVEDISV

SEQ ID NO: 512990 - protein, 9 aa, Homo Sapiens
MGTKEQEGT

SEQ ID NO: 512991 - protein, 9 aa, Homo Sapiens
HGMQRDVQD

SEQ ID NO: 512992 - protein, 9 aa, Homo Sapiens
IVSTQLDRE

SEQ ID NO: 512993 - protein, 9 aa, Homo Sapiens
GFTLRMLFK

SEQ ID NO: 512994 - protein, 9 aa, Homo Sapiens
GGCPGLTEK

SEQ ID NO: 512995 - protein, 9 aa, Homo Sapiens
QEVRAVREL

SEQ ID NO: 512996 - protein, 9 aa, Homo Sapiens
QRRDKMDEL

SEQ ID NO: 512997 - protein, 9 aa, Homo Sapiens
ISAREEVVQ

SEQ ID NO: 512998 - protein, 9 aa, Homo Sapiens
MNLFQRRDK

SEQ ID NO: 512999 - protein, 9 aa, Homo Sapiens
SCHNVLHLW

SEQ ID NO: 513000 - protein, 9 aa, Homo Sapiens
TVSQMGPVH

SEQ ID NO: 513001 - protein, 9 aa, Homo Sapiens
TLRSIIFVV

SEQ ID NO: 513002 - protein, 9 aa, Homo Sapiens
FDVKMVNEK

SEQ ID NO: 513003 - protein, 9 aa, Homo Sapiens
YGFTLRMLF

SEQ ID NO: 513004 - protein, 9 aa, Homo Sapiens
PILSPGLMR

SEQ ID NO: 513005 - protein, 9 aa, Homo Sapiens
SKPWGISLP

SEQ ID NO: 513006 - protein, 9 aa, Homo Sapiens
AEYDSFKQE

SEQ ID NO: 513007 - protein, 9 aa, Homo Sapiens
YELLQKDCN

SEQ ID NO: 513008 - protein, 9 aa, Homo Sapiens
WKTAIWEAQ

SEQ ID NO: 513009 - protein, 9 aa, Homo Sapiens
YTYECPKGF

SEQ ID NO: 513010 - protein, 9 aa, Homo Sapiens
ILIVSTQLD

SEQ ID NO: 513011 - protein, 9 aa, Homo Sapiens
TRVEGNLRV

SEQ ID NO: 513012 - protein, 9 aa, Homo Sapiens
NNASETAWM

SEQ ID NO: 513013 - protein, 9 aa, Homo Sapiens
VVVGDTVYL

SEQ ID NO: 513014 - protein, 9 aa, Homo Sapiens
FTNHKRIHT

SEQ ID NO: 513015 - protein, 9 aa, Homo Sapiens
VNIFKHLRH

SEQ ID NO: 513016 - protein, 9 aa, Homo Sapiens
QYPCKNLFL

SEQ ID NO: 513017 - protein, 9 aa, Homo Sapiens
RAASTQHCT

SEQ ID NO: 513018 - protein, 9 aa, Homo Sapiens
RLVAWDPAS

SEQ ID NO: 513019 - protein, 9 aa, Homo Sapiens
MMMKENFPN

SEQ ID NO: 513020 - protein, 9 aa, Homo Sapiens
SVTGILIVS

SEQ ID NO: 513021 - protein, 9 aa, Homo Sapiens
PRLLKNTER

SEQ ID NO: 513022 - protein, 9 aa, Homo Sapiens
IVRGAPVIV

SEQ ID NO: 513023 - protein, 9 aa, Homo Sapiens
PPKTSVDAP

SEQ ID NO: 513024 - protein, 9 aa, Homo Sapiens
ASETAWMIG

SEQ ID NO: 513025 - protein, 9 aa, Homo Sapiens
WLHLQTDDS

SEQ ID NO: 513026 - protein, 9 aa, Homo Sapiens
MAPLVQATF

SEQ ID NO: 513027 - protein, 8 aa, Homo Sapiens
LVLLAGIF

SEQ ID NO: 513028 - protein, 9 aa, Homo Sapiens
SMQELVVHS

SEQ ID NO: 513029 - protein, 9 aa, Homo Sapiens
VAWDPASLP

SEQ ID NO: 513030 - protein, 9 aa, Homo Sapiens
MGPVHAPVF

SEQ ID NO: 513031 - protein, 9 aa, Homo Sapiens
RRMPPHVLV

SEQ ID NO: 513032 - protein, 9 aa, Homo Sapiens
VLACGGDGI

SEQ ID NO: 513033 - protein, 9 aa, Homo Sapiens
VSSSSSSHE

SEQ ID NO: 513034 - protein, 9 aa, Homo Sapiens
AASTQHCTD

SEQ ID NO: 513035 - protein, 9 aa, Homo Sapiens
GKTSIMKRY

SEQ ID NO: 513036 - protein, 9 aa, Homo Sapiens
CGCSLTKGE

SEQ ID NO: 513037 - protein, 9 aa, Homo Sapiens
EKWCGLALH

SEQ ID NO: 513038 - protein, 9 aa, Homo Sapiens
KQKMGGFHG

SEQ ID NO: 513039 - protein, 9 aa, Homo Sapiens
KYSKDRKKF

SEQ ID NO: 513040 - protein, 9 aa, Homo Sapiens
VQLIVQYRP

SEQ ID NO: 513041 - protein, 9 aa, Homo Sapiens
FECEYRLAP

SEQ ID NO: 513042 - protein, 9 aa, Homo Sapiens
PPLEAIPCY

SEQ ID NO: 513043 - protein, 9 aa, Homo Sapiens
RDVSYYEKD

SEQ ID NO: 513044 - protein, 9 aa, Homo Sapiens
ATGCTLRSI

SEQ ID NO: 513045 - protein, 9 aa, Homo Sapiens
SSSSSSHEE

SEQ ID NO: 513046 - protein, 9 aa, Homo Sapiens
MCDNLLNVP

SEQ ID NO: 513047 - protein, 9 aa, Homo Sapiens
EVVQRIPEA

SEQ ID NO: 513048 - protein, 9 aa, Homo Sapiens
ATADDKKLE

SEQ ID NO: 513049 - protein, 9 aa, Homo Sapiens
SCQPPANMN

SEQ ID NO: 513050 - protein, 9 aa, Homo Sapiens
LLTQLIIWT

SEQ ID NO: 513051 - protein, 9 aa, Homo Sapiens
KRDVSYYEK

SEQ ID NO: 513052 - protein, 9 aa, Homo Sapiens
DAIQALVAN

SEQ ID NO: 513053 - protein, 9 aa, Homo Sapiens
CHNVLHLWP

SEQ ID NO: 513054 - protein, 9 aa, Homo Sapiens
EDGGAVAKP

SEQ ID NO: 513055 - protein, 9 aa, Homo Sapiens
QLHTPVNLS

SEQ ID NO: 513056 - protein, 9 aa, Homo Sapiens
AYRDTPPFK

SEQ ID NO: 513057 - protein, 9 aa, Homo Sapiens
CLSELPFVI

SEQ ID NO: 513058 - protein, 9 aa, Homo Sapiens
VAFDVKMVN

SEQ ID NO: 513059 - protein, 9 aa, Homo Sapiens
KKGREKERK

SEQ ID NO: 513060 - protein, 9 aa, Homo Sapiens
EPPLEAIPC

SEQ ID NO: 513061 - protein, 9 aa, Homo Sapiens
KTSIMKRYV

SEQ ID NO: 513062 - protein, 9 aa, Homo Sapiens
RYYYSVEDI

SEQ ID NO: 513063 - protein, 9 aa, Homo Sapiens
GRVIPDVCV

SEQ ID NO: 513064 - protein, 9 aa, Homo Sapiens
EEDGGAVAK

SEQ ID NO: 513065 - protein, 9 aa, Homo Sapiens
SFKCNSRLV

SEQ ID NO: 513066 - protein, 9 aa, Homo Sapiens
IRILKERLG

SEQ ID NO: 513067 - protein, 9 aa, Homo Sapiens
EVRAVRELE

SEQ ID NO: 513068 - protein, 9 aa, Homo Sapiens
VEKRTKFSC

SEQ ID NO: 513069 - protein, 9 aa, Homo Sapiens
DIRILKERL

SEQ ID NO: 513070 - protein, 9 aa, Homo Sapiens
MVNEKLVLA

SEQ ID NO: 513071 - protein, 9 aa, Homo Sapiens
GILIVSTQL

SEQ ID NO: 513072 - protein, 9 aa, Homo Sapiens
HFLNHLTSF

SEQ ID NO: 513073 - protein, 9 aa, Homo Sapiens
AVHLPESPE

SEQ ID NO: 513074 - protein, 9 aa, Homo Sapiens
ATFHRFHWS

SEQ ID NO: 513075 - protein, 9 aa, Homo Sapiens
LALHFLNHL

SEQ ID NO: 513076 - protein, 9 aa, Homo Sapiens
VKRPRLLKN

SEQ ID NO: 513077 - protein, 9 aa, Homo Sapiens
ALRGEDGLA

SEQ ID NO: 513078 - protein, 9 aa, Homo Sapiens
LLELEEDVM

SEQ ID NO: 513079 - protein, 9 aa, Homo Sapiens
KVNKAYRKL

SEQ ID NO: 513080 - protein, 9 aa, Homo Sapiens
QTDDSVGSV

SEQ ID NO: 513081 - protein, 9 aa, Homo Sapiens
SQMGPVHAP

SEQ ID NO: 513082 - protein, 9 aa, Homo Sapiens
ERLGEQEVS

SEQ ID NO: 513083 - protein, 9 aa, Homo Sapiens
YPSAPMLGG

SEQ ID NO: 513084 - protein, 9 aa, Homo Sapiens
SPSDLALLE

SEQ ID NO: 513085 - protein, 9 aa, Homo Sapiens
VKPGASRDK

SEQ ID NO: 513086 - protein, 9 aa, Homo Sapiens
LSSSCQPPA

SEQ ID NO: 513087 - protein, 9 aa, Homo Sapiens
KMDELEGFQ

SEQ ID NO: 513088 - protein, 9 aa, Homo Sapiens
WDPASLPLP

SEQ ID NO: 513089 - protein, 9 aa, Homo Sapiens
CPGLTEKSL

SEQ ID NO: 513090 - protein, 9 aa, Homo Sapiens
PVVKPFMPE

SEQ ID NO: 513091 - protein, 9 aa, Homo Sapiens
ALLELEEDV

SEQ ID NO: 513092 - protein, 9 aa, Homo Sapiens
QEAVWKLLH

SEQ ID NO: 513093 - protein, 9 aa, Homo Sapiens
VNDENNWGL

SEQ ID NO: 513094 - protein, 9 aa, Homo Sapiens
IFLEKGFEC

SEQ ID NO: 513095 - protein, 9 aa, Homo Sapiens
DEDSERDED

SEQ ID NO: 513096 - protein, 9 aa, Homo Sapiens
GCTLRSIIF

SEQ ID NO: 513097 - protein, 9 aa, Homo Sapiens
PSDLALLEL

SEQ ID NO: 513098 - protein, 9 aa, Homo Sapiens
ACLLTQLII

SEQ ID NO: 513099 - protein, 9 aa, Homo Sapiens
DSVTGILIV

SEQ ID NO: 513100 - protein, 9 aa, Homo Sapiens
IVQYRPAVE

SEQ ID NO: 513101 - protein, 9 aa, Homo Sapiens
PGASRDKVN

SEQ ID NO: 513102 - protein, 9 aa, Homo Sapiens
AFDVNDENN

SEQ ID NO: 513103 - protein, 8 aa, Homo Sapiens
KILCIFLT

SEQ ID NO: 513104 - protein, 9 aa, Homo Sapiens
RQWFHKACT

SEQ ID NO: 513105 - protein, 9 aa, Homo Sapiens
EVSPSRKRK

SEQ ID NO: 513106 - protein, 9 aa, Homo Sapiens
GGSPPWQQY

SEQ ID NO: 513107 - protein, 9 aa, Homo Sapiens
VTGILIVST

SEQ ID NO: 513108 - protein, 9 aa, Homo Sapiens
SDLALLELE

SEQ ID NO: 513109 - protein, 9 aa, Homo Sapiens
KGFECEYRL

SEQ ID NO: 513110 - protein, 9 aa, Homo Sapiens
LGGVPIQPF

SEQ ID NO: 513111 - protein, 9 aa, Homo Sapiens
CQPPANMNR

SEQ ID NO: 513112 - protein, 9 aa, Homo Sapiens
TPPKTSVDA

SEQ ID NO: 513113 - protein, 9 aa, Homo Sapiens
LFSILKMHS

SEQ ID NO: 513114 - protein, 9 aa, Homo Sapiens
KSGKVVQEG

SEQ ID NO: 513115 - protein, 9 aa, Homo Sapiens
PLEAIPCYV

SEQ ID NO: 513116 - protein, 9 aa, Homo Sapiens
NLFQRRDKM

SEQ ID NO: 513117 - protein, 9 aa, Homo Sapiens
FCYGFTLRM

SEQ ID NO: 513118 - protein, 9 aa, Homo Sapiens
LDCLSNTVD

SEQ ID NO: 513119 - protein, 9 aa, Homo Sapiens
GASRDKVNK

SEQ ID NO: 513120 - protein, 9 aa, Homo Sapiens
CYGFTLRML

SEQ ID NO: 513121 - protein, 9 aa, Homo Sapiens
CHQQEAVWK

SEQ ID NO: 513122 - protein, 9 aa, Homo Sapiens
FSILKMHSA

SEQ ID NO: 513123 - protein, 9 aa, Homo Sapiens
KVNIFKHLR

SEQ ID NO: 513124 - protein, 9 aa, Homo Sapiens
PLVQATFHR

SEQ ID NO: 513125 - protein, 9 aa, Homo Sapiens
QIQIIKVNI

SEQ ID NO: 513126 - protein, 9 aa, Homo Sapiens
ECGCSLTKG

SEQ ID NO: 513127 - protein, 9 aa, Homo Sapiens
EKKKGREKE

SEQ ID NO: 513128 - protein, 9 aa, Homo Sapiens
VGEVHCEGD

SEQ ID NO: 513129 - protein, 9 aa, Homo Sapiens
VVGDTVYLV

SEQ ID NO: 513130 - protein, 9 aa, Homo Sapiens
SIMKRYVHQ

SEQ ID NO: 513131 - protein, 9 aa, Homo Sapiens
RDKTYKWDV

SEQ ID NO: 513132 - protein, 9 aa, Homo Sapiens
SETAWMIGL

SEQ ID NO: 513133 - protein, 9 aa, Homo Sapiens
KPWGISLPS

SEQ ID NO: 513134 - protein, 9 aa, Homo Sapiens
SPSRKRKMS

SEQ ID NO: 513135 - protein, 9 aa, Homo Sapiens
AGRRMPPHV

SEQ ID NO: 513136 - protein, 9 aa, Homo Sapiens
LPESPEPQR

SEQ ID NO: 513137 - protein, 9 aa, Homo Sapiens
TYECPKGFS

SEQ ID NO: 513138 - protein, 9 aa, Homo Sapiens
QIIKVNIFK

SEQ ID NO: 513139 - protein, 9 aa, Homo Sapiens
ECGKSFKCN

SEQ ID NO: 513140 - protein, 9 aa, Homo Sapiens
FSDFTNHKR

SEQ ID NO: 513141 - protein, 9 aa, Homo Sapiens
VTACLLTQL

SEQ ID NO: 513142 - protein, 9 aa, Homo Sapiens
DATRAASTQ

SEQ ID NO: 513143 - protein, 9 aa, Homo Sapiens
LPWPNRLMS

SEQ ID NO: 513144 - protein, 9 aa, Homo Sapiens
SKSACKIKQ

SEQ ID NO: 513145 - protein, 9 aa, Homo Sapiens
RGEDGLATG

SEQ ID NO: 513146 - protein, 9 aa, Homo Sapiens
LIVQYRPAV

SEQ ID NO: 513147 - protein, 9 aa, Homo Sapiens
YPCKNLFLV

SEQ ID NO: 513148 - protein, 9 aa, Homo Sapiens
GLATGCTLR

SEQ ID NO: 513149 - protein, 9 aa, Homo Sapiens
PSTFSWLHT

SEQ ID NO: 513150 - protein, 9 aa, Homo Sapiens
ILFSILKMH

SEQ ID NO: 513151 - protein, 9 aa, Homo Sapiens
LALLQLHTP

SEQ ID NO: 513152 - protein, 9 aa, Homo Sapiens
GCPGLTEKS

SEQ ID NO: 513153 - protein, 9 aa, Homo Sapiens
PKGFSSQNG

SEQ ID NO: 513154 - protein, 9 aa, Homo Sapiens
KTYKWDVSD

SEQ ID NO: 513155 - protein, 9 aa, Homo Sapiens
KCFSDFTNH

SEQ ID NO: 513156 - protein, 9 aa, Homo Sapiens
GLALHFLNH

SEQ ID NO: 513157 - protein, 9 aa, Homo Sapiens
LKERLGEQE

SEQ ID NO: 513158 - protein, 9 aa, Homo Sapiens
SDFTNHKRI

SEQ ID NO: 513159 - protein, 9 aa, Homo Sapiens
PALSSSCQP

SEQ ID NO: 513160 - protein, 9 aa, Homo Sapiens
RMPPHVLVN

SEQ ID NO: 513161 - protein, 9 aa, Homo Sapiens
LVAWDPASL

SEQ ID NO: 513162 - protein, 9 aa, Homo Sapiens
ASRDKVNKA

SEQ ID NO: 513163 - protein, 9 aa, Homo Sapiens
ELVVHSKLH

SEQ ID NO: 513164 - protein, 9 aa, Homo Sapiens
PKSGKVVQE

SEQ ID NO: 513165 - protein, 9 aa, Homo Sapiens
CFSDFTNHK

SEQ ID NO: 513166 - protein, 9 aa, Homo Sapiens
GSPPWQQYW

SEQ ID NO: 513167 - protein, 9 aa, Homo Sapiens
GRRMPPHVL

SEQ ID NO: 513168 - protein, 9 aa, Homo Sapiens
LMRSPGSLP

SEQ ID NO: 513169 - protein, 9 aa, Homo Sapiens
DKTYKWDVS

SEQ ID NO: 513170 - protein, 9 aa, Homo Sapiens
STISAREEV

SEQ ID NO: 513171 - protein, 9 aa, Homo Sapiens
FILFSILKM

SEQ ID NO: 513172 - protein, 9 aa, Homo Sapiens
AARAMCDNL

SEQ ID NO: 513173 - protein, 9 aa, Homo Sapiens
IFVVVGDTV

SEQ ID NO: 513174 - protein, 9 aa, Homo Sapiens
VHCEGDAIQ

SEQ ID NO: 513175 - protein, 9 aa, Homo Sapiens
LELEEDVMP

SEQ ID NO: 513176 - protein, 9 aa, Homo Sapiens
NIYLQTRRD

SEQ ID NO: 513177 - protein, 9 aa, Homo Sapiens
SLDCLSNTV

SEQ ID NO: 513178 - protein, 9 aa, Homo Sapiens
VQATFHRFH

SEQ ID NO: 513179 - protein, 9 aa, Homo Sapiens
ECPKGFSSQ

SEQ ID NO: 513180 - protein, 9 aa, Homo Sapiens
KVAFDVKMV

SEQ ID NO: 513181 - protein, 9 aa, Homo Sapiens
GDAIQALVA

SEQ ID NO: 513182 - protein, 9 aa, Homo Sapiens
PESPEPQRA

SEQ ID NO: 513183 - protein, 9 aa, Homo Sapiens
FHKACTQCL

SEQ ID NO: 513184 - protein, 9 aa, Homo Sapiens
SASKPWGIS

SEQ ID NO: 513185 - protein, 9 aa, Homo Sapiens
PQGGGEAQP

SEQ ID NO: 513186 - protein, 9 aa, Homo Sapiens
STQHCTDLG

SEQ ID NO: 513187 - protein, 9 aa, Homo Sapiens
FQRRDKMDE

SEQ ID NO: 513188 - protein, 9 aa, Homo Sapiens
YRPAVEPAF

SEQ ID NO: 513189 - protein, 9 aa, Homo Sapiens
QPEAIIVTR

SEQ ID NO: 513190 - protein, 9 aa, Homo Sapiens
RDKVNKAYR

SEQ ID NO: 513191 - protein, 9 aa, Homo Sapiens
KTAIWEAQT

SEQ ID NO: 513192 - protein, 9 aa, Homo Sapiens
LKNTERSEE

SEQ ID NO: 513193 - protein, 9 aa, Homo Sapiens
IPDVCVTQH

SEQ ID NO: 513194 - protein, 9 aa, Homo Sapiens
QEPKSGKVV

SEQ ID NO: 513195 - protein, 9 aa, Homo Sapiens
SIIFVVVGD

SEQ ID NO: 513196 - protein, 9 aa, Homo Sapiens
LTALRGEDG

SEQ ID NO: 513197 - protein, 9 aa, Homo Sapiens
KGFSSQNGE

SEQ ID NO: 513198 - protein, 9 aa, Homo Sapiens
KRTKFSCHN

SEQ ID NO: 513199 - protein, 9 aa, Homo Sapiens
LHTPVNLSA

SEQ ID NO: 513200 - protein, 9 aa, Homo Sapiens
KSACKIKQS

SEQ ID NO: 513201 - protein, 9 aa, Homo Sapiens
TCKTQLSLE

SEQ ID NO: 513202 - protein, 9 aa, Homo Sapiens
AEKYSKDRK

SEQ ID NO: 513203 - protein, 9 aa, Homo Sapiens
TATSGPVTL

SEQ ID NO: 513204 - protein, 9 aa, Homo Sapiens
IVGWVLDCI

SEQ ID NO: 513205 - protein, 9 aa, Homo Sapiens
CEGDAIQAL

SEQ ID NO: 513206 - protein, 9 aa, Homo Sapiens
VRGAPVIVP

SEQ ID NO: 513207 - protein, 9 aa, Homo Sapiens
PFVIRAIGF

SEQ ID NO: 513208 - protein, 9 aa, Homo Sapiens
DLALLQLHT

SEQ ID NO: 513209 - protein, 9 aa, Homo Sapiens
DVSYYEKDS

SEQ ID NO: 513210 - protein, 9 aa, Homo Sapiens
EKYSKDRKK

SEQ ID NO: 513211 - protein, 9 aa, Homo Sapiens
APLVQATFH

SEQ ID NO: 513212 - protein, 9 aa, Homo Sapiens
NPVTLTCKT

SEQ ID NO: 513213 - protein, 9 aa, Homo Sapiens
ATRAASTQH

SEQ ID NO: 513214 - protein, 9 aa, Homo Sapiens
AWMIGLPHC

SEQ ID NO: 513215 - protein, 9 aa, Homo Sapiens
PLRADLAEK

SEQ ID NO: 513216 - protein, 9 aa, Homo Sapiens
CPKGFSSQN

SEQ ID NO: 513217 - protein, 9 aa, Homo Sapiens
YEPNIEVQF

SEQ ID NO: 513218 - protein, 9 aa, Homo Sapiens
SWLHTVTVT

SEQ ID NO: 513219 - protein, 9 aa, Homo Sapiens
ACGGDGIVG

SEQ ID NO: 513220 - protein, 9 aa, Homo Sapiens
CGLALHFLN

SEQ ID NO: 513221 - protein, 9 aa, Homo Sapiens
VSASKPWGI

SEQ ID NO: 513222 - protein, 9 aa, Homo Sapiens
SSSCQPPAN

SEQ ID NO: 513223 - protein, 9 aa, Homo Sapiens
EKERKGARK

SEQ ID NO: 513224 - protein, 9 aa, Homo Sapiens
PVTLTCKTQ

SEQ ID NO: 513225 - protein, 9 aa, Homo Sapiens
LTKGELTHL

SEQ ID NO: 513226 - protein, 9 aa, Homo Sapiens
AQTLLGLGG

SEQ ID NO: 513227 - protein, 9 aa, Homo Sapiens
SSSHEEAPV

SEQ ID NO: 513228 - protein, 9 aa, Homo Sapiens
DDKKLEFSL

SEQ ID NO: 513229 - protein, 9 aa, Homo Sapiens
MANIYLQTR

SEQ ID NO: 513230 - protein, 9 aa, Homo Sapiens
NLPWPNRLM

SEQ ID NO: 513231 - protein, 9 aa, Homo Sapiens
SSHEEAPVL

SEQ ID NO: 513232 - protein, 9 aa, Homo Sapiens
EAEYDSFKQ

SEQ ID NO: 513233 - protein, 9 aa, Homo Sapiens
PAYRDTPPF

SEQ ID NO: 513234 - protein, 9 aa, Homo Sapiens
KWKTAIWEA

SEQ ID NO: 513235 - protein, 9 aa, Homo Sapiens
VTQEPKSGK

SEQ ID NO: 513236 - protein, 9 aa, Homo Sapiens
VSQMGPVHA

SEQ ID NO: 513237 - protein, 9 aa, Homo Sapiens
GQPEAIIVT

SEQ ID NO: 513238 - protein, 9 aa, Homo Sapiens
SHSAARAMC

SEQ ID NO: 513239 - protein, 9 aa, Homo Sapiens
AFKCFSDFT

SEQ ID NO: 513240 - protein, 9 aa, Homo Sapiens
EVHCEGDAI

SEQ ID NO: 513241 - protein, 9 aa, Homo Sapiens
EKWKTAIWE

SEQ ID NO: 513242 - protein, 9 aa, Homo Sapiens
DDSVGSVGF

SEQ ID NO: 513243 - protein, 9 aa, Homo Sapiens
KFSCHNVLH

SEQ ID NO: 513244 - protein, 9 aa, Homo Sapiens
PVTTATSGP

SEQ ID NO: 513245 - protein, 9 aa, Homo Sapiens
PNRLMSLVS

SEQ ID NO: 513246 - protein, 9 aa, Homo Sapiens
REEVVQRIP

SEQ ID NO: 513247 - protein, 9 aa, Homo Sapiens
TSVDAPPQV

SEQ ID NO: 513248 - protein, 9 aa, Homo Sapiens
PSRKRKMSP

SEQ ID NO: 513249 - protein, 9 aa, Homo Sapiens
FSHSAARAM

SEQ ID NO: 513250 - protein, 9 aa, Homo Sapiens
ALLQLHTPV

SEQ ID NO: 513251 - protein, 9 aa, Homo Sapiens
FDRVKLFPH

SEQ ID NO: 513252 - protein, 9 aa, Homo Sapiens
QYRTVSQMG

SEQ ID NO: 513253 - protein, 9 aa, Homo Sapiens
DPASLPLPP

SEQ ID NO: 513254 - protein, 9 aa, Homo Sapiens
LYPSAPMLG

SEQ ID NO: 513255 - protein, 9 aa, Homo Sapiens
LTQLIIWTL

SEQ ID NO: 513256 - protein, 9 aa, Homo Sapiens
DPPGQPEAI

SEQ ID NO: 513257 - protein, 9 aa, Homo Sapiens
ASSSGGSIV

SEQ ID NO: 513258 - protein, 9 aa, Homo Sapiens
QTRRDRRLY

SEQ ID NO: 513259 - protein, 9 aa, Homo Sapiens
SSCQPPANM

SEQ ID NO: 513260 - protein, 9 aa, Homo Sapiens
EKEKKKGRE

SEQ ID NO: 513261 - protein, 9 aa, Homo Sapiens
MKRYVHQLF

SEQ ID NO: 513262 - protein, 9 aa, Homo Sapiens
AGHVTQEPK

SEQ ID NO: 513263 - protein, 9 aa, Homo Sapiens
EKSMGTKEQ

SEQ ID NO: 513264 - protein, 9 aa, Homo Sapiens
RRYYYSVED

SEQ ID NO: 513265 - protein, 9 aa, Homo Sapiens
TTATSGPVT

SEQ ID NO: 513266 - protein, 9 aa, Homo Sapiens
RRDRRLYIR

SEQ ID NO: 513267 - protein, 9 aa, Homo Sapiens
DLAEKYSKD

SEQ ID NO: 513268 - protein, 9 aa, Homo Sapiens
LQLHTPVNL

SEQ ID NO: 513269 - protein, 9 aa, Homo Sapiens
VTTATSGPV

SEQ ID NO: 513270 - protein, 9 aa, Homo Sapiens
FLSHFPGGS

SEQ ID NO: 513271 - protein, 9 aa, Homo Sapiens
LFQRRDKMD

SEQ ID NO: 513272 - protein, 9 aa, Homo Sapiens
FHGMQRDVQ

SEQ ID NO: 513273 - protein, 9 aa, Homo Sapiens
EDSERDEDR

SEQ ID NO: 513274 - protein, 9 aa, Homo Sapiens
IYLQTRRDR

SEQ ID NO: 513275 - protein, 9 aa, Homo Sapiens
DGIVGWVLD

SEQ ID NO: 513276 - protein, 9 aa, Homo Sapiens
NIFKHLRHL

SEQ ID NO: 513277 - protein, 9 aa, Homo Sapiens
EKGFECEYR

SEQ ID NO: 513278 - protein, 9 aa, Homo Sapiens
ENLPWPNRL

SEQ ID NO: 513279 - protein, 9 aa, Homo Sapiens
ALVANNASE

SEQ ID NO: 513280 - protein, 9 aa, Homo Sapiens
EKDEDSERD

SEQ ID NO: 513281 - protein, 9 aa, Homo Sapiens
QELVVHSKL

SEQ ID NO: 513282 - protein, 9 aa, Homo Sapiens
EKVETPPKT

SEQ ID NO: 513283 - protein, 9 aa, Homo Sapiens
LLGLGGVPI

SEQ ID NO: 513284 - protein, 9 aa, Homo Sapiens
SRDKTYKWD

SEQ ID NO: 513285 - protein, 9 aa, Homo Sapiens
TLLGLGGVP

SEQ ID NO: 513286 - protein, 9 aa, Homo Sapiens
KAFKCFSDF

SEQ ID NO: 513287 - protein, 9 aa, Homo Sapiens
WMIGLPHCL

SEQ ID NO: 513288 - protein, 9 aa, Homo Sapiens
GEYEPNIEV

SEQ ID NO: 513289 - protein, 9 aa, Homo Sapiens
SIVRGAPVI

SEQ ID NO: 513290 - protein, 9 aa, Homo Sapiens
TKFSCHNVL

SEQ ID NO: 513291 - protein, 9 aa, Homo Sapiens
LSPGLMRSP

SEQ ID NO: 513292 - protein, 9 aa, Homo Sapiens
LQKDCNLKK

SEQ ID NO: 513293 - protein, 9 aa, Homo Sapiens
KIKQSHQEC

SEQ ID NO: 513294 - protein, 9 aa, Homo Sapiens
LAPPQHLTR

SEQ ID NO: 513295 - protein, 9 aa, Homo Sapiens
ADLAEKYSK

SEQ ID NO: 513296 - protein, 9 aa, Homo Sapiens
IMAPLVQAT

SEQ ID NO: 513297 - protein, 9 aa, Homo Sapiens
ARAMCDNLL

SEQ ID NO: 513298 - protein, 9 aa, Homo Sapiens
SGGSIVRGA

SEQ ID NO: 513299 - protein, 9 aa, Homo Sapiens
QQEAVWKLL

SEQ ID NO: 513300 - protein, 9 aa, Homo Sapiens
RAPALSSSC

SEQ ID NO: 513301 - protein, 9 aa, Homo Sapiens
YLVGEVHCE

SEQ ID NO: 513302 - protein, 9 aa, Homo Sapiens
WFHKACTQC

SEQ ID NO: 513303 - protein, 9 aa, Homo Sapiens
TDDSVGSVG

SEQ ID NO: 513304 - protein, 9 aa, Homo Sapiens
HTVTVTQDG

SEQ ID NO: 513305 - protein, 9 aa, Homo Sapiens
QYENLPWPN

SEQ ID NO: 513306 - protein, 9 aa, Homo Sapiens
PSMQELVVH

SEQ ID NO: 513307 - protein, 9 aa, Homo Sapiens
TACLLTQLI

SEQ ID NO: 513308 - protein, 9 aa, Homo Sapiens
QWFHKACTQ

SEQ ID NO: 513309 - protein, 9 aa, Homo Sapiens
PEEDGGAVA

SEQ ID NO: 513310 - protein, 9 aa, Homo Sapiens
LELPKRDVS

SEQ ID NO: 513311 - protein, 9 aa, Homo Sapiens
KWDVSDRIF

SEQ ID NO: 513312 - protein, 9 aa, Homo Sapiens
LPKRDVSYY

SEQ ID NO: 513313 - protein, 9 aa, Homo Sapiens
KGARKAGKT

SEQ ID NO: 513314 - protein, 9 aa, Homo Sapiens
EAIPCYVNL

SEQ ID NO: 513315 - protein, 9 aa, Homo Sapiens
HCEGDAIQA

SEQ ID NO: 513316 - protein, 9 aa, Homo Sapiens
VMGEYEPNI

SEQ ID NO: 513317 - protein, 9 aa, Homo Sapiens
CGKSFKCNS

SEQ ID NO: 513318 - protein, 9 aa, Homo Sapiens
ATSGPVTLV

SEQ ID NO: 513319 - protein, 9 aa, Homo Sapiens
SNTVDRITS

SEQ ID NO: 513320 - protein, 9 aa, Homo Sapiens
VANNASETA

SEQ ID NO: 513321 - protein, 9 aa, Homo Sapiens
RADLAEKYS

SEQ ID NO: 513322 - protein, 9 aa, Homo Sapiens
VLTALRGED

SEQ ID NO: 513323 - protein, 9 aa, Homo Sapiens
IWEAQTFSR

SEQ ID NO: 513324 - protein, 9 aa, Homo Sapiens
QHLTRVEGN

SEQ ID NO: 513325 - protein, 9 aa, Homo Sapiens
DTPPFKRSL

SEQ ID NO: 513326 - protein, 9 aa, Homo Sapiens
LQYRTVSQM

SEQ ID NO: 513327 - protein, 9 aa, Homo Sapiens
PGGTPQGGG

SEQ ID NO: 513328 - protein, 9 aa, Homo Sapiens
KQYPCKNLF

SEQ ID NO: 513329 - protein, 9 aa, Homo Sapiens
DSERDEDRE

SEQ ID NO: 513330 - protein, 9 aa, Homo Sapiens
RVLVTVGGC

SEQ ID NO: 513331 - protein, 9 aa, Homo Sapiens
LLMMMKENF

SEQ ID NO: 513332 - protein, 9 aa, Homo Sapiens
DENNWGLSV

SEQ ID NO: 513333 - protein, 9 aa, Homo Sapiens
SDLALLQLH

SEQ ID NO: 513334 - protein, 9 aa, Homo Sapiens
SSSSHEEAP

SEQ ID NO: 513335 - protein, 9 aa, Homo Sapiens
VTLKQYPCK

SEQ ID NO: 513336 - protein, 9 aa, Homo Sapiens
LHTVTVTQD

SEQ ID NO: 513337 - protein, 9 aa, Homo Sapiens
DSVGSVGFK

SEQ ID NO: 513338 - protein, 9 aa, Homo Sapiens
LRADLAEKY

SEQ ID NO: 513339 - protein, 9 aa, Homo Sapiens
KKKGREKER

SEQ ID NO: 513340 - protein, 9 aa, Homo Sapiens
DVKMVNEKL

SEQ ID NO: 513341 - protein, 9 aa, Homo Sapiens
TISAREEVV

SEQ ID NO: 513342 - protein, 9 aa, Homo Sapiens
PQHLTRVEG

SEQ ID NO: 513343 - protein, 9 aa, Homo Sapiens
ISEPPLEAI

SEQ ID NO: 513344 - protein, 9 aa, Homo Sapiens
TKGELTHLL

SEQ ID NO: 513345 - protein, 9 aa, Homo Sapiens
HFPGGSPPW

SEQ ID NO: 513346 - protein, 9 aa, Homo Sapiens
LGLGGVPIQ

SEQ ID NO: 513347 - protein, 9 aa, Homo Sapiens
CTLRSIIFV

SEQ ID NO: 513348 - protein, 9 aa, Homo Sapiens
GDGIVGWVL

SEQ ID NO: 513349 - protein, 9 aa, Homo Sapiens
VVKPFMPET

SEQ ID NO: 513350 - protein, 9 aa, Homo Sapiens
ENNWGLSVY

SEQ ID NO: 513351 - protein, 9 aa, Homo Sapiens
SHFPGGSPP

SEQ ID NO: 513352 - protein, 9 aa, Homo Sapiens
FKRSLLKVV

SEQ ID NO: 513353 - protein, 9 aa, Homo Sapiens
LTRVEGNLR

SEQ ID NO: 513354 - protein, 9 aa, Homo Sapiens
HLQTDDSVG

SEQ ID NO: 513355 - protein, 9 aa, Homo Sapiens
PCKNLFLVE

SEQ ID NO: 513356 - protein, 9 aa, Homo Sapiens
RPAVEPAFL

SEQ ID NO: 513357 - protein, 9 aa, Homo Sapiens
LEKWKTAIW

SEQ ID NO: 513358 - protein, 9 aa, Homo Sapiens
RAMCDNLLN

SEQ ID NO: 513359 - protein, 9 aa, Homo Sapiens
SVEDISVGG

SEQ ID NO: 513360 - protein, 9 aa, Homo Sapiens
PPQHLTRVE

SEQ ID NO: 513361 - protein, 9 aa, Homo Sapiens
KLLHTEASY

SEQ ID NO: 513362 - protein, 9 aa, Homo Sapiens
PKRDVSYYE

SEQ ID NO: 513363 - protein, 9 aa, Homo Sapiens
WCGLALHFL

SEQ ID NO: 513364 - protein, 9 aa, Homo Sapiens
GEVHCEGDA

SEQ ID NO: 513365 - protein, 9 aa, Homo Sapiens
VTVGGCPGL

SEQ ID NO: 513366 - protein, 9 aa, Homo Sapiens
HSAARAMCD

SEQ ID NO: 513367 - protein, 9 aa, Homo Sapiens
DECGKSFKC

SEQ ID NO: 513368 - protein, 9 aa, Homo Sapiens
RDKMDELEG

SEQ ID NO: 513369 - protein, 9 aa, Homo Sapiens
DVNDENNWG

SEQ ID NO: 513370 - protein, 9 aa, Homo Sapiens
TGCTLRSII

SEQ ID NO: 513371 - protein, 9 aa, Homo Sapiens
KYVYELLQK

SEQ ID NO: 513372 - protein, 9 aa, Homo Sapiens
RTVSQMGPV

SEQ ID NO: 513373 - protein, 9 aa, Homo Sapiens
VSYYEKDSE

SEQ ID NO: 513374 - protein, 9 aa, Homo Sapiens
SLDATRAAS

SEQ ID NO: 513375 - protein, 9 aa, Homo Sapiens
GDTVYLVGE

SEQ ID NO: 513376 - protein, 9 aa, Homo Sapiens
LPFVIRAIG

SEQ ID NO: 513377 - protein, 9 aa, Homo Sapiens
KIEKPSLLM

SEQ ID NO: 513378 - protein, 9 aa, Homo Sapiens
TQEPKSGKV

SEQ ID NO: 513379 - protein, 9 aa, Homo Sapiens
CKIKQSHQE

SEQ ID NO: 513380 - protein, 9 aa, Homo Sapiens
RLLKNTERS

SEQ ID NO: 513381 - protein, 9 aa, Homo Sapiens
CDFILFSIL

SEQ ID NO: 513382 - protein, 9 aa, Homo Sapiens
TPQGGGEAQ

SEQ ID NO: 513383 - protein, 9 aa, Homo Sapiens
PVKRPRLLK

SEQ ID NO: 513384 - protein, 9 aa, Homo Sapiens
QMGPVHAPV

SEQ ID NO: 513385 - protein, 9 aa, Homo Sapiens
GLMRSPGSL

SEQ ID NO: 513386 - protein, 9 aa, Homo Sapiens
VLVTVGGCP

SEQ ID NO: 513387 - protein, 9 aa, Homo Sapiens
ADDKKLEFS

SEQ ID NO: 513388 - protein, 9 aa, Homo Sapiens
RILKERLGE

SEQ ID NO: 513389 - protein, 9 aa, Homo Sapiens
GPEEDGGAV

SEQ ID NO: 513390 - protein, 9 aa, Homo Sapiens
RKRKMSPLR

SEQ ID NO: 513391 - protein, 9 aa, Homo Sapiens
QKMGGFHGM

SEQ ID NO: 513392 - protein, 9 aa, Homo Sapiens
GREKERKGA

SEQ ID NO: 513393 - protein, 9 aa, Homo Sapiens
CSLTKGELT

SEQ ID NO: 513394 - protein, 9 aa, Homo Sapiens
YIPVVKPFM

SEQ ID NO: 513395 - protein, 9 aa, Homo Sapiens
SELPFVIRA

SEQ ID NO: 513396 - protein, 9 aa, Homo Sapiens
VAQTLLGLG

SEQ ID NO: 513397 - protein, 9 aa, Homo Sapiens
QTLLGLGGV

SEQ ID NO: 513398 - protein, 9 aa, Homo Sapiens
VETPPKTSV

SEQ ID NO: 513399 - protein, 9 aa, Homo Sapiens
FPGGSPPWQ

SEQ ID NO: 513400 - protein, 9 aa, Homo Sapiens
KMVNEKLVL

SEQ ID NO: 513401 - protein, 9 aa, Homo Sapiens
DKMDELEGF

SEQ ID NO: 513402 - protein, 9 aa, Homo Sapiens
EGDAIQALV

SEQ ID NO: 513403 - protein, 9 aa, Homo Sapiens
VGKTSIMKR

SEQ ID NO: 513404 - protein, 9 aa, Homo Sapiens
EEVVQRIPE

SEQ ID NO: 513405 - protein, 9 aa, Homo Sapiens
KCNSRLVQH

SEQ ID NO: 513406 - protein, 9 aa, Homo Sapiens
EECGCSLTK

SEQ ID NO: 513407 - protein, 9 aa, Homo Sapiens
AWDPASLPL

SEQ ID NO: 513408 - protein, 9 aa, Homo Sapiens
QYRPAVEPA

SEQ ID NO: 513409 - protein, 9 aa, Homo Sapiens
TALRGEDGL

SEQ ID NO: 513410 - protein, 9 aa, Homo Sapiens
LHFLNHLTS

SEQ ID NO: 513411 - protein, 9 aa, Homo Sapiens
KPSLLMMMK

SEQ ID NO: 513412 - protein, 9 aa, Homo Sapiens
KMGGFHGMQ

SEQ ID NO: 513413 - protein, 9 aa, Homo Sapiens
ELEEDVMPH

SEQ ID NO: 513414 - protein, 9 aa, Homo Sapiens
YLQTRRDRR

SEQ ID NO: 513415 - protein, 9 aa, Homo Sapiens
SRALAGRRM

SEQ ID NO: 513416 - protein, 9 aa, Homo Sapiens
WPNRLMSLV

SEQ ID NO: 513417 - protein, 9 aa, Homo Sapiens
AREEVVQRI

SEQ ID NO: 513418 - protein, 9 aa, Homo Sapiens
APPQHLTRV

SEQ ID NO: 513419 - protein, 9 aa, Homo Sapiens
SDIRILKER

SEQ ID NO: 513420 - protein, 9 aa, Homo Sapiens
SAREEVVQR

SEQ ID NO: 513421 - protein, 9 aa, Homo Sapiens
TAWMIGLPH

SEQ ID NO: 513422 - protein, 9 aa, Homo Sapiens
GGFHGMQRD

SEQ ID NO: 513423 - protein, 9 aa, Homo Sapiens
VSPSRKRKM

SEQ ID NO: 513424 - protein, 9 aa, Homo Sapiens
SGPVTLVAP

SEQ ID NO: 513425 - protein, 9 aa, Homo Sapiens
YQFRVSASK

SEQ ID NO: 513426 - protein, 9 aa, Homo Sapiens
DKVNKAYRK

SEQ ID NO: 513427 - protein, 9 aa, Homo Sapiens
ELEQELQRQ

SEQ ID NO: 513428 - protein, 9 aa, Homo Sapiens
SSSGGSIVR

SEQ ID NO: 513429 - protein, 9 aa, Homo Sapiens
NTVDRITSS

SEQ ID NO: 513430 - protein, 9 aa, Homo Sapiens
REKERKGAR

SEQ ID NO: 513431 - protein, 9 aa, Homo Sapiens
VWKLLHTEA

SEQ ID NO: 513432 - protein, 9 aa, Homo Sapiens
EDGLATGCT

SEQ ID NO: 513433 - protein, 9 aa, Homo Sapiens
RDEDRERRY

SEQ ID NO: 513434 - protein, 9 aa, Homo Sapiens
VVHSKLHYK

SEQ ID NO: 513435 - protein, 9 aa, Homo Sapiens
LEFSLKKLG

SEQ ID NO: 513436 - protein, 9 aa, Homo Sapiens
VIPDVCVTQ

SEQ ID NO: 513437 - protein, 9 aa, Homo Sapiens
IQIIKVNIF

SEQ ID NO: 513438 - protein, 9 aa, Homo Sapiens
KACTQCLNE

SEQ ID NO: 513439 - protein, 9 aa, Homo Sapiens
MQSKSACKI

SEQ ID NO: 513440 - protein, 9 aa, Homo Sapiens
DKKLEFSLK

SEQ ID NO: 513441 - protein, 9 aa, Homo Sapiens
PPGQPEAII

SEQ ID NO: 513442 - protein, 9 aa, Homo Sapiens
SRKRKMSPL

SEQ ID NO: 513443 - protein, 9 aa, Homo Sapiens
EDISVGGMC

SEQ ID NO: 513444 - protein, 9 aa, Homo Sapiens
SSGGSIVRG

SEQ ID NO: 513445 - protein, 9 aa, Homo Sapiens
ERKGARKAG

SEQ ID NO: 513446 - protein, 9 aa, Homo Sapiens
KGELTHLLN

SEQ ID NO: 513447 - protein, 9 aa, Homo Sapiens
SLPLPPPPP

SEQ ID NO: 513448 - protein, 9 aa, Homo Sapiens
PGGSPPWQQ

SEQ ID NO: 513449 - protein, 9 aa, Homo Sapiens
TYKWDVSDR

SEQ ID NO: 513450 - protein, 9 aa, Homo Sapiens
ALRAAEKSM

SEQ ID NO: 513451 - protein, 9 aa, Homo Sapiens
APGGTPQGG

SEQ ID NO: 513452 - protein, 9 aa, Homo Sapiens
AFDVKMVNE

SEQ ID NO: 513453 - protein, 9 aa, Homo Sapiens
EPKSGKVVQ

SEQ ID NO: 513454 - protein, 9 aa, Homo Sapiens
GCSLTKGEL

SEQ ID NO: 513455 - protein, 9 aa, Homo Sapiens
SPFDRVKLF

SEQ ID NO: 513456 - protein, 9 aa, Homo Sapiens
HLTRVEGNL

SEQ ID NO: 513457 - protein, 9 aa, Homo Sapiens
TRRYYYSVE

SEQ ID NO: 513458 - protein, 9 aa, Homo Sapiens
LDATRAAST

SEQ ID NO: 513459 - protein, 9 aa, Homo Sapiens
ACKIKQSHQ

SEQ ID NO: 513460 - protein, 9 aa, Homo Sapiens
ISPFDRVKL

SEQ ID NO: 513461 - protein, 9 aa, Homo Sapiens
ELLQKDCNL

SEQ ID NO: 513462 - protein, 9 aa, Homo Sapiens
DFTNHKRIH

SEQ ID NO: 513463 - protein, 9 aa, Homo Sapiens
FLEKGFECE

SEQ ID NO: 513464 - protein, 9 aa, Homo Sapiens
RRDKMDELE

SEQ ID NO: 513465 - protein, 9 aa, Homo Sapiens
WLHTVTVTQ

SEQ ID NO: 513466 - protein, 9 aa, Homo Sapiens
GTPQGGGEA

SEQ ID NO: 513467 - protein, 9 aa, Homo Sapiens
LVTVGGCPG

SEQ ID NO: 513468 - protein, 9 aa, Homo Sapiens
AIWEAQTFS

SEQ ID NO: 513469 - protein, 9 aa, Homo Sapiens
PKTSVDAPP

SEQ ID NO: 513470 - protein, 9 aa, Homo Sapiens
TQLIIWTLL

SEQ ID NO: 513471 - protein, 9 aa, Homo Sapiens
GARKAGKTT

SEQ ID NO: 513472 - protein, 9 aa, Homo Sapiens
VPSTFSWLH

SEQ ID NO: 513473 - protein, 9 aa, Homo Sapiens
APALSSSCQ

SEQ ID NO: 513474 - protein, 9 aa, Homo Sapiens
ECEYRLAPI

SEQ ID NO: 513475 - protein, 9 aa, Homo Sapiens
KEKEKKKGR

SEQ ID NO: 513476 - protein, 9 aa, Homo Sapiens
SLLMMMKEN

SEQ ID NO: 513477 - protein, 9 aa, Homo Sapiens
TAIWEAQTF

SEQ ID NO: 513478 - protein, 9 aa, Homo Sapiens
DCLSNTVDR

SEQ ID NO: 513479 - protein, 9 aa, Homo Sapiens
MLGGSGPVR

SEQ ID NO: 513480 - protein, 9 aa, Homo Sapiens
EYEPNIEVQ

SEQ ID NO: 513481 - protein, 9 aa, Homo Sapiens
AIPCYVNLD

SEQ ID NO: 513482 - protein, 9 aa, Homo Sapiens
KRPRLLKNT

SEQ ID NO: 513483 - protein, 9 aa, Homo Sapiens
HTPVNLSAA

SEQ ID NO: 513484 - protein, 9 aa, Homo Sapiens
GIVGWVLDC

SEQ ID NO: 513485 - protein, 9 aa, Homo Sapiens
AISPFDRVK

SEQ ID NO: 513486 - protein, 9 aa, Homo Sapiens
GGRVIPDVC

SEQ ID NO: 513487 - protein, 9 aa, Homo Sapiens
KSFKCNSRL

SEQ ID NO: 513488 - protein, 9 aa, Homo Sapiens
YDSFKQELE

SEQ ID NO: 513489 - protein, 9 aa, Homo Sapiens
RALAGRRMP

SEQ ID NO: 513490 - protein, 9 aa, Homo Sapiens
LRAAEKSMG

SEQ ID NO: 513491 - protein, 9 aa, Homo Sapiens
RVSASKPWG

SEQ ID NO: 513492 - protein, 9 aa, Homo Sapiens
LKQYPCKNL

SEQ ID NO: 513493 - protein, 9 aa, Homo Sapiens
SCDFILFSI

SEQ ID NO: 513494 - protein, 9 aa, Homo Sapiens
KEKKKGREK

SEQ ID NO: 513495 - protein, 9 aa, Homo Sapiens
VVQRIPEAS

SEQ ID NO: 513496 - protein, 9 aa, Homo Sapiens
GHVTQEPKS

SEQ ID NO: 513497 - protein, 9 aa, Homo Sapiens
ETPPKTSVD

SEQ ID NO: 513498 - protein, 9 aa, Homo Sapiens
AAEKSMGTK

SEQ ID NO: 513499 - protein, 9 aa, Homo Sapiens
LSELPFVIR

SEQ ID NO: 513500 - protein, 9 aa, Homo Sapiens
IPCYVNLDE

SEQ ID NO: 513501 - protein, 9 aa, Homo Sapiens
ETAWMIGLP

SEQ ID NO: 513502 - protein, 9 aa, Homo Sapiens
ELPFVIRAI

SEQ ID NO: 513503 - protein, 9 aa, Homo Sapiens
GGTPQGGGE

SEQ ID NO: 513504 - protein, 9 aa, Homo Sapiens
LLQKDCNLK

SEQ ID NO: 513505 - protein, 9 aa, Homo Sapiens
GSIVRGAPV

SEQ ID NO: 513506 - protein, 9 aa, Homo Sapiens
SPPWQQYWR

SEQ ID NO: 513507 - protein, 9 aa, Homo Sapiens
FKCNSRLVQ

SEQ ID NO: 513508 - protein, 9 aa, Homo Sapiens
CEYRLAPIP

SEQ ID NO: 513509 - protein, 9 aa, Homo Sapiens
WKLLHTEAS

SEQ ID NO: 513510 - protein, 9 aa, Homo Sapiens
VYELLQKDC

SEQ ID NO: 513511 - protein, 9 aa, Homo Sapiens
VGDTVYLVG

SEQ ID NO: 513512 - protein, 9 aa, Homo Sapiens
PLYPSAPML

SEQ ID NO: 513513 - protein, 9 aa, Homo Sapiens
YENLPWPNR

SEQ ID NO: 513514 - protein, 9 aa, Homo Sapiens
RPRLLKNTE

SEQ ID NO: 513515 - protein, 9 aa, Homo Sapiens
SRDKVNKAY

SEQ ID NO: 513516 - protein, 9 aa, Homo Sapiens
VTLTCKTQL

SEQ ID NO: 513517 - protein, 9 aa, Homo Sapiens
VCVTQHFAK

SEQ ID NO: 513518 - protein, 9 aa, Homo Sapiens
EKRTKFSCH

SEQ ID NO: 513519 - protein, 9 aa, Homo Sapiens
MWLHLQTDD

SEQ ID NO: 513520 - protein, 9 aa, Homo Sapiens
MLFKAHMGQ

SEQ ID NO: 513521 - protein, 9 aa, Homo Sapiens
EAVWKLLHT

SEQ ID NO: 513522 - protein, 9 aa, Homo Sapiens
QAISPFDRV

SEQ ID NO: 513523 - protein, 9 aa, Homo Sapiens
IMKRYVHQL

SEQ ID NO: 513524 - protein, 9 aa, Homo Sapiens
YSVEDISVG

SEQ ID NO: 513525 - protein, 9 aa, Homo Sapiens
LYIPVVKPF

SEQ ID NO: 513526 - protein, 9 aa, Homo Sapiens
SERDEDRER

SEQ ID NO: 513527 - protein, 9 aa, Homo Sapiens
LAFDVNDEN

SEQ ID NO: 513528 - protein, 9 aa, Homo Sapiens
AEKSMGTKE

SEQ ID NO: 513529 - protein, 9 aa, Homo Sapiens
QFRVSASKP

SEQ ID NO: 513530 - protein, 9 aa, Homo Sapiens
KTQLSLERS

SEQ ID NO: 513531 - protein, 9 aa, Homo Sapiens
WDVSDRIFN

SEQ ID NO: 513532 - protein, 9 aa, Homo Sapiens
MPPHVLVNW

SEQ ID NO: 513533 - protein, 9 aa, Homo Sapiens
CVTQHFAKE

SEQ ID NO: 513534 - protein, 9 aa, Homo Sapiens
FVIRAIGFY

SEQ ID NO: 513535 - protein, 9 aa, Homo Sapiens
VIRAIGFYP

SEQ ID NO: 513536 - protein, 9 aa, Homo Sapiens
ELEAEYDSF

SEQ ID NO: 513537 - protein, 9 aa, Homo Sapiens
SAPMLGGSG

SEQ ID NO: 513538 - protein, 9 aa, Homo Sapiens
RCRQWFHKA

SEQ ID NO: 513539 - protein, 9 aa, Homo Sapiens
LAEKYSKDR

SEQ ID NO: 513540 - protein, 9 aa, Homo Sapiens
FVAQTLLGL

SEQ ID NO: 513541 - protein, 9 aa, Homo Sapiens
PASLPLPPP

SEQ ID NO: 513542 - protein, 9 aa, Homo Sapiens
VHLPESPEP

SEQ ID NO: 513543 - protein, 9 aa, Homo Sapiens
HVTQEPKSG

SEQ ID NO: 513544 - protein, 9 aa, Homo Sapiens
RQAISPFDR

SEQ ID NO: 513545 - protein, 9 aa, Homo Sapiens
LVGEVHCEG

SEQ ID NO: 513546 - protein, 9 aa, Homo Sapiens
SAARAMCDN

SEQ ID NO: 513547 - protein, 9 aa, Homo Sapiens
KSMGTKEQE

SEQ ID NO: 513548 - protein, 9 aa, Homo Sapiens
DLALLELEE

SEQ ID NO: 513549 - protein, 9 aa, Homo Sapiens
MQELVVHSK

SEQ ID NO: 513550 - protein, 9 aa, Homo Sapiens
FRQAISPFD

SEQ ID NO: 513551 - protein, 9 aa, Homo Sapiens
YRDTPPFKR

SEQ ID NO: 513552 - protein, 9 aa, Homo Sapiens
RAVRELEQE

SEQ ID NO: 513553 - protein, 9 aa, Homo Sapiens
RAAEKSMGT

SEQ ID NO: 513554 - protein, 9 aa, Homo Sapiens
RSIIFVVVG

SEQ ID NO: 513555 - protein, 9 aa, Homo Sapiens
IVLDVAAGG

SEQ ID NO: 513556 - protein, 9 aa, Homo Sapiens
EPLCGTLRD

SEQ ID NO: 513557 - protein, 9 aa, Homo Sapiens
REYCPHSTD

SEQ ID NO: 513558 - protein, 9 aa, Homo Sapiens
NSSNQPHGK

SEQ ID NO: 513559 - protein, 9 aa, Homo Sapiens
CFLLDPRAN

SEQ ID NO: 513560 - protein, 9 aa, Homo Sapiens
NFEVHRYEN

SEQ ID NO: 513561 - protein, 9 aa, Homo Sapiens
AKGDALPAE

SEQ ID NO: 513562 - protein, 9 aa, Homo Sapiens
AIIFGACFL

SEQ ID NO: 513563 - protein, 9 aa, Homo Sapiens
ALVGEDAAL

SEQ ID NO: 513564 - protein, 9 aa, Homo Sapiens
ALDSQVMSL

SEQ ID NO: 513565 - protein, 9 aa, Homo Sapiens
KANRTALVA

SEQ ID NO: 513566 - protein, 9 aa, Homo Sapiens
LIIKPSLIS

SEQ ID NO: 513567 - protein, 9 aa, Homo Sapiens
RGWRPLRKT

SEQ ID NO: 513568 - protein, 9 aa, Homo Sapiens
TRNLLVILS

SEQ ID NO: 513569 - protein, 9 aa, Homo Sapiens
VGEDAALSC

SEQ ID NO: 513570 - protein, 9 aa, Homo Sapiens
NYGEEGTHM

SEQ ID NO: 513571 - protein, 9 aa, Homo Sapiens
ATTTEHFIQ

SEQ ID NO: 513572 - protein, 9 aa, Homo Sapiens
LDVKMKAII

SEQ ID NO: 513573 - protein, 9 aa, Homo Sapiens
GHPAGMTYT

SEQ ID NO: 513574 - protein, 9 aa, Homo Sapiens
VRMSRTIFS

SEQ ID NO: 513575 - protein, 9 aa, Homo Sapiens
GGGGGTQDK

SEQ ID NO: 513576 - protein, 9 aa, Homo Sapiens
ARQKNTCAS

SEQ ID NO: 513577 - protein, 9 aa, Homo Sapiens
AATTTEHFI

SEQ ID NO: 513578 - protein, 9 aa, Homo Sapiens
GIVGEAQSK

SEQ ID NO: 513579 - protein, 9 aa, Homo Sapiens
HPAQPGLSK

SEQ ID NO: 513580 - protein, 9 aa, Homo Sapiens
MPAIPAAAV

SEQ ID NO: 513581 - protein, 9 aa, Homo Sapiens
SSSVPANEL

SEQ ID NO: 513582 - protein, 9 aa, Homo Sapiens
TQKCFLLDP

SEQ ID NO: 513583 - protein, 9 aa, Homo Sapiens
KANLPPLYA

SEQ ID NO: 513584 - protein, 9 aa, Homo Sapiens
RRSLEEHKE

SEQ ID NO: 513585 - protein, 9 aa, Homo Sapiens
FETCLKTRK

SEQ ID NO: 513586 - protein, 9 aa, Homo Sapiens
DKSIKDFAH

SEQ ID NO: 513587 - protein, 9 aa, Homo Sapiens
HSHLTRARR

SEQ ID NO: 513588 - protein, 9 aa, Homo Sapiens
NITQKCFLL

SEQ ID NO: 513589 - protein, 9 aa, Homo Sapiens
SNGTPNGFY

SEQ ID NO: 513590 - protein, 9 aa, Homo Sapiens
RHSHLTRAR

SEQ ID NO: 513591 - protein, 9 aa, Homo Sapiens
ATAAATTTE

SEQ ID NO: 513592 - protein, 9 aa, Homo Sapiens
NTCASVRRL

SEQ ID NO: 513593 - protein, 9 aa, Homo Sapiens
PVVYHTSPQ

SEQ ID NO: 513594 - protein, 9 aa, Homo Sapiens
IEGSDILVA

SEQ ID NO: 513595 - protein, 9 aa, Homo Sapiens
YTANILPHH

SEQ ID NO: 513596 - protein, 9 aa, Homo Sapiens
AKSNDGYHI

SEQ ID NO: 513597 - protein, 9 aa, Homo Sapiens
RRPRHSHLT

SEQ ID NO: 513598 - protein, 9 aa, Homo Sapiens
VKNITQKCF

SEQ ID NO: 513599 - protein, 9 aa, Homo Sapiens
EVSTRNLLV

SEQ ID NO: 513600 - protein, 9 aa, Homo Sapiens
APGGVDAVI

SEQ ID NO: 513601 - protein, 9 aa, Homo Sapiens
PTPEMPAIP

SEQ ID NO: 513602 - protein, 9 aa, Homo Sapiens
MFEQSTPGS

SEQ ID NO: 513603 - protein, 9 aa, Homo Sapiens
LPSKDGSRK

SEQ ID NO: 513604 - protein, 9 aa, Homo Sapiens
QEKWLWDQE

SEQ ID NO: 513605 - protein, 9 aa, Homo Sapiens
IRSKYKVKP

SEQ ID NO: 513606 - protein, 9 aa, Homo Sapiens
TVGGLIIKP

SEQ ID NO: 513607 - protein, 9 aa, Homo Sapiens
SLATASGGN

SEQ ID NO: 513608 - protein, 9 aa, Homo Sapiens
NQDKSIKDF

SEQ ID NO: 513609 - protein, 9 aa, Homo Sapiens
VAMQSNSIP

SEQ ID NO: 513610 - protein, 9 aa, Homo Sapiens
HKSTISYDT

SEQ ID NO: 513611 - protein, 9 aa, Homo Sapiens
RNLLVILSR

SEQ ID NO: 513612 - protein, 9 aa, Homo Sapiens
RKERPPLDM

SEQ ID NO: 513613 - protein, 9 aa, Homo Sapiens
DGALDSQVM

SEQ ID NO: 513614 - protein, 9 aa, Homo Sapiens
CQYVVGHER

SEQ ID NO: 513615 - protein, 9 aa, Homo Sapiens
GRRGWRPLR

SEQ ID NO: 513616 - protein, 9 aa, Homo Sapiens
KNMLFSSTN

SEQ ID NO: 513617 - protein, 9 aa, Homo Sapiens
STIKAKSND

SEQ ID NO: 513618 - protein, 9 aa, Homo Sapiens
LMPVVYHTS

SEQ ID NO: 513619 - protein, 9 aa, Homo Sapiens
EVTFEKIFP

SEQ ID NO: 513620 - protein, 9 aa, Homo Sapiens
GSDILVACS

SEQ ID NO: 513621 - protein, 9 aa, Homo Sapiens
KSIKDFAHS

SEQ ID NO: 513622 - protein, 9 aa, Homo Sapiens
LDVAAGGLG

SEQ ID NO: 513623 - protein, 9 aa, Homo Sapiens
GTAAAAATA

SEQ ID NO: 513624 - protein, 9 aa, Homo Sapiens
DVKMKAIIF

SEQ ID NO: 513625 - protein, 9 aa, Homo Sapiens
SLRALHGSF

SEQ ID NO: 513626 - protein, 9 aa, Homo Sapiens
KIEWEKAVR

SEQ ID NO: 513627 - protein, 9 aa, Homo Sapiens
HYRLEDNKE

SEQ ID NO: 513628 - protein, 9 aa, Homo Sapiens
VVYHTSPQN

SEQ ID NO: 513629 - protein, 9 aa, Homo Sapiens
VVEEEAQVE

SEQ ID NO: 513630 - protein, 9 aa, Homo Sapiens
GALDSQVMS

SEQ ID NO: 513631 - protein, 9 aa, Homo Sapiens
HRYENSAHG

SEQ ID NO: 513632 - protein, 9 aa, Homo Sapiens
LSCFLSPKT

SEQ ID NO: 513633 - protein, 9 aa, Homo Sapiens
PGGVDAVII

SEQ ID NO: 513634 - protein, 9 aa, Homo Sapiens
AVRFETCLK

SEQ ID NO: 513635 - protein, 9 aa, Homo Sapiens
ERLQKQEKW

SEQ ID NO: 513636 - protein, 9 aa, Homo Sapiens
SIKDFAHSS

SEQ ID NO: 513637 - protein, 9 aa, Homo Sapiens
FEKIFPRSW

SEQ ID NO: 513638 - protein, 9 aa, Homo Sapiens
ALSCFLSPK

SEQ ID NO: 513639 - protein, 9 aa, Homo Sapiens
HLWEVSTRN

SEQ ID NO: 513640 - protein, 9 aa, Homo Sapiens
QYVKARSPK

SEQ ID NO: 513641 - protein, 9 aa, Homo Sapiens
LSLATASGG

SEQ ID NO: 513642 - protein, 9 aa, Homo Sapiens
FREYCPHST

SEQ ID NO: 513643 - protein, 9 aa, Homo Sapiens
AAATAAATT

SEQ ID NO: 513644 - protein, 9 aa, Homo Sapiens
YGEEGTHMG

SEQ ID NO: 513645 - protein, 9 aa, Homo Sapiens
AAATTTEHF

SEQ ID NO: 513646 - protein, 9 aa, Homo Sapiens
PVRMSRTIF

SEQ ID NO: 513647 - protein, 9 aa, Homo Sapiens
VSKKSNGTP

SEQ ID NO: 513648 - protein, 9 aa, Homo Sapiens
LFREYCPHS

SEQ ID NO: 513649 - protein, 9 aa, Homo Sapiens
TAINTEPLC

SEQ ID NO: 513650 - protein, 9 aa, Homo Sapiens
SLSVLLHYR

SEQ ID NO: 513651 - protein, 9 aa, Homo Sapiens
HGKNSSSVA

SEQ ID NO: 513652 - protein, 9 aa, Homo Sapiens
RALHGSFSM

SEQ ID NO: 513653 - protein, 9 aa, Homo Sapiens
PTRRSYRRQ

SEQ ID NO: 513654 - protein, 9 aa, Homo Sapiens
KARSPKANL

SEQ ID NO: 513655 - protein, 9 aa, Homo Sapiens
FEVHRYENS

SEQ ID NO: 513656 - protein, 9 aa, Homo Sapiens
GVWKRSVTC

SEQ ID NO: 513657 - protein, 9 aa, Homo Sapiens
VGEAQSKKP

SEQ ID NO: 513658 - protein, 9 aa, Homo Sapiens
SVPANELPA

SEQ ID NO: 513659 - protein, 9 aa, Homo Sapiens
PANELPARA

SEQ ID NO: 513660 - protein, 9 aa, Homo Sapiens
MTYTANILP

SEQ ID NO: 513661 - protein, 9 aa, Homo Sapiens
PDILLLEYG

SEQ ID NO: 513662 - protein, 9 aa, Homo Sapiens
YGVMTPMIN

SEQ ID NO: 513663 - protein, 9 aa, Homo Sapiens
RRCGAKTFA

SEQ ID NO: 513664 - protein, 9 aa, Homo Sapiens
GVGVWKRSV

SEQ ID NO: 513665 - protein, 9 aa, Homo Sapiens
KTFAGTFCG

SEQ ID NO: 513666 - protein, 9 aa, Homo Sapiens
PHVRQGKKR

SEQ ID NO: 513667 - protein, 9 aa, Homo Sapiens
AHEHPSSPT

SEQ ID NO: 513668 - protein, 9 aa, Homo Sapiens
ANRTALVAQ

SEQ ID NO: 513669 - protein, 9 aa, Homo Sapiens
GVKNITQKC

SEQ ID NO: 513670 - protein, 9 aa, Homo Sapiens
FPDILLLEY

SEQ ID NO: 513671 - protein, 9 aa, Homo Sapiens
QYVVGHERT

SEQ ID NO: 513672 - protein, 9 aa, Homo Sapiens
PRHSHLTRA

SEQ ID NO: 513673 - protein, 9 aa, Homo Sapiens
AKGRAPKIE

SEQ ID NO: 513674 - protein, 9 aa, Homo Sapiens
MPEKWAWAQ

SEQ ID NO: 513675 - protein, 9 aa, Homo Sapiens
ANELPARAK

SEQ ID NO: 513676 - protein, 9 aa, Homo Sapiens
ESLAARQKN

SEQ ID NO: 513677 - protein, 9 aa, Homo Sapiens
MINPLIYSL

SEQ ID NO: 513678 - protein, 9 aa, Homo Sapiens
GVDAVIIAI

SEQ ID NO: 513679 - protein, 9 aa, Homo Sapiens
KDFAHSSFQ

SEQ ID NO: 513680 - protein, 9 aa, Homo Sapiens
RLQKQEKWL

SEQ ID NO: 513681 - protein, 9 aa, Homo Sapiens
ELPARAKEV

SEQ ID NO: 513682 - protein, 9 aa, Homo Sapiens
AGMTYTANI

SEQ ID NO: 513683 - protein, 9 aa, Homo Sapiens
DTVVEEEAQ

SEQ ID NO: 513684 - protein, 9 aa, Homo Sapiens
LDMDEMLER

SEQ ID NO: 513685 - protein, 9 aa, Homo Sapiens
KADGALDSQ

SEQ ID NO: 513686 - protein, 9 aa, Homo Sapiens
DAVIIAIGE

SEQ ID NO: 513687 - protein, 9 aa, Homo Sapiens
QDKSIKDFA

SEQ ID NO: 513688 - protein, 9 aa, Homo Sapiens
IPGTAAAAA

SEQ ID NO: 513689 - protein, 9 aa, Homo Sapiens
DNCYHRAAK

SEQ ID NO: 513690 - protein, 9 aa, Homo Sapiens
GTHMGSAAA

SEQ ID NO: 513691 - protein, 9 aa, Homo Sapiens
MTPMINPLI

SEQ ID NO: 513692 - protein, 9 aa, Homo Sapiens
MDEMLERFK

SEQ ID NO: 513693 - protein, 9 aa, Homo Sapiens
KIFPRSWGT

SEQ ID NO: 513694 - protein, 9 aa, Homo Sapiens
KNTCASVRR

SEQ ID NO: 513695 - protein, 9 aa, Homo Sapiens
KSNGTPNGF

SEQ ID NO: 513696 - protein, 9 aa, Homo Sapiens
SSNQPHGKN

SEQ ID NO: 513697 - protein, 9 aa, Homo Sapiens
VPTPEMPAI

SEQ ID NO: 513698 - protein, 9 aa, Homo Sapiens
PREPGFFLH

SEQ ID NO: 513699 - protein, 9 aa, Homo Sapiens
PKANLPPLY

SEQ ID NO: 513700 - protein, 9 aa, Homo Sapiens
CGVGVWKRS

SEQ ID NO: 513701 - protein, 9 aa, Homo Sapiens
MSRTIFSTG

SEQ ID NO: 513702 - protein, 9 aa, Homo Sapiens
VGGLIIKPS

SEQ ID NO: 513703 - protein, 9 aa, Homo Sapiens
TAAAAATAA

SEQ ID NO: 513704 - protein, 9 aa, Homo Sapiens
PLCGTLRDG

SEQ ID NO: 513705 - protein, 9 aa, Homo Sapiens
GHPAQPGLS

SEQ ID NO: 513706 - protein, 9 aa, Homo Sapiens
QHFPDILLL

SEQ ID NO: 513707 - protein, 9 aa, Homo Sapiens
DGIEGSDIL

SEQ ID NO: 513708 - protein, 9 aa, Homo Sapiens
NGTPNGFYA

SEQ ID NO: 513709 - protein, 9 aa, Homo Sapiens
EKAVRFETC

SEQ ID NO: 513710 - protein, 9 aa, Homo Sapiens
AALSCFLSP

SEQ ID NO: 513711 - protein, 9 aa, Homo Sapiens
QSNSIPGTA

SEQ ID NO: 513712 - protein, 9 aa, Homo Sapiens
SPKANLPPL

SEQ ID NO: 513713 - protein, 9 aa, Homo Sapiens
TAAATAAAT

SEQ ID NO: 513714 - protein, 9 aa, Homo Sapiens
VWKRSVTCR

SEQ ID NO: 513715 - protein, 9 aa, Homo Sapiens
AYADGIEGS

SEQ ID NO: 513716 - protein, 9 aa, Homo Sapiens
DKADGALDS

SEQ ID NO: 513717 - protein, 9 aa, Homo Sapiens
GKNSSSVAI

SEQ ID NO: 513718 - protein, 9 aa, Homo Sapiens
KKSNGTPNG

SEQ ID NO: 513719 - protein, 9 aa, Homo Sapiens
LPARAKEVS

SEQ ID NO: 513720 - protein, 9 aa, Homo Sapiens
IHLWEVSTR

SEQ ID NO: 513721 - protein, 9 aa, Homo Sapiens
VKMKAIIFG

SEQ ID NO: 513722 - protein, 9 aa, Homo Sapiens
VMTPMINPL

SEQ ID NO: 513723 - protein, 9 aa, Homo Sapiens
DTCLSQLFF

SEQ ID NO: 513724 - protein, 9 aa, Homo Sapiens
FFLHKWSSS

SEQ ID NO: 513725 - protein, 9 aa, Homo Sapiens
FPRSWGTCS

SEQ ID NO: 513726 - protein, 9 aa, Homo Sapiens
TIKAKSNDG

SEQ ID NO: 513727 - protein, 9 aa, Homo Sapiens
MQSNSIPGT

SEQ ID NO: 513728 - protein, 9 aa, Homo Sapiens
KGDALPAEL

SEQ ID NO: 513729 - protein, 9 aa, Homo Sapiens
SRKNSVLSQ

SEQ ID NO: 513730 - protein, 9 aa, Homo Sapiens
NELPARAKE

SEQ ID NO: 513731 - protein, 9 aa, Homo Sapiens
YVVGHERTE

SEQ ID NO: 513732 - protein, 9 aa, Homo Sapiens
ERPPLDMDE

SEQ ID NO: 513733 - protein, 9 aa, Homo Sapiens
IKQDNFEVH

SEQ ID NO: 513734 - protein, 9 aa, Homo Sapiens
QGKKRKSLK

SEQ ID NO: 513735 - protein, 9 aa, Homo Sapiens
VDAVIIAIG

SEQ ID NO: 513736 - protein, 9 aa, Homo Sapiens
SIPGTAAAA

SEQ ID NO: 513737 - protein, 9 aa, Homo Sapiens
DGSRKNSVL

SEQ ID NO: 513738 - protein, 9 aa, Homo Sapiens
EVYPERSTS

SEQ ID NO: 513739 - protein, 9 aa, Homo Sapiens
TEVYPERST

SEQ ID NO: 513740 - protein, 9 aa, Homo Sapiens
PMINPLIYS

SEQ ID NO: 513741 - protein, 9 aa, Homo Sapiens
YCPHSTDGV

SEQ ID NO: 513742 - protein, 9 aa, Homo Sapiens
RKNSVLSQG

SEQ ID NO: 513743 - protein, 9 aa, Homo Sapiens
APPVRMSRT

SEQ ID NO: 513744 - protein, 9 aa, Homo Sapiens
WAWAQAPPS

SEQ ID NO: 513745 - protein, 9 aa, Homo Sapiens
TDLGRRGWR

SEQ ID NO: 513746 - protein, 9 aa, Homo Sapiens
REPGFFLHK

SEQ ID NO: 513747 - protein, 9 aa, Homo Sapiens
LRRPRHSHL

SEQ ID NO: 513748 - protein, 9 aa, Homo Sapiens
PPLDMDEML

SEQ ID NO: 513749 - protein, 9 aa, Homo Sapiens
PRRVKPSPQ

SEQ ID NO: 513750 - protein, 9 aa, Homo Sapiens
EAGIVGEAQ

SEQ ID NO: 513751 - protein, 9 aa, Homo Sapiens
QIVLDVAAG

SEQ ID NO: 513752 - protein, 9 aa, Homo Sapiens
AWAQAPPSW

SEQ ID NO: 513753 - protein, 9 aa, Homo Sapiens
PGHPAQPGL

SEQ ID NO: 513754 - protein, 9 aa, Homo Sapiens
RSYKQRRSL

SEQ ID NO: 513755 - protein, 9 aa, Homo Sapiens
LSVLLHYRL

SEQ ID NO: 513756 - protein, 9 aa, Homo Sapiens
RQGKKRKSL

SEQ ID NO: 513757 - protein, 9 aa, Homo Sapiens
LATASGGNA

SEQ ID NO: 513758 - protein, 9 aa, Homo Sapiens
LQHFPDILL

SEQ ID NO: 513759 - protein, 9 aa, Homo Sapiens
ITQKCFLLD

SEQ ID NO: 513760 - protein, 9 aa, Homo Sapiens
HGTQEEHQK

SEQ ID NO: 513761 - protein, 9 aa, Homo Sapiens
GGGGGGGTQ

SEQ ID NO: 513762 - protein, 9 aa, Homo Sapiens
RSLEEHKER

SEQ ID NO: 513763 - protein, 9 aa, Homo Sapiens
KVSKKSNGT

SEQ ID NO: 513764 - protein, 9 aa, Homo Sapiens
HPAGMTYTA

SEQ ID NO: 513765 - protein, 9 aa, Homo Sapiens
EMPAIPAAA

SEQ ID NO: 513766 - protein, 9 aa, Homo Sapiens
LTRARRCPG

SEQ ID NO: 513767 - protein, 9 aa, Homo Sapiens
TISYDTCLS

SEQ ID NO: 513768 - protein, 9 aa, Homo Sapiens
KGRAPKIEK

SEQ ID NO: 513769 - protein, 9 aa, Homo Sapiens
IEWEKAVRF

SEQ ID NO: 513770 - protein, 9 aa, Homo Sapiens
STNITSGKA

SEQ ID NO: 513771 - protein, 9 aa, Homo Sapiens
QPHGKNSSS

SEQ ID NO: 513772 - protein, 9 aa, Homo Sapiens
SWGTCSSET

SEQ ID NO: 513773 - protein, 9 aa, Homo Sapiens
SLAARQKNT

SEQ ID NO: 513774 - protein, 9 aa, Homo Sapiens
GWRPLRKTA

SEQ ID NO: 513775 - protein, 9 aa, Homo Sapiens
KDGSRKNSV

SEQ ID NO: 513776 - protein, 9 aa, Homo Sapiens
GIEGSDILV

SEQ ID NO: 513777 - protein, 9 aa, Homo Sapiens
IVAMQSNSI

SEQ ID NO: 513778 - protein, 9 aa, Homo Sapiens
SDILVACSS

SEQ ID NO: 513779 - protein, 9 aa, Homo Sapiens
LESEGGKDT

SEQ ID NO: 513780 - protein, 9 aa, Homo Sapiens
KERPPLDMD

SEQ ID NO: 513781 - protein, 9 aa, Homo Sapiens
IIAIGESEL

SEQ ID NO: 513782 - protein, 9 aa, Homo Sapiens
RSKYKVKPN

SEQ ID NO: 513783 - protein, 9 aa, Homo Sapiens
HPSSPTRRS

SEQ ID NO: 513784 - protein, 9 aa, Homo Sapiens
THMGSAAAL

SEQ ID NO: 513785 - protein, 9 aa, Homo Sapiens
FEQSTPGSA

SEQ ID NO: 513786 - protein, 9 aa, Homo Sapiens
SFSMLETVG

SEQ ID NO: 513787 - protein, 9 aa, Homo Sapiens
AARQKNTCA

SEQ ID NO: 513788 - protein, 9 aa, Homo Sapiens
QRCQYVVGH

SEQ ID NO: 513789 - protein, 9 aa, Homo Sapiens
LQKQEKWLW

SEQ ID NO: 513790 - protein, 9 aa, Homo Sapiens
KQDNFEVHR

SEQ ID NO: 513791 - protein, 9 aa, Homo Sapiens
PDPGHPAQP

SEQ ID NO: 513792 - protein, 9 aa, Homo Sapiens
KNLATVGGL

SEQ ID NO: 513793 - protein, 9 aa, Homo Sapiens
MPVVYHTSP

SEQ ID NO: 513794 - protein, 9 aa, Homo Sapiens
RSWGTCSSE

SEQ ID NO: 513795 - protein, 9 aa, Homo Sapiens
VYPERSTST

SEQ ID NO: 513796 - protein, 9 aa, Homo Sapiens
TPEMPAIPA

SEQ ID NO: 513797 - protein, 9 aa, Homo Sapiens
YDTCLSQLF

SEQ ID NO: 513798 - protein, 9 aa, Homo Sapiens
SPTRRSYRR

SEQ ID NO: 513799 - protein, 9 aa, Homo Sapiens
RCGAKTFAG

SEQ ID NO: 513800 - protein, 9 aa, Homo Sapiens
AEAGIVGEA

SEQ ID NO: 513801 - protein, 9 aa, Homo Sapiens
SNQPHGKNS

SEQ ID NO: 513802 - protein, 9 aa, Homo Sapiens
FSSTNITSG

SEQ ID NO: 513803 - protein, 9 aa, Homo Sapiens
KPSPQRETF

SEQ ID NO: 513804 - protein, 9 aa, Homo Sapiens
MSLSVLLHY

SEQ ID NO: 513805 - protein, 9 aa, Homo Sapiens
NTEPLCGTL

SEQ ID NO: 513806 - protein, 9 aa, Homo Sapiens
EPGFFLHKW

SEQ ID NO: 513807 - protein, 9 aa, Homo Sapiens
VPANELPAR

SEQ ID NO: 513808 - protein, 9 aa, Homo Sapiens
WAQAPPSWS

SEQ ID NO: 513809 - protein, 9 aa, Homo Sapiens
EYCPHSTDG

SEQ ID NO: 513810 - protein, 9 aa, Homo Sapiens
HGGGGGGGT

SEQ ID NO: 513811 - protein, 9 aa, Homo Sapiens
HQKLVRNIY

SEQ ID NO: 513812 - protein, 9 aa, Homo Sapiens
RCQYVVGHE

SEQ ID NO: 513813 - protein, 9 aa, Homo Sapiens
TPREPGFFL

SEQ ID NO: 513814 - protein, 9 aa, Homo Sapiens
KWAWAQAPP

SEQ ID NO: 513815 - protein, 9 aa, Homo Sapiens
MGSAAALDN

SEQ ID NO: 513816 - protein, 9 aa, Homo Sapiens
TRRSYRRQT

SEQ ID NO: 513817 - protein, 9 aa, Homo Sapiens
HMGSAAALD

SEQ ID NO: 513818 - protein, 9 aa, Homo Sapiens
EQSTPGSAT

SEQ ID NO: 513819 - protein, 9 aa, Homo Sapiens
PSSPTRRSY

SEQ ID NO: 513820 - protein, 9 aa, Homo Sapiens
YHTSPQNAG

SEQ ID NO: 513821 - protein, 9 aa, Homo Sapiens
GVMTPMINP

SEQ ID NO: 513822 - protein, 9 aa, Homo Sapiens
TPTEVYPER

SEQ ID NO: 513823 - protein, 9 aa, Homo Sapiens
SSVPANELP

SEQ ID NO: 513824 - protein, 9 aa, Homo Sapiens
LVGEDAALS

SEQ ID NO: 513825 - protein, 9 aa, Homo Sapiens
SLMPVVYHT

SEQ ID NO: 513826 - protein, 9 aa, Homo Sapiens
PERSTSTTM

SEQ ID NO: 513827 - protein, 9 aa, Homo Sapiens
SSPTRRSYR

SEQ ID NO: 513828 - protein, 9 aa, Homo Sapiens
PSPQRETFV

SEQ ID NO: 513829 - protein, 9 aa, Homo Sapiens
RPRHSHLTR

SEQ ID NO: 513830 - protein, 9 aa, Homo Sapiens
VVGHERTEL

SEQ ID NO: 513831 - protein, 9 aa, Homo Sapiens
STRNLLVIL

SEQ ID NO: 513832 - protein, 9 aa, Homo Sapiens
DNFEVHRYE

SEQ ID NO: 513833 - protein, 9 aa, Homo Sapiens
VSCGVGVWK

SEQ ID NO: 513834 - protein, 9 aa, Homo Sapiens
HLTRARRCP

SEQ ID NO: 513835 - protein, 9 aa, Homo Sapiens
QKIEWEKAV

SEQ ID NO: 513836 - protein, 9 aa, Homo Sapiens
QSTPGSATL

SEQ ID NO: 513837 - protein, 9 aa, Homo Sapiens
PGTAAAAAT

SEQ ID NO: 513838 - protein, 9 aa, Homo Sapiens
SHLTRARRC

SEQ ID NO: 513839 - protein, 9 aa, Homo Sapiens
EDAKGDALP

SEQ ID NO: 513840 - protein, 9 aa, Homo Sapiens
PSKDGSRKN

SEQ ID NO: 513841 - protein, 9 aa, Homo Sapiens
KMKAIIFGA

SEQ ID NO: 513842 - protein, 9 aa, Homo Sapiens
RDLLEDAKG

SEQ ID NO: 513843 - protein, 9 aa, Homo Sapiens
GAKTFAGTF

SEQ ID NO: 513844 - protein, 9 aa, Homo Sapiens
SVPTPEMPA

SEQ ID NO: 513845 - protein, 9 aa, Homo Sapiens
ERRCGAKTF

SEQ ID NO: 513846 - protein, 9 aa, Homo Sapiens
QMMFEQSTP

SEQ ID NO: 513847 - protein, 9 aa, Homo Sapiens
SYKQRRSLE

SEQ ID NO: 513848 - protein, 9 aa, Homo Sapiens
QKNTCASVR

SEQ ID NO: 513849 - protein, 9 aa, Homo Sapiens
TTIKLFREY

SEQ ID NO: 513850 - protein, 9 aa, Homo Sapiens
FYGVMTPMI

SEQ ID NO: 513851 - protein, 9 aa, Homo Sapiens
FDKADGALD

SEQ ID NO: 513852 - protein, 9 aa, Homo Sapiens
LRALHGSFS

SEQ ID NO: 513853 - protein, 9 aa, Homo Sapiens
SNSIPGTAA

SEQ ID NO: 513854 - protein, 9 aa, Homo Sapiens
SCGVGVWKR

SEQ ID NO: 513855 - protein, 9 aa, Homo Sapiens
RTIFSTGGK

SEQ ID NO: 513856 - protein, 9 aa, Homo Sapiens
NMLFSSTNI

SEQ ID NO: 513857 - protein, 9 aa, Homo Sapiens
GGGGGGTQD

SEQ ID NO: 513858 - protein, 9 aa, Homo Sapiens
VGHERTELA

SEQ ID NO: 513859 - protein, 9 aa, Homo Sapiens
VGVWKRSVT

SEQ ID NO: 513860 - protein, 9 aa, Homo Sapiens
RFETCLKTR

SEQ ID NO: 513861 - protein, 9 aa, Homo Sapiens
EDAALSCFL

SEQ ID NO: 513862 - protein, 9 aa, Homo Sapiens
AAAIDTVVE

SEQ ID NO: 513863 - protein, 9 aa, Homo Sapiens
YVKARSPKA

SEQ ID NO: 513864 - protein, 9 aa, Homo Sapiens
EMPEKWAWA

SEQ ID NO: 513865 - protein, 9 aa, Homo Sapiens
PEMPAIPAA

SEQ ID NO: 513866 - protein, 9 aa, Homo Sapiens
KKNMLFSST

SEQ ID NO: 513867 - protein, 9 aa, Homo Sapiens
KAKSNDGYH

SEQ ID NO: 513868 - protein, 9 aa, Homo Sapiens
GTPNGFYAE

SEQ ID NO: 513869 - protein, 9 aa, Homo Sapiens
TANILPHHP

SEQ ID NO: 513870 - protein, 9 aa, Homo Sapiens
PAGMTYTAN

SEQ ID NO: 513871 - protein, 9 aa, Homo Sapiens
STISYDTCL

SEQ ID NO: 513872 - protein, 9 aa, Homo Sapiens
AGIVGEAQS

SEQ ID NO: 513873 - protein, 9 aa, Homo Sapiens
KAIIFGACF

SEQ ID NO: 513874 - protein, 9 aa, Homo Sapiens
ARLSLATAS

SEQ ID NO: 513875 - protein, 9 aa, Homo Sapiens
EHPSSPTRR

SEQ ID NO: 513876 - protein, 9 aa, Homo Sapiens
ALHGSFSML

SEQ ID NO: 513877 - protein, 9 aa, Homo Sapiens
EGFDKADGA

SEQ ID NO: 513878 - protein, 9 aa, Homo Sapiens
SAEAGIVGE

SEQ ID NO: 513879 - protein, 9 aa, Homo Sapiens
LQKIEWEKA

SEQ ID NO: 513880 - protein, 9 aa, Homo Sapiens
TQEEHQKLV

SEQ ID NO: 513881 - protein, 9 aa, Homo Sapiens
YNQDKSIKD

SEQ ID NO: 513882 - protein, 9 aa, Homo Sapiens
LAARQKNTC

SEQ ID NO: 513883 - protein, 9 aa, Homo Sapiens
DAALSCFLS

SEQ ID NO: 513884 - protein, 9 aa, Homo Sapiens
TVVEEEAQV

SEQ ID NO: 513885 - protein, 9 aa, Homo Sapiens
EEHQKLVRN

SEQ ID NO: 513886 - protein, 9 aa, Homo Sapiens
DLLEDAKGD

SEQ ID NO: 513887 - protein, 9 aa, Homo Sapiens
KWLWDQEER

SEQ ID NO: 513888 - protein, 9 aa, Homo Sapiens
VLSTIKAKS

SEQ ID NO: 513889 - protein, 9 aa, Homo Sapiens
MLESEGGKD

SEQ ID NO: 513890 - protein, 9 aa, Homo Sapiens
AKSAEAGIV

SEQ ID NO: 513891 - protein, 9 aa, Homo Sapiens
LYHGTQEEH

SEQ ID NO: 513892 - protein, 9 aa, Homo Sapiens
ADGIEGSDI

SEQ ID NO: 513893 - protein, 9 aa, Homo Sapiens
AAKGRAPKI

SEQ ID NO: 513894 - protein, 9 aa, Homo Sapiens
YHGTQEEHQ

SEQ ID NO: 513895 - protein, 9 aa, Homo Sapiens
ASGGNAVAC

SEQ ID NO: 513896 - protein, 9 aa, Homo Sapiens
PPVRMSRTI

SEQ ID NO: 513897 - protein, 9 aa, Homo Sapiens
MKANRTALV

SEQ ID NO: 513898 - protein, 9 aa, Homo Sapiens
SKDGSRKNS

SEQ ID NO: 513899 - protein, 9 aa, Homo Sapiens
WEVSTRNLL

SEQ ID NO: 513900 - protein, 9 aa, Homo Sapiens
YPERSTSTT

SEQ ID NO: 513901 - protein, 9 aa, Homo Sapiens
FSTPREPGF

SEQ ID NO: 513902 - protein, 9 aa, Homo Sapiens
LSTIKAKSN

SEQ ID NO: 513903 - protein, 9 aa, Homo Sapiens
VYHTSPQNA

SEQ ID NO: 513904 - protein, 9 aa, Homo Sapiens
TEPLCGTLR

SEQ ID NO: 513905 - protein, 9 aa, Homo Sapiens
KLFREYCPH

SEQ ID NO: 513906 - protein, 9 aa, Homo Sapiens
NSLMPVVYH

SEQ ID NO: 513907 - protein, 9 aa, Homo Sapiens
VTFEKIFPR

SEQ ID NO: 513908 - protein, 9 aa, Homo Sapiens
KAVRFETCL

SEQ ID NO: 513909 - protein, 9 aa, Homo Sapiens
RSPKANLPP

SEQ ID NO: 513910 - protein, 9 aa, Homo Sapiens
IKAKSNDGY

SEQ ID NO: 513911 - protein, 9 aa, Homo Sapiens
AAYQIVLDV

SEQ ID NO: 513912 - protein, 9 aa, Homo Sapiens
EKWLWDQEE

SEQ ID NO: 513913 - protein, 9 aa, Homo Sapiens
ISYDTCLSQ

SEQ ID NO: 513914 - protein, 9 aa, Homo Sapiens
LCGTLRDGC

SEQ ID NO: 513915 - protein, 9 aa, Homo Sapiens
SGRPPDPGH

SEQ ID NO: 513916 - protein, 9 aa, Homo Sapiens
RPPLDMDEM

SEQ ID NO: 513917 - protein, 9 aa, Homo Sapiens
KEMPEKWAW

SEQ ID NO: 513918 - protein, 9 aa, Homo Sapiens
AKTFAGTFC

SEQ ID NO: 513919 - protein, 9 aa, Homo Sapiens
PRSWGTCSS

SEQ ID NO: 513920 - protein, 9 aa, Homo Sapiens
TQDKRSGFL

SEQ ID NO: 513921 - protein, 9 aa, Homo Sapiens
ADGALDSQV

SEQ ID NO: 513922 - protein, 9 aa, Homo Sapiens
WLWDQEERL

SEQ ID NO: 513923 - protein, 9 aa, Homo Sapiens
MLFSSTNIT

SEQ ID NO: 513924 - protein, 9 aa, Homo Sapiens
VKPSPQRET

SEQ ID NO: 513925 - protein, 9 aa, Homo Sapiens
ATASGGNAV

SEQ ID NO: 513926 - protein, 9 aa, Homo Sapiens
IIFGACFLI

SEQ ID NO: 513927 - protein, 9 aa, Homo Sapiens
AYQIVLDVA

SEQ ID NO: 513928 - protein, 9 aa, Homo Sapiens
YKQRRSLEE

SEQ ID NO: 513929 - protein, 9 aa, Homo Sapiens
QEEHQKLVR

SEQ ID NO: 513930 - protein, 9 aa, Homo Sapiens
GRSYKQRRS

SEQ ID NO: 513931 - protein, 9 aa, Homo Sapiens
KKRKSLKSH

SEQ ID NO: 513932 - protein, 9 aa, Homo Sapiens
LLEDAKGDA

SEQ ID NO: 513933 - protein, 9 aa, Homo Sapiens
AMQSNSIPG

SEQ ID NO: 513934 - protein, 9 aa, Homo Sapiens
SVLLHYRLE

SEQ ID NO: 513935 - protein, 9 aa, Homo Sapiens
AIDTVVEEE

SEQ ID NO: 513936 - protein, 9 aa, Homo Sapiens
SGGNAVACP

SEQ ID NO: 513937 - protein, 9 aa, Homo Sapiens
GSRKNSVLS

SEQ ID NO: 513938 - protein, 9 aa, Homo Sapiens
FVLSTIKAK

SEQ ID NO: 513939 - protein, 9 aa, Homo Sapiens
SVSCGVGVW

SEQ ID NO: 513940 - protein, 9 aa, Homo Sapiens
KNITQKCFL

SEQ ID NO: 513941 - protein, 9 aa, Homo Sapiens
VRFETCLKT

SEQ ID NO: 513942 - protein, 9 aa, Homo Sapiens
KRKSLKSHS

SEQ ID NO: 513943 - protein, 9 aa, Homo Sapiens
TASGGNAVA

SEQ ID NO: 513944 - protein, 9 aa, Homo Sapiens
HGSFSMLET

SEQ ID NO: 513945 - protein, 9 aa, Homo Sapiens
GSFSMLETV

SEQ ID NO: 513946 - protein, 9 aa, Homo Sapiens
GHERTELAR

SEQ ID NO: 513947 - protein, 9 aa, Homo Sapiens
EGSDILVAC

SEQ ID NO: 513948 - protein, 9 aa, Homo Sapiens
WEKAVRFET

SEQ ID NO: 513949 - protein, 9 aa, Homo Sapiens
GFDKADGAL

SEQ ID NO: 513950 - protein, 9 aa, Homo Sapiens
TFEKIFPRS

SEQ ID NO: 513951 - protein, 9 aa, Homo Sapiens
PTEVYPERS

SEQ ID NO: 513952 - protein, 9 aa, Homo Sapiens
WKRSVTCRG

SEQ ID NO: 513953 - protein, 9 aa, Homo Sapiens
PEKWAWAQA

SEQ ID NO: 513954 - protein, 9 aa, Homo Sapiens
WRPLRKTAP

SEQ ID NO: 513955 - protein, 9 aa, Homo Sapiens
RAAKGRAPK

SEQ ID NO: 513956 - protein, 9 aa, Homo Sapiens
DPGHPAQPG

SEQ ID NO: 513957 - protein, 9 aa, Homo Sapiens
EGTHMGSAA

SEQ ID NO: 513958 - protein, 9 aa, Homo Sapiens
NLATVGGLI

SEQ ID NO: 513959 - protein, 9 aa, Homo Sapiens
PLDMDEMLE

SEQ ID NO: 513960 - protein, 9 aa, Homo Sapiens
AAIDTVVEE

SEQ ID NO: 513961 - protein, 9 aa, Homo Sapiens
RRGWRPLRK

SEQ ID NO: 513962 - protein, 9 aa, Homo Sapiens
KQRRSLEEH

SEQ ID NO: 513963 - protein, 9 aa, Homo Sapiens
WGTCSSETS

SEQ ID NO: 513964 - protein, 9 aa, Homo Sapiens
LLHYRLEDN

SEQ ID NO: 513965 - protein, 9 aa, Homo Sapiens
KNSSSVAIA

SEQ ID NO: 513966 - protein, 9 aa, Homo Sapiens
LGRRGWRPL

SEQ ID NO: 513967 - protein, 9 aa, Homo Sapiens
TAAATTTEH

SEQ ID NO: 513968 - protein, 9 aa, Homo Sapiens
TIKLFREYC

SEQ ID NO: 513969 - protein, 9 aa, Homo Sapiens
GGGTQDKRS

SEQ ID NO: 513970 - protein, 9 aa, Homo Sapiens
STPGSATLG

SEQ ID NO: 513971 - protein, 9 aa, Homo Sapiens
LFSSTNITS

SEQ ID NO: 513972 - protein, 9 aa, Homo Sapiens
MMFEQSTPG

SEQ ID NO: 513973 - protein, 9 aa, Homo Sapiens
QDNFEVHRY

SEQ ID NO: 513974 - protein, 9 aa, Homo Sapiens
LLLEYGGEE

SEQ ID NO: 513975 - protein, 9 aa, Homo Sapiens
EWEKAVRFE

SEQ ID NO: 513976 - protein, 9 aa, Homo Sapiens
TYTANILPH

SEQ ID NO: 513977 - protein, 9 aa, Homo Sapiens
INTEPLCGT

SEQ ID NO: 513978 - protein, 9 aa, Homo Sapiens
GKKRKSLKS

SEQ ID NO: 513979 - protein, 9 aa, Homo Sapiens
DAKGDALPA

SEQ ID NO: 513980 - protein, 9 aa, Homo Sapiens
SRTIFSTGG

SEQ ID NO: 513981 - protein, 9 aa, Homo Sapiens
GTCSSETSA

SEQ ID NO: 513982 - protein, 9 aa, Homo Sapiens
GGVDAVIIA

SEQ ID NO: 513983 - protein, 9 aa, Homo Sapiens
GEEGTHMGS

SEQ ID NO: 513984 - protein, 9 aa, Homo Sapiens
INPLIYSLR

SEQ ID NO: 513985 - protein, 9 aa, Homo Sapiens
PQRETFVLK

SEQ ID NO: 513986 - protein, 9 aa, Homo Sapiens
NRTALVAQQ

SEQ ID NO: 513987 - protein, 9 aa, Homo Sapiens
GGTQDKRSG

SEQ ID NO: 513988 - protein, 9 aa, Homo Sapiens
DLGRRGWRP

SEQ ID NO: 513989 - protein, 9 aa, Homo Sapiens
HVRQGKKRK

SEQ ID NO: 513990 - protein, 9 aa, Homo Sapiens
NQPHGKNSS

SEQ ID NO: 513991 - protein, 9 aa, Homo Sapiens
VLDVAAGGL

SEQ ID NO: 513992 - protein, 9 aa, Homo Sapiens
ERSTSTTMD

SEQ ID NO: 513993 - protein, 9 aa, Homo Sapiens
IKDFAHSSF

SEQ ID NO: 513994 - protein, 9 aa, Homo Sapiens
DMDEMLERF

SEQ ID NO: 513995 - protein, 9 aa, Homo Sapiens
HRAAKGRAP

SEQ ID NO: 513996 - protein, 9 aa, Homo Sapiens
KSTISYDTC

SEQ ID NO: 513997 - protein, 9 aa, Homo Sapiens
RQKNTCASV

SEQ ID NO: 513998 - protein, 9 aa, Homo Sapiens
EHQKLVRNI

SEQ ID NO: 513999 - protein, 9 aa, Homo Sapiens
CGAKTFAGT

SEQ ID NO: 514000 - protein, 9 aa, Homo Sapiens
LEDAKGDAL

SEQ ID NO: 514001 - protein, 9 aa, Homo Sapiens
RLSLATASG

SEQ ID NO: 514002 - protein, 9 aa, Homo Sapiens
CGRSYKQRR

SEQ ID NO: 514003 - protein, 9 aa, Homo Sapiens
RSTSTTMDF

SEQ ID NO: 514004 - protein, 9 aa, Homo Sapiens
AASVPTPEM

SEQ ID NO: 514005 - protein, 9 aa, Homo Sapiens
YQIVLDVAA

SEQ ID NO: 514006 - protein, 9 aa, Homo Sapiens
TAAAIDTVV

SEQ ID NO: 514007 - protein, 9 aa, Homo Sapiens
HFPDILLLE

SEQ ID NO: 514008 - protein, 9 aa, Homo Sapiens
QKCFLLDPR

SEQ ID NO: 514009 - protein, 9 aa, Homo Sapiens
YHRAAKGRA

SEQ ID NO: 514010 - protein, 9 aa, Homo Sapiens
VSTRNLLVI

SEQ ID NO: 514011 - protein, 9 aa, Homo Sapiens
KSNDGYHII

SEQ ID NO: 514012 - protein, 9 aa, Homo Sapiens
KQEKWLWDQ

SEQ ID NO: 514013 - protein, 9 aa, Homo Sapiens
TPGSATLGS

SEQ ID NO: 514014 - protein, 9 aa, Homo Sapiens
IMSLSVLLH

SEQ ID NO: 514015 - protein, 9 aa, Homo Sapiens
GDALPAELL

SEQ ID NO: 514016 - protein, 9 aa, Homo Sapiens
TPNGFYAEI

SEQ ID NO: 514017 - protein, 9 aa, Homo Sapiens
LWEVSTRNL

SEQ ID NO: 514018 - protein, 9 aa, Homo Sapiens
PAPPVRMSR

SEQ ID NO: 514019 - protein, 9 aa, Homo Sapiens
IVGEAQSKK

SEQ ID NO: 514020 - protein, 9 aa, Homo Sapiens
EEGTHMGSA

SEQ ID NO: 514021 - protein, 9 aa, Homo Sapiens
FAGTFCGCD

SEQ ID NO: 514022 - protein, 9 aa, Homo Sapiens
GEDAALSCF

SEQ ID NO: 514023 - protein, 9 aa, Homo Sapiens
NSIPGTAAA

SEQ ID NO: 514024 - protein, 9 aa, Homo Sapiens
EVHRYENSA

SEQ ID NO: 514025 - protein, 9 aa, Homo Sapiens
NCYHRAAKG

SEQ ID NO: 514026 - protein, 9 aa, Homo Sapiens
KSAEAGIVG

SEQ ID NO: 514027 - protein, 9 aa, Homo Sapiens
RRVKPSPQR

SEQ ID NO: 514028 - protein, 9 aa, Homo Sapiens
LHYRLEDNK

SEQ ID NO: 514029 - protein, 9 aa, Homo Sapiens
QRRSLEEHK

SEQ ID NO: 514030 - protein, 9 aa, Homo Sapiens
QKQEKWLWD

SEQ ID NO: 514031 - protein, 9 aa, Homo Sapiens
LHGSFSMLE

SEQ ID NO: 514032 - protein, 9 aa, Homo Sapiens
YADGIEGSD

SEQ ID NO: 514033 - protein, 9 aa, Homo Sapiens
DILLLEYGG

SEQ ID NO: 514034 - protein, 9 aa, Homo Sapiens
MKAIIFGAC

SEQ ID NO: 514035 - protein, 9 aa, Homo Sapiens
VKARSPKAN

SEQ ID NO: 514036 - protein, 9 aa, Homo Sapiens
DKKNMLFSS

SEQ ID NO: 514037 - protein, 9 aa, Homo Sapiens
STPREPGFF

SEQ ID NO: 514038 - protein, 9 aa, Homo Sapiens
VHRYENSAH

SEQ ID NO: 514039 - protein, 9 aa, Homo Sapiens
LLEYGGEEF

SEQ ID NO: 514040 - protein, 9 aa, Homo Sapiens
EKWAWAQAP

SEQ ID NO: 514041 - protein, 9 aa, Homo Sapiens
SSTNITSGK

SEQ ID NO: 514042 - protein, 9 aa, Homo Sapiens
GTQEEHQKL

SEQ ID NO: 514043 - protein, 9 aa, Homo Sapiens
SSLRALHGS

SEQ ID NO: 514044 - protein, 9 aa, Homo Sapiens
IKLFREYCP

SEQ ID NO: 514045 - protein, 9 aa, Homo Sapiens
GMTYTANIL

SEQ ID NO: 514046 - protein, 9 aa, Homo Sapiens
EKIFPRSWG

SEQ ID NO: 514047 - protein, 9 aa, Homo Sapiens
GGLIIKPSL

SEQ ID NO: 514048 - protein, 9 aa, Homo Sapiens
PHGKNSSSV

SEQ ID NO: 514049 - protein, 9 aa, Homo Sapiens
AVIIAIGES

SEQ ID NO: 514050 - protein, 9 aa, Homo Sapiens
TCLSQLFFF

SEQ ID NO: 514051 - protein, 9 aa, Homo Sapiens
VIIAIGESE

SEQ ID NO: 514052 - protein, 9 aa, Homo Sapiens
TQMMFEQST

SEQ ID NO: 514053 - protein, 9 aa, Homo Sapiens
VLLHYRLED

SEQ ID NO: 514054 - protein, 9 aa, Homo Sapiens
TFAGTFCGC

SEQ ID NO: 514055 - protein, 9 aa, Homo Sapiens
GLIIKPSLI

SEQ ID NO: 514056 - protein, 9 aa, Homo Sapiens
QRETFVLKD

SEQ ID NO: 514057 - protein, 9 aa, Homo Sapiens
HERTELARQ

SEQ ID NO: 514058 - protein, 9 aa, Homo Sapiens
TPMINPLIY

SEQ ID NO: 514059 - protein, 9 aa, Homo Sapiens
MYNQDKSIK

SEQ ID NO: 514060 - protein, 9 aa, Homo Sapiens
ASVPTPEMP

SEQ ID NO: 514061 - protein, 9 aa, Homo Sapiens
CYHRAAKGR

SEQ ID NO: 514062 - protein, 9 aa, Homo Sapiens
KTDLGRRGW

SEQ ID NO: 514063 - protein, 9 aa, Homo Sapiens
KCFLLDPRA

SEQ ID NO: 514064 - protein, 9 aa, Homo Sapiens
VRQGKKRKS

SEQ ID NO: 514065 - protein, 9 aa, Homo Sapiens
LATVGGLII

SEQ ID NO: 514066 - protein, 9 aa, Homo Sapiens
DVAAGGLGH

SEQ ID NO: 514067 - protein, 9 aa, Homo Sapiens
PPDPGHPAQ

SEQ ID NO: 514068 - protein, 9 aa, Homo Sapiens
PGFFLHKWS

SEQ ID NO: 514069 - protein, 9 aa, Homo Sapiens
AINTEPLCG

SEQ ID NO: 514070 - protein, 9 aa, Homo Sapiens
RPPDPGHPA

SEQ ID NO: 514071 - protein, 9 aa, Homo Sapiens
VAAGGLGHA

SEQ ID NO: 514072 - protein, 9 aa, Homo Sapiens
GRPPDPGHP

SEQ ID NO: 514073 - protein, 9 aa, Homo Sapiens
HEHPSSPTR

SEQ ID NO: 514074 - protein, 9 aa, Homo Sapiens
GTQDKRSGF

SEQ ID NO: 514075 - protein, 9 aa, Homo Sapiens
SKKSNGTPN

SEQ ID NO: 514076 - protein, 9 aa, Homo Sapiens
MLPSKDGSR

SEQ ID NO: 514077 - protein, 9 aa, Homo Sapiens
ARSPKANLP

SEQ ID NO: 514078 - protein, 9 aa, Homo Sapiens
RMSRTIFST

SEQ ID NO: 514079 - protein, 9 aa, Homo Sapiens
SIRSKYKVK

SEQ ID NO: 514080 - protein, 9 aa, Homo Sapiens
CTAAAIDTV

SEQ ID NO: 514081 - protein, 9 aa, Homo Sapiens
FNSLMPVVY

SEQ ID NO: 514082 - protein, 9 aa, Homo Sapiens
GFFLHKWSS

SEQ ID NO: 514083 - protein, 9 aa, Homo Sapiens
GGGGTQDKR

SEQ ID NO: 514084 - protein, 9 aa, Homo Sapiens
GPHVRQGKK

SEQ ID NO: 514085 - protein, 9 aa, Homo Sapiens
ATVGGLIIK

SEQ ID NO: 514086 - protein, 9 aa, Homo Sapiens
SYDTCLSQL

SEQ ID NO: 514087 - protein, 9 aa, Homo Sapiens
ILLLEYGGE

SEQ ID NO: 514088 - protein, 9 aa, Homo Sapiens
SPQRETFVL

SEQ ID NO: 514089 - protein, 9 aa, Homo Sapiens
IFPRSWGTC

SEQ ID NO: 514090 - protein, 9 aa, Homo Sapiens
DLDVKMKAI

SEQ ID NO: 514091 - protein, 9 aa, Homo Sapiens
IDTVVEEEA

SEQ ID NO: 514092 - protein, 9 aa, Homo Sapiens
CGTLRDGCH

SEQ ID NO: 514093 - protein, 9 aa, Homo Sapiens
RVKPSPQRE

SEQ ID NO: 514094 - protein, 9 aa, Homo Sapiens
HKLMSEKGA

SEQ ID NO: 514095 - protein, 9 aa, Homo Sapiens
KLVVVGAGR

SEQ ID NO: 514096 - protein, 9 aa, Homo Sapiens
IHCFLYPDT

SEQ ID NO: 514097 - protein, 9 aa, Homo Sapiens
LLCQKFLTS

SEQ ID NO: 514098 - protein, 9 aa, Homo Sapiens
MLFLGRSVM

SEQ ID NO: 514099 - protein, 9 aa, Homo Sapiens
QKFLTSFVN

SEQ ID NO: 514100 - protein, 9 aa, Homo Sapiens
ARYALLCLE

SEQ ID NO: 514101 - protein, 9 aa, Homo Sapiens
KFPGEVSIP

SEQ ID NO: 514102 - protein, 9 aa, Homo Sapiens
GGWPGWRWR

SEQ ID NO: 514103 - protein, 9 aa, Homo Sapiens
DRGLSKDFS

SEQ ID NO: 514104 - protein, 9 aa, Homo Sapiens
ETMRWNVMG

SEQ ID NO: 514105 - protein, 9 aa, Homo Sapiens
LPSMPTLIH

SEQ ID NO: 514106 - protein, 9 aa, Homo Sapiens
FICVEKLRD

SEQ ID NO: 514107 - protein, 9 aa, Homo Sapiens
FLVILVDVK

SEQ ID NO: 514108 - protein, 9 aa, Homo Sapiens
ERSTPLTAL

SEQ ID NO: 514109 - protein, 9 aa, Homo Sapiens
GANMGIGKE

SEQ ID NO: 514110 - protein, 9 aa, Homo Sapiens
TQIFFQPSQ

SEQ ID NO: 514111 - protein, 9 aa, Homo Sapiens
SIDFVENKL

SEQ ID NO: 514112 - protein, 9 aa, Homo Sapiens
QHKLMSEKG

SEQ ID NO: 514113 - protein, 9 aa, Homo Sapiens
HSLEHPYLH

SEQ ID NO: 514114 - protein, 9 aa, Homo Sapiens
ALVWTVSAF

SEQ ID NO: 514115 - protein, 9 aa, Homo Sapiens
GYSHLPCQV

SEQ ID NO: 514116 - protein, 9 aa, Homo Sapiens
LLPVSRCSV

SEQ ID NO: 514117 - protein, 9 aa, Homo Sapiens
GKLLEAIKR

SEQ ID NO: 514118 - protein, 9 aa, Homo Sapiens
ARQKLELKI

SEQ ID NO: 514119 - protein, 9 aa, Homo Sapiens
YNVFRSTFH

SEQ ID NO: 514120 - protein, 9 aa, Homo Sapiens
MGIGKETAR

SEQ ID NO: 514121 - protein, 9 aa, Homo Sapiens
IAFWVSEDK

SEQ ID NO: 514122 - protein, 9 aa, Homo Sapiens
YVELKRKGV

SEQ ID NO: 514123 - protein, 9 aa, Homo Sapiens
STQGKWKVF

SEQ ID NO: 514124 - protein, 9 aa, Homo Sapiens
TPLADLLPV

SEQ ID NO: 514125 - protein, 9 aa, Homo Sapiens
FFLVILVDV

SEQ ID NO: 514126 - protein, 9 aa, Homo Sapiens
AEAKRADQV

SEQ ID NO: 514127 - protein, 9 aa, Homo Sapiens
PANSETVED

SEQ ID NO: 514128 - protein, 9 aa, Homo Sapiens
WSQVYPKYF

SEQ ID NO: 514129 - protein, 9 aa, Homo Sapiens
GVVHIYVEL

SEQ ID NO: 514130 - protein, 9 aa, Homo Sapiens
RSWCWQILK

SEQ ID NO: 514131 - protein, 9 aa, Homo Sapiens
PPKDWQPLI

SEQ ID NO: 514132 - protein, 9 aa, Homo Sapiens
YQQARLHEH

SEQ ID NO: 514133 - protein, 9 aa, Homo Sapiens
RGVSPPPLP

SEQ ID NO: 514134 - protein, 9 aa, Homo Sapiens
VFRSTFHSK

SEQ ID NO: 514135 - protein, 9 aa, Homo Sapiens
SRSSFRSKK

SEQ ID NO: 514136 - protein, 9 aa, Homo Sapiens
IIPANSETV

SEQ ID NO: 514137 - protein, 9 aa, Homo Sapiens
LGSASCRTI

SEQ ID NO: 514138 - protein, 9 aa, Homo Sapiens
EGPPVPPPV

SEQ ID NO: 514139 - protein, 9 aa, Homo Sapiens
SRNLKPQPW

SEQ ID NO: 514140 - protein, 9 aa, Homo Sapiens
GDKEDFRAY

SEQ ID NO: 514141 - protein, 9 aa, Homo Sapiens
RCFICVEKL

SEQ ID NO: 514142 - protein, 9 aa, Homo Sapiens
PYQAYDFLL

SEQ ID NO: 514143 - protein, 9 aa, Homo Sapiens
SCQPYRSAC

SEQ ID NO: 514144 - protein, 9 aa, Homo Sapiens
PPLTAASSP

SEQ ID NO: 514145 - protein, 9 aa, Homo Sapiens
LRYLDYEAL

SEQ ID NO: 514146 - protein, 9 aa, Homo Sapiens
LPTSALVST

SEQ ID NO: 514147 - protein, 9 aa, Homo Sapiens
VSSFLEGSM

SEQ ID NO: 514148 - protein, 9 aa, Homo Sapiens
CFLYPDTDW

SEQ ID NO: 514149 - protein, 9 aa, Homo Sapiens
EQERQRLSD

SEQ ID NO: 514150 - protein, 9 aa, Homo Sapiens
TSHWPFSVF

SEQ ID NO: 514151 - protein, 9 aa, Homo Sapiens
SGHHGPPLT

SEQ ID NO: 514152 - protein, 9 aa, Homo Sapiens
TDEDVKFYL

SEQ ID NO: 514153 - protein, 9 aa, Homo Sapiens
YRDVMQETL

SEQ ID NO: 514154 - protein, 9 aa, Homo Sapiens
PVLRVLFSG

SEQ ID NO: 514155 - protein, 9 aa, Homo Sapiens
VSRGSTPIQ

SEQ ID NO: 514156 - protein, 9 aa, Homo Sapiens
KHVRRESLP

SEQ ID NO: 514157 - protein, 9 aa, Homo Sapiens
IQTGAFSGL

SEQ ID NO: 514158 - protein, 9 aa, Homo Sapiens
NGKWEVLID

SEQ ID NO: 514159 - protein, 9 aa, Homo Sapiens
SLTKRLLFK

SEQ ID NO: 514160 - protein, 9 aa, Homo Sapiens
LLIDRGLSK

SEQ ID NO: 514161 - protein, 9 aa, Homo Sapiens
KVARVQPKF

SEQ ID NO: 514162 - protein, 9 aa, Homo Sapiens
SWCWQILKG

SEQ ID NO: 514163 - protein, 9 aa, Homo Sapiens
SVYKYNVFR

SEQ ID NO: 514164 - protein, 9 aa, Homo Sapiens
FKSIHCFLY

SEQ ID NO: 514165 - protein, 9 aa, Homo Sapiens
DKEKENEDK

SEQ ID NO: 514166 - protein, 9 aa, Homo Sapiens
STPLPVTSP

SEQ ID NO: 514167 - protein, 9 aa, Homo Sapiens
AWKHIKESV

SEQ ID NO: 514168 - protein, 9 aa, Homo Sapiens
PGREGPPVP

SEQ ID NO: 514169 - protein, 9 aa, Homo Sapiens
NWWSQVYPK

SEQ ID NO: 514170 - protein, 9 aa, Homo Sapiens
EEEGNGEGQ

SEQ ID NO: 514171 - protein, 9 aa, Homo Sapiens
IVTVYPIML

SEQ ID NO: 514172 - protein, 9 aa, Homo Sapiens
KSIHCFLYP

SEQ ID NO: 514173 - protein, 9 aa, Homo Sapiens
KIKETWTAE

SEQ ID NO: 514174 - protein, 9 aa, Homo Sapiens
PGSPYQAYD

SEQ ID NO: 514175 - protein, 9 aa, Homo Sapiens
ERLVEKTPD

SEQ ID NO: 514176 - protein, 9 aa, Homo Sapiens
FPEDDYNTA

SEQ ID NO: 514177 - protein, 9 aa, Homo Sapiens
VYPIMLFLG

SEQ ID NO: 514178 - protein, 9 aa, Homo Sapiens
TSALVSTNW

SEQ ID NO: 514179 - protein, 9 aa, Homo Sapiens
RHFKLVGVK

SEQ ID NO: 514180 - protein, 9 aa, Homo Sapiens
HPYLHQNSH

SEQ ID NO: 514181 - protein, 9 aa, Homo Sapiens
LTALLVSTT

SEQ ID NO: 514182 - protein, 9 aa, Homo Sapiens
PKGKLLEAI

SEQ ID NO: 514183 - protein, 9 aa, Homo Sapiens
WIHILQKRR

SEQ ID NO: 514184 - protein, 9 aa, Homo Sapiens
EVMLCGNAG

SEQ ID NO: 514185 - protein, 9 aa, Homo Sapiens
ASIFFDYAR

SEQ ID NO: 514186 - protein, 9 aa, Homo Sapiens
VELKRKGVE

SEQ ID NO: 514187 - protein, 9 aa, Homo Sapiens
RSLNQIPDT

SEQ ID NO: 514188 - protein, 9 aa, Homo Sapiens
NIIAFWVSE

SEQ ID NO: 514189 - protein, 9 aa, Homo Sapiens
QKRRNDVFK

SEQ ID NO: 514190 - protein, 9 aa, Homo Sapiens
ALCWDPVLR

SEQ ID NO: 514191 - protein, 9 aa, Homo Sapiens
IHILQKRRN

SEQ ID NO: 514192 - protein, 9 aa, Homo Sapiens
NLLEKHVRR

SEQ ID NO: 514193 - protein, 9 aa, Homo Sapiens
SARHEQKDA

SEQ ID NO: 514194 - protein, 9 aa, Homo Sapiens
IKESVGRPQ

SEQ ID NO: 514195 - protein, 9 aa, Homo Sapiens
GSTVHVKSV

SEQ ID NO: 514196 - protein, 9 aa, Homo Sapiens
SAPGSPYQA

SEQ ID NO: 514197 - protein, 9 aa, Homo Sapiens
ASLTKRLLF

SEQ ID NO: 514198 - protein, 9 aa, Homo Sapiens
QTGAFSGLK

SEQ ID NO: 514199 - protein, 9 aa, Homo Sapiens
LISALVWTV

SEQ ID NO: 514200 - protein, 9 aa, Homo Sapiens
QKLELKIKE

SEQ ID NO: 514201 - protein, 9 aa, Homo Sapiens
LFALRYLDY

SEQ ID NO: 514202 - protein, 9 aa, Homo Sapiens
GSTPIQPCR

SEQ ID NO: 514203 - protein, 9 aa, Homo Sapiens
LRVLFSGSS

SEQ ID NO: 514204 - protein, 9 aa, Homo Sapiens
VRLYISGGY

SEQ ID NO: 514205 - protein, 9 aa, Homo Sapiens
KWEVLIDST

SEQ ID NO: 514206 - protein, 9 aa, Homo Sapiens
NPVENFMKI

SEQ ID NO: 514207 - protein, 9 aa, Homo Sapiens
GWSLGSASC

SEQ ID NO: 514208 - protein, 9 aa, Homo Sapiens
KLLEAIKRD

SEQ ID NO: 514209 - protein, 9 aa, Homo Sapiens
QRPLVRVGV

SEQ ID NO: 514210 - protein, 9 aa, Homo Sapiens
GAICLYFSM

SEQ ID NO: 514211 - protein, 9 aa, Homo Sapiens
LANVSSFLE

SEQ ID NO: 514212 - protein, 9 aa, Homo Sapiens
ITGANMGIG

SEQ ID NO: 514213 - protein, 9 aa, Homo Sapiens
STHSLEHPY

SEQ ID NO: 514214 - protein, 9 aa, Homo Sapiens
LVILVDVKK

SEQ ID NO: 514215 - protein, 9 aa, Homo Sapiens
WKLIVSFIF

SEQ ID NO: 514216 - protein, 9 aa, Homo Sapiens
MRFNNSLLS

SEQ ID NO: 514217 - protein, 9 aa, Homo Sapiens
SILRVKATE

SEQ ID NO: 514218 - protein, 9 aa, Homo Sapiens
VIPLKHPRV

SEQ ID NO: 514219 - protein, 9 aa, Homo Sapiens
LLEKHVRRE

SEQ ID NO: 514220 - protein, 9 aa, Homo Sapiens
VLQIPLQIN

SEQ ID NO: 514221 - protein, 9 aa, Homo Sapiens
IVSFIFNLL

SEQ ID NO: 514222 - protein, 9 aa, Homo Sapiens
SARHSQPVP

SEQ ID NO: 514223 - protein, 9 aa, Homo Sapiens
PDKDGHRDS

SEQ ID NO: 514224 - protein, 9 aa, Homo Sapiens
VVFKPGNTQ

SEQ ID NO: 514225 - protein, 9 aa, Homo Sapiens
LVWTVSAFT

SEQ ID NO: 514226 - protein, 9 aa, Homo Sapiens
LSKEVMFTD

SEQ ID NO: 514227 - protein, 9 aa, Homo Sapiens
ERSSGIAPA

SEQ ID NO: 514228 - protein, 9 aa, Homo Sapiens
FALRYLDYE

SEQ ID NO: 514229 - protein, 9 aa, Homo Sapiens
PGLINGCHA

SEQ ID NO: 514230 - protein, 9 aa, Homo Sapiens
EDFRAYQFR

SEQ ID NO: 514231 - protein, 9 aa, Homo Sapiens
RSSGIAPAA

SEQ ID NO: 514232 - protein, 9 aa, Homo Sapiens
NVSSFLEGS

SEQ ID NO: 514233 - protein, 9 aa, Homo Sapiens
RALEGTVSV

SEQ ID NO: 514234 - protein, 9 aa, Homo Sapiens
LNIGSVSAT

SEQ ID NO: 514235 - protein, 9 aa, Homo Sapiens
LTEEATEES

SEQ ID NO: 514236 - protein, 9 aa, Homo Sapiens
LRSWCWQIL

SEQ ID NO: 514237 - protein, 9 aa, Homo Sapiens
LIHNPSLGS

SEQ ID NO: 514238 - protein, 9 aa, Homo Sapiens
IAKSVGIIP

SEQ ID NO: 514239 - protein, 9 aa, Homo Sapiens
LRMFLSLQP

SEQ ID NO: 514240 - protein, 9 aa, Homo Sapiens
GTIKVFVNK

SEQ ID NO: 514241 - protein, 9 aa, Homo Sapiens
KPKLSRVKE

SEQ ID NO: 514242 - protein, 9 aa, Homo Sapiens
SFIFNLLCQ

SEQ ID NO: 514243 - protein, 9 aa, Homo Sapiens
SYSDYVREF

SEQ ID NO: 514244 - protein, 9 aa, Homo Sapiens
EPKGKLLEA

SEQ ID NO: 514245 - protein, 9 aa, Homo Sapiens
AASSSARHS

SEQ ID NO: 514246 - protein, 9 aa, Homo Sapiens
LQKRETLRR

SEQ ID NO: 514247 - protein, 9 aa, Homo Sapiens
HSQPVPQLR

SEQ ID NO: 514248 - protein, 9 aa, Homo Sapiens
VITGANMGI

SEQ ID NO: 514249 - protein, 9 aa, Homo Sapiens
YALLCLEEG

SEQ ID NO: 514250 - protein, 9 aa, Homo Sapiens
VVVGAGRVG

SEQ ID NO: 514251 - protein, 9 aa, Homo Sapiens
GGGGWPGWR

SEQ ID NO: 514252 - protein, 9 aa, Homo Sapiens
IPLQINYGC

SEQ ID NO: 514253 - protein, 9 aa, Homo Sapiens
RIRRQDIRN

SEQ ID NO: 514254 - protein, 9 aa, Homo Sapiens
TSYDYSDIL

SEQ ID NO: 514255 - protein, 9 aa, Homo Sapiens
TEESAAEEP

SEQ ID NO: 514256 - protein, 9 aa, Homo Sapiens
IFNLLCQKF

SEQ ID NO: 514257 - protein, 9 aa, Homo Sapiens
GLLSARHEQ

SEQ ID NO: 514258 - protein, 9 aa, Homo Sapiens
LSTEPSQQL

SEQ ID NO: 514259 - protein, 9 aa, Homo Sapiens
KPQPWPQTL

SEQ ID NO: 514260 - protein, 9 aa, Homo Sapiens
VTGLLSARH

SEQ ID NO: 514261 - protein, 9 aa, Homo Sapiens
TAERLVEKT

SEQ ID NO: 514262 - protein, 9 aa, Homo Sapiens
STTALVFYY

SEQ ID NO: 514263 - protein, 9 aa, Homo Sapiens
EKENEDKGK

SEQ ID NO: 514264 - protein, 9 aa, Homo Sapiens
LLVLGAICL

SEQ ID NO: 514265 - protein, 9 aa, Homo Sapiens
HFMLGIPLL

SEQ ID NO: 514266 - protein, 9 aa, Homo Sapiens
NGGGEPKGK

SEQ ID NO: 514267 - protein, 9 aa, Homo Sapiens
ETLKNLASI

SEQ ID NO: 514268 - protein, 9 aa, Homo Sapiens
DEDVKFYLA

SEQ ID NO: 514269 - protein, 9 aa, Homo Sapiens
NQMVYTVRY

SEQ ID NO: 514270 - protein, 9 aa, Homo Sapiens
RDSPLFFLK

SEQ ID NO: 514271 - protein, 9 aa, Homo Sapiens
DLNVALKKF

SEQ ID NO: 514272 - protein, 9 aa, Homo Sapiens
GAAVSVLLR

SEQ ID NO: 514273 - protein, 9 aa, Homo Sapiens
NGEGQEGGD

SEQ ID NO: 514274 - protein, 9 aa, Homo Sapiens
DHIVPTLHQ

SEQ ID NO: 514275 - protein, 9 aa, Homo Sapiens
IPLKHPRVA

SEQ ID NO: 514276 - protein, 9 aa, Homo Sapiens
KCHTFCYSC

SEQ ID NO: 514277 - protein, 9 aa, Homo Sapiens
TVVFKPGNT

SEQ ID NO: 514278 - protein, 9 aa, Homo Sapiens
SACYILEQQ

SEQ ID NO: 514279 - protein, 9 aa, Homo Sapiens
VGLSIDFVE

SEQ ID NO: 514280 - protein, 9 aa, Homo Sapiens
YVTYHNKRK

SEQ ID NO: 514281 - protein, 9 aa, Homo Sapiens
FENPHTSTT

SEQ ID NO: 514282 - protein, 9 aa, Homo Sapiens
DIKQILAEA

SEQ ID NO: 514283 - protein, 9 aa, Homo Sapiens
PPLEGFVVN

SEQ ID NO: 514284 - protein, 9 aa, Homo Sapiens
ESAAEEPTS

SEQ ID NO: 514285 - protein, 9 aa, Homo Sapiens
LLREVFRFA

SEQ ID NO: 514286 - protein, 9 aa, Homo Sapiens
YQSPVRVLQ

SEQ ID NO: 514287 - protein, 9 aa, Homo Sapiens
EDIKQILAE

SEQ ID NO: 514288 - protein, 9 aa, Homo Sapiens
VASVLSCII

SEQ ID NO: 514289 - protein, 9 aa, Homo Sapiens
GNIIAFWVS

SEQ ID NO: 514290 - protein, 9 aa, Homo Sapiens
DWQPLISPA

SEQ ID NO: 514291 - protein, 9 aa, Homo Sapiens
GPPVPPPVK

SEQ ID NO: 514292 - protein, 9 aa, Homo Sapiens
LGSLACPRG

SEQ ID NO: 514293 - protein, 9 aa, Homo Sapiens
PSLANVSSF

SEQ ID NO: 514294 - protein, 9 aa, Homo Sapiens
KKPCALEKK

SEQ ID NO: 514295 - protein, 9 aa, Homo Sapiens
PRGSQGYSH

SEQ ID NO: 514296 - protein, 9 aa, Homo Sapiens
SMFENQMVY

SEQ ID NO: 514297 - protein, 9 aa, Homo Sapiens
HPRVAVTTT

SEQ ID NO: 514298 - protein, 9 aa, Homo Sapiens
GNGEGQEGG

SEQ ID NO: 514299 - protein, 9 aa, Homo Sapiens
RKCHTFCYS

SEQ ID NO: 514300 - protein, 9 aa, Homo Sapiens
EAFYVKDPK

SEQ ID NO: 514301 - protein, 9 aa, Homo Sapiens
VNRVQGDYF

SEQ ID NO: 514302 - protein, 9 aa, Homo Sapiens
GEVSIPSPK

SEQ ID NO: 514303 - protein, 9 aa, Homo Sapiens
LQENHQRAS

SEQ ID NO: 514304 - protein, 9 aa, Homo Sapiens
STPIQPCRT

SEQ ID NO: 514305 - protein, 9 aa, Homo Sapiens
GPPLTAASS

SEQ ID NO: 514306 - protein, 9 aa, Homo Sapiens
THQQLGFLS

SEQ ID NO: 514307 - protein, 9 aa, Homo Sapiens
FLYPDTDWC

SEQ ID NO: 514308 - protein, 9 aa, Homo Sapiens
LFTSHWPFS

SEQ ID NO: 514309 - protein, 9 aa, Homo Sapiens
IKETWTAES

SEQ ID NO: 514310 - protein, 9 aa, Homo Sapiens
GSYSDYVRE

SEQ ID NO: 514311 - protein, 9 aa, Homo Sapiens
IYSLRNNDL

SEQ ID NO: 514312 - protein, 9 aa, Homo Sapiens
ADFTGTIKV

SEQ ID NO: 514313 - protein, 9 aa, Homo Sapiens
VRVLQIPLQ

SEQ ID NO: 514314 - protein, 9 aa, Homo Sapiens
PALNIGSVS

SEQ ID NO: 514315 - protein, 9 aa, Homo Sapiens
VGAGRVGKS

SEQ ID NO: 514316 - protein, 9 aa, Homo Sapiens
SEKGARSII

SEQ ID NO: 514317 - protein, 9 aa, Homo Sapiens
RSACYILEQ

SEQ ID NO: 514318 - protein, 9 aa, Homo Sapiens
EKHVRRESL

SEQ ID NO: 514319 - protein, 9 aa, Homo Sapiens
DSTHILTPT

SEQ ID NO: 514320 - protein, 9 aa, Homo Sapiens
SRKEGPTFR

SEQ ID NO: 514321 - protein, 9 aa, Homo Sapiens
SVLLREVFR

SEQ ID NO: 514322 - protein, 9 aa, Homo Sapiens
FVVNRVQGD

SEQ ID NO: 514323 - protein, 9 aa, Homo Sapiens
YVCSECRKT

SEQ ID NO: 514324 - protein, 9 aa, Homo Sapiens
HIYVELKRK

SEQ ID NO: 514325 - protein, 9 aa, Homo Sapiens
YFPTAKRRI

SEQ ID NO: 514326 - protein, 9 aa, Homo Sapiens
RNPVENFMK

SEQ ID NO: 514327 - protein, 9 aa, Homo Sapiens
RLHEHGAAE

SEQ ID NO: 514328 - protein, 9 aa, Homo Sapiens
PVNKRYPAG

SEQ ID NO: 514329 - protein, 9 aa, Homo Sapiens
GIIPANSET

SEQ ID NO: 514330 - protein, 9 aa, Homo Sapiens
VPPKPKLSR

SEQ ID NO: 514331 - protein, 9 aa, Homo Sapiens
LEGFVVNRV

SEQ ID NO: 514332 - protein, 9 aa, Homo Sapiens
EREAFYVKD

SEQ ID NO: 514333 - protein, 9 aa, Homo Sapiens
EEEEEGNGE

SEQ ID NO: 514334 - protein, 9 aa, Homo Sapiens
GHLFALRYL

SEQ ID NO: 514335 - protein, 9 aa, Homo Sapiens
YTESDYDAF

SEQ ID NO: 514336 - protein, 9 aa, Homo Sapiens
PGNTQKEIR

SEQ ID NO: 514337 - protein, 9 aa, Homo Sapiens
KFIKNWKLI

SEQ ID NO: 514338 - protein, 9 aa, Homo Sapiens
SGIAPAASP

SEQ ID NO: 514339 - protein, 9 aa, Homo Sapiens
RKRKCHTFC

SEQ ID NO: 514340 - protein, 9 aa, Homo Sapiens
YQAYDFLLK

SEQ ID NO: 514341 - protein, 9 aa, Homo Sapiens
ICLLVLGAI

SEQ ID NO: 514342 - protein, 9 aa, Homo Sapiens
NSLLSTEPS

SEQ ID NO: 514343 - protein, 9 aa, Homo Sapiens
RSSFRSKKE

SEQ ID NO: 514344 - protein, 9 aa, Homo Sapiens
QETLKNLAS

SEQ ID NO: 514345 - protein, 9 aa, Homo Sapiens
HLFALRYLD

SEQ ID NO: 514346 - protein, 9 aa, Homo Sapiens
FSSNKVLVI

SEQ ID NO: 514347 - protein, 9 aa, Homo Sapiens
KHIKESVGR

SEQ ID NO: 514348 - protein, 9 aa, Homo Sapiens
FIKLPSMPT

SEQ ID NO: 514349 - protein, 9 aa, Homo Sapiens
ENEDKEKEN

SEQ ID NO: 514350 - protein, 9 aa, Homo Sapiens
KRETLRRAR

SEQ ID NO: 514351 - protein, 9 aa, Homo Sapiens
YSLRNNDLN

SEQ ID NO: 514352 - protein, 9 aa, Homo Sapiens
DSWPVNKRY

SEQ ID NO: 514353 - protein, 9 aa, Homo Sapiens
IDSTHILTP

SEQ ID NO: 514354 - protein, 9 aa, Homo Sapiens
VCSECRKTF

SEQ ID NO: 514355 - protein, 9 aa, Homo Sapiens
GFVVNRVQG

SEQ ID NO: 514356 - protein, 9 aa, Homo Sapiens
VMQETLKNL

SEQ ID NO: 514357 - protein, 9 aa, Homo Sapiens
KETQIFFQP

SEQ ID NO: 514358 - protein, 9 aa, Homo Sapiens
VNLLEKHVR

SEQ ID NO: 514359 - protein, 9 aa, Homo Sapiens
DWCKTQPLQ

SEQ ID NO: 514360 - protein, 9 aa, Homo Sapiens
FRCFICVEK

SEQ ID NO: 514361 - protein, 9 aa, Homo Sapiens
LHWKTYHVK

SEQ ID NO: 514362 - protein, 9 aa, Homo Sapiens
PYRSACYIL

SEQ ID NO: 514363 - protein, 9 aa, Homo Sapiens
TTNAQTWAN

SEQ ID NO: 514364 - protein, 9 aa, Homo Sapiens
GKKPCALEK

SEQ ID NO: 514365 - protein, 9 aa, Homo Sapiens
LYTRSLNQI

SEQ ID NO: 514366 - protein, 9 aa, Homo Sapiens
WMAFKGEQS

SEQ ID NO: 514367 - protein, 9 aa, Homo Sapiens
VYVTYHNKR

SEQ ID NO: 514368 - protein, 9 aa, Homo Sapiens
ILVDVKKQP

SEQ ID NO: 514369 - protein, 9 aa, Homo Sapiens
MFTDEDVKF

SEQ ID NO: 514370 - protein, 9 aa, Homo Sapiens
DDHIVPTLH

SEQ ID NO: 514371 - protein, 9 aa, Homo Sapiens
VKFDFSSNK

SEQ ID NO: 514372 - protein, 9 aa, Homo Sapiens
AEKKLKKDE

SEQ ID NO: 514373 - protein, 9 aa, Homo Sapiens
SRSNPLVKK

SEQ ID NO: 514374 - protein, 9 aa, Homo Sapiens
EAKGMDTPA

SEQ ID NO: 514375 - protein, 9 aa, Homo Sapiens
GLFEVPELS

SEQ ID NO: 514376 - protein, 9 aa, Homo Sapiens
EKKFPGEVS

SEQ ID NO: 514377 - protein, 9 aa, Homo Sapiens
EDDYNTANH

SEQ ID NO: 514378 - protein, 9 aa, Homo Sapiens
TQGKWKVFS

SEQ ID NO: 514379 - protein, 9 aa, Homo Sapiens
PRNCDPALH

SEQ ID NO: 514380 - protein, 9 aa, Homo Sapiens
DFFLVILVD

SEQ ID NO: 514381 - protein, 9 aa, Homo Sapiens
RKGKKPCAL

SEQ ID NO: 514382 - protein, 9 aa, Homo Sapiens
DSTPLPVTS

SEQ ID NO: 514383 - protein, 9 aa, Homo Sapiens
EIILGQLSV

SEQ ID NO: 514384 - protein, 9 aa, Homo Sapiens
NSRSSFRSK

SEQ ID NO: 514385 - protein, 9 aa, Homo Sapiens
SQKWAAVVV

SEQ ID NO: 514386 - protein, 9 aa, Homo Sapiens
GIAPAASPA

SEQ ID NO: 514387 - protein, 9 aa, Homo Sapiens
KLSRVKEKF

SEQ ID NO: 514388 - protein, 9 aa, Homo Sapiens
RRIRRQDIR

SEQ ID NO: 514389 - protein, 9 aa, Homo Sapiens
GTIWIHILQ

SEQ ID NO: 514390 - protein, 9 aa, Homo Sapiens
VLGAICLYF

SEQ ID NO: 514391 - protein, 9 aa, Homo Sapiens
EGNGEGQEG

SEQ ID NO: 514392 - protein, 9 aa, Homo Sapiens
LVALDWVVR

SEQ ID NO: 514393 - protein, 9 aa, Homo Sapiens
VTVYPIMLF

SEQ ID NO: 514394 - protein, 9 aa, Homo Sapiens
CVEKLRDAR

SEQ ID NO: 514395 - protein, 9 aa, Homo Sapiens
QLGFLSLTY

SEQ ID NO: 514396 - protein, 9 aa, Homo Sapiens
ELEVMLCGN

SEQ ID NO: 514397 - protein, 9 aa, Homo Sapiens
DDYNTANHN

SEQ ID NO: 514398 - protein, 9 aa, Homo Sapiens
EPVGLSIDF

SEQ ID NO: 514399 - protein, 9 aa, Homo Sapiens
HWPFSVFYL

SEQ ID NO: 514400 - protein, 9 aa, Homo Sapiens
AFSGLKILK

SEQ ID NO: 514401 - protein, 9 aa, Homo Sapiens
NGSYSDYVR

SEQ ID NO: 514402 - protein, 9 aa, Homo Sapiens
WQPLISPAG

SEQ ID NO: 514403 - protein, 9 aa, Homo Sapiens
LQQTVSEEG

SEQ ID NO: 514404 - protein, 9 aa, Homo Sapiens
DPVLRVLFS

SEQ ID NO: 514405 - protein, 9 aa, Homo Sapiens
SSNKVLVIP

SEQ ID NO: 514406 - protein, 9 aa, Homo Sapiens
SGLKILKRL

SEQ ID NO: 514407 - protein, 9 aa, Homo Sapiens
CDPALHPFE

SEQ ID NO: 514408 - protein, 9 aa, Homo Sapiens
ALRYLDYEA

SEQ ID NO: 514409 - protein, 9 aa, Homo Sapiens
TGTIKVFVN

SEQ ID NO: 514410 - protein, 9 aa, Homo Sapiens
YPIMLFLGR

SEQ ID NO: 514411 - protein, 9 aa, Homo Sapiens
KKDEKKKEL

SEQ ID NO: 514412 - protein, 9 aa, Homo Sapiens
KPGNTQKEI

SEQ ID NO: 514413 - protein, 9 aa, Homo Sapiens
GPPPGSRSN

SEQ ID NO: 514414 - protein, 9 aa, Homo Sapiens
RGLSKDFSE

SEQ ID NO: 514415 - protein, 9 aa, Homo Sapiens
RVGKSALTI

SEQ ID NO: 514416 - protein, 9 aa, Homo Sapiens
TRPAGDGTS

SEQ ID NO: 514417 - protein, 9 aa, Homo Sapiens
QVYPKYFMK

SEQ ID NO: 514418 - protein, 9 aa, Homo Sapiens
RPCVRGRRI

SEQ ID NO: 514419 - protein, 9 aa, Homo Sapiens
SERSTPLTA

SEQ ID NO: 514420 - protein, 9 aa, Homo Sapiens
SIHCFLYPD

SEQ ID NO: 514421 - protein, 9 aa, Homo Sapiens
HLMDIELVV

SEQ ID NO: 514422 - protein, 9 aa, Homo Sapiens
DFRAYQFRF

SEQ ID NO: 514423 - protein, 9 aa, Homo Sapiens
IDDHIVPTL

SEQ ID NO: 514424 - protein, 9 aa, Homo Sapiens
RFNNSLLST

SEQ ID NO: 514425 - protein, 9 aa, Homo Sapiens
RPYVCSECR

SEQ ID NO: 514426 - protein, 9 aa, Homo Sapiens
LACPRGSQG

SEQ ID NO: 514427 - protein, 9 aa, Homo Sapiens
GTHQQLGFL

SEQ ID NO: 514428 - protein, 9 aa, Homo Sapiens
GSLACPRGS

SEQ ID NO: 514429 - protein, 9 aa, Homo Sapiens
QEREAFYVK

SEQ ID NO: 514430 - protein, 9 aa, Homo Sapiens
VDSWPVNKR

SEQ ID NO: 514431 - protein, 9 aa, Homo Sapiens
LPDKDGHRD

SEQ ID NO: 514432 - protein, 9 aa, Homo Sapiens
MSAPGSPYQ

SEQ ID NO: 514433 - protein, 9 aa, Homo Sapiens
YVPPKPKLS

SEQ ID NO: 514434 - protein, 9 aa, Homo Sapiens
EYVPPKPKL

SEQ ID NO: 514435 - protein, 9 aa, Homo Sapiens
WVSEDKDIP

SEQ ID NO: 514436 - protein, 9 aa, Homo Sapiens
PNSRSSFRS

SEQ ID NO: 514437 - protein, 9 aa, Homo Sapiens
QVSRGSTPI

SEQ ID NO: 514438 - protein, 9 aa, Homo Sapiens
EKGARSIIM

SEQ ID NO: 514439 - protein, 9 aa, Homo Sapiens
RFKSIHCFL

SEQ ID NO: 514440 - protein, 9 aa, Homo Sapiens
LIVSFIFNL

SEQ ID NO: 514441 - protein, 9 aa, Homo Sapiens
PGSRSNPLV

SEQ ID NO: 514442 - protein, 9 aa, Homo Sapiens
LELKIKETW

SEQ ID NO: 514443 - protein, 9 aa, Homo Sapiens
PAGDGTSQK

SEQ ID NO: 514444 - protein, 9 aa, Homo Sapiens
PGPPPGSRS

SEQ ID NO: 514445 - protein, 9 aa, Homo Sapiens
TALCWDPVL

SEQ ID NO: 514446 - protein, 9 aa, Homo Sapiens
KYQSPVRVL

SEQ ID NO: 514447 - protein, 9 aa, Homo Sapiens
RKEGPTFRR

SEQ ID NO: 514448 - protein, 9 aa, Homo Sapiens
TCLRMELEI

SEQ ID NO: 514449 - protein, 9 aa, Homo Sapiens
IWIHILQKR

SEQ ID NO: 514450 - protein, 9 aa, Homo Sapiens
SHWPFSVFY

SEQ ID NO: 514451 - protein, 9 aa, Homo Sapiens
ENPHTSTTA

SEQ ID NO: 514452 - protein, 9 aa, Homo Sapiens
LRVKATEQD

SEQ ID NO: 514453 - protein, 9 aa, Homo Sapiens
ERRGLFEVP

SEQ ID NO: 514454 - protein, 9 aa, Homo Sapiens
ETKTRALEG

SEQ ID NO: 514455 - protein, 9 aa, Homo Sapiens
VSKAEINGQ

SEQ ID NO: 514456 - protein, 9 aa, Homo Sapiens
AGRVGKSAL

SEQ ID NO: 514457 - protein, 9 aa, Homo Sapiens
SNVNLLEKH

SEQ ID NO: 514458 - protein, 9 aa, Homo Sapiens
QQEREAFYV

SEQ ID NO: 514459 - protein, 9 aa, Homo Sapiens
DFSSNKVLV

SEQ ID NO: 514460 - protein, 9 aa, Homo Sapiens
HRDSPLFFL

SEQ ID NO: 514461 - protein, 9 aa, Homo Sapiens
GLINGCHAK

SEQ ID NO: 514462 - protein, 9 aa, Homo Sapiens
ADSVYKYNV

SEQ ID NO: 514463 - protein, 9 aa, Homo Sapiens
VYKYNVFRS

SEQ ID NO: 514464 - protein, 9 aa, Homo Sapiens
TQPLQQTVS

SEQ ID NO: 514465 - protein, 9 aa, Homo Sapiens
QPLISPAGT

SEQ ID NO: 514466 - protein, 9 aa, Homo Sapiens
ATEESAAEE

SEQ ID NO: 514467 - protein, 9 aa, Homo Sapiens
LEIILGQLS

SEQ ID NO: 514468 - protein, 9 aa, Homo Sapiens
PDSMFENQM

SEQ ID NO: 514469 - protein, 9 aa, Homo Sapiens
HGPPLTAAS

SEQ ID NO: 514470 - protein, 9 aa, Homo Sapiens
MEASLTKRL

SEQ ID NO: 514471 - protein, 9 aa, Homo Sapiens
RERPSVAYN

SEQ ID NO: 514472 - protein, 9 aa, Homo Sapiens
NCYLLLHFM

SEQ ID NO: 514473 - protein, 9 aa, Homo Sapiens
GAFSGLKIL

SEQ ID NO: 514474 - protein, 9 aa, Homo Sapiens
PKLSRVKEK

SEQ ID NO: 514475 - protein, 9 aa, Homo Sapiens
PWPQTLRKS

SEQ ID NO: 514476 - protein, 9 aa, Homo Sapiens
DGTHQQLGF

SEQ ID NO: 514477 - protein, 9 aa, Homo Sapiens
SVGRPQGFE

SEQ ID NO: 514478 - protein, 9 aa, Homo Sapiens
NHQRASIFF

SEQ ID NO: 514479 - protein, 9 aa, Homo Sapiens
VELATAFSL

SEQ ID NO: 514480 - protein, 9 aa, Homo Sapiens
ATAFSLSET

SEQ ID NO: 514481 - protein, 9 aa, Homo Sapiens
ALEGTVSVA

SEQ ID NO: 514482 - protein, 9 aa, Homo Sapiens
WPQTLRKSN

SEQ ID NO: 514483 - protein, 9 aa, Homo Sapiens
VDVKKQPKK

SEQ ID NO: 514484 - protein, 9 aa, Homo Sapiens
RGSRKRKCH

SEQ ID NO: 514485 - protein, 9 aa, Homo Sapiens
YSDILNSTA

SEQ ID NO: 514486 - protein, 9 aa, Homo Sapiens
APGSPYQAY

SEQ ID NO: 514487 - protein, 9 aa, Homo Sapiens
RDVMQETLK

SEQ ID NO: 514488 - protein, 9 aa, Homo Sapiens
PGVCFRLYT

SEQ ID NO: 514489 - protein, 9 aa, Homo Sapiens
QGWSLGSAS

SEQ ID NO: 514490 - protein, 9 aa, Homo Sapiens
VISCFKRHE

SEQ ID NO: 514491 - protein, 9 aa, Homo Sapiens
CWQILKGLL

SEQ ID NO: 514492 - protein, 9 aa, Homo Sapiens
TLKNLASIG

SEQ ID NO: 514493 - protein, 9 aa, Homo Sapiens
AQSKLLNKV

SEQ ID NO: 514494 - protein, 9 aa, Homo Sapiens
VSIPSPKPK

SEQ ID NO: 514495 - protein, 9 aa, Homo Sapiens
SPVRVLQIP

SEQ ID NO: 514496 - protein, 9 aa, Homo Sapiens
EEKKFPGEV

SEQ ID NO: 514497 - protein, 9 aa, Homo Sapiens
STEPSQQLQ

SEQ ID NO: 514498 - protein, 9 aa, Homo Sapiens
THSLEHPYL

SEQ ID NO: 514499 - protein, 9 aa, Homo Sapiens
CLRMELEII

SEQ ID NO: 514500 - protein, 9 aa, Homo Sapiens
QERQRLSDL

SEQ ID NO: 514501 - protein, 9 aa, Homo Sapiens
SHLPCQVSR

SEQ ID NO: 514502 - protein, 9 aa, Homo Sapiens
CHAKIGTVV

SEQ ID NO: 514503 - protein, 9 aa, Homo Sapiens
RSTPLTALL

SEQ ID NO: 514504 - protein, 9 aa, Homo Sapiens
LKPQPWPQT

SEQ ID NO: 514505 - protein, 9 aa, Homo Sapiens
SSFRSKKEV

SEQ ID NO: 514506 - protein, 9 aa, Homo Sapiens
LLLHFMLGI

SEQ ID NO: 514507 - protein, 9 aa, Homo Sapiens
LCQKFLTSF

SEQ ID NO: 514508 - protein, 9 aa, Homo Sapiens
TGANMGIGK

SEQ ID NO: 514509 - protein, 9 aa, Homo Sapiens
VALDWVVRP

SEQ ID NO: 514510 - protein, 9 aa, Homo Sapiens
SASCRTISG

SEQ ID NO: 514511 - protein, 9 aa, Homo Sapiens
KGEQSKHQK

SEQ ID NO: 514512 - protein, 9 aa, Homo Sapiens
RLVEKTPDE

SEQ ID NO: 514513 - protein, 9 aa, Homo Sapiens
ERYLPPSRK

SEQ ID NO: 514514 - protein, 9 aa, Homo Sapiens
KAEINGQNN

SEQ ID NO: 514515 - protein, 9 aa, Homo Sapiens
PLEGFVVNR

SEQ ID NO: 514516 - protein, 9 aa, Homo Sapiens
IPANSETVE

SEQ ID NO: 514517 - protein, 9 aa, Homo Sapiens
EQDEGINSE

SEQ ID NO: 514518 - protein, 9 aa, Homo Sapiens
FVLLFTSHW

SEQ ID NO: 514519 - protein, 9 aa, Homo Sapiens
VLPSGSTVH

SEQ ID NO: 514520 - protein, 9 aa, Homo Sapiens
ARVQPKFLQ

SEQ ID NO: 514521 - protein, 9 aa, Homo Sapiens
PLPFFSAIL

SEQ ID NO: 514522 - protein, 9 aa, Homo Sapiens
LEAPYSREQ

SEQ ID NO: 514523 - protein, 9 aa, Homo Sapiens
GWRWRRGHR

SEQ ID NO: 514524 - protein, 9 aa, Homo Sapiens
VVITGANMG

SEQ ID NO: 514525 - protein, 9 aa, Homo Sapiens
PLISPAGTE

SEQ ID NO: 514526 - protein, 9 aa, Homo Sapiens
ALLVSTTLP

SEQ ID NO: 514527 - protein, 9 aa, Homo Sapiens
LNQIPDTAT

SEQ ID NO: 514528 - protein, 9 aa, Homo Sapiens
RPSVAYNGP

SEQ ID NO: 514529 - protein, 9 aa, Homo Sapiens
KDEKKKELQ

SEQ ID NO: 514530 - protein, 9 aa, Homo Sapiens
LMDIELVVI

SEQ ID NO: 514531 - protein, 9 aa, Homo Sapiens
FPGEVSIPS

SEQ ID NO: 514532 - protein, 9 aa, Homo Sapiens
LETMRWNVM

SEQ ID NO: 514533 - protein, 9 aa, Homo Sapiens
QQLGFLSLT

SEQ ID NO: 514534 - protein, 9 aa, Homo Sapiens
IYVELKRKG

SEQ ID NO: 514535 - protein, 9 aa, Homo Sapiens
QPWPQTLRK

SEQ ID NO: 514536 - protein, 9 aa, Homo Sapiens
PLADLLPVS

SEQ ID NO: 514537 - protein, 9 aa, Homo Sapiens
VVHIYVELK

SEQ ID NO: 514538 - protein, 9 aa, Homo Sapiens
SLEHPYLHQ

SEQ ID NO: 514539 - protein, 9 aa, Homo Sapiens
NVFRSTFHS

SEQ ID NO: 514540 - protein, 9 aa, Homo Sapiens
PYSREQERQ

SEQ ID NO: 514541 - protein, 9 aa, Homo Sapiens
PVGLSIDFV

SEQ ID NO: 514542 - protein, 9 aa, Homo Sapiens
AFYVKDPKK

SEQ ID NO: 514543 - protein, 9 aa, Homo Sapiens
SEDKDIPAR

SEQ ID NO: 514544 - protein, 9 aa, Homo Sapiens
RRGLFEVPE

SEQ ID NO: 514545 - protein, 9 aa, Homo Sapiens
PVTGLLSAR

SEQ ID NO: 514546 - protein, 9 aa, Homo Sapiens
REAFYVKDP

SEQ ID NO: 514547 - protein, 9 aa, Homo Sapiens
TNAQTWANK

SEQ ID NO: 514548 - protein, 9 aa, Homo Sapiens
SAARYALLC

SEQ ID NO: 514549 - protein, 9 aa, Homo Sapiens
RWNVMGNGL

SEQ ID NO: 514550 - protein, 9 aa, Homo Sapiens
DIQTGAFSG

SEQ ID NO: 514551 - protein, 9 aa, Homo Sapiens
IAVVYVTYH

SEQ ID NO: 514552 - protein, 9 aa, Homo Sapiens
GMGSPLPTS

SEQ ID NO: 514553 - protein, 9 aa, Homo Sapiens
KKETQIFFQ

SEQ ID NO: 514554 - protein, 9 aa, Homo Sapiens
PSMPTLIHN

SEQ ID NO: 514555 - protein, 9 aa, Homo Sapiens
TALLVSTTL

SEQ ID NO: 514556 - protein, 9 aa, Homo Sapiens
SKEVMFTDE

SEQ ID NO: 514557 - protein, 9 aa, Homo Sapiens
AASGVRLYI

SEQ ID NO: 514558 - protein, 9 aa, Homo Sapiens
LEGTVSVAK

SEQ ID NO: 514559 - protein, 9 aa, Homo Sapiens
VFSTCGSHL

SEQ ID NO: 514560 - protein, 9 aa, Homo Sapiens
AVIPLKHPR

SEQ ID NO: 514561 - protein, 9 aa, Homo Sapiens
VSPPPLPFF

SEQ ID NO: 514562 - protein, 9 aa, Homo Sapiens
NLKPQPWPQ

SEQ ID NO: 514563 - protein, 9 aa, Homo Sapiens
RNCDPALHP

SEQ ID NO: 514564 - protein, 9 aa, Homo Sapiens
DVMQETLKN

SEQ ID NO: 514565 - protein, 9 aa, Homo Sapiens
VSEDKDIPA

SEQ ID NO: 514566 - protein, 9 aa, Homo Sapiens
RSNPLVKKE

SEQ ID NO: 514567 - protein, 9 aa, Homo Sapiens
GRPSRTLQK

SEQ ID NO: 514568 - protein, 9 aa, Homo Sapiens
LLSTEPSQQ

SEQ ID NO: 514569 - protein, 9 aa, Homo Sapiens
LKIKETWTA

SEQ ID NO: 514570 - protein, 9 aa, Homo Sapiens
LFEVPELSA

SEQ ID NO: 514571 - protein, 9 aa, Homo Sapiens
NPHTSTTAL

SEQ ID NO: 514572 - protein, 9 aa, Homo Sapiens
CSQDILRMF

SEQ ID NO: 514573 - protein, 9 aa, Homo Sapiens
PQPWPQTLR

SEQ ID NO: 514574 - protein, 9 aa, Homo Sapiens
KVFSTCGSH

SEQ ID NO: 514575 - protein, 9 aa, Homo Sapiens
IQTPLADLL

SEQ ID NO: 514576 - protein, 9 aa, Homo Sapiens
SLGSASCRT

SEQ ID NO: 514577 - protein, 9 aa, Homo Sapiens
SQDILRMFL

SEQ ID NO: 514578 - protein, 9 aa, Homo Sapiens
CDFFLVILV

SEQ ID NO: 514579 - protein, 9 aa, Homo Sapiens
HGEQLRERP

SEQ ID NO: 514580 - protein, 9 aa, Homo Sapiens
SPYQAYDFL

SEQ ID NO: 514581 - protein, 9 aa, Homo Sapiens
HLPCQVSRG

SEQ ID NO: 514582 - protein, 9 aa, Homo Sapiens
SCRTISGLY

SEQ ID NO: 514583 - protein, 9 aa, Homo Sapiens
SPLPTSALV

SEQ ID NO: 514584 - protein, 9 aa, Homo Sapiens
FETKARKGK

SEQ ID NO: 514585 - protein, 9 aa, Homo Sapiens
PLQINYGCL

SEQ ID NO: 514586 - protein, 9 aa, Homo Sapiens
RLETMRWNV

SEQ ID NO: 514587 - protein, 9 aa, Homo Sapiens
VSVLLREVF

SEQ ID NO: 514588 - protein, 9 aa, Homo Sapiens
EGFVVNRVQ

SEQ ID NO: 514589 - protein, 9 aa, Homo Sapiens
AFIKLPSMP

SEQ ID NO: 514590 - protein, 9 aa, Homo Sapiens
YQFRFLQTS

SEQ ID NO: 514591 - protein, 9 aa, Homo Sapiens
LSARHEQKD

SEQ ID NO: 514592 - protein, 9 aa, Homo Sapiens
QPYRSACYI

SEQ ID NO: 514593 - protein, 9 aa, Homo Sapiens
LSSASTGDS

SEQ ID NO: 514594 - protein, 9 aa, Homo Sapiens
PCQVSRGST

SEQ ID NO: 514595 - protein, 9 aa, Homo Sapiens
LDNWWSQVY

SEQ ID NO: 514596 - protein, 9 aa, Homo Sapiens
KLVGVKGPN

SEQ ID NO: 514597 - protein, 9 aa, Homo Sapiens
ASSSARHSQ

SEQ ID NO: 514598 - protein, 9 aa, Homo Sapiens
ARHEQKDAW

SEQ ID NO: 514599 - protein, 9 aa, Homo Sapiens
TEEATEESA

SEQ ID NO: 514600 - protein, 9 aa, Homo Sapiens
PLKHPRVAV

SEQ ID NO: 514601 - protein, 9 aa, Homo Sapiens
GRVGKSALT

SEQ ID NO: 514602 - protein, 9 aa, Homo Sapiens
QSRHFKLVG

SEQ ID NO: 514603 - protein, 9 aa, Homo Sapiens
LAAFIKLPS

SEQ ID NO: 514604 - protein, 9 aa, Homo Sapiens
FYVKDPKKA

SEQ ID NO: 514605 - protein, 9 aa, Homo Sapiens
YRSACYILE

SEQ ID NO: 514606 - protein, 9 aa, Homo Sapiens
KPPKDWQPL

SEQ ID NO: 514607 - protein, 9 aa, Homo Sapiens
LSKDFSENK

SEQ ID NO: 514608 - protein, 9 aa, Homo Sapiens
PRAVIPLKH

SEQ ID NO: 514609 - protein, 9 aa, Homo Sapiens
QQARLHEHG

SEQ ID NO: 514610 - protein, 9 aa, Homo Sapiens
REGPPVPPP

SEQ ID NO: 514611 - protein, 9 aa, Homo Sapiens
RYALLCLEE

SEQ ID NO: 514612 - protein, 9 aa, Homo Sapiens
CYILEQQRV

SEQ ID NO: 514613 - protein, 9 aa, Homo Sapiens
EEEEEEGNG

SEQ ID NO: 514614 - protein, 9 aa, Homo Sapiens
NAQTWANKC

SEQ ID NO: 514615 - protein, 9 aa, Homo Sapiens
LVLGAICLY

SEQ ID NO: 514616 - protein, 9 aa, Homo Sapiens
DFVENKLYW

SEQ ID NO: 514617 - protein, 9 aa, Homo Sapiens
TKRLLFKDR

SEQ ID NO: 514618 - protein, 9 aa, Homo Sapiens
QLRERPSVA

SEQ ID NO: 514619 - protein, 9 aa, Homo Sapiens
YNTANHNLE

SEQ ID NO: 514620 - protein, 9 aa, Homo Sapiens
TESDYDAFA

SEQ ID NO: 514621 - protein, 9 aa, Homo Sapiens
LEKHVRRES

SEQ ID NO: 514622 - protein, 9 aa, Homo Sapiens
FVENKLYWI

SEQ ID NO: 514623 - protein, 9 aa, Homo Sapiens
QGYSHLPCQ

SEQ ID NO: 514624 - protein, 9 aa, Homo Sapiens
PKVLRSWCW

SEQ ID NO: 514625 - protein, 9 aa, Homo Sapiens
RMELEIILG

SEQ ID NO: 514626 - protein, 9 aa, Homo Sapiens
PVRVLQIPL

SEQ ID NO: 514627 - protein, 9 aa, Homo Sapiens
AARYALLCL

SEQ ID NO: 514628 - protein, 9 aa, Homo Sapiens
YSDYVREFH

SEQ ID NO: 514629 - protein, 9 aa, Homo Sapiens
NGHLFALRY

SEQ ID NO: 514630 - protein, 9 aa, Homo Sapiens
CWDPVLRVL

SEQ ID NO: 514631 - protein, 9 aa, Homo Sapiens
AICLYFSMY

SEQ ID NO: 514632 - protein, 9 aa, Homo Sapiens
GKWEVLIDS

SEQ ID NO: 514633 - protein, 9 aa, Homo Sapiens
DNWWSQVYP

SEQ ID NO: 514634 - protein, 9 aa, Homo Sapiens
KLMSEKGAR

SEQ ID NO: 514635 - protein, 9 aa, Homo Sapiens
PLTALLVST

SEQ ID NO: 514636 - protein, 9 aa, Homo Sapiens
NNDLNVALK

SEQ ID NO: 514637 - protein, 9 aa, Homo Sapiens
INGCHAKIG

SEQ ID NO: 514638 - protein, 9 aa, Homo Sapiens
TIKVFVNKR

SEQ ID NO: 514639 - protein, 9 aa, Homo Sapiens
SYDYSDILN

SEQ ID NO: 514640 - protein, 9 aa, Homo Sapiens
STPLTALLV

SEQ ID NO: 514641 - protein, 9 aa, Homo Sapiens
NNSLLSTEP

SEQ ID NO: 514642 - protein, 9 aa, Homo Sapiens
SRGSRKRKC

SEQ ID NO: 514643 - protein, 9 aa, Homo Sapiens
GNTQKEIRV

SEQ ID NO: 514644 - protein, 9 aa, Homo Sapiens
TMRWNVMGN

SEQ ID NO: 514645 - protein, 9 aa, Homo Sapiens
FIFNLLCQK

SEQ ID NO: 514646 - protein, 9 aa, Homo Sapiens
NVNLLEKHV

SEQ ID NO: 514647 - protein, 9 aa, Homo Sapiens
RPSRTLQKR

SEQ ID NO: 514648 - protein, 9 aa, Homo Sapiens
PSRTLQKRE

SEQ ID NO: 514649 - protein, 9 aa, Homo Sapiens
QSPVRVLQI

SEQ ID NO: 514650 - protein, 9 aa, Homo Sapiens
YIPFPEDDY

SEQ ID NO: 514651 - protein, 9 aa, Homo Sapiens
QPLQQTVSE

SEQ ID NO: 514652 - protein, 9 aa, Homo Sapiens
GVRLYISGG

SEQ ID NO: 514653 - protein, 9 aa, Homo Sapiens
QQTVSEEGC

SEQ ID NO: 514654 - protein, 9 aa, Homo Sapiens
RTLQKRETL

SEQ ID NO: 514655 - protein, 9 aa, Homo Sapiens
YTRSLNQIP

SEQ ID NO: 514656 - protein, 9 aa, Homo Sapiens
LAEAKRADQ

SEQ ID NO: 514657 - protein, 9 aa, Homo Sapiens
MGSPLPTSA

SEQ ID NO: 514658 - protein, 9 aa, Homo Sapiens
TRFKSIHCF

SEQ ID NO: 514659 - protein, 9 aa, Homo Sapiens
PPLPFFSAI

SEQ ID NO: 514660 - protein, 9 aa, Homo Sapiens
IKQILAEAK

SEQ ID NO: 514661 - protein, 9 aa, Homo Sapiens
KQILAEAKR

SEQ ID NO: 514662 - protein, 9 aa, Homo Sapiens
GVKGPNDRL

SEQ ID NO: 514663 - protein, 9 aa, Homo Sapiens
HIVPTLHQM

SEQ ID NO: 514664 - protein, 9 aa, Homo Sapiens
SIVTVYPIM

SEQ ID NO: 514665 - protein, 9 aa, Homo Sapiens
YLLLHFMLG

SEQ ID NO: 514666 - protein, 9 aa, Homo Sapiens
VLRSWCWQI

SEQ ID NO: 514667 - protein, 9 aa, Homo Sapiens
TTAIGGGGW

SEQ ID NO: 514668 - protein, 9 aa, Homo Sapiens
NLLCQKFLT

SEQ ID NO: 514669 - protein, 9 aa, Homo Sapiens
RIMIDDHIV

SEQ ID NO: 514670 - protein, 9 aa, Homo Sapiens
VPRNCDPAL

SEQ ID NO: 514671 - protein, 9 aa, Homo Sapiens
LMSEKGARS

SEQ ID NO: 514672 - protein, 9 aa, Homo Sapiens
RGMGSPLPT

SEQ ID NO: 514673 - protein, 9 aa, Homo Sapiens
GSRKRKCHT

SEQ ID NO: 514674 - protein, 9 aa, Homo Sapiens
DSMFENQMV

SEQ ID NO: 514675 - protein, 9 aa, Homo Sapiens
LSADFTGTI

SEQ ID NO: 514676 - protein, 9 aa, Homo Sapiens
YDYSDILNS

SEQ ID NO: 514677 - protein, 9 aa, Homo Sapiens
EHPYLHQNS

SEQ ID NO: 514678 - protein, 9 aa, Homo Sapiens
WPGWRWRRG

SEQ ID NO: 514679 - protein, 9 aa, Homo Sapiens
VLLFTSHWP

SEQ ID NO: 514680 - protein, 9 aa, Homo Sapiens
FKRHEAKGM

SEQ ID NO: 514681 - protein, 9 aa, Homo Sapiens
CFICVEKLR

SEQ ID NO: 514682 - protein, 9 aa, Homo Sapiens
IMLFLGRSV

SEQ ID NO: 514683 - protein, 9 aa, Homo Sapiens
FGERRGLFE

SEQ ID NO: 514684 - protein, 9 aa, Homo Sapiens
RGSTPIQPC

SEQ ID NO: 514685 - protein, 9 aa, Homo Sapiens
EKKKELQEL

SEQ ID NO: 514686 - protein, 9 aa, Homo Sapiens
HIKESVGRP

SEQ ID NO: 514687 - protein, 9 aa, Homo Sapiens
VILVDVKKQ

SEQ ID NO: 514688 - protein, 9 aa, Homo Sapiens
KARKGKKPC

SEQ ID NO: 514689 - protein, 9 aa, Homo Sapiens
TPLTALLVS

SEQ ID NO: 514690 - protein, 9 aa, Homo Sapiens
LQKRRNDVF

SEQ ID NO: 514691 - protein, 9 aa, Homo Sapiens
WWSQVYPKY

SEQ ID NO: 514692 - protein, 9 aa, Homo Sapiens
HEHGAAEMV

SEQ ID NO: 514693 - protein, 9 aa, Homo Sapiens
VRNPVENFM

SEQ ID NO: 514694 - protein, 9 aa, Homo Sapiens
HQRASIFFD

SEQ ID NO: 514695 - protein, 9 aa, Homo Sapiens
KNWKLIVSF

SEQ ID NO: 514696 - protein, 9 aa, Homo Sapiens
EVLIDSTHI

SEQ ID NO: 514697 - protein, 9 aa, Homo Sapiens
PHTSTTALV

SEQ ID NO: 514698 - protein, 9 aa, Homo Sapiens
LVRVGVFLD

SEQ ID NO: 514699 - protein, 9 aa, Homo Sapiens
PTLIHNPSL

SEQ ID NO: 514700 - protein, 9 aa, Homo Sapiens
PGEVSIPSP

SEQ ID NO: 514701 - protein, 9 aa, Homo Sapiens
AFWVSEDKD

SEQ ID NO: 514702 - protein, 9 aa, Homo Sapiens
KRKCHTFCY

SEQ ID NO: 514703 - protein, 9 aa, Homo Sapiens
PVENFMKIL

SEQ ID NO: 514704 - protein, 9 aa, Homo Sapiens
GTVVFKPGN

SEQ ID NO: 514705 - protein, 9 aa, Homo Sapiens
KRHEAKGMD

SEQ ID NO: 514706 - protein, 9 aa, Homo Sapiens
NFMKILKGI

SEQ ID NO: 514707 - protein, 9 aa, Homo Sapiens
ICVEKLRDA

SEQ ID NO: 514708 - protein, 9 aa, Homo Sapiens
LCLEEGPPH

SEQ ID NO: 514709 - protein, 9 aa, Homo Sapiens
EDMEKKETQ

SEQ ID NO: 514710 - protein, 9 aa, Homo Sapiens
PPKPKLSRV

SEQ ID NO: 514711 - protein, 9 aa, Homo Sapiens
RYLPPSRKE

SEQ ID NO: 514712 - protein, 9 aa, Homo Sapiens
SGSTVHVKS

SEQ ID NO: 514713 - protein, 9 aa, Homo Sapiens
SADFTGTIK

SEQ ID NO: 514714 - protein, 9 aa, Homo Sapiens
ASCRTISGL

SEQ ID NO: 514715 - protein, 9 aa, Homo Sapiens
CQVSRGSTP

SEQ ID NO: 514716 - protein, 9 aa, Homo Sapiens
SLNQIPDTA

SEQ ID NO: 514717 - protein, 9 aa, Homo Sapiens
DLQRVPRNC

SEQ ID NO: 514718 - protein, 9 aa, Homo Sapiens
ILRVKATEQ

SEQ ID NO: 514719 - protein, 9 aa, Homo Sapiens
KGKKPCALE

SEQ ID NO: 514720 - protein, 9 aa, Homo Sapiens
AAVSVLLRE

SEQ ID NO: 514721 - protein, 9 aa, Homo Sapiens
ETKARKGKK

SEQ ID NO: 514722 - protein, 9 aa, Homo Sapiens
VVRPCVRGR

SEQ ID NO: 514723 - protein, 9 aa, Homo Sapiens
GVSPPPLPF

SEQ ID NO: 514724 - protein, 9 aa, Homo Sapiens
KLKKDEKKK

SEQ ID NO: 514725 - protein, 9 aa, Homo Sapiens
LINGCHAKI

SEQ ID NO: 514726 - protein, 9 aa, Homo Sapiens
KESVGRPQG

SEQ ID NO: 514727 - protein, 9 aa, Homo Sapiens
AGAASGVRL

SEQ ID NO: 514728 - protein, 9 aa, Homo Sapiens
CQKFLTSFV

SEQ ID NO: 514729 - protein, 9 aa, Homo Sapiens
LVDVKKQPK

SEQ ID NO: 514730 - protein, 9 aa, Homo Sapiens
RQKLELKIK

SEQ ID NO: 514731 - protein, 9 aa, Homo Sapiens
FLNGSYSDY

SEQ ID NO: 514732 - protein, 9 aa, Homo Sapiens
PLQQTVSEE

SEQ ID NO: 514733 - protein, 9 aa, Homo Sapiens
ERTPDTAER

SEQ ID NO: 514734 - protein, 9 aa, Homo Sapiens
LTGVVHIYV

SEQ ID NO: 514735 - protein, 9 aa, Homo Sapiens
VRPCVRGRR

SEQ ID NO: 514736 - protein, 9 aa, Homo Sapiens
NLYTRSLNQ

SEQ ID NO: 514737 - protein, 9 aa, Homo Sapiens
SDYVREFHN

SEQ ID NO: 514738 - protein, 9 aa, Homo Sapiens
IVPTLHQMV

SEQ ID NO: 514739 - protein, 9 aa, Homo Sapiens
SPEDTSYDY

SEQ ID NO: 514740 - protein, 9 aa, Homo Sapiens
PIMLFLGRS

SEQ ID NO: 514741 - protein, 9 aa, Homo Sapiens
GVCFRLYTE

SEQ ID NO: 514742 - protein, 9 aa, Homo Sapiens
APYSREQER

SEQ ID NO: 514743 - protein, 9 aa, Homo Sapiens
LPFFSAILA

SEQ ID NO: 514744 - protein, 9 aa, Homo Sapiens
MNCYLLLHF

SEQ ID NO: 514745 - protein, 9 aa, Homo Sapiens
LLFTSHWPF

SEQ ID NO: 514746 - protein, 9 aa, Homo Sapiens
FKGEQSKHQ

SEQ ID NO: 514747 - protein, 9 aa, Homo Sapiens
GHHGPPLTA

SEQ ID NO: 514748 - protein, 9 aa, Homo Sapiens
GGGWPGWRW

SEQ ID NO: 514749 - protein, 9 aa, Homo Sapiens
RTPDTAERL

SEQ ID NO: 514750 - protein, 9 aa, Homo Sapiens
PPPLPFFSA

SEQ ID NO: 514751 - protein, 9 aa, Homo Sapiens
VNKRYPAGN

SEQ ID NO: 514752 - protein, 9 aa, Homo Sapiens
ACPRGSQGY

SEQ ID NO: 514753 - protein, 9 aa, Homo Sapiens
GGPGLINGC

SEQ ID NO: 514754 - protein, 9 aa, Homo Sapiens
SSSGHHGPP

SEQ ID NO: 514755 - protein, 9 aa, Homo Sapiens
LLAAFIKLP

SEQ ID NO: 514756 - protein, 9 aa, Homo Sapiens
IGGGGWPGW

SEQ ID NO: 514757 - protein, 9 aa, Homo Sapiens
LRERPSVAY

SEQ ID NO: 514758 - protein, 9 aa, Homo Sapiens
ALLCLEEGP

SEQ ID NO: 514759 - protein, 9 aa, Homo Sapiens
RAYQFRFLQ

SEQ ID NO: 514760 - protein, 9 aa, Homo Sapiens
VFRCFICVE

SEQ ID NO: 514761 - protein, 9 aa, Homo Sapiens
VARVQPKFL

SEQ ID NO: 514762 - protein, 9 aa, Homo Sapiens
FIKNWKLIV

SEQ ID NO: 514763 - protein, 9 aa, Homo Sapiens
LKNLASIGE

SEQ ID NO: 514764 - protein, 9 aa, Homo Sapiens
LVKFDFSSN

SEQ ID NO: 514765 - protein, 9 aa, Homo Sapiens
ATEQDEGIN

SEQ ID NO: 514766 - protein, 9 aa, Homo Sapiens
QTPLADLLP

SEQ ID NO: 514767 - protein, 9 aa, Homo Sapiens
FKLVGVKGP

SEQ ID NO: 514768 - protein, 9 aa, Homo Sapiens
KQKENEDKE

SEQ ID NO: 514769 - protein, 9 aa, Homo Sapiens
LNVALKKFM

SEQ ID NO: 514770 - protein, 9 aa, Homo Sapiens
GLISALVWT

SEQ ID NO: 514771 - protein, 9 aa, Homo Sapiens
LSIDFVENK

SEQ ID NO: 514772 - protein, 9 aa, Homo Sapiens
RKVARVQPK

SEQ ID NO: 514773 - protein, 9 aa, Homo Sapiens
LREVFRFAY

SEQ ID NO: 514774 - protein, 9 aa, Homo Sapiens
GGEPKGKLL

SEQ ID NO: 514775 - protein, 9 aa, Homo Sapiens
QRVPRNCDP

SEQ ID NO: 514776 - protein, 9 aa, Homo Sapiens
SSSARHSQP

SEQ ID NO: 514777 - protein, 9 aa, Homo Sapiens
AVVYVTYHN

SEQ ID NO: 514778 - protein, 9 aa, Homo Sapiens
FPTAKRRIR

SEQ ID NO: 514779 - protein, 9 aa, Homo Sapiens
VGRPQGFEV

SEQ ID NO: 514780 - protein, 9 aa, Homo Sapiens
ELKIKETWT

SEQ ID NO: 514781 - protein, 9 aa, Homo Sapiens
RHEAKGMDT

SEQ ID NO: 514782 - protein, 9 aa, Homo Sapiens
SFRSKKEVY

SEQ ID NO: 514783 - protein, 9 aa, Homo Sapiens
SLRNNDLNV

SEQ ID NO: 514784 - protein, 9 aa, Homo Sapiens
VPPLEGFVV

SEQ ID NO: 514785 - protein, 9 aa, Homo Sapiens
SRKRKCHTF

SEQ ID NO: 514786 - protein, 9 aa, Homo Sapiens
GSPLPTSAL

SEQ ID NO: 514787 - protein, 9 aa, Homo Sapiens
FLEGSMGLR

SEQ ID NO: 514788 - protein, 9 aa, Homo Sapiens
KLIVSFIFN

SEQ ID NO: 514789 - protein, 9 aa, Homo Sapiens
LVVVGAGRV

SEQ ID NO: 514790 - protein, 9 aa, Homo Sapiens
EESAAEEPT

SEQ ID NO: 514791 - protein, 9 aa, Homo Sapiens
KDWQPLISP

SEQ ID NO: 514792 - protein, 9 aa, Homo Sapiens
VFKPGNTQK

SEQ ID NO: 514793 - protein, 9 aa, Homo Sapiens
VVYVTYHNK

SEQ ID NO: 514794 - protein, 9 aa, Homo Sapiens
ERVELATAF

SEQ ID NO: 514795 - protein, 9 aa, Homo Sapiens
EVPELSAPE

SEQ ID NO: 514796 - protein, 9 aa, Homo Sapiens
QDIQTGAFS

SEQ ID NO: 514797 - protein, 9 aa, Homo Sapiens
PPVPPPVKP

SEQ ID NO: 514798 - protein, 9 aa, Homo Sapiens
QKENEDKEK

SEQ ID NO: 514799 - protein, 9 aa, Homo Sapiens
SLSTHSLEH

SEQ ID NO: 514800 - protein, 9 aa, Homo Sapiens
GCHAKIGTV

SEQ ID NO: 514801 - protein, 9 aa, Homo Sapiens
LADLLPVSR

SEQ ID NO: 514802 - protein, 9 aa, Homo Sapiens
KWKVFSTCG

SEQ ID NO: 514803 - protein, 9 aa, Homo Sapiens
TGAFSGLKI

SEQ ID NO: 514804 - protein, 9 aa, Homo Sapiens
ARLHEHGAA

SEQ ID NO: 514805 - protein, 9 aa, Homo Sapiens
EASLTKRLL

SEQ ID NO: 514806 - protein, 9 aa, Homo Sapiens
FLSLQPVLQ

SEQ ID NO: 514807 - protein, 9 aa, Homo Sapiens
QGKWKVFST

SEQ ID NO: 514808 - protein, 9 aa, Homo Sapiens
GPGLINGCH

SEQ ID NO: 514809 - protein, 9 aa, Homo Sapiens
DTAERLVEK

SEQ ID NO: 514810 - protein, 9 aa, Homo Sapiens
WVVRPCVRG

SEQ ID NO: 514811 - protein, 9 aa, Homo Sapiens
KSVGIIPAN

SEQ ID NO: 514812 - protein, 9 aa, Homo Sapiens
NGCHAKIGT

SEQ ID NO: 514813 - protein, 9 aa, Homo Sapiens
LSRVKEKFL

SEQ ID NO: 514814 - protein, 9 aa, Homo Sapiens
GEQLRERPS

SEQ ID NO: 514815 - protein, 9 aa, Homo Sapiens
SSARHSQPV

SEQ ID NO: 514816 - protein, 9 aa, Homo Sapiens
DRGVSPPPL

SEQ ID NO: 514817 - protein, 9 aa, Homo Sapiens
SSTQGKWKV

SEQ ID NO: 514818 - protein, 9 aa, Homo Sapiens
VEKLRDARL

SEQ ID NO: 514819 - protein, 9 aa, Homo Sapiens
VLIDSTHIL

SEQ ID NO: 514820 - protein, 9 aa, Homo Sapiens
PAASSSARH

SEQ ID NO: 514821 - protein, 9 aa, Homo Sapiens
CLLVLGAIC

SEQ ID NO: 514822 - protein, 9 aa, Homo Sapiens
PKPKLSRVK

SEQ ID NO: 514823 - protein, 9 aa, Homo Sapiens
KEGPTFRRD

SEQ ID NO: 514824 - protein, 9 aa, Homo Sapiens
LQRVPRNCD

SEQ ID NO: 514825 - protein, 9 aa, Homo Sapiens
LHEHGAAEM

SEQ ID NO: 514826 - protein, 9 aa, Homo Sapiens
WQILKGLLF

SEQ ID NO: 514827 - protein, 9 aa, Homo Sapiens
IQYVQRPLV

SEQ ID NO: 514828 - protein, 9 aa, Homo Sapiens
FSGLKILKR

SEQ ID NO: 514829 - protein, 9 aa, Homo Sapiens
TPDTAERLV

SEQ ID NO: 514830 - protein, 9 aa, Homo Sapiens
SCFKRHEAK

SEQ ID NO: 514831 - protein, 9 aa, Homo Sapiens
PYVCSECRK

SEQ ID NO: 514832 - protein, 9 aa, Homo Sapiens
AFSLSETQV

SEQ ID NO: 514833 - protein, 9 aa, Homo Sapiens
REQERQRLS

SEQ ID NO: 514834 - protein, 9 aa, Homo Sapiens
KTRALEGTV

SEQ ID NO: 514835 - protein, 9 aa, Homo Sapiens
RNNDLNVAL

SEQ ID NO: 514836 - protein, 9 aa, Homo Sapiens
WTVSAFTLS

SEQ ID NO: 514837 - protein, 9 aa, Homo Sapiens
LPCQVSRGS

SEQ ID NO: 514838 - protein, 9 aa, Homo Sapiens
EVSIPSPKP

SEQ ID NO: 514839 - protein, 9 aa, Homo Sapiens
TRSLNQIPD

SEQ ID NO: 514840 - protein, 9 aa, Homo Sapiens
SWPVNKRYP

SEQ ID NO: 514841 - protein, 9 aa, Homo Sapiens
KRRIRRQDI

SEQ ID NO: 514842 - protein, 9 aa, Homo Sapiens
GSASCRTIS

SEQ ID NO: 514843 - protein, 9 aa, Homo Sapiens
WPVNKRYPA

SEQ ID NO: 514844 - protein, 9 aa, Homo Sapiens
VLRVLFSGS

SEQ ID NO: 514845 - protein, 9 aa, Homo Sapiens
MLQENHQRA

SEQ ID NO: 514846 - protein, 9 aa, Homo Sapiens
GLSKDFSEN

SEQ ID NO: 514847 - protein, 9 aa, Homo Sapiens
IKLPSMPTL

SEQ ID NO: 514848 - protein, 9 aa, Homo Sapiens
FSLSETQVK

SEQ ID NO: 514849 - protein, 9 aa, Homo Sapiens
QTWANKCTL

SEQ ID NO: 514850 - protein, 9 aa, Homo Sapiens
GERRGLFEV

SEQ ID NO: 514851 - protein, 9 aa, Homo Sapiens
VKDPKKALQ

SEQ ID NO: 514852 - protein, 9 aa, Homo Sapiens
MFLSLQPVL

SEQ ID NO: 514853 - protein, 9 aa, Homo Sapiens
GAASGVRLY

SEQ ID NO: 514854 - protein, 9 aa, Homo Sapiens
QLLAAFIKL

SEQ ID NO: 514855 - protein, 9 aa, Homo Sapiens
QARLHEHGA

SEQ ID NO: 514856 - protein, 9 aa, Homo Sapiens
QYVQRPLVR

SEQ ID NO: 514857 - protein, 9 aa, Homo Sapiens
YSHLPCQVS

SEQ ID NO: 514858 - protein, 9 aa, Homo Sapiens
TALVFYYVT

SEQ ID NO: 514859 - protein, 9 aa, Homo Sapiens
VMLCGNAGG

SEQ ID NO: 514860 - protein, 9 aa, Homo Sapiens
LPSGSTVHV

SEQ ID NO: 514861 - protein, 9 aa, Homo Sapiens
QKRETLRRA

SEQ ID NO: 514862 - protein, 9 aa, Homo Sapiens
AQTWANKCT

SEQ ID NO: 514863 - protein, 9 aa, Homo Sapiens
KLPSMPTLI

SEQ ID NO: 514864 - protein, 9 aa, Homo Sapiens
VENFMKILK

SEQ ID NO: 514865 - protein, 9 aa, Homo Sapiens
REVFRFAYY

SEQ ID NO: 514866 - protein, 9 aa, Homo Sapiens
LHFMLGIPL

SEQ ID NO: 514867 - protein, 9 aa, Homo Sapiens
PPGSRSNPL

SEQ ID NO: 514868 - protein, 9 aa, Homo Sapiens
AIGGGGWPG

SEQ ID NO: 514869 - protein, 9 aa, Homo Sapiens
AKSVGIIPA

SEQ ID NO: 514870 - protein, 9 aa, Homo Sapiens
FTSHWPFSV

SEQ ID NO: 514871 - protein, 9 aa, Homo Sapiens
ENHQRASIF

SEQ ID NO: 514872 - protein, 9 aa, Homo Sapiens
LNGSYSDYV

SEQ ID NO: 514873 - protein, 9 aa, Homo Sapiens
SFLEGSMGL

SEQ ID NO: 514874 - protein, 9 aa, Homo Sapiens
KLELKIKET

SEQ ID NO: 514875 - protein, 9 aa, Homo Sapiens
WDPVLRVLF

SEQ ID NO: 514876 - protein, 9 aa, Homo Sapiens
FRAYQFRFL

SEQ ID NO: 514877 - protein, 9 aa, Homo Sapiens
ENQMVYTVR

SEQ ID NO: 514878 - protein, 9 aa, Homo Sapiens
SKAEINGQN

SEQ ID NO: 514879 - protein, 9 aa, Homo Sapiens
VGIIPANSE

SEQ ID NO: 514880 - protein, 9 aa, Homo Sapiens
DEKKKELQE

SEQ ID NO: 514881 - protein, 9 aa, Homo Sapiens
CHTFCYSCG

SEQ ID NO: 514882 - protein, 9 aa, Homo Sapiens
GTSQKWAAV

SEQ ID NO: 514883 - protein, 9 aa, Homo Sapiens
MPTLIHNPS

SEQ ID NO: 514884 - protein, 9 aa, Homo Sapiens
CLEEGPPHT

SEQ ID NO: 514885 - protein, 9 aa, Homo Sapiens
EDTSYDYSD

SEQ ID NO: 514886 - protein, 9 aa, Homo Sapiens
ARKGKKPCA

SEQ ID NO: 514887 - protein, 9 aa, Homo Sapiens
CKTQPLQQT

SEQ ID NO: 514888 - protein, 9 aa, Homo Sapiens
ICLYFSMYS

SEQ ID NO: 514889 - protein, 9 aa, Homo Sapiens
ARHSQPVPQ

SEQ ID NO: 514890 - protein, 9 aa, Homo Sapiens
LISPAGTEP

SEQ ID NO: 514891 - protein, 9 aa, Homo Sapiens
EKKETQIFF

SEQ ID NO: 514892 - protein, 9 aa, Homo Sapiens
EATEESAAE

SEQ ID NO: 514893 - protein, 9 aa, Homo Sapiens
CQPYRSACY

SEQ ID NO: 514894 - protein, 9 aa, Homo Sapiens
TGVVHIYVE

SEQ ID NO: 514895 - protein, 9 aa, Homo Sapiens
LDGTHQQLG

SEQ ID NO: 514896 - protein, 9 aa, Homo Sapiens
LGFLSLTYT

SEQ ID NO: 514897 - protein, 9 aa, Homo Sapiens
LLSARHEQK

SEQ ID NO: 514898 - protein, 9 aa, Homo Sapiens
GQTARSGPS

SEQ ID NO: 514899 - protein, 9 aa, Homo Sapiens
QDILRMFLS

SEQ ID NO: 514900 - protein, 9 aa, Homo Sapiens
PSLGSLACP

SEQ ID NO: 514901 - protein, 9 aa, Homo Sapiens
LNKVASVLS

SEQ ID NO: 514902 - protein, 9 aa, Homo Sapiens
VVNRVQGDY

SEQ ID NO: 514903 - protein, 9 aa, Homo Sapiens
AKRRIRRQD

SEQ ID NO: 514904 - protein, 9 aa, Homo Sapiens
ALDWVVRPC

SEQ ID NO: 514905 - protein, 9 aa, Homo Sapiens
SPALNIGSV

SEQ ID NO: 514906 - protein, 9 aa, Homo Sapiens
VFVLLFTSH

SEQ ID NO: 514907 - protein, 9 aa, Homo Sapiens
SPPPLPFFS

SEQ ID NO: 514908 - protein, 9 aa, Homo Sapiens
WSLGSASCR

SEQ ID NO: 514909 - protein, 9 aa, Homo Sapiens
REDPNSRSS

SEQ ID NO: 514910 - protein, 9 aa, Homo Sapiens
YVKDPKKAL

SEQ ID NO: 514911 - protein, 9 aa, Homo Sapiens
GDGTSQKWA

SEQ ID NO: 514912 - protein, 9 aa, Homo Sapiens
VHVKSVSCS

SEQ ID NO: 514913 - protein, 9 aa, Homo Sapiens
VLLREVFRF

SEQ ID NO: 514914 - protein, 9 aa, Homo Sapiens
RYLDYEALQ

SEQ ID NO: 514915 - protein, 9 aa, Homo Sapiens
RGLFEVPEL

SEQ ID NO: 514916 - protein, 9 aa, Homo Sapiens
FTDEDVKFY

SEQ ID NO: 514917 - protein, 9 aa, Homo Sapiens
GEPKGKLLE

SEQ ID NO: 514918 - protein, 9 aa, Homo Sapiens
IPFPEDDYN

SEQ ID NO: 514919 - protein, 9 aa, Homo Sapiens
ELEIILGQL

SEQ ID NO: 514920 - protein, 9 aa, Homo Sapiens
TTALVFYYV

SEQ ID NO: 514921 - protein, 9 aa, Homo Sapiens
KDGHRDSPL

SEQ ID NO: 514922 - protein, 9 aa, Homo Sapiens
SAAEEPTSE

SEQ ID NO: 514923 - protein, 9 aa, Homo Sapiens
SNPLVKKEP

SEQ ID NO: 514924 - protein, 9 aa, Homo Sapiens
KENEDKEKE

SEQ ID NO: 514925 - protein, 9 aa, Homo Sapiens
QRASIFFDY

SEQ ID NO: 514926 - protein, 9 aa, Homo Sapiens
LCWDPVLRV

SEQ ID NO: 514927 - protein, 9 aa, Homo Sapiens
RMFLSLQPV

SEQ ID NO: 514928 - protein, 9 aa, Homo Sapiens
TGLLSARHE

SEQ ID NO: 514929 - protein, 9 aa, Homo Sapiens
NKVASVLSC

SEQ ID NO: 514930 - protein, 9 aa, Homo Sapiens
LTKRLLFKD

SEQ ID NO: 514931 - protein, 9 aa, Homo Sapiens
MQETLKNLA

SEQ ID NO: 514932 - protein, 9 aa, Homo Sapiens
VQRPLVRVG

SEQ ID NO: 514933 - protein, 9 aa, Homo Sapiens
NTQKEIRVG

SEQ ID NO: 514934 - protein, 9 aa, Homo Sapiens
AYQFRFLQT

SEQ ID NO: 514935 - protein, 9 aa, Homo Sapiens
PTAKRRIRR

SEQ ID NO: 514936 - protein, 9 aa, Homo Sapiens
SVGIIPANS

SEQ ID NO: 514937 - protein, 9 aa, Homo Sapiens
RHSQPVPQL

SEQ ID NO: 514938 - protein, 9 aa, Homo Sapiens
TKARKGKKP

SEQ ID NO: 514939 - protein, 9 aa, Homo Sapiens
NMGIGKETA

SEQ ID NO: 514940 - protein, 9 aa, Homo Sapiens
DYNTANHNL

SEQ ID NO: 514941 - protein, 9 aa, Homo Sapiens
DWVVRPCVR

SEQ ID NO: 514942 - protein, 9 aa, Homo Sapiens
KHPRVAVTT

SEQ ID NO: 514943 - protein, 9 aa, Homo Sapiens
LLNKVASVL

SEQ ID NO: 514944 - protein, 9 aa, Homo Sapiens
NPSLGSLAC

SEQ ID NO: 514945 - protein, 9 aa, Homo Sapiens
HCFLYPDTD

SEQ ID NO: 514946 - protein, 9 aa, Homo Sapiens
SLGSLACPR

SEQ ID NO: 514947 - protein, 9 aa, Homo Sapiens
QENHQRASI

SEQ ID NO: 514948 - protein, 9 aa, Homo Sapiens
QSKLLNKVA

SEQ ID NO: 514949 - protein, 9 aa, Homo Sapiens
VKATEQDEG

SEQ ID NO: 514950 - protein, 9 aa, Homo Sapiens
ISMTTCSTL

SEQ ID NO: 514951 - protein, 9 aa, Homo Sapiens
SKFIKNWKL

SEQ ID NO: 514952 - protein, 9 aa, Homo Sapiens
ACYILEQQR

SEQ ID NO: 514953 - protein, 9 aa, Homo Sapiens
VHIYVELKR

SEQ ID NO: 514954 - protein, 9 aa, Homo Sapiens
QVDSWPVNK

SEQ ID NO: 514955 - protein, 9 aa, Homo Sapiens
GSRSNPLVK

SEQ ID NO: 514956 - protein, 9 aa, Homo Sapiens
EINGQNNVL

SEQ ID NO: 514957 - protein, 9 aa, Homo Sapiens
CFKRHEAKG

SEQ ID NO: 514958 - protein, 9 aa, Homo Sapiens
ARPDSMFEN

SEQ ID NO: 514959 - protein, 9 aa, Homo Sapiens
ETQIFFQPS

SEQ ID NO: 514960 - protein, 9 aa, Homo Sapiens
KGKLLEAIK

SEQ ID NO: 514961 - protein, 9 aa, Homo Sapiens
EQLRERPSV

SEQ ID NO: 514962 - protein, 9 aa, Homo Sapiens
PVPPPVKPP

SEQ ID NO: 514963 - protein, 9 aa, Homo Sapiens
VKPPWMAFK

SEQ ID NO: 514964 - protein, 9 aa, Homo Sapiens
KLLNKVASV

SEQ ID NO: 514965 - protein, 9 aa, Homo Sapiens
RPAGDGTSQ

SEQ ID NO: 514966 - protein, 9 aa, Homo Sapiens
EAPYSREQE

SEQ ID NO: 514967 - protein, 9 aa, Homo Sapiens
TVHVKSVSC

SEQ ID NO: 514968 - protein, 9 aa, Homo Sapiens
RGSQGYSHL

SEQ ID NO: 514969 - protein, 9 aa, Homo Sapiens
PTSALVSTN

SEQ ID NO: 514970 - protein, 9 aa, Homo Sapiens
AGLISALVW

SEQ ID NO: 514971 - protein, 9 aa, Homo Sapiens
ANVSSFLEG

SEQ ID NO: 514972 - protein, 9 aa, Homo Sapiens
DLLPVSRCS

SEQ ID NO: 514973 - protein, 9 aa, Homo Sapiens
HVRRESLPC

SEQ ID NO: 514974 - protein, 9 aa, Homo Sapiens
TSTTALVFY

SEQ ID NO: 514975 - protein, 9 aa, Homo Sapiens
ESVGRPQGF

SEQ ID NO: 514976 - protein, 9 aa, Homo Sapiens
GHRDSPLFF

SEQ ID NO: 514977 - protein, 9 aa, Homo Sapiens
GLSIDFVEN

SEQ ID NO: 514978 - protein, 9 aa, Homo Sapiens
EVFRCFICV

SEQ ID NO: 514979 - protein, 9 aa, Homo Sapiens
IMIDDHIVP

SEQ ID NO: 514980 - protein, 9 aa, Homo Sapiens
VPPPVKPPP

SEQ ID NO: 514981 - protein, 9 aa, Homo Sapiens
EVTTNAQTW

SEQ ID NO: 514982 - protein, 9 aa, Homo Sapiens
EGTVSVAKT

SEQ ID NO: 514983 - protein, 9 aa, Homo Sapiens
ASGVRLYIS

SEQ ID NO: 514984 - protein, 9 aa, Homo Sapiens
TLIHNPSLG

SEQ ID NO: 514985 - protein, 9 aa, Homo Sapiens
FWVSEDKDI

SEQ ID NO: 514986 - protein, 9 aa, Homo Sapiens
SLANVSSFL

SEQ ID NO: 514987 - protein, 9 aa, Homo Sapiens
ATAERSSGI

SEQ ID NO: 514988 - protein, 9 aa, Homo Sapiens
AGDGTSQKW

SEQ ID NO: 514989 - protein, 9 aa, Homo Sapiens
VRVGVFLDY

SEQ ID NO: 514990 - protein, 9 aa, Homo Sapiens
SQGYSHLPC

SEQ ID NO: 514991 - protein, 9 aa, Homo Sapiens
WKHIKESVG

SEQ ID NO: 514992 - protein, 9 aa, Homo Sapiens
VTYHNKRKI

SEQ ID NO: 514993 - protein, 9 aa, Homo Sapiens
AFCIAVVYV

SEQ ID NO: 514994 - protein, 9 aa, Homo Sapiens
PFPEDDYNT

SEQ ID NO: 514995 - protein, 9 aa, Homo Sapiens
VVGAGRVGK

SEQ ID NO: 514996 - protein, 9 aa, Homo Sapiens
TVYPIMLFL

SEQ ID NO: 514997 - protein, 9 aa, Homo Sapiens
IRRQDIRNG

SEQ ID NO: 514998 - protein, 9 aa, Homo Sapiens
KRYPAGNFD

SEQ ID NO: 514999 - protein, 9 aa, Homo Sapiens
MIDDHIVPT

SEQ ID NO: 515000 - protein, 9 aa, Homo Sapiens
EDKEKENED

SEQ ID NO: 515001 - protein, 9 aa, Homo Sapiens
HILQKRRND

SEQ ID NO: 515002 - protein, 9 aa, Homo Sapiens
KTQPLQQTV

SEQ ID NO: 515003 - protein, 9 aa, Homo Sapiens
LRMELEIIL

SEQ ID NO: 515004 - protein, 9 aa, Homo Sapiens
EEATEESAA

SEQ ID NO: 515005 - protein, 9 aa, Homo Sapiens
LLDGTHQQL

SEQ ID NO: 515006 - protein, 9 aa, Homo Sapiens
LEVMLCGNA

SEQ ID NO: 515007 - protein, 9 aa, Homo Sapiens
IHNPSLGSL

SEQ ID NO: 515008 - protein, 9 aa, Homo Sapiens
SQVYPKYFM

SEQ ID NO: 515009 - protein, 9 aa, Homo Sapiens
GGGEPKGKL

SEQ ID NO: 515010 - protein, 9 aa, Homo Sapiens
IILGQLSVL

SEQ ID NO: 515011 - protein, 9 aa, Homo Sapiens
LLSADFTGT

SEQ ID NO: 515012 - protein, 9 aa, Homo Sapiens
AERSSGIAP

SEQ ID NO: 515013 - protein, 9 aa, Homo Sapiens
YSREQERQR

SEQ ID NO: 515014 - protein, 9 aa, Homo Sapiens
HQQLGFLSL

SEQ ID NO: 515015 - protein, 9 aa, Homo Sapiens
HNPSLGSLA

SEQ ID NO: 515016 - protein, 9 aa, Homo Sapiens
TKTRALEGT

SEQ ID NO: 515017 - protein, 9 aa, Homo Sapiens
RNLKPQPWP

SEQ ID NO: 515018 - protein, 9 aa, Homo Sapiens
TRALEGTVS

SEQ ID NO: 515019 - protein, 9 aa, Homo Sapiens
PEDDYNTAN

SEQ ID NO: 515020 - protein, 9 aa, Homo Sapiens
QIPLQINYG

SEQ ID NO: 515021 - protein, 9 aa, Homo Sapiens
TWANKCTLQ

SEQ ID NO: 515022 - protein, 9 aa, Homo Sapiens
ERPSVAYNG

SEQ ID NO: 515023 - protein, 9 aa, Homo Sapiens
RSGPSESLT

SEQ ID NO: 515024 - protein, 9 aa, Homo Sapiens
RPDSMFENQ

SEQ ID NO: 515025 - protein, 9 aa, Homo Sapiens
IVSKAEING

SEQ ID NO: 515026 - protein, 9 aa, Homo Sapiens
PLTAASSPS

SEQ ID NO: 515027 - protein, 9 aa, Homo Sapiens
KPPWMAFKG

SEQ ID NO: 515028 - protein, 9 aa, Homo Sapiens
RAVIPLKHP

SEQ ID NO: 515029 - protein, 9 aa, Homo Sapiens
RVKATEQDE

SEQ ID NO: 515030 - protein, 9 aa, Homo Sapiens
SNKVLVIPI

SEQ ID NO: 515031 - protein, 9 aa, Homo Sapiens
YVQRPLVRV

SEQ ID NO: 515032 - protein, 9 aa, Homo Sapiens
ERLETMRWN

SEQ ID NO: 515033 - protein, 9 aa, Homo Sapiens
GTVSVAKTQ

SEQ ID NO: 515034 - protein, 9 aa, Homo Sapiens
PGWRWRRGH

SEQ ID NO: 515035 - protein, 9 aa, Homo Sapiens
CVRNPVENF

SEQ ID NO: 515036 - protein, 9 aa, Homo Sapiens
DYSDILNST

SEQ ID NO: 515037 - protein, 9 aa, Homo Sapiens
PWMAFKGEQ

SEQ ID NO: 515038 - protein, 9 aa, Homo Sapiens
KATEQDEGI

SEQ ID NO: 515039 - protein, 9 aa, Homo Sapiens
NQIPDTATS

SEQ ID NO: 515040 - protein, 9 aa, Homo Sapiens
EEGNGEGQE

SEQ ID NO: 515041 - protein, 9 aa, Homo Sapiens
IDFVENKLY

SEQ ID NO: 515042 - protein, 9 aa, Homo Sapiens
IKNWKLIVS

SEQ ID NO: 515043 - protein, 9 aa, Homo Sapiens
EDPNSRSSF

SEQ ID NO: 515044 - protein, 9 aa, Homo Sapiens
VIQTPLADL

SEQ ID NO: 515045 - protein, 9 aa, Homo Sapiens
TAFSLSETQ

SEQ ID NO: 515046 - protein, 9 aa, Homo Sapiens
NKRYPAGNF

SEQ ID NO: 515047 - protein, 9 aa, Homo Sapiens
PLPTSALVS

SEQ ID NO: 515048 - protein, 9 aa, Homo Sapiens
STVHVKSVS

SEQ ID NO: 515049 - protein, 9 aa, Homo Sapiens
LRNNDLNVA

SEQ ID NO: 515050 - protein, 9 aa, Homo Sapiens
HHGPPLTAA

SEQ ID NO: 515051 - protein, 9 aa, Homo Sapiens
MFENQMVYT

SEQ ID NO: 515052 - protein, 9 aa, Homo Sapiens
TAIGGGGWP

SEQ ID NO: 515053 - protein, 9 aa, Homo Sapiens
NEDKEKENE

SEQ ID NO: 515054 - protein, 9 aa, Homo Sapiens
WKTYHVKDL

SEQ ID NO: 515055 - protein, 9 aa, Homo Sapiens
SLLSTEPSQ

SEQ ID NO: 515056 - protein, 9 aa, Homo Sapiens
DKDGHRDSP

SEQ ID NO: 515057 - protein, 9 aa, Homo Sapiens
FEVPELSAP

SEQ ID NO: 515058 - protein, 9 aa, Homo Sapiens
WCWQILKGL

SEQ ID NO: 515059 - protein, 9 aa, Homo Sapiens
HGLLIDRGL

SEQ ID NO: 515060 - protein, 9 aa, Homo Sapiens
IAPAASPAA

SEQ ID NO: 515061 - protein, 9 aa, Homo Sapiens
VERLETMRW

SEQ ID NO: 515062 - protein, 9 aa, Homo Sapiens
HTSTTALVF

SEQ ID NO: 515063 - protein, 9 aa, Homo Sapiens
SALVWTVSA

SEQ ID NO: 515064 - protein, 9 aa, Homo Sapiens
DMEKKETQI

SEQ ID NO: 515065 - protein, 9 aa, Homo Sapiens
RVELATAFS

SEQ ID NO: 515066 - protein, 9 aa, Homo Sapiens
NGQNNVLVE

SEQ ID NO: 515067 - protein, 9 aa, Homo Sapiens
DGTSQKWAA

SEQ ID NO: 515068 - protein, 9 aa, Homo Sapiens
CFRLYTESD

SEQ ID NO: 515069 - protein, 9 aa, Homo Sapiens
DFTGTIKVF

SEQ ID NO: 515070 - protein, 9 aa, Homo Sapiens
VGVKGPNDR

SEQ ID NO: 515071 - protein, 9 aa, Homo Sapiens
MAFKGEQSK

SEQ ID NO: 515072 - protein, 9 aa, Homo Sapiens
VVVITGANM

SEQ ID NO: 515073 - protein, 9 aa, Homo Sapiens
PSRKEGPTF

SEQ ID NO: 515074 - protein, 9 aa, Homo Sapiens
KEDFRAYQF

SEQ ID NO: 515075 - protein, 9 aa, Homo Sapiens
HVKSVSCSD

SEQ ID NO: 515076 - protein, 9 aa, Homo Sapiens
TAERSSGIA

SEQ ID NO: 515077 - protein, 9 aa, Homo Sapiens
SSFLEGSMG

SEQ ID NO: 515078 - protein, 9 aa, Homo Sapiens
VSFIFNLLC

SEQ ID NO: 515079 - protein, 9 aa, Homo Sapiens
PPPGSRSNP

SEQ ID NO: 515080 - protein, 9 aa, Homo Sapiens
WEVLIDSTH

SEQ ID NO: 515081 - protein, 9 aa, Homo Sapiens
PSGSTVHVK

SEQ ID NO: 515082 - protein, 9 aa, Homo Sapiens
LQIPLQINY

SEQ ID NO: 515083 - protein, 9 aa, Homo Sapiens
SSGHHGPPL

SEQ ID NO: 515084 - protein, 9 aa, Homo Sapiens
AAFIKLPSM

SEQ ID NO: 515085 - protein, 9 aa, Homo Sapiens
HWKTYHVKD

SEQ ID NO: 515086 - protein, 9 aa, Homo Sapiens
WCKTQPLQQ

SEQ ID NO: 515087 - protein, 9 aa, Homo Sapiens
DKEDFRAYQ

SEQ ID NO: 515088 - protein, 9 aa, Homo Sapiens
KKLKKDEKK

SEQ ID NO: 515089 - protein, 9 aa, Homo Sapiens
LVGVKGPND

SEQ ID NO: 515090 - protein, 9 aa, Homo Sapiens
KRLLFKDRH

SEQ ID NO: 515091 - protein, 9 aa, Homo Sapiens
RASIFFDYA

SEQ ID NO: 515092 - protein, 9 aa, Homo Sapiens
GSQGYSHLP

SEQ ID NO: 515093 - protein, 9 aa, Homo Sapiens
RVPRNCDPA

SEQ ID NO: 515094 - protein, 9 aa, Homo Sapiens
MELEIILGQ

SEQ ID NO: 515095 - protein, 9 aa, Homo Sapiens
NIVSKAEIN

SEQ ID NO: 515096 - protein, 9 aa, Homo Sapiens
REVTTNAQT

SEQ ID NO: 515097 - protein, 9 aa, Homo Sapiens
DGHRDSPLF

SEQ ID NO: 515098 - protein, 9 aa, Homo Sapiens
PPSRKEGPT

SEQ ID NO: 515099 - protein, 9 aa, Homo Sapiens
KEKENEDKG

SEQ ID NO: 515100 - protein, 9 aa, Homo Sapiens
ILAEAKRAD

SEQ ID NO: 515101 - protein, 9 aa, Homo Sapiens
RENNSPALN

SEQ ID NO: 515102 - protein, 9 aa, Homo Sapiens
TLQKRETLR

SEQ ID NO: 515103 - protein, 9 aa, Homo Sapiens
GLLIDRGLS

SEQ ID NO: 515104 - protein, 9 aa, Homo Sapiens
EVMFTDEDV

SEQ ID NO: 515105 - protein, 9 aa, Homo Sapiens
RVLQIPLQI

SEQ ID NO: 515106 - protein, 9 aa, Homo Sapiens
PSVAYNGPP

SEQ ID NO: 515107 - protein, 9 aa, Homo Sapiens
VTTNAQTWA

SEQ ID NO: 515108 - protein, 9 aa, Homo Sapiens
KFDFSSNKV

SEQ ID NO: 515109 - protein, 9 aa, Homo Sapiens
VYPKYFMKL

SEQ ID NO: 515110 - protein, 9 aa, Homo Sapiens
PPWMAFKGE

SEQ ID NO: 515111 - protein, 9 aa, Homo Sapiens
LEHPYLHQN

SEQ ID NO: 515112 - protein, 9 aa, Homo Sapiens
SGVRLYISG

SEQ ID NO: 515113 - protein, 9 aa, Homo Sapiens
CIAVVYVTY

SEQ ID NO: 515114 - protein, 9 aa, Homo Sapiens
NSPALNIGS

SEQ ID NO: 515115 - protein, 9 aa, Homo Sapiens
VWTVSAFTL

SEQ ID NO: 515116 - protein, 9 aa, Homo Sapiens
KVLRSWCWQ

SEQ ID NO: 515117 - protein, 9 aa, Homo Sapiens
PKDWQPLIS

SEQ ID NO: 515118 - protein, 9 aa, Homo Sapiens
SLACPRGSQ

SEQ ID NO: 515119 - protein, 9 aa, Homo Sapiens
RHEQKDAWV

SEQ ID NO: 515120 - protein, 9 aa, Homo Sapiens
SLVKFDFSS

SEQ ID NO: 515121 - protein, 9 aa, Homo Sapiens
CPRGSQGYS

SEQ ID NO: 515122 - protein, 9 aa, Homo Sapiens
VCFRLYTES

SEQ ID NO: 515123 - protein, 9 aa, Homo Sapiens
AERLVEKTP

SEQ ID NO: 515124 - protein, 9 aa, Homo Sapiens
QTARSGPSE

SEQ ID NO: 515125 - protein, 9 aa, Homo Sapiens
FTGTIKVFV

SEQ ID NO: 515126 - protein, 9 aa, Homo Sapiens
ENNSPALNI

SEQ ID NO: 515127 - protein, 9 aa, Homo Sapiens
NDLNVALKK

SEQ ID NO: 515128 - protein, 9 aa, Homo Sapiens
KGARSIIMQ

SEQ ID NO: 515129 - protein, 9 aa, Homo Sapiens
ARSGPSESL

SEQ ID NO: 515130 - protein, 9 aa, Homo Sapiens
WKVFSTCGS

SEQ ID NO: 515131 - protein, 9 aa, Homo Sapiens
LIDSTHILT

SEQ ID NO: 515132 - protein, 9 aa, Homo Sapiens
MSEKGARSI

SEQ ID NO: 515133 - protein, 9 aa, Homo Sapiens
IIAFWVSED

SEQ ID NO: 515134 - protein, 9 aa, Homo Sapiens
EEEEGNGEG

SEQ ID NO: 515135 - protein, 9 aa, Homo Sapiens
ILQKRRNDV

SEQ ID NO: 515136 - protein, 9 aa, Homo Sapiens
SRTLQKRET

SEQ ID NO: 515137 - protein, 9 aa, Homo Sapiens
FRLYTESDY

SEQ ID NO: 515138 - protein, 9 aa, Homo Sapiens
VRIMIDDHI

SEQ ID NO: 515139 - protein, 9 aa, Homo Sapiens
FENQMVYTV

SEQ ID NO: 515140 - protein, 9 aa, Homo Sapiens
RLYTESDYD

SEQ ID NO: 515141 - protein, 9 aa, Homo Sapiens
MRWNVMGNG

SEQ ID NO: 515142 - protein, 9 aa, Homo Sapiens
DILRMFLSL

SEQ ID NO: 515143 - protein, 9 aa, Homo Sapiens
HPGREGPPV

SEQ ID NO: 515144 - protein, 9 aa, Homo Sapiens
KVASVLSCI

SEQ ID NO: 515145 - protein, 9 aa, Homo Sapiens
MLHWKTYHV

SEQ ID NO: 515146 - protein, 9 aa, Homo Sapiens
ELATAFSLS

SEQ ID NO: 515147 - protein, 9 aa, Homo Sapiens
PDTAERLVE

SEQ ID NO: 515148 - protein, 9 aa, Homo Sapiens
KEVMFTDED

SEQ ID NO: 515149 - protein, 9 aa, Homo Sapiens
NNSPALNIG

SEQ ID NO: 515150 - protein, 9 aa, Homo Sapiens
SREQERQRL

SEQ ID NO: 515151 - protein, 9 aa, Homo Sapiens
LPPSRKEGP

SEQ ID NO: 515152 - protein, 9 aa, Homo Sapiens
FDFSSNKVL

SEQ ID NO: 515153 - protein, 9 aa, Homo Sapiens
YKYNVFRST

SEQ ID NO: 515154 - protein, 9 aa, Homo Sapiens
FMKILKGIG

SEQ ID NO: 515155 - protein, 9 aa, Homo Sapiens
DVFLNGSYS

SEQ ID NO: 515156 - protein, 9 aa, Homo Sapiens
AFKGEQSKH

SEQ ID NO: 515157 - protein, 9 aa, Homo Sapiens
ALNIGSVSA

SEQ ID NO: 515158 - protein, 9 aa, Homo Sapiens
ISCFKRHEA

SEQ ID NO: 515159 - protein, 9 aa, Homo Sapiens
VFLNGSYSD

SEQ ID NO: 515160 - protein, 9 aa, Homo Sapiens
AEINGQNNV

SEQ ID NO: 515161 - protein, 9 aa, Homo Sapiens
QIPDTATSR

SEQ ID NO: 515162 - protein, 9 aa, Homo Sapiens
SRGSTPIQP

SEQ ID NO: 515163 - protein, 9 aa, Homo Sapiens
KKFPGEVSI

SEQ ID NO: 515164 - protein, 9 aa, Homo Sapiens
FNNSLLSTE

SEQ ID NO: 515165 - protein, 9 aa, Homo Sapiens
FCIAVVYVT

SEQ ID NO: 515166 - protein, 9 aa, Homo Sapiens
GHAGAASGV

SEQ ID NO: 515167 - protein, 9 aa, Homo Sapiens
TARSGPSES

SEQ ID NO: 515168 - protein, 9 aa, Homo Sapiens
LLCLEEGPP

SEQ ID NO: 515169 - protein, 9 aa, Homo Sapiens
GWPGWRWRR

SEQ ID NO: 515170 - protein, 9 aa, Homo Sapiens
VMFTDEDVK

SEQ ID NO: 515171 - protein, 9 aa, Homo Sapiens
AVSVLLREV

SEQ ID NO: 515172 - protein, 9 aa, Homo Sapiens
LYTESDYDA

SEQ ID NO: 515173 - protein, 9 aa, Homo Sapiens
EKKLKKDEK

SEQ ID NO: 515174 - protein, 9 aa, Homo Sapiens
WNVMGNGLS

SEQ ID NO: 515175 - protein, 9 aa, Homo Sapiens
TSQKWAAVV

SEQ ID NO: 515176 - protein, 9 aa, Homo Sapiens
HFKLVGVKG

SEQ ID NO: 515177 - protein, 9 aa, Homo Sapiens
CYLLLHFML

SEQ ID NO: 515178 - protein, 9 aa, Homo Sapiens
TEQDEGINS

SEQ ID NO: 515179 - protein, 9 aa, Homo Sapiens
TIWIHILQK

SEQ ID NO: 515180 - protein, 9 aa, Homo Sapiens
ENFMKILKG

SEQ ID NO: 515181 - protein, 9 aa, Homo Sapiens
SMPTLIHNP

SEQ ID NO: 515182 - protein, 9 aa, Homo Sapiens
YLDYEALQE

SEQ ID NO: 515183 - protein, 9 aa, Homo Sapiens
TAKRRIRRQ

SEQ ID NO: 515184 - protein, 9 aa, Homo Sapiens
LKKDEKKKE

SEQ ID NO: 515185 - protein, 9 aa, Homo Sapiens
ILRMFLSLQ

SEQ ID NO: 515186 - protein, 9 aa, Homo Sapiens
QILAEAKRA

SEQ ID NO: 515187 - protein, 9 aa, Homo Sapiens
ANMGIGKET

SEQ ID NO: 515188 - protein, 9 aa, Homo Sapiens
LIDRGLSKD

SEQ ID NO: 515189 - protein, 9 aa, Homo Sapiens
KYNVFRSTF

SEQ ID NO: 515190 - protein, 9 aa, Homo Sapiens
MEKKETQIF

SEQ ID NO: 515191 - protein, 9 aa, Homo Sapiens
SRHFKLVGV

SEQ ID NO: 515192 - protein, 9 aa, Homo Sapiens
HEAKGMDTP

SEQ ID NO: 515193 - protein, 9 aa, Homo Sapiens
NWKLIVSFI

SEQ ID NO: 515194 - protein, 9 aa, Homo Sapiens
FNLLCQKFL

SEQ ID NO: 515195 - protein, 9 aa, Homo Sapiens
RPLVRVGVF

SEQ ID NO: 515196 - protein, 9 aa, Homo Sapiens
SSGIAPAAS

SEQ ID NO: 515197 - protein, 9 aa, Homo Sapiens
PEDTSYDYS

SEQ ID NO: 515198 - protein, 9 aa, Homo Sapiens
RVQPKFLQT

SEQ ID NO: 515199 - protein, 9 aa, Homo Sapiens
NCDPALHPF

SEQ ID NO: 515200 - protein, 9 aa, Homo Sapiens
ADLLPVSRC

SEQ ID NO: 515201 - protein, 9 aa, Homo Sapiens
PLVRVGVFL

SEQ ID NO: 515202 - protein, 9 aa, Homo Sapiens
LATAFSLSE

SEQ ID NO: 515203 - protein, 9 aa, Homo Sapiens
EAKRADQVG

SEQ ID NO: 515204 - protein, 9 aa, Homo Sapiens
DTSYDYSDI

SEQ ID NO: 515205 - protein, 9 aa, Homo Sapiens
YLPPSRKEG

SEQ ID NO: 515206 - protein, 9 aa, Homo Sapiens
HGAAEMVLQ

SEQ ID NO: 515207 - protein, 9 aa, Homo Sapiens
HAGAASGVR

SEQ ID NO: 515208 - protein, 9 aa, Homo Sapiens
LKHPRVAVT

SEQ ID NO: 515209 - protein, 9 aa, Homo Sapiens
LSTHSLEHP

SEQ ID NO: 515210 - protein, 9 aa, Homo Sapiens
LDWVVRPCV

SEQ ID NO: 515211 - protein, 9 aa, Homo Sapiens
FKPGNTQKE

SEQ ID NO: 515212 - protein, 9 aa, Homo Sapiens
VLPDKDGHR

SEQ ID NO: 515213 - protein, 9 aa, Homo Sapiens
IDRGLSKDF

SEQ ID NO: 515214 - protein, 9 aa, Homo Sapiens
EHGAAEMVL

SEQ ID NO: 515215 - protein, 9 aa, Homo Sapiens
YPKYFMKLV

SEQ ID NO: 515216 - protein, 9 aa, Homo Sapiens
QIFFQPSQG

SEQ ID NO: 515217 - protein, 9 aa, Homo Sapiens
GKWKVFSTC

SEQ ID NO: 515218 - protein, 9 aa, Homo Sapiens
INGQNNVLV

SEQ ID NO: 515219 - protein, 9 aa, Homo Sapiens
DPNSRSSFR

SEQ ID NO: 515220 - protein, 9 aa, Homo Sapiens
DSVYKYNVF

SEQ ID NO: 515221 - protein, 9 aa, Homo Sapiens
ISALVWTVS

SEQ ID NO: 515222 - protein, 9 aa, Homo Sapiens
GSPYQAYDF

SEQ ID NO: 515223 - protein, 9 aa, Homo Sapiens
GARSIIMQI

SEQ ID NO: 515224 - protein, 9 aa, Homo Sapiens
LLHFMLGIP

SEQ ID NO: 515225 - protein, 9 aa, Homo Sapiens
NIGSVSATD

SEQ ID NO: 515226 - protein, 9 aa, Homo Sapiens
GREGPPVPP

SEQ ID NO: 515227 - protein, 9 aa, Homo Sapiens
SGPSESLTA

SEQ ID NO: 515228 - protein, 9 aa, Homo Sapiens
SKLLNKVAS

SEQ ID NO: 515229 - protein, 9 aa, Homo Sapiens
LGAICLYFS

SEQ ID NO: 515230 - protein, 9 aa, Homo Sapiens
LRVHPTLES

SEQ ID NO: 515231 - protein, 9 aa, Homo Sapiens
STTFYSSPK

SEQ ID NO: 515232 - protein, 9 aa, Homo Sapiens
KAVMPPQII

SEQ ID NO: 515233 - protein, 9 aa, Homo Sapiens
GRLLMLSGV

SEQ ID NO: 515234 - protein, 9 aa, Homo Sapiens
AELANTLEP

SEQ ID NO: 515235 - protein, 9 aa, Homo Sapiens
PKSPDTTLS

SEQ ID NO: 515236 - protein, 9 aa, Homo Sapiens
PFTGSALSS

SEQ ID NO: 515237 - protein, 9 aa, Homo Sapiens
VAHRFSRKT

SEQ ID NO: 515238 - protein, 9 aa, Homo Sapiens
HPSEIAESY

SEQ ID NO: 515239 - protein, 9 aa, Homo Sapiens
TSWVHLIVQ

SEQ ID NO: 515240 - protein, 9 aa, Homo Sapiens
TKLFTEKQQ

SEQ ID NO: 515241 - protein, 9 aa, Homo Sapiens
STRGHDPQW

SEQ ID NO: 515242 - protein, 9 aa, Homo Sapiens
TIFTLSLPF

SEQ ID NO: 515243 - protein, 9 aa, Homo Sapiens
SGEEDQDYD

SEQ ID NO: 515244 - protein, 9 aa, Homo Sapiens
SPSPGTGRC

SEQ ID NO: 515245 - protein, 9 aa, Homo Sapiens
SVFVYQGDD

SEQ ID NO: 515246 - protein, 9 aa, Homo Sapiens
TTRAELANT

SEQ ID NO: 515247 - protein, 9 aa, Homo Sapiens
VRPCTLVCI

SEQ ID NO: 515248 - protein, 9 aa, Homo Sapiens
AADLRPRGA

SEQ ID NO: 515249 - protein, 9 aa, Homo Sapiens
TGSALSSAL

SEQ ID NO: 515250 - protein, 9 aa, Homo Sapiens
TNSATERSD

SEQ ID NO: 515251 - protein, 9 aa, Homo Sapiens
YSSPKSPDT

SEQ ID NO: 515252 - protein, 9 aa, Homo Sapiens
STTRAELAN

SEQ ID NO: 515253 - protein, 9 aa, Homo Sapiens
YVRPCTLVC

SEQ ID NO: 515254 - protein, 9 aa, Homo Sapiens
PPAWRELLR

SEQ ID NO: 515255 - protein, 9 aa, Homo Sapiens
EFLPTSQCP

SEQ ID NO: 515256 - protein, 9 aa, Homo Sapiens
SPKAVPLPD

SEQ ID NO: 515257 - protein, 9 aa, Homo Sapiens
SGVCPPAWR

SEQ ID NO: 515258 - protein, 9 aa, Homo Sapiens
KTPPKAVMP

SEQ ID NO: 515259 - protein, 9 aa, Homo Sapiens
EYITAKYVA

SEQ ID NO: 515260 - protein, 9 aa, Homo Sapiens
VMPPQIIQF

SEQ ID NO: 515261 - protein, 9 aa, Homo Sapiens
AVPLPDLPA

SEQ ID NO: 515262 - protein, 9 aa, Homo Sapiens
TLVCICDEC

SEQ ID NO: 515263 - protein, 9 aa, Homo Sapiens
VYSTRLCLS

SEQ ID NO: 515264 - protein, 9 aa, Homo Sapiens
PRILRRGPD

SEQ ID NO: 515265 - protein, 9 aa, Homo Sapiens
GEEGSGEED

SEQ ID NO: 515266 - protein, 9 aa, Homo Sapiens
EKQQMKYFL

SEQ ID NO: 515267 - protein, 9 aa, Homo Sapiens
RSDSTRGHD

SEQ ID NO: 515268 - protein, 9 aa, Homo Sapiens
HELLSPKAV

SEQ ID NO: 515269 - protein, 9 aa, Homo Sapiens
IAESYRFCD

SEQ ID NO: 515270 - protein, 9 aa, Homo Sapiens
DLRPRGARG

SEQ ID NO: 515271 - protein, 9 aa, Homo Sapiens
KALSLARAP

SEQ ID NO: 515272 - protein, 9 aa, Homo Sapiens
HQVKLSAAE

SEQ ID NO: 515273 - protein, 9 aa, Homo Sapiens
VPGPVPCDA

SEQ ID NO: 515274 - protein, 9 aa, Homo Sapiens
VKLSAAEEM

SEQ ID NO: 515275 - protein, 9 aa, Homo Sapiens
LVCICDECN

SEQ ID NO: 515276 - protein, 9 aa, Homo Sapiens
AQPSTSGKR

SEQ ID NO: 515277 - protein, 9 aa, Homo Sapiens
QNLSQQSLS

SEQ ID NO: 515278 - protein, 9 aa, Homo Sapiens
RVHPTLESG

SEQ ID NO: 515279 - protein, 9 aa, Homo Sapiens
MPNGKTWTS

SEQ ID NO: 515280 - protein, 9 aa, Homo Sapiens
PTNSATERS

SEQ ID NO: 515281 - protein, 9 aa, Homo Sapiens
ESYRFCDRV

SEQ ID NO: 515282 - protein, 9 aa, Homo Sapiens
SQQSLSGPQ

SEQ ID NO: 515283 - protein, 9 aa, Homo Sapiens
KSCYVIMVG

SEQ ID NO: 515284 - protein, 9 aa, Homo Sapiens
KYVAHRFSR

SEQ ID NO: 515285 - protein, 9 aa, Homo Sapiens
FAGNLVYST

SEQ ID NO: 515286 - protein, 9 aa, Homo Sapiens
VAGVKPSAN

SEQ ID NO: 515287 - protein, 9 aa, Homo Sapiens
RAPAAAPFL

SEQ ID NO: 515288 - protein, 9 aa, Homo Sapiens
EHTKRHSEP

SEQ ID NO: 515289 - protein, 9 aa, Homo Sapiens
AGVKPSANY

SEQ ID NO: 515290 - protein, 9 aa, Homo Sapiens
LPSPVPGPV

SEQ ID NO: 515291 - protein, 9 aa, Homo Sapiens
LEGHQVKLS

SEQ ID NO: 515292 - protein, 9 aa, Homo Sapiens
PSPVPGPVP

SEQ ID NO: 515293 - protein, 9 aa, Homo Sapiens
PITVMTFDL

SEQ ID NO: 515294 - protein, 9 aa, Homo Sapiens
RDTIFTLSL

SEQ ID NO: 515295 - protein, 9 aa, Homo Sapiens
CICDECNYG

SEQ ID NO: 515296 - protein, 9 aa, Homo Sapiens
ARDTIFTLS

SEQ ID NO: 515297 - protein, 9 aa, Homo Sapiens
SCFAGNLVY

SEQ ID NO: 515298 - protein, 9 aa, Homo Sapiens
LQNLSQQSL

SEQ ID NO: 515299 - protein, 9 aa, Homo Sapiens
AKYVAHRFS

SEQ ID NO: 515300 - protein, 9 aa, Homo Sapiens
AESYRFCDR

SEQ ID NO: 515301 - protein, 9 aa, Homo Sapiens
PKAVPLPDL

SEQ ID NO: 515302 - protein, 9 aa, Homo Sapiens
VCICDECNY

SEQ ID NO: 515303 - protein, 9 aa, Homo Sapiens
GKTWTSLKT

SEQ ID NO: 515304 - protein, 9 aa, Homo Sapiens
PEEAMEQKA

SEQ ID NO: 515305 - protein, 9 aa, Homo Sapiens
LESGTAETR

SEQ ID NO: 515306 - protein, 9 aa, Homo Sapiens
PGTGRCDSA

SEQ ID NO: 515307 - protein, 9 aa, Homo Sapiens
HSEPDKSLQ

SEQ ID NO: 515308 - protein, 9 aa, Homo Sapiens
FGGSGCRGS

SEQ ID NO: 515309 - protein, 9 aa, Homo Sapiens
RRALACRVS

SEQ ID NO: 515310 - protein, 9 aa, Homo Sapiens
RHSEPDKSL

SEQ ID NO: 515311 - protein, 9 aa, Homo Sapiens
GTGRCDSAL

SEQ ID NO: 515312 - protein, 9 aa, Homo Sapiens
TDMHLPTPA

SEQ ID NO: 515313 - protein, 9 aa, Homo Sapiens
HPTLESGTA

SEQ ID NO: 515314 - protein, 9 aa, Homo Sapiens
EGSGEEDQD

SEQ ID NO: 515315 - protein, 9 aa, Homo Sapiens
KTSWVHLIV

SEQ ID NO: 515316 - protein, 9 aa, Homo Sapiens
LFTEKQQMK

SEQ ID NO: 515317 - protein, 9 aa, Homo Sapiens
RAMIEAMEQ

SEQ ID NO: 515318 - protein, 9 aa, Homo Sapiens
LLMLSGVCP

SEQ ID NO: 515319 - protein, 9 aa, Homo Sapiens
EVLWMHKHI

SEQ ID NO: 515320 - protein, 9 aa, Homo Sapiens
ASPSPGTGR

SEQ ID NO: 515321 - protein, 9 aa, Homo Sapiens
RPCTLVCIC

SEQ ID NO: 515322 - protein, 9 aa, Homo Sapiens
KAVPLPDLP

SEQ ID NO: 515323 - protein, 9 aa, Homo Sapiens
RCDSALPSP

SEQ ID NO: 515324 - protein, 9 aa, Homo Sapiens
DLPASPSPG

SEQ ID NO: 515325 - protein, 9 aa, Homo Sapiens
AAFGGSGCR

SEQ ID NO: 515326 - protein, 9 aa, Homo Sapiens
EHELLSPKA

SEQ ID NO: 515327 - protein, 9 aa, Homo Sapiens
NNVLDHFLC

SEQ ID NO: 515328 - protein, 9 aa, Homo Sapiens
GAGRLLMLS

SEQ ID NO: 515329 - protein, 9 aa, Homo Sapiens
PGQEPITVM

SEQ ID NO: 515330 - protein, 9 aa, Homo Sapiens
FLPTSQCPS

SEQ ID NO: 515331 - protein, 9 aa, Homo Sapiens
EQLQIPFSR

SEQ ID NO: 515332 - protein, 9 aa, Homo Sapiens
DTIFTLSLP

SEQ ID NO: 515333 - protein, 9 aa, Homo Sapiens
KRQPEFLPT

SEQ ID NO: 515334 - protein, 9 aa, Homo Sapiens
QPEFLPTSQ

SEQ ID NO: 515335 - protein, 9 aa, Homo Sapiens
CRVSLLRPL

SEQ ID NO: 515336 - protein, 9 aa, Homo Sapiens
QEPITVMTF

SEQ ID NO: 515337 - protein, 9 aa, Homo Sapiens
SPGTGRCDS

SEQ ID NO: 515338 - protein, 9 aa, Homo Sapiens
RQPEFLPTS

SEQ ID NO: 515339 - protein, 9 aa, Homo Sapiens
TRAELANTL

SEQ ID NO: 515340 - protein, 9 aa, Homo Sapiens
FVAGVKPSA

SEQ ID NO: 515341 - protein, 9 aa, Homo Sapiens
MQCAEHELL

SEQ ID NO: 515342 - protein, 9 aa, Homo Sapiens
FLPFSGGGQ

SEQ ID NO: 515343 - protein, 9 aa, Homo Sapiens
DKSCYVIMV

SEQ ID NO: 515344 - protein, 9 aa, Homo Sapiens
RTLDPRILR

SEQ ID NO: 515345 - protein, 9 aa, Homo Sapiens
GSGEEDQDY

SEQ ID NO: 515346 - protein, 9 aa, Homo Sapiens
LATDMHLPT

SEQ ID NO: 515347 - protein, 9 aa, Homo Sapiens
RGAGRLLML

SEQ ID NO: 515348 - protein, 9 aa, Homo Sapiens
ELLQNLSQQ

SEQ ID NO: 515349 - protein, 9 aa, Homo Sapiens
GNLVYSTRL

SEQ ID NO: 515350 - protein, 9 aa, Homo Sapiens
CRGSSSGGG

SEQ ID NO: 515351 - protein, 9 aa, Homo Sapiens
VGARDTIFT

SEQ ID NO: 515352 - protein, 9 aa, Homo Sapiens
HPKTSWVHL

SEQ ID NO: 515353 - protein, 9 aa, Homo Sapiens
HLPTPADWI

SEQ ID NO: 515354 - protein, 9 aa, Homo Sapiens
DPRILRRGP

SEQ ID NO: 515355 - protein, 9 aa, Homo Sapiens
MLSGVCPPA

SEQ ID NO: 515356 - protein, 9 aa, Homo Sapiens
SGKRPREGE

SEQ ID NO: 515357 - protein, 9 aa, Homo Sapiens
YYGEEGSGE

SEQ ID NO: 515358 - protein, 9 aa, Homo Sapiens
PKTSWVHLI

SEQ ID NO: 515359 - protein, 9 aa, Homo Sapiens
TPADWIIMH

SEQ ID NO: 515360 - protein, 9 aa, Homo Sapiens
PAAAPFLPF

SEQ ID NO: 515361 - protein, 9 aa, Homo Sapiens
MHLPTPADW

SEQ ID NO: 515362 - protein, 9 aa, Homo Sapiens
FVYQGDDPG

SEQ ID NO: 515363 - protein, 9 aa, Homo Sapiens
VCPPAWREL

SEQ ID NO: 515364 - protein, 9 aa, Homo Sapiens
AEHELLSPK

SEQ ID NO: 515365 - protein, 9 aa, Homo Sapiens
VLAQPSTSG

SEQ ID NO: 515366 - protein, 9 aa, Homo Sapiens
GCRGSSSGG

SEQ ID NO: 515367 - protein, 9 aa, Homo Sapiens
NSATERSDS

SEQ ID NO: 515368 - protein, 9 aa, Homo Sapiens
LVYSTRLCL

SEQ ID NO: 515369 - protein, 9 aa, Homo Sapiens
YGEEGSGEE

SEQ ID NO: 515370 - protein, 9 aa, Homo Sapiens
ESGTAETRP

SEQ ID NO: 515371 - protein, 9 aa, Homo Sapiens
TVMTFDLTK

SEQ ID NO: 515372 - protein, 9 aa, Homo Sapiens
VFVYQGDDP

SEQ ID NO: 515373 - protein, 9 aa, Homo Sapiens
AMIEAMEQL

SEQ ID NO: 515374 - protein, 9 aa, Homo Sapiens
SGEVTSVFV

SEQ ID NO: 515375 - protein, 9 aa, Homo Sapiens
RGHDPQWSS

SEQ ID NO: 515376 - protein, 9 aa, Homo Sapiens
PTCGNNVLD

SEQ ID NO: 515377 - protein, 9 aa, Homo Sapiens
SAAEEMLQQ

SEQ ID NO: 515378 - protein, 9 aa, Homo Sapiens
QMKYFLSTL

SEQ ID NO: 515379 - protein, 9 aa, Homo Sapiens
LMLSGVCPP

SEQ ID NO: 515380 - protein, 9 aa, Homo Sapiens
SGAMRREQW

SEQ ID NO: 515381 - protein, 9 aa, Homo Sapiens
CPPAWRELL

SEQ ID NO: 515382 - protein, 9 aa, Homo Sapiens
AAAPFLPFS

SEQ ID NO: 515383 - protein, 9 aa, Homo Sapiens
HRRALACRV

SEQ ID NO: 515384 - protein, 9 aa, Homo Sapiens
VHKLTTADV

SEQ ID NO: 515385 - protein, 9 aa, Homo Sapiens
KTWTSLKTM

SEQ ID NO: 515386 - protein, 9 aa, Homo Sapiens
TDNHPKTSW

SEQ ID NO: 515387 - protein, 9 aa, Homo Sapiens
TLSLPFSGE

SEQ ID NO: 515388 - protein, 9 aa, Homo Sapiens
PVPGPVPCD

SEQ ID NO: 515389 - protein, 9 aa, Homo Sapiens
TADVRAEDQ

SEQ ID NO: 515390 - protein, 9 aa, Homo Sapiens
ERSDSTRGH

SEQ ID NO: 515391 - protein, 9 aa, Homo Sapiens
APEEAMEQK

SEQ ID NO: 515392 - protein, 9 aa, Homo Sapiens
LTTADVRAE

SEQ ID NO: 515393 - protein, 9 aa, Homo Sapiens
LAQPSTSGK

SEQ ID NO: 515394 - protein, 9 aa, Homo Sapiens
DMHLPTPAD

SEQ ID NO: 515395 - protein, 9 aa, Homo Sapiens
EHKVHKLTT

SEQ ID NO: 515396 - protein, 9 aa, Homo Sapiens
RRGPDFTPA

SEQ ID NO: 515397 - protein, 9 aa, Homo Sapiens
CDKSCYVIM

SEQ ID NO: 515398 - protein, 9 aa, Homo Sapiens
GEVTSVFVY

SEQ ID NO: 515399 - protein, 9 aa, Homo Sapiens
RLLMLSGVC

SEQ ID NO: 515400 - protein, 9 aa, Homo Sapiens
NTLEPAAEG

SEQ ID NO: 515401 - protein, 9 aa, Homo Sapiens
AGRLLMLSG

SEQ ID NO: 515402 - protein, 9 aa, Homo Sapiens
HDPQWSSGH

SEQ ID NO: 515403 - protein, 9 aa, Homo Sapiens
YVIMVGSTV

SEQ ID NO: 515404 - protein, 9 aa, Homo Sapiens
PKTPPKAVM

SEQ ID NO: 515405 - protein, 9 aa, Homo Sapiens
GVKPSANYH

SEQ ID NO: 515406 - protein, 9 aa, Homo Sapiens
HTKRHSEPD

SEQ ID NO: 515407 - protein, 9 aa, Homo Sapiens
LACRVSLLR

SEQ ID NO: 515408 - protein, 9 aa, Homo Sapiens
ACRVSLLRP

SEQ ID NO: 515409 - protein, 9 aa, Homo Sapiens
PASPSPGTG

SEQ ID NO: 515410 - protein, 9 aa, Homo Sapiens
KLTTADVRA

SEQ ID NO: 515411 - protein, 9 aa, Homo Sapiens
STSGKRPRE

SEQ ID NO: 515412 - protein, 9 aa, Homo Sapiens
NHPKTSWVH

SEQ ID NO: 515413 - protein, 9 aa, Homo Sapiens
NLVYSTRLC

SEQ ID NO: 515414 - protein, 9 aa, Homo Sapiens
HIWHRVSCN

SEQ ID NO: 515415 - protein, 9 aa, Homo Sapiens
IFTLSLPFS

SEQ ID NO: 515416 - protein, 9 aa, Homo Sapiens
AWRELLRSG

SEQ ID NO: 515417 - protein, 9 aa, Homo Sapiens
TPPKAVMPP

SEQ ID NO: 515418 - protein, 9 aa, Homo Sapiens
FTEKQQMKY

SEQ ID NO: 515419 - protein, 9 aa, Homo Sapiens
YRFCDRVQD

SEQ ID NO: 515420 - protein, 9 aa, Homo Sapiens
TEKQQMKYF

SEQ ID NO: 515421 - protein, 9 aa, Homo Sapiens
KPSANYHAL

SEQ ID NO: 515422 - protein, 9 aa, Homo Sapiens
MLRVHPTLE

SEQ ID NO: 515423 - protein, 9 aa, Homo Sapiens
LDPRILRRG

SEQ ID NO: 515424 - protein, 9 aa, Homo Sapiens
LLQNLSQQS

SEQ ID NO: 515425 - protein, 9 aa, Homo Sapiens
ARGAGRLLM

SEQ ID NO: 515426 - protein, 9 aa, Homo Sapiens
TTADVRAED

SEQ ID NO: 515427 - protein, 9 aa, Homo Sapiens
TLDPRILRR

SEQ ID NO: 515428 - protein, 9 aa, Homo Sapiens
FYYGEEGSG

SEQ ID NO: 515429 - protein, 9 aa, Homo Sapiens
QLQIPFSRP

SEQ ID NO: 515430 - protein, 9 aa, Homo Sapiens
AHRFSRKTC

SEQ ID NO: 515431 - protein, 9 aa, Homo Sapiens
LPASPSPGT

SEQ ID NO: 515432 - protein, 9 aa, Homo Sapiens
PFLPFSGGG

SEQ ID NO: 515433 - protein, 9 aa, Homo Sapiens
EPITVMTFD

SEQ ID NO: 515434 - protein, 9 aa, Homo Sapiens
SPVPGPVPC

SEQ ID NO: 515435 - protein, 9 aa, Homo Sapiens
PVPCDAADL

SEQ ID NO: 515436 - protein, 9 aa, Homo Sapiens
QVKLSAAEE

SEQ ID NO: 515437 - protein, 9 aa, Homo Sapiens
LARAPEEAM

SEQ ID NO: 515438 - protein, 9 aa, Homo Sapiens
YITAKYVAH

SEQ ID NO: 515439 - protein, 9 aa, Homo Sapiens
GPGQEPITV

SEQ ID NO: 515440 - protein, 9 aa, Homo Sapiens
LPTSQCPSA

SEQ ID NO: 515441 - protein, 9 aa, Homo Sapiens
KSPDTTLSP

SEQ ID NO: 515442 - protein, 9 aa, Homo Sapiens
SSPKSPDTT

SEQ ID NO: 515443 - protein, 9 aa, Homo Sapiens
AGNLVYSTR

SEQ ID NO: 515444 - protein, 9 aa, Homo Sapiens
LRPRGARGA

SEQ ID NO: 515445 - protein, 9 aa, Homo Sapiens
ATERSDSTR

SEQ ID NO: 515446 - protein, 9 aa, Homo Sapiens
LANTLEPAA

SEQ ID NO: 515447 - protein, 9 aa, Homo Sapiens
TLESGTAET

SEQ ID NO: 515448 - protein, 9 aa, Homo Sapiens
PTPADWIIM

SEQ ID NO: 515449 - protein, 9 aa, Homo Sapiens
SYRFCDRVQ

SEQ ID NO: 515450 - protein, 9 aa, Homo Sapiens
TAKYVAHRF

SEQ ID NO: 515451 - protein, 9 aa, Homo Sapiens
GKRPREGEA

SEQ ID NO: 515452 - protein, 9 aa, Homo Sapiens
VIMVGSTVT

SEQ ID NO: 515453 - protein, 9 aa, Homo Sapiens
TCGNNVLDH

SEQ ID NO: 515454 - protein, 9 aa, Homo Sapiens
CGNNVLDHF

SEQ ID NO: 515455 - protein, 9 aa, Homo Sapiens
NLPTCGNNV

SEQ ID NO: 515456 - protein, 9 aa, Homo Sapiens
TSVFVYQGD

SEQ ID NO: 515457 - protein, 9 aa, Homo Sapiens
CDSALPSPV

SEQ ID NO: 515458 - protein, 9 aa, Homo Sapiens
VPFTGSALS

SEQ ID NO: 515459 - protein, 9 aa, Homo Sapiens
IEAMEQLQI

SEQ ID NO: 515460 - protein, 9 aa, Homo Sapiens
TSGKRPREG

SEQ ID NO: 515461 - protein, 9 aa, Homo Sapiens
GHDPQWSSG

SEQ ID NO: 515462 - protein, 9 aa, Homo Sapiens
RGARGAGRL

SEQ ID NO: 515463 - protein, 9 aa, Homo Sapiens
AAPFLPFSG

SEQ ID NO: 515464 - protein, 9 aa, Homo Sapiens
LPDLPASPS

SEQ ID NO: 515465 - protein, 9 aa, Homo Sapiens
VFYYGEEGS

SEQ ID NO: 515466 - protein, 9 aa, Homo Sapiens
KHIWHRVSC

SEQ ID NO: 515467 - protein, 9 aa, Homo Sapiens
SATERSDST

SEQ ID NO: 515468 - protein, 9 aa, Homo Sapiens
LLSPKAVPL

SEQ ID NO: 515469 - protein, 9 aa, Homo Sapiens
PNGKTWTSL

SEQ ID NO: 515470 - protein, 9 aa, Homo Sapiens
SWVHLIVQV

SEQ ID NO: 515471 - protein, 9 aa, Homo Sapiens
MIEAMEQLQ

SEQ ID NO: 515472 - protein, 9 aa, Homo Sapiens
PDLPASPSP

SEQ ID NO: 515473 - protein, 9 aa, Homo Sapiens
ILRRGPDFT

SEQ ID NO: 515474 - protein, 9 aa, Homo Sapiens
FYSSPKSPD

SEQ ID NO: 515475 - protein, 9 aa, Homo Sapiens
CFAGNLVYS

SEQ ID NO: 515476 - protein, 9 aa, Homo Sapiens
APAAAPFLP

SEQ ID NO: 515477 - protein, 9 aa, Homo Sapiens
HKLTTADVR

SEQ ID NO: 515478 - protein, 9 aa, Homo Sapiens
WRELLRSGA

SEQ ID NO: 515479 - protein, 9 aa, Homo Sapiens
VHPTLESGT

SEQ ID NO: 515480 - protein, 9 aa, Homo Sapiens
HKHIWHRVS

SEQ ID NO: 515481 - protein, 9 aa, Homo Sapiens
GGSGCRGSS

SEQ ID NO: 515482 - protein, 9 aa, Homo Sapiens
PAWRELLRS

SEQ ID NO: 515483 - protein, 9 aa, Homo Sapiens
VPLPDLPAS

SEQ ID NO: 515484 - protein, 9 aa, Homo Sapiens
KAAFGGSGC

SEQ ID NO: 515485 - protein, 9 aa, Homo Sapiens
ALPSPVPGP

SEQ ID NO: 515486 - protein, 9 aa, Homo Sapiens
SPKSPDTTL

SEQ ID NO: 515487 - protein, 9 aa, Homo Sapiens
NVLDHFLCE

SEQ ID NO: 515488 - protein, 9 aa, Homo Sapiens
GSGCRGSSS

SEQ ID NO: 515489 - protein, 9 aa, Homo Sapiens
EEGSGEEDQ

SEQ ID NO: 515490 - protein, 9 aa, Homo Sapiens
TWTSLKTMS

SEQ ID NO: 515491 - protein, 9 aa, Homo Sapiens
SEIAESYRF

SEQ ID NO: 515492 - protein, 9 aa, Homo Sapiens
PRGARGAGR

SEQ ID NO: 515493 - protein, 9 aa, Homo Sapiens
GNNVLDHFL

SEQ ID NO: 515494 - protein, 9 aa, Homo Sapiens
GHQVKLSAA

SEQ ID NO: 515495 - protein, 9 aa, Homo Sapiens
AFGGSGCRG

SEQ ID NO: 515496 - protein, 9 aa, Homo Sapiens
EELLQNLSQ

SEQ ID NO: 515497 - protein, 9 aa, Homo Sapiens
LSGVCPPAW

SEQ ID NO: 515498 - protein, 9 aa, Homo Sapiens
FTGSALSSA

SEQ ID NO: 515499 - protein, 9 aa, Homo Sapiens
TTFYSSPKS

SEQ ID NO: 515500 - protein, 9 aa, Homo Sapiens
EAMEQLQIP

SEQ ID NO: 515501 - protein, 9 aa, Homo Sapiens
GRCDSALPS

SEQ ID NO: 515502 - protein, 9 aa, Homo Sapiens
LLRSGAMRR

SEQ ID NO: 515503 - protein, 9 aa, Homo Sapiens
LPFSGGGQR

SEQ ID NO: 515504 - protein, 9 aa, Homo Sapiens
ATDMHLPTP

SEQ ID NO: 515505 - protein, 9 aa, Homo Sapiens
SALPSPVPG

SEQ ID NO: 515506 - protein, 9 aa, Homo Sapiens
HKVHKLTTA

SEQ ID NO: 515507 - protein, 9 aa, Homo Sapiens
FGDFVAGVK

SEQ ID NO: 515508 - protein, 9 aa, Homo Sapiens
LPTPADWII

SEQ ID NO: 515509 - protein, 9 aa, Homo Sapiens
LRRGPDFTP

SEQ ID NO: 515510 - protein, 9 aa, Homo Sapiens
PTLESGTAE

SEQ ID NO: 515511 - protein, 9 aa, Homo Sapiens
ALACRVSLL

SEQ ID NO: 515512 - protein, 9 aa, Homo Sapiens
MEQLQIPFS

SEQ ID NO: 515513 - protein, 9 aa, Homo Sapiens
LWMHKHIWH

SEQ ID NO: 515514 - protein, 9 aa, Homo Sapiens
RAPEEAMEQ

SEQ ID NO: 515515 - protein, 9 aa, Homo Sapiens
PCDAADLRP

SEQ ID NO: 515516 - protein, 9 aa, Homo Sapiens
ELLSPKAVP

SEQ ID NO: 515517 - protein, 9 aa, Homo Sapiens
AMRREQWPL

SEQ ID NO: 515518 - protein, 9 aa, Homo Sapiens
QCAEHELLS

SEQ ID NO: 515519 - protein, 9 aa, Homo Sapiens
SALSSALLF

SEQ ID NO: 515520 - protein, 9 aa, Homo Sapiens
NGPGQEPIT

SEQ ID NO: 515521 - protein, 9 aa, Homo Sapiens
DAADLRPRG

SEQ ID NO: 515522 - protein, 9 aa, Homo Sapiens
EGHQVKLSA

SEQ ID NO: 515523 - protein, 9 aa, Homo Sapiens
EPDKSLQDE

SEQ ID NO: 515524 - protein, 9 aa, Homo Sapiens
PSTSGKRPR

SEQ ID NO: 515525 - protein, 9 aa, Homo Sapiens
ALSLARAPE

SEQ ID NO: 515526 - protein, 9 aa, Homo Sapiens
DSGEVTSVF

SEQ ID NO: 515527 - protein, 9 aa, Homo Sapiens
DFVAGVKPS

SEQ ID NO: 515528 - protein, 9 aa, Homo Sapiens
RELLRSGAM

SEQ ID NO: 515529 - protein, 9 aa, Homo Sapiens
VLDHFLCEL

SEQ ID NO: 515530 - protein, 9 aa, Homo Sapiens
RAELANTLE

SEQ ID NO: 515531 - protein, 9 aa, Homo Sapiens
ANTLEPAAE

SEQ ID NO: 515532 - protein, 9 aa, Homo Sapiens
ADLRPRGAR

SEQ ID NO: 515533 - protein, 9 aa, Homo Sapiens
ICDKSCYVI

SEQ ID NO: 515534 - protein, 9 aa, Homo Sapiens
ARAPEEAME

SEQ ID NO: 515535 - protein, 9 aa, Homo Sapiens
VKPSANYHA

SEQ ID NO: 515536 - protein, 9 aa, Homo Sapiens
SCYVIMVGS

SEQ ID NO: 515537 - protein, 9 aa, Homo Sapiens
DSTRGHDPQ

SEQ ID NO: 515538 - protein, 9 aa, Homo Sapiens
VPCDAADLR

SEQ ID NO: 515539 - protein, 9 aa, Homo Sapiens
WVHLIVQVP

SEQ ID NO: 515540 - protein, 9 aa, Homo Sapiens
SGCRGSSSG

SEQ ID NO: 515541 - protein, 9 aa, Homo Sapiens
NLSQQSLSG

SEQ ID NO: 515542 - protein, 9 aa, Homo Sapiens
CDHVPFTGS

SEQ ID NO: 515543 - protein, 9 aa, Homo Sapiens
MEHTKRHSE

SEQ ID NO: 515544 - protein, 9 aa, Homo Sapiens
GSALSSALL

SEQ ID NO: 515545 - protein, 9 aa, Homo Sapiens
ITAKYVAHR

SEQ ID NO: 515546 - protein, 9 aa, Homo Sapiens
PSEIAESYR

SEQ ID NO: 515547 - protein, 9 aa, Homo Sapiens
VLWMHKHIW

SEQ ID NO: 515548 - protein, 9 aa, Homo Sapiens
APKTPPKAV

SEQ ID NO: 515549 - protein, 9 aa, Homo Sapiens
KQQMKYFLS

SEQ ID NO: 515550 - protein, 9 aa, Homo Sapiens
ITVMTFDLT

SEQ ID NO: 515551 - protein, 9 aa, Homo Sapiens
AMEQLQIPF

SEQ ID NO: 515552 - protein, 9 aa, Homo Sapiens
PEFLPTSQC

SEQ ID NO: 515553 - protein, 9 aa, Homo Sapiens
QPSTSGKRP

SEQ ID NO: 515554 - protein, 9 aa, Homo Sapiens
TGRCDSALP

SEQ ID NO: 515555 - protein, 9 aa, Homo Sapiens
RPRGARGAG

SEQ ID NO: 515556 - protein, 9 aa, Homo Sapiens
KVHKLTTAD

SEQ ID NO: 515557 - protein, 9 aa, Homo Sapiens
PEVLWMHKH

SEQ ID NO: 515558 - protein, 9 aa, Homo Sapiens
LSPKAVPLP

SEQ ID NO: 515559 - protein, 9 aa, Homo Sapiens
PPKAVMPPQ

SEQ ID NO: 515560 - protein, 9 aa, Homo Sapiens
GARDTIFTL

SEQ ID NO: 515561 - protein, 9 aa, Homo Sapiens
APFLPFSGG

SEQ ID NO: 515562 - protein, 9 aa, Homo Sapiens
KRHSEPDKS

SEQ ID NO: 515563 - protein, 9 aa, Homo Sapiens
PCTLVCICD

SEQ ID NO: 515564 - protein, 9 aa, Homo Sapiens
GPVPCDAAD

SEQ ID NO: 515565 - protein, 9 aa, Homo Sapiens
CYVIMVGST

SEQ ID NO: 515566 - protein, 9 aa, Homo Sapiens
LSAAEEMLQ

SEQ ID NO: 515567 - protein, 9 aa, Homo Sapiens
YVAHRFSRK

SEQ ID NO: 515568 - protein, 9 aa, Homo Sapiens
TFYSSPKSP

SEQ ID NO: 515569 - protein, 9 aa, Homo Sapiens
TMPNGKTWT

SEQ ID NO: 515570 - protein, 9 aa, Homo Sapiens
HVPFTGSAL

SEQ ID NO: 515571 - protein, 9 aa, Homo Sapiens
PLPDLPASP

SEQ ID NO: 515572 - protein, 9 aa, Homo Sapiens
MHKHIWHRV

SEQ ID NO: 515573 - protein, 9 aa, Homo Sapiens
SEPDKSLQD

SEQ ID NO: 515574 - protein, 9 aa, Homo Sapiens
MRREQWPLL

SEQ ID NO: 515575 - protein, 9 aa, Homo Sapiens
DNHPKTSWV

SEQ ID NO: 515576 - protein, 9 aa, Homo Sapiens
CDAADLRPR

SEQ ID NO: 515577 - protein, 9 aa, Homo Sapiens
AEELLQNLS

SEQ ID NO: 515578 - protein, 9 aa, Homo Sapiens
RGHRRALAC

SEQ ID NO: 515579 - protein, 9 aa, Homo Sapiens
GVCPPAWRE

SEQ ID NO: 515580 - protein, 9 aa, Homo Sapiens
PKAVMPPQI

SEQ ID NO: 515581 - protein, 9 aa, Homo Sapiens
GDFVAGVKP

SEQ ID NO: 515582 - protein, 9 aa, Homo Sapiens
ELANTLEPA

SEQ ID NO: 515583 - protein, 9 aa, Homo Sapiens
EIAESYRFC

SEQ ID NO: 515584 - protein, 9 aa, Homo Sapiens
DSALPSPVP

SEQ ID NO: 515585 - protein, 9 aa, Homo Sapiens
TERSDSTRG

SEQ ID NO: 515586 - protein, 9 aa, Homo Sapiens
RICDKSCYV

SEQ ID NO: 515587 - protein, 9 aa, Homo Sapiens
GAMRREQWP

SEQ ID NO: 515588 - protein, 9 aa, Homo Sapiens
DPQWSSGHS

SEQ ID NO: 515589 - protein, 9 aa, Homo Sapiens
LPTCGNNVL

SEQ ID NO: 515590 - protein, 9 aa, Homo Sapiens
NGKTWTSLK

SEQ ID NO: 515591 - protein, 9 aa, Homo Sapiens
WMHKHIWHR

SEQ ID NO: 515592 - protein, 9 aa, Homo Sapiens
SDSTRGHDP

SEQ ID NO: 515593 - protein, 9 aa, Homo Sapiens
WTSLKTMSR

SEQ ID NO: 515594 - protein, 9 aa, Homo Sapiens
DHVPFTGSA

SEQ ID NO: 515595 - protein, 9 aa, Homo Sapiens
TRGHDPQWS

SEQ ID NO: 515596 - protein, 9 aa, Homo Sapiens
ELLRSGAMR

SEQ ID NO: 515597 - protein, 9 aa, Homo Sapiens
TKRHSEPDK

SEQ ID NO: 515598 - protein, 9 aa, Homo Sapiens
SLARAPEEA

SEQ ID NO: 515599 - protein, 9 aa, Homo Sapiens
FTLSLPFSG

SEQ ID NO: 515600 - protein, 9 aa, Homo Sapiens
VTSVFVYQG

SEQ ID NO: 515601 - protein, 9 aa, Homo Sapiens
LSLARAPEE

SEQ ID NO: 515602 - protein, 9 aa, Homo Sapiens
RALACRVSL

SEQ ID NO: 515603 - protein, 9 aa, Homo Sapiens
AKKRQPEFL

SEQ ID NO: 515604 - protein, 9 aa, Homo Sapiens
KLFTEKQQM

SEQ ID NO: 515605 - protein, 9 aa, Homo Sapiens
KLSAAEEML

SEQ ID NO: 515606 - protein, 9 aa, Homo Sapiens
EVTSVFVYQ

SEQ ID NO: 515607 - protein, 9 aa, Homo Sapiens
AVMPPQIIQ

SEQ ID NO: 515608 - protein, 9 aa, Homo Sapiens
CAEHELLSP

SEQ ID NO: 515609 - protein, 9 aa, Homo Sapiens
RSGAMRREQ

SEQ ID NO: 515610 - protein, 9 aa, Homo Sapiens
GQEPITVMT

SEQ ID NO: 515611 - protein, 9 aa, Homo Sapiens
RILRRGPDF

SEQ ID NO: 515612 - protein, 9 aa, Homo Sapiens
LRSGAMRRE

SEQ ID NO: 515613 - protein, 9 aa, Homo Sapiens
GARGAGRLL

SEQ ID NO: 515614 - protein, 9 aa, Homo Sapiens
LSQQSLSGP

SEQ ID NO: 515615 - protein, 9 aa, Homo Sapiens
KKRQPEFLP

SEQ ID NO: 515616 - protein, 9 aa, Homo Sapiens
GHRRALACR

SEQ ID NO: 515617 - protein, 9 aa, Homo Sapiens
YSTRLCLSE

SEQ ID NO: 515618 - protein, 9 aa, Homo Sapiens
QTMPNGKTW

SEQ ID NO: 515619 - protein, 9 aa, Homo Sapiens
CTLVCICDE

SEQ ID NO: 515620 - protein, 9 aa, Homo Sapiens
PGPVPCDAA

SEQ ID NO: 515621 - protein, 9 aa, Homo Sapiens
QQMKYFLST

SEQ ID NO: 515622 - protein, 9 aa, Homo Sapiens
PSPGTGRCD

SEQ ID NO: 515623 - protein, 9 aa, Homo Sapiens
WLRGEKVIQ

SEQ ID NO: 515624 - protein, 9 aa, Homo Sapiens
KLAVSPTPP

SEQ ID NO: 515625 - protein, 9 aa, Homo Sapiens
MPIPANQEL

SEQ ID NO: 515626 - protein, 9 aa, Homo Sapiens
YPGNTKVMD

SEQ ID NO: 515627 - protein, 9 aa, Homo Sapiens
ACLGEHSTS

SEQ ID NO: 515628 - protein, 9 aa, Homo Sapiens
RFKKAHLTH

SEQ ID NO: 515629 - protein, 9 aa, Homo Sapiens
MWGAHIFCV

SEQ ID NO: 515630 - protein, 9 aa, Homo Sapiens
SLSNLSLTS

SEQ ID NO: 515631 - protein, 9 aa, Homo Sapiens
LFQPRQPNP

SEQ ID NO: 515632 - protein, 9 aa, Homo Sapiens
PGTPVRAMA

SEQ ID NO: 515633 - protein, 9 aa, Homo Sapiens
VSFADVNQS

SEQ ID NO: 515634 - protein, 9 aa, Homo Sapiens
GIFNETSDH

SEQ ID NO: 515635 - protein, 9 aa, Homo Sapiens
AESEADFSV

SEQ ID NO: 515636 - protein, 9 aa, Homo Sapiens
EDPLTTVQE

SEQ ID NO: 515637 - protein, 9 aa, Homo Sapiens
LCKQNVDRK

SEQ ID NO: 515638 - protein, 9 aa, Homo Sapiens
TFRTNNIRI

SEQ ID NO: 515639 - protein, 9 aa, Homo Sapiens
ANAHERARM

SEQ ID NO: 515640 - protein, 9 aa, Homo Sapiens
SRRTQPPIT

SEQ ID NO: 515641 - protein, 9 aa, Homo Sapiens
VMPYQPQVD

SEQ ID NO: 515642 - protein, 9 aa, Homo Sapiens
RLRDSGSAY

SEQ ID NO: 515643 - protein, 9 aa, Homo Sapiens
PSAALLRVQ

SEQ ID NO: 515644 - protein, 9 aa, Homo Sapiens
LKNISGSNQ

SEQ ID NO: 515645 - protein, 9 aa, Homo Sapiens
YPSTAGQPH

SEQ ID NO: 515646 - protein, 9 aa, Homo Sapiens
DYNWLHHTS

SEQ ID NO: 515647 - protein, 9 aa, Homo Sapiens
HSRLNERQR

SEQ ID NO: 515648 - protein, 9 aa, Homo Sapiens
RNLFVKSEG

SEQ ID NO: 515649 - protein, 9 aa, Homo Sapiens
SYFREQGKA

SEQ ID NO: 515650 - protein, 9 aa, Homo Sapiens
PQAQPQLPP

SEQ ID NO: 515651 - protein, 9 aa, Homo Sapiens
QAAYQGGGG

SEQ ID NO: 515652 - protein, 9 aa, Homo Sapiens
ENILGHPKR

SEQ ID NO: 515653 - protein, 9 aa, Homo Sapiens
VRVPSSVAH

SEQ ID NO: 515654 - protein, 9 aa, Homo Sapiens
CKSFFNRSV

SEQ ID NO: 515655 - protein, 9 aa, Homo Sapiens
GLASRNLQA

SEQ ID NO: 515656 - protein, 9 aa, Homo Sapiens
TTDVSRTEV

SEQ ID NO: 515657 - protein, 9 aa, Homo Sapiens
NLDRFWPII

SEQ ID NO: 515658 - protein, 9 aa, Homo Sapiens
SSRSVMIQM

SEQ ID NO: 515659 - protein, 9 aa, Homo Sapiens
LLENLDRFW

SEQ ID NO: 515660 - protein, 9 aa, Homo Sapiens
AWRVSALST

SEQ ID NO: 515661 - protein, 9 aa, Homo Sapiens
YQEVPATEQ

SEQ ID NO: 515662 - protein, 9 aa, Homo Sapiens
KTQFSKKQI

SEQ ID NO: 515663 - protein, 9 aa, Homo Sapiens
LNPDLEKTI

SEQ ID NO: 515664 - protein, 9 aa, Homo Sapiens
DFYSISVLE

SEQ ID NO: 515665 - protein, 9 aa, Homo Sapiens
DSHRIHLLC

SEQ ID NO: 515666 - protein, 9 aa, Homo Sapiens
FRLKFKEFV

SEQ ID NO: 515667 - protein, 9 aa, Homo Sapiens
VPATEQGMM

SEQ ID NO: 515668 - protein, 9 aa, Homo Sapiens
PNKALPAPI

SEQ ID NO: 515669 - protein, 9 aa, Homo Sapiens
AKGMLCADT

SEQ ID NO: 515670 - protein, 9 aa, Homo Sapiens
TCSDELTVY

SEQ ID NO: 515671 - protein, 9 aa, Homo Sapiens
PCAPPLAAP

SEQ ID NO: 515672 - protein, 9 aa, Homo Sapiens
TPWGKRGCK

SEQ ID NO: 515673 - protein, 9 aa, Homo Sapiens
AEDPLTTVQ

SEQ ID NO: 515674 - protein, 9 aa, Homo Sapiens
SIECVDLAG

SEQ ID NO: 515675 - protein, 9 aa, Homo Sapiens
GRRRAFHTC

SEQ ID NO: 515676 - protein, 9 aa, Homo Sapiens
SIQKNILTI

SEQ ID NO: 515677 - protein, 9 aa, Homo Sapiens
QLEQQEQYH

SEQ ID NO: 515678 - protein, 9 aa, Homo Sapiens
LSTPGQRHQ

SEQ ID NO: 515679 - protein, 9 aa, Homo Sapiens
VLGLGPAWS

SEQ ID NO: 515680 - protein, 9 aa, Homo Sapiens
STAKLVVTS

SEQ ID NO: 515681 - protein, 9 aa, Homo Sapiens
YSPEEIVQK

SEQ ID NO: 515682 - protein, 9 aa, Homo Sapiens
GSGDDVKDP

SEQ ID NO: 515683 - protein, 9 aa, Homo Sapiens
FREQGKALV

SEQ ID NO: 515684 - protein, 9 aa, Homo Sapiens
TENIPAGAE

SEQ ID NO: 515685 - protein, 9 aa, Homo Sapiens
LKTTENIPA

SEQ ID NO: 515686 - protein, 9 aa, Homo Sapiens
CPTKCDKCN

SEQ ID NO: 515687 - protein, 9 aa, Homo Sapiens
SRNAQAAAI

SEQ ID NO: 515688 - protein, 9 aa, Homo Sapiens
CGRRKSLFP

SEQ ID NO: 515689 - protein, 9 aa, Homo Sapiens
PPCSPEWGL

SEQ ID NO: 515690 - protein, 9 aa, Homo Sapiens
STRGLLNST

SEQ ID NO: 515691 - protein, 9 aa, Homo Sapiens
ILKNISGSN

SEQ ID NO: 515692 - protein, 9 aa, Homo Sapiens
WKKKLECPN

SEQ ID NO: 515693 - protein, 9 aa, Homo Sapiens
RNLEKLAEG

SEQ ID NO: 515694 - protein, 9 aa, Homo Sapiens
CKEDYEKNK

SEQ ID NO: 515695 - protein, 9 aa, Homo Sapiens
AEYFINLGL

SEQ ID NO: 515696 - protein, 9 aa, Homo Sapiens
DPYMMGLIA

SEQ ID NO: 515697 - protein, 9 aa, Homo Sapiens
LSEMESLKS

SEQ ID NO: 515698 - protein, 9 aa, Homo Sapiens
YLFQWIYQR

SEQ ID NO: 515699 - protein, 9 aa, Homo Sapiens
NLVIFMYVL

SEQ ID NO: 515700 - protein, 9 aa, Homo Sapiens
CATGYYTSG

SEQ ID NO: 515701 - protein, 9 aa, Homo Sapiens
LIELRDFLF

SEQ ID NO: 515702 - protein, 9 aa, Homo Sapiens
EKITSLIVK

SEQ ID NO: 515703 - protein, 9 aa, Homo Sapiens
AEHPGNCLI

SEQ ID NO: 515704 - protein, 9 aa, Homo Sapiens
LLCMGSTLA

SEQ ID NO: 515705 - protein, 9 aa, Homo Sapiens
WVILTLIWF

SEQ ID NO: 515706 - protein, 9 aa, Homo Sapiens
SSSCGYGHG

SEQ ID NO: 515707 - protein, 9 aa, Homo Sapiens
LMGLDGIVL

SEQ ID NO: 515708 - protein, 9 aa, Homo Sapiens
EYGILDNMR

SEQ ID NO: 515709 - protein, 9 aa, Homo Sapiens
KLLFSFGLT

SEQ ID NO: 515710 - protein, 9 aa, Homo Sapiens
TITGNVVII

SEQ ID NO: 515711 - protein, 9 aa, Homo Sapiens
SYSYQFTSP

SEQ ID NO: 515712 - protein, 9 aa, Homo Sapiens
STNLEDSAM

SEQ ID NO: 515713 - protein, 9 aa, Homo Sapiens
QEMVLLVPT

SEQ ID NO: 515714 - protein, 9 aa, Homo Sapiens
IHLLCMGST

SEQ ID NO: 515715 - protein, 9 aa, Homo Sapiens
LTLIWFLAA

SEQ ID NO: 515716 - protein, 9 aa, Homo Sapiens
RIVGGSKAQ

SEQ ID NO: 515717 - protein, 9 aa, Homo Sapiens
QWIYQRRGL

SEQ ID NO: 515718 - protein, 9 aa, Homo Sapiens
ARNLFVKSE

SEQ ID NO: 515719 - protein, 9 aa, Homo Sapiens
KHEKNPKVH

SEQ ID NO: 515720 - protein, 9 aa, Homo Sapiens
LSPLGYGYV

SEQ ID NO: 515721 - protein, 9 aa, Homo Sapiens
QKLYSIAII

SEQ ID NO: 515722 - protein, 9 aa, Homo Sapiens
DIYHSRLNE

SEQ ID NO: 515723 - protein, 9 aa, Homo Sapiens
SAGKTSLLF

SEQ ID NO: 515724 - protein, 9 aa, Homo Sapiens
TSDLMSPAN

SEQ ID NO: 515725 - protein, 9 aa, Homo Sapiens
MYTQAVQNN

SEQ ID NO: 515726 - protein, 9 aa, Homo Sapiens
YAQAAYQGG

SEQ ID NO: 515727 - protein, 9 aa, Homo Sapiens
TTNAVAILF

SEQ ID NO: 515728 - protein, 9 aa, Homo Sapiens
LGEHQLLLF

SEQ ID NO: 515729 - protein, 9 aa, Homo Sapiens
TAPQPFISR

SEQ ID NO: 515730 - protein, 9 aa, Homo Sapiens
AVATVVAAI

SEQ ID NO: 515731 - protein, 9 aa, Homo Sapiens
KIRYTEGRQ

SEQ ID NO: 515732 - protein, 9 aa, Homo Sapiens
FLNGTYHAT

SEQ ID NO: 515733 - protein, 9 aa, Homo Sapiens
CIVNDKHFV

SEQ ID NO: 515734 - protein, 9 aa, Homo Sapiens
PSGVAAAAP

SEQ ID NO: 515735 - protein, 9 aa, Homo Sapiens
VLCPQPPVQ

SEQ ID NO: 515736 - protein, 9 aa, Homo Sapiens
GARRSRRTQ

SEQ ID NO: 515737 - protein, 9 aa, Homo Sapiens
RRCSRHAPP

SEQ ID NO: 515738 - protein, 9 aa, Homo Sapiens
ERIEELEDL

SEQ ID NO: 515739 - protein, 9 aa, Homo Sapiens
GRLEPSPAA

SEQ ID NO: 515740 - protein, 9 aa, Homo Sapiens
LRLRGLCPL

SEQ ID NO: 515741 - protein, 9 aa, Homo Sapiens
HKEVFFLIH

SEQ ID NO: 515742 - protein, 9 aa, Homo Sapiens
LLLLLIIII

SEQ ID NO: 515743 - protein, 9 aa, Homo Sapiens
APPSTTGVL

SEQ ID NO: 515744 - protein, 9 aa, Homo Sapiens
EGSRIEDGV

SEQ ID NO: 515745 - protein, 9 aa, Homo Sapiens
DRSEWGLGL

SEQ ID NO: 515746 - protein, 9 aa, Homo Sapiens
KDKLLFSFG

SEQ ID NO: 515747 - protein, 9 aa, Homo Sapiens
VSMTLGLHR

SEQ ID NO: 515748 - protein, 9 aa, Homo Sapiens
TLLDLCLNQ

SEQ ID NO: 515749 - protein, 9 aa, Homo Sapiens
DGFLDFYLI

SEQ ID NO: 515750 - protein, 9 aa, Homo Sapiens
STSENILQL

SEQ ID NO: 515751 - protein, 9 aa, Homo Sapiens
YSDKHGRFG

SEQ ID NO: 515752 - protein, 9 aa, Homo Sapiens
ADDEGGPDL

SEQ ID NO: 515753 - protein, 9 aa, Homo Sapiens
IPAGAEEIS

SEQ ID NO: 515754 - protein, 9 aa, Homo Sapiens
SVLGLGPAW

SEQ ID NO: 515755 - protein, 9 aa, Homo Sapiens
GFRAQDRAP

SEQ ID NO: 515756 - protein, 9 aa, Homo Sapiens
GTLPKIAEE

SEQ ID NO: 515757 - protein, 9 aa, Homo Sapiens
QPPPSYPLT

SEQ ID NO: 515758 - protein, 9 aa, Homo Sapiens
FQWIYQRRG

SEQ ID NO: 515759 - protein, 9 aa, Homo Sapiens
SSSNNGFKI

SEQ ID NO: 515760 - protein, 9 aa, Homo Sapiens
LSLLLDQRL

SEQ ID NO: 515761 - protein, 9 aa, Homo Sapiens
EKLKRCTLC

SEQ ID NO: 515762 - protein, 9 aa, Homo Sapiens
AMAETVASE

SEQ ID NO: 515763 - protein, 9 aa, Homo Sapiens
LQRLMISNS

SEQ ID NO: 515764 - protein, 9 aa, Homo Sapiens
LADCFGANR

SEQ ID NO: 515765 - protein, 9 aa, Homo Sapiens
VLHSSMVCK

SEQ ID NO: 515766 - protein, 9 aa, Homo Sapiens
DNEYKKDSA

SEQ ID NO: 515767 - protein, 9 aa, Homo Sapiens
HLRRETEKE

SEQ ID NO: 515768 - protein, 9 aa, Homo Sapiens
ILDDRQRKY

SEQ ID NO: 515769 - protein, 9 aa, Homo Sapiens
CQFYRTRIT

SEQ ID NO: 515770 - protein, 9 aa, Homo Sapiens
FKPRFPRDQ

SEQ ID NO: 515771 - protein, 9 aa, Homo Sapiens
DSTPPPGTP

SEQ ID NO: 515772 - protein, 9 aa, Homo Sapiens
TISECPVPS

SEQ ID NO: 515773 - protein, 9 aa, Homo Sapiens
SVDVIISDI

SEQ ID NO: 515774 - protein, 9 aa, Homo Sapiens
GTPSNGKKL

SEQ ID NO: 515775 - protein, 9 aa, Homo Sapiens
HEDGALFGS

SEQ ID NO: 515776 - protein, 9 aa, Homo Sapiens
QRLSPKLVL

SEQ ID NO: 515777 - protein, 9 aa, Homo Sapiens
GAAVREQNE

SEQ ID NO: 515778 - protein, 9 aa, Homo Sapiens
YSISVLEEK

SEQ ID NO: 515779 - protein, 9 aa, Homo Sapiens
DVKDPRRPK

SEQ ID NO: 515780 - protein, 9 aa, Homo Sapiens
YGAFFKLST

SEQ ID NO: 515781 - protein, 9 aa, Homo Sapiens
EGLHLWTGH

SEQ ID NO: 515782 - protein, 9 aa, Homo Sapiens
NTFRTNNIR

SEQ ID NO: 515783 - protein, 9 aa, Homo Sapiens
WVGVGKLRE

SEQ ID NO: 515784 - protein, 9 aa, Homo Sapiens
VNLTCGGKR

SEQ ID NO: 515785 - protein, 9 aa, Homo Sapiens
FYTIMPIPA

SEQ ID NO: 515786 - protein, 9 aa, Homo Sapiens
SFFNRSVRR

SEQ ID NO: 515787 - protein, 9 aa, Homo Sapiens
RMWGAHIFC

SEQ ID NO: 515788 - protein, 9 aa, Homo Sapiens
EVPHEYVKE

SEQ ID NO: 515789 - protein, 9 aa, Homo Sapiens
KTQMFFRFI

SEQ ID NO: 515790 - protein, 9 aa, Homo Sapiens
HVVQEYLEL

SEQ ID NO: 515791 - protein, 9 aa, Homo Sapiens
PQAVFCPVG

SEQ ID NO: 515792 - protein, 9 aa, Homo Sapiens
KGTLPKIAE

SEQ ID NO: 515793 - protein, 9 aa, Homo Sapiens
GISDETLKL

SEQ ID NO: 515794 - protein, 9 aa, Homo Sapiens
GALDHAQTS

SEQ ID NO: 515795 - protein, 9 aa, Homo Sapiens
WPRAGKERK

SEQ ID NO: 515796 - protein, 9 aa, Homo Sapiens
IFMYVLEHL

SEQ ID NO: 515797 - protein, 9 aa, Homo Sapiens
CYVLEEAWC

SEQ ID NO: 515798 - protein, 9 aa, Homo Sapiens
LSGDVLCLC

SEQ ID NO: 515799 - protein, 9 aa, Homo Sapiens
VEYLVPTSL

SEQ ID NO: 515800 - protein, 9 aa, Homo Sapiens
RKSHRHSHH

SEQ ID NO: 515801 - protein, 9 aa, Homo Sapiens
LLFQPRQPN

SEQ ID NO: 515802 - protein, 9 aa, Homo Sapiens
EEMLEGLRT

SEQ ID NO: 515803 - protein, 9 aa, Homo Sapiens
FHAWTEVHA

SEQ ID NO: 515804 - protein, 9 aa, Homo Sapiens
PVKSHSDAV

SEQ ID NO: 515805 - protein, 9 aa, Homo Sapiens
VCCLGSGPV

SEQ ID NO: 515806 - protein, 9 aa, Homo Sapiens
SCGGGRKGA

SEQ ID NO: 515807 - protein, 9 aa, Homo Sapiens
ALLRVQKYS

SEQ ID NO: 515808 - protein, 9 aa, Homo Sapiens
MSISNGKSV

SEQ ID NO: 515809 - protein, 9 aa, Homo Sapiens
STPGQRHQL

SEQ ID NO: 515810 - protein, 9 aa, Homo Sapiens
PPQPSAYLP

SEQ ID NO: 515811 - protein, 9 aa, Homo Sapiens
AALLRVQKY

SEQ ID NO: 515812 - protein, 9 aa, Homo Sapiens
AHNRGRKIA

SEQ ID NO: 515813 - protein, 9 aa, Homo Sapiens
GNCLIFKAT

SEQ ID NO: 515814 - protein, 9 aa, Homo Sapiens
AHLTHPELK

SEQ ID NO: 515815 - protein, 9 aa, Homo Sapiens
LMSPANVAL

SEQ ID NO: 515816 - protein, 9 aa, Homo Sapiens
KDLEDMNQK

SEQ ID NO: 515817 - protein, 9 aa, Homo Sapiens
IHSYPEGTC

SEQ ID NO: 515818 - protein, 9 aa, Homo Sapiens
GVQRVPQAV

SEQ ID NO: 515819 - protein, 9 aa, Homo Sapiens
SPYVGAASA

SEQ ID NO: 515820 - protein, 9 aa, Homo Sapiens
RYTEGRQKA

SEQ ID NO: 515821 - protein, 9 aa, Homo Sapiens
PAGAEEISE

SEQ ID NO: 515822 - protein, 9 aa, Homo Sapiens
GSQIVAMNF

SEQ ID NO: 515823 - protein, 9 aa, Homo Sapiens
GMFELIPDI

SEQ ID NO: 515824 - protein, 9 aa, Homo Sapiens
NESHENCDF

SEQ ID NO: 515825 - protein, 9 aa, Homo Sapiens
TLKIRSTNL

SEQ ID NO: 515826 - protein, 9 aa, Homo Sapiens
QGGEETSCA

SEQ ID NO: 515827 - protein, 9 aa, Homo Sapiens
FLIVSLAVA

SEQ ID NO: 515828 - protein, 9 aa, Homo Sapiens
DFMLFVCLA

SEQ ID NO: 515829 - protein, 9 aa, Homo Sapiens
INLVFIALF

SEQ ID NO: 515830 - protein, 9 aa, Homo Sapiens
TTTDVSRTE

SEQ ID NO: 515831 - protein, 9 aa, Homo Sapiens
TTGVLLYHT

SEQ ID NO: 515832 - protein, 9 aa, Homo Sapiens
SWMIVSINS

SEQ ID NO: 515833 - protein, 9 aa, Homo Sapiens
LRGLCPLLL

SEQ ID NO: 515834 - protein, 9 aa, Homo Sapiens
PEGPDLSNC

SEQ ID NO: 515835 - protein, 9 aa, Homo Sapiens
GAFFKLSTP

SEQ ID NO: 515836 - protein, 9 aa, Homo Sapiens
RALNDVAAP

SEQ ID NO: 515837 - protein, 9 aa, Homo Sapiens
QPPGSDPEL

SEQ ID NO: 515838 - protein, 9 aa, Homo Sapiens
GRSNLQALG

SEQ ID NO: 515839 - protein, 9 aa, Homo Sapiens
QGGGGGGLA

SEQ ID NO: 515840 - protein, 9 aa, Homo Sapiens
IWFLAAGLK

SEQ ID NO: 515841 - protein, 9 aa, Homo Sapiens
TSCEQMQPP

SEQ ID NO: 515842 - protein, 9 aa, Homo Sapiens
RAPLPPAAG

SEQ ID NO: 515843 - protein, 9 aa, Homo Sapiens
HLTHPELKA

SEQ ID NO: 515844 - protein, 9 aa, Homo Sapiens
SCTDMSAAE

SEQ ID NO: 515845 - protein, 9 aa, Homo Sapiens
ESVDVIISD

SEQ ID NO: 515846 - protein, 9 aa, Homo Sapiens
EPSPRDRDY

SEQ ID NO: 515847 - protein, 9 aa, Homo Sapiens
MNPKLGEKE

SEQ ID NO: 515848 - protein, 9 aa, Homo Sapiens
HGLSSSGVG

SEQ ID NO: 515849 - protein, 9 aa, Homo Sapiens
TYAESRNAQ

SEQ ID NO: 515850 - protein, 9 aa, Homo Sapiens
AGMEDSPDS

SEQ ID NO: 515851 - protein, 9 aa, Homo Sapiens
IILAVINFT

SEQ ID NO: 515852 - protein, 9 aa, Homo Sapiens
YRSGSYRPH

SEQ ID NO: 515853 - protein, 9 aa, Homo Sapiens
DDEGGPDLE

SEQ ID NO: 515854 - protein, 9 aa, Homo Sapiens
RQMLPHVEG

SEQ ID NO: 515855 - protein, 9 aa, Homo Sapiens
PMELGQASR

SEQ ID NO: 515856 - protein, 9 aa, Homo Sapiens
KKKLECPNR

SEQ ID NO: 515857 - protein, 9 aa, Homo Sapiens
SVVHAIQAT

SEQ ID NO: 515858 - protein, 9 aa, Homo Sapiens
KEELLQDLC

SEQ ID NO: 515859 - protein, 9 aa, Homo Sapiens
FRFKLIYNE

SEQ ID NO: 515860 - protein, 9 aa, Homo Sapiens
VGVGKLRES

SEQ ID NO: 515861 - protein, 9 aa, Homo Sapiens
QNMTTTNAV

SEQ ID NO: 515862 - protein, 9 aa, Homo Sapiens
RDQPAALVP

SEQ ID NO: 515863 - protein, 9 aa, Homo Sapiens
TSCAQQVEG

SEQ ID NO: 515864 - protein, 9 aa, Homo Sapiens
SVTTVHWEN

SEQ ID NO: 515865 - protein, 9 aa, Homo Sapiens
SRRCSRHAP

SEQ ID NO: 515866 - protein, 9 aa, Homo Sapiens
RYLFQWIYQ

SEQ ID NO: 515867 - protein, 9 aa, Homo Sapiens
VLSGLASRN

SEQ ID NO: 515868 - protein, 9 aa, Homo Sapiens
VKCQGAYSP

SEQ ID NO: 515869 - protein, 9 aa, Homo Sapiens
TEFVATKSY

SEQ ID NO: 515870 - protein, 9 aa, Homo Sapiens
CTLCYRVGY

SEQ ID NO: 515871 - protein, 9 aa, Homo Sapiens
GKLRESMIQ

SEQ ID NO: 515872 - protein, 9 aa, Homo Sapiens
VDVIISDIP

SEQ ID NO: 515873 - protein, 9 aa, Homo Sapiens
TNNIRIQSR

SEQ ID NO: 515874 - protein, 9 aa, Homo Sapiens
TCAGPLARA

SEQ ID NO: 515875 - protein, 9 aa, Homo Sapiens
AAIPGLRVQ

SEQ ID NO: 515876 - protein, 9 aa, Homo Sapiens
KRMSYIVGK

SEQ ID NO: 515877 - protein, 9 aa, Homo Sapiens
EIKNITTTL

SEQ ID NO: 515878 - protein, 9 aa, Homo Sapiens
GGKQSRKIR

SEQ ID NO: 515879 - protein, 9 aa, Homo Sapiens
GSYRPHTEV

SEQ ID NO: 515880 - protein, 9 aa, Homo Sapiens
ICPQDSLRG

SEQ ID NO: 515881 - protein, 9 aa, Homo Sapiens
PGVMMSHSI

SEQ ID NO: 515882 - protein, 9 aa, Homo Sapiens
KKLKQLNCV

SEQ ID NO: 515883 - protein, 9 aa, Homo Sapiens
QEGPLLLSR

SEQ ID NO: 515884 - protein, 9 aa, Homo Sapiens
MKVVTEEVT

SEQ ID NO: 515885 - protein, 9 aa, Homo Sapiens
ESDEKTCSD

SEQ ID NO: 515886 - protein, 9 aa, Homo Sapiens
EMLEGLRTP

SEQ ID NO: 515887 - protein, 9 aa, Homo Sapiens
EVRESNTVA

SEQ ID NO: 515888 - protein, 9 aa, Homo Sapiens
YLRLRGLCP

SEQ ID NO: 515889 - protein, 9 aa, Homo Sapiens
PPFNQFSPI

SEQ ID NO: 515890 - protein, 9 aa, Homo Sapiens
GKTSLLFRL

SEQ ID NO: 515891 - protein, 9 aa, Homo Sapiens
ADGSDEPDD

SEQ ID NO: 515892 - protein, 9 aa, Homo Sapiens
AMLFIKVKH

SEQ ID NO: 515893 - protein, 9 aa, Homo Sapiens
RLGSVVHAI

SEQ ID NO: 515894 - protein, 9 aa, Homo Sapiens
EELEDLLAK

SEQ ID NO: 515895 - protein, 9 aa, Homo Sapiens
YGILDNMRE

SEQ ID NO: 515896 - protein, 9 aa, Homo Sapiens
IFNETSDHS

SEQ ID NO: 515897 - protein, 9 aa, Homo Sapiens
EKEQEHLVA

SEQ ID NO: 515898 - protein, 9 aa, Homo Sapiens
CESVQKLYS

SEQ ID NO: 515899 - protein, 9 aa, Homo Sapiens
RFSDSEIGC

SEQ ID NO: 515900 - protein, 9 aa, Homo Sapiens
VEIYVLNLA

SEQ ID NO: 515901 - protein, 9 aa, Homo Sapiens
GTCLSQASK

SEQ ID NO: 515902 - protein, 9 aa, Homo Sapiens
GVFQKRTVQ

SEQ ID NO: 515903 - protein, 9 aa, Homo Sapiens
TPGQRHQLW

SEQ ID NO: 515904 - protein, 9 aa, Homo Sapiens
SEEMQPTVE

SEQ ID NO: 515905 - protein, 9 aa, Homo Sapiens
LLELQLEEN

SEQ ID NO: 515906 - protein, 9 aa, Homo Sapiens
QAPKATSRA

SEQ ID NO: 515907 - protein, 9 aa, Homo Sapiens
TRLHKSMVF

SEQ ID NO: 515908 - protein, 9 aa, Homo Sapiens
DLEPDYGTA

SEQ ID NO: 515909 - protein, 9 aa, Homo Sapiens
VLLSRKICW

SEQ ID NO: 515910 - protein, 9 aa, Homo Sapiens
RCGGGKQSR

SEQ ID NO: 515911 - protein, 9 aa, Homo Sapiens
LERIEELED

SEQ ID NO: 515912 - protein, 9 aa, Homo Sapiens
VIFMYVLEH

SEQ ID NO: 515913 - protein, 9 aa, Homo Sapiens
LKTYAESRN

SEQ ID NO: 515914 - protein, 9 aa, Homo Sapiens
VPHEYVKEF

SEQ ID NO: 515915 - protein, 9 aa, Homo Sapiens
NLVFIALFT

SEQ ID NO: 515916 - protein, 9 aa, Homo Sapiens
RECCDYRRE

SEQ ID NO: 515917 - protein, 9 aa, Homo Sapiens
LRRETEKEK

SEQ ID NO: 515918 - protein, 9 aa, Homo Sapiens
DSSAFKHIG

SEQ ID NO: 515919 - protein, 9 aa, Homo Sapiens
WYDAYFIKA

SEQ ID NO: 515920 - protein, 9 aa, Homo Sapiens
KHFVRDTSH

SEQ ID NO: 515921 - protein, 9 aa, Homo Sapiens
GSRRCSRHA

SEQ ID NO: 515922 - protein, 9 aa, Homo Sapiens
LRGISTAPD

SEQ ID NO: 515923 - protein, 9 aa, Homo Sapiens
GTPHAQTSS

SEQ ID NO: 515924 - protein, 9 aa, Homo Sapiens
YRPSELLSG

SEQ ID NO: 515925 - protein, 9 aa, Homo Sapiens
PAWSYPATI

SEQ ID NO: 515926 - protein, 9 aa, Homo Sapiens
FYSISVLEE

SEQ ID NO: 515927 - protein, 9 aa, Homo Sapiens
LLLIIIILT

SEQ ID NO: 515928 - protein, 9 aa, Homo Sapiens
GRETKDLDK

SEQ ID NO: 515929 - protein, 9 aa, Homo Sapiens
VRITYSPEE

SEQ ID NO: 515930 - protein, 9 aa, Homo Sapiens
LKKPSAHMS

SEQ ID NO: 515931 - protein, 9 aa, Homo Sapiens
KIIEDAHNR

SEQ ID NO: 515932 - protein, 9 aa, Homo Sapiens
LDHIGRSLL

SEQ ID NO: 515933 - protein, 9 aa, Homo Sapiens
NNSGSYNRA

SEQ ID NO: 515934 - protein, 9 aa, Homo Sapiens
HGNTALTYD

SEQ ID NO: 515935 - protein, 9 aa, Homo Sapiens
RTRVGSCAP

SEQ ID NO: 515936 - protein, 9 aa, Homo Sapiens
TKGSEPDGD

SEQ ID NO: 515937 - protein, 9 aa, Homo Sapiens
AFNSTGIFN

SEQ ID NO: 515938 - protein, 9 aa, Homo Sapiens
RLGRAELGL

SEQ ID NO: 515939 - protein, 9 aa, Homo Sapiens
LPASLPRLR

SEQ ID NO: 515940 - protein, 9 aa, Homo Sapiens
QAQNFSLHI

SEQ ID NO: 515941 - protein, 9 aa, Homo Sapiens
GVMMSHSIH

SEQ ID NO: 515942 - protein, 9 aa, Homo Sapiens
EGAEDPLTT

SEQ ID NO: 515943 - protein, 9 aa, Homo Sapiens
SEKITSLIV

SEQ ID NO: 515944 - protein, 9 aa, Homo Sapiens
SSVFKTHFI

SEQ ID NO: 515945 - protein, 9 aa, Homo Sapiens
DPEEKLAVS

SEQ ID NO: 515946 - protein, 9 aa, Homo Sapiens
EERVLKDLK

SEQ ID NO: 515947 - protein, 9 aa, Homo Sapiens
AVQNNRVVG

SEQ ID NO: 515948 - protein, 9 aa, Homo Sapiens
ESRNVSSVH

SEQ ID NO: 515949 - protein, 9 aa, Homo Sapiens
DESDEKTCS

SEQ ID NO: 515950 - protein, 9 aa, Homo Sapiens
AKYPRLSEC

SEQ ID NO: 515951 - protein, 9 aa, Homo Sapiens
VKSHSDAVF

SEQ ID NO: 515952 - protein, 9 aa, Homo Sapiens
HENDNAPVF

SEQ ID NO: 515953 - protein, 9 aa, Homo Sapiens
DMDYNWLHH

SEQ ID NO: 515954 - protein, 9 aa, Homo Sapiens
GDHDDFAMK

SEQ ID NO: 515955 - protein, 9 aa, Homo Sapiens
IPGQRVGLL

SEQ ID NO: 515956 - protein, 9 aa, Homo Sapiens
ATGYYTSGG

SEQ ID NO: 515957 - protein, 9 aa, Homo Sapiens
SRVPSQPPS

SEQ ID NO: 515958 - protein, 9 aa, Homo Sapiens
EVHAMREAR

SEQ ID NO: 515959 - protein, 9 aa, Homo Sapiens
SCGGVFQKR

SEQ ID NO: 515960 - protein, 9 aa, Homo Sapiens
SEKSQDPLA

SEQ ID NO: 515961 - protein, 9 aa, Homo Sapiens
KAYWYSSQL

SEQ ID NO: 515962 - protein, 9 aa, Homo Sapiens
ELLLFQVSA

SEQ ID NO: 515963 - protein, 9 aa, Homo Sapiens
HLFRFKLIY

SEQ ID NO: 515964 - protein, 9 aa, Homo Sapiens
HAWTEVHAM

SEQ ID NO: 515965 - protein, 9 aa, Homo Sapiens
EGFLAKTCS

SEQ ID NO: 515966 - protein, 9 aa, Homo Sapiens
LPGTVEYLV

SEQ ID NO: 515967 - protein, 9 aa, Homo Sapiens
KHENDNAPV

SEQ ID NO: 515968 - protein, 9 aa, Homo Sapiens
KEQQEAASS

SEQ ID NO: 515969 - protein, 9 aa, Homo Sapiens
LPPAAGSRR

SEQ ID NO: 515970 - protein, 9 aa, Homo Sapiens
LRQLLEVIL

SEQ ID NO: 515971 - protein, 9 aa, Homo Sapiens
NPGLADCFG

SEQ ID NO: 515972 - protein, 9 aa, Homo Sapiens
ADIGIGTTS

SEQ ID NO: 515973 - protein, 9 aa, Homo Sapiens
LATVRITYS

SEQ ID NO: 515974 - protein, 9 aa, Homo Sapiens
DISLASVSV

SEQ ID NO: 515975 - protein, 9 aa, Homo Sapiens
SRHAPPPTE

SEQ ID NO: 515976 - protein, 9 aa, Homo Sapiens
QTSTTSCEQ

SEQ ID NO: 515977 - protein, 9 aa, Homo Sapiens
AEDPEEKLA

SEQ ID NO: 515978 - protein, 9 aa, Homo Sapiens
SAKSRSQFH

SEQ ID NO: 515979 - protein, 9 aa, Homo Sapiens
LITLFHLFR

SEQ ID NO: 515980 - protein, 9 aa, Homo Sapiens
PHVEGVHLL

SEQ ID NO: 515981 - protein, 9 aa, Homo Sapiens
SRACLERIE

SEQ ID NO: 515982 - protein, 9 aa, Homo Sapiens
FCFHLRRET

SEQ ID NO: 515983 - protein, 9 aa, Homo Sapiens
AVQRADGPY

SEQ ID NO: 515984 - protein, 9 aa, Homo Sapiens
CITIAWKFD

SEQ ID NO: 515985 - protein, 9 aa, Homo Sapiens
FILIGNIPG

SEQ ID NO: 515986 - protein, 9 aa, Homo Sapiens
YLNDISLAS

SEQ ID NO: 515987 - protein, 9 aa, Homo Sapiens
TTAYFFMNP

SEQ ID NO: 515988 - protein, 9 aa, Homo Sapiens
FENGHGLDR

SEQ ID NO: 515989 - protein, 9 aa, Homo Sapiens
ETTAYFFMN

SEQ ID NO: 515990 - protein, 9 aa, Homo Sapiens
RLNERQRRK

SEQ ID NO: 515991 - protein, 9 aa, Homo Sapiens
IAETLWNIQ

SEQ ID NO: 515992 - protein, 9 aa, Homo Sapiens
MLDCCKRLL

SEQ ID NO: 515993 - protein, 9 aa, Homo Sapiens
DEWKKKLEC

SEQ ID NO: 515994 - protein, 9 aa, Homo Sapiens
VQKLYSIAI

SEQ ID NO: 515995 - protein, 9 aa, Homo Sapiens
AYFIKARPY

SEQ ID NO: 515996 - protein, 9 aa, Homo Sapiens
PLHYPVLLS

SEQ ID NO: 515997 - protein, 9 aa, Homo Sapiens
FKHIGTVEC

SEQ ID NO: 515998 - protein, 9 aa, Homo Sapiens
HEELELLLF

SEQ ID NO: 515999 - protein, 9 aa, Homo Sapiens
TLIWFLAAG

SEQ ID NO: 516000 - protein, 9 aa, Homo Sapiens
NFRQWQRFK

SEQ ID NO: 516001 - protein, 9 aa, Homo Sapiens
CSALLNPDL

SEQ ID NO: 516002 - protein, 9 aa, Homo Sapiens
EKKLKQLNC

SEQ ID NO: 516003 - protein, 9 aa, Homo Sapiens
SPTEEEPEY

SEQ ID NO: 516004 - protein, 9 aa, Homo Sapiens
VHAMREARA

SEQ ID NO: 516005 - protein, 9 aa, Homo Sapiens
TGYYTSGGK

SEQ ID NO: 516006 - protein, 9 aa, Homo Sapiens
RVPSSVAHL

SEQ ID NO: 516007 - protein, 9 aa, Homo Sapiens
RSKDHEDGA

SEQ ID NO: 516008 - protein, 9 aa, Homo Sapiens
FCYDQPVLK

SEQ ID NO: 516009 - protein, 9 aa, Homo Sapiens
PGFSGCLCE

SEQ ID NO: 516010 - protein, 9 aa, Homo Sapiens
IALFTGECV

SEQ ID NO: 516011 - protein, 9 aa, Homo Sapiens
TYHATVPEM

SEQ ID NO: 516012 - protein, 9 aa, Homo Sapiens
EPAVAAGVP

SEQ ID NO: 516013 - protein, 9 aa, Homo Sapiens
GPQGRLQRL

SEQ ID NO: 516014 - protein, 9 aa, Homo Sapiens
KFRVFRISH

SEQ ID NO: 516015 - protein, 9 aa, Homo Sapiens
SGLQEWRPE

SEQ ID NO: 516016 - protein, 9 aa, Homo Sapiens
GSKAQPGTW

SEQ ID NO: 516017 - protein, 9 aa, Homo Sapiens
RVLKDLKQL

SEQ ID NO: 516018 - protein, 9 aa, Homo Sapiens
NDISLASVS

SEQ ID NO: 516019 - protein, 9 aa, Homo Sapiens
TVASEFVSS

SEQ ID NO: 516020 - protein, 9 aa, Homo Sapiens
DAQACPLKF

SEQ ID NO: 516021 - protein, 9 aa, Homo Sapiens
CSDESDEKT

SEQ ID NO: 516022 - protein, 9 aa, Homo Sapiens
RFKLIYNEY

SEQ ID NO: 516023 - protein, 9 aa, Homo Sapiens
DAELQHATR

SEQ ID NO: 516024 - protein, 9 aa, Homo Sapiens
SDNEYKKDS

SEQ ID NO: 516025 - protein, 9 aa, Homo Sapiens
LELLLFQVS

SEQ ID NO: 516026 - protein, 9 aa, Homo Sapiens
ARTSSCAER

SEQ ID NO: 516027 - protein, 9 aa, Homo Sapiens
APWAQATSP

SEQ ID NO: 516028 - protein, 9 aa, Homo Sapiens
LCLNQIVLF

SEQ ID NO: 516029 - protein, 9 aa, Homo Sapiens
GSPVLSSEA

SEQ ID NO: 516030 - protein, 9 aa, Homo Sapiens
ASDTFQDSS

SEQ ID NO: 516031 - protein, 9 aa, Homo Sapiens
SGEYECRAL

SEQ ID NO: 516032 - protein, 9 aa, Homo Sapiens
NCYVLEEAW

SEQ ID NO: 516033 - protein, 9 aa, Homo Sapiens
RQPPPSYPL

SEQ ID NO: 516034 - protein, 9 aa, Homo Sapiens
SKERPAEPK

SEQ ID NO: 516035 - protein, 9 aa, Homo Sapiens
GSSEQEGHP

SEQ ID NO: 516036 - protein, 9 aa, Homo Sapiens
SWACASTNA

SEQ ID NO: 516037 - protein, 9 aa, Homo Sapiens
GKKLYTDGA

SEQ ID NO: 516038 - protein, 9 aa, Homo Sapiens
KVIDNLQFG

SEQ ID NO: 516039 - protein, 9 aa, Homo Sapiens
WVSSAYSKT

SEQ ID NO: 516040 - protein, 9 aa, Homo Sapiens
CGDRYAVAF

SEQ ID NO: 516041 - protein, 9 aa, Homo Sapiens
TSGAWSPPY

SEQ ID NO: 516042 - protein, 9 aa, Homo Sapiens
MYLRLRGLC

SEQ ID NO: 516043 - protein, 9 aa, Homo Sapiens
AVRYGRKEG

SEQ ID NO: 516044 - protein, 9 aa, Homo Sapiens
IPIFVYGAA

SEQ ID NO: 516045 - protein, 9 aa, Homo Sapiens
NGHTCGRRK

SEQ ID NO: 516046 - protein, 9 aa, Homo Sapiens
QQEAASSQK

SEQ ID NO: 516047 - protein, 9 aa, Homo Sapiens
GATSNSEDA

SEQ ID NO: 516048 - protein, 9 aa, Homo Sapiens
SSAQLKELE

SEQ ID NO: 516049 - protein, 9 aa, Homo Sapiens
RRRAFHTCA

SEQ ID NO: 516050 - protein, 9 aa, Homo Sapiens
YLECDEILK

SEQ ID NO: 516051 - protein, 9 aa, Homo Sapiens
NADIGIGTT

SEQ ID NO: 516052 - protein, 9 aa, Homo Sapiens
QTQGLKGQR

SEQ ID NO: 516053 - protein, 9 aa, Homo Sapiens
LLHAKSQIL

SEQ ID NO: 516054 - protein, 9 aa, Homo Sapiens
PLPSAPPPS

SEQ ID NO: 516055 - protein, 9 aa, Homo Sapiens
LLLSRCSSL

SEQ ID NO: 516056 - protein, 9 aa, Homo Sapiens
LRYLFQWIY

SEQ ID NO: 516057 - protein, 9 aa, Homo Sapiens
QTYMAFLKS

SEQ ID NO: 516058 - protein, 9 aa, Homo Sapiens
DASPMKRFI

SEQ ID NO: 516059 - protein, 9 aa, Homo Sapiens
LALARSTPG

SEQ ID NO: 516060 - protein, 9 aa, Homo Sapiens
MSAAELTDF

SEQ ID NO: 516061 - protein, 9 aa, Homo Sapiens
PTIDDRDLS

SEQ ID NO: 516062 - protein, 9 aa, Homo Sapiens
CLTITGNVV

SEQ ID NO: 516063 - protein, 9 aa, Homo Sapiens
DPLPPEEIL

SEQ ID NO: 516064 - protein, 9 aa, Homo Sapiens
RDESHYFTS

SEQ ID NO: 516065 - protein, 9 aa, Homo Sapiens
PPGRLEPSP

SEQ ID NO: 516066 - protein, 9 aa, Homo Sapiens
ASRSASKKG

SEQ ID NO: 516067 - protein, 9 aa, Homo Sapiens
MNLYPIYVE

SEQ ID NO: 516068 - protein, 9 aa, Homo Sapiens
FTTDNSSSN

SEQ ID NO: 516069 - protein, 9 aa, Homo Sapiens
ERPAEPKAR

SEQ ID NO: 516070 - protein, 9 aa, Homo Sapiens
TEELAAATS

SEQ ID NO: 516071 - protein, 9 aa, Homo Sapiens
GKQSRKIRC

SEQ ID NO: 516072 - protein, 9 aa, Homo Sapiens
LDGGSPLGL

SEQ ID NO: 516073 - protein, 9 aa, Homo Sapiens
GSYSYQFTS

SEQ ID NO: 516074 - protein, 9 aa, Homo Sapiens
PAGYFIPIF

SEQ ID NO: 516075 - protein, 9 aa, Homo Sapiens
ETSVEIDES

SEQ ID NO: 516076 - protein, 9 aa, Homo Sapiens
STLGIIPPA

SEQ ID NO: 516077 - protein, 9 aa, Homo Sapiens
DRFWPIIQI

SEQ ID NO: 516078 - protein, 9 aa, Homo Sapiens
GSEEVRESN

SEQ ID NO: 516079 - protein, 9 aa, Homo Sapiens
RLFVAVMPY

SEQ ID NO: 516080 - protein, 9 aa, Homo Sapiens
CECMSSYFR

SEQ ID NO: 516081 - protein, 9 aa, Homo Sapiens
QMQSLSRLR

SEQ ID NO: 516082 - protein, 9 aa, Homo Sapiens
VIKPQRKIT

SEQ ID NO: 516083 - protein, 9 aa, Homo Sapiens
NYSLQIYRD

SEQ ID NO: 516084 - protein, 9 aa, Homo Sapiens
ALVLVIGTG

SEQ ID NO: 516085 - protein, 9 aa, Homo Sapiens
MARLSRDPD

SEQ ID NO: 516086 - protein, 9 aa, Homo Sapiens
NVSSVHRDF

SEQ ID NO: 516087 - protein, 9 aa, Homo Sapiens
GSHMLVVTI

SEQ ID NO: 516088 - protein, 9 aa, Homo Sapiens
KSEGSRIED

SEQ ID NO: 516089 - protein, 9 aa, Homo Sapiens
WEVSPTDRR

SEQ ID NO: 516090 - protein, 9 aa, Homo Sapiens
KGSEPDGDG

SEQ ID NO: 516091 - protein, 9 aa, Homo Sapiens
DQSGEYECR

SEQ ID NO: 516092 - protein, 9 aa, Homo Sapiens
IQKNILTIK

SEQ ID NO: 516093 - protein, 9 aa, Homo Sapiens
HAGEEHYKC

SEQ ID NO: 516094 - protein, 9 aa, Homo Sapiens
DTIENMKAK

SEQ ID NO: 516095 - protein, 9 aa, Homo Sapiens
MELGQASRS

SEQ ID NO: 516096 - protein, 9 aa, Homo Sapiens
VRYSPHISD

SEQ ID NO: 516097 - protein, 9 aa, Homo Sapiens
SNGKKLEYD

SEQ ID NO: 516098 - protein, 9 aa, Homo Sapiens
YASRVPSQP

SEQ ID NO: 516099 - protein, 9 aa, Homo Sapiens
LGSPGAVRT

SEQ ID NO: 516100 - protein, 9 aa, Homo Sapiens
SLGSFFIDI

SEQ ID NO: 516101 - protein, 9 aa, Homo Sapiens
AGPLARASS

SEQ ID NO: 516102 - protein, 9 aa, Homo Sapiens
LLRKKLEKE

SEQ ID NO: 516103 - protein, 9 aa, Homo Sapiens
NGSRSPPGR

SEQ ID NO: 516104 - protein, 9 aa, Homo Sapiens
SVHRDFRLW

SEQ ID NO: 516105 - protein, 9 aa, Homo Sapiens
EMESLKSKV

SEQ ID NO: 516106 - protein, 9 aa, Homo Sapiens
DYSGPSIEF

SEQ ID NO: 516107 - protein, 9 aa, Homo Sapiens
FRLGSVVHA

SEQ ID NO: 516108 - protein, 9 aa, Homo Sapiens
LNLTHLYLN

SEQ ID NO: 516109 - protein, 9 aa, Homo Sapiens
LCPGRYLRA

SEQ ID NO: 516110 - protein, 9 aa, Homo Sapiens
YFLQSPTEE

SEQ ID NO: 516111 - protein, 9 aa, Homo Sapiens
PFNQFSPIS

SEQ ID NO: 516112 - protein, 9 aa, Homo Sapiens
EVNAARRRV

SEQ ID NO: 516113 - protein, 9 aa, Homo Sapiens
SLKTKKPRA

SEQ ID NO: 516114 - protein, 9 aa, Homo Sapiens
APCGQAVRY

SEQ ID NO: 516115 - protein, 9 aa, Homo Sapiens
RSKSKERPA

SEQ ID NO: 516116 - protein, 9 aa, Homo Sapiens
ARTVSFADV

SEQ ID NO: 516117 - protein, 9 aa, Homo Sapiens
KYPRLSECS

SEQ ID NO: 516118 - protein, 9 aa, Homo Sapiens
HHGRSNLQA

SEQ ID NO: 516119 - protein, 9 aa, Homo Sapiens
HKEIVSLGD

SEQ ID NO: 516120 - protein, 9 aa, Homo Sapiens
TSPISPGST

SEQ ID NO: 516121 - protein, 9 aa, Homo Sapiens
CPNREIIIL

SEQ ID NO: 516122 - protein, 9 aa, Homo Sapiens
KPRWVASYK

SEQ ID NO: 516123 - protein, 9 aa, Homo Sapiens
TITSVAEAN

SEQ ID NO: 516124 - protein, 9 aa, Homo Sapiens
LHKSMVFLE

SEQ ID NO: 516125 - protein, 9 aa, Homo Sapiens
HHFFCYDQP

SEQ ID NO: 516126 - protein, 9 aa, Homo Sapiens
RCARGCSTG

SEQ ID NO: 516127 - protein, 9 aa, Homo Sapiens
NILGHPKRY

SEQ ID NO: 516128 - protein, 9 aa, Homo Sapiens
KTTENIPAG

SEQ ID NO: 516129 - protein, 9 aa, Homo Sapiens
YKCKVPNKA

SEQ ID NO: 516130 - protein, 9 aa, Homo Sapiens
TITRLHKSM

SEQ ID NO: 516131 - protein, 9 aa, Homo Sapiens
RTSRSLSGS

SEQ ID NO: 516132 - protein, 9 aa, Homo Sapiens
DEKTCSDEL

SEQ ID NO: 516133 - protein, 9 aa, Homo Sapiens
EPRSAACLD

SEQ ID NO: 516134 - protein, 9 aa, Homo Sapiens
TRITCIGAQ

SEQ ID NO: 516135 - protein, 9 aa, Homo Sapiens
SVHFNRFNP

SEQ ID NO: 516136 - protein, 9 aa, Homo Sapiens
PSDTIENMK

SEQ ID NO: 516137 - protein, 9 aa, Homo Sapiens
CEQMQPPMF

SEQ ID NO: 516138 - protein, 9 aa, Homo Sapiens
INSDPDMVD

SEQ ID NO: 516139 - protein, 9 aa, Homo Sapiens
LYSYGFEGL

SEQ ID NO: 516140 - protein, 9 aa, Homo Sapiens
PASLPRLRL

SEQ ID NO: 516141 - protein, 9 aa, Homo Sapiens
VMAVDRYEA

SEQ ID NO: 516142 - protein, 9 aa, Homo Sapiens
YSGPSIEFF

SEQ ID NO: 516143 - protein, 9 aa, Homo Sapiens
ATSRASVGA

SEQ ID NO: 516144 - protein, 9 aa, Homo Sapiens
GRSLLELQL

SEQ ID NO: 516145 - protein, 9 aa, Homo Sapiens
GKSLGSFFI

SEQ ID NO: 516146 - protein, 9 aa, Homo Sapiens
DKHGRFGIP

SEQ ID NO: 516147 - protein, 9 aa, Homo Sapiens
PRGAAPPGH

SEQ ID NO: 516148 - protein, 9 aa, Homo Sapiens
WQRFKALAR

SEQ ID NO: 516149 - protein, 9 aa, Homo Sapiens
TNAVAILFY

SEQ ID NO: 516150 - protein, 9 aa, Homo Sapiens
LDKMDDDDD

SEQ ID NO: 516151 - protein, 9 aa, Homo Sapiens
AEPAVAAGV

SEQ ID NO: 516152 - protein, 9 aa, Homo Sapiens
PSDLGYAWN

SEQ ID NO: 516153 - protein, 9 aa, Homo Sapiens
QPPSDLGYA

SEQ ID NO: 516154 - protein, 9 aa, Homo Sapiens
GEVNAARRR

SEQ ID NO: 516155 - protein, 9 aa, Homo Sapiens
FELIPDIVL

SEQ ID NO: 516156 - protein, 9 aa, Homo Sapiens
TPSNGKKLE

SEQ ID NO: 516157 - protein, 9 aa, Homo Sapiens
LLLLIIIIL

SEQ ID NO: 516158 - protein, 9 aa, Homo Sapiens
PWGKRGCKM

SEQ ID NO: 516159 - protein, 9 aa, Homo Sapiens
TAGQPHPSI

SEQ ID NO: 516160 - protein, 9 aa, Homo Sapiens
PDPQWKTQF

SEQ ID NO: 516161 - protein, 9 aa, Homo Sapiens
HDPTKGSEP

SEQ ID NO: 516162 - protein, 9 aa, Homo Sapiens
HANPGLADC

SEQ ID NO: 516163 - protein, 9 aa, Homo Sapiens
MDAQACPLK

SEQ ID NO: 516164 - protein, 9 aa, Homo Sapiens
RGISTAPDR

SEQ ID NO: 516165 - protein, 9 aa, Homo Sapiens
STAGQPHPS

SEQ ID NO: 516166 - protein, 9 aa, Homo Sapiens
GRCPEPPSA

SEQ ID NO: 516167 - protein, 9 aa, Homo Sapiens
LPQNMTTTN

SEQ ID NO: 516168 - protein, 9 aa, Homo Sapiens
SGGKKTEEV

SEQ ID NO: 516169 - protein, 9 aa, Homo Sapiens
PRFPRDQVV

SEQ ID NO: 516170 - protein, 9 aa, Homo Sapiens
AAPCGQAVR

SEQ ID NO: 516171 - protein, 9 aa, Homo Sapiens
GLSSSGVGI

SEQ ID NO: 516172 - protein, 9 aa, Homo Sapiens
TFRERTKRH

SEQ ID NO: 516173 - protein, 9 aa, Homo Sapiens
LDCCKRLLE

SEQ ID NO: 516174 - protein, 9 aa, Homo Sapiens
EEQEPSPRD

SEQ ID NO: 516175 - protein, 9 aa, Homo Sapiens
QGLLNCPIY

SEQ ID NO: 516176 - protein, 9 aa, Homo Sapiens
NLTCGGKRK

SEQ ID NO: 516177 - protein, 9 aa, Homo Sapiens
LKPQRKGTL

SEQ ID NO: 516178 - protein, 9 aa, Homo Sapiens
LNDISLASV

SEQ ID NO: 516179 - protein, 9 aa, Homo Sapiens
PRSAACLDL

SEQ ID NO: 516180 - protein, 9 aa, Homo Sapiens
LQKQKSLSN

SEQ ID NO: 516181 - protein, 9 aa, Homo Sapiens
DINICPQDS

SEQ ID NO: 516182 - protein, 9 aa, Homo Sapiens
KPRFPRDQV

SEQ ID NO: 516183 - protein, 9 aa, Homo Sapiens
EHQLLLFVI

SEQ ID NO: 516184 - protein, 9 aa, Homo Sapiens
DNLQFGRRP

SEQ ID NO: 516185 - protein, 9 aa, Homo Sapiens
SEGSRIEDG

SEQ ID NO: 516186 - protein, 9 aa, Homo Sapiens
GSTRGLLNS

SEQ ID NO: 516187 - protein, 9 aa, Homo Sapiens
GGSKAQPGT

SEQ ID NO: 516188 - protein, 9 aa, Homo Sapiens
VSGKMSSVF

SEQ ID NO: 516189 - protein, 9 aa, Homo Sapiens
DSLRGSIVG

SEQ ID NO: 516190 - protein, 9 aa, Homo Sapiens
KSTSGSYSY

SEQ ID NO: 516191 - protein, 9 aa, Homo Sapiens
STAYRPSEL

SEQ ID NO: 516192 - protein, 9 aa, Homo Sapiens
FCVIKPQRK

SEQ ID NO: 516193 - protein, 9 aa, Homo Sapiens
GGEETSCAQ

SEQ ID NO: 516194 - protein, 9 aa, Homo Sapiens
NLFVKSEGS

SEQ ID NO: 516195 - protein, 9 aa, Homo Sapiens
LPADTFRGL

SEQ ID NO: 516196 - protein, 9 aa, Homo Sapiens
FIALFTGEC

SEQ ID NO: 516197 - protein, 9 aa, Homo Sapiens
RTNNIRIQS

SEQ ID NO: 516198 - protein, 9 aa, Homo Sapiens
PVLGSGAAP

SEQ ID NO: 516199 - protein, 9 aa, Homo Sapiens
RFKALARRH

SEQ ID NO: 516200 - protein, 9 aa, Homo Sapiens
RYEYGILDN

SEQ ID NO: 516201 - protein, 9 aa, Homo Sapiens
RLQAQTQGL

SEQ ID NO: 516202 - protein, 9 aa, Homo Sapiens
RSDQDYVDG

SEQ ID NO: 516203 - protein, 9 aa, Homo Sapiens
DPLALARST

SEQ ID NO: 516204 - protein, 9 aa, Homo Sapiens
PTEPSGLQE

SEQ ID NO: 516205 - protein, 9 aa, Homo Sapiens
NPPLPPTID

SEQ ID NO: 516206 - protein, 9 aa, Homo Sapiens
RTMGAIDFL

SEQ ID NO: 516207 - protein, 9 aa, Homo Sapiens
SENPQESLH

SEQ ID NO: 516208 - protein, 9 aa, Homo Sapiens
SVAEANEVD

SEQ ID NO: 516209 - protein, 9 aa, Homo Sapiens
VTVKCQGAY

SEQ ID NO: 516210 - protein, 9 aa, Homo Sapiens
VIKKSIFRI

SEQ ID NO: 516211 - protein, 9 aa, Homo Sapiens
ILSLTPFVF

SEQ ID NO: 516212 - protein, 9 aa, Homo Sapiens
CGKALRRSL

SEQ ID NO: 516213 - protein, 9 aa, Homo Sapiens
DTSDLMSPA

SEQ ID NO: 516214 - protein, 9 aa, Homo Sapiens
ENMKAKIQD

SEQ ID NO: 516215 - protein, 9 aa, Homo Sapiens
PSESVDVII

SEQ ID NO: 516216 - protein, 9 aa, Homo Sapiens
VAAAAPRRG

SEQ ID NO: 516217 - protein, 9 aa, Homo Sapiens
KRHEMQILS

SEQ ID NO: 516218 - protein, 9 aa, Homo Sapiens
RFISTLAQR

SEQ ID NO: 516219 - protein, 9 aa, Homo Sapiens
AAEEAGMED

SEQ ID NO: 516220 - protein, 9 aa, Homo Sapiens
IDNLQFGRR

SEQ ID NO: 516221 - protein, 9 aa, Homo Sapiens
SIIPGQRVG

SEQ ID NO: 516222 - protein, 9 aa, Homo Sapiens
YISVVDTMK

SEQ ID NO: 516223 - protein, 9 aa, Homo Sapiens
GAEDPLTTV

SEQ ID NO: 516224 - protein, 9 aa, Homo Sapiens
AFKPRFPRD

SEQ ID NO: 516225 - protein, 9 aa, Homo Sapiens
SDKHGRFGI

SEQ ID NO: 516226 - protein, 9 aa, Homo Sapiens
LAAEEAGME

SEQ ID NO: 516227 - protein, 9 aa, Homo Sapiens
TGVLLYHTA

SEQ ID NO: 516228 - protein, 9 aa, Homo Sapiens
HRWIANIDD

SEQ ID NO: 516229 - protein, 9 aa, Homo Sapiens
DVLCLCPGR

SEQ ID NO: 516230 - protein, 9 aa, Homo Sapiens
YFYLNDISL

SEQ ID NO: 516231 - protein, 9 aa, Homo Sapiens
KPQRPRSAA

SEQ ID NO: 516232 - protein, 9 aa, Homo Sapiens
ELLLFQPRQ

SEQ ID NO: 516233 - protein, 9 aa, Homo Sapiens
YWYSSQLIQ

SEQ ID NO: 516234 - protein, 9 aa, Homo Sapiens
SCDCIGRLE

SEQ ID NO: 516235 - protein, 9 aa, Homo Sapiens
IQMICNVTG

SEQ ID NO: 516236 - protein, 9 aa, Homo Sapiens
LHAKSQILF

SEQ ID NO: 516237 - protein, 9 aa, Homo Sapiens
CEECGKALR

SEQ ID NO: 516238 - protein, 9 aa, Homo Sapiens
FEKTIAEPA

SEQ ID NO: 516239 - protein, 9 aa, Homo Sapiens
RSRKGNTHV

SEQ ID NO: 516240 - protein, 9 aa, Homo Sapiens
ELWSCGGGR

SEQ ID NO: 516241 - protein, 9 aa, Homo Sapiens
VDTMKVVTE

SEQ ID NO: 516242 - protein, 9 aa, Homo Sapiens
TGTWNPEGP

SEQ ID NO: 516243 - protein, 9 aa, Homo Sapiens
PSPRDRDYF

SEQ ID NO: 516244 - protein, 9 aa, Homo Sapiens
SLSGSPGSS

SEQ ID NO: 516245 - protein, 9 aa, Homo Sapiens
LLVPTGGGG

SEQ ID NO: 516246 - protein, 9 aa, Homo Sapiens
YPEGTCLSQ

SEQ ID NO: 516247 - protein, 9 aa, Homo Sapiens
MSPANVALR

SEQ ID NO: 516248 - protein, 9 aa, Homo Sapiens
DRYEAVCNP

SEQ ID NO: 516249 - protein, 9 aa, Homo Sapiens
EQGMMGNFI

SEQ ID NO: 516250 - protein, 9 aa, Homo Sapiens
GLADCFGAN

SEQ ID NO: 516251 - protein, 9 aa, Homo Sapiens
INLGLFELL

SEQ ID NO: 516252 - protein, 9 aa, Homo Sapiens
LSPFSTQVE

SEQ ID NO: 516253 - protein, 9 aa, Homo Sapiens
MITGSWMIV

SEQ ID NO: 516254 - protein, 9 aa, Homo Sapiens
VASSFQVIK

SEQ ID NO: 516255 - protein, 9 aa, Homo Sapiens
QMFFRFIEE

SEQ ID NO: 516256 - protein, 9 aa, Homo Sapiens
PSPSGFRAQ

SEQ ID NO: 516257 - protein, 9 aa, Homo Sapiens
KAAVTMARL

SEQ ID NO: 516258 - protein, 9 aa, Homo Sapiens
LSGLASRNL

SEQ ID NO: 516259 - protein, 9 aa, Homo Sapiens
VKILKHWTG

SEQ ID NO: 516260 - protein, 9 aa, Homo Sapiens
QDPEFNTEF

SEQ ID NO: 516261 - protein, 9 aa, Homo Sapiens
TKFRVFRIS

SEQ ID NO: 516262 - protein, 9 aa, Homo Sapiens
VKHENDNAP

SEQ ID NO: 516263 - protein, 9 aa, Homo Sapiens
SIEFFFLVS

SEQ ID NO: 516264 - protein, 9 aa, Homo Sapiens
GGHVTDDCD

SEQ ID NO: 516265 - protein, 9 aa, Homo Sapiens
DRYAVAFFC

SEQ ID NO: 516266 - protein, 9 aa, Homo Sapiens
PDLPKGYDS

SEQ ID NO: 516267 - protein, 9 aa, Homo Sapiens
EYDIWPRAG

SEQ ID NO: 516268 - protein, 9 aa, Homo Sapiens
VAEANEVDL

SEQ ID NO: 516269 - protein, 9 aa, Homo Sapiens
TTTNAVAIL

SEQ ID NO: 516270 - protein, 9 aa, Homo Sapiens
DEKLKRCTL

SEQ ID NO: 516271 - protein, 9 aa, Homo Sapiens
TALTYDRQA

SEQ ID NO: 516272 - protein, 9 aa, Homo Sapiens
PTDRRPPAG

SEQ ID NO: 516273 - protein, 9 aa, Homo Sapiens
ASTNALTHT

SEQ ID NO: 516274 - protein, 9 aa, Homo Sapiens
RKSLFPGLH

SEQ ID NO: 516275 - protein, 9 aa, Homo Sapiens
TTVHWENSF

SEQ ID NO: 516276 - protein, 9 aa, Homo Sapiens
WMIVSINSC

SEQ ID NO: 516277 - protein, 9 aa, Homo Sapiens
VEDIVKLIN

SEQ ID NO: 516278 - protein, 9 aa, Homo Sapiens
ASPVMEFPA

SEQ ID NO: 516279 - protein, 9 aa, Homo Sapiens
GTHHGKKLY

SEQ ID NO: 516280 - protein, 9 aa, Homo Sapiens
EQFRLIEAG

SEQ ID NO: 516281 - protein, 9 aa, Homo Sapiens
SYRPHTEVF

SEQ ID NO: 516282 - protein, 9 aa, Homo Sapiens
ERMAASTQP

SEQ ID NO: 516283 - protein, 9 aa, Homo Sapiens
TPVRAMAIY

SEQ ID NO: 516284 - protein, 9 aa, Homo Sapiens
EGIEERVLK

SEQ ID NO: 516285 - protein, 9 aa, Homo Sapiens
GPDLEPDYG

SEQ ID NO: 516286 - protein, 9 aa, Homo Sapiens
EELELLLFQ

SEQ ID NO: 516287 - protein, 9 aa, Homo Sapiens
GGAPPQPSA

SEQ ID NO: 516288 - protein, 9 aa, Homo Sapiens
MERNNLSCD

SEQ ID NO: 516289 - protein, 9 aa, Homo Sapiens
VPTTTTTDV

SEQ ID NO: 516290 - protein, 9 aa, Homo Sapiens
LPCGDRYAV

SEQ ID NO: 516291 - protein, 9 aa, Homo Sapiens
ETVASEFVS

SEQ ID NO: 516292 - protein, 9 aa, Homo Sapiens
CLPGTVEYL

SEQ ID NO: 516293 - protein, 9 aa, Homo Sapiens
RSRRTQPPI

SEQ ID NO: 516294 - protein, 9 aa, Homo Sapiens
FKLSTPGQR

SEQ ID NO: 516295 - protein, 9 aa, Homo Sapiens
GGPDLEPDY

SEQ ID NO: 516296 - protein, 9 aa, Homo Sapiens
PMCWFVGVV

SEQ ID NO: 516297 - protein, 9 aa, Homo Sapiens
SSGINSDPD

SEQ ID NO: 516298 - protein, 9 aa, Homo Sapiens
QIYRDESHY

SEQ ID NO: 516299 - protein, 9 aa, Homo Sapiens
LCDHTTILF

SEQ ID NO: 516300 - protein, 9 aa, Homo Sapiens
LHYPVLLSR

SEQ ID NO: 516301 - protein, 9 aa, Homo Sapiens
SGAYREVEA

SEQ ID NO: 516302 - protein, 9 aa, Homo Sapiens
PSTTGVLLY

SEQ ID NO: 516303 - protein, 9 aa, Homo Sapiens
SMVFLEYFT

SEQ ID NO: 516304 - protein, 9 aa, Homo Sapiens
YPVLLSRKI

SEQ ID NO: 516305 - protein, 9 aa, Homo Sapiens
ILDLNTAHT

SEQ ID NO: 516306 - protein, 9 aa, Homo Sapiens
QKAAVTMAR

SEQ ID NO: 516307 - protein, 9 aa, Homo Sapiens
GIVLLLSVL

SEQ ID NO: 516308 - protein, 9 aa, Homo Sapiens
LGMAYDCFI

SEQ ID NO: 516309 - protein, 9 aa, Homo Sapiens
TLGLHRWIA

SEQ ID NO: 516310 - protein, 9 aa, Homo Sapiens
NEKSNCQKV

SEQ ID NO: 516311 - protein, 9 aa, Homo Sapiens
AFHTCASHC

SEQ ID NO: 516312 - protein, 9 aa, Homo Sapiens
GAASLVACG

SEQ ID NO: 516313 - protein, 9 aa, Homo Sapiens
LFIKVKHEN

SEQ ID NO: 516314 - protein, 9 aa, Homo Sapiens
ALVILKNIS

SEQ ID NO: 516315 - protein, 9 aa, Homo Sapiens
PRKSHRHSH

SEQ ID NO: 516316 - protein, 9 aa, Homo Sapiens
RPRSAARTS

SEQ ID NO: 516317 - protein, 9 aa, Homo Sapiens
LEVVNLVDK

SEQ ID NO: 516318 - protein, 9 aa, Homo Sapiens
DIQDELKKL

SEQ ID NO: 516319 - protein, 9 aa, Homo Sapiens
VQKTSKDLE

SEQ ID NO: 516320 - protein, 9 aa, Homo Sapiens
LAAATSQVS

SEQ ID NO: 516321 - protein, 9 aa, Homo Sapiens
FPVCICAAV

SEQ ID NO: 516322 - protein, 9 aa, Homo Sapiens
AHLVRLPRA

SEQ ID NO: 516323 - protein, 9 aa, Homo Sapiens
CSECGKAYW

SEQ ID NO: 516324 - protein, 9 aa, Homo Sapiens
GPSIEFFFL

SEQ ID NO: 516325 - protein, 9 aa, Homo Sapiens
KQGVLKEEI

SEQ ID NO: 516326 - protein, 9 aa, Homo Sapiens
VMNCGQHYC

SEQ ID NO: 516327 - protein, 9 aa, Homo Sapiens
SRNVSSVHR

SEQ ID NO: 516328 - protein, 9 aa, Homo Sapiens
CARGCSTGN

SEQ ID NO: 516329 - protein, 9 aa, Homo Sapiens
RWIANIDDT

SEQ ID NO: 516330 - protein, 9 aa, Homo Sapiens
DKMNLYPIY

SEQ ID NO: 516331 - protein, 9 aa, Homo Sapiens
RFENGHGLD

SEQ ID NO: 516332 - protein, 9 aa, Homo Sapiens
KSHSDAVFT

SEQ ID NO: 516333 - protein, 9 aa, Homo Sapiens
EEGAEDPLT

SEQ ID NO: 516334 - protein, 9 aa, Homo Sapiens
PAAAGAVGS

SEQ ID NO: 516335 - protein, 9 aa, Homo Sapiens
NPLHYPVLL

SEQ ID NO: 516336 - protein, 9 aa, Homo Sapiens
KTKKPRALV

SEQ ID NO: 516337 - protein, 9 aa, Homo Sapiens
MPAGYFIPI

SEQ ID NO: 516338 - protein, 9 aa, Homo Sapiens
RMSILYSCD

SEQ ID NO: 516339 - protein, 9 aa, Homo Sapiens
CDFMLFVCL

SEQ ID NO: 516340 - protein, 9 aa, Homo Sapiens
ANPGLADCF

SEQ ID NO: 516341 - protein, 9 aa, Homo Sapiens
YTIMPIPAN

SEQ ID NO: 516342 - protein, 9 aa, Homo Sapiens
PIYVEIIDI

SEQ ID NO: 516343 - protein, 9 aa, Homo Sapiens
RCTLCYRVG

SEQ ID NO: 516344 - protein, 9 aa, Homo Sapiens
PAIRQGPQG

SEQ ID NO: 516345 - protein, 9 aa, Homo Sapiens
YVVAHGFTN

SEQ ID NO: 516346 - protein, 9 aa, Homo Sapiens
DRQRKYDLH

SEQ ID NO: 516347 - protein, 9 aa, Homo Sapiens
YCDFMLFVC

SEQ ID NO: 516348 - protein, 9 aa, Homo Sapiens
EKTIAEPAV

SEQ ID NO: 516349 - protein, 9 aa, Homo Sapiens
IKPDDAELQ

SEQ ID NO: 516350 - protein, 9 aa, Homo Sapiens
YDIWPRAGK

SEQ ID NO: 516351 - protein, 9 aa, Homo Sapiens
NLAAEEAGM

SEQ ID NO: 516352 - protein, 9 aa, Homo Sapiens
LRCGGGKQS

SEQ ID NO: 516353 - protein, 9 aa, Homo Sapiens
IRYTEGRQK

SEQ ID NO: 516354 - protein, 9 aa, Homo Sapiens
RSPPGRLEP

SEQ ID NO: 516355 - protein, 9 aa, Homo Sapiens
NNNSNNSGS

SEQ ID NO: 516356 - protein, 9 aa, Homo Sapiens
SQTSTTSCE

SEQ ID NO: 516357 - protein, 9 aa, Homo Sapiens
HIFCVLSPL

SEQ ID NO: 516358 - protein, 9 aa, Homo Sapiens
QIQMICNVT

SEQ ID NO: 516359 - protein, 9 aa, Homo Sapiens
EDFPMDAQA

SEQ ID NO: 516360 - protein, 9 aa, Homo Sapiens
RRAFHTCAS

SEQ ID NO: 516361 - protein, 9 aa, Homo Sapiens
EIYVLNLAI

SEQ ID NO: 516362 - protein, 9 aa, Homo Sapiens
SESTSRSDQ

SEQ ID NO: 516363 - protein, 9 aa, Homo Sapiens
EELITKFRV

SEQ ID NO: 516364 - protein, 9 aa, Homo Sapiens
VEKEDGLRG

SEQ ID NO: 516365 - protein, 9 aa, Homo Sapiens
VIRIFIPKS

SEQ ID NO: 516366 - protein, 9 aa, Homo Sapiens
DIKPDDAEL

SEQ ID NO: 516367 - protein, 9 aa, Homo Sapiens
RGSPVLSSE

SEQ ID NO: 516368 - protein, 9 aa, Homo Sapiens
YDQPVLKLS

SEQ ID NO: 516369 - protein, 9 aa, Homo Sapiens
LLEQFRLIE

SEQ ID NO: 516370 - protein, 9 aa, Homo Sapiens
LLGMAYDCF

SEQ ID NO: 516371 - protein, 9 aa, Homo Sapiens
SQVSHLQLK

SEQ ID NO: 516372 - protein, 9 aa, Homo Sapiens
LHRVGHDMK

SEQ ID NO: 516373 - protein, 9 aa, Homo Sapiens
LRSRKGNTH

SEQ ID NO: 516374 - protein, 9 aa, Homo Sapiens
LFHLFRFKL

SEQ ID NO: 516375 - protein, 9 aa, Homo Sapiens
MCWFVGVVV

SEQ ID NO: 516376 - protein, 9 aa, Homo Sapiens
GRGTPSNGK

SEQ ID NO: 516377 - protein, 9 aa, Homo Sapiens
LFRFKLIYN

SEQ ID NO: 516378 - protein, 9 aa, Homo Sapiens
PGRLEPSPA

SEQ ID NO: 516379 - protein, 9 aa, Homo Sapiens
AVDRYEAVC

SEQ ID NO: 516380 - protein, 9 aa, Homo Sapiens
DVIISDIPF

SEQ ID NO: 516381 - protein, 9 aa, Homo Sapiens
ETSFHLKKP

SEQ ID NO: 516382 - protein, 9 aa, Homo Sapiens
PRWVASYKK

SEQ ID NO: 516383 - protein, 9 aa, Homo Sapiens
TQGIVSLPP

SEQ ID NO: 516384 - protein, 9 aa, Homo Sapiens
NTPEHVVQE

SEQ ID NO: 516385 - protein, 9 aa, Homo Sapiens
CPSGGPFVC

SEQ ID NO: 516386 - protein, 9 aa, Homo Sapiens
LQFGRRPVV

SEQ ID NO: 516387 - protein, 9 aa, Homo Sapiens
TAKGMLCAD

SEQ ID NO: 516388 - protein, 9 aa, Homo Sapiens
LPSPYVGAA

SEQ ID NO: 516389 - protein, 9 aa, Homo Sapiens
LELQLEENP

SEQ ID NO: 516390 - protein, 9 aa, Homo Sapiens
NKMWIAIDN

SEQ ID NO: 516391 - protein, 9 aa, Homo Sapiens
TSRSLSGSP

SEQ ID NO: 516392 - protein, 9 aa, Homo Sapiens
VPRISQEFG

SEQ ID NO: 516393 - protein, 9 aa, Homo Sapiens
DTFRGLRRL

SEQ ID NO: 516394 - protein, 9 aa, Homo Sapiens
KRSKSKERP

SEQ ID NO: 516395 - protein, 9 aa, Homo Sapiens
VSLILSLTP

SEQ ID NO: 516396 - protein, 9 aa, Homo Sapiens
EEISDLCDH

SEQ ID NO: 516397 - protein, 9 aa, Homo Sapiens
VILTLIWFL

SEQ ID NO: 516398 - protein, 9 aa, Homo Sapiens
NGKKLEYDV

SEQ ID NO: 516399 - protein, 9 aa, Homo Sapiens
DSGDCGVQR

SEQ ID NO: 516400 - protein, 9 aa, Homo Sapiens
YYTSGGKKT

SEQ ID NO: 516401 - protein, 9 aa, Homo Sapiens
MVLLVPTGG

SEQ ID NO: 516402 - protein, 9 aa, Homo Sapiens
LTITGNVVI

SEQ ID NO: 516403 - protein, 9 aa, Homo Sapiens
APPQAQPQL

SEQ ID NO: 516404 - protein, 9 aa, Homo Sapiens
GHVTDDCDR

SEQ ID NO: 516405 - protein, 9 aa, Homo Sapiens
DEEDLSAAT

SEQ ID NO: 516406 - protein, 9 aa, Homo Sapiens
IPGLRVQRM

SEQ ID NO: 516407 - protein, 9 aa, Homo Sapiens
DFVEDIVKL

SEQ ID NO: 516408 - protein, 9 aa, Homo Sapiens
PLPPEEILA

SEQ ID NO: 516409 - protein, 9 aa, Homo Sapiens
HAPPPTEPS

SEQ ID NO: 516410 - protein, 9 aa, Homo Sapiens
ILMGLDGIV

SEQ ID NO: 516411 - protein, 9 aa, Homo Sapiens
MNIYFYTIM

SEQ ID NO: 516412 - protein, 9 aa, Homo Sapiens
LHDPTKGSE

SEQ ID NO: 516413 - protein, 9 aa, Homo Sapiens
ERVLKDLKQ

SEQ ID NO: 516414 - protein, 9 aa, Homo Sapiens
NLSCTDMSA

SEQ ID NO: 516415 - protein, 9 aa, Homo Sapiens
GAAPPGHKG

SEQ ID NO: 516416 - protein, 9 aa, Homo Sapiens
PQWKTQFSK

SEQ ID NO: 516417 - protein, 9 aa, Homo Sapiens
HTCGRRKSL

SEQ ID NO: 516418 - protein, 9 aa, Homo Sapiens
IQDELKKLY

SEQ ID NO: 516419 - protein, 9 aa, Homo Sapiens
RVSALSTPA

SEQ ID NO: 516420 - protein, 9 aa, Homo Sapiens
NYYREKIGI

SEQ ID NO: 516421 - protein, 9 aa, Homo Sapiens
SSLGEHQLL

SEQ ID NO: 516422 - protein, 9 aa, Homo Sapiens
IQGKSLGSF

SEQ ID NO: 516423 - protein, 9 aa, Homo Sapiens
MGLIACANV

SEQ ID NO: 516424 - protein, 9 aa, Homo Sapiens
DLGSQIQMI

SEQ ID NO: 516425 - protein, 9 aa, Homo Sapiens
KTTERQGLL

SEQ ID NO: 516426 - protein, 9 aa, Homo Sapiens
TIVHDPLPP

SEQ ID NO: 516427 - protein, 9 aa, Homo Sapiens
RRLRHLVVH

SEQ ID NO: 516428 - protein, 9 aa, Homo Sapiens
LRDSGSAYL

SEQ ID NO: 516429 - protein, 9 aa, Homo Sapiens
LPDPQWKTQ

SEQ ID NO: 516430 - protein, 9 aa, Homo Sapiens
PHEYVKEFT

SEQ ID NO: 516431 - protein, 9 aa, Homo Sapiens
CPEPPSAAL

SEQ ID NO: 516432 - protein, 9 aa, Homo Sapiens
NLQFGRRPV

SEQ ID NO: 516433 - protein, 9 aa, Homo Sapiens
TKLTDLEGQ

SEQ ID NO: 516434 - protein, 9 aa, Homo Sapiens
ITGNVVIIT

SEQ ID NO: 516435 - protein, 9 aa, Homo Sapiens
HNRGRKIAA

SEQ ID NO: 516436 - protein, 9 aa, Homo Sapiens
AVLCPQPPV

SEQ ID NO: 516437 - protein, 9 aa, Homo Sapiens
TNVSQAECD

SEQ ID NO: 516438 - protein, 9 aa, Homo Sapiens
TRGLLNSTW

SEQ ID NO: 516439 - protein, 9 aa, Homo Sapiens
RCSRHAPPP

SEQ ID NO: 516440 - protein, 9 aa, Homo Sapiens
PEDIQDELK

SEQ ID NO: 516441 - protein, 9 aa, Homo Sapiens
RLRGLCPLL

SEQ ID NO: 516442 - protein, 9 aa, Homo Sapiens
SDPPTTTTG

SEQ ID NO: 516443 - protein, 9 aa, Homo Sapiens
AATSQVSHL

SEQ ID NO: 516444 - protein, 9 aa, Homo Sapiens
LAVINFTYS

SEQ ID NO: 516445 - protein, 9 aa, Homo Sapiens
ECMSSYFRE

SEQ ID NO: 516446 - protein, 9 aa, Homo Sapiens
EELAAATSQ

SEQ ID NO: 516447 - protein, 9 aa, Homo Sapiens
DLSAATTEE

SEQ ID NO: 516448 - protein, 9 aa, Homo Sapiens
CAGPLARAS

SEQ ID NO: 516449 - protein, 9 aa, Homo Sapiens
AVTQGIVSL

SEQ ID NO: 516450 - protein, 9 aa, Homo Sapiens
LKVRSAGCS

SEQ ID NO: 516451 - protein, 9 aa, Homo Sapiens
SDQENEAFD

SEQ ID NO: 516452 - protein, 9 aa, Homo Sapiens
HARLRDSGS

SEQ ID NO: 516453 - protein, 9 aa, Homo Sapiens
APEFLNGTY

SEQ ID NO: 516454 - protein, 9 aa, Homo Sapiens
SIQAQNFSL

SEQ ID NO: 516455 - protein, 9 aa, Homo Sapiens
AEGFLAKTC

SEQ ID NO: 516456 - protein, 9 aa, Homo Sapiens
VCQVDFIII

SEQ ID NO: 516457 - protein, 9 aa, Homo Sapiens
PTTTTTDVS

SEQ ID NO: 516458 - protein, 9 aa, Homo Sapiens
TWNPEGPDL

SEQ ID NO: 516459 - protein, 9 aa, Homo Sapiens
QCEPILDDR

SEQ ID NO: 516460 - protein, 9 aa, Homo Sapiens
STCGSHMLV

SEQ ID NO: 516461 - protein, 9 aa, Homo Sapiens
GQASRSASK

SEQ ID NO: 516462 - protein, 9 aa, Homo Sapiens
LCPQPPVQN

SEQ ID NO: 516463 - protein, 9 aa, Homo Sapiens
RCQFYRTRI

SEQ ID NO: 516464 - protein, 9 aa, Homo Sapiens
ARRQVEGCR

SEQ ID NO: 516465 - protein, 9 aa, Homo Sapiens
RTTFSSAQL

SEQ ID NO: 516466 - protein, 9 aa, Homo Sapiens
TPPPGTPVR

SEQ ID NO: 516467 - protein, 9 aa, Homo Sapiens
PSISSIQML

SEQ ID NO: 516468 - protein, 9 aa, Homo Sapiens
RIHSYPEGT

SEQ ID NO: 516469 - protein, 9 aa, Homo Sapiens
GVAAAAPRR

SEQ ID NO: 516470 - protein, 9 aa, Homo Sapiens
LGEVNAARR

SEQ ID NO: 516471 - protein, 9 aa, Homo Sapiens
GTPVRAMAI

SEQ ID NO: 516472 - protein, 9 aa, Homo Sapiens
TDNSSSNNG

SEQ ID NO: 516473 - protein, 9 aa, Homo Sapiens
ATLLSRVRY

SEQ ID NO: 516474 - protein, 9 aa, Homo Sapiens
APPLPGWSR

SEQ ID NO: 516475 - protein, 9 aa, Homo Sapiens
LIVILSSVS

SEQ ID NO: 516476 - protein, 9 aa, Homo Sapiens
PSNGKKLEY

SEQ ID NO: 516477 - protein, 8 aa, Homo Sapiens
GRKKIQIT

SEQ ID NO: 516478 - protein, 9 aa, Homo Sapiens
TGIFNETSD

SEQ ID NO: 516479 - protein, 9 aa, Homo Sapiens
QKTSKDLED

SEQ ID NO: 516480 - protein, 9 aa, Homo Sapiens
MSSVFKTHF

SEQ ID NO: 516481 - protein, 9 aa, Homo Sapiens
NAPEFLNGT

SEQ ID NO: 516482 - protein, 9 aa, Homo Sapiens
TMGAIDFLG

SEQ ID NO: 516483 - protein, 9 aa, Homo Sapiens
PAGSTRGLL

SEQ ID NO: 516484 - protein, 9 aa, Homo Sapiens
ESARRLRHL

SEQ ID NO: 516485 - protein, 9 aa, Homo Sapiens
SSAFKHIGT

SEQ ID NO: 516486 - protein, 9 aa, Homo Sapiens
PPGSDPELW

SEQ ID NO: 516487 - protein, 9 aa, Homo Sapiens
QEGHPELRG

SEQ ID NO: 516488 - protein, 9 aa, Homo Sapiens
HTYSLSAKD

SEQ ID NO: 516489 - protein, 9 aa, Homo Sapiens
SRSLSGSPG

SEQ ID NO: 516490 - protein, 9 aa, Homo Sapiens
EIEGVTKAS

SEQ ID NO: 516491 - protein, 9 aa, Homo Sapiens
GFSGCLCEI

SEQ ID NO: 516492 - protein, 9 aa, Homo Sapiens
VLATGRNLA

SEQ ID NO: 516493 - protein, 9 aa, Homo Sapiens
SGSAYLPFV

SEQ ID NO: 516494 - protein, 9 aa, Homo Sapiens
REQNETLIR

SEQ ID NO: 516495 - protein, 9 aa, Homo Sapiens
RSGPPGPQG

SEQ ID NO: 516496 - protein, 9 aa, Homo Sapiens
LVFIALFTG

SEQ ID NO: 516497 - protein, 9 aa, Homo Sapiens
KEMSMVNIM

SEQ ID NO: 516498 - protein, 9 aa, Homo Sapiens
HKQGVLKEE

SEQ ID NO: 516499 - protein, 9 aa, Homo Sapiens
ERNNLSCDC

SEQ ID NO: 516500 - protein, 9 aa, Homo Sapiens
QDVPCPAGH

SEQ ID NO: 516501 - protein, 9 aa, Homo Sapiens
TCGSHMLVV

SEQ ID NO: 516502 - protein, 9 aa, Homo Sapiens
RVRYSPHIS

SEQ ID NO: 516503 - protein, 9 aa, Homo Sapiens
RSASKKGFK

SEQ ID NO: 516504 - protein, 9 aa, Homo Sapiens
HYRSGSYRP

SEQ ID NO: 516505 - protein, 9 aa, Homo Sapiens
LIYCLTITG

SEQ ID NO: 516506 - protein, 9 aa, Homo Sapiens
CLACSDPRV

SEQ ID NO: 516507 - protein, 9 aa, Homo Sapiens
EETSCAQQV

SEQ ID NO: 516508 - protein, 9 aa, Homo Sapiens
SGSYRPHTE

SEQ ID NO: 516509 - protein, 9 aa, Homo Sapiens
MARGGDTGF

SEQ ID NO: 516510 - protein, 9 aa, Homo Sapiens
GTSGDHDDF

SEQ ID NO: 516511 - protein, 9 aa, Homo Sapiens
TFSSAQLKE

SEQ ID NO: 516512 - protein, 9 aa, Homo Sapiens
EVEKEDGLR

SEQ ID NO: 516513 - protein, 9 aa, Homo Sapiens
EYECRALND

SEQ ID NO: 516514 - protein, 9 aa, Homo Sapiens
RSVMIQMSS

SEQ ID NO: 516515 - protein, 9 aa, Homo Sapiens
EHLVAEMET

SEQ ID NO: 516516 - protein, 9 aa, Homo Sapiens
SQIVAMNFQ

SEQ ID NO: 516517 - protein, 9 aa, Homo Sapiens
KEACIWGSL

SEQ ID NO: 516518 - protein, 9 aa, Homo Sapiens
SPTDRRPPA

SEQ ID NO: 516519 - protein, 9 aa, Homo Sapiens
PPLPPTIDD

SEQ ID NO: 516520 - protein, 9 aa, Homo Sapiens
QEGMDEKKL

SEQ ID NO: 516521 - protein, 9 aa, Homo Sapiens
FPRDQVVNG

SEQ ID NO: 516522 - protein, 9 aa, Homo Sapiens
HNLQTSTLG

SEQ ID NO: 516523 - protein, 9 aa, Homo Sapiens
SWDFYSISV

SEQ ID NO: 516524 - protein, 9 aa, Homo Sapiens
TRMNLVIFM

SEQ ID NO: 516525 - protein, 9 aa, Homo Sapiens
YSSSCGYGH

SEQ ID NO: 516526 - protein, 9 aa, Homo Sapiens
EPLPPFNQF

SEQ ID NO: 516527 - protein, 9 aa, Homo Sapiens
RMRVDSDNE

SEQ ID NO: 516528 - protein, 9 aa, Homo Sapiens
SRNLQADFE

SEQ ID NO: 516529 - protein, 9 aa, Homo Sapiens
YRTRITCIG

SEQ ID NO: 516530 - protein, 9 aa, Homo Sapiens
ISDKDSADM

SEQ ID NO: 516531 - protein, 9 aa, Homo Sapiens
KLTDLEGQQ

SEQ ID NO: 516532 - protein, 9 aa, Homo Sapiens
AWVGDALLL

SEQ ID NO: 516533 - protein, 9 aa, Homo Sapiens
QDELKKLYA

SEQ ID NO: 516534 - protein, 9 aa, Homo Sapiens
DGGSPLGLG

SEQ ID NO: 516535 - protein, 9 aa, Homo Sapiens
DSTSENILQ

SEQ ID NO: 516536 - protein, 9 aa, Homo Sapiens
AIDFLGSYS

SEQ ID NO: 516537 - protein, 9 aa, Homo Sapiens
MICNVTGQL

SEQ ID NO: 516538 - protein, 9 aa, Homo Sapiens
PRMSILYSC

SEQ ID NO: 516539 - protein, 9 aa, Homo Sapiens
DAHNRGRKI

SEQ ID NO: 516540 - protein, 9 aa, Homo Sapiens
RLEPSPAAA

SEQ ID NO: 516541 - protein, 9 aa, Homo Sapiens
TMARLSRDP

SEQ ID NO: 516542 - protein, 9 aa, Homo Sapiens
PPTTTTGST

SEQ ID NO: 516543 - protein, 9 aa, Homo Sapiens
CGGKRKKCL

SEQ ID NO: 516544 - protein, 9 aa, Homo Sapiens
PRDQVVNGA

SEQ ID NO: 516545 - protein, 9 aa, Homo Sapiens
GYYTSGGKK

SEQ ID NO: 516546 - protein, 9 aa, Homo Sapiens
LFSFGLTIN

SEQ ID NO: 516547 - protein, 9 aa, Homo Sapiens
GLQEWRPED

SEQ ID NO: 516548 - protein, 9 aa, Homo Sapiens
SGAWSPPYP

SEQ ID NO: 516549 - protein, 9 aa, Homo Sapiens
DALVILKNI

SEQ ID NO: 516550 - protein, 9 aa, Homo Sapiens
YIFLHMVKG

SEQ ID NO: 516551 - protein, 9 aa, Homo Sapiens
LILSLTPFV

SEQ ID NO: 516552 - protein, 9 aa, Homo Sapiens
HMAVQRADG

SEQ ID NO: 516553 - protein, 9 aa, Homo Sapiens
SPPGTLPHF

SEQ ID NO: 516554 - protein, 9 aa, Homo Sapiens
ALSIQAQNF

SEQ ID NO: 516555 - protein, 9 aa, Homo Sapiens
HSLDPEDIQ

SEQ ID NO: 516556 - protein, 9 aa, Homo Sapiens
SLIMEWNLT

SEQ ID NO: 516557 - protein, 9 aa, Homo Sapiens
GRFGIPEAL

SEQ ID NO: 516558 - protein, 9 aa, Homo Sapiens
ELRDFLFEK

SEQ ID NO: 516559 - protein, 9 aa, Homo Sapiens
VFQKRTVQC

SEQ ID NO: 516560 - protein, 9 aa, Homo Sapiens
DKCNKTVKC

SEQ ID NO: 516561 - protein, 9 aa, Homo Sapiens
ILDNMREVV

SEQ ID NO: 516562 - protein, 9 aa, Homo Sapiens
PVRAMAIYK

SEQ ID NO: 516563 - protein, 9 aa, Homo Sapiens
FSLHIDCAL

SEQ ID NO: 516564 - protein, 9 aa, Homo Sapiens
AYWYSSQLI

SEQ ID NO: 516565 - protein, 9 aa, Homo Sapiens
LGLFELLFF

SEQ ID NO: 516566 - protein, 9 aa, Homo Sapiens
HEYDIWPRA

SEQ ID NO: 516567 - protein, 9 aa, Homo Sapiens
RATMSISNG

SEQ ID NO: 516568 - protein, 9 aa, Homo Sapiens
PRAGKERKR

SEQ ID NO: 516569 - protein, 9 aa, Homo Sapiens
RMYLRLRGL

SEQ ID NO: 516570 - protein, 9 aa, Homo Sapiens
QEEISDLCD

SEQ ID NO: 516571 - protein, 9 aa, Homo Sapiens
NMKQKRVYQ

SEQ ID NO: 516572 - protein, 9 aa, Homo Sapiens
GGRATMSIS

SEQ ID NO: 516573 - protein, 9 aa, Homo Sapiens
RLRQLLEVI

SEQ ID NO: 516574 - protein, 9 aa, Homo Sapiens
EAMCNLNPF

SEQ ID NO: 516575 - protein, 9 aa, Homo Sapiens
NEYKKDSAK

SEQ ID NO: 516576 - protein, 9 aa, Homo Sapiens
SAHKQGVLK

SEQ ID NO: 516577 - protein, 9 aa, Homo Sapiens
PEGTCLSQA

SEQ ID NO: 516578 - protein, 9 aa, Homo Sapiens
PATEQGMMG

SEQ ID NO: 516579 - protein, 9 aa, Homo Sapiens
EKDSVTVKC

SEQ ID NO: 516580 - protein, 9 aa, Homo Sapiens
AVMPYQPQV

SEQ ID NO: 516581 - protein, 9 aa, Homo Sapiens
VQNNRVVGA

SEQ ID NO: 516582 - protein, 9 aa, Homo Sapiens
HHSNTFVYS

SEQ ID NO: 516583 - protein, 9 aa, Homo Sapiens
VRSAGCSVL

SEQ ID NO: 516584 - protein, 9 aa, Homo Sapiens
DRLNETKLT

SEQ ID NO: 516585 - protein, 9 aa, Homo Sapiens
VTSNSKPVL

SEQ ID NO: 516586 - protein, 9 aa, Homo Sapiens
SLILSLTPF

SEQ ID NO: 516587 - protein, 9 aa, Homo Sapiens
PPQAVFPVC

SEQ ID NO: 516588 - protein, 9 aa, Homo Sapiens
VQRADGPYK

SEQ ID NO: 516589 - protein, 9 aa, Homo Sapiens
FASPVMEFP

SEQ ID NO: 516590 - protein, 9 aa, Homo Sapiens
LSLTPFVFR

SEQ ID NO: 516591 - protein, 9 aa, Homo Sapiens
LSRVRYSPH

SEQ ID NO: 516592 - protein, 9 aa, Homo Sapiens
IDSSAFKHI

SEQ ID NO: 516593 - protein, 9 aa, Homo Sapiens
HWENSFVSV

SEQ ID NO: 516594 - protein, 9 aa, Homo Sapiens
EYLECDEIL

SEQ ID NO: 516595 - protein, 9 aa, Homo Sapiens
EELLQDLCA

SEQ ID NO: 516596 - protein, 9 aa, Homo Sapiens
RICRDPVTL

SEQ ID NO: 516597 - protein, 9 aa, Homo Sapiens
RLSIQKNIL

SEQ ID NO: 516598 - protein, 9 aa, Homo Sapiens
SACLGEHST

SEQ ID NO: 516599 - protein, 9 aa, Homo Sapiens
RLSPKLVLI

SEQ ID NO: 516600 - protein, 9 aa, Homo Sapiens
DQPAALVPK

SEQ ID NO: 516601 - protein, 9 aa, Homo Sapiens
GNRRTAYVV

SEQ ID NO: 516602 - protein, 9 aa, Homo Sapiens
NFSLHIDCA

SEQ ID NO: 516603 - protein, 9 aa, Homo Sapiens
AEHERMAAS

SEQ ID NO: 516604 - protein, 9 aa, Homo Sapiens
KVRALGEVN

SEQ ID NO: 516605 - protein, 9 aa, Homo Sapiens
WGKRGCKMF

SEQ ID NO: 516606 - protein, 9 aa, Homo Sapiens
FRAQDRAPR

SEQ ID NO: 516607 - protein, 9 aa, Homo Sapiens
YAWNIPVKW

SEQ ID NO: 516608 - protein, 9 aa, Homo Sapiens
LQSPTEEEP

SEQ ID NO: 516609 - protein, 9 aa, Homo Sapiens
LYPIYVEII

SEQ ID NO: 516610 - protein, 9 aa, Homo Sapiens
SVAGALDHA

SEQ ID NO: 516611 - protein, 9 aa, Homo Sapiens
TCLSQASKL

SEQ ID NO: 516612 - protein, 9 aa, Homo Sapiens
KQKRVYQQT

SEQ ID NO: 516613 - protein, 9 aa, Homo Sapiens
PQSMGATSN

SEQ ID NO: 516614 - protein, 9 aa, Homo Sapiens
LPHVEGVHL

SEQ ID NO: 516615 - protein, 9 aa, Homo Sapiens
WLHHTSWHS

SEQ ID NO: 516616 - protein, 9 aa, Homo Sapiens
RQKSTSGSY

SEQ ID NO: 516617 - protein, 9 aa, Homo Sapiens
RIQTAPNNG

SEQ ID NO: 516618 - protein, 9 aa, Homo Sapiens
FRKEQQEAA

SEQ ID NO: 516619 - protein, 9 aa, Homo Sapiens
AAATSQVSH

SEQ ID NO: 516620 - protein, 9 aa, Homo Sapiens
TKKPRALVL

SEQ ID NO: 516621 - protein, 9 aa, Homo Sapiens
RLIEAGLED

SEQ ID NO: 516622 - protein, 9 aa, Homo Sapiens
PVSISSGIN

SEQ ID NO: 516623 - protein, 9 aa, Homo Sapiens
EGQGLLAAI

SEQ ID NO: 516624 - protein, 9 aa, Homo Sapiens
QEEKRGPKS

SEQ ID NO: 516625 - protein, 9 aa, Homo Sapiens
KCGSQIVAM

SEQ ID NO: 516626 - protein, 9 aa, Homo Sapiens
RSNLQALGR

SEQ ID NO: 516627 - protein, 9 aa, Homo Sapiens
LFVCLACSD

SEQ ID NO: 516628 - protein, 9 aa, Homo Sapiens
EECGKALRR

SEQ ID NO: 516629 - protein, 9 aa, Homo Sapiens
FSSLGEHQL

SEQ ID NO: 516630 - protein, 9 aa, Homo Sapiens
LLLDQRLSP

SEQ ID NO: 516631 - protein, 9 aa, Homo Sapiens
RIFIPKSEE

SEQ ID NO: 516632 - protein, 9 aa, Homo Sapiens
EAVCNPLRY

SEQ ID NO: 516633 - protein, 9 aa, Homo Sapiens
NYLDSTAYR

SEQ ID NO: 516634 - protein, 9 aa, Homo Sapiens
VVNLVDKLY

SEQ ID NO: 516635 - protein, 9 aa, Homo Sapiens
AADKVLQES

SEQ ID NO: 516636 - protein, 9 aa, Homo Sapiens
ISGSNQQAF

SEQ ID NO: 516637 - protein, 9 aa, Homo Sapiens
IYQRRGLVH

SEQ ID NO: 516638 - protein, 9 aa, Homo Sapiens
AFKHIGTVE

SEQ ID NO: 516639 - protein, 9 aa, Homo Sapiens
LASATTFAL

SEQ ID NO: 516640 - protein, 9 aa, Homo Sapiens
SQRNAANAH

SEQ ID NO: 516641 - protein, 9 aa, Homo Sapiens
CPQDSLRGS

SEQ ID NO: 516642 - protein, 9 aa, Homo Sapiens
FGLTINLLL

SEQ ID NO: 516643 - protein, 9 aa, Homo Sapiens
LVRVPSSVA

SEQ ID NO: 516644 - protein, 9 aa, Homo Sapiens
MSHSIHDKS

SEQ ID NO: 516645 - protein, 9 aa, Homo Sapiens
RETKDLDKM

SEQ ID NO: 516646 - protein, 9 aa, Homo Sapiens
SLMFCNAKT

SEQ ID NO: 516647 - protein, 9 aa, Homo Sapiens
RVFRISHRS

SEQ ID NO: 516648 - protein, 9 aa, Homo Sapiens
LLEVILAIG

SEQ ID NO: 516649 - protein, 9 aa, Homo Sapiens
RGCKMFHTL

SEQ ID NO: 516650 - protein, 9 aa, Homo Sapiens
IKPQRKITL

SEQ ID NO: 516651 - protein, 9 aa, Homo Sapiens
RVPSQPPSP

SEQ ID NO: 516652 - protein, 9 aa, Homo Sapiens
TSGDHDDFA

SEQ ID NO: 516653 - protein, 9 aa, Homo Sapiens
PQNMTTTNA

SEQ ID NO: 516654 - protein, 9 aa, Homo Sapiens
SPSSFVDKR

SEQ ID NO: 516655 - protein, 9 aa, Homo Sapiens
RPEDEACGS

SEQ ID NO: 516656 - protein, 9 aa, Homo Sapiens
YVCSVSVER

SEQ ID NO: 516657 - protein, 9 aa, Homo Sapiens
SPISPGSTE

SEQ ID NO: 516658 - protein, 9 aa, Homo Sapiens
LHTYSLSAK

SEQ ID NO: 516659 - protein, 9 aa, Homo Sapiens
NIARFSPRM

SEQ ID NO: 516660 - protein, 9 aa, Homo Sapiens
SPLDLLEPE

SEQ ID NO: 516661 - protein, 9 aa, Homo Sapiens
CAAPPLPGW

SEQ ID NO: 516662 - protein, 9 aa, Homo Sapiens
RKAQPDDLM

SEQ ID NO: 516663 - protein, 9 aa, Homo Sapiens
GRKWFRLGS

SEQ ID NO: 516664 - protein, 9 aa, Homo Sapiens
PGNCLIFKA

SEQ ID NO: 516665 - protein, 9 aa, Homo Sapiens
IPMPAGYFI

SEQ ID NO: 516666 - protein, 9 aa, Homo Sapiens
YRRLGRAEL

SEQ ID NO: 516667 - protein, 9 aa, Homo Sapiens
SNLSLTSDG

SEQ ID NO: 516668 - protein, 9 aa, Homo Sapiens
GLRFKKAHL

SEQ ID NO: 516669 - protein, 9 aa, Homo Sapiens
LHRTTLLHA

SEQ ID NO: 516670 - protein, 9 aa, Homo Sapiens
FSDDKVIEL

SEQ ID NO: 516671 - protein, 9 aa, Homo Sapiens
EILAADKVL

SEQ ID NO: 516672 - protein, 9 aa, Homo Sapiens
DPPTTTTGS

SEQ ID NO: 516673 - protein, 9 aa, Homo Sapiens
TVKCQGAYS

SEQ ID NO: 516674 - protein, 9 aa, Homo Sapiens
GAYDCPAWA

SEQ ID NO: 516675 - protein, 9 aa, Homo Sapiens
LQEGMDEKK

SEQ ID NO: 516676 - protein, 9 aa, Homo Sapiens
TSLLFRLKF

SEQ ID NO: 516677 - protein, 9 aa, Homo Sapiens
QPQLPPPPP

SEQ ID NO: 516678 - protein, 9 aa, Homo Sapiens
WRPEDEACG

SEQ ID NO: 516679 - protein, 9 aa, Homo Sapiens
LLHLPNVQP

SEQ ID NO: 516680 - protein, 9 aa, Homo Sapiens
MMTKTQMFF

SEQ ID NO: 516681 - protein, 9 aa, Homo Sapiens
SEMESLKSK

SEQ ID NO: 516682 - protein, 9 aa, Homo Sapiens
FFCYDQPVL

SEQ ID NO: 516683 - protein, 9 aa, Homo Sapiens
PGPQGRLQR

SEQ ID NO: 516684 - protein, 9 aa, Homo Sapiens
EEMNQMHES

SEQ ID NO: 516685 - protein, 9 aa, Homo Sapiens
MRRVLRMLL

SEQ ID NO: 516686 - protein, 9 aa, Homo Sapiens
YGSATSTAK

SEQ ID NO: 516687 - protein, 9 aa, Homo Sapiens
CLQKQKSLS

SEQ ID NO: 516688 - protein, 9 aa, Homo Sapiens
QGVVVSYLP

SEQ ID NO: 516689 - protein, 9 aa, Homo Sapiens
TDRRPPAGL

SEQ ID NO: 516690 - protein, 9 aa, Homo Sapiens
TLSPLGYGY

SEQ ID NO: 516691 - protein, 9 aa, Homo Sapiens
TEPSGLQEW

SEQ ID NO: 516692 - protein, 9 aa, Homo Sapiens
LIPDIVLWP

SEQ ID NO: 516693 - protein, 9 aa, Homo Sapiens
AIDMARVRE

SEQ ID NO: 516694 - protein, 9 aa, Homo Sapiens
ILAFILIGN

SEQ ID NO: 516695 - protein, 9 aa, Homo Sapiens
HHGKKLYTD

SEQ ID NO: 516696 - protein, 9 aa, Homo Sapiens
STSGSYSYQ

SEQ ID NO: 516697 - protein, 9 aa, Homo Sapiens
IGCITIAWK

SEQ ID NO: 516698 - protein, 9 aa, Homo Sapiens
DPEFNTEFV

SEQ ID NO: 516699 - protein, 9 aa, Homo Sapiens
PADTFRGLR

SEQ ID NO: 516700 - protein, 9 aa, Homo Sapiens
TYSLSAKDF

SEQ ID NO: 516701 - protein, 9 aa, Homo Sapiens
LDRFWPIIQ

SEQ ID NO: 516702 - protein, 9 aa, Homo Sapiens
VDLAGYHYT

SEQ ID NO: 516703 - protein, 9 aa, Homo Sapiens
AVREQNETL

SEQ ID NO: 516704 - protein, 9 aa, Homo Sapiens
LFVKSEGSR

SEQ ID NO: 516705 - protein, 9 aa, Homo Sapiens
ECGKALRRS

SEQ ID NO: 516706 - protein, 9 aa, Homo Sapiens
PEEKLAVSP

SEQ ID NO: 516707 - protein, 9 aa, Homo Sapiens
VYSDCRPGL

SEQ ID NO: 516708 - protein, 9 aa, Homo Sapiens
AELGLRAVW

SEQ ID NO: 516709 - protein, 9 aa, Homo Sapiens
FVCLACSDP

SEQ ID NO: 516710 - protein, 9 aa, Homo Sapiens
TIDDRDLST

SEQ ID NO: 516711 - protein, 9 aa, Homo Sapiens
QGPQGLEVS

SEQ ID NO: 516712 - protein, 9 aa, Homo Sapiens
HDPLPPEEI

SEQ ID NO: 516713 - protein, 9 aa, Homo Sapiens
GPMVGKAGD

SEQ ID NO: 516714 - protein, 9 aa, Homo Sapiens
EVVNLVDKL

SEQ ID NO: 516715 - protein, 9 aa, Homo Sapiens
VNMVMNCGQ

SEQ ID NO: 516716 - protein, 9 aa, Homo Sapiens
GGGNRRTAY

SEQ ID NO: 516717 - protein, 9 aa, Homo Sapiens
SPVASSFQV

SEQ ID NO: 516718 - protein, 9 aa, Homo Sapiens
FSPRMSILY

SEQ ID NO: 516719 - protein, 9 aa, Homo Sapiens
KAFKPRFPR

SEQ ID NO: 516720 - protein, 9 aa, Homo Sapiens
TQPPITQER

SEQ ID NO: 516721 - protein, 9 aa, Homo Sapiens
CLRYLFQWI

SEQ ID NO: 516722 - protein, 9 aa, Homo Sapiens
AAVREQNET

SEQ ID NO: 516723 - protein, 9 aa, Homo Sapiens
MCNLNPFVQ

SEQ ID NO: 516724 - protein, 9 aa, Homo Sapiens
CGSQIVAMN

SEQ ID NO: 516725 - protein, 9 aa, Homo Sapiens
EYFINLGLF

SEQ ID NO: 516726 - protein, 9 aa, Homo Sapiens
LDQRLSPKL

SEQ ID NO: 516727 - protein, 9 aa, Homo Sapiens
AQPQLPPPP

SEQ ID NO: 516728 - protein, 9 aa, Homo Sapiens
QLPPPPPPA

SEQ ID NO: 516729 - protein, 9 aa, Homo Sapiens
ESRFENGHG

SEQ ID NO: 516730 - protein, 9 aa, Homo Sapiens
SLSASAGPF

SEQ ID NO: 516731 - protein, 9 aa, Homo Sapiens
DGGWWEVEK

SEQ ID NO: 516732 - protein, 9 aa, Homo Sapiens
ARGGDTGFT

SEQ ID NO: 516733 - protein, 9 aa, Homo Sapiens
DFYLINRQG

SEQ ID NO: 516734 - protein, 9 aa, Homo Sapiens
RVLEVVNLV

SEQ ID NO: 516735 - protein, 9 aa, Homo Sapiens
CLNQIVLFL

SEQ ID NO: 516736 - protein, 9 aa, Homo Sapiens
IFCVLSPLP

SEQ ID NO: 516737 - protein, 9 aa, Homo Sapiens
DFAMKTLRS

SEQ ID NO: 516738 - protein, 9 aa, Homo Sapiens
KATHAGEEH

SEQ ID NO: 516739 - protein, 9 aa, Homo Sapiens
HSIVLTEAV

SEQ ID NO: 516740 - protein, 9 aa, Homo Sapiens
HVNCYVLEE

SEQ ID NO: 516741 - protein, 9 aa, Homo Sapiens
AAPAGRSRA

SEQ ID NO: 516742 - protein, 9 aa, Homo Sapiens
TMSSADLLN

SEQ ID NO: 516743 - protein, 9 aa, Homo Sapiens
AAYPSTAGQ

SEQ ID NO: 516744 - protein, 9 aa, Homo Sapiens
VDDCADGSD

SEQ ID NO: 516745 - protein, 9 aa, Homo Sapiens
FWKCGSQIV

SEQ ID NO: 516746 - protein, 9 aa, Homo Sapiens
AWSYPATIT

SEQ ID NO: 516747 - protein, 9 aa, Homo Sapiens
STSRSDQDY

SEQ ID NO: 516748 - protein, 9 aa, Homo Sapiens
ISPSQPPCS

SEQ ID NO: 516749 - protein, 9 aa, Homo Sapiens
LGKIQGKSL

SEQ ID NO: 516750 - protein, 9 aa, Homo Sapiens
MGATSNSED

SEQ ID NO: 516751 - protein, 9 aa, Homo Sapiens
FRFIEECSF

SEQ ID NO: 516752 - protein, 9 aa, Homo Sapiens
VLLVPTGGG

SEQ ID NO: 516753 - protein, 9 aa, Homo Sapiens
LCPLLLRCL

SEQ ID NO: 516754 - protein, 9 aa, Homo Sapiens
LGEHSTSGH

SEQ ID NO: 516755 - protein, 9 aa, Homo Sapiens
KSEEMQPTV

SEQ ID NO: 516756 - protein, 9 aa, Homo Sapiens
MPYQPQVDG

SEQ ID NO: 516757 - protein, 9 aa, Homo Sapiens
KTPWGKRGC

SEQ ID NO: 516758 - protein, 9 aa, Homo Sapiens
DDFAMKTLR

SEQ ID NO: 516759 - protein, 9 aa, Homo Sapiens
GAIDFLGSY

SEQ ID NO: 516760 - protein, 9 aa, Homo Sapiens
SPLGLGQPR

SEQ ID NO: 516761 - protein, 9 aa, Homo Sapiens
SQLEQQEQY

SEQ ID NO: 516762 - protein, 9 aa, Homo Sapiens
RGLLNSTWP

SEQ ID NO: 516763 - protein, 9 aa, Homo Sapiens
HHLLLLLII

SEQ ID NO: 516764 - protein, 9 aa, Homo Sapiens
ANYSLQIYR

SEQ ID NO: 516765 - protein, 9 aa, Homo Sapiens
GFTGPSETS

SEQ ID NO: 516766 - protein, 9 aa, Homo Sapiens
WVFGEAMCN

SEQ ID NO: 516767 - protein, 9 aa, Homo Sapiens
SVSVERLVE

SEQ ID NO: 516768 - protein, 9 aa, Homo Sapiens
SRSVMIQMS

SEQ ID NO: 516769 - protein, 9 aa, Homo Sapiens
YDCPAWAPC

SEQ ID NO: 516770 - protein, 9 aa, Homo Sapiens
YLDSTAYRP

SEQ ID NO: 516771 - protein, 9 aa, Homo Sapiens
QMLPHVEGV

SEQ ID NO: 516772 - protein, 9 aa, Homo Sapiens
PHHSNTFVY

SEQ ID NO: 516773 - protein, 9 aa, Homo Sapiens
FIPKSEEMQ

SEQ ID NO: 516774 - protein, 9 aa, Homo Sapiens
RSLMFCNAK

SEQ ID NO: 516775 - protein, 9 aa, Homo Sapiens
AGSDSLIME

SEQ ID NO: 516776 - protein, 9 aa, Homo Sapiens
NLEKHEEML

SEQ ID NO: 516777 - protein, 9 aa, Homo Sapiens
SQDPLALAR

SEQ ID NO: 516778 - protein, 9 aa, Homo Sapiens
QEQYHLLRL

SEQ ID NO: 516779 - protein, 9 aa, Homo Sapiens
TQAVQNNRV

SEQ ID NO: 516780 - protein, 9 aa, Homo Sapiens
FIKARPYFT

SEQ ID NO: 516781 - protein, 9 aa, Homo Sapiens
KIQATNVSQ

SEQ ID NO: 516782 - protein, 9 aa, Homo Sapiens
RGEKVIQLR

SEQ ID NO: 516783 - protein, 9 aa, Homo Sapiens
VFGEAMCNL

SEQ ID NO: 516784 - protein, 9 aa, Homo Sapiens
RQLPRRLCA

SEQ ID NO: 516785 - protein, 9 aa, Homo Sapiens
RQYASRVPS

SEQ ID NO: 516786 - protein, 9 aa, Homo Sapiens
LIVKVTNQI

SEQ ID NO: 516787 - protein, 9 aa, Homo Sapiens
HFVRDTSHQ

SEQ ID NO: 516788 - protein, 9 aa, Homo Sapiens
AGALDHAQT

SEQ ID NO: 516789 - protein, 9 aa, Homo Sapiens
LAEGFLAKT

SEQ ID NO: 516790 - protein, 9 aa, Homo Sapiens
DEQDRVPPL

SEQ ID NO: 516791 - protein, 9 aa, Homo Sapiens
LLDQRLSPK

SEQ ID NO: 516792 - protein, 9 aa, Homo Sapiens
DSDNEYIGV

SEQ ID NO: 516793 - protein, 9 aa, Homo Sapiens
NCLIFKATS

SEQ ID NO: 516794 - protein, 9 aa, Homo Sapiens
KLVVTSANT

SEQ ID NO: 516795 - protein, 9 aa, Homo Sapiens
HRIHLLCMG

SEQ ID NO: 516796 - protein, 9 aa, Homo Sapiens
PQDFWKCGS

SEQ ID NO: 516797 - protein, 9 aa, Homo Sapiens
AEAPALEPR

SEQ ID NO: 516798 - protein, 9 aa, Homo Sapiens
DSEIGCITI

SEQ ID NO: 516799 - protein, 9 aa, Homo Sapiens
IQATNVSQA

SEQ ID NO: 516800 - protein, 9 aa, Homo Sapiens
RPTIVHDPL

SEQ ID NO: 516801 - protein, 9 aa, Homo Sapiens
LEKLAEGFL

SEQ ID NO: 516802 - protein, 9 aa, Homo Sapiens
LCYRVGYCN

SEQ ID NO: 516803 - protein, 9 aa, Homo Sapiens
NLNPFVQCV

SEQ ID NO: 516804 - protein, 9 aa, Homo Sapiens
DIGIGTTSA

SEQ ID NO: 516805 - protein, 9 aa, Homo Sapiens
TPHAQTSSG

SEQ ID NO: 516806 - protein, 9 aa, Homo Sapiens
QSGTPHAQT

SEQ ID NO: 516807 - protein, 9 aa, Homo Sapiens
VKPEGGQNK

SEQ ID NO: 516808 - protein, 9 aa, Homo Sapiens
SCAQQVEGA

SEQ ID NO: 516809 - protein, 9 aa, Homo Sapiens
DQSIECVDL

SEQ ID NO: 516810 - protein, 9 aa, Homo Sapiens
SRSPPGRLE

SEQ ID NO: 516811 - protein, 9 aa, Homo Sapiens
SAKDFFNIE

SEQ ID NO: 516812 - protein, 9 aa, Homo Sapiens
RGHAAPCGQ

SEQ ID NO: 516813 - protein, 9 aa, Homo Sapiens
KSLGSFFID

SEQ ID NO: 516814 - protein, 9 aa, Homo Sapiens
ISDETLKLV

SEQ ID NO: 516815 - protein, 9 aa, Homo Sapiens
GVLLYHTAK

SEQ ID NO: 516816 - protein, 9 aa, Homo Sapiens
GWLPAGSTR

SEQ ID NO: 516817 - protein, 9 aa, Homo Sapiens
LLNLTHLYL

SEQ ID NO: 516818 - protein, 9 aa, Homo Sapiens
QIVSELQTN

SEQ ID NO: 516819 - protein, 9 aa, Homo Sapiens
GYISVVDTM

SEQ ID NO: 516820 - protein, 9 aa, Homo Sapiens
FHLKKPSAH

SEQ ID NO: 516821 - protein, 9 aa, Homo Sapiens
PVPVKSHSD

SEQ ID NO: 516822 - protein, 9 aa, Homo Sapiens
KTITRLHKS

SEQ ID NO: 516823 - protein, 9 aa, Homo Sapiens
RSKRLRQLL

SEQ ID NO: 516824 - protein, 9 aa, Homo Sapiens
SDESDEKTC

SEQ ID NO: 516825 - protein, 9 aa, Homo Sapiens
PESRNVSSV

SEQ ID NO: 516826 - protein, 9 aa, Homo Sapiens
EHERMAAST

SEQ ID NO: 516827 - protein, 9 aa, Homo Sapiens
AIPGLRVQR

SEQ ID NO: 516828 - protein, 9 aa, Homo Sapiens
LSNLSLTSD

SEQ ID NO: 516829 - protein, 9 aa, Homo Sapiens
SDQDYVDGD

SEQ ID NO: 516830 - protein, 9 aa, Homo Sapiens
HLLCMGSTL

SEQ ID NO: 516831 - protein, 9 aa, Homo Sapiens
QWQRFKALA

SEQ ID NO: 516832 - protein, 9 aa, Homo Sapiens
DGSGGDGIY

SEQ ID NO: 516833 - protein, 9 aa, Homo Sapiens
FSDSEIGCI

SEQ ID NO: 516834 - protein, 9 aa, Homo Sapiens
KQKSLSNLS

SEQ ID NO: 516835 - protein, 9 aa, Homo Sapiens
ELELLLFQP

SEQ ID NO: 516836 - protein, 9 aa, Homo Sapiens
LECDEILKG

SEQ ID NO: 516837 - protein, 9 aa, Homo Sapiens
LVRNESHEN

SEQ ID NO: 516838 - protein, 9 aa, Homo Sapiens
LDYSGPSIE

SEQ ID NO: 516839 - protein, 9 aa, Homo Sapiens
RRKSLFPGL

SEQ ID NO: 516840 - protein, 9 aa, Homo Sapiens
ELELLLFQV

SEQ ID NO: 516841 - protein, 9 aa, Homo Sapiens
LAAQEGPLL

SEQ ID NO: 516842 - protein, 9 aa, Homo Sapiens
AGAVGSGAY

SEQ ID NO: 516843 - protein, 9 aa, Homo Sapiens
NAQHHDAGF

SEQ ID NO: 516844 - protein, 9 aa, Homo Sapiens
PEFLNGTYH

SEQ ID NO: 516845 - protein, 9 aa, Homo Sapiens
RKWFRLGSV

SEQ ID NO: 516846 - protein, 9 aa, Homo Sapiens
SSYFREQGK

SEQ ID NO: 516847 - protein, 9 aa, Homo Sapiens
TTAVTQGIV

SEQ ID NO: 516848 - protein, 9 aa, Homo Sapiens
EEEALFKKI

SEQ ID NO: 516849 - protein, 9 aa, Homo Sapiens
NSNNSGSYN

SEQ ID NO: 516850 - protein, 9 aa, Homo Sapiens
MSLKVRSAG

SEQ ID NO: 516851 - protein, 9 aa, Homo Sapiens
FRHDSTSEN

SEQ ID NO: 516852 - protein, 9 aa, Homo Sapiens
IKEMSMVNI

SEQ ID NO: 516853 - protein, 9 aa, Homo Sapiens
LAHAYPSGP

SEQ ID NO: 516854 - protein, 9 aa, Homo Sapiens
LEKDSVTVK

SEQ ID NO: 516855 - protein, 9 aa, Homo Sapiens
DRGHAAPCG

SEQ ID NO: 516856 - protein, 9 aa, Homo Sapiens
RQSGTPHAQ

SEQ ID NO: 516857 - protein, 9 aa, Homo Sapiens
TAGSDSLIM

SEQ ID NO: 516858 - protein, 9 aa, Homo Sapiens
LKHWTGGCP

SEQ ID NO: 516859 - protein, 9 aa, Homo Sapiens
SLAHAYPSG

SEQ ID NO: 516860 - protein, 9 aa, Homo Sapiens
FFKLSTPGQ

SEQ ID NO: 516861 - protein, 9 aa, Homo Sapiens
PDLEKTIKC

SEQ ID NO: 516862 - protein, 9 aa, Homo Sapiens
EYKCKVPNK

SEQ ID NO: 516863 - protein, 9 aa, Homo Sapiens
LDLLEPEQT

SEQ ID NO: 516864 - protein, 9 aa, Homo Sapiens
PFASPVMEF

SEQ ID NO: 516865 - protein, 9 aa, Homo Sapiens
PVASSFQVI

SEQ ID NO: 516866 - protein, 9 aa, Homo Sapiens
AGSASDTFQ

SEQ ID NO: 516867 - protein, 9 aa, Homo Sapiens
AMLQDEDLS

SEQ ID NO: 516868 - protein, 9 aa, Homo Sapiens
GHPELRGIS

SEQ ID NO: 516869 - protein, 9 aa, Homo Sapiens
FLGSYSEAH

SEQ ID NO: 516870 - protein, 9 aa, Homo Sapiens
VIDNLQFGR

SEQ ID NO: 516871 - protein, 9 aa, Homo Sapiens
LLFRLKFKE

SEQ ID NO: 516872 - protein, 9 aa, Homo Sapiens
VSELQTNYI

SEQ ID NO: 516873 - protein, 9 aa, Homo Sapiens
GTWNPEGPD

SEQ ID NO: 516874 - protein, 9 aa, Homo Sapiens
ENLDRFWPI

SEQ ID NO: 516875 - protein, 9 aa, Homo Sapiens
FLHRVGHDM

SEQ ID NO: 516876 - protein, 9 aa, Homo Sapiens
AIDNWSTAT

SEQ ID NO: 516877 - protein, 9 aa, Homo Sapiens
PLPPAAGSR

SEQ ID NO: 516878 - protein, 9 aa, Homo Sapiens
TQLLVSEDR

SEQ ID NO: 516879 - protein, 9 aa, Homo Sapiens
RLMISNSHI

SEQ ID NO: 516880 - protein, 9 aa, Homo Sapiens
LDDRQRKYD

SEQ ID NO: 516881 - protein, 9 aa, Homo Sapiens
YEEQEPSPR

SEQ ID NO: 516882 - protein, 9 aa, Homo Sapiens
AHERARMRV

SEQ ID NO: 516883 - protein, 9 aa, Homo Sapiens
FFNRSVRRN

SEQ ID NO: 516884 - protein, 9 aa, Homo Sapiens
VAASWACAS

SEQ ID NO: 516885 - protein, 9 aa, Homo Sapiens
HVEGVHLLS

SEQ ID NO: 516886 - protein, 9 aa, Homo Sapiens
YGRKEGSQP

SEQ ID NO: 516887 - protein, 9 aa, Homo Sapiens
MTKTQMFFR

SEQ ID NO: 516888 - protein, 9 aa, Homo Sapiens
RNVSSVHRD

SEQ ID NO: 516889 - protein, 9 aa, Homo Sapiens
NTEDFVEDI

SEQ ID NO: 516890 - protein, 9 aa, Homo Sapiens
KSFFNRSVR

SEQ ID NO: 516891 - protein, 9 aa, Homo Sapiens
CQKVPILTE

SEQ ID NO: 516892 - protein, 9 aa, Homo Sapiens
PSGLQEWRP

SEQ ID NO: 516893 - protein, 9 aa, Homo Sapiens
NSAEFHGLS

SEQ ID NO: 516894 - protein, 9 aa, Homo Sapiens
KTIAEPAVA

SEQ ID NO: 516895 - protein, 9 aa, Homo Sapiens
FFRFIEECS

SEQ ID NO: 516896 - protein, 9 aa, Homo Sapiens
KSLSNLSLT

SEQ ID NO: 516897 - protein, 9 aa, Homo Sapiens
RCPEPPSAA

SEQ ID NO: 516898 - protein, 9 aa, Homo Sapiens
VFLGNTPEH

SEQ ID NO: 516899 - protein, 9 aa, Homo Sapiens
QPSAYLPSG

SEQ ID NO: 516900 - protein, 9 aa, Homo Sapiens
NLQALGRQQ

SEQ ID NO: 516901 - protein, 9 aa, Homo Sapiens
GKIQGKSLG

SEQ ID NO: 516902 - protein, 9 aa, Homo Sapiens
KEIVSLGDS

SEQ ID NO: 516903 - protein, 9 aa, Homo Sapiens
RESRFENGH

SEQ ID NO: 516904 - protein, 9 aa, Homo Sapiens
EMSPLDLLE

SEQ ID NO: 516905 - protein, 9 aa, Homo Sapiens
HTQLLVSED

SEQ ID NO: 516906 - protein, 9 aa, Homo Sapiens
SEDPVPVKS

SEQ ID NO: 516907 - protein, 9 aa, Homo Sapiens
LHLPNVQPP

SEQ ID NO: 516908 - protein, 9 aa, Homo Sapiens
ICRDPVTLS

SEQ ID NO: 516909 - protein, 9 aa, Homo Sapiens
GTYHATVPE

SEQ ID NO: 516910 - protein, 9 aa, Homo Sapiens
QRNAANAHE

SEQ ID NO: 516911 - protein, 9 aa, Homo Sapiens
KRFISTLAQ

SEQ ID NO: 516912 - protein, 9 aa, Homo Sapiens
TAMLQDEDL

SEQ ID NO: 516913 - protein, 9 aa, Homo Sapiens
QAVQNNRVV

SEQ ID NO: 516914 - protein, 9 aa, Homo Sapiens
RNESHENCD

SEQ ID NO: 516915 - protein, 9 aa, Homo Sapiens
SGDCGVQRV

SEQ ID NO: 516916 - protein, 9 aa, Homo Sapiens
SPGGAPPQP

SEQ ID NO: 516917 - protein, 9 aa, Homo Sapiens
NLGLFELLF

SEQ ID NO: 516918 - protein, 9 aa, Homo Sapiens
LFQVSARDG

SEQ ID NO: 516919 - protein, 9 aa, Homo Sapiens
IVGGSKAQP

SEQ ID NO: 516920 - protein, 9 aa, Homo Sapiens
DDAELQHAT

SEQ ID NO: 516921 - protein, 9 aa, Homo Sapiens
YVEIIDIND

SEQ ID NO: 516922 - protein, 9 aa, Homo Sapiens
GDMDYNWLH

SEQ ID NO: 516923 - protein, 9 aa, Homo Sapiens
SKDLEDMNQ

SEQ ID NO: 516924 - protein, 9 aa, Homo Sapiens
QATSPHSVL

SEQ ID NO: 516925 - protein, 9 aa, Homo Sapiens
VLSPFSTQV

SEQ ID NO: 516926 - protein, 9 aa, Homo Sapiens
PGAYDCPAW

SEQ ID NO: 516927 - protein, 9 aa, Homo Sapiens
SRKGNTHVW

SEQ ID NO: 516928 - protein, 9 aa, Homo Sapiens
RSTNLEDSA

SEQ ID NO: 516929 - protein, 9 aa, Homo Sapiens
ITKFRVFRI

SEQ ID NO: 516930 - protein, 9 aa, Homo Sapiens
GSPGAVRTR

SEQ ID NO: 516931 - protein, 9 aa, Homo Sapiens
LVCCLGSGP

SEQ ID NO: 516932 - protein, 9 aa, Homo Sapiens
SPFSTQVEM

SEQ ID NO: 516933 - protein, 9 aa, Homo Sapiens
EFLNGTYHA

SEQ ID NO: 516934 - protein, 9 aa, Homo Sapiens
KVIQLRSKK

SEQ ID NO: 516935 - protein, 9 aa, Homo Sapiens
DLEKTIKCA

SEQ ID NO: 516936 - protein, 9 aa, Homo Sapiens
HLKKPSAHM

SEQ ID NO: 516937 - protein, 9 aa, Homo Sapiens
KRGCKMFHT

SEQ ID NO: 516938 - protein, 9 aa, Homo Sapiens
NSTGIFNET

SEQ ID NO: 516939 - protein, 9 aa, Homo Sapiens
SRLRDKQWH

SEQ ID NO: 516940 - protein, 9 aa, Homo Sapiens
QLYFLQSPT

SEQ ID NO: 516941 - protein, 9 aa, Homo Sapiens
KDFFNIEVR

SEQ ID NO: 516942 - protein, 9 aa, Homo Sapiens
YIRFRDSGD

SEQ ID NO: 516943 - protein, 9 aa, Homo Sapiens
PVHLPCYHS

SEQ ID NO: 516944 - protein, 9 aa, Homo Sapiens
PKSEPLPPF

SEQ ID NO: 516945 - protein, 9 aa, Homo Sapiens
KRRSGPPGP

SEQ ID NO: 516946 - protein, 9 aa, Homo Sapiens
TDRGSPVLS

SEQ ID NO: 516947 - protein, 9 aa, Homo Sapiens
DDVKDPRRP

SEQ ID NO: 516948 - protein, 9 aa, Homo Sapiens
PTAPQPFIS

SEQ ID NO: 516949 - protein, 9 aa, Homo Sapiens
RHDSTSENI

SEQ ID NO: 516950 - protein, 9 aa, Homo Sapiens
ERQGLLNCP

SEQ ID NO: 516951 - protein, 9 aa, Homo Sapiens
DRQMLPHVE

SEQ ID NO: 516952 - protein, 9 aa, Homo Sapiens
KVKHENDNA

SEQ ID NO: 516953 - protein, 9 aa, Homo Sapiens
CGSHMLVVT

SEQ ID NO: 516954 - protein, 9 aa, Homo Sapiens
TSGGKKTEE

SEQ ID NO: 516955 - protein, 9 aa, Homo Sapiens
SNTVASDGS

SEQ ID NO: 516956 - protein, 9 aa, Homo Sapiens
ALTLLDLCL

SEQ ID NO: 516957 - protein, 9 aa, Homo Sapiens
LLEPEQTFF

SEQ ID NO: 516958 - protein, 9 aa, Homo Sapiens
VRALGEVNA

SEQ ID NO: 516959 - protein, 9 aa, Homo Sapiens
QFRLIEAGL

SEQ ID NO: 516960 - protein, 9 aa, Homo Sapiens
PAVAAGVPV

SEQ ID NO: 516961 - protein, 9 aa, Homo Sapiens
AVSLILSLT

SEQ ID NO: 516962 - protein, 9 aa, Homo Sapiens
KVPNKALPA

SEQ ID NO: 516963 - protein, 9 aa, Homo Sapiens
SHENCDFRV

SEQ ID NO: 516964 - protein, 9 aa, Homo Sapiens
CVGFLGPRC

SEQ ID NO: 516965 - protein, 9 aa, Homo Sapiens
GGDTGFTGP

SEQ ID NO: 516966 - protein, 9 aa, Homo Sapiens
FSVHFNRFN

SEQ ID NO: 516967 - protein, 9 aa, Homo Sapiens
KLVCCLGSG

SEQ ID NO: 516968 - protein, 9 aa, Homo Sapiens
KSACLGEHS

SEQ ID NO: 516969 - protein, 9 aa, Homo Sapiens
AHSPPHPGS

SEQ ID NO: 516970 - protein, 9 aa, Homo Sapiens
ASKVKCKED

SEQ ID NO: 516971 - protein, 9 aa, Homo Sapiens
HGRSNLQAL

SEQ ID NO: 516972 - protein, 9 aa, Homo Sapiens
DPVPVKSHS

SEQ ID NO: 516973 - protein, 9 aa, Homo Sapiens
EYFKGISDE

SEQ ID NO: 516974 - protein, 9 aa, Homo Sapiens
KATSRASVG

SEQ ID NO: 516975 - protein, 9 aa, Homo Sapiens
SDPELWSCG

SEQ ID NO: 516976 - protein, 9 aa, Homo Sapiens
RVILLENLD

SEQ ID NO: 516977 - protein, 9 aa, Homo Sapiens
YSLQIYRDE

SEQ ID NO: 516978 - protein, 9 aa, Homo Sapiens
TKWYDAYFI

SEQ ID NO: 516979 - protein, 9 aa, Homo Sapiens
KIKQPDVVC

SEQ ID NO: 516980 - protein, 9 aa, Homo Sapiens
FSNSIGNSQ

SEQ ID NO: 516981 - protein, 9 aa, Homo Sapiens
LPGWSRYIP

SEQ ID NO: 516982 - protein, 9 aa, Homo Sapiens
GAAPAGRSR

SEQ ID NO: 516983 - protein, 9 aa, Homo Sapiens
RGESTTSPI

SEQ ID NO: 516984 - protein, 9 aa, Homo Sapiens
VAIFCFHLR

SEQ ID NO: 516985 - protein, 9 aa, Homo Sapiens
AAPPGHKGQ

SEQ ID NO: 516986 - protein, 9 aa, Homo Sapiens
EVSPTDRRP

SEQ ID NO: 516987 - protein, 9 aa, Homo Sapiens
FHTCASHCI

SEQ ID NO: 516988 - protein, 9 aa, Homo Sapiens
YLINRQGPY

SEQ ID NO: 516989 - protein, 9 aa, Homo Sapiens
ITTTLPSLE

SEQ ID NO: 516990 - protein, 9 aa, Homo Sapiens
EFHPHHSNT

SEQ ID NO: 516991 - protein, 9 aa, Homo Sapiens
EMNQMHESM

SEQ ID NO: 516992 - protein, 9 aa, Homo Sapiens
GCKSFFNRS

SEQ ID NO: 516993 - protein, 9 aa, Homo Sapiens
HNEKSNCQK

SEQ ID NO: 516994 - protein, 9 aa, Homo Sapiens
NIRKAQPDD

SEQ ID NO: 516995 - protein, 9 aa, Homo Sapiens
SGQAPKATS

SEQ ID NO: 516996 - protein, 9 aa, Homo Sapiens
FRQWQRFKA

SEQ ID NO: 516997 - protein, 9 aa, Homo Sapiens
NIPAGAEEI

SEQ ID NO: 516998 - protein, 9 aa, Homo Sapiens
GKALRRSLV

SEQ ID NO: 516999 - protein, 9 aa, Homo Sapiens
RGAAPPGHK

SEQ ID NO: 517000 - protein, 9 aa, Homo Sapiens
HDMKDMMLY

SEQ ID NO: 517001 - protein, 9 aa, Homo Sapiens
PRSVTTVHW

SEQ ID NO: 517002 - protein, 9 aa, Homo Sapiens
SGPGLYGDI

SEQ ID NO: 517003 - protein, 9 aa, Homo Sapiens
TYDRQASSQ

SEQ ID NO: 517004 - protein, 9 aa, Homo Sapiens
EPSDTIENM

SEQ ID NO: 517005 - protein, 9 aa, Homo Sapiens
YFREQGKAL

SEQ ID NO: 517006 - protein, 9 aa, Homo Sapiens
TTERQGLLN

SEQ ID NO: 517007 - protein, 9 aa, Homo Sapiens
AIFCFHLRR

SEQ ID NO: 517008 - protein, 9 aa, Homo Sapiens
SSVHRDFRL

SEQ ID NO: 517009 - protein, 9 aa, Homo Sapiens
MIVSINSCA

SEQ ID NO: 517010 - protein, 9 aa, Homo Sapiens
VLNLAISNL

SEQ ID NO: 517011 - protein, 9 aa, Homo Sapiens
LPPTIDDRD

SEQ ID NO: 517012 - protein, 9 aa, Homo Sapiens
RLHYRSGSY

SEQ ID NO: 517013 - protein, 9 aa, Homo Sapiens
IGTTSANEA

SEQ ID NO: 517014 - protein, 9 aa, Homo Sapiens
QSLSRLRDK

SEQ ID NO: 517015 - protein, 9 aa, Homo Sapiens
FLIKEMSMV

SEQ ID NO: 517016 - protein, 9 aa, Homo Sapiens
PPHPGSRRC

SEQ ID NO: 517017 - protein, 9 aa, Homo Sapiens
VVLSGLASR

SEQ ID NO: 517018 - protein, 9 aa, Homo Sapiens
HFFCYDQPV

SEQ ID NO: 517019 - protein, 9 aa, Homo Sapiens
VPSQPPSPQ

SEQ ID NO: 517020 - protein, 9 aa, Homo Sapiens
ERTKRHEMQ

SEQ ID NO: 517021 - protein, 9 aa, Homo Sapiens
LGIIPPADH

SEQ ID NO: 517022 - protein, 9 aa, Homo Sapiens
FRLIEAGLE

SEQ ID NO: 517023 - protein, 9 aa, Homo Sapiens
QGTHHGKKL

SEQ ID NO: 517024 - protein, 9 aa, Homo Sapiens
RITCIGAQD

SEQ ID NO: 517025 - protein, 9 aa, Homo Sapiens
LCIVNDKHF

SEQ ID NO: 517026 - protein, 9 aa, Homo Sapiens
NKPAIIAGV

SEQ ID NO: 517027 - protein, 9 aa, Homo Sapiens
AAELTDFIL

SEQ ID NO: 517028 - protein, 9 aa, Homo Sapiens
RNNLSCDCI

SEQ ID NO: 517029 - protein, 9 aa, Homo Sapiens
EDEEMNQMH

SEQ ID NO: 517030 - protein, 9 aa, Homo Sapiens
VSISSGINS

SEQ ID NO: 517031 - protein, 9 aa, Homo Sapiens
FTLKIRSTN

SEQ ID NO: 517032 - protein, 9 aa, Homo Sapiens
SDEKTCSDE

SEQ ID NO: 517033 - protein, 9 aa, Homo Sapiens
NPEGPDLSN

SEQ ID NO: 517034 - protein, 9 aa, Homo Sapiens
ATVVAAIDM

SEQ ID NO: 517035 - protein, 9 aa, Homo Sapiens
LCAAGDKKK

SEQ ID NO: 517036 - protein, 9 aa, Homo Sapiens
ESIPSPPGT

SEQ ID NO: 517037 - protein, 9 aa, Homo Sapiens
ARVSPTRNF

SEQ ID NO: 517038 - protein, 9 aa, Homo Sapiens
GSGAASLVA

SEQ ID NO: 517039 - protein, 9 aa, Homo Sapiens
ASATTFALN

SEQ ID NO: 517040 - protein, 9 aa, Homo Sapiens
GSGAAPAGR

SEQ ID NO: 517041 - protein, 9 aa, Homo Sapiens
EQEGHPELR

SEQ ID NO: 517042 - protein, 9 aa, Homo Sapiens
HPNASDQEN

SEQ ID NO: 517043 - protein, 9 aa, Homo Sapiens
SQAECDMEC

SEQ ID NO: 517044 - protein, 9 aa, Homo Sapiens
HMVKGTPFE

SEQ ID NO: 517045 - protein, 9 aa, Homo Sapiens
EFGNMQKIK

SEQ ID NO: 517046 - protein, 9 aa, Homo Sapiens
SIISARVSP

SEQ ID NO: 517047 - protein, 9 aa, Homo Sapiens
QDGRFLLHL

SEQ ID NO: 517048 - protein, 9 aa, Homo Sapiens
AGSTRGLLN

SEQ ID NO: 517049 - protein, 9 aa, Homo Sapiens
ALTYDRQAS

SEQ ID NO: 517050 - protein, 9 aa, Homo Sapiens
PSPPGTLPH

SEQ ID NO: 517051 - protein, 9 aa, Homo Sapiens
SDLGYAWNI

SEQ ID NO: 517052 - protein, 9 aa, Homo Sapiens
FTEEGAEDP

SEQ ID NO: 517053 - protein, 9 aa, Homo Sapiens
TPMGERSVN

SEQ ID NO: 517054 - protein, 9 aa, Homo Sapiens
RYSPHISDL

SEQ ID NO: 517055 - protein, 9 aa, Homo Sapiens
LGNTPEHVV

SEQ ID NO: 517056 - protein, 9 aa, Homo Sapiens
NGGRATMSI

SEQ ID NO: 517057 - protein, 9 aa, Homo Sapiens
LEELITKFR

SEQ ID NO: 517058 - protein, 9 aa, Homo Sapiens
VEDPYMMGL

SEQ ID NO: 517059 - protein, 9 aa, Homo Sapiens
LKRCTLCYR

SEQ ID NO: 517060 - protein, 9 aa, Homo Sapiens
SEDRLNETK

SEQ ID NO: 517061 - protein, 9 aa, Homo Sapiens
PFVPPLPAL

SEQ ID NO: 517062 - protein, 9 aa, Homo Sapiens
PLLLSRCSS

SEQ ID NO: 517063 - protein, 9 aa, Homo Sapiens
YTITFSDDK

SEQ ID NO: 517064 - protein, 9 aa, Homo Sapiens
VPDGGWWEV

SEQ ID NO: 517065 - protein, 9 aa, Homo Sapiens
EDAHNRGRK

SEQ ID NO: 517066 - protein, 9 aa, Homo Sapiens
LKVLHSSMV

SEQ ID NO: 517067 - protein, 9 aa, Homo Sapiens
KWYDAYFIK

SEQ ID NO: 517068 - protein, 9 aa, Homo Sapiens
KTSKDLEDM

SEQ ID NO: 517069 - protein, 9 aa, Homo Sapiens
ASPMKRFIS

SEQ ID NO: 517070 - protein, 9 aa, Homo Sapiens
PFFRKEQQE

SEQ ID NO: 517071 - protein, 9 aa, Homo Sapiens
LDDKHLLKK

SEQ ID NO: 517072 - protein, 9 aa, Homo Sapiens
GLGPAWSYP

SEQ ID NO: 517073 - protein, 9 aa, Homo Sapiens
SPFGAAVRE

SEQ ID NO: 517074 - protein, 9 aa, Homo Sapiens
VPPQSMGAT

SEQ ID NO: 517075 - protein, 9 aa, Homo Sapiens
LDLIKNYYR

SEQ ID NO: 517076 - protein, 9 aa, Homo Sapiens
SDTIENMKA

SEQ ID NO: 517077 - protein, 9 aa, Homo Sapiens
PPPGTPVRA

SEQ ID NO: 517078 - protein, 9 aa, Homo Sapiens
PQSRSEWED

SEQ ID NO: 517079 - protein, 9 aa, Homo Sapiens
ARAPLPPAA

SEQ ID NO: 517080 - protein, 9 aa, Homo Sapiens
SATTFALNQ

SEQ ID NO: 517081 - protein, 9 aa, Homo Sapiens
AEEAGMEDS

SEQ ID NO: 517082 - protein, 9 aa, Homo Sapiens
YTQAVQNNR

SEQ ID NO: 517083 - protein, 9 aa, Homo Sapiens
RPRDQPAAL

SEQ ID NO: 517084 - protein, 9 aa, Homo Sapiens
NRGYVTTLL

SEQ ID NO: 517085 - protein, 9 aa, Homo Sapiens
LRMLLGCFL

SEQ ID NO: 517086 - protein, 9 aa, Homo Sapiens
CRDPVTLSP

SEQ ID NO: 517087 - protein, 9 aa, Homo Sapiens
DCGVQRVPQ

SEQ ID NO: 517088 - protein, 9 aa, Homo Sapiens
EWEDSSDPL

SEQ ID NO: 517089 - protein, 9 aa, Homo Sapiens
SSYGAFWAG

SEQ ID NO: 517090 - protein, 9 aa, Homo Sapiens
DLDKMDDDD

SEQ ID NO: 517091 - protein, 9 aa, Homo Sapiens
FIPIFVYGA

SEQ ID NO: 517092 - protein, 9 aa, Homo Sapiens
HPGNCLIFK

SEQ ID NO: 517093 - protein, 9 aa, Homo Sapiens
GYVTTLLGL

SEQ ID NO: 517094 - protein, 9 aa, Homo Sapiens
ALGEVNAAR

SEQ ID NO: 517095 - protein, 9 aa, Homo Sapiens
AARAPLPPA

SEQ ID NO: 517096 - protein, 9 aa, Homo Sapiens
MAVDRYEAV

SEQ ID NO: 517097 - protein, 9 aa, Homo Sapiens
LPALDELGG

SEQ ID NO: 517098 - protein, 9 aa, Homo Sapiens
SDTFQDSSV

SEQ ID NO: 517099 - protein, 9 aa, Homo Sapiens
YYENAQHHD

SEQ ID NO: 517100 - protein, 9 aa, Homo Sapiens
ITSVAEANE

SEQ ID NO: 517101 - protein, 9 aa, Homo Sapiens
TLGIIPPAD

SEQ ID NO: 517102 - protein, 9 aa, Homo Sapiens
IVAIFCFHL

SEQ ID NO: 517103 - protein, 9 aa, Homo Sapiens
IRTTFSSAQ

SEQ ID NO: 517104 - protein, 9 aa, Homo Sapiens
DEDLSSDGD

SEQ ID NO: 517105 - protein, 9 aa, Homo Sapiens
FSGCLCEIE

SEQ ID NO: 517106 - protein, 9 aa, Homo Sapiens
LLFSFGLTI

SEQ ID NO: 517107 - protein, 9 aa, Homo Sapiens
IYCLTITGN

SEQ ID NO: 517108 - protein, 9 aa, Homo Sapiens
HLSRYEYGI

SEQ ID NO: 517109 - protein, 9 aa, Homo Sapiens
SKVKCKEDY

SEQ ID NO: 517110 - protein, 9 aa, Homo Sapiens
AADDEGGPD

SEQ ID NO: 517111 - protein, 9 aa, Homo Sapiens
CAQQVEGAS

SEQ ID NO: 517112 - protein, 9 aa, Homo Sapiens
RESNTVASD

SEQ ID NO: 517113 - protein, 9 aa, Homo Sapiens
VVAAIDMAR

SEQ ID NO: 517114 - protein, 9 aa, Homo Sapiens
LIHLHAGPV

SEQ ID NO: 517115 - protein, 9 aa, Homo Sapiens
RDGSGGDGI

SEQ ID NO: 517116 - protein, 9 aa, Homo Sapiens
EKTPMGERS

SEQ ID NO: 517117 - protein, 9 aa, Homo Sapiens
GYFIPIFVY

SEQ ID NO: 517118 - protein, 9 aa, Homo Sapiens
FLDFYLINR

SEQ ID NO: 517119 - protein, 9 aa, Homo Sapiens
KITSLIVKV

SEQ ID NO: 517120 - protein, 9 aa, Homo Sapiens
ANADIGIGT

SEQ ID NO: 517121 - protein, 9 aa, Homo Sapiens
RQVEGCRGP

SEQ ID NO: 517122 - protein, 9 aa, Homo Sapiens
GGVFQKRTV

SEQ ID NO: 517123 - protein, 9 aa, Homo Sapiens
NTEFVATKS

SEQ ID NO: 517124 - protein, 9 aa, Homo Sapiens
KLRESMIQL

SEQ ID NO: 517125 - protein, 9 aa, Homo Sapiens
LQDEDLSSD

SEQ ID NO: 517126 - protein, 9 aa, Homo Sapiens
LPCYHSTIS

SEQ ID NO: 517127 - protein, 9 aa, Homo Sapiens
PSPYVGAAS

SEQ ID NO: 517128 - protein, 9 aa, Homo Sapiens
TKTQMFFRF

SEQ ID NO: 517129 - protein, 9 aa, Homo Sapiens
IGNIPGYAR

SEQ ID NO: 517130 - protein, 9 aa, Homo Sapiens
NRRTAYVVA

SEQ ID NO: 517131 - protein, 9 aa, Homo Sapiens
PCSPEWGLR

SEQ ID NO: 517132 - protein, 9 aa, Homo Sapiens
NLSCDCIGR

SEQ ID NO: 517133 - protein, 9 aa, Homo Sapiens
VRYGRKEGS

SEQ ID NO: 517134 - protein, 9 aa, Homo Sapiens
SVKVRALGE

SEQ ID NO: 517135 - protein, 9 aa, Homo Sapiens
DKHFVRDTS

SEQ ID NO: 517136 - protein, 9 aa, Homo Sapiens
RSAGCSVLP

SEQ ID NO: 517137 - protein, 9 aa, Homo Sapiens
PPQSMGATS

SEQ ID NO: 517138 - protein, 9 aa, Homo Sapiens
DHSIVLTEA

SEQ ID NO: 517139 - protein, 9 aa, Homo Sapiens
QKPRWVASY

SEQ ID NO: 517140 - protein, 9 aa, Homo Sapiens
GGCPFREGV

SEQ ID NO: 517141 - protein, 9 aa, Homo Sapiens
EGPDLSNCT

SEQ ID NO: 517142 - protein, 9 aa, Homo Sapiens
EDIQDELKK

SEQ ID NO: 517143 - protein, 9 aa, Homo Sapiens
HHTSWHSSE

SEQ ID NO: 517144 - protein, 9 aa, Homo Sapiens
RDPVTLSPL

SEQ ID NO: 517145 - protein, 9 aa, Homo Sapiens
SAHSPPHPG

SEQ ID NO: 517146 - protein, 9 aa, Homo Sapiens
FGNMQKIKQ

SEQ ID NO: 517147 - protein, 9 aa, Homo Sapiens
CSTSCGGVF

SEQ ID NO: 517148 - protein, 9 aa, Homo Sapiens
GLLLTTAFD

SEQ ID NO: 517149 - protein, 9 aa, Homo Sapiens
TMSISNGKS

SEQ ID NO: 517150 - protein, 9 aa, Homo Sapiens
LLAAIPGLR

SEQ ID NO: 517151 - protein, 9 aa, Homo Sapiens
WKTQFSKKQ

SEQ ID NO: 517152 - protein, 9 aa, Homo Sapiens
QKVPILTEL

SEQ ID NO: 517153 - protein, 9 aa, Homo Sapiens
VILSSVSFW

SEQ ID NO: 517154 - protein, 9 aa, Homo Sapiens
PSSVAHLVR

SEQ ID NO: 517155 - protein, 9 aa, Homo Sapiens
SPMKRFIST

SEQ ID NO: 517156 - protein, 9 aa, Homo Sapiens
GFLGPRCAR

SEQ ID NO: 517157 - protein, 9 aa, Homo Sapiens
SQPPCSPEW

SEQ ID NO: 517158 - protein, 9 aa, Homo Sapiens
CSRHAPPPT

SEQ ID NO: 517159 - protein, 9 aa, Homo Sapiens
HSNTFVYSS

SEQ ID NO: 517160 - protein, 9 aa, Homo Sapiens
PQGGEETSC

SEQ ID NO: 517161 - protein, 9 aa, Homo Sapiens
LVILKNISG

SEQ ID NO: 517162 - protein, 9 aa, Homo Sapiens
ARRLRHLVV

SEQ ID NO: 517163 - protein, 9 aa, Homo Sapiens
MNCGQHYCP

SEQ ID NO: 517164 - protein, 9 aa, Homo Sapiens
LFKKIAETL

SEQ ID NO: 517165 - protein, 9 aa, Homo Sapiens
PFGAAVREQ

SEQ ID NO: 517166 - protein, 9 aa, Homo Sapiens
FKKAHLTHP

SEQ ID NO: 517167 - protein, 9 aa, Homo Sapiens
KKAHLTHPE

SEQ ID NO: 517168 - protein, 9 aa, Homo Sapiens
EDLSSDGDE

SEQ ID NO: 517169 - protein, 9 aa, Homo Sapiens
LAEDEEMNQ

SEQ ID NO: 517170 - protein, 9 aa, Homo Sapiens
PASGGECPS

SEQ ID NO: 517171 - protein, 9 aa, Homo Sapiens
SAALLRVQK

SEQ ID NO: 517172 - protein, 9 aa, Homo Sapiens
TTTTDVSRT

SEQ ID NO: 517173 - protein, 9 aa, Homo Sapiens
WDRECCDYR

SEQ ID NO: 517174 - protein, 9 aa, Homo Sapiens
RIRTTFSSA

SEQ ID NO: 517175 - protein, 9 aa, Homo Sapiens
NSHISAVAP

SEQ ID NO: 517176 - protein, 9 aa, Homo Sapiens
RDSGSAYLP

SEQ ID NO: 517177 - protein, 9 aa, Homo Sapiens
NTMSSADLL

SEQ ID NO: 517178 - protein, 9 aa, Homo Sapiens
INICPQDSL

SEQ ID NO: 517179 - protein, 9 aa, Homo Sapiens
LKGTFTQLS

SEQ ID NO: 517180 - protein, 9 aa, Homo Sapiens
KCDTVDDCA

SEQ ID NO: 517181 - protein, 9 aa, Homo Sapiens
IRIFIPKSE

SEQ ID NO: 517182 - protein, 9 aa, Homo Sapiens
MSQLEQQEQ

SEQ ID NO: 517183 - protein, 9 aa, Homo Sapiens
LSRKICWLI

SEQ ID NO: 517184 - protein, 9 aa, Homo Sapiens
WIYQRRGLV

SEQ ID NO: 517185 - protein, 9 aa, Homo Sapiens
QDLCAGLAE

SEQ ID NO: 517186 - protein, 9 aa, Homo Sapiens
DPVTLSPLG

SEQ ID NO: 517187 - protein, 9 aa, Homo Sapiens
NLEDSAMYF

SEQ ID NO: 517188 - protein, 9 aa, Homo Sapiens
HPGSRRCSR

SEQ ID NO: 517189 - protein, 9 aa, Homo Sapiens
HSSMVCKVF

SEQ ID NO: 517190 - protein, 9 aa, Homo Sapiens
SSCGYGHGY

SEQ ID NO: 517191 - protein, 9 aa, Homo Sapiens
SRKLISDKD

SEQ ID NO: 517192 - protein, 9 aa, Homo Sapiens
GSAYLPFVP

SEQ ID NO: 517193 - protein, 9 aa, Homo Sapiens
VAAIDMARV

SEQ ID NO: 517194 - protein, 9 aa, Homo Sapiens
FLGPRCARG

SEQ ID NO: 517195 - protein, 9 aa, Homo Sapiens
FMNPKLGEK

SEQ ID NO: 517196 - protein, 9 aa, Homo Sapiens
FPMDAQACP

SEQ ID NO: 517197 - protein, 9 aa, Homo Sapiens
DHDDFAMKT

SEQ ID NO: 517198 - protein, 9 aa, Homo Sapiens
CDHTTILFA

SEQ ID NO: 517199 - protein, 9 aa, Homo Sapiens
AGAEEISEV

SEQ ID NO: 517200 - protein, 9 aa, Homo Sapiens
TIENMKAKI

SEQ ID NO: 517201 - protein, 9 aa, Homo Sapiens
KMWIAIDNW

SEQ ID NO: 517202 - protein, 9 aa, Homo Sapiens
DRVPPLDDK

SEQ ID NO: 517203 - protein, 9 aa, Homo Sapiens
RRMVEIYVL

SEQ ID NO: 517204 - protein, 9 aa, Homo Sapiens
DFNTMSSAD

SEQ ID NO: 517205 - protein, 9 aa, Homo Sapiens
SECPVPSLP

SEQ ID NO: 517206 - protein, 9 aa, Homo Sapiens
YGFEGLHLW

SEQ ID NO: 517207 - protein, 9 aa, Homo Sapiens
DDRQRKYDL

SEQ ID NO: 517208 - protein, 9 aa, Homo Sapiens
SLRCGYSSS

SEQ ID NO: 517209 - protein, 9 aa, Homo Sapiens
QVEMSGLSF

SEQ ID NO: 517210 - protein, 9 aa, Homo Sapiens
ILAVINFTY

SEQ ID NO: 517211 - protein, 9 aa, Homo Sapiens
NVSQAECDM

SEQ ID NO: 517212 - protein, 9 aa, Homo Sapiens
EPVHLPCYH

SEQ ID NO: 517213 - protein, 9 aa, Homo Sapiens
CEYSAHKQG

SEQ ID NO: 517214 - protein, 9 aa, Homo Sapiens
TSGSYSYQF

SEQ ID NO: 517215 - protein, 9 aa, Homo Sapiens
IDSLIELRD

SEQ ID NO: 517216 - protein, 9 aa, Homo Sapiens
ETSCAQQVE

SEQ ID NO: 517217 - protein, 9 aa, Homo Sapiens
KRCTLCYRV

SEQ ID NO: 517218 - protein, 9 aa, Homo Sapiens
VSINSCAHT

SEQ ID NO: 517219 - protein, 9 aa, Homo Sapiens
AVRTRVGSC

SEQ ID NO: 517220 - protein, 9 aa, Homo Sapiens
TEVHAMREA

SEQ ID NO: 517221 - protein, 9 aa, Homo Sapiens
QSIECVDLA

SEQ ID NO: 517222 - protein, 9 aa, Homo Sapiens
HYPVLLSRK

SEQ ID NO: 517223 - protein, 9 aa, Homo Sapiens
VTTVHWENS

SEQ ID NO: 517224 - protein, 9 aa, Homo Sapiens
TAGSASDTF

SEQ ID NO: 517225 - protein, 9 aa, Homo Sapiens
LMFCNAKTS

SEQ ID NO: 517226 - protein, 9 aa, Homo Sapiens
DTVDDCADG

SEQ ID NO: 517227 - protein, 9 aa, Homo Sapiens
VSPTDRRPP

SEQ ID NO: 517228 - protein, 9 aa, Homo Sapiens
VREQNETLI

SEQ ID NO: 517229 - protein, 9 aa, Homo Sapiens
WACASTNAL

SEQ ID NO: 517230 - protein, 9 aa, Homo Sapiens
IRQGPQGLE

SEQ ID NO: 517231 - protein, 9 aa, Homo Sapiens
VEGCRGPVS

SEQ ID NO: 517232 - protein, 9 aa, Homo Sapiens
REGMFELIP

SEQ ID NO: 517233 - protein, 9 aa, Homo Sapiens
ELRGISTAP

SEQ ID NO: 517234 - protein, 9 aa, Homo Sapiens
ISNSHISAV

SEQ ID NO: 517235 - protein, 9 aa, Homo Sapiens
YFIKARPYF

SEQ ID NO: 517236 - protein, 9 aa, Homo Sapiens
LSNILNRVT

SEQ ID NO: 517237 - protein, 9 aa, Homo Sapiens
RALVLVIGT

SEQ ID NO: 517238 - protein, 9 aa, Homo Sapiens
PVLSSEALV

SEQ ID NO: 517239 - protein, 9 aa, Homo Sapiens
IGTVECKAY

SEQ ID NO: 517240 - protein, 9 aa, Homo Sapiens
RVQKTSKDL

SEQ ID NO: 517241 - protein, 9 aa, Homo Sapiens
VINFTYSLT

SEQ ID NO: 517242 - protein, 9 aa, Homo Sapiens
FKKIAETLW

SEQ ID NO: 517243 - protein, 9 aa, Homo Sapiens
RIQSRDQRL

SEQ ID NO: 517244 - protein, 9 aa, Homo Sapiens
TDVSRTEVI

SEQ ID NO: 517245 - protein, 9 aa, Homo Sapiens
PRESRFENG

SEQ ID NO: 517246 - protein, 9 aa, Homo Sapiens
FLNPPLPPT

SEQ ID NO: 517247 - protein, 9 aa, Homo Sapiens
EAGMEDSPD

SEQ ID NO: 517248 - protein, 9 aa, Homo Sapiens
HPELRGIST

SEQ ID NO: 517249 - protein, 9 aa, Homo Sapiens
DLKGTFTQL

SEQ ID NO: 517250 - protein, 9 aa, Homo Sapiens
LLKTYAESR

SEQ ID NO: 517251 - protein, 9 aa, Homo Sapiens
LCSTSCGGV

SEQ ID NO: 517252 - protein, 9 aa, Homo Sapiens
RRTAYVVAH

SEQ ID NO: 517253 - protein, 9 aa, Homo Sapiens
SFGLTINLL

SEQ ID NO: 517254 - protein, 9 aa, Homo Sapiens
GEAMAETVA

SEQ ID NO: 517255 - protein, 9 aa, Homo Sapiens
TTSCEQMQP

SEQ ID NO: 517256 - protein, 9 aa, Homo Sapiens
ASGGECPSG

SEQ ID NO: 517257 - protein, 9 aa, Homo Sapiens
SYPEGTCLS

SEQ ID NO: 517258 - protein, 9 aa, Homo Sapiens
VDHSIVLTE

SEQ ID NO: 517259 - protein, 9 aa, Homo Sapiens
LQDPEFNTE

SEQ ID NO: 517260 - protein, 9 aa, Homo Sapiens
ALRRSLVLR

SEQ ID NO: 517261 - protein, 9 aa, Homo Sapiens
ELGQASRSA

SEQ ID NO: 517262 - protein, 9 aa, Homo Sapiens
GEEHYKCEE

SEQ ID NO: 517263 - protein, 9 aa, Homo Sapiens
LQAQTQGLK

SEQ ID NO: 517264 - protein, 9 aa, Homo Sapiens
RVLRMLLGC

SEQ ID NO: 517265 - protein, 9 aa, Homo Sapiens
VIISDIPFG

SEQ ID NO: 517266 - protein, 9 aa, Homo Sapiens
ARTDGQPCA

SEQ ID NO: 517267 - protein, 9 aa, Homo Sapiens
RFSPRMSIL

SEQ ID NO: 517268 - protein, 9 aa, Homo Sapiens
ESEADFSVH

SEQ ID NO: 517269 - protein, 9 aa, Homo Sapiens
FAEEGIEER

SEQ ID NO: 517270 - protein, 9 aa, Homo Sapiens
DKPRESRFE

SEQ ID NO: 517271 - protein, 9 aa, Homo Sapiens
PTKCDKCNK

SEQ ID NO: 517272 - protein, 9 aa, Homo Sapiens
STTSCEQMQ

SEQ ID NO: 517273 - protein, 9 aa, Homo Sapiens
LPTAPQPFI

SEQ ID NO: 517274 - protein, 9 aa, Homo Sapiens
MEWNLTSGS

SEQ ID NO: 517275 - protein, 9 aa, Homo Sapiens
FACPHCGRA

SEQ ID NO: 517276 - protein, 9 aa, Homo Sapiens
KDLDKMDDD

SEQ ID NO: 517277 - protein, 9 aa, Homo Sapiens
IQMLDCCKR

SEQ ID NO: 517278 - protein, 9 aa, Homo Sapiens
LFVAVMPYQ

SEQ ID NO: 517279 - protein, 9 aa, Homo Sapiens
EDLSAATTE

SEQ ID NO: 517280 - protein, 9 aa, Homo Sapiens
EGMDEKKLK

SEQ ID NO: 517281 - protein, 9 aa, Homo Sapiens
KRKKCLPEN

SEQ ID NO: 517282 - protein, 9 aa, Homo Sapiens
GECPSGGPF

SEQ ID NO: 517283 - protein, 9 aa, Homo Sapiens
SMTLGLHRW

SEQ ID NO: 517284 - protein, 9 aa, Homo Sapiens
SLPRLRLEE

SEQ ID NO: 517285 - protein, 9 aa, Homo Sapiens
RSEWEDSSD

SEQ ID NO: 517286 - protein, 9 aa, Homo Sapiens
VPNKALPAP

SEQ ID NO: 517287 - protein, 9 aa, Homo Sapiens
ECGKAYWYS

SEQ ID NO: 517288 - protein, 9 aa, Homo Sapiens
GEETSCAQQ

SEQ ID NO: 517289 - protein, 9 aa, Homo Sapiens
SLKVRSAGC

SEQ ID NO: 517290 - protein, 9 aa, Homo Sapiens
GPMCWFVGV

SEQ ID NO: 517291 - protein, 9 aa, Homo Sapiens
PRDQPAALV

SEQ ID NO: 517292 - protein, 9 aa, Homo Sapiens
EWRPEDEAC

SEQ ID NO: 517293 - protein, 9 aa, Homo Sapiens
KLECPNREI

SEQ ID NO: 517294 - protein, 9 aa, Homo Sapiens
IVSELQTNY

SEQ ID NO: 517295 - protein, 9 aa, Homo Sapiens
AMCNLNPFV

SEQ ID NO: 517296 - protein, 9 aa, Homo Sapiens
SPPYPPSNA

SEQ ID NO: 517297 - protein, 9 aa, Homo Sapiens
FCNAKTSDD

SEQ ID NO: 517298 - protein, 9 aa, Homo Sapiens
ASWACASTN

SEQ ID NO: 517299 - protein, 9 aa, Homo Sapiens
LTTAFDRYV

SEQ ID NO: 517300 - protein, 9 aa, Homo Sapiens
YGISSYGAF

SEQ ID NO: 517301 - protein, 9 aa, Homo Sapiens
DRGSPVLSS

SEQ ID NO: 517302 - protein, 9 aa, Homo Sapiens
LGSYSEAHS

SEQ ID NO: 517303 - protein, 9 aa, Homo Sapiens
RRSGPPGPQ

SEQ ID NO: 517304 - protein, 9 aa, Homo Sapiens
SESVDVIIS

SEQ ID NO: 517305 - protein, 9 aa, Homo Sapiens
EMVLLVPTG

SEQ ID NO: 517306 - protein, 9 aa, Homo Sapiens
LKIRYTEGR

SEQ ID NO: 517307 - protein, 9 aa, Homo Sapiens
ALEPRSAAC

SEQ ID NO: 517308 - protein, 9 aa, Homo Sapiens
SDGRRRAFH

SEQ ID NO: 517309 - protein, 9 aa, Homo Sapiens
VILKNISGS

SEQ ID NO: 517310 - protein, 9 aa, Homo Sapiens
QNKPAIIAG

SEQ ID NO: 517311 - protein, 9 aa, Homo Sapiens
LCADTCAGP

SEQ ID NO: 517312 - protein, 9 aa, Homo Sapiens
LCLCPGRYL

SEQ ID NO: 517313 - protein, 9 aa, Homo Sapiens
GPLLLSRCS

SEQ ID NO: 517314 - protein, 9 aa, Homo Sapiens
IISARVSPT

SEQ ID NO: 517315 - protein, 9 aa, Homo Sapiens
ADTCAGPLA

SEQ ID NO: 517316 - protein, 9 aa, Homo Sapiens
NDKHFVRDT

SEQ ID NO: 517317 - protein, 9 aa, Homo Sapiens
ENLAWVGDA

SEQ ID NO: 517318 - protein, 9 aa, Homo Sapiens
SEIGCITIA

SEQ ID NO: 517319 - protein, 9 aa, Homo Sapiens
AFWAGIKTE

SEQ ID NO: 517320 - protein, 9 aa, Homo Sapiens
ILQEGMDEK

SEQ ID NO: 517321 - protein, 9 aa, Homo Sapiens
FYLINRQGP

SEQ ID NO: 517322 - protein, 9 aa, Homo Sapiens
LLSRKICWL

SEQ ID NO: 517323 - protein, 9 aa, Homo Sapiens
LHVNCYVLE

SEQ ID NO: 517324 - protein, 9 aa, Homo Sapiens
GGSPLGLGQ

SEQ ID NO: 517325 - protein, 9 aa, Homo Sapiens
LEEHTERVP

SEQ ID NO: 517326 - protein, 9 aa, Homo Sapiens
TNKDVCYPG

SEQ ID NO: 517327 - protein, 9 aa, Homo Sapiens
GKRKKCLPE

SEQ ID NO: 517328 - protein, 9 aa, Homo Sapiens
QPHPSISEE

SEQ ID NO: 517329 - protein, 9 aa, Homo Sapiens
SLWDRECCD

SEQ ID NO: 517330 - protein, 9 aa, Homo Sapiens
TIAEPAVAA

SEQ ID NO: 517331 - protein, 9 aa, Homo Sapiens
PRRDGSGGD

SEQ ID NO: 517332 - protein, 9 aa, Homo Sapiens
SGSYNRAPQ

SEQ ID NO: 517333 - protein, 9 aa, Homo Sapiens
SRLNERQRR

SEQ ID NO: 517334 - protein, 9 aa, Homo Sapiens
VAVMPYQPQ

SEQ ID NO: 517335 - protein, 9 aa, Homo Sapiens
VLVLATGRN

SEQ ID NO: 517336 - protein, 9 aa, Homo Sapiens
ALDHAQTSL

SEQ ID NO: 517337 - protein, 9 aa, Homo Sapiens
PPEMSPLDL

SEQ ID NO: 517338 - protein, 9 aa, Homo Sapiens
RRSRRTQPP

SEQ ID NO: 517339 - protein, 9 aa, Homo Sapiens
RSAACLDLQ

SEQ ID NO: 517340 - protein, 9 aa, Homo Sapiens
PQAVFPVCI

SEQ ID NO: 517341 - protein, 9 aa, Homo Sapiens
VVNMVMNCG

SEQ ID NO: 517342 - protein, 9 aa, Homo Sapiens
ADFSVHFNR

SEQ ID NO: 517343 - protein, 9 aa, Homo Sapiens
YDRQASSQE

SEQ ID NO: 517344 - protein, 9 aa, Homo Sapiens
EKSNCQKVP

SEQ ID NO: 517345 - protein, 9 aa, Homo Sapiens
LQALGRQQH

SEQ ID NO: 517346 - protein, 9 aa, Homo Sapiens
EISDLCDHT

SEQ ID NO: 517347 - protein, 9 aa, Homo Sapiens
AEVQQGVVV

SEQ ID NO: 517348 - protein, 9 aa, Homo Sapiens
KGTFTQLSE

SEQ ID NO: 517349 - protein, 9 aa, Homo Sapiens
PGDEEDLSA

SEQ ID NO: 517350 - protein, 9 aa, Homo Sapiens
LEEHKALIL

SEQ ID NO: 517351 - protein, 9 aa, Homo Sapiens
EQQEQYHLL

SEQ ID NO: 517352 - protein, 9 aa, Homo Sapiens
ITGSWMIVS

SEQ ID NO: 517353 - protein, 9 aa, Homo Sapiens
GSRSPPGRL

SEQ ID NO: 517354 - protein, 9 aa, Homo Sapiens
VNLVDKLYQ

SEQ ID NO: 517355 - protein, 9 aa, Homo Sapiens
PQPFISRHS

SEQ ID NO: 517356 - protein, 9 aa, Homo Sapiens
LEPRSAACL

SEQ ID NO: 517357 - protein, 9 aa, Homo Sapiens
DFVQDVPCP

SEQ ID NO: 517358 - protein, 9 aa, Homo Sapiens
EYLVPTSLR

SEQ ID NO: 517359 - protein, 9 aa, Homo Sapiens
VRTRVGSCA

SEQ ID NO: 517360 - protein, 9 aa, Homo Sapiens
SGSYSYQFT

SEQ ID NO: 517361 - protein, 9 aa, Homo Sapiens
TLPSLELDG

SEQ ID NO: 517362 - protein, 9 aa, Homo Sapiens
RAGKERKRS

SEQ ID NO: 517363 - protein, 9 aa, Homo Sapiens
ISSGINSDP

SEQ ID NO: 517364 - protein, 9 aa, Homo Sapiens
LSSSGVGIT

SEQ ID NO: 517365 - protein, 9 aa, Homo Sapiens
LNERQRRKK

SEQ ID NO: 517366 - protein, 9 aa, Homo Sapiens
KKPRALVLV

SEQ ID NO: 517367 - protein, 9 aa, Homo Sapiens
TLLSRVRYS

SEQ ID NO: 517368 - protein, 9 aa, Homo Sapiens
RQGLLNCPI

SEQ ID NO: 517369 - protein, 9 aa, Homo Sapiens
LVDKLYQKL

SEQ ID NO: 517370 - protein, 9 aa, Homo Sapiens
YTEGRQKAF

SEQ ID NO: 517371 - protein, 9 aa, Homo Sapiens
RRTSRSLSG

SEQ ID NO: 517372 - protein, 9 aa, Homo Sapiens
AAVAAKYPR

SEQ ID NO: 517373 - protein, 9 aa, Homo Sapiens
IFIPKSEEM

SEQ ID NO: 517374 - protein, 9 aa, Homo Sapiens
HCLYTITFS

SEQ ID NO: 517375 - protein, 9 aa, Homo Sapiens
GINSDPDMV

SEQ ID NO: 517376 - protein, 9 aa, Homo Sapiens
FTQLLNLTH

SEQ ID NO: 517377 - protein, 9 aa, Homo Sapiens
PLAAPPSTT

SEQ ID NO: 517378 - protein, 9 aa, Homo Sapiens
ASLVACGFS

SEQ ID NO: 517379 - protein, 9 aa, Homo Sapiens
QNFSLHIDC

SEQ ID NO: 517380 - protein, 9 aa, Homo Sapiens
ATSPHSVLL

SEQ ID NO: 517381 - protein, 9 aa, Homo Sapiens
LRIQTAPNN

SEQ ID NO: 517382 - protein, 9 aa, Homo Sapiens
SLDPCAPSP

SEQ ID NO: 517383 - protein, 9 aa, Homo Sapiens
AAEFHPHHS

SEQ ID NO: 517384 - protein, 9 aa, Homo Sapiens
IHHFFCYDQ

SEQ ID NO: 517385 - protein, 9 aa, Homo Sapiens
DLYSYGFEG

SEQ ID NO: 517386 - protein, 9 aa, Homo Sapiens
KALILQKYA

SEQ ID NO: 517387 - protein, 9 aa, Homo Sapiens
NAVSLILSL

SEQ ID NO: 517388 - protein, 9 aa, Homo Sapiens
GSATSTAKL

SEQ ID NO: 517389 - protein, 9 aa, Homo Sapiens
SRSDQDYVD

SEQ ID NO: 517390 - protein, 9 aa, Homo Sapiens
MTPTLAAAA

SEQ ID NO: 517391 - protein, 9 aa, Homo Sapiens
PSTAGQPHP

SEQ ID NO: 517392 - protein, 9 aa, Homo Sapiens
MVKGTPFET

SEQ ID NO: 517393 - protein, 9 aa, Homo Sapiens
TEQGMMGNF

SEQ ID NO: 517394 - protein, 9 aa, Homo Sapiens
LYAEHPGNC

SEQ ID NO: 517395 - protein, 9 aa, Homo Sapiens
DANADIGIG

SEQ ID NO: 517396 - protein, 9 aa, Homo Sapiens
RGYVTTLLG

SEQ ID NO: 517397 - protein, 9 aa, Homo Sapiens
GIEERVLKD

SEQ ID NO: 517398 - protein, 9 aa, Homo Sapiens
HQGTHHGKK

SEQ ID NO: 517399 - protein, 9 aa, Homo Sapiens
GSPLGLGQP

SEQ ID NO: 517400 - protein, 9 aa, Homo Sapiens
FYLNDISLA

SEQ ID NO: 517401 - protein, 9 aa, Homo Sapiens
QRFKALARR

SEQ ID NO: 517402 - protein, 9 aa, Homo Sapiens
AVFPVCICA

SEQ ID NO: 517403 - protein, 9 aa, Homo Sapiens
LHRWIANID

SEQ ID NO: 517404 - protein, 9 aa, Homo Sapiens
LFQWIYQRR

SEQ ID NO: 517405 - protein, 9 aa, Homo Sapiens
GQAVRYGRK

SEQ ID NO: 517406 - protein, 9 aa, Homo Sapiens
ECPVPSLPI

SEQ ID NO: 517407 - protein, 9 aa, Homo Sapiens
PMPAGYFIP

SEQ ID NO: 517408 - protein, 9 aa, Homo Sapiens
SDSLIMEWN

SEQ ID NO: 517409 - protein, 9 aa, Homo Sapiens
EPSGLQEWR

SEQ ID NO: 517410 - protein, 9 aa, Homo Sapiens
YSAHKQGVL

SEQ ID NO: 517411 - protein, 9 aa, Homo Sapiens
FISRHSSSP

SEQ ID NO: 517412 - protein, 9 aa, Homo Sapiens
QDRVPPLDD

SEQ ID NO: 517413 - protein, 9 aa, Homo Sapiens
ITSLIVKVT

SEQ ID NO: 517414 - protein, 9 aa, Homo Sapiens
EANEVDLNM

SEQ ID NO: 517415 - protein, 9 aa, Homo Sapiens
CEARTVSFA

SEQ ID NO: 517416 - protein, 9 aa, Homo Sapiens
LEKTPMGER

SEQ ID NO: 517417 - protein, 9 aa, Homo Sapiens
TSEKITSLI

SEQ ID NO: 517418 - protein, 9 aa, Homo Sapiens
RMLLGCFLT

SEQ ID NO: 517419 - protein, 9 aa, Homo Sapiens
TYSPEEIVQ

SEQ ID NO: 517420 - protein, 9 aa, Homo Sapiens
LYAQAAYQG

SEQ ID NO: 517421 - protein, 9 aa, Homo Sapiens
PTKGSEPDG

SEQ ID NO: 517422 - protein, 9 aa, Homo Sapiens
PAALVPKAG

SEQ ID NO: 517423 - protein, 9 aa, Homo Sapiens
LGYAWNIPV

SEQ ID NO: 517424 - protein, 9 aa, Homo Sapiens
FGEAMCNLN

SEQ ID NO: 517425 - protein, 9 aa, Homo Sapiens
LQTTTNFLI

SEQ ID NO: 517426 - protein, 9 aa, Homo Sapiens
TTSPISPGS

SEQ ID NO: 517427 - protein, 9 aa, Homo Sapiens
SALSTPASR

SEQ ID NO: 517428 - protein, 9 aa, Homo Sapiens
LVVTIFYGT

SEQ ID NO: 517429 - protein, 9 aa, Homo Sapiens
CASTNALTH

SEQ ID NO: 517430 - protein, 9 aa, Homo Sapiens
CPAWAPCPL

SEQ ID NO: 517431 - protein, 9 aa, Homo Sapiens
LIKNYYREK

SEQ ID NO: 517432 - protein, 9 aa, Homo Sapiens
TRVGSCAPG

SEQ ID NO: 517433 - protein, 9 aa, Homo Sapiens
PSPLEKTPM

SEQ ID NO: 517434 - protein, 9 aa, Homo Sapiens
RRIRTTFSS

SEQ ID NO: 517435 - protein, 9 aa, Homo Sapiens
QWKTQFSKK

SEQ ID NO: 517436 - protein, 9 aa, Homo Sapiens
GVKLVCCLG

SEQ ID NO: 517437 - protein, 9 aa, Homo Sapiens
HRHSHHRCP

SEQ ID NO: 517438 - protein, 9 aa, Homo Sapiens
SCEQMQPPM

SEQ ID NO: 517439 - protein, 9 aa, Homo Sapiens
DNNNSNNSG

SEQ ID NO: 517440 - protein, 9 aa, Homo Sapiens
LEQFRLIEA

SEQ ID NO: 517441 - protein, 9 aa, Homo Sapiens
YFAEYFINL

SEQ ID NO: 517442 - protein, 9 aa, Homo Sapiens
GVVVNMVMN

SEQ ID NO: 517443 - protein, 9 aa, Homo Sapiens
TSPHSVLLN

SEQ ID NO: 517444 - protein, 9 aa, Homo Sapiens
SPYWVSSAY

SEQ ID NO: 517445 - protein, 9 aa, Homo Sapiens
SMGATSNSE

SEQ ID NO: 517446 - protein, 9 aa, Homo Sapiens
GGNRRTAYV

SEQ ID NO: 517447 - protein, 9 aa, Homo Sapiens
YTSGGKKTE

SEQ ID NO: 517448 - protein, 9 aa, Homo Sapiens
IENMKAKIQ

SEQ ID NO: 517449 - protein, 9 aa, Homo Sapiens
ENPQESLHI

SEQ ID NO: 517450 - protein, 9 aa, Homo Sapiens
SKRLRQLLE

SEQ ID NO: 517451 - protein, 9 aa, Homo Sapiens
DGRRRAFHT

SEQ ID NO: 517452 - protein, 9 aa, Homo Sapiens
LWSCGGGRK

SEQ ID NO: 517453 - protein, 9 aa, Homo Sapiens
DDLYSYGFE

SEQ ID NO: 517454 - protein, 9 aa, Homo Sapiens
SQPPGSDPE

SEQ ID NO: 517455 - protein, 9 aa, Homo Sapiens
NVQEEKRGP

SEQ ID NO: 517456 - protein, 9 aa, Homo Sapiens
EVFFLIHLH

SEQ ID NO: 517457 - protein, 9 aa, Homo Sapiens
IDNWSTATK

SEQ ID NO: 517458 - protein, 9 aa, Homo Sapiens
LSRYEYGIL

SEQ ID NO: 517459 - protein, 9 aa, Homo Sapiens
PRLRLEEET

SEQ ID NO: 517460 - protein, 9 aa, Homo Sapiens
AEFHGLSSS

SEQ ID NO: 517461 - protein, 9 aa, Homo Sapiens
FHLRRETEK

SEQ ID NO: 517462 - protein, 9 aa, Homo Sapiens
DMSAAELTD

SEQ ID NO: 517463 - protein, 9 aa, Homo Sapiens
IMEWNLTSG

SEQ ID NO: 517464 - protein, 9 aa, Homo Sapiens
QEHLVAEME

SEQ ID NO: 517465 - protein, 9 aa, Homo Sapiens
PSEVKEACI

SEQ ID NO: 517466 - protein, 9 aa, Homo Sapiens
TKDLDKMDD

SEQ ID NO: 517467 - protein, 9 aa, Homo Sapiens
MGMYIFLHM

SEQ ID NO: 517468 - protein, 9 aa, Homo Sapiens
KPQRKGTLP

SEQ ID NO: 517469 - protein, 9 aa, Homo Sapiens
FAMKTLRSK

SEQ ID NO: 517470 - protein, 9 aa, Homo Sapiens
VVHKEIVSL

SEQ ID NO: 517471 - protein, 9 aa, Homo Sapiens
DFLGSYSEA

SEQ ID NO: 517472 - protein, 9 aa, Homo Sapiens
SRLQAQTQG

SEQ ID NO: 517473 - protein, 9 aa, Homo Sapiens
MIILAVINF

SEQ ID NO: 517474 - protein, 9 aa, Homo Sapiens
ESLKSKVQA

SEQ ID NO: 517475 - protein, 9 aa, Homo Sapiens
NSGSYNRAP

SEQ ID NO: 517476 - protein, 9 aa, Homo Sapiens
QTAPNNGTH

SEQ ID NO: 517477 - protein, 9 aa, Homo Sapiens
TDMSAAELT

SEQ ID NO: 517478 - protein, 9 aa, Homo Sapiens
AWSPPYPPS

SEQ ID NO: 517479 - protein, 9 aa, Homo Sapiens
ILYFLIKEM

SEQ ID NO: 517480 - protein, 9 aa, Homo Sapiens
HQLLLFVIF

SEQ ID NO: 517481 - protein, 9 aa, Homo Sapiens
IYFYTIMPI

SEQ ID NO: 517482 - protein, 9 aa, Homo Sapiens
MYVLEHLSR

SEQ ID NO: 517483 - protein, 9 aa, Homo Sapiens
GKSLPASLP

SEQ ID NO: 517484 - protein, 9 aa, Homo Sapiens
AAQEGPLLL

SEQ ID NO: 517485 - protein, 9 aa, Homo Sapiens
VLRMLLGCF

SEQ ID NO: 517486 - protein, 9 aa, Homo Sapiens
AGEEHYKCE

SEQ ID NO: 517487 - protein, 9 aa, Homo Sapiens
EDGFLDFYL

SEQ ID NO: 517488 - protein, 9 aa, Homo Sapiens
PEFNTEFVA

SEQ ID NO: 517489 - protein, 9 aa, Homo Sapiens
NICPQDSLR

SEQ ID NO: 517490 - protein, 9 aa, Homo Sapiens
TLLGLHQDW

SEQ ID NO: 517491 - protein, 9 aa, Homo Sapiens
STTGVLLYH

SEQ ID NO: 517492 - protein, 9 aa, Homo Sapiens
LPSAPPPSS

SEQ ID NO: 517493 - protein, 9 aa, Homo Sapiens
RNLAVLLTL

SEQ ID NO: 517494 - protein, 9 aa, Homo Sapiens
RSQVLQTYM

SEQ ID NO: 517495 - protein, 9 aa, Homo Sapiens
GDDVKDPRR

SEQ ID NO: 517496 - protein, 9 aa, Homo Sapiens
HAMREARAH

SEQ ID NO: 517497 - protein, 9 aa, Homo Sapiens
PSGFRAQDR

SEQ ID NO: 517498 - protein, 9 aa, Homo Sapiens
CMSSYFREQ

SEQ ID NO: 517499 - protein, 9 aa, Homo Sapiens
SSNNGFKIH

SEQ ID NO: 517500 - protein, 9 aa, Homo Sapiens
AVSSLQIVS

SEQ ID NO: 517501 - protein, 9 aa, Homo Sapiens
PPLAAPPST

SEQ ID NO: 517502 - protein, 9 aa, Homo Sapiens
EPILDDRQR

SEQ ID NO: 517503 - protein, 9 aa, Homo Sapiens
VKLVCCLGS

SEQ ID NO: 517504 - protein, 9 aa, Homo Sapiens
WSPPYPPSN

SEQ ID NO: 517505 - protein, 9 aa, Homo Sapiens
PSQVYSDCR

SEQ ID NO: 517506 - protein, 9 aa, Homo Sapiens
LHYRSGSYR

SEQ ID NO: 517507 - protein, 9 aa, Homo Sapiens
PCYHSTISG

SEQ ID NO: 517508 - protein, 9 aa, Homo Sapiens
TEDFVEDIV

SEQ ID NO: 517509 - protein, 9 aa, Homo Sapiens
CYHSTISGT

SEQ ID NO: 517510 - protein, 9 aa, Homo Sapiens
HLPCYHSTI

SEQ ID NO: 517511 - protein, 9 aa, Homo Sapiens
QRRIRTTFS

SEQ ID NO: 517512 - protein, 9 aa, Homo Sapiens
PVLLSRKIC

SEQ ID NO: 517513 - protein, 9 aa, Homo Sapiens
ELIPDIVLW

SEQ ID NO: 517514 - protein, 9 aa, Homo Sapiens
LYRRLGRAE

SEQ ID NO: 517515 - protein, 9 aa, Homo Sapiens
IKELPCGDR

SEQ ID NO: 517516 - protein, 9 aa, Homo Sapiens
QATNVSQAE

SEQ ID NO: 517517 - protein, 9 aa, Homo Sapiens
LKRLKHEKN

SEQ ID NO: 517518 - protein, 9 aa, Homo Sapiens
HAKSQILFN

SEQ ID NO: 517519 - protein, 9 aa, Homo Sapiens
TWGARSKDH

SEQ ID NO: 517520 - protein, 9 aa, Homo Sapiens
SEREYLECD

SEQ ID NO: 517521 - protein, 9 aa, Homo Sapiens
TSRASVGAA

SEQ ID NO: 517522 - protein, 9 aa, Homo Sapiens
VTTLLGLHQ

SEQ ID NO: 517523 - protein, 9 aa, Homo Sapiens
THHGKKLYT

SEQ ID NO: 517524 - protein, 9 aa, Homo Sapiens
EACGSSEQE

SEQ ID NO: 517525 - protein, 9 aa, Homo Sapiens
AGKTSLLFR

SEQ ID NO: 517526 - protein, 9 aa, Homo Sapiens
KIAETLWNI

SEQ ID NO: 517527 - protein, 9 aa, Homo Sapiens
PAEVQQGVV

SEQ ID NO: 517528 - protein, 9 aa, Homo Sapiens
FIKVKHEND

SEQ ID NO: 517529 - protein, 9 aa, Homo Sapiens
IWWVILTLI

SEQ ID NO: 517530 - protein, 9 aa, Homo Sapiens
TDRQMLPHV

SEQ ID NO: 517531 - protein, 9 aa, Homo Sapiens
EEHYKCEEC

SEQ ID NO: 517532 - protein, 9 aa, Homo Sapiens
GMAYDCFIT

SEQ ID NO: 517533 - protein, 9 aa, Homo Sapiens
QPFISRHSS

SEQ ID NO: 517534 - protein, 9 aa, Homo Sapiens
LKILASATT

SEQ ID NO: 517535 - protein, 9 aa, Homo Sapiens
SECGKAYWY

SEQ ID NO: 517536 - protein, 9 aa, Homo Sapiens
SISNGKSVT

SEQ ID NO: 517537 - protein, 9 aa, Homo Sapiens
SAYLPFVPP

SEQ ID NO: 517538 - protein, 9 aa, Homo Sapiens
ALMSQLEQQ

SEQ ID NO: 517539 - protein, 9 aa, Homo Sapiens
YCLTITGNV

SEQ ID NO: 517540 - protein, 9 aa, Homo Sapiens
NLQEMVLLV

SEQ ID NO: 517541 - protein, 9 aa, Homo Sapiens
TSQVSHLQL

SEQ ID NO: 517542 - protein, 9 aa, Homo Sapiens
YPSGPGLYG

SEQ ID NO: 517543 - protein, 9 aa, Homo Sapiens
SEEVRESNT

SEQ ID NO: 517544 - protein, 9 aa, Homo Sapiens
QEAASSQKL

SEQ ID NO: 517545 - protein, 9 aa, Homo Sapiens
LLRSRKGNT

SEQ ID NO: 517546 - protein, 9 aa, Homo Sapiens
QRPSGVAAA

SEQ ID NO: 517547 - protein, 9 aa, Homo Sapiens
RRLCAAGDK

SEQ ID NO: 517548 - protein, 9 aa, Homo Sapiens
QSGEYECRA

SEQ ID NO: 517549 - protein, 9 aa, Homo Sapiens
SLIELRDFL

SEQ ID NO: 517550 - protein, 9 aa, Homo Sapiens
KCDKCNKTV

SEQ ID NO: 517551 - protein, 9 aa, Homo Sapiens
TPEHVVQEY

SEQ ID NO: 517552 - protein, 9 aa, Homo Sapiens
EDSPYWVSS

SEQ ID NO: 517553 - protein, 9 aa, Homo Sapiens
NPVVHKEIV

SEQ ID NO: 517554 - protein, 9 aa, Homo Sapiens
WSCGGGRKG

SEQ ID NO: 517555 - protein, 9 aa, Homo Sapiens
EHIKSACLG

SEQ ID NO: 517556 - protein, 9 aa, Homo Sapiens
IKQPDVVCE

SEQ ID NO: 517557 - protein, 9 aa, Homo Sapiens
GVGKLRESM

SEQ ID NO: 517558 - protein, 9 aa, Homo Sapiens
REKIGIYFV

SEQ ID NO: 517559 - protein, 9 aa, Homo Sapiens
LHMVKGTPF

SEQ ID NO: 517560 - protein, 9 aa, Homo Sapiens
PEDEACGSS

SEQ ID NO: 517561 - protein, 9 aa, Homo Sapiens
HEKNPKVHF

SEQ ID NO: 517562 - protein, 9 aa, Homo Sapiens
ANEVDLNMR

SEQ ID NO: 517563 - protein, 9 aa, Homo Sapiens
GLTINLLLH

SEQ ID NO: 517564 - protein, 9 aa, Homo Sapiens
RKGTLPKIA

SEQ ID NO: 517565 - protein, 9 aa, Homo Sapiens
DPQWKTQFS

SEQ ID NO: 517566 - protein, 9 aa, Homo Sapiens
RSAARTSSC

SEQ ID NO: 517567 - protein, 9 aa, Homo Sapiens
WGAHIFCVL

SEQ ID NO: 517568 - protein, 9 aa, Homo Sapiens
SLTPFVFRL

SEQ ID NO: 517569 - protein, 9 aa, Homo Sapiens
HIGTVECKA

SEQ ID NO: 517570 - protein, 9 aa, Homo Sapiens
CRPGFSGCL

SEQ ID NO: 517571 - protein, 9 aa, Homo Sapiens
SFVDKRMSY

SEQ ID NO: 517572 - protein, 9 aa, Homo Sapiens
WLPAGSTRG

SEQ ID NO: 517573 - protein, 9 aa, Homo Sapiens
ATEQGMMGN

SEQ ID NO: 517574 - protein, 9 aa, Homo Sapiens
FNSTGIFNE

SEQ ID NO: 517575 - protein, 9 aa, Homo Sapiens
YSYQFTSPG

SEQ ID NO: 517576 - protein, 9 aa, Homo Sapiens
FSSAQLKEL

SEQ ID NO: 517577 - protein, 9 aa, Homo Sapiens
NKDVCYPGN

SEQ ID NO: 517578 - protein, 9 aa, Homo Sapiens
EKPFACPHC

SEQ ID NO: 517579 - protein, 9 aa, Homo Sapiens
YSPHISDLC

SEQ ID NO: 517580 - protein, 9 aa, Homo Sapiens
GDVLCLCPG

SEQ ID NO: 517581 - protein, 9 aa, Homo Sapiens
HIKSACLGE

SEQ ID NO: 517582 - protein, 9 aa, Homo Sapiens
TQMFFRFIE

SEQ ID NO: 517583 - protein, 9 aa, Homo Sapiens
QASRSASKK

SEQ ID NO: 517584 - protein, 9 aa, Homo Sapiens
GVAASKVKC

SEQ ID NO: 517585 - protein, 9 aa, Homo Sapiens
SRSASKKGF

SEQ ID NO: 517586 - protein, 9 aa, Homo Sapiens
LIKEMSMVN

SEQ ID NO: 517587 - protein, 9 aa, Homo Sapiens
HMLVVTIFY

SEQ ID NO: 517588 - protein, 9 aa, Homo Sapiens
GSGGDGIYS

SEQ ID NO: 517589 - protein, 9 aa, Homo Sapiens
HRPRDQPAA

SEQ ID NO: 517590 - protein, 9 aa, Homo Sapiens
HSRRTSRSL

SEQ ID NO: 517591 - protein, 9 aa, Homo Sapiens
AYPSGPGLY

SEQ ID NO: 517592 - protein, 9 aa, Homo Sapiens
LKHEKNPKV

SEQ ID NO: 517593 - protein, 9 aa, Homo Sapiens
PAEPKARPS

SEQ ID NO: 517594 - protein, 9 aa, Homo Sapiens
ACASTNALT

SEQ ID NO: 517595 - protein, 9 aa, Homo Sapiens
LQIVSELQT

SEQ ID NO: 517596 - protein, 9 aa, Homo Sapiens
KEVFFLIHL

SEQ ID NO: 517597 - protein, 9 aa, Homo Sapiens
TAKLVVTSA

SEQ ID NO: 517598 - protein, 9 aa, Homo Sapiens
ARRSRRTQP

SEQ ID NO: 517599 - protein, 9 aa, Homo Sapiens
KPQRKITLA

SEQ ID NO: 517600 - protein, 9 aa, Homo Sapiens
NFLIVSLAV

SEQ ID NO: 517601 - protein, 9 aa, Homo Sapiens
PYVGAASAV

SEQ ID NO: 517602 - protein, 9 aa, Homo Sapiens
WSYPATITT

SEQ ID NO: 517603 - protein, 9 aa, Homo Sapiens
LSTPASRRC

SEQ ID NO: 517604 - protein, 9 aa, Homo Sapiens
YVLNLAISN

SEQ ID NO: 517605 - protein, 9 aa, Homo Sapiens
KSLPASLPR

SEQ ID NO: 517606 - protein, 9 aa, Homo Sapiens
SRINLVFIA

SEQ ID NO: 517607 - protein, 9 aa, Homo Sapiens
LDHAQTSLL

SEQ ID NO: 517608 - protein, 9 aa, Homo Sapiens
VSSAYSKTQ

SEQ ID NO: 517609 - protein, 9 aa, Homo Sapiens
HQEILAADK

SEQ ID NO: 517610 - protein, 9 aa, Homo Sapiens
GQGSIISAR

SEQ ID NO: 517611 - protein, 9 aa, Homo Sapiens
ENAQHHDAG

SEQ ID NO: 517612 - protein, 9 aa, Homo Sapiens
VYVLLRSRK

SEQ ID NO: 517613 - protein, 9 aa, Homo Sapiens
PPLPGWSRY

SEQ ID NO: 517614 - protein, 9 aa, Homo Sapiens
RSQKPRWVA

SEQ ID NO: 517615 - protein, 9 aa, Homo Sapiens
SPSGFRAQD

SEQ ID NO: 517616 - protein, 9 aa, Homo Sapiens
TFTQLSELH

SEQ ID NO: 517617 - protein, 9 aa, Homo Sapiens
RPRKSHRHS

SEQ ID NO: 517618 - protein, 9 aa, Homo Sapiens
QEILAADKV

SEQ ID NO: 517619 - protein, 9 aa, Homo Sapiens
LRESMIQLF

SEQ ID NO: 517620 - protein, 9 aa, Homo Sapiens
LCYVCSVSV

SEQ ID NO: 517621 - protein, 9 aa, Homo Sapiens
GEYECRALN

SEQ ID NO: 517622 - protein, 9 aa, Homo Sapiens
STNALTHTV

SEQ ID NO: 517623 - protein, 9 aa, Homo Sapiens
CDEILKGEV

SEQ ID NO: 517624 - protein, 9 aa, Homo Sapiens
RPGFSGCLC

SEQ ID NO: 517625 - protein, 9 aa, Homo Sapiens
GAPPQPSAY

SEQ ID NO: 517626 - protein, 9 aa, Homo Sapiens
AYRPSELLS

SEQ ID NO: 517627 - protein, 9 aa, Homo Sapiens
LENISFSII

SEQ ID NO: 517628 - protein, 9 aa, Homo Sapiens
NTTSHHVGQ

SEQ ID NO: 517629 - protein, 9 aa, Homo Sapiens
APLPPAAGS

SEQ ID NO: 517630 - protein, 9 aa, Homo Sapiens
SVQKLYSIA

SEQ ID NO: 517631 - protein, 9 aa, Homo Sapiens
ARLCYVCSV

SEQ ID NO: 517632 - protein, 9 aa, Homo Sapiens
LTCGGKRKK

SEQ ID NO: 517633 - protein, 9 aa, Homo Sapiens
HENCDFRVK

SEQ ID NO: 517634 - protein, 9 aa, Homo Sapiens
SSFVDKRMS

SEQ ID NO: 517635 - protein, 9 aa, Homo Sapiens
VKEACIWGS

SEQ ID NO: 517636 - protein, 9 aa, Homo Sapiens
LLLFQPRQP

SEQ ID NO: 517637 - protein, 9 aa, Homo Sapiens
VPVKSHSDA

SEQ ID NO: 517638 - protein, 9 aa, Homo Sapiens
AARQLPRRL

SEQ ID NO: 517639 - protein, 9 aa, Homo Sapiens
LLREGMFEL

SEQ ID NO: 517640 - protein, 9 aa, Homo Sapiens
FVEDIVKLI

SEQ ID NO: 517641 - protein, 9 aa, Homo Sapiens
WVGDALLLA

SEQ ID NO: 517642 - protein, 9 aa, Homo Sapiens
ILLFRHDST

SEQ ID NO: 517643 - protein, 9 aa, Homo Sapiens
QNVQEEKRG

SEQ ID NO: 517644 - protein, 9 aa, Homo Sapiens
FLGNTPEHV

SEQ ID NO: 517645 - protein, 9 aa, Homo Sapiens
QAECDMECK

SEQ ID NO: 517646 - protein, 9 aa, Homo Sapiens
LHSSMVCKV

SEQ ID NO: 517647 - protein, 9 aa, Homo Sapiens
LPPPPLPSA

SEQ ID NO: 517648 - protein, 9 aa, Homo Sapiens
NTVASDGSM

SEQ ID NO: 517649 - protein, 9 aa, Homo Sapiens
TTTTTDVSR

SEQ ID NO: 517650 - protein, 9 aa, Homo Sapiens
ILIGNIPGY

SEQ ID NO: 517651 - protein, 9 aa, Homo Sapiens
CEPILDDRQ

SEQ ID NO: 517652 - protein, 9 aa, Homo Sapiens
STGTWNPEG

SEQ ID NO: 517653 - protein, 9 aa, Homo Sapiens
ILKHWTGGC

SEQ ID NO: 517654 - protein, 9 aa, Homo Sapiens
PMGERSVNF

SEQ ID NO: 517655 - protein, 9 aa, Homo Sapiens
GMSLKVRSA

SEQ ID NO: 517656 - protein, 9 aa, Homo Sapiens
LAAIPGLRV

SEQ ID NO: 517657 - protein, 9 aa, Homo Sapiens
RLKHEKNPK

SEQ ID NO: 517658 - protein, 9 aa, Homo Sapiens
LNGTYHATV

SEQ ID NO: 517659 - protein, 9 aa, Homo Sapiens
MMSHSIHDK

SEQ ID NO: 517660 - protein, 9 aa, Homo Sapiens
GPRCARGCS

SEQ ID NO: 517661 - protein, 9 aa, Homo Sapiens
EHTERVPRI

SEQ ID NO: 517662 - protein, 9 aa, Homo Sapiens
PALSNQNVQ

SEQ ID NO: 517663 - protein, 9 aa, Homo Sapiens
AENILGHPK

SEQ ID NO: 517664 - protein, 9 aa, Homo Sapiens
SISVLEEKD

SEQ ID NO: 517665 - protein, 9 aa, Homo Sapiens
SNSIGNSQR

SEQ ID NO: 517666 - protein, 9 aa, Homo Sapiens
TSVAEANEV

SEQ ID NO: 517667 - protein, 9 aa, Homo Sapiens
LISDKDSAD

SEQ ID NO: 517668 - protein, 9 aa, Homo Sapiens
EEHKALILQ

SEQ ID NO: 517669 - protein, 9 aa, Homo Sapiens
NSEREYLEC

SEQ ID NO: 517670 - protein, 9 aa, Homo Sapiens
NNSNNSGSY

SEQ ID NO: 517671 - protein, 9 aa, Homo Sapiens
MFCNAKTSD

SEQ ID NO: 517672 - protein, 9 aa, Homo Sapiens
CCLGSGPVI

SEQ ID NO: 517673 - protein, 9 aa, Homo Sapiens
ILKIRYTEG

SEQ ID NO: 517674 - protein, 9 aa, Homo Sapiens
FTGPSETSA

SEQ ID NO: 517675 - protein, 9 aa, Homo Sapiens
QKIKQPDVV

SEQ ID NO: 517676 - protein, 9 aa, Homo Sapiens
NSSSNNGFK

SEQ ID NO: 517677 - protein, 9 aa, Homo Sapiens
DCRPGLVLP

SEQ ID NO: 517678 - protein, 9 aa, Homo Sapiens
THHGRSNLQ

SEQ ID NO: 517679 - protein, 9 aa, Homo Sapiens
KHKEVFFLI

SEQ ID NO: 517680 - protein, 9 aa, Homo Sapiens
GAWSPPYPP

SEQ ID NO: 517681 - protein, 9 aa, Homo Sapiens
VHWENSFVS

SEQ ID NO: 517682 - protein, 9 aa, Homo Sapiens
NPQESLHIE

SEQ ID NO: 517683 - protein, 9 aa, Homo Sapiens
LKIRSTNLE

SEQ ID NO: 517684 - protein, 9 aa, Homo Sapiens
MDYNWLHHT

SEQ ID NO: 517685 - protein, 9 aa, Homo Sapiens
KKLECPNRE

SEQ ID NO: 517686 - protein, 9 aa, Homo Sapiens
KCEECGKAL

SEQ ID NO: 517687 - protein, 9 aa, Homo Sapiens
RDSGDCGVQ

SEQ ID NO: 517688 - protein, 9 aa, Homo Sapiens
SALTLLDLC

SEQ ID NO: 517689 - protein, 9 aa, Homo Sapiens
GIRSQKPRW

SEQ ID NO: 517690 - protein, 9 aa, Homo Sapiens
SAVSDPPTT

SEQ ID NO: 517691 - protein, 9 aa, Homo Sapiens
EGCRGPVSP

SEQ ID NO: 517692 - protein, 9 aa, Homo Sapiens
EEDLSAATT

SEQ ID NO: 517693 - protein, 9 aa, Homo Sapiens
FVKLLEQFR

SEQ ID NO: 517694 - protein, 9 aa, Homo Sapiens
SVFKTHFIS

SEQ ID NO: 517695 - protein, 9 aa, Homo Sapiens
NINKMWIAI

SEQ ID NO: 517696 - protein, 9 aa, Homo Sapiens
KKIAETLWN

SEQ ID NO: 517697 - protein, 9 aa, Homo Sapiens
VDSDNEYIG

SEQ ID NO: 517698 - protein, 9 aa, Homo Sapiens
LPAGSTRGL

SEQ ID NO: 517699 - protein, 9 aa, Homo Sapiens
WFRLGSVVH

SEQ ID NO: 517700 - protein, 9 aa, Homo Sapiens
SRSEWEDSS

SEQ ID NO: 517701 - protein, 9 aa, Homo Sapiens
FFMNPKLGE

SEQ ID NO: 517702 - protein, 9 aa, Homo Sapiens
RFPRDQVVN

SEQ ID NO: 517703 - protein, 9 aa, Homo Sapiens
PNASDQENE

SEQ ID NO: 517704 - protein, 9 aa, Homo Sapiens
DDGQRPSGV

SEQ ID NO: 517705 - protein, 9 aa, Homo Sapiens
PRSAARTSS

SEQ ID NO: 517706 - protein, 9 aa, Homo Sapiens
GSIISARVS

SEQ ID NO: 517707 - protein, 9 aa, Homo Sapiens
AKLVVTSAN

SEQ ID NO: 517708 - protein, 9 aa, Homo Sapiens
ACPHCGRAF

SEQ ID NO: 517709 - protein, 9 aa, Homo Sapiens
SSADLLNAL

SEQ ID NO: 517710 - protein, 9 aa, Homo Sapiens
ADGPYKCKL

SEQ ID NO: 517711 - protein, 9 aa, Homo Sapiens
VMMSHSIHD

SEQ ID NO: 517712 - protein, 9 aa, Homo Sapiens
AAIDMARVR

SEQ ID NO: 517713 - protein, 9 aa, Homo Sapiens
SIPSPPGTL

SEQ ID NO: 517714 - protein, 9 aa, Homo Sapiens
KKVSGKMSS

SEQ ID NO: 517715 - protein, 9 aa, Homo Sapiens
TGSWMIVSI

SEQ ID NO: 517716 - protein, 9 aa, Homo Sapiens
QFYRTRITC

SEQ ID NO: 517717 - protein, 9 aa, Homo Sapiens
MAVQRADGP

SEQ ID NO: 517718 - protein, 9 aa, Homo Sapiens
TTLLGLHQD

SEQ ID NO: 517719 - protein, 9 aa, Homo Sapiens
VATVVAAID

SEQ ID NO: 517720 - protein, 9 aa, Homo Sapiens
PAGRSRAAV

SEQ ID NO: 517721 - protein, 9 aa, Homo Sapiens
TTTTGSTMC

SEQ ID NO: 517722 - protein, 9 aa, Homo Sapiens
PPTIDDRDL

SEQ ID NO: 517723 - protein, 9 aa, Homo Sapiens
DEKKLKQLN

SEQ ID NO: 517724 - protein, 9 aa, Homo Sapiens
KSKVQAVQL

SEQ ID NO: 517725 - protein, 9 aa, Homo Sapiens
ASSFQVIKK

SEQ ID NO: 517726 - protein, 9 aa, Homo Sapiens
KCKVPNKAL

SEQ ID NO: 517727 - protein, 9 aa, Homo Sapiens
VLSNILNRV

SEQ ID NO: 517728 - protein, 9 aa, Homo Sapiens
AASLVACGF

SEQ ID NO: 517729 - protein, 9 aa, Homo Sapiens
DLPKGYDSW

SEQ ID NO: 517730 - protein, 9 aa, Homo Sapiens
GSQPPGSDP

SEQ ID NO: 517731 - protein, 9 aa, Homo Sapiens
YFFMNPKLG

SEQ ID NO: 517732 - protein, 9 aa, Homo Sapiens
EVPTTTTTD

SEQ ID NO: 517733 - protein, 9 aa, Homo Sapiens
RMVEIYVLN

SEQ ID NO: 517734 - protein, 9 aa, Homo Sapiens
SLRCGGGKQ

SEQ ID NO: 517735 - protein, 9 aa, Homo Sapiens
KPEGGQNKP

SEQ ID NO: 517736 - protein, 9 aa, Homo Sapiens
LDSTAYRPS

SEQ ID NO: 517737 - protein, 9 aa, Homo Sapiens
AHTQLLVSE

SEQ ID NO: 517738 - protein, 9 aa, Homo Sapiens
YMAFLKSSE

SEQ ID NO: 517739 - protein, 9 aa, Homo Sapiens
PHPGSRRCS

SEQ ID NO: 517740 - protein, 9 aa, Homo Sapiens
KMNLYPIYV

SEQ ID NO: 517741 - protein, 9 aa, Homo Sapiens
LQEMVLLVP

SEQ ID NO: 517742 - protein, 9 aa, Homo Sapiens
TFQDSSVFN

SEQ ID NO: 517743 - protein, 9 aa, Homo Sapiens
MAASTQPLG

SEQ ID NO: 517744 - protein, 9 aa, Homo Sapiens
SQGCVDHSI

SEQ ID NO: 517745 - protein, 9 aa, Homo Sapiens
DTCAGPLAR

SEQ ID NO: 517746 - protein, 9 aa, Homo Sapiens
HDDFAMKTL

SEQ ID NO: 517747 - protein, 9 aa, Homo Sapiens
LSGSPGSSS

SEQ ID NO: 517748 - protein, 9 aa, Homo Sapiens
KGIRTMLFA

SEQ ID NO: 517749 - protein, 9 aa, Homo Sapiens
KWVGVGKLR

SEQ ID NO: 517750 - protein, 9 aa, Homo Sapiens
LMERNNLSC

SEQ ID NO: 517751 - protein, 9 aa, Homo Sapiens
ECCDYRREP

SEQ ID NO: 517752 - protein, 9 aa, Homo Sapiens
KNILTIKAN

SEQ ID NO: 517753 - protein, 9 aa, Homo Sapiens
LVYVLLRSR

SEQ ID NO: 517754 - protein, 9 aa, Homo Sapiens
TGGCPFREG

SEQ ID NO: 517755 - protein, 9 aa, Homo Sapiens
KVLQESEMR

SEQ ID NO: 517756 - protein, 9 aa, Homo Sapiens
TTNFLIVSL

SEQ ID NO: 517757 - protein, 9 aa, Homo Sapiens
GLHRWIANI

SEQ ID NO: 517758 - protein, 9 aa, Homo Sapiens
PEHVVQEYL

SEQ ID NO: 517759 - protein, 9 aa, Homo Sapiens
TAPNNGTHG

SEQ ID NO: 517760 - protein, 9 aa, Homo Sapiens
PSQPPCSPE

SEQ ID NO: 517761 - protein, 9 aa, Homo Sapiens
FNTMSSADL

SEQ ID NO: 517762 - protein, 9 aa, Homo Sapiens
SLYAEHPGN

SEQ ID NO: 517763 - protein, 9 aa, Homo Sapiens
VDIYHSRLN

SEQ ID NO: 517764 - protein, 9 aa, Homo Sapiens
LLEEHTERV

SEQ ID NO: 517765 - protein, 9 aa, Homo Sapiens
AQAAYQGGG

SEQ ID NO: 517766 - protein, 9 aa, Homo Sapiens
APDRGHAAP

SEQ ID NO: 517767 - protein, 9 aa, Homo Sapiens
GTVEYLVPT

SEQ ID NO: 517768 - protein, 9 aa, Homo Sapiens
SEADFSVHF

SEQ ID NO: 517769 - protein, 9 aa, Homo Sapiens
STTSPISPG

SEQ ID NO: 517770 - protein, 9 aa, Homo Sapiens
AQATSPHSV

SEQ ID NO: 517771 - protein, 9 aa, Homo Sapiens
AARTSSCAE

SEQ ID NO: 517772 - protein, 9 aa, Homo Sapiens
TVDDCADGS

SEQ ID NO: 517773 - protein, 9 aa, Homo Sapiens
LGRAELGLR

SEQ ID NO: 517774 - protein, 9 aa, Homo Sapiens
RALGEVNAA

SEQ ID NO: 517775 - protein, 9 aa, Homo Sapiens
MLVVTIFYG

SEQ ID NO: 517776 - protein, 9 aa, Homo Sapiens
GFLKRLKHE

SEQ ID NO: 517777 - protein, 9 aa, Homo Sapiens
TIMPIPANQ

SEQ ID NO: 517778 - protein, 9 aa, Homo Sapiens
AVFCPVGPM

SEQ ID NO: 517779 - protein, 9 aa, Homo Sapiens
SDNEYIGVT

SEQ ID NO: 517780 - protein, 9 aa, Homo Sapiens
LGLCKQNVD

SEQ ID NO: 517781 - protein, 9 aa, Homo Sapiens
PQMQSLSRL

SEQ ID NO: 517782 - protein, 9 aa, Homo Sapiens
MSYFYLNDI

SEQ ID NO: 517783 - protein, 9 aa, Homo Sapiens
GEKVIQLRS

SEQ ID NO: 517784 - protein, 9 aa, Homo Sapiens
RRMWGAHIF

SEQ ID NO: 517785 - protein, 9 aa, Homo Sapiens
TSRSDQDYV

SEQ ID NO: 517786 - protein, 9 aa, Homo Sapiens
LSAKDFFNI

SEQ ID NO: 517787 - protein, 9 aa, Homo Sapiens
FLHMVKGTP

SEQ ID NO: 517788 - protein, 9 aa, Homo Sapiens
PTLAAAADI

SEQ ID NO: 517789 - protein, 9 aa, Homo Sapiens
MQSLSRLRD

SEQ ID NO: 517790 - protein, 9 aa, Homo Sapiens
WFVGVVVNM

SEQ ID NO: 517791 - protein, 9 aa, Homo Sapiens
LCHSFCVIK

SEQ ID NO: 517792 - protein, 9 aa, Homo Sapiens
KKDSAKSRS

SEQ ID NO: 517793 - protein, 9 aa, Homo Sapiens
EGGQNKPAI

SEQ ID NO: 517794 - protein, 9 aa, Homo Sapiens
VEMSGLSFH

SEQ ID NO: 517795 - protein, 9 aa, Homo Sapiens
ELKILASAT

SEQ ID NO: 517796 - protein, 9 aa, Homo Sapiens
PKGYDSWQA

SEQ ID NO: 517797 - protein, 9 aa, Homo Sapiens
ITRLHKSMV

SEQ ID NO: 517798 - protein, 9 aa, Homo Sapiens
GHPKRYKGF

SEQ ID NO: 517799 - protein, 9 aa, Homo Sapiens
SVTVKCQGA

SEQ ID NO: 517800 - protein, 9 aa, Homo Sapiens
HGEAMAETV

SEQ ID NO: 517801 - protein, 9 aa, Homo Sapiens
ECPNREIII

SEQ ID NO: 517802 - protein, 9 aa, Homo Sapiens
AVAAKYPRL

SEQ ID NO: 517803 - protein, 9 aa, Homo Sapiens
SPVSISSGI

SEQ ID NO: 517804 - protein, 9 aa, Homo Sapiens
VAHLVRLPR

SEQ ID NO: 517805 - protein, 9 aa, Homo Sapiens
TPAIRQGPQ

SEQ ID NO: 517806 - protein, 9 aa, Homo Sapiens
ETGLLLTTA

SEQ ID NO: 517807 - protein, 9 aa, Homo Sapiens
KILASATTF

SEQ ID NO: 517808 - protein, 9 aa, Homo Sapiens
RSISRSLMF

SEQ ID NO: 517809 - protein, 9 aa, Homo Sapiens
TEEEPEYHP

SEQ ID NO: 517810 - protein, 9 aa, Homo Sapiens
CDRRLLTTY

SEQ ID NO: 517811 - protein, 9 aa, Homo Sapiens
SFQVIKKSI

SEQ ID NO: 517812 - protein, 9 aa, Homo Sapiens
HKALILQKY

SEQ ID NO: 517813 - protein, 9 aa, Homo Sapiens
RDQVVNGAG

SEQ ID NO: 517814 - protein, 9 aa, Homo Sapiens
CDTVDDCAD

SEQ ID NO: 517815 - protein, 9 aa, Homo Sapiens
EWGLGLCKQ

SEQ ID NO: 517816 - protein, 9 aa, Homo Sapiens
IQTAPNNGT

SEQ ID NO: 517817 - protein, 9 aa, Homo Sapiens
VVDTMKVVT

SEQ ID NO: 517818 - protein, 9 aa, Homo Sapiens
AVSDPPTTT

SEQ ID NO: 517819 - protein, 9 aa, Homo Sapiens
SGGDGIYSV

SEQ ID NO: 517820 - protein, 9 aa, Homo Sapiens
EGGPDLEPD

SEQ ID NO: 517821 - protein, 9 aa, Homo Sapiens
QQEQYHLLR

SEQ ID NO: 517822 - protein, 9 aa, Homo Sapiens
FNETSDHSE

SEQ ID NO: 517823 - protein, 9 aa, Homo Sapiens
KRLKHEKNP

SEQ ID NO: 517824 - protein, 9 aa, Homo Sapiens
PDRGHAAPC

SEQ ID NO: 517825 - protein, 9 aa, Homo Sapiens
ESTSRSDQD

SEQ ID NO: 517826 - protein, 9 aa, Homo Sapiens
LKTKKPRAL

SEQ ID NO: 517827 - protein, 9 aa, Homo Sapiens
GLDGIVLLL

SEQ ID NO: 517828 - protein, 9 aa, Homo Sapiens
NLNTTAVTQ

SEQ ID NO: 517829 - protein, 9 aa, Homo Sapiens
CPVGPMCWF

SEQ ID NO: 517830 - protein, 9 aa, Homo Sapiens
ALSTPASRR

SEQ ID NO: 517831 - protein, 9 aa, Homo Sapiens
RRTQPPITQ

SEQ ID NO: 517832 - protein, 9 aa, Homo Sapiens
LMISNSHIS

SEQ ID NO: 517833 - protein, 9 aa, Homo Sapiens
GKKAVMKFS

SEQ ID NO: 517834 - protein, 9 aa, Homo Sapiens
ASDQENEAF

SEQ ID NO: 517835 - protein, 9 aa, Homo Sapiens
EGSQPPGSD

SEQ ID NO: 517836 - protein, 9 aa, Homo Sapiens
FVDKRMSYI

SEQ ID NO: 517837 - protein, 9 aa, Homo Sapiens
GMEDSPDSG

SEQ ID NO: 517838 - protein, 9 aa, Homo Sapiens
HAYPSGPGL

SEQ ID NO: 517839 - protein, 9 aa, Homo Sapiens
EACIWGSLA

SEQ ID NO: 517840 - protein, 9 aa, Homo Sapiens
QRKGTLPKI

SEQ ID NO: 517841 - protein, 9 aa, Homo Sapiens
AVGSGAYRE

SEQ ID NO: 517842 - protein, 9 aa, Homo Sapiens
VETGLLLTT

SEQ ID NO: 517843 - protein, 9 aa, Homo Sapiens
NASDQENEA

SEQ ID NO: 517844 - protein, 9 aa, Homo Sapiens
LLKPQRKGT

SEQ ID NO: 517845 - protein, 9 aa, Homo Sapiens
LVVHLACFC

SEQ ID NO: 517846 - protein, 9 aa, Homo Sapiens
LMSQLEQQE

SEQ ID NO: 517847 - protein, 9 aa, Homo Sapiens
DCADGSDEP

SEQ ID NO: 517848 - protein, 9 aa, Homo Sapiens
YFINLGLFE

SEQ ID NO: 517849 - protein, 9 aa, Homo Sapiens
LKKENLAWV

SEQ ID NO: 517850 - protein, 9 aa, Homo Sapiens
MLFALMMSL

SEQ ID NO: 517851 - protein, 9 aa, Homo Sapiens
VGFSSLGEH

SEQ ID NO: 517852 - protein, 9 aa, Homo Sapiens
VDRYEAVCN

SEQ ID NO: 517853 - protein, 9 aa, Homo Sapiens
QGLEVSFRG

SEQ ID NO: 517854 - protein, 9 aa, Homo Sapiens
GAFWAGIKT

SEQ ID NO: 517855 - protein, 9 aa, Homo Sapiens
HIGRSLLEL

SEQ ID NO: 517856 - protein, 9 aa, Homo Sapiens
VKVIDNLQF

SEQ ID NO: 517857 - protein, 9 aa, Homo Sapiens
SLKSKVQAV

SEQ ID NO: 517858 - protein, 9 aa, Homo Sapiens
MLLGCFLTE

SEQ ID NO: 517859 - protein, 9 aa, Homo Sapiens
VSLDPCAPS

SEQ ID NO: 517860 - protein, 9 aa, Homo Sapiens
DGIYSVTFT

SEQ ID NO: 517861 - protein, 9 aa, Homo Sapiens
KEYKCKVPN

SEQ ID NO: 517862 - protein, 9 aa, Homo Sapiens
HKGQANATR

SEQ ID NO: 517863 - protein, 9 aa, Homo Sapiens
QTSTLGIIP

SEQ ID NO: 517864 - protein, 9 aa, Homo Sapiens
DSPYWVSSA

SEQ ID NO: 517865 - protein, 9 aa, Homo Sapiens
RFGIPEALV

SEQ ID NO: 517866 - protein, 9 aa, Homo Sapiens
NLVDKLYQK

SEQ ID NO: 517867 - protein, 9 aa, Homo Sapiens
KALRRSLVL

SEQ ID NO: 517868 - protein, 9 aa, Homo Sapiens
PDGGWWEVE

SEQ ID NO: 517869 - protein, 9 aa, Homo Sapiens
KSYYENAQH

SEQ ID NO: 517870 - protein, 9 aa, Homo Sapiens
LILQKYARA

SEQ ID NO: 517871 - protein, 9 aa, Homo Sapiens
KEGSQPPGS

SEQ ID NO: 517872 - protein, 9 aa, Homo Sapiens
APFVPPLPA

SEQ ID NO: 517873 - protein, 9 aa, Homo Sapiens
PPPTEPSGL

SEQ ID NO: 517874 - protein, 9 aa, Homo Sapiens
GQAPKATSR

SEQ ID NO: 517875 - protein, 9 aa, Homo Sapiens
SATSTAKLV

SEQ ID NO: 517876 - protein, 9 aa, Homo Sapiens
SSAYSKTQP

SEQ ID NO: 517877 - protein, 9 aa, Homo Sapiens
RQRKYDLHY

SEQ ID NO: 517878 - protein, 9 aa, Homo Sapiens
SYYENAQHH

SEQ ID NO: 517879 - protein, 9 aa, Homo Sapiens
RKEGSQPPG

SEQ ID NO: 517880 - protein, 9 aa, Homo Sapiens
GGDGIYSVT

SEQ ID NO: 517881 - protein, 9 aa, Homo Sapiens
GGKRKKCLP

SEQ ID NO: 517882 - protein, 9 aa, Homo Sapiens
PQGLEVSFR

SEQ ID NO: 517883 - protein, 9 aa, Homo Sapiens
GATDRGSPV

SEQ ID NO: 517884 - protein, 9 aa, Homo Sapiens
LHHLLLLLI

SEQ ID NO: 517885 - protein, 9 aa, Homo Sapiens
QGCVDHSIV

SEQ ID NO: 517886 - protein, 9 aa, Homo Sapiens
VLGKIQGKS

SEQ ID NO: 517887 - protein, 9 aa, Homo Sapiens
KPRESRFEN

SEQ ID NO: 517888 - protein, 9 aa, Homo Sapiens
ILLENLDRF

SEQ ID NO: 517889 - protein, 9 aa, Homo Sapiens
YMMGLIACA

SEQ ID NO: 517890 - protein, 9 aa, Homo Sapiens
YHTAKGMLC

SEQ ID NO: 517891 - protein, 9 aa, Homo Sapiens
DDCDRRLLT

SEQ ID NO: 517892 - protein, 9 aa, Homo Sapiens
QKQKSLSNL

SEQ ID NO: 517893 - protein, 9 aa, Homo Sapiens
LLAELPADT

SEQ ID NO: 517894 - protein, 9 aa, Homo Sapiens
LAAPPSTTG

SEQ ID NO: 517895 - protein, 9 aa, Homo Sapiens
FAEYFINLG

SEQ ID NO: 517896 - protein, 9 aa, Homo Sapiens
CGKAYWYSS

SEQ ID NO: 517897 - protein, 9 aa, Homo Sapiens
LQDLCAGLA

SEQ ID NO: 517898 - protein, 9 aa, Homo Sapiens
SSLQIVSEL

SEQ ID NO: 517899 - protein, 9 aa, Homo Sapiens
KHIGTVECK

SEQ ID NO: 517900 - protein, 9 aa, Homo Sapiens
VLEKDSVTV

SEQ ID NO: 517901 - protein, 9 aa, Homo Sapiens
VLQRLMISN

SEQ ID NO: 517902 - protein, 9 aa, Homo Sapiens
PGSDPELWS

SEQ ID NO: 517903 - protein, 9 aa, Homo Sapiens
APAGRSRAA

SEQ ID NO: 517904 - protein, 9 aa, Homo Sapiens
YVTTLLGLH

SEQ ID NO: 517905 - protein, 9 aa, Homo Sapiens
HAQTSLLTN

SEQ ID NO: 517906 - protein, 9 aa, Homo Sapiens
GLHDPTKGS

SEQ ID NO: 517907 - protein, 9 aa, Homo Sapiens
PSGGPFVCK

SEQ ID NO: 517908 - protein, 9 aa, Homo Sapiens
NMVMNCGQH

SEQ ID NO: 517909 - protein, 9 aa, Homo Sapiens
TSTLGIIPP

SEQ ID NO: 517910 - protein, 9 aa, Homo Sapiens
IKSACLGEH

SEQ ID NO: 517911 - protein, 9 aa, Homo Sapiens
TAYVVAHGF

SEQ ID NO: 517912 - protein, 9 aa, Homo Sapiens
PTIVHDPLP

SEQ ID NO: 517913 - protein, 9 aa, Homo Sapiens
YDSWQAVDA

SEQ ID NO: 517914 - protein, 9 aa, Homo Sapiens
KGAKGIRTM

SEQ ID NO: 517915 - protein, 9 aa, Homo Sapiens
GEHQLLLFV

SEQ ID NO: 517916 - protein, 9 aa, Homo Sapiens
PILDDRQRK

SEQ ID NO: 517917 - protein, 9 aa, Homo Sapiens
YHSTISGTD

SEQ ID NO: 517918 - protein, 9 aa, Homo Sapiens
EKHKEVFFL

SEQ ID NO: 517919 - protein, 9 aa, Homo Sapiens
PLPSESVDV

SEQ ID NO: 517920 - protein, 9 aa, Homo Sapiens
VSQAECDME

SEQ ID NO: 517921 - protein, 9 aa, Homo Sapiens
ARLAEHERM

SEQ ID NO: 517922 - protein, 9 aa, Homo Sapiens
KAQPGTWPW

SEQ ID NO: 517923 - protein, 9 aa, Homo Sapiens
YDAYFIKAR

SEQ ID NO: 517924 - protein, 9 aa, Homo Sapiens
FTQLSELHC

SEQ ID NO: 517925 - protein, 9 aa, Homo Sapiens
LAPLPSPYV

SEQ ID NO: 517926 - protein, 9 aa, Homo Sapiens
DLMSPANVA

SEQ ID NO: 517927 - protein, 9 aa, Homo Sapiens
DNGHTCGRR

SEQ ID NO: 517928 - protein, 9 aa, Homo Sapiens
SDSESTSRS

SEQ ID NO: 517929 - protein, 9 aa, Homo Sapiens
PLPSPYVGA

SEQ ID NO: 517930 - protein, 9 aa, Homo Sapiens
CADTCAGPL

SEQ ID NO: 517931 - protein, 9 aa, Homo Sapiens
STAPDRGHA

SEQ ID NO: 517932 - protein, 9 aa, Homo Sapiens
CDYRREPPC

SEQ ID NO: 517933 - protein, 9 aa, Homo Sapiens
FEGLHLWTG

SEQ ID NO: 517934 - protein, 9 aa, Homo Sapiens
MGERSVNFS

SEQ ID NO: 517935 - protein, 9 aa, Homo Sapiens
CYPGNTKVM

SEQ ID NO: 517936 - protein, 9 aa, Homo Sapiens
PLPGWSRYI

SEQ ID NO: 517937 - protein, 9 aa, Homo Sapiens
KENLAWVGD

SEQ ID NO: 517938 - protein, 9 aa, Homo Sapiens
AASKVKCKE

SEQ ID NO: 517939 - protein, 9 aa, Homo Sapiens
DFEKTIAEP

SEQ ID NO: 517940 - protein, 9 aa, Homo Sapiens
LPESIPSPP

SEQ ID NO: 517941 - protein, 9 aa, Homo Sapiens
EWKKKLECP

SEQ ID NO: 517942 - protein, 9 aa, Homo Sapiens
EKLAVSPTP

SEQ ID NO: 517943 - protein, 9 aa, Homo Sapiens
PGHKGQANA

SEQ ID NO: 517944 - protein, 9 aa, Homo Sapiens
TGRNLAVLL

SEQ ID NO: 517945 - protein, 9 aa, Homo Sapiens
GKKLEYDVK

SEQ ID NO: 517946 - protein, 9 aa, Homo Sapiens
LGSVVHAIQ

SEQ ID NO: 517947 - protein, 9 aa, Homo Sapiens
ELPCGDRYA

SEQ ID NO: 517948 - protein, 9 aa, Homo Sapiens
TALDGGSPL

SEQ ID NO: 517949 - protein, 9 aa, Homo Sapiens
IYRDESHYF

SEQ ID NO: 517950 - protein, 9 aa, Homo Sapiens
HRVLEVVNL

SEQ ID NO: 517951 - protein, 9 aa, Homo Sapiens
CAPSPAPAS

SEQ ID NO: 517952 - protein, 9 aa, Homo Sapiens
QGIVSLPPS

SEQ ID NO: 517953 - protein, 9 aa, Homo Sapiens
GLYAQAAYQ

SEQ ID NO: 517954 - protein, 9 aa, Homo Sapiens
DLIKNYYRE

SEQ ID NO: 517955 - protein, 9 aa, Homo Sapiens
RMSYIVGKD

SEQ ID NO: 517956 - protein, 9 aa, Homo Sapiens
ESGQAPKAT

SEQ ID NO: 517957 - protein, 9 aa, Homo Sapiens
TAHTQLLVS

SEQ ID NO: 517958 - protein, 9 aa, Homo Sapiens
PGSRRCSRH

SEQ ID NO: 517959 - protein, 9 aa, Homo Sapiens
KKLYTDGAC

SEQ ID NO: 517960 - protein, 9 aa, Homo Sapiens
WGLGLCKQN

SEQ ID NO: 517961 - protein, 9 aa, Homo Sapiens
IARFSPRMS

SEQ ID NO: 517962 - protein, 9 aa, Homo Sapiens
RLNETKLTD

SEQ ID NO: 517963 - protein, 9 aa, Homo Sapiens
WIAIDNWST

SEQ ID NO: 517964 - protein, 9 aa, Homo Sapiens
TVHWENSFV

SEQ ID NO: 517965 - protein, 9 aa, Homo Sapiens
HRTTLLHAK

SEQ ID NO: 517966 - protein, 9 aa, Homo Sapiens
VKSEGSRIE

SEQ ID NO: 517967 - protein, 9 aa, Homo Sapiens
TDGQPCAPP

SEQ ID NO: 517968 - protein, 9 aa, Homo Sapiens
RSLSGSPGS

SEQ ID NO: 517969 - protein, 9 aa, Homo Sapiens
GAVGSGAYR

SEQ ID NO: 517970 - protein, 9 aa, Homo Sapiens
TLCYRVGYC

SEQ ID NO: 517971 - protein, 9 aa, Homo Sapiens
AARRQVEGC

SEQ ID NO: 517972 - protein, 9 aa, Homo Sapiens
LPSLELDGL

SEQ ID NO: 517973 - protein, 9 aa, Homo Sapiens
NMTTTNAVA

SEQ ID NO: 517974 - protein, 9 aa, Homo Sapiens
IKARPYFTN

SEQ ID NO: 517975 - protein, 9 aa, Homo Sapiens
QGSIISARV

SEQ ID NO: 517976 - protein, 9 aa, Homo Sapiens
VNLQEMVLL

SEQ ID NO: 517977 - protein, 9 aa, Homo Sapiens
SNSHISAVA

SEQ ID NO: 517978 - protein, 9 aa, Homo Sapiens
VIHHFFCYD

SEQ ID NO: 517979 - protein, 9 aa, Homo Sapiens
ILSSVSFWI

SEQ ID NO: 517980 - protein, 9 aa, Homo Sapiens
SGKMSSVFK

SEQ ID NO: 517981 - protein, 9 aa, Homo Sapiens
SFSIIPGQR

SEQ ID NO: 517982 - protein, 9 aa, Homo Sapiens
ILGHPKRYK

SEQ ID NO: 517983 - protein, 9 aa, Homo Sapiens
ALFTGECVL

SEQ ID NO: 517984 - protein, 9 aa, Homo Sapiens
FVQDVPCPA

SEQ ID NO: 517985 - protein, 9 aa, Homo Sapiens
AYFFMNPKL

SEQ ID NO: 517986 - protein, 9 aa, Homo Sapiens
CAPPLAAPP

SEQ ID NO: 517987 - protein, 9 aa, Homo Sapiens
AVNRGYVTT

SEQ ID NO: 517988 - protein, 9 aa, Homo Sapiens
MLPHVEGVH

SEQ ID NO: 517989 - protein, 9 aa, Homo Sapiens
NQNVQEEKR

SEQ ID NO: 517990 - protein, 9 aa, Homo Sapiens
KNISGSNQQ

SEQ ID NO: 517991 - protein, 9 aa, Homo Sapiens
PSSFVDKRM

SEQ ID NO: 517992 - protein, 9 aa, Homo Sapiens
LINRQGPYF

SEQ ID NO: 517993 - protein, 9 aa, Homo Sapiens
GPAWSYPAT

SEQ ID NO: 517994 - protein, 9 aa, Homo Sapiens
LYHTAKGML

SEQ ID NO: 517995 - protein, 9 aa, Homo Sapiens
RFRDSGDCG

SEQ ID NO: 517996 - protein, 9 aa, Homo Sapiens
YSPGGAPPQ

SEQ ID NO: 517997 - protein, 9 aa, Homo Sapiens
SIQMLDCCK

SEQ ID NO: 517998 - protein, 9 aa, Homo Sapiens
IIEDAHNRG

SEQ ID NO: 517999 - protein, 9 aa, Homo Sapiens
VHDPLPPEE

SEQ ID NO: 518000 - protein, 9 aa, Homo Sapiens
HAQTSSGGQ

SEQ ID NO: 518001 - protein, 9 aa, Homo Sapiens
AKDFFNIEV

SEQ ID NO: 518002 - protein, 9 aa, Homo Sapiens
SKSKERPAE

SEQ ID NO: 518003 - protein, 9 aa, Homo Sapiens
KILKHWTGG

SEQ ID NO: 518004 - protein, 9 aa, Homo Sapiens
AEEGIEERV

SEQ ID NO: 518005 - protein, 9 aa, Homo Sapiens
ISRSLMFCN

SEQ ID NO: 518006 - protein, 9 aa, Homo Sapiens
QEWRPEDEA

SEQ ID NO: 518007 - protein, 9 aa, Homo Sapiens
PGLADCFGA

SEQ ID NO: 518008 - protein, 9 aa, Homo Sapiens
PEGGQNKPA

SEQ ID NO: 518009 - protein, 9 aa, Homo Sapiens
SKVQAVQLC

SEQ ID NO: 518010 - protein, 9 aa, Homo Sapiens
GYSSSCGYG

SEQ ID NO: 518011 - protein, 9 aa, Homo Sapiens
PPSTTGVLL

SEQ ID NO: 518012 - protein, 9 aa, Homo Sapiens
HSLAHAYPS

SEQ ID NO: 518013 - protein, 9 aa, Homo Sapiens
CRGPVSPSD

SEQ ID NO: 518014 - protein, 9 aa, Homo Sapiens
VILLENLDR

SEQ ID NO: 518015 - protein, 9 aa, Homo Sapiens
SGINSDPDM

SEQ ID NO: 518016 - protein, 9 aa, Homo Sapiens
PQESLHIEI

SEQ ID NO: 518017 - protein, 9 aa, Homo Sapiens
CFGANRHPA

SEQ ID NO: 518018 - protein, 9 aa, Homo Sapiens
SPTISECPV

SEQ ID NO: 518019 - protein, 9 aa, Homo Sapiens
LNETKLTDL

SEQ ID NO: 518020 - protein, 9 aa, Homo Sapiens
YFYTIMPIP

SEQ ID NO: 518021 - protein, 9 aa, Homo Sapiens
VFIALFTGE

SEQ ID NO: 518022 - protein, 9 aa, Homo Sapiens
AAAVAAKYP

SEQ ID NO: 518023 - protein, 9 aa, Homo Sapiens
YPRLSECSS

SEQ ID NO: 518024 - protein, 9 aa, Homo Sapiens
RGGDTGFTG

SEQ ID NO: 518025 - protein, 9 aa, Homo Sapiens
SILYFLIKE

SEQ ID NO: 518026 - protein, 9 aa, Homo Sapiens
DPELWSCGG

SEQ ID NO: 518027 - protein, 9 aa, Homo Sapiens
DAAAVAAKY

SEQ ID NO: 518028 - protein, 9 aa, Homo Sapiens
GAVRTRVGS

SEQ ID NO: 518029 - protein, 9 aa, Homo Sapiens
TVEYLVPTS

SEQ ID NO: 518030 - protein, 9 aa, Homo Sapiens
SAEFHGLSS

SEQ ID NO: 518031 - protein, 9 aa, Homo Sapiens
CRPGLVLPE

SEQ ID NO: 518032 - protein, 9 aa, Homo Sapiens
MEDSPDSGW

SEQ ID NO: 518033 - protein, 9 aa, Homo Sapiens
ATDRGSPVL

SEQ ID NO: 518034 - protein, 9 aa, Homo Sapiens
GCWEVSPTD

SEQ ID NO: 518035 - protein, 9 aa, Homo Sapiens
ACIWGSLAL

SEQ ID NO: 518036 - protein, 9 aa, Homo Sapiens
KDSAKSRSQ

SEQ ID NO: 518037 - protein, 9 aa, Homo Sapiens
RVPPLDDKH

SEQ ID NO: 518038 - protein, 9 aa, Homo Sapiens
WEDSSDPLQ

SEQ ID NO: 518039 - protein, 9 aa, Homo Sapiens
DLCDHTTIL

SEQ ID NO: 518040 - protein, 9 aa, Homo Sapiens
LQTYMAFLK

SEQ ID NO: 518041 - protein, 9 aa, Homo Sapiens
HWTGGCPFR

SEQ ID NO: 518042 - protein, 9 aa, Homo Sapiens
GSWMIVSIN

SEQ ID NO: 518043 - protein, 9 aa, Homo Sapiens
PDLEPDYGT

SEQ ID NO: 518044 - protein, 9 aa, Homo Sapiens
IVSLGDSNS

SEQ ID NO: 518045 - protein, 9 aa, Homo Sapiens
LSSDGDEDA

SEQ ID NO: 518046 - protein, 9 aa, Homo Sapiens
SDKDSADMF

SEQ ID NO: 518047 - protein, 9 aa, Homo Sapiens
DRYEEQEPS

SEQ ID NO: 518048 - protein, 9 aa, Homo Sapiens
QHEYDIWPR

SEQ ID NO: 518049 - protein, 9 aa, Homo Sapiens
SEWGLGLCK

SEQ ID NO: 518050 - protein, 9 aa, Homo Sapiens
GKMSSVFKT

SEQ ID NO: 518051 - protein, 9 aa, Homo Sapiens
PGTVEYLVP

SEQ ID NO: 518052 - protein, 9 aa, Homo Sapiens
QETSVEIDE

SEQ ID NO: 518053 - protein, 9 aa, Homo Sapiens
LVPTGGGGG

SEQ ID NO: 518054 - protein, 9 aa, Homo Sapiens
TERQGLLNC

SEQ ID NO: 518055 - protein, 9 aa, Homo Sapiens
AFFKLSTPG

SEQ ID NO: 518056 - protein, 9 aa, Homo Sapiens
LITKFRVFR

SEQ ID NO: 518057 - protein, 9 aa, Homo Sapiens
NRRYEVPHE

SEQ ID NO: 518058 - protein, 9 aa, Homo Sapiens
TNFLIVSLA

SEQ ID NO: 518059 - protein, 9 aa, Homo Sapiens
GWWEVEKED

SEQ ID NO: 518060 - protein, 9 aa, Homo Sapiens
RVGHDMKDM

SEQ ID NO: 518061 - protein, 9 aa, Homo Sapiens
LAFILIGNI

SEQ ID NO: 518062 - protein, 9 aa, Homo Sapiens
PPGAYDCPA

SEQ ID NO: 518063 - protein, 9 aa, Homo Sapiens
QMLDCCKRL

SEQ ID NO: 518064 - protein, 9 aa, Homo Sapiens
KLLEQFRLI

SEQ ID NO: 518065 - protein, 9 aa, Homo Sapiens
PHSVLLNWT

SEQ ID NO: 518066 - protein, 9 aa, Homo Sapiens
PPGTPVRAM

SEQ ID NO: 518067 - protein, 9 aa, Homo Sapiens
CGGGRKGAI

SEQ ID NO: 518068 - protein, 9 aa, Homo Sapiens
LYTITFSDD

SEQ ID NO: 518069 - protein, 9 aa, Homo Sapiens
SSVAHLVRL

SEQ ID NO: 518070 - protein, 9 aa, Homo Sapiens
CVIKPQRKI

SEQ ID NO: 518071 - protein, 9 aa, Homo Sapiens
SNTEDFVED

SEQ ID NO: 518072 - protein, 9 aa, Homo Sapiens
CADGSDEPD

SEQ ID NO: 518073 - protein, 9 aa, Homo Sapiens
PYSDKHGRF

SEQ ID NO: 518074 - protein, 9 aa, Homo Sapiens
RMNLVIFMY

SEQ ID NO: 518075 - protein, 9 aa, Homo Sapiens
KMSSVFKTH

SEQ ID NO: 518076 - protein, 9 aa, Homo Sapiens
DKLLFSFGL

SEQ ID NO: 518077 - protein, 9 aa, Homo Sapiens
DEGGPDLEP

SEQ ID NO: 518078 - protein, 9 aa, Homo Sapiens
DTFQDSSVF

SEQ ID NO: 518079 - protein, 9 aa, Homo Sapiens
SILMGLDGI

SEQ ID NO: 518080 - protein, 9 aa, Homo Sapiens
GVMAVDRYE

SEQ ID NO: 518081 - protein, 9 aa, Homo Sapiens
GFEGLHLWT

SEQ ID NO: 518082 - protein, 9 aa, Homo Sapiens
LPKGYDSWQ

SEQ ID NO: 518083 - protein, 9 aa, Homo Sapiens
WEVEKEDGL

SEQ ID NO: 518084 - protein, 9 aa, Homo Sapiens
PGWSRYIPE

SEQ ID NO: 518085 - protein, 9 aa, Homo Sapiens
CEHIKSACL

SEQ ID NO: 518086 - protein, 9 aa, Homo Sapiens
YLQDPEFNT

SEQ ID NO: 518087 - protein, 9 aa, Homo Sapiens
IRSTNLEDS

SEQ ID NO: 518088 - protein, 9 aa, Homo Sapiens
NPDLEKTIK

SEQ ID NO: 518089 - protein, 9 aa, Homo Sapiens
FFLIHLHAG

SEQ ID NO: 518090 - protein, 9 aa, Homo Sapiens
SETSFHLKK

SEQ ID NO: 518091 - protein, 9 aa, Homo Sapiens
VFPVCICAA

SEQ ID NO: 518092 - protein, 9 aa, Homo Sapiens
RTRITCIGA

SEQ ID NO: 518093 - protein, 9 aa, Homo Sapiens
QESLHIEIE

SEQ ID NO: 518094 - protein, 9 aa, Homo Sapiens
QVIKKSIFR

SEQ ID NO: 518095 - protein, 9 aa, Homo Sapiens
EEVRESNTV

SEQ ID NO: 518096 - protein, 9 aa, Homo Sapiens
RPSELLSGH

SEQ ID NO: 518097 - protein, 9 aa, Homo Sapiens
TAVTQGIVS

SEQ ID NO: 518098 - protein, 9 aa, Homo Sapiens
EYKKDSAKS

SEQ ID NO: 518099 - protein, 9 aa, Homo Sapiens
GNIARFSPR

SEQ ID NO: 518100 - protein, 9 aa, Homo Sapiens
AEFHPHHSN

SEQ ID NO: 518101 - protein, 9 aa, Homo Sapiens
QPPCSPEWG

SEQ ID NO: 518102 - protein, 9 aa, Homo Sapiens
DPLTTVQEE

SEQ ID NO: 518103 - protein, 9 aa, Homo Sapiens
HEYVKEFTG

SEQ ID NO: 518104 - protein, 9 aa, Homo Sapiens
YENAQHHDA

SEQ ID NO: 518105 - protein, 9 aa, Homo Sapiens
NEAFDPYEN

SEQ ID NO: 518106 - protein, 9 aa, Homo Sapiens
SDCRPGLVL

SEQ ID NO: 518107 - protein, 9 aa, Homo Sapiens
IRIQSRDQR

SEQ ID NO: 518108 - protein, 9 aa, Homo Sapiens
ISVVDTMKV

SEQ ID NO: 518109 - protein, 9 aa, Homo Sapiens
VRNESHENC

SEQ ID NO: 518110 - protein, 9 aa, Homo Sapiens
QPPQAVFPV

SEQ ID NO: 518111 - protein, 9 aa, Homo Sapiens
AIRQGPQGL

SEQ ID NO: 518112 - protein, 9 aa, Homo Sapiens
ITFSDDKVI

SEQ ID NO: 518113 - protein, 9 aa, Homo Sapiens
VTMARLSRD

SEQ ID NO: 518114 - protein, 9 aa, Homo Sapiens
EQEPSPRDR

SEQ ID NO: 518115 - protein, 9 aa, Homo Sapiens
VQRVPQAVF

SEQ ID NO: 518116 - protein, 9 aa, Homo Sapiens
YWPYLTAEA

SEQ ID NO: 518117 - protein, 9 aa, Homo Sapiens
FNTEFVATK

SEQ ID NO: 518118 - protein, 9 aa, Homo Sapiens
SLLLDQRLS

SEQ ID NO: 518119 - protein, 9 aa, Homo Sapiens
RLCYVCSVS

SEQ ID NO: 518120 - protein, 9 aa, Homo Sapiens
KCEYSAHKQ

SEQ ID NO: 518121 - protein, 9 aa, Homo Sapiens
MMGLIACAN

SEQ ID NO: 518122 - protein, 9 aa, Homo Sapiens
NSKPVLSNI

SEQ ID NO: 518123 - protein, 9 aa, Homo Sapiens
PYWVSSAYS

SEQ ID NO: 518124 - protein, 9 aa, Homo Sapiens
SSEQEGHPE

SEQ ID NO: 518125 - protein, 9 aa, Homo Sapiens
IPKSEEMQP

SEQ ID NO: 518126 - protein, 9 aa, Homo Sapiens
KSNCQKVPI

SEQ ID NO: 518127 - protein, 9 aa, Homo Sapiens
AQNFSLHID

SEQ ID NO: 518128 - protein, 9 aa, Homo Sapiens
IEYFKGISD

SEQ ID NO: 518129 - protein, 9 aa, Homo Sapiens
DIWPRAGKE

SEQ ID NO: 518130 - protein, 9 aa, Homo Sapiens
PRCARGCST

SEQ ID NO: 518131 - protein, 9 aa, Homo Sapiens
LHIEIEFSK

SEQ ID NO: 518132 - protein, 9 aa, Homo Sapiens
KSHRHSHHR

SEQ ID NO: 518133 - protein, 9 aa, Homo Sapiens
KTCSDELTV

SEQ ID NO: 518134 - protein, 9 aa, Homo Sapiens
THAGEEHYK

SEQ ID NO: 518135 - protein, 9 aa, Homo Sapiens
RMTFRERTK

SEQ ID NO: 518136 - protein, 9 aa, Homo Sapiens
CEGCKSFFN

SEQ ID NO: 518137 - protein, 9 aa, Homo Sapiens
AAYQGGGGG

SEQ ID NO: 518138 - protein, 9 aa, Homo Sapiens
SRYEYGILD

SEQ ID NO: 518139 - protein, 9 aa, Homo Sapiens
DRECCDYRR

SEQ ID NO: 518140 - protein, 9 aa, Homo Sapiens
GILDNMREV

SEQ ID NO: 518141 - protein, 9 aa, Homo Sapiens
LVPTSLRAH

SEQ ID NO: 518142 - protein, 9 aa, Homo Sapiens
APPPSSVNR

SEQ ID NO: 518143 - protein, 9 aa, Homo Sapiens
AELQHATRG

SEQ ID NO: 518144 - protein, 9 aa, Homo Sapiens
GRATMSISN

SEQ ID NO: 518145 - protein, 9 aa, Homo Sapiens
NVIHHFFCY

SEQ ID NO: 518146 - protein, 9 aa, Homo Sapiens
KGSGDDVKD

SEQ ID NO: 518147 - protein, 9 aa, Homo Sapiens
TWLRGEKVI

SEQ ID NO: 518148 - protein, 9 aa, Homo Sapiens
CWFVGVVVN

SEQ ID NO: 518149 - protein, 9 aa, Homo Sapiens
NRVVGAETA

SEQ ID NO: 518150 - protein, 9 aa, Homo Sapiens
PLDDKHLLK

SEQ ID NO: 518151 - protein, 9 aa, Homo Sapiens
VNRGYVTTL

SEQ ID NO: 518152 - protein, 9 aa, Homo Sapiens
LGSGAAPAG

SEQ ID NO: 518153 - protein, 9 aa, Homo Sapiens
DLEDMNQKL

SEQ ID NO: 518154 - protein, 9 aa, Homo Sapiens
TEPPGAYDC

SEQ ID NO: 518155 - protein, 9 aa, Homo Sapiens
NISGSNQQA

SEQ ID NO: 518156 - protein, 9 aa, Homo Sapiens
CGGGKQSRK

SEQ ID NO: 518157 - protein, 9 aa, Homo Sapiens
FVAVMPYQP

SEQ ID NO: 518158 - protein, 9 aa, Homo Sapiens
LATGRNLAV

SEQ ID NO: 518159 - protein, 9 aa, Homo Sapiens
SHRIHLLCM

SEQ ID NO: 518160 - protein, 9 aa, Homo Sapiens
MKQKRVYQQ

SEQ ID NO: 518161 - protein, 9 aa, Homo Sapiens
TPSSLSASA

SEQ ID NO: 518162 - protein, 9 aa, Homo Sapiens
KQSRKIRCV

SEQ ID NO: 518163 - protein, 9 aa, Homo Sapiens
DCFGANRHP

SEQ ID NO: 518164 - protein, 9 aa, Homo Sapiens
VQDVPCPAG

SEQ ID NO: 518165 - protein, 9 aa, Homo Sapiens
GCLCEIEIN

SEQ ID NO: 518166 - protein, 9 aa, Homo Sapiens
LELHVNCYV

SEQ ID NO: 518167 - protein, 9 aa, Homo Sapiens
VMESGVLLG

SEQ ID NO: 518168 - protein, 9 aa, Homo Sapiens
SAYSKTQPK

SEQ ID NO: 518169 - protein, 9 aa, Homo Sapiens
ATNVSQAEC

SEQ ID NO: 518170 - protein, 9 aa, Homo Sapiens
ESHENCDFR

SEQ ID NO: 518171 - protein, 9 aa, Homo Sapiens
IIPGQRVGL

SEQ ID NO: 518172 - protein, 9 aa, Homo Sapiens
IYVLNLAIS

SEQ ID NO: 518173 - protein, 9 aa, Homo Sapiens
APALEPRSA

SEQ ID NO: 518174 - protein, 9 aa, Homo Sapiens
LWDRECCDY

SEQ ID NO: 518175 - protein, 9 aa, Homo Sapiens
VGVVVNMVM

SEQ ID NO: 518176 - protein, 9 aa, Homo Sapiens
PYMMGLIAC

SEQ ID NO: 518177 - protein, 9 aa, Homo Sapiens
LAGYHYTST

SEQ ID NO: 518178 - protein, 9 aa, Homo Sapiens
RSGSYRPHT

SEQ ID NO: 518179 - protein, 9 aa, Homo Sapiens
DLCLNQIVL

SEQ ID NO: 518180 - protein, 9 aa, Homo Sapiens
SYPLTAANG

SEQ ID NO: 518181 - protein, 9 aa, Homo Sapiens
ISNGKSVTW

SEQ ID NO: 518182 - protein, 8 aa, Homo Sapiens
SAAAYMDF

SEQ ID NO: 518183 - protein, 9 aa, Homo Sapiens
GMYIFLHMV

SEQ ID NO: 518184 - protein, 9 aa, Homo Sapiens
DCDRRLLTT

SEQ ID NO: 518185 - protein, 9 aa, Homo Sapiens
TTTNFLIVS

SEQ ID NO: 518186 - protein, 9 aa, Homo Sapiens
YEVPHEYVK

SEQ ID NO: 518187 - protein, 9 aa, Homo Sapiens
KAVMKFSNS

SEQ ID NO: 518188 - protein, 9 aa, Homo Sapiens
MQKIKQPDV

SEQ ID NO: 518189 - protein, 9 aa, Homo Sapiens
HLYLNDAFL

SEQ ID NO: 518190 - protein, 9 aa, Homo Sapiens
SLLFRLKFK

SEQ ID NO: 518191 - protein, 9 aa, Homo Sapiens
TDDCDRRLL

SEQ ID NO: 518192 - protein, 9 aa, Homo Sapiens
DSAKSRSQF

SEQ ID NO: 518193 - protein, 9 aa, Homo Sapiens
VCYPGNTKV

SEQ ID NO: 518194 - protein, 9 aa, Homo Sapiens
LPRLRLEEE

SEQ ID NO: 518195 - protein, 9 aa, Homo Sapiens
SQIQMICNV

SEQ ID NO: 518196 - protein, 9 aa, Homo Sapiens
CYVCSVSVE

SEQ ID NO: 518197 - protein, 9 aa, Homo Sapiens
NIRIQSRDQ

SEQ ID NO: 518198 - protein, 9 aa, Homo Sapiens
NEYIGVTYK

SEQ ID NO: 518199 - protein, 9 aa, Homo Sapiens
SRFENGHGL

SEQ ID NO: 518200 - protein, 9 aa, Homo Sapiens
RADGPYKCK

SEQ ID NO: 518201 - protein, 9 aa, Homo Sapiens
TLVRNESHE

SEQ ID NO: 518202 - protein, 9 aa, Homo Sapiens
CLCPGRYLR

SEQ ID NO: 518203 - protein, 9 aa, Homo Sapiens
VGGSKAQPG

SEQ ID NO: 518204 - protein, 9 aa, Homo Sapiens
DDLKGTFTQ

SEQ ID NO: 518205 - protein, 9 aa, Homo Sapiens
LDPCAPSPA

SEQ ID NO: 518206 - protein, 9 aa, Homo Sapiens
PPSDLGYAW

SEQ ID NO: 518207 - protein, 9 aa, Homo Sapiens
LELLLFQPR

SEQ ID NO: 518208 - protein, 9 aa, Homo Sapiens
AEANEVDLN

SEQ ID NO: 518209 - protein, 9 aa, Homo Sapiens
SGAAPAGRS

SEQ ID NO: 518210 - protein, 9 aa, Homo Sapiens
MVEIYVLNL

SEQ ID NO: 518211 - protein, 9 aa, Homo Sapiens
IMPIPANQE

SEQ ID NO: 518212 - protein, 9 aa, Homo Sapiens
QRPRSAART

SEQ ID NO: 518213 - protein, 9 aa, Homo Sapiens
VKCKEDYEK

SEQ ID NO: 518214 - protein, 9 aa, Homo Sapiens
QQGVVVSYL

SEQ ID NO: 518215 - protein, 9 aa, Homo Sapiens
SSRKLISDK

SEQ ID NO: 518216 - protein, 9 aa, Homo Sapiens
VPQAVFCPV

SEQ ID NO: 518217 - protein, 9 aa, Homo Sapiens
VLEVVNLVD

SEQ ID NO: 518218 - protein, 9 aa, Homo Sapiens
MNMKQKRVY

SEQ ID NO: 518219 - protein, 9 aa, Homo Sapiens
PANVALRST

SEQ ID NO: 518220 - protein, 9 aa, Homo Sapiens
SSFQVIKKS

SEQ ID NO: 518221 - protein, 9 aa, Homo Sapiens
GNTALTYDR

SEQ ID NO: 518222 - protein, 9 aa, Homo Sapiens
WIGLHDPTK

SEQ ID NO: 518223 - protein, 9 aa, Homo Sapiens
MESLKSKVQ

SEQ ID NO: 518224 - protein, 9 aa, Homo Sapiens
DVPCPAGHV

SEQ ID NO: 518225 - protein, 9 aa, Homo Sapiens
YEYGILDNM

SEQ ID NO: 518226 - protein, 9 aa, Homo Sapiens
GQNKPAIIA

SEQ ID NO: 518227 - protein, 9 aa, Homo Sapiens
TFSDDKVIE

SEQ ID NO: 518228 - protein, 9 aa, Homo Sapiens
RRDGSGGDG

SEQ ID NO: 518229 - protein, 9 aa, Homo Sapiens
CDCIGRLEV

SEQ ID NO: 518230 - protein, 9 aa, Homo Sapiens
EYTMIILAV

SEQ ID NO: 518231 - protein, 9 aa, Homo Sapiens
VGQLRSDLD

SEQ ID NO: 518232 - protein, 9 aa, Homo Sapiens
GDGIYSVTF

SEQ ID NO: 518233 - protein, 9 aa, Homo Sapiens
LGSQIQMIC

SEQ ID NO: 518234 - protein, 9 aa, Homo Sapiens
SSLSASAGP

SEQ ID NO: 518235 - protein, 9 aa, Homo Sapiens
SDLMSPANV

SEQ ID NO: 518236 - protein, 9 aa, Homo Sapiens
TQLLNLTHL

SEQ ID NO: 518237 - protein, 9 aa, Homo Sapiens
GMLCADTCA

SEQ ID NO: 518238 - protein, 9 aa, Homo Sapiens
TYMAFLKSS

SEQ ID NO: 518239 - protein, 9 aa, Homo Sapiens
LLTTAFDRY

SEQ ID NO: 518240 - protein, 9 aa, Homo Sapiens
PRALVLVIG

SEQ ID NO: 518241 - protein, 9 aa, Homo Sapiens
GKEYKCKVP

SEQ ID NO: 518242 - protein, 9 aa, Homo Sapiens
CHSFCVIKP

SEQ ID NO: 518243 - protein, 9 aa, Homo Sapiens
EIVSLGDSN

SEQ ID NO: 518244 - protein, 9 aa, Homo Sapiens
MNIRKAQPD

SEQ ID NO: 518245 - protein, 9 aa, Homo Sapiens
HLPNVQPPS

SEQ ID NO: 518246 - protein, 9 aa, Homo Sapiens
LNPPLPPTI

SEQ ID NO: 518247 - protein, 9 aa, Homo Sapiens
PEPPSAALL

SEQ ID NO: 518248 - protein, 9 aa, Homo Sapiens
ALPESIPSP

SEQ ID NO: 518249 - protein, 9 aa, Homo Sapiens
PQLPPPPPP

SEQ ID NO: 518250 - protein, 9 aa, Homo Sapiens
CLGSGPVIQ

SEQ ID NO: 518251 - protein, 9 aa, Homo Sapiens
PRRLCAAGD

SEQ ID NO: 518252 - protein, 9 aa, Homo Sapiens
PSEKSQDPL

SEQ ID NO: 518253 - protein, 9 aa, Homo Sapiens
HIEIEFSKP

SEQ ID NO: 518254 - protein, 9 aa, Homo Sapiens
ISSIQMLDC

SEQ ID NO: 518255 - protein, 9 aa, Homo Sapiens
TVSFADVNQ

SEQ ID NO: 518256 - protein, 9 aa, Homo Sapiens
EHPGNCLIF

SEQ ID NO: 518257 - protein, 9 aa, Homo Sapiens
TTFALNQLK

SEQ ID NO: 518258 - protein, 9 aa, Homo Sapiens
KNITTTLPS

SEQ ID NO: 518259 - protein, 9 aa, Homo Sapiens
NMQKIKQPD

SEQ ID NO: 518260 - protein, 9 aa, Homo Sapiens
DLGYAWNIP

SEQ ID NO: 518261 - protein, 9 aa, Homo Sapiens
VCICAAVLP

SEQ ID NO: 518262 - protein, 9 aa, Homo Sapiens
DPTKGSEPD

SEQ ID NO: 518263 - protein, 9 aa, Homo Sapiens
GHAAPCGQA

SEQ ID NO: 518264 - protein, 9 aa, Homo Sapiens
PAILKIRYT

SEQ ID NO: 518265 - protein, 9 aa, Homo Sapiens
LPPEEILAD

SEQ ID NO: 518266 - protein, 9 aa, Homo Sapiens
TITFSDDKV

SEQ ID NO: 518267 - protein, 9 aa, Homo Sapiens
ATVRITYSP

SEQ ID NO: 518268 - protein, 9 aa, Homo Sapiens
PKSEEMQPT

SEQ ID NO: 518269 - protein, 9 aa, Homo Sapiens
ATGRNLAVL

SEQ ID NO: 518270 - protein, 9 aa, Homo Sapiens
NCGQHYCPL

SEQ ID NO: 518271 - protein, 9 aa, Homo Sapiens
SLHIEIEFS

SEQ ID NO: 518272 - protein, 9 aa, Homo Sapiens
SDETLKLVD

SEQ ID NO: 518273 - protein, 9 aa, Homo Sapiens
MAFLKSSEE

SEQ ID NO: 518274 - protein, 9 aa, Homo Sapiens
LLSRVRYSP

SEQ ID NO: 518275 - protein, 9 aa, Homo Sapiens
DDFVQDVPC

SEQ ID NO: 518276 - protein, 9 aa, Homo Sapiens
ASRVPSQPP

SEQ ID NO: 518277 - protein, 9 aa, Homo Sapiens
EFNTEFVAT

SEQ ID NO: 518278 - protein, 9 aa, Homo Sapiens
ILAADKVLQ

SEQ ID NO: 518279 - protein, 9 aa, Homo Sapiens
GNMQKIKQP

SEQ ID NO: 518280 - protein, 9 aa, Homo Sapiens
MVMNCGQHY

SEQ ID NO: 518281 - protein, 9 aa, Homo Sapiens
KKAVMKFSN

SEQ ID NO: 518282 - protein, 9 aa, Homo Sapiens
QVLQTYMAF

SEQ ID NO: 518283 - protein, 9 aa, Homo Sapiens
NTAHTQLLV

SEQ ID NO: 518284 - protein, 9 aa, Homo Sapiens
KVKCKEDYE

SEQ ID NO: 518285 - protein, 9 aa, Homo Sapiens
IVKVTNQII

SEQ ID NO: 518286 - protein, 9 aa, Homo Sapiens
GHTCGRRKS

SEQ ID NO: 518287 - protein, 9 aa, Homo Sapiens
SAAELTDFI

SEQ ID NO: 518288 - protein, 9 aa, Homo Sapiens
EHYKCEECG

SEQ ID NO: 518289 - protein, 9 aa, Homo Sapiens
TTFSSAQLK

SEQ ID NO: 518290 - protein, 9 aa, Homo Sapiens
SARRLRHLV

SEQ ID NO: 518291 - protein, 9 aa, Homo Sapiens
MSSYFREQG

SEQ ID NO: 518292 - protein, 9 aa, Homo Sapiens
ATHAGEEHY

SEQ ID NO: 518293 - protein, 9 aa, Homo Sapiens
NRGRKIAAF

SEQ ID NO: 518294 - protein, 9 aa, Homo Sapiens
KLAEGFLAK

SEQ ID NO: 518295 - protein, 9 aa, Homo Sapiens
RKLISDKDS

SEQ ID NO: 518296 - protein, 9 aa, Homo Sapiens
QGLLAAIPG

SEQ ID NO: 518297 - protein, 9 aa, Homo Sapiens
RLAEHERMA

SEQ ID NO: 518298 - protein, 9 aa, Homo Sapiens
RITYSPEEI

SEQ ID NO: 518299 - protein, 9 aa, Homo Sapiens
PCGDRYAVA

SEQ ID NO: 518300 - protein, 9 aa, Homo Sapiens
FRVFRISHR

SEQ ID NO: 518301 - protein, 9 aa, Homo Sapiens
EKLAEGFLA

SEQ ID NO: 518302 - protein, 9 aa, Homo Sapiens
ICRPGFSGC

SEQ ID NO: 518303 - protein, 9 aa, Homo Sapiens
GCRGPVSPS

SEQ ID NO: 518304 - protein, 9 aa, Homo Sapiens
INKMWIAID

SEQ ID NO: 518305 - protein, 9 aa, Homo Sapiens
DFSVHFNRF

SEQ ID NO: 518306 - protein, 9 aa, Homo Sapiens
QDSLRGSIV

SEQ ID NO: 518307 - protein, 9 aa, Homo Sapiens
FVKSEGSRI

SEQ ID NO: 518308 - protein, 9 aa, Homo Sapiens
DKVLQESEM

SEQ ID NO: 518309 - protein, 9 aa, Homo Sapiens
PCAPSPAPA

SEQ ID NO: 518310 - protein, 9 aa, Homo Sapiens
LYFLQSPTE

SEQ ID NO: 518311 - protein, 9 aa, Homo Sapiens
CGVQRVPQA

SEQ ID NO: 518312 - protein, 9 aa, Homo Sapiens
PSQPPSPQL

SEQ ID NO: 518313 - protein, 9 aa, Homo Sapiens
RACLERIEE

SEQ ID NO: 518314 - protein, 9 aa, Homo Sapiens
SQEEISDLC

SEQ ID NO: 518315 - protein, 9 aa, Homo Sapiens
CYDQPVLKL

SEQ ID NO: 518316 - protein, 9 aa, Homo Sapiens
ATSTAKLVV

SEQ ID NO: 518317 - protein, 9 aa, Homo Sapiens
FPFFRKEQQ

SEQ ID NO: 518318 - protein, 9 aa, Homo Sapiens
VKWVGVGKL

SEQ ID NO: 518319 - protein, 9 aa, Homo Sapiens
VLLGMAYDC

SEQ ID NO: 518320 - protein, 9 aa, Homo Sapiens
LTLLDLCLN

SEQ ID NO: 518321 - protein, 9 aa, Homo Sapiens
SPCESVQKL

SEQ ID NO: 518322 - protein, 9 aa, Homo Sapiens
QGMMGNFIE

SEQ ID NO: 518323 - protein, 9 aa, Homo Sapiens
DQENEAFDP

SEQ ID NO: 518324 - protein, 9 aa, Homo Sapiens
AEDEEMNQM

SEQ ID NO: 518325 - protein, 9 aa, Homo Sapiens
LECPNREII

SEQ ID NO: 518326 - protein, 9 aa, Homo Sapiens
SSIQMLDCC

SEQ ID NO: 518327 - protein, 9 aa, Homo Sapiens
LAADKVLQE

SEQ ID NO: 518328 - protein, 9 aa, Homo Sapiens
KPFACPHCG

SEQ ID NO: 518329 - protein, 9 aa, Homo Sapiens
VTQGIVSLP

SEQ ID NO: 518330 - protein, 9 aa, Homo Sapiens
PLEKTPMGE

SEQ ID NO: 518331 - protein, 9 aa, Homo Sapiens
ELHVNCYVL

SEQ ID NO: 518332 - protein, 9 aa, Homo Sapiens
QHHDAGFSV

SEQ ID NO: 518333 - protein, 9 aa, Homo Sapiens
IKNYYREKI

SEQ ID NO: 518334 - protein, 9 aa, Homo Sapiens
KVRSAGCSV

SEQ ID NO: 518335 - protein, 9 aa, Homo Sapiens
ATSNSEDAF

SEQ ID NO: 518336 - protein, 9 aa, Homo Sapiens
SARVSPTRN

SEQ ID NO: 518337 - protein, 9 aa, Homo Sapiens
DCPAWAPCP

SEQ ID NO: 518338 - protein, 9 aa, Homo Sapiens
AQTQGLKGQ

SEQ ID NO: 518339 - protein, 9 aa, Homo Sapiens
GHNEKSNCQ

SEQ ID NO: 518340 - protein, 9 aa, Homo Sapiens
PPLDDKHLL

SEQ ID NO: 518341 - protein, 9 aa, Homo Sapiens
PHCGRAFSH

SEQ ID NO: 518342 - protein, 9 aa, Homo Sapiens
KVSGKMSSV

SEQ ID NO: 518343 - protein, 9 aa, Homo Sapiens
IGIGTTSAN

SEQ ID NO: 518344 - protein, 9 aa, Homo Sapiens
IKNITTTLP

SEQ ID NO: 518345 - protein, 9 aa, Homo Sapiens
RAFHTCASH

SEQ ID NO: 518346 - protein, 9 aa, Homo Sapiens
SLIVKVTNQ

SEQ ID NO: 518347 - protein, 9 aa, Homo Sapiens
SQPPSPQLS

SEQ ID NO: 518348 - protein, 9 aa, Homo Sapiens
HERARMRVL

SEQ ID NO: 518349 - protein, 9 aa, Homo Sapiens
SLCIVNDKH

SEQ ID NO: 518350 - protein, 9 aa, Homo Sapiens
ESRNAQAAA

SEQ ID NO: 518351 - protein, 9 aa, Homo Sapiens
PVGPMCWFV

SEQ ID NO: 518352 - protein, 9 aa, Homo Sapiens
VPSSVAHLV

SEQ ID NO: 518353 - protein, 9 aa, Homo Sapiens
ECDEILKGE

SEQ ID NO: 518354 - protein, 9 aa, Homo Sapiens
VRESNTVAS

SEQ ID NO: 518355 - protein, 9 aa, Homo Sapiens
YREKIGIYF

SEQ ID NO: 518356 - protein, 9 aa, Homo Sapiens
GSASDTFQD

SEQ ID NO: 518357 - protein, 9 aa, Homo Sapiens
QPPVQNGTV

SEQ ID NO: 518358 - protein, 9 aa, Homo Sapiens
QDFWKCGSQ

SEQ ID NO: 518359 - protein, 9 aa, Homo Sapiens
EHKALILQK

SEQ ID NO: 518360 - protein, 9 aa, Homo Sapiens
CHNLQTSTL

SEQ ID NO: 518361 - protein, 9 aa, Homo Sapiens
EAEDPEEKL

SEQ ID NO: 518362 - protein, 9 aa, Homo Sapiens
PELWSCGGG

SEQ ID NO: 518363 - protein, 9 aa, Homo Sapiens
NEVDLNMRV

SEQ ID NO: 518364 - protein, 9 aa, Homo Sapiens
SFCVIKPQR

SEQ ID NO: 518365 - protein, 9 aa, Homo Sapiens
NAVAILFYT

SEQ ID NO: 518366 - protein, 9 aa, Homo Sapiens
EGDSHRIHL

SEQ ID NO: 518367 - protein, 9 aa, Homo Sapiens
KCKEDYEKN

SEQ ID NO: 518368 - protein, 9 aa, Homo Sapiens
ITYSPEEIV

SEQ ID NO: 518369 - protein, 9 aa, Homo Sapiens
FHLFRFKLI

SEQ ID NO: 518370 - protein, 9 aa, Homo Sapiens
LLFRHDSTS

SEQ ID NO: 518371 - protein, 9 aa, Homo Sapiens
HLLLLLIII

SEQ ID NO: 518372 - protein, 9 aa, Homo Sapiens
HERMAASTQ

SEQ ID NO: 518373 - protein, 9 aa, Homo Sapiens
RNLQADFEV

SEQ ID NO: 518374 - protein, 9 aa, Homo Sapiens
SAPPPSSVN

SEQ ID NO: 518375 - protein, 9 aa, Homo Sapiens
RIEELEDLL

SEQ ID NO: 518376 - protein, 9 aa, Homo Sapiens
ENISFSIIP

SEQ ID NO: 518377 - protein, 9 aa, Homo Sapiens
ARRAARAPL

SEQ ID NO: 518378 - protein, 9 aa, Homo Sapiens
IGRSLLELQ

SEQ ID NO: 518379 - protein, 9 aa, Homo Sapiens
IWGSLALGV

SEQ ID NO: 518380 - protein, 9 aa, Homo Sapiens
KCNKTVKCY

SEQ ID NO: 518381 - protein, 9 aa, Homo Sapiens
PSAPPPSSV

SEQ ID NO: 518382 - protein, 9 aa, Homo Sapiens
MSSADLLNA

SEQ ID NO: 518383 - protein, 9 aa, Homo Sapiens
QSPTEEEPE

SEQ ID NO: 518384 - protein, 9 aa, Homo Sapiens
VCLACSDPR

SEQ ID NO: 518385 - protein, 9 aa, Homo Sapiens
VHLPCYHST

SEQ ID NO: 518386 - protein, 9 aa, Homo Sapiens
FVGVVVNMV

SEQ ID NO: 518387 - protein, 9 aa, Homo Sapiens
DLCAGLAEE

SEQ ID NO: 518388 - protein, 9 aa, Homo Sapiens
CGSSEQEGH

SEQ ID NO: 518389 - protein, 9 aa, Homo Sapiens
VGPMCWFVG

SEQ ID NO: 518390 - protein, 9 aa, Homo Sapiens
RGLCPLLLR

SEQ ID NO: 518391 - protein, 9 aa, Homo Sapiens
LTYDRQASS

SEQ ID NO: 518392 - protein, 9 aa, Homo Sapiens
CVDLAGYHY

SEQ ID NO: 518393 - protein, 9 aa, Homo Sapiens
ISTGTWNPE

SEQ ID NO: 518394 - protein, 9 aa, Homo Sapiens
MGAIDFLGS

SEQ ID NO: 518395 - protein, 9 aa, Homo Sapiens
NIYFYTIMP

SEQ ID NO: 518396 - protein, 9 aa, Homo Sapiens
LRRSLVLRT

SEQ ID NO: 518397 - protein, 9 aa, Homo Sapiens
AGYFIPIFV

SEQ ID NO: 518398 - protein, 9 aa, Homo Sapiens
WWEVEKEDG

SEQ ID NO: 518399 - protein, 9 aa, Homo Sapiens
KMDDDDDDD

SEQ ID NO: 518400 - protein, 9 aa, Homo Sapiens
RPAEPKARP

SEQ ID NO: 518401 - protein, 9 aa, Homo Sapiens
FNRSVRRNL

SEQ ID NO: 518402 - protein, 9 aa, Homo Sapiens
KSKERPAEP

SEQ ID NO: 518403 - protein, 9 aa, Homo Sapiens
CWEVSPTDR

SEQ ID NO: 518404 - protein, 9 aa, Homo Sapiens
YEAVCNPLR

SEQ ID NO: 518405 - protein, 9 aa, Homo Sapiens
SVMIQMSSS

SEQ ID NO: 518406 - protein, 9 aa, Homo Sapiens
GYDSWQAVD

SEQ ID NO: 518407 - protein, 9 aa, Homo Sapiens
KERPAEPKA

SEQ ID NO: 518408 - protein, 9 aa, Homo Sapiens
LDLCLNQIV

SEQ ID NO: 518409 - protein, 9 aa, Homo Sapiens
FPAILKIRY

SEQ ID NO: 518410 - protein, 9 aa, Homo Sapiens
SAWRVSALS

SEQ ID NO: 518411 - protein, 9 aa, Homo Sapiens
NKTTERQGL

SEQ ID NO: 518412 - protein, 9 aa, Homo Sapiens
EHVVQEYLE

SEQ ID NO: 518413 - protein, 9 aa, Homo Sapiens
RPSGVAAAA

SEQ ID NO: 518414 - protein, 9 aa, Homo Sapiens
MKRFISTLA

SEQ ID NO: 518415 - protein, 9 aa, Homo Sapiens
RHLVVHLAC

SEQ ID NO: 518416 - protein, 9 aa, Homo Sapiens
VSWDFYSIS

SEQ ID NO: 518417 - protein, 9 aa, Homo Sapiens
SRRTSRSLS

SEQ ID NO: 518418 - protein, 9 aa, Homo Sapiens
KRVYQQTKA

SEQ ID NO: 518419 - protein, 9 aa, Homo Sapiens
KDSVTVKCQ

SEQ ID NO: 518420 - protein, 9 aa, Homo Sapiens
TKCDKCNKT

SEQ ID NO: 518421 - protein, 9 aa, Homo Sapiens
ALDGGSPLG

SEQ ID NO: 518422 - protein, 9 aa, Homo Sapiens
PPLPSAPPP

SEQ ID NO: 518423 - protein, 9 aa, Homo Sapiens
SNTFVYSSS

SEQ ID NO: 518424 - protein, 9 aa, Homo Sapiens
PHAQTSSGG

SEQ ID NO: 518425 - protein, 9 aa, Homo Sapiens
PSSLSASAG

SEQ ID NO: 518426 - protein, 9 aa, Homo Sapiens
NCQKVPILT

SEQ ID NO: 518427 - protein, 9 aa, Homo Sapiens
GTHHGRSNL

SEQ ID NO: 518428 - protein, 9 aa, Homo Sapiens
EYVKEFTGP

SEQ ID NO: 518429 - protein, 9 aa, Homo Sapiens
RDNNNSNNS

SEQ ID NO: 518430 - protein, 9 aa, Homo Sapiens
GCKMFHTLL

SEQ ID NO: 518431 - protein, 9 aa, Homo Sapiens
KSMVFLEYF

SEQ ID NO: 518432 - protein, 9 aa, Homo Sapiens
PPLPALDEL

SEQ ID NO: 518433 - protein, 9 aa, Homo Sapiens
ALILQKYAR

SEQ ID NO: 518434 - protein, 9 aa, Homo Sapiens
DKDSADMFS

SEQ ID NO: 518435 - protein, 9 aa, Homo Sapiens
TKASDPLKI

SEQ ID NO: 518436 - protein, 9 aa, Homo Sapiens
RRQVEGCRG

SEQ ID NO: 518437 - protein, 9 aa, Homo Sapiens
FTWLRGEKV

SEQ ID NO: 518438 - protein, 9 aa, Homo Sapiens
GIRTMLFAL

SEQ ID NO: 518439 - protein, 9 aa, Homo Sapiens
PVTLSPLGY

SEQ ID NO: 518440 - protein, 9 aa, Homo Sapiens
LSNQNVQEE

SEQ ID NO: 518441 - protein, 9 aa, Homo Sapiens
IRFRDSGDC

SEQ ID NO: 518442 - protein, 9 aa, Homo Sapiens
GTFTQLSEL

SEQ ID NO: 518443 - protein, 9 aa, Homo Sapiens
WDFYSISVL

SEQ ID NO: 518444 - protein, 9 aa, Homo Sapiens
YWVSSAYSK

SEQ ID NO: 518445 - protein, 9 aa, Homo Sapiens
LRFKKAHLT

SEQ ID NO: 518446 - protein, 9 aa, Homo Sapiens
CQSPTISEC

SEQ ID NO: 518447 - protein, 9 aa, Homo Sapiens
HDSTSENIL

SEQ ID NO: 518448 - protein, 9 aa, Homo Sapiens
VQQKAAVTM

SEQ ID NO: 518449 - protein, 9 aa, Homo Sapiens
AGQPHPSIS

SEQ ID NO: 518450 - protein, 9 aa, Homo Sapiens
RYEEQEPSP

SEQ ID NO: 518451 - protein, 9 aa, Homo Sapiens
NAHERARMR

SEQ ID NO: 518452 - protein, 9 aa, Homo Sapiens
EGPLLLSRC

SEQ ID NO: 518453 - protein, 9 aa, Homo Sapiens
LPSESVDVI

SEQ ID NO: 518454 - protein, 9 aa, Homo Sapiens
DMKDMMLYC

SEQ ID NO: 518455 - protein, 9 aa, Homo Sapiens
VAAKYPRLS

SEQ ID NO: 518456 - protein, 9 aa, Homo Sapiens
AQACPLKFG

SEQ ID NO: 518457 - protein, 9 aa, Homo Sapiens
SYFYLNDIS

SEQ ID NO: 518458 - protein, 9 aa, Homo Sapiens
LEDFPMDAQ

SEQ ID NO: 518459 - protein, 9 aa, Homo Sapiens
HNPPPFASP

SEQ ID NO: 518460 - protein, 9 aa, Homo Sapiens
PPYPPSNAS

SEQ ID NO: 518461 - protein, 9 aa, Homo Sapiens
GEAMCNLNP

SEQ ID NO: 518462 - protein, 9 aa, Homo Sapiens
PTNKDVCYP

SEQ ID NO: 518463 - protein, 9 aa, Homo Sapiens
EEPVHLPCY

SEQ ID NO: 518464 - protein, 9 aa, Homo Sapiens
CVDHSIVLT

SEQ ID NO: 518465 - protein, 9 aa, Homo Sapiens
LLELHVNCY

SEQ ID NO: 518466 - protein, 9 aa, Homo Sapiens
GARSKDHED

SEQ ID NO: 518467 - protein, 9 aa, Homo Sapiens
MNQMHESMK

SEQ ID NO: 518468 - protein, 9 aa, Homo Sapiens
LLFQVSARD

SEQ ID NO: 518469 - protein, 9 aa, Homo Sapiens
ISRHSSSPL

SEQ ID NO: 518470 - protein, 9 aa, Homo Sapiens
GRKEGSQPP

SEQ ID NO: 518471 - protein, 9 aa, Homo Sapiens
GQRPSGVAA

SEQ ID NO: 518472 - protein, 9 aa, Homo Sapiens
TCGRRKSLF

SEQ ID NO: 518473 - protein, 9 aa, Homo Sapiens
SRSLMFCNA

SEQ ID NO: 518474 - protein, 9 aa, Homo Sapiens
SQVYSDCRP

SEQ ID NO: 518475 - protein, 9 aa, Homo Sapiens
IAEPAVAAG

SEQ ID NO: 518476 - protein, 9 aa, Homo Sapiens
MVAENILGH

SEQ ID NO: 518477 - protein, 9 aa, Homo Sapiens
GQGLLAAIP

SEQ ID NO: 518478 - protein, 9 aa, Homo Sapiens
TSNSEDAFS

SEQ ID NO: 518479 - protein, 9 aa, Homo Sapiens
AQDGRFLLH

SEQ ID NO: 518480 - protein, 9 aa, Homo Sapiens
STQVEMSGL

SEQ ID NO: 518481 - protein, 9 aa, Homo Sapiens
YGAFWAGIK

SEQ ID NO: 518482 - protein, 9 aa, Homo Sapiens
YAESRNAQA

SEQ ID NO: 518483 - protein, 9 aa, Homo Sapiens
PTTTTGSTM

SEQ ID NO: 518484 - protein, 9 aa, Homo Sapiens
LFRHDSTSE

SEQ ID NO: 518485 - protein, 9 aa, Homo Sapiens
HHVGQLRSD

SEQ ID NO: 518486 - protein, 9 aa, Homo Sapiens
HSFCVIKPQ

SEQ ID NO: 518487 - protein, 9 aa, Homo Sapiens
NILTIKANT

SEQ ID NO: 518488 - protein, 9 aa, Homo Sapiens
PPFASPVME

SEQ ID NO: 518489 - protein, 9 aa, Homo Sapiens
EDPVPVKSH

SEQ ID NO: 518490 - protein, 9 aa, Homo Sapiens
IHDKSQMLC

SEQ ID NO: 518491 - protein, 9 aa, Homo Sapiens
DSTAYRPSE

SEQ ID NO: 518492 - protein, 9 aa, Homo Sapiens
AHAYPSGPG

SEQ ID NO: 518493 - protein, 9 aa, Homo Sapiens
FKALARRHL

SEQ ID NO: 518494 - protein, 9 aa, Homo Sapiens
KPSNTEDFV

SEQ ID NO: 518495 - protein, 9 aa, Homo Sapiens
GSSRSVMIQ

SEQ ID NO: 518496 - protein, 9 aa, Homo Sapiens
NNLSCDCIG

SEQ ID NO: 518497 - protein, 9 aa, Homo Sapiens
IVSINSCAH

SEQ ID NO: 518498 - protein, 9 aa, Homo Sapiens
RRLGRAELG

SEQ ID NO: 518499 - protein, 9 aa, Homo Sapiens
IRSQKPRWV

SEQ ID NO: 518500 - protein, 9 aa, Homo Sapiens
DSGSAYLPF

SEQ ID NO: 518501 - protein, 9 aa, Homo Sapiens
AGPPSPSGF

SEQ ID NO: 518502 - protein, 9 aa, Homo Sapiens
NSPFGAAVR

SEQ ID NO: 518503 - protein, 9 aa, Homo Sapiens
ELLQDLCAG

SEQ ID NO: 518504 - protein, 9 aa, Homo Sapiens
WGARSKDHE

SEQ ID NO: 518505 - protein, 9 aa, Homo Sapiens
MNTTSHHVG

SEQ ID NO: 518506 - protein, 9 aa, Homo Sapiens
QPCAPPLAA

SEQ ID NO: 518507 - protein, 9 aa, Homo Sapiens
NPPPFASPV

SEQ ID NO: 518508 - protein, 9 aa, Homo Sapiens
PTEEEPEYH

SEQ ID NO: 518509 - protein, 9 aa, Homo Sapiens
LDIKPDDAE

SEQ ID NO: 518510 - protein, 9 aa, Homo Sapiens
RYEVPHEYV

SEQ ID NO: 518511 - protein, 9 aa, Homo Sapiens
PLPALDELG

SEQ ID NO: 518512 - protein, 9 aa, Homo Sapiens
MHCLYTITF

SEQ ID NO: 518513 - protein, 9 aa, Homo Sapiens
VQQGVVVSY

SEQ ID NO: 518514 - protein, 9 aa, Homo Sapiens
IYVEIIDIN

SEQ ID NO: 518515 - protein, 9 aa, Homo Sapiens
AAAGAVGSG

SEQ ID NO: 518516 - protein, 9 aa, Homo Sapiens
RNKTTERQG

SEQ ID NO: 518517 - protein, 9 aa, Homo Sapiens
VMIQMSSSL

SEQ ID NO: 518518 - protein, 9 aa, Homo Sapiens
IDMARVREP

SEQ ID NO: 518519 - protein, 9 aa, Homo Sapiens
SISSGINSD

SEQ ID NO: 518520 - protein, 9 aa, Homo Sapiens
SQVLQTYMA

SEQ ID NO: 518521 - protein, 9 aa, Homo Sapiens
EVQQGVVVS

SEQ ID NO: 518522 - protein, 9 aa, Homo Sapiens
CLGEHSTSG

SEQ ID NO: 518523 - protein, 9 aa, Homo Sapiens
VRVQKTSKD

SEQ ID NO: 518524 - protein, 9 aa, Homo Sapiens
LTHLYLNDA

SEQ ID NO: 518525 - protein, 9 aa, Homo Sapiens
RVSPTRNFS

SEQ ID NO: 518526 - protein, 9 aa, Homo Sapiens
FQVIKKSIF

SEQ ID NO: 518527 - protein, 9 aa, Homo Sapiens
CDKCNKTVK

SEQ ID NO: 518528 - protein, 9 aa, Homo Sapiens
AVMKFSNSI

SEQ ID NO: 518529 - protein, 9 aa, Homo Sapiens
SHSDAVFTD

SEQ ID NO: 518530 - protein, 9 aa, Homo Sapiens
PFISRHSSS

SEQ ID NO: 518531 - protein, 9 aa, Homo Sapiens
TKRHEMQIL

SEQ ID NO: 518532 - protein, 9 aa, Homo Sapiens
EEGIEERVL

SEQ ID NO: 518533 - protein, 9 aa, Homo Sapiens
ISARVSPTR

SEQ ID NO: 518534 - protein, 9 aa, Homo Sapiens
ALLNPDLEK

SEQ ID NO: 518535 - protein, 9 aa, Homo Sapiens
DSLIELRDF

SEQ ID NO: 518536 - protein, 9 aa, Homo Sapiens
SNSKPVLSN

SEQ ID NO: 518537 - protein, 9 aa, Homo Sapiens
RLRHLVVHL

SEQ ID NO: 518538 - protein, 9 aa, Homo Sapiens
PSNTEDFVE

SEQ ID NO: 518539 - protein, 9 aa, Homo Sapiens
WKCGSQIVA

SEQ ID NO: 518540 - protein, 9 aa, Homo Sapiens
EKNPKVHFN

SEQ ID NO: 518541 - protein, 9 aa, Homo Sapiens
RTQPPITQE

SEQ ID NO: 518542 - protein, 9 aa, Homo Sapiens
RFLLHLPNV

SEQ ID NO: 518543 - protein, 9 aa, Homo Sapiens
ACGSSEQEG

SEQ ID NO: 518544 - protein, 9 aa, Homo Sapiens
AAKYPRLSE

SEQ ID NO: 518545 - protein, 9 aa, Homo Sapiens
TMKVVTEEV

SEQ ID NO: 518546 - protein, 9 aa, Homo Sapiens
FFTEEGAED

SEQ ID NO: 518547 - protein, 9 aa, Homo Sapiens
LHHTSWHSS

SEQ ID NO: 518548 - protein, 9 aa, Homo Sapiens
FMYVLEHLS

SEQ ID NO: 518549 - protein, 9 aa, Homo Sapiens
QPQMQSLSR

SEQ ID NO: 518550 - protein, 9 aa, Homo Sapiens
DTMKVVTEE

SEQ ID NO: 518551 - protein, 9 aa, Homo Sapiens
HLVVHLACF

SEQ ID NO: 518552 - protein, 9 aa, Homo Sapiens
AVTMARLSR

SEQ ID NO: 518553 - protein, 9 aa, Homo Sapiens
QVYSDCRPG

SEQ ID NO: 518554 - protein, 9 aa, Homo Sapiens
LDFYLINRQ

SEQ ID NO: 518555 - protein, 9 aa, Homo Sapiens
KLATVRITY

SEQ ID NO: 518556 - protein, 9 aa, Homo Sapiens
IRKAQPDDL

SEQ ID NO: 518557 - protein, 9 aa, Homo Sapiens
MWIAIDNWS

SEQ ID NO: 518558 - protein, 9 aa, Homo Sapiens
QSKGSGDDV

SEQ ID NO: 518559 - protein, 9 aa, Homo Sapiens
CSPEWGLRP

SEQ ID NO: 518560 - protein, 9 aa, Homo Sapiens
IRTMLFALM

SEQ ID NO: 518561 - protein, 9 aa, Homo Sapiens
SGGECPSGG

SEQ ID NO: 518562 - protein, 9 aa, Homo Sapiens
MKFSNSIGN

SEQ ID NO: 518563 - protein, 9 aa, Homo Sapiens
KHEEMLEGL

SEQ ID NO: 518564 - protein, 9 aa, Homo Sapiens
RFHAWTEVH

SEQ ID NO: 518565 - protein, 9 aa, Homo Sapiens
SGDDVKDPR

SEQ ID NO: 518566 - protein, 9 aa, Homo Sapiens
DLLEPEQTF

SEQ ID NO: 518567 - protein, 9 aa, Homo Sapiens
PSGPGLYGD

SEQ ID NO: 518568 - protein, 9 aa, Homo Sapiens
ARLRDSGSA

SEQ ID NO: 518569 - protein, 9 aa, Homo Sapiens
ILTLIWFLA

SEQ ID NO: 518570 - protein, 9 aa, Homo Sapiens
TGNVVIITV

SEQ ID NO: 518571 - protein, 9 aa, Homo Sapiens
MLEGLRTPQ

SEQ ID NO: 518572 - protein, 9 aa, Homo Sapiens
SPVMEFPAA

SEQ ID NO: 518573 - protein, 9 aa, Homo Sapiens
ITLFHLFRF

SEQ ID NO: 518574 - protein, 9 aa, Homo Sapiens
QKRVYQQTK

SEQ ID NO: 518575 - protein, 9 aa, Homo Sapiens
DVCYPGNTK

SEQ ID NO: 518576 - protein, 9 aa, Homo Sapiens
FGIPEALVQ

SEQ ID NO: 518577 - protein, 9 aa, Homo Sapiens
QRHMAVQRA

SEQ ID NO: 518578 - protein, 9 aa, Homo Sapiens
TAYFFMNPK

SEQ ID NO: 518579 - protein, 9 aa, Homo Sapiens
FLKVLHSSM

SEQ ID NO: 518580 - protein, 9 aa, Homo Sapiens
TPSAVTPSS

SEQ ID NO: 518581 - protein, 9 aa, Homo Sapiens
VNCYVLEEA

SEQ ID NO: 518582 - protein, 9 aa, Homo Sapiens
SVAHLVRLP

SEQ ID NO: 518583 - protein, 9 aa, Homo Sapiens
NLAWVGDAL

SEQ ID NO: 518584 - protein, 9 aa, Homo Sapiens
IVLLLSVLE

SEQ ID NO: 518585 - protein, 9 aa, Homo Sapiens
GRNLAVLLT

SEQ ID NO: 518586 - protein, 9 aa, Homo Sapiens
YFKGISDET

SEQ ID NO: 518587 - protein, 9 aa, Homo Sapiens
ARQLPRRLC

SEQ ID NO: 518588 - protein, 9 aa, Homo Sapiens
TQGLKGQRV

SEQ ID NO: 518589 - protein, 9 aa, Homo Sapiens
LNTAHTQLL

SEQ ID NO: 518590 - protein, 9 aa, Homo Sapiens
NTALTYDRQ

SEQ ID NO: 518591 - protein, 9 aa, Homo Sapiens
MFELIPDIV

SEQ ID NO: 518592 - protein, 9 aa, Homo Sapiens
PYPPSNASC

SEQ ID NO: 518593 - protein, 9 aa, Homo Sapiens
HSIHDKSQM

SEQ ID NO: 518594 - protein, 9 aa, Homo Sapiens
SGTPHAQTS

SEQ ID NO: 518595 - protein, 9 aa, Homo Sapiens
APKATSRAS

SEQ ID NO: 518596 - protein, 9 aa, Homo Sapiens
NNIRIQSRD

SEQ ID NO: 518597 - protein, 9 aa, Homo Sapiens
RSVTTVHWE

SEQ ID NO: 518598 - protein, 9 aa, Homo Sapiens
WRVSALSTP

SEQ ID NO: 518599 - protein, 9 aa, Homo Sapiens
PQGRLQRLL

SEQ ID NO: 518600 - protein, 9 aa, Homo Sapiens
LKSKVQAVQ

SEQ ID NO: 518601 - protein, 9 aa, Homo Sapiens
PLALARSTP

SEQ ID NO: 518602 - protein, 9 aa, Homo Sapiens
ITVKVIDNL

SEQ ID NO: 518603 - protein, 9 aa, Homo Sapiens
LPPFNQFSP

SEQ ID NO: 518604 - protein, 9 aa, Homo Sapiens
RVYQQTKAL

SEQ ID NO: 518605 - protein, 9 aa, Homo Sapiens
QILAFILIG

SEQ ID NO: 518606 - protein, 9 aa, Homo Sapiens
QAVFPVCIC

SEQ ID NO: 518607 - protein, 9 aa, Homo Sapiens
AHIFCVLSP

SEQ ID NO: 518608 - protein, 9 aa, Homo Sapiens
LSIQKNILT

SEQ ID NO: 518609 - protein, 9 aa, Homo Sapiens
SRNKTTERQ

SEQ ID NO: 518610 - protein, 9 aa, Homo Sapiens
TSCGGVFQK

SEQ ID NO: 518611 - protein, 9 aa, Homo Sapiens
SCSALLNPD

SEQ ID NO: 518612 - protein, 9 aa, Homo Sapiens
VDFNTMSSA

SEQ ID NO: 518613 - protein, 9 aa, Homo Sapiens
LLIYCLTIT

SEQ ID NO: 518614 - protein, 9 aa, Homo Sapiens
VNRQPPPSY

SEQ ID NO: 518615 - protein, 9 aa, Homo Sapiens
DEEMNQMHE

SEQ ID NO: 518616 - protein, 9 aa, Homo Sapiens
SNLQALGRQ

SEQ ID NO: 518617 - protein, 9 aa, Homo Sapiens
AHRPRDQPA

SEQ ID NO: 518618 - protein, 9 aa, Homo Sapiens
TAYRPSELL

SEQ ID NO: 518619 - protein, 9 aa, Homo Sapiens
KLSGDVLCL

SEQ ID NO: 518620 - protein, 9 aa, Homo Sapiens
GRAELGLRA

SEQ ID NO: 518621 - protein, 9 aa, Homo Sapiens
DSLIMEWNL

SEQ ID NO: 518622 - protein, 9 aa, Homo Sapiens
DHEDGALFG

SEQ ID NO: 518623 - protein, 9 aa, Homo Sapiens
APQPFISRH

SEQ ID NO: 518624 - protein, 9 aa, Homo Sapiens
TNLEDSAMY

SEQ ID NO: 518625 - protein, 9 aa, Homo Sapiens
APLPSPYVG

SEQ ID NO: 518626 - protein, 9 aa, Homo Sapiens
YPPSNASCN

SEQ ID NO: 518627 - protein, 9 aa, Homo Sapiens
SIVLTEAVC

SEQ ID NO: 518628 - protein, 9 aa, Homo Sapiens
LSRLRDKQW

SEQ ID NO: 518629 - protein, 9 aa, Homo Sapiens
SWQAVDATP

SEQ ID NO: 518630 - protein, 9 aa, Homo Sapiens
QRVPQAVFC

SEQ ID NO: 518631 - protein, 9 aa, Homo Sapiens
GHDMKDMML

SEQ ID NO: 518632 - protein, 9 aa, Homo Sapiens
SPAPASALQ

SEQ ID NO: 518633 - protein, 9 aa, Homo Sapiens
HKSMVFLEY

SEQ ID NO: 518634 - protein, 9 aa, Homo Sapiens
WWVILTLIW

SEQ ID NO: 518635 - protein, 9 aa, Homo Sapiens
SVSFWINMD

SEQ ID NO: 518636 - protein, 9 aa, Homo Sapiens
SNNSGSYNR

SEQ ID NO: 518637 - protein, 9 aa, Homo Sapiens
EDEACGSSE

SEQ ID NO: 518638 - protein, 9 aa, Homo Sapiens
ECRALNDVA

SEQ ID NO: 518639 - protein, 9 aa, Homo Sapiens
ALQTTTNFL

SEQ ID NO: 518640 - protein, 9 aa, Homo Sapiens
EREYLECDE

SEQ ID NO: 518641 - protein, 9 aa, Homo Sapiens
TSLIVKVTN

SEQ ID NO: 518642 - protein, 9 aa, Homo Sapiens
ASLWDRECC

SEQ ID NO: 518643 - protein, 9 aa, Homo Sapiens
NAANAHERA

SEQ ID NO: 518644 - protein, 9 aa, Homo Sapiens
ETKLTDLEG

SEQ ID NO: 518645 - protein, 9 aa, Homo Sapiens
NLYPIYVEI

SEQ ID NO: 518646 - protein, 9 aa, Homo Sapiens
QTTTNFLIV

SEQ ID NO: 518647 - protein, 9 aa, Homo Sapiens
KPDDAELQH

SEQ ID NO: 518648 - protein, 9 aa, Homo Sapiens
YRDESHYFT

SEQ ID NO: 518649 - protein, 9 aa, Homo Sapiens
SARIVGGSK

SEQ ID NO: 518650 - protein, 9 aa, Homo Sapiens
DKRMSYIVG

SEQ ID NO: 518651 - protein, 9 aa, Homo Sapiens
SPGAVRTRV

SEQ ID NO: 518652 - protein, 9 aa, Homo Sapiens
GDSHRIHLL

SEQ ID NO: 518653 - protein, 9 aa, Homo Sapiens
EAPALEPRS

SEQ ID NO: 518654 - protein, 9 aa, Homo Sapiens
WTGGCPFRE

SEQ ID NO: 518655 - protein, 9 aa, Homo Sapiens
AAGAVGSGA

SEQ ID NO: 518656 - protein, 9 aa, Homo Sapiens
FWAGIKTEG

SEQ ID NO: 518657 - protein, 9 aa, Homo Sapiens
SCGYGHGYG

SEQ ID NO: 518658 - protein, 9 aa, Homo Sapiens
NWLHHTSWH

SEQ ID NO: 518659 - protein, 9 aa, Homo Sapiens
DLLRKKLEK

SEQ ID NO: 518660 - protein, 9 aa, Homo Sapiens
TTDNSSSNN

SEQ ID NO: 518661 - protein, 9 aa, Homo Sapiens
LRHLVVHLA

SEQ ID NO: 518662 - protein, 9 aa, Homo Sapiens
KKPSAHMSD

SEQ ID NO: 518663 - protein, 9 aa, Homo Sapiens
HTCASHCIV

SEQ ID NO: 518664 - protein, 9 aa, Homo Sapiens
LSPKLVLII

SEQ ID NO: 518665 - protein, 9 aa, Homo Sapiens
DLAGYHYTS

SEQ ID NO: 518666 - protein, 9 aa, Homo Sapiens
KEQEHLVAE

SEQ ID NO: 518667 - protein, 9 aa, Homo Sapiens
TPTLAAAAD

SEQ ID NO: 518668 - protein, 9 aa, Homo Sapiens
EMNTTSHHV

SEQ ID NO: 518669 - protein, 9 aa, Homo Sapiens
QAVRYGRKE

SEQ ID NO: 518670 - protein, 9 aa, Homo Sapiens
TLFHLFRFK

SEQ ID NO: 518671 - protein, 9 aa, Homo Sapiens
HVGQLRSDL

SEQ ID NO: 518672 - protein, 9 aa, Homo Sapiens
DSVTVKCQG

SEQ ID NO: 518673 - protein, 9 aa, Homo Sapiens
VKVRALGEV

SEQ ID NO: 518674 - protein, 9 aa, Homo Sapiens
SLGEHQLLL

SEQ ID NO: 518675 - protein, 9 aa, Homo Sapiens
QNNRVVGAE

SEQ ID NO: 518676 - protein, 9 aa, Homo Sapiens
TVVAAIDMA

SEQ ID NO: 518677 - protein, 9 aa, Homo Sapiens
SVVDTMKVV

SEQ ID NO: 518678 - protein, 9 aa, Homo Sapiens
TTTGSTMCE

SEQ ID NO: 518679 - protein, 9 aa, Homo Sapiens
IEERVLKDL

SEQ ID NO: 518680 - protein, 9 aa, Homo Sapiens
RYEAVCNPL

SEQ ID NO: 518681 - protein, 9 aa, Homo Sapiens
RCGYSSSCG

SEQ ID NO: 518682 - protein, 9 aa, Homo Sapiens
ESNTVASDG

SEQ ID NO: 518683 - protein, 9 aa, Homo Sapiens
RHMAVQRAD

SEQ ID NO: 518684 - protein, 9 aa, Homo Sapiens
LLLFQVSAR

SEQ ID NO: 518685 - protein, 9 aa, Homo Sapiens
TSKDLEDMN

SEQ ID NO: 518686 - protein, 9 aa, Homo Sapiens
KTPMGERSV

SEQ ID NO: 518687 - protein, 9 aa, Homo Sapiens
LIWFLAAGL

SEQ ID NO: 518688 - protein, 9 aa, Homo Sapiens
EDPYMMGLI

SEQ ID NO: 518689 - protein, 9 aa, Homo Sapiens
NISFSIIPG

SEQ ID NO: 518690 - protein, 9 aa, Homo Sapiens
KELPCGDRY

SEQ ID NO: 518691 - protein, 9 aa, Homo Sapiens
SPANVALRS

SEQ ID NO: 518692 - protein, 9 aa, Homo Sapiens
DGQPCAPPL

SEQ ID NO: 518693 - protein, 9 aa, Homo Sapiens
PALEPRSAA

SEQ ID NO: 518694 - protein, 9 aa, Homo Sapiens
LGHPKRYKG

SEQ ID NO: 518695 - protein, 9 aa, Homo Sapiens
SVEIDESVR

SEQ ID NO: 518696 - protein, 9 aa, Homo Sapiens
EPSQVYSDC

SEQ ID NO: 518697 - protein, 9 aa, Homo Sapiens
HGRFGIPEA

SEQ ID NO: 518698 - protein, 9 aa, Homo Sapiens
FSTQVEMSG

SEQ ID NO: 518699 - protein, 9 aa, Homo Sapiens
PELRGISTA

SEQ ID NO: 518700 - protein, 9 aa, Homo Sapiens
AESRNAQAA

SEQ ID NO: 518701 - protein, 9 aa, Homo Sapiens
ISVLEEKDG

SEQ ID NO: 518702 - protein, 9 aa, Homo Sapiens
APPQPSAYL

SEQ ID NO: 518703 - protein, 9 aa, Homo Sapiens
QLLEVILAI

SEQ ID NO: 518704 - protein, 9 aa, Homo Sapiens
ACLERIEEL

SEQ ID NO: 518705 - protein, 9 aa, Homo Sapiens
GSDPELWSC

SEQ ID NO: 518706 - protein, 9 aa, Homo Sapiens
NRQPPPSYP

SEQ ID NO: 518707 - protein, 9 aa, Homo Sapiens
KKENLAWVG

SEQ ID NO: 518708 - protein, 9 aa, Homo Sapiens
LSCDCIGRL

SEQ ID NO: 518709 - protein, 9 aa, Homo Sapiens
HSYPEGTCL

SEQ ID NO: 518710 - protein, 9 aa, Homo Sapiens
ARSKDHEDG

SEQ ID NO: 518711 - protein, 9 aa, Homo Sapiens
RSLRCGGGK

SEQ ID NO: 518712 - protein, 9 aa, Homo Sapiens
YYREKIGIY

SEQ ID NO: 518713 - protein, 9 aa, Homo Sapiens
PWAQATSPH

SEQ ID NO: 518714 - protein, 9 aa, Homo Sapiens
SKAQPGTWP

SEQ ID NO: 518715 - protein, 9 aa, Homo Sapiens
RTDGQPCAP

SEQ ID NO: 518716 - protein, 9 aa, Homo Sapiens
RDFLFEKLL

SEQ ID NO: 518717 - protein, 9 aa, Homo Sapiens
LIGNIPGYA

SEQ ID NO: 518718 - protein, 9 aa, Homo Sapiens
QMHESMKLF

SEQ ID NO: 518719 - protein, 9 aa, Homo Sapiens
LREGMFELI

SEQ ID NO: 518720 - protein, 9 aa, Homo Sapiens
DNSSSNNGF

SEQ ID NO: 518721 - protein, 9 aa, Homo Sapiens
PLPPTIDDR

SEQ ID NO: 518722 - protein, 9 aa, Homo Sapiens
IFCFHLRRE

SEQ ID NO: 518723 - protein, 9 aa, Homo Sapiens
SGCLCEIEI

SEQ ID NO: 518724 - protein, 9 aa, Homo Sapiens
TVRITYSPE

SEQ ID NO: 518725 - protein, 9 aa, Homo Sapiens
VGKLRESMI

SEQ ID NO: 518726 - protein, 9 aa, Homo Sapiens
SALLNPDLE

SEQ ID NO: 518727 - protein, 9 aa, Homo Sapiens
KLISDKDSA

SEQ ID NO: 518728 - protein, 9 aa, Homo Sapiens
LDPEDIQDE

SEQ ID NO: 518729 - protein, 9 aa, Homo Sapiens
QKSLSNLSL

SEQ ID NO: 518730 - protein, 9 aa, Homo Sapiens
SPHSVLLNW

SEQ ID NO: 518731 - protein, 9 aa, Homo Sapiens
KPRALVLVI

SEQ ID NO: 518732 - protein, 9 aa, Homo Sapiens
TGFTGPSET

SEQ ID NO: 518733 - protein, 9 aa, Homo Sapiens
RSEWGLGLC

SEQ ID NO: 518734 - protein, 9 aa, Homo Sapiens
QAQTQGLKG

SEQ ID NO: 518735 - protein, 9 aa, Homo Sapiens
QACPLKFGS

SEQ ID NO: 518736 - protein, 9 aa, Homo Sapiens
WVASYKKGT

SEQ ID NO: 518737 - protein, 9 aa, Homo Sapiens
FGSGAASLV

SEQ ID NO: 518738 - protein, 9 aa, Homo Sapiens
AKGIRTMLF

SEQ ID NO: 518739 - protein, 9 aa, Homo Sapiens
YKKDSAKSR

SEQ ID NO: 518740 - protein, 9 aa, Homo Sapiens
IEGVTKASD

SEQ ID NO: 518741 - protein, 9 aa, Homo Sapiens
AQTSSGGQA

SEQ ID NO: 518742 - protein, 9 aa, Homo Sapiens
HLYRRLGRA

SEQ ID NO: 518743 - protein, 9 aa, Homo Sapiens
RHAPPPTEP

SEQ ID NO: 518744 - protein, 9 aa, Homo Sapiens
LSIQAQNFS

SEQ ID NO: 518745 - protein, 9 aa, Homo Sapiens
SAFKHIGTV

SEQ ID NO: 518746 - protein, 9 aa, Homo Sapiens
PPKSEPLPP

SEQ ID NO: 518747 - protein, 9 aa, Homo Sapiens
GGQNKPAII

SEQ ID NO: 518748 - protein, 9 aa, Homo Sapiens
DFLFEKLLT

SEQ ID NO: 518749 - protein, 9 aa, Homo Sapiens
KLHRTTLLH

SEQ ID NO: 518750 - protein, 9 aa, Homo Sapiens
TGLLLTTAF

SEQ ID NO: 518751 - protein, 9 aa, Homo Sapiens
SHHVGQLRS

SEQ ID NO: 518752 - protein, 9 aa, Homo Sapiens
DPCAPSPAP

SEQ ID NO: 518753 - protein, 9 aa, Homo Sapiens
ENEAFDPYE

SEQ ID NO: 518754 - protein, 9 aa, Homo Sapiens
NPKLGEKEV

SEQ ID NO: 518755 - protein, 9 aa, Homo Sapiens
RKKCLPENP

SEQ ID NO: 518756 - protein, 9 aa, Homo Sapiens
RWVASYKKG

SEQ ID NO: 518757 - protein, 9 aa, Homo Sapiens
QGLKGQRVS

SEQ ID NO: 518758 - protein, 9 aa, Homo Sapiens
GHGEAMAET

SEQ ID NO: 518759 - protein, 9 aa, Homo Sapiens
MCECMSSYF

SEQ ID NO: 518760 - protein, 9 aa, Homo Sapiens
GFLDFYLIN

SEQ ID NO: 518761 - protein, 9 aa, Homo Sapiens
ITCIGAQDP

SEQ ID NO: 518762 - protein, 9 aa, Homo Sapiens
KLLELHVNC

SEQ ID NO: 518763 - protein, 9 aa, Homo Sapiens
FISTLAQRP

SEQ ID NO: 518764 - protein, 9 aa, Homo Sapiens
PEMSPLDLL

SEQ ID NO: 518765 - protein, 9 aa, Homo Sapiens
RERTKRHEM

SEQ ID NO: 518766 - protein, 9 aa, Homo Sapiens
DSESTSRSD

SEQ ID NO: 518767 - protein, 9 aa, Homo Sapiens
SEQEGHPEL

SEQ ID NO: 518768 - protein, 9 aa, Homo Sapiens
EEHTERVPR

SEQ ID NO: 518769 - protein, 9 aa, Homo Sapiens
VTLSPLGYG

SEQ ID NO: 518770 - protein, 9 aa, Homo Sapiens
AYDCPAWAP

SEQ ID NO: 518771 - protein, 9 aa, Homo Sapiens
GGARRSRRT

SEQ ID NO: 518772 - protein, 9 aa, Homo Sapiens
GYAWNIPVK

SEQ ID NO: 518773 - protein, 9 aa, Homo Sapiens
EDRLNETKL

SEQ ID NO: 518774 - protein, 9 aa, Homo Sapiens
LGLGPAWSY

SEQ ID NO: 518775 - protein, 9 aa, Homo Sapiens
LVLATGRNL

SEQ ID NO: 518776 - protein, 9 aa, Homo Sapiens
GVLLGMAYD

SEQ ID NO: 518777 - protein, 9 aa, Homo Sapiens
LGLHRWIAN

SEQ ID NO: 518778 - protein, 9 aa, Homo Sapiens
HEEMLEGLR

SEQ ID NO: 518779 - protein, 9 aa, Homo Sapiens
MLFIKVKHE

SEQ ID NO: 518780 - protein, 9 aa, Homo Sapiens
VHKEIVSLG

SEQ ID NO: 518781 - protein, 9 aa, Homo Sapiens
GLCKQNVDR

SEQ ID NO: 518782 - protein, 9 aa, Homo Sapiens
FSIIPGQRV

SEQ ID NO: 518783 - protein, 9 aa, Homo Sapiens
GVTKASDPL

SEQ ID NO: 518784 - protein, 9 aa, Homo Sapiens
HTERVPRIS

SEQ ID NO: 518785 - protein, 9 aa, Homo Sapiens
DVSRTEVIT

SEQ ID NO: 518786 - protein, 9 aa, Homo Sapiens
LLQDLCAGL

SEQ ID NO: 518787 - protein, 9 aa, Homo Sapiens
GRGESTTSP

SEQ ID NO: 518788 - protein, 9 aa, Homo Sapiens
QYASRVPSQ

SEQ ID NO: 518789 - protein, 9 aa, Homo Sapiens
DLNTAHTQL

SEQ ID NO: 518790 - protein, 9 aa, Homo Sapiens
CLYTITFSD

SEQ ID NO: 518791 - protein, 9 aa, Homo Sapiens
DEACGSSEQ

SEQ ID NO: 518792 - protein, 9 aa, Homo Sapiens
VTPSSLSAS

SEQ ID NO: 518793 - protein, 9 aa, Homo Sapiens
DGGMSLKVR

SEQ ID NO: 518794 - protein, 9 aa, Homo Sapiens
PSIEFFFLV

SEQ ID NO: 518795 - protein, 9 aa, Homo Sapiens
CGGVFQKRT

SEQ ID NO: 518796 - protein, 9 aa, Homo Sapiens
RTAYVVAHG

SEQ ID NO: 518797 - protein, 9 aa, Homo Sapiens
TSVEIDESV

SEQ ID NO: 518798 - protein, 9 aa, Homo Sapiens
EEKLAVSPT

SEQ ID NO: 518799 - protein, 9 aa, Homo Sapiens
SLLIVILSS

SEQ ID NO: 518800 - protein, 9 aa, Homo Sapiens
RAHRPRDQP

SEQ ID NO: 518801 - protein, 9 aa, Homo Sapiens
PFACPHCGR

SEQ ID NO: 518802 - protein, 9 aa, Homo Sapiens
PSAVTPSSL

SEQ ID NO: 518803 - protein, 9 aa, Homo Sapiens
FDKPRESRF

SEQ ID NO: 518804 - protein, 9 aa, Homo Sapiens
IGLHDPTKG

SEQ ID NO: 518805 - protein, 9 aa, Homo Sapiens
NETKLTDLE

SEQ ID NO: 518806 - protein, 9 aa, Homo Sapiens
LLIIIILTC

SEQ ID NO: 518807 - protein, 9 aa, Homo Sapiens
CARTDGQPC

SEQ ID NO: 518808 - protein, 9 aa, Homo Sapiens
KDVCYPGNT

SEQ ID NO: 518809 - protein, 9 aa, Homo Sapiens
THLYLNDAF

SEQ ID NO: 518810 - protein, 9 aa, Homo Sapiens
LAELPADTF

SEQ ID NO: 518811 - protein, 9 aa, Homo Sapiens
YSLSAKDFF

SEQ ID NO: 518812 - protein, 9 aa, Homo Sapiens
RQAEKEQEH

SEQ ID NO: 518813 - protein, 9 aa, Homo Sapiens
ASRNLQADF

SEQ ID NO: 518814 - protein, 9 aa, Homo Sapiens
RVDSDNEYI

SEQ ID NO: 518815 - protein, 9 aa, Homo Sapiens
NGAPFVPPL

SEQ ID NO: 518816 - protein, 9 aa, Homo Sapiens
AETVASEFV

SEQ ID NO: 518817 - protein, 9 aa, Homo Sapiens
WAQATSPHS

SEQ ID NO: 518818 - protein, 9 aa, Homo Sapiens
EAMAETVAS

SEQ ID NO: 518819 - protein, 9 aa, Homo Sapiens
ADLLNALKT

SEQ ID NO: 518820 - protein, 9 aa, Homo Sapiens
CLCEIEINE

SEQ ID NO: 518821 - protein, 9 aa, Homo Sapiens
LRDFLFEKL

SEQ ID NO: 518822 - protein, 9 aa, Homo Sapiens
KPVLSNILN

SEQ ID NO: 518823 - protein, 9 aa, Homo Sapiens
GGWWEVEKE

SEQ ID NO: 518824 - protein, 9 aa, Homo Sapiens
KGYDSWQAV

SEQ ID NO: 518825 - protein, 9 aa, Homo Sapiens
IYHSRLNER

SEQ ID NO: 518826 - protein, 9 aa, Homo Sapiens
DQRLSPKLV

SEQ ID NO: 518827 - protein, 9 aa, Homo Sapiens
ARQAEKEQE

SEQ ID NO: 518828 - protein, 9 aa, Homo Sapiens
SSSGVGITV

SEQ ID NO: 518829 - protein, 9 aa, Homo Sapiens
QSPQSRSEW

SEQ ID NO: 518830 - protein, 9 aa, Homo Sapiens
TTLLHAKSQ

SEQ ID NO: 518831 - protein, 9 aa, Homo Sapiens
DRRPPAGLR

SEQ ID NO: 518832 - protein, 9 aa, Homo Sapiens
LDGIVLLLS

SEQ ID NO: 518833 - protein, 9 aa, Homo Sapiens
SPVLSSEAL

SEQ ID NO: 518834 - protein, 9 aa, Homo Sapiens
GPPSPSGFR

SEQ ID NO: 518835 - protein, 9 aa, Homo Sapiens
RQGPQGLEV

SEQ ID NO: 518836 - protein, 9 aa, Homo Sapiens
ESGVLLGMA

SEQ ID NO: 518837 - protein, 9 aa, Homo Sapiens
PVLSNILNR

SEQ ID NO: 518838 - protein, 9 aa, Homo Sapiens
VRSKRLRQL

SEQ ID NO: 518839 - protein, 9 aa, Homo Sapiens
VLQTYMAFL

SEQ ID NO: 518840 - protein, 9 aa, Homo Sapiens
SHMLVVTIF

SEQ ID NO: 518841 - protein, 9 aa, Homo Sapiens
AAPPSTTGV

SEQ ID NO: 518842 - protein, 9 aa, Homo Sapiens
EPPSAALLR

SEQ ID NO: 518843 - protein, 9 aa, Homo Sapiens
KAHLTHPEL

SEQ ID NO: 518844 - protein, 9 aa, Homo Sapiens
KEIEGVTKA

SEQ ID NO: 518845 - protein, 9 aa, Homo Sapiens
IAIDNWSTA

SEQ ID NO: 518846 - protein, 9 aa, Homo Sapiens
PPGPQGRLQ

SEQ ID NO: 518847 - protein, 9 aa, Homo Sapiens
KHWTGGCPF

SEQ ID NO: 518848 - protein, 9 aa, Homo Sapiens
TISPSQPPC

SEQ ID NO: 518849 - protein, 9 aa, Homo Sapiens
NQETSVEID

SEQ ID NO: 518850 - protein, 9 aa, Homo Sapiens
FHPHHSNTF

SEQ ID NO: 518851 - protein, 9 aa, Homo Sapiens
DAYFIKARP

SEQ ID NO: 518852 - protein, 9 aa, Homo Sapiens
PCGQAVRYG

SEQ ID NO: 518853 - protein, 9 aa, Homo Sapiens
YTMIILAVI

SEQ ID NO: 518854 - protein, 9 aa, Homo Sapiens
ESTTSPISP

SEQ ID NO: 518855 - protein, 9 aa, Homo Sapiens
QAQPQLPPP

SEQ ID NO: 518856 - protein, 9 aa, Homo Sapiens
RRAARAPLP

SEQ ID NO: 518857 - protein, 9 aa, Homo Sapiens
PQDSLRGSI

SEQ ID NO: 518858 - protein, 9 aa, Homo Sapiens
EYIGVTYKN

SEQ ID NO: 518859 - protein, 9 aa, Homo Sapiens
SLQIYRDES

SEQ ID NO: 518860 - protein, 9 aa, Homo Sapiens
VPPLDDKHL

SEQ ID NO: 518861 - protein, 9 aa, Homo Sapiens
DGQRPSGVA

SEQ ID NO: 518862 - protein, 9 aa, Homo Sapiens
ECATGYYTS

SEQ ID NO: 518863 - protein, 9 aa, Homo Sapiens
NGTYHATVP

SEQ ID NO: 518864 - protein, 9 aa, Homo Sapiens
QLLNLTHLY

SEQ ID NO: 518865 - protein, 9 aa, Homo Sapiens
VGHDMKDMM

SEQ ID NO: 518866 - protein, 9 aa, Homo Sapiens
RAELGLRAV

SEQ ID NO: 518867 - protein, 9 aa, Homo Sapiens
RQLLEVILA

SEQ ID NO: 518868 - protein, 9 aa, Homo Sapiens
RMAASTQPL

SEQ ID NO: 518869 - protein, 9 aa, Homo Sapiens
KQPDVVCED

SEQ ID NO: 518870 - protein, 9 aa, Homo Sapiens
KALQTTTNF

SEQ ID NO: 518871 - protein, 9 aa, Homo Sapiens
STSCGGVFQ

SEQ ID NO: 518872 - protein, 9 aa, Homo Sapiens
DLSSDGDED

SEQ ID NO: 518873 - protein, 9 aa, Homo Sapiens
LRCGYSSSC

SEQ ID NO: 518874 - protein, 9 aa, Homo Sapiens
ADTFRGLRR

SEQ ID NO: 518875 - protein, 9 aa, Homo Sapiens
MTLGLHRWI

SEQ ID NO: 518876 - protein, 9 aa, Homo Sapiens
ARFSPRMSI

SEQ ID NO: 518877 - protein, 9 aa, Homo Sapiens
HRVGHDMKD

SEQ ID NO: 518878 - protein, 9 aa, Homo Sapiens
SLVACGFSY

SEQ ID NO: 518879 - protein, 9 aa, Homo Sapiens
ACAAPPLPG

SEQ ID NO: 518880 - protein, 9 aa, Homo Sapiens
GDRYAVAFF

SEQ ID NO: 518881 - protein, 9 aa, Homo Sapiens
QEPSPRDRD

SEQ ID NO: 518882 - protein, 9 aa, Homo Sapiens
VSSVHRDFR

SEQ ID NO: 518883 - protein, 9 aa, Homo Sapiens
KRLRQLLEV

SEQ ID NO: 518884 - protein, 9 aa, Homo Sapiens
AYVVAHGFT

SEQ ID NO: 518885 - protein, 9 aa, Homo Sapiens
GSDSLIMEW

SEQ ID NO: 518886 - protein, 9 aa, Homo Sapiens
DTGFTGPSE

SEQ ID NO: 518887 - protein, 9 aa, Homo Sapiens
RRRMVEIYV

SEQ ID NO: 518888 - protein, 9 aa, Homo Sapiens
PPPFASPVM

SEQ ID NO: 518889 - protein, 9 aa, Homo Sapiens
TTENIPAGA

SEQ ID NO: 518890 - protein, 9 aa, Homo Sapiens
LDLNTAHTQ

SEQ ID NO: 518891 - protein, 9 aa, Homo Sapiens
ISTAPDRGH

SEQ ID NO: 518892 - protein, 9 aa, Homo Sapiens
SKDHEDGAL

SEQ ID NO: 518893 - protein, 9 aa, Homo Sapiens
LEQQEQYHL

SEQ ID NO: 518894 - protein, 9 aa, Homo Sapiens
LFTTDNSSS

SEQ ID NO: 518895 - protein, 9 aa, Homo Sapiens
LPRSVTTVH

SEQ ID NO: 518896 - protein, 9 aa, Homo Sapiens
MAFNSTGIF

SEQ ID NO: 518897 - protein, 9 aa, Homo Sapiens
YVGAASAVL

SEQ ID NO: 518898 - protein, 9 aa, Homo Sapiens
FSFGLTINL

SEQ ID NO: 518899 - protein, 9 aa, Homo Sapiens
PQPPVQNGT

SEQ ID NO: 518900 - protein, 9 aa, Homo Sapiens
SLSRLRDKQ

SEQ ID NO: 518901 - protein, 9 aa, Homo Sapiens
PVCICAAVL

SEQ ID NO: 518902 - protein, 9 aa, Homo Sapiens
GLCPLLLRC

SEQ ID NO: 518903 - protein, 9 aa, Homo Sapiens
QMICNVTGQ

SEQ ID NO: 518904 - protein, 9 aa, Homo Sapiens
LSAATTEEP

SEQ ID NO: 518905 - protein, 9 aa, Homo Sapiens
LFRLKFKEF

SEQ ID NO: 518906 - protein, 9 aa, Homo Sapiens
CRALNDVAA

SEQ ID NO: 518907 - protein, 9 aa, Homo Sapiens
GNTPEHVVQ

SEQ ID NO: 518908 - protein, 9 aa, Homo Sapiens
VDLGSQIQM

SEQ ID NO: 518909 - protein, 9 aa, Homo Sapiens
IEDAHNRGR

SEQ ID NO: 518910 - protein, 9 aa, Homo Sapiens
PQRKGTLPK

SEQ ID NO: 518911 - protein, 9 aa, Homo Sapiens
EVPATEQGM

SEQ ID NO: 518912 - protein, 9 aa, Homo Sapiens
RQWQRFKAL

SEQ ID NO: 518913 - protein, 9 aa, Homo Sapiens
IWPRAGKER

SEQ ID NO: 518914 - protein, 9 aa, Homo Sapiens
SLSAKDFFN

SEQ ID NO: 518915 - protein, 9 aa, Homo Sapiens
DRRMWGAHI

SEQ ID NO: 518916 - protein, 9 aa, Homo Sapiens
GKRGCKMFH

SEQ ID NO: 518917 - protein, 9 aa, Homo Sapiens
ESVQKLYSI

SEQ ID NO: 518918 - protein, 9 aa, Homo Sapiens
SISRSLMFC

SEQ ID NO: 518919 - protein, 9 aa, Homo Sapiens
SGAASLVAC

SEQ ID NO: 518920 - protein, 9 aa, Homo Sapiens
RVPQAVFCP

SEQ ID NO: 518921 - protein, 9 aa, Homo Sapiens
ESLHIEIEF

SEQ ID NO: 518922 - protein, 9 aa, Homo Sapiens
PESIPSPPG

SEQ ID NO: 518923 - protein, 9 aa, Homo Sapiens
SAARTSSCA

SEQ ID NO: 518924 - protein, 9 aa, Homo Sapiens
HGKKLYTDG

SEQ ID NO: 518925 - protein, 9 aa, Homo Sapiens
FYRTRITCI

SEQ ID NO: 518926 - protein, 9 aa, Homo Sapiens
VLLRSRKGN

SEQ ID NO: 518927 - protein, 9 aa, Homo Sapiens
IECVDLAGY

SEQ ID NO: 518928 - protein, 9 aa, Homo Sapiens
GAPFVPPLP

SEQ ID NO: 518929 - protein, 9 aa, Homo Sapiens
SAATTEEPL

SEQ ID NO: 518930 - protein, 9 aa, Homo Sapiens
FKGISDETL

SEQ ID NO: 518931 - protein, 9 aa, Homo Sapiens
LLRIQTAPN

SEQ ID NO: 518932 - protein, 9 aa, Homo Sapiens
LIACANVLS

SEQ ID NO: 518933 - protein, 9 aa, Homo Sapiens
MTFRERTKR

SEQ ID NO: 518934 - protein, 9 aa, Homo Sapiens
GISTAPDRG

SEQ ID NO: 518935 - protein, 9 aa, Homo Sapiens
GQPHPSISE

SEQ ID NO: 518936 - protein, 9 aa, Homo Sapiens
PDDAELQHA

SEQ ID NO: 518937 - protein, 9 aa, Homo Sapiens
AAVTMARLS

SEQ ID NO: 518938 - protein, 9 aa, Homo Sapiens
SPRMSILYS

SEQ ID NO: 518939 - protein, 9 aa, Homo Sapiens
SHSIHDKSQ

SEQ ID NO: 518940 - protein, 9 aa, Homo Sapiens
FRDSGDCGV

SEQ ID NO: 518941 - protein, 9 aa, Homo Sapiens
SPQSRSEWE

SEQ ID NO: 518942 - protein, 9 aa, Homo Sapiens
CPQPPVQNG

SEQ ID NO: 518943 - protein, 9 aa, Homo Sapiens
MIQMSSSLV

SEQ ID NO: 518944 - protein, 9 aa, Homo Sapiens
PMKRFISTL

SEQ ID NO: 518945 - protein, 9 aa, Homo Sapiens
QPESRNVSS

SEQ ID NO: 518946 - protein, 9 aa, Homo Sapiens
YFLIKEMSM

SEQ ID NO: 518947 - protein, 9 aa, Homo Sapiens
REYLECDEI

SEQ ID NO: 518948 - protein, 9 aa, Homo Sapiens
ASDPLKILA

SEQ ID NO: 518949 - protein, 9 aa, Homo Sapiens
LTHPELKAT

SEQ ID NO: 518950 - protein, 9 aa, Homo Sapiens
STPASRRCS

SEQ ID NO: 518951 - protein, 9 aa, Homo Sapiens
MAETVASEF

SEQ ID NO: 518952 - protein, 9 aa, Homo Sapiens
LGPAWSYPA

SEQ ID NO: 518953 - protein, 9 aa, Homo Sapiens
MKDMMLYCK

SEQ ID NO: 518954 - protein, 9 aa, Homo Sapiens
GDEEDLSAA

SEQ ID NO: 518955 - protein, 9 aa, Homo Sapiens
GLDYSGPSI

SEQ ID NO: 518956 - protein, 9 aa, Homo Sapiens
IELRDFLFE

SEQ ID NO: 518957 - protein, 9 aa, Homo Sapiens
TTAFDRYVA

SEQ ID NO: 518958 - protein, 9 aa, Homo Sapiens
SPLEKTPMG

SEQ ID NO: 518959 - protein, 9 aa, Homo Sapiens
MNLVIFMYV

SEQ ID NO: 518960 - protein, 9 aa, Homo Sapiens
GIGTTSANE

SEQ ID NO: 518961 - protein, 9 aa, Homo Sapiens
SAVTPSSLS

SEQ ID NO: 518962 - protein, 9 aa, Homo Sapiens
LEKHEEMLE

SEQ ID NO: 518963 - protein, 9 aa, Homo Sapiens
DSVAGALDH

SEQ ID NO: 518964 - protein, 9 aa, Homo Sapiens
CGYSSSCGY

SEQ ID NO: 518965 - protein, 9 aa, Homo Sapiens
RRYEVPHEY

SEQ ID NO: 518966 - protein, 9 aa, Homo Sapiens
ILASATTFA

SEQ ID NO: 518967 - protein, 9 aa, Homo Sapiens
YECRALNDV

SEQ ID NO: 518968 - protein, 9 aa, Homo Sapiens
IKSYYENAQ

SEQ ID NO: 518969 - protein, 9 aa, Homo Sapiens
APPGHKGQA

SEQ ID NO: 518970 - protein, 9 aa, Homo Sapiens
APPPTEPSG

SEQ ID NO: 518971 - protein, 9 aa, Homo Sapiens
GGECPSGGP

SEQ ID NO: 518972 - protein, 9 aa, Homo Sapiens
QGVLKEEIL

SEQ ID NO: 518973 - protein, 9 aa, Homo Sapiens
SNQNVQEEK

SEQ ID NO: 518974 - protein, 9 aa, Homo Sapiens
RVPRISQEF

SEQ ID NO: 518975 - protein, 9 aa, Homo Sapiens
RTTLLHAKS

SEQ ID NO: 518976 - protein, 9 aa, Homo Sapiens
RHSHHRCPS

SEQ ID NO: 518977 - protein, 9 aa, Homo Sapiens
YGGHVTDDC

SEQ ID NO: 518978 - protein, 9 aa, Homo Sapiens
LGPRCARGC

SEQ ID NO: 518979 - protein, 9 aa, Homo Sapiens
MTTTNAVAI

SEQ ID NO: 518980 - protein, 9 aa, Homo Sapiens
WKEELLQDL

SEQ ID NO: 518981 - protein, 9 aa, Homo Sapiens
ISFSIIPGQ

SEQ ID NO: 518982 - protein, 9 aa, Homo Sapiens
CPHCGRAFS

SEQ ID NO: 518983 - protein, 9 aa, Homo Sapiens
EARTVSFAD

SEQ ID NO: 518984 - protein, 9 aa, Homo Sapiens
EDPEEKLAV

SEQ ID NO: 518985 - protein, 9 aa, Homo Sapiens
DPEDIQDEL

SEQ ID NO: 518986 - protein, 9 aa, Homo Sapiens
PPSAALLRV

SEQ ID NO: 518987 - protein, 9 aa, Homo Sapiens
TAPDRGHAA

SEQ ID NO: 518988 - protein, 9 aa, Homo Sapiens
ERVPRISQE

SEQ ID NO: 518989 - protein, 9 aa, Homo Sapiens
KSQDPLALA

SEQ ID NO: 518990 - protein, 9 aa, Homo Sapiens
KASDPLKIL

SEQ ID NO: 518991 - protein, 9 aa, Homo Sapiens
IDFLGSYSE

SEQ ID NO: 518992 - protein, 9 aa, Homo Sapiens
VFFLIHLHA

SEQ ID NO: 518993 - protein, 9 aa, Homo Sapiens
MYIFLHMVK

SEQ ID NO: 518994 - protein, 9 aa, Homo Sapiens
AFILIGNIP

SEQ ID NO: 518995 - protein, 9 aa, Homo Sapiens
CNKTVKCYQ

SEQ ID NO: 518996 - protein, 9 aa, Homo Sapiens
QEVPATEQG

SEQ ID NO: 518997 - protein, 9 aa, Homo Sapiens
GLLAAIPGL

SEQ ID NO: 518998 - protein, 9 aa, Homo Sapiens
EQDRVPPLD

SEQ ID NO: 518999 - protein, 9 aa, Homo Sapiens
YFIPIFVYG

SEQ ID NO: 519000 - protein, 9 aa, Homo Sapiens
KGISDETLK

SEQ ID NO: 519001 - protein, 9 aa, Homo Sapiens
DLLRIQTAP

SEQ ID NO: 519002 - protein, 9 aa, Homo Sapiens
ATSQVSHLQ

SEQ ID NO: 519003 - protein, 9 aa, Homo Sapiens
RKEQQEAAS

SEQ ID NO: 519004 - protein, 9 aa, Homo Sapiens
TGSSRSVMI

SEQ ID NO: 519005 - protein, 9 aa, Homo Sapiens
KLYSIAIIK

SEQ ID NO: 519006 - protein, 9 aa, Homo Sapiens
VAGALDHAQ

SEQ ID NO: 519007 - protein, 9 aa, Homo Sapiens
VSALSTPAS

SEQ ID NO: 519008 - protein, 9 aa, Homo Sapiens
GRFLLHLPN

SEQ ID NO: 519009 - protein, 9 aa, Homo Sapiens
CNLNPFVQC

SEQ ID NO: 519010 - protein, 9 aa, Homo Sapiens
VSVERLVEC

SEQ ID NO: 519011 - protein, 9 aa, Homo Sapiens
GAHIFCVLS

SEQ ID NO: 519012 - protein, 9 aa, Homo Sapiens
ADCFGANRH

SEQ ID NO: 519013 - protein, 9 aa, Homo Sapiens
TQVEMSGLS

SEQ ID NO: 519014 - protein, 9 aa, Homo Sapiens
SEPLPPFNQ

SEQ ID NO: 519015 - protein, 9 aa, Homo Sapiens
LIMEWNLTS

SEQ ID NO: 519016 - protein, 9 aa, Homo Sapiens
ELPADTFRG

SEQ ID NO: 519017 - protein, 9 aa, Homo Sapiens
GFLAKTCST

SEQ ID NO: 519018 - protein, 9 aa, Homo Sapiens
KGMLCADTC

SEQ ID NO: 519019 - protein, 9 aa, Homo Sapiens
SADLLNALK

SEQ ID NO: 519020 - protein, 9 aa, Homo Sapiens
SLPASLPRL

SEQ ID NO: 519021 - protein, 9 aa, Homo Sapiens
TSNSKPVLS

SEQ ID NO: 519022 - protein, 9 aa, Homo Sapiens
TQLSELHCD

SEQ ID NO: 519023 - protein, 9 aa, Homo Sapiens
SLQIVSELQ

SEQ ID NO: 519024 - protein, 9 aa, Homo Sapiens
KIQGKSLGS

SEQ ID NO: 519025 - protein, 9 aa, Homo Sapiens
SHRHSHHRC

SEQ ID NO: 519026 - protein, 9 aa, Homo Sapiens
RIHLLCMGS

SEQ ID NO: 519027 - protein, 9 aa, Homo Sapiens
AQEGPLLLS

SEQ ID NO: 519028 - protein, 9 aa, Homo Sapiens
FLIHLHAGP

SEQ ID NO: 519029 - protein, 9 aa, Homo Sapiens
PQRPRSAAR

SEQ ID NO: 519030 - protein, 9 aa, Homo Sapiens
TSHHVGQLR

SEQ ID NO: 519031 - protein, 9 aa, Homo Sapiens
TTLPSLELD

SEQ ID NO: 519032 - protein, 9 aa, Homo Sapiens
PPTEPSGLQ

SEQ ID NO: 519033 - protein, 9 aa, Homo Sapiens
EDFVEDIVK

SEQ ID NO: 519034 - protein, 9 aa, Homo Sapiens
QAEKEQEHL

SEQ ID NO: 519035 - protein, 9 aa, Homo Sapiens
HTAKGMLCA

SEQ ID NO: 519036 - protein, 9 aa, Homo Sapiens
ATMSISNGK

SEQ ID NO: 519037 - protein, 9 aa, Homo Sapiens
MKAKIQDKE

SEQ ID NO: 519038 - protein, 9 aa, Homo Sapiens
EEAGMEDSP

SEQ ID NO: 519039 - protein, 9 aa, Homo Sapiens
ALVYVLLRS

SEQ ID NO: 519040 - protein, 9 aa, Homo Sapiens
MESGVLLGM

SEQ ID NO: 519041 - protein, 9 aa, Homo Sapiens
GGMSLKVRS

SEQ ID NO: 519042 - protein, 9 aa, Homo Sapiens
GPQGLEVSF

SEQ ID NO: 519043 - protein, 9 aa, Homo Sapiens
RNAANAHER

SEQ ID NO: 519044 - protein, 9 aa, Homo Sapiens
VAASKVKCK

SEQ ID NO: 519045 - protein, 9 aa, Homo Sapiens
YRPHTEVFP

SEQ ID NO: 519046 - protein, 9 aa, Homo Sapiens
ALSNQNVQE

SEQ ID NO: 519047 - protein, 9 aa, Homo Sapiens
ETKDLDKMD

SEQ ID NO: 519048 - protein, 9 aa, Homo Sapiens
KDHEDGALF

SEQ ID NO: 519049 - protein, 9 aa, Homo Sapiens
GVVVSYLPL

SEQ ID NO: 519050 - protein, 9 aa, Homo Sapiens
PCESVQKLY

SEQ ID NO: 519051 - protein, 9 aa, Homo Sapiens
GNIPGYARS

SEQ ID NO: 519052 - protein, 9 aa, Homo Sapiens
VSSLQIVSE

SEQ ID NO: 519053 - protein, 9 aa, Homo Sapiens
MSPLDLLEP

SEQ ID NO: 519054 - protein, 9 aa, Homo Sapiens
SGDVLCLCP

SEQ ID NO: 519055 - protein, 9 aa, Homo Sapiens
PGGAPPQPS

SEQ ID NO: 519056 - protein, 9 aa, Homo Sapiens
EGCKSFFNR

SEQ ID NO: 519057 - protein, 9 aa, Homo Sapiens
GDTGFTGPS

SEQ ID NO: 519058 - protein, 9 aa, Homo Sapiens
KDSADMFSL

SEQ ID NO: 519059 - protein, 9 aa, Homo Sapiens
LLIVILSSV

SEQ ID NO: 519060 - protein, 9 aa, Homo Sapiens
DGIVLLLSV

SEQ ID NO: 519061 - protein, 9 aa, Homo Sapiens
EKVIQLRSK

SEQ ID NO: 519062 - protein, 9 aa, Homo Sapiens
EPPGAYDCP

SEQ ID NO: 519063 - protein, 9 aa, Homo Sapiens
FINLGLFEL

SEQ ID NO: 519064 - protein, 9 aa, Homo Sapiens
SPPGRLEPS

SEQ ID NO: 519065 - protein, 9 aa, Homo Sapiens
TGRGTPSNG

SEQ ID NO: 519066 - protein, 9 aa, Homo Sapiens
EFHGLSSSG

SEQ ID NO: 519067 - protein, 9 aa, Homo Sapiens
DKMDDDDDD

SEQ ID NO: 519068 - protein, 9 aa, Homo Sapiens
CFHLRRETE

SEQ ID NO: 519069 - protein, 9 aa, Homo Sapiens
HCGRAFSHS

SEQ ID NO: 519070 - protein, 9 aa, Homo Sapiens
IRPAEVQQG

SEQ ID NO: 519071 - protein, 9 aa, Homo Sapiens
LNTTAVTQG

SEQ ID NO: 519072 - protein, 9 aa, Homo Sapiens
NKTVKCYQG

SEQ ID NO: 519073 - protein, 9 aa, Homo Sapiens
SPPHPGSRR

SEQ ID NO: 519074 - protein, 9 aa, Homo Sapiens
MCDLLRIQT

SEQ ID NO: 519075 - protein, 9 aa, Homo Sapiens
SGPPGPQGR

SEQ ID NO: 519076 - protein, 9 aa, Homo Sapiens
ARIVGGSKA

SEQ ID NO: 519077 - protein, 9 aa, Homo Sapiens
EVKEACIWG

SEQ ID NO: 519078 - protein, 9 aa, Homo Sapiens
DGRFLLHLP

SEQ ID NO: 519079 - protein, 9 aa, Homo Sapiens
DHEELELLL

SEQ ID NO: 519080 - protein, 9 aa, Homo Sapiens
LVACGFSYG

SEQ ID NO: 519081 - protein, 9 aa, Homo Sapiens
CTDMSAAEL

SEQ ID NO: 519082 - protein, 9 aa, Homo Sapiens
SLLELQLEE

SEQ ID NO: 519083 - protein, 9 aa, Homo Sapiens
NMKAKIQDK

SEQ ID NO: 519084 - protein, 9 aa, Homo Sapiens
GFSSLGEHQ

SEQ ID NO: 519085 - protein, 9 aa, Homo Sapiens
SISSIQMLD

SEQ ID NO: 519086 - protein, 9 aa, Homo Sapiens
GDCGVQRVP

SEQ ID NO: 519087 - protein, 9 aa, Homo Sapiens
GKAYWYSSQ

SEQ ID NO: 519088 - protein, 9 aa, Homo Sapiens
YSYGFEGLH

SEQ ID NO: 519089 - protein, 9 aa, Homo Sapiens
DLPDPQWKT

SEQ ID NO: 519090 - protein, 9 aa, Homo Sapiens
LLNPDLEKT

SEQ ID NO: 519091 - protein, 9 aa, Homo Sapiens
SFTWLRGEK

SEQ ID NO: 519092 - protein, 9 aa, Homo Sapiens
VTKASDPLK

SEQ ID NO: 519093 - protein, 9 aa, Homo Sapiens
FCPVGPMCW

SEQ ID NO: 519094 - protein, 9 aa, Homo Sapiens
VAENILGHP

SEQ ID NO: 519095 - protein, 9 aa, Homo Sapiens
TLLHAKSQI

SEQ ID NO: 519096 - protein, 9 aa, Homo Sapiens
ESPCESVQK

SEQ ID NO: 519097 - protein, 9 aa, Homo Sapiens
CCDYRREPP

SEQ ID NO: 519098 - protein, 9 aa, Homo Sapiens
LLYHTAKGM

SEQ ID NO: 519099 - protein, 9 aa, Homo Sapiens
AQHHDAGFS

SEQ ID NO: 519100 - protein, 9 aa, Homo Sapiens
EYSAHKQGV

SEQ ID NO: 519101 - protein, 9 aa, Homo Sapiens
LLDLCLNQI

SEQ ID NO: 519102 - protein, 9 aa, Homo Sapiens
SEVKEACIW

SEQ ID NO: 519103 - protein, 9 aa, Homo Sapiens
TTTLPSLEL

SEQ ID NO: 519104 - protein, 9 aa, Homo Sapiens
EKSQDPLAL

SEQ ID NO: 519105 - protein, 9 aa, Homo Sapiens
KLLKPQRKG

SEQ ID NO: 519106 - protein, 9 aa, Homo Sapiens
QSPTISECP

SEQ ID NO: 519107 - protein, 9 aa, Homo Sapiens
SSQGCVDHS

SEQ ID NO: 519108 - protein, 9 aa, Homo Sapiens
AYPSTAGQP

SEQ ID NO: 519109 - protein, 9 aa, Homo Sapiens
NTTAVTQGI

SEQ ID NO: 519110 - protein, 9 aa, Homo Sapiens
LPRLSIQKN

SEQ ID NO: 519111 - protein, 9 aa, Homo Sapiens
TEEGAEDPL

SEQ ID NO: 519112 - protein, 9 aa, Homo Sapiens
LYFLIKEMS

SEQ ID NO: 519113 - protein, 9 aa, Homo Sapiens
TSTTSCEQM

SEQ ID NO: 519114 - protein, 9 aa, Homo Sapiens
ISSYGAFWA

SEQ ID NO: 519115 - protein, 9 aa, Homo Sapiens
IEFFFLVSR

SEQ ID NO: 519116 - protein, 9 aa, Homo Sapiens
GPPGPQGRL

SEQ ID NO: 519117 - protein, 9 aa, Homo Sapiens
QPAALVPKA

SEQ ID NO: 519118 - protein, 9 aa, Homo Sapiens
PPSYPLTAA

SEQ ID NO: 519119 - protein, 9 aa, Homo Sapiens
TERVPRISQ

SEQ ID NO: 519120 - protein, 9 aa, Homo Sapiens
QVEGCRGPV

SEQ ID NO: 519121 - protein, 9 aa, Homo Sapiens
LRGEKVIQL

SEQ ID NO: 519122 - protein, 9 aa, Homo Sapiens
SEWEDSSDP

SEQ ID NO: 519123 - protein, 9 aa, Homo Sapiens
QSRSEWEDS

SEQ ID NO: 519124 - protein, 9 aa, Homo Sapiens
PPSPSGFRA

SEQ ID NO: 519125 - protein, 9 aa, Homo Sapiens
RLHKSMVFL

SEQ ID NO: 519126 - protein, 9 aa, Homo Sapiens
GISSYGAFW

SEQ ID NO: 519127 - protein, 9 aa, Homo Sapiens
RTVSFADVN

SEQ ID NO: 519128 - protein, 9 aa, Homo Sapiens
NLQTSTLGI

SEQ ID NO: 519129 - protein, 9 aa, Homo Sapiens
EEALFKKIA

SEQ ID NO: 519130 - protein, 9 aa, Homo Sapiens
GSVVHAIQA

SEQ ID NO: 519131 - protein, 9 aa, Homo Sapiens
EKTCSDELT

SEQ ID NO: 519132 - protein, 9 aa, Homo Sapiens
RAARAPLPP

SEQ ID NO: 519133 - protein, 9 aa, Homo Sapiens
GGGKQSRKI

SEQ ID NO: 519134 - protein, 9 aa, Homo Sapiens
VKDPRRPKR

SEQ ID NO: 519135 - protein, 9 aa, Homo Sapiens
VQEEKRGPK

SEQ ID NO: 519136 - protein, 9 aa, Homo Sapiens
TVKVIDNLQ

SEQ ID NO: 519137 - protein, 9 aa, Homo Sapiens
NERQRRKKI

SEQ ID NO: 519138 - protein, 9 aa, Homo Sapiens
NLEKLAEGF

SEQ ID NO: 519139 - protein, 9 aa, Homo Sapiens
FADVNQSSP

SEQ ID NO: 519140 - protein, 9 aa, Homo Sapiens
SGFRAQDRA

SEQ ID NO: 519141 - protein, 9 aa, Homo Sapiens
MGLDGIVLL

SEQ ID NO: 519142 - protein, 9 aa, Homo Sapiens
EDRYEEQEP

SEQ ID NO: 519143 - protein, 9 aa, Homo Sapiens
CGQHYCPLT

SEQ ID NO: 519144 - protein, 9 aa, Homo Sapiens
MTDRQMLPH

SEQ ID NO: 519145 - protein, 9 aa, Homo Sapiens
KAQPDDLMN

SEQ ID NO: 519146 - protein, 9 aa, Homo Sapiens
HSPPHPGSR

SEQ ID NO: 519147 - protein, 9 aa, Homo Sapiens
APPLAAPPS

SEQ ID NO: 519148 - protein, 9 aa, Homo Sapiens
AILKIRYTE

SEQ ID NO: 519149 - protein, 9 aa, Homo Sapiens
LQEWRPEDE

SEQ ID NO: 519150 - protein, 9 aa, Homo Sapiens
LAVSPTPPV

SEQ ID NO: 519151 - protein, 9 aa, Homo Sapiens
EQEHLVAEM

SEQ ID NO: 519152 - protein, 9 aa, Homo Sapiens
RGTPSNGKK

SEQ ID NO: 519153 - protein, 9 aa, Homo Sapiens
TMIILAVIN

SEQ ID NO: 519154 - protein, 9 aa, Homo Sapiens
LCAGLAEEL

SEQ ID NO: 519155 - protein, 9 aa, Homo Sapiens
WTEVHAMRE

SEQ ID NO: 519156 - protein, 9 aa, Homo Sapiens
KNYYREKIG

SEQ ID NO: 519157 - protein, 9 aa, Homo Sapiens
VGFLGPRCA

SEQ ID NO: 519158 - protein, 9 aa, Homo Sapiens
GPGDEEDLS

SEQ ID NO: 519159 - protein, 9 aa, Homo Sapiens
LENLDRFWP

SEQ ID NO: 519160 - protein, 9 aa, Homo Sapiens
PSPAPASAL

SEQ ID NO: 519161 - protein, 9 aa, Homo Sapiens
NQMHESMKL

SEQ ID NO: 519162 - protein, 9 aa, Homo Sapiens
CLERIEELE

SEQ ID NO: 519163 - protein, 9 aa, Homo Sapiens
SKPVLSNIL

SEQ ID NO: 519164 - protein, 9 aa, Homo Sapiens
WYSSQLIQH

SEQ ID NO: 519165 - protein, 9 aa, Homo Sapiens
SGGPFVCKC

SEQ ID NO: 519166 - protein, 9 aa, Homo Sapiens
PPGHKGQAN

SEQ ID NO: 519167 - protein, 9 aa, Homo Sapiens
VTDDCDRRL

SEQ ID NO: 519168 - protein, 9 aa, Homo Sapiens
RLCAAGDKK

SEQ ID NO: 519169 - protein, 9 aa, Homo Sapiens
GSGAYREVE

SEQ ID NO: 519170 - protein, 9 aa, Homo Sapiens
KTAGSASDT

SEQ ID NO: 519171 - protein, 9 aa, Homo Sapiens
YQGGGGGGL

SEQ ID NO: 519172 - protein, 9 aa, Homo Sapiens
NNRVVGAET

SEQ ID NO: 519173 - protein, 9 aa, Homo Sapiens
NLTHLYLND

SEQ ID NO: 519174 - protein, 9 aa, Homo Sapiens
MLEEHKALI

SEQ ID NO: 519175 - protein, 9 aa, Homo Sapiens
ATTFALNQL

SEQ ID NO: 519176 - protein, 9 aa, Homo Sapiens
GHKGQANAT

SEQ ID NO: 519177 - protein, 9 aa, Homo Sapiens
PRLSIQKNI

SEQ ID NO: 519178 - protein, 9 aa, Homo Sapiens
VFCPVGPMC

SEQ ID NO: 519179 - protein, 9 aa, Homo Sapiens
FLKRLKHEK

SEQ ID NO: 519180 - protein, 9 aa, Homo Sapiens
QDPLALARS

SEQ ID NO: 519181 - protein, 9 aa, Homo Sapiens
VSDPPTTTT

SEQ ID NO: 519182 - protein, 9 aa, Homo Sapiens
CKVPNKALP

SEQ ID NO: 519183 - protein, 9 aa, Homo Sapiens
LVIFMYVLE

SEQ ID NO: 519184 - protein, 9 aa, Homo Sapiens
FMLFVCLAC

SEQ ID NO: 519185 - protein, 9 aa, Homo Sapiens
HSQTSTTSC

SEQ ID NO: 519186 - protein, 9 aa, Homo Sapiens
LAEHERMAA

SEQ ID NO: 519187 - protein, 9 aa, Homo Sapiens
GRLFVAVMP

SEQ ID NO: 519188 - protein, 9 aa, Homo Sapiens
PLDLLEPEQ

SEQ ID NO: 519189 - protein, 9 aa, Homo Sapiens
KWFRLGSVV

SEQ ID NO: 519190 - protein, 9 aa, Homo Sapiens
PTISECPVP

SEQ ID NO: 519191 - protein, 9 aa, Homo Sapiens
ECPSGGPFV

SEQ ID NO: 519192 - protein, 9 aa, Homo Sapiens
IPSPPGTLP

SEQ ID NO: 519193 - protein, 9 aa, Homo Sapiens
MDEKKLKQL

SEQ ID NO: 519194 - protein, 9 aa, Homo Sapiens
KHGRFGIPE

SEQ ID NO: 519195 - protein, 9 aa, Homo Sapiens
GRRKSLFPG

SEQ ID NO: 519196 - protein, 9 aa, Homo Sapiens
VGSGAYREV

SEQ ID NO: 519197 - protein, 9 aa, Homo Sapiens
VLGSGAAPA

SEQ ID NO: 519198 - protein, 9 aa, Homo Sapiens
IKVKHENDN

SEQ ID NO: 519199 - protein, 9 aa, Homo Sapiens
AELPADTFR

SEQ ID NO: 519200 - protein, 9 aa, Homo Sapiens
FLQSPTEEE

SEQ ID NO: 519201 - protein, 9 aa, Homo Sapiens
FQPQMQSLS

SEQ ID NO: 519202 - protein, 9 aa, Homo Sapiens
CDLLRIQTA

SEQ ID NO: 519203 - protein, 9 aa, Homo Sapiens
VLCLCPGRY

SEQ ID NO: 519204 - protein, 9 aa, Homo Sapiens
SDSEIGCIT

SEQ ID NO: 519205 - protein, 9 aa, Homo Sapiens
NMSYFYLND

SEQ ID NO: 519206 - protein, 9 aa, Homo Sapiens
PKATSRASV

SEQ ID NO: 519207 - protein, 9 aa, Homo Sapiens
SGVLLGMAY

SEQ ID NO: 519208 - protein, 9 aa, Homo Sapiens
RTMLFALMM

SEQ ID NO: 519209 - protein, 9 aa, Homo Sapiens
SPSQPPCSP

SEQ ID NO: 519210 - protein, 9 aa, Homo Sapiens
MFFRFIEEC

SEQ ID NO: 519211 - protein, 9 aa, Homo Sapiens
PSYPLTAAN

SEQ ID NO: 519212 - protein, 9 aa, Homo Sapiens
AWTEVHAMR

SEQ ID NO: 519213 - protein, 9 aa, Homo Sapiens
IVILSSVSF

SEQ ID NO: 519214 - protein, 9 aa, Homo Sapiens
EQQEAASSQ

SEQ ID NO: 519215 - protein, 9 aa, Homo Sapiens
AASWACAST

SEQ ID NO: 519216 - protein, 9 aa, Homo Sapiens
ENIPAGAEE

SEQ ID NO: 519217 - protein, 9 aa, Homo Sapiens
FLLHLPNVQ

SEQ ID NO: 519218 - protein, 9 aa, Homo Sapiens
NITTTLPSL

SEQ ID NO: 519219 - protein, 9 aa, Homo Sapiens
IVHDPLPPE

SEQ ID NO: 519220 - protein, 9 aa, Homo Sapiens
EGVTKASDP

SEQ ID NO: 519221 - protein, 9 aa, Homo Sapiens
VPPLPALDE

SEQ ID NO: 519222 - protein, 9 aa, Homo Sapiens
ENFRQWQRF

SEQ ID NO: 519223 - protein, 9 aa, Homo Sapiens
TVNRQPPPS

SEQ ID NO: 519224 - protein, 9 aa, Homo Sapiens
QSMGATSNS

SEQ ID NO: 519225 - protein, 9 aa, Homo Sapiens
ASLPRLRLE

SEQ ID NO: 519226 - protein, 9 aa, Homo Sapiens
SELQTNYIG

SEQ ID NO: 519227 - protein, 9 aa, Homo Sapiens
GLGLCKQNV

SEQ ID NO: 519228 - protein, 9 aa, Homo Sapiens
LSCTDMSAA

SEQ ID NO: 519229 - protein, 9 aa, Homo Sapiens
QQKAAVTMA

SEQ ID NO: 519230 - protein, 9 aa, Homo Sapiens
SLDPEDIQD

SEQ ID NO: 519231 - protein, 9 aa, Homo Sapiens
CPVPSLPIR

SEQ ID NO: 519232 - protein, 9 aa, Homo Sapiens
EGHPELRGI

SEQ ID NO: 519233 - protein, 9 aa, Homo Sapiens
LQTSTLGII

SEQ ID NO: 519234 - protein, 9 aa, Homo Sapiens
QENEAFDPY

SEQ ID NO: 519235 - protein, 9 aa, Homo Sapiens
APSPAPASA

SEQ ID NO: 519236 - protein, 9 aa, Homo Sapiens
TSTAKLVVT

SEQ ID NO: 519237 - protein, 9 aa, Homo Sapiens
RYGRKEGSQ

SEQ ID NO: 519238 - protein, 9 aa, Homo Sapiens
VKLLEQFRL

SEQ ID NO: 519239 - protein, 9 aa, Homo Sapiens
IQMSSSLVS

SEQ ID NO: 519240 - protein, 9 aa, Homo Sapiens
CKMFHTLLR

SEQ ID NO: 519241 - protein, 9 aa, Homo Sapiens
RINLVFIAL

SEQ ID NO: 519242 - protein, 9 aa, Homo Sapiens
DNEYIGVTY

SEQ ID NO: 519243 - protein, 9 aa, Homo Sapiens
YPIYVEIID

SEQ ID NO: 519244 - protein, 9 aa, Homo Sapiens
SQKPRWVAS

SEQ ID NO: 519245 - protein, 9 aa, Homo Sapiens
DDCADGSDE

SEQ ID NO: 519246 - protein, 9 aa, Homo Sapiens
KILLFRHDS

SEQ ID NO: 519247 - protein, 9 aa, Homo Sapiens
ADKVLQESE

SEQ ID NO: 519248 - protein, 9 aa, Homo Sapiens
SYGFEGLHL

SEQ ID NO: 519249 - protein, 9 aa, Homo Sapiens
CGQAVRYGR

SEQ ID NO: 519250 - protein, 9 aa, Homo Sapiens
MISNSHISA

SEQ ID NO: 519251 - protein, 9 aa, Homo Sapiens
YVLLRSRKG

SEQ ID NO: 519252 - protein, 9 aa, Homo Sapiens
HVTDDCDRR

SEQ ID NO: 519253 - protein, 9 aa, Homo Sapiens
RSLLELQLE

SEQ ID NO: 519254 - protein, 9 aa, Homo Sapiens
RGRKIAAFI

SEQ ID NO: 519255 - protein, 9 aa, Homo Sapiens
MRVDSDNEY

SEQ ID NO: 519256 - protein, 9 aa, Homo Sapiens
DRQASSQEC

SEQ ID NO: 519257 - protein, 9 aa, Homo Sapiens
QAVFCPVGP

SEQ ID NO: 519258 - protein, 9 aa, Homo Sapiens
PGRLFVAVM

SEQ ID NO: 519259 - protein, 9 aa, Homo Sapiens
TCGGKRKKC

SEQ ID NO: 519260 - protein, 9 aa, Homo Sapiens
AEKEQEHLV

SEQ ID NO: 519261 - protein, 9 aa, Homo Sapiens
YHSRLNERQ

SEQ ID NO: 519262 - protein, 9 aa, Homo Sapiens
PFSTQVEMS

SEQ ID NO: 519263 - protein, 9 aa, Homo Sapiens
AVINFTYSL

SEQ ID NO: 519264 - protein, 9 aa, Homo Sapiens
GEKPFACPH

SEQ ID NO: 519265 - protein, 9 aa, Homo Sapiens
PMDAQACPL

SEQ ID NO: 519266 - protein, 9 aa, Homo Sapiens
EHQGTHHGK

SEQ ID NO: 519267 - protein, 9 aa, Homo Sapiens
PPQAQPQLP

SEQ ID NO: 519268 - protein, 9 aa, Homo Sapiens
VVVNMVMNC

SEQ ID NO: 519269 - protein, 9 aa, Homo Sapiens
MLCADTCAG

SEQ ID NO: 519270 - protein, 9 aa, Homo Sapiens
IEELEDLLA

SEQ ID NO: 519271 - protein, 9 aa, Homo Sapiens
RPAEVQQGV

SEQ ID NO: 519272 - protein, 9 aa, Homo Sapiens
FFRKEQQEA

SEQ ID NO: 519273 - protein, 9 aa, Homo Sapiens
HIKELPCGD

SEQ ID NO: 519274 - protein, 9 aa, Homo Sapiens
HLAPLPSPY

SEQ ID NO: 519275 - protein, 9 aa, Homo Sapiens
AYQGGGGGG

SEQ ID NO: 519276 - protein, 9 aa, Homo Sapiens
AHKQGVLKE

SEQ ID NO: 519277 - protein, 9 aa, Homo Sapiens
KSETSFHLK

SEQ ID NO: 519278 - protein, 9 aa, Homo Sapiens
TVLVLATGR

SEQ ID NO: 519279 - protein, 9 aa, Homo Sapiens
LLSRCSSLS

SEQ ID NO: 519280 - protein, 9 aa, Homo Sapiens
VMKFSNSIG

SEQ ID NO: 519281 - protein, 9 aa, Homo Sapiens
KPAIIAGVF

SEQ ID NO: 519282 - protein, 9 aa, Homo Sapiens
VNDKHFVRD

SEQ ID NO: 519283 - protein, 9 aa, Homo Sapiens
SRVRYSPHI

SEQ ID NO: 519284 - protein, 9 aa, Homo Sapiens
QDEDLSSDG

SEQ ID NO: 519285 - protein, 9 aa, Homo Sapiens
SIHDKSQML

SEQ ID NO: 519286 - protein, 9 aa, Homo Sapiens
TFRGLRRLR

SEQ ID NO: 519287 - protein, 9 aa, Homo Sapiens
QRADGPYKC

SEQ ID NO: 519288 - protein, 9 aa, Homo Sapiens
GMDEKKLKQ

SEQ ID NO: 519289 - protein, 9 aa, Homo Sapiens
TDASPMKRF

SEQ ID NO: 519290 - protein, 9 aa, Homo Sapiens
VLLYHTAKG

SEQ ID NO: 519291 - protein, 9 aa, Homo Sapiens
LGQASRSAS

SEQ ID NO: 519292 - protein, 9 aa, Homo Sapiens
LAWVGDALL

SEQ ID NO: 519293 - protein, 9 aa, Homo Sapiens
PPGTLPHFI

SEQ ID NO: 519294 - protein, 9 aa, Homo Sapiens
SYGAFWAGI

SEQ ID NO: 519295 - protein, 9 aa, Homo Sapiens
PGAVRTRVG

SEQ ID NO: 519296 - protein, 9 aa, Homo Sapiens
WNPEGPDLS

SEQ ID NO: 519297 - protein, 9 aa, Homo Sapiens
LLKKENLAW

SEQ ID NO: 519298 - protein, 9 aa, Homo Sapiens
SLRGSIVGG

SEQ ID NO: 519299 - protein, 9 aa, Homo Sapiens
PHGVKLVCC

SEQ ID NO: 519300 - protein, 9 aa, Homo Sapiens
PPPLPSAPP

SEQ ID NO: 519301 - protein, 9 aa, Homo Sapiens
FGAAVREQN

SEQ ID NO: 519302 - protein, 9 aa, Homo Sapiens
GSILYFLIK

SEQ ID NO: 519303 - protein, 9 aa, Homo Sapiens
RRVLRMLLG

SEQ ID NO: 519304 - protein, 9 aa, Homo Sapiens
HPKRYKGFS

SEQ ID NO: 519305 - protein, 9 aa, Homo Sapiens
KFSNSIGNS

SEQ ID NO: 519306 - protein, 9 aa, Homo Sapiens
QGKSLGSFF

SEQ ID NO: 519307 - protein, 9 aa, Homo Sapiens
RTKRHEMQI

SEQ ID NO: 519308 - protein, 9 aa, Homo Sapiens
LSSVSFWIN

SEQ ID NO: 519309 - protein, 9 aa, Homo Sapiens
HPHHSNTFV

SEQ ID NO: 519310 - protein, 9 aa, Homo Sapiens
PQPSAYLPS

SEQ ID NO: 519311 - protein, 9 aa, Homo Sapiens
NRSVRRNLS

SEQ ID NO: 519312 - protein, 9 aa, Homo Sapiens
DHAQTSLLT

SEQ ID NO: 519313 - protein, 9 aa, Homo Sapiens
PMVGKAGDF

SEQ ID NO: 519314 - protein, 9 aa, Homo Sapiens
SHHRCPSRS

SEQ ID NO: 519315 - protein, 9 aa, Homo Sapiens
LASRNLQAD

SEQ ID NO: 519316 - protein, 9 aa, Homo Sapiens
EALFKKIAE

SEQ ID NO: 519317 - protein, 9 aa, Homo Sapiens
GSQIQMICN

SEQ ID NO: 519318 - protein, 9 aa, Homo Sapiens
PPPSYPLTA

SEQ ID NO: 519319 - protein, 9 aa, Homo Sapiens
SGPSIEFFF

SEQ ID NO: 519320 - protein, 9 aa, Homo Sapiens
QLPRRLCAA

SEQ ID NO: 519321 - protein, 9 aa, Homo Sapiens
CQVDFIIIN

SEQ ID NO: 519322 - protein, 9 aa, Homo Sapiens
AWNIPVKWT

SEQ ID NO: 519323 - protein, 9 aa, Homo Sapiens
KLSTPGQRH

SEQ ID NO: 519324 - protein, 9 aa, Homo Sapiens
FRTNNIRIQ

SEQ ID NO: 519325 - protein, 9 aa, Homo Sapiens
CSVSVERLV

SEQ ID NO: 519326 - protein, 9 aa, Homo Sapiens
AVTPSSLSA

SEQ ID NO: 519327 - protein, 9 aa, Homo Sapiens
GLIACANVL

SEQ ID NO: 519328 - protein, 9 aa, Homo Sapiens
QKSTSGSYS

SEQ ID NO: 519329 - protein, 9 aa, Homo Sapiens
FRERTKRHE

SEQ ID NO: 519330 - protein, 9 aa, Homo Sapiens
HHNPPPFAS

SEQ ID NO: 519331 - protein, 9 aa, Homo Sapiens
IVNDKHFVR

SEQ ID NO: 519332 - protein, 9 aa, Homo Sapiens
ELQHATRGS

SEQ ID NO: 519333 - protein, 9 aa, Homo Sapiens
HAAPCGQAV

SEQ ID NO: 519334 - protein, 9 aa, Homo Sapiens
LLFTTDNSS

SEQ ID NO: 519335 - protein, 9 aa, Homo Sapiens
ALFKKIAET

SEQ ID NO: 519336 - protein, 9 aa, Homo Sapiens
ENCDFRVKD

SEQ ID NO: 519337 - protein, 9 aa, Homo Sapiens
YNWLHHTSW

SEQ ID NO: 519338 - protein, 9 aa, Homo Sapiens
LQIYRDESH

SEQ ID NO: 519339 - protein, 9 aa, Homo Sapiens
LDDLKGTFT

SEQ ID NO: 519340 - protein, 9 aa, Homo Sapiens
SASDTFQDS

SEQ ID NO: 519341 - protein, 9 aa, Homo Sapiens
KLKRCTLCY

SEQ ID NO: 519342 - protein, 9 aa, Homo Sapiens
LLLTTAFDR

SEQ ID NO: 519343 - protein, 9 aa, Homo Sapiens
TTSHHVGQL

SEQ ID NO: 519344 - protein, 9 aa, Homo Sapiens
PLPPFNQFS

SEQ ID NO: 519345 - protein, 9 aa, Homo Sapiens
YLVPTSLRA

SEQ ID NO: 519346 - protein, 9 aa, Homo Sapiens
KVLHSSMVC

SEQ ID NO: 519347 - protein, 9 aa, Homo Sapiens
KMLEEHKAL

SEQ ID NO: 519348 - protein, 9 aa, Homo Sapiens
STPPPGTPV

SEQ ID NO: 519349 - protein, 9 aa, Homo Sapiens
LPTNKDVCY

SEQ ID NO: 519350 - protein, 9 aa, Homo Sapiens
EKHEEMLEG

SEQ ID NO: 519351 - protein, 9 aa, Homo Sapiens
ELITKFRVF

SEQ ID NO: 519352 - protein, 9 aa, Homo Sapiens
GCITIAWKF

SEQ ID NO: 519353 - protein, 9 aa, Homo Sapiens
ISDLCDHTT

SEQ ID NO: 519354 - protein, 9 aa, Homo Sapiens
ISRLQAQTQ

SEQ ID NO: 519355 - protein, 9 aa, Homo Sapiens
GQPCAPPLA

SEQ ID NO: 519356 - protein, 9 aa, Homo Sapiens
IFLHMVKGT

SEQ ID NO: 519357 - protein, 9 aa, Homo Sapiens
DFPMDAQAC

SEQ ID NO: 519358 - protein, 9 aa, Homo Sapiens
MLQDEDLSS

SEQ ID NO: 519359 - protein, 9 aa, Homo Sapiens
LDANADIGI

SEQ ID NO: 519360 - protein, 9 aa, Homo Sapiens
PVVHKEIVS

SEQ ID NO: 519361 - protein, 9 aa, Homo Sapiens
SFADVNQSS

SEQ ID NO: 519362 - protein, 9 aa, Homo Sapiens
SSVSFWINM

SEQ ID NO: 519363 - protein, 9 aa, Homo Sapiens
ECVDLAGYH

SEQ ID NO: 519364 - protein, 9 aa, Homo Sapiens
EADFSVHFN

SEQ ID NO: 519365 - protein, 9 aa, Homo Sapiens
HGVKLVCCL

SEQ ID NO: 519366 - protein, 9 aa, Homo Sapiens
GNAVSLILS

SEQ ID NO: 519367 - protein, 9 aa, Homo Sapiens
STGIFNETS

SEQ ID NO: 519368 - protein, 9 aa, Homo Sapiens
SKGSGDDVK

SEQ ID NO: 519369 - protein, 9 aa, Homo Sapiens
HSHHRCPSR

SEQ ID NO: 519370 - protein, 9 aa, Homo Sapiens
DSWQAVDAT

SEQ ID NO: 519371 - protein, 9 aa, Homo Sapiens
TMLFALMMS

SEQ ID NO: 519372 - protein, 9 aa, Homo Sapiens
FHGLSSSGV

SEQ ID NO: 519373 - protein, 9 aa, Homo Sapiens
SGVAAAAPR

SEQ ID NO: 519374 - protein, 9 aa, Homo Sapiens
AANAHERAR

SEQ ID NO: 519375 - protein, 9 aa, Homo Sapiens
YAEHPGNCL

SEQ ID NO: 519376 - protein, 9 aa, Homo Sapiens
QRLMISNSH

SEQ ID NO: 519377 - protein, 9 aa, Homo Sapiens
SNCQKVPIL

SEQ ID NO: 519378 - protein, 9 aa, Homo Sapiens
GCVDHSIVL

SEQ ID NO: 519379 - protein, 9 aa, Homo Sapiens
LACAAPPLP

SEQ ID NO: 519380 - protein, 9 aa, Homo Sapiens
SGLASRNLQ

SEQ ID NO: 519381 - protein, 9 aa, Homo Sapiens
KTSLLFRLK

SEQ ID NO: 519382 - protein, 9 aa, Homo Sapiens
VHFNRFNPD

SEQ ID NO: 519383 - protein, 9 aa, Homo Sapiens
CIWGSLALG

SEQ ID NO: 519384 - protein, 9 aa, Homo Sapiens
YSDCRPGLV

SEQ ID NO: 519385 - protein, 9 aa, Homo Sapiens
ELAAATSQV

SEQ ID NO: 519386 - protein, 9 aa, Homo Sapiens
KSEPLPPFN

SEQ ID NO: 519387 - protein, 9 aa, Homo Sapiens
GAKGIRTML

SEQ ID NO: 519388 - protein, 9 aa, Homo Sapiens
RNAQAAAIC

SEQ ID NO: 519389 - protein, 9 aa, Homo Sapiens
QKNILTIKA

SEQ ID NO: 519390 - protein, 9 aa, Homo Sapiens
VDKRMSYIV

SEQ ID NO: 519391 - protein, 9 aa, Homo Sapiens
PISPGSTEI

SEQ ID NO: 519392 - protein, 9 aa, Homo Sapiens
EGMFELIPD

SEQ ID NO: 519393 - protein, 9 aa, Homo Sapiens
FVPPLPALD

SEQ ID NO: 519394 - protein, 9 aa, Homo Sapiens
GVSWDFYSI

SEQ ID NO: 519395 - protein, 9 aa, Homo Sapiens
KTYAESRNA

SEQ ID NO: 519396 - protein, 9 aa, Homo Sapiens
DETLKLVDR

SEQ ID NO: 519397 - protein, 9 aa, Homo Sapiens
SGDHDDFAM

SEQ ID NO: 519398 - protein, 9 aa, Homo Sapiens
SDLCDHTTI

SEQ ID NO: 519399 - protein, 9 aa, Homo Sapiens
DFWKCGSQI

SEQ ID NO: 519400 - protein, 9 aa, Homo Sapiens
LPRRLCAAG

SEQ ID NO: 519401 - protein, 9 aa, Homo Sapiens
EGTCLSQAS

SEQ ID NO: 519402 - protein, 9 aa, Homo Sapiens
ISECPVPSL

SEQ ID NO: 519403 - protein, 9 aa, Homo Sapiens
VCSVSVERL

SEQ ID NO: 519404 - protein, 9 aa, Homo Sapiens
MLFVCLACS

SEQ ID NO: 519405 - protein, 9 aa, Homo Sapiens
DHIGRSLLE

SEQ ID NO: 519406 - protein, 9 aa, Homo Sapiens
KNPVVHKEI

SEQ ID NO: 519407 - protein, 9 aa, Homo Sapiens
ADVNQSSPI

SEQ ID NO: 519408 - protein, 9 aa, Homo Sapiens
IQAQNFSLH

SEQ ID NO: 519409 - protein, 9 aa, Homo Sapiens
KIRSTNLED

SEQ ID NO: 519410 - protein, 9 aa, Homo Sapiens
AAPPLPGWS

SEQ ID NO: 519411 - protein, 9 aa, Homo Sapiens
EIGCITIAW

SEQ ID NO: 519412 - protein, 9 aa, Homo Sapiens
VLSSEALVR

SEQ ID NO: 519413 - protein, 9 aa, Homo Sapiens
DCFNKAAPI

SEQ ID NO: 519414 - protein, 9 aa, Homo Sapiens
EKTEDACVP

SEQ ID NO: 519415 - protein, 9 aa, Homo Sapiens
KNKFMSVTE

SEQ ID NO: 519416 - protein, 9 aa, Homo Sapiens
LKASKGESG

SEQ ID NO: 519417 - protein, 9 aa, Homo Sapiens
VSDKRHQGG

SEQ ID NO: 519418 - protein, 9 aa, Homo Sapiens
MSADLHLAS

SEQ ID NO: 519419 - protein, 9 aa, Homo Sapiens
ITLTLLCFL

SEQ ID NO: 519420 - protein, 9 aa, Homo Sapiens
EVKYQGYCG

SEQ ID NO: 519421 - protein, 9 aa, Homo Sapiens
GNLVPITLT

SEQ ID NO: 519422 - protein, 9 aa, Homo Sapiens
KKVEQCKFC

SEQ ID NO: 519423 - protein, 9 aa, Homo Sapiens
VLTWFFPVI

SEQ ID NO: 519424 - protein, 9 aa, Homo Sapiens
RDVGPDRVA

SEQ ID NO: 519425 - protein, 9 aa, Homo Sapiens
HAEAGSLHL

SEQ ID NO: 519426 - protein, 9 aa, Homo Sapiens
TLHLEYFKE

SEQ ID NO: 519427 - protein, 9 aa, Homo Sapiens
RKREGLHSV

SEQ ID NO: 519428 - protein, 9 aa, Homo Sapiens
IWGLSLLFC

SEQ ID NO: 519429 - protein, 9 aa, Homo Sapiens
DLSQPTTPS

SEQ ID NO: 519430 - protein, 9 aa, Homo Sapiens
VPITLTLLC

SEQ ID NO: 519431 - protein, 9 aa, Homo Sapiens
RVGSFQCQC

SEQ ID NO: 519432 - protein, 9 aa, Homo Sapiens
FLSTIALIN

SEQ ID NO: 519433 - protein, 9 aa, Homo Sapiens
AADGAKLEE

SEQ ID NO: 519434 - protein, 9 aa, Homo Sapiens
SPRNVLLQT

SEQ ID NO: 519435 - protein, 9 aa, Homo Sapiens
LLRRLKIHG

SEQ ID NO: 519436 - protein, 9 aa, Homo Sapiens
QGNKYSLPA

SEQ ID NO: 519437 - protein, 9 aa, Homo Sapiens
TVTALVNGN

SEQ ID NO: 519438 - protein, 9 aa, Homo Sapiens
KYLKTQKLT

SEQ ID NO: 519439 - protein, 9 aa, Homo Sapiens
AKLEESSKN

SEQ ID NO: 519440 - protein, 9 aa, Homo Sapiens
HLEYFKEAM

SEQ ID NO: 519441 - protein, 9 aa, Homo Sapiens
KQKEEEQVR

SEQ ID NO: 519442 - protein, 9 aa, Homo Sapiens
TLVYSEGAA

SEQ ID NO: 519443 - protein, 9 aa, Homo Sapiens
LSKVQRMQL

SEQ ID NO: 519444 - protein, 9 aa, Homo Sapiens
SRLMSTSMK

SEQ ID NO: 519445 - protein, 9 aa, Homo Sapiens
SNLVQEQRN

SEQ ID NO: 519446 - protein, 9 aa, Homo Sapiens
KVLTPPHDV

SEQ ID NO: 519447 - protein, 9 aa, Homo Sapiens
QGVGMYINP

SEQ ID NO: 519448 - protein, 9 aa, Homo Sapiens
KTGDVTVKP

SEQ ID NO: 519449 - protein, 9 aa, Homo Sapiens
GPSILNSNL

SEQ ID NO: 519450 - protein, 9 aa, Homo Sapiens
DKRHQGGQL

SEQ ID NO: 519451 - protein, 9 aa, Homo Sapiens
YNQKSQEVE

SEQ ID NO: 519452 - protein, 9 aa, Homo Sapiens
IMPEKKRLS

SEQ ID NO: 519453 - protein, 9 aa, Homo Sapiens
SRKVKFGPG

SEQ ID NO: 519454 - protein, 9 aa, Homo Sapiens
THAEAGSLH

SEQ ID NO: 519455 - protein, 9 aa, Homo Sapiens
PRKSHLFQD

SEQ ID NO: 519456 - protein, 9 aa, Homo Sapiens
VPRNHDLSQ

SEQ ID NO: 519457 - protein, 9 aa, Homo Sapiens
TGPGEAEPG

SEQ ID NO: 519458 - protein, 9 aa, Homo Sapiens
WNTNLVHKG

SEQ ID NO: 519459 - protein, 9 aa, Homo Sapiens
AFSSVSTLN

SEQ ID NO: 519460 - protein, 9 aa, Homo Sapiens
KKQKEEEQV

SEQ ID NO: 519461 - protein, 9 aa, Homo Sapiens
LEEEVQFST

SEQ ID NO: 519462 - protein, 9 aa, Homo Sapiens
APLTKVLTP

SEQ ID NO: 519463 - protein, 9 aa, Homo Sapiens
GGATGPGEA

SEQ ID NO: 519464 - protein, 9 aa, Homo Sapiens
HTSVFISVR

SEQ ID NO: 519465 - protein, 9 aa, Homo Sapiens
TFQPHSSIG

SEQ ID NO: 519466 - protein, 9 aa, Homo Sapiens
ADGAKLEES

SEQ ID NO: 519467 - protein, 9 aa, Homo Sapiens
RNGQCINRV

SEQ ID NO: 519468 - protein, 9 aa, Homo Sapiens
GPDRVASEW

SEQ ID NO: 519469 - protein, 9 aa, Homo Sapiens
KQTGTRWNL

SEQ ID NO: 519470 - protein, 9 aa, Homo Sapiens
LDLSYNAIE

SEQ ID NO: 519471 - protein, 9 aa, Homo Sapiens
PRNGEEVIF

SEQ ID NO: 519472 - protein, 9 aa, Homo Sapiens
VNYNQKSQE

SEQ ID NO: 519473 - protein, 9 aa, Homo Sapiens
TRWNLCWEL

SEQ ID NO: 519474 - protein, 9 aa, Homo Sapiens
EYFKEAMNY

SEQ ID NO: 519475 - protein, 9 aa, Homo Sapiens
ADLHLASSL

SEQ ID NO: 519476 - protein, 9 aa, Homo Sapiens
FDLSRVTFY

SEQ ID NO: 519477 - protein, 9 aa, Homo Sapiens
RETQYYDIL

SEQ ID NO: 519478 - protein, 9 aa, Homo Sapiens
IHTVTALVN

SEQ ID NO: 519479 - protein, 9 aa, Homo Sapiens
KVEQCKFCM

SEQ ID NO: 519480 - protein, 9 aa, Homo Sapiens
KGIRLHRRK

SEQ ID NO: 519481 - protein, 9 aa, Homo Sapiens
AVRHARKHL

SEQ ID NO: 519482 - protein, 9 aa, Homo Sapiens
CRNGQCINR

SEQ ID NO: 519483 - protein, 9 aa, Homo Sapiens
HKFDLSRVT

SEQ ID NO: 519484 - protein, 9 aa, Homo Sapiens
DDSHFFQRT

SEQ ID NO: 519485 - protein, 9 aa, Homo Sapiens
YGAKKYGPH

SEQ ID NO: 519486 - protein, 9 aa, Homo Sapiens
VTHAEAGSL

SEQ ID NO: 519487 - protein, 9 aa, Homo Sapiens
SFYNRSCPV

SEQ ID NO: 519488 - protein, 9 aa, Homo Sapiens
DLPAADGAK

SEQ ID NO: 519489 - protein, 9 aa, Homo Sapiens
QLSVLERDN

SEQ ID NO: 519490 - protein, 9 aa, Homo Sapiens
DAEVRVTGR

SEQ ID NO: 519491 - protein, 9 aa, Homo Sapiens
EKKRLSAGR

SEQ ID NO: 519492 - protein, 9 aa, Homo Sapiens
HARKHLSQA

SEQ ID NO: 519493 - protein, 9 aa, Homo Sapiens
SEGAALPRP

SEQ ID NO: 519494 - protein, 9 aa, Homo Sapiens
KGESGGSMH

SEQ ID NO: 519495 - protein, 9 aa, Homo Sapiens
ITFYKYLKT

SEQ ID NO: 519496 - protein, 9 aa, Homo Sapiens
FRQGVGMYI

SEQ ID NO: 519497 - protein, 9 aa, Homo Sapiens
NKQLSVLER

SEQ ID NO: 519498 - protein, 9 aa, Homo Sapiens
HNDFEEVAQ

SEQ ID NO: 519499 - protein, 9 aa, Homo Sapiens
TLKASKGES

SEQ ID NO: 519500 - protein, 9 aa, Homo Sapiens
LLQTTPQPS

SEQ ID NO: 519501 - protein, 9 aa, Homo Sapiens
PHLLEEEVQ

SEQ ID NO: 519502 - protein, 9 aa, Homo Sapiens
AFQEVVSDK

SEQ ID NO: 519503 - protein, 9 aa, Homo Sapiens
IVVTHAEAG

SEQ ID NO: 519504 - protein, 9 aa, Homo Sapiens
NLVPITLTL

SEQ ID NO: 519505 - protein, 9 aa, Homo Sapiens
RLRALDAEV

SEQ ID NO: 519506 - protein, 9 aa, Homo Sapiens
EFMCQVLDI

SEQ ID NO: 519507 - protein, 9 aa, Homo Sapiens
RKAVRTLLG

SEQ ID NO: 519508 - protein, 9 aa, Homo Sapiens
LISMDAEQR

SEQ ID NO: 519509 - protein, 9 aa, Homo Sapiens
GIRLHRRKQ

SEQ ID NO: 519510 - protein, 9 aa, Homo Sapiens
PSSQSLKKE

SEQ ID NO: 519511 - protein, 9 aa, Homo Sapiens
ESHSSEDEV

SEQ ID NO: 519512 - protein, 9 aa, Homo Sapiens
PSILNSNLA

SEQ ID NO: 519513 - protein, 9 aa, Homo Sapiens
EEDIKQTGT

SEQ ID NO: 519514 - protein, 9 aa, Homo Sapiens
GGGATGPGE

SEQ ID NO: 519515 - protein, 9 aa, Homo Sapiens
IFKNYGAKK

SEQ ID NO: 519516 - protein, 9 aa, Homo Sapiens
SQSLKKEML

SEQ ID NO: 519517 - protein, 9 aa, Homo Sapiens
RHARKHLSQ

SEQ ID NO: 519518 - protein, 9 aa, Homo Sapiens
NTFLSTIAL

SEQ ID NO: 519519 - protein, 9 aa, Homo Sapiens
QEVVSDKRH

SEQ ID NO: 519520 - protein, 9 aa, Homo Sapiens
VKYQGYCGA

SEQ ID NO: 519521 - protein, 9 aa, Homo Sapiens
AKPVPENNA

SEQ ID NO: 519522 - protein, 9 aa, Homo Sapiens
NKFMSVTER

SEQ ID NO: 519523 - protein, 9 aa, Homo Sapiens
TTPQPSRLM

SEQ ID NO: 519524 - protein, 9 aa, Homo Sapiens
RGKGIRLHR

SEQ ID NO: 519525 - protein, 9 aa, Homo Sapiens
DIKQTGTRW

SEQ ID NO: 519526 - protein, 9 aa, Homo Sapiens
HDLSQPTTP

SEQ ID NO: 519527 - protein, 9 aa, Homo Sapiens
KIMPEKKRL

SEQ ID NO: 519528 - protein, 9 aa, Homo Sapiens
RWNLCWELW

SEQ ID NO: 519529 - protein, 9 aa, Homo Sapiens
CGPYLSYYR

SEQ ID NO: 519530 - protein, 9 aa, Homo Sapiens
HRAHANKQA

SEQ ID NO: 519531 - protein, 9 aa, Homo Sapiens
RELDLSYNA

SEQ ID NO: 519532 - protein, 9 aa, Homo Sapiens
YNRSCPVHI

SEQ ID NO: 519533 - protein, 9 aa, Homo Sapiens
QSLKKEMLP

SEQ ID NO: 519534 - protein, 9 aa, Homo Sapiens
GLQHRVMAK

SEQ ID NO: 519535 - protein, 9 aa, Homo Sapiens
RNHDLSQPT

SEQ ID NO: 519536 - protein, 9 aa, Homo Sapiens
LFCGPYLSY

SEQ ID NO: 519537 - protein, 9 aa, Homo Sapiens
ARLRALDAE

SEQ ID NO: 519538 - protein, 9 aa, Homo Sapiens
SEHIKKNFA

SEQ ID NO: 519539 - protein, 9 aa, Homo Sapiens
AALPRPLER

SEQ ID NO: 519540 - protein, 9 aa, Homo Sapiens
VVTHAEAGS

SEQ ID NO: 519541 - protein, 9 aa, Homo Sapiens
ALDAEVRVT

SEQ ID NO: 519542 - protein, 9 aa, Homo Sapiens
CINRVGSFQ

SEQ ID NO: 519543 - protein, 9 aa, Homo Sapiens
AYVPDLTQQ

SEQ ID NO: 519544 - protein, 9 aa, Homo Sapiens
VLMYDQIFM

SEQ ID NO: 519545 - protein, 9 aa, Homo Sapiens
EKPRHKMVR

SEQ ID NO: 519546 - protein, 9 aa, Homo Sapiens
VKFGPGVIE

SEQ ID NO: 519547 - protein, 9 aa, Homo Sapiens
GTSPRNVLL

SEQ ID NO: 519548 - protein, 9 aa, Homo Sapiens
KKQPFCDDS

SEQ ID NO: 519549 - protein, 9 aa, Homo Sapiens
RLKIHGGPP

SEQ ID NO: 519550 - protein, 9 aa, Homo Sapiens
ESCIKVAVL

SEQ ID NO: 519551 - protein, 9 aa, Homo Sapiens
PRHKMVRET

SEQ ID NO: 519552 - protein, 9 aa, Homo Sapiens
LQKRHNDFE

SEQ ID NO: 519553 - protein, 9 aa, Homo Sapiens
RPSSQSLKK

SEQ ID NO: 519554 - protein, 9 aa, Homo Sapiens
LMYDQIFMT

SEQ ID NO: 519555 - protein, 9 aa, Homo Sapiens
QLEGAPASG

SEQ ID NO: 519556 - protein, 9 aa, Homo Sapiens
HSSEDEVFP

SEQ ID NO: 519557 - protein, 9 aa, Homo Sapiens
NLVQEQRNV

SEQ ID NO: 519558 - protein, 9 aa, Homo Sapiens
FDKENENDG

SEQ ID NO: 519559 - protein, 9 aa, Homo Sapiens
IYAKPVPEN

SEQ ID NO: 519560 - protein, 9 aa, Homo Sapiens
YSEGAALPR

SEQ ID NO: 519561 - protein, 9 aa, Homo Sapiens
VLLRRLKIH

SEQ ID NO: 519562 - protein, 9 aa, Homo Sapiens
WMSADLHLA

SEQ ID NO: 519563 - protein, 9 aa, Homo Sapiens
PIIEFMCQV

SEQ ID NO: 519564 - protein, 9 aa, Homo Sapiens
SSQSLKKEM

SEQ ID NO: 519565 - protein, 9 aa, Homo Sapiens
KSNKDSLRK

SEQ ID NO: 519566 - protein, 9 aa, Homo Sapiens
SEMGDDCFN

SEQ ID NO: 519567 - protein, 9 aa, Homo Sapiens
PSRLMSTSM

SEQ ID NO: 519568 - protein, 9 aa, Homo Sapiens
ANKQAEYEF

SEQ ID NO: 519569 - protein, 9 aa, Homo Sapiens
YVPSSRKVK

SEQ ID NO: 519570 - protein, 9 aa, Homo Sapiens
QGYCGACWA

SEQ ID NO: 519571 - protein, 9 aa, Homo Sapiens
VTFYAAEII

SEQ ID NO: 519572 - protein, 9 aa, Homo Sapiens
KNYGAKKYG

SEQ ID NO: 519573 - protein, 9 aa, Homo Sapiens
NKQAEYEFI

SEQ ID NO: 519574 - protein, 9 aa, Homo Sapiens
NDFEEVAQN

SEQ ID NO: 519575 - protein, 9 aa, Homo Sapiens
CDDSHFFQR

SEQ ID NO: 519576 - protein, 9 aa, Homo Sapiens
LQHRVMAKT

SEQ ID NO: 519577 - protein, 9 aa, Homo Sapiens
VASEWLLRC

SEQ ID NO: 519578 - protein, 9 aa, Homo Sapiens
PITLTLLCF

SEQ ID NO: 519579 - protein, 9 aa, Homo Sapiens
GLHSVAFKS

SEQ ID NO: 519580 - protein, 9 aa, Homo Sapiens
SYNAIEAIG

SEQ ID NO: 519581 - protein, 9 aa, Homo Sapiens
LEYFKEAMN

SEQ ID NO: 519582 - protein, 9 aa, Homo Sapiens
LSYNAIEAI

SEQ ID NO: 519583 - protein, 9 aa, Homo Sapiens
KSEQGNKYS

SEQ ID NO: 519584 - protein, 9 aa, Homo Sapiens
IKSEQGNKY

SEQ ID NO: 519585 - protein, 9 aa, Homo Sapiens
KANKQLSVL

SEQ ID NO: 519586 - protein, 9 aa, Homo Sapiens
EECGKAFSS

SEQ ID NO: 519587 - protein, 9 aa, Homo Sapiens
SPGVQPTCC

SEQ ID NO: 519588 - protein, 9 aa, Homo Sapiens
NRVGSFQCQ

SEQ ID NO: 519589 - protein, 9 aa, Homo Sapiens
DAEPFDKEN

SEQ ID NO: 519590 - protein, 9 aa, Homo Sapiens
AGAAYVPDL

SEQ ID NO: 519591 - protein, 9 aa, Homo Sapiens
NKTRPRNGE

SEQ ID NO: 519592 - protein, 9 aa, Homo Sapiens
YFKEAMNYL

SEQ ID NO: 519593 - protein, 9 aa, Homo Sapiens
RHKMVRETQ

SEQ ID NO: 519594 - protein, 9 aa, Homo Sapiens
TLGNLVPIT

SEQ ID NO: 519595 - protein, 9 aa, Homo Sapiens
HSSIGCRKK

SEQ ID NO: 519596 - protein, 9 aa, Homo Sapiens
GLLQYSEEN

SEQ ID NO: 519597 - protein, 9 aa, Homo Sapiens
AAYVPDLTQ

SEQ ID NO: 519598 - protein, 9 aa, Homo Sapiens
SAGSAVNKL

SEQ ID NO: 519599 - protein, 9 aa, Homo Sapiens
ARRTTIYAK

SEQ ID NO: 519600 - protein, 9 aa, Homo Sapiens
ESLSKVQRM

SEQ ID NO: 519601 - protein, 9 aa, Homo Sapiens
GVQPTCCVT

SEQ ID NO: 519602 - protein, 9 aa, Homo Sapiens
WNLCWELWN

SEQ ID NO: 519603 - protein, 9 aa, Homo Sapiens
LPAADGAKL

SEQ ID NO: 519604 - protein, 9 aa, Homo Sapiens
KVTFQPHSS

SEQ ID NO: 519605 - protein, 9 aa, Homo Sapiens
MTVPRKSHL

SEQ ID NO: 519606 - protein, 9 aa, Homo Sapiens
LRLAPLTKV

SEQ ID NO: 519607 - protein, 9 aa, Homo Sapiens
VTFQPHSSI

SEQ ID NO: 519608 - protein, 9 aa, Homo Sapiens
LRRLKIHGG

SEQ ID NO: 519609 - protein, 9 aa, Homo Sapiens
QIFMTEDPS

SEQ ID NO: 519610 - protein, 9 aa, Homo Sapiens
LGNLVPITL

SEQ ID NO: 519611 - protein, 9 aa, Homo Sapiens
NIHQSVSEH

SEQ ID NO: 519612 - protein, 9 aa, Homo Sapiens
ELRLAPLTK

SEQ ID NO: 519613 - protein, 9 aa, Homo Sapiens
NSNLANLGA

SEQ ID NO: 519614 - protein, 9 aa, Homo Sapiens
GKGIRLHRR

SEQ ID NO: 519615 - protein, 9 aa, Homo Sapiens
KLPESHSSE

SEQ ID NO: 519616 - protein, 9 aa, Homo Sapiens
RKHLSQAEG

SEQ ID NO: 519617 - protein, 9 aa, Homo Sapiens
KRHNDFEEV

SEQ ID NO: 519618 - protein, 9 aa, Homo Sapiens
REGLHSVAF

SEQ ID NO: 519619 - protein, 9 aa, Homo Sapiens
FFVLKHEES

SEQ ID NO: 519620 - protein, 9 aa, Homo Sapiens
SDLISMDAE

SEQ ID NO: 519621 - protein, 9 aa, Homo Sapiens
KAFSSVSTL

SEQ ID NO: 519622 - protein, 9 aa, Homo Sapiens
CGKAFSSVS

SEQ ID NO: 519623 - protein, 9 aa, Homo Sapiens
LAKCRPITV

SEQ ID NO: 519624 - protein, 9 aa, Homo Sapiens
GFTFDRVSA

SEQ ID NO: 519625 - protein, 9 aa, Homo Sapiens
LLQYSEENC

SEQ ID NO: 519626 - protein, 9 aa, Homo Sapiens
FVLKHEESR

SEQ ID NO: 519627 - protein, 9 aa, Homo Sapiens
DEPELLFLE

SEQ ID NO: 519628 - protein, 9 aa, Homo Sapiens
GTPGALEQK

SEQ ID NO: 519629 - protein, 9 aa, Homo Sapiens
QPHSSIGCR

SEQ ID NO: 519630 - protein, 9 aa, Homo Sapiens
PLNLALGFT

SEQ ID NO: 519631 - protein, 9 aa, Homo Sapiens
LLFLEGPST

SEQ ID NO: 519632 - protein, 9 aa, Homo Sapiens
RTTIYAKPV

SEQ ID NO: 519633 - protein, 9 aa, Homo Sapiens
EHLTEEEDI

SEQ ID NO: 519634 - protein, 9 aa, Homo Sapiens
TSPRNVLLQ

SEQ ID NO: 519635 - protein, 9 aa, Homo Sapiens
GFSGMHTSV

SEQ ID NO: 519636 - protein, 9 aa, Homo Sapiens
SHLFQDDLY

SEQ ID NO: 519637 - protein, 9 aa, Homo Sapiens
WELWNTNLV

SEQ ID NO: 519638 - protein, 9 aa, Homo Sapiens
ALGFTFDRV

SEQ ID NO: 519639 - protein, 9 aa, Homo Sapiens
GMSRGKGIR

SEQ ID NO: 519640 - protein, 9 aa, Homo Sapiens
MVRETQYYD

SEQ ID NO: 519641 - protein, 9 aa, Homo Sapiens
GAKKYGPHS

SEQ ID NO: 519642 - protein, 9 aa, Homo Sapiens
KHLSQAEGS

SEQ ID NO: 519643 - protein, 9 aa, Homo Sapiens
QTFRQGVGM

SEQ ID NO: 519644 - protein, 9 aa, Homo Sapiens
MYDQIFMTE

SEQ ID NO: 519645 - protein, 9 aa, Homo Sapiens
PRNVLLQTT

SEQ ID NO: 519646 - protein, 9 aa, Homo Sapiens
PDGFEKTED

SEQ ID NO: 519647 - protein, 9 aa, Homo Sapiens
PITVRSGDA

SEQ ID NO: 519648 - protein, 9 aa, Homo Sapiens
DGFEKTEDA

SEQ ID NO: 519649 - protein, 9 aa, Homo Sapiens
ATQAGSAGS

SEQ ID NO: 519650 - protein, 9 aa, Homo Sapiens
GAKLEESSK

SEQ ID NO: 519651 - protein, 9 aa, Homo Sapiens
LEQKTSGLG

SEQ ID NO: 519652 - protein, 9 aa, Homo Sapiens
AFASSKVLV

SEQ ID NO: 519653 - protein, 9 aa, Homo Sapiens
PGALEQKTS

SEQ ID NO: 519654 - protein, 9 aa, Homo Sapiens
QCINRVGSF

SEQ ID NO: 519655 - protein, 9 aa, Homo Sapiens
MSRGKGIRL

SEQ ID NO: 519656 - protein, 9 aa, Homo Sapiens
ELWNTNLVH

SEQ ID NO: 519657 - protein, 9 aa, Homo Sapiens
LEGPSTSRW

SEQ ID NO: 519658 - protein, 9 aa, Homo Sapiens
ASGPAASPQ

SEQ ID NO: 519659 - protein, 9 aa, Homo Sapiens
SKSVDQKNK

SEQ ID NO: 519660 - protein, 9 aa, Homo Sapiens
AKIDACKTG

SEQ ID NO: 519661 - protein, 9 aa, Homo Sapiens
NGIVVTHAE

SEQ ID NO: 519662 - protein, 9 aa, Homo Sapiens
KTEDACVPP

SEQ ID NO: 519663 - protein, 9 aa, Homo Sapiens
LSLLFCGPY

SEQ ID NO: 519664 - protein, 9 aa, Homo Sapiens
DSHFFQRTG

SEQ ID NO: 519665 - protein, 9 aa, Homo Sapiens
FCDDSHFFQ

SEQ ID NO: 519666 - protein, 9 aa, Homo Sapiens
YKYLKTQKL

SEQ ID NO: 519667 - protein, 9 aa, Homo Sapiens
LLEEEVQFS

SEQ ID NO: 519668 - protein, 9 aa, Homo Sapiens
LEKKKQKEE

SEQ ID NO: 519669 - protein, 9 aa, Homo Sapiens
SNKDSLRKA

SEQ ID NO: 519670 - protein, 9 aa, Homo Sapiens
HLLEEEVQF

SEQ ID NO: 519671 - protein, 9 aa, Homo Sapiens
KREGLHSVA

SEQ ID NO: 519672 - protein, 9 aa, Homo Sapiens
VVLMYDQIF

SEQ ID NO: 519673 - protein, 9 aa, Homo Sapiens
MPEKKRLSA

SEQ ID NO: 519674 - protein, 9 aa, Homo Sapiens
MAKTAPDVL

SEQ ID NO: 519675 - protein, 9 aa, Homo Sapiens
SPLNLALGF

SEQ ID NO: 519676 - protein, 9 aa, Homo Sapiens
KGTSPRNVL

SEQ ID NO: 519677 - protein, 9 aa, Homo Sapiens
KAVRTLLGY

SEQ ID NO: 519678 - protein, 9 aa, Homo Sapiens
SKVQRMQLD

SEQ ID NO: 519679 - protein, 9 aa, Homo Sapiens
QVLDIQNIN

SEQ ID NO: 519680 - protein, 9 aa, Homo Sapiens
INTFLSTIA

SEQ ID NO: 519681 - protein, 9 aa, Homo Sapiens
KCLLLIEGG

SEQ ID NO: 519682 - protein, 9 aa, Homo Sapiens
GTRWNLCWE

SEQ ID NO: 519683 - protein, 9 aa, Homo Sapiens
VPSSRKVKF

SEQ ID NO: 519684 - protein, 9 aa, Homo Sapiens
EQVLLRRLK

SEQ ID NO: 519685 - protein, 9 aa, Homo Sapiens
TIALINRLN

SEQ ID NO: 519686 - protein, 9 aa, Homo Sapiens
QCKFCMVHL

SEQ ID NO: 519687 - protein, 9 aa, Homo Sapiens
VTEVKYQGY

SEQ ID NO: 519688 - protein, 9 aa, Homo Sapiens
KPVPENNAL

SEQ ID NO: 519689 - protein, 9 aa, Homo Sapiens
NHDLSQPTT

SEQ ID NO: 519690 - protein, 9 aa, Homo Sapiens
PGVQPTCCV

SEQ ID NO: 519691 - protein, 9 aa, Homo Sapiens
NKCLLLIEG

SEQ ID NO: 519692 - protein, 9 aa, Homo Sapiens
ANKQLSVLE

SEQ ID NO: 519693 - protein, 9 aa, Homo Sapiens
VCPDGFEKT

SEQ ID NO: 519694 - protein, 9 aa, Homo Sapiens
LALGFTFDR

SEQ ID NO: 519695 - protein, 9 aa, Homo Sapiens
NCAFEEEIR

SEQ ID NO: 519696 - protein, 9 aa, Homo Sapiens
EGDAEPFDK

SEQ ID NO: 519697 - protein, 9 aa, Homo Sapiens
EQGNKYSLP

SEQ ID NO: 519698 - protein, 9 aa, Homo Sapiens
RVAFASSKV

SEQ ID NO: 519699 - protein, 9 aa, Homo Sapiens
KIDACKTGD

SEQ ID NO: 519700 - protein, 9 aa, Homo Sapiens
IIEFMCQVL

SEQ ID NO: 519701 - protein, 9 aa, Homo Sapiens
LSEMGDDCF

SEQ ID NO: 519702 - protein, 9 aa, Homo Sapiens
KFGPGVIEQ

SEQ ID NO: 519703 - protein, 9 aa, Homo Sapiens
MSTSMKSLI

SEQ ID NO: 519704 - protein, 9 aa, Homo Sapiens
QPTCCVTGG

SEQ ID NO: 519705 - protein, 9 aa, Homo Sapiens
SGPAASPQT

SEQ ID NO: 519706 - protein, 9 aa, Homo Sapiens
DGSDLISMD

SEQ ID NO: 519707 - protein, 9 aa, Homo Sapiens
LDKKVEQCK

SEQ ID NO: 519708 - protein, 9 aa, Homo Sapiens
KRHQGGQLL

SEQ ID NO: 519709 - protein, 9 aa, Homo Sapiens
LWNTNLVHK

SEQ ID NO: 519710 - protein, 9 aa, Homo Sapiens
EHIKKNFAK

SEQ ID NO: 519711 - protein, 9 aa, Homo Sapiens
GDAEPFDKE

SEQ ID NO: 519712 - protein, 9 aa, Homo Sapiens
DQIFMTEDP

SEQ ID NO: 519713 - protein, 9 aa, Homo Sapiens
NLCWELWNT

SEQ ID NO: 519714 - protein, 9 aa, Homo Sapiens
EVVSDKRHQ

SEQ ID NO: 519715 - protein, 9 aa, Homo Sapiens
RALQKRHND

SEQ ID NO: 519716 - protein, 9 aa, Homo Sapiens
AGSAGSAVN

SEQ ID NO: 519717 - protein, 9 aa, Homo Sapiens
EAEPGEDTA

SEQ ID NO: 519718 - protein, 9 aa, Homo Sapiens
DSTWMSADL

SEQ ID NO: 519719 - protein, 9 aa, Homo Sapiens
VDQKNKFMS

SEQ ID NO: 519720 - protein, 9 aa, Homo Sapiens
LFLEGPSTS

SEQ ID NO: 519721 - protein, 9 aa, Homo Sapiens
HKMVRETQY

SEQ ID NO: 519722 - protein, 9 aa, Homo Sapiens
LVPITLTLL

SEQ ID NO: 519723 - protein, 9 aa, Homo Sapiens
SKVLVVLIS

SEQ ID NO: 519724 - protein, 9 aa, Homo Sapiens
QPIIEFMCQ

SEQ ID NO: 519725 - protein, 9 aa, Homo Sapiens
VAFASSKVL

SEQ ID NO: 519726 - protein, 9 aa, Homo Sapiens
ELAVNYNQK

SEQ ID NO: 519727 - protein, 9 aa, Homo Sapiens
GAPASGPAA

SEQ ID NO: 519728 - protein, 9 aa, Homo Sapiens
TEHLTEEED

SEQ ID NO: 519729 - protein, 9 aa, Homo Sapiens
TQAGSAGSA

SEQ ID NO: 519730 - protein, 9 aa, Homo Sapiens
LKHEESRYL

SEQ ID NO: 519731 - protein, 9 aa, Homo Sapiens
AKKYGPHSV

SEQ ID NO: 519732 - protein, 9 aa, Homo Sapiens
LHLEYFKEA

SEQ ID NO: 519733 - protein, 9 aa, Homo Sapiens
PVLTWFFPV

SEQ ID NO: 519734 - protein, 9 aa, Homo Sapiens
ALPRPLERP

SEQ ID NO: 519735 - protein, 9 aa, Homo Sapiens
LKIMPEKKR

SEQ ID NO: 519736 - protein, 9 aa, Homo Sapiens
DSEGDAEPF

SEQ ID NO: 519737 - protein, 9 aa, Homo Sapiens
LEELAVNYN

SEQ ID NO: 519738 - protein, 9 aa, Homo Sapiens
IEIKKSNLV

SEQ ID NO: 519739 - protein, 9 aa, Homo Sapiens
DHIHTVTAL

SEQ ID NO: 519740 - protein, 9 aa, Homo Sapiens
KDSLRKAVR

SEQ ID NO: 519741 - protein, 9 aa, Homo Sapiens
GIVVTHAEA

SEQ ID NO: 519742 - protein, 9 aa, Homo Sapiens
GSDLISMDA

SEQ ID NO: 519743 - protein, 9 aa, Homo Sapiens
IEHGIVTKW

SEQ ID NO: 519744 - protein, 9 aa, Homo Sapiens
GPGEAEPGE

SEQ ID NO: 519745 - protein, 9 aa, Homo Sapiens
TVPRKSHLF

SEQ ID NO: 519746 - protein, 9 aa, Homo Sapiens
MGDDCFNKA

SEQ ID NO: 519747 - protein, 9 aa, Homo Sapiens
FTFDRVSAF

SEQ ID NO: 519748 - protein, 9 aa, Homo Sapiens
LRKAVRTLL

SEQ ID NO: 519749 - protein, 9 aa, Homo Sapiens
FYKYLKTQK

SEQ ID NO: 519750 - protein, 9 aa, Homo Sapiens
EMGDDCFNK

SEQ ID NO: 519751 - protein, 9 aa, Homo Sapiens
CKTGDVTVK

SEQ ID NO: 519752 - protein, 9 aa, Homo Sapiens
EEITFYKYL

SEQ ID NO: 519753 - protein, 9 aa, Homo Sapiens
SVAFKSYKP

SEQ ID NO: 519754 - protein, 9 aa, Homo Sapiens
KMVRETQYY

SEQ ID NO: 519755 - protein, 9 aa, Homo Sapiens
TVRSGDAFH

SEQ ID NO: 519756 - protein, 9 aa, Homo Sapiens
ERVPHLGFN

SEQ ID NO: 519757 - protein, 9 aa, Homo Sapiens
DLSYNAIEA

SEQ ID NO: 519758 - protein, 9 aa, Homo Sapiens
FMCQVLDIQ

SEQ ID NO: 519759 - protein, 9 aa, Homo Sapiens
RALDAEVRV

SEQ ID NO: 519760 - protein, 9 aa, Homo Sapiens
TPQPSRLMS

SEQ ID NO: 519761 - protein, 9 aa, Homo Sapiens
ALEQKTSGL

SEQ ID NO: 519762 - protein, 9 aa, Homo Sapiens
ADGSDLISM

SEQ ID NO: 519763 - protein, 9 aa, Homo Sapiens
GQCINRVGS

SEQ ID NO: 519764 - protein, 9 aa, Homo Sapiens
KASKGESGG

SEQ ID NO: 519765 - protein, 9 aa, Homo Sapiens
IKLPESHSS

SEQ ID NO: 519766 - protein, 9 aa, Homo Sapiens
TWMSADLHL

SEQ ID NO: 519767 - protein, 9 aa, Homo Sapiens
LESSPGVQP

SEQ ID NO: 519768 - protein, 9 aa, Homo Sapiens
FSGMHTSVF

SEQ ID NO: 519769 - protein, 9 aa, Homo Sapiens
INRVGSFQC

SEQ ID NO: 519770 - protein, 9 aa, Homo Sapiens
PQNGIVVTH

SEQ ID NO: 519771 - protein, 9 aa, Homo Sapiens
GFEKTEDAC

SEQ ID NO: 519772 - protein, 9 aa, Homo Sapiens
NTNLVHKGT

SEQ ID NO: 519773 - protein, 9 aa, Homo Sapiens
ATGPGEAEP

SEQ ID NO: 519774 - protein, 9 aa, Homo Sapiens
TGTRWNLCW

SEQ ID NO: 519775 - protein, 9 aa, Homo Sapiens
EEEDIKQTG

SEQ ID NO: 519776 - protein, 9 aa, Homo Sapiens
PVIGHMGIC

SEQ ID NO: 519777 - protein, 9 aa, Homo Sapiens
SHSSEDEVF

SEQ ID NO: 519778 - protein, 9 aa, Homo Sapiens
EEEVQFSTD

SEQ ID NO: 519779 - protein, 9 aa, Homo Sapiens
FCGPYLSYY

SEQ ID NO: 519780 - protein, 9 aa, Homo Sapiens
VGPDRVASE

SEQ ID NO: 519781 - protein, 9 aa, Homo Sapiens
YDQIFMTED

SEQ ID NO: 519782 - protein, 9 aa, Homo Sapiens
SLLFCGPYL

SEQ ID NO: 519783 - protein, 9 aa, Homo Sapiens
QAGSAGSAV

SEQ ID NO: 519784 - protein, 9 aa, Homo Sapiens
RNVLLQTTP

SEQ ID NO: 519785 - protein, 9 aa, Homo Sapiens
EDIKQTGTR

SEQ ID NO: 519786 - protein, 9 aa, Homo Sapiens
GNTGFSGMH

SEQ ID NO: 519787 - protein, 9 aa, Homo Sapiens
LSQPTTPSQ

SEQ ID NO: 519788 - protein, 9 aa, Homo Sapiens
GEAEPGEDT

SEQ ID NO: 519789 - protein, 9 aa, Homo Sapiens
QKEEEQVRA

SEQ ID NO: 519790 - protein, 9 aa, Homo Sapiens
LTEEEDIKQ

SEQ ID NO: 519791 - protein, 9 aa, Homo Sapiens
IKQTGTRWN

SEQ ID NO: 519792 - protein, 9 aa, Homo Sapiens
LEGAPASGP

SEQ ID NO: 519793 - protein, 9 aa, Homo Sapiens
SCIKVAVLD

SEQ ID NO: 519794 - protein, 9 aa, Homo Sapiens
NLALGFTFD

SEQ ID NO: 519795 - protein, 9 aa, Homo Sapiens
SKGESGGSM

SEQ ID NO: 519796 - protein, 9 aa, Homo Sapiens
LTKVLTPPH

SEQ ID NO: 519797 - protein, 9 aa, Homo Sapiens
YQGYCGACW

SEQ ID NO: 519798 - protein, 9 aa, Homo Sapiens
LSKTSLVNK

SEQ ID NO: 519799 - protein, 9 aa, Homo Sapiens
KQLSVLERD

SEQ ID NO: 519800 - protein, 9 aa, Homo Sapiens
RVPRNHDLS

SEQ ID NO: 519801 - protein, 9 aa, Homo Sapiens
CSFYNRSCP

SEQ ID NO: 519802 - protein, 9 aa, Homo Sapiens
KSHLFQDDL

SEQ ID NO: 519803 - protein, 9 aa, Homo Sapiens
TFRQGVGMY

SEQ ID NO: 519804 - protein, 9 aa, Homo Sapiens
NTGFSGMHT

SEQ ID NO: 519805 - protein, 9 aa, Homo Sapiens
CPVHIIATS

SEQ ID NO: 519806 - protein, 9 aa, Homo Sapiens
VAFKSYKPE

SEQ ID NO: 519807 - protein, 9 aa, Homo Sapiens
DGAKLEESS

SEQ ID NO: 519808 - protein, 9 aa, Homo Sapiens
LCWELWNTN

SEQ ID NO: 519809 - protein, 9 aa, Homo Sapiens
PQPSRLMST

SEQ ID NO: 519810 - protein, 9 aa, Homo Sapiens
EIKKSNLVQ

SEQ ID NO: 519811 - protein, 9 aa, Homo Sapiens
DVGPDRVAS

SEQ ID NO: 519812 - protein, 9 aa, Homo Sapiens
LDAEVRVTG

SEQ ID NO: 519813 - protein, 9 aa, Homo Sapiens
VMAKTAPDV

SEQ ID NO: 519814 - protein, 9 aa, Homo Sapiens
RRIKLPESH

SEQ ID NO: 519815 - protein, 9 aa, Homo Sapiens
EGAPASGPA

SEQ ID NO: 519816 - protein, 9 aa, Homo Sapiens
GVGMYINPA

SEQ ID NO: 519817 - protein, 9 aa, Homo Sapiens
PHSSIGCRK

SEQ ID NO: 519818 - protein, 9 aa, Homo Sapiens
NRSCPVHII

SEQ ID NO: 519819 - protein, 9 aa, Homo Sapiens
LSNKCLLLI

SEQ ID NO: 519820 - protein, 9 aa, Homo Sapiens
HEESRYLNN

SEQ ID NO: 519821 - protein, 9 aa, Homo Sapiens
LAPLTKVLT

SEQ ID NO: 519822 - protein, 9 aa, Homo Sapiens
SLRKAVRTL

SEQ ID NO: 519823 - protein, 9 aa, Homo Sapiens
NGILPLSNK

SEQ ID NO: 519824 - protein, 9 aa, Homo Sapiens
CPDGFEKTE

SEQ ID NO: 519825 - protein, 9 aa, Homo Sapiens
EEQVRATSQ

SEQ ID NO: 519826 - protein, 9 aa, Homo Sapiens
VVSDKRHQG

SEQ ID NO: 519827 - protein, 9 aa, Homo Sapiens
KAKIDACKT

SEQ ID NO: 519828 - protein, 9 aa, Homo Sapiens
RVTFYAAEI

SEQ ID NO: 519829 - protein, 9 aa, Homo Sapiens
KEEEQVRAT

SEQ ID NO: 519830 - protein, 9 aa, Homo Sapiens
ETLHLEYFK

SEQ ID NO: 519831 - protein, 9 aa, Homo Sapiens
QDHIHTVTA

SEQ ID NO: 519832 - protein, 9 aa, Homo Sapiens
PASGPAASP

SEQ ID NO: 519833 - protein, 9 aa, Homo Sapiens
KPRHKMVRE

SEQ ID NO: 519834 - protein, 9 aa, Homo Sapiens
LLFCGPYLS

SEQ ID NO: 519835 - protein, 9 aa, Homo Sapiens
SKVTFQPHS

SEQ ID NO: 519836 - protein, 9 aa, Homo Sapiens
KKKQKEEEQ

SEQ ID NO: 519837 - protein, 9 aa, Homo Sapiens
ITVRSGDAF

SEQ ID NO: 519838 - protein, 9 aa, Homo Sapiens
SAVNKLVPR

SEQ ID NO: 519839 - protein, 9 aa, Homo Sapiens
TRPRNGEEV

SEQ ID NO: 519840 - protein, 9 aa, Homo Sapiens
SRPSSQSLK

SEQ ID NO: 519841 - protein, 9 aa, Homo Sapiens
PSSRKVKFG

SEQ ID NO: 519842 - protein, 9 aa, Homo Sapiens
HKGTSPRNV

SEQ ID NO: 519843 - protein, 9 aa, Homo Sapiens
VIGHMGICT

SEQ ID NO: 519844 - protein, 9 aa, Homo Sapiens
LHLASSLSP

SEQ ID NO: 519845 - protein, 9 aa, Homo Sapiens
ELHRAHANK

SEQ ID NO: 519846 - protein, 9 aa, Homo Sapiens
GESCIKVAV

SEQ ID NO: 519847 - protein, 9 aa, Homo Sapiens
QPFCDDSHF

SEQ ID NO: 519848 - protein, 9 aa, Homo Sapiens
VQFSTDLID

SEQ ID NO: 519849 - protein, 9 aa, Homo Sapiens
KKSNLVQEQ

SEQ ID NO: 519850 - protein, 9 aa, Homo Sapiens
VHKGTSPRN

SEQ ID NO: 519851 - protein, 9 aa, Homo Sapiens
MQLKIMPEK

SEQ ID NO: 519852 - protein, 9 aa, Homo Sapiens
KHEESRYLN

SEQ ID NO: 519853 - protein, 9 aa, Homo Sapiens
EGLHSVAFK

SEQ ID NO: 519854 - protein, 9 aa, Homo Sapiens
GAALPRPLE

SEQ ID NO: 519855 - protein, 9 aa, Homo Sapiens
GNKYSLPAL

SEQ ID NO: 519856 - protein, 9 aa, Homo Sapiens
RKSHLFQDD

SEQ ID NO: 519857 - protein, 9 aa, Homo Sapiens
RSCPVHIIA

SEQ ID NO: 519858 - protein, 9 aa, Homo Sapiens
SVSEHIKKN

SEQ ID NO: 519859 - protein, 9 aa, Homo Sapiens
SRVTFYAAE

SEQ ID NO: 519860 - protein, 9 aa, Homo Sapiens
QTTPQPSRL

SEQ ID NO: 519861 - protein, 9 aa, Homo Sapiens
LRALDAEVR

SEQ ID NO: 519862 - protein, 9 aa, Homo Sapiens
SKKQPFCDD

SEQ ID NO: 519863 - protein, 9 aa, Homo Sapiens
VSEHIKKNF

SEQ ID NO: 519864 - protein, 9 aa, Homo Sapiens
LNLALGFTF

SEQ ID NO: 519865 - protein, 9 aa, Homo Sapiens
VEQCKFCMV

SEQ ID NO: 519866 - protein, 9 aa, Homo Sapiens
VTKWDDMEK

SEQ ID NO: 519867 - protein, 9 aa, Homo Sapiens
CVCPDGFEK

SEQ ID NO: 519868 - protein, 9 aa, Homo Sapiens
KYSLPALTP

SEQ ID NO: 519869 - protein, 9 aa, Homo Sapiens
MTLKASKGE

SEQ ID NO: 519870 - protein, 9 aa, Homo Sapiens
SILNSNLAN

SEQ ID NO: 519871 - protein, 9 aa, Homo Sapiens
SADLHLASS

SEQ ID NO: 519872 - protein, 9 aa, Homo Sapiens
QINTFLSTI

SEQ ID NO: 519873 - protein, 9 aa, Homo Sapiens
SSKVLVVLI

SEQ ID NO: 519874 - protein, 9 aa, Homo Sapiens
NKDSLRKAV

SEQ ID NO: 519875 - protein, 9 aa, Homo Sapiens
NVLLQTTPQ

SEQ ID NO: 519876 - protein, 9 aa, Homo Sapiens
QKTSGLGQE

SEQ ID NO: 519877 - protein, 9 aa, Homo Sapiens
MHTSVFISV

SEQ ID NO: 519878 - protein, 9 aa, Homo Sapiens
PSRPSSQSL

SEQ ID NO: 519879 - protein, 9 aa, Homo Sapiens
APASGPAAS

SEQ ID NO: 519880 - protein, 9 aa, Homo Sapiens
HLFQDDLYP

SEQ ID NO: 519881 - protein, 9 aa, Homo Sapiens
PDRVASEWL

SEQ ID NO: 519882 - protein, 9 aa, Homo Sapiens
LGFTFDRVS

SEQ ID NO: 519883 - protein, 9 aa, Homo Sapiens
TGDVTVKPS

SEQ ID NO: 519884 - protein, 9 aa, Homo Sapiens
EEVQFSTDL

SEQ ID NO: 519885 - protein, 9 aa, Homo Sapiens
IHVWNGESC

SEQ ID NO: 519886 - protein, 9 aa, Homo Sapiens
YNAIEAIGS

SEQ ID NO: 519887 - protein, 9 aa, Homo Sapiens
TNLVHKGTS

SEQ ID NO: 519888 - protein, 9 aa, Homo Sapiens
GDDCFNKAA

SEQ ID NO: 519889 - protein, 9 aa, Homo Sapiens
CRGMSRGKG

SEQ ID NO: 519890 - protein, 9 aa, Homo Sapiens
LPLSNKCLL

SEQ ID NO: 519891 - protein, 9 aa, Homo Sapiens
FPVIGHMGI

SEQ ID NO: 519892 - protein, 9 aa, Homo Sapiens
KVKFGPGVI

SEQ ID NO: 519893 - protein, 9 aa, Homo Sapiens
VPRKSHLFQ

SEQ ID NO: 519894 - protein, 9 aa, Homo Sapiens
ESSPGVQPT

SEQ ID NO: 519895 - protein, 9 aa, Homo Sapiens
LAVNYNQKS

SEQ ID NO: 519896 - protein, 9 aa, Homo Sapiens
DLHLASSLS

SEQ ID NO: 519897 - protein, 9 aa, Homo Sapiens
DLTQQFPLK

SEQ ID NO: 519898 - protein, 9 aa, Homo Sapiens
GALEQKTSG

SEQ ID NO: 519899 - protein, 9 aa, Homo Sapiens
YSEENCAFE

SEQ ID NO: 519900 - protein, 9 aa, Homo Sapiens
TEEEDIKQT

SEQ ID NO: 519901 - protein, 9 aa, Homo Sapiens
KSNLVQEQR

SEQ ID NO: 519902 - protein, 9 aa, Homo Sapiens
ILPLSNKCL

SEQ ID NO: 519903 - protein, 9 aa, Homo Sapiens
STWMSADLH

SEQ ID NO: 519904 - protein, 9 aa, Homo Sapiens
EVQFSTDLI

SEQ ID NO: 519905 - protein, 9 aa, Homo Sapiens
PAADGAKLE

SEQ ID NO: 519906 - protein, 9 aa, Homo Sapiens
EQKTSGLGQ

SEQ ID NO: 519907 - protein, 9 aa, Homo Sapiens
NKYSLPALT

SEQ ID NO: 519908 - protein, 9 aa, Homo Sapiens
CIKVAVLDG

SEQ ID NO: 519909 - protein, 9 aa, Homo Sapiens
ISMDAEQRG

SEQ ID NO: 519910 - protein, 9 aa, Homo Sapiens
EHGIVTKWD

SEQ ID NO: 519911 - protein, 9 aa, Homo Sapiens
SVDQKNKFM

SEQ ID NO: 519912 - protein, 9 aa, Homo Sapiens
ARALQKRHN

SEQ ID NO: 519913 - protein, 9 aa, Homo Sapiens
FLAKCRPIT

SEQ ID NO: 519914 - protein, 9 aa, Homo Sapiens
YCGACWAFS

SEQ ID NO: 519915 - protein, 9 aa, Homo Sapiens
ILSEMGDDC

SEQ ID NO: 519916 - protein, 9 aa, Homo Sapiens
VGTPGALEQ

SEQ ID NO: 519917 - protein, 9 aa, Homo Sapiens
SGMHTSVFI

SEQ ID NO: 519918 - protein, 9 aa, Homo Sapiens
EITFYKYLK

SEQ ID NO: 519919 - protein, 9 aa, Homo Sapiens
GIVTKWDDM

SEQ ID NO: 519920 - protein, 9 aa, Homo Sapiens
KVVLMYDQI

SEQ ID NO: 519921 - protein, 9 aa, Homo Sapiens
PESHSSEDE

SEQ ID NO: 519922 - protein, 9 aa, Homo Sapiens
DRWESLSKV

SEQ ID NO: 519923 - protein, 9 aa, Homo Sapiens
RIKLPESHS

SEQ ID NO: 519924 - protein, 9 aa, Homo Sapiens
LSRVTFYAA

SEQ ID NO: 519925 - protein, 9 aa, Homo Sapiens
SLKKEMLPP

SEQ ID NO: 519926 - protein, 9 aa, Homo Sapiens
PLSNKCLLL

SEQ ID NO: 519927 - protein, 9 aa, Homo Sapiens
LNSNLANLG

SEQ ID NO: 519928 - protein, 9 aa, Homo Sapiens
TIYAKPVPE

SEQ ID NO: 519929 - protein, 9 aa, Homo Sapiens
ALQKRHNDF

SEQ ID NO: 519930 - protein, 9 aa, Homo Sapiens
STIALINRL

SEQ ID NO: 519931 - protein, 9 aa, Homo Sapiens
VRETQYYDI

SEQ ID NO: 519932 - protein, 9 aa, Homo Sapiens
HANKQAEYE

SEQ ID NO: 519933 - protein, 9 aa, Homo Sapiens
PLTKVLTPP

SEQ ID NO: 519934 - protein, 9 aa, Homo Sapiens
GKAFSSVST

SEQ ID NO: 519935 - protein, 9 aa, Homo Sapiens
LVHKGTSPR

SEQ ID NO: 519936 - protein, 9 aa, Homo Sapiens
KIHGGPPQN

SEQ ID NO: 519937 - protein, 9 aa, Homo Sapiens
ASSKVLVVL

SEQ ID NO: 519938 - protein, 9 aa, Homo Sapiens
DFFVLKHEE

SEQ ID NO: 519939 - protein, 9 aa, Homo Sapiens
LRELDLSYN

SEQ ID NO: 519940 - protein, 9 aa, Homo Sapiens
TTLGNLVPI

SEQ ID NO: 519941 - protein, 9 aa, Homo Sapiens
QYSEENCAF

SEQ ID NO: 519942 - protein, 9 aa, Homo Sapiens
IRDVGPDRV

SEQ ID NO: 519943 - protein, 9 aa, Homo Sapiens
DRVASEWLL

SEQ ID NO: 519944 - protein, 9 aa, Homo Sapiens
KFCMVHLKT

SEQ ID NO: 519945 - protein, 9 aa, Homo Sapiens
KWDDMEKIW

SEQ ID NO: 519946 - protein, 9 aa, Homo Sapiens
EEEQVRATS

SEQ ID NO: 519947 - protein, 9 aa, Homo Sapiens
AGGLQHRVM

SEQ ID NO: 519948 - protein, 9 aa, Homo Sapiens
KLEESSKNT

SEQ ID NO: 519949 - protein, 9 aa, Homo Sapiens
ANKTRPRNG

SEQ ID NO: 519950 - protein, 9 aa, Homo Sapiens
NYGAKKYGP

SEQ ID NO: 519951 - protein, 9 aa, Homo Sapiens
ELDLSYNAI

SEQ ID NO: 519952 - protein, 9 aa, Homo Sapiens
HGIVTKWDD

SEQ ID NO: 519953 - protein, 9 aa, Homo Sapiens
SEQGNKYSL

SEQ ID NO: 519954 - protein, 9 aa, Homo Sapiens
LVYSEGAAL

SEQ ID NO: 519955 - protein, 9 aa, Homo Sapiens
PEKKRLSAG

SEQ ID NO: 519956 - protein, 9 aa, Homo Sapiens
HLSQAEGSQ

SEQ ID NO: 519957 - protein, 9 aa, Homo Sapiens
SSKVTFQPH

SEQ ID NO: 519958 - protein, 9 aa, Homo Sapiens
NLVHKGTSP

SEQ ID NO: 519959 - protein, 9 aa, Homo Sapiens
QSVSEHIKK

SEQ ID NO: 519960 - protein, 9 aa, Homo Sapiens
NGESCIKVA

SEQ ID NO: 519961 - protein, 9 aa, Homo Sapiens
TPGALEQKT

SEQ ID NO: 519962 - protein, 9 aa, Homo Sapiens
KVLVVLISP

SEQ ID NO: 519963 - protein, 9 aa, Homo Sapiens
RQGVGMYIN

SEQ ID NO: 519964 - protein, 9 aa, Homo Sapiens
LKIHGGPPQ

SEQ ID NO: 519965 - protein, 9 aa, Homo Sapiens
CHKFDLSRV

SEQ ID NO: 519966 - protein, 9 aa, Homo Sapiens
ILNSNLANL

SEQ ID NO: 519967 - protein, 9 aa, Homo Sapiens
WNGESCIKV

SEQ ID NO: 519968 - protein, 9 aa, Homo Sapiens
YVPDLTQQF

SEQ ID NO: 519969 - protein, 9 aa, Homo Sapiens
GLSLLFCGP

SEQ ID NO: 519970 - protein, 9 aa, Homo Sapiens
TWFFPVIGH

SEQ ID NO: 519971 - protein, 9 aa, Homo Sapiens
KCRPITVRS

SEQ ID NO: 519972 - protein, 9 aa, Homo Sapiens
RLAPLTKVL

SEQ ID NO: 519973 - protein, 9 aa, Homo Sapiens
GEEVIFDNL

SEQ ID NO: 519974 - protein, 9 aa, Homo Sapiens
ACKTGDVTV

SEQ ID NO: 519975 - protein, 9 aa, Homo Sapiens
AVNYNQKSQ

SEQ ID NO: 519976 - protein, 9 aa, Homo Sapiens
LTWFFPVIG

SEQ ID NO: 519977 - protein, 9 aa, Homo Sapiens
NLANLGAEC

SEQ ID NO: 519978 - protein, 9 aa, Homo Sapiens
GATGPGEAE

SEQ ID NO: 519979 - protein, 9 aa, Homo Sapiens
CRPITVRSG

SEQ ID NO: 519980 - protein, 9 aa, Homo Sapiens
DDCFNKAAP

SEQ ID NO: 519981 - protein, 9 aa, Homo Sapiens
GSAGSAVNK

SEQ ID NO: 519982 - protein, 9 aa, Homo Sapiens
MCQVLDIQN

SEQ ID NO: 519983 - protein, 9 aa, Homo Sapiens
TARLRALDA

SEQ ID NO: 519984 - protein, 9 aa, Homo Sapiens
AKCRPITVR

SEQ ID NO: 519985 - protein, 9 aa, Homo Sapiens
RLMSTSMKS

SEQ ID NO: 519986 - protein, 9 aa, Homo Sapiens
AGSAVNKLV

SEQ ID NO: 519987 - protein, 9 aa, Homo Sapiens
TFYKYLKTQ

SEQ ID NO: 519988 - protein, 9 aa, Homo Sapiens
LSTIALINR

SEQ ID NO: 519989 - protein, 9 aa, Homo Sapiens
CFNKAAPIK

SEQ ID NO: 519990 - protein, 9 aa, Homo Sapiens
FQPHSSIGC

SEQ ID NO: 519991 - protein, 9 aa, Homo Sapiens
HIKSEQGNK

SEQ ID NO: 519992 - protein, 9 aa, Homo Sapiens
QFSTDLIDS

SEQ ID NO: 519993 - protein, 9 aa, Homo Sapiens
MYINPAATE

SEQ ID NO: 519994 - protein, 9 aa, Homo Sapiens
PFCDDSHFF

SEQ ID NO: 519995 - protein, 9 aa, Homo Sapiens
IHQSVSEHI

SEQ ID NO: 519996 - protein, 9 aa, Homo Sapiens
NQKSQEVED

SEQ ID NO: 519997 - protein, 9 aa, Homo Sapiens
LLESSPGVQ

SEQ ID NO: 519998 - protein, 9 aa, Homo Sapiens
KQAEYEFIS

SEQ ID NO: 519999 - protein, 9 aa, Homo Sapiens
FKNYGAKKY

SEQ ID NO: 520000 - protein, 9 aa, Homo Sapiens
LHSVAFKSY

SEQ ID NO: 520001 - protein, 9 aa, Homo Sapiens
SDKRHQGGQ

SEQ ID NO: 520002 - protein, 9 aa, Homo Sapiens
SSRKVKFGP

SEQ ID NO: 520003 - protein, 9 aa, Homo Sapiens
LQTTPQPSR

SEQ ID NO: 520004 - protein, 9 aa, Homo Sapiens
PIEHGIVTK

SEQ ID NO: 520005 - protein, 9 aa, Homo Sapiens
CQVLDIQNI

SEQ ID NO: 520006 - protein, 9 aa, Homo Sapiens
VYSEGAALP

SEQ ID NO: 520007 - protein, 9 aa, Homo Sapiens
AHANKQAEY

SEQ ID NO: 520008 - protein, 9 aa, Homo Sapiens
PFDKENEND

SEQ ID NO: 520009 - protein, 9 aa, Homo Sapiens
GRVPRNHDL

SEQ ID NO: 520010 - protein, 9 aa, Homo Sapiens
RWESLSKVQ

SEQ ID NO: 520011 - protein, 9 aa, Homo Sapiens
TTIYAKPVP

SEQ ID NO: 520012 - protein, 9 aa, Homo Sapiens
EIFKNYGAK

SEQ ID NO: 520013 - protein, 9 aa, Homo Sapiens
QHRVMAKTA

SEQ ID NO: 520014 - protein, 9 aa, Homo Sapiens
GQLEGAPAS

SEQ ID NO: 520015 - protein, 9 aa, Homo Sapiens
RVMAKTAPD

SEQ ID NO: 520016 - protein, 9 aa, Homo Sapiens
SMDAEQRGQ

SEQ ID NO: 520017 - protein, 9 aa, Homo Sapiens
FYNRSCPVH

SEQ ID NO: 520018 - protein, 9 aa, Homo Sapiens
EELAVNYNQ

SEQ ID NO: 520019 - protein, 9 aa, Homo Sapiens
RKVKFGPGV

SEQ ID NO: 520020 - protein, 9 aa, Homo Sapiens
GMYINPAAT

SEQ ID NO: 520021 - protein, 9 aa, Homo Sapiens
WRVAFASSK

SEQ ID NO: 520022 - protein, 9 aa, Homo Sapiens
KQPFCDDSH

SEQ ID NO: 520023 - protein, 9 aa, Homo Sapiens
IVTKWDDME

SEQ ID NO: 520024 - protein, 9 aa, Homo Sapiens
FASSKVLVV

SEQ ID NO: 520025 - protein, 9 aa, Homo Sapiens
EPFDKENEN

SEQ ID NO: 520026 - protein, 9 aa, Homo Sapiens
GILPLSNKC

SEQ ID NO: 520027 - protein, 9 aa, Homo Sapiens
VWNGESCIK

SEQ ID NO: 520028 - protein, 9 aa, Homo Sapiens
LVQEQRNVT

SEQ ID NO: 520029 - protein, 9 aa, Homo Sapiens
IKKSNLVQE

SEQ ID NO: 520030 - protein, 9 aa, Homo Sapiens
QVLLRRLKI

SEQ ID NO: 520031 - protein, 9 aa, Homo Sapiens
QTGTRWNLC

SEQ ID NO: 520032 - protein, 9 aa, Homo Sapiens
RVASEWLLR

SEQ ID NO: 520033 - protein, 9 aa, Homo Sapiens
KTRPRNGEE

SEQ ID NO: 520034 - protein, 9 aa, Homo Sapiens
LMSTSMKSL

SEQ ID NO: 520035 - protein, 9 aa, Homo Sapiens
TGFSGMHTS

SEQ ID NO: 520036 - protein, 9 aa, Homo Sapiens
GSAVNKLVP

SEQ ID NO: 520037 - protein, 9 aa, Homo Sapiens
RLRELDLSY

SEQ ID NO: 520038 - protein, 9 aa, Homo Sapiens
NYNQKSQEV

SEQ ID NO: 520039 - protein, 9 aa, Homo Sapiens
HVWNGESCI

SEQ ID NO: 520040 - protein, 9 aa, Homo Sapiens
HIHTVTALV

SEQ ID NO: 520041 - protein, 9 aa, Homo Sapiens
CWELWNTNL

SEQ ID NO: 520042 - protein, 9 aa, Homo Sapiens
SNLANLGAE

SEQ ID NO: 520043 - protein, 9 aa, Homo Sapiens
SEGDAEPFD

SEQ ID NO: 520044 - protein, 9 aa, Homo Sapiens
DACKTGDVT

SEQ ID NO: 520045 - protein, 9 aa, Homo Sapiens
DLSRVTFYA

SEQ ID NO: 520046 - protein, 9 aa, Homo Sapiens
IQINTFLST

SEQ ID NO: 520047 - protein, 9 aa, Homo Sapiens
IGPSILNSN

SEQ ID NO: 520048 - protein, 9 aa, Homo Sapiens
QPSRLMSTS

SEQ ID NO: 520049 - protein, 9 aa, Homo Sapiens
LHRAHANKQ

SEQ ID NO: 520050 - protein, 9 aa, Homo Sapiens
RHNDFEEVA

SEQ ID NO: 520051 - protein, 9 aa, Homo Sapiens
GYEEITFYK

SEQ ID NO: 520052 - protein, 9 aa, Homo Sapiens
YEEITFYKY

SEQ ID NO: 520053 - protein, 9 aa, Homo Sapiens
FEKTEDACV

SEQ ID NO: 520054 - protein, 9 aa, Homo Sapiens
PKQDHIHTV

SEQ ID NO: 520055 - protein, 9 aa, Homo Sapiens
QNGIVVTHA

SEQ ID NO: 520056 - protein, 9 aa, Homo Sapiens
TKWDDMEKI

SEQ ID NO: 520057 - protein, 9 aa, Homo Sapiens
RPITVRSGD

SEQ ID NO: 520058 - protein, 9 aa, Homo Sapiens
QLKIMPEKK

SEQ ID NO: 520059 - protein, 9 aa, Homo Sapiens
EQCKFCMVH

SEQ ID NO: 520060 - protein, 9 aa, Homo Sapiens
SEENCAFEE

SEQ ID NO: 520061 - protein, 9 aa, Homo Sapiens
CKFCMVHLK

SEQ ID NO: 520062 - protein, 9 aa, Homo Sapiens
IPKQDHIHT

SEQ ID NO: 520063 - protein, 9 aa, Homo Sapiens
KYQGYCGAC

SEQ ID NO: 520064 - protein, 9 aa, Homo Sapiens
WESLSKVQR

SEQ ID NO: 520065 - protein, 9 aa, Homo Sapiens
SCPVHIIAT

SEQ ID NO: 520066 - protein, 9 aa, Homo Sapiens
RNGEEVIFD

SEQ ID NO: 520067 - protein, 9 aa, Homo Sapiens
GAAYVPDLT

SEQ ID NO: 520068 - protein, 9 aa, Homo Sapiens
HRVMAKTAP

SEQ ID NO: 520069 - protein, 9 aa, Homo Sapiens
EKVVLMYDQ

SEQ ID NO: 520070 - protein, 9 aa, Homo Sapiens
KVQRMQLDI

SEQ ID NO: 520071 - protein, 9 aa, Homo Sapiens
FKEAMNYLL

SEQ ID NO: 520072 - protein, 9 aa, Homo Sapiens
FQEVVSDKR

SEQ ID NO: 520073 - protein, 9 aa, Homo Sapiens
TFLSTIALI

SEQ ID NO: 520074 - protein, 9 aa, Homo Sapiens
QCSFYNRSC

SEQ ID NO: 520075 - protein, 9 aa, Homo Sapiens
RRLKIHGGP

SEQ ID NO: 520076 - protein, 9 aa, Homo Sapiens
KSVDQKNKF

SEQ ID NO: 520077 - protein, 9 aa, Homo Sapiens
KFDLSRVTF

SEQ ID NO: 520078 - protein, 9 aa, Homo Sapiens
SSPGVQPTC

SEQ ID NO: 520079 - protein, 9 aa, Homo Sapiens
KKYGPHSVC

SEQ ID NO: 520080 - protein, 9 aa, Homo Sapiens
QKNKFMSVT

SEQ ID NO: 520081 - protein, 9 aa, Homo Sapiens
PRNHDLSQP

SEQ ID NO: 520082 - protein, 9 aa, Homo Sapiens
ELLFLEGPS

SEQ ID NO: 520083 - protein, 9 aa, Homo Sapiens
VRHARKHLS

SEQ ID NO: 520084 - protein, 9 aa, Homo Sapiens
NGEEVIFDN

SEQ ID NO: 520085 - protein, 9 aa, Homo Sapiens
NGQCINRVG

SEQ ID NO: 520086 - protein, 9 aa, Homo Sapiens
GYCGACWAF

SEQ ID NO: 520087 - protein, 9 aa, Homo Sapiens
EPELLFLEG

SEQ ID NO: 520088 - protein, 9 aa, Homo Sapiens
KEAMNYLLS

SEQ ID NO: 520089 - protein, 9 aa, Homo Sapiens
RRTTIYAKP

SEQ ID NO: 520090 - protein, 9 aa, Homo Sapiens
SNKCLLLIE

SEQ ID NO: 520091 - protein, 9 aa, Homo Sapiens
SLSKVQRMQ

SEQ ID NO: 520092 - protein, 9 aa, Homo Sapiens
DQKNKFMSV

SEQ ID NO: 520093 - protein, 9 aa, Homo Sapiens
KQDHIHTVT

SEQ ID NO: 520094 - protein, 9 aa, Homo Sapiens
WGLSLLFCG

SEQ ID NO: 520095 - protein, 9 aa, Homo Sapiens
DSLRKAVRT

SEQ ID NO: 520096 - protein, 9 aa, Homo Sapiens
MDAEQRGQP

SEQ ID NO: 520097 - protein, 9 aa, Homo Sapiens
VQRMQLDII

SEQ ID NO: 520098 - protein, 9 aa, Homo Sapiens
ARKHLSQAE

SEQ ID NO: 520099 - protein, 9 aa, Homo Sapiens
LPESHSSED

SEQ ID NO: 520100 - protein, 9 aa, Homo Sapiens
EGAALPRPL

SEQ ID NO: 520101 - protein, 9 aa, Homo Sapiens
DKANKQLSV

SEQ ID NO: 520102 - protein, 9 aa, Homo Sapiens
HTVTALVNG

SEQ ID NO: 520103 - protein, 9 aa, Homo Sapiens
VLKHEESRY

SEQ ID NO: 520104 - protein, 9 aa, Homo Sapiens
LKKEMLPPP

SEQ ID NO: 520105 - protein, 9 aa, Homo Sapiens
ASKGESGGS

SEQ ID NO: 520106 - protein, 9 aa, Homo Sapiens
DKKVEQCKF

SEQ ID NO: 520107 - protein, 9 aa, Homo Sapiens
ENCAFEEEI

SEQ ID NO: 520108 - protein, 9 aa, Homo Sapiens
IMTVPRKSH

SEQ ID NO: 520109 - protein, 9 aa, Homo Sapiens
SRGKGIRLH

SEQ ID NO: 520110 - protein, 9 aa, Homo Sapiens
PDLTQQFPL

SEQ ID NO: 520111 - protein, 9 aa, Homo Sapiens
QKRHNDFEE

SEQ ID NO: 520112 - protein, 9 aa, Homo Sapiens
RAHANKQAE

SEQ ID NO: 520113 - protein, 9 aa, Homo Sapiens
EDFFVLKHE

SEQ ID NO: 520114 - protein, 8 aa, Homo Sapiens
SRSVALAV

SEQ ID NO: 520115 - protein, 9 aa, Homo Sapiens
WFFPVIGHM

SEQ ID NO: 520116 - protein, 9 aa, Homo Sapiens
TKVLTPPHD

SEQ ID NO: 520117 - protein, 9 aa, Homo Sapiens
HQSVSEHIK

SEQ ID NO: 520118 - protein, 9 aa, Homo Sapiens
VGMYINPAA

SEQ ID NO: 520119 - protein, 9 aa, Homo Sapiens
FFPVIGHMG

SEQ ID NO: 520120 - protein, 9 aa, Homo Sapiens
LSQAEGSQL

SEQ ID NO: 520121 - protein, 9 aa, Homo Sapiens
VQPTCCVTG

SEQ ID NO: 520122 - protein, 9 aa, Homo Sapiens
PELLFLEGP

SEQ ID NO: 520123 - protein, 9 aa, Homo Sapiens
RPRNGEEVI

SEQ ID NO: 520124 - protein, 9 aa, Homo Sapiens
GMHTSVFIS

SEQ ID NO: 520125 - protein, 9 aa, Homo Sapiens
PGEAEPGED

SEQ ID NO: 520126 - protein, 9 aa, Homo Sapiens
LSVLERDNR

SEQ ID NO: 520127 - protein, 9 aa, Homo Sapiens
IDACKTGDV

SEQ ID NO: 520128 - protein, 9 aa, Homo Sapiens
FLEGPSTSR

SEQ ID NO: 520129 - protein, 9 aa, Homo Sapiens
TEVKYQGYC

SEQ ID NO: 520130 - protein, 9 aa, Homo Sapiens
IEFMCQVLD

SEQ ID NO: 520131 - protein, 9 aa, Homo Sapiens
HIKKNFAKS

SEQ ID NO: 520132 - protein, 9 aa, Homo Sapiens
RGMSRGKGI

SEQ ID NO: 520133 - protein, 9 aa, Homo Sapiens
QAGAAYVPD

SEQ ID NO: 520134 - protein, 9 aa, Homo Sapiens
EKKKQKEEE

SEQ ID NO: 520135 - protein, 9 aa, Homo Sapiens
ECGKAFSSV

SEQ ID NO: 520136 - protein, 9 aa, Homo Sapiens
GGLQHRVMA

SEQ ID NO: 520137 - protein, 9 aa, Homo Sapiens
EENCAFEEE

SEQ ID NO: 520138 - protein, 9 aa, Homo Sapiens
TDKANKQLS

SEQ ID NO: 520139 - protein, 9 aa, Homo Sapiens
EESRYLNND

SEQ ID NO: 520140 - protein, 9 aa, Homo Sapiens
EIEIKKSNL

SEQ ID NO: 520141 - protein, 9 aa, Homo Sapiens
DLISMDAEQ

SEQ ID NO: 520142 - protein, 9 aa, Homo Sapiens
KFMSVTERE

SEQ ID NO: 520143 - protein, 9 aa, Homo Sapiens
VDEPELLFL

SEQ ID NO: 520144 - protein, 9 aa, Homo Sapiens
LQYSEENCA

SEQ ID NO: 520145 - protein, 9 aa, Homo Sapiens
DTDKANKQL

SEQ ID NO: 520146 - protein, 9 aa, Homo Sapiens
YAKPVPENN

SEQ ID NO: 520147 - protein, 9 aa, Homo Sapiens
HSVAFKSYK

SEQ ID NO: 520148 - protein, 9 aa, Homo Sapiens
AEPFDKENE

SEQ ID NO: 520149 - protein, 9 aa, Homo Sapiens
VLLQTTPQP

SEQ ID NO: 520150 - protein, 9 aa, Homo Sapiens
HLTEEEDIK

SEQ ID NO: 520151 - protein, 9 aa, Homo Sapiens
VPDLTQQFP

SEQ ID NO: 520152 - protein, 9 aa, Homo Sapiens
QLRVISAEV

SEQ ID NO: 520153 - protein, 9 aa, Homo Sapiens
FTPEMERQR

SEQ ID NO: 520154 - protein, 9 aa, Homo Sapiens
QRRMAMPET

SEQ ID NO: 520155 - protein, 9 aa, Homo Sapiens
VMDDLLPIK

SEQ ID NO: 520156 - protein, 9 aa, Homo Sapiens
QAYADGVNL

SEQ ID NO: 520157 - protein, 9 aa, Homo Sapiens
AENDILCWN

SEQ ID NO: 520158 - protein, 9 aa, Homo Sapiens
KVKTNKKMD

SEQ ID NO: 520159 - protein, 9 aa, Homo Sapiens
NKEAQSSKA

SEQ ID NO: 520160 - protein, 9 aa, Homo Sapiens
SHLPTLASR

SEQ ID NO: 520161 - protein, 9 aa, Homo Sapiens
QNTGSSHLN

SEQ ID NO: 520162 - protein, 9 aa, Homo Sapiens
VQTYKLTPN

SEQ ID NO: 520163 - protein, 9 aa, Homo Sapiens
DILCWNGQE

SEQ ID NO: 520164 - protein, 9 aa, Homo Sapiens
VWREGRFTA

SEQ ID NO: 520165 - protein, 9 aa, Homo Sapiens
APRQEQKAE

SEQ ID NO: 520166 - protein, 9 aa, Homo Sapiens
FILVPRLEC

SEQ ID NO: 520167 - protein, 9 aa, Homo Sapiens
KLVSTLLMM

SEQ ID NO: 520168 - protein, 9 aa, Homo Sapiens
TILAYCSLS

SEQ ID NO: 520169 - protein, 9 aa, Homo Sapiens
PGCIFGLEN

SEQ ID NO: 520170 - protein, 9 aa, Homo Sapiens
GFPQFPLQI

SEQ ID NO: 520171 - protein, 9 aa, Homo Sapiens
FEGFPQFPL

SEQ ID NO: 520172 - protein, 9 aa, Homo Sapiens
WELGKELSG

SEQ ID NO: 520173 - protein, 9 aa, Homo Sapiens
GVQTYKLTP

SEQ ID NO: 520174 - protein, 9 aa, Homo Sapiens
CAAVAAEKE

SEQ ID NO: 520175 - protein, 9 aa, Homo Sapiens
LERLQELER

SEQ ID NO: 520176 - protein, 9 aa, Homo Sapiens
SWTHRSRNH

SEQ ID NO: 520177 - protein, 9 aa, Homo Sapiens
SPPFTAENW

SEQ ID NO: 520178 - protein, 9 aa, Homo Sapiens
GLLEEVLGC

SEQ ID NO: 520179 - protein, 9 aa, Homo Sapiens
DEPSEKADE

SEQ ID NO: 520180 - protein, 9 aa, Homo Sapiens
HLASAPATP

SEQ ID NO: 520181 - protein, 9 aa, Homo Sapiens
ICDICQFGA

SEQ ID NO: 520182 - protein, 9 aa, Homo Sapiens
WREGRFTAL

SEQ ID NO: 520183 - protein, 9 aa, Homo Sapiens
QDQLLACKL

SEQ ID NO: 520184 - protein, 9 aa, Homo Sapiens
PSEKADEPM

SEQ ID NO: 520185 - protein, 9 aa, Homo Sapiens
KATPVQTSQ

SEQ ID NO: 520186 - protein, 9 aa, Homo Sapiens
VSSVPAVGK

SEQ ID NO: 520187 - protein, 9 aa, Homo Sapiens
LILRIPNFT

SEQ ID NO: 520188 - protein, 9 aa, Homo Sapiens
ESRLGAHRQ

SEQ ID NO: 520189 - protein, 9 aa, Homo Sapiens
EVSSVAYGL

SEQ ID NO: 520190 - protein, 9 aa, Homo Sapiens
WMHAHHGSS

SEQ ID NO: 520191 - protein, 9 aa, Homo Sapiens
PHLASAPAT

SEQ ID NO: 520192 - protein, 9 aa, Homo Sapiens
WANDRQCFQ

SEQ ID NO: 520193 - protein, 9 aa, Homo Sapiens
MGLPSWTHR

SEQ ID NO: 520194 - protein, 9 aa, Homo Sapiens
GCAAVAAEK

SEQ ID NO: 520195 - protein, 9 aa, Homo Sapiens
ALCAVWREG

SEQ ID NO: 520196 - protein, 9 aa, Homo Sapiens
KETSICDIC

SEQ ID NO: 520197 - protein, 9 aa, Homo Sapiens
QNERYGQFT

SEQ ID NO: 520198 - protein, 9 aa, Homo Sapiens
ISVRQRQGV

SEQ ID NO: 520199 - protein, 9 aa, Homo Sapiens
QGTKSITCQ

SEQ ID NO: 520200 - protein, 9 aa, Homo Sapiens
DLDFGANGE

SEQ ID NO: 520201 - protein, 9 aa, Homo Sapiens
MLHETAAPS

SEQ ID NO: 520202 - protein, 9 aa, Homo Sapiens
GKNKDNFSN

SEQ ID NO: 520203 - protein, 9 aa, Homo Sapiens
LMPQSFFFF

SEQ ID NO: 520204 - protein, 9 aa, Homo Sapiens
PETEWTTVG

SEQ ID NO: 520205 - protein, 9 aa, Homo Sapiens
VQESPAPRQ

SEQ ID NO: 520206 - protein, 9 aa, Homo Sapiens
FPGSSHLPT

SEQ ID NO: 520207 - protein, 9 aa, Homo Sapiens
SEKADEPME

SEQ ID NO: 520208 - protein, 9 aa, Homo Sapiens
AGTAGARHH

SEQ ID NO: 520209 - protein, 9 aa, Homo Sapiens
GYTEPREWE

SEQ ID NO: 520210 - protein, 9 aa, Homo Sapiens
FRKALSIPG

SEQ ID NO: 520211 - protein, 9 aa, Homo Sapiens
GQFTLVNST

SEQ ID NO: 520212 - protein, 9 aa, Homo Sapiens
YEQRLEQQD

SEQ ID NO: 520213 - protein, 9 aa, Homo Sapiens
VKTNKKMDH

SEQ ID NO: 520214 - protein, 9 aa, Homo Sapiens
AEVSSVAYG

SEQ ID NO: 520215 - protein, 9 aa, Homo Sapiens
EQQDQLLAC

SEQ ID NO: 520216 - protein, 9 aa, Homo Sapiens
RQRQGVSIG

SEQ ID NO: 520217 - protein, 9 aa, Homo Sapiens
LMMGIFGDE

SEQ ID NO: 520218 - protein, 9 aa, Homo Sapiens
GNLSPGALS

SEQ ID NO: 520219 - protein, 9 aa, Homo Sapiens
AEVHANHLM

SEQ ID NO: 520220 - protein, 9 aa, Homo Sapiens
SVRQRQGVS

SEQ ID NO: 520221 - protein, 9 aa, Homo Sapiens
FIVVAGHDG

SEQ ID NO: 520222 - protein, 9 aa, Homo Sapiens
ILRIPNFTD

SEQ ID NO: 520223 - protein, 9 aa, Homo Sapiens
AGGGGLLEE

SEQ ID NO: 520224 - protein, 9 aa, Homo Sapiens
SIPGYTEPR

SEQ ID NO: 520225 - protein, 9 aa, Homo Sapiens
GDAAALCAV

SEQ ID NO: 520226 - protein, 9 aa, Homo Sapiens
FFIVVAGHD

SEQ ID NO: 520227 - protein, 9 aa, Homo Sapiens
MHAHHGSSR

SEQ ID NO: 520228 - protein, 9 aa, Homo Sapiens
LVGRTQREP

SEQ ID NO: 520229 - protein, 9 aa, Homo Sapiens
FPQFPLQIP

SEQ ID NO: 520230 - protein, 9 aa, Homo Sapiens
ADEPSEKAD

SEQ ID NO: 520231 - protein, 9 aa, Homo Sapiens
KEAQSSKAT

SEQ ID NO: 520232 - protein, 9 aa, Homo Sapiens
VVMDDLLPI

SEQ ID NO: 520233 - protein, 9 aa, Homo Sapiens
LSCWEVIDV

SEQ ID NO: 520234 - protein, 9 aa, Homo Sapiens
LHETAAPSD

SEQ ID NO: 520235 - protein, 9 aa, Homo Sapiens
GHDGVLVGR

SEQ ID NO: 520236 - protein, 9 aa, Homo Sapiens
NLTEKIPLA

SEQ ID NO: 520237 - protein, 9 aa, Homo Sapiens
LAYCSLSFP

SEQ ID NO: 520238 - protein, 9 aa, Homo Sapiens
KEHFACEYD

SEQ ID NO: 520239 - protein, 9 aa, Homo Sapiens
TLLMMGIFG

SEQ ID NO: 520240 - protein, 9 aa, Homo Sapiens
EIKKLSCWE

SEQ ID NO: 520241 - protein, 9 aa, Homo Sapiens
RDMQLRVIS

SEQ ID NO: 520242 - protein, 9 aa, Homo Sapiens
RIPNFTDQD

SEQ ID NO: 520243 - protein, 9 aa, Homo Sapiens
SFGVQTYKL

SEQ ID NO: 520244 - protein, 9 aa, Homo Sapiens
HDGVLVGRT

SEQ ID NO: 520245 - protein, 9 aa, Homo Sapiens
GARHHTREI

SEQ ID NO: 520246 - protein, 9 aa, Homo Sapiens
TLQELERLQ

SEQ ID NO: 520247 - protein, 9 aa, Homo Sapiens
HKNLIELRR

SEQ ID NO: 520248 - protein, 9 aa, Homo Sapiens
GPLQRGNLS

SEQ ID NO: 520249 - protein, 9 aa, Homo Sapiens
KLACMDIYM

SEQ ID NO: 520250 - protein, 9 aa, Homo Sapiens
WGRAVPLPA

SEQ ID NO: 520251 - protein, 9 aa, Homo Sapiens
PKEESRLGA

SEQ ID NO: 520252 - protein, 9 aa, Homo Sapiens
LLMMGIFGD

SEQ ID NO: 520253 - protein, 9 aa, Homo Sapiens
AYCSLSFPG

SEQ ID NO: 520254 - protein, 9 aa, Homo Sapiens
CEYDCYGDS

SEQ ID NO: 520255 - protein, 9 aa, Homo Sapiens
IQLSETISE

SEQ ID NO: 520256 - protein, 9 aa, Homo Sapiens
FTALATSSQ

SEQ ID NO: 520257 - protein, 9 aa, Homo Sapiens
PRQEQKAEE

SEQ ID NO: 520258 - protein, 9 aa, Homo Sapiens
GSSHLPTLA

SEQ ID NO: 520259 - protein, 9 aa, Homo Sapiens
DVVMDDLLP

SEQ ID NO: 520260 - protein, 9 aa, Homo Sapiens
DQLLACKLN

SEQ ID NO: 520261 - protein, 9 aa, Homo Sapiens
AYADGVNLT

SEQ ID NO: 520262 - protein, 9 aa, Homo Sapiens
VGRTQREPL

SEQ ID NO: 520263 - protein, 9 aa, Homo Sapiens
DSAMYFCVM

SEQ ID NO: 520264 - protein, 9 aa, Homo Sapiens
HANHLMREL

SEQ ID NO: 520265 - protein, 9 aa, Homo Sapiens
THRSRNHDV

SEQ ID NO: 520266 - protein, 9 aa, Homo Sapiens
RDLDFGANG

SEQ ID NO: 520267 - protein, 9 aa, Homo Sapiens
SWMHAHHGS

SEQ ID NO: 520268 - protein, 9 aa, Homo Sapiens
APWGRAVPL

SEQ ID NO: 520269 - protein, 9 aa, Homo Sapiens
PSWTHRSRN

SEQ ID NO: 520270 - protein, 9 aa, Homo Sapiens
LSFPGSSHL

SEQ ID NO: 520271 - protein, 9 aa, Homo Sapiens
EVLGCAAVA

SEQ ID NO: 520272 - protein, 9 aa, Homo Sapiens
LEEVLGCAA

SEQ ID NO: 520273 - protein, 9 aa, Homo Sapiens
PTNYYLFRL

SEQ ID NO: 520274 - protein, 9 aa, Homo Sapiens
SAPHLASAP

SEQ ID NO: 520275 - protein, 9 aa, Homo Sapiens
VNVKLWAND

SEQ ID NO: 520276 - protein, 9 aa, Homo Sapiens
TKEHFACEY

SEQ ID NO: 520277 - protein, 9 aa, Homo Sapiens
LCLAPWGRA

SEQ ID NO: 520278 - protein, 9 aa, Homo Sapiens
MLRASALFP

SEQ ID NO: 520279 - protein, 9 aa, Homo Sapiens
YHFRKALSI

SEQ ID NO: 520280 - protein, 9 aa, Homo Sapiens
LQRGNLSPG

SEQ ID NO: 520281 - protein, 9 aa, Homo Sapiens
QTYKLTPNE

SEQ ID NO: 520282 - protein, 9 aa, Homo Sapiens
PGSSHLPTL

SEQ ID NO: 520283 - protein, 9 aa, Homo Sapiens
RLGAHRQPG

SEQ ID NO: 520284 - protein, 9 aa, Homo Sapiens
FFPFFFILV

SEQ ID NO: 520285 - protein, 9 aa, Homo Sapiens
KDNFSNEVF

SEQ ID NO: 520286 - protein, 9 aa, Homo Sapiens
FRSNCIDCL

SEQ ID NO: 520287 - protein, 9 aa, Homo Sapiens
ALVLCLAPW

SEQ ID NO: 520288 - protein, 9 aa, Homo Sapiens
PFFFILVPR

SEQ ID NO: 520289 - protein, 9 aa, Homo Sapiens
QDRAGAAAP

SEQ ID NO: 520290 - protein, 9 aa, Homo Sapiens
QESPAPRQE

SEQ ID NO: 520291 - protein, 9 aa, Homo Sapiens
ANGEVRCNI

SEQ ID NO: 520292 - protein, 9 aa, Homo Sapiens
AAAPPRHQP

SEQ ID NO: 520293 - protein, 9 aa, Homo Sapiens
APKEESRLG

SEQ ID NO: 520294 - protein, 9 aa, Homo Sapiens
VAGHDGVLV

SEQ ID NO: 520295 - protein, 9 aa, Homo Sapiens
EEEIKKLSC

SEQ ID NO: 520296 - protein, 9 aa, Homo Sapiens
KANEKWGRG

SEQ ID NO: 520297 - protein, 9 aa, Homo Sapiens
MQLRVISAE

SEQ ID NO: 520298 - protein, 9 aa, Homo Sapiens
FGEWVDVVM

SEQ ID NO: 520299 - protein, 9 aa, Homo Sapiens
CMDIYMINL

SEQ ID NO: 520300 - protein, 9 aa, Homo Sapiens
YMLHETAAP

SEQ ID NO: 520301 - protein, 9 aa, Homo Sapiens
SVPGESPKE

SEQ ID NO: 520302 - protein, 9 aa, Homo Sapiens
KGYGCAEVS

SEQ ID NO: 520303 - protein, 9 aa, Homo Sapiens
KLTPNELFG

SEQ ID NO: 520304 - protein, 9 aa, Homo Sapiens
EPLGYQDRA

SEQ ID NO: 520305 - protein, 9 aa, Homo Sapiens
DRYPALQWA

SEQ ID NO: 520306 - protein, 9 aa, Homo Sapiens
NDILCWNGQ

SEQ ID NO: 520307 - protein, 9 aa, Homo Sapiens
LLKLACMDI

SEQ ID NO: 520308 - protein, 9 aa, Homo Sapiens
YYLFRLAVS

SEQ ID NO: 520309 - protein, 9 aa, Homo Sapiens
VAENDILCW

SEQ ID NO: 520310 - protein, 9 aa, Homo Sapiens
RTGPLQRGN

SEQ ID NO: 520311 - protein, 9 aa, Homo Sapiens
TFEGFPQFP

SEQ ID NO: 520312 - protein, 9 aa, Homo Sapiens
EPREWELGK

SEQ ID NO: 520313 - protein, 9 aa, Homo Sapiens
QFPLQIPGS

SEQ ID NO: 520314 - protein, 9 aa, Homo Sapiens
KTRDLDFGA

SEQ ID NO: 520315 - protein, 9 aa, Homo Sapiens
WTHRSRNHD

SEQ ID NO: 520316 - protein, 9 aa, Homo Sapiens
GVLVGRTQR

SEQ ID NO: 520317 - protein, 9 aa, Homo Sapiens
VLQGTKSIT

SEQ ID NO: 520318 - protein, 9 aa, Homo Sapiens
GRFTALATS

SEQ ID NO: 520319 - protein, 9 aa, Homo Sapiens
LEQQDQLLA

SEQ ID NO: 520320 - protein, 9 aa, Homo Sapiens
ETEWTTVGP

SEQ ID NO: 520321 - protein, 9 aa, Homo Sapiens
GVFRSNCID

SEQ ID NO: 520322 - protein, 9 aa, Homo Sapiens
YDGPDPGCI

SEQ ID NO: 520323 - protein, 9 aa, Homo Sapiens
MVNLLILRI

SEQ ID NO: 520324 - protein, 9 aa, Homo Sapiens
QWAQLRLDF

SEQ ID NO: 520325 - protein, 9 aa, Homo Sapiens
VSTLLMMGI

SEQ ID NO: 520326 - protein, 9 aa, Homo Sapiens
DFGANGEVR

SEQ ID NO: 520327 - protein, 9 aa, Homo Sapiens
RHHTREIFV

SEQ ID NO: 520328 - protein, 9 aa, Homo Sapiens
SVSGKASIQ

SEQ ID NO: 520329 - protein, 9 aa, Homo Sapiens
SPAPRQEQK

SEQ ID NO: 520330 - protein, 9 aa, Homo Sapiens
LARHQKIYS

SEQ ID NO: 520331 - protein, 9 aa, Homo Sapiens
CWEVIDVVR

SEQ ID NO: 520332 - protein, 9 aa, Homo Sapiens
NYYLFRLAV

SEQ ID NO: 520333 - protein, 9 aa, Homo Sapiens
SSHLPTLAS

SEQ ID NO: 520334 - protein, 9 aa, Homo Sapiens
PVAENDILC

SEQ ID NO: 520335 - protein, 9 aa, Homo Sapiens
SFPGSSHLP

SEQ ID NO: 520336 - protein, 9 aa, Homo Sapiens
SGTILAYCS

SEQ ID NO: 520337 - protein, 9 aa, Homo Sapiens
RKVKTNKKM

SEQ ID NO: 520338 - protein, 9 aa, Homo Sapiens
WVDVVMDDL

SEQ ID NO: 520339 - protein, 9 aa, Homo Sapiens
ESEHSHKNL

SEQ ID NO: 520340 - protein, 9 aa, Homo Sapiens
CAEVSSVAY

SEQ ID NO: 520341 - protein, 9 aa, Homo Sapiens
MSSEFTPEM

SEQ ID NO: 520342 - protein, 9 aa, Homo Sapiens
EWELGKELS

SEQ ID NO: 520343 - protein, 9 aa, Homo Sapiens
RLAVSDLLV

SEQ ID NO: 520344 - protein, 9 aa, Homo Sapiens
LSAPHLASA

SEQ ID NO: 520345 - protein, 9 aa, Homo Sapiens
GLPSWTHRS

SEQ ID NO: 520346 - protein, 9 aa, Homo Sapiens
ARHHTREIF

SEQ ID NO: 520347 - protein, 9 aa, Homo Sapiens
IKKLSCWEV

SEQ ID NO: 520348 - protein, 9 aa, Homo Sapiens
LVSTLLMMG

SEQ ID NO: 520349 - protein, 9 aa, Homo Sapiens
NERYGQFTL

SEQ ID NO: 520350 - protein, 9 aa, Homo Sapiens
SIQLSETIS

SEQ ID NO: 520351 - protein, 9 aa, Homo Sapiens
PALQWAQLR

SEQ ID NO: 520352 - protein, 9 aa, Homo Sapiens
PDPGCIFGL

SEQ ID NO: 520353 - protein, 9 aa, Homo Sapiens
PRCGDAAAL

SEQ ID NO: 520354 - protein, 9 aa, Homo Sapiens
SRRCSVPGE

SEQ ID NO: 520355 - protein, 9 aa, Homo Sapiens
SPVSSVPAV

SEQ ID NO: 520356 - protein, 9 aa, Homo Sapiens
WMVNLLILR

SEQ ID NO: 520357 - protein, 9 aa, Homo Sapiens
FTAENWKKT

SEQ ID NO: 520358 - protein, 9 aa, Homo Sapiens
HAHHGSSRC

SEQ ID NO: 520359 - protein, 9 aa, Homo Sapiens
VLVGRTQRE

SEQ ID NO: 520360 - protein, 9 aa, Homo Sapiens
EDYVLQGTK

SEQ ID NO: 520361 - protein, 9 aa, Homo Sapiens
RTQREPLGY

SEQ ID NO: 520362 - protein, 9 aa, Homo Sapiens
RYGQFTLVN

SEQ ID NO: 520363 - protein, 9 aa, Homo Sapiens
GEWVDVVMD

SEQ ID NO: 520364 - protein, 9 aa, Homo Sapiens
WKKTMDKII

SEQ ID NO: 520365 - protein, 9 aa, Homo Sapiens
RRMAMPETE

SEQ ID NO: 520366 - protein, 9 aa, Homo Sapiens
SGPQNTGSS

SEQ ID NO: 520367 - protein, 9 aa, Homo Sapiens
TYKLTPNEL

SEQ ID NO: 520368 - protein, 9 aa, Homo Sapiens
SSEFTPEME

SEQ ID NO: 520369 - protein, 9 aa, Homo Sapiens
SSSRRCSVP

SEQ ID NO: 520370 - protein, 9 aa, Homo Sapiens
TPSEGTTQL

SEQ ID NO: 520371 - protein, 9 aa, Homo Sapiens
ISAEVKFLD

SEQ ID NO: 520372 - protein, 9 aa, Homo Sapiens
GKASIQLSE

SEQ ID NO: 520373 - protein, 9 aa, Homo Sapiens
KNKDNFSNE

SEQ ID NO: 520374 - protein, 9 aa, Homo Sapiens
ENWKKTMDK

SEQ ID NO: 520375 - protein, 9 aa, Homo Sapiens
VAWDLELSE

SEQ ID NO: 520376 - protein, 9 aa, Homo Sapiens
QYYMLHETA

SEQ ID NO: 520377 - protein, 9 aa, Homo Sapiens
QRGNLSPGA

SEQ ID NO: 520378 - protein, 9 aa, Homo Sapiens
KAMVEQSIC

SEQ ID NO: 520379 - protein, 9 aa, Homo Sapiens
NLSPGALSS

SEQ ID NO: 520380 - protein, 9 aa, Homo Sapiens
KEESRLGAH

SEQ ID NO: 520381 - protein, 9 aa, Homo Sapiens
LEGKNKDNF

SEQ ID NO: 520382 - protein, 9 aa, Homo Sapiens
ETSICDICQ

SEQ ID NO: 520383 - protein, 9 aa, Homo Sapiens
SKATPVQTS

SEQ ID NO: 520384 - protein, 9 aa, Homo Sapiens
NCIDCLDRT

SEQ ID NO: 520385 - protein, 9 aa, Homo Sapiens
EQRLEQQDQ

SEQ ID NO: 520386 - protein, 9 aa, Homo Sapiens
MAMPETEWT

SEQ ID NO: 520387 - protein, 9 aa, Homo Sapiens
AWDLELSEE

SEQ ID NO: 520388 - protein, 9 aa, Homo Sapiens
TAAPSDIVG

SEQ ID NO: 520389 - protein, 9 aa, Homo Sapiens
SICDICQFG

SEQ ID NO: 520390 - protein, 9 aa, Homo Sapiens
PSTKEHFAC

SEQ ID NO: 520391 - protein, 9 aa, Homo Sapiens
GKELSGKVE

SEQ ID NO: 520392 - protein, 9 aa, Homo Sapiens
HHTREIFVL

SEQ ID NO: 520393 - protein, 9 aa, Homo Sapiens
SAMYFCVMR

SEQ ID NO: 520394 - protein, 9 aa, Homo Sapiens
VISAEVKFL

SEQ ID NO: 520395 - protein, 9 aa, Homo Sapiens
QPADEPSEK

SEQ ID NO: 520396 - protein, 9 aa, Homo Sapiens
GCAEVSSVA

SEQ ID NO: 520397 - protein, 9 aa, Homo Sapiens
ILAVAWDLE

SEQ ID NO: 520398 - protein, 9 aa, Homo Sapiens
ELERLQELE

SEQ ID NO: 520399 - protein, 9 aa, Homo Sapiens
TEWTTVGPE

SEQ ID NO: 520400 - protein, 9 aa, Homo Sapiens
VNLLILRIP

SEQ ID NO: 520401 - protein, 9 aa, Homo Sapiens
CSGTILAYC

SEQ ID NO: 520402 - protein, 9 aa, Homo Sapiens
LGAHRQPGG

SEQ ID NO: 520403 - protein, 9 aa, Homo Sapiens
PLQRGNLSP

SEQ ID NO: 520404 - protein, 9 aa, Homo Sapiens
ISGPQNTGS

SEQ ID NO: 520405 - protein, 9 aa, Homo Sapiens
FFFILVPRL

SEQ ID NO: 520406 - protein, 9 aa, Homo Sapiens
ILVPRLECS

SEQ ID NO: 520407 - protein, 9 aa, Homo Sapiens
WDLELSEEG

SEQ ID NO: 520408 - protein, 9 aa, Homo Sapiens
ARHQKIYSG

SEQ ID NO: 520409 - protein, 9 aa, Homo Sapiens
FPLQIPGSP

SEQ ID NO: 520410 - protein, 9 aa, Homo Sapiens
KRKVKTNKK

SEQ ID NO: 520411 - protein, 9 aa, Homo Sapiens
AQSSKATPV

SEQ ID NO: 520412 - protein, 9 aa, Homo Sapiens
LGCAAVAAE

SEQ ID NO: 520413 - protein, 9 aa, Homo Sapiens
EEIKKLSCW

SEQ ID NO: 520414 - protein, 9 aa, Homo Sapiens
TGPLQRGNL

SEQ ID NO: 520415 - protein, 9 aa, Homo Sapiens
GTKSITCQR

SEQ ID NO: 520416 - protein, 9 aa, Homo Sapiens
RVAGGGGLL

SEQ ID NO: 520417 - protein, 9 aa, Homo Sapiens
TGSSHLNKK

SEQ ID NO: 520418 - protein, 9 aa, Homo Sapiens
QEQKAEEKE

SEQ ID NO: 520419 - protein, 9 aa, Homo Sapiens
SRLGAHRQP

SEQ ID NO: 520420 - protein, 9 aa, Homo Sapiens
NHLMRELDF

SEQ ID NO: 520421 - protein, 9 aa, Homo Sapiens
ILAYCSLSF

SEQ ID NO: 520422 - protein, 9 aa, Homo Sapiens
VPAVGKKPL

SEQ ID NO: 520423 - protein, 9 aa, Homo Sapiens
STKEHFACE

SEQ ID NO: 520424 - protein, 9 aa, Homo Sapiens
VPGESPKER

SEQ ID NO: 520425 - protein, 9 aa, Homo Sapiens
GDIENIARE

SEQ ID NO: 520426 - protein, 9 aa, Homo Sapiens
WAQLRLDFI

SEQ ID NO: 520427 - protein, 9 aa, Homo Sapiens
IYFFPFFFI

SEQ ID NO: 520428 - protein, 9 aa, Homo Sapiens
HLPTLASRV

SEQ ID NO: 520429 - protein, 9 aa, Homo Sapiens
RLQELERLR

SEQ ID NO: 520430 - protein, 9 aa, Homo Sapiens
LFRLAVSDL

SEQ ID NO: 520431 - protein, 9 aa, Homo Sapiens
FGANGEVRC

SEQ ID NO: 520432 - protein, 9 aa, Homo Sapiens
ASWMHAHHG

SEQ ID NO: 520433 - protein, 9 aa, Homo Sapiens
TNYYLFRLA

SEQ ID NO: 520434 - protein, 9 aa, Homo Sapiens
ETAAPSDIV

SEQ ID NO: 520435 - protein, 9 aa, Homo Sapiens
VLGCAAVAA

SEQ ID NO: 520436 - protein, 9 aa, Homo Sapiens
AVWREGRFT

SEQ ID NO: 520437 - protein, 9 aa, Homo Sapiens
LACMDIYMI

SEQ ID NO: 520438 - protein, 9 aa, Homo Sapiens
NTGSSHLNK

SEQ ID NO: 520439 - protein, 9 aa, Homo Sapiens
VDVVMDDLL

SEQ ID NO: 520440 - protein, 9 aa, Homo Sapiens
VEQNISVRQ

SEQ ID NO: 520441 - protein, 9 aa, Homo Sapiens
AQPADEPSE

SEQ ID NO: 520442 - protein, 9 aa, Homo Sapiens
EGTTQLTST

SEQ ID NO: 520443 - protein, 9 aa, Homo Sapiens
YQDRAGAAA

SEQ ID NO: 520444 - protein, 9 aa, Homo Sapiens
TKSITCQRI

SEQ ID NO: 520445 - protein, 9 aa, Homo Sapiens
LGYQDRAGA

SEQ ID NO: 520446 - protein, 9 aa, Homo Sapiens
FSNEVFPQG

SEQ ID NO: 520447 - protein, 9 aa, Homo Sapiens
GGGGLLEEV

SEQ ID NO: 520448 - protein, 9 aa, Homo Sapiens
LDFGANGEV

SEQ ID NO: 520449 - protein, 9 aa, Homo Sapiens
TYDGPDPGC

SEQ ID NO: 520450 - protein, 9 aa, Homo Sapiens
GPQNTGSSH

SEQ ID NO: 520451 - protein, 9 aa, Homo Sapiens
TLASRVAGT

SEQ ID NO: 520452 - protein, 9 aa, Homo Sapiens
FPFFFILVP

SEQ ID NO: 520453 - protein, 9 aa, Homo Sapiens
RCSVPGESP

SEQ ID NO: 520454 - protein, 9 aa, Homo Sapiens
GRGDIENIA

SEQ ID NO: 520455 - protein, 9 aa, Homo Sapiens
VPRLECSGT

SEQ ID NO: 520456 - protein, 9 aa, Homo Sapiens
LSIPGYTEP

SEQ ID NO: 520457 - protein, 9 aa, Homo Sapiens
YADGVNLTE

SEQ ID NO: 520458 - protein, 9 aa, Homo Sapiens
RMAMPETEW

SEQ ID NO: 520459 - protein, 9 aa, Homo Sapiens
RRCSVPGES

SEQ ID NO: 520460 - protein, 9 aa, Homo Sapiens
ERLQELERL

SEQ ID NO: 520461 - protein, 9 aa, Homo Sapiens
PVSSVPAVG

SEQ ID NO: 520462 - protein, 9 aa, Homo Sapiens
LKLVSTLLM

SEQ ID NO: 520463 - protein, 9 aa, Homo Sapiens
YCSLSFPGS

SEQ ID NO: 520464 - protein, 9 aa, Homo Sapiens
HHGSSRCTD

SEQ ID NO: 520465 - protein, 9 aa, Homo Sapiens
PFTAENWKK

SEQ ID NO: 520466 - protein, 9 aa, Homo Sapiens
SHKNLIELR

SEQ ID NO: 520467 - protein, 9 aa, Homo Sapiens
TAGARHHTR

SEQ ID NO: 520468 - protein, 9 aa, Homo Sapiens
DFFIVVAGH

SEQ ID NO: 520469 - protein, 9 aa, Homo Sapiens
ECSGTILAY

SEQ ID NO: 520470 - protein, 9 aa, Homo Sapiens
ANDRQCFQT

SEQ ID NO: 520471 - protein, 9 aa, Homo Sapiens
STLLMMGIF

SEQ ID NO: 520472 - protein, 9 aa, Homo Sapiens
HLARHQKIY

SEQ ID NO: 520473 - protein, 9 aa, Homo Sapiens
DEDYVLQGT

SEQ ID NO: 520474 - protein, 9 aa, Homo Sapiens
LQWAQLRLD

SEQ ID NO: 520475 - protein, 9 aa, Homo Sapiens
LAPWGRAVP

SEQ ID NO: 520476 - protein, 9 aa, Homo Sapiens
CGDAAALCA

SEQ ID NO: 520477 - protein, 9 aa, Homo Sapiens
REPLGYQDR

SEQ ID NO: 520478 - protein, 9 aa, Homo Sapiens
NVKLWANDR

SEQ ID NO: 520479 - protein, 9 aa, Homo Sapiens
PREWELGKE

SEQ ID NO: 520480 - protein, 9 aa, Homo Sapiens
EVHANHLMR

SEQ ID NO: 520481 - protein, 9 aa, Homo Sapiens
ANHLMRELD

SEQ ID NO: 520482 - protein, 9 aa, Homo Sapiens
PQSFFFFFL

SEQ ID NO: 520483 - protein, 9 aa, Homo Sapiens
EESRLGAHR

SEQ ID NO: 520484 - protein, 9 aa, Homo Sapiens
AALCAVWRE

SEQ ID NO: 520485 - protein, 9 aa, Homo Sapiens
PQFPLQIPG

SEQ ID NO: 520486 - protein, 9 aa, Homo Sapiens
LRIPNFTDQ

SEQ ID NO: 520487 - protein, 9 aa, Homo Sapiens
RVAGTAGAR

SEQ ID NO: 520488 - protein, 9 aa, Homo Sapiens
PEMERQRLQ

SEQ ID NO: 520489 - protein, 9 aa, Homo Sapiens
IDCLDRTNV

SEQ ID NO: 520490 - protein, 9 aa, Homo Sapiens
LCAVWREGR

SEQ ID NO: 520491 - protein, 9 aa, Homo Sapiens
DPGCIFGLE

SEQ ID NO: 520492 - protein, 9 aa, Homo Sapiens
HQKIYSGEK

SEQ ID NO: 520493 - protein, 9 aa, Homo Sapiens
DYVLQGTKS

SEQ ID NO: 520494 - protein, 9 aa, Homo Sapiens
VAGGGGLLE

SEQ ID NO: 520495 - protein, 9 aa, Homo Sapiens
QSSKATPVQ

SEQ ID NO: 520496 - protein, 9 aa, Homo Sapiens
AMPETEWTT

SEQ ID NO: 520497 - protein, 9 aa, Homo Sapiens
PLGYQDRAG

SEQ ID NO: 520498 - protein, 9 aa, Homo Sapiens
TAENWKKTM

SEQ ID NO: 520499 - protein, 9 aa, Homo Sapiens
AVAWDLELS

SEQ ID NO: 520500 - protein, 9 aa, Homo Sapiens
AAPPRHQPR

SEQ ID NO: 520501 - protein, 9 aa, Homo Sapiens
NFDKKRKVK

SEQ ID NO: 520502 - protein, 9 aa, Homo Sapiens
FTLVNSTSA

SEQ ID NO: 520503 - protein, 9 aa, Homo Sapiens
DDRYPALQW

SEQ ID NO: 520504 - protein, 9 aa, Homo Sapiens
APATPKADK

SEQ ID NO: 520505 - protein, 9 aa, Homo Sapiens
FGVQTYKLT

SEQ ID NO: 520506 - protein, 9 aa, Homo Sapiens
ALQWAQLRL

SEQ ID NO: 520507 - protein, 9 aa, Homo Sapiens
IYMINLLLV

SEQ ID NO: 520508 - protein, 9 aa, Homo Sapiens
CSLSFPGSS

SEQ ID NO: 520509 - protein, 9 aa, Homo Sapiens
RGSPVSSVP

SEQ ID NO: 520510 - protein, 9 aa, Homo Sapiens
YKLTPNELF

SEQ ID NO: 520511 - protein, 9 aa, Homo Sapiens
GSFGVQTYK

SEQ ID NO: 520512 - protein, 9 aa, Homo Sapiens
VFRSNCIDC

SEQ ID NO: 520513 - protein, 9 aa, Homo Sapiens
RAGAAAPPR

SEQ ID NO: 520514 - protein, 9 aa, Homo Sapiens
YYMLHETAA

SEQ ID NO: 520515 - protein, 9 aa, Homo Sapiens
AAALCAVWR

SEQ ID NO: 520516 - protein, 9 aa, Homo Sapiens
DAEVHANHL

SEQ ID NO: 520517 - protein, 9 aa, Homo Sapiens
LLILRIPNF

SEQ ID NO: 520518 - protein, 9 aa, Homo Sapiens
EGFPQFPLQ

SEQ ID NO: 520519 - protein, 9 aa, Homo Sapiens
HSPVAENDI

SEQ ID NO: 520520 - protein, 9 aa, Homo Sapiens
EFTPEMERQ

SEQ ID NO: 520521 - protein, 9 aa, Homo Sapiens
EEVLGCAAV

SEQ ID NO: 520522 - protein, 9 aa, Homo Sapiens
AHHGSSRCT

SEQ ID NO: 520523 - protein, 9 aa, Homo Sapiens
LVNVKLWAN

SEQ ID NO: 520524 - protein, 9 aa, Homo Sapiens
GSSHLNKKG

SEQ ID NO: 520525 - protein, 9 aa, Homo Sapiens
KASIQLSET

SEQ ID NO: 520526 - protein, 9 aa, Homo Sapiens
GTTQLTSTP

SEQ ID NO: 520527 - protein, 9 aa, Homo Sapiens
ADGVNLTEK

SEQ ID NO: 520528 - protein, 9 aa, Homo Sapiens
FACEYDCYG

SEQ ID NO: 520529 - protein, 9 aa, Homo Sapiens
APPRHQPRA

SEQ ID NO: 520530 - protein, 9 aa, Homo Sapiens
QKIYSGEKP

SEQ ID NO: 520531 - protein, 9 aa, Homo Sapiens
EHSHKNLIE

SEQ ID NO: 520532 - protein, 9 aa, Homo Sapiens
GTAGARHHT

SEQ ID NO: 520533 - protein, 9 aa, Homo Sapiens
ERGSPVSSV

SEQ ID NO: 520534 - protein, 9 aa, Homo Sapiens
KELSGKVES

SEQ ID NO: 520535 - protein, 9 aa, Homo Sapiens
CIFGLENLI

SEQ ID NO: 520536 - protein, 9 aa, Homo Sapiens
SEHSHKNLI

SEQ ID NO: 520537 - protein, 9 aa, Homo Sapiens
HSHKNLIEL

SEQ ID NO: 520538 - protein, 9 aa, Homo Sapiens
MPQSFFFFF

SEQ ID NO: 520539 - protein, 9 aa, Homo Sapiens
STFEGFPQF

SEQ ID NO: 520540 - protein, 9 aa, Homo Sapiens
AENWKKTMD

SEQ ID NO: 520541 - protein, 9 aa, Homo Sapiens
SSKATPVQT

SEQ ID NO: 520542 - protein, 9 aa, Homo Sapiens
AMYFCVMRE

SEQ ID NO: 520543 - protein, 9 aa, Homo Sapiens
NFSNEVFPQ

SEQ ID NO: 520544 - protein, 9 aa, Homo Sapiens
LPTLASRVA

SEQ ID NO: 520545 - protein, 9 aa, Homo Sapiens
QRLEQQDQL

SEQ ID NO: 520546 - protein, 9 aa, Homo Sapiens
LRVISAEVK

SEQ ID NO: 520547 - protein, 9 aa, Homo Sapiens
MMGIFGDED

SEQ ID NO: 520548 - protein, 9 aa, Homo Sapiens
EGVFRSNCI

SEQ ID NO: 520549 - protein, 9 aa, Homo Sapiens
DGVNLTEKI

SEQ ID NO: 520550 - protein, 9 aa, Homo Sapiens
KLWANDRQC

SEQ ID NO: 520551 - protein, 9 aa, Homo Sapiens
PADEPSEKA

SEQ ID NO: 520552 - protein, 9 aa, Homo Sapiens
ACEYDCYGD

SEQ ID NO: 520553 - protein, 9 aa, Homo Sapiens
SRVAGTAGA

SEQ ID NO: 520554 - protein, 9 aa, Homo Sapiens
HETAAPSDI

SEQ ID NO: 520555 - protein, 9 aa, Homo Sapiens
SPVAENDIL

SEQ ID NO: 520556 - protein, 9 aa, Homo Sapiens
GANGEVRCN

SEQ ID NO: 520557 - protein, 9 aa, Homo Sapiens
MDIYMINLL

SEQ ID NO: 520558 - protein, 9 aa, Homo Sapiens
ETSQKETSI

SEQ ID NO: 520559 - protein, 9 aa, Homo Sapiens
QELERLQEL

SEQ ID NO: 520560 - protein, 9 aa, Homo Sapiens
STPSEGTTQ

SEQ ID NO: 520561 - protein, 9 aa, Homo Sapiens
QQDQLLACK

SEQ ID NO: 520562 - protein, 9 aa, Homo Sapiens
PSEGTTQLT

SEQ ID NO: 520563 - protein, 9 aa, Homo Sapiens
CLAPWGRAV

SEQ ID NO: 520564 - protein, 9 aa, Homo Sapiens
RFTALATSS

SEQ ID NO: 520565 - protein, 9 aa, Homo Sapiens
FRLAVSDLL

SEQ ID NO: 520566 - protein, 9 aa, Homo Sapiens
HFRKALSIP

SEQ ID NO: 520567 - protein, 9 aa, Homo Sapiens
ANEKWGRGD

SEQ ID NO: 520568 - protein, 9 aa, Homo Sapiens
GGGLLEEVL

SEQ ID NO: 520569 - protein, 9 aa, Homo Sapiens
EAQSSKATP

SEQ ID NO: 520570 - protein, 9 aa, Homo Sapiens
ILCWNGQEL

SEQ ID NO: 520571 - protein, 9 aa, Homo Sapiens
LLEEVLGCA

SEQ ID NO: 520572 - protein, 9 aa, Homo Sapiens
IVVAGHDGV

SEQ ID NO: 520573 - protein, 9 aa, Homo Sapiens
LQAYADGVN

SEQ ID NO: 520574 - protein, 9 aa, Homo Sapiens
RHQKIYSGE

SEQ ID NO: 520575 - protein, 9 aa, Homo Sapiens
PAPRQEQKA

SEQ ID NO: 520576 - protein, 9 aa, Homo Sapiens
TIKGYGCAE

SEQ ID NO: 520577 - protein, 9 aa, Homo Sapiens
GAAAPPRHQ

SEQ ID NO: 520578 - protein, 9 aa, Homo Sapiens
YGCAEVSSV

SEQ ID NO: 520579 - protein, 9 aa, Homo Sapiens
VRQRQGVSI

SEQ ID NO: 520580 - protein, 9 aa, Homo Sapiens
NLLILRIPN

SEQ ID NO: 520581 - protein, 9 aa, Homo Sapiens
GCIFGLENL

SEQ ID NO: 520582 - protein, 9 aa, Homo Sapiens
KWGRGDIEN

SEQ ID NO: 520583 - protein, 9 aa, Homo Sapiens
ENDILCWNG

SEQ ID NO: 520584 - protein, 9 aa, Homo Sapiens
RCGDAAALC

SEQ ID NO: 520585 - protein, 9 aa, Homo Sapiens
EPSEKADEP

SEQ ID NO: 520586 - protein, 9 aa, Homo Sapiens
WGRGDIENI

SEQ ID NO: 520587 - protein, 9 aa, Homo Sapiens
SSVPAVGKK

SEQ ID NO: 520588 - protein, 9 aa, Homo Sapiens
TQLTSTPVS

SEQ ID NO: 520589 - protein, 9 aa, Homo Sapiens
GTILAYCSL

SEQ ID NO: 520590 - protein, 9 aa, Homo Sapiens
YGQFTLVNS

SEQ ID NO: 520591 - protein, 9 aa, Homo Sapiens
TQREPLGYQ

SEQ ID NO: 520592 - protein, 9 aa, Homo Sapiens
VSGKASIQL

SEQ ID NO: 520593 - protein, 9 aa, Homo Sapiens
KKLSCWEVI

SEQ ID NO: 520594 - protein, 9 aa, Homo Sapiens
LAVAWDLEL

SEQ ID NO: 520595 - protein, 9 aa, Homo Sapiens
EILAVAWDL

SEQ ID NO: 520596 - protein, 9 aa, Homo Sapiens
TREIFVLFL

SEQ ID NO: 520597 - protein, 9 aa, Homo Sapiens
VDAEVHANH

SEQ ID NO: 520598 - protein, 9 aa, Homo Sapiens
EMERQRLQY

SEQ ID NO: 520599 - protein, 9 aa, Homo Sapiens
QNISVRQRQ

SEQ ID NO: 520600 - protein, 9 aa, Homo Sapiens
AGAAAPPRH

SEQ ID NO: 520601 - protein, 9 aa, Homo Sapiens
GVNLTEKIP

SEQ ID NO: 520602 - protein, 9 aa, Homo Sapiens
NKDNFSNEV

SEQ ID NO: 520603 - protein, 9 aa, Homo Sapiens
DSSSRRCSV

SEQ ID NO: 520604 - protein, 9 aa, Homo Sapiens
VRVAGGGGL

SEQ ID NO: 520605 - protein, 9 aa, Homo Sapiens
RQEILAVAW

SEQ ID NO: 520606 - protein, 9 aa, Homo Sapiens
GDSAMYFCV

SEQ ID NO: 520607 - protein, 9 aa, Homo Sapiens
NEKWGRGDI

SEQ ID NO: 520608 - protein, 9 aa, Homo Sapiens
YLFRLAVSD

SEQ ID NO: 520609 - protein, 9 aa, Homo Sapiens
SGKASIQLS

SEQ ID NO: 520610 - protein, 9 aa, Homo Sapiens
SLSFPGSSH

SEQ ID NO: 520611 - protein, 9 aa, Homo Sapiens
SEFTPEMER

SEQ ID NO: 520612 - protein, 9 aa, Homo Sapiens
HFACEYDCY

SEQ ID NO: 520613 - protein, 9 aa, Homo Sapiens
FDKKRKVKT

SEQ ID NO: 520614 - protein, 9 aa, Homo Sapiens
HRSRNHDVS

SEQ ID NO: 520615 - protein, 9 aa, Homo Sapiens
DAAALCAVW

SEQ ID NO: 520616 - protein, 9 aa, Homo Sapiens
PAQPADEPS

SEQ ID NO: 520617 - protein, 9 aa, Homo Sapiens
QREPLGYQD

SEQ ID NO: 520618 - protein, 9 aa, Homo Sapiens
GYQDRAGAA

SEQ ID NO: 520619 - protein, 9 aa, Homo Sapiens
TSQKETSIC

SEQ ID NO: 520620 - protein, 9 aa, Homo Sapiens
YFFPFFFIL

SEQ ID NO: 520621 - protein, 9 aa, Homo Sapiens
CIDCLDRTN

SEQ ID NO: 520622 - protein, 9 aa, Homo Sapiens
DIKAMVEQS

SEQ ID NO: 520623 - protein, 9 aa, Homo Sapiens
GRTQREPLG

SEQ ID NO: 520624 - protein, 9 aa, Homo Sapiens
NWKKTMDKI

SEQ ID NO: 520625 - protein, 9 aa, Homo Sapiens
VNLTEKIPL

SEQ ID NO: 520626 - protein, 9 aa, Homo Sapiens
AGARHHTRE

SEQ ID NO: 520627 - protein, 9 aa, Homo Sapiens
YTEPREWEL

SEQ ID NO: 520628 - protein, 9 aa, Homo Sapiens
CSVPGESPK

SEQ ID NO: 520629 - protein, 9 aa, Homo Sapiens
SAPATPKAD

SEQ ID NO: 520630 - protein, 9 aa, Homo Sapiens
IPGYTEPRE

SEQ ID NO: 520631 - protein, 9 aa, Homo Sapiens
SNCIDCLDR

SEQ ID NO: 520632 - protein, 9 aa, Homo Sapiens
LKLACMDIY

SEQ ID NO: 520633 - protein, 9 aa, Homo Sapiens
SFFFFFLFF

SEQ ID NO: 520634 - protein, 9 aa, Homo Sapiens
NLIELRREF

SEQ ID NO: 520635 - protein, 9 aa, Homo Sapiens
TRDLDFGAN

SEQ ID NO: 520636 - protein, 9 aa, Homo Sapiens
RKALSIPGY

SEQ ID NO: 520637 - protein, 9 aa, Homo Sapiens
VKLWANDRQ

SEQ ID NO: 520638 - protein, 9 aa, Homo Sapiens
ESPAPRQEQ

SEQ ID NO: 520639 - protein, 9 aa, Homo Sapiens
ALSIPGYTE

SEQ ID NO: 520640 - protein, 9 aa, Homo Sapiens
SVPAVGKKP

SEQ ID NO: 520641 - protein, 9 aa, Homo Sapiens
LQELERLQE

SEQ ID NO: 520642 - protein, 9 aa, Homo Sapiens
KKRKVKTNK

SEQ ID NO: 520643 - protein, 9 aa, Homo Sapiens
TTQLTSTPV

SEQ ID NO: 520644 - protein, 9 aa, Homo Sapiens
RLEQQDQLL

SEQ ID NO: 520645 - protein, 9 aa, Homo Sapiens
HLMRELDFA

SEQ ID NO: 520646 - protein, 9 aa, Homo Sapiens
RGNLSPGAL

SEQ ID NO: 520647 - protein, 9 aa, Homo Sapiens
QFTLVNSTS

SEQ ID NO: 520648 - protein, 9 aa, Homo Sapiens
KLSCWEVID

SEQ ID NO: 520649 - protein, 9 aa, Homo Sapiens
YPALQWAQL

SEQ ID NO: 520650 - protein, 9 aa, Homo Sapiens
VISGPQNTG

SEQ ID NO: 520651 - protein, 9 aa, Homo Sapiens
GPDPGCIFG

SEQ ID NO: 520652 - protein, 9 aa, Homo Sapiens
GYGCAEVSS

SEQ ID NO: 520653 - protein, 9 aa, Homo Sapiens
QSFFFFFLF

SEQ ID NO: 520654 - protein, 9 aa, Homo Sapiens
ASIQLSETI

SEQ ID NO: 520655 - protein, 9 aa, Homo Sapiens
RVISAEVKF

SEQ ID NO: 520656 - protein, 9 aa, Homo Sapiens
ERYGQFTLV

SEQ ID NO: 520657 - protein, 9 aa, Homo Sapiens
DGPDPGCIF

SEQ ID NO: 520658 - protein, 9 aa, Homo Sapiens
AAVAAEKEI

SEQ ID NO: 520659 - protein, 9 aa, Homo Sapiens
NDRQCFQTI

SEQ ID NO: 520660 - protein, 9 aa, Homo Sapiens
QKETSICDI

SEQ ID NO: 520661 - protein, 9 aa, Homo Sapiens
TEPREWELG

SEQ ID NO: 520662 - protein, 9 aa, Homo Sapiens
IKGYGCAEV

SEQ ID NO: 520663 - protein, 9 aa, Homo Sapiens
RSNCIDCLD

SEQ ID NO: 520664 - protein, 9 aa, Homo Sapiens
LQGTKSITC

SEQ ID NO: 520665 - protein, 9 aa, Homo Sapiens
DGVLVGRTQ

SEQ ID NO: 520666 - protein, 9 aa, Homo Sapiens
EGRFTALAT

SEQ ID NO: 520667 - protein, 9 aa, Homo Sapiens
MDDLLPIKD

SEQ ID NO: 520668 - protein, 9 aa, Homo Sapiens
KALSIPGYT

SEQ ID NO: 520669 - protein, 9 aa, Homo Sapiens
ASRVAGTAG

SEQ ID NO: 520670 - protein, 9 aa, Homo Sapiens
EHFACEYDC

SEQ ID NO: 520671 - protein, 9 aa, Homo Sapiens
PQNTGSSHL

SEQ ID NO: 520672 - protein, 9 aa, Homo Sapiens
QNFDKKRKV

SEQ ID NO: 520673 - protein, 9 aa, Homo Sapiens
RGDIENIAR

SEQ ID NO: 520674 - protein, 9 aa, Homo Sapiens
AAPSDIVGA

SEQ ID NO: 520675 - protein, 9 aa, Homo Sapiens
TSICDICQF

SEQ ID NO: 520676 - protein, 9 aa, Homo Sapiens
GSPVSSVPA

SEQ ID NO: 520677 - protein, 9 aa, Homo Sapiens
YVLQGTKSI

SEQ ID NO: 520678 - protein, 9 aa, Homo Sapiens
EGKNKDNFS

SEQ ID NO: 520679 - protein, 9 aa, Homo Sapiens
REGRFTALA

SEQ ID NO: 520680 - protein, 9 aa, Homo Sapiens
ELGKELSGK

SEQ ID NO: 520681 - protein, 9 aa, Homo Sapiens
CAVWREGRF

SEQ ID NO: 520682 - protein, 9 aa, Homo Sapiens
EESEHSHKN

SEQ ID NO: 520683 - protein, 9 aa, Homo Sapiens
PGYTEPREW

SEQ ID NO: 520684 - protein, 9 aa, Homo Sapiens
APHLASAPA

SEQ ID NO: 520685 - protein, 9 aa, Homo Sapiens
IKAMVEQSI

SEQ ID NO: 520686 - protein, 9 aa, Homo Sapiens
DMQLRVISA

SEQ ID NO: 520687 - protein, 9 aa, Homo Sapiens
PWGRAVPLP

SEQ ID NO: 520688 - protein, 9 aa, Homo Sapiens
LVLCLAPWG

SEQ ID NO: 520689 - protein, 9 aa, Homo Sapiens
TPASWMHAH

SEQ ID NO: 520690 - protein, 9 aa, Homo Sapiens
VLCLAPWGR

SEQ ID NO: 520691 - protein, 9 aa, Homo Sapiens
SSRRCSVPG

SEQ ID NO: 520692 - protein, 9 aa, Homo Sapiens
TPEMERQRL

SEQ ID NO: 520693 - protein, 9 aa, Homo Sapiens
EKWGRGDIE

SEQ ID NO: 520694 - protein, 9 aa, Homo Sapiens
SQKETSICD

SEQ ID NO: 520695 - protein, 9 aa, Homo Sapiens
DNFSNEVFP

SEQ ID NO: 520696 - protein, 9 aa, Homo Sapiens
ACMDIYMIN

SEQ ID NO: 520697 - protein, 9 aa, Homo Sapiens
QEILAVAWD

SEQ ID NO: 520698 - protein, 9 aa, Homo Sapiens
EWVDVVMDD

SEQ ID NO: 520699 - protein, 9 aa, Homo Sapiens
QLSETISEG

SEQ ID NO: 520700 - protein, 9 aa, Homo Sapiens
RYPALQWAQ

SEQ ID NO: 520701 - protein, 9 aa, Homo Sapiens
HTREIFVLF

SEQ ID NO: 520702 - protein, 9 aa, Homo Sapiens
FFILVPRLE

SEQ ID NO: 520703 - protein, 9 aa, Homo Sapiens
QLTSTPVSH

SEQ ID NO: 520704 - protein, 9 aa, Homo Sapiens
DRAGAAAPP

SEQ ID NO: 520705 - protein, 9 aa, Homo Sapiens
QRQGVSIGR

SEQ ID NO: 520706 - protein, 9 aa, Homo Sapiens
EQNISVRQR

SEQ ID NO: 520707 - protein, 9 aa, Homo Sapiens
ASAPATPKA

SEQ ID NO: 520708 - protein, 9 aa, Homo Sapiens
KQNERYGQF

SEQ ID NO: 520709 - protein, 9 aa, Homo Sapiens
SCWEVIDVV

SEQ ID NO: 520710 - protein, 9 aa, Homo Sapiens
NISVRQRQG

SEQ ID NO: 520711 - protein, 9 aa, Homo Sapiens
SPRCGDAAA

SEQ ID NO: 520712 - protein, 9 aa, Homo Sapiens
TPTNYYLFR

SEQ ID NO: 520713 - protein, 9 aa, Homo Sapiens
LASRVAGTA

SEQ ID NO: 520714 - protein, 9 aa, Homo Sapiens
AMVEQSICR

SEQ ID NO: 520715 - protein, 9 aa, Homo Sapiens
REWELGKEL

SEQ ID NO: 520716 - protein, 9 aa, Homo Sapiens
LPSWTHRSR

SEQ ID NO: 520717 - protein, 9 aa, Homo Sapiens
ENKEAQSSK

SEQ ID NO: 520718 - protein, 9 aa, Homo Sapiens
SSPRCGDAA

SEQ ID NO: 520719 - protein, 9 aa, Homo Sapiens
PPFTAENWK

SEQ ID NO: 520720 - protein, 9 aa, Homo Sapiens
SEGTTQLTS

SEQ ID NO: 520721 - protein, 9 aa, Homo Sapiens
RQEQKAEEK

SEQ ID NO: 520722 - protein, 9 aa, Homo Sapiens
PASWMHAHH

SEQ ID NO: 520723 - protein, 9 aa, Homo Sapiens
DIYMINLLL

SEQ ID NO: 520724 - protein, 9 aa, Homo Sapiens
DKKRKVKTN

SEQ ID NO: 520725 - protein, 9 aa, Homo Sapiens
LVPRLECSG

SEQ ID NO: 520726 - protein, 9 aa, Homo Sapiens
KNLIELRRE

SEQ ID NO: 520727 - protein, 9 aa, Homo Sapiens
SAEVKFLDT

SEQ ID NO: 520728 - protein, 9 aa, Homo Sapiens
GGLLEEVLG

SEQ ID NO: 520729 - protein, 9 aa, Homo Sapiens
MPETEWTTV

SEQ ID NO: 520730 - protein, 9 aa, Homo Sapiens
MERQRLQYL

SEQ ID NO: 520731 - protein, 9 aa, Homo Sapiens
LGKELSGKV

SEQ ID NO: 520732 - protein, 9 aa, Homo Sapiens
VHANHLMRE

SEQ ID NO: 520733 - protein, 9 aa, Homo Sapiens
LASAPATPK

SEQ ID NO: 520734 - protein, 9 aa, Homo Sapiens
LWANDRQCF

SEQ ID NO: 520735 - protein, 9 aa, Homo Sapiens
VAGTAGARH

SEQ ID NO: 520736 - protein, 9 aa, Homo Sapiens
VVAGHDGVL

SEQ ID NO: 520737 - protein, 9 aa, Homo Sapiens
AGHDGVLVG

SEQ ID NO: 520738 - protein, 9 aa, Homo Sapiens
AGRVRQGLI

SEQ ID NO: 520739 - protein, 9 aa, Homo Sapiens
RNNTWPNCD

SEQ ID NO: 520740 - protein, 9 aa, Homo Sapiens
LSALCGFPV

SEQ ID NO: 520741 - protein, 9 aa, Homo Sapiens
MYEERDAWV

SEQ ID NO: 520742 - protein, 9 aa, Homo Sapiens
EMHIRASEH

SEQ ID NO: 520743 - protein, 9 aa, Homo Sapiens
KQLREVQES

SEQ ID NO: 520744 - protein, 9 aa, Homo Sapiens
EEDHFDRSM

SEQ ID NO: 520745 - protein, 9 aa, Homo Sapiens
WHFEATMYE

SEQ ID NO: 520746 - protein, 9 aa, Homo Sapiens
YYHRFTCNI

SEQ ID NO: 520747 - protein, 9 aa, Homo Sapiens
TSSGERLLL

SEQ ID NO: 520748 - protein, 9 aa, Homo Sapiens
LQVDAVSQA

SEQ ID NO: 520749 - protein, 9 aa, Homo Sapiens
KSRKLGIYW

SEQ ID NO: 520750 - protein, 9 aa, Homo Sapiens
RWGLLSSKT

SEQ ID NO: 520751 - protein, 9 aa, Homo Sapiens
VSLEISSKC

SEQ ID NO: 520752 - protein, 9 aa, Homo Sapiens
PVLALRLDA

SEQ ID NO: 520753 - protein, 9 aa, Homo Sapiens
HTRFPSVIQ

SEQ ID NO: 520754 - protein, 9 aa, Homo Sapiens
EQAHIPILD

SEQ ID NO: 520755 - protein, 9 aa, Homo Sapiens
AVTHKQSYY

SEQ ID NO: 520756 - protein, 9 aa, Homo Sapiens
KRRQHAELE

SEQ ID NO: 520757 - protein, 9 aa, Homo Sapiens
LWEKHLKEI

SEQ ID NO: 520758 - protein, 9 aa, Homo Sapiens
AVILTAHVE

SEQ ID NO: 520759 - protein, 9 aa, Homo Sapiens
QLCSSGTSP

SEQ ID NO: 520760 - protein, 9 aa, Homo Sapiens
WTSNMVGLS

SEQ ID NO: 520761 - protein, 9 aa, Homo Sapiens
LQVPCSAQA

SEQ ID NO: 520762 - protein, 9 aa, Homo Sapiens
KKRVFSGIK

SEQ ID NO: 520763 - protein, 9 aa, Homo Sapiens
GIPALYGPR

SEQ ID NO: 520764 - protein, 9 aa, Homo Sapiens
NTWPNCDQS

SEQ ID NO: 520765 - protein, 9 aa, Homo Sapiens
TRGWTTSSH

SEQ ID NO: 520766 - protein, 9 aa, Homo Sapiens
IMESMGLKL

SEQ ID NO: 520767 - protein, 9 aa, Homo Sapiens
SERPQLSWP

SEQ ID NO: 520768 - protein, 9 aa, Homo Sapiens
ITENLMRPS

SEQ ID NO: 520769 - protein, 9 aa, Homo Sapiens
LAVKEGGAG

SEQ ID NO: 520770 - protein, 9 aa, Homo Sapiens
KAENTIGTA

SEQ ID NO: 520771 - protein, 9 aa, Homo Sapiens
GLIQEVVDE

SEQ ID NO: 520772 - protein, 9 aa, Homo Sapiens
GHPPGSAFW

SEQ ID NO: 520773 - protein, 9 aa, Homo Sapiens
SFLSRHAPE

SEQ ID NO: 520774 - protein, 9 aa, Homo Sapiens
AGRGPSGAG

SEQ ID NO: 520775 - protein, 9 aa, Homo Sapiens
TIGTASSKT

SEQ ID NO: 520776 - protein, 9 aa, Homo Sapiens
DAEAEDETL

SEQ ID NO: 520777 - protein, 9 aa, Homo Sapiens
EIHNLIPVM

SEQ ID NO: 520778 - protein, 9 aa, Homo Sapiens
FSSGGEEDH

SEQ ID NO: 520779 - protein, 9 aa, Homo Sapiens
RGSPSTGFI

SEQ ID NO: 520780 - protein, 9 aa, Homo Sapiens
LSEMDTKIQ

SEQ ID NO: 520781 - protein, 9 aa, Homo Sapiens
EVFQTSYCL

SEQ ID NO: 520782 - protein, 9 aa, Homo Sapiens
PQPNEMHIR

SEQ ID NO: 520783 - protein, 9 aa, Homo Sapiens
IQEVVDEVD

SEQ ID NO: 520784 - protein, 9 aa, Homo Sapiens
RHIVSAGGD

SEQ ID NO: 520785 - protein, 9 aa, Homo Sapiens
LLLADMPFL

SEQ ID NO: 520786 - protein, 9 aa, Homo Sapiens
TLTSRIHTP

SEQ ID NO: 520787 - protein, 9 aa, Homo Sapiens
AVVSGIVSG

SEQ ID NO: 520788 - protein, 9 aa, Homo Sapiens
NVSALRTFT

SEQ ID NO: 520789 - protein, 9 aa, Homo Sapiens
VGGKGAGDV

SEQ ID NO: 520790 - protein, 9 aa, Homo Sapiens
AIKEFQFLL

SEQ ID NO: 520791 - protein, 9 aa, Homo Sapiens
ELAVGGKGA

SEQ ID NO: 520792 - protein, 9 aa, Homo Sapiens
LREVQESIR

SEQ ID NO: 520793 - protein, 9 aa, Homo Sapiens
TGAVVISLF

SEQ ID NO: 520794 - protein, 9 aa, Homo Sapiens
VFSGIKPTG

SEQ ID NO: 520795 - protein, 9 aa, Homo Sapiens
GDRVDIAEG

SEQ ID NO: 520796 - protein, 9 aa, Homo Sapiens
PPGDDIYDG

SEQ ID NO: 520797 - protein, 9 aa, Homo Sapiens
EVLKIGQHK

SEQ ID NO: 520798 - protein, 9 aa, Homo Sapiens
APQHCLIDG

SEQ ID NO: 520799 - protein, 9 aa, Homo Sapiens
MKPHRYRPG

SEQ ID NO: 520800 - protein, 9 aa, Homo Sapiens
GDFVQVTRN

SEQ ID NO: 520801 - protein, 9 aa, Homo Sapiens
GQEGFSQRW

SEQ ID NO: 520802 - protein, 9 aa, Homo Sapiens
SQSTAVTHK

SEQ ID NO: 520803 - protein, 9 aa, Homo Sapiens
FLSSRQVRN

SEQ ID NO: 520804 - protein, 9 aa, Homo Sapiens
QGLIQEVVD

SEQ ID NO: 520805 - protein, 9 aa, Homo Sapiens
TIVIFYQKN

SEQ ID NO: 520806 - protein, 9 aa, Homo Sapiens
VKALIEHEM

SEQ ID NO: 520807 - protein, 9 aa, Homo Sapiens
CANRGTLIK

SEQ ID NO: 520808 - protein, 9 aa, Homo Sapiens
QPNEMHIRA

SEQ ID NO: 520809 - protein, 9 aa, Homo Sapiens
RSVVGSSGV

SEQ ID NO: 520810 - protein, 9 aa, Homo Sapiens
WRTTEHALK

SEQ ID NO: 520811 - protein, 9 aa, Homo Sapiens
IKPTGILHL

SEQ ID NO: 520812 - protein, 9 aa, Homo Sapiens
WRCWLVFRK

SEQ ID NO: 520813 - protein, 9 aa, Homo Sapiens
PGEPGKEIH

SEQ ID NO: 520814 - protein, 9 aa, Homo Sapiens
NNTNELLKE

SEQ ID NO: 520815 - protein, 9 aa, Homo Sapiens
KVIETKSKE

SEQ ID NO: 520816 - protein, 9 aa, Homo Sapiens
LMPPAAPGT

SEQ ID NO: 520817 - protein, 9 aa, Homo Sapiens
GERLLLYHT

SEQ ID NO: 520818 - protein, 9 aa, Homo Sapiens
VVFFLSFLS

SEQ ID NO: 520819 - protein, 9 aa, Homo Sapiens
IKWLSCGLV

SEQ ID NO: 520820 - protein, 9 aa, Homo Sapiens
ETLFFMFYY

SEQ ID NO: 520821 - protein, 9 aa, Homo Sapiens
PPLDGTAGF

SEQ ID NO: 520822 - protein, 9 aa, Homo Sapiens
KGAGDVGSE

SEQ ID NO: 520823 - protein, 9 aa, Homo Sapiens
VNHTRFPSV

SEQ ID NO: 520824 - protein, 9 aa, Homo Sapiens
EKRRLLLES

SEQ ID NO: 520825 - protein, 9 aa, Homo Sapiens
NNSAQVLLL

SEQ ID NO: 520826 - protein, 9 aa, Homo Sapiens
RTKHETELS

SEQ ID NO: 520827 - protein, 9 aa, Homo Sapiens
PTRGWTTSS

SEQ ID NO: 520828 - protein, 9 aa, Homo Sapiens
GLKLSPGAQ

SEQ ID NO: 520829 - protein, 9 aa, Homo Sapiens
IDGVQEVFQ

SEQ ID NO: 520830 - protein, 9 aa, Homo Sapiens
KKAAENVKA

SEQ ID NO: 520831 - protein, 9 aa, Homo Sapiens
SLEISSKCM

SEQ ID NO: 520832 - protein, 9 aa, Homo Sapiens
VMTEVMHTI

SEQ ID NO: 520833 - protein, 9 aa, Homo Sapiens
GTKLGPEIQ

SEQ ID NO: 520834 - protein, 9 aa, Homo Sapiens
TKHETELSL

SEQ ID NO: 520835 - protein, 9 aa, Homo Sapiens
FTPLDSPQA

SEQ ID NO: 520836 - protein, 9 aa, Homo Sapiens
DEDVQYDED

SEQ ID NO: 520837 - protein, 9 aa, Homo Sapiens
ILDRSVVGS

SEQ ID NO: 520838 - protein, 9 aa, Homo Sapiens
SPSNPLPCQ

SEQ ID NO: 520839 - protein, 9 aa, Homo Sapiens
PGFPNEYDD

SEQ ID NO: 520840 - protein, 9 aa, Homo Sapiens
SPRMAETGD

SEQ ID NO: 520841 - protein, 9 aa, Homo Sapiens
ALHALWVAS

SEQ ID NO: 520842 - protein, 9 aa, Homo Sapiens
HLNNVFVFA

SEQ ID NO: 520843 - protein, 9 aa, Homo Sapiens
AGQQLYAAV

SEQ ID NO: 520844 - protein, 9 aa, Homo Sapiens
SLDHGVHAA

SEQ ID NO: 520845 - protein, 9 aa, Homo Sapiens
RMAETGDTS

SEQ ID NO: 520846 - protein, 9 aa, Homo Sapiens
SHVVHVNAQ

SEQ ID NO: 520847 - protein, 9 aa, Homo Sapiens
NAVQADEGG

SEQ ID NO: 520848 - protein, 9 aa, Homo Sapiens
DTSLSNGVK

SEQ ID NO: 520849 - protein, 9 aa, Homo Sapiens
FISYTVTIF

SEQ ID NO: 520850 - protein, 9 aa, Homo Sapiens
FQAQSCYPP

SEQ ID NO: 520851 - protein, 9 aa, Homo Sapiens
APQAGLVDA

SEQ ID NO: 520852 - protein, 9 aa, Homo Sapiens
GTGAVVISL

SEQ ID NO: 520853 - protein, 9 aa, Homo Sapiens
RPPDTWLHG

SEQ ID NO: 520854 - protein, 9 aa, Homo Sapiens
FNNTNELLK

SEQ ID NO: 520855 - protein, 9 aa, Homo Sapiens
FDSPSNPLP

SEQ ID NO: 520856 - protein, 9 aa, Homo Sapiens
VAEDQESAN

SEQ ID NO: 520857 - protein, 9 aa, Homo Sapiens
TTEIHNLIP

SEQ ID NO: 520858 - protein, 9 aa, Homo Sapiens
KHGPQVSLD

SEQ ID NO: 520859 - protein, 9 aa, Homo Sapiens
LQVIWGRIL

SEQ ID NO: 520860 - protein, 9 aa, Homo Sapiens
TRAQREHDA

SEQ ID NO: 520861 - protein, 9 aa, Homo Sapiens
SRKLGIYWR

SEQ ID NO: 520862 - protein, 9 aa, Homo Sapiens
LQDLAVKEG

SEQ ID NO: 520863 - protein, 9 aa, Homo Sapiens
ACVFRVEAW

SEQ ID NO: 520864 - protein, 9 aa, Homo Sapiens
VKCFSADFL

SEQ ID NO: 520865 - protein, 9 aa, Homo Sapiens
AGSPPAGRN

SEQ ID NO: 520866 - protein, 9 aa, Homo Sapiens
EMDTKIQEK

SEQ ID NO: 520867 - protein, 9 aa, Homo Sapiens
VPDVEKRRL

SEQ ID NO: 520868 - protein, 9 aa, Homo Sapiens
ASSFVLGIF

SEQ ID NO: 520869 - protein, 9 aa, Homo Sapiens
DTIVIFYQK

SEQ ID NO: 520870 - protein, 9 aa, Homo Sapiens
YNTLKTPGE

SEQ ID NO: 520871 - protein, 9 aa, Homo Sapiens
NVASCDSKC

SEQ ID NO: 520872 - protein, 9 aa, Homo Sapiens
SGIKPTGIL

SEQ ID NO: 520873 - protein, 9 aa, Homo Sapiens
TGAPQHCLI

SEQ ID NO: 520874 - protein, 9 aa, Homo Sapiens
FLSFLSRHA

SEQ ID NO: 520875 - protein, 9 aa, Homo Sapiens
HTICCAFDS

SEQ ID NO: 520876 - protein, 9 aa, Homo Sapiens
MRRSAAQSQ

SEQ ID NO: 520877 - protein, 9 aa, Homo Sapiens
CHDVSLSCS

SEQ ID NO: 520878 - protein, 9 aa, Homo Sapiens
LGPAPEPPN

SEQ ID NO: 520879 - protein, 9 aa, Homo Sapiens
CVPGKPTLV

SEQ ID NO: 520880 - protein, 9 aa, Homo Sapiens
DQGFYNGPF

SEQ ID NO: 520881 - protein, 9 aa, Homo Sapiens
TRDWRTTEH

SEQ ID NO: 520882 - protein, 9 aa, Homo Sapiens
GAGRVRQGL

SEQ ID NO: 520883 - protein, 9 aa, Homo Sapiens
RRTPTAPEN

SEQ ID NO: 520884 - protein, 9 aa, Homo Sapiens
TWPNCDQSD

SEQ ID NO: 520885 - protein, 9 aa, Homo Sapiens
DPAKTAKAL

SEQ ID NO: 520886 - protein, 9 aa, Homo Sapiens
FFAAICGAF

SEQ ID NO: 520887 - protein, 9 aa, Homo Sapiens
VVISLFMTP

SEQ ID NO: 520888 - protein, 9 aa, Homo Sapiens
PYCHQVRLT

SEQ ID NO: 520889 - protein, 9 aa, Homo Sapiens
TKLGPEIQR

SEQ ID NO: 520890 - protein, 9 aa, Homo Sapiens
LSLQALDLC

SEQ ID NO: 520891 - protein, 9 aa, Homo Sapiens
EFPLLVVFF

SEQ ID NO: 520892 - protein, 9 aa, Homo Sapiens
EEKRRQHAE

SEQ ID NO: 520893 - protein, 9 aa, Homo Sapiens
ASGTGAVVI

SEQ ID NO: 520894 - protein, 9 aa, Homo Sapiens
FGFSSQAES

SEQ ID NO: 520895 - protein, 9 aa, Homo Sapiens
WGLLSSKTY

SEQ ID NO: 520896 - protein, 9 aa, Homo Sapiens
PPTEGACVP

SEQ ID NO: 520897 - protein, 9 aa, Homo Sapiens
VSLSCSADW

SEQ ID NO: 520898 - protein, 9 aa, Homo Sapiens
ETQKVLNLK

SEQ ID NO: 520899 - protein, 9 aa, Homo Sapiens
HHGHKHRKR

SEQ ID NO: 520900 - protein, 9 aa, Homo Sapiens
VSPGSAFPD

SEQ ID NO: 520901 - protein, 9 aa, Homo Sapiens
QSNGAVVKD

SEQ ID NO: 520902 - protein, 9 aa, Homo Sapiens
WVVFFLSFL

SEQ ID NO: 520903 - protein, 9 aa, Homo Sapiens
QSCYPPGPG

SEQ ID NO: 520904 - protein, 9 aa, Homo Sapiens
DGALLGDRV

SEQ ID NO: 520905 - protein, 9 aa, Homo Sapiens
TAQRPSARL

SEQ ID NO: 520906 - protein, 9 aa, Homo Sapiens
IHTPFRLCV

SEQ ID NO: 520907 - protein, 9 aa, Homo Sapiens
DKKCDIMDT

SEQ ID NO: 520908 - protein, 9 aa, Homo Sapiens
GVNNNSAQV

SEQ ID NO: 520909 - protein, 9 aa, Homo Sapiens
VIELTKMLC

SEQ ID NO: 520910 - protein, 9 aa, Homo Sapiens
LLDADPAKT

SEQ ID NO: 520911 - protein, 9 aa, Homo Sapiens
IRFINLART

SEQ ID NO: 520912 - protein, 9 aa, Homo Sapiens
NINLGPYGN

SEQ ID NO: 520913 - protein, 9 aa, Homo Sapiens
AICGAFMFR

SEQ ID NO: 520914 - protein, 9 aa, Homo Sapiens
TEIKWLSCG

SEQ ID NO: 520915 - protein, 9 aa, Homo Sapiens
PPFQQQQQP

SEQ ID NO: 520916 - protein, 9 aa, Homo Sapiens
YTEIKWLSC

SEQ ID NO: 520917 - protein, 9 aa, Homo Sapiens
GDKKCDIMD

SEQ ID NO: 520918 - protein, 9 aa, Homo Sapiens
GGEEDHFDR

SEQ ID NO: 520919 - protein, 9 aa, Homo Sapiens
ADEDVQYDE

SEQ ID NO: 520920 - protein, 9 aa, Homo Sapiens
HCLIDGLLV

SEQ ID NO: 520921 - protein, 9 aa, Homo Sapiens
DVKGIPALY

SEQ ID NO: 520922 - protein, 9 aa, Homo Sapiens
PGSAFPDVK

SEQ ID NO: 520923 - protein, 9 aa, Homo Sapiens
LFFMFYYLE

SEQ ID NO: 520924 - protein, 9 aa, Homo Sapiens
FGDFVQVTR

SEQ ID NO: 520925 - protein, 9 aa, Homo Sapiens
RGTLIKVGQ

SEQ ID NO: 520926 - protein, 9 aa, Homo Sapiens
VVASSFVLG

SEQ ID NO: 520927 - protein, 9 aa, Homo Sapiens
LYAAVSHHD

SEQ ID NO: 520928 - protein, 9 aa, Homo Sapiens
AAICGAFMF

SEQ ID NO: 520929 - protein, 9 aa, Homo Sapiens
LVVFFISYT

SEQ ID NO: 520930 - protein, 9 aa, Homo Sapiens
QAESAINSV

SEQ ID NO: 520931 - protein, 9 aa, Homo Sapiens
HLSLQALDL

SEQ ID NO: 520932 - protein, 9 aa, Homo Sapiens
SNPLPCQKS

SEQ ID NO: 520933 - protein, 9 aa, Homo Sapiens
QAQSCYPPG

SEQ ID NO: 520934 - protein, 9 aa, Homo Sapiens
MKQTVAVGV

SEQ ID NO: 520935 - protein, 9 aa, Homo Sapiens
LRAQAAAPR

SEQ ID NO: 520936 - protein, 9 aa, Homo Sapiens
LRTFTVLRA

SEQ ID NO: 520937 - protein, 9 aa, Homo Sapiens
LVDALHALW

SEQ ID NO: 520938 - protein, 9 aa, Homo Sapiens
KPTGILHLG

SEQ ID NO: 520939 - protein, 9 aa, Homo Sapiens
GSQVVQYEI

SEQ ID NO: 520940 - protein, 9 aa, Homo Sapiens
ESNPDSPYC

SEQ ID NO: 520941 - protein, 9 aa, Homo Sapiens
NNVFVFAPS

SEQ ID NO: 520942 - protein, 9 aa, Homo Sapiens
IETKSKEEL

SEQ ID NO: 520943 - protein, 9 aa, Homo Sapiens
FFYLPYFKK

SEQ ID NO: 520944 - protein, 9 aa, Homo Sapiens
IQAYEKLRG

SEQ ID NO: 520945 - protein, 9 aa, Homo Sapiens
ETKSKEELE

SEQ ID NO: 520946 - protein, 9 aa, Homo Sapiens
NNRVLFDLS

SEQ ID NO: 520947 - protein, 9 aa, Homo Sapiens
SGPPLDGTA

SEQ ID NO: 520948 - protein, 9 aa, Homo Sapiens
GRVRQGLIQ

SEQ ID NO: 520949 - protein, 9 aa, Homo Sapiens
NLGPYGNPH

SEQ ID NO: 520950 - protein, 9 aa, Homo Sapiens
SAGHAGQQL

SEQ ID NO: 520951 - protein, 9 aa, Homo Sapiens
KSKEELEDY

SEQ ID NO: 520952 - protein, 9 aa, Homo Sapiens
LSIGPLLFA

SEQ ID NO: 520953 - protein, 9 aa, Homo Sapiens
LDRSVVGSS

SEQ ID NO: 520954 - protein, 9 aa, Homo Sapiens
KTPGEPGKE

SEQ ID NO: 520955 - protein, 9 aa, Homo Sapiens
QGFYNGPFS

SEQ ID NO: 520956 - protein, 9 aa, Homo Sapiens
LFDLSIGPL

SEQ ID NO: 520957 - protein, 9 aa, Homo Sapiens
AAENVKALI

SEQ ID NO: 520958 - protein, 9 aa, Homo Sapiens
PKVEILRST

SEQ ID NO: 520959 - protein, 9 aa, Homo Sapiens
HGEHHAWLQ

SEQ ID NO: 520960 - protein, 9 aa, Homo Sapiens
TFFYKSCLF

SEQ ID NO: 520961 - protein, 9 aa, Homo Sapiens
HDVVVMTEV

SEQ ID NO: 520962 - protein, 9 aa, Homo Sapiens
NPADFIIQV

SEQ ID NO: 520963 - protein, 9 aa, Homo Sapiens
DARLHGEHH

SEQ ID NO: 520964 - protein, 9 aa, Homo Sapiens
QLREVQESI

SEQ ID NO: 520965 - protein, 9 aa, Homo Sapiens
DHSSTQYYH

SEQ ID NO: 520966 - protein, 9 aa, Homo Sapiens
RAQREHDAQ

SEQ ID NO: 520967 - protein, 9 aa, Homo Sapiens
IVSGERFFP

SEQ ID NO: 520968 - protein, 9 aa, Homo Sapiens
TENLMRPSL

SEQ ID NO: 520969 - protein, 9 aa, Homo Sapiens
RVLFDLSIG

SEQ ID NO: 520970 - protein, 9 aa, Homo Sapiens
CSAQAPQAG

SEQ ID NO: 520971 - protein, 9 aa, Homo Sapiens
HSSTQYYHR

SEQ ID NO: 520972 - protein, 9 aa, Homo Sapiens
DATTVAEDQ

SEQ ID NO: 520973 - protein, 9 aa, Homo Sapiens
MGLKLSPGA

SEQ ID NO: 520974 - protein, 9 aa, Homo Sapiens
HGTHDGTGA

SEQ ID NO: 520975 - protein, 9 aa, Homo Sapiens
VQVTRNLFC

SEQ ID NO: 520976 - protein, 9 aa, Homo Sapiens
HYEEYHLSL

SEQ ID NO: 520977 - protein, 9 aa, Homo Sapiens
LLVCSELAV

SEQ ID NO: 520978 - protein, 9 aa, Homo Sapiens
LALRLDART

SEQ ID NO: 520979 - protein, 9 aa, Homo Sapiens
KVKVGDKKC

SEQ ID NO: 520980 - protein, 9 aa, Homo Sapiens
EHALKYSVV

SEQ ID NO: 520981 - protein, 9 aa, Homo Sapiens
SQAESAINS

SEQ ID NO: 520982 - protein, 9 aa, Homo Sapiens
GFSQRWGLL

SEQ ID NO: 520983 - protein, 9 aa, Homo Sapiens
CSSGTSPPY

SEQ ID NO: 520984 - protein, 9 aa, Homo Sapiens
TGRRCLPLW

SEQ ID NO: 520985 - protein, 9 aa, Homo Sapiens
KALQDLAVK

SEQ ID NO: 520986 - protein, 9 aa, Homo Sapiens
PPDTWLHGT

SEQ ID NO: 520987 - protein, 9 aa, Homo Sapiens
DITKETFDD

SEQ ID NO: 520988 - protein, 9 aa, Homo Sapiens
GAVVISLFM

SEQ ID NO: 520989 - protein, 9 aa, Homo Sapiens
GLRAQAAAP

SEQ ID NO: 520990 - protein, 9 aa, Homo Sapiens
TFTVLRALK

SEQ ID NO: 520991 - protein, 9 aa, Homo Sapiens
MGLAADPAS

SEQ ID NO: 520992 - protein, 9 aa, Homo Sapiens
AQEVAKPVR

SEQ ID NO: 520993 - protein, 9 aa, Homo Sapiens
PLRPLRDRE

SEQ ID NO: 520994 - protein, 9 aa, Homo Sapiens
KLEDSYELI

SEQ ID NO: 520995 - protein, 9 aa, Homo Sapiens
LCCANRGTL

SEQ ID NO: 520996 - protein, 9 aa, Homo Sapiens
GPGVNNNSA

SEQ ID NO: 520997 - protein, 9 aa, Homo Sapiens
QRGLRRLSG

SEQ ID NO: 520998 - protein, 9 aa, Homo Sapiens
LDADPAKTA

SEQ ID NO: 520999 - protein, 9 aa, Homo Sapiens
TKSKEELED

SEQ ID NO: 521000 - protein, 9 aa, Homo Sapiens
SQNINLGPY

SEQ ID NO: 521001 - protein, 9 aa, Homo Sapiens
LAADPASGA

SEQ ID NO: 521002 - protein, 9 aa, Homo Sapiens
RVFSGIKPT

SEQ ID NO: 521003 - protein, 9 aa, Homo Sapiens
VRNQKILTH

SEQ ID NO: 521004 - protein, 9 aa, Homo Sapiens
RIFQLISLM

SEQ ID NO: 521005 - protein, 9 aa, Homo Sapiens
RQGLIQEVV

SEQ ID NO: 521006 - protein, 9 aa, Homo Sapiens
GVMKPHRYR

SEQ ID NO: 521007 - protein, 9 aa, Homo Sapiens
CYFMHVNHT

SEQ ID NO: 521008 - protein, 9 aa, Homo Sapiens
KGIPALYGP

SEQ ID NO: 521009 - protein, 9 aa, Homo Sapiens
VAIKEFQFL

SEQ ID NO: 521010 - protein, 9 aa, Homo Sapiens
WRGFFAAIC

SEQ ID NO: 521011 - protein, 9 aa, Homo Sapiens
VRDMKQTVA

SEQ ID NO: 521012 - protein, 9 aa, Homo Sapiens
GKGAGDVGS

SEQ ID NO: 521013 - protein, 9 aa, Homo Sapiens
SGIVSGERF

SEQ ID NO: 521014 - protein, 9 aa, Homo Sapiens
QAHIPILDR

SEQ ID NO: 521015 - protein, 9 aa, Homo Sapiens
VIFYQKNGQ

SEQ ID NO: 521016 - protein, 9 aa, Homo Sapiens
EPPNPATSK

SEQ ID NO: 521017 - protein, 9 aa, Homo Sapiens
LMDSPFFDH

SEQ ID NO: 521018 - protein, 9 aa, Homo Sapiens
AYEKLRGEE

SEQ ID NO: 521019 - protein, 9 aa, Homo Sapiens
LAVYSAQHG

SEQ ID NO: 521020 - protein, 9 aa, Homo Sapiens
ALWVASHVV

SEQ ID NO: 521021 - protein, 9 aa, Homo Sapiens
VYMLKRQGR

SEQ ID NO: 521022 - protein, 9 aa, Homo Sapiens
QTSYCLYPS

SEQ ID NO: 521023 - protein, 9 aa, Homo Sapiens
LVSATVSGV

SEQ ID NO: 521024 - protein, 9 aa, Homo Sapiens
RGLRRLSGA

SEQ ID NO: 521025 - protein, 9 aa, Homo Sapiens
HDAQKQHSV

SEQ ID NO: 521026 - protein, 9 aa, Homo Sapiens
LTSSGERLL

SEQ ID NO: 521027 - protein, 9 aa, Homo Sapiens
IQRCWRPST

SEQ ID NO: 521028 - protein, 9 aa, Homo Sapiens
STTEIHNLI

SEQ ID NO: 521029 - protein, 9 aa, Homo Sapiens
QADEGGYEC

SEQ ID NO: 521030 - protein, 9 aa, Homo Sapiens
NIMRADFNN

SEQ ID NO: 521031 - protein, 9 aa, Homo Sapiens
VTVSDIDAE

SEQ ID NO: 521032 - protein, 9 aa, Homo Sapiens
PNEMHIRAS

SEQ ID NO: 521033 - protein, 9 aa, Homo Sapiens
VSGVTTCLC

SEQ ID NO: 521034 - protein, 9 aa, Homo Sapiens
LLTFTVLLL

SEQ ID NO: 521035 - protein, 9 aa, Homo Sapiens
NLFHSAGHA

SEQ ID NO: 521036 - protein, 9 aa, Homo Sapiens
QESIRFLRQ

SEQ ID NO: 521037 - protein, 9 aa, Homo Sapiens
DADEDVQYD

SEQ ID NO: 521038 - protein, 9 aa, Homo Sapiens
HFEATMYEE

SEQ ID NO: 521039 - protein, 9 aa, Homo Sapiens
TPTAPENTD

SEQ ID NO: 521040 - protein, 9 aa, Homo Sapiens
NNNSAQVLL

SEQ ID NO: 521041 - protein, 9 aa, Homo Sapiens
ETLRTRSKG

SEQ ID NO: 521042 - protein, 9 aa, Homo Sapiens
PHYEEYHLS

SEQ ID NO: 521043 - protein, 9 aa, Homo Sapiens
PADFIIQVA

SEQ ID NO: 521044 - protein, 9 aa, Homo Sapiens
AYNTLKTPG

SEQ ID NO: 521045 - protein, 9 aa, Homo Sapiens
AVQADEGGY

SEQ ID NO: 521046 - protein, 9 aa, Homo Sapiens
AENVKALIE

SEQ ID NO: 521047 - protein, 9 aa, Homo Sapiens
LLVVFFISY

SEQ ID NO: 521048 - protein, 9 aa, Homo Sapiens
DEGGYECRV

SEQ ID NO: 521049 - protein, 9 aa, Homo Sapiens
LTRDWRTTE

SEQ ID NO: 521050 - protein, 9 aa, Homo Sapiens
NGAVVKDKQ

SEQ ID NO: 521051 - protein, 9 aa, Homo Sapiens
PPPGDDIYD

SEQ ID NO: 521052 - protein, 9 aa, Homo Sapiens
NGPFSKFWA

SEQ ID NO: 521053 - protein, 9 aa, Homo Sapiens
GDRHIVSAG

SEQ ID NO: 521054 - protein, 9 aa, Homo Sapiens
DPDWWKEVN

SEQ ID NO: 521055 - protein, 9 aa, Homo Sapiens
QVIWGRILH

SEQ ID NO: 521056 - protein, 9 aa, Homo Sapiens
PCLLLADMP

SEQ ID NO: 521057 - protein, 9 aa, Homo Sapiens
ARLHGEHHA

SEQ ID NO: 521058 - protein, 9 aa, Homo Sapiens
EEVLKIGQH

SEQ ID NO: 521059 - protein, 9 aa, Homo Sapiens
IDGLLVCSE

SEQ ID NO: 521060 - protein, 9 aa, Homo Sapiens
SLDVQQVAD

SEQ ID NO: 521061 - protein, 9 aa, Homo Sapiens
LVSLEISSK

SEQ ID NO: 521062 - protein, 9 aa, Homo Sapiens
SALCGFPVC

SEQ ID NO: 521063 - protein, 9 aa, Homo Sapiens
YFMHVNHTR

SEQ ID NO: 521064 - protein, 9 aa, Homo Sapiens
QSTAVTHKQ

SEQ ID NO: 521065 - protein, 9 aa, Homo Sapiens
HAAAQDAHV

SEQ ID NO: 521066 - protein, 9 aa, Homo Sapiens
EFQFLLLLS

SEQ ID NO: 521067 - protein, 9 aa, Homo Sapiens
NVADSPQNK

SEQ ID NO: 521068 - protein, 9 aa, Homo Sapiens
SLSNGVKCF

SEQ ID NO: 521069 - protein, 9 aa, Homo Sapiens
ISPSAFVLE

SEQ ID NO: 521070 - protein, 9 aa, Homo Sapiens
ITLADEIHE

SEQ ID NO: 521071 - protein, 9 aa, Homo Sapiens
YHLSLQALD

SEQ ID NO: 521072 - protein, 9 aa, Homo Sapiens
SCYPPGPGR

SEQ ID NO: 521073 - protein, 9 aa, Homo Sapiens
QRWGLLSSK

SEQ ID NO: 521074 - protein, 9 aa, Homo Sapiens
GLVDALHAL

SEQ ID NO: 521075 - protein, 9 aa, Homo Sapiens
DDFRTKHET

SEQ ID NO: 521076 - protein, 9 aa, Homo Sapiens
FQTSYCLYP

SEQ ID NO: 521077 - protein, 9 aa, Homo Sapiens
TAPENTDVR

SEQ ID NO: 521078 - protein, 9 aa, Homo Sapiens
LEDSYELIE

SEQ ID NO: 521079 - protein, 9 aa, Homo Sapiens
PCQKSCNND

SEQ ID NO: 521080 - protein, 9 aa, Homo Sapiens
KDDVKGIPA

SEQ ID NO: 521081 - protein, 9 aa, Homo Sapiens
FSGIKPTGI

SEQ ID NO: 521082 - protein, 9 aa, Homo Sapiens
RQHAELEAF

SEQ ID NO: 521083 - protein, 9 aa, Homo Sapiens
GPYGNPHAK

SEQ ID NO: 521084 - protein, 9 aa, Homo Sapiens
RRCLPLWTS

SEQ ID NO: 521085 - protein, 9 aa, Homo Sapiens
QPQPNEMHI

SEQ ID NO: 521086 - protein, 9 aa, Homo Sapiens
KLSHLNNVF

SEQ ID NO: 521087 - protein, 9 aa, Homo Sapiens
PPPPGDDIY

SEQ ID NO: 521088 - protein, 9 aa, Homo Sapiens
LNLKINLKA

SEQ ID NO: 521089 - protein, 9 aa, Homo Sapiens
RPLRDREIW

SEQ ID NO: 521090 - protein, 9 aa, Homo Sapiens
EGVAVKALS

SEQ ID NO: 521091 - protein, 9 aa, Homo Sapiens
ICGAFMFRL

SEQ ID NO: 521092 - protein, 9 aa, Homo Sapiens
MPPAAPGTR

SEQ ID NO: 521093 - protein, 9 aa, Homo Sapiens
VPLVEEVLK

SEQ ID NO: 521094 - protein, 9 aa, Homo Sapiens
DRSVVGSSG

SEQ ID NO: 521095 - protein, 9 aa, Homo Sapiens
DGVQEVFQT

SEQ ID NO: 521096 - protein, 9 aa, Homo Sapiens
PLLVVFFIS

SEQ ID NO: 521097 - protein, 9 aa, Homo Sapiens
LPCQKSCNN

SEQ ID NO: 521098 - protein, 9 aa, Homo Sapiens
LVEEVLKIG

SEQ ID NO: 521099 - protein, 9 aa, Homo Sapiens
AVSQAVHVR

SEQ ID NO: 521100 - protein, 9 aa, Homo Sapiens
DETLRTRSK

SEQ ID NO: 521101 - protein, 9 aa, Homo Sapiens
AENTIGTAS

SEQ ID NO: 521102 - protein, 9 aa, Homo Sapiens
QAGRGPSGA

SEQ ID NO: 521103 - protein, 9 aa, Homo Sapiens
MDAEAEDET

SEQ ID NO: 521104 - protein, 9 aa, Homo Sapiens
AWLQVPCSA

SEQ ID NO: 521105 - protein, 9 aa, Homo Sapiens
LDGTAGFVG

SEQ ID NO: 521106 - protein, 9 aa, Homo Sapiens
NEYDDNQIC

SEQ ID NO: 521107 - protein, 9 aa, Homo Sapiens
PDSPYCHQV

SEQ ID NO: 521108 - protein, 9 aa, Homo Sapiens
ALQDLAVKE

SEQ ID NO: 521109 - protein, 9 aa, Homo Sapiens
NSVFQRGLR

SEQ ID NO: 521110 - protein, 9 aa, Homo Sapiens
AQREHDAQK

SEQ ID NO: 521111 - protein, 9 aa, Homo Sapiens
PVRHKHGPQ

SEQ ID NO: 521112 - protein, 9 aa, Homo Sapiens
STAVTHKQS

SEQ ID NO: 521113 - protein, 9 aa, Homo Sapiens
VRRSPHHER

SEQ ID NO: 521114 - protein, 9 aa, Homo Sapiens
RRLLLESLR

SEQ ID NO: 521115 - protein, 9 aa, Homo Sapiens
CVVASSFVL

SEQ ID NO: 521116 - protein, 9 aa, Homo Sapiens
GQAGRGPSG

SEQ ID NO: 521117 - protein, 9 aa, Homo Sapiens
QRAECTIRM

SEQ ID NO: 521118 - protein, 9 aa, Homo Sapiens
GAGAKPLGL

SEQ ID NO: 521119 - protein, 9 aa, Homo Sapiens
FGPGVNNNS

SEQ ID NO: 521120 - protein, 9 aa, Homo Sapiens
RNLVSLEIS

SEQ ID NO: 521121 - protein, 9 aa, Homo Sapiens
AAYNTLKTP

SEQ ID NO: 521122 - protein, 9 aa, Homo Sapiens
PQQFQAQSC

SEQ ID NO: 521123 - protein, 9 aa, Homo Sapiens
GGIFPPPPG

SEQ ID NO: 521124 - protein, 9 aa, Homo Sapiens
TSLSNGVKC

SEQ ID NO: 521125 - protein, 9 aa, Homo Sapiens
REVQESIRF

SEQ ID NO: 521126 - protein, 9 aa, Homo Sapiens
KNGSQVVQY

SEQ ID NO: 521127 - protein, 9 aa, Homo Sapiens
PQLSWPPWT

SEQ ID NO: 521128 - protein, 9 aa, Homo Sapiens
LWVASHVVH

SEQ ID NO: 521129 - protein, 9 aa, Homo Sapiens
GHAGQQLYA

SEQ ID NO: 521130 - protein, 9 aa, Homo Sapiens
DFIIQVASG

SEQ ID NO: 521131 - protein, 9 aa, Homo Sapiens
PNPATSKII

SEQ ID NO: 521132 - protein, 9 aa, Homo Sapiens
KSHRRHRHH

SEQ ID NO: 521133 - protein, 9 aa, Homo Sapiens
GPFSKFWAY

SEQ ID NO: 521134 - protein, 9 aa, Homo Sapiens
SPFFDHSST

SEQ ID NO: 521135 - protein, 9 aa, Homo Sapiens
SPYCHQVRL

SEQ ID NO: 521136 - protein, 9 aa, Homo Sapiens
EDVQYDEDD

SEQ ID NO: 521137 - protein, 9 aa, Homo Sapiens
YAAVSHHDV

SEQ ID NO: 521138 - protein, 9 aa, Homo Sapiens
QQFQAQSCY

SEQ ID NO: 521139 - protein, 9 aa, Homo Sapiens
ELQSLWEKH

SEQ ID NO: 521140 - protein, 9 aa, Homo Sapiens
SGTSPPYMP

SEQ ID NO: 521141 - protein, 9 aa, Homo Sapiens
KPVRHKHGP

SEQ ID NO: 521142 - protein, 9 aa, Homo Sapiens
ITKETFDDL

SEQ ID NO: 521143 - protein, 9 aa, Homo Sapiens
KEIHGEPLH

SEQ ID NO: 521144 - protein, 9 aa, Homo Sapiens
STRRGSPST

SEQ ID NO: 521145 - protein, 9 aa, Homo Sapiens
AADINPQNA

SEQ ID NO: 521146 - protein, 9 aa, Homo Sapiens
HVRPPDTWL

SEQ ID NO: 521147 - protein, 9 aa, Homo Sapiens
LMSNNLSEM

SEQ ID NO: 521148 - protein, 9 aa, Homo Sapiens
RDVKDFFKE

SEQ ID NO: 521149 - protein, 9 aa, Homo Sapiens
QAGSRWSSY

SEQ ID NO: 521150 - protein, 9 aa, Homo Sapiens
TRCECLSAL

SEQ ID NO: 521151 - protein, 9 aa, Homo Sapiens
RRQHAELEA

SEQ ID NO: 521152 - protein, 9 aa, Homo Sapiens
LSSRQVRNQ

SEQ ID NO: 521153 - protein, 9 aa, Homo Sapiens
AQAPQAGLV

SEQ ID NO: 521154 - protein, 9 aa, Homo Sapiens
APCLLLADM

SEQ ID NO: 521155 - protein, 9 aa, Homo Sapiens
NSAQVLLLL

SEQ ID NO: 521156 - protein, 9 aa, Homo Sapiens
NPTFFYKSC

SEQ ID NO: 521157 - protein, 9 aa, Homo Sapiens
SFVLGIFFM

SEQ ID NO: 521158 - protein, 9 aa, Homo Sapiens
RRHRHHGHK

SEQ ID NO: 521159 - protein, 9 aa, Homo Sapiens
TEVVRRSPH

SEQ ID NO: 521160 - protein, 9 aa, Homo Sapiens
PGDDIYDGI

SEQ ID NO: 521161 - protein, 9 aa, Homo Sapiens
QHCLIDGLL

SEQ ID NO: 521162 - protein, 9 aa, Homo Sapiens
KRRLLLESL

SEQ ID NO: 521163 - protein, 9 aa, Homo Sapiens
QVADGPQHP

SEQ ID NO: 521164 - protein, 9 aa, Homo Sapiens
DKQPSSAKS

SEQ ID NO: 521165 - protein, 9 aa, Homo Sapiens
NLSRRDRKA

SEQ ID NO: 521166 - protein, 9 aa, Homo Sapiens
VKEGGAGRV

SEQ ID NO: 521167 - protein, 9 aa, Homo Sapiens
PLPCQKSCN

SEQ ID NO: 521168 - protein, 9 aa, Homo Sapiens
SPGFPNEYD

SEQ ID NO: 521169 - protein, 9 aa, Homo Sapiens
LQFSILMDS

SEQ ID NO: 521170 - protein, 9 aa, Homo Sapiens
QDLAVKEGG

SEQ ID NO: 521171 - protein, 9 aa, Homo Sapiens
STETLFFMF

SEQ ID NO: 521172 - protein, 9 aa, Homo Sapiens
YGSISPSAF

SEQ ID NO: 521173 - protein, 9 aa, Homo Sapiens
VSREKVKAV

SEQ ID NO: 521174 - protein, 9 aa, Homo Sapiens
LRSTIQYIE

SEQ ID NO: 521175 - protein, 9 aa, Homo Sapiens
PFCHDVSLS

SEQ ID NO: 521176 - protein, 9 aa, Homo Sapiens
ACFNLFHSA

SEQ ID NO: 521177 - protein, 9 aa, Homo Sapiens
LHGTHDGTG

SEQ ID NO: 521178 - protein, 9 aa, Homo Sapiens
KCDIMDTFK

SEQ ID NO: 521179 - protein, 9 aa, Homo Sapiens
AFVLEIFKG

SEQ ID NO: 521180 - protein, 9 aa, Homo Sapiens
LHGEHHAWL

SEQ ID NO: 521181 - protein, 9 aa, Homo Sapiens
RCECLSALC

SEQ ID NO: 521182 - protein, 9 aa, Homo Sapiens
SVVGSSGVS

SEQ ID NO: 521183 - protein, 9 aa, Homo Sapiens
SHHDVLLDA

SEQ ID NO: 521184 - protein, 9 aa, Homo Sapiens
QESANNYTA

SEQ ID NO: 521185 - protein, 9 aa, Homo Sapiens
VCSELAVGG

SEQ ID NO: 521186 - protein, 9 aa, Homo Sapiens
DVQYDEDDD

SEQ ID NO: 521187 - protein, 9 aa, Homo Sapiens
VSGERFFPP

SEQ ID NO: 521188 - protein, 9 aa, Homo Sapiens
TSRIHTPFR

SEQ ID NO: 521189 - protein, 9 aa, Homo Sapiens
KLGPEIQRA

SEQ ID NO: 521190 - protein, 9 aa, Homo Sapiens
PTEGACVPG

SEQ ID NO: 521191 - protein, 9 aa, Homo Sapiens
GAVVKDKQP

SEQ ID NO: 521192 - protein, 9 aa, Homo Sapiens
KDKQPSSAK

SEQ ID NO: 521193 - protein, 9 aa, Homo Sapiens
RKQLREVQE

SEQ ID NO: 521194 - protein, 9 aa, Homo Sapiens
VCVVASSFV

SEQ ID NO: 521195 - protein, 9 aa, Homo Sapiens
GRSVIELTK

SEQ ID NO: 521196 - protein, 9 aa, Homo Sapiens
PTAPENTDV

SEQ ID NO: 521197 - protein, 9 aa, Homo Sapiens
SPSAFVLEI

SEQ ID NO: 521198 - protein, 9 aa, Homo Sapiens
AWDACVFRV

SEQ ID NO: 521199 - protein, 9 aa, Homo Sapiens
GTHDGTGAP

SEQ ID NO: 521200 - protein, 9 aa, Homo Sapiens
FGTQSTTEI

SEQ ID NO: 521201 - protein, 9 aa, Homo Sapiens
NPLPCQKSC

SEQ ID NO: 521202 - protein, 9 aa, Homo Sapiens
DGELSCRIF

SEQ ID NO: 521203 - protein, 9 aa, Homo Sapiens
WDACVFRVE

SEQ ID NO: 521204 - protein, 9 aa, Homo Sapiens
RRLSGAMCT

SEQ ID NO: 521205 - protein, 9 aa, Homo Sapiens
ILTAHVEQA

SEQ ID NO: 521206 - protein, 9 aa, Homo Sapiens
RVRQGLIQE

SEQ ID NO: 521207 - protein, 9 aa, Homo Sapiens
HVVHVNAQE

SEQ ID NO: 521208 - protein, 9 aa, Homo Sapiens
CDSKCPSAT

SEQ ID NO: 521209 - protein, 9 aa, Homo Sapiens
YDDNQICYW

SEQ ID NO: 521210 - protein, 9 aa, Homo Sapiens
GGYECRVST

SEQ ID NO: 521211 - protein, 9 aa, Homo Sapiens
FLLLLSHPC

SEQ ID NO: 521212 - protein, 9 aa, Homo Sapiens
TAMAVVYML

SEQ ID NO: 521213 - protein, 9 aa, Homo Sapiens
ITLISMFDR

SEQ ID NO: 521214 - protein, 9 aa, Homo Sapiens
TVSGVTTCL

SEQ ID NO: 521215 - protein, 9 aa, Homo Sapiens
LGIYWRCWL

SEQ ID NO: 521216 - protein, 9 aa, Homo Sapiens
SREKVKAVL

SEQ ID NO: 521217 - protein, 9 aa, Homo Sapiens
EISSKCMMK

SEQ ID NO: 521218 - protein, 9 aa, Homo Sapiens
PPNPATSKI

SEQ ID NO: 521219 - protein, 9 aa, Homo Sapiens
QKSCNNDVF

SEQ ID NO: 521220 - protein, 9 aa, Homo Sapiens
PPVLALRLD

SEQ ID NO: 521221 - protein, 9 aa, Homo Sapiens
HVEQAHIPI

SEQ ID NO: 521222 - protein, 9 aa, Homo Sapiens
GELSCRIFQ

SEQ ID NO: 521223 - protein, 9 aa, Homo Sapiens
DMPFLPPRG

SEQ ID NO: 521224 - protein, 9 aa, Homo Sapiens
ADPASGAPS

SEQ ID NO: 521225 - protein, 9 aa, Homo Sapiens
IYWRCWLVF

SEQ ID NO: 521226 - protein, 9 aa, Homo Sapiens
EGACVPGKP

SEQ ID NO: 521227 - protein, 9 aa, Homo Sapiens
FTVLRALKT

SEQ ID NO: 521228 - protein, 9 aa, Homo Sapiens
RFKAEGVAV

SEQ ID NO: 521229 - protein, 9 aa, Homo Sapiens
RGFFAAICG

SEQ ID NO: 521230 - protein, 9 aa, Homo Sapiens
VVHVNAQEV

SEQ ID NO: 521231 - protein, 9 aa, Homo Sapiens
FRTKHETEL

SEQ ID NO: 521232 - protein, 9 aa, Homo Sapiens
LLLMPPAAP

SEQ ID NO: 521233 - protein, 9 aa, Homo Sapiens
SGRLPLAVY

SEQ ID NO: 521234 - protein, 9 aa, Homo Sapiens
LRPLRDREI

SEQ ID NO: 521235 - protein, 9 aa, Homo Sapiens
VQESIRFLR

SEQ ID NO: 521236 - protein, 9 aa, Homo Sapiens
RLHGEHHAW

SEQ ID NO: 521237 - protein, 9 aa, Homo Sapiens
CQKSCNNDV

SEQ ID NO: 521238 - protein, 9 aa, Homo Sapiens
TPLVAGQAG

SEQ ID NO: 521239 - protein, 9 aa, Homo Sapiens
ADMPFLPPR

SEQ ID NO: 521240 - protein, 9 aa, Homo Sapiens
MHVNHTRFP

SEQ ID NO: 521241 - protein, 9 aa, Homo Sapiens
SCGLVLKRF

SEQ ID NO: 521242 - protein, 9 aa, Homo Sapiens
SVFQRGLRR

SEQ ID NO: 521243 - protein, 9 aa, Homo Sapiens
FEATMYEER

SEQ ID NO: 521244 - protein, 9 aa, Homo Sapiens
GPAPEPPNP

SEQ ID NO: 521245 - protein, 9 aa, Homo Sapiens
IQVASGEYG

SEQ ID NO: 521246 - protein, 9 aa, Homo Sapiens
PFSKFWAYA

SEQ ID NO: 521247 - protein, 9 aa, Homo Sapiens
GIYWRCWLV

SEQ ID NO: 521248 - protein, 9 aa, Homo Sapiens
RSAAQSQLQ

SEQ ID NO: 521249 - protein, 9 aa, Homo Sapiens
LGPEIQRAE

SEQ ID NO: 521250 - protein, 9 aa, Homo Sapiens
SPQNKKEKS

SEQ ID NO: 521251 - protein, 9 aa, Homo Sapiens
NTPVSPGSA

SEQ ID NO: 521252 - protein, 9 aa, Homo Sapiens
HGHKHRKRD

SEQ ID NO: 521253 - protein, 9 aa, Homo Sapiens
LTSRIHTPF

SEQ ID NO: 521254 - protein, 9 aa, Homo Sapiens
QAYEKLRGE

SEQ ID NO: 521255 - protein, 9 aa, Homo Sapiens
NEMHIRASE

SEQ ID NO: 521256 - protein, 9 aa, Homo Sapiens
TAHVEQAHI

SEQ ID NO: 521257 - protein, 9 aa, Homo Sapiens
AFDSPSNPL

SEQ ID NO: 521258 - protein, 9 aa, Homo Sapiens
SNNRVLFDL

SEQ ID NO: 521259 - protein, 9 aa, Homo Sapiens
RADFNNTNE

SEQ ID NO: 521260 - protein, 9 aa, Homo Sapiens
NPQNADVYH

SEQ ID NO: 521261 - protein, 9 aa, Homo Sapiens
DPATYVWDS

SEQ ID NO: 521262 - protein, 9 aa, Homo Sapiens
SSGERLLLY

SEQ ID NO: 521263 - protein, 9 aa, Homo Sapiens
CECLSALCG

SEQ ID NO: 521264 - protein, 9 aa, Homo Sapiens
DSYELIEKN

SEQ ID NO: 521265 - protein, 9 aa, Homo Sapiens
DSPFFDHSS

SEQ ID NO: 521266 - protein, 9 aa, Homo Sapiens
TCKAENTIG

SEQ ID NO: 521267 - protein, 9 aa, Homo Sapiens
AHIPILDRS

SEQ ID NO: 521268 - protein, 9 aa, Homo Sapiens
VEQAHIPIL

SEQ ID NO: 521269 - protein, 9 aa, Homo Sapiens
VVVMTEVMH

SEQ ID NO: 521270 - protein, 9 aa, Homo Sapiens
VGSEAVILT

SEQ ID NO: 521271 - protein, 9 aa, Homo Sapiens
VSHHDVLLD

SEQ ID NO: 521272 - protein, 9 aa, Homo Sapiens
WWKEVNGQV

SEQ ID NO: 521273 - protein, 9 aa, Homo Sapiens
RCWRPSTAQ

SEQ ID NO: 521274 - protein, 9 aa, Homo Sapiens
SCDSKCPSA

SEQ ID NO: 521275 - protein, 9 aa, Homo Sapiens
AEGVAVKAL

SEQ ID NO: 521276 - protein, 9 aa, Homo Sapiens
IVSAGGDDC

SEQ ID NO: 521277 - protein, 9 aa, Homo Sapiens
AHVEQAHIP

SEQ ID NO: 521278 - protein, 9 aa, Homo Sapiens
WLQVPCSAQ

SEQ ID NO: 521279 - protein, 9 aa, Homo Sapiens
LTFTVLLLL

SEQ ID NO: 521280 - protein, 9 aa, Homo Sapiens
KIDTIVIFY

SEQ ID NO: 521281 - protein, 9 aa, Homo Sapiens
AVRDMKQTV

SEQ ID NO: 521282 - protein, 9 aa, Homo Sapiens
QQVADGPQH

SEQ ID NO: 521283 - protein, 9 aa, Homo Sapiens
QLSWPPWTR

SEQ ID NO: 521284 - protein, 9 aa, Homo Sapiens
SILMDSPFF

SEQ ID NO: 521285 - protein, 9 aa, Homo Sapiens
GSAFWVEAG

SEQ ID NO: 521286 - protein, 9 aa, Homo Sapiens
TPVSPGSAF

SEQ ID NO: 521287 - protein, 9 aa, Homo Sapiens
SPQAGSRWS

SEQ ID NO: 521288 - protein, 9 aa, Homo Sapiens
DTWLHGTHD

SEQ ID NO: 521289 - protein, 9 aa, Homo Sapiens
STIQYIERL

SEQ ID NO: 521290 - protein, 9 aa, Homo Sapiens
GLLVCSELA

SEQ ID NO: 521291 - protein, 9 aa, Homo Sapiens
KKELQSLWE

SEQ ID NO: 521292 - protein, 9 aa, Homo Sapiens
KTAKALQDL

SEQ ID NO: 521293 - protein, 9 aa, Homo Sapiens
SSFVLGIFF

SEQ ID NO: 521294 - protein, 9 aa, Homo Sapiens
QNLQVIWGR

SEQ ID NO: 521295 - protein, 9 aa, Homo Sapiens
FNLFHSAGH

SEQ ID NO: 521296 - protein, 9 aa, Homo Sapiens
LLMPPAAPG

SEQ ID NO: 521297 - protein, 9 aa, Homo Sapiens
VLNLKINLK

SEQ ID NO: 521298 - protein, 9 aa, Homo Sapiens
FWVEAGCRA

SEQ ID NO: 521299 - protein, 9 aa, Homo Sapiens
SAFPDVKPD

SEQ ID NO: 521300 - protein, 9 aa, Homo Sapiens
FQQQQQPPP

SEQ ID NO: 521301 - protein, 9 aa, Homo Sapiens
FPLLVVFFI

SEQ ID NO: 521302 - protein, 9 aa, Homo Sapiens
HECPFGRSV

SEQ ID NO: 521303 - protein, 9 aa, Homo Sapiens
EIQRAECTI

SEQ ID NO: 521304 - protein, 9 aa, Homo Sapiens
GVHAAAQDA

SEQ ID NO: 521305 - protein, 9 aa, Homo Sapiens
QVTRNLFCL

SEQ ID NO: 521306 - protein, 9 aa, Homo Sapiens
HHAWLQVPC

SEQ ID NO: 521307 - protein, 9 aa, Homo Sapiens
RTPTAPENT

SEQ ID NO: 521308 - protein, 9 aa, Homo Sapiens
EVVRRSPHH

SEQ ID NO: 521309 - protein, 9 aa, Homo Sapiens
ILQLITLAD

SEQ ID NO: 521310 - protein, 9 aa, Homo Sapiens
TLKTPGEPG

SEQ ID NO: 521311 - protein, 9 aa, Homo Sapiens
PRRTPTAPE

SEQ ID NO: 521312 - protein, 9 aa, Homo Sapiens
VISLFMTPL

SEQ ID NO: 521313 - protein, 9 aa, Homo Sapiens
GSPRMAETG

SEQ ID NO: 521314 - protein, 9 aa, Homo Sapiens
HDGTGAPQH

SEQ ID NO: 521315 - protein, 9 aa, Homo Sapiens
DFNNTNELL

SEQ ID NO: 521316 - protein, 9 aa, Homo Sapiens
GQQLYAAVS

SEQ ID NO: 521317 - protein, 9 aa, Homo Sapiens
PNCDQSDGV

SEQ ID NO: 521318 - protein, 9 aa, Homo Sapiens
DGTGAPQHC

SEQ ID NO: 521319 - protein, 9 aa, Homo Sapiens
PEPPNPATS

SEQ ID NO: 521320 - protein, 9 aa, Homo Sapiens
MSNNLSEMD

SEQ ID NO: 521321 - protein, 9 aa, Homo Sapiens
SLLAWDACV

SEQ ID NO: 521322 - protein, 9 aa, Homo Sapiens
VILTAHVEQ

SEQ ID NO: 521323 - protein, 9 aa, Homo Sapiens
NHTRFPSVI

SEQ ID NO: 521324 - protein, 9 aa, Homo Sapiens
FQFLLLLSH

SEQ ID NO: 521325 - protein, 9 aa, Homo Sapiens
VASSFVLGI

SEQ ID NO: 521326 - protein, 9 aa, Homo Sapiens
TRNLFCLQL

SEQ ID NO: 521327 - protein, 9 aa, Homo Sapiens
KLLLLTFTV

SEQ ID NO: 521328 - protein, 9 aa, Homo Sapiens
ENTIGTASS

SEQ ID NO: 521329 - protein, 9 aa, Homo Sapiens
VSLDHGVHA

SEQ ID NO: 521330 - protein, 9 aa, Homo Sapiens
RWTSNMVGL

SEQ ID NO: 521331 - protein, 9 aa, Homo Sapiens
DHGVHAAAQ

SEQ ID NO: 521332 - protein, 9 aa, Homo Sapiens
DVSLSCSAD

SEQ ID NO: 521333 - protein, 9 aa, Homo Sapiens
ENILQLITL

SEQ ID NO: 521334 - protein, 9 aa, Homo Sapiens
FTVLLLLSQ

SEQ ID NO: 521335 - protein, 9 aa, Homo Sapiens
KAEGVAVKA

SEQ ID NO: 521336 - protein, 9 aa, Homo Sapiens
VTHKQSYYS

SEQ ID NO: 521337 - protein, 9 aa, Homo Sapiens
VDARLHGEH

SEQ ID NO: 521338 - protein, 9 aa, Homo Sapiens
SSGGEEDHF

SEQ ID NO: 521339 - protein, 9 aa, Homo Sapiens
KFPTRGWTT

SEQ ID NO: 521340 - protein, 9 aa, Homo Sapiens
GVAVKALST

SEQ ID NO: 521341 - protein, 9 aa, Homo Sapiens
WVASHVVHV

SEQ ID NO: 521342 - protein, 9 aa, Homo Sapiens
KKCDIMDTF

SEQ ID NO: 521343 - protein, 9 aa, Homo Sapiens
STGFIEQKG

SEQ ID NO: 521344 - protein, 9 aa, Homo Sapiens
TVSDIDAED

SEQ ID NO: 521345 - protein, 9 aa, Homo Sapiens
LLLPLLLMP

SEQ ID NO: 521346 - protein, 9 aa, Homo Sapiens
SGDRHIVSA

SEQ ID NO: 521347 - protein, 9 aa, Homo Sapiens
SPGSAFPDV

SEQ ID NO: 521348 - protein, 9 aa, Homo Sapiens
PLLLMPPAA

SEQ ID NO: 521349 - protein, 9 aa, Homo Sapiens
NKNGSQVVQ

SEQ ID NO: 521350 - protein, 9 aa, Homo Sapiens
AGHAGQQLY

SEQ ID NO: 521351 - protein, 9 aa, Homo Sapiens
DVQQVADGP

SEQ ID NO: 521352 - protein, 9 aa, Homo Sapiens
AETGDTSEM

SEQ ID NO: 521353 - protein, 9 aa, Homo Sapiens
HDVLLDADP

SEQ ID NO: 521354 - protein, 9 aa, Homo Sapiens
TWLHGTHDG

SEQ ID NO: 521355 - protein, 9 aa, Homo Sapiens
ENLMRPSLA

SEQ ID NO: 521356 - protein, 9 aa, Homo Sapiens
LADEIHEGD

SEQ ID NO: 521357 - protein, 9 aa, Homo Sapiens
TAVTHKQSY

SEQ ID NO: 521358 - protein, 9 aa, Homo Sapiens
LLGDRVDIA

SEQ ID NO: 521359 - protein, 9 aa, Homo Sapiens
FVFAPSPSS

SEQ ID NO: 521360 - protein, 9 aa, Homo Sapiens
SMFDRDFGV

SEQ ID NO: 521361 - protein, 9 aa, Homo Sapiens
AQSCYPPGP

SEQ ID NO: 521362 - protein, 9 aa, Homo Sapiens
GDTSEMVNG

SEQ ID NO: 521363 - protein, 9 aa, Homo Sapiens
VSATVSGVT

SEQ ID NO: 521364 - protein, 9 aa, Homo Sapiens
RTFTVLRAL

SEQ ID NO: 521365 - protein, 9 aa, Homo Sapiens
AAVSHHDVL

SEQ ID NO: 521366 - protein, 9 aa, Homo Sapiens
TIQYIERLQ

SEQ ID NO: 521367 - protein, 9 aa, Homo Sapiens
TIMESMGLK

SEQ ID NO: 521368 - protein, 9 aa, Homo Sapiens
ENVKALIEH

SEQ ID NO: 521369 - protein, 9 aa, Homo Sapiens
EYTCKAENT

SEQ ID NO: 521370 - protein, 9 aa, Homo Sapiens
DVLLDADPA

SEQ ID NO: 521371 - protein, 9 aa, Homo Sapiens
HRRHRHHGH

SEQ ID NO: 521372 - protein, 9 aa, Homo Sapiens
ADFIIQVAS

SEQ ID NO: 521373 - protein, 9 aa, Homo Sapiens
MLKRQGRTL

SEQ ID NO: 521374 - protein, 9 aa, Homo Sapiens
ADFNNTNEL

SEQ ID NO: 521375 - protein, 9 aa, Homo Sapiens
VKDKQPSSA

SEQ ID NO: 521376 - protein, 9 aa, Homo Sapiens
TEHALKYSV

SEQ ID NO: 521377 - protein, 9 aa, Homo Sapiens
LDTLTSRIH

SEQ ID NO: 521378 - protein, 9 aa, Homo Sapiens
EYDDNQICY

SEQ ID NO: 521379 - protein, 9 aa, Homo Sapiens
LSRRDRKAI

SEQ ID NO: 521380 - protein, 9 aa, Homo Sapiens
TKETFDDLP

SEQ ID NO: 521381 - protein, 9 aa, Homo Sapiens
AQSQLQGNS

SEQ ID NO: 521382 - protein, 9 aa, Homo Sapiens
NDVFLQFSI

SEQ ID NO: 521383 - protein, 9 aa, Homo Sapiens
LLPLLLMPP

SEQ ID NO: 521384 - protein, 9 aa, Homo Sapiens
DRVDIAEGR

SEQ ID NO: 521385 - protein, 9 aa, Homo Sapiens
LADMPFLPP

SEQ ID NO: 521386 - protein, 9 aa, Homo Sapiens
SNNLSEMDT

SEQ ID NO: 521387 - protein, 9 aa, Homo Sapiens
VNNNSAQVL

SEQ ID NO: 521388 - protein, 9 aa, Homo Sapiens
SGERLLLYH

SEQ ID NO: 521389 - protein, 9 aa, Homo Sapiens
INLGPYGNP

SEQ ID NO: 521390 - protein, 9 aa, Homo Sapiens
GEPGKEIHG

SEQ ID NO: 521391 - protein, 9 aa, Homo Sapiens
PSTRIRFIN

SEQ ID NO: 521392 - protein, 9 aa, Homo Sapiens
LSTETLFFM

SEQ ID NO: 521393 - protein, 9 aa, Homo Sapiens
EPPVLALRL

SEQ ID NO: 521394 - protein, 9 aa, Homo Sapiens
SELAVGGKG

SEQ ID NO: 521395 - protein, 9 aa, Homo Sapiens
SALRTFTVL

SEQ ID NO: 521396 - protein, 9 aa, Homo Sapiens
AMAVVYMLK

SEQ ID NO: 521397 - protein, 9 aa, Homo Sapiens
EILRSTIQY

SEQ ID NO: 521398 - protein, 9 aa, Homo Sapiens
WLSCGLVLK

SEQ ID NO: 521399 - protein, 9 aa, Homo Sapiens
VVKDKQPSS

SEQ ID NO: 521400 - protein, 9 aa, Homo Sapiens
LLLTFTVLL

SEQ ID NO: 521401 - protein, 9 aa, Homo Sapiens
DLSIGPLLF

SEQ ID NO: 521402 - protein, 9 aa, Homo Sapiens
DREIWAPWN

SEQ ID NO: 521403 - protein, 9 aa, Homo Sapiens
HGPQVSLDH

SEQ ID NO: 521404 - protein, 9 aa, Homo Sapiens
AVHVRPPDT

SEQ ID NO: 521405 - protein, 9 aa, Homo Sapiens
ECPFGRSVI

SEQ ID NO: 521406 - protein, 9 aa, Homo Sapiens
LAVGGKGAG

SEQ ID NO: 521407 - protein, 9 aa, Homo Sapiens
FFGPGVNNN

SEQ ID NO: 521408 - protein, 9 aa, Homo Sapiens
LLLESLRGP

SEQ ID NO: 521409 - protein, 9 aa, Homo Sapiens
KRVFSGIKP

SEQ ID NO: 521410 - protein, 9 aa, Homo Sapiens
QAPQAGLVD

SEQ ID NO: 521411 - protein, 9 aa, Homo Sapiens
VVSGIVSGE

SEQ ID NO: 521412 - protein, 9 aa, Homo Sapiens
MESMGLKLS

SEQ ID NO: 521413 - protein, 9 aa, Homo Sapiens
PEIQRAECT

SEQ ID NO: 521414 - protein, 9 aa, Homo Sapiens
LITLADEIH

SEQ ID NO: 521415 - protein, 9 aa, Homo Sapiens
TAGSPPAGR

SEQ ID NO: 521416 - protein, 9 aa, Homo Sapiens
SEAVILTAH

SEQ ID NO: 521417 - protein, 9 aa, Homo Sapiens
TRIRFINLA

SEQ ID NO: 521418 - protein, 9 aa, Homo Sapiens
VQQVADGPQ

SEQ ID NO: 521419 - protein, 9 aa, Homo Sapiens
DAHVGQLLQ

SEQ ID NO: 521420 - protein, 9 aa, Homo Sapiens
PLDSPQAGS

SEQ ID NO: 521421 - protein, 9 aa, Homo Sapiens
NRGTLIKVG

SEQ ID NO: 521422 - protein, 9 aa, Homo Sapiens
DDVKGIPAL

SEQ ID NO: 521423 - protein, 9 aa, Homo Sapiens
HLVSATVSG

SEQ ID NO: 521424 - protein, 9 aa, Homo Sapiens
DPASGAPSP

SEQ ID NO: 521425 - protein, 9 aa, Homo Sapiens
DQLCSSGTS

SEQ ID NO: 521426 - protein, 9 aa, Homo Sapiens
RSPHHERCS

SEQ ID NO: 521427 - protein, 9 aa, Homo Sapiens
ALCGFPVCE

SEQ ID NO: 521428 - protein, 9 aa, Homo Sapiens
INPQNADVY

SEQ ID NO: 521429 - protein, 9 aa, Homo Sapiens
GTQSTTEIH

SEQ ID NO: 521430 - protein, 9 aa, Homo Sapiens
FVLEIFKGI

SEQ ID NO: 521431 - protein, 9 aa, Homo Sapiens
VRQGLIQEV

SEQ ID NO: 521432 - protein, 9 aa, Homo Sapiens
LHALWVASH

SEQ ID NO: 521433 - protein, 9 aa, Homo Sapiens
RMYRWTSNM

SEQ ID NO: 521434 - protein, 9 aa, Homo Sapiens
THDGTGAPQ

SEQ ID NO: 521435 - protein, 9 aa, Homo Sapiens
NLVSLEISS

SEQ ID NO: 521436 - protein, 9 aa, Homo Sapiens
GPQVSLDHG

SEQ ID NO: 521437 - protein, 9 aa, Homo Sapiens
GFPNEYDDN

SEQ ID NO: 521438 - protein, 9 aa, Homo Sapiens
VHVNAQEVA

SEQ ID NO: 521439 - protein, 9 aa, Homo Sapiens
FVLGIFFMC

SEQ ID NO: 521440 - protein, 9 aa, Homo Sapiens
TAKALQDLA

SEQ ID NO: 521441 - protein, 9 aa, Homo Sapiens
TEKFSESFE

SEQ ID NO: 521442 - protein, 9 aa, Homo Sapiens
SRRDRKAIH

SEQ ID NO: 521443 - protein, 9 aa, Homo Sapiens
APEPPNPAT

SEQ ID NO: 521444 - protein, 9 aa, Homo Sapiens
QAGLVDALH

SEQ ID NO: 521445 - protein, 9 aa, Homo Sapiens
DFFKENWSF

SEQ ID NO: 521446 - protein, 9 aa, Homo Sapiens
PSNPLPCQK

SEQ ID NO: 521447 - protein, 9 aa, Homo Sapiens
GDDIYDGIE

SEQ ID NO: 521448 - protein, 9 aa, Homo Sapiens
EVQESIRFL

SEQ ID NO: 521449 - protein, 9 aa, Homo Sapiens
KHETELSLR

SEQ ID NO: 521450 - protein, 9 aa, Homo Sapiens
EDHFDRSMH

SEQ ID NO: 521451 - protein, 9 aa, Homo Sapiens
QTWHFEATM

SEQ ID NO: 521452 - protein, 9 aa, Homo Sapiens
LRDREIWAP

SEQ ID NO: 521453 - protein, 9 aa, Homo Sapiens
ILRSTIQYI

SEQ ID NO: 521454 - protein, 9 aa, Homo Sapiens
LSWPPWTRL

SEQ ID NO: 521455 - protein, 9 aa, Homo Sapiens
RSNSDVTVS

SEQ ID NO: 521456 - protein, 9 aa, Homo Sapiens
QVPCSAQAP

SEQ ID NO: 521457 - protein, 9 aa, Homo Sapiens
LLQVDAVSQ

SEQ ID NO: 521458 - protein, 9 aa, Homo Sapiens
RIVSQNLSR

SEQ ID NO: 521459 - protein, 9 aa, Homo Sapiens
KPLGLRAQA

SEQ ID NO: 521460 - protein, 9 aa, Homo Sapiens
VYSQSTAVT

SEQ ID NO: 521461 - protein, 9 aa, Homo Sapiens
NPFCHDVSL

SEQ ID NO: 521462 - protein, 9 aa, Homo Sapiens
RCLPLWTSE

SEQ ID NO: 521463 - protein, 9 aa, Homo Sapiens
VNAQEVAKP

SEQ ID NO: 521464 - protein, 9 aa, Homo Sapiens
EDQESANNY

SEQ ID NO: 521465 - protein, 9 aa, Homo Sapiens
EVAKPVRHK

SEQ ID NO: 521466 - protein, 9 aa, Homo Sapiens
VRPPDTWLH

SEQ ID NO: 521467 - protein, 9 aa, Homo Sapiens
DTLTSRIHT

SEQ ID NO: 521468 - protein, 9 aa, Homo Sapiens
FIIQVASGE

SEQ ID NO: 521469 - protein, 9 aa, Homo Sapiens
KEGGAGRVR

SEQ ID NO: 521470 - protein, 9 aa, Homo Sapiens
ATAGSPPAG

SEQ ID NO: 521471 - protein, 9 aa, Homo Sapiens
GIKPTGILH

SEQ ID NO: 521472 - protein, 9 aa, Homo Sapiens
GVKCFSADF

SEQ ID NO: 521473 - protein, 9 aa, Homo Sapiens
LTAHVEQAH

SEQ ID NO: 521474 - protein, 9 aa, Homo Sapiens
NTIGTASSK

SEQ ID NO: 521475 - protein, 9 aa, Homo Sapiens
GSISPSAFV

SEQ ID NO: 521476 - protein, 9 aa, Homo Sapiens
AEDQESANN

SEQ ID NO: 521477 - protein, 9 aa, Homo Sapiens
SPHHERCSD

SEQ ID NO: 521478 - protein, 9 aa, Homo Sapiens
FDLSIGPLL

SEQ ID NO: 521479 - protein, 9 aa, Homo Sapiens
FFLSFLSRH

SEQ ID NO: 521480 - protein, 9 aa, Homo Sapiens
IDTIVIFYQ

SEQ ID NO: 521481 - protein, 9 aa, Homo Sapiens
QEVAKPVRH

SEQ ID NO: 521482 - protein, 9 aa, Homo Sapiens
LFHSAGHAG

SEQ ID NO: 521483 - protein, 9 aa, Homo Sapiens
ERMYRWTSN

SEQ ID NO: 521484 - protein, 9 aa, Homo Sapiens
VLFDLSIGP

SEQ ID NO: 521485 - protein, 9 aa, Homo Sapiens
VEKRRLLLE

SEQ ID NO: 521486 - protein, 9 aa, Homo Sapiens
VFFLSFLSR

SEQ ID NO: 521487 - protein, 9 aa, Homo Sapiens
VVGSSGVSV

SEQ ID NO: 521488 - protein, 9 aa, Homo Sapiens
PLWTSERPQ

SEQ ID NO: 521489 - protein, 9 aa, Homo Sapiens
HVNAQEVAK

SEQ ID NO: 521490 - protein, 9 aa, Homo Sapiens
DVKDFFKEN

SEQ ID NO: 521491 - protein, 9 aa, Homo Sapiens
YVWDSNYHQ

SEQ ID NO: 521492 - protein, 9 aa, Homo Sapiens
PILDRSVVG

SEQ ID NO: 521493 - protein, 9 aa, Homo Sapiens
TYVWDSNYH

SEQ ID NO: 521494 - protein, 9 aa, Homo Sapiens
GALLGDRVD

SEQ ID NO: 521495 - protein, 9 aa, Homo Sapiens
MFYYLEGTK

SEQ ID NO: 521496 - protein, 9 aa, Homo Sapiens
YEEYHLSLQ

SEQ ID NO: 521497 - protein, 9 aa, Homo Sapiens
LKLEDSYEL

SEQ ID NO: 521498 - protein, 9 aa, Homo Sapiens
WTSERPQLS

SEQ ID NO: 521499 - protein, 9 aa, Homo Sapiens
FQRGLRRLS

SEQ ID NO: 521500 - protein, 9 aa, Homo Sapiens
LDSPQAGSR

SEQ ID NO: 521501 - protein, 9 aa, Homo Sapiens
LEEEKRRQH

SEQ ID NO: 521502 - protein, 9 aa, Homo Sapiens
DSPYCHQVR

SEQ ID NO: 521503 - protein, 9 aa, Homo Sapiens
FYNGPFSKF

SEQ ID NO: 521504 - protein, 9 aa, Homo Sapiens
ACVPGKPTL

SEQ ID NO: 521505 - protein, 9 aa, Homo Sapiens
AGAKPLGLR

SEQ ID NO: 521506 - protein, 9 aa, Homo Sapiens
HRFTCNICS

SEQ ID NO: 521507 - protein, 9 aa, Homo Sapiens
NLKINLKAS

SEQ ID NO: 521508 - protein, 9 aa, Homo Sapiens
PVYSQSTAV

SEQ ID NO: 521509 - protein, 9 aa, Homo Sapiens
WNPFCHDVS

SEQ ID NO: 521510 - protein, 9 aa, Homo Sapiens
PGVNNNSAQ

SEQ ID NO: 521511 - protein, 9 aa, Homo Sapiens
WNKNGSQVV

SEQ ID NO: 521512 - protein, 9 aa, Homo Sapiens
ICCAFDSPS

SEQ ID NO: 521513 - protein, 9 aa, Homo Sapiens
VTRNLFCLQ

SEQ ID NO: 521514 - protein, 9 aa, Homo Sapiens
QVDAVSQAV

SEQ ID NO: 521515 - protein, 9 aa, Homo Sapiens
FTSGDRHIV

SEQ ID NO: 521516 - protein, 9 aa, Homo Sapiens
WPNCDQSDG

SEQ ID NO: 521517 - protein, 9 aa, Homo Sapiens
TVITLISMF

SEQ ID NO: 521518 - protein, 9 aa, Homo Sapiens
PDTWLHGTH

SEQ ID NO: 521519 - protein, 9 aa, Homo Sapiens
LSHLNNVFV

SEQ ID NO: 521520 - protein, 9 aa, Homo Sapiens
GEPLHPDTE

SEQ ID NO: 521521 - protein, 9 aa, Homo Sapiens
IPILDRSVV

SEQ ID NO: 521522 - protein, 9 aa, Homo Sapiens
HCWNKNGSQ

SEQ ID NO: 521523 - protein, 9 aa, Homo Sapiens
PQNKKEKSS

SEQ ID NO: 521524 - protein, 9 aa, Homo Sapiens
YDITKETFD

SEQ ID NO: 521525 - protein, 9 aa, Homo Sapiens
VRHKHGPQV

SEQ ID NO: 521526 - protein, 9 aa, Homo Sapiens
WTRAQREHD

SEQ ID NO: 521527 - protein, 9 aa, Homo Sapiens
SGGEEDHFD

SEQ ID NO: 521528 - protein, 9 aa, Homo Sapiens
VQYDEDDDE

SEQ ID NO: 521529 - protein, 9 aa, Homo Sapiens
PKDDVKGIP

SEQ ID NO: 521530 - protein, 9 aa, Homo Sapiens
PQVSLDHGV

SEQ ID NO: 521531 - protein, 9 aa, Homo Sapiens
QNLSRRDRK

SEQ ID NO: 521532 - protein, 9 aa, Homo Sapiens
EVVDEVDAR

SEQ ID NO: 521533 - protein, 9 aa, Homo Sapiens
NLQVIWGRI

SEQ ID NO: 521534 - protein, 9 aa, Homo Sapiens
IETQKVLNL

SEQ ID NO: 521535 - protein, 9 aa, Homo Sapiens
AKVIETKSK

SEQ ID NO: 521536 - protein, 9 aa, Homo Sapiens
VADSPQNKK

SEQ ID NO: 521537 - protein, 9 aa, Homo Sapiens
LVYDITKET

SEQ ID NO: 521538 - protein, 9 aa, Homo Sapiens
MDGELSCRI

SEQ ID NO: 521539 - protein, 9 aa, Homo Sapiens
GYECRVSTF

SEQ ID NO: 521540 - protein, 9 aa, Homo Sapiens
YDADEDVQY

SEQ ID NO: 521541 - protein, 9 aa, Homo Sapiens
RNQKILTHR

SEQ ID NO: 521542 - protein, 9 aa, Homo Sapiens
GQLLQVDAV

SEQ ID NO: 521543 - protein, 9 aa, Homo Sapiens
ATYVWDSNY

SEQ ID NO: 521544 - protein, 9 aa, Homo Sapiens
QNINLGPYG

SEQ ID NO: 521545 - protein, 9 aa, Homo Sapiens
GIVSGERFF

SEQ ID NO: 521546 - protein, 9 aa, Homo Sapiens
DFNMAADIN

SEQ ID NO: 521547 - protein, 9 aa, Homo Sapiens
LRRLSGAMC

SEQ ID NO: 521548 - protein, 9 aa, Homo Sapiens
VVRRSPHHE

SEQ ID NO: 521549 - protein, 9 aa, Homo Sapiens
TNEPSTRIR

SEQ ID NO: 521550 - protein, 9 aa, Homo Sapiens
DFVQVTRNL

SEQ ID NO: 521551 - protein, 9 aa, Homo Sapiens
MHIRASEHW

SEQ ID NO: 521552 - protein, 9 aa, Homo Sapiens
TPGEPGKEI

SEQ ID NO: 521553 - protein, 9 aa, Homo Sapiens
RDWRTTEHA

SEQ ID NO: 521554 - protein, 9 aa, Homo Sapiens
SNYHQPWEP

SEQ ID NO: 521555 - protein, 9 aa, Homo Sapiens
EDSYELIEK

SEQ ID NO: 521556 - protein, 9 aa, Homo Sapiens
REHDAQKQH

SEQ ID NO: 521557 - protein, 9 aa, Homo Sapiens
SNGAVVKDK

SEQ ID NO: 521558 - protein, 9 aa, Homo Sapiens
RLPLAVYSA

SEQ ID NO: 521559 - protein, 9 aa, Homo Sapiens
ADPAKTAKA

SEQ ID NO: 521560 - protein, 9 aa, Homo Sapiens
SAAQSQLQG

SEQ ID NO: 521561 - protein, 9 aa, Homo Sapiens
AQDAHVGQL

SEQ ID NO: 521562 - protein, 9 aa, Homo Sapiens
LSCGLVLKR

SEQ ID NO: 521563 - protein, 9 aa, Homo Sapiens
TQSTTEIHN

SEQ ID NO: 521564 - protein, 9 aa, Homo Sapiens
PQHCLIDGL

SEQ ID NO: 521565 - protein, 9 aa, Homo Sapiens
VFQTSYCLY

SEQ ID NO: 521566 - protein, 9 aa, Homo Sapiens
SRQVRNQKI

SEQ ID NO: 521567 - protein, 9 aa, Homo Sapiens
LQLITLADE

SEQ ID NO: 521568 - protein, 9 aa, Homo Sapiens
TTVAEDQES

SEQ ID NO: 521569 - protein, 9 aa, Homo Sapiens
REKVKAVLD

SEQ ID NO: 521570 - protein, 9 aa, Homo Sapiens
NNTWPNCDQ

SEQ ID NO: 521571 - protein, 9 aa, Homo Sapiens
SVIELTKML

SEQ ID NO: 521572 - protein, 9 aa, Homo Sapiens
RQEPPVLAL

SEQ ID NO: 521573 - protein, 9 aa, Homo Sapiens
APATGGVMK

SEQ ID NO: 521574 - protein, 9 aa, Homo Sapiens
AGQAGRGPS

SEQ ID NO: 521575 - protein, 9 aa, Homo Sapiens
HKHGPQVSL

SEQ ID NO: 521576 - protein, 9 aa, Homo Sapiens
LISMFDRDF

SEQ ID NO: 521577 - protein, 9 aa, Homo Sapiens
FSKFWAYAF

SEQ ID NO: 521578 - protein, 9 aa, Homo Sapiens
QDAHVGQLL

SEQ ID NO: 521579 - protein, 9 aa, Homo Sapiens
GGKGAGDVG

SEQ ID NO: 521580 - protein, 9 aa, Homo Sapiens
GSEAVILTA

SEQ ID NO: 521581 - protein, 9 aa, Homo Sapiens
LRQEPPVLA

SEQ ID NO: 521582 - protein, 9 aa, Homo Sapiens
SQVVQYEID

SEQ ID NO: 521583 - protein, 9 aa, Homo Sapiens
LGDRVDIAE

SEQ ID NO: 521584 - protein, 9 aa, Homo Sapiens
ESMGLKLSP

SEQ ID NO: 521585 - protein, 9 aa, Homo Sapiens
RIHTPFRLC

SEQ ID NO: 521586 - protein, 9 aa, Homo Sapiens
CDQSDGVFG

SEQ ID NO: 521587 - protein, 9 aa, Homo Sapiens
KDEVAIKEF

SEQ ID NO: 521588 - protein, 9 aa, Homo Sapiens
LLLLTFTVL

SEQ ID NO: 521589 - protein, 9 aa, Homo Sapiens
AVVKDKQPS

SEQ ID NO: 521590 - protein, 9 aa, Homo Sapiens
MYRWTSNMV

SEQ ID NO: 521591 - protein, 9 aa, Homo Sapiens
FSLLAWDAC

SEQ ID NO: 521592 - protein, 9 aa, Homo Sapiens
SAKDEVAIK

SEQ ID NO: 521593 - protein, 9 aa, Homo Sapiens
HMTEVVRRS

SEQ ID NO: 521594 - protein, 9 aa, Homo Sapiens
AGLVDALHA

SEQ ID NO: 521595 - protein, 9 aa, Homo Sapiens
KVGDKKCDI

SEQ ID NO: 521596 - protein, 9 aa, Homo Sapiens
SWVVFFLSF

SEQ ID NO: 521597 - protein, 9 aa, Homo Sapiens
DVVVMTEVM

SEQ ID NO: 521598 - protein, 9 aa, Homo Sapiens
QLLQVDAVS

SEQ ID NO: 521599 - protein, 9 aa, Homo Sapiens
MKLLLLTFT

SEQ ID NO: 521600 - protein, 9 aa, Homo Sapiens
AVKEGGAGR

SEQ ID NO: 521601 - protein, 9 aa, Homo Sapiens
PFQQQQQPP

SEQ ID NO: 521602 - protein, 9 aa, Homo Sapiens
AVVISLFMT

SEQ ID NO: 521603 - protein, 9 aa, Homo Sapiens
LKLSPGAQQ

SEQ ID NO: 521604 - protein, 9 aa, Homo Sapiens
QRCWRPSTA

SEQ ID NO: 521605 - protein, 9 aa, Homo Sapiens
ISLFMTPLD

SEQ ID NO: 521606 - protein, 9 aa, Homo Sapiens
PLVAGQAGR

SEQ ID NO: 521607 - protein, 9 aa, Homo Sapiens
MPFLPPRGP

SEQ ID NO: 521608 - protein, 9 aa, Homo Sapiens
GRLPLAVYS

SEQ ID NO: 521609 - protein, 9 aa, Homo Sapiens
PSLARPGLR

SEQ ID NO: 521610 - protein, 9 aa, Homo Sapiens
LEISSKCMM

SEQ ID NO: 521611 - protein, 9 aa, Homo Sapiens
DSKCPSATI

SEQ ID NO: 521612 - protein, 9 aa, Homo Sapiens
CLLLADMPF

SEQ ID NO: 521613 - protein, 9 aa, Homo Sapiens
TRDVKDFFK

SEQ ID NO: 521614 - protein, 9 aa, Homo Sapiens
VEEVLKIGQ

SEQ ID NO: 521615 - protein, 9 aa, Homo Sapiens
YRWTSNMVG

SEQ ID NO: 521616 - protein, 9 aa, Homo Sapiens
SEMDTKIQE

SEQ ID NO: 521617 - protein, 9 aa, Homo Sapiens
VLLDADPAK

SEQ ID NO: 521618 - protein, 9 aa, Homo Sapiens
ALGSSGPPL

SEQ ID NO: 521619 - protein, 9 aa, Homo Sapiens
FMFYYLEGT

SEQ ID NO: 521620 - protein, 9 aa, Homo Sapiens
VQADEGGYE

SEQ ID NO: 521621 - protein, 9 aa, Homo Sapiens
QEVVDEVDA

SEQ ID NO: 521622 - protein, 9 aa, Homo Sapiens
TGVSREKVK

SEQ ID NO: 521623 - protein, 9 aa, Homo Sapiens
KFGFSSQAE

SEQ ID NO: 521624 - protein, 9 aa, Homo Sapiens
NAQEVAKPV

SEQ ID NO: 521625 - protein, 9 aa, Homo Sapiens
ANRGTLIKV

SEQ ID NO: 521626 - protein, 9 aa, Homo Sapiens
RRDRKAIHT

SEQ ID NO: 521627 - protein, 9 aa, Homo Sapiens
TSGDRHIVS

SEQ ID NO: 521628 - protein, 9 aa, Homo Sapiens
EVAIKEFQF

SEQ ID NO: 521629 - protein, 9 aa, Homo Sapiens
SQAVHVRPP

SEQ ID NO: 521630 - protein, 9 aa, Homo Sapiens
CYPPGPGRA

SEQ ID NO: 521631 - protein, 9 aa, Homo Sapiens
GLPPPFQQQ

SEQ ID NO: 521632 - protein, 9 aa, Homo Sapiens
LAWDACVFR

SEQ ID NO: 521633 - protein, 9 aa, Homo Sapiens
NRVLFDLSI

SEQ ID NO: 521634 - protein, 9 aa, Homo Sapiens
CLIDGLLVC

SEQ ID NO: 521635 - protein, 9 aa, Homo Sapiens
PSTAQRPSA

SEQ ID NO: 521636 - protein, 9 aa, Homo Sapiens
GRRCLPLWT

SEQ ID NO: 521637 - protein, 9 aa, Homo Sapiens
NLMRPSLAR

SEQ ID NO: 521638 - protein, 9 aa, Homo Sapiens
AGDVGSEAV

SEQ ID NO: 521639 - protein, 9 aa, Homo Sapiens
NVKALIEHE

SEQ ID NO: 521640 - protein, 9 aa, Homo Sapiens
IFVERMYRW

SEQ ID NO: 521641 - protein, 9 aa, Homo Sapiens
NNLSEMDTK

SEQ ID NO: 521642 - protein, 9 aa, Homo Sapiens
IFYQKNGQI

SEQ ID NO: 521643 - protein, 9 aa, Homo Sapiens
TSERPQLSW

SEQ ID NO: 521644 - protein, 9 aa, Homo Sapiens
RHKHGPQVS

SEQ ID NO: 521645 - protein, 9 aa, Homo Sapiens
PLDGTAGFV

SEQ ID NO: 521646 - protein, 9 aa, Homo Sapiens
DAVSQAVHV

SEQ ID NO: 521647 - protein, 9 aa, Homo Sapiens
VMHTICCAF

SEQ ID NO: 521648 - protein, 9 aa, Homo Sapiens
TEVMHTICC

SEQ ID NO: 521649 - protein, 9 aa, Homo Sapiens
TVLRALKTI

SEQ ID NO: 521650 - protein, 9 aa, Homo Sapiens
VADGPQHPE

SEQ ID NO: 521651 - protein, 9 aa, Homo Sapiens
QFSILMDSP

SEQ ID NO: 521652 - protein, 9 aa, Homo Sapiens
FQPQPNEMH

SEQ ID NO: 521653 - protein, 9 aa, Homo Sapiens
SQRWGLLSS

SEQ ID NO: 521654 - protein, 9 aa, Homo Sapiens
PQAGSRWSS

SEQ ID NO: 521655 - protein, 9 aa, Homo Sapiens
GLRRLSGAM

SEQ ID NO: 521656 - protein, 9 aa, Homo Sapiens
MYDADEDVQ

SEQ ID NO: 521657 - protein, 9 aa, Homo Sapiens
VNLTSSGER

SEQ ID NO: 521658 - protein, 9 aa, Homo Sapiens
IVSQNLSRR

SEQ ID NO: 521659 - protein, 9 aa, Homo Sapiens
PLGLRAQAA

SEQ ID NO: 521660 - protein, 9 aa, Homo Sapiens
PSAFVLEIF

SEQ ID NO: 521661 - protein, 9 aa, Homo Sapiens
RHRHHGHKH

SEQ ID NO: 521662 - protein, 9 aa, Homo Sapiens
EAEDETLRT

SEQ ID NO: 521663 - protein, 9 aa, Homo Sapiens
TVAEDQESA

SEQ ID NO: 521664 - protein, 9 aa, Homo Sapiens
HETELSLRQ

SEQ ID NO: 521665 - protein, 9 aa, Homo Sapiens
CCAFDSPSN

SEQ ID NO: 521666 - protein, 9 aa, Homo Sapiens
EDETLRTRS

SEQ ID NO: 521667 - protein, 9 aa, Homo Sapiens
YTCKAENTI

SEQ ID NO: 521668 - protein, 9 aa, Homo Sapiens
PPGSAFWVE

SEQ ID NO: 521669 - protein, 9 aa, Homo Sapiens
MAVVYMLKR

SEQ ID NO: 521670 - protein, 9 aa, Homo Sapiens
VHVRPPDTW

SEQ ID NO: 521671 - protein, 9 aa, Homo Sapiens
ILVYDITKE

SEQ ID NO: 521672 - protein, 9 aa, Homo Sapiens
LDHGVHAAA

SEQ ID NO: 521673 - protein, 9 aa, Homo Sapiens
IWGRILHNG

SEQ ID NO: 521674 - protein, 9 aa, Homo Sapiens
ISMFDRDFG

SEQ ID NO: 521675 - protein, 9 aa, Homo Sapiens
FMHVNHTRF

SEQ ID NO: 521676 - protein, 9 aa, Homo Sapiens
VLKIGQHKP

SEQ ID NO: 521677 - protein, 9 aa, Homo Sapiens
LVCSELAVG

SEQ ID NO: 521678 - protein, 9 aa, Homo Sapiens
RIRFINLAR

SEQ ID NO: 521679 - protein, 9 aa, Homo Sapiens
VVDEVDARL

SEQ ID NO: 521680 - protein, 9 aa, Homo Sapiens
PRMAETGDT

SEQ ID NO: 521681 - protein, 9 aa, Homo Sapiens
APPTEGACV

SEQ ID NO: 521682 - protein, 9 aa, Homo Sapiens
RQVRNQKIL

SEQ ID NO: 521683 - protein, 9 aa, Homo Sapiens
NNDVFLQFS

SEQ ID NO: 521684 - protein, 9 aa, Homo Sapiens
SNSDVTVSD

SEQ ID NO: 521685 - protein, 9 aa, Homo Sapiens
CRIFQLISL

SEQ ID NO: 521686 - protein, 9 aa, Homo Sapiens
YGNPHAKPT

SEQ ID NO: 521687 - protein, 9 aa, Homo Sapiens
EGGYECRVS

SEQ ID NO: 521688 - protein, 9 aa, Homo Sapiens
DEVDARLHG

SEQ ID NO: 521689 - protein, 9 aa, Homo Sapiens
DSPQAGSRW

SEQ ID NO: 521690 - protein, 9 aa, Homo Sapiens
SCNNDVFLQ

SEQ ID NO: 521691 - protein, 9 aa, Homo Sapiens
GGVMKPHRY

SEQ ID NO: 521692 - protein, 9 aa, Homo Sapiens
LKTPGEPGK

SEQ ID NO: 521693 - protein, 9 aa, Homo Sapiens
CPFGRSVIE

SEQ ID NO: 521694 - protein, 9 aa, Homo Sapiens
DDNQICYWH

SEQ ID NO: 521695 - protein, 9 aa, Homo Sapiens
KGAGATAGS

SEQ ID NO: 521696 - protein, 9 aa, Homo Sapiens
RPSLARPGL

SEQ ID NO: 521697 - protein, 9 aa, Homo Sapiens
AVGGKGAGD

SEQ ID NO: 521698 - protein, 9 aa, Homo Sapiens
YNGPFSKFW

SEQ ID NO: 521699 - protein, 9 aa, Homo Sapiens
VVMTEVMHT

SEQ ID NO: 521700 - protein, 9 aa, Homo Sapiens
SLWEKHLKE

SEQ ID NO: 521701 - protein, 9 aa, Homo Sapiens
NMAADINPQ

SEQ ID NO: 521702 - protein, 9 aa, Homo Sapiens
GIKKAAENV

SEQ ID NO: 521703 - protein, 9 aa, Homo Sapiens
QKVLNLKIN

SEQ ID NO: 521704 - protein, 9 aa, Homo Sapiens
IFPPPPGDD

SEQ ID NO: 521705 - protein, 9 aa, Homo Sapiens
EIHGEPLHP

SEQ ID NO: 521706 - protein, 9 aa, Homo Sapiens
TSNVADSPQ

SEQ ID NO: 521707 - protein, 9 aa, Homo Sapiens
DFRTKHETE

SEQ ID NO: 521708 - protein, 9 aa, Homo Sapiens
GAGATAGSP

SEQ ID NO: 521709 - protein, 9 aa, Homo Sapiens
FNMAADINP

SEQ ID NO: 521710 - protein, 9 aa, Homo Sapiens
LQSLWEKHL

SEQ ID NO: 521711 - protein, 9 aa, Homo Sapiens
QSTTEIHNL

SEQ ID NO: 521712 - protein, 9 aa, Homo Sapiens
ILMDSPFFD

SEQ ID NO: 521713 - protein, 9 aa, Homo Sapiens
GLAADPASG

SEQ ID NO: 521714 - protein, 9 aa, Homo Sapiens
GRFAVRDMK

SEQ ID NO: 521715 - protein, 9 aa, Homo Sapiens
FPNEYDDNQ

SEQ ID NO: 521716 - protein, 9 aa, Homo Sapiens
VLRFKAEGV

SEQ ID NO: 521717 - protein, 9 aa, Homo Sapiens
LGSSGPPLD

SEQ ID NO: 521718 - protein, 9 aa, Homo Sapiens
PATGGVMKP

SEQ ID NO: 521719 - protein, 9 aa, Homo Sapiens
VASHVVHVN

SEQ ID NO: 521720 - protein, 9 aa, Homo Sapiens
HALWVASHV

SEQ ID NO: 521721 - protein, 9 aa, Homo Sapiens
QEVFQTSYC

SEQ ID NO: 521722 - protein, 9 aa, Homo Sapiens
QEGFSQRWG

SEQ ID NO: 521723 - protein, 9 aa, Homo Sapiens
TPLDSPQAG

SEQ ID NO: 521724 - protein, 9 aa, Homo Sapiens
HSKTEKFSE

SEQ ID NO: 521725 - protein, 9 aa, Homo Sapiens
NRLLKLEDS

SEQ ID NO: 521726 - protein, 9 aa, Homo Sapiens
SKEELEDYI

SEQ ID NO: 521727 - protein, 9 aa, Homo Sapiens
GAGDVGSEA

SEQ ID NO: 521728 - protein, 9 aa, Homo Sapiens
ATGGVMKPH

SEQ ID NO: 521729 - protein, 9 aa, Homo Sapiens
QRSNSDVTV

SEQ ID NO: 521730 - protein, 9 aa, Homo Sapiens
GATAGSPPA

SEQ ID NO: 521731 - protein, 9 aa, Homo Sapiens
GTVITLISM

SEQ ID NO: 521732 - protein, 9 aa, Homo Sapiens
GAPQHCLID

SEQ ID NO: 521733 - protein, 9 aa, Homo Sapiens
DINPQNADV

SEQ ID NO: 521734 - protein, 9 aa, Homo Sapiens
FGRSVIELT

SEQ ID NO: 521735 - protein, 9 aa, Homo Sapiens
WKEVNGQVG

SEQ ID NO: 521736 - protein, 9 aa, Homo Sapiens
EEYHLSLQA

SEQ ID NO: 521737 - protein, 9 aa, Homo Sapiens
NGVKCFSAD

SEQ ID NO: 521738 - protein, 9 aa, Homo Sapiens
TEGACVPGK

SEQ ID NO: 521739 - protein, 9 aa, Homo Sapiens
DQESANNYT

SEQ ID NO: 521740 - protein, 9 aa, Homo Sapiens
SLQALDLCL

SEQ ID NO: 521741 - protein, 9 aa, Homo Sapiens
HACFNLFHS

SEQ ID NO: 521742 - protein, 9 aa, Homo Sapiens
LGLRAQAAA

SEQ ID NO: 521743 - protein, 9 aa, Homo Sapiens
VFQNLQVIW

SEQ ID NO: 521744 - protein, 9 aa, Homo Sapiens
CAFDSPSNP

SEQ ID NO: 521745 - protein, 9 aa, Homo Sapiens
DVGSEAVIL

SEQ ID NO: 521746 - protein, 9 aa, Homo Sapiens
FFTPLDSPQ

SEQ ID NO: 521747 - protein, 9 aa, Homo Sapiens
EGGAGRVRQ

SEQ ID NO: 521748 - protein, 9 aa, Homo Sapiens
NVFVFAPSP

SEQ ID NO: 521749 - protein, 9 aa, Homo Sapiens
SSRQVRNQK

SEQ ID NO: 521750 - protein, 9 aa, Homo Sapiens
SHSKTEKFS

SEQ ID NO: 521751 - protein, 9 aa, Homo Sapiens
PAPEPPNPA

SEQ ID NO: 521752 - protein, 9 aa, Homo Sapiens
RSTIQYIER

SEQ ID NO: 521753 - protein, 9 aa, Homo Sapiens
YSAQHGPGS

SEQ ID NO: 521754 - protein, 9 aa, Homo Sapiens
FHSAGHAGQ

SEQ ID NO: 521755 - protein, 9 aa, Homo Sapiens
GFYNGPFSK

SEQ ID NO: 521756 - protein, 9 aa, Homo Sapiens
PGSAFWVEA

SEQ ID NO: 521757 - protein, 9 aa, Homo Sapiens
VGSSGVSVV

SEQ ID NO: 521758 - protein, 9 aa, Homo Sapiens
PSTGFIEQK

SEQ ID NO: 521759 - protein, 9 aa, Homo Sapiens
DVTVSDIDA

SEQ ID NO: 521760 - protein, 9 aa, Homo Sapiens
PDVEKRRLL

SEQ ID NO: 521761 - protein, 9 aa, Homo Sapiens
HFSLDVQQV

SEQ ID NO: 521762 - protein, 9 aa, Homo Sapiens
GGAGRVRQG

SEQ ID NO: 521763 - protein, 9 aa, Homo Sapiens
TLFFMFYYL

SEQ ID NO: 521764 - protein, 9 aa, Homo Sapiens
LVAGQAGRG

SEQ ID NO: 521765 - protein, 9 aa, Homo Sapiens
DSPQNKKEK

SEQ ID NO: 521766 - protein, 9 aa, Homo Sapiens
KWLSCGLVL

SEQ ID NO: 521767 - protein, 9 aa, Homo Sapiens
NLTSSGERL

SEQ ID NO: 521768 - protein, 9 aa, Homo Sapiens
VIWGRILHN

SEQ ID NO: 521769 - protein, 9 aa, Homo Sapiens
KEVNGQVGL

SEQ ID NO: 521770 - protein, 9 aa, Homo Sapiens
MTEVMHTIC

SEQ ID NO: 521771 - protein, 9 aa, Homo Sapiens
LSFLSRHAP

SEQ ID NO: 521772 - protein, 9 aa, Homo Sapiens
KEELEDYIV

SEQ ID NO: 521773 - protein, 9 aa, Homo Sapiens
VFLQFSILM

SEQ ID NO: 521774 - protein, 9 aa, Homo Sapiens
SKTEKFSES

SEQ ID NO: 521775 - protein, 9 aa, Homo Sapiens
HAELEAFEN

SEQ ID NO: 521776 - protein, 9 aa, Homo Sapiens
KVLNLKINL

SEQ ID NO: 521777 - protein, 9 aa, Homo Sapiens
AKDEVAIKE

SEQ ID NO: 521778 - protein, 9 aa, Homo Sapiens
YKSCLFDSC

SEQ ID NO: 521779 - protein, 9 aa, Homo Sapiens
VSALRTFTV

SEQ ID NO: 521780 - protein, 9 aa, Homo Sapiens
LPLLLMPPA

SEQ ID NO: 521781 - protein, 9 aa, Homo Sapiens
GSPSTGFIE

SEQ ID NO: 521782 - protein, 9 aa, Homo Sapiens
LLKLEDSYE

SEQ ID NO: 521783 - protein, 9 aa, Homo Sapiens
FKVKVGDKK

SEQ ID NO: 521784 - protein, 9 aa, Homo Sapiens
AVYSAQHGP

SEQ ID NO: 521785 - protein, 9 aa, Homo Sapiens
GSAFPDVKP

SEQ ID NO: 521786 - protein, 9 aa, Homo Sapiens
IFQLISLMD

SEQ ID NO: 521787 - protein, 9 aa, Homo Sapiens
VWDSNYHQP

SEQ ID NO: 521788 - protein, 9 aa, Homo Sapiens
GEEDHFDRS

SEQ ID NO: 521789 - protein, 9 aa, Homo Sapiens
QFQAQSCYP

SEQ ID NO: 521790 - protein, 9 aa, Homo Sapiens
SHLNNVFVF

SEQ ID NO: 521791 - protein, 9 aa, Homo Sapiens
CLSALCGFP

SEQ ID NO: 521792 - protein, 9 aa, Homo Sapiens
VDALHALWV

SEQ ID NO: 521793 - protein, 9 aa, Homo Sapiens
IIETQKVLN

SEQ ID NO: 521794 - protein, 9 aa, Homo Sapiens
DALHALWVA

SEQ ID NO: 521795 - protein, 9 aa, Homo Sapiens
IKKAAENVK

SEQ ID NO: 521796 - protein, 9 aa, Homo Sapiens
DVEKRRLLL

SEQ ID NO: 521797 - protein, 9 aa, Homo Sapiens
GTSPPYMPG

SEQ ID NO: 521798 - protein, 9 aa, Homo Sapiens
YWRGFFAAI

SEQ ID NO: 521799 - protein, 9 aa, Homo Sapiens
PALYGPRKV

SEQ ID NO: 521800 - protein, 9 aa, Homo Sapiens
NLSEMDTKI

SEQ ID NO: 521801 - protein, 9 aa, Homo Sapiens
SAPATGGVM

SEQ ID NO: 521802 - protein, 9 aa, Homo Sapiens
HAWLQVPCS

SEQ ID NO: 521803 - protein, 9 aa, Homo Sapiens
LPLWTSERP

SEQ ID NO: 521804 - protein, 9 aa, Homo Sapiens
DLAVKEGGA

SEQ ID NO: 521805 - protein, 9 aa, Homo Sapiens
VAKPVRHKH

SEQ ID NO: 521806 - protein, 9 aa, Homo Sapiens
FFMFYYLEG

SEQ ID NO: 521807 - protein, 9 aa, Homo Sapiens
CSELAVGGK

SEQ ID NO: 521808 - protein, 9 aa, Homo Sapiens
WLKGAGATA

SEQ ID NO: 521809 - protein, 9 aa, Homo Sapiens
DGLLVCSEL

SEQ ID NO: 521810 - protein, 9 aa, Homo Sapiens
RDREIWAPW

SEQ ID NO: 521811 - protein, 9 aa, Homo Sapiens
LGPYGNPHA

SEQ ID NO: 521812 - protein, 9 aa, Homo Sapiens
FCHDVSLSC

SEQ ID NO: 521813 - protein, 9 aa, Homo Sapiens
YSQSTAVTH

SEQ ID NO: 521814 - protein, 9 aa, Homo Sapiens
PFFDHSSTQ

SEQ ID NO: 521815 - protein, 9 aa, Homo Sapiens
VAGQAGRGP

SEQ ID NO: 521816 - protein, 9 aa, Homo Sapiens
QHAELEAFE

SEQ ID NO: 521817 - protein, 9 aa, Homo Sapiens
TQYYHRFTC

SEQ ID NO: 521818 - protein, 9 aa, Homo Sapiens
VGDKKCDIM

SEQ ID NO: 521819 - protein, 9 aa, Homo Sapiens
SATVSGVTT

SEQ ID NO: 521820 - protein, 9 aa, Homo Sapiens
VSQAVHVRP

SEQ ID NO: 521821 - protein, 9 aa, Homo Sapiens
LWTSERPQL

SEQ ID NO: 521822 - protein, 9 aa, Homo Sapiens
PTRCECLSA

SEQ ID NO: 521823 - protein, 9 aa, Homo Sapiens
YWRCWLVFR

SEQ ID NO: 521824 - protein, 9 aa, Homo Sapiens
IHGEPLHPD

SEQ ID NO: 521825 - protein, 9 aa, Homo Sapiens
LIDGLLVCS

SEQ ID NO: 521826 - protein, 9 aa, Homo Sapiens
GPEIQRAEC

SEQ ID NO: 521827 - protein, 9 aa, Homo Sapiens
EVDARLHGE

SEQ ID NO: 521828 - protein, 9 aa, Homo Sapiens
HRHHGHKHR

SEQ ID NO: 521829 - protein, 9 aa, Homo Sapiens
SNPDSPYCH

SEQ ID NO: 521830 - protein, 9 aa, Homo Sapiens
EYVPLVEEV

SEQ ID NO: 521831 - protein, 9 aa, Homo Sapiens
EEEKRRQHA

SEQ ID NO: 521832 - protein, 9 aa, Homo Sapiens
NILQLITLA

SEQ ID NO: 521833 - protein, 9 aa, Homo Sapiens
NGSQVVQYE

SEQ ID NO: 521834 - protein, 9 aa, Homo Sapiens
PPPFQQQQQ

SEQ ID NO: 521835 - protein, 9 aa, Homo Sapiens
FQNLQVIWG

SEQ ID NO: 521836 - protein, 9 aa, Homo Sapiens
DSPSNPLPC

SEQ ID NO: 521837 - protein, 9 aa, Homo Sapiens
GTGAPQHCL

SEQ ID NO: 521838 - protein, 9 aa, Homo Sapiens
EGFSQRWGL

SEQ ID NO: 521839 - protein, 9 aa, Homo Sapiens
YMLKRQGRT

SEQ ID NO: 521840 - protein, 9 aa, Homo Sapiens
GAKPLGLRA

SEQ ID NO: 521841 - protein, 9 aa, Homo Sapiens
AKTAKALQD

SEQ ID NO: 521842 - protein, 9 aa, Homo Sapiens
EVMHTICCA

SEQ ID NO: 521843 - protein, 9 aa, Homo Sapiens
QNRLLKLED

SEQ ID NO: 521844 - protein, 9 aa, Homo Sapiens
DWWKEVNGQ

SEQ ID NO: 521845 - protein, 9 aa, Homo Sapiens
SSQAESAIN

SEQ ID NO: 521846 - protein, 9 aa, Homo Sapiens
ATTVAEDQE

SEQ ID NO: 521847 - protein, 9 aa, Homo Sapiens
VVFFISYTV

SEQ ID NO: 521848 - protein, 9 aa, Homo Sapiens
FSSQAESAI

SEQ ID NO: 521849 - protein, 9 aa, Homo Sapiens
RRSPHHERC

SEQ ID NO: 521850 - protein, 9 aa, Homo Sapiens
IIQVASGEY

SEQ ID NO: 521851 - protein, 9 aa, Homo Sapiens
LRFKAEGVA

SEQ ID NO: 521852 - protein, 9 aa, Homo Sapiens
TRRGSPSTG

SEQ ID NO: 521853 - protein, 9 aa, Homo Sapiens
ATMYEERDA

SEQ ID NO: 521854 - protein, 9 aa, Homo Sapiens
MIQAYEKLR

SEQ ID NO: 521855 - protein, 9 aa, Homo Sapiens
EHDAQKQHS

SEQ ID NO: 521856 - protein, 9 aa, Homo Sapiens
PCSAQAPQA

SEQ ID NO: 521857 - protein, 9 aa, Homo Sapiens
SCLFDSCID

SEQ ID NO: 521858 - protein, 9 aa, Homo Sapiens
VDAVSQAVH

SEQ ID NO: 521859 - protein, 9 aa, Homo Sapiens
QVRNQKILT

SEQ ID NO: 521860 - protein, 9 aa, Homo Sapiens
MRPSLARPG

SEQ ID NO: 521861 - protein, 9 aa, Homo Sapiens
ALLGDRVDI

SEQ ID NO: 521862 - protein, 9 aa, Homo Sapiens
AFWVEAGCR

SEQ ID NO: 521863 - protein, 9 aa, Homo Sapiens
HAGQQLYAA

SEQ ID NO: 521864 - protein, 9 aa, Homo Sapiens
GPPLDGTAG

SEQ ID NO: 521865 - protein, 9 aa, Homo Sapiens
QFFYLPYFK

SEQ ID NO: 521866 - protein, 9 aa, Homo Sapiens
VVYMLKRQG

SEQ ID NO: 521867 - protein, 9 aa, Homo Sapiens
PLVEEVLKI

SEQ ID NO: 521868 - protein, 9 aa, Homo Sapiens
HFDRSMHKL

SEQ ID NO: 521869 - protein, 9 aa, Homo Sapiens
KGRSHSKTE

SEQ ID NO: 521870 - protein, 9 aa, Homo Sapiens
SQNLSRRDR

SEQ ID NO: 521871 - protein, 9 aa, Homo Sapiens
LCSSGTSPP

SEQ ID NO: 521872 - protein, 9 aa, Homo Sapiens
DHFDRSMHK

SEQ ID NO: 521873 - protein, 9 aa, Homo Sapiens
FSLDVQQVA

SEQ ID NO: 521874 - protein, 9 aa, Homo Sapiens
ELSCRIFQL

SEQ ID NO: 521875 - protein, 9 aa, Homo Sapiens
VDEVDARLH

SEQ ID NO: 521876 - protein, 9 aa, Homo Sapiens
TGDTSEMVN

SEQ ID NO: 521877 - protein, 9 aa, Homo Sapiens
DMKQTVAVG

SEQ ID NO: 521878 - protein, 9 aa, Homo Sapiens
VYSAQHGPG

SEQ ID NO: 521879 - protein, 9 aa, Homo Sapiens
SAFVLEIFK

SEQ ID NO: 521880 - protein, 9 aa, Homo Sapiens
HIVSAGGDD

SEQ ID NO: 521881 - protein, 9 aa, Homo Sapiens
DACVFRVEA

SEQ ID NO: 521882 - protein, 9 aa, Homo Sapiens
ETGDTSEMV

SEQ ID NO: 521883 - protein, 9 aa, Homo Sapiens
CLPLWTSER

SEQ ID NO: 521884 - protein, 9 aa, Homo Sapiens
SHDVVVMTE

SEQ ID NO: 521885 - protein, 9 aa, Homo Sapiens
ENTDVRDFI

SEQ ID NO: 521886 - protein, 9 aa, Homo Sapiens
FDHSSTQYY

SEQ ID NO: 521887 - protein, 9 aa, Homo Sapiens
KEDPDWWKE

SEQ ID NO: 521888 - protein, 9 aa, Homo Sapiens
GFSSQAESA

SEQ ID NO: 521889 - protein, 9 aa, Homo Sapiens
TWHFEATMY

SEQ ID NO: 521890 - protein, 9 aa, Homo Sapiens
AHVGQLLQV

SEQ ID NO: 521891 - protein, 9 aa, Homo Sapiens
LTRDVKDFF

SEQ ID NO: 521892 - protein, 9 aa, Homo Sapiens
KELQSLWEK

SEQ ID NO: 521893 - protein, 9 aa, Homo Sapiens
SFGDFVQVT

SEQ ID NO: 521894 - protein, 9 aa, Homo Sapiens
TMYEERDAW

SEQ ID NO: 521895 - protein, 9 aa, Homo Sapiens
ERLLLYHTE

SEQ ID NO: 521896 - protein, 9 aa, Homo Sapiens
VPVESPVQV

SEQ ID NO: 521897 - protein, 9 aa, Homo Sapiens
APLRPLRDR

SEQ ID NO: 521898 - protein, 9 aa, Homo Sapiens
YHRFTCNIC

SEQ ID NO: 521899 - protein, 9 aa, Homo Sapiens
MRADFNNTN

SEQ ID NO: 521900 - protein, 9 aa, Homo Sapiens
QVSLDHGVH

SEQ ID NO: 521901 - protein, 9 aa, Homo Sapiens
VSQNLSRRD

SEQ ID NO: 521902 - protein, 9 aa, Homo Sapiens
MDTKIQEKA

SEQ ID NO: 521903 - protein, 9 aa, Homo Sapiens
KGLPPPFQQ

SEQ ID NO: 521904 - protein, 9 aa, Homo Sapiens
TTEHALKYS

SEQ ID NO: 521905 - protein, 9 aa, Homo Sapiens
VFQRGLRRL

SEQ ID NO: 521906 - protein, 9 aa, Homo Sapiens
EPSTRIRFI

SEQ ID NO: 521907 - protein, 9 aa, Homo Sapiens
VITLISMFD

SEQ ID NO: 521908 - protein, 9 aa, Homo Sapiens
WLHGTHDGT

SEQ ID NO: 521909 - protein, 9 aa, Homo Sapiens
GTGVSREKV

SEQ ID NO: 521910 - protein, 9 aa, Homo Sapiens
NQKILTHRL

SEQ ID NO: 521911 - protein, 9 aa, Homo Sapiens
QAVHVRPPD

SEQ ID NO: 521912 - protein, 9 aa, Homo Sapiens
RPSTAQRPS

SEQ ID NO: 521913 - protein, 9 aa, Homo Sapiens
CWNKNGSQV

SEQ ID NO: 521914 - protein, 9 aa, Homo Sapiens
LLRQEPPVL

SEQ ID NO: 521915 - protein, 9 aa, Homo Sapiens
SAFWVEAGC

SEQ ID NO: 521916 - protein, 9 aa, Homo Sapiens
APENTDVRD

SEQ ID NO: 521917 - protein, 9 aa, Homo Sapiens
KLGIYWRCW

SEQ ID NO: 521918 - protein, 9 aa, Homo Sapiens
VHAAAQDAH

SEQ ID NO: 521919 - protein, 9 aa, Homo Sapiens
SNGVKCFSA

SEQ ID NO: 521920 - protein, 9 aa, Homo Sapiens
KEFQFLLLL

SEQ ID NO: 521921 - protein, 9 aa, Homo Sapiens
DAQKQHSVE

SEQ ID NO: 521922 - protein, 9 aa, Homo Sapiens
YHCWNKNGS

SEQ ID NO: 521923 - protein, 9 aa, Homo Sapiens
PKGLPPPFQ

SEQ ID NO: 521924 - protein, 9 aa, Homo Sapiens
GDVGSEAVI

SEQ ID NO: 521925 - protein, 9 aa, Homo Sapiens
AKPVRHKHG

SEQ ID NO: 521926 - protein, 9 aa, Homo Sapiens
EIKWLSCGL

SEQ ID NO: 521927 - protein, 9 aa, Homo Sapiens
VMKPHRYRP

SEQ ID NO: 521928 - protein, 9 aa, Homo Sapiens
LNNVFVFAP

SEQ ID NO: 521929 - protein, 9 aa, Homo Sapiens
RRSAAQSQL

SEQ ID NO: 521930 - protein, 9 aa, Homo Sapiens
FLSRHAPEI

SEQ ID NO: 521931 - protein, 9 aa, Homo Sapiens
SRIHTPFRL

SEQ ID NO: 521932 - protein, 9 aa, Homo Sapiens
FSILMDSPF

SEQ ID NO: 521933 - protein, 9 aa, Homo Sapiens
ECLSALCGF

SEQ ID NO: 521934 - protein, 9 aa, Homo Sapiens
SCRIFQLIS

SEQ ID NO: 521935 - protein, 9 aa, Homo Sapiens
RSHSKTEKF

SEQ ID NO: 521936 - protein, 9 aa, Homo Sapiens
SDDFRTKHE

SEQ ID NO: 521937 - protein, 9 aa, Homo Sapiens
MHTICCAFD

SEQ ID NO: 521938 - protein, 9 aa, Homo Sapiens
ASDDFRTKH

SEQ ID NO: 521939 - protein, 9 aa, Homo Sapiens
FAAICGAFM

SEQ ID NO: 521940 - protein, 9 aa, Homo Sapiens
PQAGLVDAL

SEQ ID NO: 521941 - protein, 9 aa, Homo Sapiens
ASHVVHVNA

SEQ ID NO: 521942 - protein, 9 aa, Homo Sapiens
PYGNPHAKP

SEQ ID NO: 521943 - protein, 9 aa, Homo Sapiens
IPALYGPRK

SEQ ID NO: 521944 - protein, 9 aa, Homo Sapiens
FYKSCLFDS

SEQ ID NO: 521945 - protein, 9 aa, Homo Sapiens
HPPGSAFWV

SEQ ID NO: 521946 - protein, 9 aa, Homo Sapiens
AVVYMLKRQ

SEQ ID NO: 521947 - protein, 9 aa, Homo Sapiens
KQTVAVGVI

SEQ ID NO: 521948 - protein, 9 aa, Homo Sapiens
RHHGHKHRK

SEQ ID NO: 521949 - protein, 9 aa, Homo Sapiens
LPKGLPPPF

SEQ ID NO: 521950 - protein, 9 aa, Homo Sapiens
WEKHLKEIS

SEQ ID NO: 521951 - protein, 9 aa, Homo Sapiens
VLGIFFMCV

SEQ ID NO: 521952 - protein, 9 aa, Homo Sapiens
FPPPPGDDI

SEQ ID NO: 521953 - protein, 9 aa, Homo Sapiens
RFTSGDRHI

SEQ ID NO: 521954 - protein, 9 aa, Homo Sapiens
RDMKQTVAV

SEQ ID NO: 521955 - protein, 9 aa, Homo Sapiens
CFNLFHSAG

SEQ ID NO: 521956 - protein, 9 aa, Homo Sapiens
QLITLADEI

SEQ ID NO: 521957 - protein, 9 aa, Homo Sapiens
PLRDREIWA

SEQ ID NO: 521958 - protein, 9 aa, Homo Sapiens
NEPSTRIRF

SEQ ID NO: 521959 - protein, 9 aa, Homo Sapiens
FFYKSCLFD

SEQ ID NO: 521960 - protein, 9 aa, Homo Sapiens
GAVVSGIVS

SEQ ID NO: 521961 - protein, 9 aa, Homo Sapiens
HHDVLLDAD

SEQ ID NO: 521962 - protein, 9 aa, Homo Sapiens
WGRILHNGA

SEQ ID NO: 521963 - protein, 9 aa, Homo Sapiens
LDVQQVADG

SEQ ID NO: 521964 - protein, 9 aa, Homo Sapiens
TFTVLLLLS

SEQ ID NO: 521965 - protein, 9 aa, Homo Sapiens
GFFAAICGA

SEQ ID NO: 521966 - protein, 9 aa, Homo Sapiens
SLSCSADWG

SEQ ID NO: 521967 - protein, 9 aa, Homo Sapiens
WVEAGCRAL

SEQ ID NO: 521968 - protein, 9 aa, Homo Sapiens
NPATSKIIL

SEQ ID NO: 521969 - protein, 9 aa, Homo Sapiens
SNVADSPQN

SEQ ID NO: 521970 - protein, 9 aa, Homo Sapiens
YVPLVEEVL

SEQ ID NO: 521971 - protein, 9 aa, Homo Sapiens
IQRAECTIR

SEQ ID NO: 521972 - protein, 9 aa, Homo Sapiens
ATVSGVTTC

SEQ ID NO: 521973 - protein, 9 aa, Homo Sapiens
AAQDAHVGQ

SEQ ID NO: 521974 - protein, 9 aa, Homo Sapiens
GSSGPPLDG

SEQ ID NO: 521975 - protein, 9 aa, Homo Sapiens
FVERMYRWT

SEQ ID NO: 521976 - protein, 9 aa, Homo Sapiens
STAQRPSAR

SEQ ID NO: 521977 - protein, 9 aa, Homo Sapiens
NTNEPSTRI

SEQ ID NO: 521978 - protein, 9 aa, Homo Sapiens
AKPLGLRAQ

SEQ ID NO: 521979 - protein, 9 aa, Homo Sapiens
AAAQDAHVG

SEQ ID NO: 521980 - protein, 9 aa, Homo Sapiens
VFVFAPSPS

SEQ ID NO: 521981 - protein, 9 aa, Homo Sapiens
LLAWDACVF

SEQ ID NO: 521982 - protein, 9 aa, Homo Sapiens
KSCLFDSCI

SEQ ID NO: 521983 - protein, 9 aa, Homo Sapiens
EDPDWWKEV

SEQ ID NO: 521984 - protein, 9 aa, Homo Sapiens
TLIKVGQHL

SEQ ID NO: 521985 - protein, 9 aa, Homo Sapiens
QREHDAQKQ

SEQ ID NO: 521986 - protein, 9 aa, Homo Sapiens
DGAVVSGIV

SEQ ID NO: 521987 - protein, 9 aa, Homo Sapiens
VPCSAQAPQ

SEQ ID NO: 521988 - protein, 9 aa, Homo Sapiens
GKEIHGEPL

SEQ ID NO: 521989 - protein, 9 aa, Homo Sapiens
PATYVWDSN

SEQ ID NO: 521990 - protein, 9 aa, Homo Sapiens
AADPASGAP

SEQ ID NO: 521991 - protein, 9 aa, Homo Sapiens
VEILRSTIQ

SEQ ID NO: 521992 - protein, 9 aa, Homo Sapiens
YRNLVSLEI

SEQ ID NO: 521993 - protein, 9 aa, Homo Sapiens
LNHLVSATV

SEQ ID NO: 521994 - protein, 9 aa, Homo Sapiens
MKIDTIVIF

SEQ ID NO: 521995 - protein, 9 aa, Homo Sapiens
VLALRLDAR

SEQ ID NO: 521996 - protein, 9 aa, Homo Sapiens
YCHQVRLTL

SEQ ID NO: 521997 - protein, 9 aa, Homo Sapiens
EYHLSLQAL

SEQ ID NO: 521998 - protein, 9 aa, Homo Sapiens
NCDQSDGVF

SEQ ID NO: 521999 - protein, 9 aa, Homo Sapiens
VERMYRWTS

SEQ ID NO: 522000 - protein, 9 aa, Homo Sapiens
AGTGVSREK

SEQ ID NO: 522001 - protein, 9 aa, Homo Sapiens
HIRASEHWI

SEQ ID NO: 522002 - protein, 9 aa, Homo Sapiens
VFFISYTVT

SEQ ID NO: 522003 - protein, 9 aa, Homo Sapiens
TSPPYMPGL

SEQ ID NO: 522004 - protein, 9 aa, Homo Sapiens
KDFFKENWS

SEQ ID NO: 522005 - protein, 9 aa, Homo Sapiens
MDSPFFDHS

SEQ ID NO: 522006 - protein, 9 aa, Homo Sapiens
GACVPGKPT

SEQ ID NO: 522007 - protein, 9 aa, Homo Sapiens
FLQFSILMD

SEQ ID NO: 522008 - protein, 9 aa, Homo Sapiens
MAADINPQN

SEQ ID NO: 522009 - protein, 9 aa, Homo Sapiens
NTLKTPGEP

SEQ ID NO: 522010 - protein, 9 aa, Homo Sapiens
LPPPFQQQQ

SEQ ID NO: 522011 - protein, 9 aa, Homo Sapiens
VAVKALSTC

SEQ ID NO: 522012 - protein, 9 aa, Homo Sapiens
SKGRSHSKT

SEQ ID NO: 522013 - protein, 9 aa, Homo Sapiens
ERPQLSWPP

SEQ ID NO: 522014 - protein, 9 aa, Homo Sapiens
CCANRGTLI

SEQ ID NO: 522015 - protein, 9 aa, Homo Sapiens
SAQAPQAGL

SEQ ID NO: 522016 - protein, 9 aa, Homo Sapiens
PRNNTWPNC

SEQ ID NO: 522017 - protein, 9 aa, Homo Sapiens
KSCNNDVFL

SEQ ID NO: 522018 - protein, 9 aa, Homo Sapiens
LAPLRPLRD

SEQ ID NO: 522019 - protein, 9 aa, Homo Sapiens
SLARPGLRR

SEQ ID NO: 522020 - protein, 9 aa, Homo Sapiens
QSLWEKHLK

SEQ ID NO: 522021 - protein, 9 aa, Homo Sapiens
CVFRVEAWR

SEQ ID NO: 522022 - protein, 9 aa, Homo Sapiens
SKCPSATIY

SEQ ID NO: 522023 - protein, 9 aa, Homo Sapiens
HDVSLSCSA

SEQ ID NO: 522024 - protein, 9 aa, Homo Sapiens
RLLLYHTEE

SEQ ID NO: 522025 - protein, 9 aa, Homo Sapiens
HGVHAAAQD

SEQ ID NO: 522026 - protein, 9 aa, Homo Sapiens
LLADMPFLP

SEQ ID NO: 522027 - protein, 9 aa, Homo Sapiens
TLADEIHEG

SEQ ID NO: 522028 - protein, 9 aa, Homo Sapiens
LIKVGQHLG

SEQ ID NO: 522029 - protein, 9 aa, Homo Sapiens
VSDIDAEDV

SEQ ID NO: 522030 - protein, 9 aa, Homo Sapiens
HSAGHAGQQ

SEQ ID NO: 522031 - protein, 9 aa, Homo Sapiens
NHLVSATVS

SEQ ID NO: 522032 - protein, 9 aa, Homo Sapiens
AVSHHDVLL

SEQ ID NO: 522033 - protein, 9 aa, Homo Sapiens
VSGIVSGER

SEQ ID NO: 522034 - protein, 9 aa, Homo Sapiens
QEPPVLALR

SEQ ID NO: 522035 - protein, 9 aa, Homo Sapiens
LSCRIFQLI

SEQ ID NO: 522036 - protein, 9 aa, Homo Sapiens
TGGVMKPHR

SEQ ID NO: 522037 - protein, 9 aa, Homo Sapiens
SPPYMPGLE

SEQ ID NO: 522038 - protein, 9 aa, Homo Sapiens
AESAINSVV

SEQ ID NO: 522039 - protein, 9 aa, Homo Sapiens
PFGRSVIEL

SEQ ID NO: 522040 - protein, 9 aa, Homo Sapiens
SDVTVSDID

SEQ ID NO: 522041 - protein, 9 aa, Homo Sapiens
VGQLLQVDA

SEQ ID NO: 522042 - protein, 9 aa, Homo Sapiens
VKVGDKKCD

SEQ ID NO: 522043 - protein, 9 aa, Homo Sapiens
AGATAGSPP

SEQ ID NO: 522044 - protein, 9 aa, Homo Sapiens
CWRPSTAQR

SEQ ID NO: 522045 - protein, 9 aa, Homo Sapiens
DWRTTEHAL

SEQ ID NO: 522046 - protein, 9 aa, Homo Sapiens
IMRADFNNT

SEQ ID NO: 522047 - protein, 9 aa, Homo Sapiens
PDWWKEVNG

SEQ ID NO: 522048 - protein, 9 aa, Homo Sapiens
DVFLQFSIL

SEQ ID NO: 522049 - protein, 9 aa, Homo Sapiens
FSTRRGSPS

SEQ ID NO: 522050 - protein, 9 aa, Homo Sapiens
LMRPSLARP

SEQ ID NO: 522051 - protein, 9 aa, Homo Sapiens
IVIFYQKNG

SEQ ID NO: 522052 - protein, 9 aa, Homo Sapiens
SPSTGFIEQ

SEQ ID NO: 522053 - protein, 9 aa, Homo Sapiens
RRGSPSTGF

SEQ ID NO: 522054 - protein, 9 aa, Homo Sapiens
LKGAGATAG

SEQ ID NO: 522055 - protein, 9 aa, Homo Sapiens
EHHAWLQVP

SEQ ID NO: 522056 - protein, 9 aa, Homo Sapiens
QVASGEYGD

SEQ ID NO: 522057 - protein, 9 aa, Homo Sapiens
AEAEDETLR

SEQ ID NO: 522058 - protein, 9 aa, Homo Sapiens
RTTEHALKY

SEQ ID NO: 522059 - protein, 9 aa, Homo Sapiens
PINVASCDS

SEQ ID NO: 522060 - protein, 9 aa, Homo Sapiens
SHRRHRHHG

SEQ ID NO: 522061 - protein, 9 aa, Homo Sapiens
RLLKLEDSY

SEQ ID NO: 522062 - protein, 9 aa, Homo Sapiens
ADEGGYECR

SEQ ID NO: 522063 - protein, 9 aa, Homo Sapiens
GVSREKVKA

SEQ ID NO: 522064 - protein, 9 aa, Homo Sapiens
VASCDSKCP

SEQ ID NO: 522065 - protein, 9 aa, Homo Sapiens
TLISMFDRD

SEQ ID NO: 522066 - protein, 9 aa, Homo Sapiens
FKAEGVAVK

SEQ ID NO: 522067 - protein, 9 aa, Homo Sapiens
STPLVAGQA

SEQ ID NO: 522068 - protein, 9 aa, Homo Sapiens
HNPADFIIQ

SEQ ID NO: 522069 - protein, 9 aa, Homo Sapiens
SGTGAVVIS

SEQ ID NO: 522070 - protein, 9 aa, Homo Sapiens
VIETKSKEE

SEQ ID NO: 522071 - protein, 9 aa, Homo Sapiens
MAETGDTSE

SEQ ID NO: 522072 - protein, 9 aa, Homo Sapiens
SSTQYYHRF

SEQ ID NO: 522073 - protein, 9 aa, Homo Sapiens
PNEYDDNQI

SEQ ID NO: 522074 - protein, 9 aa, Homo Sapiens
TEIHNLIPV

SEQ ID NO: 522075 - protein, 9 aa, Homo Sapiens
GVQEVFQTS

SEQ ID NO: 522076 - protein, 9 aa, Homo Sapiens
SISPSAFVL

SEQ ID NO: 522077 - protein, 9 aa, Homo Sapiens
GRSHSKTEK

SEQ ID NO: 522078 - protein, 9 aa, Homo Sapiens
VKGIPALYG

SEQ ID NO: 522079 - protein, 9 aa, Homo Sapiens
KAAENVKAL

SEQ ID NO: 522080 - protein, 9 aa, Homo Sapiens
FPTRGWTTS

SEQ ID NO: 522081 - protein, 9 aa, Homo Sapiens
DRHIVSAGG

SEQ ID NO: 522082 - protein, 9 aa, Homo Sapiens
ADINPQNAD

SEQ ID NO: 522083 - protein, 9 aa, Homo Sapiens
PENTDVRDF

SEQ ID NO: 522084 - protein, 9 aa, Homo Sapiens
QTIMESMGL

SEQ ID NO: 522085 - protein, 9 aa, Homo Sapiens
NTNELLKEI

SEQ ID NO: 522086 - protein, 9 aa, Homo Sapiens
FFKENWSFF

SEQ ID NO: 522087 - protein, 9 aa, Homo Sapiens
HTPFRLCVV

SEQ ID NO: 522088 - protein, 9 aa, Homo Sapiens
QYYHRFTCN

SEQ ID NO: 522089 - protein, 9 aa, Homo Sapiens
CNNDVFLQF

SEQ ID NO: 522090 - protein, 9 aa, Homo Sapiens
HIPILDRSV

SEQ ID NO: 522091 - protein, 9 aa, Homo Sapiens
LIQEVVDEV

SEQ ID NO: 522092 - protein, 9 aa, Homo Sapiens
NCYFMHVNH

SEQ ID NO: 522093 - protein, 9 aa, Homo Sapiens
IKEFQFLLL

SEQ ID NO: 522094 - protein, 9 aa, Homo Sapiens
AAQSQLQGN

SEQ ID NO: 522095 - protein, 9 aa, Homo Sapiens
PLAVYSAQH

SEQ ID NO: 522096 - protein, 9 aa, Homo Sapiens
EKRRQHAEL

SEQ ID NO: 522097 - protein, 9 aa, Homo Sapiens
KRKQLREVQ

SEQ ID NO: 522098 - protein, 9 aa, Homo Sapiens
TQKVLNLKI

SEQ ID NO: 522099 - protein, 9 aa, Homo Sapiens
TICCAFDSP

SEQ ID NO: 522100 - protein, 9 aa, Homo Sapiens
ADSPQNKKE

SEQ ID NO: 522101 - protein, 9 aa, Homo Sapiens
ESAINSVVY

SEQ ID NO: 522102 - protein, 9 aa, Homo Sapiens
RKLGIYWRC

SEQ ID NO: 522103 - protein, 9 aa, Homo Sapiens
AFPDVKPDL

SEQ ID NO: 522104 - protein, 9 aa, Homo Sapiens
CKAENTIGT

SEQ ID NO: 522105 - protein, 9 aa, Homo Sapiens
FFISYTVTI

SEQ ID NO: 522106 - protein, 9 aa, Homo Sapiens
STQYYHRFT

SEQ ID NO: 522107 - protein, 9 aa, Homo Sapiens
GIFPPPPGD

SEQ ID NO: 522108 - protein, 9 aa, Homo Sapiens
VYDITKETF

SEQ ID NO: 522109 - protein, 9 aa, Homo Sapiens
PAKTAKALQ

SEQ ID NO: 522110 - protein, 9 aa, Homo Sapiens
LSNGVKCFS

SEQ ID NO: 522111 - protein, 9 aa, Homo Sapiens
KVEILRSTI

SEQ ID NO: 522112 - protein, 9 aa, Homo Sapiens
AEDETLRTR

SEQ ID NO: 522113 - protein, 9 aa, Homo Sapiens
DADPAKTAK

SEQ ID NO: 522114 - protein, 9 aa, Homo Sapiens
NSDVTVSDI

SEQ ID NO: 522115 - protein, 9 aa, Homo Sapiens
ASCDSKCPS

SEQ ID NO: 522116 - protein, 9 aa, Homo Sapiens
HVGQLLQVD

SEQ ID NO: 522117 - protein, 9 aa, Homo Sapiens
PVSPGSAFP

SEQ ID NO: 522118 - protein, 9 aa, Homo Sapiens
CHQVRLTLL

SEQ ID NO: 522119 - protein, 9 aa, Homo Sapiens
VTAMAVVYM

SEQ ID NO: 522120 - protein, 9 aa, Homo Sapiens
FSQRWGLLS

SEQ ID NO: 522121 - protein, 9 aa, Homo Sapiens
SSGPPLDGT

SEQ ID NO: 522122 - protein, 9 aa, Homo Sapiens
RLLLESLRG

SEQ ID NO: 522123 - protein, 9 aa, Homo Sapiens
SSGTSPPYM

SEQ ID NO: 522124 - protein, 9 aa, Homo Sapiens
RPQLSWPPW

SEQ ID NO: 522125 - protein, 9 aa, Homo Sapiens
RSVIELTKM

SEQ ID NO: 522126 - protein, 9 aa, Homo Sapiens
CGLVLKRFF

SEQ ID NO: 522127 - protein, 9 aa, Homo Sapiens
NDTSLSNGV

SEQ ID NO: 522128 - protein, 9 aa, Homo Sapiens
FFDHSSTQY

SEQ ID NO: 522129 - protein, 9 aa, Homo Sapiens
VQEVFQTSY

SEQ ID NO: 522130 - protein, 9 aa, Homo Sapiens
ALRTFTVLR

SEQ ID NO: 522131 - protein, 9 aa, Homo Sapiens
TETLFFMFY

SEQ ID NO: 522132 - protein, 9 aa, Homo Sapiens
SMGLKLSPG

SEQ ID NO: 522133 - protein, 9 aa, Homo Sapiens
INVASCDSK

SEQ ID NO: 522134 - protein, 9 aa, Homo Sapiens
DSNYHQPWE

SEQ ID NO: 522135 - protein, 9 aa, Homo Sapiens
QFLLLLSHP

SEQ ID NO: 522136 - protein, 9 aa, Homo Sapiens
VNPTFFYKS

SEQ ID NO: 522137 - protein, 9 aa, Homo Sapiens
HVNHTRFPS

SEQ ID NO: 522138 - protein, 9 aa, Homo Sapiens
PTFFYKSCL

SEQ ID NO: 522139 - protein, 9 aa, Homo Sapiens
RFAVRDMKQ

SEQ ID NO: 522140 - protein, 9 aa, Homo Sapiens
QLTRDVKDF

SEQ ID NO: 522141 - protein, 9 aa, Homo Sapiens
KTEKFSESF

SEQ ID NO: 522142 - protein, 9 aa, Homo Sapiens
FVQVTRNLF

SEQ ID NO: 522143 - protein, 9 aa, Homo Sapiens
IKKELQSLW

SEQ ID NO: 522144 - protein, 9 aa, Homo Sapiens
WDSNYHQPW

SEQ ID NO: 522145 - protein, 9 aa, Homo Sapiens
FAVRDMKQT

SEQ ID NO: 522146 - protein, 9 aa, Homo Sapiens
PGKEIHGEP

SEQ ID NO: 522147 - protein, 9 aa, Homo Sapiens
EAVILTAHV

SEQ ID NO: 522148 - protein, 9 aa, Homo Sapiens
EPGKEIHGE

SEQ ID NO: 522149 - protein, 9 aa, Homo Sapiens
AKALQDLAV

SEQ ID NO: 522150 - protein, 9 aa, Homo Sapiens
HGEPLHPDT

SEQ ID NO: 522151 - protein, 9 aa, Homo Sapiens
MTEVVRRSP

SEQ ID NO: 522152 - protein, 9 aa, Homo Sapiens
MFDRDFGVN

SEQ ID NO: 522153 - protein, 9 aa, Homo Sapiens
QLYAAVSHH

SEQ ID NO: 522154 - protein, 9 aa, Homo Sapiens
STRIRFINL

SEQ ID NO: 522155 - protein, 9 aa, Homo Sapiens
DEVAIKEFQ

SEQ ID NO: 522156 - protein, 9 aa, Homo Sapiens
LPLAVYSAQ

SEQ ID NO: 522157 - protein, 9 aa, Homo Sapiens
GTLIKVGQH

SEQ ID NO: 522158 - protein, 9 aa, Homo Sapiens
VKDFFKENW

SEQ ID NO: 522159 - protein, 9 aa, Homo Sapiens
WRPSTAQRP

SEQ ID NO: 522160 - protein, 9 aa, Homo Sapiens
EATMYEERD

SEQ ID NO: 522161 - protein, 9 aa, Homo Sapiens
QQLYAAVSH

SEQ ID NO: 522162 - protein, 9 aa, Homo Sapiens
GEHHAWLQV

SEQ ID NO: 522163 - protein, 9 aa, Homo Sapiens
QSQLQGNSF

SEQ ID NO: 522164 - protein, 9 aa, Homo Sapiens
NPDSPYCHQ

SEQ ID NO: 522165 - protein, 9 aa, Homo Sapiens
HLTASCWAA

SEQ ID NO: 522166 - protein, 9 aa, Homo Sapiens
KAGSSVDRC

SEQ ID NO: 522167 - protein, 9 aa, Homo Sapiens
CVPGFQGPC

SEQ ID NO: 522168 - protein, 9 aa, Homo Sapiens
YIVTEDIDD

SEQ ID NO: 522169 - protein, 9 aa, Homo Sapiens
TFLRCKAKN

SEQ ID NO: 522170 - protein, 9 aa, Homo Sapiens
HRLLRKCNY

SEQ ID NO: 522171 - protein, 9 aa, Homo Sapiens
RGMPGMPCK

SEQ ID NO: 522172 - protein, 9 aa, Homo Sapiens
AEQEMEVEE

SEQ ID NO: 522173 - protein, 9 aa, Homo Sapiens
KNVESFAPM

SEQ ID NO: 522174 - protein, 9 aa, Homo Sapiens
KPIRCLAGD

SEQ ID NO: 522175 - protein, 9 aa, Homo Sapiens
ILDPVCDMD

SEQ ID NO: 522176 - protein, 9 aa, Homo Sapiens
TKFQRLIPG

SEQ ID NO: 522177 - protein, 9 aa, Homo Sapiens
LRRRPGPAG

SEQ ID NO: 522178 - protein, 9 aa, Homo Sapiens
TYPWPPMHQ

SEQ ID NO: 522179 - protein, 9 aa, Homo Sapiens
ILENQHVDN

SEQ ID NO: 522180 - protein, 9 aa, Homo Sapiens
VTHHPISAH

SEQ ID NO: 522181 - protein, 9 aa, Homo Sapiens
PNPGFCSQL

SEQ ID NO: 522182 - protein, 9 aa, Homo Sapiens
QLPVRGPWD

SEQ ID NO: 522183 - protein, 9 aa, Homo Sapiens
EDILENQHV

SEQ ID NO: 522184 - protein, 9 aa, Homo Sapiens
EQQECPVTP

SEQ ID NO: 522185 - protein, 9 aa, Homo Sapiens
PGICGLTSL

SEQ ID NO: 522186 - protein, 9 aa, Homo Sapiens
LHNLLWLVQ

SEQ ID NO: 522187 - protein, 9 aa, Homo Sapiens
GTITGDWRI

SEQ ID NO: 522188 - protein, 9 aa, Homo Sapiens
FLDGSGYCV

SEQ ID NO: 522189 - protein, 9 aa, Homo Sapiens
RHGTARGLT

SEQ ID NO: 522190 - protein, 9 aa, Homo Sapiens
VDRAEQEME

SEQ ID NO: 522191 - protein, 9 aa, Homo Sapiens
TVAKVKCGL

SEQ ID NO: 522192 - protein, 9 aa, Homo Sapiens
LDKSLLLCC

SEQ ID NO: 522193 - protein, 9 aa, Homo Sapiens
ARAASQPLR

SEQ ID NO: 522194 - protein, 9 aa, Homo Sapiens
NEKEEVLLD

SEQ ID NO: 522195 - protein, 9 aa, Homo Sapiens
IRGLSFSAA

SEQ ID NO: 522196 - protein, 9 aa, Homo Sapiens
STKLPSVDH

SEQ ID NO: 522197 - protein, 9 aa, Homo Sapiens
AKIVMNVSD

SEQ ID NO: 522198 - protein, 9 aa, Homo Sapiens
TKHETLVIK

SEQ ID NO: 522199 - protein, 9 aa, Homo Sapiens
LQSELMVTA

SEQ ID NO: 522200 - protein, 9 aa, Homo Sapiens
CLQSPCPPS

SEQ ID NO: 522201 - protein, 9 aa, Homo Sapiens
PLFFLLLGF

SEQ ID NO: 522202 - protein, 9 aa, Homo Sapiens
GDVGQTVND

SEQ ID NO: 522203 - protein, 9 aa, Homo Sapiens
GDWRIVLVD

SEQ ID NO: 522204 - protein, 9 aa, Homo Sapiens
GLGNGGAKR

SEQ ID NO: 522205 - protein, 9 aa, Homo Sapiens
PRQYGPSPK

SEQ ID NO: 522206 - protein, 9 aa, Homo Sapiens
IKQTSLWLE

SEQ ID NO: 522207 - protein, 9 aa, Homo Sapiens
QEWDFYKTL

SEQ ID NO: 522208 - protein, 9 aa, Homo Sapiens
CLAGDPCLP

SEQ ID NO: 522209 - protein, 9 aa, Homo Sapiens
IQSKRQEWK

SEQ ID NO: 522210 - protein, 9 aa, Homo Sapiens
DNEEESTVI

SEQ ID NO: 522211 - protein, 9 aa, Homo Sapiens
MVTAARGGD

SEQ ID NO: 522212 - protein, 9 aa, Homo Sapiens
KGEKIKVLE

SEQ ID NO: 522213 - protein, 9 aa, Homo Sapiens
APMLRHSPL

SEQ ID NO: 522214 - protein, 9 aa, Homo Sapiens
PPSKSKNGQ

SEQ ID NO: 522215 - protein, 9 aa, Homo Sapiens
GSSAASTAM

SEQ ID NO: 522216 - protein, 9 aa, Homo Sapiens
LLWAGSTGL

SEQ ID NO: 522217 - protein, 9 aa, Homo Sapiens
SFSAARYAL

SEQ ID NO: 522218 - protein, 9 aa, Homo Sapiens
LAFPDDMDL

SEQ ID NO: 522219 - protein, 9 aa, Homo Sapiens
FQGPCCELD

SEQ ID NO: 522220 - protein, 9 aa, Homo Sapiens
MLCHKQEME

SEQ ID NO: 522221 - protein, 9 aa, Homo Sapiens
ALPSPPCQL

SEQ ID NO: 522222 - protein, 9 aa, Homo Sapiens
YYSEVIKKS

SEQ ID NO: 522223 - protein, 9 aa, Homo Sapiens
FFLISSKKS

SEQ ID NO: 522224 - protein, 9 aa, Homo Sapiens
SQGILSQDT

SEQ ID NO: 522225 - protein, 9 aa, Homo Sapiens
TVKIHGVHL

SEQ ID NO: 522226 - protein, 9 aa, Homo Sapiens
EFDPQQEWD

SEQ ID NO: 522227 - protein, 9 aa, Homo Sapiens
KGLGNGGAK

SEQ ID NO: 522228 - protein, 9 aa, Homo Sapiens
MNVSDAHSL

SEQ ID NO: 522229 - protein, 9 aa, Homo Sapiens
SSMEMSDAF

SEQ ID NO: 522230 - protein, 9 aa, Homo Sapiens
CDGDNDYGD

SEQ ID NO: 522231 - protein, 9 aa, Homo Sapiens
GSTGLACWL

SEQ ID NO: 522232 - protein, 9 aa, Homo Sapiens
GGLGGQGCR

SEQ ID NO: 522233 - protein, 9 aa, Homo Sapiens
HLKAEGKGK

SEQ ID NO: 522234 - protein, 9 aa, Homo Sapiens
QIRCCTDDV

SEQ ID NO: 522235 - protein, 9 aa, Homo Sapiens
SLGNTCFMN

SEQ ID NO: 522236 - protein, 9 aa, Homo Sapiens
HGVHLGQAV

SEQ ID NO: 522237 - protein, 9 aa, Homo Sapiens
CIPVQKTFL

SEQ ID NO: 522238 - protein, 9 aa, Homo Sapiens
AGPHAVNKL

SEQ ID NO: 522239 - protein, 9 aa, Homo Sapiens
KMQEDPAST

SEQ ID NO: 522240 - protein, 9 aa, Homo Sapiens
KFQRLIPGR

SEQ ID NO: 522241 - protein, 9 aa, Homo Sapiens
HVTHHPISA

SEQ ID NO: 522242 - protein, 9 aa, Homo Sapiens
AEGKGKRRP

SEQ ID NO: 522243 - protein, 9 aa, Homo Sapiens
FFKGGRQGG

SEQ ID NO: 522244 - protein, 9 aa, Homo Sapiens
ASTAMERPS

SEQ ID NO: 522245 - protein, 9 aa, Homo Sapiens
YQIRCCTDD

SEQ ID NO: 522246 - protein, 9 aa, Homo Sapiens
STGLACWLA

SEQ ID NO: 522247 - protein, 9 aa, Homo Sapiens
QAGPHAVNK

SEQ ID NO: 522248 - protein, 9 aa, Homo Sapiens
TFLLLYTGW

SEQ ID NO: 522249 - protein, 9 aa, Homo Sapiens
DLHEINNWV

SEQ ID NO: 522250 - protein, 9 aa, Homo Sapiens
FLRCKAKNY

SEQ ID NO: 522251 - protein, 9 aa, Homo Sapiens
PSQAQAHLP

SEQ ID NO: 522252 - protein, 9 aa, Homo Sapiens
SNEFLDGSG

SEQ ID NO: 522253 - protein, 9 aa, Homo Sapiens
PLDKSLLLC

SEQ ID NO: 522254 - protein, 9 aa, Homo Sapiens
KKSNHYSLS

SEQ ID NO: 522255 - protein, 9 aa, Homo Sapiens
LSGPSGTYL

SEQ ID NO: 522256 - protein, 9 aa, Homo Sapiens
PVQKTFLLL

SEQ ID NO: 522257 - protein, 9 aa, Homo Sapiens
PHAVNKLSS

SEQ ID NO: 522258 - protein, 9 aa, Homo Sapiens
QGELKRITL

SEQ ID NO: 522259 - protein, 9 aa, Homo Sapiens
CCTDDVRPQ

SEQ ID NO: 522260 - protein, 9 aa, Homo Sapiens
RRQTAWMRL

SEQ ID NO: 522261 - protein, 9 aa, Homo Sapiens
ELKRITLVL

SEQ ID NO: 522262 - protein, 9 aa, Homo Sapiens
CLNEKEEVL

SEQ ID NO: 522263 - protein, 9 aa, Homo Sapiens
PRASKSASM

SEQ ID NO: 522264 - protein, 9 aa, Homo Sapiens
FLLLYTGWS

SEQ ID NO: 522265 - protein, 9 aa, Homo Sapiens
AVHIRPTRP

SEQ ID NO: 522266 - protein, 9 aa, Homo Sapiens
TKNTHQDNS

SEQ ID NO: 522267 - protein, 9 aa, Homo Sapiens
RQGGLARDG

SEQ ID NO: 522268 - protein, 9 aa, Homo Sapiens
DNEYLGLQI

SEQ ID NO: 522269 - protein, 9 aa, Homo Sapiens
GSSVDRCLQ

SEQ ID NO: 522270 - protein, 9 aa, Homo Sapiens
LQRSCEMNE

SEQ ID NO: 522271 - protein, 9 aa, Homo Sapiens
TGNPRLDLH

SEQ ID NO: 522272 - protein, 9 aa, Homo Sapiens
TANDLPSQG

SEQ ID NO: 522273 - protein, 9 aa, Homo Sapiens
KEKKHISEQ

SEQ ID NO: 522274 - protein, 9 aa, Homo Sapiens
EVSCEQQEC

SEQ ID NO: 522275 - protein, 9 aa, Homo Sapiens
VSQSSVKKA

SEQ ID NO: 522276 - protein, 9 aa, Homo Sapiens
HETLVIKKS

SEQ ID NO: 522277 - protein, 9 aa, Homo Sapiens
AVPTPSQRS

SEQ ID NO: 522278 - protein, 9 aa, Homo Sapiens
FPDDMDLRV

SEQ ID NO: 522279 - protein, 9 aa, Homo Sapiens
QAHLPSGEV

SEQ ID NO: 522280 - protein, 9 aa, Homo Sapiens
CTGDGSDVP

SEQ ID NO: 522281 - protein, 9 aa, Homo Sapiens
MERPSFLSQ

SEQ ID NO: 522282 - protein, 9 aa, Homo Sapiens
LPSQAQAHL

SEQ ID NO: 522283 - protein, 9 aa, Homo Sapiens
CKSCFGSHG

SEQ ID NO: 522284 - protein, 9 aa, Homo Sapiens
STPTQGELK

SEQ ID NO: 522285 - protein, 9 aa, Homo Sapiens
SGPSGTYLT

SEQ ID NO: 522286 - protein, 9 aa, Homo Sapiens
VYIVTEDID

SEQ ID NO: 522287 - protein, 9 aa, Homo Sapiens
RDQFQPTIR

SEQ ID NO: 522288 - protein, 9 aa, Homo Sapiens
DPASTCHCS

SEQ ID NO: 522289 - protein, 9 aa, Homo Sapiens
HIRPTRPFC

SEQ ID NO: 522290 - protein, 9 aa, Homo Sapiens
EFLDGSGYC

SEQ ID NO: 522291 - protein, 9 aa, Homo Sapiens
TPTQGELKR

SEQ ID NO: 522292 - protein, 9 aa, Homo Sapiens
LRCKAKNYS

SEQ ID NO: 522293 - protein, 9 aa, Homo Sapiens
KGGKGLGNG

SEQ ID NO: 522294 - protein, 9 aa, Homo Sapiens
ITGDWRIVL

SEQ ID NO: 522295 - protein, 9 aa, Homo Sapiens
ADGFLAAGE

SEQ ID NO: 522296 - protein, 9 aa, Homo Sapiens
KTFLLLYTG

SEQ ID NO: 522297 - protein, 9 aa, Homo Sapiens
GKGGKGLGN

SEQ ID NO: 522298 - protein, 9 aa, Homo Sapiens
EQERCQREL

SEQ ID NO: 522299 - protein, 9 aa, Homo Sapiens
PVCDMDEEI

SEQ ID NO: 522300 - protein, 9 aa, Homo Sapiens
VSCEQQECP

SEQ ID NO: 522301 - protein, 9 aa, Homo Sapiens
QRSCEMNER

SEQ ID NO: 522302 - protein, 9 aa, Homo Sapiens
VSFKQCLNE

SEQ ID NO: 522303 - protein, 9 aa, Homo Sapiens
TAWMRLSKY

SEQ ID NO: 522304 - protein, 9 aa, Homo Sapiens
EEGNVAVHI

SEQ ID NO: 522305 - protein, 9 aa, Homo Sapiens
SKATKHETL

SEQ ID NO: 522306 - protein, 9 aa, Homo Sapiens
EMRELKGHM

SEQ ID NO: 522307 - protein, 9 aa, Homo Sapiens
WGQLPVRGP

SEQ ID NO: 522308 - protein, 9 aa, Homo Sapiens
MQEDPASTC

SEQ ID NO: 522309 - protein, 9 aa, Homo Sapiens
RGHLEFTDQ

SEQ ID NO: 522310 - protein, 9 aa, Homo Sapiens
DGFLAAGEI

SEQ ID NO: 522311 - protein, 9 aa, Homo Sapiens
LVSFKQCLN

SEQ ID NO: 522312 - protein, 9 aa, Homo Sapiens
AHLPSGEVV

SEQ ID NO: 522313 - protein, 9 aa, Homo Sapiens
GMPCKHGAK

SEQ ID NO: 522314 - protein, 9 aa, Homo Sapiens
EDRAGHRHS

SEQ ID NO: 522315 - protein, 9 aa, Homo Sapiens
TSLGNTCFM

SEQ ID NO: 522316 - protein, 9 aa, Homo Sapiens
NEFLDGSGY

SEQ ID NO: 522317 - protein, 9 aa, Homo Sapiens
ISCMPGTVG

SEQ ID NO: 522318 - protein, 9 aa, Homo Sapiens
LTTKLNGFE

SEQ ID NO: 522319 - protein, 9 aa, Homo Sapiens
SLQPSHGAS

SEQ ID NO: 522320 - protein, 9 aa, Homo Sapiens
SGTYLTNRL

SEQ ID NO: 522321 - protein, 9 aa, Homo Sapiens
APNCKSCFG

SEQ ID NO: 522322 - protein, 9 aa, Homo Sapiens
DVDRAEQEM

SEQ ID NO: 522323 - protein, 9 aa, Homo Sapiens
RELLWAGST

SEQ ID NO: 522324 - protein, 9 aa, Homo Sapiens
NPRLDLHEI

SEQ ID NO: 522325 - protein, 9 aa, Homo Sapiens
GKKDSKKDE

SEQ ID NO: 522326 - protein, 9 aa, Homo Sapiens
STYPWPPMH

SEQ ID NO: 522327 - protein, 9 aa, Homo Sapiens
KDEKKKDAK

SEQ ID NO: 522328 - protein, 9 aa, Homo Sapiens
RAASQPLRR

SEQ ID NO: 522329 - protein, 9 aa, Homo Sapiens
KSASMSNRS

SEQ ID NO: 522330 - protein, 9 aa, Homo Sapiens
LGRRSSKPT

SEQ ID NO: 522331 - protein, 9 aa, Homo Sapiens
ISSKKSNHY

SEQ ID NO: 522332 - protein, 9 aa, Homo Sapiens
TSTPTQGEL

SEQ ID NO: 522333 - protein, 9 aa, Homo Sapiens
SCEMNERAE

SEQ ID NO: 522334 - protein, 9 aa, Homo Sapiens
SKKDEKKKD

SEQ ID NO: 522335 - protein, 9 aa, Homo Sapiens
KRQEWKRRS

SEQ ID NO: 522336 - protein, 9 aa, Homo Sapiens
GRRAGGRAG

SEQ ID NO: 522337 - protein, 9 aa, Homo Sapiens
LLLYTGWSL

SEQ ID NO: 522338 - protein, 9 aa, Homo Sapiens
EGYDTKNTH

SEQ ID NO: 522339 - protein, 9 aa, Homo Sapiens
GPSGTYLTN

SEQ ID NO: 522340 - protein, 9 aa, Homo Sapiens
RQYGPSPKF

SEQ ID NO: 522341 - protein, 9 aa, Homo Sapiens
TLSNSNVEL

SEQ ID NO: 522342 - protein, 9 aa, Homo Sapiens
RHEFSIPYV

SEQ ID NO: 522343 - protein, 9 aa, Homo Sapiens
WKKRARADP

SEQ ID NO: 522344 - protein, 9 aa, Homo Sapiens
EKEKKHISE

SEQ ID NO: 522345 - protein, 9 aa, Homo Sapiens
FKQCLNEKE

SEQ ID NO: 522346 - protein, 9 aa, Homo Sapiens
SLLLCCSNW

SEQ ID NO: 522347 - protein, 9 aa, Homo Sapiens
HPTKFQRLI

SEQ ID NO: 522348 - protein, 9 aa, Homo Sapiens
QQQFLVIKQ

SEQ ID NO: 522349 - protein, 9 aa, Homo Sapiens
DEKKKDAKK

SEQ ID NO: 522350 - protein, 9 aa, Homo Sapiens
ARLQRSCEM

SEQ ID NO: 522351 - protein, 9 aa, Homo Sapiens
KILDPVCDM

SEQ ID NO: 522352 - protein, 9 aa, Homo Sapiens
GTARGLTLK

SEQ ID NO: 522353 - protein, 9 aa, Homo Sapiens
SEVIKKSFS

SEQ ID NO: 522354 - protein, 9 aa, Homo Sapiens
ERLRPHVPY

SEQ ID NO: 522355 - protein, 9 aa, Homo Sapiens
SDIHDLLNI

SEQ ID NO: 522356 - protein, 9 aa, Homo Sapiens
GLARDGRRE

SEQ ID NO: 522357 - protein, 9 aa, Homo Sapiens
PSKSKNGQT

SEQ ID NO: 522358 - protein, 9 aa, Homo Sapiens
VTVKIHGVH

SEQ ID NO: 522359 - protein, 9 aa, Homo Sapiens
IRCLAGDPC

SEQ ID NO: 522360 - protein, 9 aa, Homo Sapiens
PIRCLAGDP

SEQ ID NO: 522361 - protein, 9 aa, Homo Sapiens
EQEMEVEER

SEQ ID NO: 522362 - protein, 9 aa, Homo Sapiens
MDLRVYGPA

SEQ ID NO: 522363 - protein, 9 aa, Homo Sapiens
LAGLERLRP

SEQ ID NO: 522364 - protein, 9 aa, Homo Sapiens
TGWGQLPVR

SEQ ID NO: 522365 - protein, 9 aa, Homo Sapiens
QPLRRRPGP

SEQ ID NO: 522366 - protein, 9 aa, Homo Sapiens
AIRQCIPVQ

SEQ ID NO: 522367 - protein, 9 aa, Homo Sapiens
TITGDWRIV

SEQ ID NO: 522368 - protein, 9 aa, Homo Sapiens
RCLQSPCPP

SEQ ID NO: 522369 - protein, 9 aa, Homo Sapiens
TLEQERCQR

SEQ ID NO: 522370 - protein, 9 aa, Homo Sapiens
LEEGSGRRA

SEQ ID NO: 522371 - protein, 9 aa, Homo Sapiens
TDNEYLGLQ

SEQ ID NO: 522372 - protein, 9 aa, Homo Sapiens
LTSTYPWPP

SEQ ID NO: 522373 - protein, 9 aa, Homo Sapiens
EEGSGRRAG

SEQ ID NO: 522374 - protein, 9 aa, Homo Sapiens
FSAARYALL

SEQ ID NO: 522375 - protein, 9 aa, Homo Sapiens
RKCAPNCKS

SEQ ID NO: 522376 - protein, 9 aa, Homo Sapiens
GHRHSADRS

SEQ ID NO: 522377 - protein, 9 aa, Homo Sapiens
RGHSRGHNQ

SEQ ID NO: 522378 - protein, 9 aa, Homo Sapiens
QCSGHMTVK

SEQ ID NO: 522379 - protein, 9 aa, Homo Sapiens
VLDGTDNEY

SEQ ID NO: 522380 - protein, 9 aa, Homo Sapiens
LTANDLPSQ

SEQ ID NO: 522381 - protein, 9 aa, Homo Sapiens
VEFDPQQEW

SEQ ID NO: 522382 - protein, 9 aa, Homo Sapiens
LTGWGQLPV

SEQ ID NO: 522383 - protein, 9 aa, Homo Sapiens
FDPQQEWDF

SEQ ID NO: 522384 - protein, 9 aa, Homo Sapiens
SVTVKIHGV

SEQ ID NO: 522385 - protein, 9 aa, Homo Sapiens
EAEMRELKG

SEQ ID NO: 522386 - protein, 9 aa, Homo Sapiens
PYSQCTGDG

SEQ ID NO: 522387 - protein, 9 aa, Homo Sapiens
GHNQCSGHM

SEQ ID NO: 522388 - protein, 9 aa, Homo Sapiens
TCHCSANVT

SEQ ID NO: 522389 - protein, 9 aa, Homo Sapiens
NEEESTVIS

SEQ ID NO: 522390 - protein, 9 aa, Homo Sapiens
GPCCELDID

SEQ ID NO: 522391 - protein, 9 aa, Homo Sapiens
NPGFCSQLQ

SEQ ID NO: 522392 - protein, 9 aa, Homo Sapiens
DFLTTKLNG

SEQ ID NO: 522393 - protein, 9 aa, Homo Sapiens
QAGEVSCEQ

SEQ ID NO: 522394 - protein, 9 aa, Homo Sapiens
MEGMLCHKQ

SEQ ID NO: 522395 - protein, 9 aa, Homo Sapiens
SNVELLLSG

SEQ ID NO: 522396 - protein, 9 aa, Homo Sapiens
RASGDFLTT

SEQ ID NO: 522397 - protein, 9 aa, Homo Sapiens
SVSQSSVKK

SEQ ID NO: 522398 - protein, 9 aa, Homo Sapiens
RAHLTASCW

SEQ ID NO: 522399 - protein, 9 aa, Homo Sapiens
DILENQHVD

SEQ ID NO: 522400 - protein, 9 aa, Homo Sapiens
PQPPWKKRA

SEQ ID NO: 522401 - protein, 9 aa, Homo Sapiens
KNKTFLRCK

SEQ ID NO: 522402 - protein, 9 aa, Homo Sapiens
VLSGPSGTY

SEQ ID NO: 522403 - protein, 9 aa, Homo Sapiens
GTDNEYLGL

SEQ ID NO: 522404 - protein, 9 aa, Homo Sapiens
QEDPASTCH

SEQ ID NO: 522405 - protein, 9 aa, Homo Sapiens
KATKHETLV

SEQ ID NO: 522406 - protein, 9 aa, Homo Sapiens
WMRLSKYAA

SEQ ID NO: 522407 - protein, 9 aa, Homo Sapiens
SVDRCLQSP

SEQ ID NO: 522408 - protein, 9 aa, Homo Sapiens
SKSASMSNR

SEQ ID NO: 522409 - protein, 9 aa, Homo Sapiens
DPVCDMDEE

SEQ ID NO: 522410 - protein, 9 aa, Homo Sapiens
ICGLTSLGN

SEQ ID NO: 522411 - protein, 9 aa, Homo Sapiens
SKRQEWKRR

SEQ ID NO: 522412 - protein, 9 aa, Homo Sapiens
PKNVESFAP

SEQ ID NO: 522413 - protein, 9 aa, Homo Sapiens
AVLAFPDDM

SEQ ID NO: 522414 - protein, 9 aa, Homo Sapiens
GQLPVRGPW

SEQ ID NO: 522415 - protein, 9 aa, Homo Sapiens
RLQRSCEMN

SEQ ID NO: 522416 - protein, 9 aa, Homo Sapiens
KLSEKEKKH

SEQ ID NO: 522417 - protein, 9 aa, Homo Sapiens
LSFSAARYA

SEQ ID NO: 522418 - protein, 9 aa, Homo Sapiens
SGDFLTTKL

SEQ ID NO: 522419 - protein, 9 aa, Homo Sapiens
RELKGHMEN

SEQ ID NO: 522420 - protein, 9 aa, Homo Sapiens
HPGSSDSSV

SEQ ID NO: 522421 - protein, 9 aa, Homo Sapiens
SKNGQTPGG

SEQ ID NO: 522422 - protein, 9 aa, Homo Sapiens
QCIPVQKTF

SEQ ID NO: 522423 - protein, 9 aa, Homo Sapiens
ELLWAGSTG

SEQ ID NO: 522424 - protein, 9 aa, Homo Sapiens
AGEVSCEQQ

SEQ ID NO: 522425 - protein, 9 aa, Homo Sapiens
SLCPRQYGP

SEQ ID NO: 522426 - protein, 9 aa, Homo Sapiens
YPKPIRCLA

SEQ ID NO: 522427 - protein, 9 aa, Homo Sapiens
GICGLTSLG

SEQ ID NO: 522428 - protein, 9 aa, Homo Sapiens
AMERPSFLS

SEQ ID NO: 522429 - protein, 9 aa, Homo Sapiens
TIRVADLLQ

SEQ ID NO: 522430 - protein, 9 aa, Homo Sapiens
NVAVHIRPT

SEQ ID NO: 522431 - protein, 9 aa, Homo Sapiens
GLGGQGCRA

SEQ ID NO: 522432 - protein, 9 aa, Homo Sapiens
HGTARGLTL

SEQ ID NO: 522433 - protein, 9 aa, Homo Sapiens
SADLVPILG

SEQ ID NO: 522434 - protein, 9 aa, Homo Sapiens
HRHSADRSR

SEQ ID NO: 522435 - protein, 9 aa, Homo Sapiens
FLNIQSTKL

SEQ ID NO: 522436 - protein, 9 aa, Homo Sapiens
KCAPNCKSC

SEQ ID NO: 522437 - protein, 9 aa, Homo Sapiens
REAEMRELK

SEQ ID NO: 522438 - protein, 9 aa, Homo Sapiens
WEPWKRHEF

SEQ ID NO: 522439 - protein, 9 aa, Homo Sapiens
DLLNILDDS

SEQ ID NO: 522440 - protein, 9 aa, Homo Sapiens
IHDLLNILD

SEQ ID NO: 522441 - protein, 9 aa, Homo Sapiens
DRCLQSPCP

SEQ ID NO: 522442 - protein, 9 aa, Homo Sapiens
QSPCPPSLQ

SEQ ID NO: 522443 - protein, 9 aa, Homo Sapiens
QQECPVTPC

SEQ ID NO: 522444 - protein, 9 aa, Homo Sapiens
YLCDGDNDY

SEQ ID NO: 522445 - protein, 9 aa, Homo Sapiens
RGLSFSAAR

SEQ ID NO: 522446 - protein, 9 aa, Homo Sapiens
KCNYSERVG

SEQ ID NO: 522447 - protein, 9 aa, Homo Sapiens
SFKQCLNEK

SEQ ID NO: 522448 - protein, 9 aa, Homo Sapiens
KSNHYSLST

SEQ ID NO: 522449 - protein, 9 aa, Homo Sapiens
TGDGSDVPI

SEQ ID NO: 522450 - protein, 9 aa, Homo Sapiens
LPVEQDNPM

SEQ ID NO: 522451 - protein, 9 aa, Homo Sapiens
LSSMEMSDA

SEQ ID NO: 522452 - protein, 9 aa, Homo Sapiens
EGLEEGSGR

SEQ ID NO: 522453 - protein, 9 aa, Homo Sapiens
LTSLGNTCF

SEQ ID NO: 522454 - protein, 9 aa, Homo Sapiens
GVPPSKSKN

SEQ ID NO: 522455 - protein, 9 aa, Homo Sapiens
WAGSTGLAC

SEQ ID NO: 522456 - protein, 9 aa, Homo Sapiens
GLFAKIVMN

SEQ ID NO: 522457 - protein, 9 aa, Homo Sapiens
THHPISAHE

SEQ ID NO: 522458 - protein, 9 aa, Homo Sapiens
LGGQGCRAL

SEQ ID NO: 522459 - protein, 9 aa, Homo Sapiens
RGLTLKEVL

SEQ ID NO: 522460 - protein, 9 aa, Homo Sapiens
AQAHLPSGE

SEQ ID NO: 522461 - protein, 9 aa, Homo Sapiens
RHSADRSRQ

SEQ ID NO: 522462 - protein, 9 aa, Homo Sapiens
RARLQRSCE

SEQ ID NO: 522463 - protein, 9 aa, Homo Sapiens
SDNEEESTV

SEQ ID NO: 522464 - protein, 9 aa, Homo Sapiens
GVNWEPWKR

SEQ ID NO: 522465 - protein, 9 aa, Homo Sapiens
KSTLSSMEM

SEQ ID NO: 522466 - protein, 9 aa, Homo Sapiens
VAVHIRPTR

SEQ ID NO: 522467 - protein, 9 aa, Homo Sapiens
GDGIRGLSF

SEQ ID NO: 522468 - protein, 9 aa, Homo Sapiens
LHEINNWVQ

SEQ ID NO: 522469 - protein, 9 aa, Homo Sapiens
LSADLVPIL

SEQ ID NO: 522470 - protein, 9 aa, Homo Sapiens
GYDTKNTHQ

SEQ ID NO: 522471 - protein, 9 aa, Homo Sapiens
PLALPSPPC

SEQ ID NO: 522472 - protein, 9 aa, Homo Sapiens
PNSPLALSA

SEQ ID NO: 522473 - protein, 9 aa, Homo Sapiens
PRDQFQPTI

SEQ ID NO: 522474 - protein, 9 aa, Homo Sapiens
LLLCCSNWD

SEQ ID NO: 522475 - protein, 9 aa, Homo Sapiens
GFQGPCCEL

SEQ ID NO: 522476 - protein, 9 aa, Homo Sapiens
IAVPTPSQR

SEQ ID NO: 522477 - protein, 9 aa, Homo Sapiens
AVKILDPVC

SEQ ID NO: 522478 - protein, 9 aa, Homo Sapiens
PPWKKRARA

SEQ ID NO: 522479 - protein, 9 aa, Homo Sapiens
CSEPRASKS

SEQ ID NO: 522480 - protein, 9 aa, Homo Sapiens
FQRLIPGRE

SEQ ID NO: 522481 - protein, 9 aa, Homo Sapiens
LEQERCQRE

SEQ ID NO: 522482 - protein, 9 aa, Homo Sapiens
AGSSVDRCL

SEQ ID NO: 522483 - protein, 9 aa, Homo Sapiens
IHGVHLGQA

SEQ ID NO: 522484 - protein, 9 aa, Homo Sapiens
HEDRAGHRH

SEQ ID NO: 522485 - protein, 9 aa, Homo Sapiens
CNGNSNEFL

SEQ ID NO: 522486 - protein, 9 aa, Homo Sapiens
SQAQAHLPS

SEQ ID NO: 522487 - protein, 9 aa, Homo Sapiens
HLPSGEVVK

SEQ ID NO: 522488 - protein, 9 aa, Homo Sapiens
LADGFLAAG

SEQ ID NO: 522489 - protein, 9 aa, Homo Sapiens
LALPSPPCQ

SEQ ID NO: 522490 - protein, 9 aa, Homo Sapiens
DWRIVLVDD

SEQ ID NO: 522491 - protein, 9 aa, Homo Sapiens
FTDQPGVSI

SEQ ID NO: 522492 - protein, 9 aa, Homo Sapiens
KGKRRPGGF

SEQ ID NO: 522493 - protein, 9 aa, Homo Sapiens
QPPWKKRAR

SEQ ID NO: 522494 - protein, 9 aa, Homo Sapiens
SSVSQSSVK

SEQ ID NO: 522495 - protein, 9 aa, Homo Sapiens
PATFLNIQS

SEQ ID NO: 522496 - protein, 9 aa, Homo Sapiens
NLTANDLPS

SEQ ID NO: 522497 - protein, 9 aa, Homo Sapiens
PYSDIHDLL

SEQ ID NO: 522498 - protein, 9 aa, Homo Sapiens
AGHRHSADR

SEQ ID NO: 522499 - protein, 9 aa, Homo Sapiens
MTVKEPPYF

SEQ ID NO: 522500 - protein, 9 aa, Homo Sapiens
LCCSNWDAE

SEQ ID NO: 522501 - protein, 9 aa, Homo Sapiens
YDTKNTHQD

SEQ ID NO: 522502 - protein, 9 aa, Homo Sapiens
PMLRHSPLT

SEQ ID NO: 522503 - protein, 9 aa, Homo Sapiens
SAHEATLRC

SEQ ID NO: 522504 - protein, 9 aa, Homo Sapiens
LCDGDNDYG

SEQ ID NO: 522505 - protein, 9 aa, Homo Sapiens
GHSRGHNQN

SEQ ID NO: 522506 - protein, 9 aa, Homo Sapiens
WKRRSTANP

SEQ ID NO: 522507 - protein, 9 aa, Homo Sapiens
KRHEFSIPY

SEQ ID NO: 522508 - protein, 9 aa, Homo Sapiens
QTLEQERCQ

SEQ ID NO: 522509 - protein, 9 aa, Homo Sapiens
HISEQLNAL

SEQ ID NO: 522510 - protein, 9 aa, Homo Sapiens
GWGQLPVRG

SEQ ID NO: 522511 - protein, 9 aa, Homo Sapiens
FAKIVMNVS

SEQ ID NO: 522512 - protein, 9 aa, Homo Sapiens
GEKIKVLEE

SEQ ID NO: 522513 - protein, 9 aa, Homo Sapiens
PQQEWDFYK

SEQ ID NO: 522514 - protein, 9 aa, Homo Sapiens
AWMRLSKYA

SEQ ID NO: 522515 - protein, 9 aa, Homo Sapiens
RVHRLLRKC

SEQ ID NO: 522516 - protein, 9 aa, Homo Sapiens
QFLVIKQTS

SEQ ID NO: 522517 - protein, 9 aa, Homo Sapiens
DDSKATKHE

SEQ ID NO: 522518 - protein, 9 aa, Homo Sapiens
PASTCHCSA

SEQ ID NO: 522519 - protein, 9 aa, Homo Sapiens
LSSLLADGF

SEQ ID NO: 522520 - protein, 9 aa, Homo Sapiens
GNVAVHIRP

SEQ ID NO: 522521 - protein, 9 aa, Homo Sapiens
ALAGLERLR

SEQ ID NO: 522522 - protein, 9 aa, Homo Sapiens
GRQGGLARD

SEQ ID NO: 522523 - protein, 9 aa, Homo Sapiens
NWSHSRPGP

SEQ ID NO: 522524 - protein, 9 aa, Homo Sapiens
NATLSNSNV

SEQ ID NO: 522525 - protein, 9 aa, Homo Sapiens
ASGDFLTTK

SEQ ID NO: 522526 - protein, 9 aa, Homo Sapiens
PTQGELKRI

SEQ ID NO: 522527 - protein, 9 aa, Homo Sapiens
DSKATKHET

SEQ ID NO: 522528 - protein, 9 aa, Homo Sapiens
TGLACWLAG

SEQ ID NO: 522529 - protein, 9 aa, Homo Sapiens
PGFQGPCCE

SEQ ID NO: 522530 - protein, 9 aa, Homo Sapiens
NGGAKRHRK

SEQ ID NO: 522531 - protein, 9 aa, Homo Sapiens
LSEKEKKHI

SEQ ID NO: 522532 - protein, 9 aa, Homo Sapiens
YLTSTYPWP

SEQ ID NO: 522533 - protein, 9 aa, Homo Sapiens
WRIVLVDDR

SEQ ID NO: 522534 - protein, 9 aa, Homo Sapiens
RLLRKCNYS

SEQ ID NO: 522535 - protein, 9 aa, Homo Sapiens
LQRASGDFL

SEQ ID NO: 522536 - protein, 9 aa, Homo Sapiens
VAEPNPGFC

SEQ ID NO: 522537 - protein, 9 aa, Homo Sapiens
CKAKNYSGR

SEQ ID NO: 522538 - protein, 9 aa, Homo Sapiens
NDPYATFVK

SEQ ID NO: 522539 - protein, 9 aa, Homo Sapiens
IPLFFLLLG

SEQ ID NO: 522540 - protein, 9 aa, Homo Sapiens
KDSKKDEKK

SEQ ID NO: 522541 - protein, 9 aa, Homo Sapiens
VLPSQAQAH

SEQ ID NO: 522542 - protein, 9 aa, Homo Sapiens
NQHVDNHVQ

SEQ ID NO: 522543 - protein, 9 aa, Homo Sapiens
VRRQTAWMR

SEQ ID NO: 522544 - protein, 9 aa, Homo Sapiens
IKVLEEHGE

SEQ ID NO: 522545 - protein, 9 aa, Homo Sapiens
HNQNSRRPS

SEQ ID NO: 522546 - protein, 9 aa, Homo Sapiens
IRQCIPVQK

SEQ ID NO: 522547 - protein, 9 aa, Homo Sapiens
VGQTVNDPY

SEQ ID NO: 522548 - protein, 9 aa, Homo Sapiens
NDLPSQGIL

SEQ ID NO: 522549 - protein, 9 aa, Homo Sapiens
DIHDLLNIL

SEQ ID NO: 522550 - protein, 9 aa, Homo Sapiens
GALAGLERL

SEQ ID NO: 522551 - protein, 9 aa, Homo Sapiens
QRASGDFLT

SEQ ID NO: 522552 - protein, 9 aa, Homo Sapiens
AGLERLRPH

SEQ ID NO: 522553 - protein, 9 aa, Homo Sapiens
FLLLGFYTV

SEQ ID NO: 522554 - protein, 9 aa, Homo Sapiens
CPPSLQPSH

SEQ ID NO: 522555 - protein, 9 aa, Homo Sapiens
AHEATLRCW

SEQ ID NO: 522556 - protein, 9 aa, Homo Sapiens
RSCEMNERA

SEQ ID NO: 522557 - protein, 9 aa, Homo Sapiens
ESFAPMLRH

SEQ ID NO: 522558 - protein, 9 aa, Homo Sapiens
RLIPGRENC

SEQ ID NO: 522559 - protein, 9 aa, Homo Sapiens
VPGFQGPCC

SEQ ID NO: 522560 - protein, 9 aa, Homo Sapiens
LLYTGWSLW

SEQ ID NO: 522561 - protein, 9 aa, Homo Sapiens
VRGPWDLGK

SEQ ID NO: 522562 - protein, 9 aa, Homo Sapiens
PCKHGAKGA

SEQ ID NO: 522563 - protein, 9 aa, Homo Sapiens
PLALSADLV

SEQ ID NO: 522564 - protein, 9 aa, Homo Sapiens
AVNKLSSGN

SEQ ID NO: 522565 - protein, 9 aa, Homo Sapiens
PMRGHLEFT

SEQ ID NO: 522566 - protein, 9 aa, Homo Sapiens
LENQHVDNH

SEQ ID NO: 522567 - protein, 9 aa, Homo Sapiens
VNDPYATFV

SEQ ID NO: 522568 - protein, 9 aa, Homo Sapiens
KIVMNVSDA

SEQ ID NO: 522569 - protein, 9 aa, Homo Sapiens
DVGQTVNDP

SEQ ID NO: 522570 - protein, 9 aa, Homo Sapiens
QGPCCELDI

SEQ ID NO: 522571 - protein, 9 aa, Homo Sapiens
RQCIPVQKT

SEQ ID NO: 522572 - protein, 9 aa, Homo Sapiens
CYQIRCCTD

SEQ ID NO: 522573 - protein, 9 aa, Homo Sapiens
QCTGDGSDV

SEQ ID NO: 522574 - protein, 9 aa, Homo Sapiens
KPTVAKVKC

SEQ ID NO: 522575 - protein, 9 aa, Homo Sapiens
YSEVIKKSF

SEQ ID NO: 522576 - protein, 9 aa, Homo Sapiens
QEMEVEERA

SEQ ID NO: 522577 - protein, 9 aa, Homo Sapiens
QQFLVIKQT

SEQ ID NO: 522578 - protein, 9 aa, Homo Sapiens
PYYSEVIKK

SEQ ID NO: 522579 - protein, 9 aa, Homo Sapiens
CNYSERVGA

SEQ ID NO: 522580 - protein, 9 aa, Homo Sapiens
AASTAMERP

SEQ ID NO: 522581 - protein, 9 aa, Homo Sapiens
CCELDIDEC

SEQ ID NO: 522582 - protein, 9 aa, Homo Sapiens
STCHCSANV

SEQ ID NO: 522583 - protein, 9 aa, Homo Sapiens
SFAPMLRHS

SEQ ID NO: 522584 - protein, 9 aa, Homo Sapiens
GLTLKEVLE

SEQ ID NO: 522585 - protein, 9 aa, Homo Sapiens
YFTNWSHSR

SEQ ID NO: 522586 - protein, 9 aa, Homo Sapiens
PDDMDLRVY

SEQ ID NO: 522587 - protein, 9 aa, Homo Sapiens
EQMEGMLCH

SEQ ID NO: 522588 - protein, 9 aa, Homo Sapiens
PGTVGRWNY

SEQ ID NO: 522589 - protein, 9 aa, Homo Sapiens
DGTDNEYLG

SEQ ID NO: 522590 - protein, 9 aa, Homo Sapiens
SQPLRRRPG

SEQ ID NO: 522591 - protein, 9 aa, Homo Sapiens
QLRAHLTAS

SEQ ID NO: 522592 - protein, 9 aa, Homo Sapiens
GDFLTTKLN

SEQ ID NO: 522593 - protein, 9 aa, Homo Sapiens
SMEMSDAFS

SEQ ID NO: 522594 - protein, 9 aa, Homo Sapiens
NWEPWKRHE

SEQ ID NO: 522595 - protein, 9 aa, Homo Sapiens
ERGMPGMPC

SEQ ID NO: 522596 - protein, 9 aa, Homo Sapiens
PCPPSLQPS

SEQ ID NO: 522597 - protein, 9 aa, Homo Sapiens
SSVDRCLQS

SEQ ID NO: 522598 - protein, 9 aa, Homo Sapiens
PSQGILSQD

SEQ ID NO: 522599 - protein, 9 aa, Homo Sapiens
TGDWRIVLV

SEQ ID NO: 522600 - protein, 9 aa, Homo Sapiens
QSELMVTAA

SEQ ID NO: 522601 - protein, 9 aa, Homo Sapiens
PNCKSCFGS

SEQ ID NO: 522602 - protein, 9 aa, Homo Sapiens
EGSGRRAGG

SEQ ID NO: 522603 - protein, 9 aa, Homo Sapiens
ELMVTAARG

SEQ ID NO: 522604 - protein, 9 aa, Homo Sapiens
FLTTKLNGF

SEQ ID NO: 522605 - protein, 9 aa, Homo Sapiens
SSHLHNLLW

SEQ ID NO: 522606 - protein, 9 aa, Homo Sapiens
HQDNSILKV

SEQ ID NO: 522607 - protein, 9 aa, Homo Sapiens
LFAKIVMNV

SEQ ID NO: 522608 - protein, 9 aa, Homo Sapiens
AGSTGLACW

SEQ ID NO: 522609 - protein, 9 aa, Homo Sapiens
ALSADLVPI

SEQ ID NO: 522610 - protein, 9 aa, Homo Sapiens
TAARGGDPR

SEQ ID NO: 522611 - protein, 9 aa, Homo Sapiens
EIQSKRQEW

SEQ ID NO: 522612 - protein, 9 aa, Homo Sapiens
ETQKPYYSE

SEQ ID NO: 522613 - protein, 9 aa, Homo Sapiens
RRRPGPAGS

SEQ ID NO: 522614 - protein, 9 aa, Homo Sapiens
EAPQPPWKK

SEQ ID NO: 522615 - protein, 9 aa, Homo Sapiens
SDSSVSQSS

SEQ ID NO: 522616 - protein, 9 aa, Homo Sapiens
APMRGHLEF

SEQ ID NO: 522617 - protein, 9 aa, Homo Sapiens
FCSQLQKYE

SEQ ID NO: 522618 - protein, 9 aa, Homo Sapiens
YPRDQFQPT

SEQ ID NO: 522619 - protein, 9 aa, Homo Sapiens
MRELKGHME

SEQ ID NO: 522620 - protein, 9 aa, Homo Sapiens
LFFLLLGFY

SEQ ID NO: 522621 - protein, 9 aa, Homo Sapiens
KQCLNEKEE

SEQ ID NO: 522622 - protein, 9 aa, Homo Sapiens
LMVTAARGG

SEQ ID NO: 522623 - protein, 9 aa, Homo Sapiens
RRSSKPTVA

SEQ ID NO: 522624 - protein, 9 aa, Homo Sapiens
MRGHLEFTD

SEQ ID NO: 522625 - protein, 9 aa, Homo Sapiens
ELKGHMENS

SEQ ID NO: 522626 - protein, 9 aa, Homo Sapiens
TSEAPQPPW

SEQ ID NO: 522627 - protein, 9 aa, Homo Sapiens
GGRQGGLAR

SEQ ID NO: 522628 - protein, 9 aa, Homo Sapiens
SFKKGEKIK

SEQ ID NO: 522629 - protein, 9 aa, Homo Sapiens
EGMLCHKQE

SEQ ID NO: 522630 - protein, 9 aa, Homo Sapiens
PISAHEATL

SEQ ID NO: 522631 - protein, 9 aa, Homo Sapiens
CDMDEEIEA

SEQ ID NO: 522632 - protein, 9 aa, Homo Sapiens
TVGRWNYPP

SEQ ID NO: 522633 - protein, 9 aa, Homo Sapiens
LTASCWAAP

SEQ ID NO: 522634 - protein, 9 aa, Homo Sapiens
WKRHEFSIP

SEQ ID NO: 522635 - protein, 9 aa, Homo Sapiens
VQKTFLLLY

SEQ ID NO: 522636 - protein, 9 aa, Homo Sapiens
CCSNWDAET

SEQ ID NO: 522637 - protein, 9 aa, Homo Sapiens
GEEGNVAVH

SEQ ID NO: 522638 - protein, 9 aa, Homo Sapiens
LNEKEEVLL

SEQ ID NO: 522639 - protein, 9 aa, Homo Sapiens
GHLEFTDQP

SEQ ID NO: 522640 - protein, 9 aa, Homo Sapiens
LPVRGPWDL

SEQ ID NO: 522641 - protein, 9 aa, Homo Sapiens
VGFCYQIRC

SEQ ID NO: 522642 - protein, 9 aa, Homo Sapiens
DCGGSDNEE

SEQ ID NO: 522643 - protein, 9 aa, Homo Sapiens
PPYSDIHDL

SEQ ID NO: 522644 - protein, 9 aa, Homo Sapiens
AARGGDPRP

SEQ ID NO: 522645 - protein, 9 aa, Homo Sapiens
FAPMLRHSP

SEQ ID NO: 522646 - protein, 9 aa, Homo Sapiens
LQSPCPPSL

SEQ ID NO: 522647 - protein, 9 aa, Homo Sapiens
FTNWSHSRP

SEQ ID NO: 522648 - protein, 9 aa, Homo Sapiens
HAVNKLSSG

SEQ ID NO: 522649 - protein, 9 aa, Homo Sapiens
QERCQRELL

SEQ ID NO: 522650 - protein, 9 aa, Homo Sapiens
IDDFTRNAY

SEQ ID NO: 522651 - protein, 9 aa, Homo Sapiens
ACGALAGLE

SEQ ID NO: 522652 - protein, 9 aa, Homo Sapiens
IVMNVSDAH

SEQ ID NO: 522653 - protein, 9 aa, Homo Sapiens
GPRGGLGGQ

SEQ ID NO: 522654 - protein, 9 aa, Homo Sapiens
DYGDNSDEN

SEQ ID NO: 522655 - protein, 9 aa, Homo Sapiens
HMTVKEPPY

SEQ ID NO: 522656 - protein, 9 aa, Homo Sapiens
RAEQEMEVE

SEQ ID NO: 522657 - protein, 9 aa, Homo Sapiens
DPQQEWDFY

SEQ ID NO: 522658 - protein, 9 aa, Homo Sapiens
GEVSCEQQE

SEQ ID NO: 522659 - protein, 9 aa, Homo Sapiens
QKPYYSEVI

SEQ ID NO: 522660 - protein, 9 aa, Homo Sapiens
STAMERPSF

SEQ ID NO: 522661 - protein, 9 aa, Homo Sapiens
DSSVSQSSV

SEQ ID NO: 522662 - protein, 9 aa, Homo Sapiens
QAQAHLPSG

SEQ ID NO: 522663 - protein, 9 aa, Homo Sapiens
NSNVELLLS

SEQ ID NO: 522664 - protein, 9 aa, Homo Sapiens
QTVNDPYAT

SEQ ID NO: 522665 - protein, 9 aa, Homo Sapiens
APQPPWKKR

SEQ ID NO: 522666 - protein, 9 aa, Homo Sapiens
KKHISEQLN

SEQ ID NO: 522667 - protein, 9 aa, Homo Sapiens
NVESFAPML

SEQ ID NO: 522668 - protein, 9 aa, Homo Sapiens
IPVQKTFLL

SEQ ID NO: 522669 - protein, 9 aa, Homo Sapiens
VLAFPDDMD

SEQ ID NO: 522670 - protein, 9 aa, Homo Sapiens
TQVVRIAVP

SEQ ID NO: 522671 - protein, 9 aa, Homo Sapiens
CGLTSLGNT

SEQ ID NO: 522672 - protein, 9 aa, Homo Sapiens
SKPTVAKVK

SEQ ID NO: 522673 - protein, 9 aa, Homo Sapiens
THQDNSILK

SEQ ID NO: 522674 - protein, 9 aa, Homo Sapiens
PSLQPSHGA

SEQ ID NO: 522675 - protein, 9 aa, Homo Sapiens
CQLSESEKS

SEQ ID NO: 522676 - protein, 9 aa, Homo Sapiens
VPPSKSKNG

SEQ ID NO: 522677 - protein, 9 aa, Homo Sapiens
PCCELDIDE

SEQ ID NO: 522678 - protein, 9 aa, Homo Sapiens
LTLKEVLEY

SEQ ID NO: 522679 - protein, 9 aa, Homo Sapiens
AEMRELKGH

SEQ ID NO: 522680 - protein, 9 aa, Homo Sapiens
LKGHMENSS

SEQ ID NO: 522681 - protein, 9 aa, Homo Sapiens
SGHMTVKEP

SEQ ID NO: 522682 - protein, 9 aa, Homo Sapiens
GGSDNEEES

SEQ ID NO: 522683 - protein, 9 aa, Homo Sapiens
SSAASTAME

SEQ ID NO: 522684 - protein, 9 aa, Homo Sapiens
KSCFGSHGD

SEQ ID NO: 522685 - protein, 9 aa, Homo Sapiens
EDPASTCHC

SEQ ID NO: 522686 - protein, 9 aa, Homo Sapiens
DDMDLRVYG

SEQ ID NO: 522687 - protein, 9 aa, Homo Sapiens
HNQCSGHMT

SEQ ID NO: 522688 - protein, 9 aa, Homo Sapiens
NSPLALSAD

SEQ ID NO: 522689 - protein, 9 aa, Homo Sapiens
KGGRQGGLA

SEQ ID NO: 522690 - protein, 9 aa, Homo Sapiens
STLSSMEMS

SEQ ID NO: 522691 - protein, 9 aa, Homo Sapiens
RIAVPTPSQ

SEQ ID NO: 522692 - protein, 9 aa, Homo Sapiens
QGCRALSSG

SEQ ID NO: 522693 - protein, 9 aa, Homo Sapiens
LLADGFLAA

SEQ ID NO: 522694 - protein, 9 aa, Homo Sapiens
KETQKPYYS

SEQ ID NO: 522695 - protein, 9 aa, Homo Sapiens
LVSYLTSTY

SEQ ID NO: 522696 - protein, 9 aa, Homo Sapiens
EPWKRHEFS

SEQ ID NO: 522697 - protein, 9 aa, Homo Sapiens
IPNSPLALS

SEQ ID NO: 522698 - protein, 9 aa, Homo Sapiens
DNDYGDNSD

SEQ ID NO: 522699 - protein, 9 aa, Homo Sapiens
GFCYQIRCC

SEQ ID NO: 522700 - protein, 9 aa, Homo Sapiens
VRIAVPTPS

SEQ ID NO: 522701 - protein, 9 aa, Homo Sapiens
ITSVTVKIH

SEQ ID NO: 522702 - protein, 9 aa, Homo Sapiens
GDCGGSDNE

SEQ ID NO: 522703 - protein, 9 aa, Homo Sapiens
FQPTIRVAD

SEQ ID NO: 522704 - protein, 9 aa, Homo Sapiens
PGFCSQLQK

SEQ ID NO: 522705 - protein, 9 aa, Homo Sapiens
QVVRIAVPT

SEQ ID NO: 522706 - protein, 9 aa, Homo Sapiens
PTIRVADLL

SEQ ID NO: 522707 - protein, 9 aa, Homo Sapiens
GYPKPIRCL

SEQ ID NO: 522708 - protein, 9 aa, Homo Sapiens
SKSKNGQTP

SEQ ID NO: 522709 - protein, 9 aa, Homo Sapiens
LLCCSNWDA

SEQ ID NO: 522710 - protein, 9 aa, Homo Sapiens
SELMVTAAR

SEQ ID NO: 522711 - protein, 9 aa, Homo Sapiens
EKKKDAKKN

SEQ ID NO: 522712 - protein, 9 aa, Homo Sapiens
CHKQEMEAF

SEQ ID NO: 522713 - protein, 9 aa, Homo Sapiens
NEYLGLQIG

SEQ ID NO: 522714 - protein, 9 aa, Homo Sapiens
LSFKKGEKI

SEQ ID NO: 522715 - protein, 9 aa, Homo Sapiens
NKTFLRCKA

SEQ ID NO: 522716 - protein, 9 aa, Homo Sapiens
LGNGGAKRH

SEQ ID NO: 522717 - protein, 9 aa, Homo Sapiens
SQTLEQERC

SEQ ID NO: 522718 - protein, 9 aa, Homo Sapiens
EWDFYKTLS

SEQ ID NO: 522719 - protein, 9 aa, Homo Sapiens
VGRWNYPPP

SEQ ID NO: 522720 - protein, 9 aa, Homo Sapiens
PPSLQPSHG

SEQ ID NO: 522721 - protein, 9 aa, Homo Sapiens
SEPYSQCTG

SEQ ID NO: 522722 - protein, 9 aa, Homo Sapiens
SNSNVELLL

SEQ ID NO: 522723 - protein, 9 aa, Homo Sapiens
VCYFTNWSH

SEQ ID NO: 522724 - protein, 9 aa, Homo Sapiens
RIPLFFLLL

SEQ ID NO: 522725 - protein, 9 aa, Homo Sapiens
RCQRELLEQ

SEQ ID NO: 522726 - protein, 9 aa, Homo Sapiens
VTEDIDDFT

SEQ ID NO: 522727 - protein, 9 aa, Homo Sapiens
QFQPTIRVA

SEQ ID NO: 522728 - protein, 9 aa, Homo Sapiens
LEFTDQPGV

SEQ ID NO: 522729 - protein, 9 aa, Homo Sapiens
EKIKVLEEH

SEQ ID NO: 522730 - protein, 9 aa, Homo Sapiens
QMEGMLCHK

SEQ ID NO: 522731 - protein, 9 aa, Homo Sapiens
TLKEVLEYV

SEQ ID NO: 522732 - protein, 9 aa, Homo Sapiens
QPTIRVADL

SEQ ID NO: 522733 - protein, 9 aa, Homo Sapiens
ASTCHCSAN

SEQ ID NO: 522734 - protein, 9 aa, Homo Sapiens
LQLRAHLTA

SEQ ID NO: 522735 - protein, 9 aa, Homo Sapiens
DIDDFTRNA

SEQ ID NO: 522736 - protein, 9 aa, Homo Sapiens
TSVTVKIHG

SEQ ID NO: 522737 - protein, 9 aa, Homo Sapiens
KAEGKGKRR

SEQ ID NO: 522738 - protein, 9 aa, Homo Sapiens
EMSDAFSQS

SEQ ID NO: 522739 - protein, 9 aa, Homo Sapiens
GLTSLGNTC

SEQ ID NO: 522740 - protein, 9 aa, Homo Sapiens
LYVRRQTAW

SEQ ID NO: 522741 - protein, 9 aa, Homo Sapiens
SQCTGDGSD

SEQ ID NO: 522742 - protein, 9 aa, Homo Sapiens
PSGTYLTNR

SEQ ID NO: 522743 - protein, 9 aa, Homo Sapiens
NTHQDNSIL

SEQ ID NO: 522744 - protein, 9 aa, Homo Sapiens
PKPIRCLAG

SEQ ID NO: 522745 - protein, 9 aa, Homo Sapiens
FQAGPHAVN

SEQ ID NO: 522746 - protein, 9 aa, Homo Sapiens
LISSKKSNH

SEQ ID NO: 522747 - protein, 9 aa, Homo Sapiens
QGSLCPRQY

SEQ ID NO: 522748 - protein, 9 aa, Homo Sapiens
DLPSQGILS

SEQ ID NO: 522749 - protein, 9 aa, Homo Sapiens
QLLPVEQDN

SEQ ID NO: 522750 - protein, 9 aa, Homo Sapiens
DMDLRVYGP

SEQ ID NO: 522751 - protein, 9 aa, Homo Sapiens
PTKFQRLIP

SEQ ID NO: 522752 - protein, 9 aa, Homo Sapiens
TNWSHSRPG

SEQ ID NO: 522753 - protein, 9 aa, Homo Sapiens
NSNEFLDGS

SEQ ID NO: 522754 - protein, 9 aa, Homo Sapiens
EWKRRSTAN

SEQ ID NO: 522755 - protein, 9 aa, Homo Sapiens
SLLADGFLA

SEQ ID NO: 522756 - protein, 9 aa, Homo Sapiens
SGRRAGGRA

SEQ ID NO: 522757 - protein, 9 aa, Homo Sapiens
CEQQECPVT

SEQ ID NO: 522758 - protein, 9 aa, Homo Sapiens
FKGGRQGGL

SEQ ID NO: 522759 - protein, 9 aa, Homo Sapiens
NCKSCFGSH

SEQ ID NO: 522760 - protein, 9 aa, Homo Sapiens
LNIQSTKLP

SEQ ID NO: 522761 - protein, 9 aa, Homo Sapiens
ANDLPSQGI

SEQ ID NO: 522762 - protein, 9 aa, Homo Sapiens
SRGHNQNSR

SEQ ID NO: 522763 - protein, 9 aa, Homo Sapiens
PTVAKVKCG

SEQ ID NO: 522764 - protein, 9 aa, Homo Sapiens
GLEEGSGRR

SEQ ID NO: 522765 - protein, 9 aa, Homo Sapiens
KHISEQLNA

SEQ ID NO: 522766 - protein, 9 aa, Homo Sapiens
SASMSNRSD

SEQ ID NO: 522767 - protein, 9 aa, Homo Sapiens
QHVDNHVQL

SEQ ID NO: 522768 - protein, 9 aa, Homo Sapiens
LSNSNVELL

SEQ ID NO: 522769 - protein, 9 aa, Homo Sapiens
IQSTKLPSV

SEQ ID NO: 522770 - protein, 9 aa, Homo Sapiens
QSKRQEWKR

SEQ ID NO: 522771 - protein, 9 aa, Homo Sapiens
KSKNGQTPG

SEQ ID NO: 522772 - protein, 9 aa, Homo Sapiens
VELLLSGVY

SEQ ID NO: 522773 - protein, 9 aa, Homo Sapiens
GKGLGNGGA

SEQ ID NO: 522774 - protein, 9 aa, Homo Sapiens
FKKGEKIKV

SEQ ID NO: 522775 - protein, 9 aa, Homo Sapiens
SSKPTVAKV

SEQ ID NO: 522776 - protein, 9 aa, Homo Sapiens
DQFQPTIRV

SEQ ID NO: 522777 - protein, 9 aa, Homo Sapiens
VSYLTSTYP

SEQ ID NO: 522778 - protein, 9 aa, Homo Sapiens
HLEFTDQPG

SEQ ID NO: 522779 - protein, 9 aa, Homo Sapiens
SHLHNLLWL

SEQ ID NO: 522780 - protein, 9 aa, Homo Sapiens
CPRQYGPSP

SEQ ID NO: 522781 - protein, 9 aa, Homo Sapiens
KPYYSEVIK

SEQ ID NO: 522782 - protein, 9 aa, Homo Sapiens
GTYLTNRLA

SEQ ID NO: 522783 - protein, 9 aa, Homo Sapiens
LLNILDDSG

SEQ ID NO: 522784 - protein, 9 aa, Homo Sapiens
CKHGAKGAP

SEQ ID NO: 522785 - protein, 9 aa, Homo Sapiens
CAPNCKSCF

SEQ ID NO: 522786 - protein, 9 aa, Homo Sapiens
ELSSHLHNL

SEQ ID NO: 522787 - protein, 9 aa, Homo Sapiens
GGLARDGRR

SEQ ID NO: 522788 - protein, 9 aa, Homo Sapiens
HVDNHVQLA

SEQ ID NO: 522789 - protein, 9 aa, Homo Sapiens
TQKPYYSEV

SEQ ID NO: 522790 - protein, 9 aa, Homo Sapiens
LDLHEINNW

SEQ ID NO: 522791 - protein, 9 aa, Homo Sapiens
LYTGWSLWL

SEQ ID NO: 522792 - protein, 9 aa, Homo Sapiens
WSHSRPGPA

SEQ ID NO: 522793 - protein, 9 aa, Homo Sapiens
GRWNYPPPL

SEQ ID NO: 522794 - protein, 9 aa, Homo Sapiens
QKTFLLLYT

SEQ ID NO: 522795 - protein, 9 aa, Homo Sapiens
ATFLNIQST

SEQ ID NO: 522796 - protein, 9 aa, Homo Sapiens
GINELSSHL

SEQ ID NO: 522797 - protein, 9 aa, Homo Sapiens
GSGRRAGGR

SEQ ID NO: 522798 - protein, 9 aa, Homo Sapiens
ARGLTLKEV

SEQ ID NO: 522799 - protein, 9 aa, Homo Sapiens
LSSHLHNLL

SEQ ID NO: 522800 - protein, 9 aa, Homo Sapiens
SCEQQECPV

SEQ ID NO: 522801 - protein, 9 aa, Homo Sapiens
GQGCRALSS

SEQ ID NO: 522802 - protein, 9 aa, Homo Sapiens
GKRRPGGFE

SEQ ID NO: 522803 - protein, 9 aa, Homo Sapiens
NKLSSGNSK

SEQ ID NO: 522804 - protein, 9 aa, Homo Sapiens
RQTAWMRLS

SEQ ID NO: 522805 - protein, 9 aa, Homo Sapiens
VHRLLRKCN

SEQ ID NO: 522806 - protein, 9 aa, Homo Sapiens
PWKRHEFSI

SEQ ID NO: 522807 - protein, 9 aa, Homo Sapiens
TARGLTLKE

SEQ ID NO: 522808 - protein, 9 aa, Homo Sapiens
ATLSNSNVE

SEQ ID NO: 522809 - protein, 9 aa, Homo Sapiens
GPQQQFLVI

SEQ ID NO: 522810 - protein, 9 aa, Homo Sapiens
EDIDDFTRN

SEQ ID NO: 522811 - protein, 9 aa, Homo Sapiens
HDLLNILDD

SEQ ID NO: 522812 - protein, 9 aa, Homo Sapiens
ENQHVDNHV

SEQ ID NO: 522813 - protein, 9 aa, Homo Sapiens
PWKKRARAD

SEQ ID NO: 522814 - protein, 9 aa, Homo Sapiens
GGQGCRALS

SEQ ID NO: 522815 - protein, 9 aa, Homo Sapiens
LLPVEQDNP

SEQ ID NO: 522816 - protein, 9 aa, Homo Sapiens
VGDVGQTVN

SEQ ID NO: 522817 - protein, 9 aa, Homo Sapiens
EFTDQPGVS

SEQ ID NO: 522818 - protein, 9 aa, Homo Sapiens
GHNQNSRRP

SEQ ID NO: 522819 - protein, 9 aa, Homo Sapiens
IPGRENCKD

SEQ ID NO: 522820 - protein, 9 aa, Homo Sapiens
YVRRQTAWM

SEQ ID NO: 522821 - protein, 9 aa, Homo Sapiens
SPPCQLSES

SEQ ID NO: 522822 - protein, 9 aa, Homo Sapiens
SEKEKKHIS

SEQ ID NO: 522823 - protein, 9 aa, Homo Sapiens
GFCSQLQKY

SEQ ID NO: 522824 - protein, 9 aa, Homo Sapiens
ITQVVRIAV

SEQ ID NO: 522825 - protein, 9 aa, Homo Sapiens
LCHKQEMEA

SEQ ID NO: 522826 - protein, 9 aa, Homo Sapiens
YPWPPMHQS

SEQ ID NO: 522827 - protein, 9 aa, Homo Sapiens
RGHNQNSRR

SEQ ID NO: 522828 - protein, 9 aa, Homo Sapiens
GNPRLDLHE

SEQ ID NO: 522829 - protein, 9 aa, Homo Sapiens
GGKGLGNGG

SEQ ID NO: 522830 - protein, 9 aa, Homo Sapiens
SPCPPSLQP

SEQ ID NO: 522831 - protein, 9 aa, Homo Sapiens
TAMERPSFL

SEQ ID NO: 522832 - protein, 9 aa, Homo Sapiens
MPCKHGAKG

SEQ ID NO: 522833 - protein, 9 aa, Homo Sapiens
DRAEQEMEV

SEQ ID NO: 522834 - protein, 9 aa, Homo Sapiens
VHIRPTRPF

SEQ ID NO: 522835 - protein, 9 aa, Homo Sapiens
ATKHETLVI

SEQ ID NO: 522836 - protein, 9 aa, Homo Sapiens
VIKQTSLWL

SEQ ID NO: 522837 - protein, 9 aa, Homo Sapiens
HPISAHEAT

SEQ ID NO: 522838 - protein, 9 aa, Homo Sapiens
AFPDDMDLR

SEQ ID NO: 522839 - protein, 9 aa, Homo Sapiens
FGDCGGSDN

SEQ ID NO: 522840 - protein, 9 aa, Homo Sapiens
GSDNEEEST

SEQ ID NO: 522841 - protein, 9 aa, Homo Sapiens
VMNVSDAHS

SEQ ID NO: 522842 - protein, 9 aa, Homo Sapiens
DPGYPKPIR

SEQ ID NO: 522843 - protein, 9 aa, Homo Sapiens
TFLNIQSTK

SEQ ID NO: 522844 - protein, 9 aa, Homo Sapiens
VNKLSSGNS

SEQ ID NO: 522845 - protein, 9 aa, Homo Sapiens
DGIRGLSFS

SEQ ID NO: 522846 - protein, 9 aa, Homo Sapiens
KIKVLEEHG

SEQ ID NO: 522847 - protein, 9 aa, Homo Sapiens
LDGTDNEYL

SEQ ID NO: 522848 - protein, 9 aa, Homo Sapiens
RGGLGGQGC

SEQ ID NO: 522849 - protein, 9 aa, Homo Sapiens
ASKSASMSN

SEQ ID NO: 522850 - protein, 9 aa, Homo Sapiens
LERLRPHVP

SEQ ID NO: 522851 - protein, 9 aa, Homo Sapiens
GQTVNDPYA

SEQ ID NO: 522852 - protein, 9 aa, Homo Sapiens
AAIRQCIPV

SEQ ID NO: 522853 - protein, 9 aa, Homo Sapiens
SSKKSNHYS

SEQ ID NO: 522854 - protein, 9 aa, Homo Sapiens
FFLLLGFYT

SEQ ID NO: 522855 - protein, 9 aa, Homo Sapiens
SQRGHSRGH

SEQ ID NO: 522856 - protein, 9 aa, Homo Sapiens
CGALAGLER

SEQ ID NO: 522857 - protein, 9 aa, Homo Sapiens
QCLNEKEEV

SEQ ID NO: 522858 - protein, 9 aa, Homo Sapiens
CEMNERAEE

SEQ ID NO: 522859 - protein, 9 aa, Homo Sapiens
HHEDRAGHR

SEQ ID NO: 522860 - protein, 9 aa, Homo Sapiens
AGLFAKIVM

SEQ ID NO: 522861 - protein, 9 aa, Homo Sapiens
KRRPGGFEA

SEQ ID NO: 522862 - protein, 9 aa, Homo Sapiens
LCPRQYGPS

SEQ ID NO: 522863 - protein, 9 aa, Homo Sapiens
GSLCPRQYG

SEQ ID NO: 522864 - protein, 9 aa, Homo Sapiens
VESFAPMLR

SEQ ID NO: 522865 - protein, 9 aa, Homo Sapiens
ERCQRELLE

SEQ ID NO: 522866 - protein, 9 aa, Homo Sapiens
SEPRASKSA

SEQ ID NO: 522867 - protein, 9 aa, Homo Sapiens
QQEWDFYKT

SEQ ID NO: 522868 - protein, 9 aa, Homo Sapiens
YGDNSDENP

SEQ ID NO: 522869 - protein, 9 aa, Homo Sapiens
GLERLRPHV

SEQ ID NO: 522870 - protein, 9 aa, Homo Sapiens
LRIPLFFLL

SEQ ID NO: 522871 - protein, 9 aa, Homo Sapiens
HSRGHNQNS

SEQ ID NO: 522872 - protein, 9 aa, Homo Sapiens
DGDNDYGDN

SEQ ID NO: 522873 - protein, 9 aa, Homo Sapiens
TSTYPWPPM

SEQ ID NO: 522874 - protein, 9 aa, Homo Sapiens
DSKKDEKKK

SEQ ID NO: 522875 - protein, 9 aa, Homo Sapiens
PLRRRPGPA

SEQ ID NO: 522876 - protein, 9 aa, Homo Sapiens
MVYIVTEDI

SEQ ID NO: 522877 - protein, 9 aa, Homo Sapiens
WEDILENQH

SEQ ID NO: 522878 - protein, 9 aa, Homo Sapiens
VVRIAVPTP

SEQ ID NO: 522879 - protein, 9 aa, Homo Sapiens
QSTKLPSVD

SEQ ID NO: 522880 - protein, 9 aa, Homo Sapiens
KHETLVIKK

SEQ ID NO: 522881 - protein, 9 aa, Homo Sapiens
SAASTAMER

SEQ ID NO: 522882 - protein, 9 aa, Homo Sapiens
FLVIKQTSL

SEQ ID NO: 522883 - protein, 9 aa, Homo Sapiens
PRGGLGGQG

SEQ ID NO: 522884 - protein, 9 aa, Homo Sapiens
GLSFSAARY

SEQ ID NO: 522885 - protein, 9 aa, Homo Sapiens
EPYSQCTGD

SEQ ID NO: 522886 - protein, 9 aa, Homo Sapiens
DCNGNSNEF

SEQ ID NO: 522887 - protein, 9 aa, Homo Sapiens
EKKHISEQL

SEQ ID NO: 522888 - protein, 9 aa, Homo Sapiens
CSQLQKYEE

SEQ ID NO: 522889 - protein, 9 aa, Homo Sapiens
SSDSSVSQS

SEQ ID NO: 522890 - protein, 9 aa, Homo Sapiens
QTAWMRLSK

SEQ ID NO: 522891 - protein, 9 aa, Homo Sapiens
SEAPQPPWK

SEQ ID NO: 522892 - protein, 9 aa, Homo Sapiens
ISAHEATLR

SEQ ID NO: 522893 - protein, 9 aa, Homo Sapiens
LPSQGILSQ

SEQ ID NO: 522894 - protein, 9 aa, Homo Sapiens
PCQLSESEK

SEQ ID NO: 522895 - protein, 9 aa, Homo Sapiens
FVGTITGDW

SEQ ID NO: 522896 - protein, 9 aa, Homo Sapiens
SSLLADGFL

SEQ ID NO: 522897 - protein, 9 aa, Homo Sapiens
RFFLISSKK

SEQ ID NO: 522898 - protein, 9 aa, Homo Sapiens
VTAARGGDP

SEQ ID NO: 522899 - protein, 9 aa, Homo Sapiens
GRRSSKPTV

SEQ ID NO: 522900 - protein, 9 aa, Homo Sapiens
VCDMDEEIE

SEQ ID NO: 522901 - protein, 9 aa, Homo Sapiens
MPGMPCKHG

SEQ ID NO: 522902 - protein, 9 aa, Homo Sapiens
KKDSKKDEK

SEQ ID NO: 522903 - protein, 9 aa, Homo Sapiens
AEPNPGFCS

SEQ ID NO: 522904 - protein, 9 aa, Homo Sapiens
SHSRPGPAS

SEQ ID NO: 522905 - protein, 9 aa, Homo Sapiens
PGMPCKHGA

SEQ ID NO: 522906 - protein, 9 aa, Homo Sapiens
HHPISAHEA

SEQ ID NO: 522907 - protein, 9 aa, Homo Sapiens
HEINNWVQA

SEQ ID NO: 522908 - protein, 9 aa, Homo Sapiens
SPLALSADL

SEQ ID NO: 522909 - protein, 9 aa, Homo Sapiens
YGPSPKFQL

SEQ ID NO: 522910 - protein, 9 aa, Homo Sapiens
VNWEPWKRH

SEQ ID NO: 522911 - protein, 9 aa, Homo Sapiens
KIHGVHLGQ

SEQ ID NO: 522912 - protein, 9 aa, Homo Sapiens
ILSSLLADG

SEQ ID NO: 522913 - protein, 9 aa, Homo Sapiens
GIRGLSFSA

SEQ ID NO: 522914 - protein, 9 aa, Homo Sapiens
EPNPGFCSQ

SEQ ID NO: 522915 - protein, 9 aa, Homo Sapiens
IVLDGTDNE

SEQ ID NO: 522916 - protein, 9 aa, Homo Sapiens
KNGQTPGGA

SEQ ID NO: 522917 - protein, 9 aa, Homo Sapiens
VKIHGVHLG

SEQ ID NO: 522918 - protein, 9 aa, Homo Sapiens
PRLDLHEIN

SEQ ID NO: 522919 - protein, 9 aa, Homo Sapiens
CGGSDNEEE

SEQ ID NO: 522920 - protein, 9 aa, Homo Sapiens
GDNDYGDNS

SEQ ID NO: 522921 - protein, 9 aa, Homo Sapiens
LLGFYTVTV

SEQ ID NO: 522922 - protein, 9 aa, Homo Sapiens
DKSLLLCCS

SEQ ID NO: 522923 - protein, 9 aa, Homo Sapiens
CRKCAPNCK

SEQ ID NO: 522924 - protein, 9 aa, Homo Sapiens
CMPGTVGRW

SEQ ID NO: 522925 - protein, 9 aa, Homo Sapiens
RASKSASMS

SEQ ID NO: 522926 - protein, 9 aa, Homo Sapiens
CYFTNWSHS

SEQ ID NO: 522927 - protein, 9 aa, Homo Sapiens
RQEWKRRST

SEQ ID NO: 522928 - protein, 9 aa, Homo Sapiens
VGTITGDWR

SEQ ID NO: 522929 - protein, 9 aa, Homo Sapiens
NIQSTKLPS

SEQ ID NO: 522930 - protein, 9 aa, Homo Sapiens
KKGEKIKVL

SEQ ID NO: 522931 - protein, 9 aa, Homo Sapiens
RRAGGRAGG

SEQ ID NO: 522932 - protein, 9 aa, Homo Sapiens
TQGELKRIT

SEQ ID NO: 522933 - protein, 9 aa, Homo Sapiens
EGNVAVHIR

SEQ ID NO: 522934 - protein, 9 aa, Homo Sapiens
FCYQIRCCT

SEQ ID NO: 522935 - protein, 9 aa, Homo Sapiens
LIPGRENCK

SEQ ID NO: 522936 - protein, 9 aa, Homo Sapiens
QEWKRRSTA

SEQ ID NO: 522937 - protein, 9 aa, Homo Sapiens
NELSSHLHN

SEQ ID NO: 522938 - protein, 9 aa, Homo Sapiens
KTFLRCKAK

SEQ ID NO: 522939 - protein, 9 aa, Homo Sapiens
GNGGAKRHR

SEQ ID NO: 522940 - protein, 9 aa, Homo Sapiens
AHLTASCWA

SEQ ID NO: 522941 - protein, 9 aa, Homo Sapiens
IRCCTDDVR

SEQ ID NO: 522942 - protein, 9 aa, Homo Sapiens
TVNDPYATF

SEQ ID NO: 522943 - protein, 9 aa, Homo Sapiens
RLDLHEINN

SEQ ID NO: 522944 - protein, 9 aa, Homo Sapiens
YILSSLLAD

SEQ ID NO: 522945 - protein, 9 aa, Homo Sapiens
RCLAGDPCL

SEQ ID NO: 522946 - protein, 9 aa, Homo Sapiens
LRAHLTASC

SEQ ID NO: 522947 - protein, 9 aa, Homo Sapiens
GMPGMPCKH

SEQ ID NO: 522948 - protein, 9 aa, Homo Sapiens
INELSSHLH

SEQ ID NO: 522949 - protein, 9 aa, Homo Sapiens
GNSNEFLDG

SEQ ID NO: 522950 - protein, 9 aa, Homo Sapiens
DTKNTHQDN

SEQ ID NO: 522951 - protein, 9 aa, Homo Sapiens
EPRASKSAS

SEQ ID NO: 522952 - protein, 9 aa, Homo Sapiens
RAGHRHSAD

SEQ ID NO: 522953 - protein, 9 aa, Homo Sapiens
VDRCLQSPC

SEQ ID NO: 522954 - protein, 9 aa, Homo Sapiens
GMLCHKQEM

SEQ ID NO: 522955 - protein, 9 aa, Homo Sapiens
LKRITLVLQ

SEQ ID NO: 522956 - protein, 9 aa, Homo Sapiens
PPCQLSESE

SEQ ID NO: 522957 - protein, 9 aa, Homo Sapiens
RKCNYSERV

SEQ ID NO: 522958 - protein, 9 aa, Homo Sapiens
NDYGDNSDE

SEQ ID NO: 522959 - protein, 9 aa, Homo Sapiens
IVTEDIDDF

SEQ ID NO: 522960 - protein, 9 aa, Homo Sapiens
YSDIHDLLN

SEQ ID NO: 522961 - protein, 9 aa, Homo Sapiens
WDFYKTLSL

SEQ ID NO: 522962 - protein, 9 aa, Homo Sapiens
KKDEKKKDA

SEQ ID NO: 522963 - protein, 9 aa, Homo Sapiens
MPGTVGRWN

SEQ ID NO: 522964 - protein, 9 aa, Homo Sapiens
LRKCNYSER

SEQ ID NO: 522965 - protein, 9 aa, Homo Sapiens
GHMTVKEPP

SEQ ID NO: 522966 - protein, 9 aa, Homo Sapiens
GSSDSSVSQ

SEQ ID NO: 522967 - protein, 9 aa, Homo Sapiens
KRARLQRSC

SEQ ID NO: 522968 - protein, 9 aa, Homo Sapiens
LWAGSTGLA

SEQ ID NO: 522969 - protein, 9 aa, Homo Sapiens
KSLLLCCSN

SEQ ID NO: 522970 - protein, 9 aa, Homo Sapiens
QRLIPGREN

SEQ ID NO: 522971 - protein, 9 aa, Homo Sapiens
LVIKQTSLW

SEQ ID NO: 522972 - protein, 9 aa, Homo Sapiens
AASQPLRRR

SEQ ID NO: 522973 - protein, 9 aa, Homo Sapiens
MEMSDAFSQ

SEQ ID NO: 522974 - protein, 9 aa, Homo Sapiens
SCMPGTVGR

SEQ ID NO: 522975 - protein, 9 aa, Homo Sapiens
FLISSKKSN

SEQ ID NO: 522976 - protein, 9 aa, Homo Sapiens
CSGHMTVKE

SEQ ID NO: 522977 - protein, 9 aa, Homo Sapiens
LLLGFYTVT

SEQ ID NO: 522978 - protein, 9 aa, Homo Sapiens
LALSADLVP

SEQ ID NO: 522979 - protein, 9 aa, Homo Sapiens
LKSTLSSME

SEQ ID NO: 522980 - protein, 9 aa, Homo Sapiens
EGKGKRRPG

SEQ ID NO: 522981 - protein, 9 aa, Homo Sapiens
RCKAKNYSG

SEQ ID NO: 522982 - protein, 9 aa, Homo Sapiens
ETLVIKKSV

SEQ ID NO: 522983 - protein, 9 aa, Homo Sapiens
NGQTPGGAQ

SEQ ID NO: 522984 - protein, 9 aa, Homo Sapiens
NQCSGHMTV

SEQ ID NO: 522985 - protein, 9 aa, Homo Sapiens
QGGLARDGR

SEQ ID NO: 522986 - protein, 9 aa, Homo Sapiens
PGSSDSSVS

SEQ ID NO: 522987 - protein, 9 aa, Homo Sapiens
HLHNLLWLV

SEQ ID NO: 522988 - protein, 9 aa, Homo Sapiens
KAKNYSGRF

SEQ ID NO: 522989 - protein, 9 aa, Homo Sapiens
PSPPCQLSE

SEQ ID NO: 522990 - protein, 9 aa, Homo Sapiens
QRGHSRGHN

SEQ ID NO: 522991 - protein, 9 aa, Homo Sapiens
KNTHQDNSI

SEQ ID NO: 522992 - protein, 9 aa, Homo Sapiens
VKILDPVCD

SEQ ID NO: 522993 - protein, 9 aa, Homo Sapiens
LKAEGKGKR

SEQ ID NO: 522994 - protein, 9 aa, Homo Sapiens
DRAGHRHSA

SEQ ID NO: 522995 - protein, 9 aa, Homo Sapiens
LLRKCNYSE

SEQ ID NO: 522996 - protein, 9 aa, Homo Sapiens
GPHAVNKLS

SEQ ID NO: 522997 - protein, 9 aa, Homo Sapiens
SYLTSTYPW

SEQ ID NO: 522998 - protein, 9 aa, Homo Sapiens
NVELLLSGV

SEQ ID NO: 522999 - protein, 9 aa, Homo Sapiens
NGNSNEFLD

SEQ ID NO: 523000 - protein, 9 aa, Homo Sapiens
GELKRITLV

SEQ ID NO: 523001 - protein, 9 aa, Homo Sapiens
PVRGPWDLG

SEQ ID NO: 523002 - protein, 9 aa, Homo Sapiens
KKHKKKHKQ

SEQ ID NO: 523003 - protein, 9 aa, Homo Sapiens
QPGICGLTS

SEQ ID NO: 523004 - protein, 9 aa, Homo Sapiens
YSQCTGDGS

SEQ ID NO: 523005 - protein, 9 aa, Homo Sapiens
SKKSNHYSL

SEQ ID NO: 523006 - protein, 9 aa, Homo Sapiens
HKQEMEAFG

SEQ ID NO: 523007 - protein, 9 aa, Homo Sapiens
ASQPLRRRP

SEQ ID NO: 523008 - protein, 9 aa, Homo Sapiens
GDGSDVPIR

SEQ ID NO: 523009 - protein, 9 aa, Homo Sapiens
LPSPPCQLS

SEQ ID NO: 523010 - protein, 9 aa, Homo Sapiens
RSSKPTVAK

SEQ ID NO: 523011 - protein, 9 aa, Homo Sapiens
GTVGRWNYP

SEQ ID NO: 523012 - protein, 9 aa, Homo Sapiens
EYLGLQIGQ

SEQ ID NO: 523013 - protein, 9 aa, Homo Sapiens
PGYPKPIRC

SEQ ID NO: 523014 - protein, 9 aa, Homo Sapiens
GKGKRRPGG

SEQ ID NO: 523015 - protein, 9 aa, Homo Sapiens
QYGPSPKFQ

SEQ ID NO: 523016 - protein, 9 aa, Homo Sapiens
RCCTDDVRP

SEQ ID NO: 523017 - protein, 9 aa, Homo Sapiens
PQQQFLVIK

SEQ ID NO: 523018 - protein, 9 aa, Homo Sapiens
TLSSMEMSD

SEQ ID NO: 523019 - protein, 9 aa, Homo Sapiens
CQRELLEQH

SEQ ID NO: 523020 - protein, 9 aa, Homo Sapiens
LDPVCDMDE

SEQ ID NO: 523021 - protein, 9 aa, Homo Sapiens
TEDIDDFTR

SEQ ID NO: 523022 - protein, 9 aa, Homo Sapiens
SISTATAAQ

SEQ ID NO: 523023 - protein, 9 aa, Homo Sapiens
HAAFTGSQD

SEQ ID NO: 523024 - protein, 9 aa, Homo Sapiens
AAPVCSSRT

SEQ ID NO: 523025 - protein, 9 aa, Homo Sapiens
LQLILQISE

SEQ ID NO: 523026 - protein, 9 aa, Homo Sapiens
QYTHLSIYD

SEQ ID NO: 523027 - protein, 9 aa, Homo Sapiens
GGCWDPLVD

SEQ ID NO: 523028 - protein, 9 aa, Homo Sapiens
LLALYKDKK

SEQ ID NO: 523029 - protein, 9 aa, Homo Sapiens
SASPSSSPG

SEQ ID NO: 523030 - protein, 9 aa, Homo Sapiens
KREPGELSG

SEQ ID NO: 523031 - protein, 9 aa, Homo Sapiens
VQPCLGPAE

SEQ ID NO: 523032 - protein, 9 aa, Homo Sapiens
KHKPKIKGN

SEQ ID NO: 523033 - protein, 9 aa, Homo Sapiens
QSFLLLLFQ

SEQ ID NO: 523034 - protein, 9 aa, Homo Sapiens
FYLSALDQF

SEQ ID NO: 523035 - protein, 9 aa, Homo Sapiens
DNGNNASPT

SEQ ID NO: 523036 - protein, 9 aa, Homo Sapiens
QHCVCWLRS

SEQ ID NO: 523037 - protein, 9 aa, Homo Sapiens
STGLPLIQL

SEQ ID NO: 523038 - protein, 9 aa, Homo Sapiens
MPCTGGCWD

SEQ ID NO: 523039 - protein, 9 aa, Homo Sapiens
KDACHKKCD

SEQ ID NO: 523040 - protein, 9 aa, Homo Sapiens
LFSLGSFNW

SEQ ID NO: 523041 - protein, 9 aa, Homo Sapiens
LRKQGLMNL

SEQ ID NO: 523042 - protein, 9 aa, Homo Sapiens
SLLQEGIYF

SEQ ID NO: 523043 - protein, 9 aa, Homo Sapiens
SLALSLAVQ

SEQ ID NO: 523044 - protein, 9 aa, Homo Sapiens
PCLGPAEAG

SEQ ID NO: 523045 - protein, 9 aa, Homo Sapiens
GTHNEIRWL

SEQ ID NO: 523046 - protein, 9 aa, Homo Sapiens
DQPPNSLYM

SEQ ID NO: 523047 - protein, 9 aa, Homo Sapiens
DCSENIDYC

SEQ ID NO: 523048 - protein, 9 aa, Homo Sapiens
PTALQLILQ

SEQ ID NO: 523049 - protein, 9 aa, Homo Sapiens
GFDGWMKID

SEQ ID NO: 523050 - protein, 9 aa, Homo Sapiens
VAGKIREGK

SEQ ID NO: 523051 - protein, 9 aa, Homo Sapiens
PRSISTATA

SEQ ID NO: 523052 - protein, 9 aa, Homo Sapiens
QQHQHQHQQ

SEQ ID NO: 523053 - protein, 9 aa, Homo Sapiens
VHRVDFPCS

SEQ ID NO: 523054 - protein, 9 aa, Homo Sapiens
YIHTHTFYV

SEQ ID NO: 523055 - protein, 9 aa, Homo Sapiens
NTATDDSKL

SEQ ID NO: 523056 - protein, 9 aa, Homo Sapiens
DLRKQGLMN

SEQ ID NO: 523057 - protein, 9 aa, Homo Sapiens
LRITAESVC

SEQ ID NO: 523058 - protein, 9 aa, Homo Sapiens
AEPTIRNTA

SEQ ID NO: 523059 - protein, 9 aa, Homo Sapiens
LGFKLSRWN

SEQ ID NO: 523060 - protein, 9 aa, Homo Sapiens
AGRTALDLA

SEQ ID NO: 523061 - protein, 9 aa, Homo Sapiens
ALTVKSISV

SEQ ID NO: 523062 - protein, 9 aa, Homo Sapiens
TFLLGKGIR

SEQ ID NO: 523063 - protein, 9 aa, Homo Sapiens
NASPGGSED

SEQ ID NO: 523064 - protein, 9 aa, Homo Sapiens
PFNSLLSPL

SEQ ID NO: 523065 - protein, 9 aa, Homo Sapiens
EILSATEHF

SEQ ID NO: 523066 - protein, 9 aa, Homo Sapiens
SLSSLNSSR

SEQ ID NO: 523067 - protein, 9 aa, Homo Sapiens
QQQHQHQHQ

SEQ ID NO: 523068 - protein, 9 aa, Homo Sapiens
YPVSSHHSI

SEQ ID NO: 523069 - protein, 9 aa, Homo Sapiens
CHKKCDQKK

SEQ ID NO: 523070 - protein, 9 aa, Homo Sapiens
GNPTALQLI

SEQ ID NO: 523071 - protein, 9 aa, Homo Sapiens
RHQQSPDSS

SEQ ID NO: 523072 - protein, 9 aa, Homo Sapiens
SCGYPTLCS

SEQ ID NO: 523073 - protein, 9 aa, Homo Sapiens
TVKSISVSL

SEQ ID NO: 523074 - protein, 9 aa, Homo Sapiens
TRSCGYPTL

SEQ ID NO: 523075 - protein, 9 aa, Homo Sapiens
PGLSQFYLS

SEQ ID NO: 523076 - protein, 9 aa, Homo Sapiens
SFSTNVLLI

SEQ ID NO: 523077 - protein, 9 aa, Homo Sapiens
TNRCELCTC

SEQ ID NO: 523078 - protein, 9 aa, Homo Sapiens
VTSFSSVST

SEQ ID NO: 523079 - protein, 9 aa, Homo Sapiens
FEKYFNRKA

SEQ ID NO: 523080 - protein, 9 aa, Homo Sapiens
IDYCAFASC

SEQ ID NO: 523081 - protein, 9 aa, Homo Sapiens
LCLYKGSLG

SEQ ID NO: 523082 - protein, 9 aa, Homo Sapiens
TWQFSQFMM

SEQ ID NO: 523083 - protein, 9 aa, Homo Sapiens
SPTFLLGKG

SEQ ID NO: 523084 - protein, 9 aa, Homo Sapiens
HGSRHQQSP

SEQ ID NO: 523085 - protein, 9 aa, Homo Sapiens
AYWNLGFKL

SEQ ID NO: 523086 - protein, 9 aa, Homo Sapiens
GLYSHVLDQ

SEQ ID NO: 523087 - protein, 9 aa, Homo Sapiens
DYPVSSHHS

SEQ ID NO: 523088 - protein, 9 aa, Homo Sapiens
PIKGFDGWM

SEQ ID NO: 523089 - protein, 9 aa, Homo Sapiens
IKKKKKKKG

SEQ ID NO: 523090 - protein, 9 aa, Homo Sapiens
ECQPQMPKQ

SEQ ID NO: 523091 - protein, 9 aa, Homo Sapiens
LMSKILQRI

SEQ ID NO: 523092 - protein, 9 aa, Homo Sapiens
SEDNKRAYM

SEQ ID NO: 523093 - protein, 9 aa, Homo Sapiens
VRELHDIFT

SEQ ID NO: 523094 - protein, 9 aa, Homo Sapiens
LYKDKKERP

SEQ ID NO: 523095 - protein, 9 aa, Homo Sapiens
DPFLCIFLP

SEQ ID NO: 523096 - protein, 9 aa, Homo Sapiens
DFLWGEGAT

SEQ ID NO: 523097 - protein, 9 aa, Homo Sapiens
CNEESGYLV

SEQ ID NO: 523098 - protein, 9 aa, Homo Sapiens
SSWISKREP

SEQ ID NO: 523099 - protein, 9 aa, Homo Sapiens
IKESQQGPK

SEQ ID NO: 523100 - protein, 9 aa, Homo Sapiens
NCYLFSLGS

SEQ ID NO: 523101 - protein, 9 aa, Homo Sapiens
FCGSLGPGA

SEQ ID NO: 523102 - protein, 9 aa, Homo Sapiens
ERSVRELHD

SEQ ID NO: 523103 - protein, 9 aa, Homo Sapiens
LKQILGPEE

SEQ ID NO: 523104 - protein, 9 aa, Homo Sapiens
SLVIEDKEC

SEQ ID NO: 523105 - protein, 9 aa, Homo Sapiens
VTWIYLFSG

SEQ ID NO: 523106 - protein, 9 aa, Homo Sapiens
AVTWIYLFS

SEQ ID NO: 523107 - protein, 9 aa, Homo Sapiens
IQYTHLSIY

SEQ ID NO: 523108 - protein, 9 aa, Homo Sapiens
LDLPLKQIL

SEQ ID NO: 523109 - protein, 9 aa, Homo Sapiens
PTFLLGKGI

SEQ ID NO: 523110 - protein, 9 aa, Homo Sapiens
EKDACHKKC

SEQ ID NO: 523111 - protein, 9 aa, Homo Sapiens
RTLLEGGAN

SEQ ID NO: 523112 - protein, 9 aa, Homo Sapiens
GDNGFLIHL

SEQ ID NO: 523113 - protein, 9 aa, Homo Sapiens
PGELSGVWT

SEQ ID NO: 523114 - protein, 9 aa, Homo Sapiens
SVRELHDIF

SEQ ID NO: 523115 - protein, 9 aa, Homo Sapiens
APVCSSRTL

SEQ ID NO: 523116 - protein, 9 aa, Homo Sapiens
RDRAIKESQ

SEQ ID NO: 523117 - protein, 9 aa, Homo Sapiens
SRTLQAEVP

SEQ ID NO: 523118 - protein, 9 aa, Homo Sapiens
DIFQPPLFG

SEQ ID NO: 523119 - protein, 9 aa, Homo Sapiens
RTLQAEVPL

SEQ ID NO: 523120 - protein, 9 aa, Homo Sapiens
VCLPDVVLL

SEQ ID NO: 523121 - protein, 9 aa, Homo Sapiens
FRNICGQPE

SEQ ID NO: 523122 - protein, 9 aa, Homo Sapiens
LSLALSLAV

SEQ ID NO: 523123 - protein, 9 aa, Homo Sapiens
KVFDCNEES

SEQ ID NO: 523124 - protein, 9 aa, Homo Sapiens
GYPTLCSSW

SEQ ID NO: 523125 - protein, 9 aa, Homo Sapiens
LKFEKYFNR

SEQ ID NO: 523126 - protein, 9 aa, Homo Sapiens
RWAKDQNSL

SEQ ID NO: 523127 - protein, 9 aa, Homo Sapiens
QLERSVREL

SEQ ID NO: 523128 - protein, 9 aa, Homo Sapiens
SYSSTGLPL

SEQ ID NO: 523129 - protein, 9 aa, Homo Sapiens
PVSSHHSII

SEQ ID NO: 523130 - protein, 9 aa, Homo Sapiens
LRCRTARRP

SEQ ID NO: 523131 - protein, 9 aa, Homo Sapiens
FNSLLSPLC

SEQ ID NO: 523132 - protein, 9 aa, Homo Sapiens
SRSGGEQDY

SEQ ID NO: 523133 - protein, 9 aa, Homo Sapiens
IYIYTHIYI

SEQ ID NO: 523134 - protein, 9 aa, Homo Sapiens
SVCLPDVVL

SEQ ID NO: 523135 - protein, 9 aa, Homo Sapiens
ISPSSCSSW

SEQ ID NO: 523136 - protein, 9 aa, Homo Sapiens
LGYIGTHNE

SEQ ID NO: 523137 - protein, 9 aa, Homo Sapiens
DDCSENIDY

SEQ ID NO: 523138 - protein, 9 aa, Homo Sapiens
ERCGFCGSL

SEQ ID NO: 523139 - protein, 9 aa, Homo Sapiens
AWRTHAAFT

SEQ ID NO: 523140 - protein, 9 aa, Homo Sapiens
FLPIPLPHT

SEQ ID NO: 523141 - protein, 9 aa, Homo Sapiens
SFTRSCGYP

SEQ ID NO: 523142 - protein, 9 aa, Homo Sapiens
QDLCLYKGS

SEQ ID NO: 523143 - protein, 9 aa, Homo Sapiens
RIANHVLFT

SEQ ID NO: 523144 - protein, 9 aa, Homo Sapiens
CTPLNRLFM

SEQ ID NO: 523145 - protein, 9 aa, Homo Sapiens
ISKREPGEL

SEQ ID NO: 523146 - protein, 9 aa, Homo Sapiens
SSRTLQAEV

SEQ ID NO: 523147 - protein, 9 aa, Homo Sapiens
YEEDFQAPF

SEQ ID NO: 523148 - protein, 9 aa, Homo Sapiens
EAGQPQSVP

SEQ ID NO: 523149 - protein, 9 aa, Homo Sapiens
LCSSWISKR

SEQ ID NO: 523150 - protein, 9 aa, Homo Sapiens
TSYSSTGLP

SEQ ID NO: 523151 - protein, 9 aa, Homo Sapiens
QKEKDACHK

SEQ ID NO: 523152 - protein, 9 aa, Homo Sapiens
SSSPGHAPA

SEQ ID NO: 523153 - protein, 9 aa, Homo Sapiens
KCQLEGSGH

SEQ ID NO: 523154 - protein, 9 aa, Homo Sapiens
RIESFIQSL

SEQ ID NO: 523155 - protein, 9 aa, Homo Sapiens
QKCQLEGSG

SEQ ID NO: 523156 - protein, 9 aa, Homo Sapiens
FIQSLQDLS

SEQ ID NO: 523157 - protein, 9 aa, Homo Sapiens
YTHLSIYDN

SEQ ID NO: 523158 - protein, 9 aa, Homo Sapiens
TATDDSKLL

SEQ ID NO: 523159 - protein, 9 aa, Homo Sapiens
ALQLILQIS

SEQ ID NO: 523160 - protein, 9 aa, Homo Sapiens
QVTSYSSTG

SEQ ID NO: 523161 - protein, 9 aa, Homo Sapiens
KASGSPTFL

SEQ ID NO: 523162 - protein, 9 aa, Homo Sapiens
KECQPQMPK

SEQ ID NO: 523163 - protein, 9 aa, Homo Sapiens
CWDPLVDYL

SEQ ID NO: 523164 - protein, 9 aa, Homo Sapiens
DKECQPQMP

SEQ ID NO: 523165 - protein, 9 aa, Homo Sapiens
LDPRSISTA

SEQ ID NO: 523166 - protein, 9 aa, Homo Sapiens
GACGLSGEK

SEQ ID NO: 523167 - protein, 9 aa, Homo Sapiens
FSLTWQFSQ

SEQ ID NO: 523168 - protein, 9 aa, Homo Sapiens
SSGGAPSPF

SEQ ID NO: 523169 - protein, 9 aa, Homo Sapiens
WAKDQNSLL

SEQ ID NO: 523170 - protein, 9 aa, Homo Sapiens
GSCGSASPS

SEQ ID NO: 523171 - protein, 9 aa, Homo Sapiens
FLCIFLPIP

SEQ ID NO: 523172 - protein, 9 aa, Homo Sapiens
PENAVSKIE

SEQ ID NO: 523173 - protein, 9 aa, Homo Sapiens
GGYGDKQIY

SEQ ID NO: 523174 - protein, 9 aa, Homo Sapiens
RPGLYSHVL

SEQ ID NO: 523175 - protein, 9 aa, Homo Sapiens
FLWGEGATS

SEQ ID NO: 523176 - protein, 9 aa, Homo Sapiens
MKKLKPTVR

SEQ ID NO: 523177 - protein, 9 aa, Homo Sapiens
RVKHDLVLS

SEQ ID NO: 523178 - protein, 9 aa, Homo Sapiens
LCIFLPIPL

SEQ ID NO: 523179 - protein, 9 aa, Homo Sapiens
PRMPPVTAP

SEQ ID NO: 523180 - protein, 9 aa, Homo Sapiens
VKKHKPKIK

SEQ ID NO: 523181 - protein, 9 aa, Homo Sapiens
PKIKGNMSG

SEQ ID NO: 523182 - protein, 9 aa, Homo Sapiens
EYGACGLSG

SEQ ID NO: 523183 - protein, 9 aa, Homo Sapiens
FPCSVRIHL

SEQ ID NO: 523184 - protein, 9 aa, Homo Sapiens
YFNRKALQL

SEQ ID NO: 523185 - protein, 9 aa, Homo Sapiens
QAGMCSVVI

SEQ ID NO: 523186 - protein, 9 aa, Homo Sapiens
KHDLVLSGD

SEQ ID NO: 523187 - protein, 9 aa, Homo Sapiens
LPQESLVPY

SEQ ID NO: 523188 - protein, 9 aa, Homo Sapiens
LLQEGIYFI

SEQ ID NO: 523189 - protein, 9 aa, Homo Sapiens
ARTLLEGGA

SEQ ID NO: 523190 - protein, 9 aa, Homo Sapiens
LLKDFALTV

SEQ ID NO: 523191 - protein, 9 aa, Homo Sapiens
WGEGATSYG

SEQ ID NO: 523192 - protein, 9 aa, Homo Sapiens
KMASDFLWG

SEQ ID NO: 523193 - protein, 9 aa, Homo Sapiens
VDFPCSVRI

SEQ ID NO: 523194 - protein, 9 aa, Homo Sapiens
GCWDPLVDY

SEQ ID NO: 523195 - protein, 9 aa, Homo Sapiens
GKERQEGQR

SEQ ID NO: 523196 - protein, 9 aa, Homo Sapiens
GMCSVVISA

SEQ ID NO: 523197 - protein, 9 aa, Homo Sapiens
RALQKCQLE

SEQ ID NO: 523198 - protein, 9 aa, Homo Sapiens
THAAFTGSQ

SEQ ID NO: 523199 - protein, 9 aa, Homo Sapiens
KKHKPKIKG

SEQ ID NO: 523200 - protein, 9 aa, Homo Sapiens
SPGGSEDNK

SEQ ID NO: 523201 - protein, 9 aa, Homo Sapiens
TFDPFLCIF

SEQ ID NO: 523202 - protein, 9 aa, Homo Sapiens
RNTAGRTAL

SEQ ID NO: 523203 - protein, 9 aa, Homo Sapiens
EEVPGVFSR

SEQ ID NO: 523204 - protein, 9 aa, Homo Sapiens
PGCHWNEGH

SEQ ID NO: 523205 - protein, 9 aa, Homo Sapiens
STNVLLIEH

SEQ ID NO: 523206 - protein, 9 aa, Homo Sapiens
WGFFRNICG

SEQ ID NO: 523207 - protein, 9 aa, Homo Sapiens
RSISTATAA

SEQ ID NO: 523208 - protein, 9 aa, Homo Sapiens
SRHQQSPDS

SEQ ID NO: 523209 - protein, 9 aa, Homo Sapiens
QLNHFSKLT

SEQ ID NO: 523210 - protein, 9 aa, Homo Sapiens
RLEPIKGFD

SEQ ID NO: 523211 - protein, 9 aa, Homo Sapiens
QGLMNLWQV

SEQ ID NO: 523212 - protein, 9 aa, Homo Sapiens
SLNSSRSGG

SEQ ID NO: 523213 - protein, 9 aa, Homo Sapiens
IAQAGMCSV

SEQ ID NO: 523214 - protein, 9 aa, Homo Sapiens
KKLKPTVRN

SEQ ID NO: 523215 - protein, 9 aa, Homo Sapiens
IEIVTILTV

SEQ ID NO: 523216 - protein, 9 aa, Homo Sapiens
RTHAAFTGS

SEQ ID NO: 523217 - protein, 9 aa, Homo Sapiens
LLPSVLGLG

SEQ ID NO: 523218 - protein, 9 aa, Homo Sapiens
PSSSPGHAP

SEQ ID NO: 523219 - protein, 9 aa, Homo Sapiens
SLLCIPAVT

SEQ ID NO: 523220 - protein, 9 aa, Homo Sapiens
PAEAGQPQS

SEQ ID NO: 523221 - protein, 9 aa, Homo Sapiens
PCTPLNRLF

SEQ ID NO: 523222 - protein, 9 aa, Homo Sapiens
SFYLLQEAI

SEQ ID NO: 523223 - protein, 9 aa, Homo Sapiens
YCAFASCTP

SEQ ID NO: 523224 - protein, 9 aa, Homo Sapiens
ARGPPGAWK

SEQ ID NO: 523225 - protein, 9 aa, Homo Sapiens
EVAGKIREG

SEQ ID NO: 523226 - protein, 9 aa, Homo Sapiens
GIVKKHKPK

SEQ ID NO: 523227 - protein, 9 aa, Homo Sapiens
GNCLLDLPL

SEQ ID NO: 523228 - protein, 9 aa, Homo Sapiens
LGGDWQLNH

SEQ ID NO: 523229 - protein, 9 aa, Homo Sapiens
MSKILQRIA

SEQ ID NO: 523230 - protein, 9 aa, Homo Sapiens
SATEHFSII

SEQ ID NO: 523231 - protein, 9 aa, Homo Sapiens
VIEDKECQP

SEQ ID NO: 523232 - protein, 9 aa, Homo Sapiens
LCIPAVTWI

SEQ ID NO: 523233 - protein, 9 aa, Homo Sapiens
EEDFQAPFL

SEQ ID NO: 523234 - protein, 9 aa, Homo Sapiens
AKDQNSLLK

SEQ ID NO: 523235 - protein, 9 aa, Homo Sapiens
CGLSGEKAV

SEQ ID NO: 523236 - protein, 9 aa, Homo Sapiens
KIKGNMSGN

SEQ ID NO: 523237 - protein, 9 aa, Homo Sapiens
SQFMMLMQA

SEQ ID NO: 523238 - protein, 9 aa, Homo Sapiens
NPTALQLIL

SEQ ID NO: 523239 - protein, 9 aa, Homo Sapiens
ITRIESFIQ

SEQ ID NO: 523240 - protein, 9 aa, Homo Sapiens
GFFRNICGQ

SEQ ID NO: 523241 - protein, 9 aa, Homo Sapiens
KIQYTHLSI

SEQ ID NO: 523242 - protein, 9 aa, Homo Sapiens
LEPIKGFDG

SEQ ID NO: 523243 - protein, 9 aa, Homo Sapiens
QFSQFMMLM

SEQ ID NO: 523244 - protein, 9 aa, Homo Sapiens
PQKFAGLGF

SEQ ID NO: 523245 - protein, 9 aa, Homo Sapiens
LPLKQILGP

SEQ ID NO: 523246 - protein, 9 aa, Homo Sapiens
LALRCRTAR

SEQ ID NO: 523247 - protein, 9 aa, Homo Sapiens
NNASPTYNT

SEQ ID NO: 523248 - protein, 9 aa, Homo Sapiens
CSENIDYCA

SEQ ID NO: 523249 - protein, 9 aa, Homo Sapiens
RNICGQPEV

SEQ ID NO: 523250 - protein, 9 aa, Homo Sapiens
KPTVRNYVE

SEQ ID NO: 523251 - protein, 9 aa, Homo Sapiens
YSSTGLPLI

SEQ ID NO: 523252 - protein, 9 aa, Homo Sapiens
KQGLMNLWQ

SEQ ID NO: 523253 - protein, 9 aa, Homo Sapiens
QKFAGLGFL

SEQ ID NO: 523254 - protein, 9 aa, Homo Sapiens
PDSSTDSGT

SEQ ID NO: 523255 - protein, 9 aa, Homo Sapiens
CHWNEGHAT

SEQ ID NO: 523256 - protein, 9 aa, Homo Sapiens
QESLVPYMP

SEQ ID NO: 523257 - protein, 9 aa, Homo Sapiens
PPGAWKGRR

SEQ ID NO: 523258 - protein, 9 aa, Homo Sapiens
KGFDGWMKI

SEQ ID NO: 523259 - protein, 9 aa, Homo Sapiens
LTWQFSQFM

SEQ ID NO: 523260 - protein, 9 aa, Homo Sapiens
FALTVKSIS

SEQ ID NO: 523261 - protein, 9 aa, Homo Sapiens
VYEEDFQAP

SEQ ID NO: 523262 - protein, 9 aa, Homo Sapiens
SARDRAIKE

SEQ ID NO: 523263 - protein, 9 aa, Homo Sapiens
CNTATDDSK

SEQ ID NO: 523264 - protein, 9 aa, Homo Sapiens
FFRNICGQP

SEQ ID NO: 523265 - protein, 9 aa, Homo Sapiens
TARLPQESL

SEQ ID NO: 523266 - protein, 9 aa, Homo Sapiens
ALCNTATDD

SEQ ID NO: 523267 - protein, 9 aa, Homo Sapiens
SSTGLPLIQ

SEQ ID NO: 523268 - protein, 9 aa, Homo Sapiens
LSLLCIPAV

SEQ ID NO: 523269 - protein, 9 aa, Homo Sapiens
CVCWLRSIQ

SEQ ID NO: 523270 - protein, 9 aa, Homo Sapiens
TSTNRCELC

SEQ ID NO: 523271 - protein, 9 aa, Homo Sapiens
AEAGQPQSV

SEQ ID NO: 523272 - protein, 9 aa, Homo Sapiens
RCRTARRPD

SEQ ID NO: 523273 - protein, 9 aa, Homo Sapiens
PSSCSSWGP

SEQ ID NO: 523274 - protein, 9 aa, Homo Sapiens
CGYPTLCSS

SEQ ID NO: 523275 - protein, 9 aa, Homo Sapiens
TRIESFIQS

SEQ ID NO: 523276 - protein, 9 aa, Homo Sapiens
QTAEDYPVS

SEQ ID NO: 523277 - protein, 9 aa, Homo Sapiens
HDLVLSGDL

SEQ ID NO: 523278 - protein, 9 aa, Homo Sapiens
DLCLYKGSL

SEQ ID NO: 523279 - protein, 9 aa, Homo Sapiens
RRALCNTAT

SEQ ID NO: 523280 - protein, 9 aa, Homo Sapiens
CPTWKVFDC

SEQ ID NO: 523281 - protein, 9 aa, Homo Sapiens
SLYMVRIIS

SEQ ID NO: 523282 - protein, 9 aa, Homo Sapiens
QQSPDSSTD

SEQ ID NO: 523283 - protein, 9 aa, Homo Sapiens
FSLGSFNWE

SEQ ID NO: 523284 - protein, 9 aa, Homo Sapiens
AEEREAEER

SEQ ID NO: 523285 - protein, 9 aa, Homo Sapiens
LNSSRSGGE

SEQ ID NO: 523286 - protein, 9 aa, Homo Sapiens
LYSHVLDQL

SEQ ID NO: 523287 - protein, 9 aa, Homo Sapiens
PTLCSSWIS

SEQ ID NO: 523288 - protein, 9 aa, Homo Sapiens
QQLERSVRE

SEQ ID NO: 523289 - protein, 9 aa, Homo Sapiens
IFLPIPLPH

SEQ ID NO: 523290 - protein, 9 aa, Homo Sapiens
KEKDACHKK

SEQ ID NO: 523291 - protein, 9 aa, Homo Sapiens
ILQISEEEE

SEQ ID NO: 523292 - protein, 9 aa, Homo Sapiens
AGLGFLISP

SEQ ID NO: 523293 - protein, 9 aa, Homo Sapiens
ASPSSSPGH

SEQ ID NO: 523294 - protein, 9 aa, Homo Sapiens
EMFTKFGDN

SEQ ID NO: 523295 - protein, 9 aa, Homo Sapiens
FQPPLFGLV

SEQ ID NO: 523296 - protein, 9 aa, Homo Sapiens
QRPPQKFAG

SEQ ID NO: 523297 - protein, 9 aa, Homo Sapiens
RSGGEQDYD

SEQ ID NO: 523298 - protein, 9 aa, Homo Sapiens
EIVTILTVL

SEQ ID NO: 523299 - protein, 9 aa, Homo Sapiens
REPGELSGV

SEQ ID NO: 523300 - protein, 9 aa, Homo Sapiens
IPAVTWIYL

SEQ ID NO: 523301 - protein, 9 aa, Homo Sapiens
NLGFKLSRW

SEQ ID NO: 523302 - protein, 9 aa, Homo Sapiens
TVWDIFQPP

SEQ ID NO: 523303 - protein, 9 aa, Homo Sapiens
CIPAVTWIY

SEQ ID NO: 523304 - protein, 9 aa, Homo Sapiens
VLDQLYELN

SEQ ID NO: 523305 - protein, 9 aa, Homo Sapiens
GLSGEKAVE

SEQ ID NO: 523306 - protein, 9 aa, Homo Sapiens
MFPPRMPPV

SEQ ID NO: 523307 - protein, 9 aa, Homo Sapiens
IFQPPLFGL

SEQ ID NO: 523308 - protein, 9 aa, Homo Sapiens
CSSWISKRE

SEQ ID NO: 523309 - protein, 9 aa, Homo Sapiens
TGGCWDPLV

SEQ ID NO: 523310 - protein, 9 aa, Homo Sapiens
HCVCWLRSI

SEQ ID NO: 523311 - protein, 9 aa, Homo Sapiens
TALQLILQI

SEQ ID NO: 523312 - protein, 9 aa, Homo Sapiens
FYLLQEAII

SEQ ID NO: 523313 - protein, 9 aa, Homo Sapiens
IKGFDGWMK

SEQ ID NO: 523314 - protein, 9 aa, Homo Sapiens
HIYIHTHTF

SEQ ID NO: 523315 - protein, 9 aa, Homo Sapiens
SGSPTFLLG

SEQ ID NO: 523316 - protein, 9 aa, Homo Sapiens
AAPPSGPPW

SEQ ID NO: 523317 - protein, 9 aa, Homo Sapiens
FMKKLKPTV

SEQ ID NO: 523318 - protein, 9 aa, Homo Sapiens
SLGPGAPLE

SEQ ID NO: 523319 - protein, 9 aa, Homo Sapiens
RALCNTATD

SEQ ID NO: 523320 - protein, 9 aa, Homo Sapiens
QRLALRCRT

SEQ ID NO: 523321 - protein, 9 aa, Homo Sapiens
LYMVRIISK

SEQ ID NO: 523322 - protein, 9 aa, Homo Sapiens
KDFALTVKS

SEQ ID NO: 523323 - protein, 9 aa, Homo Sapiens
IEDKECQPQ

SEQ ID NO: 523324 - protein, 9 aa, Homo Sapiens
SLTWQFSQF

SEQ ID NO: 523325 - protein, 9 aa, Homo Sapiens
VTFLDPRSI

SEQ ID NO: 523326 - protein, 9 aa, Homo Sapiens
PFLCIFLPI

SEQ ID NO: 523327 - protein, 9 aa, Homo Sapiens
GPGSFTRSC

SEQ ID NO: 523328 - protein, 9 aa, Homo Sapiens
EPTIRNTAG

SEQ ID NO: 523329 - protein, 9 aa, Homo Sapiens
YLLQEAIIP

SEQ ID NO: 523330 - protein, 9 aa, Homo Sapiens
FDPFLCIFL

SEQ ID NO: 523331 - protein, 9 aa, Homo Sapiens
TVLISYGFI

SEQ ID NO: 523332 - protein, 9 aa, Homo Sapiens
MFTKFGDNG

SEQ ID NO: 523333 - protein, 9 aa, Homo Sapiens
VEINKRVKH

SEQ ID NO: 523334 - protein, 9 aa, Homo Sapiens
IPCTPLNRL

SEQ ID NO: 523335 - protein, 9 aa, Homo Sapiens
LTARLPQES

SEQ ID NO: 523336 - protein, 9 aa, Homo Sapiens
SFSSVSTGD

SEQ ID NO: 523337 - protein, 9 aa, Homo Sapiens
APSPFNSLL

SEQ ID NO: 523338 - protein, 9 aa, Homo Sapiens
TLLEGGANV

SEQ ID NO: 523339 - protein, 9 aa, Homo Sapiens
RLPQESLVP

SEQ ID NO: 523340 - protein, 9 aa, Homo Sapiens
RFWGFFRNI

SEQ ID NO: 523341 - protein, 9 aa, Homo Sapiens
RKALQLLHC

SEQ ID NO: 523342 - protein, 9 aa, Homo Sapiens
LSGEKAVEK

SEQ ID NO: 523343 - protein, 9 aa, Homo Sapiens
QAPFLEMSA

SEQ ID NO: 523344 - protein, 9 aa, Homo Sapiens
VWTSAWRTH

SEQ ID NO: 523345 - protein, 9 aa, Homo Sapiens
KFAGLGFLI

SEQ ID NO: 523346 - protein, 9 aa, Homo Sapiens
LSGVWTSAW

SEQ ID NO: 523347 - protein, 9 aa, Homo Sapiens
DKQIYSASV

SEQ ID NO: 523348 - protein, 9 aa, Homo Sapiens
GDWQLNHFS

SEQ ID NO: 523349 - protein, 9 aa, Homo Sapiens
PGSFTRSCG

SEQ ID NO: 523350 - protein, 9 aa, Homo Sapiens
TNVLLIEHA

SEQ ID NO: 523351 - protein, 9 aa, Homo Sapiens
EKYFNRKAL

SEQ ID NO: 523352 - protein, 9 aa, Homo Sapiens
DFALTVKSI

SEQ ID NO: 523353 - protein, 9 aa, Homo Sapiens
SGEKAVEKF

SEQ ID NO: 523354 - protein, 9 aa, Homo Sapiens
MRSFYLLQE

SEQ ID NO: 523355 - protein, 9 aa, Homo Sapiens
PGGSEDNKR

SEQ ID NO: 523356 - protein, 9 aa, Homo Sapiens
NGFLIHLDN

SEQ ID NO: 523357 - protein, 9 aa, Homo Sapiens
KLSRWNYKS

SEQ ID NO: 523358 - protein, 9 aa, Homo Sapiens
KTPPRWAKD

SEQ ID NO: 523359 - protein, 9 aa, Homo Sapiens
AEGGYGDKQ

SEQ ID NO: 523360 - protein, 9 aa, Homo Sapiens
LSATEHFSI

SEQ ID NO: 523361 - protein, 9 aa, Homo Sapiens
FSQFMMLMQ

SEQ ID NO: 523362 - protein, 9 aa, Homo Sapiens
LYLGGDWQL

SEQ ID NO: 523363 - protein, 9 aa, Homo Sapiens
YLTARLPQE

SEQ ID NO: 523364 - protein, 9 aa, Homo Sapiens
LSQKEKDAC

SEQ ID NO: 523365 - protein, 9 aa, Homo Sapiens
PVCSSRTLQ

SEQ ID NO: 523366 - protein, 9 aa, Homo Sapiens
AEDYPVSSH

SEQ ID NO: 523367 - protein, 9 aa, Homo Sapiens
YSHVLDQLY

SEQ ID NO: 523368 - protein, 9 aa, Homo Sapiens
DPLVDYLPE

SEQ ID NO: 523369 - protein, 9 aa, Homo Sapiens
CGFCGSLGP

SEQ ID NO: 523370 - protein, 9 aa, Homo Sapiens
FNTVLSLAL

SEQ ID NO: 523371 - protein, 9 aa, Homo Sapiens
PAEGGYGDK

SEQ ID NO: 523372 - protein, 9 aa, Homo Sapiens
KEVAGKIRE

SEQ ID NO: 523373 - protein, 9 aa, Homo Sapiens
TPPRWAKDQ

SEQ ID NO: 523374 - protein, 9 aa, Homo Sapiens
IYTHIYIHT

SEQ ID NO: 523375 - protein, 9 aa, Homo Sapiens
LEGGANVNA

SEQ ID NO: 523376 - protein, 9 aa, Homo Sapiens
AQVTSYSST

SEQ ID NO: 523377 - protein, 9 aa, Homo Sapiens
FDCNEESGY

SEQ ID NO: 523378 - protein, 9 aa, Homo Sapiens
YKDKKERPR

SEQ ID NO: 523379 - protein, 9 aa, Homo Sapiens
WKVFDCNEE

SEQ ID NO: 523380 - protein, 9 aa, Homo Sapiens
SKIEVAEVA

SEQ ID NO: 523381 - protein, 9 aa, Homo Sapiens
SLGSFNWEK

SEQ ID NO: 523382 - protein, 9 aa, Homo Sapiens
RSCGYPTLC

SEQ ID NO: 523383 - protein, 9 aa, Homo Sapiens
FLLGKGIRL

SEQ ID NO: 523384 - protein, 9 aa, Homo Sapiens
KGRRPGDER

SEQ ID NO: 523385 - protein, 9 aa, Homo Sapiens
SSCSSWGPG

SEQ ID NO: 523386 - protein, 9 aa, Homo Sapiens
LNHFSKLTS

SEQ ID NO: 523387 - protein, 9 aa, Homo Sapiens
QPPNSLYMV

SEQ ID NO: 523388 - protein, 9 aa, Homo Sapiens
LKDFALTVK

SEQ ID NO: 523389 - protein, 9 aa, Homo Sapiens
LALYKDKKE

SEQ ID NO: 523390 - protein, 9 aa, Homo Sapiens
FGQTAEDYP

SEQ ID NO: 523391 - protein, 9 aa, Homo Sapiens
LQRIANHVL

SEQ ID NO: 523392 - protein, 9 aa, Homo Sapiens
KREILSATE

SEQ ID NO: 523393 - protein, 9 aa, Homo Sapiens
DACHKKCDQ

SEQ ID NO: 523394 - protein, 9 aa, Homo Sapiens
GLMNLWQVF

SEQ ID NO: 523395 - protein, 9 aa, Homo Sapiens
GSPTFLLGK

SEQ ID NO: 523396 - protein, 9 aa, Homo Sapiens
YTHIYIHTH

SEQ ID NO: 523397 - protein, 9 aa, Homo Sapiens
AEEREAREK

SEQ ID NO: 523398 - protein, 9 aa, Homo Sapiens
GPPGAWKGR

SEQ ID NO: 523399 - protein, 9 aa, Homo Sapiens
GVWTSAWRT

SEQ ID NO: 523400 - protein, 9 aa, Homo Sapiens
SCSSWGPGS

SEQ ID NO: 523401 - protein, 9 aa, Homo Sapiens
KDKKERPRS

SEQ ID NO: 523402 - protein, 9 aa, Homo Sapiens
YLDNGNNAS

SEQ ID NO: 523403 - protein, 9 aa, Homo Sapiens
MMFPPRMPP

SEQ ID NO: 523404 - protein, 9 aa, Homo Sapiens
LQPCRSQPA

SEQ ID NO: 523405 - protein, 9 aa, Homo Sapiens
AFSQKEVAG

SEQ ID NO: 523406 - protein, 9 aa, Homo Sapiens
APPSGPPWA

SEQ ID NO: 523407 - protein, 9 aa, Homo Sapiens
VVISAHYSL

SEQ ID NO: 523408 - protein, 9 aa, Homo Sapiens
NIDYCAFAS

SEQ ID NO: 523409 - protein, 9 aa, Homo Sapiens
IQQLERSVR

SEQ ID NO: 523410 - protein, 9 aa, Homo Sapiens
LVIEDKECQ

SEQ ID NO: 523411 - protein, 9 aa, Homo Sapiens
SGPPWAPGP

SEQ ID NO: 523412 - protein, 9 aa, Homo Sapiens
SVYEEDFQA

SEQ ID NO: 523413 - protein, 9 aa, Homo Sapiens
TEHFSIIRA

SEQ ID NO: 523414 - protein, 9 aa, Homo Sapiens
SRPGLYSHV

SEQ ID NO: 523415 - protein, 9 aa, Homo Sapiens
ATPLPVTSF

SEQ ID NO: 523416 - protein, 9 aa, Homo Sapiens
AAFTGSQDL

SEQ ID NO: 523417 - protein, 9 aa, Homo Sapiens
GGDWQLNHF

SEQ ID NO: 523418 - protein, 9 aa, Homo Sapiens
WDPLVDYLP

SEQ ID NO: 523419 - protein, 9 aa, Homo Sapiens
GLSQFYLSA

SEQ ID NO: 523420 - protein, 9 aa, Homo Sapiens
SVLGLGGSD

SEQ ID NO: 523421 - protein, 9 aa, Homo Sapiens
GIYFILDLC

SEQ ID NO: 523422 - protein, 9 aa, Homo Sapiens
RVDFPCSVR

SEQ ID NO: 523423 - protein, 9 aa, Homo Sapiens
EPENAVSKI

SEQ ID NO: 523424 - protein, 9 aa, Homo Sapiens
LGFLISPSS

SEQ ID NO: 523425 - protein, 9 aa, Homo Sapiens
GAWKGRRPG

SEQ ID NO: 523426 - protein, 9 aa, Homo Sapiens
APDQPPNSL

SEQ ID NO: 523427 - protein, 9 aa, Homo Sapiens
SPDSSTDSG

SEQ ID NO: 523428 - protein, 9 aa, Homo Sapiens
WAVAGVQVG

SEQ ID NO: 523429 - protein, 9 aa, Homo Sapiens
PTIRNTAGR

SEQ ID NO: 523430 - protein, 9 aa, Homo Sapiens
FSQKEVAGK

SEQ ID NO: 523431 - protein, 9 aa, Homo Sapiens
KLRRERLLK

SEQ ID NO: 523432 - protein, 9 aa, Homo Sapiens
GYIGTHNEI

SEQ ID NO: 523433 - protein, 9 aa, Homo Sapiens
GSLGPGAPL

SEQ ID NO: 523434 - protein, 9 aa, Homo Sapiens
NGNNASPTY

SEQ ID NO: 523435 - protein, 9 aa, Homo Sapiens
PQSPGCHWN

SEQ ID NO: 523436 - protein, 9 aa, Homo Sapiens
GGAPSPFNS

SEQ ID NO: 523437 - protein, 9 aa, Homo Sapiens
RSVRELHDI

SEQ ID NO: 523438 - protein, 9 aa, Homo Sapiens
FQQHCVCWL

SEQ ID NO: 523439 - protein, 9 aa, Homo Sapiens
KIEVAEVAY

SEQ ID NO: 523440 - protein, 9 aa, Homo Sapiens
LGPAEAGQP

SEQ ID NO: 523441 - protein, 9 aa, Homo Sapiens
QRIANHVLF

SEQ ID NO: 523442 - protein, 9 aa, Homo Sapiens
LLDLPLKQI

SEQ ID NO: 523443 - protein, 9 aa, Homo Sapiens
EVRRALCNT

SEQ ID NO: 523444 - protein, 9 aa, Homo Sapiens
PNSLYMVRI

SEQ ID NO: 523445 - protein, 9 aa, Homo Sapiens
KQNCADQIE

SEQ ID NO: 523446 - protein, 9 aa, Homo Sapiens
CRSQPAFMQ

SEQ ID NO: 523447 - protein, 9 aa, Homo Sapiens
FAGLGFLIS

SEQ ID NO: 523448 - protein, 9 aa, Homo Sapiens
VPGVFSRSV

SEQ ID NO: 523449 - protein, 9 aa, Homo Sapiens
CLLDLPLKQ

SEQ ID NO: 523450 - protein, 9 aa, Homo Sapiens
FLISPSSCS

SEQ ID NO: 523451 - protein, 9 aa, Homo Sapiens
FGDNGFLIH

SEQ ID NO: 523452 - protein, 9 aa, Homo Sapiens
PCRSQPAFM

SEQ ID NO: 523453 - protein, 9 aa, Homo Sapiens
PLLPSVLGL

SEQ ID NO: 523454 - protein, 9 aa, Homo Sapiens
LQKCQLEGS

SEQ ID NO: 523455 - protein, 9 aa, Homo Sapiens
WGPGSFTRS

SEQ ID NO: 523456 - protein, 9 aa, Homo Sapiens
ARDRAIKES

SEQ ID NO: 523457 - protein, 9 aa, Homo Sapiens
GSASPSSSP

SEQ ID NO: 523458 - protein, 9 aa, Homo Sapiens
IGTHNEIRW

SEQ ID NO: 523459 - protein, 9 aa, Homo Sapiens
QLILQISEE

SEQ ID NO: 523460 - protein, 9 aa, Homo Sapiens
LTITRIESF

SEQ ID NO: 523461 - protein, 9 aa, Homo Sapiens
SDFLWGEGA

SEQ ID NO: 523462 - protein, 9 aa, Homo Sapiens
WTSAWRTHA

SEQ ID NO: 523463 - protein, 9 aa, Homo Sapiens
LWGEGATSY

SEQ ID NO: 523464 - protein, 9 aa, Homo Sapiens
VGGVTHMLL

SEQ ID NO: 523465 - protein, 9 aa, Homo Sapiens
NAVSKIEVA

SEQ ID NO: 523466 - protein, 9 aa, Homo Sapiens
HQQSPDSST

SEQ ID NO: 523467 - protein, 9 aa, Homo Sapiens
KGDPQSPGC

SEQ ID NO: 523468 - protein, 9 aa, Homo Sapiens
CYLFSLGSF

SEQ ID NO: 523469 - protein, 9 aa, Homo Sapiens
PSVLGLGGS

SEQ ID NO: 523470 - protein, 9 aa, Homo Sapiens
CRTARRPDS

SEQ ID NO: 523471 - protein, 9 aa, Homo Sapiens
RCELCTCGD

SEQ ID NO: 523472 - protein, 9 aa, Homo Sapiens
IYIHTHTFY

SEQ ID NO: 523473 - protein, 9 aa, Homo Sapiens
WDIFQPPLF

SEQ ID NO: 523474 - protein, 9 aa, Homo Sapiens
NKRVKHDLV

SEQ ID NO: 523475 - protein, 9 aa, Homo Sapiens
EQKIQYTHL

SEQ ID NO: 523476 - protein, 9 aa, Homo Sapiens
SCGSASPSS

SEQ ID NO: 523477 - protein, 9 aa, Homo Sapiens
MCSVVISAH

SEQ ID NO: 523478 - protein, 9 aa, Homo Sapiens
LREEVPGVF

SEQ ID NO: 523479 - protein, 9 aa, Homo Sapiens
VLLIEHAKL

SEQ ID NO: 523480 - protein, 9 aa, Homo Sapiens
PPSGPPWAP

SEQ ID NO: 523481 - protein, 9 aa, Homo Sapiens
DPRSISTAT

SEQ ID NO: 523482 - protein, 9 aa, Homo Sapiens
ILQRIANHV

SEQ ID NO: 523483 - protein, 9 aa, Homo Sapiens
FCLLGYIGT

SEQ ID NO: 523484 - protein, 9 aa, Homo Sapiens
RERLLKQNC

SEQ ID NO: 523485 - protein, 9 aa, Homo Sapiens
ITAESVCLP

SEQ ID NO: 523486 - protein, 9 aa, Homo Sapiens
EIQQLERSV

SEQ ID NO: 523487 - protein, 9 aa, Homo Sapiens
SSLQPCRSQ

SEQ ID NO: 523488 - protein, 9 aa, Homo Sapiens
NTAGRTALD

SEQ ID NO: 523489 - protein, 9 aa, Homo Sapiens
NCLLDLPLK

SEQ ID NO: 523490 - protein, 9 aa, Homo Sapiens
EEREAEERE

SEQ ID NO: 523491 - protein, 9 aa, Homo Sapiens
DLPLKQILG

SEQ ID NO: 523492 - protein, 9 aa, Homo Sapiens
KKGKERQEG

SEQ ID NO: 523493 - protein, 9 aa, Homo Sapiens
QSPGCHWNE

SEQ ID NO: 523494 - protein, 9 aa, Homo Sapiens
PEWEQKIQY

SEQ ID NO: 523495 - protein, 9 aa, Homo Sapiens
LTVLISYGF

SEQ ID NO: 523496 - protein, 9 aa, Homo Sapiens
THNEIRWLL

SEQ ID NO: 523497 - protein, 9 aa, Homo Sapiens
PPNSLYMVR

SEQ ID NO: 523498 - protein, 9 aa, Homo Sapiens
SQDLCLYKG

SEQ ID NO: 523499 - protein, 9 aa, Homo Sapiens
ALRCRTARR

SEQ ID NO: 523500 - protein, 9 aa, Homo Sapiens
KGKERQEGQ

SEQ ID NO: 523501 - protein, 9 aa, Homo Sapiens
LFQSLKQHP

SEQ ID NO: 523502 - protein, 9 aa, Homo Sapiens
AQAGMCSVV

SEQ ID NO: 523503 - protein, 9 aa, Homo Sapiens
LILQISEEE

SEQ ID NO: 523504 - protein, 9 aa, Homo Sapiens
KLMSKILQR

SEQ ID NO: 523505 - protein, 9 aa, Homo Sapiens
FSSSLQPCR

SEQ ID NO: 523506 - protein, 9 aa, Homo Sapiens
QRPLLPSVL

SEQ ID NO: 523507 - protein, 9 aa, Homo Sapiens
GAPSPFNSL

SEQ ID NO: 523508 - protein, 9 aa, Homo Sapiens
QKIQYTHLS

SEQ ID NO: 523509 - protein, 9 aa, Homo Sapiens
FPPRMPPVT

SEQ ID NO: 523510 - protein, 9 aa, Homo Sapiens
YIYTHIYIH

SEQ ID NO: 523511 - protein, 9 aa, Homo Sapiens
VTSYSSTGL

SEQ ID NO: 523512 - protein, 9 aa, Homo Sapiens
LLLLFQSLK

SEQ ID NO: 523513 - protein, 9 aa, Homo Sapiens
SWISKREPG

SEQ ID NO: 523514 - protein, 9 aa, Homo Sapiens
WQFSQFMML

SEQ ID NO: 523515 - protein, 9 aa, Homo Sapiens
AIMRSFYLL

SEQ ID NO: 523516 - protein, 9 aa, Homo Sapiens
VCWLRSIQQ

SEQ ID NO: 523517 - protein, 9 aa, Homo Sapiens
RQEGQRPPQ

SEQ ID NO: 523518 - protein, 9 aa, Homo Sapiens
REAEEREAR

SEQ ID NO: 523519 - protein, 9 aa, Homo Sapiens
ENAVSKIEV

SEQ ID NO: 523520 - protein, 9 aa, Homo Sapiens
ERLLKQNCA

SEQ ID NO: 523521 - protein, 9 aa, Homo Sapiens
EGGYGDKQI

SEQ ID NO: 523522 - protein, 9 aa, Homo Sapiens
SSWGPGSFT

SEQ ID NO: 523523 - protein, 9 aa, Homo Sapiens
EEREAREKG

SEQ ID NO: 523524 - protein, 9 aa, Homo Sapiens
REAEEREAE

SEQ ID NO: 523525 - protein, 9 aa, Homo Sapiens
SQKEKDACH

SEQ ID NO: 523526 - protein, 9 aa, Homo Sapiens
LFQQHCVCW

SEQ ID NO: 523527 - protein, 9 aa, Homo Sapiens
LKQNCADQI

SEQ ID NO: 523528 - protein, 9 aa, Homo Sapiens
GENCYLFSL

SEQ ID NO: 523529 - protein, 9 aa, Homo Sapiens
TITRIESFI

SEQ ID NO: 523530 - protein, 9 aa, Homo Sapiens
LLCIPAVTW

SEQ ID NO: 523531 - protein, 9 aa, Homo Sapiens
ALQKCQLEG

SEQ ID NO: 523532 - protein, 9 aa, Homo Sapiens
HQHQHQQQQ

SEQ ID NO: 523533 - protein, 9 aa, Homo Sapiens
CSSRTLQAE

SEQ ID NO: 523534 - protein, 9 aa, Homo Sapiens
WEQKIQYTH

SEQ ID NO: 523535 - protein, 9 aa, Homo Sapiens
FTAFSQKEV

SEQ ID NO: 523536 - protein, 9 aa, Homo Sapiens
EPGELSGVW

SEQ ID NO: 523537 - protein, 9 aa, Homo Sapiens
KYFNRKALQ

SEQ ID NO: 523538 - protein, 9 aa, Homo Sapiens
PSPFNSLLS

SEQ ID NO: 523539 - protein, 9 aa, Homo Sapiens
IRNTAGRTA

SEQ ID NO: 523540 - protein, 9 aa, Homo Sapiens
KASTSTNRC

SEQ ID NO: 523541 - protein, 9 aa, Homo Sapiens
LSQFYLSAL

SEQ ID NO: 523542 - protein, 9 aa, Homo Sapiens
PPQKFAGLG

SEQ ID NO: 523543 - protein, 9 aa, Homo Sapiens
AEFMKKLKP

SEQ ID NO: 523544 - protein, 9 aa, Homo Sapiens
KDQNSLLKM

SEQ ID NO: 523545 - protein, 9 aa, Homo Sapiens
FLLLLFQSL

SEQ ID NO: 523546 - protein, 9 aa, Homo Sapiens
FLDPRSIST

SEQ ID NO: 523547 - protein, 9 aa, Homo Sapiens
VSKIEVAEV

SEQ ID NO: 523548 - protein, 9 aa, Homo Sapiens
TSFSSVSTG

SEQ ID NO: 523549 - protein, 9 aa, Homo Sapiens
AVSKIEVAE

SEQ ID NO: 523550 - protein, 9 aa, Homo Sapiens
KRVKHDLVL

SEQ ID NO: 523551 - protein, 9 aa, Homo Sapiens
CQLEGSGHR

SEQ ID NO: 523552 - protein, 9 aa, Homo Sapiens
KLKPTVRNY

SEQ ID NO: 523553 - protein, 9 aa, Homo Sapiens
LSARDRAIK

SEQ ID NO: 523554 - protein, 9 aa, Homo Sapiens
SLQPCRSQP

SEQ ID NO: 523555 - protein, 9 aa, Homo Sapiens
GSFTRSCGY

SEQ ID NO: 523556 - protein, 9 aa, Homo Sapiens
PSGPPWAPG

SEQ ID NO: 523557 - protein, 9 aa, Homo Sapiens
TAEDYPVSS

SEQ ID NO: 523558 - protein, 9 aa, Homo Sapiens
YLGGDWQLN

SEQ ID NO: 523559 - protein, 9 aa, Homo Sapiens
GPAEAGQPQ

SEQ ID NO: 523560 - protein, 9 aa, Homo Sapiens
QPPLFGLVG

SEQ ID NO: 523561 - protein, 9 aa, Homo Sapiens
GMMFPPRMP

SEQ ID NO: 523562 - protein, 9 aa, Homo Sapiens
EREAEEREA

SEQ ID NO: 523563 - protein, 9 aa, Homo Sapiens
LGLGGSDLG

SEQ ID NO: 523564 - protein, 9 aa, Homo Sapiens
PLKQILGPE

SEQ ID NO: 523565 - protein, 9 aa, Homo Sapiens
PPRMPPVTA

SEQ ID NO: 523566 - protein, 9 aa, Homo Sapiens
TSAWRTHAA

SEQ ID NO: 523567 - protein, 9 aa, Homo Sapiens
YKGSLGLHI

SEQ ID NO: 523568 - protein, 9 aa, Homo Sapiens
ICGQPEVFF

SEQ ID NO: 523569 - protein, 9 aa, Homo Sapiens
EDNKRAYMN

SEQ ID NO: 523570 - protein, 9 aa, Homo Sapiens
KYLDNGNNA

SEQ ID NO: 523571 - protein, 9 aa, Homo Sapiens
QSPDSSTDS

SEQ ID NO: 523572 - protein, 9 aa, Homo Sapiens
TAGRTALDL

SEQ ID NO: 523573 - protein, 9 aa, Homo Sapiens
CLLGYIGTH

SEQ ID NO: 523574 - protein, 9 aa, Homo Sapiens
LGSFNWEKS

SEQ ID NO: 523575 - protein, 9 aa, Homo Sapiens
PKMASDFLW

SEQ ID NO: 523576 - protein, 9 aa, Homo Sapiens
YWNLGFKLS

SEQ ID NO: 523577 - protein, 9 aa, Homo Sapiens
FWGFFRNIC

SEQ ID NO: 523578 - protein, 9 aa, Homo Sapiens
YPTLCSSWI

SEQ ID NO: 523579 - protein, 9 aa, Homo Sapiens
ERQEGQRPP

SEQ ID NO: 523580 - protein, 9 aa, Homo Sapiens
VKHDLVLSG

SEQ ID NO: 523581 - protein, 9 aa, Homo Sapiens
TLCSSWISK

SEQ ID NO: 523582 - protein, 9 aa, Homo Sapiens
TIRNTAGRT

SEQ ID NO: 523583 - protein, 9 aa, Homo Sapiens
REEVPGVFS

SEQ ID NO: 523584 - protein, 9 aa, Homo Sapiens
MASDFLWGE

SEQ ID NO: 523585 - protein, 9 aa, Homo Sapiens
YGACGLSGE

SEQ ID NO: 523586 - protein, 9 aa, Homo Sapiens
LSLAVQRPA

SEQ ID NO: 523587 - protein, 9 aa, Homo Sapiens
DWQLNHFSK

SEQ ID NO: 523588 - protein, 9 aa, Homo Sapiens
LRRERLLKQ

SEQ ID NO: 523589 - protein, 9 aa, Homo Sapiens
SKILQRIAN

SEQ ID NO: 523590 - protein, 9 aa, Homo Sapiens
LFSSSLQPC

SEQ ID NO: 523591 - protein, 9 aa, Homo Sapiens
ASDFLWGEG

SEQ ID NO: 523592 - protein, 9 aa, Homo Sapiens
VSLLALYKD

SEQ ID NO: 523593 - protein, 9 aa, Homo Sapiens
WKGRRPGDE

SEQ ID NO: 523594 - protein, 9 aa, Homo Sapiens
LKPTVRNYV

SEQ ID NO: 523595 - protein, 9 aa, Homo Sapiens
ALKYLDNGN

SEQ ID NO: 523596 - protein, 9 aa, Homo Sapiens
PGLYSHVLD

SEQ ID NO: 523597 - protein, 9 aa, Homo Sapiens
PDQPPNSLY

SEQ ID NO: 523598 - protein, 9 aa, Homo Sapiens
ELFQQHCVC

SEQ ID NO: 523599 - protein, 9 aa, Homo Sapiens
ENCYLFSLG

SEQ ID NO: 523600 - protein, 9 aa, Homo Sapiens
FTKFGDNGF

SEQ ID NO: 523601 - protein, 9 aa, Homo Sapiens
QFYLSALDQ

SEQ ID NO: 523602 - protein, 9 aa, Homo Sapiens
KESFSTNVL

SEQ ID NO: 523603 - protein, 9 aa, Homo Sapiens
HVLDQLYEL

SEQ ID NO: 523604 - protein, 9 aa, Homo Sapiens
STNRCELCT

SEQ ID NO: 523605 - protein, 9 aa, Homo Sapiens
QLEGSGHRL

SEQ ID NO: 523606 - protein, 9 aa, Homo Sapiens
SLLALYKDK

SEQ ID NO: 523607 - protein, 9 aa, Homo Sapiens
ILSATEHFS

SEQ ID NO: 523608 - protein, 9 aa, Homo Sapiens
CRLEPIKGF

SEQ ID NO: 523609 - protein, 9 aa, Homo Sapiens
ENIDYCAFA

SEQ ID NO: 523610 - protein, 9 aa, Homo Sapiens
PQESLVPYM

SEQ ID NO: 523611 - protein, 9 aa, Homo Sapiens
RLALRCRTA

SEQ ID NO: 523612 - protein, 9 aa, Homo Sapiens
CIFLPIPLP

SEQ ID NO: 523613 - protein, 9 aa, Homo Sapiens
YGDKQIYSA

SEQ ID NO: 523614 - protein, 9 aa, Homo Sapiens
PCTGGCWDP

SEQ ID NO: 523615 - protein, 9 aa, Homo Sapiens
ASPGGSEDN

SEQ ID NO: 523616 - protein, 9 aa, Homo Sapiens
GEKAVEKFG

SEQ ID NO: 523617 - protein, 9 aa, Homo Sapiens
SQKEVAGKI

SEQ ID NO: 523618 - protein, 9 aa, Homo Sapiens
NICGQPEVF

SEQ ID NO: 523619 - protein, 9 aa, Homo Sapiens
FQSLKQHPP

SEQ ID NO: 523620 - protein, 9 aa, Homo Sapiens
GQTAEDYPV

SEQ ID NO: 523621 - protein, 9 aa, Homo Sapiens
EFMKKLKPT

SEQ ID NO: 523622 - protein, 9 aa, Homo Sapiens
CARTLLEGG

SEQ ID NO: 523623 - protein, 9 aa, Homo Sapiens
SAEFMKKLK

SEQ ID NO: 523624 - protein, 9 aa, Homo Sapiens
KERQEGQRP

SEQ ID NO: 523625 - protein, 9 aa, Homo Sapiens
EGQRPPQKF

SEQ ID NO: 523626 - protein, 9 aa, Homo Sapiens
PPLFGLVGA

SEQ ID NO: 523627 - protein, 9 aa, Homo Sapiens
QKASTSTNR

SEQ ID NO: 523628 - protein, 9 aa, Homo Sapiens
FNRKALQLL

SEQ ID NO: 523629 - protein, 9 aa, Homo Sapiens
ALYKDKKER

SEQ ID NO: 523630 - protein, 9 aa, Homo Sapiens
NRCELCTCG

SEQ ID NO: 523631 - protein, 9 aa, Homo Sapiens
PAVTWIYLF

SEQ ID NO: 523632 - protein, 9 aa, Homo Sapiens
YLFSLGSFN

SEQ ID NO: 523633 - protein, 9 aa, Homo Sapiens
QKEVAGKIR

SEQ ID NO: 523634 - protein, 9 aa, Homo Sapiens
LMNLWQVFI

SEQ ID NO: 523635 - protein, 9 aa, Homo Sapiens
GDKQIYSAS

SEQ ID NO: 523636 - protein, 9 aa, Homo Sapiens
GFKLSRWNY

SEQ ID NO: 523637 - protein, 9 aa, Homo Sapiens
VKSISVSLR

SEQ ID NO: 523638 - protein, 9 aa, Homo Sapiens
GDPQSPGCH

SEQ ID NO: 523639 - protein, 9 aa, Homo Sapiens
SENIDYCAF

SEQ ID NO: 523640 - protein, 9 aa, Homo Sapiens
AGMCSVVIS

SEQ ID NO: 523641 - protein, 9 aa, Homo Sapiens
KILQRIANH

SEQ ID NO: 523642 - protein, 9 aa, Homo Sapiens
SRALQKCQL

SEQ ID NO: 523643 - protein, 9 aa, Homo Sapiens
GSEDNKRAY

SEQ ID NO: 523644 - protein, 9 aa, Homo Sapiens
FILDLCIEP

SEQ ID NO: 523645 - protein, 9 aa, Homo Sapiens
EDKECQPQM

SEQ ID NO: 523646 - protein, 9 aa, Homo Sapiens
VCSSRTLQA

SEQ ID NO: 523647 - protein, 9 aa, Homo Sapiens
IVKKHKPKI

SEQ ID NO: 523648 - protein, 9 aa, Homo Sapiens
PGAWKGRRP

SEQ ID NO: 523649 - protein, 9 aa, Homo Sapiens
LLLFQSLKQ

SEQ ID NO: 523650 - protein, 9 aa, Homo Sapiens
PKTPPRWAK

SEQ ID NO: 523651 - protein, 9 aa, Homo Sapiens
WISKREPGE

SEQ ID NO: 523652 - protein, 9 aa, Homo Sapiens
VQVGGVTHM

SEQ ID NO: 523653 - protein, 9 aa, Homo Sapiens
QQHCVCWLR

SEQ ID NO: 523654 - protein, 9 aa, Homo Sapiens
CSSWGPGSF

SEQ ID NO: 523655 - protein, 9 aa, Homo Sapiens
SFIQSLQDL

SEQ ID NO: 523656 - protein, 9 aa, Homo Sapiens
DCNEESGYL

SEQ ID NO: 523657 - protein, 9 aa, Homo Sapiens
LSSLNSSRS

SEQ ID NO: 523658 - protein, 9 aa, Homo Sapiens
AYEDLRKQG

SEQ ID NO: 523659 - protein, 9 aa, Homo Sapiens
QQQQHQHQH

SEQ ID NO: 523660 - protein, 9 aa, Homo Sapiens
VCRLEPIKG

SEQ ID NO: 523661 - protein, 9 aa, Homo Sapiens
PGMMFPPRM

SEQ ID NO: 523662 - protein, 9 aa, Homo Sapiens
EGGANVNAI

SEQ ID NO: 523663 - protein, 9 aa, Homo Sapiens
SFLLLLFQS

SEQ ID NO: 523664 - protein, 9 aa, Homo Sapiens
TAFSQKEVA

SEQ ID NO: 523665 - protein, 9 aa, Homo Sapiens
IHTHTFYVS

SEQ ID NO: 523666 - protein, 9 aa, Homo Sapiens
EINKRVKHD

SEQ ID NO: 523667 - protein, 9 aa, Homo Sapiens
ATEHFSIIR

SEQ ID NO: 523668 - protein, 9 aa, Homo Sapiens
WQLNHFSKL

SEQ ID NO: 523669 - protein, 9 aa, Homo Sapiens
CLYKGSLGL

SEQ ID NO: 523670 - protein, 9 aa, Homo Sapiens
FSTNVLLIE

SEQ ID NO: 523671 - protein, 9 aa, Homo Sapiens
IVTILTVLI

SEQ ID NO: 523672 - protein, 9 aa, Homo Sapiens
ILTVLISYG

SEQ ID NO: 523673 - protein, 9 aa, Homo Sapiens
SPSSSPGHA

SEQ ID NO: 523674 - protein, 9 aa, Homo Sapiens
AIKESQQGP

SEQ ID NO: 523675 - protein, 9 aa, Homo Sapiens
HKPKIKGNM

SEQ ID NO: 523676 - protein, 9 aa, Homo Sapiens
PAYWNLGFK

SEQ ID NO: 523677 - protein, 9 aa, Homo Sapiens
LPALKYLDN

SEQ ID NO: 523678 - protein, 9 aa, Homo Sapiens
ALSLAVQRP

SEQ ID NO: 523679 - protein, 9 aa, Homo Sapiens
ASTSTNRCE

SEQ ID NO: 523680 - protein, 9 aa, Homo Sapiens
LLGYIGTHN

SEQ ID NO: 523681 - protein, 9 aa, Homo Sapiens
CLPDVVLLN

SEQ ID NO: 523682 - protein, 9 aa, Homo Sapiens
FTGSQDLCL

SEQ ID NO: 523683 - protein, 9 aa, Homo Sapiens
RLLKQNCAD

SEQ ID NO: 523684 - protein, 9 aa, Homo Sapiens
GSRHQQSPD

SEQ ID NO: 523685 - protein, 9 aa, Homo Sapiens
CGSASPSSS

SEQ ID NO: 523686 - protein, 9 aa, Homo Sapiens
VLSLALSLA

SEQ ID NO: 523687 - protein, 9 aa, Homo Sapiens
CKESFSTNV

SEQ ID NO: 523688 - protein, 9 aa, Homo Sapiens
DYCAFASCT

SEQ ID NO: 523689 - protein, 9 aa, Homo Sapiens
PVTSFSSVS

SEQ ID NO: 523690 - protein, 9 aa, Homo Sapiens
SHVLDQLYE

SEQ ID NO: 523691 - protein, 9 aa, Homo Sapiens
GELSGVWTS

SEQ ID NO: 523692 - protein, 9 aa, Homo Sapiens
SVTFLDPRS

SEQ ID NO: 523693 - protein, 9 aa, Homo Sapiens
PTWKVFDCN

SEQ ID NO: 523694 - protein, 9 aa, Homo Sapiens
RPPQKFAGL

SEQ ID NO: 523695 - protein, 9 aa, Homo Sapiens
FTRSCGYPT

SEQ ID NO: 523696 - protein, 9 aa, Homo Sapiens
QPCRSQPAF

SEQ ID NO: 523697 - protein, 9 aa, Homo Sapiens
YIGTHNEIR

SEQ ID NO: 523698 - protein, 9 aa, Homo Sapiens
PALKYLDNG

SEQ ID NO: 523699 - protein, 9 aa, Homo Sapiens
RMPPVTAPG

SEQ ID NO: 523700 - protein, 9 aa, Homo Sapiens
SGGAPSPFN

SEQ ID NO: 523701 - protein, 9 aa, Homo Sapiens
KPKIKGNMS

SEQ ID NO: 523702 - protein, 9 aa, Homo Sapiens
SSSLQPCRS

SEQ ID NO: 523703 - protein, 9 aa, Homo Sapiens
RAIKESQQG

SEQ ID NO: 523704 - protein, 9 aa, Homo Sapiens
EPIKGFDGW

SEQ ID NO: 523705 - protein, 9 aa, Homo Sapiens
FQAPFLEMS

SEQ ID NO: 523706 - protein, 9 aa, Homo Sapiens
QHQHQHQQQ

SEQ ID NO: 523707 - protein, 9 aa, Homo Sapiens
TAESVCLPD

SEQ ID NO: 523708 - protein, 9 aa, Homo Sapiens
CWLRSIQQV

SEQ ID NO: 523709 - protein, 9 aa, Homo Sapiens
PRWAKDQNS

SEQ ID NO: 523710 - protein, 9 aa, Homo Sapiens
DRAIKESQQ

SEQ ID NO: 523711 - protein, 9 aa, Homo Sapiens
TFLDPRSIS

SEQ ID NO: 523712 - protein, 9 aa, Homo Sapiens
AESVCLPDV

SEQ ID NO: 523713 - protein, 9 aa, Homo Sapiens
YLSALDQFA

SEQ ID NO: 523714 - protein, 9 aa, Homo Sapiens
STSTNRCEL

SEQ ID NO: 523715 - protein, 9 aa, Homo Sapiens
LTVKSISVS

SEQ ID NO: 523716 - protein, 9 aa, Homo Sapiens
LKYLDNGNN

SEQ ID NO: 523717 - protein, 9 aa, Homo Sapiens
DNGFLIHLD

SEQ ID NO: 523718 - protein, 9 aa, Homo Sapiens
ESFIQSLQD

SEQ ID NO: 523719 - protein, 9 aa, Homo Sapiens
LALSLAVQR

SEQ ID NO: 523720 - protein, 9 aa, Homo Sapiens
SPFNSLLSP

SEQ ID NO: 523721 - protein, 9 aa, Homo Sapiens
CTGGCWDPL

SEQ ID NO: 523722 - protein, 9 aa, Homo Sapiens
GCHWNEGHA

SEQ ID NO: 523723 - protein, 9 aa, Homo Sapiens
QIPGLSQFY

SEQ ID NO: 523724 - protein, 9 aa, Homo Sapiens
FSSVSTGDT

SEQ ID NO: 523725 - protein, 9 aa, Homo Sapiens
QVGGVTHML

SEQ ID NO: 523726 - protein, 9 aa, Homo Sapiens
QPCLGPAEA

SEQ ID NO: 523727 - protein, 9 aa, Homo Sapiens
EDFQAPFLE

SEQ ID NO: 523728 - protein, 9 aa, Homo Sapiens
IMRSFYLLQ

SEQ ID NO: 523729 - protein, 9 aa, Homo Sapiens
IYFILDLCI

SEQ ID NO: 523730 - protein, 9 aa, Homo Sapiens
GYGDKQIYS

SEQ ID NO: 523731 - protein, 9 aa, Homo Sapiens
TGSQDLCLY

SEQ ID NO: 523732 - protein, 9 aa, Homo Sapiens
LNRLFMHLF

SEQ ID NO: 523733 - protein, 9 aa, Homo Sapiens
AAAPVCSSR

SEQ ID NO: 523734 - protein, 9 aa, Homo Sapiens
ACGLSGEKA

SEQ ID NO: 523735 - protein, 9 aa, Homo Sapiens
KAIMRSFYL

SEQ ID NO: 523736 - protein, 9 aa, Homo Sapiens
ACARTLLEG

SEQ ID NO: 523737 - protein, 9 aa, Homo Sapiens
ASGSPTFLL

SEQ ID NO: 523738 - protein, 9 aa, Homo Sapiens
DIPCTPLNR

SEQ ID NO: 523739 - protein, 9 aa, Homo Sapiens
CQPQMPKQN

SEQ ID NO: 523740 - protein, 9 aa, Homo Sapiens
NRKALQLLH

SEQ ID NO: 523741 - protein, 9 aa, Homo Sapiens
RGPPGAWKG

SEQ ID NO: 523742 - protein, 9 aa, Homo Sapiens
GGVTHMLLQ

SEQ ID NO: 523743 - protein, 9 aa, Homo Sapiens
RTARRPDSR

SEQ ID NO: 523744 - protein, 9 aa, Homo Sapiens
TILTVLISY

SEQ ID NO: 523745 - protein, 9 aa, Homo Sapiens
RKQGLMNLW

SEQ ID NO: 523746 - protein, 9 aa, Homo Sapiens
PPGMMFPPR

SEQ ID NO: 523747 - protein, 9 aa, Homo Sapiens
SPGCHWNEG

SEQ ID NO: 523748 - protein, 9 aa, Homo Sapiens
PLFGLVGAE

SEQ ID NO: 523749 - protein, 9 aa, Homo Sapiens
QEGQRPPQK

SEQ ID NO: 523750 - protein, 9 aa, Homo Sapiens
NRLFMHLFV

SEQ ID NO: 523751 - protein, 9 aa, Homo Sapiens
LLFQSLKQH

SEQ ID NO: 523752 - protein, 9 aa, Homo Sapiens
LISPSSCSS

SEQ ID NO: 523753 - protein, 9 aa, Homo Sapiens
YEDLRKQGL

SEQ ID NO: 523754 - protein, 9 aa, Homo Sapiens
DFPCSVRIH

SEQ ID NO: 523755 - protein, 9 aa, Homo Sapiens
RRERLLKQN

SEQ ID NO: 523756 - protein, 9 aa, Homo Sapiens
IESFIQSLQ

SEQ ID NO: 523757 - protein, 9 aa, Homo Sapiens
EDYPVSSHH

SEQ ID NO: 523758 - protein, 9 aa, Homo Sapiens
WNLGFKLSR

SEQ ID NO: 523759 - protein, 9 aa, Homo Sapiens
KQIYSASVT

SEQ ID NO: 523760 - protein, 9 aa, Homo Sapiens
NSLYMVRII

SEQ ID NO: 523761 - protein, 9 aa, Homo Sapiens
LAQVTSYSS

SEQ ID NO: 523762 - protein, 9 aa, Homo Sapiens
DPQSPGCHW

SEQ ID NO: 523763 - protein, 9 aa, Homo Sapiens
ELSGVWTSA

SEQ ID NO: 523764 - protein, 9 aa, Homo Sapiens
PCSVRIHLL

SEQ ID NO: 523765 - protein, 9 aa, Homo Sapiens
LYKGSLGLH

SEQ ID NO: 523766 - protein, 9 aa, Homo Sapiens
EGIYFILDL

SEQ ID NO: 523767 - protein, 9 aa, Homo Sapiens
ARLPQESLV

SEQ ID NO: 523768 - protein, 9 aa, Homo Sapiens
ACHKKCDQK

SEQ ID NO: 523769 - protein, 9 aa, Homo Sapiens
CGSLGPGAP

SEQ ID NO: 523770 - protein, 9 aa, Homo Sapiens
EQRLALRCR

SEQ ID NO: 523771 - protein, 9 aa, Homo Sapiens
SEPENAVSK

SEQ ID NO: 523772 - protein, 9 aa, Homo Sapiens
RITAESVCL

SEQ ID NO: 523773 - protein, 9 aa, Homo Sapiens
WRTHAAFTG

SEQ ID NO: 523774 - protein, 9 aa, Homo Sapiens
GGSEDNKRA

SEQ ID NO: 523775 - protein, 9 aa, Homo Sapiens
REILSATEH

SEQ ID NO: 523776 - protein, 9 aa, Homo Sapiens
AFTGSQDLC

SEQ ID NO: 523777 - protein, 9 aa, Homo Sapiens
AWKGRRPGD

SEQ ID NO: 523778 - protein, 9 aa, Homo Sapiens
SPSSCSSWG

SEQ ID NO: 523779 - protein, 9 aa, Homo Sapiens
SGVWTSAWR

SEQ ID NO: 523780 - protein, 9 aa, Homo Sapiens
EVPGVFSRS

SEQ ID NO: 523781 - protein, 9 aa, Homo Sapiens
EDLRKQGLM

SEQ ID NO: 523782 - protein, 9 aa, Homo Sapiens
SSLNSSRSG

SEQ ID NO: 523783 - protein, 9 aa, Homo Sapiens
SAWRTHAAF

SEQ ID NO: 523784 - protein, 9 aa, Homo Sapiens
KFGDNGFLI

SEQ ID NO: 523785 - protein, 9 aa, Homo Sapiens
TVLSLALSL

SEQ ID NO: 523786 - protein, 9 aa, Homo Sapiens
SVVISAHYS

SEQ ID NO: 523787 - protein, 9 aa, Homo Sapiens
TKFGDNGFL

SEQ ID NO: 523788 - protein, 9 aa, Homo Sapiens
GPPWAPGPH

SEQ ID NO: 523789 - protein, 9 aa, Homo Sapiens
KKKKKGKER

SEQ ID NO: 523790 - protein, 9 aa, Homo Sapiens
NSSRSGGEQ

SEQ ID NO: 523791 - protein, 9 aa, Homo Sapiens
SIEIVTILT

SEQ ID NO: 523792 - protein, 9 aa, Homo Sapiens
KKKKGKERQ

SEQ ID NO: 523793 - protein, 9 aa, Homo Sapiens
ESFSTNVLL

SEQ ID NO: 523794 - protein, 9 aa, Homo Sapiens
LGPGAPLEP

SEQ ID NO: 523795 - protein, 9 aa, Homo Sapiens
CLGPAEAGQ

SEQ ID NO: 523796 - protein, 9 aa, Homo Sapiens
NVLLIEHAK

SEQ ID NO: 523797 - protein, 9 aa, Homo Sapiens
FVHRVDFPC

SEQ ID NO: 523798 - protein, 9 aa, Homo Sapiens
VFDCNEESG

SEQ ID NO: 523799 - protein, 9 aa, Homo Sapiens
ESVCLPDVV

SEQ ID NO: 523800 - protein, 9 aa, Homo Sapiens
EAEEREAEE

SEQ ID NO: 523801 - protein, 9 aa, Homo Sapiens
SQFYLSALD

SEQ ID NO: 523802 - protein, 9 aa, Homo Sapiens
LFSLTWQFS

SEQ ID NO: 523803 - protein, 9 aa, Homo Sapiens
FKLSRWNYK

SEQ ID NO: 523804 - protein, 9 aa, Homo Sapiens
NTVLSLALS

SEQ ID NO: 523805 - protein, 9 aa, Homo Sapiens
LCNTATDDS

SEQ ID NO: 523806 - protein, 9 aa, Homo Sapiens
LDNGNNASP

SEQ ID NO: 523807 - protein, 9 aa, Homo Sapiens
VTILTVLIS

SEQ ID NO: 523808 - protein, 9 aa, Homo Sapiens
IPGLSQFYL

SEQ ID NO: 523809 - protein, 9 aa, Homo Sapiens
SWGPGSFTR

SEQ ID NO: 523810 - protein, 9 aa, Homo Sapiens
AKREILSAT

SEQ ID NO: 523811 - protein, 9 aa, Homo Sapiens
CSVRIHLLT

SEQ ID NO: 523812 - protein, 9 aa, Homo Sapiens
GSQDLCLYK

SEQ ID NO: 523813 - protein, 9 aa, Homo Sapiens
TPLNRLFMH

SEQ ID NO: 523814 - protein, 9 aa, Homo Sapiens
PLNRLFMHL

SEQ ID NO: 523815 - protein, 9 aa, Homo Sapiens
TWKVFDCNE

SEQ ID NO: 523816 - protein, 9 aa, Homo Sapiens
QSLKQHPPL

SEQ ID NO: 523817 - protein, 9 aa, Homo Sapiens
RPLLPSVLG

SEQ ID NO: 523818 - protein, 9 aa, Homo Sapiens
HRVDFPCSV

SEQ ID NO: 523819 - protein, 9 aa, Homo Sapiens
SKREPGELS

SEQ ID NO: 523820 - protein, 9 aa, Homo Sapiens
RCGFCGSLG

SEQ ID NO: 523821 - protein, 9 aa, Homo Sapiens
GGANVNAIT

SEQ ID NO: 523822 - protein, 9 aa, Homo Sapiens
RSVYEEDFQ

SEQ ID NO: 523823 - protein, 9 aa, Homo Sapiens
EAEEREARE

SEQ ID NO: 523824 - protein, 9 aa, Homo Sapiens
PPRWAKDQN

SEQ ID NO: 523825 - protein, 9 aa, Homo Sapiens
ESLVPYMPN

SEQ ID NO: 523826 - protein, 9 aa, Homo Sapiens
LPSVLGLGG

SEQ ID NO: 523827 - protein, 9 aa, Homo Sapiens
RSFYLLQEA

SEQ ID NO: 523828 - protein, 9 aa, Homo Sapiens
ALSARDRAI

SEQ ID NO: 523829 - protein, 9 aa, Homo Sapiens
VWDIFQPPL

SEQ ID NO: 523830 - protein, 9 aa, Homo Sapiens
THIYIHTHT

SEQ ID NO: 523831 - protein, 9 aa, Homo Sapiens
DNKRAYMNL

SEQ ID NO: 523832 - protein, 9 aa, Homo Sapiens
SSRSGGEQD

SEQ ID NO: 523833 - protein, 9 aa, Homo Sapiens
QEGIYFILD

SEQ ID NO: 523834 - protein, 9 aa, Homo Sapiens
MKAIMRSFY

SEQ ID NO: 523835 - protein, 9 aa, Homo Sapiens
KFEKYFNRK

SEQ ID NO: 523836 - protein, 9 aa, Homo Sapiens
LEGSGHRLG

SEQ ID NO: 523837 - protein, 9 aa, Homo Sapiens
RLFMHLFVA

SEQ ID NO: 523838 - protein, 9 aa, Homo Sapiens
GLGFLISPS

SEQ ID NO: 523839 - protein, 9 aa, Homo Sapiens
GFCGSLGPG

SEQ ID NO: 523840 - protein, 9 aa, Homo Sapiens
CSVVISAHY

SEQ ID NO: 523841 - protein, 9 aa, Homo Sapiens
INKRVKHDL

SEQ ID NO: 523842 - protein, 9 aa, Homo Sapiens
LPVTSFSSV

SEQ ID NO: 523843 - protein, 9 aa, Homo Sapiens
YFILDLCIE

SEQ ID NO: 523844 - protein, 9 aa, Homo Sapiens
LLGKGIRLQ

SEQ ID NO: 523845 - protein, 9 aa, Homo Sapiens
LLKQNCADQ

SEQ ID NO: 523846 - protein, 9 aa, Homo Sapiens
GNNASPTYN

SEQ ID NO: 523847 - protein, 9 aa, Homo Sapiens
VLGLGGSDL

SEQ ID NO: 523848 - protein, 9 aa, Homo Sapiens
VRRALCNTA

SEQ ID NO: 523849 - protein, 9 aa, Homo Sapiens
DFQAPFLEM

SEQ ID NO: 523850 - protein, 9 aa, Homo Sapiens
LQEGIYFIL

SEQ ID NO: 523851 - protein, 9 aa, Homo Sapiens
GQRPPQKFA

SEQ ID NO: 523852 - protein, 9 aa, Homo Sapiens
LERSVRELH

SEQ ID NO: 523853 - protein, 9 aa, Homo Sapiens
EWEQKIQYT

SEQ ID NO: 523854 - protein, 9 aa, Homo Sapiens
GFLISPSSC

SEQ ID NO: 523855 - protein, 9 aa, Homo Sapiens
KKKGKERQE

SEQ ID NO: 523856 - protein, 9 aa, Homo Sapiens
GSGSPCQSG

SEQ ID NO: 523857 - protein, 9 aa, Homo Sapiens
QHLQREYLS

SEQ ID NO: 523858 - protein, 9 aa, Homo Sapiens
TSHDMEYHI

SEQ ID NO: 523859 - protein, 9 aa, Homo Sapiens
VNISSHVHT

SEQ ID NO: 523860 - protein, 9 aa, Homo Sapiens
APRERIKIA

SEQ ID NO: 523861 - protein, 9 aa, Homo Sapiens
EHAHIHATE

SEQ ID NO: 523862 - protein, 9 aa, Homo Sapiens
PVVFSGLFF

SEQ ID NO: 523863 - protein, 9 aa, Homo Sapiens
GAMAALELE

SEQ ID NO: 523864 - protein, 9 aa, Homo Sapiens
ERGGGAMAA

SEQ ID NO: 523865 - protein, 9 aa, Homo Sapiens
IYSQEKRGK

SEQ ID NO: 523866 - protein, 9 aa, Homo Sapiens
VGPMPEQSL

SEQ ID NO: 523867 - protein, 9 aa, Homo Sapiens
IGLLLDKQL

SEQ ID NO: 523868 - protein, 9 aa, Homo Sapiens
KSKEELTEH

SEQ ID NO: 523869 - protein, 9 aa, Homo Sapiens
YIHSNENVI

SEQ ID NO: 523870 - protein, 9 aa, Homo Sapiens
YWKLHHSVP

SEQ ID NO: 523871 - protein, 9 aa, Homo Sapiens
YIHTHTFYV

SEQ ID NO: 523872 - protein, 9 aa, Homo Sapiens
LLRAALILR

SEQ ID NO: 523873 - protein, 9 aa, Homo Sapiens
SQVQRRLVQ

SEQ ID NO: 523874 - protein, 9 aa, Homo Sapiens
HFQRSRRSF

SEQ ID NO: 523875 - protein, 9 aa, Homo Sapiens
CFTSHDMEY

SEQ ID NO: 523876 - protein, 9 aa, Homo Sapiens
VILSSLKIY

SEQ ID NO: 523877 - protein, 9 aa, Homo Sapiens
TVYSGFGSI

SEQ ID NO: 523878 - protein, 9 aa, Homo Sapiens
IQLSEVDKS

SEQ ID NO: 523879 - protein, 9 aa, Homo Sapiens
GDLLAVGLL

SEQ ID NO: 523880 - protein, 9 aa, Homo Sapiens
VKNYRMIKE

SEQ ID NO: 523881 - protein, 9 aa, Homo Sapiens
YSGFGSIPS

SEQ ID NO: 523882 - protein, 9 aa, Homo Sapiens
RDPLSKITE

SEQ ID NO: 523883 - protein, 9 aa, Homo Sapiens
QAPRERIKI

SEQ ID NO: 523884 - protein, 9 aa, Homo Sapiens
LGLASPQER

SEQ ID NO: 523885 - protein, 9 aa, Homo Sapiens
QEHAHIHAT

SEQ ID NO: 523886 - protein, 9 aa, Homo Sapiens
AYIHSNENV

SEQ ID NO: 523887 - protein, 9 aa, Homo Sapiens
IKERKGLRL

SEQ ID NO: 523888 - protein, 9 aa, Homo Sapiens
GADQLLHHL

SEQ ID NO: 523889 - protein, 9 aa, Homo Sapiens
LKREAETLW

SEQ ID NO: 523890 - protein, 9 aa, Homo Sapiens
NISSHVHTV

SEQ ID NO: 523891 - protein, 9 aa, Homo Sapiens
SMWELGLLI

SEQ ID NO: 523892 - protein, 9 aa, Homo Sapiens
HIGLLLDKQ

SEQ ID NO: 523893 - protein, 9 aa, Homo Sapiens
DKQLDSGQV

SEQ ID NO: 523894 - protein, 9 aa, Homo Sapiens
GVILSSLKI

SEQ ID NO: 523895 - protein, 9 aa, Homo Sapiens
EVVVMLHFQ

SEQ ID NO: 523896 - protein, 9 aa, Homo Sapiens
SLNTDYSVS

SEQ ID NO: 523897 - protein, 9 aa, Homo Sapiens
SGQVSVAGS

SEQ ID NO: 523898 - protein, 9 aa, Homo Sapiens
VEQVNDIGA

SEQ ID NO: 523899 - protein, 9 aa, Homo Sapiens
ILSSLKIYS

SEQ ID NO: 523900 - protein, 9 aa, Homo Sapiens
LGGQVQRAE

SEQ ID NO: 523901 - protein, 9 aa, Homo Sapiens
GSLTSTSDG

SEQ ID NO: 523902 - protein, 9 aa, Homo Sapiens
VAGSQVQSG

SEQ ID NO: 523903 - protein, 9 aa, Homo Sapiens
PCQSGSDSE

SEQ ID NO: 523904 - protein, 9 aa, Homo Sapiens
QVQRRLVQG

SEQ ID NO: 523905 - protein, 9 aa, Homo Sapiens
VWDFMGAMY

SEQ ID NO: 523906 - protein, 9 aa, Homo Sapiens
IYIYTHIYI

SEQ ID NO: 523907 - protein, 9 aa, Homo Sapiens
ALAAETADG

SEQ ID NO: 523908 - protein, 9 aa, Homo Sapiens
NAFQEHAHI

SEQ ID NO: 523909 - protein, 9 aa, Homo Sapiens
GHTLRASMW

SEQ ID NO: 523910 - protein, 9 aa, Homo Sapiens
MSGSGSPCQ

SEQ ID NO: 523911 - protein, 9 aa, Homo Sapiens
SPQERGGGA

SEQ ID NO: 523912 - protein, 9 aa, Homo Sapiens
LAAETADGE

SEQ ID NO: 523913 - protein, 9 aa, Homo Sapiens
NCFAGNLEQ

SEQ ID NO: 523914 - protein, 9 aa, Homo Sapiens
FFFFFPFFF

SEQ ID NO: 523915 - protein, 9 aa, Homo Sapiens
GAAPLAPLQ

SEQ ID NO: 523916 - protein, 9 aa, Homo Sapiens
TKKHPSASM

SEQ ID NO: 523917 - protein, 9 aa, Homo Sapiens
RGGGAMAAL

SEQ ID NO: 523918 - protein, 9 aa, Homo Sapiens
QMSGSGSPC

SEQ ID NO: 523919 - protein, 9 aa, Homo Sapiens
TALGQASSS

SEQ ID NO: 523920 - protein, 9 aa, Homo Sapiens
ALQVDVGPM

SEQ ID NO: 523921 - protein, 9 aa, Homo Sapiens
FTVYSGFGS

SEQ ID NO: 523922 - protein, 9 aa, Homo Sapiens
RLVQGSPGQ

SEQ ID NO: 523923 - protein, 9 aa, Homo Sapiens
DFVWDFMGA

SEQ ID NO: 523924 - protein, 9 aa, Homo Sapiens
LRVPVGGSQ

SEQ ID NO: 523925 - protein, 9 aa, Homo Sapiens
FFSHLCADF

SEQ ID NO: 523926 - protein, 9 aa, Homo Sapiens
RAEPLLVEQ

SEQ ID NO: 523927 - protein, 9 aa, Homo Sapiens
KQLDSGQVS

SEQ ID NO: 523928 - protein, 9 aa, Homo Sapiens
PQERGGGAM

SEQ ID NO: 523929 - protein, 9 aa, Homo Sapiens
TLRASMWEL

SEQ ID NO: 523930 - protein, 9 aa, Homo Sapiens
NKLFPDSKD

SEQ ID NO: 523931 - protein, 9 aa, Homo Sapiens
CVPALGGQV

SEQ ID NO: 523932 - protein, 9 aa, Homo Sapiens
AAPLAPLQP

SEQ ID NO: 523933 - protein, 9 aa, Homo Sapiens
RPTVPTKKH

SEQ ID NO: 523934 - protein, 9 aa, Homo Sapiens
SWSCFTSHD

SEQ ID NO: 523935 - protein, 9 aa, Homo Sapiens
GMFTVYSGF

SEQ ID NO: 523936 - protein, 9 aa, Homo Sapiens
GPMPEQSLH

SEQ ID NO: 523937 - protein, 9 aa, Homo Sapiens
VVVMLHFQR

SEQ ID NO: 523938 - protein, 9 aa, Homo Sapiens
AVGLLRAAL

SEQ ID NO: 523939 - protein, 9 aa, Homo Sapiens
QVNDIGADQ

SEQ ID NO: 523940 - protein, 9 aa, Homo Sapiens
FAGNLEQLD

SEQ ID NO: 523941 - protein, 9 aa, Homo Sapiens
ETADGEPGA

SEQ ID NO: 523942 - protein, 9 aa, Homo Sapiens
QGSPGQHIG

SEQ ID NO: 523943 - protein, 9 aa, Homo Sapiens
ERKGLRLID

SEQ ID NO: 523944 - protein, 9 aa, Homo Sapiens
PLAPLQPPS

SEQ ID NO: 523945 - protein, 9 aa, Homo Sapiens
SCFTSHDME

SEQ ID NO: 523946 - protein, 9 aa, Homo Sapiens
WDFMGAMYG

SEQ ID NO: 523947 - protein, 9 aa, Homo Sapiens
LAVGLLRAA

SEQ ID NO: 523948 - protein, 9 aa, Homo Sapiens
LEFEMQHLQ

SEQ ID NO: 523949 - protein, 9 aa, Homo Sapiens
EKRFPDFVW

SEQ ID NO: 523950 - protein, 9 aa, Homo Sapiens
SPCQSGSDS

SEQ ID NO: 523951 - protein, 9 aa, Homo Sapiens
EPLLVEQVN

SEQ ID NO: 523952 - protein, 9 aa, Homo Sapiens
GLASPQERG

SEQ ID NO: 523953 - protein, 9 aa, Homo Sapiens
EQVNDIGAD

SEQ ID NO: 523954 - protein, 9 aa, Homo Sapiens
EALQVDVGP

SEQ ID NO: 523955 - protein, 9 aa, Homo Sapiens
MLHFQRSRR

SEQ ID NO: 523956 - protein, 9 aa, Homo Sapiens
ETLWEREGE

SEQ ID NO: 523957 - protein, 9 aa, Homo Sapiens
PVGGSQVQR

SEQ ID NO: 523958 - protein, 9 aa, Homo Sapiens
LVYWKLHHS

SEQ ID NO: 523959 - protein, 9 aa, Homo Sapiens
TDYSVSYID

SEQ ID NO: 523960 - protein, 9 aa, Homo Sapiens
LWEREGEEF

SEQ ID NO: 523961 - protein, 9 aa, Homo Sapiens
FFFFFFPFF

SEQ ID NO: 523962 - protein, 9 aa, Homo Sapiens
LVQGSPGQH

SEQ ID NO: 523963 - protein, 9 aa, Homo Sapiens
LSSLKIYSQ

SEQ ID NO: 523964 - protein, 9 aa, Homo Sapiens
RAALAAETA

SEQ ID NO: 523965 - protein, 9 aa, Homo Sapiens
LLLDKQLDS

SEQ ID NO: 523966 - protein, 9 aa, Homo Sapiens
MIKERKGLR

SEQ ID NO: 523967 - protein, 9 aa, Homo Sapiens
LHRLCVPAL

SEQ ID NO: 523968 - protein, 9 aa, Homo Sapiens
TVPTKKHPS

SEQ ID NO: 523969 - protein, 9 aa, Homo Sapiens
GLLLDKQLD

SEQ ID NO: 523970 - protein, 9 aa, Homo Sapiens
QFFFFFFPF

SEQ ID NO: 523971 - protein, 9 aa, Homo Sapiens
RMIKERKGL

SEQ ID NO: 523972 - protein, 9 aa, Homo Sapiens
ALGGQVQRA

SEQ ID NO: 523973 - protein, 9 aa, Homo Sapiens
LNCFAGNLE

SEQ ID NO: 523974 - protein, 9 aa, Homo Sapiens
HDMEYHIEV

SEQ ID NO: 523975 - protein, 9 aa, Homo Sapiens
DTLEFEMQH

SEQ ID NO: 523976 - protein, 9 aa, Homo Sapiens
YSLNTDYSV

SEQ ID NO: 523977 - protein, 9 aa, Homo Sapiens
PLSKITEQE

SEQ ID NO: 523978 - protein, 9 aa, Homo Sapiens
PDFVWDFMG

SEQ ID NO: 523979 - protein, 9 aa, Homo Sapiens
SDGLPLGYP

SEQ ID NO: 523980 - protein, 9 aa, Homo Sapiens
AGNLEQLDQ

SEQ ID NO: 523981 - protein, 9 aa, Homo Sapiens
GGSQVQRRL

SEQ ID NO: 523982 - protein, 9 aa, Homo Sapiens
LNTDYSVSY

SEQ ID NO: 523983 - protein, 9 aa, Homo Sapiens
LLNCFAGNL

SEQ ID NO: 523984 - protein, 9 aa, Homo Sapiens
VFSGLFFSH

SEQ ID NO: 523985 - protein, 9 aa, Homo Sapiens
SSLKIYSQE

SEQ ID NO: 523986 - protein, 9 aa, Homo Sapiens
LDSGQVSVA

SEQ ID NO: 523987 - protein, 9 aa, Homo Sapiens
DIGADQLLH

SEQ ID NO: 523988 - protein, 9 aa, Homo Sapiens
TADGEPGAD

SEQ ID NO: 523989 - protein, 9 aa, Homo Sapiens
TKEYVSNDV

SEQ ID NO: 523990 - protein, 9 aa, Homo Sapiens
SPGQHIGLL

SEQ ID NO: 523991 - protein, 9 aa, Homo Sapiens
PALGGQVQR

SEQ ID NO: 523992 - protein, 9 aa, Homo Sapiens
QVQRAEPLL

SEQ ID NO: 523993 - protein, 9 aa, Homo Sapiens
HHSVPNSSQ

SEQ ID NO: 523994 - protein, 9 aa, Homo Sapiens
PTKKHPSAS

SEQ ID NO: 523995 - protein, 9 aa, Homo Sapiens
ALGQASSSG

SEQ ID NO: 523996 - protein, 9 aa, Homo Sapiens
AALELEALQ

SEQ ID NO: 523997 - protein, 9 aa, Homo Sapiens
GNLEQLDQL

SEQ ID NO: 523998 - protein, 9 aa, Homo Sapiens
ASPQERGGG

SEQ ID NO: 523999 - protein, 9 aa, Homo Sapiens
SNENVIGSS

SEQ ID NO: 524000 - protein, 9 aa, Homo Sapiens
VYWKLHHSV

SEQ ID NO: 524001 - protein, 9 aa, Homo Sapiens
SGLFFSHLC

SEQ ID NO: 524002 - protein, 9 aa, Homo Sapiens
GQASSSGPG

SEQ ID NO: 524003 - protein, 9 aa, Homo Sapiens
SGSPCQSGS

SEQ ID NO: 524004 - protein, 9 aa, Homo Sapiens
LCVPALGGQ

SEQ ID NO: 524005 - protein, 9 aa, Homo Sapiens
RASMWELGL

SEQ ID NO: 524006 - protein, 9 aa, Homo Sapiens
MPEQSLHRL

SEQ ID NO: 524007 - protein, 9 aa, Homo Sapiens
SGFGSIPSG

SEQ ID NO: 524008 - protein, 9 aa, Homo Sapiens
GQHIGLLLD

SEQ ID NO: 524009 - protein, 9 aa, Homo Sapiens
HIYIHTHTF

SEQ ID NO: 524010 - protein, 9 aa, Homo Sapiens
FQEHAHIHA

SEQ ID NO: 524011 - protein, 9 aa, Homo Sapiens
QERGGGAMA

SEQ ID NO: 524012 - protein, 9 aa, Homo Sapiens
HHLRVPVGG

SEQ ID NO: 524013 - protein, 9 aa, Homo Sapiens
GQVQRAEPL

SEQ ID NO: 524014 - protein, 9 aa, Homo Sapiens
LVEQVNDIG

SEQ ID NO: 524015 - protein, 9 aa, Homo Sapiens
VMLHFQRSR

SEQ ID NO: 524016 - protein, 9 aa, Homo Sapiens
SHDMEYHIE

SEQ ID NO: 524017 - protein, 9 aa, Homo Sapiens
AHGMFTVYS

SEQ ID NO: 524018 - protein, 9 aa, Homo Sapiens
SVTALGQAS

SEQ ID NO: 524019 - protein, 9 aa, Homo Sapiens
HAHIHATEY

SEQ ID NO: 524020 - protein, 9 aa, Homo Sapiens
IYTHIYIHT

SEQ ID NO: 524021 - protein, 9 aa, Homo Sapiens
SVAGSQVQS

SEQ ID NO: 524022 - protein, 9 aa, Homo Sapiens
KYQRPTVPT

SEQ ID NO: 524023 - protein, 9 aa, Homo Sapiens
AGSLTSTSD

SEQ ID NO: 524024 - protein, 9 aa, Homo Sapiens
LLVEQVNDI

SEQ ID NO: 524025 - protein, 9 aa, Homo Sapiens
LEALQVDVG

SEQ ID NO: 524026 - protein, 9 aa, Homo Sapiens
EPVNISSHV

SEQ ID NO: 524027 - protein, 9 aa, Homo Sapiens
MAALELEAL

SEQ ID NO: 524028 - protein, 9 aa, Homo Sapiens
MQAPRERIK

SEQ ID NO: 524029 - protein, 9 aa, Homo Sapiens
LELEALQVD

SEQ ID NO: 524030 - protein, 9 aa, Homo Sapiens
VNDIGADQL

SEQ ID NO: 524031 - protein, 9 aa, Homo Sapiens
KNYRMIKER

SEQ ID NO: 524032 - protein, 9 aa, Homo Sapiens
SLHRLCVPA

SEQ ID NO: 524033 - protein, 9 aa, Homo Sapiens
YTHIYIHTH

SEQ ID NO: 524034 - protein, 9 aa, Homo Sapiens
SLTSTSDGL

SEQ ID NO: 524035 - protein, 9 aa, Homo Sapiens
LGPGAAPLA

SEQ ID NO: 524036 - protein, 9 aa, Homo Sapiens
NDVAQSDDE

SEQ ID NO: 524037 - protein, 9 aa, Homo Sapiens
RDTLEFEMQ

SEQ ID NO: 524038 - protein, 9 aa, Homo Sapiens
AETLWEREG

SEQ ID NO: 524039 - protein, 9 aa, Homo Sapiens
RLLNCFAGN

SEQ ID NO: 524040 - protein, 9 aa, Homo Sapiens
TLWEREGEE

SEQ ID NO: 524041 - protein, 9 aa, Homo Sapiens
STSDGLPLG

SEQ ID NO: 524042 - protein, 9 aa, Homo Sapiens
LQVDVGPMP

SEQ ID NO: 524043 - protein, 9 aa, Homo Sapiens
PGAAPLAPL

SEQ ID NO: 524044 - protein, 9 aa, Homo Sapiens
SGSGSPCQS

SEQ ID NO: 524045 - protein, 9 aa, Homo Sapiens
KRFPDFVWD

SEQ ID NO: 524046 - protein, 9 aa, Homo Sapiens
QLDSGQVSV

SEQ ID NO: 524047 - protein, 9 aa, Homo Sapiens
AEPLLVEQV

SEQ ID NO: 524048 - protein, 9 aa, Homo Sapiens
FPFFFLRRS

SEQ ID NO: 524049 - protein, 9 aa, Homo Sapiens
NTDYSVSYI

SEQ ID NO: 524050 - protein, 9 aa, Homo Sapiens
LHFQRSRRS

SEQ ID NO: 524051 - protein, 9 aa, Homo Sapiens
AETADGEPG

SEQ ID NO: 524052 - protein, 9 aa, Homo Sapiens
SKEELTEHI

SEQ ID NO: 524053 - protein, 9 aa, Homo Sapiens
DYSVSYIDS

SEQ ID NO: 524054 - protein, 9 aa, Homo Sapiens
QRRLVQGSP

SEQ ID NO: 524055 - protein, 9 aa, Homo Sapiens
GGGAMAALE

SEQ ID NO: 524056 - protein, 9 aa, Homo Sapiens
ENVIGSSKA

SEQ ID NO: 524057 - protein, 9 aa, Homo Sapiens
CFAGNLEQL

SEQ ID NO: 524058 - protein, 9 aa, Homo Sapiens
TLEFEMQHL

SEQ ID NO: 524059 - protein, 9 aa, Homo Sapiens
QVDVGPMPE

SEQ ID NO: 524060 - protein, 9 aa, Homo Sapiens
GNAFQEHAH

SEQ ID NO: 524061 - protein, 9 aa, Homo Sapiens
GPGAAPLAP

SEQ ID NO: 524062 - protein, 9 aa, Homo Sapiens
LHHLRVPVG

SEQ ID NO: 524063 - protein, 9 aa, Homo Sapiens
VDVGPMPEQ

SEQ ID NO: 524064 - protein, 9 aa, Homo Sapiens
GSQVQSGVA

SEQ ID NO: 524065 - protein, 9 aa, Homo Sapiens
LHHSVPNSS

SEQ ID NO: 524066 - protein, 9 aa, Homo Sapiens
IYIHTHTFY

SEQ ID NO: 524067 - protein, 9 aa, Homo Sapiens
LTSTSDGLP

SEQ ID NO: 524068 - protein, 9 aa, Homo Sapiens
TSDGLPLGY

SEQ ID NO: 524069 - protein, 9 aa, Homo Sapiens
MFTVYSGFG

SEQ ID NO: 524070 - protein, 9 aa, Homo Sapiens
RVPVGGSQV

SEQ ID NO: 524071 - protein, 9 aa, Homo Sapiens
KEYVSNDVA

SEQ ID NO: 524072 - protein, 9 aa, Homo Sapiens
ISTRDPLSK

SEQ ID NO: 524073 - protein, 9 aa, Homo Sapiens
ERAALAAET

SEQ ID NO: 524074 - protein, 9 aa, Homo Sapiens
FVWDFMGAM

SEQ ID NO: 524075 - protein, 9 aa, Homo Sapiens
VYSGFGSIP

SEQ ID NO: 524076 - protein, 9 aa, Homo Sapiens
MWELGLLIF

SEQ ID NO: 524077 - protein, 9 aa, Homo Sapiens
DLLAVGLLR

SEQ ID NO: 524078 - protein, 9 aa, Homo Sapiens
CQSGSDSES

SEQ ID NO: 524079 - protein, 9 aa, Homo Sapiens
RFPDFVWDF

SEQ ID NO: 524080 - protein, 9 aa, Homo Sapiens
YIYTHIYIH

SEQ ID NO: 524081 - protein, 9 aa, Homo Sapiens
TSTSDGLPL

SEQ ID NO: 524082 - protein, 9 aa, Homo Sapiens
HRLCVPALG

SEQ ID NO: 524083 - protein, 9 aa, Homo Sapiens
QQFFFFFFP

SEQ ID NO: 524084 - protein, 9 aa, Homo Sapiens
QLLHHLRVP

SEQ ID NO: 524085 - protein, 9 aa, Homo Sapiens
LSKITEQEK

SEQ ID NO: 524086 - protein, 9 aa, Homo Sapiens
PEQSLHRLC

SEQ ID NO: 524087 - protein, 9 aa, Homo Sapiens
SRRSFIQPL

SEQ ID NO: 524088 - protein, 9 aa, Homo Sapiens
FQRSRRSFI

SEQ ID NO: 524089 - protein, 9 aa, Homo Sapiens
FFFPFFFLR

SEQ ID NO: 524090 - protein, 9 aa, Homo Sapiens
EQSLHRLCV

SEQ ID NO: 524091 - protein, 9 aa, Homo Sapiens
HLVYWKLHH

SEQ ID NO: 524092 - protein, 9 aa, Homo Sapiens
MQHLQREYL

SEQ ID NO: 524093 - protein, 9 aa, Homo Sapiens
VSVAGSQVQ

SEQ ID NO: 524094 - protein, 9 aa, Homo Sapiens
VGLLRAALI

SEQ ID NO: 524095 - protein, 9 aa, Homo Sapiens
FFPFFFLRR

SEQ ID NO: 524096 - protein, 9 aa, Homo Sapiens
SLKIYSQEK

SEQ ID NO: 524097 - protein, 9 aa, Homo Sapiens
YRMIKERKG

SEQ ID NO: 524098 - protein, 9 aa, Homo Sapiens
QLSEVDKSK

SEQ ID NO: 524099 - protein, 9 aa, Homo Sapiens
KREVVVMLH

SEQ ID NO: 524100 - protein, 9 aa, Homo Sapiens
KSWSCFTSH

SEQ ID NO: 524101 - protein, 9 aa, Homo Sapiens
EAETLWERE

SEQ ID NO: 524102 - protein, 9 aa, Homo Sapiens
PFFFLRRSL

SEQ ID NO: 524103 - protein, 9 aa, Homo Sapiens
FPDFVWDFM

SEQ ID NO: 524104 - protein, 9 aa, Homo Sapiens
GLFFSHLCA

SEQ ID NO: 524105 - protein, 9 aa, Homo Sapiens
EYVSNDVAQ

SEQ ID NO: 524106 - protein, 9 aa, Homo Sapiens
IHTHTFYVS

SEQ ID NO: 524107 - protein, 9 aa, Homo Sapiens
LRAALILRV

SEQ ID NO: 524108 - protein, 9 aa, Homo Sapiens
LLGQMNKLF

SEQ ID NO: 524109 - protein, 9 aa, Homo Sapiens
FSHLCADFA

SEQ ID NO: 524110 - protein, 9 aa, Homo Sapiens
NDIGADQLL

SEQ ID NO: 524111 - protein, 9 aa, Homo Sapiens
LGQASSSGP

SEQ ID NO: 524112 - protein, 9 aa, Homo Sapiens
DVAQSDDEE

SEQ ID NO: 524113 - protein, 9 aa, Homo Sapiens
WSCFTSHDM

SEQ ID NO: 524114 - protein, 9 aa, Homo Sapiens
FTSHDMEYH

SEQ ID NO: 524115 - protein, 9 aa, Homo Sapiens
HSNENVIGS

SEQ ID NO: 524116 - protein, 9 aa, Homo Sapiens
KLFPDSKDL

SEQ ID NO: 524117 - protein, 9 aa, Homo Sapiens
YVSNDVAQS

SEQ ID NO: 524118 - protein, 9 aa, Homo Sapiens
ALGPGAAPL

SEQ ID NO: 524119 - protein, 9 aa, Homo Sapiens
REVVVMLHF

SEQ ID NO: 524120 - protein, 9 aa, Homo Sapiens
GLLRAALIL

SEQ ID NO: 524121 - protein, 9 aa, Homo Sapiens
LKIYSQEKR

SEQ ID NO: 524122 - protein, 9 aa, Homo Sapiens
QVSVAGSQV

SEQ ID NO: 524123 - protein, 9 aa, Homo Sapiens
VQRRLVQGS

SEQ ID NO: 524124 - protein, 9 aa, Homo Sapiens
IHSNENVIG

SEQ ID NO: 524125 - protein, 9 aa, Homo Sapiens
PLLVEQVND

SEQ ID NO: 524126 - protein, 9 aa, Homo Sapiens
QRSRRSFIQ

SEQ ID NO: 524127 - protein, 9 aa, Homo Sapiens
VQRAEPLLV

SEQ ID NO: 524128 - protein, 9 aa, Homo Sapiens
MNKLFPDSK

SEQ ID NO: 524129 - protein, 9 aa, Homo Sapiens
WEREGEEFD

SEQ ID NO: 524130 - protein, 9 aa, Homo Sapiens
WKLHHSVPN

SEQ ID NO: 524131 - protein, 9 aa, Homo Sapiens
VLLGQMNKL

SEQ ID NO: 524132 - protein, 9 aa, Homo Sapiens
PMPEQSLHR

SEQ ID NO: 524133 - protein, 9 aa, Homo Sapiens
VVLLGQMNK

SEQ ID NO: 524134 - protein, 9 aa, Homo Sapiens
EMQHLQREY

SEQ ID NO: 524135 - protein, 9 aa, Homo Sapiens
GGAMAALEL

SEQ ID NO: 524136 - protein, 9 aa, Homo Sapiens
DGLPLGYPQ

SEQ ID NO: 524137 - protein, 9 aa, Homo Sapiens
LLHHLRVPV

SEQ ID NO: 524138 - protein, 9 aa, Homo Sapiens
VAQSDDEEK

SEQ ID NO: 524139 - protein, 9 aa, Homo Sapiens
VVFSGLFFS

SEQ ID NO: 524140 - protein, 9 aa, Homo Sapiens
GSQVQRRLV

SEQ ID NO: 524141 - protein, 9 aa, Homo Sapiens
AMAALELEA

SEQ ID NO: 524142 - protein, 9 aa, Homo Sapiens
EVDKSKEEL

SEQ ID NO: 524143 - protein, 9 aa, Homo Sapiens
RLCVPALGG

SEQ ID NO: 524144 - protein, 9 aa, Homo Sapiens
AGSQVQSGV

SEQ ID NO: 524145 - protein, 9 aa, Homo Sapiens
ADQLLHHLR

SEQ ID NO: 524146 - protein, 9 aa, Homo Sapiens
AFQEHAHIH

SEQ ID NO: 524147 - protein, 9 aa, Homo Sapiens
YSVSYIDSA

SEQ ID NO: 524148 - protein, 9 aa, Homo Sapiens
QRAEPLLVE

SEQ ID NO: 524149 - protein, 9 aa, Homo Sapiens
DQLLHHLRV

SEQ ID NO: 524150 - protein, 9 aa, Homo Sapiens
VTALGQASS

SEQ ID NO: 524151 - protein, 9 aa, Homo Sapiens
QRPTVPTKK

SEQ ID NO: 524152 - protein, 9 aa, Homo Sapiens
HGMFTVYSG

SEQ ID NO: 524153 - protein, 9 aa, Homo Sapiens
YQRPTVPTK

SEQ ID NO: 524154 - protein, 9 aa, Homo Sapiens
KLHHSVPNS

SEQ ID NO: 524155 - protein, 9 aa, Homo Sapiens
GSPGQHIGL

SEQ ID NO: 524156 - protein, 9 aa, Homo Sapiens
VAYIHSNEN

SEQ ID NO: 524157 - protein, 9 aa, Homo Sapiens
QMNKLFPDS

SEQ ID NO: 524158 - protein, 9 aa, Homo Sapiens
ISSHVHTVT

SEQ ID NO: 524159 - protein, 9 aa, Homo Sapiens
RRLVQGSPG

SEQ ID NO: 524160 - protein, 9 aa, Homo Sapiens
SSSGPGMAP

SEQ ID NO: 524161 - protein, 9 aa, Homo Sapiens
DVGPMPEQS

SEQ ID NO: 524162 - protein, 9 aa, Homo Sapiens
AGNAFQEHA

SEQ ID NO: 524163 - protein, 9 aa, Homo Sapiens
AAETADGEP

SEQ ID NO: 524164 - protein, 9 aa, Homo Sapiens
LFFSHLCAD

SEQ ID NO: 524165 - protein, 9 aa, Homo Sapiens
TRDPLSKIT

SEQ ID NO: 524166 - protein, 9 aa, Homo Sapiens
DKSKEELTE

SEQ ID NO: 524167 - protein, 9 aa, Homo Sapiens
DPLSKITEQ

SEQ ID NO: 524168 - protein, 9 aa, Homo Sapiens
ALELEALQV

SEQ ID NO: 524169 - protein, 9 aa, Homo Sapiens
LAPLQPPSV

SEQ ID NO: 524170 - protein, 9 aa, Homo Sapiens
LDKQLDSGQ

SEQ ID NO: 524171 - protein, 9 aa, Homo Sapiens
EFEMQHLQR

SEQ ID NO: 524172 - protein, 9 aa, Homo Sapiens
RSRRSFIQP

SEQ ID NO: 524173 - protein, 9 aa, Homo Sapiens
KYSLNTDYS

SEQ ID NO: 524174 - protein, 9 aa, Homo Sapiens
HLRVPVGGS

SEQ ID NO: 524175 - protein, 9 aa, Homo Sapiens
GQMNKLFPD

SEQ ID NO: 524176 - protein, 9 aa, Homo Sapiens
GSPCQSGSD

SEQ ID NO: 524177 - protein, 9 aa, Homo Sapiens
LLDKQLDSG

SEQ ID NO: 524178 - protein, 9 aa, Homo Sapiens
KREAETLWE

SEQ ID NO: 524179 - protein, 9 aa, Homo Sapiens
SQVQSGVAV

SEQ ID NO: 524180 - protein, 9 aa, Homo Sapiens
GQVSVAGSQ

SEQ ID NO: 524181 - protein, 9 aa, Homo Sapiens
PTVPTKKHP

SEQ ID NO: 524182 - protein, 9 aa, Homo Sapiens
SEVDKSKEE

SEQ ID NO: 524183 - protein, 9 aa, Homo Sapiens
WELGLLIFF

SEQ ID NO: 524184 - protein, 9 aa, Homo Sapiens
APLAPLQPP

SEQ ID NO: 524185 - protein, 9 aa, Homo Sapiens
VPVGGSQVQ

SEQ ID NO: 524186 - protein, 9 aa, Homo Sapiens
NENVIGSSK

SEQ ID NO: 524187 - protein, 9 aa, Homo Sapiens
FEMQHLQRE

SEQ ID NO: 524188 - protein, 9 aa, Homo Sapiens
NYRMIKERK

SEQ ID NO: 524189 - protein, 9 aa, Homo Sapiens
VPALGGQVQ

SEQ ID NO: 524190 - protein, 9 aa, Homo Sapiens
STRDPLSKI

SEQ ID NO: 524191 - protein, 9 aa, Homo Sapiens
KIYSQEKRG

SEQ ID NO: 524192 - protein, 9 aa, Homo Sapiens
QHIGLLLDK

SEQ ID NO: 524193 - protein, 9 aa, Homo Sapiens
NLEQLDQLL

SEQ ID NO: 524194 - protein, 9 aa, Homo Sapiens
VSNDVAQSD

SEQ ID NO: 524195 - protein, 9 aa, Homo Sapiens
SKYSLNTDY

SEQ ID NO: 524196 - protein, 9 aa, Homo Sapiens
SKITEQEKD

SEQ ID NO: 524197 - protein, 9 aa, Homo Sapiens
ASSSGPGMA

SEQ ID NO: 524198 - protein, 9 aa, Homo Sapiens
LGQMNKLFP

SEQ ID NO: 524199 - protein, 9 aa, Homo Sapiens
QASSSGPGM

SEQ ID NO: 524200 - protein, 9 aa, Homo Sapiens
LRASMWELG

SEQ ID NO: 524201 - protein, 9 aa, Homo Sapiens
ELEALQVDV

SEQ ID NO: 524202 - protein, 9 aa, Homo Sapiens
AALAAETAD

SEQ ID NO: 524203 - protein, 9 aa, Homo Sapiens
VVMLHFQRS

SEQ ID NO: 524204 - protein, 9 aa, Homo Sapiens
QSLHRLCVP

SEQ ID NO: 524205 - protein, 9 aa, Homo Sapiens
VQGSPGQHI

SEQ ID NO: 524206 - protein, 9 aa, Homo Sapiens
PGQHIGLLL

SEQ ID NO: 524207 - protein, 9 aa, Homo Sapiens
PKREVVVML

SEQ ID NO: 524208 - protein, 9 aa, Homo Sapiens
FSGLFFSHL

SEQ ID NO: 524209 - protein, 9 aa, Homo Sapiens
DSGQVSVAG

SEQ ID NO: 524210 - protein, 9 aa, Homo Sapiens
ASMWELGLL

SEQ ID NO: 524211 - protein, 9 aa, Homo Sapiens
EVAYIHSNE

SEQ ID NO: 524212 - protein, 9 aa, Homo Sapiens
KERKGLRLI

SEQ ID NO: 524213 - protein, 9 aa, Homo Sapiens
IGADQLLHH

SEQ ID NO: 524214 - protein, 9 aa, Homo Sapiens
EHLVYWKLH

SEQ ID NO: 524215 - protein, 9 aa, Homo Sapiens
REAETLWER

SEQ ID NO: 524216 - protein, 9 aa, Homo Sapiens
LASPQERGG

SEQ ID NO: 524217 - protein, 9 aa, Homo Sapiens
SNDVAQSDD

SEQ ID NO: 524218 - protein, 9 aa, Homo Sapiens
GGQVQRAEP

SEQ ID NO: 524219 - protein, 9 aa, Homo Sapiens
THIYIHTHT

SEQ ID NO: 524220 - protein, 9 aa, Homo Sapiens
VPTKKHPSA

SEQ ID NO: 524221 - protein, 9 aa, Homo Sapiens
LLAVGLLRA

SEQ ID NO: 524222 - protein, 9 aa, Homo Sapiens
HTLRASMWE

SEQ ID NO: 524223 - protein, 9 aa, Homo Sapiens
VDKSKEELT

SEQ ID NO: 524224 - protein, 9 aa, Homo Sapiens
FFFFPFFFL

SEQ ID NO: 524225 - protein, 9 aa, Homo Sapiens
PPKREVVVM

SEQ ID NO: 524226 - protein, 9 aa, Homo Sapiens
KITEQEKDF

SEQ ID NO: 524227 - protein, 9 aa, Homo Sapiens
PVNISSHVH

SEQ ID NO: 524228 - protein, 9 aa, Homo Sapiens
LSEVDKSKE

SEQ ID NO: 524229 - protein, 9 aa, Homo Sapiens
VGGSQVQRR

SEQ ID NO: 524230 - protein, 9 aa, Homo Sapiens
SAGPRGACP

SEQ ID NO: 524231 - protein, 9 aa, Homo Sapiens
AICGYGLFA

SEQ ID NO: 524232 - protein, 9 aa, Homo Sapiens
MCYLGKVLE

SEQ ID NO: 524233 - protein, 9 aa, Homo Sapiens
RLLGSARLE

SEQ ID NO: 524234 - protein, 9 aa, Homo Sapiens
TIRKRRLDQ

SEQ ID NO: 524235 - protein, 9 aa, Homo Sapiens
NLNRNFPDA

SEQ ID NO: 524236 - protein, 9 aa, Homo Sapiens
ADLQPGDII

SEQ ID NO: 524237 - protein, 9 aa, Homo Sapiens
RFEVGEKLS

SEQ ID NO: 524238 - protein, 9 aa, Homo Sapiens
PPSPVPGMP

SEQ ID NO: 524239 - protein, 9 aa, Homo Sapiens
SLVVFSACC

SEQ ID NO: 524240 - protein, 9 aa, Homo Sapiens
ASGFGSPVG

SEQ ID NO: 524241 - protein, 9 aa, Homo Sapiens
ALKSLIPSL

SEQ ID NO: 524242 - protein, 9 aa, Homo Sapiens
FLFPAVPEE

SEQ ID NO: 524243 - protein, 9 aa, Homo Sapiens
INMCYLGKV

SEQ ID NO: 524244 - protein, 9 aa, Homo Sapiens
PRGACPASP

SEQ ID NO: 524245 - protein, 9 aa, Homo Sapiens
GSLTPRPPS

SEQ ID NO: 524246 - protein, 9 aa, Homo Sapiens
KTLNWIQLA

SEQ ID NO: 524247 - protein, 9 aa, Homo Sapiens
PFPCACVKE

SEQ ID NO: 524248 - protein, 9 aa, Homo Sapiens
SRLLGSARL

SEQ ID NO: 524249 - protein, 9 aa, Homo Sapiens
AFWGPITLQ

SEQ ID NO: 524250 - protein, 9 aa, Homo Sapiens
HITLHDEEA

SEQ ID NO: 524251 - protein, 9 aa, Homo Sapiens
QEQPHEDPK

SEQ ID NO: 524252 - protein, 9 aa, Homo Sapiens
VDVMKKACL

SEQ ID NO: 524253 - protein, 9 aa, Homo Sapiens
TEMEKLIRF

SEQ ID NO: 524254 - protein, 9 aa, Homo Sapiens
AVGLLRAAL

SEQ ID NO: 524255 - protein, 9 aa, Homo Sapiens
VNGYIYDQN

SEQ ID NO: 524256 - protein, 9 aa, Homo Sapiens
LNWIQLARN

SEQ ID NO: 524257 - protein, 9 aa, Homo Sapiens
LFDLRADRE

SEQ ID NO: 524258 - protein, 9 aa, Homo Sapiens
LLRAALILR

SEQ ID NO: 524259 - protein, 9 aa, Homo Sapiens
IDRQGQSSH

SEQ ID NO: 524260 - protein, 9 aa, Homo Sapiens
TNPFPCACV

SEQ ID NO: 524261 - protein, 9 aa, Homo Sapiens
HPPPTLMTS

SEQ ID NO: 524262 - protein, 9 aa, Homo Sapiens
MEKLIRFIG

SEQ ID NO: 524263 - protein, 9 aa, Homo Sapiens
GDLLAVGLL

SEQ ID NO: 524264 - protein, 9 aa, Homo Sapiens
PRTKPRVGR

SEQ ID NO: 524265 - protein, 9 aa, Homo Sapiens
LTPRPPSPV

SEQ ID NO: 524266 - protein, 9 aa, Homo Sapiens
RELICFSHE

SEQ ID NO: 524267 - protein, 9 aa, Homo Sapiens
CGYGLFAGP

SEQ ID NO: 524268 - protein, 9 aa, Homo Sapiens
WTIRKRRLD

SEQ ID NO: 524269 - protein, 9 aa, Homo Sapiens
TISQAGSDR

SEQ ID NO: 524270 - protein, 9 aa, Homo Sapiens
VGRGPTVGT

SEQ ID NO: 524271 - protein, 9 aa, Homo Sapiens
NSIKSLITS

SEQ ID NO: 524272 - protein, 9 aa, Homo Sapiens
LKYFVPFHG

SEQ ID NO: 524273 - protein, 9 aa, Homo Sapiens
VAVFDHDLM

SEQ ID NO: 524274 - protein, 9 aa, Homo Sapiens
PTSTTASVA

SEQ ID NO: 524275 - protein, 9 aa, Homo Sapiens
NWIQLARNQ

SEQ ID NO: 524276 - protein, 9 aa, Homo Sapiens
PSPVPGMPR

SEQ ID NO: 524277 - protein, 9 aa, Homo Sapiens
TLNWIQLAR

SEQ ID NO: 524278 - protein, 9 aa, Homo Sapiens
STSTEMEKL

SEQ ID NO: 524279 - protein, 9 aa, Homo Sapiens
KNEVTPTST

SEQ ID NO: 524280 - protein, 9 aa, Homo Sapiens
FWGPITLQG

SEQ ID NO: 524281 - protein, 9 aa, Homo Sapiens
KEFPCVNGY

SEQ ID NO: 524282 - protein, 9 aa, Homo Sapiens
RADRELICF

SEQ ID NO: 524283 - protein, 9 aa, Homo Sapiens
RDWRTEEEN

SEQ ID NO: 524284 - protein, 9 aa, Homo Sapiens
TVSNSIKSL

SEQ ID NO: 524285 - protein, 9 aa, Homo Sapiens
EVYAWTPKP

SEQ ID NO: 524286 - protein, 9 aa, Homo Sapiens
TQSQRRQKT

SEQ ID NO: 524287 - protein, 9 aa, Homo Sapiens
VEVYAWTPK

SEQ ID NO: 524288 - protein, 9 aa, Homo Sapiens
KEEFVQEIK

SEQ ID NO: 524289 - protein, 9 aa, Homo Sapiens
CGPGCYGRW

SEQ ID NO: 524290 - protein, 9 aa, Homo Sapiens
QYEEQESFT

SEQ ID NO: 524291 - protein, 9 aa, Homo Sapiens
YSQIDRQGQ

SEQ ID NO: 524292 - protein, 9 aa, Homo Sapiens
LHYWTIRKR

SEQ ID NO: 524293 - protein, 9 aa, Homo Sapiens
VLRRFEVGE

SEQ ID NO: 524294 - protein, 9 aa, Homo Sapiens
FPCACVKEN

SEQ ID NO: 524295 - protein, 9 aa, Homo Sapiens
CILSKFWVL

SEQ ID NO: 524296 - protein, 9 aa, Homo Sapiens
QSSHYSQID

SEQ ID NO: 524297 - protein, 9 aa, Homo Sapiens
FVQEIKKLA

SEQ ID NO: 524298 - protein, 9 aa, Homo Sapiens
TESTATTMQ

SEQ ID NO: 524299 - protein, 9 aa, Homo Sapiens
QGYCNGLMS

SEQ ID NO: 524300 - protein, 9 aa, Homo Sapiens
DEEANNDIF

SEQ ID NO: 524301 - protein, 9 aa, Homo Sapiens
LMGSDDLIG

SEQ ID NO: 524302 - protein, 9 aa, Homo Sapiens
STISQAGSD

SEQ ID NO: 524303 - protein, 9 aa, Homo Sapiens
FSACCGGFR

SEQ ID NO: 524304 - protein, 9 aa, Homo Sapiens
IYPIRTKGV

SEQ ID NO: 524305 - protein, 9 aa, Homo Sapiens
KDADLQPGD

SEQ ID NO: 524306 - protein, 9 aa, Homo Sapiens
CPASPQAQP

SEQ ID NO: 524307 - protein, 9 aa, Homo Sapiens
PKGFQGYCN

SEQ ID NO: 524308 - protein, 9 aa, Homo Sapiens
IRTKGVAYV

SEQ ID NO: 524309 - protein, 9 aa, Homo Sapiens
AFGPVNPSL

SEQ ID NO: 524310 - protein, 9 aa, Homo Sapiens
EDPKRKGSL

SEQ ID NO: 524311 - protein, 9 aa, Homo Sapiens
RQKTVRLLL

SEQ ID NO: 524312 - protein, 9 aa, Homo Sapiens
TYSKGARRS

SEQ ID NO: 524313 - protein, 9 aa, Homo Sapiens
DWRTEEENL

SEQ ID NO: 524314 - protein, 9 aa, Homo Sapiens
QPHEDPKRK

SEQ ID NO: 524315 - protein, 9 aa, Homo Sapiens
DPHLKCALC

SEQ ID NO: 524316 - protein, 9 aa, Homo Sapiens
AAFWGPITL

SEQ ID NO: 524317 - protein, 9 aa, Homo Sapiens
NYPKGFQGY

SEQ ID NO: 524318 - protein, 9 aa, Homo Sapiens
LAFGCILSK

SEQ ID NO: 524319 - protein, 9 aa, Homo Sapiens
NTDPVLTLP

SEQ ID NO: 524320 - protein, 9 aa, Homo Sapiens
EFVQEIKKL

SEQ ID NO: 524321 - protein, 9 aa, Homo Sapiens
PVCREPLMY

SEQ ID NO: 524322 - protein, 9 aa, Homo Sapiens
LRKDCENVN

SEQ ID NO: 524323 - protein, 9 aa, Homo Sapiens
DRELICFSH

SEQ ID NO: 524324 - protein, 9 aa, Homo Sapiens
RLASGLSTI

SEQ ID NO: 524325 - protein, 9 aa, Homo Sapiens
RGINMCYLG

SEQ ID NO: 524326 - protein, 9 aa, Homo Sapiens
DLQPGDIIV

SEQ ID NO: 524327 - protein, 9 aa, Homo Sapiens
SGFGSPVGQ

SEQ ID NO: 524328 - protein, 9 aa, Homo Sapiens
RVGRGPTVG

SEQ ID NO: 524329 - protein, 9 aa, Homo Sapiens
SGLSTISQA

SEQ ID NO: 524330 - protein, 9 aa, Homo Sapiens
PPPTLMTSP

SEQ ID NO: 524331 - protein, 9 aa, Homo Sapiens
PFHGLPFTL

SEQ ID NO: 524332 - protein, 9 aa, Homo Sapiens
LECVEIESK

SEQ ID NO: 524333 - protein, 9 aa, Homo Sapiens
YNQYNLNRN

SEQ ID NO: 524334 - protein, 9 aa, Homo Sapiens
PSTSTEMEK

SEQ ID NO: 524335 - protein, 9 aa, Homo Sapiens
PLMYDLASL

SEQ ID NO: 524336 - protein, 9 aa, Homo Sapiens
HSHTVSNSI

SEQ ID NO: 524337 - protein, 9 aa, Homo Sapiens
EKCKEEFVQ

SEQ ID NO: 524338 - protein, 9 aa, Homo Sapiens
ELSIAICGY

SEQ ID NO: 524339 - protein, 9 aa, Homo Sapiens
SRMNKTYSK

SEQ ID NO: 524340 - protein, 9 aa, Homo Sapiens
NGYIYDQNT

SEQ ID NO: 524341 - protein, 9 aa, Homo Sapiens
LHMYLSALK

SEQ ID NO: 524342 - protein, 9 aa, Homo Sapiens
AGPRGACPA

SEQ ID NO: 524343 - protein, 9 aa, Homo Sapiens
NVLLDVNGR

SEQ ID NO: 524344 - protein, 9 aa, Homo Sapiens
ACPASPQAQ

SEQ ID NO: 524345 - protein, 9 aa, Homo Sapiens
CLKTLNWIQ

SEQ ID NO: 524346 - protein, 9 aa, Homo Sapiens
SGSEPSGAF

SEQ ID NO: 524347 - protein, 9 aa, Homo Sapiens
LRRFEVGEK

SEQ ID NO: 524348 - protein, 9 aa, Homo Sapiens
SSGCVQYEE

SEQ ID NO: 524349 - protein, 9 aa, Homo Sapiens
VLKLACEDT

SEQ ID NO: 524350 - protein, 9 aa, Homo Sapiens
VGEKLSQIA

SEQ ID NO: 524351 - protein, 9 aa, Homo Sapiens
LAVGLLRAA

SEQ ID NO: 524352 - protein, 9 aa, Homo Sapiens
LSALKSLIP

SEQ ID NO: 524353 - protein, 9 aa, Homo Sapiens
PSKGPKTLF

SEQ ID NO: 524354 - protein, 9 aa, Homo Sapiens
HGLPFTLFC

SEQ ID NO: 524355 - protein, 9 aa, Homo Sapiens
NKTYSKGAR

SEQ ID NO: 524356 - protein, 9 aa, Homo Sapiens
HTVSNSIKS

SEQ ID NO: 524357 - protein, 9 aa, Homo Sapiens
SALKSLIPS

SEQ ID NO: 524358 - protein, 9 aa, Homo Sapiens
TLHDEEANN

SEQ ID NO: 524359 - protein, 9 aa, Homo Sapiens
LTGASGFGS

SEQ ID NO: 524360 - protein, 9 aa, Homo Sapiens
MDLRVYGPA

SEQ ID NO: 524361 - protein, 9 aa, Homo Sapiens
PSGAFGPVN

SEQ ID NO: 524362 - protein, 9 aa, Homo Sapiens
GLLRAALIL

SEQ ID NO: 524363 - protein, 9 aa, Homo Sapiens
LKLACEDTS

SEQ ID NO: 524364 - protein, 9 aa, Homo Sapiens
EVTPTSTTA

SEQ ID NO: 524365 - protein, 9 aa, Homo Sapiens
GFGSPVGQP

SEQ ID NO: 524366 - protein, 9 aa, Homo Sapiens
FDLRADREL

SEQ ID NO: 524367 - protein, 9 aa, Homo Sapiens
DTKVVFLFP

SEQ ID NO: 524368 - protein, 9 aa, Homo Sapiens
GSARLELGA

SEQ ID NO: 524369 - protein, 9 aa, Homo Sapiens
VLHYWTIRK

SEQ ID NO: 524370 - protein, 9 aa, Homo Sapiens
LHDEEANND

SEQ ID NO: 524371 - protein, 9 aa, Homo Sapiens
LKSLIPSLF

SEQ ID NO: 524372 - protein, 9 aa, Homo Sapiens
NKELSIAIC

SEQ ID NO: 524373 - protein, 9 aa, Homo Sapiens
ACEDTSLYE

SEQ ID NO: 524374 - protein, 9 aa, Homo Sapiens
HEDPKRKGS

SEQ ID NO: 524375 - protein, 9 aa, Homo Sapiens
LRADRELIC

SEQ ID NO: 524376 - protein, 9 aa, Homo Sapiens
AFGCILSKF

SEQ ID NO: 524377 - protein, 9 aa, Homo Sapiens
FQGYCNGLM

SEQ ID NO: 524378 - protein, 9 aa, Homo Sapiens
RRQKTVRLL

SEQ ID NO: 524379 - protein, 9 aa, Homo Sapiens
FRVHITLHD

SEQ ID NO: 524380 - protein, 9 aa, Homo Sapiens
KKEFPCVNG

SEQ ID NO: 524381 - protein, 9 aa, Homo Sapiens
EDVIYPIRT

SEQ ID NO: 524382 - protein, 9 aa, Homo Sapiens
EPLMYDLAS

SEQ ID NO: 524383 - protein, 9 aa, Homo Sapiens
ESKVRVPKP

SEQ ID NO: 524384 - protein, 9 aa, Homo Sapiens
ATQSQRRQK

SEQ ID NO: 524385 - protein, 9 aa, Homo Sapiens
LPSCNNRHF

SEQ ID NO: 524386 - protein, 9 aa, Homo Sapiens
RTKPRVGRG

SEQ ID NO: 524387 - protein, 9 aa, Homo Sapiens
RHPPPTLMT

SEQ ID NO: 524388 - protein, 9 aa, Homo Sapiens
STEMEKLIR

SEQ ID NO: 524389 - protein, 9 aa, Homo Sapiens
PHLKCALCH

SEQ ID NO: 524390 - protein, 9 aa, Homo Sapiens
RMNKTYSKG

SEQ ID NO: 524391 - protein, 9 aa, Homo Sapiens
NMCYLGKVL

SEQ ID NO: 524392 - protein, 9 aa, Homo Sapiens
VSNSIKSLI

SEQ ID NO: 524393 - protein, 9 aa, Homo Sapiens
ADRELICFS

SEQ ID NO: 524394 - protein, 9 aa, Homo Sapiens
YAWTPKPYH

SEQ ID NO: 524395 - protein, 9 aa, Homo Sapiens
VYAWTPKPY

SEQ ID NO: 524396 - protein, 9 aa, Homo Sapiens
FTVDVMKKA

SEQ ID NO: 524397 - protein, 9 aa, Homo Sapiens
KLACEDTSL

SEQ ID NO: 524398 - protein, 9 aa, Homo Sapiens
KELSIAICG

SEQ ID NO: 524399 - protein, 9 aa, Homo Sapiens
AVLAFPDDM

SEQ ID NO: 524400 - protein, 9 aa, Homo Sapiens
YNLNRNFPD

SEQ ID NO: 524401 - protein, 9 aa, Homo Sapiens
CAPSKGPKT

SEQ ID NO: 524402 - protein, 9 aa, Homo Sapiens
ACPGRDWRT

SEQ ID NO: 524403 - protein, 9 aa, Homo Sapiens
GAPRTKPRV

SEQ ID NO: 524404 - protein, 9 aa, Homo Sapiens
DVIYPIRTK

SEQ ID NO: 524405 - protein, 9 aa, Homo Sapiens
TSTTASVAR

SEQ ID NO: 524406 - protein, 9 aa, Homo Sapiens
NFCLKTLNW

SEQ ID NO: 524407 - protein, 9 aa, Homo Sapiens
CYLGKVLEL

SEQ ID NO: 524408 - protein, 9 aa, Homo Sapiens
GAFGPVNPS

SEQ ID NO: 524409 - protein, 9 aa, Homo Sapiens
VFDHDLMGS

SEQ ID NO: 524410 - protein, 9 aa, Homo Sapiens
LLDVNGRLA

SEQ ID NO: 524411 - protein, 9 aa, Homo Sapiens
SSVEVYAWT

SEQ ID NO: 524412 - protein, 9 aa, Homo Sapiens
PAVLKLACE

SEQ ID NO: 524413 - protein, 9 aa, Homo Sapiens
WGPITLQGT

SEQ ID NO: 524414 - protein, 9 aa, Homo Sapiens
PKTLFAGHK

SEQ ID NO: 524415 - protein, 9 aa, Homo Sapiens
RFDGDVDPH

SEQ ID NO: 524416 - protein, 9 aa, Homo Sapiens
CILSNRTRQ

SEQ ID NO: 524417 - protein, 9 aa, Homo Sapiens
LVVFSACCG

SEQ ID NO: 524418 - protein, 9 aa, Homo Sapiens
KTLFAGHKL

SEQ ID NO: 524419 - protein, 9 aa, Homo Sapiens
DKLNLYLMM

SEQ ID NO: 524420 - protein, 9 aa, Homo Sapiens
TVTVVKTKP

SEQ ID NO: 524421 - protein, 9 aa, Homo Sapiens
CGGFRGVLK

SEQ ID NO: 524422 - protein, 9 aa, Homo Sapiens
LQGTGFLAI

SEQ ID NO: 524423 - protein, 9 aa, Homo Sapiens
RLFDLRADR

SEQ ID NO: 524424 - protein, 9 aa, Homo Sapiens
MGSDDLIGE

SEQ ID NO: 524425 - protein, 9 aa, Homo Sapiens
KRKGSLSNL

SEQ ID NO: 524426 - protein, 9 aa, Homo Sapiens
FLMFTVDVM

SEQ ID NO: 524427 - protein, 9 aa, Homo Sapiens
LSKFWVLSI

SEQ ID NO: 524428 - protein, 9 aa, Homo Sapiens
VIYPIRTKG

SEQ ID NO: 524429 - protein, 9 aa, Homo Sapiens
CVNGYIYDQ

SEQ ID NO: 524430 - protein, 9 aa, Homo Sapiens
LSNRTRQQN

SEQ ID NO: 524431 - protein, 9 aa, Homo Sapiens
GSPVGQPWG

SEQ ID NO: 524432 - protein, 9 aa, Homo Sapiens
YLMMEFLPG

SEQ ID NO: 524433 - protein, 9 aa, Homo Sapiens
ILSNRTRQQ

SEQ ID NO: 524434 - protein, 9 aa, Homo Sapiens
PRVGRGPTV

SEQ ID NO: 524435 - protein, 9 aa, Homo Sapiens
LAFPDDMDL

SEQ ID NO: 524436 - protein, 9 aa, Homo Sapiens
MDEESKGGV

SEQ ID NO: 524437 - protein, 9 aa, Homo Sapiens
GHSHTVSNS

SEQ ID NO: 524438 - protein, 9 aa, Homo Sapiens
NDTKVVFLF

SEQ ID NO: 524439 - protein, 9 aa, Homo Sapiens
TLQGTGFLA

SEQ ID NO: 524440 - protein, 9 aa, Homo Sapiens
TVVTTVTVV

SEQ ID NO: 524441 - protein, 9 aa, Homo Sapiens
LTLPAEPCS

SEQ ID NO: 524442 - protein, 9 aa, Homo Sapiens
VLTLPAEPC

SEQ ID NO: 524443 - protein, 9 aa, Homo Sapiens
TRHPPPTLM

SEQ ID NO: 524444 - protein, 9 aa, Homo Sapiens
DVNGRLADF

SEQ ID NO: 524445 - protein, 9 aa, Homo Sapiens
SYKNEVTPT

SEQ ID NO: 524446 - protein, 9 aa, Homo Sapiens
LKTLNWIQL

SEQ ID NO: 524447 - protein, 9 aa, Homo Sapiens
MFTVDVMKK

SEQ ID NO: 524448 - protein, 9 aa, Homo Sapiens
PKRKGSLSN

SEQ ID NO: 524449 - protein, 9 aa, Homo Sapiens
GSEPSGAFG

SEQ ID NO: 524450 - protein, 9 aa, Homo Sapiens
NGRLADFGS

SEQ ID NO: 524451 - protein, 9 aa, Homo Sapiens
DCENVNEGK

SEQ ID NO: 524452 - protein, 9 aa, Homo Sapiens
LCGPGCYGR

SEQ ID NO: 524453 - protein, 9 aa, Homo Sapiens
KAKDADLQP

SEQ ID NO: 524454 - protein, 9 aa, Homo Sapiens
EPSGAFGPV

SEQ ID NO: 524455 - protein, 9 aa, Homo Sapiens
SEPSGAFGP

SEQ ID NO: 524456 - protein, 9 aa, Homo Sapiens
EEFVQEIKK

SEQ ID NO: 524457 - protein, 9 aa, Homo Sapiens
DGDVDPHLK

SEQ ID NO: 524458 - protein, 9 aa, Homo Sapiens
YPKGFQGYC

SEQ ID NO: 524459 - protein, 9 aa, Homo Sapiens
VTPTSTTAS

SEQ ID NO: 524460 - protein, 9 aa, Homo Sapiens
FPCVNGYIY

SEQ ID NO: 524461 - protein, 9 aa, Homo Sapiens
CENVNEGKM

SEQ ID NO: 524462 - protein, 9 aa, Homo Sapiens
WRTEEENLR

SEQ ID NO: 524463 - protein, 9 aa, Homo Sapiens
SSHYSQIDR

SEQ ID NO: 524464 - protein, 9 aa, Homo Sapiens
KSRMNKTYS

SEQ ID NO: 524465 - protein, 9 aa, Homo Sapiens
ESTATTMQS

SEQ ID NO: 524466 - protein, 9 aa, Homo Sapiens
FGSPVGQPW

SEQ ID NO: 524467 - protein, 9 aa, Homo Sapiens
GCILSKFWV

SEQ ID NO: 524468 - protein, 9 aa, Homo Sapiens
STATTMQSE

SEQ ID NO: 524469 - protein, 9 aa, Homo Sapiens
CVQYEEQES

SEQ ID NO: 524470 - protein, 9 aa, Homo Sapiens
NQYNLNRNF

SEQ ID NO: 524471 - protein, 9 aa, Homo Sapiens
RLRKDCENV

SEQ ID NO: 524472 - protein, 9 aa, Homo Sapiens
EIESKVRVP

SEQ ID NO: 524473 - protein, 9 aa, Homo Sapiens
ESKGGVSSS

SEQ ID NO: 524474 - protein, 9 aa, Homo Sapiens
DADLQPGDI

SEQ ID NO: 524475 - protein, 9 aa, Homo Sapiens
TTMQSEMST

SEQ ID NO: 524476 - protein, 9 aa, Homo Sapiens
ENYNQYNLN

SEQ ID NO: 524477 - protein, 9 aa, Homo Sapiens
EQPSTSTEM

SEQ ID NO: 524478 - protein, 9 aa, Homo Sapiens
FHGLPFTLF

SEQ ID NO: 524479 - protein, 9 aa, Homo Sapiens
KGPKTLFAG

SEQ ID NO: 524480 - protein, 9 aa, Homo Sapiens
RPPSPVPGM

SEQ ID NO: 524481 - protein, 9 aa, Homo Sapiens
PVLTLPAEP

SEQ ID NO: 524482 - protein, 9 aa, Homo Sapiens
GPRGACPAS

SEQ ID NO: 524483 - protein, 9 aa, Homo Sapiens
LMTSPSPPV

SEQ ID NO: 524484 - protein, 9 aa, Homo Sapiens
ENVNEGKMH

SEQ ID NO: 524485 - protein, 9 aa, Homo Sapiens
HDLMGSDDL

SEQ ID NO: 524486 - protein, 9 aa, Homo Sapiens
FVPFHGLPF

SEQ ID NO: 524487 - protein, 9 aa, Homo Sapiens
EFSSGCVQY

SEQ ID NO: 524488 - protein, 9 aa, Homo Sapiens
MYDLASLKA

SEQ ID NO: 524489 - protein, 9 aa, Homo Sapiens
RKDCENVNE

SEQ ID NO: 524490 - protein, 9 aa, Homo Sapiens
TSTEMEKLI

SEQ ID NO: 524491 - protein, 9 aa, Homo Sapiens
DLRADRELI

SEQ ID NO: 524492 - protein, 9 aa, Homo Sapiens
PDDMDLRVY

SEQ ID NO: 524493 - protein, 9 aa, Homo Sapiens
YSGSEPSGA

SEQ ID NO: 524494 - protein, 9 aa, Homo Sapiens
QYNLNRNFP

SEQ ID NO: 524495 - protein, 9 aa, Homo Sapiens
SGCVQYEEQ

SEQ ID NO: 524496 - protein, 9 aa, Homo Sapiens
LDPNTDPVL

SEQ ID NO: 524497 - protein, 9 aa, Homo Sapiens
FEVGEKLSQ

SEQ ID NO: 524498 - protein, 9 aa, Homo Sapiens
DPKRKGSLS

SEQ ID NO: 524499 - protein, 9 aa, Homo Sapiens
HMYLSALKS

SEQ ID NO: 524500 - protein, 9 aa, Homo Sapiens
CCGGFRGVL

SEQ ID NO: 524501 - protein, 9 aa, Homo Sapiens
KFWVLSIAS

SEQ ID NO: 524502 - protein, 9 aa, Homo Sapiens
VQYEEQESF

SEQ ID NO: 524503 - protein, 9 aa, Homo Sapiens
CVEIESKVR

SEQ ID NO: 524504 - protein, 9 aa, Homo Sapiens
QIDRQGQSS

SEQ ID NO: 524505 - protein, 9 aa, Homo Sapiens
TPRPPSPVP

SEQ ID NO: 524506 - protein, 9 aa, Homo Sapiens
PSCNNRHFW

SEQ ID NO: 524507 - protein, 9 aa, Homo Sapiens
DPVLTLPAE

SEQ ID NO: 524508 - protein, 9 aa, Homo Sapiens
VTTVTVVKT

SEQ ID NO: 524509 - protein, 9 aa, Homo Sapiens
SKVRVPKPI

SEQ ID NO: 524510 - protein, 9 aa, Homo Sapiens
DHDLMGSDD

SEQ ID NO: 524511 - protein, 9 aa, Homo Sapiens
NPFPCACVK

SEQ ID NO: 524512 - protein, 9 aa, Homo Sapiens
LMMEFLPGG

SEQ ID NO: 524513 - protein, 9 aa, Homo Sapiens
GQSSHYSQI

SEQ ID NO: 524514 - protein, 9 aa, Homo Sapiens
IESKVRVPK

SEQ ID NO: 524515 - protein, 9 aa, Homo Sapiens
TPTSTTASV

SEQ ID NO: 524516 - protein, 9 aa, Homo Sapiens
DLLAVGLLR

SEQ ID NO: 524517 - protein, 9 aa, Homo Sapiens
DVDPHLKCA

SEQ ID NO: 524518 - protein, 9 aa, Homo Sapiens
LLGSARLEL

SEQ ID NO: 524519 - protein, 9 aa, Homo Sapiens
GCAPSKGPK

SEQ ID NO: 524520 - protein, 9 aa, Homo Sapiens
PNTDPVLTL

SEQ ID NO: 524521 - protein, 9 aa, Homo Sapiens
DPNTDPVLT

SEQ ID NO: 524522 - protein, 9 aa, Homo Sapiens
SLCGPGCYG

SEQ ID NO: 524523 - protein, 9 aa, Homo Sapiens
VCREPLMYD

SEQ ID NO: 524524 - protein, 9 aa, Homo Sapiens
LGSARLELG

SEQ ID NO: 524525 - protein, 9 aa, Homo Sapiens
ARLELGAAL

SEQ ID NO: 524526 - protein, 9 aa, Homo Sapiens
KTYSKGARR

SEQ ID NO: 524527 - protein, 9 aa, Homo Sapiens
TKVVFLFPA

SEQ ID NO: 524528 - protein, 9 aa, Homo Sapiens
TVDVMKKAC

SEQ ID NO: 524529 - protein, 9 aa, Homo Sapiens
GCYGRWNAD

SEQ ID NO: 524530 - protein, 9 aa, Homo Sapiens
LSTISQAGS

SEQ ID NO: 524531 - protein, 9 aa, Homo Sapiens
EEAQRFLYC

SEQ ID NO: 524532 - protein, 9 aa, Homo Sapiens
VTVVKTKPR

SEQ ID NO: 524533 - protein, 9 aa, Homo Sapiens
VLAFPDDMD

SEQ ID NO: 524534 - protein, 9 aa, Homo Sapiens
SGAFGPVNP

SEQ ID NO: 524535 - protein, 9 aa, Homo Sapiens
PCACVKENH

SEQ ID NO: 524536 - protein, 9 aa, Homo Sapiens
ECVEIESKV

SEQ ID NO: 524537 - protein, 9 aa, Homo Sapiens
VEDVIYPIR

SEQ ID NO: 524538 - protein, 9 aa, Homo Sapiens
EDTSLYETL

SEQ ID NO: 524539 - protein, 9 aa, Homo Sapiens
GPITLQGTG

SEQ ID NO: 524540 - protein, 9 aa, Homo Sapiens
MTTESTATT

SEQ ID NO: 524541 - protein, 9 aa, Homo Sapiens
QRGINMCYL

SEQ ID NO: 524542 - protein, 9 aa, Homo Sapiens
NRVLHYWTI

SEQ ID NO: 524543 - protein, 9 aa, Homo Sapiens
TTVTVVKTK

SEQ ID NO: 524544 - protein, 9 aa, Homo Sapiens
VGLLRAALI

SEQ ID NO: 524545 - protein, 9 aa, Homo Sapiens
RVNYPKGFQ

SEQ ID NO: 524546 - protein, 9 aa, Homo Sapiens
GRLADFGSC

SEQ ID NO: 524547 - protein, 9 aa, Homo Sapiens
SLTPRPPSP

SEQ ID NO: 524548 - protein, 9 aa, Homo Sapiens
TDPVLTLPA

SEQ ID NO: 524549 - protein, 9 aa, Homo Sapiens
GPGCYGRWN

SEQ ID NO: 524550 - protein, 9 aa, Homo Sapiens
PRPPSPVPG

SEQ ID NO: 524551 - protein, 9 aa, Homo Sapiens
PGRDWRTEE

SEQ ID NO: 524552 - protein, 9 aa, Homo Sapiens
TKPRVGRGP

SEQ ID NO: 524553 - protein, 9 aa, Homo Sapiens
PPTLMTSPS

SEQ ID NO: 524554 - protein, 9 aa, Homo Sapiens
ASGLSTISQ

SEQ ID NO: 524555 - protein, 9 aa, Homo Sapiens
PITLQGTGF

SEQ ID NO: 524556 - protein, 9 aa, Homo Sapiens
TTESTATTM

SEQ ID NO: 524557 - protein, 9 aa, Homo Sapiens
SKGPKTLFA

SEQ ID NO: 524558 - protein, 9 aa, Homo Sapiens
EEMDEESKG

SEQ ID NO: 524559 - protein, 9 aa, Homo Sapiens
TVVKTKPRV

SEQ ID NO: 524560 - protein, 9 aa, Homo Sapiens
ICGYGLFAG

SEQ ID NO: 524561 - protein, 9 aa, Homo Sapiens
RQQNLDGHI

SEQ ID NO: 524562 - protein, 9 aa, Homo Sapiens
FGCILSKFW

SEQ ID NO: 524563 - protein, 9 aa, Homo Sapiens
CLPSCNNRH

SEQ ID NO: 524564 - protein, 9 aa, Homo Sapiens
SARLELGAA

SEQ ID NO: 524565 - protein, 9 aa, Homo Sapiens
RVLHYWTIR

SEQ ID NO: 524566 - protein, 9 aa, Homo Sapiens
YEEQESFTP

SEQ ID NO: 524567 - protein, 9 aa, Homo Sapiens
SKGGVSSSK

SEQ ID NO: 524568 - protein, 9 aa, Homo Sapiens
MYLSALKSL

SEQ ID NO: 524569 - protein, 9 aa, Homo Sapiens
MNKTYSKGA

SEQ ID NO: 524570 - protein, 9 aa, Homo Sapiens
ITLHDEEAN

SEQ ID NO: 524571 - protein, 9 aa, Homo Sapiens
LRAALILRV

SEQ ID NO: 524572 - protein, 9 aa, Homo Sapiens
AVLKLACED

SEQ ID NO: 524573 - protein, 9 aa, Homo Sapiens
VFLFPAVPE

SEQ ID NO: 524574 - protein, 9 aa, Homo Sapiens
EMEKLIRFI

SEQ ID NO: 524575 - protein, 9 aa, Homo Sapiens
SPVPGMPRA

SEQ ID NO: 524576 - protein, 9 aa, Homo Sapiens
RQRGINMCY

SEQ ID NO: 524577 - protein, 9 aa, Homo Sapiens
LELGAALGI

SEQ ID NO: 524578 - protein, 9 aa, Homo Sapiens
ISQAGSDRK

SEQ ID NO: 524579 - protein, 9 aa, Homo Sapiens
APSKGPKTL

SEQ ID NO: 524580 - protein, 9 aa, Homo Sapiens
LQPGDIIVA

SEQ ID NO: 524581 - protein, 9 aa, Homo Sapiens
KPRVGRGPT

SEQ ID NO: 524582 - protein, 9 aa, Homo Sapiens
DMDLRVYGP

SEQ ID NO: 524583 - protein, 9 aa, Homo Sapiens
SKGARRSQR

SEQ ID NO: 524584 - protein, 9 aa, Homo Sapiens
GASGFGSPV

SEQ ID NO: 524585 - protein, 9 aa, Homo Sapiens
EFPCVNGYI

SEQ ID NO: 524586 - protein, 9 aa, Homo Sapiens
FEEMDEESK

SEQ ID NO: 524587 - protein, 9 aa, Homo Sapiens
LASGLSTIS

SEQ ID NO: 524588 - protein, 9 aa, Homo Sapiens
LEVLRRFEV

SEQ ID NO: 524589 - protein, 9 aa, Homo Sapiens
SQIDRQGQS

SEQ ID NO: 524590 - protein, 9 aa, Homo Sapiens
NVNEGKMHE

SEQ ID NO: 524591 - protein, 9 aa, Homo Sapiens
REPLMYDLA

SEQ ID NO: 524592 - protein, 9 aa, Homo Sapiens
ILECVEIES

SEQ ID NO: 524593 - protein, 9 aa, Homo Sapiens
RRFEVGEKL

SEQ ID NO: 524594 - protein, 9 aa, Homo Sapiens
SKKEFPCVN

SEQ ID NO: 524595 - protein, 9 aa, Homo Sapiens
CEDTSLYET

SEQ ID NO: 524596 - protein, 9 aa, Homo Sapiens
ASAGPRGAC

SEQ ID NO: 524597 - protein, 9 aa, Homo Sapiens
LYLMMEFLP

SEQ ID NO: 524598 - protein, 9 aa, Homo Sapiens
FCLKTLNWI

SEQ ID NO: 524599 - protein, 9 aa, Homo Sapiens
PGCYGRWNA

SEQ ID NO: 524600 - protein, 9 aa, Homo Sapiens
APRTKPRVG

SEQ ID NO: 524601 - protein, 9 aa, Homo Sapiens
VHITLHDEE

SEQ ID NO: 524602 - protein, 9 aa, Homo Sapiens
TMQSEMSTS

SEQ ID NO: 524603 - protein, 9 aa, Homo Sapiens
HLKCALCHK

SEQ ID NO: 524604 - protein, 9 aa, Homo Sapiens
NRTRQQNLD

SEQ ID NO: 524605 - protein, 9 aa, Homo Sapiens
QDKLNLYLM

SEQ ID NO: 524606 - protein, 9 aa, Homo Sapiens
EQPHEDPKR

SEQ ID NO: 524607 - protein, 9 aa, Homo Sapiens
RENYNQYNL

SEQ ID NO: 524608 - protein, 9 aa, Homo Sapiens
VVKTKPRVD

SEQ ID NO: 524609 - protein, 9 aa, Homo Sapiens
YKNEVTPTS

SEQ ID NO: 524610 - protein, 9 aa, Homo Sapiens
AVFDHDLMG

SEQ ID NO: 524611 - protein, 9 aa, Homo Sapiens
VDPHLKCAL

SEQ ID NO: 524612 - protein, 9 aa, Homo Sapiens
QPSTSTEME

SEQ ID NO: 524613 - protein, 9 aa, Homo Sapiens
FPAVPEEPE

SEQ ID NO: 524614 - protein, 9 aa, Homo Sapiens
DDMDLRVYG

SEQ ID NO: 524615 - protein, 9 aa, Homo Sapiens
SIAICGYGL

SEQ ID NO: 524616 - protein, 9 aa, Homo Sapiens
VELGYRVTV

SEQ ID NO: 524617 - protein, 9 aa, Homo Sapiens
VFSACCGGF

SEQ ID NO: 524618 - protein, 9 aa, Homo Sapiens
VMKKACLPG

SEQ ID NO: 524619 - protein, 9 aa, Homo Sapiens
YSKGARRSQ

SEQ ID NO: 524620 - protein, 9 aa, Homo Sapiens
EFLMFTVDV

SEQ ID NO: 524621 - protein, 9 aa, Homo Sapiens
ITLQGTGFL

SEQ ID NO: 524622 - protein, 9 aa, Homo Sapiens
EVGEKLSQI

SEQ ID NO: 524623 - protein, 9 aa, Homo Sapiens
ILKYFVPFH

SEQ ID NO: 524624 - protein, 9 aa, Homo Sapiens
AGHSHTVSN

SEQ ID NO: 524625 - protein, 9 aa, Homo Sapiens
IAICGYGLF

SEQ ID NO: 524626 - protein, 9 aa, Homo Sapiens
GPKTLFAGH

SEQ ID NO: 524627 - protein, 9 aa, Homo Sapiens
TGASGFGSP

SEQ ID NO: 524628 - protein, 9 aa, Homo Sapiens
KVVFLFPAV

SEQ ID NO: 524629 - protein, 9 aa, Homo Sapiens
QKTVRLLLA

SEQ ID NO: 524630 - protein, 9 aa, Homo Sapiens
ATTMQSEMS

SEQ ID NO: 524631 - protein, 9 aa, Homo Sapiens
RGACPASPQ

SEQ ID NO: 524632 - protein, 9 aa, Homo Sapiens
EMDEESKGG

SEQ ID NO: 524633 - protein, 9 aa, Homo Sapiens
EAQRFLYCD

SEQ ID NO: 524634 - protein, 9 aa, Homo Sapiens
MRQRGINMC

SEQ ID NO: 524635 - protein, 9 aa, Homo Sapiens
LMFTVDVMK

SEQ ID NO: 524636 - protein, 9 aa, Homo Sapiens
FDHDLMGSD

SEQ ID NO: 524637 - protein, 9 aa, Homo Sapiens
GACPASPQA

SEQ ID NO: 524638 - protein, 9 aa, Homo Sapiens
SQRRQKTVR

SEQ ID NO: 524639 - protein, 9 aa, Homo Sapiens
CPVCREPLM

SEQ ID NO: 524640 - protein, 9 aa, Homo Sapiens
QRRQKTVRL

SEQ ID NO: 524641 - protein, 9 aa, Homo Sapiens
AFPDDMDLR

SEQ ID NO: 524642 - protein, 9 aa, Homo Sapiens
LRLRKDCEN

SEQ ID NO: 524643 - protein, 9 aa, Homo Sapiens
RVHITLHDE

SEQ ID NO: 524644 - protein, 9 aa, Homo Sapiens
DVMKKACLP

SEQ ID NO: 524645 - protein, 9 aa, Homo Sapiens
YFVPFHGLP

SEQ ID NO: 524646 - protein, 9 aa, Homo Sapiens
SHYSQIDRQ

SEQ ID NO: 524647 - protein, 9 aa, Homo Sapiens
VVTTVTVVK

SEQ ID NO: 524648 - protein, 9 aa, Homo Sapiens
RTRQQNLDG

SEQ ID NO: 524649 - protein, 9 aa, Homo Sapiens
DLMGSDDLI

SEQ ID NO: 524650 - protein, 9 aa, Homo Sapiens
LACEDTSLY

SEQ ID NO: 524651 - protein, 9 aa, Homo Sapiens
CPGRDWRTE

SEQ ID NO: 524652 - protein, 9 aa, Homo Sapiens
AWTPKPYHK

SEQ ID NO: 524653 - protein, 9 aa, Homo Sapiens
VQEIKKLAT

SEQ ID NO: 524654 - protein, 9 aa, Homo Sapiens
TRQQNLDGH

SEQ ID NO: 524655 - protein, 9 aa, Homo Sapiens
EESKGGVSS

SEQ ID NO: 524656 - protein, 9 aa, Homo Sapiens
PHEDPKRKG

SEQ ID NO: 524657 - protein, 9 aa, Homo Sapiens
VVFLFPAVP

SEQ ID NO: 524658 - protein, 9 aa, Homo Sapiens
KYFVPFHGL

SEQ ID NO: 524659 - protein, 9 aa, Homo Sapiens
SHTVSNSIK

SEQ ID NO: 524660 - protein, 9 aa, Homo Sapiens
WIQLARNQN

SEQ ID NO: 524661 - protein, 9 aa, Homo Sapiens
PCVNGYIYD

SEQ ID NO: 524662 - protein, 9 aa, Homo Sapiens
VEIESKVRV

SEQ ID NO: 524663 - protein, 9 aa, Homo Sapiens
CTRHPPPTL

SEQ ID NO: 524664 - protein, 9 aa, Homo Sapiens
HYSQIDRQG

SEQ ID NO: 524665 - protein, 9 aa, Homo Sapiens
QSQRRQKTV

SEQ ID NO: 524666 - protein, 9 aa, Homo Sapiens
TATTMQSEM

SEQ ID NO: 524667 - protein, 9 aa, Homo Sapiens
FPDDMDLRV

SEQ ID NO: 524668 - protein, 9 aa, Homo Sapiens
ILSKFWVLS

SEQ ID NO: 524669 - protein, 9 aa, Homo Sapiens
NLYLMMEFL

SEQ ID NO: 524670 - protein, 9 aa, Homo Sapiens
SNRTRQQNL

SEQ ID NO: 524671 - protein, 9 aa, Homo Sapiens
KDCENVNEG

SEQ ID NO: 524672 - protein, 9 aa, Homo Sapiens
YLSALKSLI

SEQ ID NO: 524673 - protein, 9 aa, Homo Sapiens
GCVQYEEQE

SEQ ID NO: 524674 - protein, 9 aa, Homo Sapiens
YGRWNADGS

SEQ ID NO: 524675 - protein, 9 aa, Homo Sapiens
GRWNADGSA

SEQ ID NO: 524676 - protein, 9 aa, Homo Sapiens
PTLMTSPSP

SEQ ID NO: 524677 - protein, 9 aa, Homo Sapiens
CYGRWNADG

SEQ ID NO: 524678 - protein, 9 aa, Homo Sapiens
GTVVTTVTV

SEQ ID NO: 524679 - protein, 9 aa, Homo Sapiens
KGGVSSSKE

SEQ ID NO: 524680 - protein, 9 aa, Homo Sapiens
CACVKENHF

SEQ ID NO: 524681 - protein, 9 aa, Homo Sapiens
SNSIKSLIT

SEQ ID NO: 524682 - protein, 9 aa, Homo Sapiens
DATQSQRRQ

SEQ ID NO: 524683 - protein, 9 aa, Homo Sapiens
TPKPYHKFM

SEQ ID NO: 524684 - protein, 9 aa, Homo Sapiens
SACCGGFRG

SEQ ID NO: 524685 - protein, 9 aa, Homo Sapiens
KCKEEFVQE

SEQ ID NO: 524686 - protein, 9 aa, Homo Sapiens
GFQGYCNGL

SEQ ID NO: 524687 - protein, 9 aa, Homo Sapiens
RLELGAALG

SEQ ID NO: 524688 - protein, 9 aa, Homo Sapiens
TLMTSPSPP

SEQ ID NO: 524689 - protein, 9 aa, Homo Sapiens
NEVTPTSTT

SEQ ID NO: 524690 - protein, 9 aa, Homo Sapiens
VVFSACCGG

SEQ ID NO: 524691 - protein, 9 aa, Homo Sapiens
CACPGRDWR

SEQ ID NO: 524692 - protein, 9 aa, Homo Sapiens
HYWTIRKRR

SEQ ID NO: 524693 - protein, 9 aa, Homo Sapiens
VLLDVNGRL

SEQ ID NO: 524694 - protein, 9 aa, Homo Sapiens
GLSTISQAG

SEQ ID NO: 524695 - protein, 9 aa, Homo Sapiens
LFPAVPEEP

SEQ ID NO: 524696 - protein, 9 aa, Homo Sapiens
VNGRLADFG

SEQ ID NO: 524697 - protein, 9 aa, Homo Sapiens
GRENYNQYN

SEQ ID NO: 524698 - protein, 9 aa, Homo Sapiens
YWTIRKRRL

SEQ ID NO: 524699 - protein, 9 aa, Homo Sapiens
LDVNGRLAD

SEQ ID NO: 524700 - protein, 9 aa, Homo Sapiens
KSLIPSLFA

SEQ ID NO: 524701 - protein, 9 aa, Homo Sapiens
KGFQGYCNG

SEQ ID NO: 524702 - protein, 9 aa, Homo Sapiens
IRKRRLDQC

SEQ ID NO: 524703 - protein, 9 aa, Homo Sapiens
SPVGQPWGV

SEQ ID NO: 524704 - protein, 9 aa, Homo Sapiens
WTPKPYHKF

SEQ ID NO: 524705 - protein, 9 aa, Homo Sapiens
GDVDPHLKC

SEQ ID NO: 524706 - protein, 9 aa, Homo Sapiens
SKFWVLSIA

SEQ ID NO: 524707 - protein, 9 aa, Homo Sapiens
SVEVYAWTP

SEQ ID NO: 524708 - protein, 9 aa, Homo Sapiens
ACCGGFRGV

SEQ ID NO: 524709 - protein, 9 aa, Homo Sapiens
FSSGCVQYE

SEQ ID NO: 524710 - protein, 9 aa, Homo Sapiens
DEESKGGVS

SEQ ID NO: 524711 - protein, 9 aa, Homo Sapiens
QPGDIIVAI

SEQ ID NO: 524712 - protein, 9 aa, Homo Sapiens
NYNQYNLNR

SEQ ID NO: 524713 - protein, 9 aa, Homo Sapiens
ACVKENHFR

SEQ ID NO: 524714 - protein, 9 aa, Homo Sapiens
GINMCYLGK

SEQ ID NO: 524715 - protein, 9 aa, Homo Sapiens
CREPLMYDL

SEQ ID NO: 524716 - protein, 9 aa, Homo Sapiens
VCACPGRDW

SEQ ID NO: 524717 - protein, 9 aa, Homo Sapiens
SCLPSCNNR

SEQ ID NO: 524718 - protein, 9 aa, Homo Sapiens
LNLYLMMEF

SEQ ID NO: 524719 - protein, 9 aa, Homo Sapiens
VPFHGLPFT

SEQ ID NO: 524720 - protein, 9 aa, Homo Sapiens
LSIAICGYG

SEQ ID NO: 524721 - protein, 9 aa, Homo Sapiens
LLAVGLLRA

SEQ ID NO: 524722 - protein, 9 aa, Homo Sapiens
DVEDVIYPI

SEQ ID NO: 524723 - protein, 9 aa, Homo Sapiens
VNYPKGFQG

SEQ ID NO: 524724 - protein, 9 aa, Homo Sapiens
KLNLYLMME

SEQ ID NO: 524725 - protein, 9 aa, Homo Sapiens
QEIKKLATQ

SEQ ID NO: 524726 - protein, 9 aa, Homo Sapiens
GKAKDADLQ

SEQ ID NO: 524727 - protein, 9 aa, Homo Sapiens
LMYDLASLK

SEQ ID NO: 524728 - protein, 9 aa, Homo Sapiens
CKEEFVQEI

SEQ ID NO: 524729 - protein, 9 aa, Homo Sapiens
HDEEANNDI

SEQ ID NO: 524730 - protein, 9 aa, Homo Sapiens
YPIRTKGVA

SEQ ID NO: 524731 - protein, 9 aa, Homo Sapiens
PIRTKGVAY

SEQ ID NO: 524732 - protein, 9 aa, Homo Sapiens
EVLRRFEVG

SEQ ID NO: 524733 - protein, 9 aa, Homo Sapiens
MMEFLPGGD

SEQ ID NO: 524734 - protein, 9 aa, Homo Sapiens
QQNLDGHIT

SEQ ID NO: 524735 - protein, 9 aa, Homo Sapiens
AKDADLQPG

SEQ ID NO: 524736 - protein, 9 aa, Homo Sapiens
GRDWRTEEE

SEQ ID NO: 524737 - protein, 9 aa, Homo Sapiens
AQRFLYCDV

SEQ ID NO: 524738 - protein, 9 aa, Homo Sapiens
FDGDVDPHL

SEQ ID NO: 524739 - protein, 9 aa, Homo Sapiens
STLAKVFLN

SEQ ID NO: 524740 - protein, 9 aa, Homo Sapiens
MSLGCPSFK

SEQ ID NO: 524741 - protein, 9 aa, Homo Sapiens
QRLLQYDGD

SEQ ID NO: 524742 - protein, 9 aa, Homo Sapiens
EEVQKVKTP

SEQ ID NO: 524743 - protein, 9 aa, Homo Sapiens
ATQERNPQK

SEQ ID NO: 524744 - protein, 9 aa, Homo Sapiens
RNYLRKTRD

SEQ ID NO: 524745 - protein, 9 aa, Homo Sapiens
FLNFKERLL

SEQ ID NO: 524746 - protein, 9 aa, Homo Sapiens
EPDMKYDDM

SEQ ID NO: 524747 - protein, 9 aa, Homo Sapiens
QRVQELLDA

SEQ ID NO: 524748 - protein, 9 aa, Homo Sapiens
QSSASRKTH

SEQ ID NO: 524749 - protein, 9 aa, Homo Sapiens
IVENIGFGK

SEQ ID NO: 524750 - protein, 9 aa, Homo Sapiens
KDKDPKRML

SEQ ID NO: 524751 - protein, 9 aa, Homo Sapiens
TGQRLLQYD

SEQ ID NO: 524752 - protein, 9 aa, Homo Sapiens
TGRRPGGST

SEQ ID NO: 524753 - protein, 9 aa, Homo Sapiens
HEILQRVQE

SEQ ID NO: 524754 - protein, 9 aa, Homo Sapiens
TKSSLFSTL

SEQ ID NO: 524755 - protein, 9 aa, Homo Sapiens
GLACIKLGS

SEQ ID NO: 524756 - protein, 9 aa, Homo Sapiens
TVINKHIMK

SEQ ID NO: 524757 - protein, 9 aa, Homo Sapiens
CPSFKPELI

SEQ ID NO: 524758 - protein, 9 aa, Homo Sapiens
VINKHIMKL

SEQ ID NO: 524759 - protein, 9 aa, Homo Sapiens
AKVFLNFKE

SEQ ID NO: 524760 - protein, 9 aa, Homo Sapiens
KLELIMHAE

SEQ ID NO: 524761 - protein, 9 aa, Homo Sapiens
GLQHEILQR

SEQ ID NO: 524762 - protein, 9 aa, Homo Sapiens
ELIMHAEGG

SEQ ID NO: 524763 - protein, 9 aa, Homo Sapiens
GGLGPSSPW

SEQ ID NO: 524764 - protein, 9 aa, Homo Sapiens
SRSSNPHLL

SEQ ID NO: 524765 - protein, 9 aa, Homo Sapiens
LNFKERLLI

SEQ ID NO: 524766 - protein, 9 aa, Homo Sapiens
ENIGFGKTA

SEQ ID NO: 524767 - protein, 9 aa, Homo Sapiens
PYACSDCGK

SEQ ID NO: 524768 - protein, 9 aa, Homo Sapiens
LAKVFLNFK

SEQ ID NO: 524769 - protein, 9 aa, Homo Sapiens
KLNESDKQH

SEQ ID NO: 524770 - protein, 9 aa, Homo Sapiens
DEPDMKYDD

SEQ ID NO: 524771 - protein, 9 aa, Homo Sapiens
LLMSLGCPS

SEQ ID NO: 524772 - protein, 9 aa, Homo Sapiens
SPWAGPPLT

SEQ ID NO: 524773 - protein, 9 aa, Homo Sapiens
VQCQHQWQK

SEQ ID NO: 524774 - protein, 9 aa, Homo Sapiens
CRNYLRKTR

SEQ ID NO: 524775 - protein, 9 aa, Homo Sapiens
RKTHKKKKK

SEQ ID NO: 524776 - protein, 9 aa, Homo Sapiens
YGSRSSNPH

SEQ ID NO: 524777 - protein, 9 aa, Homo Sapiens
KSTGPCIYN

SEQ ID NO: 524778 - protein, 9 aa, Homo Sapiens
RILPFICSY

SEQ ID NO: 524779 - protein, 9 aa, Homo Sapiens
IGKDEQMDF

SEQ ID NO: 524780 - protein, 9 aa, Homo Sapiens
HAEGGLWLR

SEQ ID NO: 524781 - protein, 9 aa, Homo Sapiens
PDINDLAAL

SEQ ID NO: 524782 - protein, 9 aa, Homo Sapiens
HCVEPDIND

SEQ ID NO: 524783 - protein, 9 aa, Homo Sapiens
RKGDDVKFG

SEQ ID NO: 524784 - protein, 9 aa, Homo Sapiens
ILQRVQELL

SEQ ID NO: 524785 - protein, 9 aa, Homo Sapiens
QMGECDPEE

SEQ ID NO: 524786 - protein, 9 aa, Homo Sapiens
CLRILPFIC

SEQ ID NO: 524787 - protein, 9 aa, Homo Sapiens
WADAGIKKL

SEQ ID NO: 524788 - protein, 9 aa, Homo Sapiens
NTGQRLLQY

SEQ ID NO: 524789 - protein, 9 aa, Homo Sapiens
LLCWADAGI

SEQ ID NO: 524790 - protein, 9 aa, Homo Sapiens
VKFGEFVAY

SEQ ID NO: 524791 - protein, 9 aa, Homo Sapiens
LQHEILQRV

SEQ ID NO: 524792 - protein, 9 aa, Homo Sapiens
EILQRVQEL

SEQ ID NO: 524793 - protein, 9 aa, Homo Sapiens
VMMYGLYWL

SEQ ID NO: 524794 - protein, 9 aa, Homo Sapiens
EYTWVPPGL

SEQ ID NO: 524795 - protein, 9 aa, Homo Sapiens
DVQCQHQWQ

SEQ ID NO: 524796 - protein, 9 aa, Homo Sapiens
KRKGLACIK

SEQ ID NO: 524797 - protein, 9 aa, Homo Sapiens
WLKVAKQLI

SEQ ID NO: 524798 - protein, 9 aa, Homo Sapiens
AHCVEPDIN

SEQ ID NO: 524799 - protein, 9 aa, Homo Sapiens
LINQWFPAL

SEQ ID NO: 524800 - protein, 9 aa, Homo Sapiens
DHVNSLINQ

SEQ ID NO: 524801 - protein, 9 aa, Homo Sapiens
EEYTWVPPG

SEQ ID NO: 524802 - protein, 9 aa, Homo Sapiens
IMHAEGGLW

SEQ ID NO: 524803 - protein, 9 aa, Homo Sapiens
SDCGKAFGQ

SEQ ID NO: 524804 - protein, 9 aa, Homo Sapiens
PIIKNAMSL

SEQ ID NO: 524805 - protein, 9 aa, Homo Sapiens
FLKKFSVTM

SEQ ID NO: 524806 - protein, 9 aa, Homo Sapiens
CDRNWLYEQ

SEQ ID NO: 524807 - protein, 9 aa, Homo Sapiens
DDEPDMKYD

SEQ ID NO: 524808 - protein, 9 aa, Homo Sapiens
EAARQRQLV

SEQ ID NO: 524809 - protein, 9 aa, Homo Sapiens
SSPWAGPPL

SEQ ID NO: 524810 - protein, 9 aa, Homo Sapiens
KYDDMMTCY

SEQ ID NO: 524811 - protein, 9 aa, Homo Sapiens
HVNSLINQW

SEQ ID NO: 524812 - protein, 9 aa, Homo Sapiens
IIKNAMSLP

SEQ ID NO: 524813 - protein, 9 aa, Homo Sapiens
KVQMRLRRQ

SEQ ID NO: 524814 - protein, 9 aa, Homo Sapiens
GKDEQMDFC

SEQ ID NO: 524815 - protein, 9 aa, Homo Sapiens
WLRAFGHYF

SEQ ID NO: 524816 - protein, 9 aa, Homo Sapiens
VTMDAIPDH

SEQ ID NO: 524817 - protein, 9 aa, Homo Sapiens
ANTGQRLLQ

SEQ ID NO: 524818 - protein, 9 aa, Homo Sapiens
PDCVIGKDE

SEQ ID NO: 524819 - protein, 9 aa, Homo Sapiens
KKFSVTMDA

SEQ ID NO: 524820 - protein, 9 aa, Homo Sapiens
KSSLFSTLT

SEQ ID NO: 524821 - protein, 9 aa, Homo Sapiens
SDKQHQENE

SEQ ID NO: 524822 - protein, 9 aa, Homo Sapiens
PFIGSYQGS

SEQ ID NO: 524823 - protein, 9 aa, Homo Sapiens
PSNYAYVNF

SEQ ID NO: 524824 - protein, 9 aa, Homo Sapiens
RRPGGSTFT

SEQ ID NO: 524825 - protein, 9 aa, Homo Sapiens
YWLRAFGHY

SEQ ID NO: 524826 - protein, 9 aa, Homo Sapiens
RKLELIMHA

SEQ ID NO: 524827 - protein, 9 aa, Homo Sapiens
IKNAMSLPQ

SEQ ID NO: 524828 - protein, 9 aa, Homo Sapiens
RNPQKVQMR

SEQ ID NO: 524829 - protein, 9 aa, Homo Sapiens
HTTPILTKS

SEQ ID NO: 524830 - protein, 9 aa, Homo Sapiens
YDDMMTCYL

SEQ ID NO: 524831 - protein, 9 aa, Homo Sapiens
CIYNPCGLR

SEQ ID NO: 524832 - protein, 9 aa, Homo Sapiens
QWQKVLNPE

SEQ ID NO: 524833 - protein, 9 aa, Homo Sapiens
ITSGPSNYA

SEQ ID NO: 524834 - protein, 9 aa, Homo Sapiens
TQERNPQKV

SEQ ID NO: 524835 - protein, 9 aa, Homo Sapiens
LITSGPSNY

SEQ ID NO: 524836 - protein, 9 aa, Homo Sapiens
AHCLRILPF

SEQ ID NO: 524837 - protein, 9 aa, Homo Sapiens
ESDKQHQEN

SEQ ID NO: 524838 - protein, 9 aa, Homo Sapiens
LQRVQELLD

SEQ ID NO: 524839 - protein, 9 aa, Homo Sapiens
DKQHQENEG

SEQ ID NO: 524840 - protein, 9 aa, Homo Sapiens
RAHCLRILP

SEQ ID NO: 524841 - protein, 9 aa, Homo Sapiens
MKDKNSPGL

SEQ ID NO: 524842 - protein, 9 aa, Homo Sapiens
DKSTGPCIY

SEQ ID NO: 524843 - protein, 9 aa, Homo Sapiens
KDPKRMLFT

SEQ ID NO: 524844 - protein, 9 aa, Homo Sapiens
NWLYEQIEI

SEQ ID NO: 524845 - protein, 9 aa, Homo Sapiens
CQHQWQKVL

SEQ ID NO: 524846 - protein, 9 aa, Homo Sapiens
YGLYWLRAF

SEQ ID NO: 524847 - protein, 9 aa, Homo Sapiens
LATGRRPGG

SEQ ID NO: 524848 - protein, 9 aa, Homo Sapiens
SFKPELIYQ

SEQ ID NO: 524849 - protein, 9 aa, Homo Sapiens
AEQLAQMGE

SEQ ID NO: 524850 - protein, 9 aa, Homo Sapiens
VENIGFGKT

SEQ ID NO: 524851 - protein, 9 aa, Homo Sapiens
CVEPDINDL

SEQ ID NO: 524852 - protein, 9 aa, Homo Sapiens
RSSNPHLLS

SEQ ID NO: 524853 - protein, 9 aa, Homo Sapiens
KVAKQLINP

SEQ ID NO: 524854 - protein, 9 aa, Homo Sapiens
KGSFSPQLQ

SEQ ID NO: 524855 - protein, 9 aa, Homo Sapiens
SASRKTHKK

SEQ ID NO: 524856 - protein, 9 aa, Homo Sapiens
LRILPFICS

SEQ ID NO: 524857 - protein, 9 aa, Homo Sapiens
GLYWLRAFG

SEQ ID NO: 524858 - protein, 9 aa, Homo Sapiens
GEFVAYLID

SEQ ID NO: 524859 - protein, 9 aa, Homo Sapiens
QSKGSFSPQ

SEQ ID NO: 524860 - protein, 9 aa, Homo Sapiens
GRKRKGLAC

SEQ ID NO: 524861 - protein, 9 aa, Homo Sapiens
EAAEQLAQM

SEQ ID NO: 524862 - protein, 9 aa, Homo Sapiens
VEPDINDLA

SEQ ID NO: 524863 - protein, 9 aa, Homo Sapiens
DAGIKKLEC

SEQ ID NO: 524864 - protein, 9 aa, Homo Sapiens
GWLKVAKQL

SEQ ID NO: 524865 - protein, 9 aa, Homo Sapiens
TMDAIPDHH

SEQ ID NO: 524866 - protein, 9 aa, Homo Sapiens
MDAIPDHHP

SEQ ID NO: 524867 - protein, 9 aa, Homo Sapiens
DSNSPFIGS

SEQ ID NO: 524868 - protein, 9 aa, Homo Sapiens
GPCIYNPCG

SEQ ID NO: 524869 - protein, 9 aa, Homo Sapiens
QERNPQKVQ

SEQ ID NO: 524870 - protein, 9 aa, Homo Sapiens
MMKDKNSPG

SEQ ID NO: 524871 - protein, 9 aa, Homo Sapiens
GQRLLQYDG

SEQ ID NO: 524872 - protein, 9 aa, Homo Sapiens
LPEHCIVYV

SEQ ID NO: 524873 - protein, 9 aa, Homo Sapiens
LKKFSVTMD

SEQ ID NO: 524874 - protein, 9 aa, Homo Sapiens
GDDVKFGEF

SEQ ID NO: 524875 - protein, 9 aa, Homo Sapiens
KVKTPTPEP

SEQ ID NO: 524876 - protein, 9 aa, Homo Sapiens
VAEEERRRR

SEQ ID NO: 524877 - protein, 9 aa, Homo Sapiens
EHCIVYVRM

SEQ ID NO: 524878 - protein, 9 aa, Homo Sapiens
LMSLGCPSF

SEQ ID NO: 524879 - protein, 9 aa, Homo Sapiens
HERQSKGSF

SEQ ID NO: 524880 - protein, 9 aa, Homo Sapiens
LGCPSFKPE

SEQ ID NO: 524881 - protein, 9 aa, Homo Sapiens
TWVPPGLRP

SEQ ID NO: 524882 - protein, 9 aa, Homo Sapiens
SVTMDAIPD

SEQ ID NO: 524883 - protein, 9 aa, Homo Sapiens
AAEQLAQMG

SEQ ID NO: 524884 - protein, 9 aa, Homo Sapiens
AARQRQLVA

SEQ ID NO: 524885 - protein, 9 aa, Homo Sapiens
QKVQMRLRR

SEQ ID NO: 524886 - protein, 9 aa, Homo Sapiens
PSSPWAGPP

SEQ ID NO: 524887 - protein, 9 aa, Homo Sapiens
SLINQWFPA

SEQ ID NO: 524888 - protein, 9 aa, Homo Sapiens
LEEYTWVPP

SEQ ID NO: 524889 - protein, 9 aa, Homo Sapiens
SGCALEEYT

SEQ ID NO: 524890 - protein, 9 aa, Homo Sapiens
GSRSSNPHL

SEQ ID NO: 524891 - protein, 9 aa, Homo Sapiens
SSASRKTHK

SEQ ID NO: 524892 - protein, 9 aa, Homo Sapiens
KVFLNFKER

SEQ ID NO: 524893 - protein, 9 aa, Homo Sapiens
ISPIIKNAM

SEQ ID NO: 524894 - protein, 9 aa, Homo Sapiens
RPNGRKRKG

SEQ ID NO: 524895 - protein, 9 aa, Homo Sapiens
GAECRCDRN

SEQ ID NO: 524896 - protein, 9 aa, Homo Sapiens
CRCDRNWLY

SEQ ID NO: 524897 - protein, 9 aa, Homo Sapiens
INKHIMKLV

SEQ ID NO: 524898 - protein, 9 aa, Homo Sapiens
ADAGIKKLE

SEQ ID NO: 524899 - protein, 9 aa, Homo Sapiens
SRKTHKKKK

SEQ ID NO: 524900 - protein, 9 aa, Homo Sapiens
MYGLYWLRA

SEQ ID NO: 524901 - protein, 9 aa, Homo Sapiens
INQWFPALT

SEQ ID NO: 524902 - protein, 9 aa, Homo Sapiens
LQYDGDLDE

SEQ ID NO: 524903 - protein, 9 aa, Homo Sapiens
DTGHERQSK

SEQ ID NO: 524904 - protein, 9 aa, Homo Sapiens
TLEKEEGED

SEQ ID NO: 524905 - protein, 9 aa, Homo Sapiens
WRRAHCLRI

SEQ ID NO: 524906 - protein, 9 aa, Homo Sapiens
YAGWLKVAK

SEQ ID NO: 524907 - protein, 9 aa, Homo Sapiens
PCIYNPCGL

SEQ ID NO: 524908 - protein, 9 aa, Homo Sapiens
YACSDCGKA

SEQ ID NO: 524909 - protein, 9 aa, Homo Sapiens
TSGPSNYAY

SEQ ID NO: 524910 - protein, 9 aa, Homo Sapiens
MKLVESVFR

SEQ ID NO: 524911 - protein, 9 aa, Homo Sapiens
ASSKDKDPK

SEQ ID NO: 524912 - protein, 9 aa, Homo Sapiens
QCQHQWQKV

SEQ ID NO: 524913 - protein, 9 aa, Homo Sapiens
DDVKFGEFV

SEQ ID NO: 524914 - protein, 9 aa, Homo Sapiens
VIGKDEQMD

SEQ ID NO: 524915 - protein, 9 aa, Homo Sapiens
EVQKVKTPT

SEQ ID NO: 524916 - protein, 9 aa, Homo Sapiens
SKGSFSPQL

SEQ ID NO: 524917 - protein, 9 aa, Homo Sapiens
AGIKKLECT

SEQ ID NO: 524918 - protein, 9 aa, Homo Sapiens
LAQMGECDP

SEQ ID NO: 524919 - protein, 9 aa, Homo Sapiens
PNGRKRKGL

SEQ ID NO: 524920 - protein, 9 aa, Homo Sapiens
EVMMYGLYW

SEQ ID NO: 524921 - protein, 9 aa, Homo Sapiens
QEECRNYLR

SEQ ID NO: 524922 - protein, 9 aa, Homo Sapiens
KGDDVKFGE

SEQ ID NO: 524923 - protein, 9 aa, Homo Sapiens
LGPSSPWAG

SEQ ID NO: 524924 - protein, 9 aa, Homo Sapiens
NDLAALRVQ

SEQ ID NO: 524925 - protein, 9 aa, Homo Sapiens
RRAHCLRIL

SEQ ID NO: 524926 - protein, 9 aa, Homo Sapiens
PSDEEKYSL

SEQ ID NO: 524927 - protein, 9 aa, Homo Sapiens
PWAGPPLTR

SEQ ID NO: 524928 - protein, 9 aa, Homo Sapiens
MKYDDMMTC

SEQ ID NO: 524929 - protein, 9 aa, Homo Sapiens
DKLNESDKQ

SEQ ID NO: 524930 - protein, 9 aa, Homo Sapiens
NPQKVQMRL

SEQ ID NO: 524931 - protein, 9 aa, Homo Sapiens
FYTLEKEEG

SEQ ID NO: 524932 - protein, 9 aa, Homo Sapiens
VIVENIGFG

SEQ ID NO: 524933 - protein, 9 aa, Homo Sapiens
ASRKTHKKK

SEQ ID NO: 524934 - protein, 9 aa, Homo Sapiens
DCVIGKDEQ

SEQ ID NO: 524935 - protein, 9 aa, Homo Sapiens
MPSDEEKYS

SEQ ID NO: 524936 - protein, 9 aa, Homo Sapiens
MHAEGGLWL

SEQ ID NO: 524937 - protein, 9 aa, Homo Sapiens
RNWLYEQIE

SEQ ID NO: 524938 - protein, 9 aa, Homo Sapiens
FSVTMDAIP

SEQ ID NO: 524939 - protein, 9 aa, Homo Sapiens
YTWVPPGLR

SEQ ID NO: 524940 - protein, 9 aa, Homo Sapiens
AGWLKVAKQ

SEQ ID NO: 524941 - protein, 9 aa, Homo Sapiens
LNESDKQHQ

SEQ ID NO: 524942 - protein, 9 aa, Homo Sapiens
VVIVENIGF

SEQ ID NO: 524943 - protein, 9 aa, Homo Sapiens
RQRQLVAEE

SEQ ID NO: 524944 - protein, 9 aa, Homo Sapiens
ATGRRPGGS

SEQ ID NO: 524945 - protein, 9 aa, Homo Sapiens
EPDINDLAA

SEQ ID NO: 524946 - protein, 9 aa, Homo Sapiens
MGECDPEEI

SEQ ID NO: 524947 - protein, 9 aa, Homo Sapiens
VNSLINQWF

SEQ ID NO: 524948 - protein, 9 aa, Homo Sapiens
DINDLAALR

SEQ ID NO: 524949 - protein, 9 aa, Homo Sapiens
VHTTPILTK

SEQ ID NO: 524950 - protein, 9 aa, Homo Sapiens
IKKLECTLP

SEQ ID NO: 524951 - protein, 9 aa, Homo Sapiens
TPILTKSSL

SEQ ID NO: 524952 - protein, 9 aa, Homo Sapiens
PEEVQKVKT

SEQ ID NO: 524953 - protein, 9 aa, Homo Sapiens
QKVKTPTPE

SEQ ID NO: 524954 - protein, 9 aa, Homo Sapiens
PPEEVQKVK

SEQ ID NO: 524955 - protein, 9 aa, Homo Sapiens
KPYACSDCG

SEQ ID NO: 524956 - protein, 9 aa, Homo Sapiens
NESDKQHQE

SEQ ID NO: 524957 - protein, 9 aa, Homo Sapiens
PILTKSSLF

SEQ ID NO: 524958 - protein, 9 aa, Homo Sapiens
RTDVQCQHQ

SEQ ID NO: 524959 - protein, 9 aa, Homo Sapiens
ECRCDRNWL

SEQ ID NO: 524960 - protein, 9 aa, Homo Sapiens
AECRCDRNW

SEQ ID NO: 524961 - protein, 9 aa, Homo Sapiens
SLATGRRPG

SEQ ID NO: 524962 - protein, 9 aa, Homo Sapiens
KFGEFVAYL

SEQ ID NO: 524963 - protein, 9 aa, Homo Sapiens
HKKKKKKAS

SEQ ID NO: 524964 - protein, 9 aa, Homo Sapiens
RQSKGSFSP

SEQ ID NO: 524965 - protein, 9 aa, Homo Sapiens
VYVRMLQWP

SEQ ID NO: 524966 - protein, 9 aa, Homo Sapiens
EQLAQMGEC

SEQ ID NO: 524967 - protein, 9 aa, Homo Sapiens
YTLEKEEGE

SEQ ID NO: 524968 - protein, 9 aa, Homo Sapiens
AQMGECDPE

SEQ ID NO: 524969 - protein, 9 aa, Homo Sapiens
RKGLACIKL

SEQ ID NO: 524970 - protein, 9 aa, Homo Sapiens
NQGVVIVEN

SEQ ID NO: 524971 - protein, 9 aa, Homo Sapiens
LTKSSLFST

SEQ ID NO: 524972 - protein, 9 aa, Homo Sapiens
NQWFPALTA

SEQ ID NO: 524973 - protein, 9 aa, Homo Sapiens
TLAKVFLNF

SEQ ID NO: 524974 - protein, 9 aa, Homo Sapiens
ARQRQLVAE

SEQ ID NO: 524975 - protein, 9 aa, Homo Sapiens
HCLRILPFI

SEQ ID NO: 524976 - protein, 9 aa, Homo Sapiens
KDEQMDFCW

SEQ ID NO: 524977 - protein, 9 aa, Homo Sapiens
EQMDFCWDP

SEQ ID NO: 524978 - protein, 9 aa, Homo Sapiens
CWADAGIKK

SEQ ID NO: 524979 - protein, 9 aa, Homo Sapiens
CIVYVRMLQ

SEQ ID NO: 524980 - protein, 9 aa, Homo Sapiens
SNSPFIGSY

SEQ ID NO: 524981 - protein, 9 aa, Homo Sapiens
NSPFIGSYQ

SEQ ID NO: 524982 - protein, 9 aa, Homo Sapiens
VAKQLINPF

SEQ ID NO: 524983 - protein, 9 aa, Homo Sapiens
AKQLINPFG

SEQ ID NO: 524984 - protein, 9 aa, Homo Sapiens
DKDPKRMLF

SEQ ID NO: 524985 - protein, 9 aa, Homo Sapiens
TTPILTKSS

SEQ ID NO: 524986 - protein, 9 aa, Homo Sapiens
GLGPSSPWA

SEQ ID NO: 524987 - protein, 9 aa, Homo Sapiens
LVAEEERRR

SEQ ID NO: 524988 - protein, 9 aa, Homo Sapiens
SPIIKNAMS

SEQ ID NO: 524989 - protein, 9 aa, Homo Sapiens
NKHIMKLVE

SEQ ID NO: 524990 - protein, 9 aa, Homo Sapiens
KFSVTMDAI

SEQ ID NO: 524991 - protein, 9 aa, Homo Sapiens
EGEDSNSPF

SEQ ID NO: 524992 - protein, 9 aa, Homo Sapiens
STGPCIYNP

SEQ ID NO: 524993 - protein, 9 aa, Homo Sapiens
GHERQSKGS

SEQ ID NO: 524994 - protein, 9 aa, Homo Sapiens
RLPEHCIVY

SEQ ID NO: 524995 - protein, 9 aa, Homo Sapiens
QHQWQKVLN

SEQ ID NO: 524996 - protein, 9 aa, Homo Sapiens
LKVAKQLIN

SEQ ID NO: 524997 - protein, 9 aa, Homo Sapiens
FGEFVAYLI

SEQ ID NO: 524998 - protein, 9 aa, Homo Sapiens
DLITSGPSN

SEQ ID NO: 524999 - protein, 9 aa, Homo Sapiens
PRLPEHCIV

SEQ ID NO: 525000 - protein, 9 aa, Homo Sapiens
GCALEEYTW

SEQ ID NO: 525001 - protein, 9 aa, Homo Sapiens
VNQGVVIVE

SEQ ID NO: 525002 - protein, 9 aa, Homo Sapiens
THKKKKKKA

SEQ ID NO: 525003 - protein, 9 aa, Homo Sapiens
PPPEEVQKV

SEQ ID NO: 525004 - protein, 9 aa, Homo Sapiens
PQKVQMRLR

SEQ ID NO: 525005 - protein, 9 aa, Homo Sapiens
RASSKDKDP

SEQ ID NO: 525006 - protein, 9 aa, Homo Sapiens
YNPCGLRAR

SEQ ID NO: 525007 - protein, 9 aa, Homo Sapiens
NFKERLLIY

SEQ ID NO: 525008 - protein, 9 aa, Homo Sapiens
QRQLVAEEE

SEQ ID NO: 525009 - protein, 9 aa, Homo Sapiens
PDMKYDDMM

SEQ ID NO: 525010 - protein, 9 aa, Homo Sapiens
HIMKLVESV

SEQ ID NO: 525011 - protein, 9 aa, Homo Sapiens
SGPSNYAYV

SEQ ID NO: 525012 - protein, 9 aa, Homo Sapiens
GCPSFKPEL

SEQ ID NO: 525013 - protein, 9 aa, Homo Sapiens
FIGSYQGSQ

SEQ ID NO: 525014 - protein, 9 aa, Homo Sapiens
VKTPTPEPF

SEQ ID NO: 525015 - protein, 9 aa, Homo Sapiens
PEHCIVYVR

SEQ ID NO: 525016 - protein, 9 aa, Homo Sapiens
HQWQKVLNP

SEQ ID NO: 525017 - protein, 9 aa, Homo Sapiens
DMKYDDMMT

SEQ ID NO: 525018 - protein, 9 aa, Homo Sapiens
ERQSKGSFS

SEQ ID NO: 525019 - protein, 9 aa, Homo Sapiens
IYNPCGLRA

SEQ ID NO: 525020 - protein, 9 aa, Homo Sapiens
IMKLVESVF

SEQ ID NO: 525021 - protein, 9 aa, Homo Sapiens
TDHVNSLIN

SEQ ID NO: 525022 - protein, 9 aa, Homo Sapiens
GEDSNSPFI

SEQ ID NO: 525023 - protein, 9 aa, Homo Sapiens
DEQMDFCWD

SEQ ID NO: 525024 - protein, 9 aa, Homo Sapiens
PSFKPELIY

SEQ ID NO: 525025 - protein, 9 aa, Homo Sapiens
RLLQYDGDL

SEQ ID NO: 525026 - protein, 9 aa, Homo Sapiens
QLVAEEERR

SEQ ID NO: 525027 - protein, 9 aa, Homo Sapiens
WAGPPLTRV

SEQ ID NO: 525028 - protein, 9 aa, Homo Sapiens
CVIGKDEQM

SEQ ID NO: 525029 - protein, 9 aa, Homo Sapiens
ILTKSSLFS

SEQ ID NO: 525030 - protein, 9 aa, Homo Sapiens
SRASSKDKD

SEQ ID NO: 525031 - protein, 9 aa, Homo Sapiens
KQLINPFGE

SEQ ID NO: 525032 - protein, 9 aa, Homo Sapiens
GPSSPWAGP

SEQ ID NO: 525033 - protein, 9 aa, Homo Sapiens
SSKDKDPKR

SEQ ID NO: 525034 - protein, 9 aa, Homo Sapiens
RCDRNWLYE

SEQ ID NO: 525035 - protein, 9 aa, Homo Sapiens
YNRSLATGR

SEQ ID NO: 525036 - protein, 9 aa, Homo Sapiens
LLQYDGDLD

SEQ ID NO: 525037 - protein, 9 aa, Homo Sapiens
NGRKRKGLA

SEQ ID NO: 525038 - protein, 9 aa, Homo Sapiens
QDKLNESDK

SEQ ID NO: 525039 - protein, 9 aa, Homo Sapiens
CALEEYTWV

SEQ ID NO: 525040 - protein, 9 aa, Homo Sapiens
INDLAALRV

SEQ ID NO: 525041 - protein, 9 aa, Homo Sapiens
VQKVKTPTP

SEQ ID NO: 525042 - protein, 9 aa, Homo Sapiens
TDVQCQHQW

SEQ ID NO: 525043 - protein, 9 aa, Homo Sapiens
GIKKLECTL

SEQ ID NO: 525044 - protein, 9 aa, Homo Sapiens
AGLQHEILQ

SEQ ID NO: 525045 - protein, 9 aa, Homo Sapiens
RDLITSGPS

SEQ ID NO: 525046 - protein, 9 aa, Homo Sapiens
ALEEYTWVP

SEQ ID NO: 525047 - protein, 9 aa, Homo Sapiens
RSLATGRRP

SEQ ID NO: 525048 - protein, 9 aa, Homo Sapiens
RRKLELIMH

SEQ ID NO: 525049 - protein, 9 aa, Homo Sapiens
ERNPQKVQM

SEQ ID NO: 525050 - protein, 9 aa, Homo Sapiens
ACSDCGKAF

SEQ ID NO: 525051 - protein, 9 aa, Homo Sapiens
KQHQENEGT

SEQ ID NO: 525052 - protein, 9 aa, Homo Sapiens
NRSLATGRR

SEQ ID NO: 525053 - protein, 9 aa, Homo Sapiens
MSLPQLNQA

SEQ ID NO: 525054 - protein, 9 aa, Homo Sapiens
NSLINQWFP

SEQ ID NO: 525055 - protein, 9 aa, Homo Sapiens
CRDLITSGP

SEQ ID NO: 525056 - protein, 9 aa, Homo Sapiens
GPSNYAYVN

SEQ ID NO: 525057 - protein, 9 aa, Homo Sapiens
DRNWLYEQI

SEQ ID NO: 525058 - protein, 9 aa, Homo Sapiens
QYDGDLDEA

SEQ ID NO: 525059 - protein, 9 aa, Homo Sapiens
RKRKGLACI

SEQ ID NO: 525060 - protein, 9 aa, Homo Sapiens
ECRNYLRKT

SEQ ID NO: 525061 - protein, 9 aa, Homo Sapiens
AMSLPQLNQ

SEQ ID NO: 525062 - protein, 9 aa, Homo Sapiens
SLGCPSFKP

SEQ ID NO: 525063 - protein, 9 aa, Homo Sapiens
DDDEPDMKY

SEQ ID NO: 525064 - protein, 9 aa, Homo Sapiens
KTHKKKKKK

SEQ ID NO: 525065 - protein, 9 aa, Homo Sapiens
KHIMKLVES

SEQ ID NO: 525066 - protein, 9 aa, Homo Sapiens
TGHERQSKG

SEQ ID NO: 525067 - protein, 9 aa, Homo Sapiens
LIMHAEGGL

SEQ ID NO: 525068 - protein, 9 aa, Homo Sapiens
QGVVIVENI

SEQ ID NO: 525069 - protein, 9 aa, Homo Sapiens
GVVIVENIG

SEQ ID NO: 525070 - protein, 9 aa, Homo Sapiens
DVKFGEFVA

SEQ ID NO: 525071 - protein, 9 aa, Homo Sapiens
EDSNSPFIG

SEQ ID NO: 525072 - protein, 9 aa, Homo Sapiens
QLAQMGECD

SEQ ID NO: 525073 - protein, 9 aa, Homo Sapiens
SKDKDPKRM

SEQ ID NO: 525074 - protein, 9 aa, Homo Sapiens
SPFIGSYQG

SEQ ID NO: 525075 - protein, 9 aa, Homo Sapiens
HCIVYVRML

SEQ ID NO: 525076 - protein, 9 aa, Homo Sapiens
TGPCIYNPC

SEQ ID NO: 525077 - protein, 9 aa, Homo Sapiens
MMYGLYWLR

SEQ ID NO: 525078 - protein, 9 aa, Homo Sapiens
DPKRMLFTG

SEQ ID NO: 525079 - protein, 9 aa, Homo Sapiens
GRRPGGSTF

SEQ ID NO: 525080 - protein, 9 aa, Homo Sapiens
QHEILQRVQ

SEQ ID NO: 525081 - protein, 9 aa, Homo Sapiens
IVYVRMLQW

SEQ ID NO: 525082 - protein, 9 aa, Homo Sapiens
LCWADAGIK

SEQ ID NO: 525083 - protein, 9 aa, Homo Sapiens
RQLVAEEER

SEQ ID NO: 525084 - protein, 9 aa, Homo Sapiens
LELIMHAEG

SEQ ID NO: 525085 - protein, 9 aa, Homo Sapiens
KGLACIKLG

SEQ ID NO: 525086 - protein, 9 aa, Homo Sapiens
PTVINKHIM

SEQ ID NO: 525087 - protein, 9 aa, Homo Sapiens
VFLNFKERL

SEQ ID NO: 525088 - protein, 9 aa, Homo Sapiens
EECRNYLRK

SEQ ID NO: 525089 - protein, 9 aa, Homo Sapiens
LYWLRAFGH

SEQ ID NO: 525090 - protein, 9 aa, Homo Sapiens
MDTVQNKQL

SEQ ID NO: 525091 - protein, 9 aa, Homo Sapiens
SSCYFFLPL

SEQ ID NO: 525092 - protein, 9 aa, Homo Sapiens
TTMFPLSTP

SEQ ID NO: 525093 - protein, 9 aa, Homo Sapiens
ETPQGWIQA

SEQ ID NO: 525094 - protein, 9 aa, Homo Sapiens
SSHPLVLPN

SEQ ID NO: 525095 - protein, 9 aa, Homo Sapiens
AAQKTKPVA

SEQ ID NO: 525096 - protein, 9 aa, Homo Sapiens
ILTPTTGLE

SEQ ID NO: 525097 - protein, 9 aa, Homo Sapiens
AHVPSCTGA

SEQ ID NO: 525098 - protein, 9 aa, Homo Sapiens
PLQCWGRRR

SEQ ID NO: 525099 - protein, 9 aa, Homo Sapiens
GRLHALAHS

SEQ ID NO: 525100 - protein, 9 aa, Homo Sapiens
VEKGEMLIF

SEQ ID NO: 525101 - protein, 9 aa, Homo Sapiens
EGKKEIEDE

SEQ ID NO: 525102 - protein, 9 aa, Homo Sapiens
RLHALAHSF

SEQ ID NO: 525103 - protein, 9 aa, Homo Sapiens
PPAPGSSCY

SEQ ID NO: 525104 - protein, 9 aa, Homo Sapiens
CQLGLRFEG

SEQ ID NO: 525105 - protein, 9 aa, Homo Sapiens
EQQILPRVG

SEQ ID NO: 525106 - protein, 9 aa, Homo Sapiens
ALRLWEGPV

SEQ ID NO: 525107 - protein, 9 aa, Homo Sapiens
KGEMLIFEV

SEQ ID NO: 525108 - protein, 9 aa, Homo Sapiens
EIEDEEDDF

SEQ ID NO: 525109 - protein, 9 aa, Homo Sapiens
AIATTCNRH

SEQ ID NO: 525110 - protein, 9 aa, Homo Sapiens
CAGRRRQDC

SEQ ID NO: 525111 - protein, 9 aa, Homo Sapiens
PWRSRGNSG

SEQ ID NO: 525112 - protein, 9 aa, Homo Sapiens
DHHYSIRNS

SEQ ID NO: 525113 - protein, 9 aa, Homo Sapiens
VESAPRGRR

SEQ ID NO: 525114 - protein, 9 aa, Homo Sapiens
WGSFPQHCA

SEQ ID NO: 525115 - protein, 9 aa, Homo Sapiens
VTPCHSRQP

SEQ ID NO: 525116 - protein, 9 aa, Homo Sapiens
RRSRVGVAA

SEQ ID NO: 525117 - protein, 9 aa, Homo Sapiens
WTLSRFFFL

SEQ ID NO: 525118 - protein, 9 aa, Homo Sapiens
EFAIMQIEA

SEQ ID NO: 525119 - protein, 9 aa, Homo Sapiens
HNLMDTVQN

SEQ ID NO: 525120 - protein, 9 aa, Homo Sapiens
QHCAGRRRQ

SEQ ID NO: 525121 - protein, 9 aa, Homo Sapiens
RSAHVPSCT

SEQ ID NO: 525122 - protein, 9 aa, Homo Sapiens
RHKKEVRKG

SEQ ID NO: 525123 - protein, 9 aa, Homo Sapiens
PGKTQPGRG

SEQ ID NO: 525124 - protein, 9 aa, Homo Sapiens
PQGWIQAKK

SEQ ID NO: 525125 - protein, 9 aa, Homo Sapiens
ADRQAVRVT

SEQ ID NO: 525126 - protein, 9 aa, Homo Sapiens
RQDCARPSP

SEQ ID NO: 525127 - protein, 9 aa, Homo Sapiens
YFFLPLAPA

SEQ ID NO: 525128 - protein, 9 aa, Homo Sapiens
CSWDSALRL

SEQ ID NO: 525129 - protein, 9 aa, Homo Sapiens
KKEIEDEED

SEQ ID NO: 525130 - protein, 9 aa, Homo Sapiens
AGLGEVVDE

SEQ ID NO: 525131 - protein, 9 aa, Homo Sapiens
APGSSCYFF

SEQ ID NO: 525132 - protein, 9 aa, Homo Sapiens
MLIFEVGSR

SEQ ID NO: 525133 - protein, 9 aa, Homo Sapiens
GYQPPGARP

SEQ ID NO: 525134 - protein, 9 aa, Homo Sapiens
LLPRTDISD

SEQ ID NO: 525135 - protein, 9 aa, Homo Sapiens
ARPGLGSMP

SEQ ID NO: 525136 - protein, 9 aa, Homo Sapiens
CWGRRRRQW

SEQ ID NO: 525137 - protein, 9 aa, Homo Sapiens
CVGRRRQWG

SEQ ID NO: 525138 - protein, 9 aa, Homo Sapiens
NRHKKEVRK

SEQ ID NO: 525139 - protein, 9 aa, Homo Sapiens
RPTQIISTR

SEQ ID NO: 525140 - protein, 9 aa, Homo Sapiens
GMKRSSTLE

SEQ ID NO: 525141 - protein, 9 aa, Homo Sapiens
FAIMQIEAL

SEQ ID NO: 525142 - protein, 9 aa, Homo Sapiens
EHRPPAPGS

SEQ ID NO: 525143 - protein, 9 aa, Homo Sapiens
REGHLLELL

SEQ ID NO: 525144 - protein, 9 aa, Homo Sapiens
PVQELRKLR

SEQ ID NO: 525145 - protein, 9 aa, Homo Sapiens
EELEFAIMQ

SEQ ID NO: 525146 - protein, 9 aa, Homo Sapiens
DRQAVRVTP

SEQ ID NO: 525147 - protein, 9 aa, Homo Sapiens
RPGLGSMPS

SEQ ID NO: 525148 - protein, 9 aa, Homo Sapiens
DCARPSPSW

SEQ ID NO: 525149 - protein, 9 aa, Homo Sapiens
RACPVMQTC

SEQ ID NO: 525150 - protein, 9 aa, Homo Sapiens
NSGETLPRN

SEQ ID NO: 525151 - protein, 9 aa, Homo Sapiens
GALSRRQGE

SEQ ID NO: 525152 - protein, 9 aa, Homo Sapiens
CARSLISVY

SEQ ID NO: 525153 - protein, 9 aa, Homo Sapiens
TKPVATAPI

SEQ ID NO: 525154 - protein, 9 aa, Homo Sapiens
TLSRFFFLP

SEQ ID NO: 525155 - protein, 9 aa, Homo Sapiens
IRNSDSECP

SEQ ID NO: 525156 - protein, 9 aa, Homo Sapiens
DILTPTTGL

SEQ ID NO: 525157 - protein, 9 aa, Homo Sapiens
SFPLQCVGR

SEQ ID NO: 525158 - protein, 9 aa, Homo Sapiens
MDICATGPR

SEQ ID NO: 525159 - protein, 9 aa, Homo Sapiens
LAGPWSSEA

SEQ ID NO: 525160 - protein, 9 aa, Homo Sapiens
LMDTVQNKQ

SEQ ID NO: 525161 - protein, 9 aa, Homo Sapiens
AHSFGTTLM

SEQ ID NO: 525162 - protein, 9 aa, Homo Sapiens
DLPPGRPTQ

SEQ ID NO: 525163 - protein, 9 aa, Homo Sapiens
VQELRKLRE

SEQ ID NO: 525164 - protein, 9 aa, Homo Sapiens
QELRKLREN

SEQ ID NO: 525165 - protein, 9 aa, Homo Sapiens
RTDISDKIT

SEQ ID NO: 525166 - protein, 9 aa, Homo Sapiens
QAVRVTPCH

SEQ ID NO: 525167 - protein, 9 aa, Homo Sapiens
SWFRSCSWD

SEQ ID NO: 525168 - protein, 9 aa, Homo Sapiens
SDQTALYIC

SEQ ID NO: 525169 - protein, 9 aa, Homo Sapiens
AVRVTPCHS

SEQ ID NO: 525170 - protein, 9 aa, Homo Sapiens
KCLVCEKAF

SEQ ID NO: 525171 - protein, 9 aa, Homo Sapiens
LPLAPASSH

SEQ ID NO: 525172 - protein, 9 aa, Homo Sapiens
TLPRNFTGR

SEQ ID NO: 525173 - protein, 9 aa, Homo Sapiens
SDITVFDIL

SEQ ID NO: 525174 - protein, 9 aa, Homo Sapiens
RGSCQLGLR

SEQ ID NO: 525175 - protein, 9 aa, Homo Sapiens
SEAWDSEGM

SEQ ID NO: 525176 - protein, 9 aa, Homo Sapiens
SCTGAPWRS

SEQ ID NO: 525177 - protein, 9 aa, Homo Sapiens
PRGRRRPAV

SEQ ID NO: 525178 - protein, 9 aa, Homo Sapiens
NSSEHLQAP

SEQ ID NO: 525179 - protein, 9 aa, Homo Sapiens
EDLDLPPGR

SEQ ID NO: 525180 - protein, 9 aa, Homo Sapiens
VDKHSPLAD

SEQ ID NO: 525181 - protein, 9 aa, Homo Sapiens
GRRRPAVAS

SEQ ID NO: 525182 - protein, 9 aa, Homo Sapiens
LPRTDISDK

SEQ ID NO: 525183 - protein, 9 aa, Homo Sapiens
WGSFPLQCW

SEQ ID NO: 525184 - protein, 9 aa, Homo Sapiens
MSTRRSRVG

SEQ ID NO: 525185 - protein, 9 aa, Homo Sapiens
GRGRRNAAR

SEQ ID NO: 525186 - protein, 9 aa, Homo Sapiens
QCVGRRRQW

SEQ ID NO: 525187 - protein, 9 aa, Homo Sapiens
SSEAWDSEG

SEQ ID NO: 525188 - protein, 9 aa, Homo Sapiens
KREGHLLEL

SEQ ID NO: 525189 - protein, 9 aa, Homo Sapiens
SPLADLLLT

SEQ ID NO: 525190 - protein, 9 aa, Homo Sapiens
RVGALSRRQ

SEQ ID NO: 525191 - protein, 9 aa, Homo Sapiens
GRPTQIIST

SEQ ID NO: 525192 - protein, 9 aa, Homo Sapiens
EGANINKLL

SEQ ID NO: 525193 - protein, 9 aa, Homo Sapiens
EMLIFEVGS

SEQ ID NO: 525194 - protein, 9 aa, Homo Sapiens
APRGRRRPA

SEQ ID NO: 525195 - protein, 9 aa, Homo Sapiens
MQIEALKLA

SEQ ID NO: 525196 - protein, 9 aa, Homo Sapiens
GNSGETLPR

SEQ ID NO: 525197 - protein, 9 aa, Homo Sapiens
CGYQPPGAR

SEQ ID NO: 525198 - protein, 9 aa, Homo Sapiens
ICATGPRAC

SEQ ID NO: 525199 - protein, 9 aa, Homo Sapiens
RSCSWDSAL

SEQ ID NO: 525200 - protein, 9 aa, Homo Sapiens
WEGPVQELR

SEQ ID NO: 525201 - protein, 9 aa, Homo Sapiens
ANINKLLTT

SEQ ID NO: 525202 - protein, 9 aa, Homo Sapiens
VVDELNQKK

SEQ ID NO: 525203 - protein, 9 aa, Homo Sapiens
SAPRGRRRP

SEQ ID NO: 525204 - protein, 9 aa, Homo Sapiens
LYICMLGDV

SEQ ID NO: 525205 - protein, 9 aa, Homo Sapiens
TDISDKITS

SEQ ID NO: 525206 - protein, 9 aa, Homo Sapiens
EVVDELNQK

SEQ ID NO: 525207 - protein, 9 aa, Homo Sapiens
GKTQPGRGR

SEQ ID NO: 525208 - protein, 9 aa, Homo Sapiens
FFLPLAPAS

SEQ ID NO: 525209 - protein, 9 aa, Homo Sapiens
LQCWGRRRR

SEQ ID NO: 525210 - protein, 9 aa, Homo Sapiens
VVDLLPRTD

SEQ ID NO: 525211 - protein, 9 aa, Homo Sapiens
PLADLLLTE

SEQ ID NO: 525212 - protein, 9 aa, Homo Sapiens
EKAAQKTKP

SEQ ID NO: 525213 - protein, 9 aa, Homo Sapiens
TGRLHALAH

SEQ ID NO: 525214 - protein, 9 aa, Homo Sapiens
LPPGRPTQI

SEQ ID NO: 525215 - protein, 9 aa, Homo Sapiens
WRSRGNSGE

SEQ ID NO: 525216 - protein, 9 aa, Homo Sapiens
ELRKLRENL

SEQ ID NO: 525217 - protein, 9 aa, Homo Sapiens
FPLSTPSSC

SEQ ID NO: 525218 - protein, 9 aa, Homo Sapiens
GARPGLGSM

SEQ ID NO: 525219 - protein, 9 aa, Homo Sapiens
TALYICMLG

SEQ ID NO: 525220 - protein, 9 aa, Homo Sapiens
SHPLVLPNK

SEQ ID NO: 525221 - protein, 9 aa, Homo Sapiens
MFPLSTPSS

SEQ ID NO: 525222 - protein, 9 aa, Homo Sapiens
GAPWRSRGN

SEQ ID NO: 525223 - protein, 9 aa, Homo Sapiens
PASSHPLVL

SEQ ID NO: 525224 - protein, 9 aa, Homo Sapiens
MKRSSTLEH

SEQ ID NO: 525225 - protein, 9 aa, Homo Sapiens
GRGSCQLGL

SEQ ID NO: 525226 - protein, 9 aa, Homo Sapiens
EGPVQELRK

SEQ ID NO: 525227 - protein, 9 aa, Homo Sapiens
GEVVDELNQ

SEQ ID NO: 525228 - protein, 9 aa, Homo Sapiens
NINKLLTTL

SEQ ID NO: 525229 - protein, 9 aa, Homo Sapiens
CLVCEKAFS

SEQ ID NO: 525230 - protein, 9 aa, Homo Sapiens
RGRRNAARL

SEQ ID NO: 525231 - protein, 9 aa, Homo Sapiens
FRSCSWDSA

SEQ ID NO: 525232 - protein, 9 aa, Homo Sapiens
DISDKITSE

SEQ ID NO: 525233 - protein, 9 aa, Homo Sapiens
RSRVGVAAV

SEQ ID NO: 525234 - protein, 9 aa, Homo Sapiens
QILPRVGAL

SEQ ID NO: 525235 - protein, 9 aa, Homo Sapiens
PSQEECLSG

SEQ ID NO: 525236 - protein, 9 aa, Homo Sapiens
WGSFPLQCV

SEQ ID NO: 525237 - protein, 9 aa, Homo Sapiens
RVTPCHSRQ

SEQ ID NO: 525238 - protein, 9 aa, Homo Sapiens
QKTKPVATA

SEQ ID NO: 525239 - protein, 9 aa, Homo Sapiens
HHYSIRNSD

SEQ ID NO: 525240 - protein, 9 aa, Homo Sapiens
IATTCNRHK

SEQ ID NO: 525241 - protein, 9 aa, Homo Sapiens
PRTDISDKI

SEQ ID NO: 525242 - protein, 9 aa, Homo Sapiens
RGRRRPAVA

SEQ ID NO: 525243 - protein, 9 aa, Homo Sapiens
ELEFAIMQI

SEQ ID NO: 525244 - protein, 9 aa, Homo Sapiens
LGLRFEGAL

SEQ ID NO: 525245 - protein, 9 aa, Homo Sapiens
FIPVEKGEM

SEQ ID NO: 525246 - protein, 9 aa, Homo Sapiens
RGNSGETLP

SEQ ID NO: 525247 - protein, 9 aa, Homo Sapiens
EKPFKCLVC

SEQ ID NO: 525248 - protein, 9 aa, Homo Sapiens
SFPLQCWGR

SEQ ID NO: 525249 - protein, 9 aa, Homo Sapiens
TGAPWRSRG

SEQ ID NO: 525250 - protein, 9 aa, Homo Sapiens
DLLPRTDIS

SEQ ID NO: 525251 - protein, 9 aa, Homo Sapiens
AWDSEGMKR

SEQ ID NO: 525252 - protein, 9 aa, Homo Sapiens
PSWFRSCSW

SEQ ID NO: 525253 - protein, 9 aa, Homo Sapiens
YSIRNSDSE

SEQ ID NO: 525254 - protein, 9 aa, Homo Sapiens
SEGMKRSST

SEQ ID NO: 525255 - protein, 9 aa, Homo Sapiens
PGRGRRNAA

SEQ ID NO: 525256 - protein, 9 aa, Homo Sapiens
QEECLSGVL

SEQ ID NO: 525257 - protein, 9 aa, Homo Sapiens
ASVDKHSPL

SEQ ID NO: 525258 - protein, 9 aa, Homo Sapiens
SWDSALRLW

SEQ ID NO: 525259 - protein, 9 aa, Homo Sapiens
LLTTLGKVI

SEQ ID NO: 525260 - protein, 9 aa, Homo Sapiens
VFDILTPTT

SEQ ID NO: 525261 - protein, 9 aa, Homo Sapiens
VRVTPCHSR

SEQ ID NO: 525262 - protein, 9 aa, Homo Sapiens
VPSCTGAPW

SEQ ID NO: 525263 - protein, 9 aa, Homo Sapiens
HPGKTQPGR

SEQ ID NO: 525264 - protein, 9 aa, Homo Sapiens
RVVENMEGA

SEQ ID NO: 525265 - protein, 9 aa, Homo Sapiens
WFRSCSWDS

SEQ ID NO: 525266 - protein, 9 aa, Homo Sapiens
EGHLLELLN

SEQ ID NO: 525267 - protein, 9 aa, Homo Sapiens
VGRRRQWGS

SEQ ID NO: 525268 - protein, 9 aa, Homo Sapiens
KPFKCLVCE

SEQ ID NO: 525269 - protein, 9 aa, Homo Sapiens
WIQAKKWSR

SEQ ID NO: 525270 - protein, 9 aa, Homo Sapiens
VENMEGASQ

SEQ ID NO: 525271 - protein, 9 aa, Homo Sapiens
GRRRRQWGS

SEQ ID NO: 525272 - protein, 9 aa, Homo Sapiens
GPVQELRKL

SEQ ID NO: 525273 - protein, 9 aa, Homo Sapiens
FKCLVCEKA

SEQ ID NO: 525274 - protein, 9 aa, Homo Sapiens
RRQWGSFPL

SEQ ID NO: 525275 - protein, 9 aa, Homo Sapiens
DEVAGLGEV

SEQ ID NO: 525276 - protein, 9 aa, Homo Sapiens
DSEGMKRSS

SEQ ID NO: 525277 - protein, 9 aa, Homo Sapiens
VSNHNLMDT

SEQ ID NO: 525278 - protein, 9 aa, Homo Sapiens
DSALRLWEG

SEQ ID NO: 525279 - protein, 9 aa, Homo Sapiens
RRQWGSFPQ

SEQ ID NO: 525280 - protein, 9 aa, Homo Sapiens
WDSEGMKRS

SEQ ID NO: 525281 - protein, 9 aa, Homo Sapiens
SALRLWEGP

SEQ ID NO: 525282 - protein, 9 aa, Homo Sapiens
LHALAHSFG

SEQ ID NO: 525283 - protein, 9 aa, Homo Sapiens
TVFDILTPT

SEQ ID NO: 525284 - protein, 9 aa, Homo Sapiens
SQEECLSGV

SEQ ID NO: 525285 - protein, 9 aa, Homo Sapiens
SRVGVAAVG

SEQ ID NO: 525286 - protein, 9 aa, Homo Sapiens
SIRNSDSEC

SEQ ID NO: 525287 - protein, 9 aa, Homo Sapiens
KHSPLADLL

SEQ ID NO: 525288 - protein, 9 aa, Homo Sapiens
DDHHYSIRN

SEQ ID NO: 525289 - protein, 9 aa, Homo Sapiens
EDDHHYSIR

SEQ ID NO: 525290 - protein, 9 aa, Homo Sapiens
AGRRRQDCA

SEQ ID NO: 525291 - protein, 9 aa, Homo Sapiens
PSPSWFRSC

SEQ ID NO: 525292 - protein, 9 aa, Homo Sapiens
CYFFLPLAP

SEQ ID NO: 525293 - protein, 9 aa, Homo Sapiens
HSPLADLLL

SEQ ID NO: 525294 - protein, 9 aa, Homo Sapiens
HRPPAPGSS

SEQ ID NO: 525295 - protein, 9 aa, Homo Sapiens
AGPWSSEAW

SEQ ID NO: 525296 - protein, 9 aa, Homo Sapiens
CNRHKKEVR

SEQ ID NO: 525297 - protein, 9 aa, Homo Sapiens
PFKCLVCEK

SEQ ID NO: 525298 - protein, 9 aa, Homo Sapiens
RNFTGRLHA

SEQ ID NO: 525299 - protein, 9 aa, Homo Sapiens
WGRRRRQWG

SEQ ID NO: 525300 - protein, 9 aa, Homo Sapiens
DGRGSCQLG

SEQ ID NO: 525301 - protein, 9 aa, Homo Sapiens
ATTCNRHKK

SEQ ID NO: 525302 - protein, 9 aa, Homo Sapiens
LAHSFGTTL

SEQ ID NO: 525303 - protein, 9 aa, Homo Sapiens
QLGLRFEGA

SEQ ID NO: 525304 - protein, 9 aa, Homo Sapiens
KEIEDEEDD

SEQ ID NO: 525305 - protein, 9 aa, Homo Sapiens
QPTLPNSSE

SEQ ID NO: 525306 - protein, 9 aa, Homo Sapiens
LPNSSEHLQ

SEQ ID NO: 525307 - protein, 9 aa, Homo Sapiens
WDSALRLWE

SEQ ID NO: 525308 - protein, 9 aa, Homo Sapiens
VAGLGEVVD

SEQ ID NO: 525309 - protein, 9 aa, Homo Sapiens
PRVGALSRR

SEQ ID NO: 525310 - protein, 9 aa, Homo Sapiens
RFQTARFCR

SEQ ID NO: 525311 - protein, 9 aa, Homo Sapiens
SVDKHSPLA

SEQ ID NO: 525312 - protein, 9 aa, Homo Sapiens
LGEVVDELN

SEQ ID NO: 525313 - protein, 9 aa, Homo Sapiens
PLSTPSSCL

SEQ ID NO: 525314 - protein, 9 aa, Homo Sapiens
YICMLGDVR

SEQ ID NO: 525315 - protein, 9 aa, Homo Sapiens
TMFPLSTPS

SEQ ID NO: 525316 - protein, 9 aa, Homo Sapiens
TARFCRDVL

SEQ ID NO: 525317 - protein, 9 aa, Homo Sapiens
KEGANINKL

SEQ ID NO: 525318 - protein, 9 aa, Homo Sapiens
TRRSRVGVA

SEQ ID NO: 525319 - protein, 9 aa, Homo Sapiens
QPGRGRRNA

SEQ ID NO: 525320 - protein, 9 aa, Homo Sapiens
HVPSCTGAP

SEQ ID NO: 525321 - protein, 9 aa, Homo Sapiens
NLMDTVQNK

SEQ ID NO: 525322 - protein, 9 aa, Homo Sapiens
RLWEGPVQE

SEQ ID NO: 525323 - protein, 9 aa, Homo Sapiens
ETKREGHLL

SEQ ID NO: 525324 - protein, 9 aa, Homo Sapiens
PGSSCYFFL

SEQ ID NO: 525325 - protein, 9 aa, Homo Sapiens
LADLLLTEE

SEQ ID NO: 525326 - protein, 9 aa, Homo Sapiens
HALAHSFGT

SEQ ID NO: 525327 - protein, 9 aa, Homo Sapiens
QIEALKLAR

SEQ ID NO: 525328 - protein, 9 aa, Homo Sapiens
STRRSRVGV

SEQ ID NO: 525329 - protein, 9 aa, Homo Sapiens
PPGARPGLG

SEQ ID NO: 525330 - protein, 9 aa, Homo Sapiens
NKLLTTLGK

SEQ ID NO: 525331 - protein, 9 aa, Homo Sapiens
QPPGARPGL

SEQ ID NO: 525332 - protein, 9 aa, Homo Sapiens
ETLPRNFTG

SEQ ID NO: 525333 - protein, 9 aa, Homo Sapiens
ATGPRACPV

SEQ ID NO: 525334 - protein, 9 aa, Homo Sapiens
AQKTKPVAT

SEQ ID NO: 525335 - protein, 9 aa, Homo Sapiens
IPVEKGEML

SEQ ID NO: 525336 - protein, 9 aa, Homo Sapiens
SNHNLMDTV

SEQ ID NO: 525337 - protein, 9 aa, Homo Sapiens
GPWSSEAWD

SEQ ID NO: 525338 - protein, 9 aa, Homo Sapiens
PQHCAGRRR

SEQ ID NO: 525339 - protein, 9 aa, Homo Sapiens
EGMKRSSTL

SEQ ID NO: 525340 - protein, 9 aa, Homo Sapiens
KEKEGKKEI

SEQ ID NO: 525341 - protein, 9 aa, Homo Sapiens
SGETLPRNF

SEQ ID NO: 525342 - protein, 9 aa, Homo Sapiens
RENLAGPWS

SEQ ID NO: 525343 - protein, 9 aa, Homo Sapiens
QWGSFPQHC

SEQ ID NO: 525344 - protein, 9 aa, Homo Sapiens
LRLWEGPVQ

SEQ ID NO: 525345 - protein, 9 aa, Homo Sapiens
GETLPRNFT

SEQ ID NO: 525346 - protein, 9 aa, Homo Sapiens
GLGEVVDEL

SEQ ID NO: 525347 - protein, 9 aa, Homo Sapiens
LSTPSSCLH

SEQ ID NO: 525348 - protein, 9 aa, Homo Sapiens
RPSPSWFRS

SEQ ID NO: 525349 - protein, 9 aa, Homo Sapiens
SCYFFLPLA

SEQ ID NO: 525350 - protein, 9 aa, Homo Sapiens
HPLVLPNKL

SEQ ID NO: 525351 - protein, 9 aa, Homo Sapiens
ALYICMLGD

SEQ ID NO: 525352 - protein, 9 aa, Homo Sapiens
KAAQKTKPV

SEQ ID NO: 525353 - protein, 9 aa, Homo Sapiens
YETKREGHL

SEQ ID NO: 525354 - protein, 9 aa, Homo Sapiens
REDDHHYSI

SEQ ID NO: 525355 - protein, 9 aa, Homo Sapiens
TLEHRPPAP

SEQ ID NO: 525356 - protein, 9 aa, Homo Sapiens
NMEGASQAN

SEQ ID NO: 525357 - protein, 9 aa, Homo Sapiens
QDCARPSPS

SEQ ID NO: 525358 - protein, 9 aa, Homo Sapiens
KTKPVATAP

SEQ ID NO: 525359 - protein, 9 aa, Homo Sapiens
RQWGSFPQH

SEQ ID NO: 525360 - protein, 9 aa, Homo Sapiens
VVENMEGAS

SEQ ID NO: 525361 - protein, 9 aa, Homo Sapiens
EEKAAQKTK

SEQ ID NO: 525362 - protein, 9 aa, Homo Sapiens
KLRENLAGP

SEQ ID NO: 525363 - protein, 9 aa, Homo Sapiens
LTGRVVENM

SEQ ID NO: 525364 - protein, 9 aa, Homo Sapiens
HKKEVRKGG

SEQ ID NO: 525365 - protein, 9 aa, Homo Sapiens
LQCVGRRRQ

SEQ ID NO: 525366 - protein, 9 aa, Homo Sapiens
SCQLGLRFE

SEQ ID NO: 525367 - protein, 9 aa, Homo Sapiens
ICMLGDVRV

SEQ ID NO: 525368 - protein, 9 aa, Homo Sapiens
APASSHPLV

SEQ ID NO: 525369 - protein, 9 aa, Homo Sapiens
EAWDSEGMK

SEQ ID NO: 525370 - protein, 9 aa, Homo Sapiens
LDLPPGRPT

SEQ ID NO: 525371 - protein, 9 aa, Homo Sapiens
SSTLEHRPP

SEQ ID NO: 525372 - protein, 9 aa, Homo Sapiens
TCNRHKKEV

SEQ ID NO: 525373 - protein, 9 aa, Homo Sapiens
PLAPASSHP

SEQ ID NO: 525374 - protein, 9 aa, Homo Sapiens
DLDLPPGRP

SEQ ID NO: 525375 - protein, 9 aa, Homo Sapiens
CATGPRACP

SEQ ID NO: 525376 - protein, 9 aa, Homo Sapiens
APWRSRGNS

SEQ ID NO: 525377 - protein, 9 aa, Homo Sapiens
LEFAIMQIE

SEQ ID NO: 525378 - protein, 9 aa, Homo Sapiens
LEHRPPAPG

SEQ ID NO: 525379 - protein, 9 aa, Homo Sapiens
SLISVYSEK

SEQ ID NO: 525380 - protein, 9 aa, Homo Sapiens
DICATGPRA

SEQ ID NO: 525381 - protein, 9 aa, Homo Sapiens
TPCHSRQPS

SEQ ID NO: 525382 - protein, 9 aa, Homo Sapiens
SSEHLQAPF

SEQ ID NO: 525383 - protein, 9 aa, Homo Sapiens
GWIQAKKWS

SEQ ID NO: 525384 - protein, 9 aa, Homo Sapiens
PNSSEHLQA

SEQ ID NO: 525385 - protein, 9 aa, Homo Sapiens
EKGEMLIFE

SEQ ID NO: 525386 - protein, 9 aa, Homo Sapiens
QTALYICML

SEQ ID NO: 525387 - protein, 9 aa, Homo Sapiens
DKHSPLADL

SEQ ID NO: 525388 - protein, 9 aa, Homo Sapiens
GKKEIEDEE

SEQ ID NO: 525389 - protein, 9 aa, Homo Sapiens
TPQGWIQAK

SEQ ID NO: 525390 - protein, 9 aa, Homo Sapiens
CMLGDVRVR

SEQ ID NO: 525391 - protein, 9 aa, Homo Sapiens
PRACPVMQT

SEQ ID NO: 525392 - protein, 9 aa, Homo Sapiens
FDILTPTTG

SEQ ID NO: 525393 - protein, 9 aa, Homo Sapiens
ARSLISVYS

SEQ ID NO: 525394 - protein, 9 aa, Homo Sapiens
GSFPQHCAG

SEQ ID NO: 525395 - protein, 9 aa, Homo Sapiens
SAHVPSCTG

SEQ ID NO: 525396 - protein, 9 aa, Homo Sapiens
ITVFDILTP

SEQ ID NO: 525397 - protein, 9 aa, Homo Sapiens
LRENLAGPW

SEQ ID NO: 525398 - protein, 9 aa, Homo Sapiens
QCWGRRRRQ

SEQ ID NO: 525399 - protein, 9 aa, Homo Sapiens
TLPNSSEHL

SEQ ID NO: 525400 - protein, 9 aa, Homo Sapiens
KTQPGRGRR

SEQ ID NO: 525401 - protein, 9 aa, Homo Sapiens
RRRQWGSFP

SEQ ID NO: 525402 - protein, 9 aa, Homo Sapiens
SCSWDSALR

SEQ ID NO: 525403 - protein, 9 aa, Homo Sapiens
TQPGRGRRN

SEQ ID NO: 525404 - protein, 9 aa, Homo Sapiens
IDGRGSCQL

SEQ ID NO: 525405 - protein, 9 aa, Homo Sapiens
KLLTTLGKV

SEQ ID NO: 525406 - protein, 9 aa, Homo Sapiens
PSCTGAPWR

SEQ ID NO: 525407 - protein, 9 aa, Homo Sapiens
NFTGRLHAL

SEQ ID NO: 525408 - protein, 9 aa, Homo Sapiens
YQPPGARPG

SEQ ID NO: 525409 - protein, 9 aa, Homo Sapiens
GSFPLQCVG

SEQ ID NO: 525410 - protein, 9 aa, Homo Sapiens
NHNLMDTVQ

SEQ ID NO: 525411 - protein, 9 aa, Homo Sapiens
ARPSPSWFR

SEQ ID NO: 525412 - protein, 9 aa, Homo Sapiens
RSLISVYSE

SEQ ID NO: 525413 - protein, 9 aa, Homo Sapiens
GRRRQDCAR

SEQ ID NO: 525414 - protein, 9 aa, Homo Sapiens
RRRQDCARP

SEQ ID NO: 525415 - protein, 9 aa, Homo Sapiens
QGWIQAKKW

SEQ ID NO: 525416 - protein, 9 aa, Homo Sapiens
LETPQGWIQ

SEQ ID NO: 525417 - protein, 9 aa, Homo Sapiens
SFPQHCAGR

SEQ ID NO: 525418 - protein, 9 aa, Homo Sapiens
TKREGHLLE

SEQ ID NO: 525419 - protein, 9 aa, Homo Sapiens
ASSHPLVLP

SEQ ID NO: 525420 - protein, 9 aa, Homo Sapiens
FPLQCWGRR

SEQ ID NO: 525421 - protein, 9 aa, Homo Sapiens
DITVFDILT

SEQ ID NO: 525422 - protein, 9 aa, Homo Sapiens
NRFQTARFC

SEQ ID NO: 525423 - protein, 9 aa, Homo Sapiens
FLPLAPASS

SEQ ID NO: 525424 - protein, 9 aa, Homo Sapiens
VASMSTRRS

SEQ ID NO: 525425 - protein, 9 aa, Homo Sapiens
SPSWFRSCS

SEQ ID NO: 525426 - protein, 9 aa, Homo Sapiens
FPQHCAGRR

SEQ ID NO: 525427 - protein, 9 aa, Homo Sapiens
EKEGKKEIE

SEQ ID NO: 525428 - protein, 9 aa, Homo Sapiens
LSRFFFLPS

SEQ ID NO: 525429 - protein, 9 aa, Homo Sapiens
PLQCVGRRR

SEQ ID NO: 525430 - protein, 9 aa, Homo Sapiens
TPSSCLHWH

SEQ ID NO: 525431 - protein, 9 aa, Homo Sapiens
ATYETKREG

SEQ ID NO: 525432 - protein, 9 aa, Homo Sapiens
STLEHRPPA

SEQ ID NO: 525433 - protein, 9 aa, Homo Sapiens
ILPRVGALS

SEQ ID NO: 525434 - protein, 9 aa, Homo Sapiens
VIVSNHNLM

SEQ ID NO: 525435 - protein, 9 aa, Homo Sapiens
SVQPTLPNS

SEQ ID NO: 525436 - protein, 9 aa, Homo Sapiens
GPRACPVMQ

SEQ ID NO: 525437 - protein, 9 aa, Homo Sapiens
TTCNRHKKE

SEQ ID NO: 525438 - protein, 9 aa, Homo Sapiens
KEGKKEIED

SEQ ID NO: 525439 - protein, 9 aa, Homo Sapiens
LVCEKAFSG

SEQ ID NO: 525440 - protein, 9 aa, Homo Sapiens
KWTLSRFFF

SEQ ID NO: 525441 - protein, 9 aa, Homo Sapiens
TGRVVENME

SEQ ID NO: 525442 - protein, 9 aa, Homo Sapiens
WSSEAWDSE

SEQ ID NO: 525443 - protein, 9 aa, Homo Sapiens
LAPASSHPL

SEQ ID NO: 525444 - protein, 9 aa, Homo Sapiens
GRVVENMEG

SEQ ID NO: 525445 - protein, 9 aa, Homo Sapiens
RQAVRVTPC

SEQ ID NO: 525446 - protein, 9 aa, Homo Sapiens
AIMQIEALK

SEQ ID NO: 525447 - protein, 9 aa, Homo Sapiens
PWSSEAWDS

SEQ ID NO: 525448 - protein, 9 aa, Homo Sapiens
MACARSLIS

SEQ ID NO: 525449 - protein, 9 aa, Homo Sapiens
ARFCRDVLG

SEQ ID NO: 525450 - protein, 9 aa, Homo Sapiens
FATYETKRE

SEQ ID NO: 525451 - protein, 9 aa, Homo Sapiens
ASMSTRRSR

SEQ ID NO: 525452 - protein, 9 aa, Homo Sapiens
TGPRACPVM

SEQ ID NO: 525453 - protein, 9 aa, Homo Sapiens
GRRRQWGSF

SEQ ID NO: 525454 - protein, 9 aa, Homo Sapiens
PPGRPTQII

SEQ ID NO: 525455 - protein, 9 aa, Homo Sapiens
VCEKAFSGK

SEQ ID NO: 525456 - protein, 9 aa, Homo Sapiens
RRRRQWGSF

SEQ ID NO: 525457 - protein, 9 aa, Homo Sapiens
VDLLPRTDI

SEQ ID NO: 525458 - protein, 9 aa, Homo Sapiens
YTTMFPLST

SEQ ID NO: 525459 - protein, 9 aa, Homo Sapiens
QQILPRVGA

SEQ ID NO: 525460 - protein, 9 aa, Homo Sapiens
ENLAGPWSS

SEQ ID NO: 525461 - protein, 9 aa, Homo Sapiens
IPSQEECLS

SEQ ID NO: 525462 - protein, 9 aa, Homo Sapiens
GSSCYFFLP

SEQ ID NO: 525463 - protein, 9 aa, Homo Sapiens
PTLPNSSEH

SEQ ID NO: 525464 - protein, 9 aa, Homo Sapiens
FPLQCVGRR

SEQ ID NO: 525465 - protein, 9 aa, Homo Sapiens
PGRPTQIIS

SEQ ID NO: 525466 - protein, 9 aa, Homo Sapiens
PVEKGEMLI

SEQ ID NO: 525467 - protein, 9 aa, Homo Sapiens
KRSSTLEHR

SEQ ID NO: 525468 - protein, 9 aa, Homo Sapiens
EVAGLGEVV

SEQ ID NO: 525469 - protein, 9 aa, Homo Sapiens
AVESAPRGR

SEQ ID NO: 525470 - protein, 9 aa, Homo Sapiens
RPPAPGSSC

SEQ ID NO: 525471 - protein, 9 aa, Homo Sapiens
HYSIRNSDS

SEQ ID NO: 525472 - protein, 9 aa, Homo Sapiens
RAVESAPRG

SEQ ID NO: 525473 - protein, 9 aa, Homo Sapiens
ACARSLISV

SEQ ID NO: 525474 - protein, 9 aa, Homo Sapiens
DQTALYICM

SEQ ID NO: 525475 - protein, 9 aa, Homo Sapiens
GANINKLLT

SEQ ID NO: 525476 - protein, 9 aa, Homo Sapiens
GEKPFKCLV

SEQ ID NO: 525477 - protein, 9 aa, Homo Sapiens
RRQDCARPS

SEQ ID NO: 525478 - protein, 9 aa, Homo Sapiens
TYETKREGH

SEQ ID NO: 525479 - protein, 9 aa, Homo Sapiens
SRSAHVPSC

SEQ ID NO: 525480 - protein, 9 aa, Homo Sapiens
PSDITVFDI

SEQ ID NO: 525481 - protein, 9 aa, Homo Sapiens
RKLRENLAG

SEQ ID NO: 525482 - protein, 9 aa, Homo Sapiens
LPRNFTGRL

SEQ ID NO: 525483 - protein, 9 aa, Homo Sapiens
SMSTRRSRV

SEQ ID NO: 525484 - protein, 9 aa, Homo Sapiens
VGALSRRQG

SEQ ID NO: 525485 - protein, 9 aa, Homo Sapiens
IVSNHNLMD

SEQ ID NO: 525486 - protein, 9 aa, Homo Sapiens
EEEKAAQKT

SEQ ID NO: 525487 - protein, 9 aa, Homo Sapiens
LPRVGALSR

SEQ ID NO: 525488 - protein, 9 aa, Homo Sapiens
ALAHSFGTT

SEQ ID NO: 525489 - protein, 9 aa, Homo Sapiens
ESAPRGRRR

SEQ ID NO: 525490 - protein, 9 aa, Homo Sapiens
STPSSCLHW

SEQ ID NO: 525491 - protein, 9 aa, Homo Sapiens
PGARPGLGS

SEQ ID NO: 525492 - protein, 9 aa, Homo Sapiens
LWEGPVQEL

SEQ ID NO: 525493 - protein, 9 aa, Homo Sapiens
QWGSFPLQC

SEQ ID NO: 525494 - protein, 9 aa, Homo Sapiens
GSCQLGLRF

SEQ ID NO: 525495 - protein, 9 aa, Homo Sapiens
SRGNSGETL

SEQ ID NO: 525496 - protein, 9 aa, Homo Sapiens
QTARFCRDV

SEQ ID NO: 525497 - protein, 9 aa, Homo Sapiens
FTGRLHALA

SEQ ID NO: 525498 - protein, 9 aa, Homo Sapiens
RFCRDVLGM

SEQ ID NO: 525499 - protein, 9 aa, Homo Sapiens
ENMEGASQA

SEQ ID NO: 525500 - protein, 9 aa, Homo Sapiens
CRDVLGMKV

SEQ ID NO: 525501 - protein, 9 aa, Homo Sapiens
LLETPQGWI

SEQ ID NO: 525502 - protein, 9 aa, Homo Sapiens
PAPGSSCYF

SEQ ID NO: 525503 - protein, 9 aa, Homo Sapiens
DLTGRVVEN

SEQ ID NO: 525504 - protein, 9 aa, Homo Sapiens
GSFPLQCWG

SEQ ID NO: 525505 - protein, 9 aa, Homo Sapiens
LRKLRENLA

SEQ ID NO: 525506 - protein, 9 aa, Homo Sapiens
CARPSPSWF

SEQ ID NO: 525507 - protein, 9 aa, Homo Sapiens
FCRDVLGMK

SEQ ID NO: 525508 - protein, 9 aa, Homo Sapiens
FQTARFCRD

SEQ ID NO: 525509 - protein, 9 aa, Homo Sapiens
NLAGPWSSE

SEQ ID NO: 525510 - protein, 9 aa, Homo Sapiens
RSRGNSGET

SEQ ID NO: 525511 - protein, 9 aa, Homo Sapiens
MLLETPQGW

SEQ ID NO: 525512 - protein, 9 aa, Homo Sapiens
PRNFTGRLH

SEQ ID NO: 525513 - protein, 9 aa, Homo Sapiens
CTGAPWRSR

SEQ ID NO: 525514 - protein, 9 aa, Homo Sapiens
INKLLTTLG

SEQ ID NO: 525515 - protein, 9 aa, Homo Sapiens
GEMLIFEVG

SEQ ID NO: 525516 - protein, 9 aa, Homo Sapiens
RSSTLEHRP

SEQ ID NO: 525517 - protein, 9 aa, Homo Sapiens
HCAGRRRQD

SEQ ID NO: 525518 - protein, 9 aa, Homo Sapiens
RQWGSFPLQ

SEQ ID NO: 525519 - protein, 9 aa, Homo Sapiens
VQPTLPNSS

SEQ ID NO: 525520 - protein, 9 aa, Homo Sapiens
IMQIEALKL

SEQ ID NO: 525521 - protein, 9 aa, Homo Sapiens
IEDEEDDFD

SEQ ID NO: 525522 - protein, 9 aa, Homo Sapiens
KYQNIEYEY

SEQ ID NO: 525523 - protein, 9 aa, Homo Sapiens
DKSDAEGEH

SEQ ID NO: 525524 - protein, 9 aa, Homo Sapiens
GYDSTSAKQ

SEQ ID NO: 525525 - protein, 9 aa, Homo Sapiens
KDFNPLSIL

SEQ ID NO: 525526 - protein, 9 aa, Homo Sapiens
YKCNECEHR

SEQ ID NO: 525527 - protein, 9 aa, Homo Sapiens
SDHMKVHRQ

SEQ ID NO: 525528 - protein, 9 aa, Homo Sapiens
APRNPGVEV

SEQ ID NO: 525529 - protein, 9 aa, Homo Sapiens
IERGDARIQ

SEQ ID NO: 525530 - protein, 9 aa, Homo Sapiens
GGVPAEEMQ

SEQ ID NO: 525531 - protein, 9 aa, Homo Sapiens
RTVITVGNL

SEQ ID NO: 525532 - protein, 9 aa, Homo Sapiens
ALRASGVPK

SEQ ID NO: 525533 - protein, 9 aa, Homo Sapiens
RKICCTKKL

SEQ ID NO: 525534 - protein, 9 aa, Homo Sapiens
YGLFMLHKK

SEQ ID NO: 525535 - protein, 9 aa, Homo Sapiens
RLGSTCGVS

SEQ ID NO: 525536 - protein, 9 aa, Homo Sapiens
NKRAEQLAC

SEQ ID NO: 525537 - protein, 9 aa, Homo Sapiens
SLQEVQEGP

SEQ ID NO: 525538 - protein, 9 aa, Homo Sapiens
PPPGTLRGS

SEQ ID NO: 525539 - protein, 9 aa, Homo Sapiens
AIDRHRSDY

SEQ ID NO: 525540 - protein, 9 aa, Homo Sapiens
FLARWAQEA

SEQ ID NO: 525541 - protein, 9 aa, Homo Sapiens
VELPVQRGV

SEQ ID NO: 525542 - protein, 9 aa, Homo Sapiens
QKVSELHRA

SEQ ID NO: 525543 - protein, 9 aa, Homo Sapiens
LTAASPGVL

SEQ ID NO: 525544 - protein, 9 aa, Homo Sapiens
FCKDAQGAD

SEQ ID NO: 525545 - protein, 9 aa, Homo Sapiens
SRTAAGPRW

SEQ ID NO: 525546 - protein, 9 aa, Homo Sapiens
AELAFGKTK

SEQ ID NO: 525547 - protein, 9 aa, Homo Sapiens
IPPPGTLRG

SEQ ID NO: 525548 - protein, 9 aa, Homo Sapiens
LVAAGGRDL

SEQ ID NO: 525549 - protein, 9 aa, Homo Sapiens
EPPELILYA

SEQ ID NO: 525550 - protein, 9 aa, Homo Sapiens
IGGVPAEEM

SEQ ID NO: 525551 - protein, 9 aa, Homo Sapiens
SQYLYVELD

SEQ ID NO: 525552 - protein, 9 aa, Homo Sapiens
AGACLPHAR

SEQ ID NO: 525553 - protein, 9 aa, Homo Sapiens
DFKTSDALQ

SEQ ID NO: 525554 - protein, 9 aa, Homo Sapiens
LAFPDDMDL

SEQ ID NO: 525555 - protein, 9 aa, Homo Sapiens
PEEKNKNFQ

SEQ ID NO: 525556 - protein, 9 aa, Homo Sapiens
AAAFGVMRG

SEQ ID NO: 525557 - protein, 9 aa, Homo Sapiens
HTPIMIGIG

SEQ ID NO: 525558 - protein, 9 aa, Homo Sapiens
AIKDFNPLS

SEQ ID NO: 525559 - protein, 9 aa, Homo Sapiens
SMVDKRASP

SEQ ID NO: 525560 - protein, 9 aa, Homo Sapiens
LFGWGQNVN

SEQ ID NO: 525561 - protein, 9 aa, Homo Sapiens
AKNLCSQRG

SEQ ID NO: 525562 - protein, 9 aa, Homo Sapiens
IHVDKRSNF

SEQ ID NO: 525563 - protein, 9 aa, Homo Sapiens
TEPMIRAPE

SEQ ID NO: 525564 - protein, 9 aa, Homo Sapiens
VTWYLKSAD

SEQ ID NO: 525565 - protein, 9 aa, Homo Sapiens
KKLYEEDDM

SEQ ID NO: 525566 - protein, 9 aa, Homo Sapiens
LVRDAVILQ

SEQ ID NO: 525567 - protein, 9 aa, Homo Sapiens
SISGEVYQL

SEQ ID NO: 525568 - protein, 9 aa, Homo Sapiens
GSTGNWMSY

SEQ ID NO: 525569 - protein, 9 aa, Homo Sapiens
LATEPPTKS

SEQ ID NO: 525570 - protein, 9 aa, Homo Sapiens
KAEIAREEK

SEQ ID NO: 525571 - protein, 9 aa, Homo Sapiens
GSDSGLDSY

SEQ ID NO: 525572 - protein, 9 aa, Homo Sapiens
LTKKPLYLR

SEQ ID NO: 525573 - protein, 9 aa, Homo Sapiens
ASTLSTTPG

SEQ ID NO: 525574 - protein, 9 aa, Homo Sapiens
IRAPEEKNK

SEQ ID NO: 525575 - protein, 9 aa, Homo Sapiens
PLGKIKQSL

SEQ ID NO: 525576 - protein, 9 aa, Homo Sapiens
MICFTEAFS

SEQ ID NO: 525577 - protein, 9 aa, Homo Sapiens
QNKILETKW

SEQ ID NO: 525578 - protein, 9 aa, Homo Sapiens
RSNFLHRQV

SEQ ID NO: 525579 - protein, 9 aa, Homo Sapiens
LRTITATDG

SEQ ID NO: 525580 - protein, 9 aa, Homo Sapiens
RFNPDSYQS

SEQ ID NO: 525581 - protein, 9 aa, Homo Sapiens
CHREQMKSE

SEQ ID NO: 525582 - protein, 9 aa, Homo Sapiens
PEARKCLQT

SEQ ID NO: 525583 - protein, 9 aa, Homo Sapiens
AAAAAFGVM

SEQ ID NO: 525584 - protein, 9 aa, Homo Sapiens
RLHAVKPMN

SEQ ID NO: 525585 - protein, 9 aa, Homo Sapiens
SLGGPAAFL

SEQ ID NO: 525586 - protein, 9 aa, Homo Sapiens
SLQDLLGMN

SEQ ID NO: 525587 - protein, 9 aa, Homo Sapiens
WATYVNRKS

SEQ ID NO: 525588 - protein, 9 aa, Homo Sapiens
TEAFSAAPA

SEQ ID NO: 525589 - protein, 9 aa, Homo Sapiens
KRRDFTYDS

SEQ ID NO: 525590 - protein, 9 aa, Homo Sapiens
CCLQKLYMN

SEQ ID NO: 525591 - protein, 9 aa, Homo Sapiens
DNYLRTITA

SEQ ID NO: 525592 - protein, 9 aa, Homo Sapiens
PFSFGDKEK

SEQ ID NO: 525593 - protein, 9 aa, Homo Sapiens
GDTLKKDLI

SEQ ID NO: 525594 - protein, 9 aa, Homo Sapiens
LRAAGMVSD

SEQ ID NO: 525595 - protein, 9 aa, Homo Sapiens
IGELLQEQR

SEQ ID NO: 525596 - protein, 9 aa, Homo Sapiens
VFAVMAYDH

SEQ ID NO: 525597 - protein, 9 aa, Homo Sapiens
SDKSDAEGE

SEQ ID NO: 525598 - protein, 9 aa, Homo Sapiens
GVAWAAPAA

SEQ ID NO: 525599 - protein, 9 aa, Homo Sapiens
LKREAKNLC

SEQ ID NO: 525600 - protein, 9 aa, Homo Sapiens
DEDVPWTGM

SEQ ID NO: 525601 - protein, 9 aa, Homo Sapiens
RRGLRAVGL

SEQ ID NO: 525602 - protein, 9 aa, Homo Sapiens
LQTRVLDLQ

SEQ ID NO: 525603 - protein, 9 aa, Homo Sapiens
ALKQLLEVG

SEQ ID NO: 525604 - protein, 9 aa, Homo Sapiens
LVGCHKLDR

SEQ ID NO: 525605 - protein, 9 aa, Homo Sapiens
SLSTDSSRQ

SEQ ID NO: 525606 - protein, 9 aa, Homo Sapiens
GGPAAFLAR

SEQ ID NO: 525607 - protein, 9 aa, Homo Sapiens
LRAVGLYRL

SEQ ID NO: 525608 - protein, 9 aa, Homo Sapiens
GSSNCDISC

SEQ ID NO: 525609 - protein, 9 aa, Homo Sapiens
KHRLHAVKP

SEQ ID NO: 525610 - protein, 9 aa, Homo Sapiens
ITVGNLVGC

SEQ ID NO: 525611 - protein, 9 aa, Homo Sapiens
SLPQGIAKP

SEQ ID NO: 525612 - protein, 9 aa, Homo Sapiens
SIRREESTC

SEQ ID NO: 525613 - protein, 9 aa, Homo Sapiens
LPRKICCTK

SEQ ID NO: 525614 - protein, 9 aa, Homo Sapiens
DGAPLGKIK

SEQ ID NO: 525615 - protein, 9 aa, Homo Sapiens
PGTLRGSRT

SEQ ID NO: 525616 - protein, 9 aa, Homo Sapiens
FEESSEYFP

SEQ ID NO: 525617 - protein, 9 aa, Homo Sapiens
SITVKKLKL

SEQ ID NO: 525618 - protein, 9 aa, Homo Sapiens
SGFRCSSSP

SEQ ID NO: 525619 - protein, 9 aa, Homo Sapiens
ARLGSTCGV

SEQ ID NO: 525620 - protein, 9 aa, Homo Sapiens
RDIIFVLDG

SEQ ID NO: 525621 - protein, 9 aa, Homo Sapiens
APEEKNKNF

SEQ ID NO: 525622 - protein, 9 aa, Homo Sapiens
NCKHGKCRL

SEQ ID NO: 525623 - protein, 9 aa, Homo Sapiens
RRSNRLRPL

SEQ ID NO: 525624 - protein, 9 aa, Homo Sapiens
AENSLQEVQ

SEQ ID NO: 525625 - protein, 9 aa, Homo Sapiens
NMTVDIVCN

SEQ ID NO: 525626 - protein, 9 aa, Homo Sapiens
FSSASHAWS

SEQ ID NO: 525627 - protein, 9 aa, Homo Sapiens
AAGMVSDLD

SEQ ID NO: 525628 - protein, 9 aa, Homo Sapiens
KAEAAEAAM

SEQ ID NO: 525629 - protein, 9 aa, Homo Sapiens
SALRETLVH

SEQ ID NO: 525630 - protein, 9 aa, Homo Sapiens
VKSQEEEDL

SEQ ID NO: 525631 - protein, 9 aa, Homo Sapiens
RTQRNMNFG

SEQ ID NO: 525632 - protein, 9 aa, Homo Sapiens
AAVDNKLGF

SEQ ID NO: 525633 - protein, 9 aa, Homo Sapiens
GLVAAGGRD

SEQ ID NO: 525634 - protein, 9 aa, Homo Sapiens
FNRSLLTMD

SEQ ID NO: 525635 - protein, 9 aa, Homo Sapiens
ASHAWSYGI

SEQ ID NO: 525636 - protein, 9 aa, Homo Sapiens
TDPFNRSLL

SEQ ID NO: 525637 - protein, 9 aa, Homo Sapiens
AFSAAPAIQ

SEQ ID NO: 525638 - protein, 9 aa, Homo Sapiens
KDKGGLQPP

SEQ ID NO: 525639 - protein, 9 aa, Homo Sapiens
LLEVGFAVE

SEQ ID NO: 525640 - protein, 9 aa, Homo Sapiens
ERYYGYRSA

SEQ ID NO: 525641 - protein, 9 aa, Homo Sapiens
NNGKAHHNE

SEQ ID NO: 525642 - protein, 9 aa, Homo Sapiens
PRWAVPVHV

SEQ ID NO: 525643 - protein, 9 aa, Homo Sapiens
RLEDTHQTR

SEQ ID NO: 525644 - protein, 9 aa, Homo Sapiens
PVPMPVPVP

SEQ ID NO: 525645 - protein, 9 aa, Homo Sapiens
KGSTGNWMS

SEQ ID NO: 525646 - protein, 9 aa, Homo Sapiens
VLDLQQQLA

SEQ ID NO: 525647 - protein, 9 aa, Homo Sapiens
KNLHPDVKA

SEQ ID NO: 525648 - protein, 9 aa, Homo Sapiens
SLTVFSLNQ

SEQ ID NO: 525649 - protein, 9 aa, Homo Sapiens
TVKSQEEED

SEQ ID NO: 525650 - protein, 9 aa, Homo Sapiens
SMTDGAPLG

SEQ ID NO: 525651 - protein, 9 aa, Homo Sapiens
AGMVSDLDA

SEQ ID NO: 525652 - protein, 9 aa, Homo Sapiens
PPAHTCPRG

SEQ ID NO: 525653 - protein, 9 aa, Homo Sapiens
FPPLDTHSS

SEQ ID NO: 525654 - protein, 9 aa, Homo Sapiens
FGVMRGVAW

SEQ ID NO: 525655 - protein, 9 aa, Homo Sapiens
PPAEEATAE

SEQ ID NO: 525656 - protein, 9 aa, Homo Sapiens
QKALKKDED

SEQ ID NO: 525657 - protein, 9 aa, Homo Sapiens
GLGALHRAA

SEQ ID NO: 525658 - protein, 9 aa, Homo Sapiens
EFPDLGQHC

SEQ ID NO: 525659 - protein, 9 aa, Homo Sapiens
QMVCQPRHF

SEQ ID NO: 525660 - protein, 9 aa, Homo Sapiens
GYRSAFRCL

SEQ ID NO: 525661 - protein, 9 aa, Homo Sapiens
RGLRAVGLY

SEQ ID NO: 525662 - protein, 9 aa, Homo Sapiens
LAGGAGLLH

SEQ ID NO: 525663 - protein, 9 aa, Homo Sapiens
EIKNVVFGK

SEQ ID NO: 525664 - protein, 9 aa, Homo Sapiens
EPMIRAPEE

SEQ ID NO: 525665 - protein, 9 aa, Homo Sapiens
NDSHETCSS

SEQ ID NO: 525666 - protein, 9 aa, Homo Sapiens
EPPTKSLLL

SEQ ID NO: 525667 - protein, 9 aa, Homo Sapiens
GTYRYTYTR

SEQ ID NO: 525668 - protein, 9 aa, Homo Sapiens
FPVVIIRNG

SEQ ID NO: 525669 - protein, 9 aa, Homo Sapiens
KFYSISGEV

SEQ ID NO: 525670 - protein, 9 aa, Homo Sapiens
KKEERDAGL

SEQ ID NO: 525671 - protein, 9 aa, Homo Sapiens
WAVPVHVPG

SEQ ID NO: 525672 - protein, 9 aa, Homo Sapiens
FGKTSACFE

SEQ ID NO: 525673 - protein, 9 aa, Homo Sapiens
MLLSDSIPH

SEQ ID NO: 525674 - protein, 9 aa, Homo Sapiens
KHLDALLKR

SEQ ID NO: 525675 - protein, 9 aa, Homo Sapiens
LLKNLHPDV

SEQ ID NO: 525676 - protein, 9 aa, Homo Sapiens
GPHLNVVNM

SEQ ID NO: 525677 - protein, 9 aa, Homo Sapiens
NIRTVKSQE

SEQ ID NO: 525678 - protein, 9 aa, Homo Sapiens
LQTPAEMLL

SEQ ID NO: 525679 - protein, 9 aa, Homo Sapiens
KKPLYLRLH

SEQ ID NO: 525680 - protein, 9 aa, Homo Sapiens
DKNVIVALM

SEQ ID NO: 525681 - protein, 9 aa, Homo Sapiens
AAEAAMATP

SEQ ID NO: 525682 - protein, 9 aa, Homo Sapiens
VCNDCNGRS

SEQ ID NO: 525683 - protein, 9 aa, Homo Sapiens
HLECLICKV

SEQ ID NO: 525684 - protein, 9 aa, Homo Sapiens
IDKNVIVAL

SEQ ID NO: 525685 - protein, 9 aa, Homo Sapiens
QLFSRLFEV

SEQ ID NO: 525686 - protein, 9 aa, Homo Sapiens
LHKKIVNRK

SEQ ID NO: 525687 - protein, 9 aa, Homo Sapiens
LDRAKVTGP

SEQ ID NO: 525688 - protein, 9 aa, Homo Sapiens
ATSLTKPYT

SEQ ID NO: 525689 - protein, 9 aa, Homo Sapiens
KIVAIKDFN

SEQ ID NO: 525690 - protein, 9 aa, Homo Sapiens
IKDFNPLSI

SEQ ID NO: 525691 - protein, 9 aa, Homo Sapiens
RATESHRCL

SEQ ID NO: 525692 - protein, 9 aa, Homo Sapiens
TVSSSIDKN

SEQ ID NO: 525693 - protein, 9 aa, Homo Sapiens
QAELGVTVL

SEQ ID NO: 525694 - protein, 9 aa, Homo Sapiens
SFCASGGKD

SEQ ID NO: 525695 - protein, 9 aa, Homo Sapiens
ALLKRIKFV

SEQ ID NO: 525696 - protein, 9 aa, Homo Sapiens
MDKRRDFTY

SEQ ID NO: 525697 - protein, 9 aa, Homo Sapiens
LRGSRTAAG

SEQ ID NO: 525698 - protein, 9 aa, Homo Sapiens
DGSFCASGG

SEQ ID NO: 525699 - protein, 9 aa, Homo Sapiens
ITRLQELKR

SEQ ID NO: 525700 - protein, 9 aa, Homo Sapiens
QPCIGGVPA

SEQ ID NO: 525701 - protein, 9 aa, Homo Sapiens
VILQAQGIG

SEQ ID NO: 525702 - protein, 9 aa, Homo Sapiens
GAPLGKIKQ

SEQ ID NO: 525703 - protein, 9 aa, Homo Sapiens
YTYTRKRFR

SEQ ID NO: 525704 - protein, 9 aa, Homo Sapiens
SHAHTGSSN

SEQ ID NO: 525705 - protein, 9 aa, Homo Sapiens
VGFAVELPV

SEQ ID NO: 525706 - protein, 9 aa, Homo Sapiens
SRWQGTPEA

SEQ ID NO: 525707 - protein, 9 aa, Homo Sapiens
PAAFLARWA

SEQ ID NO: 525708 - protein, 9 aa, Homo Sapiens
AASPGVLVL

SEQ ID NO: 525709 - protein, 9 aa, Homo Sapiens
MPHAVTPGN

SEQ ID NO: 525710 - protein, 9 aa, Homo Sapiens
EENILNREI

SEQ ID NO: 525711 - protein, 9 aa, Homo Sapiens
EGPPGLSPQ

SEQ ID NO: 525712 - protein, 9 aa, Homo Sapiens
LNNFSALMK

SEQ ID NO: 525713 - protein, 9 aa, Homo Sapiens
MTVDIVCND

SEQ ID NO: 525714 - protein, 9 aa, Homo Sapiens
FLAKVFPSP

SEQ ID NO: 525715 - protein, 9 aa, Homo Sapiens
EQLACDFRI

SEQ ID NO: 525716 - protein, 9 aa, Homo Sapiens
DTRVQQADR

SEQ ID NO: 525717 - protein, 9 aa, Homo Sapiens
NQPFSFGDK

SEQ ID NO: 525718 - protein, 9 aa, Homo Sapiens
KLSLQLENA

SEQ ID NO: 525719 - protein, 9 aa, Homo Sapiens
EPVGNREEN

SEQ ID NO: 525720 - protein, 9 aa, Homo Sapiens
IKNVVFGKT

SEQ ID NO: 525721 - protein, 9 aa, Homo Sapiens
LAAKPLVVV

SEQ ID NO: 525722 - protein, 9 aa, Homo Sapiens
QSNDSHETC

SEQ ID NO: 525723 - protein, 9 aa, Homo Sapiens
LQEVQEGPL

SEQ ID NO: 525724 - protein, 9 aa, Homo Sapiens
PRNPGVEVA

SEQ ID NO: 525725 - protein, 9 aa, Homo Sapiens
MSSAELAFG

SEQ ID NO: 525726 - protein, 9 aa, Homo Sapiens
YLRLHQTLH

SEQ ID NO: 525727 - protein, 9 aa, Homo Sapiens
VQQADRDWK

SEQ ID NO: 525728 - protein, 9 aa, Homo Sapiens
ARVVENELV

SEQ ID NO: 525729 - protein, 9 aa, Homo Sapiens
ACHLLRGAQ

SEQ ID NO: 525730 - protein, 9 aa, Homo Sapiens
SKLEGSDSG

SEQ ID NO: 525731 - protein, 9 aa, Homo Sapiens
APGAAVDNK

SEQ ID NO: 525732 - protein, 9 aa, Homo Sapiens
MGGTYRYTY

SEQ ID NO: 525733 - protein, 9 aa, Homo Sapiens
ALNNFSALM

SEQ ID NO: 525734 - protein, 9 aa, Homo Sapiens
IEMFAYHVP

SEQ ID NO: 525735 - protein, 9 aa, Homo Sapiens
VDNKLGFGR

SEQ ID NO: 525736 - protein, 9 aa, Homo Sapiens
PTKSLLLRK

SEQ ID NO: 525737 - protein, 9 aa, Homo Sapiens
HKLDRAKVT

SEQ ID NO: 525738 - protein, 9 aa, Homo Sapiens
PFNRSLLTM

SEQ ID NO: 525739 - protein, 9 aa, Homo Sapiens
EMQAPGLVA

SEQ ID NO: 525740 - protein, 9 aa, Homo Sapiens
EIISPVAEH

SEQ ID NO: 525741 - protein, 9 aa, Homo Sapiens
DCDLDECTF

SEQ ID NO: 525742 - protein, 9 aa, Homo Sapiens
GSSKDKGGL

SEQ ID NO: 525743 - protein, 9 aa, Homo Sapiens
TKSLLLRKP

SEQ ID NO: 525744 - protein, 9 aa, Homo Sapiens
LNNNSPERR

SEQ ID NO: 525745 - protein, 9 aa, Homo Sapiens
PLFGWGQNV

SEQ ID NO: 525746 - protein, 9 aa, Homo Sapiens
RLQWPQLFS

SEQ ID NO: 525747 - protein, 9 aa, Homo Sapiens
SNYCEDSFR

SEQ ID NO: 525748 - protein, 9 aa, Homo Sapiens
QQNSKEEVY

SEQ ID NO: 525749 - protein, 9 aa, Homo Sapiens
EQMGCPAGC

SEQ ID NO: 525750 - protein, 9 aa, Homo Sapiens
PGVEVALLV

SEQ ID NO: 525751 - protein, 9 aa, Homo Sapiens
ISDHMKVHR

SEQ ID NO: 525752 - protein, 9 aa, Homo Sapiens
AAFGVMRGV

SEQ ID NO: 525753 - protein, 9 aa, Homo Sapiens
AGLGPPATE

SEQ ID NO: 525754 - protein, 9 aa, Homo Sapiens
ISGDTLKKD

SEQ ID NO: 525755 - protein, 9 aa, Homo Sapiens
GNTMYTVFH

SEQ ID NO: 525756 - protein, 9 aa, Homo Sapiens
KLYFFQWLS

SEQ ID NO: 525757 - protein, 9 aa, Homo Sapiens
ICCTKKLYE

SEQ ID NO: 525758 - protein, 9 aa, Homo Sapiens
HSWSSTVGN

SEQ ID NO: 525759 - protein, 9 aa, Homo Sapiens
NYNKRFLAK

SEQ ID NO: 525760 - protein, 9 aa, Homo Sapiens
SGSIKTLDT

SEQ ID NO: 525761 - protein, 9 aa, Homo Sapiens
KLCCLQKLY

SEQ ID NO: 525762 - protein, 9 aa, Homo Sapiens
YHVPDATLS

SEQ ID NO: 525763 - protein, 9 aa, Homo Sapiens
CLENLIWSS

SEQ ID NO: 525764 - protein, 9 aa, Homo Sapiens
QKERKERKN

SEQ ID NO: 525765 - protein, 9 aa, Homo Sapiens
FFFPQKVSE

SEQ ID NO: 525766 - protein, 9 aa, Homo Sapiens
ERGDARIQR

SEQ ID NO: 525767 - protein, 9 aa, Homo Sapiens
ENILNREIG

SEQ ID NO: 525768 - protein, 9 aa, Homo Sapiens
SLRAAGMVS

SEQ ID NO: 525769 - protein, 9 aa, Homo Sapiens
KVHRQGPHH

SEQ ID NO: 525770 - protein, 9 aa, Homo Sapiens
TEDHLECLI

SEQ ID NO: 525771 - protein, 9 aa, Homo Sapiens
PQSLQDLLG

SEQ ID NO: 525772 - protein, 9 aa, Homo Sapiens
ESSEYFPHF

SEQ ID NO: 525773 - protein, 9 aa, Homo Sapiens
MEFPDLGQH

SEQ ID NO: 525774 - protein, 9 aa, Homo Sapiens
GVQTGAPGG

SEQ ID NO: 525775 - protein, 9 aa, Homo Sapiens
KERKNNGKA

SEQ ID NO: 525776 - protein, 9 aa, Homo Sapiens
AGGHSWSST

SEQ ID NO: 525777 - protein, 9 aa, Homo Sapiens
PGVLVLSPV

SEQ ID NO: 525778 - protein, 9 aa, Homo Sapiens
NSRKVVCGT

SEQ ID NO: 525779 - protein, 9 aa, Homo Sapiens
GKWNSVPPE

SEQ ID NO: 525780 - protein, 9 aa, Homo Sapiens
LDTHSSTND

SEQ ID NO: 525781 - protein, 9 aa, Homo Sapiens
EARVVENEL

SEQ ID NO: 525782 - protein, 9 aa, Homo Sapiens
VLNKSLEGA

SEQ ID NO: 525783 - protein, 9 aa, Homo Sapiens
VLAFPDDMD

SEQ ID NO: 525784 - protein, 9 aa, Homo Sapiens
FQWLSVFLD

SEQ ID NO: 525785 - protein, 9 aa, Homo Sapiens
ENSLQEVQE

SEQ ID NO: 525786 - protein, 9 aa, Homo Sapiens
TRLQELKRP

SEQ ID NO: 525787 - protein, 9 aa, Homo Sapiens
FVVTELIVF

SEQ ID NO: 525788 - protein, 9 aa, Homo Sapiens
PAKLPVPRG

SEQ ID NO: 525789 - protein, 9 aa, Homo Sapiens
ESHRCLRIP

SEQ ID NO: 525790 - protein, 9 aa, Homo Sapiens
EIGELLQEQ

SEQ ID NO: 525791 - protein, 9 aa, Homo Sapiens
LEVGFAVEL

SEQ ID NO: 525792 - protein, 9 aa, Homo Sapiens
GQMVCQPRH

SEQ ID NO: 525793 - protein, 9 aa, Homo Sapiens
FLTEQFCIP

SEQ ID NO: 525794 - protein, 9 aa, Homo Sapiens
LLRLLWPPP

SEQ ID NO: 525795 - protein, 9 aa, Homo Sapiens
SIDKNVIVA

SEQ ID NO: 525796 - protein, 9 aa, Homo Sapiens
VNFLLLHYK

SEQ ID NO: 525797 - protein, 9 aa, Homo Sapiens
LQEEDTRVQ

SEQ ID NO: 525798 - protein, 9 aa, Homo Sapiens
SFLSLTVFS

SEQ ID NO: 525799 - protein, 9 aa, Homo Sapiens
GTDKDAKAL

SEQ ID NO: 525800 - protein, 9 aa, Homo Sapiens
PGLSPQPPP

SEQ ID NO: 525801 - protein, 9 aa, Homo Sapiens
EAKNLCSQR

SEQ ID NO: 525802 - protein, 9 aa, Homo Sapiens
RIPPPGTLR

SEQ ID NO: 525803 - protein, 9 aa, Homo Sapiens
ATFEESSEY

SEQ ID NO: 525804 - protein, 9 aa, Homo Sapiens
KDEDVPWTG

SEQ ID NO: 525805 - protein, 9 aa, Homo Sapiens
GLIIHEGPL

SEQ ID NO: 525806 - protein, 9 aa, Homo Sapiens
VVAFALKQL

SEQ ID NO: 525807 - protein, 9 aa, Homo Sapiens
LLLHYKKEV

SEQ ID NO: 525808 - protein, 9 aa, Homo Sapiens
GEEIRPSIN

SEQ ID NO: 525809 - protein, 9 aa, Homo Sapiens
EIQEEIGEL

SEQ ID NO: 525810 - protein, 9 aa, Homo Sapiens
ELILYANMA

SEQ ID NO: 525811 - protein, 9 aa, Homo Sapiens
DYMDKRRDF

SEQ ID NO: 525812 - protein, 9 aa, Homo Sapiens
YRDCWFFGV

SEQ ID NO: 525813 - protein, 9 aa, Homo Sapiens
DCWFFGVNT

SEQ ID NO: 525814 - protein, 9 aa, Homo Sapiens
LFQSNDSHE

SEQ ID NO: 525815 - protein, 9 aa, Homo Sapiens
YFPHFSEPG

SEQ ID NO: 525816 - protein, 9 aa, Homo Sapiens
ARYELVRGS

SEQ ID NO: 525817 - protein, 9 aa, Homo Sapiens
PPGLSPQPP

SEQ ID NO: 525818 - protein, 9 aa, Homo Sapiens
EVVAVLNKS

SEQ ID NO: 525819 - protein, 9 aa, Homo Sapiens
LGVTVLAAE

SEQ ID NO: 525820 - protein, 9 aa, Homo Sapiens
DSKNVEENS

SEQ ID NO: 525821 - protein, 9 aa, Homo Sapiens
LQPLIVTVA

SEQ ID NO: 525822 - protein, 9 aa, Homo Sapiens
RKKAEAAEA

SEQ ID NO: 525823 - protein, 9 aa, Homo Sapiens
LGDDACHLL

SEQ ID NO: 525824 - protein, 9 aa, Homo Sapiens
YFGTKLHTP

SEQ ID NO: 525825 - protein, 9 aa, Homo Sapiens
SLATSLTKP

SEQ ID NO: 525826 - protein, 9 aa, Homo Sapiens
QQIELEKVC

SEQ ID NO: 525827 - protein, 9 aa, Homo Sapiens
RKKLIEHYE

SEQ ID NO: 525828 - protein, 9 aa, Homo Sapiens
YNKRFLAKV

SEQ ID NO: 525829 - protein, 9 aa, Homo Sapiens
TAASPGVLV

SEQ ID NO: 525830 - protein, 9 aa, Homo Sapiens
VISSRDNLI

SEQ ID NO: 525831 - protein, 9 aa, Homo Sapiens
NKSLEGADL

SEQ ID NO: 525832 - protein, 9 aa, Homo Sapiens
EESSEYFPH

SEQ ID NO: 525833 - protein, 9 aa, Homo Sapiens
GIAKPEDSL

SEQ ID NO: 525834 - protein, 9 aa, Homo Sapiens
IDGKGSTGN

SEQ ID NO: 525835 - protein, 9 aa, Homo Sapiens
HLLVGPELL

SEQ ID NO: 525836 - protein, 9 aa, Homo Sapiens
KKRKKDSKN

SEQ ID NO: 525837 - protein, 9 aa, Homo Sapiens
VLAAEARVV

SEQ ID NO: 525838 - protein, 9 aa, Homo Sapiens
VEVALLVQP

SEQ ID NO: 525839 - protein, 9 aa, Homo Sapiens
KRSNFLHRQ

SEQ ID NO: 525840 - protein, 8 aa, Homo Sapiens
SYGEIEEF

SEQ ID NO: 525841 - protein, 9 aa, Homo Sapiens
SEQQNSKEE

SEQ ID NO: 525842 - protein, 9 aa, Homo Sapiens
KLDRAKVTG

SEQ ID NO: 525843 - protein, 9 aa, Homo Sapiens
DACHLLRGA

SEQ ID NO: 525844 - protein, 9 aa, Homo Sapiens
VGPELLVLL

SEQ ID NO: 525845 - protein, 9 aa, Homo Sapiens
SGEVYQLDI

SEQ ID NO: 525846 - protein, 9 aa, Homo Sapiens
PCFCKDAQG

SEQ ID NO: 525847 - protein, 9 aa, Homo Sapiens
PSAGGHSWS

SEQ ID NO: 525848 - protein, 9 aa, Homo Sapiens
AAEARVVEN

SEQ ID NO: 525849 - protein, 9 aa, Homo Sapiens
KALKKDEDV

SEQ ID NO: 525850 - protein, 9 aa, Homo Sapiens
IRPSINRKL

SEQ ID NO: 525851 - protein, 9 aa, Homo Sapiens
LAQSRNAFA

SEQ ID NO: 525852 - protein, 9 aa, Homo Sapiens
KEERDAGLG

SEQ ID NO: 525853 - protein, 9 aa, Homo Sapiens
GLFMLHKKI

SEQ ID NO: 525854 - protein, 9 aa, Homo Sapiens
HTGSSNCDI

SEQ ID NO: 525855 - protein, 9 aa, Homo Sapiens
DTKERPHHH

SEQ ID NO: 525856 - protein, 9 aa, Homo Sapiens
FAYHVPDAT

SEQ ID NO: 525857 - protein, 9 aa, Homo Sapiens
MPAENTVQV

SEQ ID NO: 525858 - protein, 9 aa, Homo Sapiens
LVQGYDSTS

SEQ ID NO: 525859 - protein, 9 aa, Homo Sapiens
TEPPTKSLL

SEQ ID NO: 525860 - protein, 9 aa, Homo Sapiens
SLQLENAET

SEQ ID NO: 525861 - protein, 9 aa, Homo Sapiens
EHQQIELEK

SEQ ID NO: 525862 - protein, 9 aa, Homo Sapiens
RKKDSKNVE

SEQ ID NO: 525863 - protein, 9 aa, Homo Sapiens
SAGGHSWSS

SEQ ID NO: 525864 - protein, 9 aa, Homo Sapiens
LSPVRTVIT

SEQ ID NO: 525865 - protein, 9 aa, Homo Sapiens
EGPLVYRIF

SEQ ID NO: 525866 - protein, 9 aa, Homo Sapiens
HAHTGSSNC

SEQ ID NO: 525867 - protein, 9 aa, Homo Sapiens
AQSRNAFAL

SEQ ID NO: 525868 - protein, 9 aa, Homo Sapiens
GPLVYRIFK

SEQ ID NO: 525869 - protein, 9 aa, Homo Sapiens
PVAEHPEDR

SEQ ID NO: 525870 - protein, 9 aa, Homo Sapiens
GHSWSSTVG

SEQ ID NO: 525871 - protein, 9 aa, Homo Sapiens
QDPSRRSNR

SEQ ID NO: 525872 - protein, 9 aa, Homo Sapiens
GVTVLAAEA

SEQ ID NO: 525873 - protein, 9 aa, Homo Sapiens
LYFFQWLSV

SEQ ID NO: 525874 - protein, 9 aa, Homo Sapiens
FPFPPPWIG

SEQ ID NO: 525875 - protein, 9 aa, Homo Sapiens
KNVIVALMY

SEQ ID NO: 525876 - protein, 9 aa, Homo Sapiens
ALHRAAAAA

SEQ ID NO: 525877 - protein, 9 aa, Homo Sapiens
EMLLSDSIP

SEQ ID NO: 525878 - protein, 9 aa, Homo Sapiens
EDVPWTGML

SEQ ID NO: 525879 - protein, 9 aa, Homo Sapiens
NREDAKSTG

SEQ ID NO: 525880 - protein, 9 aa, Homo Sapiens
LNVVNMLGA

SEQ ID NO: 525881 - protein, 9 aa, Homo Sapiens
NQFIKIMII

SEQ ID NO: 525882 - protein, 9 aa, Homo Sapiens
DLGQHCSEK

SEQ ID NO: 525883 - protein, 9 aa, Homo Sapiens
ILYANMARE

SEQ ID NO: 525884 - protein, 9 aa, Homo Sapiens
HTTNDLVQG

SEQ ID NO: 525885 - protein, 9 aa, Homo Sapiens
PLVYRIFKR

SEQ ID NO: 525886 - protein, 9 aa, Homo Sapiens
ELAFVFELL

SEQ ID NO: 525887 - protein, 9 aa, Homo Sapiens
HLNVVNMLG

SEQ ID NO: 525888 - protein, 9 aa, Homo Sapiens
EERDAGLGP

SEQ ID NO: 525889 - protein, 9 aa, Homo Sapiens
FPDDMDLRV

SEQ ID NO: 525890 - protein, 9 aa, Homo Sapiens
PSSRANHSS

SEQ ID NO: 525891 - protein, 9 aa, Homo Sapiens
NILNREIGF

SEQ ID NO: 525892 - protein, 9 aa, Homo Sapiens
HRQGPHHVC

SEQ ID NO: 525893 - protein, 9 aa, Homo Sapiens
RLQTPAEML

SEQ ID NO: 525894 - protein, 9 aa, Homo Sapiens
LHLGPQAEG

SEQ ID NO: 525895 - protein, 9 aa, Homo Sapiens
IKPHVISSR

SEQ ID NO: 525896 - protein, 9 aa, Homo Sapiens
AEAAMATPA

SEQ ID NO: 525897 - protein, 9 aa, Homo Sapiens
NSGSIKTLD

SEQ ID NO: 525898 - protein, 9 aa, Homo Sapiens
LCCLQKLYM

SEQ ID NO: 525899 - protein, 9 aa, Homo Sapiens
FCASGGKDG

SEQ ID NO: 525900 - protein, 9 aa, Homo Sapiens
WMPAENTVQ

SEQ ID NO: 525901 - protein, 9 aa, Homo Sapiens
DGKGSTGNW

SEQ ID NO: 525902 - protein, 9 aa, Homo Sapiens
SWNREDAKS

SEQ ID NO: 525903 - protein, 9 aa, Homo Sapiens
TKKPLYLRL

SEQ ID NO: 525904 - protein, 9 aa, Homo Sapiens
ADFRLKYEN

SEQ ID NO: 525905 - protein, 9 aa, Homo Sapiens
TGAPGGRRA

SEQ ID NO: 525906 - protein, 9 aa, Homo Sapiens
VDTFSHDVY

SEQ ID NO: 525907 - protein, 9 aa, Homo Sapiens
LPEIKNVVF

SEQ ID NO: 525908 - protein, 9 aa, Homo Sapiens
SQEGPPGLS

SEQ ID NO: 525909 - protein, 9 aa, Homo Sapiens
RYTYTRKRF

SEQ ID NO: 525910 - protein, 9 aa, Homo Sapiens
STCSLPQGI

SEQ ID NO: 525911 - protein, 9 aa, Homo Sapiens
DSDFKTSDA

SEQ ID NO: 525912 - protein, 9 aa, Homo Sapiens
ENELVGHQP

SEQ ID NO: 525913 - protein, 9 aa, Homo Sapiens
LHGVHGLLA

SEQ ID NO: 525914 - protein, 9 aa, Homo Sapiens
LPVQRGVAA

SEQ ID NO: 525915 - protein, 9 aa, Homo Sapiens
DECTFRDPK

SEQ ID NO: 525916 - protein, 9 aa, Homo Sapiens
ISGEVYQLD

SEQ ID NO: 525917 - protein, 9 aa, Homo Sapiens
AENTVQVKN

SEQ ID NO: 525918 - protein, 9 aa, Homo Sapiens
TGPLGDDAC

SEQ ID NO: 525919 - protein, 9 aa, Homo Sapiens
IISHSTTGL

SEQ ID NO: 525920 - protein, 9 aa, Homo Sapiens
RPSAGGHSW

SEQ ID NO: 525921 - protein, 9 aa, Homo Sapiens
VAVLNKSLE

SEQ ID NO: 525922 - protein, 9 aa, Homo Sapiens
SSRDNLISC

SEQ ID NO: 525923 - protein, 9 aa, Homo Sapiens
AADFRLKYE

SEQ ID NO: 525924 - protein, 9 aa, Homo Sapiens
LGVQTGAPG

SEQ ID NO: 525925 - protein, 9 aa, Homo Sapiens
RTVKSQEEE

SEQ ID NO: 525926 - protein, 9 aa, Homo Sapiens
AHQMVHTGE

SEQ ID NO: 525927 - protein, 9 aa, Homo Sapiens
ILETKWHLL

SEQ ID NO: 525928 - protein, 9 aa, Homo Sapiens
AVGLYRLCG

SEQ ID NO: 525929 - protein, 9 aa, Homo Sapiens
YQNMTVDIV

SEQ ID NO: 525930 - protein, 9 aa, Homo Sapiens
LVRGSSLSL

SEQ ID NO: 525931 - protein, 9 aa, Homo Sapiens
GQNVNDDKV

SEQ ID NO: 525932 - protein, 9 aa, Homo Sapiens
ACLPHARAS

SEQ ID NO: 525933 - protein, 9 aa, Homo Sapiens
CFTEAFSAA

SEQ ID NO: 525934 - protein, 9 aa, Homo Sapiens
MLLKAEIAR

SEQ ID NO: 525935 - protein, 9 aa, Homo Sapiens
SIKTLDTEE

SEQ ID NO: 525936 - protein, 9 aa, Homo Sapiens
VSEQQNSKE

SEQ ID NO: 525937 - protein, 9 aa, Homo Sapiens
EGLGALHRA

SEQ ID NO: 525938 - protein, 9 aa, Homo Sapiens
NGTDKDAKA

SEQ ID NO: 525939 - protein, 9 aa, Homo Sapiens
PQQRILPEA

SEQ ID NO: 525940 - protein, 9 aa, Homo Sapiens
TAMLEKGEQ

SEQ ID NO: 525941 - protein, 9 aa, Homo Sapiens
FMLHKKIVN

SEQ ID NO: 525942 - protein, 9 aa, Homo Sapiens
PDGSFCASG

SEQ ID NO: 525943 - protein, 9 aa, Homo Sapiens
HLGPQAEGL

SEQ ID NO: 525944 - protein, 9 aa, Homo Sapiens
GIGASVQLT

SEQ ID NO: 525945 - protein, 9 aa, Homo Sapiens
PWIGMPLPP

SEQ ID NO: 525946 - protein, 9 aa, Homo Sapiens
PISGLYKER

SEQ ID NO: 525947 - protein, 9 aa, Homo Sapiens
ATEPPTKSL

SEQ ID NO: 525948 - protein, 9 aa, Homo Sapiens
LLRGAQVHL

SEQ ID NO: 525949 - protein, 9 aa, Homo Sapiens
GNAPCSCGF

SEQ ID NO: 525950 - protein, 9 aa, Homo Sapiens
SSKDKGGLQ

SEQ ID NO: 525951 - protein, 9 aa, Homo Sapiens
LIIHEGPLV

SEQ ID NO: 525952 - protein, 9 aa, Homo Sapiens
VNMLGACTK

SEQ ID NO: 525953 - protein, 9 aa, Homo Sapiens
GSRTAAGPR

SEQ ID NO: 525954 - protein, 9 aa, Homo Sapiens
CDFRIPDKR

SEQ ID NO: 525955 - protein, 9 aa, Homo Sapiens
SHSRWQGTP

SEQ ID NO: 525956 - protein, 9 aa, Homo Sapiens
TFPVVIIRN

SEQ ID NO: 525957 - protein, 9 aa, Homo Sapiens
AQIERGDAR

SEQ ID NO: 525958 - protein, 9 aa, Homo Sapiens
QQWPAKLPV

SEQ ID NO: 525959 - protein, 9 aa, Homo Sapiens
AAGGRDLLV

SEQ ID NO: 525960 - protein, 9 aa, Homo Sapiens
CKDAQGADS

SEQ ID NO: 525961 - protein, 9 aa, Homo Sapiens
SWSSTVGNV

SEQ ID NO: 525962 - protein, 9 aa, Homo Sapiens
NDPYVIIFQ

SEQ ID NO: 525963 - protein, 9 aa, Homo Sapiens
QELKRPSGD

SEQ ID NO: 525964 - protein, 9 aa, Homo Sapiens
TSLTKPYTS

SEQ ID NO: 525965 - protein, 9 aa, Homo Sapiens
IIHEGPLVY

SEQ ID NO: 525966 - protein, 9 aa, Homo Sapiens
SNDSHETCS

SEQ ID NO: 525967 - protein, 9 aa, Homo Sapiens
SGTYVGGHV

SEQ ID NO: 525968 - protein, 9 aa, Homo Sapiens
IMAQIERGD

SEQ ID NO: 525969 - protein, 9 aa, Homo Sapiens
IHTKLYFFQ

SEQ ID NO: 525970 - protein, 9 aa, Homo Sapiens
EVQEGPLDL

SEQ ID NO: 525971 - protein, 9 aa, Homo Sapiens
LEKGEQMGC

SEQ ID NO: 525972 - protein, 9 aa, Homo Sapiens
GPQAEGLGA

SEQ ID NO: 525973 - protein, 9 aa, Homo Sapiens
DAVILQAQG

SEQ ID NO: 525974 - protein, 9 aa, Homo Sapiens
LVGHQPLHG

SEQ ID NO: 525975 - protein, 9 aa, Homo Sapiens
HVISSRDNL

SEQ ID NO: 525976 - protein, 9 aa, Homo Sapiens
VNQPFSFGD

SEQ ID NO: 525977 - protein, 9 aa, Homo Sapiens
FVFELLQQF

SEQ ID NO: 525978 - protein, 9 aa, Homo Sapiens
VIIFQNGEE

SEQ ID NO: 525979 - protein, 9 aa, Homo Sapiens
SDISGDTLK

SEQ ID NO: 525980 - protein, 9 aa, Homo Sapiens
SFLTEQFCI

SEQ ID NO: 525981 - protein, 9 aa, Homo Sapiens
PSPNSGSIK

SEQ ID NO: 525982 - protein, 9 aa, Homo Sapiens
LGELSMSSA

SEQ ID NO: 525983 - protein, 9 aa, Homo Sapiens
MAPPTPSKN

SEQ ID NO: 525984 - protein, 9 aa, Homo Sapiens
VPVPVPMPV

SEQ ID NO: 525985 - protein, 9 aa, Homo Sapiens
GEPAHHPGC

SEQ ID NO: 525986 - protein, 9 aa, Homo Sapiens
LKKDEDVPW

SEQ ID NO: 525987 - protein, 9 aa, Homo Sapiens
ECAIDRHRS

SEQ ID NO: 525988 - protein, 9 aa, Homo Sapiens
AWAAPAAWN

SEQ ID NO: 525989 - protein, 9 aa, Homo Sapiens
HRCLRIPPP

SEQ ID NO: 525990 - protein, 9 aa, Homo Sapiens
RNMNFGISQ

SEQ ID NO: 525991 - protein, 9 aa, Homo Sapiens
IGKKWKYQN

SEQ ID NO: 525992 - protein, 9 aa, Homo Sapiens
TFVVTELIV

SEQ ID NO: 525993 - protein, 9 aa, Homo Sapiens
STSLATSLT

SEQ ID NO: 525994 - protein, 9 aa, Homo Sapiens
PGLVAAGGR

SEQ ID NO: 525995 - protein, 9 aa, Homo Sapiens
ECEHRRIHT

SEQ ID NO: 525996 - protein, 9 aa, Homo Sapiens
FAVELPVQR

SEQ ID NO: 525997 - protein, 9 aa, Homo Sapiens
KDSKNVEEN

SEQ ID NO: 525998 - protein, 9 aa, Homo Sapiens
VTVLAAEAR

SEQ ID NO: 525999 - protein, 9 aa, Homo Sapiens
LLKRIKFVV

SEQ ID NO: 526000 - protein, 9 aa, Homo Sapiens
PDDMDLRVY

SEQ ID NO: 526001 - protein, 9 aa, Homo Sapiens
QAQGIGASV

SEQ ID NO: 526002 - protein, 9 aa, Homo Sapiens
HGVHGLLAG

SEQ ID NO: 526003 - protein, 9 aa, Homo Sapiens
VPKRYWGRL

SEQ ID NO: 526004 - protein, 9 aa, Homo Sapiens
PHVISSRDN

SEQ ID NO: 526005 - protein, 9 aa, Homo Sapiens
RKFYSISGE

SEQ ID NO: 526006 - protein, 9 aa, Homo Sapiens
SNFLHRQVL

SEQ ID NO: 526007 - protein, 9 aa, Homo Sapiens
GPSPNSGSI

SEQ ID NO: 526008 - protein, 9 aa, Homo Sapiens
EIAREEKMK

SEQ ID NO: 526009 - protein, 9 aa, Homo Sapiens
DIIFVLDGS

SEQ ID NO: 526010 - protein, 9 aa, Homo Sapiens
LGPQAEGLG

SEQ ID NO: 526011 - protein, 9 aa, Homo Sapiens
DTFSHDVYH

SEQ ID NO: 526012 - protein, 9 aa, Homo Sapiens
KLPVPRGAD

SEQ ID NO: 526013 - protein, 9 aa, Homo Sapiens
LGGPAAFLA

SEQ ID NO: 526014 - protein, 9 aa, Homo Sapiens
QQNKILETK

SEQ ID NO: 526015 - protein, 9 aa, Homo Sapiens
SISCLENLI

SEQ ID NO: 526016 - protein, 9 aa, Homo Sapiens
STTGLVTWD

SEQ ID NO: 526017 - protein, 9 aa, Homo Sapiens
AQVHLQPLI

SEQ ID NO: 526018 - protein, 9 aa, Homo Sapiens
LPEARKCLQ

SEQ ID NO: 526019 - protein, 9 aa, Homo Sapiens
EQQNKILET

SEQ ID NO: 526020 - protein, 9 aa, Homo Sapiens
VHGLLAGGA

SEQ ID NO: 526021 - protein, 9 aa, Homo Sapiens
CEHRRIHTG

SEQ ID NO: 526022 - protein, 9 aa, Homo Sapiens
QLENAETDE

SEQ ID NO: 526023 - protein, 9 aa, Homo Sapiens
EVVNQPFSF

SEQ ID NO: 526024 - protein, 9 aa, Homo Sapiens
LNSRKVVCG

SEQ ID NO: 526025 - protein, 9 aa, Homo Sapiens
SSIDKNVIV

SEQ ID NO: 526026 - protein, 9 aa, Homo Sapiens
GAQVHLQPL

SEQ ID NO: 526027 - protein, 9 aa, Homo Sapiens
EYFPHFSEP

SEQ ID NO: 526028 - protein, 9 aa, Homo Sapiens
TSLATSLTK

SEQ ID NO: 526029 - protein, 9 aa, Homo Sapiens
AARLQWPQL

SEQ ID NO: 526030 - protein, 9 aa, Homo Sapiens
SSSFLSLTV

SEQ ID NO: 526031 - protein, 9 aa, Homo Sapiens
PRKICCTKK

SEQ ID NO: 526032 - protein, 9 aa, Homo Sapiens
LAGLFQSND

SEQ ID NO: 526033 - protein, 9 aa, Homo Sapiens
ALIQDQTEE

SEQ ID NO: 526034 - protein, 9 aa, Homo Sapiens
CSLPQGIAK

SEQ ID NO: 526035 - protein, 9 aa, Homo Sapiens
GLVEVAGAC

SEQ ID NO: 526036 - protein, 9 aa, Homo Sapiens
GLGPPATEG

SEQ ID NO: 526037 - protein, 9 aa, Homo Sapiens
RGTPSEHEA

SEQ ID NO: 526038 - protein, 9 aa, Homo Sapiens
WEVSEQQNS

SEQ ID NO: 526039 - protein, 9 aa, Homo Sapiens
HEAKAETIR

SEQ ID NO: 526040 - protein, 9 aa, Homo Sapiens
RGVAWAAPA

SEQ ID NO: 526041 - protein, 9 aa, Homo Sapiens
ELGVTVLAA

SEQ ID NO: 526042 - protein, 9 aa, Homo Sapiens
SRRSNRLRP

SEQ ID NO: 526043 - protein, 9 aa, Homo Sapiens
HADIDYMDK

SEQ ID NO: 526044 - protein, 9 aa, Homo Sapiens
LLAGGAGLL

SEQ ID NO: 526045 - protein, 9 aa, Homo Sapiens
AEEATAEVQ

SEQ ID NO: 526046 - protein, 9 aa, Homo Sapiens
LATSLTKPY

SEQ ID NO: 526047 - protein, 9 aa, Homo Sapiens
TKLYFFQWL

SEQ ID NO: 526048 - protein, 9 aa, Homo Sapiens
DCNQDRTYY

SEQ ID NO: 526049 - protein, 9 aa, Homo Sapiens
IQDQTEEEE

SEQ ID NO: 526050 - protein, 9 aa, Homo Sapiens
ALSFLTEQF

SEQ ID NO: 526051 - protein, 9 aa, Homo Sapiens
GVPAEEMQA

SEQ ID NO: 526052 - protein, 9 aa, Homo Sapiens
SDFKTSDAL

SEQ ID NO: 526053 - protein, 9 aa, Homo Sapiens
QRGVAAQAE

SEQ ID NO: 526054 - protein, 9 aa, Homo Sapiens
KKLIEHYEG

SEQ ID NO: 526055 - protein, 9 aa, Homo Sapiens
CLRIPPPGT

SEQ ID NO: 526056 - protein, 9 aa, Homo Sapiens
TSIGKKWKY

SEQ ID NO: 526057 - protein, 9 aa, Homo Sapiens
QPCFCKDAQ

SEQ ID NO: 526058 - protein, 9 aa, Homo Sapiens
GQPCFCKDA

SEQ ID NO: 526059 - protein, 9 aa, Homo Sapiens
KDAQGADSV

SEQ ID NO: 526060 - protein, 9 aa, Homo Sapiens
GPLGDDACH

SEQ ID NO: 526061 - protein, 9 aa, Homo Sapiens
QRTQRNMNF

SEQ ID NO: 526062 - protein, 9 aa, Homo Sapiens
LQNRGLNNN

SEQ ID NO: 526063 - protein, 9 aa, Homo Sapiens
GGAGLLHLG

SEQ ID NO: 526064 - protein, 9 aa, Homo Sapiens
CSCGFLSTI

SEQ ID NO: 526065 - protein, 9 aa, Homo Sapiens
ELHRATESH

SEQ ID NO: 526066 - protein, 9 aa, Homo Sapiens
RNPGVEVAL

SEQ ID NO: 526067 - protein, 9 aa, Homo Sapiens
YLRTITATD

SEQ ID NO: 526068 - protein, 9 aa, Homo Sapiens
RQGPHHVCE

SEQ ID NO: 526069 - protein, 9 aa, Homo Sapiens
DTHSSTNDV

SEQ ID NO: 526070 - protein, 9 aa, Homo Sapiens
SSNCDISCK

SEQ ID NO: 526071 - protein, 9 aa, Homo Sapiens
DNARLTAAD

SEQ ID NO: 526072 - protein, 9 aa, Homo Sapiens
NTMYTVFHR

SEQ ID NO: 526073 - protein, 9 aa, Homo Sapiens
TQRNMNFGI

SEQ ID NO: 526074 - protein, 9 aa, Homo Sapiens
FVLDGSANV

SEQ ID NO: 526075 - protein, 9 aa, Homo Sapiens
GAPGGRRAG

SEQ ID NO: 526076 - protein, 9 aa, Homo Sapiens
ECTFRDPKA

SEQ ID NO: 526077 - protein, 9 aa, Homo Sapiens
HLLTAPTSA

SEQ ID NO: 526078 - protein, 9 aa, Homo Sapiens
GHQPLHGVH

SEQ ID NO: 526079 - protein, 9 aa, Homo Sapiens
WNREDAKST

SEQ ID NO: 526080 - protein, 9 aa, Homo Sapiens
GLLAGGAGL

SEQ ID NO: 526081 - protein, 9 aa, Homo Sapiens
PVQRGVAAQ

SEQ ID NO: 526082 - protein, 9 aa, Homo Sapiens
NIKKMCHRE

SEQ ID NO: 526083 - protein, 9 aa, Homo Sapiens
LHAVKPMNA

SEQ ID NO: 526084 - protein, 9 aa, Homo Sapiens
AGVHLLVGP

SEQ ID NO: 526085 - protein, 9 aa, Homo Sapiens
PELILYANM

SEQ ID NO: 526086 - protein, 9 aa, Homo Sapiens
WIGMPLPPP

SEQ ID NO: 526087 - protein, 9 aa, Homo Sapiens
LQELKRPSG

SEQ ID NO: 526088 - protein, 9 aa, Homo Sapiens
LRLQTPAEM

SEQ ID NO: 526089 - protein, 9 aa, Homo Sapiens
KIMIIFSIA

SEQ ID NO: 526090 - protein, 9 aa, Homo Sapiens
NARLTAADF

SEQ ID NO: 526091 - protein, 9 aa, Homo Sapiens
LLAAKPLVV

SEQ ID NO: 526092 - protein, 9 aa, Homo Sapiens
LGQHCSEKT

SEQ ID NO: 526093 - protein, 9 aa, Homo Sapiens
SECAIDRHR

SEQ ID NO: 526094 - protein, 9 aa, Homo Sapiens
HRKFYSISG

SEQ ID NO: 526095 - protein, 9 aa, Homo Sapiens
KNVVFGKTS

SEQ ID NO: 526096 - protein, 9 aa, Homo Sapiens
GMAPPTPSK

SEQ ID NO: 526097 - protein, 9 aa, Homo Sapiens
WLNSRKVVC

SEQ ID NO: 526098 - protein, 9 aa, Homo Sapiens
KKLKLLFSM

SEQ ID NO: 526099 - protein, 9 aa, Homo Sapiens
RNIRTVKSQ

SEQ ID NO: 526100 - protein, 9 aa, Homo Sapiens
QNRGLNNNS

SEQ ID NO: 526101 - protein, 9 aa, Homo Sapiens
ENAETDELL

SEQ ID NO: 526102 - protein, 9 aa, Homo Sapiens
FNPCQAINC

SEQ ID NO: 526103 - protein, 9 aa, Homo Sapiens
FLSLTVFSL

SEQ ID NO: 526104 - protein, 9 aa, Homo Sapiens
VPAEEMQAP

SEQ ID NO: 526105 - protein, 9 aa, Homo Sapiens
CDLDECTFR

SEQ ID NO: 526106 - protein, 9 aa, Homo Sapiens
FHKFSNSNI

SEQ ID NO: 526107 - protein, 9 aa, Homo Sapiens
IHEGPLVYR

SEQ ID NO: 526108 - protein, 9 aa, Homo Sapiens
VFGKTSACF

SEQ ID NO: 526109 - protein, 9 aa, Homo Sapiens
PLYLRLHQT

SEQ ID NO: 526110 - protein, 9 aa, Homo Sapiens
AAPGAAVDN

SEQ ID NO: 526111 - protein, 9 aa, Homo Sapiens
DKDAKALFK

SEQ ID NO: 526112 - protein, 9 aa, Homo Sapiens
INRKLSDHP

SEQ ID NO: 526113 - protein, 9 aa, Homo Sapiens
FSFGDKEKN

SEQ ID NO: 526114 - protein, 9 aa, Homo Sapiens
ELDTKERPH

SEQ ID NO: 526115 - protein, 9 aa, Homo Sapiens
RCLLMVNPT

SEQ ID NO: 526116 - protein, 9 aa, Homo Sapiens
KVNFIPWLF

SEQ ID NO: 526117 - protein, 9 aa, Homo Sapiens
TVFSLNQER

SEQ ID NO: 526118 - protein, 9 aa, Homo Sapiens
RYYGYRSAF

SEQ ID NO: 526119 - protein, 9 aa, Homo Sapiens
FFGVNTKID

SEQ ID NO: 526120 - protein, 9 aa, Homo Sapiens
KPLYLRLHQ

SEQ ID NO: 526121 - protein, 9 aa, Homo Sapiens
RGVAAQAEL

SEQ ID NO: 526122 - protein, 9 aa, Homo Sapiens
TAAGPRWAV

SEQ ID NO: 526123 - protein, 9 aa, Homo Sapiens
MVCQPRHFP

SEQ ID NO: 526124 - protein, 9 aa, Homo Sapiens
QIEMFAYHV

SEQ ID NO: 526125 - protein, 9 aa, Homo Sapiens
ATAEVQPPP

SEQ ID NO: 526126 - protein, 9 aa, Homo Sapiens
LVYRIFKRW

SEQ ID NO: 526127 - protein, 9 aa, Homo Sapiens
RPSSRANHS

SEQ ID NO: 526128 - protein, 9 aa, Homo Sapiens
LLVRDAVIL

SEQ ID NO: 526129 - protein, 9 aa, Homo Sapiens
LEPPELILY

SEQ ID NO: 526130 - protein, 9 aa, Homo Sapiens
EMFAYHVPD

SEQ ID NO: 526131 - protein, 9 aa, Homo Sapiens
PAEEMQAPG

SEQ ID NO: 526132 - protein, 9 aa, Homo Sapiens
DTLKKDLIN

SEQ ID NO: 526133 - protein, 9 aa, Homo Sapiens
VTVAPRNPG

SEQ ID NO: 526134 - protein, 9 aa, Homo Sapiens
GPELLVLLA

SEQ ID NO: 526135 - protein, 9 aa, Homo Sapiens
TVDIVCNDC

SEQ ID NO: 526136 - protein, 9 aa, Homo Sapiens
VDLAYQKRV

SEQ ID NO: 526137 - protein, 9 aa, Homo Sapiens
VITVGNLVG

SEQ ID NO: 526138 - protein, 9 aa, Homo Sapiens
SHDVYHLTS

SEQ ID NO: 526139 - protein, 9 aa, Homo Sapiens
EIRPSINRK

SEQ ID NO: 526140 - protein, 9 aa, Homo Sapiens
LEGSDSGLD

SEQ ID NO: 526141 - protein, 9 aa, Homo Sapiens
TLKKDLINH

SEQ ID NO: 526142 - protein, 9 aa, Homo Sapiens
KQQWPAKLP

SEQ ID NO: 526143 - protein, 9 aa, Homo Sapiens
KREAKNLCS

SEQ ID NO: 526144 - protein, 9 aa, Homo Sapiens
DNKLGFGRG

SEQ ID NO: 526145 - protein, 9 aa, Homo Sapiens
LGALHRAAA

SEQ ID NO: 526146 - protein, 9 aa, Homo Sapiens
MVSDLDADS

SEQ ID NO: 526147 - protein, 9 aa, Homo Sapiens
MTSSPRPPP

SEQ ID NO: 526148 - protein, 9 aa, Homo Sapiens
QEIQEEIGE

SEQ ID NO: 526149 - protein, 9 aa, Homo Sapiens
EFEHQQIEL

SEQ ID NO: 526150 - protein, 9 aa, Homo Sapiens
LGSTCGVSG

SEQ ID NO: 526151 - protein, 9 aa, Homo Sapiens
VSSSIDKNV

SEQ ID NO: 526152 - protein, 9 aa, Homo Sapiens
QYLYVELDT

SEQ ID NO: 526153 - protein, 9 aa, Homo Sapiens
ICFTEAFSA

SEQ ID NO: 526154 - protein, 9 aa, Homo Sapiens
TYRYTYTRK

SEQ ID NO: 526155 - protein, 9 aa, Homo Sapiens
MVHTGERPF

SEQ ID NO: 526156 - protein, 9 aa, Homo Sapiens
LGKIKQSLT

SEQ ID NO: 526157 - protein, 9 aa, Homo Sapiens
DLDECTFRD

SEQ ID NO: 526158 - protein, 9 aa, Homo Sapiens
EQQNSKEEV

SEQ ID NO: 526159 - protein, 9 aa, Homo Sapiens
RVQQADRDW

SEQ ID NO: 526160 - protein, 9 aa, Homo Sapiens
HSTTGLVTW

SEQ ID NO: 526161 - protein, 9 aa, Homo Sapiens
VDKRASPAT

SEQ ID NO: 526162 - protein, 9 aa, Homo Sapiens
ENTVQVKNV

SEQ ID NO: 526163 - protein, 9 aa, Homo Sapiens
RVVDLAYQK

SEQ ID NO: 526164 - protein, 9 aa, Homo Sapiens
RLGLAQSRN

SEQ ID NO: 526165 - protein, 9 aa, Homo Sapiens
KNVEENSKK

SEQ ID NO: 526166 - protein, 9 aa, Homo Sapiens
LEQQNKILE

SEQ ID NO: 526167 - protein, 9 aa, Homo Sapiens
TRVQQADRD

SEQ ID NO: 526168 - protein, 9 aa, Homo Sapiens
QSLQTRVLD

SEQ ID NO: 526169 - protein, 9 aa, Homo Sapiens
TPIMIGIGC

SEQ ID NO: 526170 - protein, 9 aa, Homo Sapiens
CGVSGRVVT

SEQ ID NO: 526171 - protein, 9 aa, Homo Sapiens
QRILPEARK

SEQ ID NO: 526172 - protein, 9 aa, Homo Sapiens
HVDKRSNFL

SEQ ID NO: 526173 - protein, 9 aa, Homo Sapiens
RIKFVVEKH

SEQ ID NO: 526174 - protein, 9 aa, Homo Sapiens
GGTYRYTYT

SEQ ID NO: 526175 - protein, 9 aa, Homo Sapiens
FLSTITLKV

SEQ ID NO: 526176 - protein, 9 aa, Homo Sapiens
ALATEPPTK

SEQ ID NO: 526177 - protein, 9 aa, Homo Sapiens
ASYDCNQDR

SEQ ID NO: 526178 - protein, 9 aa, Homo Sapiens
SAFRCLVEN

SEQ ID NO: 526179 - protein, 9 aa, Homo Sapiens
NRSLLTMDQ

SEQ ID NO: 526180 - protein, 9 aa, Homo Sapiens
IISPVAEHP

SEQ ID NO: 526181 - protein, 9 aa, Homo Sapiens
QEEDTRVQQ

SEQ ID NO: 526182 - protein, 9 aa, Homo Sapiens
TPSKNPEEE

SEQ ID NO: 526183 - protein, 9 aa, Homo Sapiens
ECLICKVGE

SEQ ID NO: 526184 - protein, 9 aa, Homo Sapiens
PPPGEQGRG

SEQ ID NO: 526185 - protein, 9 aa, Homo Sapiens
RLTAADFRL

SEQ ID NO: 526186 - protein, 9 aa, Homo Sapiens
IELEKVCNP

SEQ ID NO: 526187 - protein, 9 aa, Homo Sapiens
WPQLFSRLF

SEQ ID NO: 526188 - protein, 9 aa, Homo Sapiens
DQTEEEEEE

SEQ ID NO: 526189 - protein, 9 aa, Homo Sapiens
VDIVCNDCN

SEQ ID NO: 526190 - protein, 9 aa, Homo Sapiens
GPAAFLARW

SEQ ID NO: 526191 - protein, 9 aa, Homo Sapiens
VENELVGHQ

SEQ ID NO: 526192 - protein, 9 aa, Homo Sapiens
GWGQNVNDD

SEQ ID NO: 526193 - protein, 9 aa, Homo Sapiens
YVIIFQNGE

SEQ ID NO: 526194 - protein, 9 aa, Homo Sapiens
FPILFFFFP

SEQ ID NO: 526195 - protein, 9 aa, Homo Sapiens
LIWSSVEDN

SEQ ID NO: 526196 - protein, 9 aa, Homo Sapiens
VVNMLGACT

SEQ ID NO: 526197 - protein, 9 aa, Homo Sapiens
ERKNNGKAH

SEQ ID NO: 526198 - protein, 9 aa, Homo Sapiens
CTKKLYEED

SEQ ID NO: 526199 - protein, 9 aa, Homo Sapiens
KRYWGRLLH

SEQ ID NO: 526200 - protein, 9 aa, Homo Sapiens
KRFLAKVFP

SEQ ID NO: 526201 - protein, 9 aa, Homo Sapiens
SLLKNLHPD

SEQ ID NO: 526202 - protein, 9 aa, Homo Sapiens
HSRWQGTPE

SEQ ID NO: 526203 - protein, 9 aa, Homo Sapiens
FILRLEDTH

SEQ ID NO: 526204 - protein, 9 aa, Homo Sapiens
TESHRCLRI

SEQ ID NO: 526205 - protein, 9 aa, Homo Sapiens
KMCHREQMK

SEQ ID NO: 526206 - protein, 9 aa, Homo Sapiens
YWMPAENTV

SEQ ID NO: 526207 - protein, 9 aa, Homo Sapiens
KWKYQNIEY

SEQ ID NO: 526208 - protein, 9 aa, Homo Sapiens
KGEQMGCPA

SEQ ID NO: 526209 - protein, 9 aa, Homo Sapiens
AKALFKCFR

SEQ ID NO: 526210 - protein, 9 aa, Homo Sapiens
APPTPSKNP

SEQ ID NO: 526211 - protein, 9 aa, Homo Sapiens
EDHLECLIC

SEQ ID NO: 526212 - protein, 9 aa, Homo Sapiens
NFGISQVFQ

SEQ ID NO: 526213 - protein, 9 aa, Homo Sapiens
EVLGVQTGA

SEQ ID NO: 526214 - protein, 9 aa, Homo Sapiens
APGLVAAGG

SEQ ID NO: 526215 - protein, 9 aa, Homo Sapiens
EVAGACLPH

SEQ ID NO: 526216 - protein, 9 aa, Homo Sapiens
KKDSKNVEE

SEQ ID NO: 526217 - protein, 9 aa, Homo Sapiens
HAVTPGNRE

SEQ ID NO: 526218 - protein, 9 aa, Homo Sapiens
LIRCLLMVN

SEQ ID NO: 526219 - protein, 9 aa, Homo Sapiens
FRCSSSPSA

SEQ ID NO: 526220 - protein, 9 aa, Homo Sapiens
NNNSPERRR

SEQ ID NO: 526221 - protein, 9 aa, Homo Sapiens
SPNSGSIKT

SEQ ID NO: 526222 - protein, 9 aa, Homo Sapiens
EHYEGKLNK

SEQ ID NO: 526223 - protein, 9 aa, Homo Sapiens
EKGEQMGCP

SEQ ID NO: 526224 - protein, 9 aa, Homo Sapiens
AFALKQLLE

SEQ ID NO: 526225 - protein, 9 aa, Homo Sapiens
EEDTRVQQA

SEQ ID NO: 526226 - protein, 9 aa, Homo Sapiens
YLQEEDTRV

SEQ ID NO: 526227 - protein, 9 aa, Homo Sapiens
QKQQWPAKL

SEQ ID NO: 526228 - protein, 9 aa, Homo Sapiens
KFSNSNIHT

SEQ ID NO: 526229 - protein, 9 aa, Homo Sapiens
AKVTGPLGD

SEQ ID NO: 526230 - protein, 9 aa, Homo Sapiens
RDAGLGPPA

SEQ ID NO: 526231 - protein, 9 aa, Homo Sapiens
PPGTLRGSR

SEQ ID NO: 526232 - protein, 9 aa, Homo Sapiens
WPAKLPVPR

SEQ ID NO: 526233 - protein, 9 aa, Homo Sapiens
EEMQAPGLV

SEQ ID NO: 526234 - protein, 9 aa, Homo Sapiens
EEIGELLQE

SEQ ID NO: 526235 - protein, 9 aa, Homo Sapiens
LDLQQQLAV

SEQ ID NO: 526236 - protein, 9 aa, Homo Sapiens
KQLLEVGFA

SEQ ID NO: 526237 - protein, 9 aa, Homo Sapiens
YSISGEVYQ

SEQ ID NO: 526238 - protein, 9 aa, Homo Sapiens
GRLGLAQSR

SEQ ID NO: 526239 - protein, 9 aa, Homo Sapiens
VGNREENIL

SEQ ID NO: 526240 - protein, 9 aa, Homo Sapiens
YQNIEYEYQ

SEQ ID NO: 526241 - protein, 9 aa, Homo Sapiens
AALIQDQTE

SEQ ID NO: 526242 - protein, 9 aa, Homo Sapiens
QLLEVGFAV

SEQ ID NO: 526243 - protein, 9 aa, Homo Sapiens
SPGVLVLSP

SEQ ID NO: 526244 - protein, 9 aa, Homo Sapiens
VTELIVFAV

SEQ ID NO: 526245 - protein, 9 aa, Homo Sapiens
CLLMVNPTR

SEQ ID NO: 526246 - protein, 9 aa, Homo Sapiens
LIVTVAPRN

SEQ ID NO: 526247 - protein, 9 aa, Homo Sapiens
DRAKVTGPL

SEQ ID NO: 526248 - protein, 9 aa, Homo Sapiens
IMIIFSIAF

SEQ ID NO: 526249 - protein, 9 aa, Homo Sapiens
KVSELHRAT

SEQ ID NO: 526250 - protein, 9 aa, Homo Sapiens
LLVQPCIGG

SEQ ID NO: 526251 - protein, 9 aa, Homo Sapiens
IVFAVMAYD

SEQ ID NO: 526252 - protein, 9 aa, Homo Sapiens
TLSTTPGDS

SEQ ID NO: 526253 - protein, 9 aa, Homo Sapiens
VVFGKTSAC

SEQ ID NO: 526254 - protein, 9 aa, Homo Sapiens
AALLRLLWP

SEQ ID NO: 526255 - protein, 9 aa, Homo Sapiens
IERRGLRAV

SEQ ID NO: 526256 - protein, 9 aa, Homo Sapiens
SASSPTDSN

SEQ ID NO: 526257 - protein, 9 aa, Homo Sapiens
SLTKPYTSS

SEQ ID NO: 526258 - protein, 9 aa, Homo Sapiens
VRGSSLSLV

SEQ ID NO: 526259 - protein, 9 aa, Homo Sapiens
VFSLNQERY

SEQ ID NO: 526260 - protein, 9 aa, Homo Sapiens
TSTSLATSL

SEQ ID NO: 526261 - protein, 9 aa, Homo Sapiens
ETRITRLQE

SEQ ID NO: 526262 - protein, 9 aa, Homo Sapiens
SKDKGGLQP

SEQ ID NO: 526263 - protein, 9 aa, Homo Sapiens
CHKLDRAKV

SEQ ID NO: 526264 - protein, 9 aa, Homo Sapiens
ELSMSSAEL

SEQ ID NO: 526265 - protein, 9 aa, Homo Sapiens
WKYQNIEYE

SEQ ID NO: 526266 - protein, 9 aa, Homo Sapiens
PCSCGFLST

SEQ ID NO: 526267 - protein, 9 aa, Homo Sapiens
DPSRRSNRL

SEQ ID NO: 526268 - protein, 9 aa, Homo Sapiens
LSLQLENAE

SEQ ID NO: 526269 - protein, 9 aa, Homo Sapiens
TRITRLQEL

SEQ ID NO: 526270 - protein, 9 aa, Homo Sapiens
DSGLDSYLP

SEQ ID NO: 526271 - protein, 9 aa, Homo Sapiens
AEQLACDFR

SEQ ID NO: 526272 - protein, 9 aa, Homo Sapiens
LYANMAREQ

SEQ ID NO: 526273 - protein, 9 aa, Homo Sapiens
SASHAWSYG

SEQ ID NO: 526274 - protein, 9 aa, Homo Sapiens
LRIPPPGTL

SEQ ID NO: 526275 - protein, 9 aa, Homo Sapiens
SQFVDTFSH

SEQ ID NO: 526276 - protein, 9 aa, Homo Sapiens
VAWAAPAAW

SEQ ID NO: 526277 - protein, 9 aa, Homo Sapiens
HNQFIKIMI

SEQ ID NO: 526278 - protein, 9 aa, Homo Sapiens
ERKERKNNG

SEQ ID NO: 526279 - protein, 9 aa, Homo Sapiens
ISGLYKERM

SEQ ID NO: 526280 - protein, 9 aa, Homo Sapiens
AEEMQAPGL

SEQ ID NO: 526281 - protein, 9 aa, Homo Sapiens
PGAAVDNKL

SEQ ID NO: 526282 - protein, 9 aa, Homo Sapiens
AAKPLVVVA

SEQ ID NO: 526283 - protein, 9 aa, Homo Sapiens
LHRATESHR

SEQ ID NO: 526284 - protein, 9 aa, Homo Sapiens
IRTVKSQEE

SEQ ID NO: 526285 - protein, 9 aa, Homo Sapiens
FRNDKDSLS

SEQ ID NO: 526286 - protein, 9 aa, Homo Sapiens
HLQPLIVTV

SEQ ID NO: 526287 - protein, 9 aa, Homo Sapiens
QMVHTGERP

SEQ ID NO: 526288 - protein, 9 aa, Homo Sapiens
SSFLSLTVF

SEQ ID NO: 526289 - protein, 9 aa, Homo Sapiens
CQAINCKHG

SEQ ID NO: 526290 - protein, 9 aa, Homo Sapiens
QDSDFKTSD

SEQ ID NO: 526291 - protein, 9 aa, Homo Sapiens
FIKIMIIFS

SEQ ID NO: 526292 - protein, 9 aa, Homo Sapiens
MALSFLTEQ

SEQ ID NO: 526293 - protein, 9 aa, Homo Sapiens
LAYQKRVSV

SEQ ID NO: 526294 - protein, 9 aa, Homo Sapiens
SDSDISGDT

SEQ ID NO: 526295 - protein, 9 aa, Homo Sapiens
REDAKSTGQ

SEQ ID NO: 526296 - protein, 9 aa, Homo Sapiens
LQAQGIGAS

SEQ ID NO: 526297 - protein, 9 aa, Homo Sapiens
GELSMSSAE

SEQ ID NO: 526298 - protein, 9 aa, Homo Sapiens
GDYDSGFRC

SEQ ID NO: 526299 - protein, 9 aa, Homo Sapiens
ATGKWNSVP

SEQ ID NO: 526300 - protein, 9 aa, Homo Sapiens
KNDPYVIIF

SEQ ID NO: 526301 - protein, 9 aa, Homo Sapiens
DGHVLDSGT

SEQ ID NO: 526302 - protein, 9 aa, Homo Sapiens
AFVFELLQQ

SEQ ID NO: 526303 - protein, 9 aa, Homo Sapiens
ELIVFAVMA

SEQ ID NO: 526304 - protein, 9 aa, Homo Sapiens
STGNWMSYV

SEQ ID NO: 526305 - protein, 9 aa, Homo Sapiens
MPHNQFIKI

SEQ ID NO: 526306 - protein, 9 aa, Homo Sapiens
HEGPLVYRI

SEQ ID NO: 526307 - protein, 9 aa, Homo Sapiens
LFFFFPQKV

SEQ ID NO: 526308 - protein, 9 aa, Homo Sapiens
YYGYRSAFR

SEQ ID NO: 526309 - protein, 9 aa, Homo Sapiens
FPPPWIGMP

SEQ ID NO: 526310 - protein, 9 aa, Homo Sapiens
QPLIVTVAP

SEQ ID NO: 526311 - protein, 9 aa, Homo Sapiens
FLLLHYKKE

SEQ ID NO: 526312 - protein, 9 aa, Homo Sapiens
GTLRGSRTA

SEQ ID NO: 526313 - protein, 9 aa, Homo Sapiens
AFPDDMDLR

SEQ ID NO: 526314 - protein, 9 aa, Homo Sapiens
PVPVPMPVP

SEQ ID NO: 526315 - protein, 9 aa, Homo Sapiens
QFVDTFSHD

SEQ ID NO: 526316 - protein, 9 aa, Homo Sapiens
PMPVPVPEP

SEQ ID NO: 526317 - protein, 9 aa, Homo Sapiens
IRNGPSGIC

SEQ ID NO: 526318 - protein, 9 aa, Homo Sapiens
ATYVNRKSA

SEQ ID NO: 526319 - protein, 9 aa, Homo Sapiens
FGTKLHTPI

SEQ ID NO: 526320 - protein, 9 aa, Homo Sapiens
PDSYQSEQT

SEQ ID NO: 526321 - protein, 9 aa, Homo Sapiens
QGIGASVQL

SEQ ID NO: 526322 - protein, 9 aa, Homo Sapiens
ARLQWPQLF

SEQ ID NO: 526323 - protein, 9 aa, Homo Sapiens
EEIRPSINR

SEQ ID NO: 526324 - protein, 9 aa, Homo Sapiens
GTPSEHEAK

SEQ ID NO: 526325 - protein, 9 aa, Homo Sapiens
REDLTAASP

SEQ ID NO: 526326 - protein, 9 aa, Homo Sapiens
AFGVMRGVA

SEQ ID NO: 526327 - protein, 9 aa, Homo Sapiens
PRPPPGEQG

SEQ ID NO: 526328 - protein, 9 aa, Homo Sapiens
GACLPHARA

SEQ ID NO: 526329 - protein, 9 aa, Homo Sapiens
LVQPCIGGV

SEQ ID NO: 526330 - protein, 9 aa, Homo Sapiens
RAVGLYRLC

SEQ ID NO: 526331 - protein, 9 aa, Homo Sapiens
LLVGPELLV

SEQ ID NO: 526332 - protein, 9 aa, Homo Sapiens
VLLAAKPLV

SEQ ID NO: 526333 - protein, 9 aa, Homo Sapiens
SNKRDIIFV

SEQ ID NO: 526334 - protein, 9 aa, Homo Sapiens
KKAEAAEAA

SEQ ID NO: 526335 - protein, 9 aa, Homo Sapiens
KKMCHREQM

SEQ ID NO: 526336 - protein, 9 aa, Homo Sapiens
DAARLQWPQ

SEQ ID NO: 526337 - protein, 9 aa, Homo Sapiens
RVWEVSEQQ

SEQ ID NO: 526338 - protein, 9 aa, Homo Sapiens
PKRYWGRLL

SEQ ID NO: 526339 - protein, 9 aa, Homo Sapiens
CIGGVPAEE

SEQ ID NO: 526340 - protein, 9 aa, Homo Sapiens
NRKSAIKGM

SEQ ID NO: 526341 - protein, 9 aa, Homo Sapiens
EQCPISGLY

SEQ ID NO: 526342 - protein, 9 aa, Homo Sapiens
KLHTPIMIG

SEQ ID NO: 526343 - protein, 9 aa, Homo Sapiens
SNRLRPLPS

SEQ ID NO: 526344 - protein, 9 aa, Homo Sapiens
KPFMLSIRR

SEQ ID NO: 526345 - protein, 9 aa, Homo Sapiens
TGSSNCDIS

SEQ ID NO: 526346 - protein, 9 aa, Homo Sapiens
ILPEARKCL

SEQ ID NO: 526347 - protein, 9 aa, Homo Sapiens
GELLQEQRA

SEQ ID NO: 526348 - protein, 9 aa, Homo Sapiens
KNIKKMCHR

SEQ ID NO: 526349 - protein, 9 aa, Homo Sapiens
TKLHTPIMI

SEQ ID NO: 526350 - protein, 9 aa, Homo Sapiens
RANHSSERP

SEQ ID NO: 526351 - protein, 9 aa, Homo Sapiens
LLHLGPQAE

SEQ ID NO: 526352 - protein, 9 aa, Homo Sapiens
WQGTPEAYE

SEQ ID NO: 526353 - protein, 9 aa, Homo Sapiens
RAKVTGPLG

SEQ ID NO: 526354 - protein, 9 aa, Homo Sapiens
KGQMVCQPR

SEQ ID NO: 526355 - protein, 9 aa, Homo Sapiens
KNLCSQRGL

SEQ ID NO: 526356 - protein, 9 aa, Homo Sapiens
PNSGSIKTL

SEQ ID NO: 526357 - protein, 9 aa, Homo Sapiens
FFQWLSVFL

SEQ ID NO: 526358 - protein, 9 aa, Homo Sapiens
PMIRAPEEK

SEQ ID NO: 526359 - protein, 9 aa, Homo Sapiens
VGHQPLHGV

SEQ ID NO: 526360 - protein, 9 aa, Homo Sapiens
CTFRDPKAE

SEQ ID NO: 526361 - protein, 9 aa, Homo Sapiens
GEKVNFIPW

SEQ ID NO: 526362 - protein, 9 aa, Homo Sapiens
RGSSLSLVS

SEQ ID NO: 526363 - protein, 9 aa, Homo Sapiens
DDGHVLDSG

SEQ ID NO: 526364 - protein, 9 aa, Homo Sapiens
VNFIPWLFN

SEQ ID NO: 526365 - protein, 9 aa, Homo Sapiens
AGPRWAVPV

SEQ ID NO: 526366 - protein, 9 aa, Homo Sapiens
TVAPRNPGV

SEQ ID NO: 526367 - protein, 9 aa, Homo Sapiens
QGYDSTSAK

SEQ ID NO: 526368 - protein, 9 aa, Homo Sapiens
LFNPCQAIN

SEQ ID NO: 526369 - protein, 9 aa, Homo Sapiens
TAADFRLKY

SEQ ID NO: 526370 - protein, 9 aa, Homo Sapiens
PERPSSRAN

SEQ ID NO: 526371 - protein, 9 aa, Homo Sapiens
GVAAQAELG

SEQ ID NO: 526372 - protein, 9 aa, Homo Sapiens
LVLSPVRTV

SEQ ID NO: 526373 - protein, 9 aa, Homo Sapiens
SSTNDVQPG

SEQ ID NO: 526374 - protein, 9 aa, Homo Sapiens
TNDLVQGYD

SEQ ID NO: 526375 - protein, 9 aa, Homo Sapiens
TVSPDGSFC

SEQ ID NO: 526376 - protein, 9 aa, Homo Sapiens
RGDARIQRR

SEQ ID NO: 526377 - protein, 9 aa, Homo Sapiens
YCEDSFRND

SEQ ID NO: 526378 - protein, 9 aa, Homo Sapiens
ASQWLNSRK

SEQ ID NO: 526379 - protein, 9 aa, Homo Sapiens
VVAVLNKSL

SEQ ID NO: 526380 - protein, 9 aa, Homo Sapiens
EVALLVQPC

SEQ ID NO: 526381 - protein, 9 aa, Homo Sapiens
PVRTVITVG

SEQ ID NO: 526382 - protein, 9 aa, Homo Sapiens
VKKLKLLFS

SEQ ID NO: 526383 - protein, 9 aa, Homo Sapiens
SHSTTGLVT

SEQ ID NO: 526384 - protein, 9 aa, Homo Sapiens
GDDACHLLR

SEQ ID NO: 526385 - protein, 9 aa, Homo Sapiens
QIELEKVCN

SEQ ID NO: 526386 - protein, 9 aa, Homo Sapiens
DVVPQSLQD

SEQ ID NO: 526387 - protein, 9 aa, Homo Sapiens
TVKKLKLLF

SEQ ID NO: 526388 - protein, 9 aa, Homo Sapiens
TFRDPKAEE

SEQ ID NO: 526389 - protein, 9 aa, Homo Sapiens
PVPVPVPMP

SEQ ID NO: 526390 - protein, 9 aa, Homo Sapiens
AKPLVVVAF

SEQ ID NO: 526391 - protein, 9 aa, Homo Sapiens
MVDKRASPA

SEQ ID NO: 526392 - protein, 9 aa, Homo Sapiens
ETSGNTMYT

SEQ ID NO: 526393 - protein, 9 aa, Homo Sapiens
MAQIERGDA

SEQ ID NO: 526394 - protein, 9 aa, Homo Sapiens
PHAVTPGNR

SEQ ID NO: 526395 - protein, 9 aa, Homo Sapiens
EAAMATPAR

SEQ ID NO: 526396 - protein, 9 aa, Homo Sapiens
AKHRLHAVK

SEQ ID NO: 526397 - protein, 9 aa, Homo Sapiens
EQSKLEGSD

SEQ ID NO: 526398 - protein, 9 aa, Homo Sapiens
SPDGSFCAS

SEQ ID NO: 526399 - protein, 9 aa, Homo Sapiens
FPGDYDSGF

SEQ ID NO: 526400 - protein, 9 aa, Homo Sapiens
MNFGISQVF

SEQ ID NO: 526401 - protein, 9 aa, Homo Sapiens
VAFALKQLL

SEQ ID NO: 526402 - protein, 9 aa, Homo Sapiens
NSLQEVQEG

SEQ ID NO: 526403 - protein, 9 aa, Homo Sapiens
HVPDATLSN

SEQ ID NO: 526404 - protein, 9 aa, Homo Sapiens
GLAQSRNAF

SEQ ID NO: 526405 - protein, 9 aa, Homo Sapiens
AIISHSTTG

SEQ ID NO: 526406 - protein, 9 aa, Homo Sapiens
GHVLDSGTY

SEQ ID NO: 526407 - protein, 9 aa, Homo Sapiens
NMNLKREAK

SEQ ID NO: 526408 - protein, 9 aa, Homo Sapiens
NYLRTITAT

SEQ ID NO: 526409 - protein, 9 aa, Homo Sapiens
RVVENELVG

SEQ ID NO: 526410 - protein, 9 aa, Homo Sapiens
AEGLGALHR

SEQ ID NO: 526411 - protein, 9 aa, Homo Sapiens
QEEIGELLQ

SEQ ID NO: 526412 - protein, 9 aa, Homo Sapiens
QTEEEEEEE

SEQ ID NO: 526413 - protein, 9 aa, Homo Sapiens
LFMLHKKIV

SEQ ID NO: 526414 - protein, 9 aa, Homo Sapiens
LVLLAAKPL

SEQ ID NO: 526415 - protein, 9 aa, Homo Sapiens
NVIVALMYT

SEQ ID NO: 526416 - protein, 9 aa, Homo Sapiens
HQPLHGVHG

SEQ ID NO: 526417 - protein, 9 aa, Homo Sapiens
QIERRGLRA

SEQ ID NO: 526418 - protein, 9 aa, Homo Sapiens
QEFVNFLLL

SEQ ID NO: 526419 - protein, 9 aa, Homo Sapiens
AAQAELGVT

SEQ ID NO: 526420 - protein, 9 aa, Homo Sapiens
GFLSTITLK

SEQ ID NO: 526421 - protein, 9 aa, Homo Sapiens
NKLGFGRGR

SEQ ID NO: 526422 - protein, 9 aa, Homo Sapiens
IVCNDCNGR

SEQ ID NO: 526423 - protein, 9 aa, Homo Sapiens
YTVFHRDKT

SEQ ID NO: 526424 - protein, 9 aa, Homo Sapiens
VQGYDSTSA

SEQ ID NO: 526425 - protein, 9 aa, Homo Sapiens
KCNECEHRR

SEQ ID NO: 526426 - protein, 9 aa, Homo Sapiens
ARLTAADFR

SEQ ID NO: 526427 - protein, 9 aa, Homo Sapiens
KEEFEHQQI

SEQ ID NO: 526428 - protein, 9 aa, Homo Sapiens
ISPVAEHPE

SEQ ID NO: 526429 - protein, 9 aa, Homo Sapiens
PGYRDSWNR

SEQ ID NO: 526430 - protein, 9 aa, Homo Sapiens
LHPDVKASA

SEQ ID NO: 526431 - protein, 9 aa, Homo Sapiens
SHRCLRIPP

SEQ ID NO: 526432 - protein, 9 aa, Homo Sapiens
LRLEDTHQT

SEQ ID NO: 526433 - protein, 9 aa, Homo Sapiens
LRASGVPKR

SEQ ID NO: 526434 - protein, 9 aa, Homo Sapiens
VSPDGSFCA

SEQ ID NO: 526435 - protein, 9 aa, Homo Sapiens
DLTAASPGV

SEQ ID NO: 526436 - protein, 9 aa, Homo Sapiens
IKKMCHREQ

SEQ ID NO: 526437 - protein, 9 aa, Homo Sapiens
NPCQAINCK

SEQ ID NO: 526438 - protein, 9 aa, Homo Sapiens
IPWLFNETS

SEQ ID NO: 526439 - protein, 9 aa, Homo Sapiens
SLAGLFQSN

SEQ ID NO: 526440 - protein, 9 aa, Homo Sapiens
AVKPMNAMA

SEQ ID NO: 526441 - protein, 9 aa, Homo Sapiens
AKGQMVCQP

SEQ ID NO: 526442 - protein, 9 aa, Homo Sapiens
GTYVGGHVE

SEQ ID NO: 526443 - protein, 9 aa, Homo Sapiens
THQTRVVPG

SEQ ID NO: 526444 - protein, 9 aa, Homo Sapiens
QNMTVDIVC

SEQ ID NO: 526445 - protein, 9 aa, Homo Sapiens
TELIVFAVM

SEQ ID NO: 526446 - protein, 9 aa, Homo Sapiens
VKSLSTDSS

SEQ ID NO: 526447 - protein, 9 aa, Homo Sapiens
TLPPLFGWG

SEQ ID NO: 526448 - protein, 9 aa, Homo Sapiens
LKQLLEVGF

SEQ ID NO: 526449 - protein, 9 aa, Homo Sapiens
KVFPSPMRI

SEQ ID NO: 526450 - protein, 9 aa, Homo Sapiens
QEGPPGLSP

SEQ ID NO: 526451 - protein, 9 aa, Homo Sapiens
ATESHRCLR

SEQ ID NO: 526452 - protein, 9 aa, Homo Sapiens
CNECEHRRI

SEQ ID NO: 526453 - protein, 9 aa, Homo Sapiens
AGEKVNFIP

SEQ ID NO: 526454 - protein, 9 aa, Homo Sapiens
AKIVAIKDF

SEQ ID NO: 526455 - protein, 9 aa, Homo Sapiens
PHLNVVNML

SEQ ID NO: 526456 - protein, 9 aa, Homo Sapiens
CLATGKWNS

SEQ ID NO: 526457 - protein, 9 aa, Homo Sapiens
KALFKCFRS

SEQ ID NO: 526458 - protein, 9 aa, Homo Sapiens
PAENTVQVK

SEQ ID NO: 526459 - protein, 9 aa, Homo Sapiens
WGQNVNDDK

SEQ ID NO: 526460 - protein, 9 aa, Homo Sapiens
SLNVTWYLK

SEQ ID NO: 526461 - protein, 9 aa, Homo Sapiens
QPRHFPWAD

SEQ ID NO: 526462 - protein, 9 aa, Homo Sapiens
EAAEAAMAT

SEQ ID NO: 526463 - protein, 9 aa, Homo Sapiens
LPQGIAKPE

SEQ ID NO: 526464 - protein, 9 aa, Homo Sapiens
PYVIIFQNG

SEQ ID NO: 526465 - protein, 9 aa, Homo Sapiens
YRKFSSASH

SEQ ID NO: 526466 - protein, 9 aa, Homo Sapiens
AEAAEAAMA

SEQ ID NO: 526467 - protein, 9 aa, Homo Sapiens
LLKAEIARE

SEQ ID NO: 526468 - protein, 9 aa, Homo Sapiens
AVLNKSLEG

SEQ ID NO: 526469 - protein, 9 aa, Homo Sapiens
APGGRRAGE

SEQ ID NO: 526470 - protein, 9 aa, Homo Sapiens
KKIVNRKTT

SEQ ID NO: 526471 - protein, 9 aa, Homo Sapiens
EERRASYDC

SEQ ID NO: 526472 - protein, 9 aa, Homo Sapiens
CVKALNNFS

SEQ ID NO: 526473 - protein, 9 aa, Homo Sapiens
RRASYDCNQ

SEQ ID NO: 526474 - protein, 9 aa, Homo Sapiens
NSPERRRRP

SEQ ID NO: 526475 - protein, 9 aa, Homo Sapiens
GPRWAVPVH

SEQ ID NO: 526476 - protein, 9 aa, Homo Sapiens
KPLIQDSDF

SEQ ID NO: 526477 - protein, 9 aa, Homo Sapiens
APTSALRET

SEQ ID NO: 526478 - protein, 9 aa, Homo Sapiens
DSYQSEQTL

SEQ ID NO: 526479 - protein, 9 aa, Homo Sapiens
KRDNYLRTI

SEQ ID NO: 526480 - protein, 9 aa, Homo Sapiens
SSPRPPPGE

SEQ ID NO: 526481 - protein, 9 aa, Homo Sapiens
REENILNRE

SEQ ID NO: 526482 - protein, 9 aa, Homo Sapiens
SGVPKRYWG

SEQ ID NO: 526483 - protein, 9 aa, Homo Sapiens
VTGPLGDDA

SEQ ID NO: 526484 - protein, 9 aa, Homo Sapiens
LQDLLGMNN

SEQ ID NO: 526485 - protein, 9 aa, Homo Sapiens
LGMPLTPQQ

SEQ ID NO: 526486 - protein, 9 aa, Homo Sapiens
YELVRGSSL

SEQ ID NO: 526487 - protein, 9 aa, Homo Sapiens
KLEGSDSGL

SEQ ID NO: 526488 - protein, 9 aa, Homo Sapiens
HVLDSGTYV

SEQ ID NO: 526489 - protein, 9 aa, Homo Sapiens
YGYRSAFRC

SEQ ID NO: 526490 - protein, 9 aa, Homo Sapiens
RHRSDYTTL

SEQ ID NO: 526491 - protein, 9 aa, Homo Sapiens
SPQPPPPVA

SEQ ID NO: 526492 - protein, 9 aa, Homo Sapiens
RETSGNTMY

SEQ ID NO: 526493 - protein, 9 aa, Homo Sapiens
QAEGLGALH

SEQ ID NO: 526494 - protein, 9 aa, Homo Sapiens
ERRASYDCN

SEQ ID NO: 526495 - protein, 9 aa, Homo Sapiens
VGEEIRPSI

SEQ ID NO: 526496 - protein, 9 aa, Homo Sapiens
ASGVPKRYW

SEQ ID NO: 526497 - protein, 9 aa, Homo Sapiens
YIAHQMVHT

SEQ ID NO: 526498 - protein, 9 aa, Homo Sapiens
DFNPLSILV

SEQ ID NO: 526499 - protein, 9 aa, Homo Sapiens
GAAVDNKLG

SEQ ID NO: 526500 - protein, 9 aa, Homo Sapiens
PCDLSLNVT

SEQ ID NO: 526501 - protein, 9 aa, Homo Sapiens
QGTPEAYEG

SEQ ID NO: 526502 - protein, 9 aa, Homo Sapiens
VHLLVGPEL

SEQ ID NO: 526503 - protein, 9 aa, Homo Sapiens
GLNNNSPER

SEQ ID NO: 526504 - protein, 9 aa, Homo Sapiens
LVGPELLVL

SEQ ID NO: 526505 - protein, 9 aa, Homo Sapiens
VLQCLATGK

SEQ ID NO: 526506 - protein, 9 aa, Homo Sapiens
MDLRVYGPA

SEQ ID NO: 526507 - protein, 9 aa, Homo Sapiens
STNDVQPGR

SEQ ID NO: 526508 - protein, 9 aa, Homo Sapiens
NPGVEVALL

SEQ ID NO: 526509 - protein, 9 aa, Homo Sapiens
EDVVPQSLQ

SEQ ID NO: 526510 - protein, 9 aa, Homo Sapiens
SINRKLSDH

SEQ ID NO: 526511 - protein, 9 aa, Homo Sapiens
VPVPVPVPM

SEQ ID NO: 526512 - protein, 9 aa, Homo Sapiens
YLMGGTYRY

SEQ ID NO: 526513 - protein, 9 aa, Homo Sapiens
ASPGVLVLS

SEQ ID NO: 526514 - protein, 9 aa, Homo Sapiens
AGGAGLLHL

SEQ ID NO: 526515 - protein, 9 aa, Homo Sapiens
TPAEMLLSD

SEQ ID NO: 526516 - protein, 9 aa, Homo Sapiens
DSDISGDTL

SEQ ID NO: 526517 - protein, 9 aa, Homo Sapiens
PGDSNSPVV

SEQ ID NO: 526518 - protein, 9 aa, Homo Sapiens
PGGSSKDKG

SEQ ID NO: 526519 - protein, 9 aa, Homo Sapiens
RPPPGEQGR

SEQ ID NO: 526520 - protein, 9 aa, Homo Sapiens
TVGNLVGCH

SEQ ID NO: 526521 - protein, 9 aa, Homo Sapiens
HPEDRSDAE

SEQ ID NO: 526522 - protein, 9 aa, Homo Sapiens
PCIGGVPAE

SEQ ID NO: 526523 - protein, 9 aa, Homo Sapiens
LHRAAAAAF

SEQ ID NO: 526524 - protein, 9 aa, Homo Sapiens
ENLIWSSVE

SEQ ID NO: 526525 - protein, 9 aa, Homo Sapiens
AHTGSSNCD

SEQ ID NO: 526526 - protein, 9 aa, Homo Sapiens
PDLGQHCSE

SEQ ID NO: 526527 - protein, 9 aa, Homo Sapiens
LLTMDQIRP

SEQ ID NO: 526528 - protein, 9 aa, Homo Sapiens
PPLDTHSST

SEQ ID NO: 526529 - protein, 9 aa, Homo Sapiens
FPDLGQHCS

SEQ ID NO: 526530 - protein, 9 aa, Homo Sapiens
DPFNRSLLT

SEQ ID NO: 526531 - protein, 9 aa, Homo Sapiens
LDTKERPHH

SEQ ID NO: 526532 - protein, 9 aa, Homo Sapiens
TFEESSEYF

SEQ ID NO: 526533 - protein, 9 aa, Homo Sapiens
MLGACTKGG

SEQ ID NO: 526534 - protein, 9 aa, Homo Sapiens
QEEVVAVLN

SEQ ID NO: 526535 - protein, 9 aa, Homo Sapiens
PTSALRETL

SEQ ID NO: 526536 - protein, 9 aa, Homo Sapiens
KNNGKAHHN

SEQ ID NO: 526537 - protein, 9 aa, Homo Sapiens
SSDYIAHQM

SEQ ID NO: 526538 - protein, 9 aa, Homo Sapiens
HQMVHTGER

SEQ ID NO: 526539 - protein, 9 aa, Homo Sapiens
FALKQLLEV

SEQ ID NO: 526540 - protein, 9 aa, Homo Sapiens
GYRDSWNRE

SEQ ID NO: 526541 - protein, 9 aa, Homo Sapiens
PSKNPEEEQ

SEQ ID NO: 526542 - protein, 9 aa, Homo Sapiens
PHNQFIKIM

SEQ ID NO: 526543 - protein, 9 aa, Homo Sapiens
AVLAFPDDM

SEQ ID NO: 526544 - protein, 9 aa, Homo Sapiens
GSIKTLDTE

SEQ ID NO: 526545 - protein, 9 aa, Homo Sapiens
LENLIWSSV

SEQ ID NO: 526546 - protein, 9 aa, Homo Sapiens
GMPLTPQQA

SEQ ID NO: 526547 - protein, 9 aa, Homo Sapiens
RIKNDPYVI

SEQ ID NO: 526548 - protein, 9 aa, Homo Sapiens
AQEIQEEIG

SEQ ID NO: 526549 - protein, 9 aa, Homo Sapiens
NELVGHQPL

SEQ ID NO: 526550 - protein, 9 aa, Homo Sapiens
VQPCIGGVP

SEQ ID NO: 526551 - protein, 9 aa, Homo Sapiens
DTEPMIRAP

SEQ ID NO: 526552 - protein, 9 aa, Homo Sapiens
AMLEKGEQM

SEQ ID NO: 526553 - protein, 9 aa, Homo Sapiens
FHRKFYSIS

SEQ ID NO: 526554 - protein, 9 aa, Homo Sapiens
EDTHQTRVV

SEQ ID NO: 526555 - protein, 9 aa, Homo Sapiens
VQEGPLDLT

SEQ ID NO: 526556 - protein, 9 aa, Homo Sapiens
SPRPPPGEQ

SEQ ID NO: 526557 - protein, 9 aa, Homo Sapiens
NMNFGISQV

SEQ ID NO: 526558 - protein, 9 aa, Homo Sapiens
RKNNGKAHH

SEQ ID NO: 526559 - protein, 9 aa, Homo Sapiens
CGFLSTITL

SEQ ID NO: 526560 - protein, 9 aa, Homo Sapiens
FELLQQFED

SEQ ID NO: 526561 - protein, 9 aa, Homo Sapiens
NPDSYQSEQ

SEQ ID NO: 526562 - protein, 9 aa, Homo Sapiens
PILFFFFPQ

SEQ ID NO: 526563 - protein, 9 aa, Homo Sapiens
RLHQTLHKE

SEQ ID NO: 526564 - protein, 9 aa, Homo Sapiens
FSAAPAIQL

SEQ ID NO: 526565 - protein, 9 aa, Homo Sapiens
QRGTPSEHE

SEQ ID NO: 526566 - protein, 9 aa, Homo Sapiens
DHLECLICK

SEQ ID NO: 526567 - protein, 9 aa, Homo Sapiens
WSLLKNLHP

SEQ ID NO: 526568 - protein, 9 aa, Homo Sapiens
LRLLWPPPR

SEQ ID NO: 526569 - protein, 9 aa, Homo Sapiens
RGVPACSHV

SEQ ID NO: 526570 - protein, 9 aa, Homo Sapiens
EGMAPPTPS

SEQ ID NO: 526571 - protein, 9 aa, Homo Sapiens
VAEHPEDRS

SEQ ID NO: 526572 - protein, 9 aa, Homo Sapiens
YLEEDNSDK

SEQ ID NO: 526573 - protein, 9 aa, Homo Sapiens
YMDKRRDFT

SEQ ID NO: 526574 - protein, 9 aa, Homo Sapiens
NFIPWLFNE

SEQ ID NO: 526575 - protein, 9 aa, Homo Sapiens
LSTTPGDSN

SEQ ID NO: 526576 - protein, 9 aa, Homo Sapiens
SRDNLISCI

SEQ ID NO: 526577 - protein, 9 aa, Homo Sapiens
VQTGAPGGR

SEQ ID NO: 526578 - protein, 9 aa, Homo Sapiens
KLIEHYEGK

SEQ ID NO: 526579 - protein, 9 aa, Homo Sapiens
GVHGLLAGG

SEQ ID NO: 526580 - protein, 9 aa, Homo Sapiens
SSRQESDTV

SEQ ID NO: 526581 - protein, 9 aa, Homo Sapiens
HRLHAVKPM

SEQ ID NO: 526582 - protein, 9 aa, Homo Sapiens
SYDCNQDRT

SEQ ID NO: 526583 - protein, 9 aa, Homo Sapiens
GVHLLVGPE

SEQ ID NO: 526584 - protein, 9 aa, Homo Sapiens
RRKKAEAAE

SEQ ID NO: 526585 - protein, 9 aa, Homo Sapiens
GSAKHRLHA

SEQ ID NO: 526586 - protein, 9 aa, Homo Sapiens
LTKPYTSSS

SEQ ID NO: 526587 - protein, 9 aa, Homo Sapiens
IKNDPYVII

SEQ ID NO: 526588 - protein, 9 aa, Homo Sapiens
NSDKSDAEG

SEQ ID NO: 526589 - protein, 9 aa, Homo Sapiens
GGRDLLVRD

SEQ ID NO: 526590 - protein, 9 aa, Homo Sapiens
MVSASSPTD

SEQ ID NO: 526591 - protein, 9 aa, Homo Sapiens
THSSTNDVQ

SEQ ID NO: 526592 - protein, 9 aa, Homo Sapiens
NVVNMLGAC

SEQ ID NO: 526593 - protein, 9 aa, Homo Sapiens
DPYVIIFQN

SEQ ID NO: 526594 - protein, 9 aa, Homo Sapiens
DSWNREDAK

SEQ ID NO: 526595 - protein, 9 aa, Homo Sapiens
VVENELVGH

SEQ ID NO: 526596 - protein, 9 aa, Homo Sapiens
LKPFMLSIR

SEQ ID NO: 526597 - protein, 9 aa, Homo Sapiens
HKKIVNRKT

SEQ ID NO: 526598 - protein, 9 aa, Homo Sapiens
ALLVQPCIG

SEQ ID NO: 526599 - protein, 9 aa, Homo Sapiens
KSQEEEDLL

SEQ ID NO: 526600 - protein, 9 aa, Homo Sapiens
LVEVAGACL

SEQ ID NO: 526601 - protein, 9 aa, Homo Sapiens
LATGKWNSV

SEQ ID NO: 526602 - protein, 9 aa, Homo Sapiens
ACDFRIPDK

SEQ ID NO: 526603 - protein, 9 aa, Homo Sapiens
ETEDHLECL

SEQ ID NO: 526604 - protein, 9 aa, Homo Sapiens
ERPSSRANH

SEQ ID NO: 526605 - protein, 9 aa, Homo Sapiens
ERKKLIEHY

SEQ ID NO: 526606 - protein, 9 aa, Homo Sapiens
ALRETLVHL

SEQ ID NO: 526607 - protein, 9 aa, Homo Sapiens
SNIHTIRHT

SEQ ID NO: 526608 - protein, 9 aa, Homo Sapiens
LSPQPPPPV

SEQ ID NO: 526609 - protein, 9 aa, Homo Sapiens
VVPQSLQDL

SEQ ID NO: 526610 - protein, 9 aa, Homo Sapiens
HYEGKLNKA

SEQ ID NO: 526611 - protein, 9 aa, Homo Sapiens
FSHDVYHLT

SEQ ID NO: 526612 - protein, 9 aa, Homo Sapiens
HQTRVVPGA

SEQ ID NO: 526613 - protein, 9 aa, Homo Sapiens
GMVSDLDAD

SEQ ID NO: 526614 - protein, 9 aa, Homo Sapiens
SAKHRLHAV

SEQ ID NO: 526615 - protein, 9 aa, Homo Sapiens
SKNPEEEQK

SEQ ID NO: 526616 - protein, 9 aa, Homo Sapiens
CQPRHFPWA

SEQ ID NO: 526617 - protein, 9 aa, Homo Sapiens
GVMRGVAWA

SEQ ID NO: 526618 - protein, 9 aa, Homo Sapiens
SGLYKERMT

SEQ ID NO: 526619 - protein, 9 aa, Homo Sapiens
LEEDNSDKS

SEQ ID NO: 526620 - protein, 9 aa, Homo Sapiens
RTITATDGT

SEQ ID NO: 526621 - protein, 9 aa, Homo Sapiens
ARPSAGGHS

SEQ ID NO: 526622 - protein, 9 aa, Homo Sapiens
VAAQAELGV

SEQ ID NO: 526623 - protein, 9 aa, Homo Sapiens
SYRFNPDSY

SEQ ID NO: 526624 - protein, 9 aa, Homo Sapiens
EHEAKAETI

SEQ ID NO: 526625 - protein, 9 aa, Homo Sapiens
EATAEVQPP

SEQ ID NO: 526626 - protein, 9 aa, Homo Sapiens
IDRHRSDYT

SEQ ID NO: 526627 - protein, 9 aa, Homo Sapiens
SRANHSSER

SEQ ID NO: 526628 - protein, 9 aa, Homo Sapiens
NRGLNNNSP

SEQ ID NO: 526629 - protein, 9 aa, Homo Sapiens
CFCKDAQGA

SEQ ID NO: 526630 - protein, 9 aa, Homo Sapiens
VNRKSAIKG

SEQ ID NO: 526631 - protein, 9 aa, Homo Sapiens
PAHTCPRGV

SEQ ID NO: 526632 - protein, 9 aa, Homo Sapiens
KILETKWHL

SEQ ID NO: 526633 - protein, 9 aa, Homo Sapiens
SRKVVCGTK

SEQ ID NO: 526634 - protein, 9 aa, Homo Sapiens
VLDSGTYVG

SEQ ID NO: 526635 - protein, 9 aa, Homo Sapiens
AVILQAQGI

SEQ ID NO: 526636 - protein, 9 aa, Homo Sapiens
GAGVHLLVG

SEQ ID NO: 526637 - protein, 9 aa, Homo Sapiens
RDAVILQAQ

SEQ ID NO: 526638 - protein, 9 aa, Homo Sapiens
TGKWNSVPP

SEQ ID NO: 526639 - protein, 9 aa, Homo Sapiens
ILRLEDTHQ

SEQ ID NO: 526640 - protein, 9 aa, Homo Sapiens
GLFQSNDSH

SEQ ID NO: 526641 - protein, 9 aa, Homo Sapiens
AYIHMMPHA

SEQ ID NO: 526642 - protein, 9 aa, Homo Sapiens
GSECAIDRH

SEQ ID NO: 526643 - protein, 9 aa, Homo Sapiens
KRKKDSKNV

SEQ ID NO: 526644 - protein, 9 aa, Homo Sapiens
GPPGLSPQP

SEQ ID NO: 526645 - protein, 9 aa, Homo Sapiens
HAVKPMNAM

SEQ ID NO: 526646 - protein, 9 aa, Homo Sapiens
PRHFPWADG

SEQ ID NO: 526647 - protein, 9 aa, Homo Sapiens
QSKLEGSDS

SEQ ID NO: 526648 - protein, 9 aa, Homo Sapiens
NVTWYLKSA

SEQ ID NO: 526649 - protein, 9 aa, Homo Sapiens
HRAAAAAFG

SEQ ID NO: 526650 - protein, 9 aa, Homo Sapiens
EAFSAAPAI

SEQ ID NO: 526651 - protein, 9 aa, Homo Sapiens
DALLKRIKF

SEQ ID NO: 526652 - protein, 9 aa, Homo Sapiens
ILFFFFPQK

SEQ ID NO: 526653 - protein, 9 aa, Homo Sapiens
PEIKNVVFG

SEQ ID NO: 526654 - protein, 9 aa, Homo Sapiens
DLQQQLAVA

SEQ ID NO: 526655 - protein, 9 aa, Homo Sapiens
GCHKLDRAK

SEQ ID NO: 526656 - protein, 9 aa, Homo Sapiens
LYLRLHQTL

SEQ ID NO: 526657 - protein, 9 aa, Homo Sapiens
NCDISCKGM

SEQ ID NO: 526658 - protein, 9 aa, Homo Sapiens
HRATESHRC

SEQ ID NO: 526659 - protein, 9 aa, Homo Sapiens
KRIKFVVEK

SEQ ID NO: 526660 - protein, 9 aa, Homo Sapiens
RDNLISCIR

SEQ ID NO: 526661 - protein, 9 aa, Homo Sapiens
APCSCGFLS

SEQ ID NO: 526662 - protein, 9 aa, Homo Sapiens
INCKHGKCR

SEQ ID NO: 526663 - protein, 9 aa, Homo Sapiens
CWFFGVNTK

SEQ ID NO: 526664 - protein, 9 aa, Homo Sapiens
ISHSTTGLV

SEQ ID NO: 526665 - protein, 9 aa, Homo Sapiens
IGMPLPPPF

SEQ ID NO: 526666 - protein, 9 aa, Homo Sapiens
NECEHRRIH

SEQ ID NO: 526667 - protein, 9 aa, Homo Sapiens
DRHRSDYTT

SEQ ID NO: 526668 - protein, 9 aa, Homo Sapiens
QWPQLFSRL

SEQ ID NO: 526669 - protein, 9 aa, Homo Sapiens
LEDTHQTRV

SEQ ID NO: 526670 - protein, 9 aa, Homo Sapiens
SDSGLDSYL

SEQ ID NO: 526671 - protein, 9 aa, Homo Sapiens
NASHSRWQG

SEQ ID NO: 526672 - protein, 9 aa, Homo Sapiens
RLQELKRPS

SEQ ID NO: 526673 - protein, 9 aa, Homo Sapiens
GSTCGVSGR

SEQ ID NO: 526674 - protein, 9 aa, Homo Sapiens
VEVAGACLP

SEQ ID NO: 526675 - protein, 9 aa, Homo Sapiens
KSLLLRKPY

SEQ ID NO: 526676 - protein, 9 aa, Homo Sapiens
LIQDSDFKT

SEQ ID NO: 526677 - protein, 9 aa, Homo Sapiens
RKERKNNGK

SEQ ID NO: 526678 - protein, 9 aa, Homo Sapiens
VFELLQQFE

SEQ ID NO: 526679 - protein, 9 aa, Homo Sapiens
HTCPRGVPA

SEQ ID NO: 526680 - protein, 9 aa, Homo Sapiens
VVNQPFSFG

SEQ ID NO: 526681 - protein, 9 aa, Homo Sapiens
AGLFQSNDS

SEQ ID NO: 526682 - protein, 9 aa, Homo Sapiens
MMPHAVTPG

SEQ ID NO: 526683 - protein, 9 aa, Homo Sapiens
DTHQTRVVP

SEQ ID NO: 526684 - protein, 9 aa, Homo Sapiens
LECLICKVG

SEQ ID NO: 526685 - protein, 9 aa, Homo Sapiens
QRNMNFGIS

SEQ ID NO: 526686 - protein, 9 aa, Homo Sapiens
DISGDTLKK

SEQ ID NO: 526687 - protein, 9 aa, Homo Sapiens
VGCHKLDRA

SEQ ID NO: 526688 - protein, 9 aa, Homo Sapiens
QQRILPEAR

SEQ ID NO: 526689 - protein, 9 aa, Homo Sapiens
TCGVSGRVV

SEQ ID NO: 526690 - protein, 9 aa, Homo Sapiens
VDKRSNFLH

SEQ ID NO: 526691 - protein, 9 aa, Homo Sapiens
VCQPRHFPW

SEQ ID NO: 526692 - protein, 9 aa, Homo Sapiens
NAPCSCGFL

SEQ ID NO: 526693 - protein, 9 aa, Homo Sapiens
RTAAGPRWA

SEQ ID NO: 526694 - protein, 9 aa, Homo Sapiens
HQQIELEKV

SEQ ID NO: 526695 - protein, 9 aa, Homo Sapiens
RDCWFFGVN

SEQ ID NO: 526696 - protein, 9 aa, Homo Sapiens
SLLTMDQIR

SEQ ID NO: 526697 - protein, 9 aa, Homo Sapiens
LEDVVPQSL

SEQ ID NO: 526698 - protein, 9 aa, Homo Sapiens
HLLRGAQVH

SEQ ID NO: 526699 - protein, 9 aa, Homo Sapiens
QAPGLVAAG

SEQ ID NO: 526700 - protein, 9 aa, Homo Sapiens
AYQKRVSVR

SEQ ID NO: 526701 - protein, 9 aa, Homo Sapiens
GFAVELPVQ

SEQ ID NO: 526702 - protein, 9 aa, Homo Sapiens
IKTLDTEEE

SEQ ID NO: 526703 - protein, 9 aa, Homo Sapiens
KSAIKGMIR

SEQ ID NO: 526704 - protein, 9 aa, Homo Sapiens
VPQSLQDLL

SEQ ID NO: 526705 - protein, 9 aa, Homo Sapiens
AGGRDLLVR

SEQ ID NO: 526706 - protein, 9 aa, Homo Sapiens
QCLATGKWN

SEQ ID NO: 526707 - protein, 9 aa, Homo Sapiens
RAPEEKNKN

SEQ ID NO: 526708 - protein, 9 aa, Homo Sapiens
KEVVNQPFS

SEQ ID NO: 526709 - protein, 9 aa, Homo Sapiens
VSELHRATE

SEQ ID NO: 526710 - protein, 9 aa, Homo Sapiens
STCGVSGRV

SEQ ID NO: 526711 - protein, 9 aa, Homo Sapiens
QFIKIMIIF

SEQ ID NO: 526712 - protein, 9 aa, Homo Sapiens
RNDKDSLSQ

SEQ ID NO: 526713 - protein, 9 aa, Homo Sapiens
MYTVFHRDK

SEQ ID NO: 526714 - protein, 9 aa, Homo Sapiens
QAVASMVDK

SEQ ID NO: 526715 - protein, 9 aa, Homo Sapiens
EKVNFIPWL

SEQ ID NO: 526716 - protein, 9 aa, Homo Sapiens
QGIAKPEDS

SEQ ID NO: 526717 - protein, 9 aa, Homo Sapiens
AAFLARWAQ

SEQ ID NO: 526718 - protein, 9 aa, Homo Sapiens
FGVNTKIDT

SEQ ID NO: 526719 - protein, 9 aa, Homo Sapiens
NREENILNR

SEQ ID NO: 526720 - protein, 9 aa, Homo Sapiens
KDAKALFKC

SEQ ID NO: 526721 - protein, 9 aa, Homo Sapiens
IHMMPHAVT

SEQ ID NO: 526722 - protein, 9 aa, Homo Sapiens
SSAELAFGK

SEQ ID NO: 526723 - protein, 9 aa, Homo Sapiens
PCQAINCKH

SEQ ID NO: 526724 - protein, 9 aa, Homo Sapiens
LHTPIMIGI

SEQ ID NO: 526725 - protein, 9 aa, Homo Sapiens
DVPWTGMLA

SEQ ID NO: 526726 - protein, 9 aa, Homo Sapiens
LIQDQTEEE

SEQ ID NO: 526727 - protein, 9 aa, Homo Sapiens
DAKALFKCF

SEQ ID NO: 526728 - protein, 9 aa, Homo Sapiens
VALLVQPCI

SEQ ID NO: 526729 - protein, 9 aa, Homo Sapiens
QIERGDARI

SEQ ID NO: 526730 - protein, 9 aa, Homo Sapiens
VGRLGLAQS

SEQ ID NO: 526731 - protein, 9 aa, Homo Sapiens
SHFIDGKGS

SEQ ID NO: 526732 - protein, 9 aa, Homo Sapiens
QSLRAAGMV

SEQ ID NO: 526733 - protein, 9 aa, Homo Sapiens
SDACGLIRC

SEQ ID NO: 526734 - protein, 9 aa, Homo Sapiens
CPPAHTCPR

SEQ ID NO: 526735 - protein, 9 aa, Homo Sapiens
YRDSWNRED

SEQ ID NO: 526736 - protein, 9 aa, Homo Sapiens
IRCLLMVNP

SEQ ID NO: 526737 - protein, 9 aa, Homo Sapiens
FPQKVSELH

SEQ ID NO: 526738 - protein, 9 aa, Homo Sapiens
RITRLQELK

SEQ ID NO: 526739 - protein, 9 aa, Homo Sapiens
DKRASPATS

SEQ ID NO: 526740 - protein, 9 aa, Homo Sapiens
LVVVAFALK

SEQ ID NO: 526741 - protein, 9 aa, Homo Sapiens
NETEDHLEC

SEQ ID NO: 526742 - protein, 9 aa, Homo Sapiens
LTAADFRLK

SEQ ID NO: 526743 - protein, 9 aa, Homo Sapiens
LLVLLAAKP

SEQ ID NO: 526744 - protein, 9 aa, Homo Sapiens
SQRGTPSEH

SEQ ID NO: 526745 - protein, 9 aa, Homo Sapiens
NLVGCHKLD

SEQ ID NO: 526746 - protein, 9 aa, Homo Sapiens
PVGNREENI

SEQ ID NO: 526747 - protein, 9 aa, Homo Sapiens
PELLVLLAA

SEQ ID NO: 526748 - protein, 9 aa, Homo Sapiens
VMRGVAWAA

SEQ ID NO: 526749 - protein, 9 aa, Homo Sapiens
QQSLRAAGM

SEQ ID NO: 526750 - protein, 9 aa, Homo Sapiens
LRNIRTVKS

SEQ ID NO: 526751 - protein, 9 aa, Homo Sapiens
SSSIDKNVI

SEQ ID NO: 526752 - protein, 9 aa, Homo Sapiens
QWPAKLPVP

SEQ ID NO: 526753 - protein, 9 aa, Homo Sapiens
LACDFRIPD

SEQ ID NO: 526754 - protein, 9 aa, Homo Sapiens
DLSLNVTWY

SEQ ID NO: 526755 - protein, 9 aa, Homo Sapiens
GVPKRYWGR

SEQ ID NO: 526756 - protein, 9 aa, Homo Sapiens
SFGDKEKNK

SEQ ID NO: 526757 - protein, 9 aa, Homo Sapiens
QERYYGYRS

SEQ ID NO: 526758 - protein, 9 aa, Homo Sapiens
GAGLLHLGP

SEQ ID NO: 526759 - protein, 9 aa, Homo Sapiens
PAEEATAEV

SEQ ID NO: 526760 - protein, 9 aa, Homo Sapiens
RCLRIPPPG

SEQ ID NO: 526761 - protein, 9 aa, Homo Sapiens
QHCSEKTCK

SEQ ID NO: 526762 - protein, 9 aa, Homo Sapiens
FVDTFSHDV

SEQ ID NO: 526763 - protein, 9 aa, Homo Sapiens
QVHLQPLIV

SEQ ID NO: 526764 - protein, 9 aa, Homo Sapiens
MCHREQMKS

SEQ ID NO: 526765 - protein, 9 aa, Homo Sapiens
FQSNDSHET

SEQ ID NO: 526766 - protein, 9 aa, Homo Sapiens
VPDATLSNL

SEQ ID NO: 526767 - protein, 9 aa, Homo Sapiens
TTPGDSNSP

SEQ ID NO: 526768 - protein, 9 aa, Homo Sapiens
ANHSSERPP

SEQ ID NO: 526769 - protein, 9 aa, Homo Sapiens
SSRANHSSE

SEQ ID NO: 526770 - protein, 9 aa, Homo Sapiens
AEHPEDRSD

SEQ ID NO: 526771 - protein, 9 aa, Homo Sapiens
GTKLHTPIM

SEQ ID NO: 526772 - protein, 9 aa, Homo Sapiens
IHTIRHTGK

SEQ ID NO: 526773 - protein, 9 aa, Homo Sapiens
ALKKDEDVP

SEQ ID NO: 526774 - protein, 9 aa, Homo Sapiens
TRVLDLQQQ

SEQ ID NO: 526775 - protein, 9 aa, Homo Sapiens
IVAIKDFNP

SEQ ID NO: 526776 - protein, 9 aa, Homo Sapiens
FLEQCPISG

SEQ ID NO: 526777 - protein, 9 aa, Homo Sapiens
VVIIRNGPS

SEQ ID NO: 526778 - protein, 9 aa, Homo Sapiens
YSITVKKLK

SEQ ID NO: 526779 - protein, 9 aa, Homo Sapiens
HARYELVRG

SEQ ID NO: 526780 - protein, 9 aa, Homo Sapiens
EEDNSDKSD

SEQ ID NO: 526781 - protein, 9 aa, Homo Sapiens
VLVLSPVRT

SEQ ID NO: 526782 - protein, 9 aa, Homo Sapiens
LIVFAVMAY

SEQ ID NO: 526783 - protein, 9 aa, Homo Sapiens
PQAEGLGAL

SEQ ID NO: 526784 - protein, 9 aa, Homo Sapiens
VAPRNPGVE

SEQ ID NO: 526785 - protein, 9 aa, Homo Sapiens
EPCDLSLNV

SEQ ID NO: 526786 - protein, 9 aa, Homo Sapiens
STTPGDSNS

SEQ ID NO: 526787 - protein, 9 aa, Homo Sapiens
IWSSVEDNC

SEQ ID NO: 526788 - protein, 9 aa, Homo Sapiens
RASGVPKRY

SEQ ID NO: 526789 - protein, 9 aa, Homo Sapiens
HAWSYGIVM

SEQ ID NO: 526790 - protein, 9 aa, Homo Sapiens
PFMLSIRRE

SEQ ID NO: 526791 - protein, 9 aa, Homo Sapiens
SYSITVKKL

SEQ ID NO: 526792 - protein, 9 aa, Homo Sapiens
ALLRLLWPP

SEQ ID NO: 526793 - protein, 9 aa, Homo Sapiens
PTPSKNPEE

SEQ ID NO: 526794 - protein, 9 aa, Homo Sapiens
ELLQQFEDA

SEQ ID NO: 526795 - protein, 9 aa, Homo Sapiens
PQGIAKPED

SEQ ID NO: 526796 - protein, 9 aa, Homo Sapiens
LSLNVTWYL

SEQ ID NO: 526797 - protein, 9 aa, Homo Sapiens
FFFFPQKVS

SEQ ID NO: 526798 - protein, 9 aa, Homo Sapiens
LSIRREEST

SEQ ID NO: 526799 - protein, 9 aa, Homo Sapiens
IKIMIIFSI

SEQ ID NO: 526800 - protein, 9 aa, Homo Sapiens
VRTVITVGN

SEQ ID NO: 526801 - protein, 9 aa, Homo Sapiens
NNSPERRRR

SEQ ID NO: 526802 - protein, 9 aa, Homo Sapiens
VPVPMPVPV

SEQ ID NO: 526803 - protein, 9 aa, Homo Sapiens
VLSPVRTVI

SEQ ID NO: 526804 - protein, 9 aa, Homo Sapiens
AEARVVENE

SEQ ID NO: 526805 - protein, 9 aa, Homo Sapiens
VVDLAYQKR

SEQ ID NO: 526806 - protein, 9 aa, Homo Sapiens
MFAYHVPDA

SEQ ID NO: 526807 - protein, 9 aa, Homo Sapiens
ECVKALNNF

SEQ ID NO: 526808 - protein, 9 aa, Homo Sapiens
GVLVLSPVR

SEQ ID NO: 526809 - protein, 9 aa, Homo Sapiens
TKKLYEEDD

SEQ ID NO: 526810 - protein, 9 aa, Homo Sapiens
VTVSPDGSF

SEQ ID NO: 526811 - protein, 9 aa, Homo Sapiens
GNREENILN

SEQ ID NO: 526812 - protein, 9 aa, Homo Sapiens
PLDTHSSTN

SEQ ID NO: 526813 - protein, 9 aa, Homo Sapiens
DNSDKSDAE

SEQ ID NO: 526814 - protein, 9 aa, Homo Sapiens
SDYIAHQMV

SEQ ID NO: 526815 - protein, 9 aa, Homo Sapiens
MTDGAPLGK

SEQ ID NO: 526816 - protein, 9 aa, Homo Sapiens
FRDPKAEEN

SEQ ID NO: 526817 - protein, 9 aa, Homo Sapiens
SEHEAKAET

SEQ ID NO: 526818 - protein, 9 aa, Homo Sapiens
KRDIIFVLD

SEQ ID NO: 526819 - protein, 9 aa, Homo Sapiens
SSASHAWSY

SEQ ID NO: 526820 - protein, 9 aa, Homo Sapiens
LTAPTSALR

SEQ ID NO: 526821 - protein, 9 aa, Homo Sapiens
CGLIRCLLM

SEQ ID NO: 526822 - protein, 9 aa, Homo Sapiens
AINCKHGKC

SEQ ID NO: 526823 - protein, 9 aa, Homo Sapiens
KFSSASHAW

SEQ ID NO: 526824 - protein, 9 aa, Homo Sapiens
LIEHYEGKL

SEQ ID NO: 526825 - protein, 9 aa, Homo Sapiens
VKALNNFSA

SEQ ID NO: 526826 - protein, 9 aa, Homo Sapiens
NTVQVKNVM

SEQ ID NO: 526827 - protein, 9 aa, Homo Sapiens
SAELAFGKT

SEQ ID NO: 526828 - protein, 9 aa, Homo Sapiens
QSLQDLLGM

SEQ ID NO: 526829 - protein, 9 aa, Homo Sapiens
PPWIGMPLP

SEQ ID NO: 526830 - protein, 9 aa, Homo Sapiens
VELDTKERP

SEQ ID NO: 526831 - protein, 9 aa, Homo Sapiens
LQAVASMVD

SEQ ID NO: 526832 - protein, 9 aa, Homo Sapiens
HTKLYFFQW

SEQ ID NO: 526833 - protein, 9 aa, Homo Sapiens
VASMVDKRA

SEQ ID NO: 526834 - protein, 9 aa, Homo Sapiens
FTEAFSAAP

SEQ ID NO: 526835 - protein, 9 aa, Homo Sapiens
IQEEIGELL

SEQ ID NO: 526836 - protein, 9 aa, Homo Sapiens
PYKCNECEH

SEQ ID NO: 526837 - protein, 9 aa, Homo Sapiens
NLIWSSVED

SEQ ID NO: 526838 - protein, 9 aa, Homo Sapiens
LRGAQVHLQ

SEQ ID NO: 526839 - protein, 9 aa, Homo Sapiens
AYHVPDATL

SEQ ID NO: 526840 - protein, 9 aa, Homo Sapiens
TDSSRQESD

SEQ ID NO: 526841 - protein, 9 aa, Homo Sapiens
FIDGKGSTG

SEQ ID NO: 526842 - protein, 9 aa, Homo Sapiens
PSINRKLSD

SEQ ID NO: 526843 - protein, 9 aa, Homo Sapiens
GLSPQPPPP

SEQ ID NO: 526844 - protein, 9 aa, Homo Sapiens
SQEEEDLLR

SEQ ID NO: 526845 - protein, 9 aa, Homo Sapiens
SPVAEHPED

SEQ ID NO: 526846 - protein, 9 aa, Homo Sapiens
LTVFSLNQE

SEQ ID NO: 526847 - protein, 9 aa, Homo Sapiens
FYRDCWFFG

SEQ ID NO: 526848 - protein, 9 aa, Homo Sapiens
REAKNLCSQ

SEQ ID NO: 526849 - protein, 9 aa, Homo Sapiens
DAQGADSVE

SEQ ID NO: 526850 - protein, 9 aa, Homo Sapiens
QNSKEEVYR

SEQ ID NO: 526851 - protein, 9 aa, Homo Sapiens
PVVIIRNGP

SEQ ID NO: 526852 - protein, 9 aa, Homo Sapiens
PFPPPWIGM

SEQ ID NO: 526853 - protein, 9 aa, Homo Sapiens
SCGFLSTIT

SEQ ID NO: 526854 - protein, 9 aa, Homo Sapiens
NRLRPLPSP

SEQ ID NO: 526855 - protein, 9 aa, Homo Sapiens
VQRGVAAQA

SEQ ID NO: 526856 - protein, 9 aa, Homo Sapiens
YLYVELDTK

SEQ ID NO: 526857 - protein, 9 aa, Homo Sapiens
CLICKVGEK

SEQ ID NO: 526858 - protein, 9 aa, Homo Sapiens
DDMDLRVYG

SEQ ID NO: 526859 - protein, 9 aa, Homo Sapiens
LSTDSSRQE

SEQ ID NO: 526860 - protein, 9 aa, Homo Sapiens
TCSLPQGIA

SEQ ID NO: 526861 - protein, 9 aa, Homo Sapiens
CMICFTEAF

SEQ ID NO: 526862 - protein, 9 aa, Homo Sapiens
CPRGVPACS

SEQ ID NO: 526863 - protein, 9 aa, Homo Sapiens
SYQSEQTLC

SEQ ID NO: 526864 - protein, 9 aa, Homo Sapiens
AGLLHLGPQ

SEQ ID NO: 526865 - protein, 9 aa, Homo Sapiens
AQAELGVTV

SEQ ID NO: 526866 - protein, 9 aa, Homo Sapiens
ACGLIRCLL

SEQ ID NO: 526867 - protein, 9 aa, Homo Sapiens
ELVRGSSLS

SEQ ID NO: 526868 - protein, 9 aa, Homo Sapiens
EECVKALNN

SEQ ID NO: 526869 - protein, 9 aa, Homo Sapiens
MIRAPEEKN

SEQ ID NO: 526870 - protein, 9 aa, Homo Sapiens
QPLHGVHGL

SEQ ID NO: 526871 - protein, 9 aa, Homo Sapiens
TTNDLVQGY

SEQ ID NO: 526872 - protein, 9 aa, Homo Sapiens
LVGRLGLAQ

SEQ ID NO: 526873 - protein, 9 aa, Homo Sapiens
LNKSLEGAD

SEQ ID NO: 526874 - protein, 9 aa, Homo Sapiens
TFSHDVYHL

SEQ ID NO: 526875 - protein, 9 aa, Homo Sapiens
LERKKLIEH

SEQ ID NO: 526876 - protein, 9 aa, Homo Sapiens
KSDAEGEHG

SEQ ID NO: 526877 - protein, 9 aa, Homo Sapiens
STDSSRQES

SEQ ID NO: 526878 - protein, 9 aa, Homo Sapiens
LGPPATEGS

SEQ ID NO: 526879 - protein, 9 aa, Homo Sapiens
IDYMDKRRD

SEQ ID NO: 526880 - protein, 9 aa, Homo Sapiens
AGLVEVAGA

SEQ ID NO: 526881 - protein, 9 aa, Homo Sapiens
DLLVRDAVI

SEQ ID NO: 526882 - protein, 9 aa, Homo Sapiens
NAETDELLR

SEQ ID NO: 526883 - protein, 9 aa, Homo Sapiens
AHTCPRGVP

SEQ ID NO: 526884 - protein, 9 aa, Homo Sapiens
FYSISGEVY

SEQ ID NO: 526885 - protein, 9 aa, Homo Sapiens
KPLVVVAFA

SEQ ID NO: 526886 - protein, 9 aa, Homo Sapiens
VAAGGRDLL

SEQ ID NO: 526887 - protein, 9 aa, Homo Sapiens
AREEKMKEP

SEQ ID NO: 526888 - protein, 9 aa, Homo Sapiens
DSGTYVGGH

SEQ ID NO: 526889 - protein, 9 aa, Homo Sapiens
QTGAPGGRR

SEQ ID NO: 526890 - protein, 9 aa, Homo Sapiens
MQAPGLVAA

SEQ ID NO: 526891 - protein, 9 aa, Homo Sapiens
VIIRNGPSG

SEQ ID NO: 526892 - protein, 9 aa, Homo Sapiens
FLHRQVLQV

SEQ ID NO: 526893 - protein, 9 aa, Homo Sapiens
NLKREAKNL

SEQ ID NO: 526894 - protein, 9 aa, Homo Sapiens
LRLHQTLHK

SEQ ID NO: 526895 - protein, 9 aa, Homo Sapiens
FSNSNIHTI

SEQ ID NO: 526896 - protein, 9 aa, Homo Sapiens
MARLGSTCG

SEQ ID NO: 526897 - protein, 9 aa, Homo Sapiens
RETRITRLQ

SEQ ID NO: 526898 - protein, 9 aa, Homo Sapiens
CEECVKALN

SEQ ID NO: 526899 - protein, 9 aa, Homo Sapiens
LNVTWYLKS

SEQ ID NO: 526900 - protein, 9 aa, Homo Sapiens
HSSTNDVQP

SEQ ID NO: 526901 - protein, 9 aa, Homo Sapiens
TAYWMPAEN

SEQ ID NO: 526902 - protein, 9 aa, Homo Sapiens
VSASSPTDS

SEQ ID NO: 526903 - protein, 9 aa, Homo Sapiens
CAIDRHRSD

SEQ ID NO: 526904 - protein, 9 aa, Homo Sapiens
SIGKKWKYQ

SEQ ID NO: 526905 - protein, 9 aa, Homo Sapiens
LKNIKKMCH

SEQ ID NO: 526906 - protein, 9 aa, Homo Sapiens
NIHTIRHTG

SEQ ID NO: 526907 - protein, 9 aa, Homo Sapiens
QLACDFRIP

SEQ ID NO: 526908 - protein, 9 aa, Homo Sapiens
RREESTCTA

SEQ ID NO: 526909 - protein, 9 aa, Homo Sapiens
FMLSIRREE

SEQ ID NO: 526910 - protein, 9 aa, Homo Sapiens
ARVVDLAYQ

SEQ ID NO: 526911 - protein, 9 aa, Homo Sapiens
KWNSVPPEC

SEQ ID NO: 526912 - protein, 9 aa, Homo Sapiens
GALHRAAAA

SEQ ID NO: 526913 - protein, 9 aa, Homo Sapiens
YFFQWLSVF

SEQ ID NO: 526914 - protein, 9 aa, Homo Sapiens
RAEQLACDF

SEQ ID NO: 526915 - protein, 9 aa, Homo Sapiens
NKRFLAKVF

SEQ ID NO: 526916 - protein, 9 aa, Homo Sapiens
TMYTVFHRD

SEQ ID NO: 526917 - protein, 9 aa, Homo Sapiens
FFPQKVSEL

SEQ ID NO: 526918 - protein, 9 aa, Homo Sapiens
RNGTDKDAK

SEQ ID NO: 526919 - protein, 9 aa, Homo Sapiens
RKVVCGTKC

SEQ ID NO: 526920 - protein, 9 aa, Homo Sapiens
IGASVQLTA

SEQ ID NO: 526921 - protein, 9 aa, Homo Sapiens
EHPEDRSDA

SEQ ID NO: 526922 - protein, 9 aa, Homo Sapiens
ESTAIISHS

SEQ ID NO: 526923 - protein, 9 aa, Homo Sapiens
RGSRTAAGP

SEQ ID NO: 526924 - protein, 9 aa, Homo Sapiens
YANMAREQH

SEQ ID NO: 526925 - protein, 9 aa, Homo Sapiens
TLRGSRTAA

SEQ ID NO: 526926 - protein, 9 aa, Homo Sapiens
QAINCKHGK

SEQ ID NO: 526927 - protein, 9 aa, Homo Sapiens
PFLEQCPIS

SEQ ID NO: 526928 - protein, 9 aa, Homo Sapiens
RPSINRKLS

SEQ ID NO: 526929 - protein, 9 aa, Homo Sapiens
LGLAQSRNA

SEQ ID NO: 526930 - protein, 9 aa, Homo Sapiens
GGSSKDKGG

SEQ ID NO: 526931 - protein, 9 aa, Homo Sapiens
PPELILYAN

SEQ ID NO: 526932 - protein, 9 aa, Homo Sapiens
LDALLKRIK

SEQ ID NO: 526933 - protein, 9 aa, Homo Sapiens
QGQPCFCKD

SEQ ID NO: 526934 - protein, 9 aa, Homo Sapiens
QAENSLQEV

SEQ ID NO: 526935 - protein, 9 aa, Homo Sapiens
RSAFRCLVE

SEQ ID NO: 526936 - protein, 9 aa, Homo Sapiens
MPVPVPEPG

SEQ ID NO: 526937 - protein, 9 aa, Homo Sapiens
PPTKSLLLR

SEQ ID NO: 526938 - protein, 9 aa, Homo Sapiens
GLRAVGLYR

SEQ ID NO: 526939 - protein, 9 aa, Homo Sapiens
RIAIPLGVT

SEQ ID NO: 526940 - protein, 9 aa, Homo Sapiens
LAKVFPSPM

SEQ ID NO: 526941 - protein, 9 aa, Homo Sapiens
QKRVSVRWS

SEQ ID NO: 526942 - protein, 9 aa, Homo Sapiens
PAEMLLSDS

SEQ ID NO: 526943 - protein, 9 aa, Homo Sapiens
DYDSGFRCS

SEQ ID NO: 526944 - protein, 9 aa, Homo Sapiens
TDGAPLGKI

SEQ ID NO: 526945 - protein, 9 aa, Homo Sapiens
YRYTYTRKR

SEQ ID NO: 526946 - protein, 9 aa, Homo Sapiens
SKKRKKDSK

SEQ ID NO: 526947 - protein, 9 aa, Homo Sapiens
RDNYLRTIT

SEQ ID NO: 526948 - protein, 9 aa, Homo Sapiens
DDACHLLRG

SEQ ID NO: 526949 - protein, 9 aa, Homo Sapiens
LQQEFVNFL

SEQ ID NO: 526950 - protein, 9 aa, Homo Sapiens
DLAYQKRVS

SEQ ID NO: 526951 - protein, 9 aa, Homo Sapiens
VVTELIVFA

SEQ ID NO: 526952 - protein, 9 aa, Homo Sapiens
NDLVQGYDS

SEQ ID NO: 526953 - protein, 9 aa, Homo Sapiens
LDSGTYVGG

SEQ ID NO: 526954 - protein, 9 aa, Homo Sapiens
PQKVSELHR

SEQ ID NO: 526955 - protein, 9 aa, Homo Sapiens
CCTKKLYEE

SEQ ID NO: 526956 - protein, 9 aa, Homo Sapiens
MAALLRLLW

SEQ ID NO: 526957 - protein, 9 aa, Homo Sapiens
SKNVEENSK

SEQ ID NO: 526958 - protein, 9 aa, Homo Sapiens
NYCEDSFRN

SEQ ID NO: 526959 - protein, 9 aa, Homo Sapiens
ERDAGLGPP

SEQ ID NO: 526960 - protein, 9 aa, Homo Sapiens
QQEFVNFLL

SEQ ID NO: 526961 - protein, 9 aa, Homo Sapiens
PSRRSNRLR

SEQ ID NO: 526962 - protein, 9 aa, Homo Sapiens
NLHPDVKAS

SEQ ID NO: 526963 - protein, 9 aa, Homo Sapiens
DLVQGYDST

SEQ ID NO: 526964 - protein, 9 aa, Homo Sapiens
FNPDSYQSE

SEQ ID NO: 526965 - protein, 9 aa, Homo Sapiens
GQHCSEKTC

SEQ ID NO: 526966 - protein, 9 aa, Homo Sapiens
LSFLTEQFC

SEQ ID NO: 526967 - protein, 9 aa, Homo Sapiens
QLKNIKKMC

SEQ ID NO: 526968 - protein, 9 aa, Homo Sapiens
MRGVAWAAP

SEQ ID NO: 526969 - protein, 9 aa, Homo Sapiens
QEVQEGPLD

SEQ ID NO: 526970 - protein, 9 aa, Homo Sapiens
TDKDAKALF

SEQ ID NO: 526971 - protein, 9 aa, Homo Sapiens
QSRNAFALY

SEQ ID NO: 526972 - protein, 9 aa, Homo Sapiens
LMGGTYRYT

SEQ ID NO: 526973 - protein, 9 aa, Homo Sapiens
PQLFSRLFE

SEQ ID NO: 526974 - protein, 9 aa, Homo Sapiens
SKLSLQLEN

SEQ ID NO: 526975 - protein, 9 aa, Homo Sapiens
RSNRLRPLP

SEQ ID NO: 526976 - protein, 9 aa, Homo Sapiens
AEMLLSDSI

SEQ ID NO: 526977 - protein, 9 aa, Homo Sapiens
RNGPSGICL

SEQ ID NO: 526978 - protein, 9 aa, Homo Sapiens
HMMPHAVTP

SEQ ID NO: 526979 - protein, 9 aa, Homo Sapiens
RDSWNREDA

SEQ ID NO: 526980 - protein, 9 aa, Homo Sapiens
QPFSFGDKE

SEQ ID NO: 526981 - protein, 9 aa, Homo Sapiens
NKRDIIFVL

SEQ ID NO: 526982 - protein, 9 aa, Homo Sapiens
VRDAVILQA

SEQ ID NO: 526983 - protein, 9 aa, Homo Sapiens
LILYANMAR

SEQ ID NO: 526984 - protein, 9 aa, Homo Sapiens
LQCLATGKW

SEQ ID NO: 526985 - protein, 9 aa, Homo Sapiens
QTPAEMLLS

SEQ ID NO: 526986 - protein, 9 aa, Homo Sapiens
IDNARLTAA

SEQ ID NO: 526987 - protein, 9 aa, Homo Sapiens
LLTAPTSAL

SEQ ID NO: 526988 - protein, 9 aa, Homo Sapiens
LVKSLSTDS

SEQ ID NO: 526989 - protein, 9 aa, Homo Sapiens
DSFRNDKDS

SEQ ID NO: 526990 - protein, 9 aa, Homo Sapiens
GFRCSSSPS

SEQ ID NO: 526991 - protein, 9 aa, Homo Sapiens
PLVVVAFAL

SEQ ID NO: 526992 - protein, 9 aa, Homo Sapiens
PAHHPGCQL

SEQ ID NO: 526993 - protein, 9 aa, Homo Sapiens
RVLDLQQQL

SEQ ID NO: 526994 - protein, 9 aa, Homo Sapiens
KSLSTDSSR

SEQ ID NO: 526995 - protein, 9 aa, Homo Sapiens
SELHRATES

SEQ ID NO: 526996 - protein, 9 aa, Homo Sapiens
SQWLNSRKV

SEQ ID NO: 526997 - protein, 9 aa, Homo Sapiens
YQKRVSVRW

SEQ ID NO: 526998 - protein, 9 aa, Homo Sapiens
TAPTSALRE

SEQ ID NO: 526999 - protein, 9 aa, Homo Sapiens
EDLTAASPG

SEQ ID NO: 527000 - protein, 9 aa, Homo Sapiens
PPPWIGMPL

SEQ ID NO: 527001 - protein, 9 aa, Homo Sapiens
NVVFGKTSA

SEQ ID NO: 527002 - protein, 9 aa, Homo Sapiens
KKDEDVPWT

SEQ ID NO: 527003 - protein, 9 aa, Homo Sapiens
SLRNKEVKH

SEQ ID NO: 527004 - protein, 9 aa, Homo Sapiens
DYIAHQMVH

SEQ ID NO: 527005 - protein, 9 aa, Homo Sapiens
STAIISHST

SEQ ID NO: 527006 - protein, 9 aa, Homo Sapiens
AQGIGASVQ

SEQ ID NO: 527007 - protein, 9 aa, Homo Sapiens
LLQQFEDAL

SEQ ID NO: 527008 - protein, 9 aa, Homo Sapiens
PAPGGSSKD

SEQ ID NO: 527009 - protein, 9 aa, Homo Sapiens
LENAETDEL

SEQ ID NO: 527010 - protein, 9 aa, Homo Sapiens
KKWKYQNIE

SEQ ID NO: 527011 - protein, 9 aa, Homo Sapiens
HHARYELVR

SEQ ID NO: 527012 - protein, 9 aa, Homo Sapiens
GNLVGCHKL

SEQ ID NO: 527013 - protein, 9 aa, Homo Sapiens
TSGNTMYTV

SEQ ID NO: 527014 - protein, 9 aa, Homo Sapiens
IQDSDFKTS

SEQ ID NO: 527015 - protein, 9 aa, Homo Sapiens
VHLQPLIVT

SEQ ID NO: 527016 - protein, 9 aa, Homo Sapiens
FIPWLFNET

SEQ ID NO: 527017 - protein, 9 aa, Homo Sapiens
LGAGVHLLV

SEQ ID NO: 527018 - protein, 9 aa, Homo Sapiens
SYFGTKLHT

SEQ ID NO: 527019 - protein, 9 aa, Homo Sapiens
VLGVQTGAP

SEQ ID NO: 527020 - protein, 9 aa, Homo Sapiens
KCEECVKAL

SEQ ID NO: 527021 - protein, 9 aa, Homo Sapiens
AVELPVQRG

SEQ ID NO: 527022 - protein, 9 aa, Homo Sapiens
IAREEKMKE

SEQ ID NO: 527023 - protein, 9 aa, Homo Sapiens
YVNRKSAIK

SEQ ID NO: 527024 - protein, 9 aa, Homo Sapiens
RKFSSASHA

SEQ ID NO: 527025 - protein, 9 aa, Homo Sapiens
KVTGPLGDD

SEQ ID NO: 527026 - protein, 9 aa, Homo Sapiens
LKNLHPDVK

SEQ ID NO: 527027 - protein, 9 aa, Homo Sapiens
EGSDSGLDS

SEQ ID NO: 527028 - protein, 9 aa, Homo Sapiens
AVDNKLGFG

SEQ ID NO: 527029 - protein, 9 aa, Homo Sapiens
GDARIQRRI

SEQ ID NO: 527030 - protein, 9 aa, Homo Sapiens
LARWAQEAY

SEQ ID NO: 527031 - protein, 9 aa, Homo Sapiens
FVNFLLLHY

SEQ ID NO: 527032 - protein, 9 aa, Homo Sapiens
YRFNPDSYQ

SEQ ID NO: 527033 - protein, 9 aa, Homo Sapiens
SLQTRVLDL

SEQ ID NO: 527034 - protein, 9 aa, Homo Sapiens
SEYFPHFSE

SEQ ID NO: 527035 - protein, 9 aa, Homo Sapiens
DARIQRRIS

SEQ ID NO: 527036 - protein, 9 aa, Homo Sapiens
LKRIKFVVE

SEQ ID NO: 527037 - protein, 9 aa, Homo Sapiens
FGWGQNVND

SEQ ID NO: 527038 - protein, 9 aa, Homo Sapiens
GKKWKYQNI

SEQ ID NO: 527039 - protein, 9 aa, Homo Sapiens
LKAEIAREE

SEQ ID NO: 527040 - protein, 9 aa, Homo Sapiens
LAFVFELLQ

SEQ ID NO: 527041 - protein, 9 aa, Homo Sapiens
PLGDDACHL

SEQ ID NO: 527042 - protein, 9 aa, Homo Sapiens
HGLLAGGAG

SEQ ID NO: 527043 - protein, 9 aa, Homo Sapiens
GVEVALLVQ

SEQ ID NO: 527044 - protein, 9 aa, Homo Sapiens
QTDPFNRSL

SEQ ID NO: 527045 - protein, 9 aa, Homo Sapiens
EDNSDKSDA

SEQ ID NO: 527046 - protein, 9 aa, Homo Sapiens
VYGLFMLHK

SEQ ID NO: 527047 - protein, 9 aa, Homo Sapiens
YRSAFRCLV

SEQ ID NO: 527048 - protein, 9 aa, Homo Sapiens
DSSRQESDT

SEQ ID NO: 527049 - protein, 9 aa, Homo Sapiens
ALGMPLTPQ

SEQ ID NO: 527050 - protein, 9 aa, Homo Sapiens
TSALRETLV

SEQ ID NO: 527051 - protein, 9 aa, Homo Sapiens
SFRNDKDSL

SEQ ID NO: 527052 - protein, 9 aa, Homo Sapiens
EVSEQQNSK

SEQ ID NO: 527053 - protein, 9 aa, Homo Sapiens
AAAAFGVMR

SEQ ID NO: 527054 - protein, 9 aa, Homo Sapiens
HLDALLKRI

SEQ ID NO: 527055 - protein, 9 aa, Homo Sapiens
DSGFRCSSS

SEQ ID NO: 527056 - protein, 9 aa, Homo Sapiens
KLKLLFSML

SEQ ID NO: 527057 - protein, 9 aa, Homo Sapiens
RASYDCNQD

SEQ ID NO: 527058 - protein, 9 aa, Homo Sapiens
LDECTFRDP

SEQ ID NO: 527059 - protein, 9 aa, Homo Sapiens
ISCLENLIW

SEQ ID NO: 527060 - protein, 9 aa, Homo Sapiens
REKRDNYLR

SEQ ID NO: 527061 - protein, 9 aa, Homo Sapiens
RWQGTPEAY

SEQ ID NO: 527062 - protein, 9 aa, Homo Sapiens
PWLFNETSL

SEQ ID NO: 527063 - protein, 9 aa, Homo Sapiens
ADIDYMDKR

SEQ ID NO: 527064 - protein, 9 aa, Homo Sapiens
SNCDISCKG

SEQ ID NO: 527065 - protein, 9 aa, Homo Sapiens
HMKVHRQGP

SEQ ID NO: 527066 - protein, 9 aa, Homo Sapiens
GFPFPPPWI

SEQ ID NO: 527067 - protein, 9 aa, Homo Sapiens
VHRQGPHHV

SEQ ID NO: 527068 - protein, 9 aa, Homo Sapiens
PLIQDSDFK

SEQ ID NO: 527069 - protein, 9 aa, Homo Sapiens
RYELVRGSS

SEQ ID NO: 527070 - protein, 9 aa, Homo Sapiens
IVTVAPRNP

SEQ ID NO: 527071 - protein, 9 aa, Homo Sapiens
DIVCNDCNG

SEQ ID NO: 527072 - protein, 9 aa, Homo Sapiens
RAKIVAIKD

SEQ ID NO: 527073 - protein, 9 aa, Homo Sapiens
TAIISHSTT

SEQ ID NO: 527074 - protein, 9 aa, Homo Sapiens
LPPLFGWGQ

SEQ ID NO: 527075 - protein, 9 aa, Homo Sapiens
AEIAREEKM

SEQ ID NO: 527076 - protein, 9 aa, Homo Sapiens
KERKERKNN

SEQ ID NO: 527077 - protein, 9 aa, Homo Sapiens
FGISQVFQR

SEQ ID NO: 527078 - protein, 9 aa, Homo Sapiens
GASVQLTAQ

SEQ ID NO: 527079 - protein, 9 aa, Homo Sapiens
IIFVLDGSA

SEQ ID NO: 527080 - protein, 9 aa, Homo Sapiens
SCLENLIWS

SEQ ID NO: 527081 - protein, 9 aa, Homo Sapiens
LYVELDTKE

SEQ ID NO: 527082 - protein, 9 aa, Homo Sapiens
AFLARWAQE

SEQ ID NO: 527083 - protein, 9 aa, Homo Sapiens
AELGVTVLA

SEQ ID NO: 527084 - protein, 9 aa, Homo Sapiens
LQLENAETD

SEQ ID NO: 527085 - protein, 9 aa, Homo Sapiens
RDLLVRDAV

SEQ ID NO: 527086 - protein, 9 aa, Homo Sapiens
LSLTVFSLN

SEQ ID NO: 527087 - protein, 9 aa, Homo Sapiens
GLLHLGPQA

SEQ ID NO: 527088 - protein, 9 aa, Homo Sapiens
TVITVGNLV

SEQ ID NO: 527089 - protein, 9 aa, Homo Sapiens
KICCTKKLY

SEQ ID NO: 527090 - protein, 9 aa, Homo Sapiens
FPQQRILPE

SEQ ID NO: 527091 - protein, 9 aa, Homo Sapiens
TPSEHEAKA

SEQ ID NO: 527092 - protein, 9 aa, Homo Sapiens
SMSSAELAF

SEQ ID NO: 527093 - protein, 9 aa, Homo Sapiens
QWLNSRKVV

SEQ ID NO: 527094 - protein, 9 aa, Homo Sapiens
EEFEHQQIE

SEQ ID NO: 527095 - protein, 9 aa, Homo Sapiens
DACGLIRCL

SEQ ID NO: 527096 - protein, 9 aa, Homo Sapiens
EKRDNYLRT

SEQ ID NO: 527097 - protein, 9 aa, Homo Sapiens
YQSEQTLCV

SEQ ID NO: 527098 - protein, 9 aa, Homo Sapiens
EDTRVQQAD

SEQ ID NO: 527099 - protein, 9 aa, Homo Sapiens
VVVAFALKQ

SEQ ID NO: 527100 - protein, 9 aa, Homo Sapiens
MRIAIPLGV

SEQ ID NO: 527101 - protein, 9 aa, Homo Sapiens
RSLLTMDQI

SEQ ID NO: 527102 - protein, 9 aa, Homo Sapiens
AAGPRWAVP

SEQ ID NO: 527103 - protein, 9 aa, Homo Sapiens
IFVLDGSAN

SEQ ID NO: 527104 - protein, 9 aa, Homo Sapiens
FAALIQDQT

SEQ ID NO: 527105 - protein, 9 aa, Homo Sapiens
DMDLRVYGP

SEQ ID NO: 527106 - protein, 9 aa, Homo Sapiens
AYWMPAENT

SEQ ID NO: 527107 - protein, 9 aa, Homo Sapiens
VAIKDFNPL

SEQ ID NO: 527108 - protein, 9 aa, Homo Sapiens
EIHTKLYFF

SEQ ID NO: 527109 - protein, 9 aa, Homo Sapiens
HFIDGKGST

SEQ ID NO: 527110 - protein, 9 aa, Homo Sapiens
DIDYMDKRR

SEQ ID NO: 527111 - protein, 9 aa, Homo Sapiens
EVGFAVELP

SEQ ID NO: 527112 - protein, 9 aa, Homo Sapiens
IIRNGPSGI

SEQ ID NO: 527113 - protein, 9 aa, Homo Sapiens
SHAWSYGIV

SEQ ID NO: 527114 - protein, 9 aa, Homo Sapiens
HRSDYTTLL

SEQ ID NO: 527115 - protein, 9 aa, Homo Sapiens
PPPAEEATA

SEQ ID NO: 527116 - protein, 9 aa, Homo Sapiens
TSSPRPPPG

SEQ ID NO: 527117 - protein, 9 aa, Homo Sapiens
PRGVPACSH

SEQ ID NO: 527118 - protein, 9 aa, Homo Sapiens
NKILETKWH

SEQ ID NO: 527119 - protein, 9 aa, Homo Sapiens
TYVNRKSAI

SEQ ID NO: 527120 - protein, 9 aa, Homo Sapiens
NMLGACTKG

SEQ ID NO: 527121 - protein, 9 aa, Homo Sapiens
DKRRDFTYD

SEQ ID NO: 527122 - protein, 9 aa, Homo Sapiens
NFLHRQVLQ

SEQ ID NO: 527123 - protein, 9 aa, Homo Sapiens
KRAEQLACD

SEQ ID NO: 527124 - protein, 9 aa, Homo Sapiens
VAGACLPHA

SEQ ID NO: 527125 - protein, 9 aa, Homo Sapiens
YDCNQDRTY

SEQ ID NO: 527126 - protein, 9 aa, Homo Sapiens
NSNIHTIRH

SEQ ID NO: 527127 - protein, 9 aa, Homo Sapiens
FEHQQIELE

SEQ ID NO: 527128 - protein, 9 aa, Homo Sapiens
WFFGVNTKI

SEQ ID NO: 527129 - protein, 9 aa, Homo Sapiens
GKGSTGNWM

SEQ ID NO: 527130 - protein, 9 aa, Homo Sapiens
ASYSITVKK

SEQ ID NO: 527131 - protein, 9 aa, Homo Sapiens
CEDSFRNDK

SEQ ID NO: 527132 - protein, 9 aa, Homo Sapiens
KPHVISSRD

SEQ ID NO: 527133 - protein, 9 aa, Homo Sapiens
STLSTTPGD

SEQ ID NO: 527134 - protein, 9 aa, Homo Sapiens
AKVFPSPMR

SEQ ID NO: 527135 - protein, 9 aa, Homo Sapiens
YDSGFRCSS

SEQ ID NO: 527136 - protein, 9 aa, Homo Sapiens
RAAGMVSDL

SEQ ID NO: 527137 - protein, 9 aa, Homo Sapiens
GKIKQSLTK

SEQ ID NO: 527138 - protein, 9 aa, Homo Sapiens
DHMKVHRQG

SEQ ID NO: 527139 - protein, 9 aa, Homo Sapiens
DAGLGPPAT

SEQ ID NO: 527140 - protein, 9 aa, Homo Sapiens
APAPGGSSK

SEQ ID NO: 527141 - protein, 9 aa, Homo Sapiens
DFYRDCWFF

SEQ ID NO: 527142 - protein, 9 aa, Homo Sapiens
VGNLVGCHK

SEQ ID NO: 527143 - protein, 9 aa, Homo Sapiens
ILQAQGIGA

SEQ ID NO: 527144 - protein, 9 aa, Homo Sapiens
LSMSSAELA

SEQ ID NO: 527145 - protein, 9 aa, Homo Sapiens
AVASMVDKR

SEQ ID NO: 527146 - protein, 9 aa, Homo Sapiens
KVVCGTKCN

SEQ ID NO: 527147 - protein, 9 aa, Homo Sapiens
QDQTEEEEE

SEQ ID NO: 527148 - protein, 9 aa, Homo Sapiens
EELAFVFEL

SEQ ID NO: 527149 - protein, 9 aa, Homo Sapiens
ELLVLLAAK

SEQ ID NO: 527150 - protein, 9 aa, Homo Sapiens
QMGCPAGCP

SEQ ID NO: 527151 - protein, 9 aa, Homo Sapiens
ASMVDKRAS

SEQ ID NO: 527152 - protein, 9 aa, Homo Sapiens
IAKPEDSLL

SEQ ID NO: 527153 - protein, 9 aa, Homo Sapiens
LLWSLLKNL

SEQ ID NO: 527154 - protein, 9 aa, Homo Sapiens
RQDPSRRSN

SEQ ID NO: 527155 - protein, 9 aa, Homo Sapiens
FKTSDALQL

SEQ ID NO: 527156 - protein, 9 aa, Homo Sapiens
YWATYVNRK

SEQ ID NO: 527157 - protein, 9 aa, Homo Sapiens
ISSRDNLIS

SEQ ID NO: 527158 - protein, 9 aa, Homo Sapiens
QPPPAEEAT

SEQ ID NO: 527159 - protein, 9 aa, Homo Sapiens
PPTPSKNPE

SEQ ID NO: 527160 - protein, 9 aa, Homo Sapiens
PLIVTVAPR

SEQ ID NO: 527161 - protein, 9 aa, Homo Sapiens
GDSNSPVVT

SEQ ID NO: 527162 - protein, 9 aa, Homo Sapiens
REEKMKEPL

SEQ ID NO: 527163 - protein, 9 aa, Homo Sapiens
SGNTMYTVF

SEQ ID NO: 527164 - protein, 9 aa, Homo Sapiens
CNQDRTYYE

SEQ ID NO: 527165 - protein, 9 aa, Homo Sapiens
EFVNFLLLH

SEQ ID NO: 527166 - protein, 9 aa, Homo Sapiens
GSFCASGGK

SEQ ID NO: 527167 - protein, 9 aa, Homo Sapiens
ITVKKLKLL

SEQ ID NO: 527168 - protein, 9 aa, Homo Sapiens
YIHMMPHAV

SEQ ID NO: 527169 - protein, 9 aa, Homo Sapiens
VTFPVVIIR

SEQ ID NO: 527170 - protein, 9 aa, Homo Sapiens
AAYIHMMPH

SEQ ID NO: 527171 - protein, 9 aa, Homo Sapiens
ELPVQRGVA

SEQ ID NO: 527172 - protein, 9 aa, Homo Sapiens
VPMPVPVPE

SEQ ID NO: 527173 - protein, 9 aa, Homo Sapiens
QALGMPLTP

SEQ ID NO: 527174 - protein, 9 aa, Homo Sapiens
NHSSERPPP

SEQ ID NO: 527175 - protein, 9 aa, Homo Sapiens
LQWPQLFSR

SEQ ID NO: 527176 - protein, 9 aa, Homo Sapiens
QQQQQQQGE

SEQ ID NO: 527177 - protein, 9 aa, Homo Sapiens
VLDGSANVG

SEQ ID NO: 527178 - protein, 9 aa, Homo Sapiens
IAHQMVHTG

SEQ ID NO: 527179 - protein, 9 aa, Homo Sapiens
VWEVSEQQN

SEQ ID NO: 527180 - protein, 9 aa, Homo Sapiens
DKRSNFLHR

SEQ ID NO: 527181 - protein, 9 aa, Homo Sapiens
NFLLLHYKK

SEQ ID NO: 527182 - protein, 9 aa, Homo Sapiens
ERRGLRAVG

SEQ ID NO: 527183 - protein, 9 aa, Homo Sapiens
MNLKREAKN

SEQ ID NO: 527184 - protein, 9 aa, Homo Sapiens
IEHYEGKLN

SEQ ID NO: 527185 - protein, 9 aa, Homo Sapiens
APGGSSKDK

SEQ ID NO: 527186 - protein, 9 aa, Homo Sapiens
EPAHHPGCQ

SEQ ID NO: 527187 - protein, 9 aa, Homo Sapiens
QCPISGLYK

SEQ ID NO: 527188 - protein, 9 aa, Homo Sapiens
EEVVAVLNK

SEQ ID NO: 527189 - protein, 9 aa, Homo Sapiens
SGDTLKKDL

SEQ ID NO: 527190 - protein, 9 aa, Homo Sapiens
ASHSRWQGT

SEQ ID NO: 527191 - protein, 9 aa, Homo Sapiens
PLHGVHGLL

SEQ ID NO: 527192 - protein, 9 aa, Homo Sapiens
GGHSWSSTV

SEQ ID NO: 527193 - protein, 9 aa, Homo Sapiens
EEATAEVQP

SEQ ID NO: 527194 - protein, 9 aa, Homo Sapiens
TPGDSNSPV

SEQ ID NO: 527195 - protein, 9 aa, Homo Sapiens
KRIKNDPYV

SEQ ID NO: 527196 - protein, 9 aa, Homo Sapiens
MKVHRQGPH

SEQ ID NO: 527197 - protein, 9 aa, Homo Sapiens
GLIRCLLMV

SEQ ID NO: 527198 - protein, 9 aa, Homo Sapiens
EDSFRNDKD

SEQ ID NO: 527199 - protein, 9 aa, Homo Sapiens
RAAAAAFGV

SEQ ID NO: 527200 - protein, 9 aa, Homo Sapiens
LAAEARVVE

SEQ ID NO: 527201 - protein, 9 aa, Homo Sapiens
TCPRGVPAC

SEQ ID NO: 527202 - protein, 9 aa, Homo Sapiens
HDVYHLTSR

SEQ ID NO: 527203 - protein, 9 aa, Homo Sapiens
TVLAAEARV

SEQ ID NO: 527204 - protein, 9 aa, Homo Sapiens
IRREESTCT

SEQ ID NO: 527205 - protein, 9 aa, Homo Sapiens
RFLAKVFPS

SEQ ID NO: 527206 - protein, 9 aa, Homo Sapiens
YVELDTKER

SEQ ID NO: 527207 - protein, 9 aa, Homo Sapiens
PSEHEAKAE

SEQ ID NO: 527208 - protein, 9 aa, Homo Sapiens
RKSAIKGMI

SEQ ID NO: 527209 - protein, 9 aa, Homo Sapiens
PPLFGWGQN

SEQ ID NO: 527210 - protein, 9 aa, Homo Sapiens
CHLLRGAQV

SEQ ID NO: 527211 - protein, 9 aa, Homo Sapiens
CPISGLYKE

SEQ ID NO: 527212 - protein, 9 aa, Homo Sapiens
LNASHSRWQ

SEQ ID NO: 527213 - protein, 9 aa, Homo Sapiens
TAEVQPPPA

SEQ ID NO: 527214 - protein, 9 aa, Homo Sapiens
RILPEARKC

SEQ ID NO: 527215 - protein, 9 aa, Homo Sapiens
PGDYDSGFR

SEQ ID NO: 527216 - protein, 9 aa, Homo Sapiens
LEQCPISGL

SEQ ID NO: 527217 - protein, 9 aa, Homo Sapiens
RGAQVHLQP

SEQ ID NO: 527218 - protein, 9 aa, Homo Sapiens
ELVGHQPLH

SEQ ID NO: 527219 - protein, 9 aa, Homo Sapiens
MLEKGEQMG

SEQ ID NO: 527220 - protein, 9 aa, Homo Sapiens
GRDLLVRDA

SEQ ID NO: 527221 - protein, 9 aa, Homo Sapiens
KALNNFSAL

SEQ ID NO: 527222 - protein, 9 aa, Homo Sapiens
QTRVLDLQQ

SEQ ID NO: 527223 - protein, 9 aa, Homo Sapiens
AKLPVPRGA

SEQ ID NO: 527224 - protein, 9 aa, Homo Sapiens
RGLNNNSPE

SEQ ID NO: 527225 - protein, 9 aa, Homo Sapiens
MPLTPQQAQ

SEQ ID NO: 527226 - protein, 9 aa, Homo Sapiens
RWAVPVHVP

SEQ ID NO: 527227 - protein, 9 aa, Homo Sapiens
SSEYFPHFS

SEQ ID NO: 527228 - protein, 9 aa, Homo Sapiens
MLHKKIVNR

SEQ ID NO: 527229 - protein, 9 aa, Homo Sapiens
APLGKIKQS

SEQ ID NO: 527230 - protein, 9 aa, Homo Sapiens
AFPQQRILP

SEQ ID NO: 527231 - protein, 9 aa, Homo Sapiens
LWSLLKNLH

SEQ ID NO: 527232 - protein, 9 aa, Homo Sapiens
GEQMGCPAG

SEQ ID NO: 527233 - protein, 9 aa, Homo Sapiens
SNSNIHTIR

SEQ ID NO: 527234 - protein, 9 aa, Homo Sapiens
MLSIRREES

SEQ ID NO: 527235 - protein, 9 aa, Homo Sapiens
SPVRTVITV

SEQ ID NO: 527236 - protein, 9 aa, Homo Sapiens
LPVPRGADQ

SEQ ID NO: 527237 - protein, 9 aa, Homo Sapiens
CDLSLNVTW

SEQ ID NO: 527238 - protein, 9 aa, Homo Sapiens
TISVRVKVA

SEQ ID NO: 527239 - protein, 9 aa, Homo Sapiens
NDVATLLKP

SEQ ID NO: 527240 - protein, 9 aa, Homo Sapiens
TAIARTINE

SEQ ID NO: 527241 - protein, 9 aa, Homo Sapiens
GYGNSYESL

SEQ ID NO: 527242 - protein, 9 aa, Homo Sapiens
YTMSVKPVS

SEQ ID NO: 527243 - protein, 9 aa, Homo Sapiens
GVNMNAADS

SEQ ID NO: 527244 - protein, 9 aa, Homo Sapiens
SVRVKVAPY

SEQ ID NO: 527245 - protein, 9 aa, Homo Sapiens
SSLQCLSSI

SEQ ID NO: 527246 - protein, 9 aa, Homo Sapiens
IAKAVLRMK

SEQ ID NO: 527247 - protein, 9 aa, Homo Sapiens
WTDACLSHL

SEQ ID NO: 527248 - protein, 9 aa, Homo Sapiens
ISVRVKVAP

SEQ ID NO: 527249 - protein, 9 aa, Homo Sapiens
DKSFVHGVT

SEQ ID NO: 527250 - protein, 9 aa, Homo Sapiens
LRIPLLGAE

SEQ ID NO: 527251 - protein, 9 aa, Homo Sapiens
SHLCANGST

SEQ ID NO: 527252 - protein, 9 aa, Homo Sapiens
RVKVAPYWI

SEQ ID NO: 527253 - protein, 9 aa, Homo Sapiens
PHENDVATL

SEQ ID NO: 527254 - protein, 9 aa, Homo Sapiens
LCANGSTCT

SEQ ID NO: 527255 - protein, 9 aa, Homo Sapiens
REHREKERQ

SEQ ID NO: 527256 - protein, 9 aa, Homo Sapiens
DTYFLNDKS

SEQ ID NO: 527257 - protein, 9 aa, Homo Sapiens
VNETYTMSV

SEQ ID NO: 527258 - protein, 9 aa, Homo Sapiens
LSMKEREHR

SEQ ID NO: 527259 - protein, 9 aa, Homo Sapiens
FLLDFGVNM

SEQ ID NO: 527260 - protein, 9 aa, Homo Sapiens
DFGVNMNAA

SEQ ID NO: 527261 - protein, 9 aa, Homo Sapiens
YESLEEKDI

SEQ ID NO: 527262 - protein, 9 aa, Homo Sapiens
GAEEEGSED

SEQ ID NO: 527263 - protein, 9 aa, Homo Sapiens
AEEEGSEDE

SEQ ID NO: 527264 - protein, 9 aa, Homo Sapiens
LRMKSKASQ

SEQ ID NO: 527265 - protein, 9 aa, Homo Sapiens
TVNETYTMS

SEQ ID NO: 527266 - protein, 9 aa, Homo Sapiens
TYFLNDKSF

SEQ ID NO: 527267 - protein, 9 aa, Homo Sapiens
LNDKSFVHG

SEQ ID NO: 527268 - protein, 9 aa, Homo Sapiens
ETYTMSVKP

SEQ ID NO: 527269 - protein, 9 aa, Homo Sapiens
RIPLLGAEE

SEQ ID NO: 527270 - protein, 9 aa, Homo Sapiens
VAPYWITAP

SEQ ID NO: 527271 - protein, 9 aa, Homo Sapiens
QCLSSIVDS

SEQ ID NO: 527272 - protein, 9 aa, Homo Sapiens
PLLGAEEEG

SEQ ID NO: 527273 - protein, 9 aa, Homo Sapiens
DSSASSSLQ

SEQ ID NO: 527274 - protein, 9 aa, Homo Sapiens
VRVKVAPYW

SEQ ID NO: 527275 - protein, 9 aa, Homo Sapiens
LQCLSSIVD

SEQ ID NO: 527276 - protein, 9 aa, Homo Sapiens
KVAPYWITA

SEQ ID NO: 527277 - protein, 9 aa, Homo Sapiens
SGYGNSYES

SEQ ID NO: 527278 - protein, 9 aa, Homo Sapiens
VSSSFSSTL

SEQ ID NO: 527279 - protein, 9 aa, Homo Sapiens
VLRMKSKAS

SEQ ID NO: 527280 - protein, 9 aa, Homo Sapiens
VGWEQLLTA

SEQ ID NO: 527281 - protein, 9 aa, Homo Sapiens
SSASSSLQC

SEQ ID NO: 527282 - protein, 9 aa, Homo Sapiens
NETYTMSVK

SEQ ID NO: 527283 - protein, 9 aa, Homo Sapiens
TDACLSHLC

SEQ ID NO: 527284 - protein, 9 aa, Homo Sapiens
MKSKASQRK

SEQ ID NO: 527285 - protein, 9 aa, Homo Sapiens
NMNAADSDG

SEQ ID NO: 527286 - protein, 9 aa, Homo Sapiens
SSSLQCLSS

SEQ ID NO: 527287 - protein, 9 aa, Homo Sapiens
MKEREHREK

SEQ ID NO: 527288 - protein, 9 aa, Homo Sapiens
CLSHLCANG

SEQ ID NO: 527289 - protein, 9 aa, Homo Sapiens
KEREHREKE

SEQ ID NO: 527290 - protein, 9 aa, Homo Sapiens
AKAVLRMKS

SEQ ID NO: 527291 - protein, 9 aa, Homo Sapiens
WEQLLTAIA

SEQ ID NO: 527292 - protein, 9 aa, Homo Sapiens
IPVSSSFSS

SEQ ID NO: 527293 - protein, 9 aa, Homo Sapiens
NLRIPLLGA

SEQ ID NO: 527294 - protein, 9 aa, Homo Sapiens
ENDVATLLK

SEQ ID NO: 527295 - protein, 9 aa, Homo Sapiens
QPHENDVAT

SEQ ID NO: 527296 - protein, 9 aa, Homo Sapiens
HTISVRVKV

SEQ ID NO: 527297 - protein, 9 aa, Homo Sapiens
SMKEREHRE

SEQ ID NO: 527298 - protein, 9 aa, Homo Sapiens
ACLSHLCAN

SEQ ID NO: 527299 - protein, 9 aa, Homo Sapiens
LGAEEEGSE

SEQ ID NO: 527300 - protein, 9 aa, Homo Sapiens
ATLLKPISE

SEQ ID NO: 527301 - protein, 9 aa, Homo Sapiens
SPSSVSTGD

SEQ ID NO: 527302 - protein, 9 aa, Homo Sapiens
QLLTAIART

SEQ ID NO: 527303 - protein, 9 aa, Homo Sapiens
EREHREKER

SEQ ID NO: 527304 - protein, 9 aa, Homo Sapiens
FLNDKSFVH

SEQ ID NO: 527305 - protein, 9 aa, Homo Sapiens
LLDFGVNMN

SEQ ID NO: 527306 - protein, 9 aa, Homo Sapiens
HLCANGSTC

SEQ ID NO: 527307 - protein, 9 aa, Homo Sapiens
VATLLKPIS

SEQ ID NO: 527308 - protein, 9 aa, Homo Sapiens
AVLRMKSKA

SEQ ID NO: 527309 - protein, 9 aa, Homo Sapiens
KAVLRMKSK

SEQ ID NO: 527310 - protein, 9 aa, Homo Sapiens
EQLLTAIAR

SEQ ID NO: 527311 - protein, 9 aa, Homo Sapiens
TLLKPISEK

SEQ ID NO: 527312 - protein, 9 aa, Homo Sapiens
SSSFSSTLL

SEQ ID NO: 527313 - protein, 9 aa, Homo Sapiens
NSYESLEEK

SEQ ID NO: 527314 - protein, 9 aa, Homo Sapiens
VKVAPYWIT

SEQ ID NO: 527315 - protein, 9 aa, Homo Sapiens
GNSYESLEE

SEQ ID NO: 527316 - protein, 9 aa, Homo Sapiens
TYTMSVKPV

SEQ ID NO: 527317 - protein, 9 aa, Homo Sapiens
YIAKAVLRM

SEQ ID NO: 527318 - protein, 9 aa, Homo Sapiens
DVATLLKPI

SEQ ID NO: 527319 - protein, 9 aa, Homo Sapiens
SLQCLSSIV

SEQ ID NO: 527320 - protein, 9 aa, Homo Sapiens
PVSSSFSST

SEQ ID NO: 527321 - protein, 9 aa, Homo Sapiens
MNAADSDGW

SEQ ID NO: 527322 - protein, 9 aa, Homo Sapiens
MSVKPVSVQ

SEQ ID NO: 527323 - protein, 9 aa, Homo Sapiens
LLGAEEEGS

SEQ ID NO: 527324 - protein, 9 aa, Homo Sapiens
YTVNETYTM

SEQ ID NO: 527325 - protein, 9 aa, Homo Sapiens
EHREKERQV

SEQ ID NO: 527326 - protein, 9 aa, Homo Sapiens
HREKERQVS

SEQ ID NO: 527327 - protein, 9 aa, Homo Sapiens
LTAIARTIN

SEQ ID NO: 527328 - protein, 9 aa, Homo Sapiens
YFLNDKSFV

SEQ ID NO: 527329 - protein, 9 aa, Homo Sapiens
SASSSLQCL

SEQ ID NO: 527330 - protein, 9 aa, Homo Sapiens
LSHLCANGS

SEQ ID NO: 527331 - protein, 9 aa, Homo Sapiens
TMSVKPVSV

SEQ ID NO: 527332 - protein, 9 aa, Homo Sapiens
LLTAIARTI

SEQ ID NO: 527333 - protein, 9 aa, Homo Sapiens
LDFGVNMNA

SEQ ID NO: 527334 - protein, 9 aa, Homo Sapiens
RMKSKASQR

SEQ ID NO: 527335 - protein, 9 aa, Homo Sapiens
HENDVATLL

SEQ ID NO: 527336 - protein, 9 aa, Homo Sapiens
VNMNAADSD

SEQ ID NO: 527337 - protein, 9 aa, Homo Sapiens
REKERQVSE

SEQ ID NO: 527338 - protein, 9 aa, Homo Sapiens
ASSSLQCLS

SEQ ID NO: 527339 - protein, 9 aa, Homo Sapiens
FGVNMNAAD

SEQ ID NO: 527340 - protein, 9 aa, Homo Sapiens
DSGYGNSYE

SEQ ID NO: 527341 - protein, 9 aa, Homo Sapiens
AIARTINEV

SEQ ID NO: 527342 - protein, 9 aa, Homo Sapiens
SYESLEEKD

SEQ ID NO: 527343 - protein, 9 aa, Homo Sapiens
NDKSFVHGV

SEQ ID NO: 527344 - protein, 9 aa, Homo Sapiens
DACLSHLCA

SEQ ID NO: 527345 - protein, 9 aa, Homo Sapiens
SDSGYGNSY

SEQ ID NO: 527346 - protein, 9 aa, Homo Sapiens
GWEQLLTAI

SEQ ID NO: 527347 - protein, 9 aa, Homo Sapiens
YGNSYESLE

SEQ ID NO: 527348 - protein, 9 aa, Homo Sapiens
IPLLGAEEE

SEQ ID NO: 527349 - protein, 9 aa, Homo Sapiens
GISPAVESI

SEQ ID NO: 527350 - protein, 9 aa, Homo Sapiens
PTALPLSAH

SEQ ID NO: 527351 - protein, 9 aa, Homo Sapiens
PRPTPSTPH

SEQ ID NO: 527352 - protein, 9 aa, Homo Sapiens
SLCAGVKYS

SEQ ID NO: 527353 - protein, 9 aa, Homo Sapiens
STPHPTPQD

SEQ ID NO: 527354 - protein, 9 aa, Homo Sapiens
VKYSTPPGE

SEQ ID NO: 527355 - protein, 9 aa, Homo Sapiens
PSTSGKRPR

SEQ ID NO: 527356 - protein, 9 aa, Homo Sapiens
KVDAAPGIS

SEQ ID NO: 527357 - protein, 9 aa, Homo Sapiens
KLSLPESLK

SEQ ID NO: 527358 - protein, 9 aa, Homo Sapiens
GPLPASHPL

SEQ ID NO: 527359 - protein, 9 aa, Homo Sapiens
QIDQAGMCG

SEQ ID NO: 527360 - protein, 9 aa, Homo Sapiens
IMKLSLPES

SEQ ID NO: 527361 - protein, 9 aa, Homo Sapiens
PASHPLFGR

SEQ ID NO: 527362 - protein, 9 aa, Homo Sapiens
PGPLPASHP

SEQ ID NO: 527363 - protein, 9 aa, Homo Sapiens
AKELKTRLG

SEQ ID NO: 527364 - protein, 9 aa, Homo Sapiens
FMLQWASHT

SEQ ID NO: 527365 - protein, 9 aa, Homo Sapiens
CAGVKYSTP

SEQ ID NO: 527366 - protein, 9 aa, Homo Sapiens
TVLLSATIF

SEQ ID NO: 527367 - protein, 9 aa, Homo Sapiens
TLQIRGREH

SEQ ID NO: 527368 - protein, 9 aa, Homo Sapiens
IRGREHFEM

SEQ ID NO: 527369 - protein, 9 aa, Homo Sapiens
GSNFTSQGG

SEQ ID NO: 527370 - protein, 9 aa, Homo Sapiens
ERAKELKTR

SEQ ID NO: 527371 - protein, 9 aa, Homo Sapiens
TALPLSAHE

SEQ ID NO: 527372 - protein, 9 aa, Homo Sapiens
RPTPSTPHP

SEQ ID NO: 527373 - protein, 9 aa, Homo Sapiens
PTDDHVQID

SEQ ID NO: 527374 - protein, 9 aa, Homo Sapiens
DSEGEEAPQ

SEQ ID NO: 527375 - protein, 9 aa, Homo Sapiens
LPGPLPASH

SEQ ID NO: 527376 - protein, 9 aa, Homo Sapiens
TAGLPTALP

SEQ ID NO: 527377 - protein, 9 aa, Homo Sapiens
GKRPREGEA

SEQ ID NO: 527378 - protein, 9 aa, Homo Sapiens
LREKIMKLS

SEQ ID NO: 527379 - protein, 9 aa, Homo Sapiens
TCLERAKEL

SEQ ID NO: 527380 - protein, 9 aa, Homo Sapiens
LPASHPLFG

SEQ ID NO: 527381 - protein, 9 aa, Homo Sapiens
YSTPPGESY

SEQ ID NO: 527382 - protein, 9 aa, Homo Sapiens
SGKRPREGE

SEQ ID NO: 527383 - protein, 9 aa, Homo Sapiens
TVFLHIRTS

SEQ ID NO: 527384 - protein, 9 aa, Homo Sapiens
EAPQPMPSV

SEQ ID NO: 527385 - protein, 9 aa, Homo Sapiens
SPTDDHVQI

SEQ ID NO: 527386 - protein, 9 aa, Homo Sapiens
WASHTFGKF

SEQ ID NO: 527387 - protein, 9 aa, Homo Sapiens
AAPGISPAV

SEQ ID NO: 527388 - protein, 9 aa, Homo Sapiens
DDHVQIDQA

SEQ ID NO: 527389 - protein, 9 aa, Homo Sapiens
NFTSQGGTP

SEQ ID NO: 527390 - protein, 9 aa, Homo Sapiens
TSGKRPREG

SEQ ID NO: 527391 - protein, 9 aa, Homo Sapiens
QPSTSGKRP

SEQ ID NO: 527392 - protein, 9 aa, Homo Sapiens
KIMKLSLPE

SEQ ID NO: 527393 - protein, 9 aa, Homo Sapiens
VLAQPSTSG

SEQ ID NO: 527394 - protein, 9 aa, Homo Sapiens
KYSTPPGES

SEQ ID NO: 527395 - protein, 9 aa, Homo Sapiens
SNFTSQGGT

SEQ ID NO: 527396 - protein, 9 aa, Homo Sapiens
PQPMPSVPE

SEQ ID NO: 527397 - protein, 9 aa, Homo Sapiens
HFEMFRELN

SEQ ID NO: 527398 - protein, 9 aa, Homo Sapiens
LSLPESLKA

SEQ ID NO: 527399 - protein, 9 aa, Homo Sapiens
VFLHIRTSI

SEQ ID NO: 527400 - protein, 9 aa, Homo Sapiens
LPTALPLSA

SEQ ID NO: 527401 - protein, 9 aa, Homo Sapiens
TWVYEGTVL

SEQ ID NO: 527402 - protein, 9 aa, Homo Sapiens
DHVQIDQAG

SEQ ID NO: 527403 - protein, 9 aa, Homo Sapiens
TAAPGVEEI

SEQ ID NO: 527404 - protein, 9 aa, Homo Sapiens
RRKFMLQWA

SEQ ID NO: 527405 - protein, 9 aa, Homo Sapiens
GSTVFLHIR

SEQ ID NO: 527406 - protein, 9 aa, Homo Sapiens
RAKELKTRL

SEQ ID NO: 527407 - protein, 9 aa, Homo Sapiens
REKIMKLSL

SEQ ID NO: 527408 - protein, 9 aa, Homo Sapiens
QGGGSNFTS

SEQ ID NO: 527409 - protein, 9 aa, Homo Sapiens
RAAQGGGSN

SEQ ID NO: 527410 - protein, 9 aa, Homo Sapiens
LERAKELKT

SEQ ID NO: 527411 - protein, 9 aa, Homo Sapiens
QWASHTFGK

SEQ ID NO: 527412 - protein, 9 aa, Homo Sapiens
RSTAGLPTA

SEQ ID NO: 527413 - protein, 9 aa, Homo Sapiens
LQWASHTFG

SEQ ID NO: 527414 - protein, 9 aa, Homo Sapiens
CLERAKELK

SEQ ID NO: 527415 - protein, 9 aa, Homo Sapiens
ISPAVESIQ

SEQ ID NO: 527416 - protein, 9 aa, Homo Sapiens
AQGGGSNFT

SEQ ID NO: 527417 - protein, 9 aa, Homo Sapiens
GGGSNFTSQ

SEQ ID NO: 527418 - protein, 9 aa, Homo Sapiens
QIRGREHFE

SEQ ID NO: 527419 - protein, 9 aa, Homo Sapiens
AQPSTSGKR

SEQ ID NO: 527420 - protein, 9 aa, Homo Sapiens
ELKTRLGIF

SEQ ID NO: 527421 - protein, 9 aa, Homo Sapiens
MKLSLPESL

SEQ ID NO: 527422 - protein, 9 aa, Homo Sapiens
FLHIRTSIK

SEQ ID NO: 527423 - protein, 9 aa, Homo Sapiens
TPHPTPQDW

SEQ ID NO: 527424 - protein, 9 aa, Homo Sapiens
VDAAPGISP

SEQ ID NO: 527425 - protein, 9 aa, Homo Sapiens
VLLSATIFL

SEQ ID NO: 527426 - protein, 9 aa, Homo Sapiens
AGLPTALPL

SEQ ID NO: 527427 - protein, 9 aa, Homo Sapiens
SLPESLKAY

SEQ ID NO: 527428 - protein, 9 aa, Homo Sapiens
EGTVLLSAT

SEQ ID NO: 527429 - protein, 9 aa, Homo Sapiens
LAQPSTSGK

SEQ ID NO: 527430 - protein, 9 aa, Homo Sapiens
EGEEAPQPM

SEQ ID NO: 527431 - protein, 9 aa, Homo Sapiens
ASHPLFGRL

SEQ ID NO: 527432 - protein, 9 aa, Homo Sapiens
PHPTPQDWL

SEQ ID NO: 527433 - protein, 9 aa, Homo Sapiens
REHFEMFRE

SEQ ID NO: 527434 - protein, 9 aa, Homo Sapiens
YEGTVLLSA

SEQ ID NO: 527435 - protein, 9 aa, Homo Sapiens
IDQAGMCGD

SEQ ID NO: 527436 - protein, 9 aa, Homo Sapiens
AGVKYSTPP

SEQ ID NO: 527437 - protein, 9 aa, Homo Sapiens
RGREHFEMF

SEQ ID NO: 527438 - protein, 9 aa, Homo Sapiens
APGISPAVE

SEQ ID NO: 527439 - protein, 9 aa, Homo Sapiens
PLPASHPLF

SEQ ID NO: 527440 - protein, 9 aa, Homo Sapiens
PSTPHPTPQ

SEQ ID NO: 527441 - protein, 9 aa, Homo Sapiens
LHIRTSIKD

SEQ ID NO: 527442 - protein, 9 aa, Homo Sapiens
KFMLQWASH

SEQ ID NO: 527443 - protein, 9 aa, Homo Sapiens
APQPMPSVP

SEQ ID NO: 527444 - protein, 9 aa, Homo Sapiens
ALPLSAHEA

SEQ ID NO: 527445 - protein, 9 aa, Homo Sapiens
ETAAPGVEE

SEQ ID NO: 527446 - protein, 9 aa, Homo Sapiens
SEGEEAPQP

SEQ ID NO: 527447 - protein, 9 aa, Homo Sapiens
TDDHVQIDQ

SEQ ID NO: 527448 - protein, 9 aa, Homo Sapiens
VYEGTVLLS

SEQ ID NO: 527449 - protein, 9 aa, Homo Sapiens
LKTRLGIFL

SEQ ID NO: 527450 - protein, 9 aa, Homo Sapiens
STSGKRPRE

SEQ ID NO: 527451 - protein, 9 aa, Homo Sapiens
RKFMLQWAS

SEQ ID NO: 527452 - protein, 9 aa, Homo Sapiens
MLQWASHTF

SEQ ID NO: 527453 - protein, 9 aa, Homo Sapiens
GGSNFTSQG

SEQ ID NO: 527454 - protein, 9 aa, Homo Sapiens
GVKYSTPPG

SEQ ID NO: 527455 - protein, 9 aa, Homo Sapiens
SHPLFGRLV

SEQ ID NO: 527456 - protein, 9 aa, Homo Sapiens
QPMPSVPED

SEQ ID NO: 527457 - protein, 9 aa, Homo Sapiens
DAAPGISPA

SEQ ID NO: 527458 - protein, 9 aa, Homo Sapiens
LSLCAGVKY

SEQ ID NO: 527459 - protein, 9 aa, Homo Sapiens
PGISPAVES

SEQ ID NO: 527460 - protein, 9 aa, Homo Sapiens
GREHFEMFR

SEQ ID NO: 527461 - protein, 9 aa, Homo Sapiens
HPTPQDWLH

SEQ ID NO: 527462 - protein, 9 aa, Homo Sapiens
GLPTALPLS

SEQ ID NO: 527463 - protein, 9 aa, Homo Sapiens
YGSTVFLHI

SEQ ID NO: 527464 - protein, 9 aa, Homo Sapiens
EKIMKLSLP

SEQ ID NO: 527465 - protein, 9 aa, Homo Sapiens
EEAPQPMPS

SEQ ID NO: 527466 - protein, 9 aa, Homo Sapiens
HVQIDQAGM

SEQ ID NO: 527467 - protein, 9 aa, Homo Sapiens
PTPSTPHPT

SEQ ID NO: 527468 - protein, 9 aa, Homo Sapiens
AAQGGGSNF

SEQ ID NO: 527469 - protein, 9 aa, Homo Sapiens
GEEAPQPMP

SEQ ID NO: 527470 - protein, 9 aa, Homo Sapiens
LQIRGREHF

SEQ ID NO: 527471 - protein, 9 aa, Homo Sapiens
TPSTPHPTP

SEQ ID NO: 527472 - protein, 9 aa, Homo Sapiens
IRTSIKDAL

SEQ ID NO: 527473 - protein, 9 aa, Homo Sapiens
STAGLPTAL

SEQ ID NO: 527474 - protein, 9 aa, Homo Sapiens
HIRTSIKDA

SEQ ID NO: 527475 - protein, 9 aa, Homo Sapiens
STVFLHIRT

SEQ ID NO: 527476 - protein, 9 aa, Homo Sapiens
LLSATIFLV

SEQ ID NO: 527477 - protein, 9 aa, Homo Sapiens
ASHTFGKFH

SEQ ID NO: 527478 - protein, 9 aa, Homo Sapiens
WVYEGTVLL

SEQ ID NO: 527479 - protein, 9 aa, Homo Sapiens
LCAGVKYST

SEQ ID NO: 527480 - protein, 9 aa, Homo Sapiens
AAPGVEEIS

SEQ ID NO: 527481 - protein, 9 aa, Homo Sapiens
VQIDQAGMC

SEQ ID NO: 527482 - protein, 9 aa, Homo Sapiens
GTVLLSATI

SEQ ID NO: 527483 - protein, 9 aa, Homo Sapiens
EHFEMFREL

SEQ ID NO: 527484 - protein, 9 aa, Homo Sapiens
LLPGPLPAS

SEQ ID NO: 527485 - protein, 9 aa, Homo Sapiens
SPAVESIQD

SEQ ID NO: 527486 - protein, 9 aa, Homo Sapiens
KELKTRLGI

SEQ ID NO: 527487 - protein, 9 aa, Homo Sapiens
WSWRLCSAR

SEQ ID NO: 527488 - protein, 9 aa, Homo Sapiens
QFYVKQQSD

SEQ ID NO: 527489 - protein, 9 aa, Homo Sapiens
SSGGRSLLS

SEQ ID NO: 527490 - protein, 9 aa, Homo Sapiens
RLLDPTNRA

SEQ ID NO: 527491 - protein, 9 aa, Homo Sapiens
SRSPCVSHS

SEQ ID NO: 527492 - protein, 9 aa, Homo Sapiens
GVKMCKPCT

SEQ ID NO: 527493 - protein, 9 aa, Homo Sapiens
FNEVKLSGA

SEQ ID NO: 527494 - protein, 9 aa, Homo Sapiens
VTSWPWRAH

SEQ ID NO: 527495 - protein, 9 aa, Homo Sapiens
PCTLSGGSW

SEQ ID NO: 527496 - protein, 9 aa, Homo Sapiens
WPWRAHSPA

SEQ ID NO: 527497 - protein, 9 aa, Homo Sapiens
HPGIFRGDK

SEQ ID NO: 527498 - protein, 9 aa, Homo Sapiens
MVRFGICRV

SEQ ID NO: 527499 - protein, 9 aa, Homo Sapiens
SEGTDGCEI

SEQ ID NO: 527500 - protein, 9 aa, Homo Sapiens
KPERRPPQG

SEQ ID NO: 527501 - protein, 9 aa, Homo Sapiens
RRFPHHERC

SEQ ID NO: 527502 - protein, 9 aa, Homo Sapiens
RGVPRLSGQ

SEQ ID NO: 527503 - protein, 9 aa, Homo Sapiens
AHSPASSPS

SEQ ID NO: 527504 - protein, 9 aa, Homo Sapiens
EDIADAALA

SEQ ID NO: 527505 - protein, 9 aa, Homo Sapiens
SQASSGPCT

SEQ ID NO: 527506 - protein, 9 aa, Homo Sapiens
IERSTPTGV

SEQ ID NO: 527507 - protein, 9 aa, Homo Sapiens
RIERSTPTG

SEQ ID NO: 527508 - protein, 9 aa, Homo Sapiens
RSTPTGVDR

SEQ ID NO: 527509 - protein, 9 aa, Homo Sapiens
QNKLCFSID

SEQ ID NO: 527510 - protein, 9 aa, Homo Sapiens
SHSAGCVGA

SEQ ID NO: 527511 - protein, 9 aa, Homo Sapiens
LTTSSGGRS

SEQ ID NO: 527512 - protein, 9 aa, Homo Sapiens
CPAGSGTRL

SEQ ID NO: 527513 - protein, 9 aa, Homo Sapiens
SPASSPSRS

SEQ ID NO: 527514 - protein, 9 aa, Homo Sapiens
PAGSGTRLA

SEQ ID NO: 527515 - protein, 9 aa, Homo Sapiens
DPTNRAHLG

SEQ ID NO: 527516 - protein, 9 aa, Homo Sapiens
VGAGCPAGS

SEQ ID NO: 527517 - protein, 9 aa, Homo Sapiens
HNLRQFYVK

SEQ ID NO: 527518 - protein, 9 aa, Homo Sapiens
NEVKLSGAI

SEQ ID NO: 527519 - protein, 9 aa, Homo Sapiens
SELHNLRQF

SEQ ID NO: 527520 - protein, 9 aa, Homo Sapiens
PPPGKPERR

SEQ ID NO: 527521 - protein, 9 aa, Homo Sapiens
QASRTWSWR

SEQ ID NO: 527522 - protein, 9 aa, Homo Sapiens
ERSTPTGVD

SEQ ID NO: 527523 - protein, 9 aa, Homo Sapiens
AGCVGAGCP

SEQ ID NO: 527524 - protein, 9 aa, Homo Sapiens
GSGTRLAPQ

SEQ ID NO: 527525 - protein, 9 aa, Homo Sapiens
FKTPEPVVP

SEQ ID NO: 527526 - protein, 9 aa, Homo Sapiens
SGCFNEVKL

SEQ ID NO: 527527 - protein, 9 aa, Homo Sapiens
RPFSAAAAA

SEQ ID NO: 527528 - protein, 9 aa, Homo Sapiens
IFYTSFIHS

SEQ ID NO: 527529 - protein, 9 aa, Homo Sapiens
RTPSQASSG

SEQ ID NO: 527530 - protein, 9 aa, Homo Sapiens
LVQCQPPAG

SEQ ID NO: 527531 - protein, 9 aa, Homo Sapiens
GRSLLSAHC

SEQ ID NO: 527532 - protein, 9 aa, Homo Sapiens
YHPGIFRGD

SEQ ID NO: 527533 - protein, 9 aa, Homo Sapiens
TWSWRLCSA

SEQ ID NO: 527534 - protein, 9 aa, Homo Sapiens
SPSRSPCVS

SEQ ID NO: 527535 - protein, 9 aa, Homo Sapiens
RSRLARQRT

SEQ ID NO: 527536 - protein, 9 aa, Homo Sapiens
LSGAIIHTV

SEQ ID NO: 527537 - protein, 9 aa, Homo Sapiens
PFSAAAAAA

SEQ ID NO: 527538 - protein, 9 aa, Homo Sapiens
RQPHVVSQW

SEQ ID NO: 527539 - protein, 9 aa, Homo Sapiens
CTPVTSWPW

SEQ ID NO: 527540 - protein, 9 aa, Homo Sapiens
LCFSIDPFQ

SEQ ID NO: 527541 - protein, 9 aa, Homo Sapiens
VTSLAFGDL

SEQ ID NO: 527542 - protein, 9 aa, Homo Sapiens
KMEVEENGV

SEQ ID NO: 527543 - protein, 9 aa, Homo Sapiens
SGQASRTWS

SEQ ID NO: 527544 - protein, 9 aa, Homo Sapiens
KMVPIKVVH

SEQ ID NO: 527545 - protein, 9 aa, Homo Sapiens
TSFIHSDPH

SEQ ID NO: 527546 - protein, 9 aa, Homo Sapiens
YSLRNKEIT

SEQ ID NO: 527547 - protein, 9 aa, Homo Sapiens
NKEITKAIK

SEQ ID NO: 527548 - protein, 9 aa, Homo Sapiens
TLSGGSWPS

SEQ ID NO: 527549 - protein, 9 aa, Homo Sapiens
AEQIFYTSF

SEQ ID NO: 527550 - protein, 9 aa, Homo Sapiens
EGTDGCEIM

SEQ ID NO: 527551 - protein, 9 aa, Homo Sapiens
AGSPPWPCT

SEQ ID NO: 527552 - protein, 9 aa, Homo Sapiens
EHHKSLDPN

SEQ ID NO: 527553 - protein, 9 aa, Homo Sapiens
AMALASLTT

SEQ ID NO: 527554 - protein, 9 aa, Homo Sapiens
APRGLKPTM

SEQ ID NO: 527555 - protein, 9 aa, Homo Sapiens
AGSGTRLAP

SEQ ID NO: 527556 - protein, 9 aa, Homo Sapiens
VKEHHKSLD

SEQ ID NO: 527557 - protein, 9 aa, Homo Sapiens
LAVKHFAVE

SEQ ID NO: 527558 - protein, 9 aa, Homo Sapiens
GTRLAPQER

SEQ ID NO: 527559 - protein, 9 aa, Homo Sapiens
VKMVPIKVV

SEQ ID NO: 527560 - protein, 9 aa, Homo Sapiens
GGRSLLSAH

SEQ ID NO: 527561 - protein, 9 aa, Homo Sapiens
RHRRGVPRL

SEQ ID NO: 527562 - protein, 9 aa, Homo Sapiens
LLSAHCTPV

SEQ ID NO: 527563 - protein, 9 aa, Homo Sapiens
LQRIERSTP

SEQ ID NO: 527564 - protein, 9 aa, Homo Sapiens
RSKLEDIAD

SEQ ID NO: 527565 - protein, 9 aa, Homo Sapiens
SAGCVGAGC

SEQ ID NO: 527566 - protein, 9 aa, Homo Sapiens
GIFRGDKWS

SEQ ID NO: 527567 - protein, 9 aa, Homo Sapiens
TNRAHLGLE

SEQ ID NO: 527568 - protein, 9 aa, Homo Sapiens
GVPRLSGQA

SEQ ID NO: 527569 - protein, 9 aa, Homo Sapiens
EKLFMAVEN

SEQ ID NO: 527570 - protein, 9 aa, Homo Sapiens
SSGPCTLLT

SEQ ID NO: 527571 - protein, 9 aa, Homo Sapiens
LRNKEITKA

SEQ ID NO: 527572 - protein, 9 aa, Homo Sapiens
NIFVTSLAF

SEQ ID NO: 527573 - protein, 9 aa, Homo Sapiens
ENGVKMCKP

SEQ ID NO: 527574 - protein, 9 aa, Homo Sapiens
SRRQPHVVS

SEQ ID NO: 527575 - protein, 9 aa, Homo Sapiens
MTEVVRRFP

SEQ ID NO: 527576 - protein, 9 aa, Homo Sapiens
RRGVPRLSG

SEQ ID NO: 527577 - protein, 9 aa, Homo Sapiens
PTNRAHLGL

SEQ ID NO: 527578 - protein, 9 aa, Homo Sapiens
WPSAPAMAL

SEQ ID NO: 527579 - protein, 9 aa, Homo Sapiens
GKPERRPPQ

SEQ ID NO: 527580 - protein, 9 aa, Homo Sapiens
SSFKTPEPV

SEQ ID NO: 527581 - protein, 9 aa, Homo Sapiens
FSAAAAAAA

SEQ ID NO: 527582 - protein, 9 aa, Homo Sapiens
SFIHSDPHP

SEQ ID NO: 527583 - protein, 9 aa, Homo Sapiens
KEHHKSLDP

SEQ ID NO: 527584 - protein, 9 aa, Homo Sapiens
MALASLTTS

SEQ ID NO: 527585 - protein, 9 aa, Homo Sapiens
GSYHPGIFR

SEQ ID NO: 527586 - protein, 9 aa, Homo Sapiens
MVPIKVVHS

SEQ ID NO: 527587 - protein, 9 aa, Homo Sapiens
PPWPCTLSG

SEQ ID NO: 527588 - protein, 9 aa, Homo Sapiens
FVTSLAFGD

SEQ ID NO: 527589 - protein, 9 aa, Homo Sapiens
PHVVSQWSR

SEQ ID NO: 527590 - protein, 9 aa, Homo Sapiens
VDRLLDPTN

SEQ ID NO: 527591 - protein, 9 aa, Homo Sapiens
PAGSPPWPC

SEQ ID NO: 527592 - protein, 9 aa, Homo Sapiens
AVKHFAVEG

SEQ ID NO: 527593 - protein, 9 aa, Homo Sapiens
RSSFKTPEP

SEQ ID NO: 527594 - protein, 9 aa, Homo Sapiens
EVKLSGAII

SEQ ID NO: 527595 - protein, 9 aa, Homo Sapiens
EITKAIKRT

SEQ ID NO: 527596 - protein, 9 aa, Homo Sapiens
KVVHSESQP

SEQ ID NO: 527597 - protein, 9 aa, Homo Sapiens
TPSQASSGP

SEQ ID NO: 527598 - protein, 9 aa, Homo Sapiens
IEPAQLLKA

SEQ ID NO: 527599 - protein, 9 aa, Homo Sapiens
VPRLSGQAS

SEQ ID NO: 527600 - protein, 9 aa, Homo Sapiens
TVKMVPIKV

SEQ ID NO: 527601 - protein, 9 aa, Homo Sapiens
RCRTNRSSF

SEQ ID NO: 527602 - protein, 9 aa, Homo Sapiens
EENGVKMCK

SEQ ID NO: 527603 - protein, 9 aa, Homo Sapiens
AGCPAGSGT

SEQ ID NO: 527604 - protein, 9 aa, Homo Sapiens
NLRQFYVKQ

SEQ ID NO: 527605 - protein, 9 aa, Homo Sapiens
DAALAASAV

SEQ ID NO: 527606 - protein, 9 aa, Homo Sapiens
FMAVENAQG

SEQ ID NO: 527607 - protein, 9 aa, Homo Sapiens
RQFYVKQQS

SEQ ID NO: 527608 - protein, 9 aa, Homo Sapiens
VVRRFPHHE

SEQ ID NO: 527609 - protein, 9 aa, Homo Sapiens
VPIKVVHSE

SEQ ID NO: 527610 - protein, 9 aa, Homo Sapiens
LKPTMVRFG

SEQ ID NO: 527611 - protein, 9 aa, Homo Sapiens
SPCVSHSAG

SEQ ID NO: 527612 - protein, 9 aa, Homo Sapiens
IADAALAAS

SEQ ID NO: 527613 - protein, 9 aa, Homo Sapiens
LEDIADAAL

SEQ ID NO: 527614 - protein, 9 aa, Homo Sapiens
EVEENGVKM

SEQ ID NO: 527615 - protein, 9 aa, Homo Sapiens
PWPCTLSGG

SEQ ID NO: 527616 - protein, 9 aa, Homo Sapiens
FYTSFIHSD

SEQ ID NO: 527617 - protein, 9 aa, Homo Sapiens
RLSGQASRT

SEQ ID NO: 527618 - protein, 9 aa, Homo Sapiens
HMTEVVRRF

SEQ ID NO: 527619 - protein, 9 aa, Homo Sapiens
PTGVDREVI

SEQ ID NO: 527620 - protein, 9 aa, Homo Sapiens
FYVKQQSDL

SEQ ID NO: 527621 - protein, 9 aa, Homo Sapiens
CRTNRSSFK

SEQ ID NO: 527622 - protein, 9 aa, Homo Sapiens
DVDRLLDPT

SEQ ID NO: 527623 - protein, 9 aa, Homo Sapiens
VSQWSRSAS

SEQ ID NO: 527624 - protein, 9 aa, Homo Sapiens
KLFMAVENA

SEQ ID NO: 527625 - protein, 9 aa, Homo Sapiens
PTMVRFGIC

SEQ ID NO: 527626 - protein, 9 aa, Homo Sapiens
DHLAVKHFA

SEQ ID NO: 527627 - protein, 9 aa, Homo Sapiens
HSPASSPSR

SEQ ID NO: 527628 - protein, 9 aa, Homo Sapiens
LFMAVENAQ

SEQ ID NO: 527629 - protein, 9 aa, Homo Sapiens
PVTSWPWRA

SEQ ID NO: 527630 - protein, 9 aa, Homo Sapiens
QRIERSTPT

SEQ ID NO: 527631 - protein, 9 aa, Homo Sapiens
SAHCTPVTS

SEQ ID NO: 527632 - protein, 9 aa, Homo Sapiens
QIFYTSFIH

SEQ ID NO: 527633 - protein, 9 aa, Homo Sapiens
PPAGSPPWP

SEQ ID NO: 527634 - protein, 9 aa, Homo Sapiens
GCFNEVKLS

SEQ ID NO: 527635 - protein, 9 aa, Homo Sapiens
QASSGPCTL

SEQ ID NO: 527636 - protein, 9 aa, Homo Sapiens
RTNRSSFKT

SEQ ID NO: 527637 - protein, 9 aa, Homo Sapiens
SWRLCSARS

SEQ ID NO: 527638 - protein, 9 aa, Homo Sapiens
LLKADVMVK

SEQ ID NO: 527639 - protein, 9 aa, Homo Sapiens
ITKAIKRTI

SEQ ID NO: 527640 - protein, 9 aa, Homo Sapiens
ASLTTSSGG

SEQ ID NO: 527641 - protein, 9 aa, Homo Sapiens
HKSLDPNCP

SEQ ID NO: 527642 - protein, 9 aa, Homo Sapiens
CFSIDPFQL

SEQ ID NO: 527643 - protein, 9 aa, Homo Sapiens
QPHVVSQWS

SEQ ID NO: 527644 - protein, 9 aa, Homo Sapiens
ERRPPQGGN

SEQ ID NO: 527645 - protein, 9 aa, Homo Sapiens
TPTGVDREV

SEQ ID NO: 527646 - protein, 9 aa, Homo Sapiens
VKMCKPCTD

SEQ ID NO: 527647 - protein, 9 aa, Homo Sapiens
HLAVKHFAV

SEQ ID NO: 527648 - protein, 9 aa, Homo Sapiens
LSGGSWPSA

SEQ ID NO: 527649 - protein, 9 aa, Homo Sapiens
LSAHCTPVT

SEQ ID NO: 527650 - protein, 9 aa, Homo Sapiens
EDLREKLFM

SEQ ID NO: 527651 - protein, 9 aa, Homo Sapiens
FPHHERCSD

SEQ ID NO: 527652 - protein, 9 aa, Homo Sapiens
RAHSPASSP

SEQ ID NO: 527653 - protein, 9 aa, Homo Sapiens
PIKVVHSES

SEQ ID NO: 527654 - protein, 9 aa, Homo Sapiens
TTSSGGRSL

SEQ ID NO: 527655 - protein, 9 aa, Homo Sapiens
RSLLSAHCT

SEQ ID NO: 527656 - protein, 9 aa, Homo Sapiens
SAPAMALAS

SEQ ID NO: 527657 - protein, 9 aa, Homo Sapiens
ARQRTPSQA

SEQ ID NO: 527658 - protein, 9 aa, Homo Sapiens
VKHFAVEGQ

SEQ ID NO: 527659 - protein, 9 aa, Homo Sapiens
TVPNIFVTS

SEQ ID NO: 527660 - protein, 9 aa, Homo Sapiens
QTVPNIFVT

SEQ ID NO: 527661 - protein, 9 aa, Homo Sapiens
HHKSLDPNC

SEQ ID NO: 527662 - protein, 9 aa, Homo Sapiens
RVKEHHKSL

SEQ ID NO: 527663 - protein, 9 aa, Homo Sapiens
STPTGVDRE

SEQ ID NO: 527664 - protein, 9 aa, Homo Sapiens
KHFAVEGQL

SEQ ID NO: 527665 - protein, 9 aa, Homo Sapiens
MQNKLCFSI

SEQ ID NO: 527666 - protein, 9 aa, Homo Sapiens
PSRSPCVSH

SEQ ID NO: 527667 - protein, 9 aa, Homo Sapiens
HVVSQWSRS

SEQ ID NO: 527668 - protein, 9 aa, Homo Sapiens
PAMALASLT

SEQ ID NO: 527669 - protein, 9 aa, Homo Sapiens
KLCFSIDPF

SEQ ID NO: 527670 - protein, 9 aa, Homo Sapiens
PGIFRGDKW

SEQ ID NO: 527671 - protein, 9 aa, Homo Sapiens
DRLLDPTNR

SEQ ID NO: 527672 - protein, 9 aa, Homo Sapiens
GQASRTWSW

SEQ ID NO: 527673 - protein, 9 aa, Homo Sapiens
LLDPTNRAH

SEQ ID NO: 527674 - protein, 9 aa, Homo Sapiens
AVEGQLEFR

SEQ ID NO: 527675 - protein, 9 aa, Homo Sapiens
RVCSKTSEG

SEQ ID NO: 527676 - protein, 9 aa, Homo Sapiens
ELHNLRQFY

SEQ ID NO: 527677 - protein, 9 aa, Homo Sapiens
ALASLTTSS

SEQ ID NO: 527678 - protein, 9 aa, Homo Sapiens
PRGLKPTMV

SEQ ID NO: 527679 - protein, 9 aa, Homo Sapiens
SWPSAPAMA

SEQ ID NO: 527680 - protein, 9 aa, Homo Sapiens
VSHSAGCVG

SEQ ID NO: 527681 - protein, 9 aa, Homo Sapiens
ERHRRGVPR

SEQ ID NO: 527682 - protein, 9 aa, Homo Sapiens
GAGCPAGSG

SEQ ID NO: 527683 - protein, 9 aa, Homo Sapiens
MQTVPNIFV

SEQ ID NO: 527684 - protein, 9 aa, Homo Sapiens
KLSGAIIHT

SEQ ID NO: 527685 - protein, 9 aa, Homo Sapiens
LDPTNRAHL

SEQ ID NO: 527686 - protein, 9 aa, Homo Sapiens
ASSGPCTLL

SEQ ID NO: 527687 - protein, 9 aa, Homo Sapiens
ARSRLARQR

SEQ ID NO: 527688 - protein, 9 aa, Homo Sapiens
HFAVEGQLE

SEQ ID NO: 527689 - protein, 9 aa, Homo Sapiens
DIADAALAA

SEQ ID NO: 527690 - protein, 9 aa, Homo Sapiens
HCTPVTSWP

SEQ ID NO: 527691 - protein, 9 aa, Homo Sapiens
QRTPSQASS

SEQ ID NO: 527692 - protein, 9 aa, Homo Sapiens
CQPPAGSPP

SEQ ID NO: 527693 - protein, 9 aa, Homo Sapiens
YTSFIHSDP

SEQ ID NO: 527694 - protein, 9 aa, Homo Sapiens
RFPHHERCS

SEQ ID NO: 527695 - protein, 9 aa, Homo Sapiens
TKAIKRTIF

SEQ ID NO: 527696 - protein, 9 aa, Homo Sapiens
GGSWPSAPA

SEQ ID NO: 527697 - protein, 9 aa, Homo Sapiens
RLARQRTPS

SEQ ID NO: 527698 - protein, 9 aa, Homo Sapiens
DLREKLFMA

SEQ ID NO: 527699 - protein, 9 aa, Homo Sapiens
KSLDPNCPR

SEQ ID NO: 527700 - protein, 9 aa, Homo Sapiens
AHCTPVTSW

SEQ ID NO: 527701 - protein, 9 aa, Homo Sapiens
FSIDPFQLP

SEQ ID NO: 527702 - protein, 9 aa, Homo Sapiens
SLTTSSGGR

SEQ ID NO: 527703 - protein, 9 aa, Homo Sapiens
GSWPSAPAM

SEQ ID NO: 527704 - protein, 9 aa, Homo Sapiens
CVSHSAGCV

SEQ ID NO: 527705 - protein, 9 aa, Homo Sapiens
SKTSEGTDG

SEQ ID NO: 527706 - protein, 9 aa, Homo Sapiens
KPTMVRFGI

SEQ ID NO: 527707 - protein, 9 aa, Homo Sapiens
TNRSSFKTP

SEQ ID NO: 527708 - protein, 9 aa, Homo Sapiens
VPNIFVTSL

SEQ ID NO: 527709 - protein, 9 aa, Homo Sapiens
SESSTTSSE

SEQ ID NO: 527710 - protein, 9 aa, Homo Sapiens
RQRTPSQAS

SEQ ID NO: 527711 - protein, 9 aa, Homo Sapiens
VCSKTSEGT

SEQ ID NO: 527712 - protein, 9 aa, Homo Sapiens
VQCQPPAGS

SEQ ID NO: 527713 - protein, 9 aa, Homo Sapiens
LKADVMVKC

SEQ ID NO: 527714 - protein, 9 aa, Homo Sapiens
GRVCSKTSE

SEQ ID NO: 527715 - protein, 9 aa, Homo Sapiens
SARSRLARQ

SEQ ID NO: 527716 - protein, 9 aa, Homo Sapiens
GPCTLLTPT

SEQ ID NO: 527717 - protein, 9 aa, Homo Sapiens
REKLFMAVE

SEQ ID NO: 527718 - protein, 9 aa, Homo Sapiens
IKVVHSESQ

SEQ ID NO: 527719 - protein, 9 aa, Homo Sapiens
ESSTTSSEA

SEQ ID NO: 527720 - protein, 9 aa, Homo Sapiens
TSWPWRAHS

SEQ ID NO: 527721 - protein, 9 aa, Homo Sapiens
LARQRTPSQ

SEQ ID NO: 527722 - protein, 9 aa, Homo Sapiens
SGPCTLLTP

SEQ ID NO: 527723 - protein, 9 aa, Homo Sapiens
TMVRFGICR

SEQ ID NO: 527724 - protein, 9 aa, Homo Sapiens
PNIFVTSLA

SEQ ID NO: 527725 - protein, 9 aa, Homo Sapiens
GLKPTMVRF

SEQ ID NO: 527726 - protein, 9 aa, Homo Sapiens
LAPQERHRR

SEQ ID NO: 527727 - protein, 9 aa, Homo Sapiens
SGGRSLLSA

SEQ ID NO: 527728 - protein, 9 aa, Homo Sapiens
ADVMVKCYH

SEQ ID NO: 527729 - protein, 9 aa, Homo Sapiens
CSKTSEGTD

SEQ ID NO: 527730 - protein, 9 aa, Homo Sapiens
AQLLKADVM

SEQ ID NO: 527731 - protein, 9 aa, Homo Sapiens
WRAHSPASS

SEQ ID NO: 527732 - protein, 9 aa, Homo Sapiens
APQERHRRG

SEQ ID NO: 527733 - protein, 9 aa, Homo Sapiens
RLAPQERHR

SEQ ID NO: 527734 - protein, 9 aa, Homo Sapiens
SWPWRAHSP

SEQ ID NO: 527735 - protein, 9 aa, Homo Sapiens
GSPPWPCTL

SEQ ID NO: 527736 - protein, 9 aa, Homo Sapiens
TSEGTDGCE

SEQ ID NO: 527737 - protein, 9 aa, Homo Sapiens
LHNLRQFYV

SEQ ID NO: 527738 - protein, 9 aa, Homo Sapiens
MEVEENGVK

SEQ ID NO: 527739 - protein, 9 aa, Homo Sapiens
AFQILLRKR

SEQ ID NO: 527740 - protein, 9 aa, Homo Sapiens
ERVKEHHKS

SEQ ID NO: 527741 - protein, 9 aa, Homo Sapiens
NRSSFKTPE

SEQ ID NO: 527742 - protein, 9 aa, Homo Sapiens
LCSARSRLA

SEQ ID NO: 527743 - protein, 9 aa, Homo Sapiens
FAEQIFYTS

SEQ ID NO: 527744 - protein, 9 aa, Homo Sapiens
SFKTPEPVV

SEQ ID NO: 527745 - protein, 9 aa, Homo Sapiens
LRQFYVKQQ

SEQ ID NO: 527746 - protein, 9 aa, Homo Sapiens
GCVGAGCPA

SEQ ID NO: 527747 - protein, 9 aa, Homo Sapiens
GCPAGSGTR

SEQ ID NO: 527748 - protein, 9 aa, Homo Sapiens
PERRPPQGG

SEQ ID NO: 527749 - protein, 9 aa, Homo Sapiens
CVGAGCPAG

SEQ ID NO: 527750 - protein, 9 aa, Homo Sapiens
HRRGVPRLS

SEQ ID NO: 527751 - protein, 9 aa, Homo Sapiens
PRLSGQASR

SEQ ID NO: 527752 - protein, 9 aa, Homo Sapiens
PQERHRRGV

SEQ ID NO: 527753 - protein, 9 aa, Homo Sapiens
WPCTLSGGS

SEQ ID NO: 527754 - protein, 9 aa, Homo Sapiens
LASLTTSSG

SEQ ID NO: 527755 - protein, 9 aa, Homo Sapiens
SLLSAHCTP

SEQ ID NO: 527756 - protein, 9 aa, Homo Sapiens
SYHPGIFRG

SEQ ID NO: 527757 - protein, 9 aa, Homo Sapiens
SRLARQRTP

SEQ ID NO: 527758 - protein, 9 aa, Homo Sapiens
VVSQWSRSA

SEQ ID NO: 527759 - protein, 9 aa, Homo Sapiens
PASSPSRSP

SEQ ID NO: 527760 - protein, 9 aa, Homo Sapiens
SKLEDIADA

SEQ ID NO: 527761 - protein, 9 aa, Homo Sapiens
FEDLREKLF

SEQ ID NO: 527762 - protein, 9 aa, Homo Sapiens
VKLSGAIIH

SEQ ID NO: 527763 - protein, 9 aa, Homo Sapiens
RRPPQGGNQ

SEQ ID NO: 527764 - protein, 9 aa, Homo Sapiens
EQIFYTSFI

SEQ ID NO: 527765 - protein, 9 aa, Homo Sapiens
CFNEVKLSG

SEQ ID NO: 527766 - protein, 9 aa, Homo Sapiens
SIDPFQLPA

SEQ ID NO: 527767 - protein, 9 aa, Homo Sapiens
SGGSWPSAP

SEQ ID NO: 527768 - protein, 9 aa, Homo Sapiens
CTLSGGSWP

SEQ ID NO: 527769 - protein, 9 aa, Homo Sapiens
VVHSESQPE

SEQ ID NO: 527770 - protein, 9 aa, Homo Sapiens
PAQLLKADV

SEQ ID NO: 527771 - protein, 9 aa, Homo Sapiens
ASRTWSWRL

SEQ ID NO: 527772 - protein, 9 aa, Homo Sapiens
RSPCVSHSA

SEQ ID NO: 527773 - protein, 9 aa, Homo Sapiens
HSRRQPHVV

SEQ ID NO: 527774 - protein, 9 aa, Homo Sapiens
RLCSARSRL

SEQ ID NO: 527775 - protein, 9 aa, Homo Sapiens
IDPFQLPAK

SEQ ID NO: 527776 - protein, 9 aa, Homo Sapiens
TSSGGRSLL

SEQ ID NO: 527777 - protein, 9 aa, Homo Sapiens
TEVVRRFPH

SEQ ID NO: 527778 - protein, 9 aa, Homo Sapiens
ASSPSRSPC

SEQ ID NO: 527779 - protein, 9 aa, Homo Sapiens
SERVKEHHK

SEQ ID NO: 527780 - protein, 9 aa, Homo Sapiens
KTSEGTDGC

SEQ ID NO: 527781 - protein, 9 aa, Homo Sapiens
WRLCSARSR

SEQ ID NO: 527782 - protein, 9 aa, Homo Sapiens
PWRAHSPAS

SEQ ID NO: 527783 - protein, 9 aa, Homo Sapiens
PGKPERRPP

SEQ ID NO: 527784 - protein, 9 aa, Homo Sapiens
KLEDIADAA

SEQ ID NO: 527785 - protein, 9 aa, Homo Sapiens
PSQASSGPC

SEQ ID NO: 527786 - protein, 9 aa, Homo Sapiens
PCVSHSAGC

SEQ ID NO: 527787 - protein, 9 aa, Homo Sapiens
ADAALAASA

SEQ ID NO: 527788 - protein, 9 aa, Homo Sapiens
SGTRLAPQE

SEQ ID NO: 527789 - protein, 9 aa, Homo Sapiens
RTWSWRLCS

SEQ ID NO: 527790 - protein, 9 aa, Homo Sapiens
TPVTSWPWR

SEQ ID NO: 527791 - protein, 9 aa, Homo Sapiens
QERHRRGVP

SEQ ID NO: 527792 - protein, 9 aa, Homo Sapiens
LSGQASRTW

SEQ ID NO: 527793 - protein, 9 aa, Homo Sapiens
NKLCFSIDP

SEQ ID NO: 527794 - protein, 9 aa, Homo Sapiens
VRRFPHHER

SEQ ID NO: 527795 - protein, 9 aa, Homo Sapiens
QLLKADVMV

SEQ ID NO: 527796 - protein, 9 aa, Homo Sapiens
SPPWPCTLS

SEQ ID NO: 527797 - protein, 9 aa, Homo Sapiens
RGLKPTMVR

SEQ ID NO: 527798 - protein, 9 aa, Homo Sapiens
RNKEITKAI

SEQ ID NO: 527799 - protein, 9 aa, Homo Sapiens
SLRNKEITK

SEQ ID NO: 527800 - protein, 9 aa, Homo Sapiens
QCQPPAGSP

SEQ ID NO: 527801 - protein, 9 aa, Homo Sapiens
IFVTSLAFG

SEQ ID NO: 527802 - protein, 9 aa, Homo Sapiens
EVVRRFPHH

SEQ ID NO: 527803 - protein, 9 aa, Homo Sapiens
PPGKPERRP

SEQ ID NO: 527804 - protein, 9 aa, Homo Sapiens
RRQPHVVSQ

SEQ ID NO: 527805 - protein, 9 aa, Homo Sapiens
EPAQLLKAD

SEQ ID NO: 527806 - protein, 9 aa, Homo Sapiens
SSPSRSPCV

SEQ ID NO: 527807 - protein, 9 aa, Homo Sapiens
IFRGDKWSC

SEQ ID NO: 527808 - protein, 9 aa, Homo Sapiens
NGVKMCKPC

SEQ ID NO: 527809 - protein, 9 aa, Homo Sapiens
VEENGVKMC

SEQ ID NO: 527810 - protein, 9 aa, Homo Sapiens
TRLAPQERH

SEQ ID NO: 527811 - protein, 9 aa, Homo Sapiens
KADVMVKCY

SEQ ID NO: 527812 - protein, 9 aa, Homo Sapiens
HSAGCVGAG

SEQ ID NO: 527813 - protein, 9 aa, Homo Sapiens
QPPAGSPPW

SEQ ID NO: 527814 - protein, 9 aa, Homo Sapiens
PSAPAMALA

SEQ ID NO: 527815 - protein, 9 aa, Homo Sapiens
FAVEGQLEF

SEQ ID NO: 527816 - protein, 9 aa, Homo Sapiens
LREKLFMAV

SEQ ID NO: 527817 - protein, 9 aa, Homo Sapiens
APAMALASL

SEQ ID NO: 527818 - protein, 9 aa, Homo Sapiens
CSARSRLAR

SEQ ID NO: 527819 - protein, 9 aa, Homo Sapiens
SRTWSWRLC

SEQ ID NO: 527820 - protein, 9 aa, Homo Sapiens
SELRDGIAM

SEQ ID NO: 527821 - protein, 9 aa, Homo Sapiens
HRCNHCSLA

SEQ ID NO: 527822 - protein, 9 aa, Homo Sapiens
RRRQEEAKK

SEQ ID NO: 527823 - protein, 9 aa, Homo Sapiens
PALEIANAL

SEQ ID NO: 527824 - protein, 9 aa, Homo Sapiens
QEEAKKRIG

SEQ ID NO: 527825 - protein, 9 aa, Homo Sapiens
QVLLACADG

SEQ ID NO: 527826 - protein, 9 aa, Homo Sapiens
DKVDLTDEK

SEQ ID NO: 527827 - protein, 9 aa, Homo Sapiens
FFPEPGGGL

SEQ ID NO: 527828 - protein, 9 aa, Homo Sapiens
IATLLAGRK

SEQ ID NO: 527829 - protein, 9 aa, Homo Sapiens
KKKSLGKWL

SEQ ID NO: 527830 - protein, 9 aa, Homo Sapiens
IMIGTRMIK

SEQ ID NO: 527831 - protein, 9 aa, Homo Sapiens
WRGLKSDPP

SEQ ID NO: 527832 - protein, 9 aa, Homo Sapiens
GKWLQASLG

SEQ ID NO: 527833 - protein, 9 aa, Homo Sapiens
TQQQIVRLA

SEQ ID NO: 527834 - protein, 9 aa, Homo Sapiens
TWRGLKSDP

SEQ ID NO: 527835 - protein, 9 aa, Homo Sapiens
SSTPDLNIQ

SEQ ID NO: 527836 - protein, 9 aa, Homo Sapiens
GKNTNKPPM

SEQ ID NO: 527837 - protein, 9 aa, Homo Sapiens
SYERSRDRE

SEQ ID NO: 527838 - protein, 9 aa, Homo Sapiens
RDGIAMLVA

SEQ ID NO: 527839 - protein, 9 aa, Homo Sapiens
RMIKFPGKN

SEQ ID NO: 527840 - protein, 9 aa, Homo Sapiens
PEPGGGLWS

SEQ ID NO: 527841 - protein, 9 aa, Homo Sapiens
TDEKSLLSS

SEQ ID NO: 527842 - protein, 9 aa, Homo Sapiens
GLKSDPPNS

SEQ ID NO: 527843 - protein, 9 aa, Homo Sapiens
ALEIANALR

SEQ ID NO: 527844 - protein, 9 aa, Homo Sapiens
LIMSPKSGR

SEQ ID NO: 527845 - protein, 9 aa, Homo Sapiens
PFSSSRAAI

SEQ ID NO: 527846 - protein, 9 aa, Homo Sapiens
DLCLPASSK

SEQ ID NO: 527847 - protein, 9 aa, Homo Sapiens
QFIDYEYFG

SEQ ID NO: 527848 - protein, 9 aa, Homo Sapiens
HQLLQDSTI

SEQ ID NO: 527849 - protein, 9 aa, Homo Sapiens
RQEEAKKRI

SEQ ID NO: 527850 - protein, 9 aa, Homo Sapiens
KSLLSSWDF

SEQ ID NO: 527851 - protein, 9 aa, Homo Sapiens
DSELRDGIA

SEQ ID NO: 527852 - protein, 9 aa, Homo Sapiens
TRMIKFPGK

SEQ ID NO: 527853 - protein, 9 aa, Homo Sapiens
KRVQKRYIL

SEQ ID NO: 527854 - protein, 9 aa, Homo Sapiens
KKRIGGEVG

SEQ ID NO: 527855 - protein, 9 aa, Homo Sapiens
SKPSADSRP

SEQ ID NO: 527856 - protein, 9 aa, Homo Sapiens
LRDGIAMLV

SEQ ID NO: 527857 - protein, 9 aa, Homo Sapiens
IDSELRDGI

SEQ ID NO: 527858 - protein, 9 aa, Homo Sapiens
LDTQQQIVR

SEQ ID NO: 527859 - protein, 9 aa, Homo Sapiens
RYILIMSPK

SEQ ID NO: 527860 - protein, 9 aa, Homo Sapiens
PDLNIQFHS

SEQ ID NO: 527861 - protein, 9 aa, Homo Sapiens
LLQDSTIAT

SEQ ID NO: 527862 - protein, 9 aa, Homo Sapiens
KWLQASLGG

SEQ ID NO: 527863 - protein, 9 aa, Homo Sapiens
TVDASHALH

SEQ ID NO: 527864 - protein, 9 aa, Homo Sapiens
DSTIATLLA

SEQ ID NO: 527865 - protein, 9 aa, Homo Sapiens
HVYKHRCNH

SEQ ID NO: 527866 - protein, 9 aa, Homo Sapiens
DTQQQIVRL

SEQ ID NO: 527867 - protein, 9 aa, Homo Sapiens
YKHRCNHCS

SEQ ID NO: 527868 - protein, 9 aa, Homo Sapiens
ASSKPSADS

SEQ ID NO: 527869 - protein, 9 aa, Homo Sapiens
PSYPCPQVL

SEQ ID NO: 527870 - protein, 9 aa, Homo Sapiens
TPDLNIQFH

SEQ ID NO: 527871 - protein, 9 aa, Homo Sapiens
YSSTPDLNI

SEQ ID NO: 527872 - protein, 9 aa, Homo Sapiens
EPSYPCPQV

SEQ ID NO: 527873 - protein, 9 aa, Homo Sapiens
CPFSSSRAA

SEQ ID NO: 527874 - protein, 9 aa, Homo Sapiens
LNAGDLSYP

SEQ ID NO: 527875 - protein, 9 aa, Homo Sapiens
EEAKKRIGG

SEQ ID NO: 527876 - protein, 9 aa, Homo Sapiens
FSSSRAAIF

SEQ ID NO: 527877 - protein, 9 aa, Homo Sapiens
LHIQGIQPA

SEQ ID NO: 527878 - protein, 9 aa, Homo Sapiens
LQDSTIATL

SEQ ID NO: 527879 - protein, 9 aa, Homo Sapiens
LSYPWLADS

SEQ ID NO: 527880 - protein, 9 aa, Homo Sapiens
EPGGGLWSI

SEQ ID NO: 527881 - protein, 9 aa, Homo Sapiens
VLLACADGR

SEQ ID NO: 527882 - protein, 9 aa, Homo Sapiens
MTVDASHAL

SEQ ID NO: 527883 - protein, 9 aa, Homo Sapiens
DLNIQFHSD

SEQ ID NO: 527884 - protein, 9 aa, Homo Sapiens
PGLRIGLGT

SEQ ID NO: 527885 - protein, 9 aa, Homo Sapiens
VSDRHVYKH

SEQ ID NO: 527886 - protein, 9 aa, Homo Sapiens
PCPQVLLAC

SEQ ID NO: 527887 - protein, 9 aa, Homo Sapiens
QQQIVRLAV

SEQ ID NO: 527888 - protein, 9 aa, Homo Sapiens
PGKNTNKPP

SEQ ID NO: 527889 - protein, 9 aa, Homo Sapiens
SPKSGRIMI

SEQ ID NO: 527890 - protein, 9 aa, Homo Sapiens
AFDPCCPFS

SEQ ID NO: 527891 - protein, 9 aa, Homo Sapiens
GDLSYPWLA

SEQ ID NO: 527892 - protein, 9 aa, Homo Sapiens
PQVLLACAD

SEQ ID NO: 527893 - protein, 9 aa, Homo Sapiens
GLLNAGDLS

SEQ ID NO: 527894 - protein, 9 aa, Homo Sapiens
SQFFPEPGG

SEQ ID NO: 527895 - protein, 9 aa, Homo Sapiens
SRDRERERH

SEQ ID NO: 527896 - protein, 9 aa, Homo Sapiens
ILIMSPKSG

SEQ ID NO: 527897 - protein, 9 aa, Homo Sapiens
RSRDRERER

SEQ ID NO: 527898 - protein, 9 aa, Homo Sapiens
VDLTDEKSL

SEQ ID NO: 527899 - protein, 9 aa, Homo Sapiens
NIQFHSDPA

SEQ ID NO: 527900 - protein, 9 aa, Homo Sapiens
GRPLPLDTQ

SEQ ID NO: 527901 - protein, 9 aa, Homo Sapiens
YFGYNYLAY

SEQ ID NO: 527902 - protein, 9 aa, Homo Sapiens
DRHVYKHRC

SEQ ID NO: 527903 - protein, 9 aa, Homo Sapiens
VQFIDYEYF

SEQ ID NO: 527904 - protein, 9 aa, Homo Sapiens
HALHIQGIQ

SEQ ID NO: 527905 - protein, 9 aa, Homo Sapiens
TKIIDSELR

SEQ ID NO: 527906 - protein, 9 aa, Homo Sapiens
RRQEEAKKR

SEQ ID NO: 527907 - protein, 9 aa, Homo Sapiens
SSKPSADSR

SEQ ID NO: 527908 - protein, 9 aa, Homo Sapiens
LTDEKSLLS

SEQ ID NO: 527909 - protein, 9 aa, Homo Sapiens
MIGTRMIKF

SEQ ID NO: 527910 - protein, 9 aa, Homo Sapiens
IMSPKSGRI

SEQ ID NO: 527911 - protein, 9 aa, Homo Sapiens
QLLQDSTIA

SEQ ID NO: 527912 - protein, 9 aa, Homo Sapiens
DLSYPWLAD

SEQ ID NO: 527913 - protein, 9 aa, Homo Sapiens
YPCPQVLLA

SEQ ID NO: 527914 - protein, 9 aa, Homo Sapiens
LCLPASSKP

SEQ ID NO: 527915 - protein, 9 aa, Homo Sapiens
SAFDPCCPF

SEQ ID NO: 527916 - protein, 9 aa, Homo Sapiens
LRKPLVIIA

SEQ ID NO: 527917 - protein, 9 aa, Homo Sapiens
NTNKPPMVT

SEQ ID NO: 527918 - protein, 9 aa, Homo Sapiens
QKRYILIMS

SEQ ID NO: 527919 - protein, 9 aa, Homo Sapiens
KVDLTDEKS

SEQ ID NO: 527920 - protein, 9 aa, Homo Sapiens
IDYEYFGYN

SEQ ID NO: 527921 - protein, 9 aa, Homo Sapiens
LKSDPPNSR

SEQ ID NO: 527922 - protein, 9 aa, Homo Sapiens
RSQFFPEPG

SEQ ID NO: 527923 - protein, 9 aa, Homo Sapiens
CCPFSSSRA

SEQ ID NO: 527924 - protein, 9 aa, Homo Sapiens
EAKKRIGGE

SEQ ID NO: 527925 - protein, 9 aa, Homo Sapiens
TNKPPMVTT

SEQ ID NO: 527926 - protein, 9 aa, Homo Sapiens
KFPGKNTNK

SEQ ID NO: 527927 - protein, 9 aa, Homo Sapiens
GLRIGLGTA

SEQ ID NO: 527928 - protein, 9 aa, Homo Sapiens
RSYERSRDR

SEQ ID NO: 527929 - protein, 9 aa, Homo Sapiens
KSGRIMIGT

SEQ ID NO: 527930 - protein, 9 aa, Homo Sapiens
KHRCNHCSL

SEQ ID NO: 527931 - protein, 9 aa, Homo Sapiens
AGDLSYPWL

SEQ ID NO: 527932 - protein, 9 aa, Homo Sapiens
RPGLRIGLG

SEQ ID NO: 527933 - protein, 9 aa, Homo Sapiens
DASHALHIQ

SEQ ID NO: 527934 - protein, 9 aa, Homo Sapiens
YERSRDRER

SEQ ID NO: 527935 - protein, 9 aa, Homo Sapiens
ALRKPLVII

SEQ ID NO: 527936 - protein, 9 aa, Homo Sapiens
PGLLNAGDL

SEQ ID NO: 527937 - protein, 9 aa, Homo Sapiens
KRYILIMSP

SEQ ID NO: 527938 - protein, 9 aa, Homo Sapiens
CPQVLLACA

SEQ ID NO: 527939 - protein, 9 aa, Homo Sapiens
LNIQFHSDP

SEQ ID NO: 527940 - protein, 9 aa, Homo Sapiens
KKKKSLGKW

SEQ ID NO: 527941 - protein, 9 aa, Homo Sapiens
GTRMIKFPG

SEQ ID NO: 527942 - protein, 9 aa, Homo Sapiens
DRERERHRH

SEQ ID NO: 527943 - protein, 9 aa, Homo Sapiens
FPGKNTNKP

SEQ ID NO: 527944 - protein, 9 aa, Homo Sapiens
HRSYERSRD

SEQ ID NO: 527945 - protein, 9 aa, Homo Sapiens
ATRPGLRIG

SEQ ID NO: 527946 - protein, 9 aa, Homo Sapiens
EKSLLSSWD

SEQ ID NO: 527947 - protein, 9 aa, Homo Sapiens
AKKRIGGEV

SEQ ID NO: 527948 - protein, 9 aa, Homo Sapiens
STPDLNIQF

SEQ ID NO: 527949 - protein, 9 aa, Homo Sapiens
VYKHRCNHC

SEQ ID NO: 527950 - protein, 9 aa, Homo Sapiens
SDPPNSRFW

SEQ ID NO: 527951 - protein, 9 aa, Homo Sapiens
NAGDLSYPW

SEQ ID NO: 527952 - protein, 9 aa, Homo Sapiens
VDASHALHI

SEQ ID NO: 527953 - protein, 9 aa, Homo Sapiens
KSLGKWLQA

SEQ ID NO: 527954 - protein, 9 aa, Homo Sapiens
ALHIQGIQP

SEQ ID NO: 527955 - protein, 9 aa, Homo Sapiens
RIGLGTATI

SEQ ID NO: 527956 - protein, 9 aa, Homo Sapiens
RGLKSDPPN

SEQ ID NO: 527957 - protein, 9 aa, Homo Sapiens
TRPGLRIGL

SEQ ID NO: 527958 - protein, 9 aa, Homo Sapiens
EYFGYNYLA

SEQ ID NO: 527959 - protein, 9 aa, Homo Sapiens
KKSLGKWLQ

SEQ ID NO: 527960 - protein, 9 aa, Homo Sapiens
LLNAGDLSY

SEQ ID NO: 527961 - protein, 9 aa, Homo Sapiens
DPPNSRFWA

SEQ ID NO: 527962 - protein, 9 aa, Homo Sapiens
IKFPGKNTN

SEQ ID NO: 527963 - protein, 9 aa, Homo Sapiens
IIDSELRDG

SEQ ID NO: 527964 - protein, 9 aa, Homo Sapiens
TIATLLAGR

SEQ ID NO: 527965 - protein, 9 aa, Homo Sapiens
DLTDEKSLL

SEQ ID NO: 527966 - protein, 9 aa, Homo Sapiens
PGGGLWSIR

SEQ ID NO: 527967 - protein, 9 aa, Homo Sapiens
ELRDGIAML

SEQ ID NO: 527968 - protein, 9 aa, Homo Sapiens
LRIGLGTAT

SEQ ID NO: 527969 - protein, 9 aa, Homo Sapiens
KIIDSELRD

SEQ ID NO: 527970 - protein, 9 aa, Homo Sapiens
PASSKPSAD

SEQ ID NO: 527971 - protein, 9 aa, Homo Sapiens
FPEPGGGLW

SEQ ID NO: 527972 - protein, 9 aa, Homo Sapiens
PKSGRIMIG

SEQ ID NO: 527973 - protein, 9 aa, Homo Sapiens
LPLDTQQQI

SEQ ID NO: 527974 - protein, 9 aa, Homo Sapiens
SGRIMIGTR

SEQ ID NO: 527975 - protein, 9 aa, Homo Sapiens
YILIMSPKS

SEQ ID NO: 527976 - protein, 9 aa, Homo Sapiens
IANALRKPL

SEQ ID NO: 527977 - protein, 9 aa, Homo Sapiens
QDSTIATLL

SEQ ID NO: 527978 - protein, 9 aa, Homo Sapiens
LEIANALRK

SEQ ID NO: 527979 - protein, 9 aa, Homo Sapiens
SYPCPQVLL

SEQ ID NO: 527980 - protein, 9 aa, Homo Sapiens
KNTNKPPMV

SEQ ID NO: 527981 - protein, 9 aa, Homo Sapiens
PLDTQQQIV

SEQ ID NO: 527982 - protein, 9 aa, Homo Sapiens
DPCCPFSSS

SEQ ID NO: 527983 - protein, 9 aa, Homo Sapiens
LPASSKPSA

SEQ ID NO: 527984 - protein, 9 aa, Homo Sapiens
NALRKPLVI

SEQ ID NO: 527985 - protein, 9 aa, Homo Sapiens
RDRERERHR

SEQ ID NO: 527986 - protein, 9 aa, Homo Sapiens
YEYFGYNYL

SEQ ID NO: 527987 - protein, 9 aa, Homo Sapiens
SLGKWLQAS

SEQ ID NO: 527988 - protein, 9 aa, Homo Sapiens
RHVYKHRCN

SEQ ID NO: 527989 - protein, 9 aa, Homo Sapiens
SHALHIQGI

SEQ ID NO: 527990 - protein, 9 aa, Homo Sapiens
RVQKRYILI

SEQ ID NO: 527991 - protein, 9 aa, Homo Sapiens
GRIMIGTRM

SEQ ID NO: 527992 - protein, 9 aa, Homo Sapiens
ERSRDRERE

SEQ ID NO: 527993 - protein, 9 aa, Homo Sapiens
PLPLDTQQQ

SEQ ID NO: 527994 - protein, 9 aa, Homo Sapiens
WLQASLGGG

SEQ ID NO: 527995 - protein, 9 aa, Homo Sapiens
CLPASSKPS

SEQ ID NO: 527996 - protein, 9 aa, Homo Sapiens
VQKRYILIM

SEQ ID NO: 527997 - protein, 9 aa, Homo Sapiens
SDRHVYKHR

SEQ ID NO: 527998 - protein, 9 aa, Homo Sapiens
GGGLWSIRP

SEQ ID NO: 527999 - protein, 9 aa, Homo Sapiens
EIANALRKP

SEQ ID NO: 528000 - protein, 9 aa, Homo Sapiens
IGTRMIKFP

SEQ ID NO: 528001 - protein, 9 aa, Homo Sapiens
LYSSTPDLN

SEQ ID NO: 528002 - protein, 9 aa, Homo Sapiens
MSPKSGRIM

SEQ ID NO: 528003 - protein, 9 aa, Homo Sapiens
VTWRGLKSD

SEQ ID NO: 528004 - protein, 9 aa, Homo Sapiens
PCCPFSSSR

SEQ ID NO: 528005 - protein, 9 aa, Homo Sapiens
QFFPEPGGG

SEQ ID NO: 528006 - protein, 9 aa, Homo Sapiens
ANALRKPLV

SEQ ID NO: 528007 - protein, 9 aa, Homo Sapiens
MIKFPGKNT

SEQ ID NO: 528008 - protein, 9 aa, Homo Sapiens
IGLGTATIL

SEQ ID NO: 528009 - protein, 9 aa, Homo Sapiens
RIMIGTRMI

SEQ ID NO: 528010 - protein, 9 aa, Homo Sapiens
FIDYEYFGY

SEQ ID NO: 528011 - protein, 9 aa, Homo Sapiens
FGYNYLAYD

SEQ ID NO: 528012 - protein, 9 aa, Homo Sapiens
DEKSLLSSW

SEQ ID NO: 528013 - protein, 9 aa, Homo Sapiens
KPSADSRPS

SEQ ID NO: 528014 - protein, 9 aa, Homo Sapiens
KRRRQEEAK

SEQ ID NO: 528015 - protein, 9 aa, Homo Sapiens
GLGTATILL

SEQ ID NO: 528016 - protein, 9 aa, Homo Sapiens
FDPCCPFSS

SEQ ID NO: 528017 - protein, 9 aa, Homo Sapiens
LGKWLQASL

SEQ ID NO: 528018 - protein, 9 aa, Homo Sapiens
STIATLLAG

SEQ ID NO: 528019 - protein, 9 aa, Homo Sapiens
DYEYFGYNY

SEQ ID NO: 528020 - protein, 9 aa, Homo Sapiens
KSDPPNSRF

SEQ ID NO: 528021 - protein, 9 aa, Homo Sapiens
RPLPLDTQQ

SEQ ID NO: 528022 - protein, 9 aa, Homo Sapiens
ASHALHIQG

SEQ ID NO: 528023 - protein, 9 aa, Homo Sapiens
SLVPKAKIN

SEQ ID NO: 528024 - protein, 9 aa, Homo Sapiens
TLPTGLELF

SEQ ID NO: 528025 - protein, 9 aa, Homo Sapiens
AGAIMTAAT

SEQ ID NO: 528026 - protein, 9 aa, Homo Sapiens
LKTIQQRNL

SEQ ID NO: 528027 - protein, 9 aa, Homo Sapiens
RSGWIMFSV

SEQ ID NO: 528028 - protein, 9 aa, Homo Sapiens
VRIVGSSNE

SEQ ID NO: 528029 - protein, 9 aa, Homo Sapiens
MGGGLPAGF

SEQ ID NO: 528030 - protein, 9 aa, Homo Sapiens
IAIRLDSHQ

SEQ ID NO: 528031 - protein, 9 aa, Homo Sapiens
VGARRVPCG

SEQ ID NO: 528032 - protein, 9 aa, Homo Sapiens
VPCGAAPRI

SEQ ID NO: 528033 - protein, 9 aa, Homo Sapiens
MTAATRRTQ

SEQ ID NO: 528034 - protein, 9 aa, Homo Sapiens
TFSWMGNAL

SEQ ID NO: 528035 - protein, 9 aa, Homo Sapiens
LKFTTVVPG

SEQ ID NO: 528036 - protein, 9 aa, Homo Sapiens
SGWIMFSVG

SEQ ID NO: 528037 - protein, 9 aa, Homo Sapiens
LVPKAKINT

SEQ ID NO: 528038 - protein, 9 aa, Homo Sapiens
DLVQLSHNM

SEQ ID NO: 528039 - protein, 9 aa, Homo Sapiens
PLTFSWMGN

SEQ ID NO: 528040 - protein, 9 aa, Homo Sapiens
SSRTSSTCR

SEQ ID NO: 528041 - protein, 9 aa, Homo Sapiens
MPLSSAACW

SEQ ID NO: 528042 - protein, 9 aa, Homo Sapiens
RRTQAWSAA

SEQ ID NO: 528043 - protein, 9 aa, Homo Sapiens
IVNDPDGRE

SEQ ID NO: 528044 - protein, 9 aa, Homo Sapiens
VVPGGQFAM

SEQ ID NO: 528045 - protein, 9 aa, Homo Sapiens
IFRQDRVSK

SEQ ID NO: 528046 - protein, 9 aa, Homo Sapiens
SGPRSKTAS

SEQ ID NO: 528047 - protein, 9 aa, Homo Sapiens
GQFAMTSGK

SEQ ID NO: 528048 - protein, 9 aa, Homo Sapiens
DSHQHTPMY

SEQ ID NO: 528049 - protein, 9 aa, Homo Sapiens
LTFSWMGNA

SEQ ID NO: 528050 - protein, 9 aa, Homo Sapiens
SSAACWVTP

SEQ ID NO: 528051 - protein, 9 aa, Homo Sapiens
FRQDRVSKG

SEQ ID NO: 528052 - protein, 9 aa, Homo Sapiens
RIEEELRLE

SEQ ID NO: 528053 - protein, 9 aa, Homo Sapiens
GARRVPCGA

SEQ ID NO: 528054 - protein, 9 aa, Homo Sapiens
VPGGQFAMT

SEQ ID NO: 528055 - protein, 9 aa, Homo Sapiens
KILMPLSSA

SEQ ID NO: 528056 - protein, 9 aa, Homo Sapiens
PCTKWELAL

SEQ ID NO: 528057 - protein, 9 aa, Homo Sapiens
LELFNRPPS

SEQ ID NO: 528058 - protein, 9 aa, Homo Sapiens
KTRQDPKEN

SEQ ID NO: 528059 - protein, 9 aa, Homo Sapiens
ACWVTPKEG

SEQ ID NO: 528060 - protein, 9 aa, Homo Sapiens
DGDIFRQDR

SEQ ID NO: 528061 - protein, 9 aa, Homo Sapiens
SHQHTPMYL

SEQ ID NO: 528062 - protein, 9 aa, Homo Sapiens
QHTPMYLFL

SEQ ID NO: 528063 - protein, 9 aa, Homo Sapiens
HATSLPVTN

SEQ ID NO: 528064 - protein, 9 aa, Homo Sapiens
IEEELRLEQ

SEQ ID NO: 528065 - protein, 9 aa, Homo Sapiens
ALMGGGLPA

SEQ ID NO: 528066 - protein, 9 aa, Homo Sapiens
AACWVTPKE

SEQ ID NO: 528067 - protein, 9 aa, Homo Sapiens
LFNRPPSST

SEQ ID NO: 528068 - protein, 9 aa, Homo Sapiens
PKAKINTIL

SEQ ID NO: 528069 - protein, 9 aa, Homo Sapiens
MGNALSPLD

SEQ ID NO: 528070 - protein, 9 aa, Homo Sapiens
GLKFTTVVP

SEQ ID NO: 528071 - protein, 9 aa, Homo Sapiens
RSKTASPKL

SEQ ID NO: 528072 - protein, 9 aa, Homo Sapiens
QFAMTSGKI

SEQ ID NO: 528073 - protein, 9 aa, Homo Sapiens
EEKIVNDPD

SEQ ID NO: 528074 - protein, 9 aa, Homo Sapiens
TRAPHNPGH

SEQ ID NO: 528075 - protein, 9 aa, Homo Sapiens
NEAGLKFTT

SEQ ID NO: 528076 - protein, 9 aa, Homo Sapiens
AIMTAATRR

SEQ ID NO: 528077 - protein, 9 aa, Homo Sapiens
TTVVPGGQF

SEQ ID NO: 528078 - protein, 9 aa, Homo Sapiens
AIASGRARY

SEQ ID NO: 528079 - protein, 9 aa, Homo Sapiens
PHNPGHVIQ

SEQ ID NO: 528080 - protein, 9 aa, Homo Sapiens
LALGRSGWI

SEQ ID NO: 528081 - protein, 9 aa, Homo Sapiens
LVQLSHNML

SEQ ID NO: 528082 - protein, 9 aa, Homo Sapiens
GLLVALMGG

SEQ ID NO: 528083 - protein, 9 aa, Homo Sapiens
FECLKTIQQ

SEQ ID NO: 528084 - protein, 9 aa, Homo Sapiens
IMFSVGARR

SEQ ID NO: 528085 - protein, 9 aa, Homo Sapiens
PGGQFAMTS

SEQ ID NO: 528086 - protein, 9 aa, Homo Sapiens
AAPRIAGAI

SEQ ID NO: 528087 - protein, 9 aa, Homo Sapiens
QAHITRAPH

SEQ ID NO: 528088 - protein, 9 aa, Homo Sapiens
FSWMGNALS

SEQ ID NO: 528089 - protein, 9 aa, Homo Sapiens
GAIMTAATR

SEQ ID NO: 528090 - protein, 9 aa, Homo Sapiens
ELFNRPPSS

SEQ ID NO: 528091 - protein, 9 aa, Homo Sapiens
FEVFFQRLA

SEQ ID NO: 528092 - protein, 9 aa, Homo Sapiens
PRIAGAIMT

SEQ ID NO: 528093 - protein, 9 aa, Homo Sapiens
FGLINSQNP

SEQ ID NO: 528094 - protein, 9 aa, Homo Sapiens
TPKEGPCTK

SEQ ID NO: 528095 - protein, 9 aa, Homo Sapiens
PPLTFSWMG

SEQ ID NO: 528096 - protein, 9 aa, Homo Sapiens
SAACWVTPK

SEQ ID NO: 528097 - protein, 9 aa, Homo Sapiens
SPEETIQSK

SEQ ID NO: 528098 - protein, 9 aa, Homo Sapiens
LVALMGGGL

SEQ ID NO: 528099 - protein, 9 aa, Homo Sapiens
KEGPCTKWE

SEQ ID NO: 528100 - protein, 9 aa, Homo Sapiens
GPCTKWELA

SEQ ID NO: 528101 - protein, 9 aa, Homo Sapiens
INTILIDPS

SEQ ID NO: 528102 - protein, 9 aa, Homo Sapiens
CWVTPKEGP

SEQ ID NO: 528103 - protein, 9 aa, Homo Sapiens
ILMPLSSAA

SEQ ID NO: 528104 - protein, 9 aa, Homo Sapiens
QSEEKIVND

SEQ ID NO: 528105 - protein, 9 aa, Homo Sapiens
FFQRLAIAS

SEQ ID NO: 528106 - protein, 9 aa, Homo Sapiens
FSVGARRVP

SEQ ID NO: 528107 - protein, 9 aa, Homo Sapiens
GPPLTFSWM

SEQ ID NO: 528108 - protein, 9 aa, Homo Sapiens
WVTPKEGPC

SEQ ID NO: 528109 - protein, 9 aa, Homo Sapiens
SSNEAGLKF

SEQ ID NO: 528110 - protein, 9 aa, Homo Sapiens
HQHTPMYLF

SEQ ID NO: 528111 - protein, 9 aa, Homo Sapiens
LPTGLELFN

SEQ ID NO: 528112 - protein, 9 aa, Homo Sapiens
QCFECLKTI

SEQ ID NO: 528113 - protein, 9 aa, Homo Sapiens
TAWLEWWHV

SEQ ID NO: 528114 - protein, 9 aa, Homo Sapiens
GVHHAAGQV

SEQ ID NO: 528115 - protein, 9 aa, Homo Sapiens
EEELRLEQQ

SEQ ID NO: 528116 - protein, 9 aa, Homo Sapiens
ELRLEQQKQ

SEQ ID NO: 528117 - protein, 9 aa, Homo Sapiens
LSSAACWVT

SEQ ID NO: 528118 - protein, 9 aa, Homo Sapiens
ATSLPVTNT

SEQ ID NO: 528119 - protein, 9 aa, Homo Sapiens
AMTSGKILM

SEQ ID NO: 528120 - protein, 9 aa, Homo Sapiens
WELALGRSG

SEQ ID NO: 528121 - protein, 9 aa, Homo Sapiens
KDLVQLSHN

SEQ ID NO: 528122 - protein, 9 aa, Homo Sapiens
IKDLVQLSH

SEQ ID NO: 528123 - protein, 9 aa, Homo Sapiens
LEWWHVQPT

SEQ ID NO: 528124 - protein, 9 aa, Homo Sapiens
RAPHNPGHV

SEQ ID NO: 528125 - protein, 9 aa, Homo Sapiens
APHNPGHVI

SEQ ID NO: 528126 - protein, 9 aa, Homo Sapiens
LAIASGRAR

SEQ ID NO: 528127 - protein, 9 aa, Homo Sapiens
AGLKFTTVV

SEQ ID NO: 528128 - protein, 9 aa, Homo Sapiens
NGLLVALMG

SEQ ID NO: 528129 - protein, 9 aa, Homo Sapiens
IAGAIMTAA

SEQ ID NO: 528130 - protein, 9 aa, Homo Sapiens
IMTAATRRT

SEQ ID NO: 528131 - protein, 9 aa, Homo Sapiens
KTKTRQDPK

SEQ ID NO: 528132 - protein, 9 aa, Homo Sapiens
IVGSSNEAG

SEQ ID NO: 528133 - protein, 9 aa, Homo Sapiens
LFLDGDIFR

SEQ ID NO: 528134 - protein, 9 aa, Homo Sapiens
MQAHITRAP

SEQ ID NO: 528135 - protein, 9 aa, Homo Sapiens
EGPCTKWEL

SEQ ID NO: 528136 - protein, 9 aa, Homo Sapiens
MTSGKILMP

SEQ ID NO: 528137 - protein, 9 aa, Homo Sapiens
CFECLKTIQ

SEQ ID NO: 528138 - protein, 9 aa, Homo Sapiens
FTTVVPGGQ

SEQ ID NO: 528139 - protein, 9 aa, Homo Sapiens
TGLELFNRP

SEQ ID NO: 528140 - protein, 9 aa, Homo Sapiens
LMGGGLPAG

SEQ ID NO: 528141 - protein, 9 aa, Homo Sapiens
INSQNPFLG

SEQ ID NO: 528142 - protein, 9 aa, Homo Sapiens
RIAGAIMTA

SEQ ID NO: 528143 - protein, 9 aa, Homo Sapiens
KINTILIDP

SEQ ID NO: 528144 - protein, 9 aa, Homo Sapiens
IRLDSHQHT

SEQ ID NO: 528145 - protein, 9 aa, Homo Sapiens
APRIAGAIM

SEQ ID NO: 528146 - protein, 9 aa, Homo Sapiens
TKWELALGR

SEQ ID NO: 528147 - protein, 9 aa, Homo Sapiens
TASPKLSPE

SEQ ID NO: 528148 - protein, 9 aa, Homo Sapiens
PLSSAACWV

SEQ ID NO: 528149 - protein, 9 aa, Homo Sapiens
RLAIASGRA

SEQ ID NO: 528150 - protein, 9 aa, Homo Sapiens
EVFFQRLAI

SEQ ID NO: 528151 - protein, 9 aa, Homo Sapiens
GDIFRQDRV

SEQ ID NO: 528152 - protein, 9 aa, Homo Sapiens
FCHWFFGLI

SEQ ID NO: 528153 - protein, 9 aa, Homo Sapiens
RTQAWSAAS

SEQ ID NO: 528154 - protein, 9 aa, Homo Sapiens
EKIVNDPDG

SEQ ID NO: 528155 - protein, 9 aa, Homo Sapiens
RDLKTKTRQ

SEQ ID NO: 528156 - protein, 9 aa, Homo Sapiens
VNDPDGREC

SEQ ID NO: 528157 - protein, 9 aa, Homo Sapiens
NTILIDPSD

SEQ ID NO: 528158 - protein, 9 aa, Homo Sapiens
PCGAAPRIA

SEQ ID NO: 528159 - protein, 9 aa, Homo Sapiens
WWHVQPTLD

SEQ ID NO: 528160 - protein, 9 aa, Homo Sapiens
LGRSGWIMF

SEQ ID NO: 528161 - protein, 9 aa, Homo Sapiens
KFTTVVPGG

SEQ ID NO: 528162 - protein, 9 aa, Homo Sapiens
EWWHVQPTL

SEQ ID NO: 528163 - protein, 9 aa, Homo Sapiens
GKILMPLSS

SEQ ID NO: 528164 - protein, 9 aa, Homo Sapiens
ERRRIEEEL

SEQ ID NO: 528165 - protein, 9 aa, Homo Sapiens
TRRTQAWSA

SEQ ID NO: 528166 - protein, 9 aa, Homo Sapiens
ELALGRSGW

SEQ ID NO: 528167 - protein, 9 aa, Homo Sapiens
WFFGLINSQ

SEQ ID NO: 528168 - protein, 9 aa, Homo Sapiens
TLSGPRSKT

SEQ ID NO: 528169 - protein, 9 aa, Homo Sapiens
RLFLDGDIF

SEQ ID NO: 528170 - protein, 9 aa, Homo Sapiens
QDPKENRKT

SEQ ID NO: 528171 - protein, 9 aa, Homo Sapiens
TKTRQDPKE

SEQ ID NO: 528172 - protein, 9 aa, Homo Sapiens
FFGLINSQN

SEQ ID NO: 528173 - protein, 9 aa, Homo Sapiens
SLPVTNTSS

SEQ ID NO: 528174 - protein, 9 aa, Homo Sapiens
PKEGPCTKW

SEQ ID NO: 528175 - protein, 9 aa, Homo Sapiens
TAATRRTQA

SEQ ID NO: 528176 - protein, 9 aa, Homo Sapiens
GWIMFSVGA

SEQ ID NO: 528177 - protein, 9 aa, Homo Sapiens
WMGNALSPL

SEQ ID NO: 528178 - protein, 9 aa, Homo Sapiens
EELRLEQQK

SEQ ID NO: 528179 - protein, 9 aa, Homo Sapiens
LMPLSSAAC

SEQ ID NO: 528180 - protein, 9 aa, Homo Sapiens
GLELFNRPP

SEQ ID NO: 528181 - protein, 9 aa, Homo Sapiens
GGQFAMTSG

SEQ ID NO: 528182 - protein, 9 aa, Homo Sapiens
TSGKILMPL

SEQ ID NO: 528183 - protein, 9 aa, Homo Sapiens
AHITRAPHN

SEQ ID NO: 528184 - protein, 9 aa, Homo Sapiens
WHVQPTLDL

SEQ ID NO: 528185 - protein, 9 aa, Homo Sapiens
RRIEEELRL

SEQ ID NO: 528186 - protein, 9 aa, Homo Sapiens
VPKAKINTI

SEQ ID NO: 528187 - protein, 9 aa, Homo Sapiens
LQSEEKIVN

SEQ ID NO: 528188 - protein, 9 aa, Homo Sapiens
TSLPVTNTS

SEQ ID NO: 528189 - protein, 9 aa, Homo Sapiens
SKTASPKLS

SEQ ID NO: 528190 - protein, 9 aa, Homo Sapiens
SEEKIVNDP

SEQ ID NO: 528191 - protein, 9 aa, Homo Sapiens
CTKWELALG

SEQ ID NO: 528192 - protein, 9 aa, Homo Sapiens
VALMGGGLP

SEQ ID NO: 528193 - protein, 9 aa, Homo Sapiens
LDGDIFRQD

SEQ ID NO: 528194 - protein, 9 aa, Homo Sapiens
PIKDLVQLS

SEQ ID NO: 528195 - protein, 9 aa, Homo Sapiens
LKTKTRQDP

SEQ ID NO: 528196 - protein, 9 aa, Homo Sapiens
CGAAPRIAG

SEQ ID NO: 528197 - protein, 9 aa, Homo Sapiens
GGTAWLEWW

SEQ ID NO: 528198 - protein, 9 aa, Homo Sapiens
AATRRTQAW

SEQ ID NO: 528199 - protein, 9 aa, Homo Sapiens
QLSHNMLHG

SEQ ID NO: 528200 - protein, 9 aa, Homo Sapiens
KSPEETIQS

SEQ ID NO: 528201 - protein, 9 aa, Homo Sapiens
FLDGDIFRQ

SEQ ID NO: 528202 - protein, 9 aa, Homo Sapiens
AWLEWWHVQ

SEQ ID NO: 528203 - protein, 9 aa, Homo Sapiens
VGSSNEAGL

SEQ ID NO: 528204 - protein, 9 aa, Homo Sapiens
LSGPRSKTA

SEQ ID NO: 528205 - protein, 9 aa, Homo Sapiens
PTGLELFNR

SEQ ID NO: 528206 - protein, 9 aa, Homo Sapiens
WLEWWHVQP

SEQ ID NO: 528207 - protein, 9 aa, Homo Sapiens
RLDSHQHTP

SEQ ID NO: 528208 - protein, 9 aa, Homo Sapiens
ARRVPCGAA

SEQ ID NO: 528209 - protein, 9 aa, Homo Sapiens
PRSKTASPK

SEQ ID NO: 528210 - protein, 9 aa, Homo Sapiens
GTAWLEWWH

SEQ ID NO: 528211 - protein, 9 aa, Homo Sapiens
DLKTKTRQD

SEQ ID NO: 528212 - protein, 9 aa, Homo Sapiens
HWFFGLINS

SEQ ID NO: 528213 - protein, 9 aa, Homo Sapiens
HITRAPHNP

SEQ ID NO: 528214 - protein, 9 aa, Homo Sapiens
SNEAGLKFT

SEQ ID NO: 528215 - protein, 9 aa, Homo Sapiens
FQRLAIASG

SEQ ID NO: 528216 - protein, 9 aa, Homo Sapiens
GSSNEAGLK

SEQ ID NO: 528217 - protein, 9 aa, Homo Sapiens
GRSGWIMFS

SEQ ID NO: 528218 - protein, 9 aa, Homo Sapiens
GLINSQNPF

SEQ ID NO: 528219 - protein, 9 aa, Homo Sapiens
KTASPKLSP

SEQ ID NO: 528220 - protein, 9 aa, Homo Sapiens
RQDPKENRK

SEQ ID NO: 528221 - protein, 9 aa, Homo Sapiens
VHHAAGQVG

SEQ ID NO: 528222 - protein, 9 aa, Homo Sapiens
LDSHQHTPM

SEQ ID NO: 528223 - protein, 9 aa, Homo Sapiens
RVPCGAAPR

SEQ ID NO: 528224 - protein, 9 aa, Homo Sapiens
RIVGSSNEA

SEQ ID NO: 528225 - protein, 9 aa, Homo Sapiens
VQLSHNMLH

SEQ ID NO: 528226 - protein, 9 aa, Homo Sapiens
FAMTSGKIL

SEQ ID NO: 528227 - protein, 9 aa, Homo Sapiens
GPRSKTASP

SEQ ID NO: 528228 - protein, 9 aa, Homo Sapiens
DIFRQDRVS

SEQ ID NO: 528229 - protein, 9 aa, Homo Sapiens
LLVALMGGG

SEQ ID NO: 528230 - protein, 9 aa, Homo Sapiens
QRLAIASGR

SEQ ID NO: 528231 - protein, 9 aa, Homo Sapiens
RRVPCGAAP

SEQ ID NO: 528232 - protein, 9 aa, Homo Sapiens
VFFQRLAIA

SEQ ID NO: 528233 - protein, 9 aa, Homo Sapiens
TNGLLVALM

SEQ ID NO: 528234 - protein, 9 aa, Homo Sapiens
SGKILMPLS

SEQ ID NO: 528235 - protein, 9 aa, Homo Sapiens
TRQDPKENR

SEQ ID NO: 528236 - protein, 9 aa, Homo Sapiens
SWMGNALSP

SEQ ID NO: 528237 - protein, 9 aa, Homo Sapiens
FPIKDLVQL

SEQ ID NO: 528238 - protein, 9 aa, Homo Sapiens
GAAPRIAGA

SEQ ID NO: 528239 - protein, 9 aa, Homo Sapiens
CHWFFGLIN

SEQ ID NO: 528240 - protein, 9 aa, Homo Sapiens
TLQSEEKIV

SEQ ID NO: 528241 - protein, 9 aa, Homo Sapiens
FNRPPSSTE

SEQ ID NO: 528242 - protein, 9 aa, Homo Sapiens
RRRIEEELR

SEQ ID NO: 528243 - protein, 9 aa, Homo Sapiens
VTPKEGPCT

SEQ ID NO: 528244 - protein, 9 aa, Homo Sapiens
KAKINTILI

SEQ ID NO: 528245 - protein, 9 aa, Homo Sapiens
SVGARRVPC

SEQ ID NO: 528246 - protein, 9 aa, Homo Sapiens
TVVPGGQFA

SEQ ID NO: 528247 - protein, 9 aa, Homo Sapiens
ECLKTIQQR

SEQ ID NO: 528248 - protein, 9 aa, Homo Sapiens
EAGLKFTTV

SEQ ID NO: 528249 - protein, 9 aa, Homo Sapiens
DFPIKDLVQ

SEQ ID NO: 528250 - protein, 9 aa, Homo Sapiens
MFSVGARRV

SEQ ID NO: 528251 - protein, 9 aa, Homo Sapiens
KIVNDPDGR

SEQ ID NO: 528252 - protein, 9 aa, Homo Sapiens
LINSQNPFL

SEQ ID NO: 528253 - protein, 9 aa, Homo Sapiens
ALGRSGWIM

SEQ ID NO: 528254 - protein, 9 aa, Homo Sapiens
ITRAPHNPG

SEQ ID NO: 528255 - protein, 9 aa, Homo Sapiens
CLKTIQQRN

SEQ ID NO: 528256 - protein, 9 aa, Homo Sapiens
AIRLDSHQH

SEQ ID NO: 528257 - protein, 9 aa, Homo Sapiens
WIMFSVGAR

SEQ ID NO: 528258 - protein, 9 aa, Homo Sapiens
KWELALGRS

SEQ ID NO: 528259 - protein, 9 aa, Homo Sapiens
ATRRTQAWS

SEQ ID NO: 528260 - protein, 9 aa, Homo Sapiens
AKINTILID

SEQ ID NO: 528261 - protein, 9 aa, Homo Sapiens
VKIRYSQDY

SEQ ID NO: 528262 - protein, 9 aa, Homo Sapiens
LIIRENNLT

SEQ ID NO: 528263 - protein, 9 aa, Homo Sapiens
LPPMSTFYR

SEQ ID NO: 528264 - protein, 9 aa, Homo Sapiens
VTSMTSMTS

SEQ ID NO: 528265 - protein, 9 aa, Homo Sapiens
GCSTVKIRY

SEQ ID NO: 528266 - protein, 9 aa, Homo Sapiens
LPRPASYPS

SEQ ID NO: 528267 - protein, 9 aa, Homo Sapiens
KILNDEKRR

SEQ ID NO: 528268 - protein, 9 aa, Homo Sapiens
KQWQKILND

SEQ ID NO: 528269 - protein, 9 aa, Homo Sapiens
TEKLIIREN

SEQ ID NO: 528270 - protein, 9 aa, Homo Sapiens
STFYRSGTN

SEQ ID NO: 528271 - protein, 9 aa, Homo Sapiens
LDAIKPVGI

SEQ ID NO: 528272 - protein, 9 aa, Homo Sapiens
QWQKILNDE

SEQ ID NO: 528273 - protein, 9 aa, Homo Sapiens
SWSPDISGG

SEQ ID NO: 528274 - protein, 9 aa, Homo Sapiens
DDKDKPMSQ

SEQ ID NO: 528275 - protein, 9 aa, Homo Sapiens
DISGGREIF

SEQ ID NO: 528276 - protein, 9 aa, Homo Sapiens
SMTSMTSMS

SEQ ID NO: 528277 - protein, 9 aa, Homo Sapiens
SMEWDGPPS

SEQ ID NO: 528278 - protein, 9 aa, Homo Sapiens
GGREIFKPR

SEQ ID NO: 528279 - protein, 9 aa, Homo Sapiens
ISGGREIFK

SEQ ID NO: 528280 - protein, 9 aa, Homo Sapiens
SGGREIFKP

SEQ ID NO: 528281 - protein, 9 aa, Homo Sapiens
FYRSGTNHY

SEQ ID NO: 528282 - protein, 9 aa, Homo Sapiens
TSSALKLLM

SEQ ID NO: 528283 - protein, 9 aa, Homo Sapiens
RLPRPASYP

SEQ ID NO: 528284 - protein, 9 aa, Homo Sapiens
VGNGSMEWD

SEQ ID NO: 528285 - protein, 9 aa, Homo Sapiens
EKLIIRENN

SEQ ID NO: 528286 - protein, 9 aa, Homo Sapiens
LTATPPPQQ

SEQ ID NO: 528287 - protein, 9 aa, Homo Sapiens
LCLSSERFR

SEQ ID NO: 528288 - protein, 9 aa, Homo Sapiens
QPDTVELDA

SEQ ID NO: 528289 - protein, 9 aa, Homo Sapiens
EQLLCRMFG

SEQ ID NO: 528290 - protein, 9 aa, Homo Sapiens
ASQSAGSTG

SEQ ID NO: 528291 - protein, 9 aa, Homo Sapiens
VNPMTPVTS

SEQ ID NO: 528292 - protein, 9 aa, Homo Sapiens
IPEDKGNVK

SEQ ID NO: 528293 - protein, 9 aa, Homo Sapiens
GITMGNQER

SEQ ID NO: 528294 - protein, 9 aa, Homo Sapiens
AFEQLLCRM

SEQ ID NO: 528295 - protein, 9 aa, Homo Sapiens
WGCSTVKIR

SEQ ID NO: 528296 - protein, 9 aa, Homo Sapiens
DENDDKDKP

SEQ ID NO: 528297 - protein, 9 aa, Homo Sapiens
RCVGNGSME

SEQ ID NO: 528298 - protein, 9 aa, Homo Sapiens
NQERKLQEL

SEQ ID NO: 528299 - protein, 9 aa, Homo Sapiens
PMSTFYRSG

SEQ ID NO: 528300 - protein, 9 aa, Homo Sapiens
QLLCRMFGE

SEQ ID NO: 528301 - protein, 9 aa, Homo Sapiens
CRMFGEDFI

SEQ ID NO: 528302 - protein, 9 aa, Homo Sapiens
LRCVGNGSM

SEQ ID NO: 528303 - protein, 9 aa, Homo Sapiens
RMFGEDFIA

SEQ ID NO: 528304 - protein, 9 aa, Homo Sapiens
PDISGGREI

SEQ ID NO: 528305 - protein, 9 aa, Homo Sapiens
TSMTSMTSM

SEQ ID NO: 528306 - protein, 9 aa, Homo Sapiens
ALKLLMPTL

SEQ ID NO: 528307 - protein, 9 aa, Homo Sapiens
PSWSPDISG

SEQ ID NO: 528308 - protein, 9 aa, Homo Sapiens
NDEKRRVYW

SEQ ID NO: 528309 - protein, 9 aa, Homo Sapiens
MTPVTSMTS

SEQ ID NO: 528310 - protein, 9 aa, Homo Sapiens
PVTSMTSMT

SEQ ID NO: 528311 - protein, 9 aa, Homo Sapiens
PLTATPPPQ

SEQ ID NO: 528312 - protein, 9 aa, Homo Sapiens
RKLQELSVS

SEQ ID NO: 528313 - protein, 9 aa, Homo Sapiens
SALKLLMPT

SEQ ID NO: 528314 - protein, 9 aa, Homo Sapiens
ASASQSAGS

SEQ ID NO: 528315 - protein, 9 aa, Homo Sapiens
PRPASYPST

SEQ ID NO: 528316 - protein, 9 aa, Homo Sapiens
NGCCLCLSS

SEQ ID NO: 528317 - protein, 9 aa, Homo Sapiens
GCCLCLSSE

SEQ ID NO: 528318 - protein, 9 aa, Homo Sapiens
STVKIRYSQ

SEQ ID NO: 528319 - protein, 9 aa, Homo Sapiens
TVELDAIKP

SEQ ID NO: 528320 - protein, 9 aa, Homo Sapiens
SLETSSALK

SEQ ID NO: 528321 - protein, 9 aa, Homo Sapiens
PPLTATPPP

SEQ ID NO: 528322 - protein, 9 aa, Homo Sapiens
WQKILNDEK

SEQ ID NO: 528323 - protein, 9 aa, Homo Sapiens
PPPQQPHAL

SEQ ID NO: 528324 - protein, 9 aa, Homo Sapiens
ATPPPQQPH

SEQ ID NO: 528325 - protein, 9 aa, Homo Sapiens
KLLMPTLES

SEQ ID NO: 528326 - protein, 9 aa, Homo Sapiens
RRVYWGCST

SEQ ID NO: 528327 - protein, 9 aa, Homo Sapiens
MSTFYRSGT

SEQ ID NO: 528328 - protein, 9 aa, Homo Sapiens
PPPLTATPP

SEQ ID NO: 528329 - protein, 9 aa, Homo Sapiens
SASQSAGST

SEQ ID NO: 528330 - protein, 9 aa, Homo Sapiens
LETSSALKL

SEQ ID NO: 528331 - protein, 9 aa, Homo Sapiens
DKDKPMSQK

SEQ ID NO: 528332 - protein, 9 aa, Homo Sapiens
CLCLSSERF

SEQ ID NO: 528333 - protein, 9 aa, Homo Sapiens
ITMGNQERK

SEQ ID NO: 528334 - protein, 9 aa, Homo Sapiens
TVKIRYSQD

SEQ ID NO: 528335 - protein, 9 aa, Homo Sapiens
FSVGNGCCL

SEQ ID NO: 528336 - protein, 9 aa, Homo Sapiens
KRRVYWGCS

SEQ ID NO: 528337 - protein, 9 aa, Homo Sapiens
LLCRMFGED

SEQ ID NO: 528338 - protein, 9 aa, Homo Sapiens
DEKRRVYWG

SEQ ID NO: 528339 - protein, 9 aa, Homo Sapiens
ELDAIKPVG

SEQ ID NO: 528340 - protein, 9 aa, Homo Sapiens
KLIIRENNL

SEQ ID NO: 528341 - protein, 9 aa, Homo Sapiens
GPPPLTATP

SEQ ID NO: 528342 - protein, 9 aa, Homo Sapiens
RVYWGCSTV

SEQ ID NO: 528343 - protein, 9 aa, Homo Sapiens
FEQLLCRMF

SEQ ID NO: 528344 - protein, 9 aa, Homo Sapiens
KDDIPEDKG

SEQ ID NO: 528345 - protein, 9 aa, Homo Sapiens
YSWTEKLII

SEQ ID NO: 528346 - protein, 9 aa, Homo Sapiens
VYWGCSTVK

SEQ ID NO: 528347 - protein, 9 aa, Homo Sapiens
YRSGTNHYS

SEQ ID NO: 528348 - protein, 9 aa, Homo Sapiens
RPASYPSTV

SEQ ID NO: 528349 - protein, 9 aa, Homo Sapiens
GNGSMEWDG

SEQ ID NO: 528350 - protein, 9 aa, Homo Sapiens
QSAGSTGPA

SEQ ID NO: 528351 - protein, 9 aa, Homo Sapiens
NPMTPVTSM

SEQ ID NO: 528352 - protein, 9 aa, Homo Sapiens
LCRMFGEDF

SEQ ID NO: 528353 - protein, 9 aa, Homo Sapiens
DTVELDAIK

SEQ ID NO: 528354 - protein, 9 aa, Homo Sapiens
DIPEDKGNV

SEQ ID NO: 528355 - protein, 9 aa, Homo Sapiens
PMTPVTSMT

SEQ ID NO: 528356 - protein, 9 aa, Homo Sapiens
DDIPEDKGN

SEQ ID NO: 528357 - protein, 9 aa, Homo Sapiens
NGSMEWDGP

SEQ ID NO: 528358 - protein, 9 aa, Homo Sapiens
PDTVELDAI

SEQ ID NO: 528359 - protein, 9 aa, Homo Sapiens
TMGNQERKL

SEQ ID NO: 528360 - protein, 9 aa, Homo Sapiens
GSMEWDGPP

SEQ ID NO: 528361 - protein, 9 aa, Homo Sapiens
GNQERKLQE

SEQ ID NO: 528362 - protein, 9 aa, Homo Sapiens
TATPPPQQP

SEQ ID NO: 528363 - protein, 9 aa, Homo Sapiens
ETSSALKLL

SEQ ID NO: 528364 - protein, 9 aa, Homo Sapiens
WTEKLIIRE

SEQ ID NO: 528365 - protein, 9 aa, Homo Sapiens
ASYPSTVST

SEQ ID NO: 528366 - protein, 9 aa, Homo Sapiens
WSPDISGGR

SEQ ID NO: 528367 - protein, 9 aa, Homo Sapiens
KKDDIPEDK

SEQ ID NO: 528368 - protein, 9 aa, Homo Sapiens
YWGCSTVKI

SEQ ID NO: 528369 - protein, 9 aa, Homo Sapiens
VELDAIKPV

SEQ ID NO: 528370 - protein, 9 aa, Homo Sapiens
IRENNLTEL

SEQ ID NO: 528371 - protein, 9 aa, Homo Sapiens
MFGEDFIAT

SEQ ID NO: 528372 - protein, 9 aa, Homo Sapiens
QQPDTVELD

SEQ ID NO: 528373 - protein, 9 aa, Homo Sapiens
SPDISGGRE

SEQ ID NO: 528374 - protein, 9 aa, Homo Sapiens
GNGCCLCLS

SEQ ID NO: 528375 - protein, 9 aa, Homo Sapiens
MGNQERKLQ

SEQ ID NO: 528376 - protein, 9 aa, Homo Sapiens
ERKLQELSV

SEQ ID NO: 528377 - protein, 9 aa, Homo Sapiens
SVGNGCCLC

SEQ ID NO: 528378 - protein, 9 aa, Homo Sapiens
SQSAGSTGP

SEQ ID NO: 528379 - protein, 9 aa, Homo Sapiens
CCLCLSSER

SEQ ID NO: 528380 - protein, 9 aa, Homo Sapiens
PEDKGNVKQ

SEQ ID NO: 528381 - protein, 9 aa, Homo Sapiens
LQQPDTVEL

SEQ ID NO: 528382 - protein, 9 aa, Homo Sapiens
SYPSTVSTV

SEQ ID NO: 528383 - protein, 9 aa, Homo Sapiens
KKKDDIPED

SEQ ID NO: 528384 - protein, 9 aa, Homo Sapiens
VGNGCCLCL

SEQ ID NO: 528385 - protein, 9 aa, Homo Sapiens
IIRENNLTE

SEQ ID NO: 528386 - protein, 9 aa, Homo Sapiens
ILNDEKRRV

SEQ ID NO: 528387 - protein, 9 aa, Homo Sapiens
QERKLQELS

SEQ ID NO: 528388 - protein, 9 aa, Homo Sapiens
NDDKDKPMS

SEQ ID NO: 528389 - protein, 9 aa, Homo Sapiens
MEWDGPPSP

SEQ ID NO: 528390 - protein, 9 aa, Homo Sapiens
LNDEKRRVY

SEQ ID NO: 528391 - protein, 9 aa, Homo Sapiens
EKRRVYWGC

SEQ ID NO: 528392 - protein, 9 aa, Homo Sapiens
LGRLPRPAS

SEQ ID NO: 528393 - protein, 9 aa, Homo Sapiens
CVGNGSMEW

SEQ ID NO: 528394 - protein, 9 aa, Homo Sapiens
CSTVKIRYS

SEQ ID NO: 528395 - protein, 9 aa, Homo Sapiens
TPPPQQPHA

SEQ ID NO: 528396 - protein, 9 aa, Homo Sapiens
TPVTSMTSM

SEQ ID NO: 528397 - protein, 9 aa, Homo Sapiens
QKILNDEKR

SEQ ID NO: 528398 - protein, 9 aa, Homo Sapiens
SLPPMSTFY

SEQ ID NO: 528399 - protein, 9 aa, Homo Sapiens
LKLLMPTLE

SEQ ID NO: 528400 - protein, 9 aa, Homo Sapiens
PPMSTFYRS

SEQ ID NO: 528401 - protein, 9 aa, Homo Sapiens
ENDDKDKPM

SEQ ID NO: 528402 - protein, 9 aa, Homo Sapiens
GRLPRPASY

SEQ ID NO: 528403 - protein, 9 aa, Homo Sapiens
SAGSTGPAQ

SEQ ID NO: 528404 - protein, 9 aa, Homo Sapiens
PASYPSTVS

SEQ ID NO: 528405 - protein, 9 aa, Homo Sapiens
SWTEKLIIR

SEQ ID NO: 528406 - protein, 9 aa, Homo Sapiens
TFYRSGTNH

SEQ ID NO: 528407 - protein, 9 aa, Homo Sapiens
SSALKLLMP

SEQ ID NO: 528408 - protein, 9 aa, Homo Sapiens
WPVQLWVDS

SEQ ID NO: 528409 - protein, 9 aa, Homo Sapiens
KMTKFSPIQ

SEQ ID NO: 528410 - protein, 9 aa, Homo Sapiens
SESKLAAKV

SEQ ID NO: 528411 - protein, 9 aa, Homo Sapiens
DPKMTKFSP

SEQ ID NO: 528412 - protein, 9 aa, Homo Sapiens
EAPSESKLA

SEQ ID NO: 528413 - protein, 9 aa, Homo Sapiens
PANSHRAPE

SEQ ID NO: 528414 - protein, 9 aa, Homo Sapiens
HLGNSRQPI

SEQ ID NO: 528415 - protein, 9 aa, Homo Sapiens
SPEKPQSRR

SEQ ID NO: 528416 - protein, 9 aa, Homo Sapiens
DAHMWCLGD

SEQ ID NO: 528417 - protein, 9 aa, Homo Sapiens
TKPLKRDEE

SEQ ID NO: 528418 - protein, 9 aa, Homo Sapiens
WSGKDLSGK

SEQ ID NO: 528419 - protein, 9 aa, Homo Sapiens
PSNTLEFLV

SEQ ID NO: 528420 - protein, 9 aa, Homo Sapiens
AEAPSESKL

SEQ ID NO: 528421 - protein, 9 aa, Homo Sapiens
PPSSPGLAK

SEQ ID NO: 528422 - protein, 9 aa, Homo Sapiens
FCQLAKTWP

SEQ ID NO: 528423 - protein, 9 aa, Homo Sapiens
PQWPSFEGG

SEQ ID NO: 528424 - protein, 9 aa, Homo Sapiens
VSSSPTPPV

SEQ ID NO: 528425 - protein, 9 aa, Homo Sapiens
PLYYTFVTD

SEQ ID NO: 528426 - protein, 9 aa, Homo Sapiens
PISLGPPRT

SEQ ID NO: 528427 - protein, 9 aa, Homo Sapiens
LYMHLNRLK

SEQ ID NO: 528428 - protein, 9 aa, Homo Sapiens
SSKWECTEL

SEQ ID NO: 528429 - protein, 9 aa, Homo Sapiens
PSSTPTTHL

SEQ ID NO: 528430 - protein, 9 aa, Homo Sapiens
RAHLATIER

SEQ ID NO: 528431 - protein, 9 aa, Homo Sapiens
AHLGNSRQP

SEQ ID NO: 528432 - protein, 9 aa, Homo Sapiens
NRLKIAPQI

SEQ ID NO: 528433 - protein, 9 aa, Homo Sapiens
LATIERWED

SEQ ID NO: 528434 - protein, 9 aa, Homo Sapiens
FLVTGLLPK

SEQ ID NO: 528435 - protein, 9 aa, Homo Sapiens
GKKTRSCKA

SEQ ID NO: 528436 - protein, 9 aa, Homo Sapiens
NATCSHYTQ

SEQ ID NO: 528437 - protein, 9 aa, Homo Sapiens
SRQPISLGP

SEQ ID NO: 528438 - protein, 9 aa, Homo Sapiens
TKFSPIQES

SEQ ID NO: 528439 - protein, 9 aa, Homo Sapiens
GRPGTKPLK

SEQ ID NO: 528440 - protein, 9 aa, Homo Sapiens
PGTKPLKRD

SEQ ID NO: 528441 - protein, 9 aa, Homo Sapiens
IQPSNTLEF

SEQ ID NO: 528442 - protein, 9 aa, Homo Sapiens
FVTDPNSEW

SEQ ID NO: 528443 - protein, 9 aa, Homo Sapiens
PGRPGTKPL

SEQ ID NO: 528444 - protein, 9 aa, Homo Sapiens
SATAPPSSP

SEQ ID NO: 528445 - protein, 9 aa, Homo Sapiens
TCSHYTQLV

SEQ ID NO: 528446 - protein, 9 aa, Homo Sapiens
SAVSSSPTP

SEQ ID NO: 528447 - protein, 9 aa, Homo Sapiens
AHMWCLGDR

SEQ ID NO: 528448 - protein, 9 aa, Homo Sapiens
CSSKWECTE

SEQ ID NO: 528449 - protein, 9 aa, Homo Sapiens
VGPLYYTFV

SEQ ID NO: 528450 - protein, 9 aa, Homo Sapiens
SNTLEFLVT

SEQ ID NO: 528451 - protein, 9 aa, Homo Sapiens
QPISLGPPR

SEQ ID NO: 528452 - protein, 9 aa, Homo Sapiens
VPSPQWPSF

SEQ ID NO: 528453 - protein, 9 aa, Homo Sapiens
LIDPKMTKF

SEQ ID NO: 528454 - protein, 9 aa, Homo Sapiens
KTWPVQLWV

SEQ ID NO: 528455 - protein, 9 aa, Homo Sapiens
SSCSSKWEC

SEQ ID NO: 528456 - protein, 9 aa, Homo Sapiens
MFCQLAKTW

SEQ ID NO: 528457 - protein, 9 aa, Homo Sapiens
IDPKMTKFS

SEQ ID NO: 528458 - protein, 9 aa, Homo Sapiens
LRAHLATIE

SEQ ID NO: 528459 - protein, 9 aa, Homo Sapiens
MTKFSPIQE

SEQ ID NO: 528460 - protein, 9 aa, Homo Sapiens
QSSCSSKWE

SEQ ID NO: 528461 - protein, 9 aa, Homo Sapiens
ECDAHMWCL

SEQ ID NO: 528462 - protein, 9 aa, Homo Sapiens
QPSNTLEFL

SEQ ID NO: 528463 - protein, 9 aa, Homo Sapiens
LYYTFVTDP

SEQ ID NO: 528464 - protein, 9 aa, Homo Sapiens
TPTTHLSAS

SEQ ID NO: 528465 - protein, 9 aa, Homo Sapiens
GVPSPQWPS

SEQ ID NO: 528466 - protein, 9 aa, Homo Sapiens
RQPISLGPP

SEQ ID NO: 528467 - protein, 9 aa, Homo Sapiens
LECDAHMWC

SEQ ID NO: 528468 - protein, 9 aa, Homo Sapiens
GGGSPEKPQ

SEQ ID NO: 528469 - protein, 9 aa, Homo Sapiens
ANSHRAPET

SEQ ID NO: 528470 - protein, 9 aa, Homo Sapiens
SCSSKWECT

SEQ ID NO: 528471 - protein, 9 aa, Homo Sapiens
DSPANSHRA

SEQ ID NO: 528472 - protein, 9 aa, Homo Sapiens
ATCSHYTQL

SEQ ID NO: 528473 - protein, 9 aa, Homo Sapiens
PEKPQSRRR

SEQ ID NO: 528474 - protein, 9 aa, Homo Sapiens
PSPQWPSFE

SEQ ID NO: 528475 - protein, 9 aa, Homo Sapiens
CQLAKTWPV

SEQ ID NO: 528476 - protein, 9 aa, Homo Sapiens
LNRLKIAPQ

SEQ ID NO: 528477 - protein, 9 aa, Homo Sapiens
HLNRLKIAP

SEQ ID NO: 528478 - protein, 9 aa, Homo Sapiens
GGSPEKPQS

SEQ ID NO: 528479 - protein, 9 aa, Homo Sapiens
QGVPSPQWP

SEQ ID NO: 528480 - protein, 9 aa, Homo Sapiens
SPANSHRAP

SEQ ID NO: 528481 - protein, 9 aa, Homo Sapiens
TGLRAHLAT

SEQ ID NO: 528482 - protein, 9 aa, Homo Sapiens
PSSPGLAKP

SEQ ID NO: 528483 - protein, 9 aa, Homo Sapiens
RAPETQPLA

SEQ ID NO: 528484 - protein, 9 aa, Homo Sapiens
HRAPETQPL

SEQ ID NO: 528485 - protein, 9 aa, Homo Sapiens
RNATCSHYT

SEQ ID NO: 528486 - protein, 9 aa, Homo Sapiens
MWCLGDRRI

SEQ ID NO: 528487 - protein, 9 aa, Homo Sapiens
LAAKVDSPS

SEQ ID NO: 528488 - protein, 9 aa, Homo Sapiens
AKTWPVQLW

SEQ ID NO: 528489 - protein, 9 aa, Homo Sapiens
LGNSRQPIS

SEQ ID NO: 528490 - protein, 9 aa, Homo Sapiens
KPQSRRRPP

SEQ ID NO: 528491 - protein, 9 aa, Homo Sapiens
RPGTKPLKR

SEQ ID NO: 528492 - protein, 9 aa, Homo Sapiens
KIAPQIYGL

SEQ ID NO: 528493 - protein, 9 aa, Homo Sapiens
HLSASSTTL

SEQ ID NO: 528494 - protein, 9 aa, Homo Sapiens
SPQWPSFEG

SEQ ID NO: 528495 - protein, 9 aa, Homo Sapiens
CSHYTQLVW

SEQ ID NO: 528496 - protein, 9 aa, Homo Sapiens
APETQPLAP

SEQ ID NO: 528497 - protein, 9 aa, Homo Sapiens
YMHLNRLKI

SEQ ID NO: 528498 - protein, 9 aa, Homo Sapiens
AVSSSPTPP

SEQ ID NO: 528499 - protein, 9 aa, Homo Sapiens
SLIDPKMTK

SEQ ID NO: 528500 - protein, 9 aa, Homo Sapiens
TAPPSSPGL

SEQ ID NO: 528501 - protein, 9 aa, Homo Sapiens
SGKKTRSCK

SEQ ID NO: 528502 - protein, 9 aa, Homo Sapiens
KLAAKVDSP

SEQ ID NO: 528503 - protein, 9 aa, Homo Sapiens
ATIERWEDR

SEQ ID NO: 528504 - protein, 9 aa, Homo Sapiens
NSHRAPETQ

SEQ ID NO: 528505 - protein, 9 aa, Homo Sapiens
PSESKLAAK

SEQ ID NO: 528506 - protein, 9 aa, Homo Sapiens
LKRDEERGK

SEQ ID NO: 528507 - protein, 9 aa, Homo Sapiens
CLGDRRIPE

SEQ ID NO: 528508 - protein, 9 aa, Homo Sapiens
WDQSSCSSK

SEQ ID NO: 528509 - protein, 9 aa, Homo Sapiens
AHLATIERW

SEQ ID NO: 528510 - protein, 9 aa, Homo Sapiens
YTFVTDPNS

SEQ ID NO: 528511 - protein, 9 aa, Homo Sapiens
PSAVSSSPT

SEQ ID NO: 528512 - protein, 9 aa, Homo Sapiens
LAKTWPVQL

SEQ ID NO: 528513 - protein, 9 aa, Homo Sapiens
PSATAPPSS

SEQ ID NO: 528514 - protein, 9 aa, Homo Sapiens
DQSSCSSKW

SEQ ID NO: 528515 - protein, 9 aa, Homo Sapiens
TTHLSASST

SEQ ID NO: 528516 - protein, 9 aa, Homo Sapiens
APSAVSSSP

SEQ ID NO: 528517 - protein, 9 aa, Homo Sapiens
KPLKRDEER

SEQ ID NO: 528518 - protein, 9 aa, Homo Sapiens
CARNATCSH

SEQ ID NO: 528519 - protein, 9 aa, Homo Sapiens
NSRQPISLG

SEQ ID NO: 528520 - protein, 9 aa, Homo Sapiens
ESKLAAKVD

SEQ ID NO: 528521 - protein, 9 aa, Homo Sapiens
THLSASSTT

SEQ ID NO: 528522 - protein, 9 aa, Homo Sapiens
LKIAPQIYG

SEQ ID NO: 528523 - protein, 9 aa, Homo Sapiens
SGKDLSGKK

SEQ ID NO: 528524 - protein, 9 aa, Homo Sapiens
SKLAAKVDS

SEQ ID NO: 528525 - protein, 9 aa, Homo Sapiens
PKMTKFSPI

SEQ ID NO: 528526 - protein, 9 aa, Homo Sapiens
SHYTQLVWA

SEQ ID NO: 528527 - protein, 9 aa, Homo Sapiens
HMWCLGDRR

SEQ ID NO: 528528 - protein, 9 aa, Homo Sapiens
SKWECTELI

SEQ ID NO: 528529 - protein, 9 aa, Homo Sapiens
MHLNRLKIA

SEQ ID NO: 528530 - protein, 9 aa, Homo Sapiens
TWPVQLWVD

SEQ ID NO: 528531 - protein, 9 aa, Homo Sapiens
PQSRRRPPD

SEQ ID NO: 528532 - protein, 9 aa, Homo Sapiens
ARNATCSHY

SEQ ID NO: 528533 - protein, 9 aa, Homo Sapiens
KSLIDPKMT

SEQ ID NO: 528534 - protein, 9 aa, Homo Sapiens
YYTFVTDPN

SEQ ID NO: 528535 - protein, 9 aa, Homo Sapiens
APSESKLAA

SEQ ID NO: 528536 - protein, 9 aa, Homo Sapiens
ECARNATCS

SEQ ID NO: 528537 - protein, 9 aa, Homo Sapiens
STPTTHLSA

SEQ ID NO: 528538 - protein, 9 aa, Homo Sapiens
SHRAPETQP

SEQ ID NO: 528539 - protein, 9 aa, Homo Sapiens
LSGKKTRSC

SEQ ID NO: 528540 - protein, 9 aa, Homo Sapiens
GPLYYTFVT

SEQ ID NO: 528541 - protein, 9 aa, Homo Sapiens
CDAHMWCLG

SEQ ID NO: 528542 - protein, 9 aa, Homo Sapiens
TLEFLVTGL

SEQ ID NO: 528543 - protein, 9 aa, Homo Sapiens
NTLEFLVTG

SEQ ID NO: 528544 - protein, 9 aa, Homo Sapiens
KKTRSCKAP

SEQ ID NO: 528545 - protein, 9 aa, Homo Sapiens
WPSFEGGGE

SEQ ID NO: 528546 - protein, 9 aa, Homo Sapiens
TIERWEDRP

SEQ ID NO: 528547 - protein, 9 aa, Homo Sapiens
RLKIAPQIY

SEQ ID NO: 528548 - protein, 9 aa, Homo Sapiens
EKPQSRRRP

SEQ ID NO: 528549 - protein, 9 aa, Homo Sapiens
GNSRQPISL

SEQ ID NO: 528550 - protein, 9 aa, Homo Sapiens
EFLVTGLLP

SEQ ID NO: 528551 - protein, 9 aa, Homo Sapiens
PLKRDEERG

SEQ ID NO: 528552 - protein, 9 aa, Homo Sapiens
GSPEKPQSR

SEQ ID NO: 528553 - protein, 9 aa, Homo Sapiens
TFVTDPNSE

SEQ ID NO: 528554 - protein, 9 aa, Homo Sapiens
TLGIPLTPQ

SEQ ID NO: 528555 - protein, 9 aa, Homo Sapiens
LEFLVTGLL

SEQ ID NO: 528556 - protein, 9 aa, Homo Sapiens
VTDPNSEWK

SEQ ID NO: 528557 - protein, 9 aa, Homo Sapiens
QWPSFEGGG

SEQ ID NO: 528558 - protein, 9 aa, Homo Sapiens
GKDLSGKKT

SEQ ID NO: 528559 - protein, 9 aa, Homo Sapiens
LSASSTTLG

SEQ ID NO: 528560 - protein, 9 aa, Homo Sapiens
PTTHLSASS

SEQ ID NO: 528561 - protein, 9 aa, Homo Sapiens
DLSGKKTRS

SEQ ID NO: 528562 - protein, 9 aa, Homo Sapiens
WCLGDRRIP

SEQ ID NO: 528563 - protein, 9 aa, Homo Sapiens
EGPSATAPP

SEQ ID NO: 528564 - protein, 9 aa, Homo Sapiens
APPSSPGLA

SEQ ID NO: 528565 - protein, 9 aa, Homo Sapiens
ATAPPSSPG

SEQ ID NO: 528566 - protein, 9 aa, Homo Sapiens
SSTPTTHLS

SEQ ID NO: 528567 - protein, 9 aa, Homo Sapiens
QLAKTWPVQ

SEQ ID NO: 528568 - protein, 9 aa, Homo Sapiens
HLATIERWE

SEQ ID NO: 528569 - protein, 9 aa, Homo Sapiens
PQGVPSPQW

SEQ ID NO: 528570 - protein, 9 aa, Homo Sapiens
GTKPLKRDE

SEQ ID NO: 528571 - protein, 9 aa, Homo Sapiens
KDLSGKKTR

SEQ ID NO: 528572 - protein, 9 aa, Homo Sapiens
GPSATAPPS

SEQ ID NO: 528573 - protein, 9 aa, Homo Sapiens
GLRAHLATI

SEQ ID NO: 528574 - protein, 9 aa, Homo Sapiens
EYRGRSPNA

SEQ ID NO: 528575 - protein, 9 aa, Homo Sapiens
MGGGLPAGF

SEQ ID NO: 528576 - protein, 9 aa, Homo Sapiens
CYQIRCCTD

SEQ ID NO: 528577 - protein, 9 aa, Homo Sapiens
LSKKSQKWN

SEQ ID NO: 528578 - protein, 9 aa, Homo Sapiens
QKWNEMNIL

SEQ ID NO: 528579 - protein, 9 aa, Homo Sapiens
LPTVAASRP

SEQ ID NO: 528580 - protein, 9 aa, Homo Sapiens
VTSLSPSSA

SEQ ID NO: 528581 - protein, 9 aa, Homo Sapiens
KWNEMNILA

SEQ ID NO: 528582 - protein, 9 aa, Homo Sapiens
GKFTSHIAG

SEQ ID NO: 528583 - protein, 9 aa, Homo Sapiens
ASDLDDGLN

SEQ ID NO: 528584 - protein, 9 aa, Homo Sapiens
AASRPVCQR

SEQ ID NO: 528585 - protein, 9 aa, Homo Sapiens
AVTSLSPSS

SEQ ID NO: 528586 - protein, 9 aa, Homo Sapiens
WTDACLSHL

SEQ ID NO: 528587 - protein, 9 aa, Homo Sapiens
PNASDLDDG

SEQ ID NO: 528588 - protein, 9 aa, Homo Sapiens
KKSQKWNEM

SEQ ID NO: 528589 - protein, 9 aa, Homo Sapiens
DHRSSRDMA

SEQ ID NO: 528590 - protein, 9 aa, Homo Sapiens
SHLCANGST

SEQ ID NO: 528591 - protein, 9 aa, Homo Sapiens
SGRRGDHRS

SEQ ID NO: 528592 - protein, 9 aa, Homo Sapiens
ALMGGGLPA

SEQ ID NO: 528593 - protein, 9 aa, Homo Sapiens
SKKSQKWNE

SEQ ID NO: 528594 - protein, 9 aa, Homo Sapiens
SPSSAHPFI

SEQ ID NO: 528595 - protein, 9 aa, Homo Sapiens
LCANGSTCT

SEQ ID NO: 528596 - protein, 9 aa, Homo Sapiens
RGRSPNAHS

SEQ ID NO: 528597 - protein, 9 aa, Homo Sapiens
DEDDKSPEP

SEQ ID NO: 528598 - protein, 9 aa, Homo Sapiens
FTSHIAGVY

SEQ ID NO: 528599 - protein, 9 aa, Homo Sapiens
QDEDDKSPE

SEQ ID NO: 528600 - protein, 9 aa, Homo Sapiens
GLLVALMGG

SEQ ID NO: 528601 - protein, 9 aa, Homo Sapiens
HTHTHTQLS

SEQ ID NO: 528602 - protein, 9 aa, Homo Sapiens
PTVAASRPV

SEQ ID NO: 528603 - protein, 9 aa, Homo Sapiens
FKQEGVLNG

SEQ ID NO: 528604 - protein, 9 aa, Homo Sapiens
TSHIAGVYY

SEQ ID NO: 528605 - protein, 9 aa, Homo Sapiens
GKVGMDYRS

SEQ ID NO: 528606 - protein, 9 aa, Homo Sapiens
THTQLSPCG

SEQ ID NO: 528607 - protein, 9 aa, Homo Sapiens
PSSAHPFIS

SEQ ID NO: 528608 - protein, 9 aa, Homo Sapiens
VGFCYQIRC

SEQ ID NO: 528609 - protein, 9 aa, Homo Sapiens
VGKFTSHIA

SEQ ID NO: 528610 - protein, 9 aa, Homo Sapiens
TVAASRPVC

SEQ ID NO: 528611 - protein, 9 aa, Homo Sapiens
AGVPSTAPV

SEQ ID NO: 528612 - protein, 9 aa, Homo Sapiens
QEGVLNGKV

SEQ ID NO: 528613 - protein, 9 aa, Homo Sapiens
DGSGRRGDH

SEQ ID NO: 528614 - protein, 9 aa, Homo Sapiens
QIRCCTDDV

SEQ ID NO: 528615 - protein, 9 aa, Homo Sapiens
DALPTVAAS

SEQ ID NO: 528616 - protein, 9 aa, Homo Sapiens
LNGKVGMDY

SEQ ID NO: 528617 - protein, 9 aa, Homo Sapiens
GRRGDHRSS

SEQ ID NO: 528618 - protein, 9 aa, Homo Sapiens
YRGRSPNAH

SEQ ID NO: 528619 - protein, 9 aa, Homo Sapiens
ALPTVAASR

SEQ ID NO: 528620 - protein, 9 aa, Homo Sapiens
AVGKFTSHI

SEQ ID NO: 528621 - protein, 9 aa, Homo Sapiens
SQKWNEMNI

SEQ ID NO: 528622 - protein, 9 aa, Homo Sapiens
NGLLVALMG

SEQ ID NO: 528623 - protein, 9 aa, Homo Sapiens
NEMNILATY

SEQ ID NO: 528624 - protein, 9 aa, Homo Sapiens
YQIRCCTDD

SEQ ID NO: 528625 - protein, 9 aa, Homo Sapiens
LDDGLNGDI

SEQ ID NO: 528626 - protein, 9 aa, Homo Sapiens
HTHTQLSPC

SEQ ID NO: 528627 - protein, 9 aa, Homo Sapiens
RRGDHRSSR

SEQ ID NO: 528628 - protein, 9 aa, Homo Sapiens
TSLSPSSAH

SEQ ID NO: 528629 - protein, 9 aa, Homo Sapiens
TAVGKFTSH

SEQ ID NO: 528630 - protein, 9 aa, Homo Sapiens
NASDLDDGL

SEQ ID NO: 528631 - protein, 9 aa, Homo Sapiens
IRCCTDDVR

SEQ ID NO: 528632 - protein, 9 aa, Homo Sapiens
SDLDDGLNG

SEQ ID NO: 528633 - protein, 9 aa, Homo Sapiens
LMGGGLPAG

SEQ ID NO: 528634 - protein, 9 aa, Homo Sapiens
EGVLNGKVG

SEQ ID NO: 528635 - protein, 9 aa, Homo Sapiens
HRSSRDMAG

SEQ ID NO: 528636 - protein, 9 aa, Homo Sapiens
TDACLSHLC

SEQ ID NO: 528637 - protein, 9 aa, Homo Sapiens
DGLNGDIIY

SEQ ID NO: 528638 - protein, 9 aa, Homo Sapiens
WNEMNILAT

SEQ ID NO: 528639 - protein, 9 aa, Homo Sapiens
GDHRSSRDM

SEQ ID NO: 528640 - protein, 9 aa, Homo Sapiens
GMTEIGIHG

SEQ ID NO: 528641 - protein, 9 aa, Homo Sapiens
LVALMGGGL

SEQ ID NO: 528642 - protein, 9 aa, Homo Sapiens
KSPEPTWAD

SEQ ID NO: 528643 - protein, 9 aa, Homo Sapiens
HPNASDLDD

SEQ ID NO: 528644 - protein, 9 aa, Homo Sapiens
DDGLNGDII

SEQ ID NO: 528645 - protein, 9 aa, Homo Sapiens
PNAHSGGRN

SEQ ID NO: 528646 - protein, 9 aa, Homo Sapiens
KFTSHIAGV

SEQ ID NO: 528647 - protein, 9 aa, Homo Sapiens
PQGGSKSQS

SEQ ID NO: 528648 - protein, 9 aa, Homo Sapiens
SLSPSSAHP

SEQ ID NO: 528649 - protein, 9 aa, Homo Sapiens
VAASRPVCQ

SEQ ID NO: 528650 - protein, 9 aa, Homo Sapiens
SHTHTHTQL

SEQ ID NO: 528651 - protein, 9 aa, Homo Sapiens
LSPSSAHPF

SEQ ID NO: 528652 - protein, 9 aa, Homo Sapiens
VLNGKVGMD

SEQ ID NO: 528653 - protein, 9 aa, Homo Sapiens
GRSPNAHSG

SEQ ID NO: 528654 - protein, 9 aa, Homo Sapiens
FCYQIRCCT

SEQ ID NO: 528655 - protein, 9 aa, Homo Sapiens
GIHGEELEG

SEQ ID NO: 528656 - protein, 9 aa, Homo Sapiens
PLAVTSLSP

SEQ ID NO: 528657 - protein, 9 aa, Homo Sapiens
HLCANGSTC

SEQ ID NO: 528658 - protein, 9 aa, Homo Sapiens
VALMGGGLP

SEQ ID NO: 528659 - protein, 9 aa, Homo Sapiens
SHIAGVYYF

SEQ ID NO: 528660 - protein, 9 aa, Homo Sapiens
LAVTSLSPS

SEQ ID NO: 528661 - protein, 9 aa, Homo Sapiens
ASRPVCQRC

SEQ ID NO: 528662 - protein, 9 aa, Homo Sapiens
DDKSPEPTW

SEQ ID NO: 528663 - protein, 9 aa, Homo Sapiens
ACLSHLCAN

SEQ ID NO: 528664 - protein, 9 aa, Homo Sapiens
GSGRRGDHR

SEQ ID NO: 528665 - protein, 9 aa, Homo Sapiens
SRPVCQRCG

SEQ ID NO: 528666 - protein, 9 aa, Homo Sapiens
GFCYQIRCC

SEQ ID NO: 528667 - protein, 9 aa, Homo Sapiens
IGIHGEELE

SEQ ID NO: 528668 - protein, 9 aa, Homo Sapiens
KQEGVLNGK

SEQ ID NO: 528669 - protein, 9 aa, Homo Sapiens
HTQLSPCGL

SEQ ID NO: 528670 - protein, 9 aa, Homo Sapiens
HGEELEGNW

SEQ ID NO: 528671 - protein, 9 aa, Homo Sapiens
NAHSGGRNS

SEQ ID NO: 528672 - protein, 9 aa, Homo Sapiens
GCSHTHTHT

SEQ ID NO: 528673 - protein, 9 aa, Homo Sapiens
RDQDEDDKS

SEQ ID NO: 528674 - protein, 9 aa, Homo Sapiens
KSQKWNEMN

SEQ ID NO: 528675 - protein, 9 aa, Homo Sapiens
SPNAHSGGR

SEQ ID NO: 528676 - protein, 9 aa, Homo Sapiens
RCCTDDVRP

SEQ ID NO: 528677 - protein, 9 aa, Homo Sapiens
RGDHRSSRD

SEQ ID NO: 528678 - protein, 9 aa, Homo Sapiens
LLVALMGGG

SEQ ID NO: 528679 - protein, 9 aa, Homo Sapiens
CCTDDVRPQ

SEQ ID NO: 528680 - protein, 9 aa, Homo Sapiens
SPEPTWADD

SEQ ID NO: 528681 - protein, 9 aa, Homo Sapiens
TEIGIHGEE

SEQ ID NO: 528682 - protein, 9 aa, Homo Sapiens
TNGLLVALM

SEQ ID NO: 528683 - protein, 9 aa, Homo Sapiens
LSHLCANGS

SEQ ID NO: 528684 - protein, 9 aa, Homo Sapiens
WGMTEIGIH

SEQ ID NO: 528685 - protein, 9 aa, Homo Sapiens
TQLSPCGLG

SEQ ID NO: 528686 - protein, 9 aa, Homo Sapiens
EEYRGRSPN

SEQ ID NO: 528687 - protein, 9 aa, Homo Sapiens
NGKVGMDYR

SEQ ID NO: 528688 - protein, 9 aa, Homo Sapiens
MTEIGIHGE

SEQ ID NO: 528689 - protein, 9 aa, Homo Sapiens
CSHTHTHTQ

SEQ ID NO: 528690 - protein, 9 aa, Homo Sapiens
GVPSTAPVS

SEQ ID NO: 528691 - protein, 9 aa, Homo Sapiens
DKSPEPTWA

SEQ ID NO: 528692 - protein, 9 aa, Homo Sapiens
PPQGGSKSQ

SEQ ID NO: 528693 - protein, 9 aa, Homo Sapiens
DLDDGLNGD

SEQ ID NO: 528694 - protein, 9 aa, Homo Sapiens
EDDKSPEPT

SEQ ID NO: 528695 - protein, 9 aa, Homo Sapiens
DTAVGKFTS

SEQ ID NO: 528696 - protein, 9 aa, Homo Sapiens
GVLNGKVGM

SEQ ID NO: 528697 - protein, 9 aa, Homo Sapiens
EIGIHGEEL

SEQ ID NO: 528698 - protein, 9 aa, Homo Sapiens
DACLSHLCA

SEQ ID NO: 528699 - protein, 9 aa, Homo Sapiens
IHGEELEGN

SEQ ID NO: 528700 - protein, 9 aa, Homo Sapiens
RSPNAHSGG

SEQ ID NO: 528701 - protein, 9 aa, Homo Sapiens
CLSHLCANG

SEQ ID NO: 528702 - protein, 9 aa, Homo Sapiens
DQDEDDKSP

SEQ ID NO: 528703 - protein, 9 aa, Homo Sapiens
THTHTQLSP

SEQ ID NO: 528704 - protein, 9 aa, Homo Sapiens
VSGNLGLII

SEQ ID NO: 528705 - protein, 9 aa, Homo Sapiens
SMAACPEAP

SEQ ID NO: 528706 - protein, 9 aa, Homo Sapiens
DVVPDTMWG

SEQ ID NO: 528707 - protein, 9 aa, Homo Sapiens
HRLETSVDQ

SEQ ID NO: 528708 - protein, 9 aa, Homo Sapiens
HLSQAPRTL

SEQ ID NO: 528709 - protein, 9 aa, Homo Sapiens
ERERESLGG

SEQ ID NO: 528710 - protein, 9 aa, Homo Sapiens
GAGAKQLSL

SEQ ID NO: 528711 - protein, 9 aa, Homo Sapiens
LGGAGKHGE

SEQ ID NO: 528712 - protein, 9 aa, Homo Sapiens
EGAGDRGRG

SEQ ID NO: 528713 - protein, 9 aa, Homo Sapiens
AHRLETSVD

SEQ ID NO: 528714 - protein, 9 aa, Homo Sapiens
GSYQGCCVI

SEQ ID NO: 528715 - protein, 9 aa, Homo Sapiens
CYGSLTHSP

SEQ ID NO: 528716 - protein, 9 aa, Homo Sapiens
ASGAPRPPR

SEQ ID NO: 528717 - protein, 9 aa, Homo Sapiens
SGNLGLIII

SEQ ID NO: 528718 - protein, 9 aa, Homo Sapiens
EERERERES

SEQ ID NO: 528719 - protein, 9 aa, Homo Sapiens
TSVDQYPTH

SEQ ID NO: 528720 - protein, 9 aa, Homo Sapiens
CCTPAPCLS

SEQ ID NO: 528721 - protein, 9 aa, Homo Sapiens
RNRLIHKRF

SEQ ID NO: 528722 - protein, 9 aa, Homo Sapiens
TCSDLHGIC

SEQ ID NO: 528723 - protein, 9 aa, Homo Sapiens
TVRNPAVKC

SEQ ID NO: 528724 - protein, 9 aa, Homo Sapiens
FCKDHGFYP

SEQ ID NO: 528725 - protein, 9 aa, Homo Sapiens
VTALFCKDH

SEQ ID NO: 528726 - protein, 9 aa, Homo Sapiens
HPSQTPTRT

SEQ ID NO: 528727 - protein, 9 aa, Homo Sapiens
AWRISAQHP

SEQ ID NO: 528728 - protein, 9 aa, Homo Sapiens
GTTPSQASG

SEQ ID NO: 528729 - protein, 9 aa, Homo Sapiens
GIPLTTQQA

SEQ ID NO: 528730 - protein, 9 aa, Homo Sapiens
IHKRFLCLG

SEQ ID NO: 528731 - protein, 9 aa, Homo Sapiens
NNRLYKLTY

SEQ ID NO: 528732 - protein, 9 aa, Homo Sapiens
PQPPVEEDE

SEQ ID NO: 528733 - protein, 9 aa, Homo Sapiens
NKELVHMIS

SEQ ID NO: 528734 - protein, 9 aa, Homo Sapiens
PESQLHHVL

SEQ ID NO: 528735 - protein, 9 aa, Homo Sapiens
QPPVEEDEH

SEQ ID NO: 528736 - protein, 9 aa, Homo Sapiens
TPSQASGAP

SEQ ID NO: 528737 - protein, 9 aa, Homo Sapiens
WEQEKELRE

SEQ ID NO: 528738 - protein, 9 aa, Homo Sapiens
CEPPCCTPA

SEQ ID NO: 528739 - protein, 9 aa, Homo Sapiens
TPAPCLSLV

SEQ ID NO: 528740 - protein, 9 aa, Homo Sapiens
VVPDTMWGK

SEQ ID NO: 528741 - protein, 9 aa, Homo Sapiens
LAQQLKQEC

SEQ ID NO: 528742 - protein, 9 aa, Homo Sapiens
RPPRHAPPA

SEQ ID NO: 528743 - protein, 9 aa, Homo Sapiens
VVHVRVLCE

SEQ ID NO: 528744 - protein, 9 aa, Homo Sapiens
IPLTTQQAQ

SEQ ID NO: 528745 - protein, 9 aa, Homo Sapiens
QAPRTLLGF

SEQ ID NO: 528746 - protein, 9 aa, Homo Sapiens
HLRNRLIHK

SEQ ID NO: 528747 - protein, 9 aa, Homo Sapiens
KDHGFYPPE

SEQ ID NO: 528748 - protein, 9 aa, Homo Sapiens
GSHTSPHQQ

SEQ ID NO: 528749 - protein, 9 aa, Homo Sapiens
RVLCESVVE

SEQ ID NO: 528750 - protein, 9 aa, Homo Sapiens
LGLGLHLSQ

SEQ ID NO: 528751 - protein, 9 aa, Homo Sapiens
NAHRLETSV

SEQ ID NO: 528752 - protein, 9 aa, Homo Sapiens
ALFCKDHGF

SEQ ID NO: 528753 - protein, 9 aa, Homo Sapiens
ASSEPAPAC

SEQ ID NO: 528754 - protein, 9 aa, Homo Sapiens
PFGTTPSQA

SEQ ID NO: 528755 - protein, 9 aa, Homo Sapiens
AWGSHTSPH

SEQ ID NO: 528756 - protein, 9 aa, Homo Sapiens
ALGIPLTTQ

SEQ ID NO: 528757 - protein, 9 aa, Homo Sapiens
LRNRLIHKR

SEQ ID NO: 528758 - protein, 9 aa, Homo Sapiens
RAHAWGSHT

SEQ ID NO: 528759 - protein, 9 aa, Homo Sapiens
CSDLHGICE

SEQ ID NO: 528760 - protein, 9 aa, Homo Sapiens
SPQPPVEED

SEQ ID NO: 528761 - protein, 9 aa, Homo Sapiens
VHVRVLCES

SEQ ID NO: 528762 - protein, 9 aa, Homo Sapiens
RLETSVDQY

SEQ ID NO: 528763 - protein, 9 aa, Homo Sapiens
TSPHQQCGL

SEQ ID NO: 528764 - protein, 9 aa, Homo Sapiens
EILEPDGNT

SEQ ID NO: 528765 - protein, 9 aa, Homo Sapiens
AESRELLVS

SEQ ID NO: 528766 - protein, 9 aa, Homo Sapiens
CCEPPCCTP

SEQ ID NO: 528767 - protein, 9 aa, Homo Sapiens
HSILRVLLG

SEQ ID NO: 528768 - protein, 9 aa, Homo Sapiens
LHCARKVGY

SEQ ID NO: 528769 - protein, 9 aa, Homo Sapiens
SQAPRTLLG

SEQ ID NO: 528770 - protein, 9 aa, Homo Sapiens
ERESLGGAG

SEQ ID NO: 528771 - protein, 9 aa, Homo Sapiens
TNMLQRKHL

SEQ ID NO: 528772 - protein, 9 aa, Homo Sapiens
SSEPAPACA

SEQ ID NO: 528773 - protein, 9 aa, Homo Sapiens
ESQTRSGSY

SEQ ID NO: 528774 - protein, 9 aa, Homo Sapiens
LAPFGTTPS

SEQ ID NO: 528775 - protein, 9 aa, Homo Sapiens
ISQFSGPSV

SEQ ID NO: 528776 - protein, 9 aa, Homo Sapiens
LGVSGNLGL

SEQ ID NO: 528777 - protein, 9 aa, Homo Sapiens
KSVDFPEYS

SEQ ID NO: 528778 - protein, 9 aa, Homo Sapiens
GAGDRGRGT

SEQ ID NO: 528779 - protein, 9 aa, Homo Sapiens
TRSGSYSLS

SEQ ID NO: 528780 - protein, 9 aa, Homo Sapiens
LRYGRYGGE

SEQ ID NO: 528781 - protein, 9 aa, Homo Sapiens
KHGEMSMSM

SEQ ID NO: 528782 - protein, 9 aa, Homo Sapiens
RELLVSSRL

SEQ ID NO: 528783 - protein, 9 aa, Homo Sapiens
GKHGEMSMS

SEQ ID NO: 528784 - protein, 9 aa, Homo Sapiens
HKESGQVVT

SEQ ID NO: 528785 - protein, 9 aa, Homo Sapiens
LSLSGRPTA

SEQ ID NO: 528786 - protein, 9 aa, Homo Sapiens
SCCEPPCCT

SEQ ID NO: 528787 - protein, 9 aa, Homo Sapiens
AGDRGRGTR

SEQ ID NO: 528788 - protein, 9 aa, Homo Sapiens
EPAPACAAK

SEQ ID NO: 528789 - protein, 9 aa, Homo Sapiens
QHPSQTPTR

SEQ ID NO: 528790 - protein, 9 aa, Homo Sapiens
YIPSVVLHN

SEQ ID NO: 528791 - protein, 9 aa, Homo Sapiens
SAQHPSQTP

SEQ ID NO: 528792 - protein, 9 aa, Homo Sapiens
LLGANGTYS

SEQ ID NO: 528793 - protein, 9 aa, Homo Sapiens
GLHLSQAPR

SEQ ID NO: 528794 - protein, 9 aa, Homo Sapiens
MSMSMAACP

SEQ ID NO: 528795 - protein, 9 aa, Homo Sapiens
ESQLHHVLK

SEQ ID NO: 528796 - protein, 9 aa, Homo Sapiens
IPSVVLHNL

SEQ ID NO: 528797 - protein, 9 aa, Homo Sapiens
HAPPAPAWR

SEQ ID NO: 528798 - protein, 9 aa, Homo Sapiens
EQETEEEVP

SEQ ID NO: 528799 - protein, 9 aa, Homo Sapiens
RISAQHPSQ

SEQ ID NO: 528800 - protein, 9 aa, Homo Sapiens
GQVVTIKQV

SEQ ID NO: 528801 - protein, 9 aa, Homo Sapiens
GAGKHGEMS

SEQ ID NO: 528802 - protein, 9 aa, Homo Sapiens
GCCVICGGP

SEQ ID NO: 528803 - protein, 9 aa, Homo Sapiens
LNNRLYKLT

SEQ ID NO: 528804 - protein, 9 aa, Homo Sapiens
HKRFLCLGW

SEQ ID NO: 528805 - protein, 9 aa, Homo Sapiens
VHNKANKVT

SEQ ID NO: 528806 - protein, 9 aa, Homo Sapiens
KESGQVVTI

SEQ ID NO: 528807 - protein, 9 aa, Homo Sapiens
MMSLTKLAN

SEQ ID NO: 528808 - protein, 9 aa, Homo Sapiens
NKANKVTGN

SEQ ID NO: 528809 - protein, 9 aa, Homo Sapiens
VRVLCESVV

SEQ ID NO: 528810 - protein, 9 aa, Homo Sapiens
SLTHSPYQV

SEQ ID NO: 528811 - protein, 9 aa, Homo Sapiens
QLHHVLKRP

SEQ ID NO: 528812 - protein, 9 aa, Homo Sapiens
ALGLGLHLS

SEQ ID NO: 528813 - protein, 9 aa, Homo Sapiens
VLCESVVEA

SEQ ID NO: 528814 - protein, 9 aa, Homo Sapiens
IRESQTRSG

SEQ ID NO: 528815 - protein, 9 aa, Homo Sapiens
VPDTMWGKI

SEQ ID NO: 528816 - protein, 9 aa, Homo Sapiens
GFLTFFRGV

SEQ ID NO: 528817 - protein, 9 aa, Homo Sapiens
APSKEASPE

SEQ ID NO: 528818 - protein, 9 aa, Homo Sapiens
SGPSVEQMC

SEQ ID NO: 528819 - protein, 9 aa, Homo Sapiens
LWEQEKELR

SEQ ID NO: 528820 - protein, 9 aa, Homo Sapiens
DHGFYPPEI

SEQ ID NO: 528821 - protein, 9 aa, Homo Sapiens
NYGSYQGCC

SEQ ID NO: 528822 - protein, 9 aa, Homo Sapiens
GHLRNRLIH

SEQ ID NO: 528823 - protein, 9 aa, Homo Sapiens
KVTGNQNQD

SEQ ID NO: 528824 - protein, 9 aa, Homo Sapiens
CEDGGKPPV

SEQ ID NO: 528825 - protein, 9 aa, Homo Sapiens
QRKHLQTLM

SEQ ID NO: 528826 - protein, 9 aa, Homo Sapiens
VVLHNLSSI

SEQ ID NO: 528827 - protein, 9 aa, Homo Sapiens
NLGLIIIIL

SEQ ID NO: 528828 - protein, 9 aa, Homo Sapiens
KQECQKELA

SEQ ID NO: 528829 - protein, 9 aa, Homo Sapiens
EASPEAGRA

SEQ ID NO: 528830 - protein, 9 aa, Homo Sapiens
KENCLHCAR

SEQ ID NO: 528831 - protein, 9 aa, Homo Sapiens
RTRSSTWAL

SEQ ID NO: 528832 - protein, 9 aa, Homo Sapiens
HINAHRLET

SEQ ID NO: 528833 - protein, 9 aa, Homo Sapiens
PAVKCLSPG

SEQ ID NO: 528834 - protein, 9 aa, Homo Sapiens
QEKELWEQE

SEQ ID NO: 528835 - protein, 9 aa, Homo Sapiens
ECQKELACL

SEQ ID NO: 528836 - protein, 9 aa, Homo Sapiens
FTVSAESRE

SEQ ID NO: 528837 - protein, 9 aa, Homo Sapiens
EPDGNTPQF

SEQ ID NO: 528838 - protein, 9 aa, Homo Sapiens
LGIPLTTQQ

SEQ ID NO: 528839 - protein, 9 aa, Homo Sapiens
SEEILEPDG

SEQ ID NO: 528840 - protein, 9 aa, Homo Sapiens
AGKHGEMSM

SEQ ID NO: 528841 - protein, 9 aa, Homo Sapiens
KHLQTLMSV

SEQ ID NO: 528842 - protein, 9 aa, Homo Sapiens
GLGLHLSQA

SEQ ID NO: 528843 - protein, 9 aa, Homo Sapiens
YGDVVPDTM

SEQ ID NO: 528844 - protein, 9 aa, Homo Sapiens
ESGQVVTIK

SEQ ID NO: 528845 - protein, 9 aa, Homo Sapiens
GPSVEQMCK

SEQ ID NO: 528846 - protein, 9 aa, Homo Sapiens
HGICEDGGK

SEQ ID NO: 528847 - protein, 9 aa, Homo Sapiens
ESLGGAGKH

SEQ ID NO: 528848 - protein, 9 aa, Homo Sapiens
NPAVKCLSP

SEQ ID NO: 528849 - protein, 9 aa, Homo Sapiens
RSSTWALGL

SEQ ID NO: 528850 - protein, 9 aa, Homo Sapiens
RNPAVKCLS

SEQ ID NO: 528851 - protein, 9 aa, Homo Sapiens
VEEDEHFDD

SEQ ID NO: 528852 - protein, 9 aa, Homo Sapiens
ERERERESL

SEQ ID NO: 528853 - protein, 9 aa, Homo Sapiens
CKDHGFYPP

SEQ ID NO: 528854 - protein, 9 aa, Homo Sapiens
MLRYGRYGG

SEQ ID NO: 528855 - protein, 9 aa, Homo Sapiens
HHVLKRPHQ

SEQ ID NO: 528856 - protein, 9 aa, Homo Sapiens
ASPEAGRAA

SEQ ID NO: 528857 - protein, 9 aa, Homo Sapiens
HVKENCLHC

SEQ ID NO: 528858 - protein, 9 aa, Homo Sapiens
ISAQHPSQT

SEQ ID NO: 528859 - protein, 9 aa, Homo Sapiens
FSGPSVEQM

SEQ ID NO: 528860 - protein, 9 aa, Homo Sapiens
APPAPAWRI

SEQ ID NO: 528861 - protein, 9 aa, Homo Sapiens
SLGGAGKHG

SEQ ID NO: 528862 - protein, 9 aa, Homo Sapiens
CLHCARKVG

SEQ ID NO: 528863 - protein, 9 aa, Homo Sapiens
LGLHLSQAP

SEQ ID NO: 528864 - protein, 9 aa, Homo Sapiens
ANKELVHMI

SEQ ID NO: 528865 - protein, 9 aa, Homo Sapiens
FPEYSPSSN

SEQ ID NO: 528866 - protein, 9 aa, Homo Sapiens
PSQASGAPR

SEQ ID NO: 528867 - protein, 9 aa, Homo Sapiens
FGTTPSQAS

SEQ ID NO: 528868 - protein, 9 aa, Homo Sapiens
AKQLSLSGR

SEQ ID NO: 528869 - protein, 9 aa, Homo Sapiens
SLSGRPTAS

SEQ ID NO: 528870 - protein, 9 aa, Homo Sapiens
PEYSPSSNY

SEQ ID NO: 528871 - protein, 9 aa, Homo Sapiens
PRHAPPAPA

SEQ ID NO: 528872 - protein, 9 aa, Homo Sapiens
LKQECQKEL

SEQ ID NO: 528873 - protein, 9 aa, Homo Sapiens
GDVVPDTMW

SEQ ID NO: 528874 - protein, 9 aa, Homo Sapiens
LRVLLGANG

SEQ ID NO: 528875 - protein, 9 aa, Homo Sapiens
VPDDAQFEM

SEQ ID NO: 528876 - protein, 9 aa, Homo Sapiens
LIHKRFLCL

SEQ ID NO: 528877 - protein, 9 aa, Homo Sapiens
LANKELVHM

SEQ ID NO: 528878 - protein, 9 aa, Homo Sapiens
EMSMSMAAC

SEQ ID NO: 528879 - protein, 9 aa, Homo Sapiens
EVPDDAQFE

SEQ ID NO: 528880 - protein, 9 aa, Homo Sapiens
PCCTPAPCL

SEQ ID NO: 528881 - protein, 9 aa, Homo Sapiens
LREQEKELW

SEQ ID NO: 528882 - protein, 9 aa, Homo Sapiens
CAAKQEKPA

SEQ ID NO: 528883 - protein, 9 aa, Homo Sapiens
NVHNKANKV

SEQ ID NO: 528884 - protein, 9 aa, Homo Sapiens
PLAPFGTTP

SEQ ID NO: 528885 - protein, 9 aa, Homo Sapiens
LHHVLKRPH

SEQ ID NO: 528886 - protein, 9 aa, Homo Sapiens
GVTALFCKD

SEQ ID NO: 528887 - protein, 9 aa, Homo Sapiens
DVHSILRVL

SEQ ID NO: 528888 - protein, 9 aa, Homo Sapiens
TRRSEEILE

SEQ ID NO: 528889 - protein, 9 aa, Homo Sapiens
WGSHTSPHQ

SEQ ID NO: 528890 - protein, 9 aa, Homo Sapiens
GICEDGGKP

SEQ ID NO: 528891 - protein, 9 aa, Homo Sapiens
VKCLSPGGH

SEQ ID NO: 528892 - protein, 9 aa, Homo Sapiens
NKVTGNQNQ

SEQ ID NO: 528893 - protein, 9 aa, Homo Sapiens
RRSEEILEP

SEQ ID NO: 528894 - protein, 9 aa, Homo Sapiens
QECQKELAC

SEQ ID NO: 528895 - protein, 9 aa, Homo Sapiens
AVKCLSPGG

SEQ ID NO: 528896 - protein, 9 aa, Homo Sapiens
MSLTKLANK

SEQ ID NO: 528897 - protein, 9 aa, Homo Sapiens
TWALGLGLH

SEQ ID NO: 528898 - protein, 9 aa, Homo Sapiens
NMLQRKHLQ

SEQ ID NO: 528899 - protein, 9 aa, Homo Sapiens
PPVEEDEHF

SEQ ID NO: 528900 - protein, 9 aa, Homo Sapiens
PSKEASPEA

SEQ ID NO: 528901 - protein, 9 aa, Homo Sapiens
LSLNNRLYK

SEQ ID NO: 528902 - protein, 9 aa, Homo Sapiens
LTHSPYQVS

SEQ ID NO: 528903 - protein, 9 aa, Homo Sapiens
RHAPPAPAW

SEQ ID NO: 528904 - protein, 9 aa, Homo Sapiens
STWALGLGL

SEQ ID NO: 528905 - protein, 9 aa, Homo Sapiens
SQFSGPSVE

SEQ ID NO: 528906 - protein, 9 aa, Homo Sapiens
ILGVSGNLG

SEQ ID NO: 528907 - protein, 9 aa, Homo Sapiens
EYSPSSNYI

SEQ ID NO: 528908 - protein, 9 aa, Homo Sapiens
RESQTRSGS

SEQ ID NO: 528909 - protein, 9 aa, Homo Sapiens
GNLGLIIII

SEQ ID NO: 528910 - protein, 9 aa, Homo Sapiens
TTPSQASGA

SEQ ID NO: 528911 - protein, 9 aa, Homo Sapiens
TKLANKELV

SEQ ID NO: 528912 - protein, 9 aa, Homo Sapiens
APFGTTPSQ

SEQ ID NO: 528913 - protein, 9 aa, Homo Sapiens
QTRSGSYSL

SEQ ID NO: 528914 - protein, 9 aa, Homo Sapiens
LHLSQAPRT

SEQ ID NO: 528915 - protein, 9 aa, Homo Sapiens
VHSILRVLL

SEQ ID NO: 528916 - protein, 9 aa, Homo Sapiens
ENCLHCARK

SEQ ID NO: 528917 - protein, 9 aa, Homo Sapiens
PVVHVRVLC

SEQ ID NO: 528918 - protein, 9 aa, Homo Sapiens
GGAGKHGEM

SEQ ID NO: 528919 - protein, 9 aa, Homo Sapiens
ILRVLLGAN

SEQ ID NO: 528920 - protein, 9 aa, Homo Sapiens
TFFRGVMLV

SEQ ID NO: 528921 - protein, 9 aa, Homo Sapiens
QLSLSGRPT

SEQ ID NO: 528922 - protein, 9 aa, Homo Sapiens
KANKVTGNQ

SEQ ID NO: 528923 - protein, 9 aa, Homo Sapiens
DFPEYSPSS

SEQ ID NO: 528924 - protein, 9 aa, Homo Sapiens
NCLHCARKV

SEQ ID NO: 528925 - protein, 9 aa, Homo Sapiens
ICEDGGKPP

SEQ ID NO: 528926 - protein, 9 aa, Homo Sapiens
AKAGFLTFF

SEQ ID NO: 528927 - protein, 9 aa, Homo Sapiens
AGAKQLSLS

SEQ ID NO: 528928 - protein, 9 aa, Homo Sapiens
SLTKLANKE

SEQ ID NO: 528929 - protein, 9 aa, Homo Sapiens
SQASGAPRP

SEQ ID NO: 528930 - protein, 9 aa, Homo Sapiens
NYIPSVVLH

SEQ ID NO: 528931 - protein, 9 aa, Homo Sapiens
NRLIHKRFL

SEQ ID NO: 528932 - protein, 9 aa, Homo Sapiens
SQTRSGSYS

SEQ ID NO: 528933 - protein, 9 aa, Homo Sapiens
HGEMSMSMA

SEQ ID NO: 528934 - protein, 9 aa, Homo Sapiens
VEQMCKTYS

SEQ ID NO: 528935 - protein, 9 aa, Homo Sapiens
MLQRKHLQT

SEQ ID NO: 528936 - protein, 9 aa, Homo Sapiens
KLANKELVH

SEQ ID NO: 528937 - protein, 9 aa, Homo Sapiens
SPEAGRAAL

SEQ ID NO: 528938 - protein, 9 aa, Homo Sapiens
PACAAKQEK

SEQ ID NO: 528939 - protein, 9 aa, Homo Sapiens
LSQAPRTLL

SEQ ID NO: 528940 - protein, 9 aa, Homo Sapiens
AHAWGSHTS

SEQ ID NO: 528941 - protein, 9 aa, Homo Sapiens
SMSMAACPE

SEQ ID NO: 528942 - protein, 9 aa, Homo Sapiens
REQEKELWE

SEQ ID NO: 528943 - protein, 9 aa, Homo Sapiens
HVRVLCESV

SEQ ID NO: 528944 - protein, 9 aa, Homo Sapiens
RVLLGANGT

SEQ ID NO: 528945 - protein, 9 aa, Homo Sapiens
TTGLSLNNR

SEQ ID NO: 528946 - protein, 9 aa, Homo Sapiens
CTPAPCLSL

SEQ ID NO: 528947 - protein, 9 aa, Homo Sapiens
GAKQLSLSG

SEQ ID NO: 528948 - protein, 9 aa, Homo Sapiens
SILRVLLGA

SEQ ID NO: 528949 - protein, 9 aa, Homo Sapiens
TIKQVPVES

SEQ ID NO: 528950 - protein, 9 aa, Homo Sapiens
LIRESQTRS

SEQ ID NO: 528951 - protein, 9 aa, Homo Sapiens
LSGRPTASV

SEQ ID NO: 528952 - protein, 9 aa, Homo Sapiens
TALFCKDHG

SEQ ID NO: 528953 - protein, 9 aa, Homo Sapiens
INAHRLETS

SEQ ID NO: 528954 - protein, 9 aa, Homo Sapiens
QETEEEVPD

SEQ ID NO: 528955 - protein, 9 aa, Homo Sapiens
PVEEDEHFD

SEQ ID NO: 528956 - protein, 9 aa, Homo Sapiens
RSGSYSLSV

SEQ ID NO: 528957 - protein, 9 aa, Homo Sapiens
PSVEQMCKT

SEQ ID NO: 528958 - protein, 9 aa, Homo Sapiens
PPCCTPAPC

SEQ ID NO: 528959 - protein, 9 aa, Homo Sapiens
TGLSLNNRL

SEQ ID NO: 528960 - protein, 9 aa, Homo Sapiens
PEAGRAALL

SEQ ID NO: 528961 - protein, 9 aa, Homo Sapiens
GAPRPPRHA

SEQ ID NO: 528962 - protein, 9 aa, Homo Sapiens
YGSYQGCCV

SEQ ID NO: 528963 - protein, 9 aa, Homo Sapiens
LHGICEDGG

SEQ ID NO: 528964 - protein, 9 aa, Homo Sapiens
PRPPRHAPP

SEQ ID NO: 528965 - protein, 9 aa, Homo Sapiens
NTVRNPAVK

SEQ ID NO: 528966 - protein, 9 aa, Homo Sapiens
PPAPAWRIS

SEQ ID NO: 528967 - protein, 9 aa, Homo Sapiens
SEPAPACAA

SEQ ID NO: 528968 - protein, 9 aa, Homo Sapiens
SRELLVSSR

SEQ ID NO: 528969 - protein, 9 aa, Homo Sapiens
SAESRELLV

SEQ ID NO: 528970 - protein, 9 aa, Homo Sapiens
LEPDGNTPQ

SEQ ID NO: 528971 - protein, 9 aa, Homo Sapiens
QALGIPLTT

SEQ ID NO: 528972 - protein, 9 aa, Homo Sapiens
SGSYSLSVR

SEQ ID NO: 528973 - protein, 9 aa, Homo Sapiens
VSAESRELL

SEQ ID NO: 528974 - protein, 9 aa, Homo Sapiens
EPPCCTPAP

SEQ ID NO: 528975 - protein, 9 aa, Homo Sapiens
KNYIPSVVL

SEQ ID NO: 528976 - protein, 9 aa, Homo Sapiens
RERESLGGA

SEQ ID NO: 528977 - protein, 9 aa, Homo Sapiens
VSPVVHVRV

SEQ ID NO: 528978 - protein, 9 aa, Homo Sapiens
HTSPHQQCG

SEQ ID NO: 528979 - protein, 9 aa, Homo Sapiens
LGLIIIILK

SEQ ID NO: 528980 - protein, 9 aa, Homo Sapiens
GLSLNNRLY

SEQ ID NO: 528981 - protein, 9 aa, Homo Sapiens
CNYGSYQGC

SEQ ID NO: 528982 - protein, 9 aa, Homo Sapiens
KAGFLTFFR

SEQ ID NO: 528983 - protein, 9 aa, Homo Sapiens
ETSVDQYPT

SEQ ID NO: 528984 - protein, 9 aa, Homo Sapiens
QLKQECQKE

SEQ ID NO: 528985 - protein, 9 aa, Homo Sapiens
AQHPSQTPT

SEQ ID NO: 528986 - protein, 9 aa, Homo Sapiens
SVEQMCKTY

SEQ ID NO: 528987 - protein, 9 aa, Homo Sapiens
YFTVSAESR

SEQ ID NO: 528988 - protein, 8 aa, Homo Sapiens
FPQSRHPT

SEQ ID NO: 528989 - protein, 9 aa, Homo Sapiens
GEMSMSMAA

SEQ ID NO: 528990 - protein, 9 aa, Homo Sapiens
HCARKVGYR

SEQ ID NO: 528991 - protein, 9 aa, Homo Sapiens
WALGLGLHL

SEQ ID NO: 528992 - protein, 9 aa, Homo Sapiens
TYRCYGSLT

SEQ ID NO: 528993 - protein, 9 aa, Homo Sapiens
YQGCCVICG

SEQ ID NO: 528994 - protein, 9 aa, Homo Sapiens
RERERESLG

SEQ ID NO: 528995 - protein, 9 aa, Homo Sapiens
PDTMWGKIV

SEQ ID NO: 528996 - protein, 9 aa, Homo Sapiens
IGYGDVVPD

SEQ ID NO: 528997 - protein, 9 aa, Homo Sapiens
KQLSLSGRP

SEQ ID NO: 528998 - protein, 9 aa, Homo Sapiens
QVVTIKQVP

SEQ ID NO: 528999 - protein, 9 aa, Homo Sapiens
PTRTRSSTW

SEQ ID NO: 529000 - protein, 9 aa, Homo Sapiens
PPRHAPPAP

SEQ ID NO: 529001 - protein, 9 aa, Homo Sapiens
FTNMLQRKH

SEQ ID NO: 529002 - protein, 9 aa, Homo Sapiens
QQLKQECQK

SEQ ID NO: 529003 - protein, 9 aa, Homo Sapiens
SDLHGICED

SEQ ID NO: 529004 - protein, 9 aa, Homo Sapiens
FRGVMLVIP

SEQ ID NO: 529005 - protein, 9 aa, Homo Sapiens
DTMWGKIVC

SEQ ID NO: 529006 - protein, 9 aa, Homo Sapiens
ENTVRNPAV

SEQ ID NO: 529007 - protein, 9 aa, Homo Sapiens
GLIIIILKQ

SEQ ID NO: 529008 - protein, 9 aa, Homo Sapiens
DLHGICEDG

SEQ ID NO: 529009 - protein, 9 aa, Homo Sapiens
LYKNYIPSV

SEQ ID NO: 529010 - protein, 9 aa, Homo Sapiens
SQTPTRTRS

SEQ ID NO: 529011 - protein, 9 aa, Homo Sapiens
AQQLKQECQ

SEQ ID NO: 529012 - protein, 9 aa, Homo Sapiens
SQLHHVLKR

SEQ ID NO: 529013 - protein, 9 aa, Homo Sapiens
QTPTRTRSS

SEQ ID NO: 529014 - protein, 9 aa, Homo Sapiens
TRTRSSTWA

SEQ ID NO: 529015 - protein, 9 aa, Homo Sapiens
VLLGANGTY

SEQ ID NO: 529016 - protein, 9 aa, Homo Sapiens
CQKELACLR

SEQ ID NO: 529017 - protein, 9 aa, Homo Sapiens
HAWGSHTSP

SEQ ID NO: 529018 - protein, 9 aa, Homo Sapiens
VRNPAVKCL

SEQ ID NO: 529019 - protein, 9 aa, Homo Sapiens
SLNNRLYKL

SEQ ID NO: 529020 - protein, 9 aa, Homo Sapiens
KELWEQEKE

SEQ ID NO: 529021 - protein, 9 aa, Homo Sapiens
TEEEVPDDA

SEQ ID NO: 529022 - protein, 9 aa, Homo Sapiens
LTKLANKEL

SEQ ID NO: 529023 - protein, 9 aa, Homo Sapiens
RCYGSLTHS

SEQ ID NO: 529024 - protein, 9 aa, Homo Sapiens
HLQTLMSVD

SEQ ID NO: 529025 - protein, 9 aa, Homo Sapiens
SPVVHVRVL

SEQ ID NO: 529026 - protein, 9 aa, Homo Sapiens
YRCYGSLTH

SEQ ID NO: 529027 - protein, 9 aa, Homo Sapiens
SGQVVTIKQ

SEQ ID NO: 529028 - protein, 9 aa, Homo Sapiens
KEQETEEEV

SEQ ID NO: 529029 - protein, 9 aa, Homo Sapiens
GSLTHSPYQ

SEQ ID NO: 529030 - protein, 9 aa, Homo Sapiens
PAWRISAQH

SEQ ID NO: 529031 - protein, 9 aa, Homo Sapiens
VVTIKQVPV

SEQ ID NO: 529032 - protein, 9 aa, Homo Sapiens
CCVICGGPG

SEQ ID NO: 529033 - protein, 9 aa, Homo Sapiens
ANKVTGNQN

SEQ ID NO: 529034 - protein, 9 aa, Homo Sapiens
QASGAPRPP

SEQ ID NO: 529035 - protein, 9 aa, Homo Sapiens
APACAAKQE

SEQ ID NO: 529036 - protein, 9 aa, Homo Sapiens
KEASPEAGR

SEQ ID NO: 529037 - protein, 9 aa, Homo Sapiens
WRISAQHPS

SEQ ID NO: 529038 - protein, 9 aa, Homo Sapiens
SVDFPEYSP

SEQ ID NO: 529039 - protein, 9 aa, Homo Sapiens
ACAAKQEKP

SEQ ID NO: 529040 - protein, 9 aa, Homo Sapiens
NRLYKLTYS

SEQ ID NO: 529041 - protein, 9 aa, Homo Sapiens
APRPPRHAP

SEQ ID NO: 529042 - protein, 9 aa, Homo Sapiens
SHTSPHQQC

SEQ ID NO: 529043 - protein, 9 aa, Homo Sapiens
AGFLTFFRG

SEQ ID NO: 529044 - protein, 9 aa, Homo Sapiens
ELWEQEKEL

SEQ ID NO: 529045 - protein, 9 aa, Homo Sapiens
VTIKQVPVE

SEQ ID NO: 529046 - protein, 9 aa, Homo Sapiens
HVLKRPHQS

SEQ ID NO: 529047 - protein, 9 aa, Homo Sapiens
PSQTPTRTR

SEQ ID NO: 529048 - protein, 9 aa, Homo Sapiens
GYGDVVPDT

SEQ ID NO: 529049 - protein, 9 aa, Homo Sapiens
TPTRTRSST

SEQ ID NO: 529050 - protein, 9 aa, Homo Sapiens
ILEPDGNTP

SEQ ID NO: 529051 - protein, 9 aa, Homo Sapiens
SGAPRPPRH

SEQ ID NO: 529052 - protein, 9 aa, Homo Sapiens
TVSAESREL

SEQ ID NO: 529053 - protein, 9 aa, Homo Sapiens
YGSLTHSPY

SEQ ID NO: 529054 - protein, 9 aa, Homo Sapiens
SAPSKEASP

SEQ ID NO: 529055 - protein, 9 aa, Homo Sapiens
MSMAACPEA

SEQ ID NO: 529056 - protein, 9 aa, Homo Sapiens
EKELWEQEK

SEQ ID NO: 529057 - protein, 9 aa, Homo Sapiens
SKEASPEAG

SEQ ID NO: 529058 - protein, 9 aa, Homo Sapiens
YSPSSNYIR

SEQ ID NO: 529059 - protein, 9 aa, Homo Sapiens
ESRELLVSS

SEQ ID NO: 529060 - protein, 9 aa, Homo Sapiens
SYQGCCVIC

SEQ ID NO: 529061 - protein, 9 aa, Homo Sapiens
LTFFRGVML

SEQ ID NO: 529062 - protein, 9 aa, Homo Sapiens
RKHLQTLMS

SEQ ID NO: 529063 - protein, 9 aa, Homo Sapiens
GVSGNLGLI

SEQ ID NO: 529064 - protein, 9 aa, Homo Sapiens
APAWRISAQ

SEQ ID NO: 529065 - protein, 9 aa, Homo Sapiens
VDFPEYSPS

SEQ ID NO: 529066 - protein, 9 aa, Homo Sapiens
VTGNQNQDT

SEQ ID NO: 529067 - protein, 9 aa, Homo Sapiens
PSVVLHNLS

SEQ ID NO: 529068 - protein, 9 aa, Homo Sapiens
LFCKDHGFY

SEQ ID NO: 529069 - protein, 9 aa, Homo Sapiens
QPESQLHHV

SEQ ID NO: 529070 - protein, 9 aa, Homo Sapiens
QFSGPSVEQ

SEQ ID NO: 529071 - protein, 9 aa, Homo Sapiens
SPLAPFGTT

SEQ ID NO: 529072 - protein, 9 aa, Homo Sapiens
EQEKELWEQ

SEQ ID NO: 529073 - protein, 9 aa, Homo Sapiens
RESLGGAGK

SEQ ID NO: 529074 - protein, 9 aa, Homo Sapiens
FLTFFRGVM

SEQ ID NO: 529075 - protein, 9 aa, Homo Sapiens
YKNYIPSVV

SEQ ID NO: 529076 - protein, 9 aa, Homo Sapiens
CARKVGYRC

SEQ ID NO: 529077 - protein, 9 aa, Homo Sapiens
RLIHKRFLC

SEQ ID NO: 529078 - protein, 9 aa, Homo Sapiens
FFRGVMLVI

SEQ ID NO: 529079 - protein, 9 aa, Homo Sapiens
SSTWALGLG

SEQ ID NO: 529080 - protein, 9 aa, Homo Sapiens
EEVPDDAQF

SEQ ID NO: 529081 - protein, 9 aa, Homo Sapiens
ETEEEVPDD

SEQ ID NO: 529082 - protein, 9 aa, Homo Sapiens
QGCCVICGG

SEQ ID NO: 529083 - protein, 9 aa, Homo Sapiens
EEILEPDGN

SEQ ID NO: 529084 - protein, 9 aa, Homo Sapiens
PAPAWRISA

SEQ ID NO: 529085 - protein, 9 aa, Homo Sapiens
LQRKHLQTL

SEQ ID NO: 529086 - protein, 9 aa, Homo Sapiens
SPSSNYIRG

SEQ ID NO: 529087 - protein, 9 aa, Homo Sapiens
RSEEILEPD

SEQ ID NO: 529088 - protein, 9 aa, Homo Sapiens
PAPACAAKQ

SEQ ID NO: 529089 - protein, 9 aa, Homo Sapiens
EEEVPDDAQ

SEQ ID NO: 529090 - protein, 9 aa, Homo Sapiens
VKENCLHCA

SEQ ID NO: 529091 - protein, 9 aa, Homo Sapiens
TRSSTWALG

SEQ ID NO: 529092 - protein, 9 aa, Homo Sapiens
HNKANKVTG

SEQ ID NO: 529093 - protein, 9 aa, Homo Sapiens
VLKRPHQSC

SEQ ID NO: 529094 - protein, 9 aa, Homo Sapiens
LETSVDQYP

SEQ ID NO: 529095 - protein, 9 aa, Homo Sapiens
SVVLHNLSS

SEQ ID NO: 529096 - protein, 9 aa, Homo Sapiens
NTIPSVDTS

SEQ ID NO: 529097 - protein, 9 aa, Homo Sapiens
AARDENNTI

SEQ ID NO: 529098 - protein, 9 aa, Homo Sapiens
CVNGGSCRQ

SEQ ID NO: 529099 - protein, 9 aa, Homo Sapiens
TLQCGSQKG

SEQ ID NO: 529100 - protein, 9 aa, Homo Sapiens
PMYHLMKLI

SEQ ID NO: 529101 - protein, 9 aa, Homo Sapiens
EKMVIVLDD

SEQ ID NO: 529102 - protein, 9 aa, Homo Sapiens
YYRGAQAAV

SEQ ID NO: 529103 - protein, 9 aa, Homo Sapiens
MYHLMKLIP

SEQ ID NO: 529104 - protein, 9 aa, Homo Sapiens
GGNMTLQCG

SEQ ID NO: 529105 - protein, 9 aa, Homo Sapiens
ASGGNMTLQ

SEQ ID NO: 529106 - protein, 9 aa, Homo Sapiens
RGAQAAVVV

SEQ ID NO: 529107 - protein, 9 aa, Homo Sapiens
GNMTLQCGS

SEQ ID NO: 529108 - protein, 9 aa, Homo Sapiens
AQAAVVVYD

SEQ ID NO: 529109 - protein, 9 aa, Homo Sapiens
GFFIVSSMI

SEQ ID NO: 529110 - protein, 9 aa, Homo Sapiens
TIRYVRLRT

SEQ ID NO: 529111 - protein, 9 aa, Homo Sapiens
RKGISGKRP

SEQ ID NO: 529112 - protein, 9 aa, Homo Sapiens
KGITFNSLL

SEQ ID NO: 529113 - protein, 9 aa, Homo Sapiens
SGAGRSGPY

SEQ ID NO: 529114 - protein, 9 aa, Homo Sapiens
PDPYIQRLV

SEQ ID NO: 529115 - protein, 9 aa, Homo Sapiens
IDRASECHK

SEQ ID NO: 529116 - protein, 9 aa, Homo Sapiens
LAEKMVIVL

SEQ ID NO: 529117 - protein, 9 aa, Homo Sapiens
LVETPAHFS

SEQ ID NO: 529118 - protein, 9 aa, Homo Sapiens
NHSPPHMFL

SEQ ID NO: 529119 - protein, 9 aa, Homo Sapiens
IVSSMIMLI

SEQ ID NO: 529120 - protein, 9 aa, Homo Sapiens
CPDPYIQRL

SEQ ID NO: 529121 - protein, 9 aa, Homo Sapiens
YRGAQAAVV

SEQ ID NO: 529122 - protein, 9 aa, Homo Sapiens
PPMYHLMKL

SEQ ID NO: 529123 - protein, 9 aa, Homo Sapiens
QAAVVVYDI

SEQ ID NO: 529124 - protein, 9 aa, Homo Sapiens
IKTIRYVRL

SEQ ID NO: 529125 - protein, 9 aa, Homo Sapiens
ARDENNTIP

SEQ ID NO: 529126 - protein, 9 aa, Homo Sapiens
YHLMKLIPL

SEQ ID NO: 529127 - protein, 9 aa, Homo Sapiens
LRTKHDVDM

SEQ ID NO: 529128 - protein, 9 aa, Homo Sapiens
HMFLFFLVL

SEQ ID NO: 529129 - protein, 9 aa, Homo Sapiens
RGKKVLQDD

SEQ ID NO: 529130 - protein, 9 aa, Homo Sapiens
KWCEVGILD

SEQ ID NO: 529131 - protein, 9 aa, Homo Sapiens
KIDRASECH

SEQ ID NO: 529132 - protein, 9 aa, Homo Sapiens
MFLFFLVLG

SEQ ID NO: 529133 - protein, 9 aa, Homo Sapiens
GRSGPYGEP

SEQ ID NO: 529134 - protein, 9 aa, Homo Sapiens
LIPLYSKVQ

SEQ ID NO: 529135 - protein, 9 aa, Homo Sapiens
NNTIPSVDT

SEQ ID NO: 529136 - protein, 9 aa, Homo Sapiens
MKLIPLYSK

SEQ ID NO: 529137 - protein, 9 aa, Homo Sapiens
QDDWRGRPV

SEQ ID NO: 529138 - protein, 9 aa, Homo Sapiens
VVVYDITNQ

SEQ ID NO: 529139 - protein, 9 aa, Homo Sapiens
ASECHKKYA

SEQ ID NO: 529140 - protein, 9 aa, Homo Sapiens
GKKVLQDDW

SEQ ID NO: 529141 - protein, 9 aa, Homo Sapiens
ENNTIPSVD

SEQ ID NO: 529142 - protein, 9 aa, Homo Sapiens
FIVSSMIML

SEQ ID NO: 529143 - protein, 9 aa, Homo Sapiens
VGILDYDEE

SEQ ID NO: 529144 - protein, 9 aa, Homo Sapiens
GITFNSLLA

SEQ ID NO: 529145 - protein, 9 aa, Homo Sapiens
TSRVGHLNA

SEQ ID NO: 529146 - protein, 9 aa, Homo Sapiens
DDWRGRPVV

SEQ ID NO: 529147 - protein, 9 aa, Homo Sapiens
SECHKKYAF

SEQ ID NO: 529148 - protein, 9 aa, Homo Sapiens
SPCVNGGSC

SEQ ID NO: 529149 - protein, 9 aa, Homo Sapiens
QCGSQKGYH

SEQ ID NO: 529150 - protein, 9 aa, Homo Sapiens
LASGAGRSG

SEQ ID NO: 529151 - protein, 9 aa, Homo Sapiens
RYVRLRTKH

SEQ ID NO: 529152 - protein, 9 aa, Homo Sapiens
SGGNMTLQC

SEQ ID NO: 529153 - protein, 9 aa, Homo Sapiens
VLQDDWRGR

SEQ ID NO: 529154 - protein, 9 aa, Homo Sapiens
ECHKKYAFK

SEQ ID NO: 529155 - protein, 9 aa, Homo Sapiens
HVIVRTSRV

SEQ ID NO: 529156 - protein, 9 aa, Homo Sapiens
MTLQCGSQK

SEQ ID NO: 529157 - protein, 9 aa, Homo Sapiens
SQLLRNVLC

SEQ ID NO: 529158 - protein, 9 aa, Homo Sapiens
DRASECHKK

SEQ ID NO: 529159 - protein, 9 aa, Homo Sapiens
IVRTSRVGH

SEQ ID NO: 529160 - protein, 9 aa, Homo Sapiens
FKGITFNSL

SEQ ID NO: 529161 - protein, 9 aa, Homo Sapiens
ILASGAGRS

SEQ ID NO: 529162 - protein, 9 aa, Homo Sapiens
RVGHLNAND

SEQ ID NO: 529163 - protein, 9 aa, Homo Sapiens
HLMKLIPLY

SEQ ID NO: 529164 - protein, 9 aa, Homo Sapiens
VGHLNANDW

SEQ ID NO: 529165 - protein, 9 aa, Homo Sapiens
ILDYDEEKK

SEQ ID NO: 529166 - protein, 9 aa, Homo Sapiens
SCRQTGDFT

SEQ ID NO: 529167 - protein, 9 aa, Homo Sapiens
TFNSLLAID

SEQ ID NO: 529168 - protein, 9 aa, Homo Sapiens
IRYVRLRTK

SEQ ID NO: 529169 - protein, 9 aa, Homo Sapiens
RTSRVGHLN

SEQ ID NO: 529170 - protein, 9 aa, Homo Sapiens
PPHMFLFFL

SEQ ID NO: 529171 - protein, 9 aa, Homo Sapiens
KYKWCEVGI

SEQ ID NO: 529172 - protein, 9 aa, Homo Sapiens
RRKGISGKR

SEQ ID NO: 529173 - protein, 9 aa, Homo Sapiens
SFKGITFNS

SEQ ID NO: 529174 - protein, 9 aa, Homo Sapiens
DENNTIPSV

SEQ ID NO: 529175 - protein, 9 aa, Homo Sapiens
GAQAAVVVY

SEQ ID NO: 529176 - protein, 9 aa, Homo Sapiens
IFNHSPPHM

SEQ ID NO: 529177 - protein, 9 aa, Homo Sapiens
RPGAGEGPG

SEQ ID NO: 529178 - protein, 9 aa, Homo Sapiens
RASECHKKY

SEQ ID NO: 529179 - protein, 9 aa, Homo Sapiens
MVIVLDDRV

SEQ ID NO: 529180 - protein, 9 aa, Homo Sapiens
SRVGHLNAN

SEQ ID NO: 529181 - protein, 9 aa, Homo Sapiens
ISGKRPGAG

SEQ ID NO: 529182 - protein, 9 aa, Homo Sapiens
VRLRTKHDV

SEQ ID NO: 529183 - protein, 9 aa, Homo Sapiens
FNHSPPHMF

SEQ ID NO: 529184 - protein, 9 aa, Homo Sapiens
PHMFLFFLV

SEQ ID NO: 529185 - protein, 9 aa, Homo Sapiens
ITFNSLLAI

SEQ ID NO: 529186 - protein, 9 aa, Homo Sapiens
GISGKRPGA

SEQ ID NO: 529187 - protein, 9 aa, Homo Sapiens
NMTLQCGSQ

SEQ ID NO: 529188 - protein, 9 aa, Homo Sapiens
PSFKGITFN

SEQ ID NO: 529189 - protein, 9 aa, Homo Sapiens
MIMLIGARY

SEQ ID NO: 529190 - protein, 9 aa, Homo Sapiens
SGKRPGAGE

SEQ ID NO: 529191 - protein, 9 aa, Homo Sapiens
SDSILAEKM

SEQ ID NO: 529192 - protein, 9 aa, Homo Sapiens
GILDYDEEK

SEQ ID NO: 529193 - protein, 9 aa, Homo Sapiens
IQRLVETPA

SEQ ID NO: 529194 - protein, 9 aa, Homo Sapiens
DSILAEKMV

SEQ ID NO: 529195 - protein, 9 aa, Homo Sapiens
SMIMLIGAR

SEQ ID NO: 529196 - protein, 9 aa, Homo Sapiens
CEVGILDYD

SEQ ID NO: 529197 - protein, 9 aa, Homo Sapiens
IMLIGARYI

SEQ ID NO: 529198 - protein, 9 aa, Homo Sapiens
SSMIMLIGA

SEQ ID NO: 529199 - protein, 9 aa, Homo Sapiens
DPYIQRLVE

SEQ ID NO: 529200 - protein, 9 aa, Homo Sapiens
RDENNTIPS

SEQ ID NO: 529201 - protein, 9 aa, Homo Sapiens
GGSCRQTGD

SEQ ID NO: 529202 - protein, 9 aa, Homo Sapiens
SILAEKMVI

SEQ ID NO: 529203 - protein, 9 aa, Homo Sapiens
QRAARDENN

SEQ ID NO: 529204 - protein, 9 aa, Homo Sapiens
RSGPYGEPP

SEQ ID NO: 529205 - protein, 9 aa, Homo Sapiens
GSCRQTGDF

SEQ ID NO: 529206 - protein, 9 aa, Homo Sapiens
ILAEKMVIV

SEQ ID NO: 529207 - protein, 9 aa, Homo Sapiens
GILASGAGR

SEQ ID NO: 529208 - protein, 9 aa, Homo Sapiens
FFIVSSMIM

SEQ ID NO: 529209 - protein, 9 aa, Homo Sapiens
VSSMIMLIG

SEQ ID NO: 529210 - protein, 9 aa, Homo Sapiens
NGGSCRQTG

SEQ ID NO: 529211 - protein, 9 aa, Homo Sapiens
EVGILDYDE

SEQ ID NO: 529212 - protein, 9 aa, Homo Sapiens
YVRLRTKHD

SEQ ID NO: 529213 - protein, 9 aa, Homo Sapiens
PCVNGGSCR

SEQ ID NO: 529214 - protein, 9 aa, Homo Sapiens
LMKLIPLYS

SEQ ID NO: 529215 - protein, 9 aa, Homo Sapiens
NRGKKVLQD

SEQ ID NO: 529216 - protein, 9 aa, Homo Sapiens
YIQRLVETP

SEQ ID NO: 529217 - protein, 9 aa, Homo Sapiens
AEKMVIVLD

SEQ ID NO: 529218 - protein, 9 aa, Homo Sapiens
VRTSRVGHL

SEQ ID NO: 529219 - protein, 9 aa, Homo Sapiens
KMVIVLDDR

SEQ ID NO: 529220 - protein, 9 aa, Homo Sapiens
LNPSFKGIT

SEQ ID NO: 529221 - protein, 9 aa, Homo Sapiens
AGRSGPYGE

SEQ ID NO: 529222 - protein, 9 aa, Homo Sapiens
NPSFKGITF

SEQ ID NO: 529223 - protein, 9 aa, Homo Sapiens
KLIPLYSKV

SEQ ID NO: 529224 - protein, 9 aa, Homo Sapiens
QRLVETPAH

SEQ ID NO: 529225 - protein, 9 aa, Homo Sapiens
KKVLQDDWR

SEQ ID NO: 529226 - protein, 9 aa, Homo Sapiens
ASGAGRSGP

SEQ ID NO: 529227 - protein, 9 aa, Homo Sapiens
RLVETPAHF

SEQ ID NO: 529228 - protein, 9 aa, Homo Sapiens
KTIRYVRLR

SEQ ID NO: 529229 - protein, 9 aa, Homo Sapiens
KGISGKRPG

SEQ ID NO: 529230 - protein, 9 aa, Homo Sapiens
GAGRSGPYG

SEQ ID NO: 529231 - protein, 9 aa, Homo Sapiens
HKKYAFKAC

SEQ ID NO: 529232 - protein, 9 aa, Homo Sapiens
HSPPHMFLF

SEQ ID NO: 529233 - protein, 9 aa, Homo Sapiens
RAARDENNT

SEQ ID NO: 529234 - protein, 9 aa, Homo Sapiens
KRPGAGEGP

SEQ ID NO: 529235 - protein, 9 aa, Homo Sapiens
YKWCEVGIL

SEQ ID NO: 529236 - protein, 9 aa, Homo Sapiens
SPPHMFLFF

SEQ ID NO: 529237 - protein, 9 aa, Homo Sapiens
WCEVGILDY

SEQ ID NO: 529238 - protein, 9 aa, Homo Sapiens
PSPCVNGGS

SEQ ID NO: 529239 - protein, 9 aa, Homo Sapiens
MSQLLRNVL

SEQ ID NO: 529240 - protein, 9 aa, Homo Sapiens
PYIQRLVET

SEQ ID NO: 529241 - protein, 9 aa, Homo Sapiens
RLRTKHDVD

SEQ ID NO: 529242 - protein, 9 aa, Homo Sapiens
VIVRTSRVG

SEQ ID NO: 529243 - protein, 9 aa, Homo Sapiens
LQCGSQKGY

SEQ ID NO: 529244 - protein, 9 aa, Homo Sapiens
VNGGSCRQT

SEQ ID NO: 529245 - protein, 9 aa, Homo Sapiens
LQDDWRGRP

SEQ ID NO: 529246 - protein, 9 aa, Homo Sapiens
KVLQDDWRG

SEQ ID NO: 529247 - protein, 9 aa, Homo Sapiens
GKRPGAGEG

SEQ ID NO: 529248 - protein, 9 aa, Homo Sapiens
CHKKYAFKA

SEQ ID NO: 529249 - protein, 9 aa, Homo Sapiens
AALGPNTES

SEQ ID NO: 529250 - protein, 9 aa, Homo Sapiens
QVSASQTRS

SEQ ID NO: 529251 - protein, 9 aa, Homo Sapiens
LGPNTESAK

SEQ ID NO: 529252 - protein, 9 aa, Homo Sapiens
RVYRILPLS

SEQ ID NO: 529253 - protein, 9 aa, Homo Sapiens
GSSRSMMGS

SEQ ID NO: 529254 - protein, 9 aa, Homo Sapiens
LNSLQKEPN

SEQ ID NO: 529255 - protein, 9 aa, Homo Sapiens
ALGPNTESA

SEQ ID NO: 529256 - protein, 9 aa, Homo Sapiens
KGLAITRKL

SEQ ID NO: 529257 - protein, 9 aa, Homo Sapiens
TNTIVRNAL

SEQ ID NO: 529258 - protein, 9 aa, Homo Sapiens
SMMGSSFLA

SEQ ID NO: 529259 - protein, 9 aa, Homo Sapiens
SASQTRSAG

SEQ ID NO: 529260 - protein, 9 aa, Homo Sapiens
DKRYGNRLA

SEQ ID NO: 529261 - protein, 9 aa, Homo Sapiens
AGSSRSMMG

SEQ ID NO: 529262 - protein, 9 aa, Homo Sapiens
REQEEREQQ

SEQ ID NO: 529263 - protein, 9 aa, Homo Sapiens
DTEVASFCL

SEQ ID NO: 529264 - protein, 9 aa, Homo Sapiens
VAPLLGASL

SEQ ID NO: 529265 - protein, 9 aa, Homo Sapiens
EPNGEGLLC

SEQ ID NO: 529266 - protein, 9 aa, Homo Sapiens
LTPVRDSPF

SEQ ID NO: 529267 - protein, 9 aa, Homo Sapiens
RYDKRYGNR

SEQ ID NO: 529268 - protein, 9 aa, Homo Sapiens
IHTHTFYVS

SEQ ID NO: 529269 - protein, 9 aa, Homo Sapiens
PSIGITAWT

SEQ ID NO: 529270 - protein, 9 aa, Homo Sapiens
EEGGSSPIP

SEQ ID NO: 529271 - protein, 9 aa, Homo Sapiens
EQEEREQQL

SEQ ID NO: 529272 - protein, 9 aa, Homo Sapiens
LLGASLGGI

SEQ ID NO: 529273 - protein, 9 aa, Homo Sapiens
REKERCNQE

SEQ ID NO: 529274 - protein, 9 aa, Homo Sapiens
QQKICQNRA

SEQ ID NO: 529275 - protein, 9 aa, Homo Sapiens
NNAFRVYRI

SEQ ID NO: 529276 - protein, 9 aa, Homo Sapiens
ILPLSERPS

SEQ ID NO: 529277 - protein, 9 aa, Homo Sapiens
YIHTHTFYV

SEQ ID NO: 529278 - protein, 9 aa, Homo Sapiens
VGQVSASQT

SEQ ID NO: 529279 - protein, 9 aa, Homo Sapiens
RCNQEAHQE

SEQ ID NO: 529280 - protein, 9 aa, Homo Sapiens
YDPSIGITA

SEQ ID NO: 529281 - protein, 9 aa, Homo Sapiens
RENPMIFNK

SEQ ID NO: 529282 - protein, 9 aa, Homo Sapiens
IYIHTHTFY

SEQ ID NO: 529283 - protein, 9 aa, Homo Sapiens
VYRILPLSE

SEQ ID NO: 529284 - protein, 9 aa, Homo Sapiens
YRILPLSER

SEQ ID NO: 529285 - protein, 9 aa, Homo Sapiens
PNGEGLLCR

SEQ ID NO: 529286 - protein, 9 aa, Homo Sapiens
LPVTNTIVR

SEQ ID NO: 529287 - protein, 9 aa, Homo Sapiens
CWVGQVSAS

SEQ ID NO: 529288 - protein, 9 aa, Homo Sapiens
QEEREQQLR

SEQ ID NO: 529289 - protein, 9 aa, Homo Sapiens
HSRAEEGGS

SEQ ID NO: 529290 - protein, 9 aa, Homo Sapiens
TKLISPVVT

SEQ ID NO: 529291 - protein, 9 aa, Homo Sapiens
SRAEEGGSS

SEQ ID NO: 529292 - protein, 9 aa, Homo Sapiens
TPVRDSPFT

SEQ ID NO: 529293 - protein, 9 aa, Homo Sapiens
EPTKLISPV

SEQ ID NO: 529294 - protein, 9 aa, Homo Sapiens
DTVRYDKRY

SEQ ID NO: 529295 - protein, 9 aa, Homo Sapiens
ERCNQEAHQ

SEQ ID NO: 529296 - protein, 9 aa, Homo Sapiens
ASQTRSAGQ

SEQ ID NO: 529297 - protein, 9 aa, Homo Sapiens
FHSRAEEGG

SEQ ID NO: 529298 - protein, 9 aa, Homo Sapiens
KICQNRARK

SEQ ID NO: 529299 - protein, 9 aa, Homo Sapiens
DDTEVASFC

SEQ ID NO: 529300 - protein, 9 aa, Homo Sapiens
EGGSSPIPL

SEQ ID NO: 529301 - protein, 9 aa, Homo Sapiens
AKRRPCAGS

SEQ ID NO: 529302 - protein, 9 aa, Homo Sapiens
SAKRRPCAG

SEQ ID NO: 529303 - protein, 9 aa, Homo Sapiens
MIFNKGLAI

SEQ ID NO: 529304 - protein, 9 aa, Homo Sapiens
MMGSSFLAN

SEQ ID NO: 529305 - protein, 9 aa, Homo Sapiens
AEEGGSSPI

SEQ ID NO: 529306 - protein, 9 aa, Homo Sapiens
EKERCNQEA

SEQ ID NO: 529307 - protein, 9 aa, Homo Sapiens
IPLPVTNTI

SEQ ID NO: 529308 - protein, 9 aa, Homo Sapiens
LLQQQKICQ

SEQ ID NO: 529309 - protein, 9 aa, Homo Sapiens
QQQKICQNR

SEQ ID NO: 529310 - protein, 9 aa, Homo Sapiens
YIYTHIYIH

SEQ ID NO: 529311 - protein, 9 aa, Homo Sapiens
PVTNTIVRN

SEQ ID NO: 529312 - protein, 9 aa, Homo Sapiens
DPSIGITAW

SEQ ID NO: 529313 - protein, 9 aa, Homo Sapiens
GASLGGIIY

SEQ ID NO: 529314 - protein, 9 aa, Homo Sapiens
SMWCWVGQV

SEQ ID NO: 529315 - protein, 9 aa, Homo Sapiens
FTPRLRSVS

SEQ ID NO: 529316 - protein, 9 aa, Homo Sapiens
ESAKRRPCA

SEQ ID NO: 529317 - protein, 9 aa, Homo Sapiens
GGSSPIPLP

SEQ ID NO: 529318 - protein, 9 aa, Homo Sapiens
EVASFCLEG

SEQ ID NO: 529319 - protein, 9 aa, Homo Sapiens
LEDTVRYDK

SEQ ID NO: 529320 - protein, 9 aa, Homo Sapiens
VRYDKRYGN

SEQ ID NO: 529321 - protein, 9 aa, Homo Sapiens
VRDSPFTPR

SEQ ID NO: 529322 - protein, 9 aa, Homo Sapiens
EIPLPVTNT

SEQ ID NO: 529323 - protein, 9 aa, Homo Sapiens
IFNKGLAIT

SEQ ID NO: 529324 - protein, 9 aa, Homo Sapiens
NGEGLLCRF

SEQ ID NO: 529325 - protein, 9 aa, Homo Sapiens
TEVASFCLE

SEQ ID NO: 529326 - protein, 9 aa, Homo Sapiens
KYDPSIGIT

SEQ ID NO: 529327 - protein, 9 aa, Homo Sapiens
ASFCLEGIR

SEQ ID NO: 529328 - protein, 9 aa, Homo Sapiens
SSRSMMGSS

SEQ ID NO: 529329 - protein, 9 aa, Homo Sapiens
PTKLISPVV

SEQ ID NO: 529330 - protein, 9 aa, Homo Sapiens
PNTESAKRR

SEQ ID NO: 529331 - protein, 9 aa, Homo Sapiens
LGASLGGII

SEQ ID NO: 529332 - protein, 9 aa, Homo Sapiens
RILPLSERP

SEQ ID NO: 529333 - protein, 9 aa, Homo Sapiens
CDDTEVASF

SEQ ID NO: 529334 - protein, 9 aa, Homo Sapiens
EREQQLRRE

SEQ ID NO: 529335 - protein, 9 aa, Homo Sapiens
NTIVRNALF

SEQ ID NO: 529336 - protein, 9 aa, Homo Sapiens
ITAWTSMWC

SEQ ID NO: 529337 - protein, 9 aa, Homo Sapiens
AFRVYRILP

SEQ ID NO: 529338 - protein, 9 aa, Homo Sapiens
IGITAWTSM

SEQ ID NO: 529339 - protein, 9 aa, Homo Sapiens
GQVSASQTR

SEQ ID NO: 529340 - protein, 9 aa, Homo Sapiens
TESAKRRPC

SEQ ID NO: 529341 - protein, 9 aa, Homo Sapiens
LQKEPNGEG

SEQ ID NO: 529342 - protein, 9 aa, Homo Sapiens
MWCWVGQVS

SEQ ID NO: 529343 - protein, 9 aa, Homo Sapiens
GFSEPTKLI

SEQ ID NO: 529344 - protein, 9 aa, Homo Sapiens
IYIYTHIYI

SEQ ID NO: 529345 - protein, 9 aa, Homo Sapiens
DSPFTPRLR

SEQ ID NO: 529346 - protein, 9 aa, Homo Sapiens
RPCAGSSRS

SEQ ID NO: 529347 - protein, 9 aa, Homo Sapiens
VVAPLLGAS

SEQ ID NO: 529348 - protein, 9 aa, Homo Sapiens
ICQNRARKY

SEQ ID NO: 529349 - protein, 9 aa, Homo Sapiens
LRIREKERC

SEQ ID NO: 529350 - protein, 9 aa, Homo Sapiens
CNQEAHQEK

SEQ ID NO: 529351 - protein, 9 aa, Homo Sapiens
SFCLEGIRC

SEQ ID NO: 529352 - protein, 9 aa, Homo Sapiens
CAGSSRSMM

SEQ ID NO: 529353 - protein, 9 aa, Homo Sapiens
GQAALGPNT

SEQ ID NO: 529354 - protein, 9 aa, Homo Sapiens
KLISPVVTS

SEQ ID NO: 529355 - protein, 9 aa, Homo Sapiens
SIGITAWTS

SEQ ID NO: 529356 - protein, 9 aa, Homo Sapiens
LISPVVTSS

SEQ ID NO: 529357 - protein, 9 aa, Homo Sapiens
VSASQTRSA

SEQ ID NO: 529358 - protein, 9 aa, Homo Sapiens
GITAWTSMW

SEQ ID NO: 529359 - protein, 9 aa, Homo Sapiens
FCLEGIRCA

SEQ ID NO: 529360 - protein, 9 aa, Homo Sapiens
NKGLAITRK

SEQ ID NO: 529361 - protein, 9 aa, Homo Sapiens
NAFRVYRIL

SEQ ID NO: 529362 - protein, 9 aa, Homo Sapiens
RSAGQAALG

SEQ ID NO: 529363 - protein, 9 aa, Homo Sapiens
VASFCLEGI

SEQ ID NO: 529364 - protein, 9 aa, Homo Sapiens
KRRPCAGSS

SEQ ID NO: 529365 - protein, 9 aa, Homo Sapiens
NSLQKEPNG

SEQ ID NO: 529366 - protein, 9 aa, Homo Sapiens
FNKGLAITR

SEQ ID NO: 529367 - protein, 9 aa, Homo Sapiens
QAALGPNTE

SEQ ID NO: 529368 - protein, 9 aa, Homo Sapiens
AGQAALGPN

SEQ ID NO: 529369 - protein, 9 aa, Homo Sapiens
ENPMIFNKG

SEQ ID NO: 529370 - protein, 9 aa, Homo Sapiens
IYTHIYIHT

SEQ ID NO: 529371 - protein, 9 aa, Homo Sapiens
SQTRSAGQA

SEQ ID NO: 529372 - protein, 9 aa, Homo Sapiens
SPFTPRLRS

SEQ ID NO: 529373 - protein, 9 aa, Homo Sapiens
PFTPRLRSV

SEQ ID NO: 529374 - protein, 9 aa, Homo Sapiens
QKICQNRAR

SEQ ID NO: 529375 - protein, 9 aa, Homo Sapiens
GPNTESAKR

SEQ ID NO: 529376 - protein, 9 aa, Homo Sapiens
RRPCAGSSR

SEQ ID NO: 529377 - protein, 9 aa, Homo Sapiens
SAGQAALGP

SEQ ID NO: 529378 - protein, 9 aa, Homo Sapiens
AWTSMWCWV

SEQ ID NO: 529379 - protein, 9 aa, Homo Sapiens
WTSMWCWVG

SEQ ID NO: 529380 - protein, 9 aa, Homo Sapiens
EDTVRYDKR

SEQ ID NO: 529381 - protein, 9 aa, Homo Sapiens
QNRARKYFV

SEQ ID NO: 529382 - protein, 9 aa, Homo Sapiens
WCWVGQVSA

SEQ ID NO: 529383 - protein, 9 aa, Homo Sapiens
GSSPIPLPF

SEQ ID NO: 529384 - protein, 9 aa, Homo Sapiens
RIREKERCN

SEQ ID NO: 529385 - protein, 9 aa, Homo Sapiens
SLGGIIYLV

SEQ ID NO: 529386 - protein, 9 aa, Homo Sapiens
WVGQVSASQ

SEQ ID NO: 529387 - protein, 9 aa, Homo Sapiens
CQNRARKYF

SEQ ID NO: 529388 - protein, 9 aa, Homo Sapiens
YTHIYIHTH

SEQ ID NO: 529389 - protein, 9 aa, Homo Sapiens
LQQQKICQN

SEQ ID NO: 529390 - protein, 9 aa, Homo Sapiens
SLQKEPNGE

SEQ ID NO: 529391 - protein, 9 aa, Homo Sapiens
PLPVTNTIV

SEQ ID NO: 529392 - protein, 9 aa, Homo Sapiens
TIVRNALFC

SEQ ID NO: 529393 - protein, 9 aa, Homo Sapiens
RDSPFTPRL

SEQ ID NO: 529394 - protein, 9 aa, Homo Sapiens
TLGIPLTPQ

SEQ ID NO: 529395 - protein, 9 aa, Homo Sapiens
APLLGASLG

SEQ ID NO: 529396 - protein, 9 aa, Homo Sapiens
TVRYDKRYG

SEQ ID NO: 529397 - protein, 9 aa, Homo Sapiens
FSEPTKLIS

SEQ ID NO: 529398 - protein, 9 aa, Homo Sapiens
SEPTKLISP

SEQ ID NO: 529399 - protein, 9 aa, Homo Sapiens
ASLGGIIYL

SEQ ID NO: 529400 - protein, 9 aa, Homo Sapiens
KEPNGEGLL

SEQ ID NO: 529401 - protein, 9 aa, Homo Sapiens
PGFSEPTKL

SEQ ID NO: 529402 - protein, 9 aa, Homo Sapiens
TRSAGQAAL

SEQ ID NO: 529403 - protein, 9 aa, Homo Sapiens
THIYIHTHT

SEQ ID NO: 529404 - protein, 9 aa, Homo Sapiens
NPMIFNKGL

SEQ ID NO: 529405 - protein, 9 aa, Homo Sapiens
VTNTIVRNA

SEQ ID NO: 529406 - protein, 9 aa, Homo Sapiens
EEREQQLRR

SEQ ID NO: 529407 - protein, 9 aa, Homo Sapiens
RAEEGGSSP

SEQ ID NO: 529408 - protein, 9 aa, Homo Sapiens
PMIFNKGLA

SEQ ID NO: 529409 - protein, 9 aa, Homo Sapiens
RREQEEREQ

SEQ ID NO: 529410 - protein, 9 aa, Homo Sapiens
FRVYRILPL

SEQ ID NO: 529411 - protein, 9 aa, Homo Sapiens
NTESAKRRP

SEQ ID NO: 529412 - protein, 9 aa, Homo Sapiens
PVRDSPFTP

SEQ ID NO: 529413 - protein, 9 aa, Homo Sapiens
PLLGASLGG

SEQ ID NO: 529414 - protein, 9 aa, Homo Sapiens
KLEDTVRYD

SEQ ID NO: 529415 - protein, 9 aa, Homo Sapiens
YDKRYGNRL

SEQ ID NO: 529416 - protein, 9 aa, Homo Sapiens
QKEPNGEGL

SEQ ID NO: 529417 - protein, 9 aa, Homo Sapiens
QTRSAGQAA

SEQ ID NO: 529418 - protein, 9 aa, Homo Sapiens
TSMWCWVGQ

SEQ ID NO: 529419 - protein, 9 aa, Homo Sapiens
HIYIHTHTF

SEQ ID NO: 529420 - protein, 9 aa, Homo Sapiens
RSMMGSSFL

SEQ ID NO: 529421 - protein, 9 aa, Homo Sapiens
TAWTSMWCW

SEQ ID NO: 529422 - protein, 9 aa, Homo Sapiens
SRSMMGSSF

SEQ ID NO: 529423 - protein, 9 aa, Homo Sapiens
LRREQEERE

SEQ ID NO: 529424 - protein, 9 aa, Homo Sapiens
KERCNQEAH

SEQ ID NO: 529425 - protein, 9 aa, Homo Sapiens
PCAGSSRSM

SEQ ID NO: 529426 - protein, 9 aa, Homo Sapiens
IREKERCNQ

SEQ ID NO: 529427 - protein, 9 aa, Homo Sapiens
GDQCINIGT

SEQ ID NO: 529428 - protein, 9 aa, Homo Sapiens
HPERDHISH

SEQ ID NO: 529429 - protein, 9 aa, Homo Sapiens
DQCINIGTT

SEQ ID NO: 529430 - protein, 9 aa, Homo Sapiens
IEWEHTMML

SEQ ID NO: 529431 - protein, 9 aa, Homo Sapiens
LLPLGIILF

SEQ ID NO: 529432 - protein, 9 aa, Homo Sapiens
RGDQCINIG

SEQ ID NO: 529433 - protein, 9 aa, Homo Sapiens
SLHHPERDH

SEQ ID NO: 529434 - protein, 9 aa, Homo Sapiens
QCINIGTTL

SEQ ID NO: 529435 - protein, 9 aa, Homo Sapiens
CYRACFHQC

SEQ ID NO: 529436 - protein, 9 aa, Homo Sapiens
ESLHHPERD

SEQ ID NO: 529437 - protein, 9 aa, Homo Sapiens
GDMASQVYN

SEQ ID NO: 529438 - protein, 9 aa, Homo Sapiens
MFLLEFLLP

SEQ ID NO: 529439 - protein, 9 aa, Homo Sapiens
PTFSIPPTN

SEQ ID NO: 529440 - protein, 9 aa, Homo Sapiens
REVRRVPPT

SEQ ID NO: 529441 - protein, 9 aa, Homo Sapiens
EFLLPLGII

SEQ ID NO: 529442 - protein, 9 aa, Homo Sapiens
KIRQIYQCN

SEQ ID NO: 529443 - protein, 9 aa, Homo Sapiens
DMASQVYNV

SEQ ID NO: 529444 - protein, 9 aa, Homo Sapiens
SGDMASQVY

SEQ ID NO: 529445 - protein, 9 aa, Homo Sapiens
IYQCNYDPS

SEQ ID NO: 529446 - protein, 9 aa, Homo Sapiens
CFHQCVPRV

SEQ ID NO: 529447 - protein, 9 aa, Homo Sapiens
RRVPPTFSI

SEQ ID NO: 529448 - protein, 9 aa, Homo Sapiens
DIRKNQLPS

SEQ ID NO: 529449 - protein, 9 aa, Homo Sapiens
WEHTMMLML

SEQ ID NO: 529450 - protein, 9 aa, Homo Sapiens
HTMMLMLCD

SEQ ID NO: 529451 - protein, 9 aa, Homo Sapiens
YQCNYDPSG

SEQ ID NO: 529452 - protein, 9 aa, Homo Sapiens
NQLPSLLGG

SEQ ID NO: 529453 - protein, 9 aa, Homo Sapiens
IRKNQLPSL

SEQ ID NO: 529454 - protein, 9 aa, Homo Sapiens
VPPTFSIPP

SEQ ID NO: 529455 - protein, 9 aa, Homo Sapiens
EHTMMLMLC

SEQ ID NO: 529456 - protein, 9 aa, Homo Sapiens
EAMFLLEFL

SEQ ID NO: 529457 - protein, 9 aa, Homo Sapiens
QIYQCNYDP

SEQ ID NO: 529458 - protein, 9 aa, Homo Sapiens
PPTFSIPPT

SEQ ID NO: 529459 - protein, 9 aa, Homo Sapiens
TGYVFSGDM

SEQ ID NO: 529460 - protein, 9 aa, Homo Sapiens
SQDTTGTIV

SEQ ID NO: 529461 - protein, 9 aa, Homo Sapiens
RACFHQCVP

SEQ ID NO: 529462 - protein, 9 aa, Homo Sapiens
RKNQLPSLL

SEQ ID NO: 529463 - protein, 9 aa, Homo Sapiens
LLEFLLPLG

SEQ ID NO: 529464 - protein, 9 aa, Homo Sapiens
PSLLGGVGP

SEQ ID NO: 529465 - protein, 9 aa, Homo Sapiens
VFSGDMASQ

SEQ ID NO: 529466 - protein, 9 aa, Homo Sapiens
DTTGTIVLP

SEQ ID NO: 529467 - protein, 9 aa, Homo Sapiens
LEFLLPLGI

SEQ ID NO: 529468 - protein, 9 aa, Homo Sapiens
ACFHQCVPR

SEQ ID NO: 529469 - protein, 9 aa, Homo Sapiens
MASQVYNVS

SEQ ID NO: 529470 - protein, 9 aa, Homo Sapiens
SHSSQDTTG

SEQ ID NO: 529471 - protein, 9 aa, Homo Sapiens
LPSLLGGVG

SEQ ID NO: 529472 - protein, 9 aa, Homo Sapiens
EYDIRGDQC

SEQ ID NO: 529473 - protein, 9 aa, Homo Sapiens
IRGDQCINI

SEQ ID NO: 529474 - protein, 9 aa, Homo Sapiens
FSGDMASQV

SEQ ID NO: 529475 - protein, 9 aa, Homo Sapiens
QLPSLLGGV

SEQ ID NO: 529476 - protein, 9 aa, Homo Sapiens
DIRGDQCIN

SEQ ID NO: 529477 - protein, 9 aa, Homo Sapiens
LHHPERDHI

SEQ ID NO: 529478 - protein, 9 aa, Homo Sapiens
YRACFHQCV

SEQ ID NO: 529479 - protein, 9 aa, Homo Sapiens
ASHSSQDTT

SEQ ID NO: 529480 - protein, 9 aa, Homo Sapiens
HQCVPRVSV

SEQ ID NO: 529481 - protein, 9 aa, Homo Sapiens
YDIRGDQCI

SEQ ID NO: 529482 - protein, 9 aa, Homo Sapiens
QDTTGTIVL

SEQ ID NO: 529483 - protein, 9 aa, Homo Sapiens
LAGHIEWEH

SEQ ID NO: 529484 - protein, 9 aa, Homo Sapiens
FLLPLGIIL

SEQ ID NO: 529485 - protein, 9 aa, Homo Sapiens
RVPPTFSIP

SEQ ID NO: 529486 - protein, 9 aa, Homo Sapiens
AMFLLEFLL

SEQ ID NO: 529487 - protein, 9 aa, Homo Sapiens
AESLHHPER

SEQ ID NO: 529488 - protein, 9 aa, Homo Sapiens
AGHIEWEHT

SEQ ID NO: 529489 - protein, 9 aa, Homo Sapiens
TFSIPPTNH

SEQ ID NO: 529490 - protein, 9 aa, Homo Sapiens
CNYDPSGTA

SEQ ID NO: 529491 - protein, 9 aa, Homo Sapiens
HHPERDHIS

SEQ ID NO: 529492 - protein, 9 aa, Homo Sapiens
RQIYQCNYD

SEQ ID NO: 529493 - protein, 9 aa, Homo Sapiens
CLLSAQFHQ

SEQ ID NO: 529494 - protein, 9 aa, Homo Sapiens
HIEWEHTMM

SEQ ID NO: 529495 - protein, 9 aa, Homo Sapiens
EVRRVPPTF

SEQ ID NO: 529496 - protein, 9 aa, Homo Sapiens
KNQLPSLLG

SEQ ID NO: 529497 - protein, 9 aa, Homo Sapiens
TASHSSQDT

SEQ ID NO: 529498 - protein, 9 aa, Homo Sapiens
HSSQDTTGT

SEQ ID NO: 529499 - protein, 9 aa, Homo Sapiens
IRQIYQCNY

SEQ ID NO: 529500 - protein, 9 aa, Homo Sapiens
SLLGGVGPM

SEQ ID NO: 529501 - protein, 9 aa, Homo Sapiens
QCNYDPSGT

SEQ ID NO: 529502 - protein, 9 aa, Homo Sapiens
EWEHTMMLM

SEQ ID NO: 529503 - protein, 9 aa, Homo Sapiens
ERDHISHCL

SEQ ID NO: 529504 - protein, 9 aa, Homo Sapiens
CINIGTTLG

SEQ ID NO: 529505 - protein, 9 aa, Homo Sapiens
GYVFSGDMA

SEQ ID NO: 529506 - protein, 9 aa, Homo Sapiens
KCCYRACFH

SEQ ID NO: 529507 - protein, 9 aa, Homo Sapiens
YVFSGDMAS

SEQ ID NO: 529508 - protein, 9 aa, Homo Sapiens
TTGTIVLPA

SEQ ID NO: 529509 - protein, 9 aa, Homo Sapiens
GHIEWEHTM

SEQ ID NO: 529510 - protein, 9 aa, Homo Sapiens
VRRVPPTFS

SEQ ID NO: 529511 - protein, 9 aa, Homo Sapiens
PERDHISHC

SEQ ID NO: 529512 - protein, 9 aa, Homo Sapiens
QKIRQIYQC

SEQ ID NO: 529513 - protein, 9 aa, Homo Sapiens
FHQCVPRVS

SEQ ID NO: 529514 - protein, 9 aa, Homo Sapiens
SSQDTTGTI

SEQ ID NO: 529515 - protein, 9 aa, Homo Sapiens
CCYRACFHQ

SEQ ID NO: 529516 - protein, 9 aa, Homo Sapiens
LLSAQFHQK

SEQ ID NO: 529517 - protein, 9 aa, Homo Sapiens
FLLEFLLPL

SEQ ID NO: 529518 - protein, 9 aa, Homo Sapiens
AFAALMNTE

SEQ ID NO: 529519 - protein, 9 aa, Homo Sapiens
LRMSVDSCF

SEQ ID NO: 529520 - protein, 9 aa, Homo Sapiens
SVDSCFRGK

SEQ ID NO: 529521 - protein, 9 aa, Homo Sapiens
VLWVAQMLP

SEQ ID NO: 529522 - protein, 9 aa, Homo Sapiens
WIDLHNLSA

SEQ ID NO: 529523 - protein, 9 aa, Homo Sapiens
FYRHKMPRL

SEQ ID NO: 529524 - protein, 9 aa, Homo Sapiens
QAFLCHLDL

SEQ ID NO: 529525 - protein, 9 aa, Homo Sapiens
KLSLPESLK

SEQ ID NO: 529526 - protein, 9 aa, Homo Sapiens
LISDFAWID

SEQ ID NO: 529527 - protein, 9 aa, Homo Sapiens
ISDFAWIDL

SEQ ID NO: 529528 - protein, 9 aa, Homo Sapiens
GQVLFTQGF

SEQ ID NO: 529529 - protein, 9 aa, Homo Sapiens
RPPIDPNNP

SEQ ID NO: 529530 - protein, 9 aa, Homo Sapiens
RFWQLTMEY

SEQ ID NO: 529531 - protein, 9 aa, Homo Sapiens
HLDLPLGHE

SEQ ID NO: 529532 - protein, 9 aa, Homo Sapiens
EKEDIQLLV

SEQ ID NO: 529533 - protein, 9 aa, Homo Sapiens
PEAAWCSMT

SEQ ID NO: 529534 - protein, 9 aa, Homo Sapiens
IMKLSLPES

SEQ ID NO: 529535 - protein, 9 aa, Homo Sapiens
GSVEVLQAF

SEQ ID NO: 529536 - protein, 9 aa, Homo Sapiens
LWGDARRWA

SEQ ID NO: 529537 - protein, 9 aa, Homo Sapiens
CSRLLVVVL

SEQ ID NO: 529538 - protein, 9 aa, Homo Sapiens
RERDEGSLG

SEQ ID NO: 529539 - protein, 9 aa, Homo Sapiens
GSSGAPGED

SEQ ID NO: 529540 - protein, 9 aa, Homo Sapiens
PELEDRLQC

SEQ ID NO: 529541 - protein, 9 aa, Homo Sapiens
SWAGGFGLS

SEQ ID NO: 529542 - protein, 9 aa, Homo Sapiens
RLSVTNLEE

SEQ ID NO: 529543 - protein, 9 aa, Homo Sapiens
LCHLDLPLG

SEQ ID NO: 529544 - protein, 9 aa, Homo Sapiens
MPEAAWCSM

SEQ ID NO: 529545 - protein, 9 aa, Homo Sapiens
KEDIQLLVY

SEQ ID NO: 529546 - protein, 9 aa, Homo Sapiens
FVNFRRPSM

SEQ ID NO: 529547 - protein, 9 aa, Homo Sapiens
AGNQDIITL

SEQ ID NO: 529548 - protein, 9 aa, Homo Sapiens
GVPQRERDE

SEQ ID NO: 529549 - protein, 9 aa, Homo Sapiens
RLLVVVLGC

SEQ ID NO: 529550 - protein, 9 aa, Homo Sapiens
EETVDGNRP

SEQ ID NO: 529551 - protein, 9 aa, Homo Sapiens
RDHDSYGVH

SEQ ID NO: 529552 - protein, 9 aa, Homo Sapiens
FVLAIIVFS

SEQ ID NO: 529553 - protein, 9 aa, Homo Sapiens
FGLSMVKVF

SEQ ID NO: 529554 - protein, 9 aa, Homo Sapiens
GAPGPCCDG

SEQ ID NO: 529555 - protein, 9 aa, Homo Sapiens
IAAQGSVEV

SEQ ID NO: 529556 - protein, 9 aa, Homo Sapiens
KSFDDEETV

SEQ ID NO: 529557 - protein, 9 aa, Homo Sapiens
TVALKALSA

SEQ ID NO: 529558 - protein, 9 aa, Homo Sapiens
VRPLGQVLF

SEQ ID NO: 529559 - protein, 9 aa, Homo Sapiens
RCSRLLVVV

SEQ ID NO: 529560 - protein, 9 aa, Homo Sapiens
DPSATRLAY

SEQ ID NO: 529561 - protein, 9 aa, Homo Sapiens
ETELRFWQL

SEQ ID NO: 529562 - protein, 9 aa, Homo Sapiens
WQLTMEYQA

SEQ ID NO: 529563 - protein, 9 aa, Homo Sapiens
HKMPRLIAK

SEQ ID NO: 529564 - protein, 9 aa, Homo Sapiens
VFSPFVLAI

SEQ ID NO: 529565 - protein, 9 aa, Homo Sapiens
VLAIIVFST

SEQ ID NO: 529566 - protein, 9 aa, Homo Sapiens
LREKIMKLS

SEQ ID NO: 529567 - protein, 9 aa, Homo Sapiens
VQSHTREEE

SEQ ID NO: 529568 - protein, 9 aa, Homo Sapiens
GSRDPSATR

SEQ ID NO: 529569 - protein, 9 aa, Homo Sapiens
LGQVLFTQG

SEQ ID NO: 529570 - protein, 9 aa, Homo Sapiens
HKKRKRGMP

SEQ ID NO: 529571 - protein, 9 aa, Homo Sapiens
SCFRGKGIA

SEQ ID NO: 529572 - protein, 9 aa, Homo Sapiens
VALKALSAF

SEQ ID NO: 529573 - protein, 9 aa, Homo Sapiens
LWVAQMLPA

SEQ ID NO: 529574 - protein, 9 aa, Homo Sapiens
LSAFAALMN

SEQ ID NO: 529575 - protein, 9 aa, Homo Sapiens
SLGVPQRER

SEQ ID NO: 529576 - protein, 9 aa, Homo Sapiens
YGVHKKRKR

SEQ ID NO: 529577 - protein, 9 aa, Homo Sapiens
QGKVGSSGA

SEQ ID NO: 529578 - protein, 9 aa, Homo Sapiens
ELRFWQLTM

SEQ ID NO: 529579 - protein, 9 aa, Homo Sapiens
FAWIDLHNL

SEQ ID NO: 529580 - protein, 9 aa, Homo Sapiens
LRFWQLTME

SEQ ID NO: 529581 - protein, 9 aa, Homo Sapiens
RPSMPEAAW

SEQ ID NO: 529582 - protein, 9 aa, Homo Sapiens
PQRERDEGS

SEQ ID NO: 529583 - protein, 9 aa, Homo Sapiens
SVEVLQAFL

SEQ ID NO: 529584 - protein, 9 aa, Homo Sapiens
VRCSRLLVV

SEQ ID NO: 529585 - protein, 9 aa, Homo Sapiens
VGSSGAPGE

SEQ ID NO: 529586 - protein, 9 aa, Homo Sapiens
SDQFYRHKM

SEQ ID NO: 529587 - protein, 9 aa, Homo Sapiens
AIIVFSTLL

SEQ ID NO: 529588 - protein, 9 aa, Homo Sapiens
NFRRPSMPE

SEQ ID NO: 529589 - protein, 9 aa, Homo Sapiens
KIMKLSLPE

SEQ ID NO: 529590 - protein, 9 aa, Homo Sapiens
GFGLSMVKV

SEQ ID NO: 529591 - protein, 9 aa, Homo Sapiens
VAQMLPAAG

SEQ ID NO: 529592 - protein, 9 aa, Homo Sapiens
VVVLGCYCY

SEQ ID NO: 529593 - protein, 9 aa, Homo Sapiens
LAIIVFSTL

SEQ ID NO: 529594 - protein, 9 aa, Homo Sapiens
HRMREKEDI

SEQ ID NO: 529595 - protein, 9 aa, Homo Sapiens
LSLPESLKA

SEQ ID NO: 529596 - protein, 9 aa, Homo Sapiens
DHRMREKED

SEQ ID NO: 529597 - protein, 9 aa, Homo Sapiens
GPCCDGVGA

SEQ ID NO: 529598 - protein, 9 aa, Homo Sapiens
PSATRLAYG

SEQ ID NO: 529599 - protein, 9 aa, Homo Sapiens
LEALWGDAR

SEQ ID NO: 529600 - protein, 9 aa, Homo Sapiens
NLISDFAWI

SEQ ID NO: 529601 - protein, 9 aa, Homo Sapiens
GVHKKRKRG

SEQ ID NO: 529602 - protein, 9 aa, Homo Sapiens
VPQRERDEG

SEQ ID NO: 529603 - protein, 9 aa, Homo Sapiens
KCAGNQDII

SEQ ID NO: 529604 - protein, 9 aa, Homo Sapiens
LQAFLCHLD

SEQ ID NO: 529605 - protein, 9 aa, Homo Sapiens
ENESGGDRP

SEQ ID NO: 529606 - protein, 9 aa, Homo Sapiens
IVFSPFVLA

SEQ ID NO: 529607 - protein, 9 aa, Homo Sapiens
LSMVKVFLI

SEQ ID NO: 529608 - protein, 9 aa, Homo Sapiens
MREKEDIQL

SEQ ID NO: 529609 - protein, 9 aa, Homo Sapiens
VHKKRKRGM

SEQ ID NO: 529610 - protein, 9 aa, Homo Sapiens
EELKRRILR

SEQ ID NO: 529611 - protein, 9 aa, Homo Sapiens
SDHRMREKE

SEQ ID NO: 529612 - protein, 9 aa, Homo Sapiens
RMSVDSCFR

SEQ ID NO: 529613 - protein, 9 aa, Homo Sapiens
EETELRFWQ

SEQ ID NO: 529614 - protein, 9 aa, Homo Sapiens
VHIAAQGSV

SEQ ID NO: 529615 - protein, 9 aa, Homo Sapiens
PLGQVLFTQ

SEQ ID NO: 529616 - protein, 9 aa, Homo Sapiens
SRDPSATRL

SEQ ID NO: 529617 - protein, 9 aa, Homo Sapiens
PLGHEDVQV

SEQ ID NO: 529618 - protein, 9 aa, Homo Sapiens
AWIDLHNLS

SEQ ID NO: 529619 - protein, 9 aa, Homo Sapiens
PFVLAIIVF

SEQ ID NO: 529620 - protein, 9 aa, Homo Sapiens
REKIMKLSL

SEQ ID NO: 529621 - protein, 9 aa, Homo Sapiens
SGGDRPPID

SEQ ID NO: 529622 - protein, 9 aa, Homo Sapiens
AGGFGLSMV

SEQ ID NO: 529623 - protein, 9 aa, Homo Sapiens
DGVGAAAIA

SEQ ID NO: 529624 - protein, 9 aa, Homo Sapiens
VDSCFRGKG

SEQ ID NO: 529625 - protein, 9 aa, Homo Sapiens
LKCAGNQDI

SEQ ID NO: 529626 - protein, 9 aa, Homo Sapiens
SAFAALMNT

SEQ ID NO: 529627 - protein, 9 aa, Homo Sapiens
VSLPELEDR

SEQ ID NO: 529628 - protein, 9 aa, Homo Sapiens
SLICAVQSH

SEQ ID NO: 529629 - protein, 9 aa, Homo Sapiens
QDIITLRAE

SEQ ID NO: 529630 - protein, 9 aa, Homo Sapiens
QVSLPELED

SEQ ID NO: 529631 - protein, 9 aa, Homo Sapiens
ICAVQSHTR

SEQ ID NO: 529632 - protein, 9 aa, Homo Sapiens
ILKCAGNQD

SEQ ID NO: 529633 - protein, 9 aa, Homo Sapiens
DFAWIDLHN

SEQ ID NO: 529634 - protein, 9 aa, Homo Sapiens
TELRFWQLT

SEQ ID NO: 529635 - protein, 9 aa, Homo Sapiens
QMLPAAGCH

SEQ ID NO: 529636 - protein, 9 aa, Homo Sapiens
AVQSHTREE

SEQ ID NO: 529637 - protein, 9 aa, Homo Sapiens
HDSYGVHKK

SEQ ID NO: 529638 - protein, 9 aa, Homo Sapiens
KVGSSGAPG

SEQ ID NO: 529639 - protein, 9 aa, Homo Sapiens
EKIMKLSLP

SEQ ID NO: 529640 - protein, 9 aa, Homo Sapiens
TVDGNRPSS

SEQ ID NO: 529641 - protein, 9 aa, Homo Sapiens
VLFTQGFQP

SEQ ID NO: 529642 - protein, 9 aa, Homo Sapiens
FWQLTMEYQ

SEQ ID NO: 529643 - protein, 9 aa, Homo Sapiens
MKLSLPESL

SEQ ID NO: 529644 - protein, 9 aa, Homo Sapiens
LSVTNLEEL

SEQ ID NO: 529645 - protein, 9 aa, Homo Sapiens
PGPCCDGVG

SEQ ID NO: 529646 - protein, 9 aa, Homo Sapiens
GNQDIITLR

SEQ ID NO: 529647 - protein, 9 aa, Homo Sapiens
REKEDIQLL

SEQ ID NO: 529648 - protein, 9 aa, Homo Sapiens
LDLPLGHED

SEQ ID NO: 529649 - protein, 9 aa, Homo Sapiens
HEDVQVRPL

SEQ ID NO: 529650 - protein, 9 aa, Homo Sapiens
SRLLVVVLG

SEQ ID NO: 529651 - protein, 9 aa, Homo Sapiens
DLPLGHEDV

SEQ ID NO: 529652 - protein, 9 aa, Homo Sapiens
YRHKMPRLI

SEQ ID NO: 529653 - protein, 9 aa, Homo Sapiens
DSCFRGKGI

SEQ ID NO: 529654 - protein, 9 aa, Homo Sapiens
ATRLAYGYG

SEQ ID NO: 529655 - protein, 9 aa, Homo Sapiens
DQFYRHKMP

SEQ ID NO: 529656 - protein, 9 aa, Homo Sapiens
PCCDGVGAA

SEQ ID NO: 529657 - protein, 9 aa, Homo Sapiens
EVHIAAQGS

SEQ ID NO: 529658 - protein, 9 aa, Homo Sapiens
RRPSMPEAA

SEQ ID NO: 529659 - protein, 9 aa, Homo Sapiens
SLPESLKAY

SEQ ID NO: 529660 - protein, 9 aa, Homo Sapiens
CDGVGAAAI

SEQ ID NO: 529661 - protein, 9 aa, Homo Sapiens
KILKCAGNQ

SEQ ID NO: 529662 - protein, 9 aa, Homo Sapiens
SYGVHKKRK

SEQ ID NO: 529663 - protein, 9 aa, Homo Sapiens
DRPPIDPNN

SEQ ID NO: 529664 - protein, 9 aa, Homo Sapiens
FSPFVLAII

SEQ ID NO: 529665 - protein, 9 aa, Homo Sapiens
SSGAPGEDG

SEQ ID NO: 529666 - protein, 9 aa, Homo Sapiens
LPAAGCHAA

SEQ ID NO: 529667 - protein, 9 aa, Homo Sapiens
AWQVSLPEL

SEQ ID NO: 529668 - protein, 9 aa, Homo Sapiens
CFRGKGIAK

SEQ ID NO: 529669 - protein, 9 aa, Homo Sapiens
WVAQMLPAA

SEQ ID NO: 529670 - protein, 9 aa, Homo Sapiens
SLPELEDRL

SEQ ID NO: 529671 - protein, 9 aa, Homo Sapiens
VNFRRPSMP

SEQ ID NO: 529672 - protein, 9 aa, Homo Sapiens
DEETVDGNR

SEQ ID NO: 529673 - protein, 9 aa, Homo Sapiens
AFVNFRRPS

SEQ ID NO: 529674 - protein, 9 aa, Homo Sapiens
SMPEAAWCS

SEQ ID NO: 529675 - protein, 9 aa, Homo Sapiens
AAQGSVEVL

SEQ ID NO: 529676 - protein, 9 aa, Homo Sapiens
HCLEALWGD

SEQ ID NO: 529677 - protein, 9 aa, Homo Sapiens
CLEALWGDA

SEQ ID NO: 529678 - protein, 9 aa, Homo Sapiens
LLVVVLGCY

SEQ ID NO: 529679 - protein, 9 aa, Homo Sapiens
DHDSYGVHK

SEQ ID NO: 529680 - protein, 9 aa, Homo Sapiens
GDARRWACP

SEQ ID NO: 529681 - protein, 9 aa, Homo Sapiens
AFLCHLDLP

SEQ ID NO: 529682 - protein, 9 aa, Homo Sapiens
DKSFDDEET

SEQ ID NO: 529683 - protein, 9 aa, Homo Sapiens
TSLGVPQRE

SEQ ID NO: 529684 - protein, 9 aa, Homo Sapiens
DSYGVHKKR

SEQ ID NO: 529685 - protein, 9 aa, Homo Sapiens
GGFGLSMVK

SEQ ID NO: 529686 - protein, 9 aa, Homo Sapiens
QSHTREEEL

SEQ ID NO: 529687 - protein, 9 aa, Homo Sapiens
VLQAFLCHL

SEQ ID NO: 529688 - protein, 9 aa, Homo Sapiens
KEETELRFW

SEQ ID NO: 529689 - protein, 9 aa, Homo Sapiens
WGDARRWAC

SEQ ID NO: 529690 - protein, 9 aa, Homo Sapiens
FTQGFQPGG

SEQ ID NO: 529691 - protein, 9 aa, Homo Sapiens
LVVVLGCYC

SEQ ID NO: 529692 - protein, 9 aa, Homo Sapiens
PAAGCHAAA

SEQ ID NO: 529693 - protein, 9 aa, Homo Sapiens
EALWGDARR

SEQ ID NO: 529694 - protein, 9 aa, Homo Sapiens
CAGNQDIIT

SEQ ID NO: 529695 - protein, 9 aa, Homo Sapiens
FLCHLDLPL

SEQ ID NO: 529696 - protein, 9 aa, Homo Sapiens
RPLGQVLFT

SEQ ID NO: 529697 - protein, 9 aa, Homo Sapiens
LKALSAFAA

SEQ ID NO: 529698 - protein, 9 aa, Homo Sapiens
ALKALSAFA

SEQ ID NO: 529699 - protein, 9 aa, Homo Sapiens
EDVQVRPLG

SEQ ID NO: 529700 - protein, 9 aa, Homo Sapiens
NESGGDRPP

SEQ ID NO: 529701 - protein, 9 aa, Homo Sapiens
AGSRDPSAT

SEQ ID NO: 529702 - protein, 9 aa, Homo Sapiens
GSWAGGFGL

SEQ ID NO: 529703 - protein, 9 aa, Homo Sapiens
QFYRHKMPR

SEQ ID NO: 529704 - protein, 9 aa, Homo Sapiens
GKVGSSGAP

SEQ ID NO: 529705 - protein, 9 aa, Homo Sapiens
QVRPLGQVL

SEQ ID NO: 529706 - protein, 9 aa, Homo Sapiens
PQGKVGSSG

SEQ ID NO: 529707 - protein, 9 aa, Homo Sapiens
EVLQAFLCH

SEQ ID NO: 529708 - protein, 9 aa, Homo Sapiens
AGPQGKVGS

SEQ ID NO: 529709 - protein, 9 aa, Homo Sapiens
TNLEELKRR

SEQ ID NO: 529710 - protein, 9 aa, Homo Sapiens
LGVPQRERD

SEQ ID NO: 529711 - protein, 9 aa, Homo Sapiens
LGHEDVQVR

SEQ ID NO: 529712 - protein, 9 aa, Homo Sapiens
NQDIITLRA

SEQ ID NO: 529713 - protein, 9 aa, Homo Sapiens
SVTNLEELK

SEQ ID NO: 529714 - protein, 9 aa, Homo Sapiens
TRLAYGYGP

SEQ ID NO: 529715 - protein, 9 aa, Homo Sapiens
KALSAFAAL

SEQ ID NO: 529716 - protein, 9 aa, Homo Sapiens
SVSDQFYRH

SEQ ID NO: 529717 - protein, 9 aa, Homo Sapiens
ETVDGNRPS

SEQ ID NO: 529718 - protein, 9 aa, Homo Sapiens
HIAAQGSVE

SEQ ID NO: 529719 - protein, 9 aa, Homo Sapiens
MLPAAGCHA

SEQ ID NO: 529720 - protein, 9 aa, Homo Sapiens
LLRMSVDSC

SEQ ID NO: 529721 - protein, 9 aa, Homo Sapiens
EAAWCSMTG

SEQ ID NO: 529722 - protein, 9 aa, Homo Sapiens
SFDDEETVD

SEQ ID NO: 529723 - protein, 9 aa, Homo Sapiens
ALSAFAALM

SEQ ID NO: 529724 - protein, 9 aa, Homo Sapiens
PSMPEAAWC

SEQ ID NO: 529725 - protein, 9 aa, Homo Sapiens
AAWCSMTGL

SEQ ID NO: 529726 - protein, 9 aa, Homo Sapiens
FRRPSMPEA

SEQ ID NO: 529727 - protein, 9 aa, Homo Sapiens
ASLICAVQS

SEQ ID NO: 529728 - protein, 9 aa, Homo Sapiens
SATRLAYGY

SEQ ID NO: 529729 - protein, 9 aa, Homo Sapiens
GHEDVQVRP

SEQ ID NO: 529730 - protein, 9 aa, Homo Sapiens
MAWQVSLPE

SEQ ID NO: 529731 - protein, 9 aa, Homo Sapiens
WAGGFGLSM

SEQ ID NO: 529732 - protein, 9 aa, Homo Sapiens
VTNLEELKR

SEQ ID NO: 529733 - protein, 9 aa, Homo Sapiens
LICAVQSHT

SEQ ID NO: 529734 - protein, 9 aa, Homo Sapiens
PGRPRIKKR

SEQ ID NO: 529735 - protein, 9 aa, Homo Sapiens
QGSVEVLQA

SEQ ID NO: 529736 - protein, 9 aa, Homo Sapiens
ALWGDARRW

SEQ ID NO: 529737 - protein, 9 aa, Homo Sapiens
SHTREEELL

SEQ ID NO: 529738 - protein, 9 aa, Homo Sapiens
IDLHNLSAL

SEQ ID NO: 529739 - protein, 9 aa, Homo Sapiens
EDIQLLVYT

SEQ ID NO: 529740 - protein, 9 aa, Homo Sapiens
ELKRRILRV

SEQ ID NO: 529741 - protein, 9 aa, Homo Sapiens
GLSMVKVFL

SEQ ID NO: 529742 - protein, 9 aa, Homo Sapiens
LFTQGFQPG

SEQ ID NO: 529743 - protein, 9 aa, Homo Sapiens
NLEELKRRI

SEQ ID NO: 529744 - protein, 9 aa, Homo Sapiens
QVLFTQGFQ

SEQ ID NO: 529745 - protein, 9 aa, Homo Sapiens
VEVLQAFLC

SEQ ID NO: 529746 - protein, 9 aa, Homo Sapiens
AQMLPAAGC

SEQ ID NO: 529747 - protein, 9 aa, Homo Sapiens
AENESGGDR

SEQ ID NO: 529748 - protein, 9 aa, Homo Sapiens
CAVQSHTRE

SEQ ID NO: 529749 - protein, 9 aa, Homo Sapiens
GDRPPIDPN

SEQ ID NO: 529750 - protein, 9 aa, Homo Sapiens
VQVRPLGQV

SEQ ID NO: 529751 - protein, 9 aa, Homo Sapiens
AQGSVEVLQ

SEQ ID NO: 529752 - protein, 9 aa, Homo Sapiens
SDFAWIDLH

SEQ ID NO: 529753 - protein, 9 aa, Homo Sapiens
RHKMPRLIA

SEQ ID NO: 529754 - protein, 9 aa, Homo Sapiens
DVQVRPLGQ

SEQ ID NO: 529755 - protein, 9 aa, Homo Sapiens
VSDQFYRHK

SEQ ID NO: 529756 - protein, 9 aa, Homo Sapiens
FDDEETVDG

SEQ ID NO: 529757 - protein, 9 aa, Homo Sapiens
GGDRPPIDP

SEQ ID NO: 529758 - protein, 9 aa, Homo Sapiens
WQVSLPELE

SEQ ID NO: 529759 - protein, 9 aa, Homo Sapiens
LPLGHEDVQ

SEQ ID NO: 529760 - protein, 9 aa, Homo Sapiens
LPELEDRLQ

SEQ ID NO: 529761 - protein, 9 aa, Homo Sapiens
LEELKRRIL

SEQ ID NO: 529762 - protein, 9 aa, Homo Sapiens
PGAPGPCCD

SEQ ID NO: 529763 - protein, 9 aa, Homo Sapiens
TQGFQPGGL

SEQ ID NO: 529764 - protein, 9 aa, Homo Sapiens
CCDGVGAAA

SEQ ID NO: 529765 - protein, 9 aa, Homo Sapiens
RMREKEDIQ

SEQ ID NO: 529766 - protein, 9 aa, Homo Sapiens
QRERDEGSL

SEQ ID NO: 529767 - protein, 9 aa, Homo Sapiens
RDPSATRLA

SEQ ID NO: 529768 - protein, 9 aa, Homo Sapiens
APGPCCDGV

SEQ ID NO: 529769 - protein, 9 aa, Homo Sapiens
SPFVLAIIV

SEQ ID NO: 529770 - protein, 9 aa, Homo Sapiens
DDEETVDGN

SEQ ID NO: 529771 - protein, 9 aa, Homo Sapiens
ESGGDRPPI

SEQ ID NO: 529772 - protein, 9 aa, Homo Sapiens
VVLGCYCYM

SEQ ID NO: 529773 - protein, 9 aa, Homo Sapiens
MSVDSCFRG

SEQ ID NO: 529774 - protein, 9 aa, Homo Sapiens
CHLDLPLGH

SEQ ID NO: 529775 - protein, 9 aa, Homo Sapiens
GPQGKVGSS

SEQ ID NO: 529776 - protein, 9 aa, Homo Sapiens
GDGGHWALR

SEQ ID NO: 529777 - protein, 9 aa, Homo Sapiens
PTISRARNG

SEQ ID NO: 529778 - protein, 9 aa, Homo Sapiens
PVYTPLPLS

SEQ ID NO: 529779 - protein, 9 aa, Homo Sapiens
SRARNGEEV

SEQ ID NO: 529780 - protein, 9 aa, Homo Sapiens
MDLRVYGPA

SEQ ID NO: 529781 - protein, 9 aa, Homo Sapiens
LFAEGCWSS

SEQ ID NO: 529782 - protein, 9 aa, Homo Sapiens
AEGCWSSCD

SEQ ID NO: 529783 - protein, 9 aa, Homo Sapiens
DCHPLPYIL

SEQ ID NO: 529784 - protein, 9 aa, Homo Sapiens
KNVIEFILI

SEQ ID NO: 529785 - protein, 9 aa, Homo Sapiens
LSGDCHPLP

SEQ ID NO: 529786 - protein, 9 aa, Homo Sapiens
GNGLTVVTI

SEQ ID NO: 529787 - protein, 9 aa, Homo Sapiens
WALRHKNGP

SEQ ID NO: 529788 - protein, 9 aa, Homo Sapiens
PDDMDLRVY

SEQ ID NO: 529789 - protein, 9 aa, Homo Sapiens
CSSSTLTYT

SEQ ID NO: 529790 - protein, 9 aa, Homo Sapiens
MEKKKNVIE

SEQ ID NO: 529791 - protein, 9 aa, Homo Sapiens
STLTYTPSE

SEQ ID NO: 529792 - protein, 9 aa, Homo Sapiens
TYTPSERAR

SEQ ID NO: 529793 - protein, 9 aa, Homo Sapiens
ESPHTGEFK

SEQ ID NO: 529794 - protein, 9 aa, Homo Sapiens
VYTPLPLSG

SEQ ID NO: 529795 - protein, 9 aa, Homo Sapiens
PAKESPHTG

SEQ ID NO: 529796 - protein, 9 aa, Homo Sapiens
SGDCHPLPY

SEQ ID NO: 529797 - protein, 9 aa, Homo Sapiens
LEPGTLYVH

SEQ ID NO: 529798 - protein, 9 aa, Homo Sapiens
SVLLSHQRT

SEQ ID NO: 529799 - protein, 9 aa, Homo Sapiens
CWSSCDPLC

SEQ ID NO: 529800 - protein, 9 aa, Homo Sapiens
ILSGDCHPL

SEQ ID NO: 529801 - protein, 9 aa, Homo Sapiens
DGGHWALRH

SEQ ID NO: 529802 - protein, 9 aa, Homo Sapiens
FSWQSVLLS

SEQ ID NO: 529803 - protein, 9 aa, Homo Sapiens
SKQEAWSTH

SEQ ID NO: 529804 - protein, 9 aa, Homo Sapiens
QEAWSTHNT

SEQ ID NO: 529805 - protein, 9 aa, Homo Sapiens
VDLEPGTLY

SEQ ID NO: 529806 - protein, 9 aa, Homo Sapiens
EPGTLYVHS

SEQ ID NO: 529807 - protein, 9 aa, Homo Sapiens
TVVTILASK

SEQ ID NO: 529808 - protein, 9 aa, Homo Sapiens
DLFAEGCWS

SEQ ID NO: 529809 - protein, 9 aa, Homo Sapiens
PGRPRSKQE

SEQ ID NO: 529810 - protein, 9 aa, Homo Sapiens
QPVYTPLPL

SEQ ID NO: 529811 - protein, 9 aa, Homo Sapiens
NVIEFILIG

SEQ ID NO: 529812 - protein, 9 aa, Homo Sapiens
AFPDDMDLR

SEQ ID NO: 529813 - protein, 9 aa, Homo Sapiens
EAWSTHNTV

SEQ ID NO: 529814 - protein, 9 aa, Homo Sapiens
YKRALDVAA

SEQ ID NO: 529815 - protein, 9 aa, Homo Sapiens
GHPRPTISR

SEQ ID NO: 529816 - protein, 9 aa, Homo Sapiens
CDPLCSSST

SEQ ID NO: 529817 - protein, 9 aa, Homo Sapiens
GLTVVTILA

SEQ ID NO: 529818 - protein, 9 aa, Homo Sapiens
SSSTLTYTP

SEQ ID NO: 529819 - protein, 9 aa, Homo Sapiens
GRPRSKQEA

SEQ ID NO: 529820 - protein, 9 aa, Homo Sapiens
CHPLPYILF

SEQ ID NO: 529821 - protein, 9 aa, Homo Sapiens
TGEFKGAAL

SEQ ID NO: 529822 - protein, 9 aa, Homo Sapiens
KKNVIEFIL

SEQ ID NO: 529823 - protein, 9 aa, Homo Sapiens
VLGNGLTVV

SEQ ID NO: 529824 - protein, 9 aa, Homo Sapiens
AVLAFPDDM

SEQ ID NO: 529825 - protein, 9 aa, Homo Sapiens
ALRHKNGPV

SEQ ID NO: 529826 - protein, 9 aa, Homo Sapiens
ALILSQPVY

SEQ ID NO: 529827 - protein, 9 aa, Homo Sapiens
GHWALRHKN

SEQ ID NO: 529828 - protein, 8 aa, Homo Sapiens
DTQKQIHK

SEQ ID NO: 529829 - protein, 9 aa, Homo Sapiens
HPLPYILFG

SEQ ID NO: 529830 - protein, 9 aa, Homo Sapiens
LVTVLNEYK

SEQ ID NO: 529831 - protein, 9 aa, Homo Sapiens
WSSCDPLCS

SEQ ID NO: 529832 - protein, 9 aa, Homo Sapiens
KRALDVAAE

SEQ ID NO: 529833 - protein, 9 aa, Homo Sapiens
KQEAWSTHN

SEQ ID NO: 529834 - protein, 9 aa, Homo Sapiens
DDMDLRVYG

SEQ ID NO: 529835 - protein, 9 aa, Homo Sapiens
RAKTVDLEP

SEQ ID NO: 529836 - protein, 9 aa, Homo Sapiens
FAEGCWSSC

SEQ ID NO: 529837 - protein, 9 aa, Homo Sapiens
PRPTISRAR

SEQ ID NO: 529838 - protein, 9 aa, Homo Sapiens
GEFKGAALV

SEQ ID NO: 529839 - protein, 9 aa, Homo Sapiens
VLAFPDDMD

SEQ ID NO: 529840 - protein, 9 aa, Homo Sapiens
FPDDMDLRV

SEQ ID NO: 529841 - protein, 9 aa, Homo Sapiens
LSQPVYTPL

SEQ ID NO: 529842 - protein, 9 aa, Homo Sapiens
SRAKTVDLE

SEQ ID NO: 529843 - protein, 9 aa, Homo Sapiens
TVDLEPGTL

SEQ ID NO: 529844 - protein, 9 aa, Homo Sapiens
DLEPGTLYV

SEQ ID NO: 529845 - protein, 9 aa, Homo Sapiens
SCDPLCSSS

SEQ ID NO: 529846 - protein, 9 aa, Homo Sapiens
RPTISRARN

SEQ ID NO: 529847 - protein, 9 aa, Homo Sapiens
TVLNEYKRA

SEQ ID NO: 529848 - protein, 9 aa, Homo Sapiens
EGCWSSCDP

SEQ ID NO: 529849 - protein, 9 aa, Homo Sapiens
RILSGDCHP

SEQ ID NO: 529850 - protein, 9 aa, Homo Sapiens
LRHKNGPVH

SEQ ID NO: 529851 - protein, 9 aa, Homo Sapiens
PHTGEFKGA

SEQ ID NO: 529852 - protein, 9 aa, Homo Sapiens
RARNGEEVQ

SEQ ID NO: 529853 - protein, 9 aa, Homo Sapiens
KRILSGDCH

SEQ ID NO: 529854 - protein, 9 aa, Homo Sapiens
LAFPDDMDL

SEQ ID NO: 529855 - protein, 9 aa, Homo Sapiens
TISRARNGE

SEQ ID NO: 529856 - protein, 9 aa, Homo Sapiens
YTPLPLSGA

SEQ ID NO: 529857 - protein, 9 aa, Homo Sapiens
WQSVLLSHQ

SEQ ID NO: 529858 - protein, 9 aa, Homo Sapiens
SSTLTYTPS

SEQ ID NO: 529859 - protein, 9 aa, Homo Sapiens
LNEYKRALD

SEQ ID NO: 529860 - protein, 9 aa, Homo Sapiens
QSVLLSHQR

SEQ ID NO: 529861 - protein, 9 aa, Homo Sapiens
PLCSSSTLT

SEQ ID NO: 529862 - protein, 9 aa, Homo Sapiens
GCWSSCDPL

SEQ ID NO: 529863 - protein, 9 aa, Homo Sapiens
RDLFAEGCW

SEQ ID NO: 529864 - protein, 9 aa, Homo Sapiens
SSCDPLCSS

SEQ ID NO: 529865 - protein, 9 aa, Homo Sapiens
PRSKQEAWS

SEQ ID NO: 529866 - protein, 9 aa, Homo Sapiens
SPHTGEFKG

SEQ ID NO: 529867 - protein, 9 aa, Homo Sapiens
GRDLFAEGC

SEQ ID NO: 529868 - protein, 9 aa, Homo Sapiens
GDCHPLPYI

SEQ ID NO: 529869 - protein, 9 aa, Homo Sapiens
HTGEFKGAA

SEQ ID NO: 529870 - protein, 9 aa, Homo Sapiens
RPRSKQEAW

SEQ ID NO: 529871 - protein, 9 aa, Homo Sapiens
SWQSVLLSH

SEQ ID NO: 529872 - protein, 9 aa, Homo Sapiens
HWALRHKNG

SEQ ID NO: 529873 - protein, 9 aa, Homo Sapiens
RSKQEAWST

SEQ ID NO: 529874 - protein, 9 aa, Homo Sapiens
NEYKRALDV

SEQ ID NO: 529875 - protein, 9 aa, Homo Sapiens
TLTYTPSER

SEQ ID NO: 529876 - protein, 9 aa, Homo Sapiens
DPLCSSSTL

SEQ ID NO: 529877 - protein, 9 aa, Homo Sapiens
KESPHTGEF

SEQ ID NO: 529878 - protein, 9 aa, Homo Sapiens
AVVLGNGLT

SEQ ID NO: 529879 - protein, 9 aa, Homo Sapiens
VVLGNGLTV

SEQ ID NO: 529880 - protein, 9 aa, Homo Sapiens
DMDLRVYGP

SEQ ID NO: 529881 - protein, 9 aa, Homo Sapiens
ISRARNGEE

SEQ ID NO: 529882 - protein, 9 aa, Homo Sapiens
HPRPTISRA

SEQ ID NO: 529883 - protein, 9 aa, Homo Sapiens
KTVDLEPGT

SEQ ID NO: 529884 - protein, 9 aa, Homo Sapiens
RHKNGPVHG

SEQ ID NO: 529885 - protein, 9 aa, Homo Sapiens
GGHWALRHK

SEQ ID NO: 529886 - protein, 9 aa, Homo Sapiens
ILSQPVYTP

SEQ ID NO: 529887 - protein, 9 aa, Homo Sapiens
LTVVTILAS

SEQ ID NO: 529888 - protein, 9 aa, Homo Sapiens
EYKRALDVA

SEQ ID NO: 529889 - protein, 9 aa, Homo Sapiens
AKTVDLEPG

SEQ ID NO: 529890 - protein, 9 aa, Homo Sapiens
IEFILIGLT

SEQ ID NO: 529891 - protein, 9 aa, Homo Sapiens
VLNEYKRAL

SEQ ID NO: 529892 - protein, 9 aa, Homo Sapiens
SQPVYTPLP

SEQ ID NO: 529893 - protein, 9 aa, Homo Sapiens
VLLSHQRTH

SEQ ID NO: 529894 - protein, 9 aa, Homo Sapiens
LGNGLTVVT

SEQ ID NO: 529895 - protein, 9 aa, Homo Sapiens
LCSSSTLTY

SEQ ID NO: 529896 - protein, 9 aa, Homo Sapiens
VTVLNEYKR

SEQ ID NO: 529897 - protein, 9 aa, Homo Sapiens
AKESPHTGE

SEQ ID NO: 529898 - protein, 9 aa, Homo Sapiens
KKKNVIEFI

SEQ ID NO: 529899 - protein, 9 aa, Homo Sapiens
LILSQPVYT

SEQ ID NO: 529900 - protein, 9 aa, Homo Sapiens
EKKKNVIEF

SEQ ID NO: 529901 - protein, 9 aa, Homo Sapiens
LTYTPSERA

SEQ ID NO: 529902 - protein, 9 aa, Homo Sapiens
NGLTVVTIL

SEQ ID NO: 529903 - protein, 9 aa, Homo Sapiens
VIEFILIGL

SEQ ID NO: 529904 - protein, 9 aa, Homo Sapiens
PFSAQVGNE

SEQ ID NO: 529905 - protein, 9 aa, Homo Sapiens
MVDMQVMRN

SEQ ID NO: 529906 - protein, 9 aa, Homo Sapiens
LPKRYMQGV

SEQ ID NO: 529907 - protein, 9 aa, Homo Sapiens
TEKTQGMEG

SEQ ID NO: 529908 - protein, 9 aa, Homo Sapiens
HFQMSPYAE

SEQ ID NO: 529909 - protein, 9 aa, Homo Sapiens
LLFLVSFGM

SEQ ID NO: 529910 - protein, 9 aa, Homo Sapiens
TGSQAWHFW

SEQ ID NO: 529911 - protein, 9 aa, Homo Sapiens
PVKYETRMA

SEQ ID NO: 529912 - protein, 9 aa, Homo Sapiens
CFVIYRLRD

SEQ ID NO: 529913 - protein, 9 aa, Homo Sapiens
SEKCVITTA

SEQ ID NO: 529914 - protein, 9 aa, Homo Sapiens
VHTREPTTS

SEQ ID NO: 529915 - protein, 9 aa, Homo Sapiens
QLVIDSPVE

SEQ ID NO: 529916 - protein, 9 aa, Homo Sapiens
CVITTAPGP

SEQ ID NO: 529917 - protein, 9 aa, Homo Sapiens
FGMLTVSLG

SEQ ID NO: 529918 - protein, 9 aa, Homo Sapiens
MASPKNAPR

SEQ ID NO: 529919 - protein, 9 aa, Homo Sapiens
PLKQRMFEY

SEQ ID NO: 529920 - protein, 9 aa, Homo Sapiens
GMEGDLNLE

SEQ ID NO: 529921 - protein, 9 aa, Homo Sapiens
LIVKLWRSF

SEQ ID NO: 529922 - protein, 9 aa, Homo Sapiens
IASFSGPQV

SEQ ID NO: 529923 - protein, 9 aa, Homo Sapiens
LNRKQISPA

SEQ ID NO: 529924 - protein, 9 aa, Homo Sapiens
PLSLEELLE

SEQ ID NO: 529925 - protein, 9 aa, Homo Sapiens
ALHLACASD

SEQ ID NO: 529926 - protein, 9 aa, Homo Sapiens
TTSPPVLSE

SEQ ID NO: 529927 - protein, 9 aa, Homo Sapiens
GQIEFQDFG

SEQ ID NO: 529928 - protein, 9 aa, Homo Sapiens
KCVITTAPG

SEQ ID NO: 529929 - protein, 9 aa, Homo Sapiens
LALRQPLCR

SEQ ID NO: 529930 - protein, 9 aa, Homo Sapiens
ANSVAWNPH

SEQ ID NO: 529931 - protein, 9 aa, Homo Sapiens
DKGDGKEKH

SEQ ID NO: 529932 - protein, 9 aa, Homo Sapiens
SARCNLRIW

SEQ ID NO: 529933 - protein, 9 aa, Homo Sapiens
SFLHLGSWN

SEQ ID NO: 529934 - protein, 9 aa, Homo Sapiens
KYETRMACG

SEQ ID NO: 529935 - protein, 9 aa, Homo Sapiens
GQPGSQVPD

SEQ ID NO: 529936 - protein, 9 aa, Homo Sapiens
DPAGSWTCG

SEQ ID NO: 529937 - protein, 9 aa, Homo Sapiens
ISARCNLRI

SEQ ID NO: 529938 - protein, 9 aa, Homo Sapiens
LADQSQVAK

SEQ ID NO: 529939 - protein, 9 aa, Homo Sapiens
GKSKEPNCA

SEQ ID NO: 529940 - protein, 9 aa, Homo Sapiens
NLIVKLWRS

SEQ ID NO: 529941 - protein, 9 aa, Homo Sapiens
PKRYMQGVM

SEQ ID NO: 529942 - protein, 9 aa, Homo Sapiens
SGPQVLDLR

SEQ ID NO: 529943 - protein, 9 aa, Homo Sapiens
MRNGTKVVS

SEQ ID NO: 529944 - protein, 9 aa, Homo Sapiens
ALPEDHYEC

SEQ ID NO: 529945 - protein, 9 aa, Homo Sapiens
QAWHFWQQD

SEQ ID NO: 529946 - protein, 9 aa, Homo Sapiens
ELLERYESS

SEQ ID NO: 529947 - protein, 9 aa, Homo Sapiens
YMQGVMTGE

SEQ ID NO: 529948 - protein, 9 aa, Homo Sapiens
LDPAGSWTC

SEQ ID NO: 529949 - protein, 9 aa, Homo Sapiens
MAYYRYIAI

SEQ ID NO: 529950 - protein, 9 aa, Homo Sapiens
IFIYILALR

SEQ ID NO: 529951 - protein, 9 aa, Homo Sapiens
TGMLPKRYM

SEQ ID NO: 529952 - protein, 9 aa, Homo Sapiens
DHVKVVTLL

SEQ ID NO: 529953 - protein, 9 aa, Homo Sapiens
FSAQVGNER

SEQ ID NO: 529954 - protein, 9 aa, Homo Sapiens
NAQLLEVRR

SEQ ID NO: 529955 - protein, 9 aa, Homo Sapiens
VITTAPGPP

SEQ ID NO: 529956 - protein, 9 aa, Homo Sapiens
KMASPKNAP

SEQ ID NO: 529957 - protein, 9 aa, Homo Sapiens
QVLTQFVSE

SEQ ID NO: 529958 - protein, 9 aa, Homo Sapiens
SQAWHFWQQ

SEQ ID NO: 529959 - protein, 9 aa, Homo Sapiens
LAYFSGKSK

SEQ ID NO: 529960 - protein, 9 aa, Homo Sapiens
LKKQHLKEE

SEQ ID NO: 529961 - protein, 9 aa, Homo Sapiens
LACASDHVK

SEQ ID NO: 529962 - protein, 9 aa, Homo Sapiens
KSGHFQMSP

SEQ ID NO: 529963 - protein, 9 aa, Homo Sapiens
QGMEGDLNL

SEQ ID NO: 529964 - protein, 9 aa, Homo Sapiens
VLLFNRQFY

SEQ ID NO: 529965 - protein, 9 aa, Homo Sapiens
NRKQISPAF

SEQ ID NO: 529966 - protein, 9 aa, Homo Sapiens
VCVFVCFIS

SEQ ID NO: 529967 - protein, 9 aa, Homo Sapiens
KTYNMLCFV

SEQ ID NO: 529968 - protein, 9 aa, Homo Sapiens
GIHRANSVA

SEQ ID NO: 529969 - protein, 9 aa, Homo Sapiens
ILKHWTGGC

SEQ ID NO: 529970 - protein, 9 aa, Homo Sapiens
SYHPGIFRG

SEQ ID NO: 529971 - protein, 9 aa, Homo Sapiens
LIFKSGHFQ

SEQ ID NO: 529972 - protein, 9 aa, Homo Sapiens
ISQADVISK

SEQ ID NO: 529973 - protein, 9 aa, Homo Sapiens
LKHWTGGCP

SEQ ID NO: 529974 - protein, 9 aa, Homo Sapiens
RSTYYNWWR

SEQ ID NO: 529975 - protein, 9 aa, Homo Sapiens
PTRTIIPVK

SEQ ID NO: 529976 - protein, 9 aa, Homo Sapiens
QTVCTNIYN

SEQ ID NO: 529977 - protein, 9 aa, Homo Sapiens
TYFGNLCLT

SEQ ID NO: 529978 - protein, 9 aa, Homo Sapiens
GDGKEKHRG

SEQ ID NO: 529979 - protein, 9 aa, Homo Sapiens
FSGPQVLDL

SEQ ID NO: 529980 - protein, 9 aa, Homo Sapiens
EKTQGMEGD

SEQ ID NO: 529981 - protein, 9 aa, Homo Sapiens
PQGGQIEFQ

SEQ ID NO: 529982 - protein, 9 aa, Homo Sapiens
KEPNCACDQ

SEQ ID NO: 529983 - protein, 9 aa, Homo Sapiens
ASFSGPQVL

SEQ ID NO: 529984 - protein, 9 aa, Homo Sapiens
FVLLFNRQF

SEQ ID NO: 529985 - protein, 9 aa, Homo Sapiens
GSWTCGQPG

SEQ ID NO: 529986 - protein, 9 aa, Homo Sapiens
QPGSQVPDL

SEQ ID NO: 529987 - protein, 9 aa, Homo Sapiens
LHGIHRANS

SEQ ID NO: 529988 - protein, 9 aa, Homo Sapiens
WTGGCPFRE

SEQ ID NO: 529989 - protein, 9 aa, Homo Sapiens
YRYIAICNP

SEQ ID NO: 529990 - protein, 9 aa, Homo Sapiens
HATVQVLTQ

SEQ ID NO: 529991 - protein, 9 aa, Homo Sapiens
NERMQCLMR

SEQ ID NO: 529992 - protein, 9 aa, Homo Sapiens
SGHFQMSPY

SEQ ID NO: 529993 - protein, 9 aa, Homo Sapiens
CDVPPIFAL

SEQ ID NO: 529994 - protein, 9 aa, Homo Sapiens
CVFVCFISQ

SEQ ID NO: 529995 - protein, 9 aa, Homo Sapiens
GKEKHRGLK

SEQ ID NO: 529996 - protein, 9 aa, Homo Sapiens
HPGIFRGDK

SEQ ID NO: 529997 - protein, 9 aa, Homo Sapiens
VKYETRMAC

SEQ ID NO: 529998 - protein, 9 aa, Homo Sapiens
LLAAMAYYR

SEQ ID NO: 529999 - protein, 9 aa, Homo Sapiens
GCMVDMQVM

SEQ ID NO: 530000 - protein, 9 aa, Homo Sapiens
KMSDLKKQH

SEQ ID NO: 530001 - protein, 9 aa, Homo Sapiens
GFMPSFLHL

SEQ ID NO: 530002 - protein, 9 aa, Homo Sapiens
FEYFQTTWA

SEQ ID NO: 530003 - protein, 9 aa, Homo Sapiens
SKEPNCACD

SEQ ID NO: 530004 - protein, 9 aa, Homo Sapiens
PPIFALSCS

SEQ ID NO: 530005 - protein, 9 aa, Homo Sapiens
LFNRQFYEE

SEQ ID NO: 530006 - protein, 9 aa, Homo Sapiens
FLTGSQAWH

SEQ ID NO: 530007 - protein, 9 aa, Homo Sapiens
YFGNLCLTQ

SEQ ID NO: 530008 - protein, 9 aa, Homo Sapiens
TVCTNIYNI

SEQ ID NO: 530009 - protein, 9 aa, Homo Sapiens
AGSWTCGQP

SEQ ID NO: 530010 - protein, 9 aa, Homo Sapiens
DSPVEKREM

SEQ ID NO: 530011 - protein, 9 aa, Homo Sapiens
FSGKSKEPN

SEQ ID NO: 530012 - protein, 9 aa, Homo Sapiens
CGQPGSQVP

SEQ ID NO: 530013 - protein, 9 aa, Homo Sapiens
TVQVLTQFV

SEQ ID NO: 530014 - protein, 9 aa, Homo Sapiens
TGGCPFREG

SEQ ID NO: 530015 - protein, 9 aa, Homo Sapiens
REPTTSPPV

SEQ ID NO: 530016 - protein, 9 aa, Homo Sapiens
FVCFISQAD

SEQ ID NO: 530017 - protein, 9 aa, Homo Sapiens
YYNWWRKAL

SEQ ID NO: 530018 - protein, 9 aa, Homo Sapiens
GIFRGDKWS

SEQ ID NO: 530019 - protein, 9 aa, Homo Sapiens
YYRYIAICN

SEQ ID NO: 530020 - protein, 9 aa, Homo Sapiens
KNAQLLEVR

SEQ ID NO: 530021 - protein, 9 aa, Homo Sapiens
RCNLRIWGS

SEQ ID NO: 530022 - protein, 9 aa, Homo Sapiens
SKLIFKSGH

SEQ ID NO: 530023 - protein, 9 aa, Homo Sapiens
VIYRLRDAH

SEQ ID NO: 530024 - protein, 9 aa, Homo Sapiens
AYYRYIAIC

SEQ ID NO: 530025 - protein, 9 aa, Homo Sapiens
AQVGNERMQ

SEQ ID NO: 530026 - protein, 9 aa, Homo Sapiens
HLACASDHV

SEQ ID NO: 530027 - protein, 9 aa, Homo Sapiens
DGKEKHRGL

SEQ ID NO: 530028 - protein, 9 aa, Homo Sapiens
FMPSFLHLG

SEQ ID NO: 530029 - protein, 9 aa, Homo Sapiens
RIWGSSDSP

SEQ ID NO: 530030 - protein, 9 aa, Homo Sapiens
ATVQVLTQF

SEQ ID NO: 530031 - protein, 9 aa, Homo Sapiens
DHYECTTPD

SEQ ID NO: 530032 - protein, 9 aa, Homo Sapiens
MFEYFQTTW

SEQ ID NO: 530033 - protein, 9 aa, Homo Sapiens
SQADVISKL

SEQ ID NO: 530034 - protein, 9 aa, Homo Sapiens
NLRIWGSSD

SEQ ID NO: 530035 - protein, 9 aa, Homo Sapiens
QRMFEYFQT

SEQ ID NO: 530036 - protein, 9 aa, Homo Sapiens
LEVRRREDS

SEQ ID NO: 530037 - protein, 9 aa, Homo Sapiens
FCDVPPIFA

SEQ ID NO: 530038 - protein, 9 aa, Homo Sapiens
HRANSVAWN

SEQ ID NO: 530039 - protein, 9 aa, Homo Sapiens
GMLPKRYMQ

SEQ ID NO: 530040 - protein, 9 aa, Homo Sapiens
LSFVLLFNR

SEQ ID NO: 530041 - protein, 9 aa, Homo Sapiens
TYYNWWRKA

SEQ ID NO: 530042 - protein, 9 aa, Homo Sapiens
DLKKQHLKE

SEQ ID NO: 530043 - protein, 9 aa, Homo Sapiens
MPSFLHLGS

SEQ ID NO: 530044 - protein, 9 aa, Homo Sapiens
VPPIFALSC

SEQ ID NO: 530045 - protein, 9 aa, Homo Sapiens
HYECTTPDG

SEQ ID NO: 530046 - protein, 9 aa, Homo Sapiens
SLEELLERY

SEQ ID NO: 530047 - protein, 9 aa, Homo Sapiens
VTVQPGCYL

SEQ ID NO: 530048 - protein, 9 aa, Homo Sapiens
AAMAYYRYI

SEQ ID NO: 530049 - protein, 9 aa, Homo Sapiens
STYYNWWRK

SEQ ID NO: 530050 - protein, 9 aa, Homo Sapiens
GGRLDPAGS

SEQ ID NO: 530051 - protein, 9 aa, Homo Sapiens
EDHYECTTP

SEQ ID NO: 530052 - protein, 9 aa, Homo Sapiens
PGSQVPDLQ

SEQ ID NO: 530053 - protein, 9 aa, Homo Sapiens
TQGMEGDLN

SEQ ID NO: 530054 - protein, 9 aa, Homo Sapiens
KHWTGGCPF

SEQ ID NO: 530055 - protein, 9 aa, Homo Sapiens
FIYILALRQ

SEQ ID NO: 530056 - protein, 9 aa, Homo Sapiens
SFGMLTVSL

SEQ ID NO: 530057 - protein, 9 aa, Homo Sapiens
TIIPVKYET

SEQ ID NO: 530058 - protein, 9 aa, Homo Sapiens
QISPAFQPP

SEQ ID NO: 530059 - protein, 9 aa, Homo Sapiens
IYNILLLQA

SEQ ID NO: 530060 - protein, 9 aa, Homo Sapiens
PFLLFLVSF

SEQ ID NO: 530061 - protein, 9 aa, Homo Sapiens
SRSTYYNWW

SEQ ID NO: 530062 - protein, 9 aa, Homo Sapiens
EPTTSPPVL

SEQ ID NO: 530063 - protein, 9 aa, Homo Sapiens
VSFGMLTVS

SEQ ID NO: 530064 - protein, 9 aa, Homo Sapiens
GSYHPGIFR

SEQ ID NO: 530065 - protein, 9 aa, Homo Sapiens
IWGSSDSPA

SEQ ID NO: 530066 - protein, 9 aa, Homo Sapiens
LETEKTQGM

SEQ ID NO: 530067 - protein, 9 aa, Homo Sapiens
PCIFIYILA

SEQ ID NO: 530068 - protein, 9 aa, Homo Sapiens
IYILALRQP

SEQ ID NO: 530069 - protein, 9 aa, Homo Sapiens
PSFLHLGSW

SEQ ID NO: 530070 - protein, 9 aa, Homo Sapiens
GNLCLTQGS

SEQ ID NO: 530071 - protein, 9 aa, Homo Sapiens
IFKSGHFQM

SEQ ID NO: 530072 - protein, 9 aa, Homo Sapiens
CIFIYILAL

SEQ ID NO: 530073 - protein, 9 aa, Homo Sapiens
HRGLKNNCL

SEQ ID NO: 530074 - protein, 9 aa, Homo Sapiens
MQVMRNGTK

SEQ ID NO: 530075 - protein, 9 aa, Homo Sapiens
QLLEVRRRE

SEQ ID NO: 530076 - protein, 9 aa, Homo Sapiens
VFVCFISQA

SEQ ID NO: 530077 - protein, 9 aa, Homo Sapiens
LLERYESSH

SEQ ID NO: 530078 - protein, 9 aa, Homo Sapiens
LTGSQAWHF

SEQ ID NO: 530079 - protein, 9 aa, Homo Sapiens
KGFMPSFLH

SEQ ID NO: 530080 - protein, 9 aa, Homo Sapiens
LHLACASDH

SEQ ID NO: 530081 - protein, 9 aa, Homo Sapiens
PFSEKCVIT

SEQ ID NO: 530082 - protein, 9 aa, Homo Sapiens
YFSGKSKEP

SEQ ID NO: 530083 - protein, 9 aa, Homo Sapiens
EVTVQPGCY

SEQ ID NO: 530084 - protein, 9 aa, Homo Sapiens
SFSGPQVLD

SEQ ID NO: 530085 - protein, 9 aa, Homo Sapiens
SDHVKVVTL

SEQ ID NO: 530086 - protein, 9 aa, Homo Sapiens
KQRMFEYFQ

SEQ ID NO: 530087 - protein, 9 aa, Homo Sapiens
LVSFGMLTV

SEQ ID NO: 530088 - protein, 9 aa, Homo Sapiens
RMFEYFQTT

SEQ ID NO: 530089 - protein, 9 aa, Homo Sapiens
NMLCFVIYR

SEQ ID NO: 530090 - protein, 9 aa, Homo Sapiens
AKIERQKVD

SEQ ID NO: 530091 - protein, 9 aa, Homo Sapiens
SAQVGNERM

SEQ ID NO: 530092 - protein, 9 aa, Homo Sapiens
PRPLKQRMF

SEQ ID NO: 530093 - protein, 9 aa, Homo Sapiens
VLDLRTFVN

SEQ ID NO: 530094 - protein, 9 aa, Homo Sapiens
DQLVIDSPV

SEQ ID NO: 530095 - protein, 9 aa, Homo Sapiens
FQDFGLRYR

SEQ ID NO: 530096 - protein, 9 aa, Homo Sapiens
LLFNRQFYE

SEQ ID NO: 530097 - protein, 9 aa, Homo Sapiens
GKMASPKNA

SEQ ID NO: 530098 - protein, 9 aa, Homo Sapiens
MESGKMASP

SEQ ID NO: 530099 - protein, 9 aa, Homo Sapiens
KQISPAFQP

SEQ ID NO: 530100 - protein, 9 aa, Homo Sapiens
LSLEELLER

SEQ ID NO: 530101 - protein, 9 aa, Homo Sapiens
TLNRKQISP

SEQ ID NO: 530102 - protein, 9 aa, Homo Sapiens
LERYESSHP

SEQ ID NO: 530103 - protein, 9 aa, Homo Sapiens
NILLLQAYR

SEQ ID NO: 530104 - protein, 9 aa, Homo Sapiens
KKNAQLLEV

SEQ ID NO: 530105 - protein, 9 aa, Homo Sapiens
HASDCSGLY

SEQ ID NO: 530106 - protein, 9 aa, Homo Sapiens
FSEKCVITT

SEQ ID NO: 530107 - protein, 9 aa, Homo Sapiens
RLDPAGSWT

SEQ ID NO: 530108 - protein, 9 aa, Homo Sapiens
AWHFWQQDE

SEQ ID NO: 530109 - protein, 9 aa, Homo Sapiens
LLHGIHRAN

SEQ ID NO: 530110 - protein, 9 aa, Homo Sapiens
CASDHVKVV

SEQ ID NO: 530111 - protein, 9 aa, Homo Sapiens
FLLFLVSFG

SEQ ID NO: 530112 - protein, 9 aa, Homo Sapiens
QHATVQVLT

SEQ ID NO: 530113 - protein, 9 aa, Homo Sapiens
GSQAWHFWQ

SEQ ID NO: 530114 - protein, 9 aa, Homo Sapiens
ECTTPDGSI

SEQ ID NO: 530115 - protein, 9 aa, Homo Sapiens
ILALRQPLC

SEQ ID NO: 530116 - protein, 9 aa, Homo Sapiens
LPTSILLVS

SEQ ID NO: 530117 - protein, 9 aa, Homo Sapiens
KRYMQGVMT

SEQ ID NO: 530118 - protein, 9 aa, Homo Sapiens
NWWRKALRR

SEQ ID NO: 530119 - protein, 9 aa, Homo Sapiens
IHRANSVAW

SEQ ID NO: 530120 - protein, 9 aa, Homo Sapiens
TVQPGCYLP

SEQ ID NO: 530121 - protein, 9 aa, Homo Sapiens
VIDSPVEKR

SEQ ID NO: 530122 - protein, 9 aa, Homo Sapiens
ASPKNAPRD

SEQ ID NO: 530123 - protein, 9 aa, Homo Sapiens
RYMQGVMTG

SEQ ID NO: 530124 - protein, 9 aa, Homo Sapiens
SDLKKQHLK

SEQ ID NO: 530125 - protein, 9 aa, Homo Sapiens
VAKIERQKV

SEQ ID NO: 530126 - protein, 9 aa, Homo Sapiens
SQVAKIERQ

SEQ ID NO: 530127 - protein, 9 aa, Homo Sapiens
PEDHYECTT

SEQ ID NO: 530128 - protein, 9 aa, Homo Sapiens
IEFQDFGLR

SEQ ID NO: 530129 - protein, 9 aa, Homo Sapiens
FLHLGSWNV

SEQ ID NO: 530130 - protein, 9 aa, Homo Sapiens
GGTLNRKQI

SEQ ID NO: 530131 - protein, 9 aa, Homo Sapiens
SGKSKEPNC

SEQ ID NO: 530132 - protein, 9 aa, Homo Sapiens
WRSFRTLIV

SEQ ID NO: 530133 - protein, 9 aa, Homo Sapiens
FISQADVIS

SEQ ID NO: 530134 - protein, 9 aa, Homo Sapiens
LFLVSFGML

SEQ ID NO: 530135 - protein, 9 aa, Homo Sapiens
EELLERYES

SEQ ID NO: 530136 - protein, 9 aa, Homo Sapiens
LQYQHATVQ

SEQ ID NO: 530137 - protein, 9 aa, Homo Sapiens
EKCVITTAP

SEQ ID NO: 530138 - protein, 9 aa, Homo Sapiens
KHRGLKNNC

SEQ ID NO: 530139 - protein, 9 aa, Homo Sapiens
KIERQKVDV

SEQ ID NO: 530140 - protein, 9 aa, Homo Sapiens
QVMRNGTKV

SEQ ID NO: 530141 - protein, 9 aa, Homo Sapiens
CMVDMQVMR

SEQ ID NO: 530142 - protein, 9 aa, Homo Sapiens
IPVKYETRM

SEQ ID NO: 530143 - protein, 9 aa, Homo Sapiens
RKQISPAFQ

SEQ ID NO: 530144 - protein, 9 aa, Homo Sapiens
PIFALSCSN

SEQ ID NO: 530145 - protein, 9 aa, Homo Sapiens
YILALRQPL

SEQ ID NO: 530146 - protein, 9 aa, Homo Sapiens
FNRQFYEEE

SEQ ID NO: 530147 - protein, 9 aa, Homo Sapiens
RANSVAWNP

SEQ ID NO: 530148 - protein, 9 aa, Homo Sapiens
ARCNLRIWG

SEQ ID NO: 530149 - protein, 9 aa, Homo Sapiens
GGCPFREGV

SEQ ID NO: 530150 - protein, 9 aa, Homo Sapiens
SPPVLSERA

SEQ ID NO: 530151 - protein, 9 aa, Homo Sapiens
QVAKIERQK

SEQ ID NO: 530152 - protein, 9 aa, Homo Sapiens
PGIFRGDKW

SEQ ID NO: 530153 - protein, 9 aa, Homo Sapiens
IIPVKYETR

SEQ ID NO: 530154 - protein, 9 aa, Homo Sapiens
HGIHRANSV

SEQ ID NO: 530155 - protein, 9 aa, Homo Sapiens
KSKEPNCAC

SEQ ID NO: 530156 - protein, 9 aa, Homo Sapiens
QSQVAKIER

SEQ ID NO: 530157 - protein, 9 aa, Homo Sapiens
EFQDFGLRY

SEQ ID NO: 530158 - protein, 9 aa, Homo Sapiens
LEELLERYE

SEQ ID NO: 530159 - protein, 9 aa, Homo Sapiens
FLVSFGMLT

SEQ ID NO: 530160 - protein, 9 aa, Homo Sapiens
VKILKHWTG

SEQ ID NO: 530161 - protein, 9 aa, Homo Sapiens
QLKMSDLKK

SEQ ID NO: 530162 - protein, 9 aa, Homo Sapiens
TYNMLCFVI

SEQ ID NO: 530163 - protein, 9 aa, Homo Sapiens
MEGDLNLEQ

SEQ ID NO: 530164 - protein, 9 aa, Homo Sapiens
LVIDSPVEK

SEQ ID NO: 530165 - protein, 9 aa, Homo Sapiens
QVGNERMQC

SEQ ID NO: 530166 - protein, 9 aa, Homo Sapiens
DVPPIFALS

SEQ ID NO: 530167 - protein, 9 aa, Homo Sapiens
FVIYRLRDA

SEQ ID NO: 530168 - protein, 9 aa, Homo Sapiens
HTREPTTSP

SEQ ID NO: 530169 - protein, 9 aa, Homo Sapiens
VCTNIYNIL

SEQ ID NO: 530170 - protein, 9 aa, Homo Sapiens
KLIFKSGHF

SEQ ID NO: 530171 - protein, 9 aa, Homo Sapiens
HLGSWNVVM

SEQ ID NO: 530172 - protein, 9 aa, Homo Sapiens
VMRNGTKVV

SEQ ID NO: 530173 - protein, 9 aa, Homo Sapiens
KEKHRGLKN

SEQ ID NO: 530174 - protein, 9 aa, Homo Sapiens
SPVEKREME

SEQ ID NO: 530175 - protein, 9 aa, Homo Sapiens
GHFQMSPYA

SEQ ID NO: 530176 - protein, 9 aa, Homo Sapiens
KLWRSFRTL

SEQ ID NO: 530177 - protein, 9 aa, Homo Sapiens
SWTCGQPGS

SEQ ID NO: 530178 - protein, 9 aa, Homo Sapiens
LCFVIYRLR

SEQ ID NO: 530179 - protein, 9 aa, Homo Sapiens
LKQRMFEYF

SEQ ID NO: 530180 - protein, 9 aa, Homo Sapiens
NSVAWNPHK

SEQ ID NO: 530181 - protein, 9 aa, Homo Sapiens
YNWWRKALR

SEQ ID NO: 530182 - protein, 9 aa, Homo Sapiens
GPCIFIYIL

SEQ ID NO: 530183 - protein, 9 aa, Homo Sapiens
ESGKMASPK

SEQ ID NO: 530184 - protein, 9 aa, Homo Sapiens
LDQLVIDSP

SEQ ID NO: 530185 - protein, 9 aa, Homo Sapiens
IFRGDKWSC

SEQ ID NO: 530186 - protein, 9 aa, Homo Sapiens
KILKHWTGG

SEQ ID NO: 530187 - protein, 9 aa, Homo Sapiens
RPLKQRMFE

SEQ ID NO: 530188 - protein, 9 aa, Homo Sapiens
RTIIPVKYE

SEQ ID NO: 530189 - protein, 9 aa, Homo Sapiens
LKMSDLKKQ

SEQ ID NO: 530190 - protein, 9 aa, Homo Sapiens
NIYNILLLQ

SEQ ID NO: 530191 - protein, 9 aa, Homo Sapiens
MPFSAQVGN

SEQ ID NO: 530192 - protein, 9 aa, Homo Sapiens
FPSPHASDC

SEQ ID NO: 530193 - protein, 9 aa, Homo Sapiens
CLTQGSYLW

SEQ ID NO: 530194 - protein, 9 aa, Homo Sapiens
WGGRLDPAG

SEQ ID NO: 530195 - protein, 9 aa, Homo Sapiens
HWTGGCPFR

SEQ ID NO: 530196 - protein, 9 aa, Homo Sapiens
QYQHATVQV

SEQ ID NO: 530197 - protein, 9 aa, Homo Sapiens
AYFSGKSKE

SEQ ID NO: 530198 - protein, 9 aa, Homo Sapiens
TCGQPGSQV

SEQ ID NO: 530199 - protein, 9 aa, Homo Sapiens
LHLGSWNVV

SEQ ID NO: 530200 - protein, 9 aa, Homo Sapiens
VKLWRSFRT

SEQ ID NO: 530201 - protein, 9 aa, Homo Sapiens
YECTTPDGS

SEQ ID NO: 530202 - protein, 9 aa, Homo Sapiens
VLSFVLLFN

SEQ ID NO: 530203 - protein, 9 aa, Homo Sapiens
GPFSEKCVI

SEQ ID NO: 530204 - protein, 9 aa, Homo Sapiens
VCFISQADV

SEQ ID NO: 530205 - protein, 9 aa, Homo Sapiens
MSDLKKQHL

SEQ ID NO: 530206 - protein, 9 aa, Homo Sapiens
LPEDHYECT

SEQ ID NO: 530207 - protein, 9 aa, Homo Sapiens
LCLTQGSYL

SEQ ID NO: 530208 - protein, 9 aa, Homo Sapiens
FKSGHFQMS

SEQ ID NO: 530209 - protein, 9 aa, Homo Sapiens
ETYFGNLCL

SEQ ID NO: 530210 - protein, 9 aa, Homo Sapiens
YHPGIFRGD

SEQ ID NO: 530211 - protein, 9 aa, Homo Sapiens
QIEFQDFGL

SEQ ID NO: 530212 - protein, 9 aa, Homo Sapiens
KGDGKEKHR

SEQ ID NO: 530213 - protein, 9 aa, Homo Sapiens
KTQGMEGDL

SEQ ID NO: 530214 - protein, 9 aa, Homo Sapiens
ETEKTQGME

SEQ ID NO: 530215 - protein, 9 aa, Homo Sapiens
ADQSQVAKI

SEQ ID NO: 530216 - protein, 9 aa, Homo Sapiens
FALSCSNVD

SEQ ID NO: 530217 - protein, 9 aa, Homo Sapiens
DVLSFVLLF

SEQ ID NO: 530218 - protein, 9 aa, Homo Sapiens
SPHASDCSG

SEQ ID NO: 530219 - protein, 9 aa, Homo Sapiens
WTCGQPGSQ

SEQ ID NO: 530220 - protein, 9 aa, Homo Sapiens
EKHRGLKNN

SEQ ID NO: 530221 - protein, 9 aa, Homo Sapiens
FGPFSEKCV

SEQ ID NO: 530222 - protein, 9 aa, Homo Sapiens
DMQVMRNGT

SEQ ID NO: 530223 - protein, 9 aa, Homo Sapiens
SPKNAPRDA

SEQ ID NO: 530224 - protein, 9 aa, Homo Sapiens
LLEVRRRED

SEQ ID NO: 530225 - protein, 9 aa, Homo Sapiens
PQVLDLRTF

SEQ ID NO: 530226 - protein, 9 aa, Homo Sapiens
AQLLEVRRR

SEQ ID NO: 530227 - protein, 9 aa, Homo Sapiens
YNMLCFVIY

SEQ ID NO: 530228 - protein, 9 aa, Homo Sapiens
LWRSFRTLI

SEQ ID NO: 530229 - protein, 9 aa, Homo Sapiens
NLCLTQGSY

SEQ ID NO: 530230 - protein, 9 aa, Homo Sapiens
WHFWQQDEP

SEQ ID NO: 530231 - protein, 9 aa, Homo Sapiens
PVEKREMER

SEQ ID NO: 530232 - protein, 9 aa, Homo Sapiens
IFALSCSNV

SEQ ID NO: 530233 - protein, 9 aa, Homo Sapiens
GPQVLDLRT

SEQ ID NO: 530234 - protein, 9 aa, Homo Sapiens
FGNLCLTQG

SEQ ID NO: 530235 - protein, 9 aa, Homo Sapiens
AMAYYRYIA

SEQ ID NO: 530236 - protein, 9 aa, Homo Sapiens
LAAMAYYRY

SEQ ID NO: 530237 - protein, 9 aa, Homo Sapiens
TQLKMSDLK

SEQ ID NO: 530238 - protein, 9 aa, Homo Sapiens
GTLNRKQIS

SEQ ID NO: 530239 - protein, 9 aa, Homo Sapiens
CTNIYNILL

SEQ ID NO: 530240 - protein, 9 aa, Homo Sapiens
YQHATVQVL

SEQ ID NO: 530241 - protein, 9 aa, Homo Sapiens
SGKMASPKN

SEQ ID NO: 530242 - protein, 9 aa, Homo Sapiens
EPLSLEELL

SEQ ID NO: 530243 - protein, 9 aa, Homo Sapiens
CFISQADVI

SEQ ID NO: 530244 - protein, 9 aa, Homo Sapiens
GNERMQCLM

SEQ ID NO: 530245 - protein, 9 aa, Homo Sapiens
MNLIVKLWR

SEQ ID NO: 530246 - protein, 9 aa, Homo Sapiens
ACASDHVKV

SEQ ID NO: 530247 - protein, 9 aa, Homo Sapiens
DQSQVAKIE

SEQ ID NO: 530248 - protein, 9 aa, Homo Sapiens
TNIYNILLL

SEQ ID NO: 530249 - protein, 9 aa, Homo Sapiens
TRTIIPVKY

SEQ ID NO: 530250 - protein, 9 aa, Homo Sapiens
MQGVMTGES

SEQ ID NO: 530251 - protein, 9 aa, Homo Sapiens
WWRKALRRN

SEQ ID NO: 530252 - protein, 9 aa, Homo Sapiens
ASDHVKVVT

SEQ ID NO: 530253 - protein, 9 aa, Homo Sapiens
LFLTGSQAW

SEQ ID NO: 530254 - protein, 9 aa, Homo Sapiens
WRKALRRNP

SEQ ID NO: 530255 - protein, 9 aa, Homo Sapiens
TSPPVLSER

SEQ ID NO: 530256 - protein, 9 aa, Homo Sapiens
GRLDPAGSW

SEQ ID NO: 530257 - protein, 9 aa, Homo Sapiens
TREPTTSPP

SEQ ID NO: 530258 - protein, 9 aa, Homo Sapiens
PFPSPHASD

SEQ ID NO: 530259 - protein, 9 aa, Homo Sapiens
CNLRIWGSS

SEQ ID NO: 530260 - protein, 9 aa, Homo Sapiens
PAGSWTCGQ

SEQ ID NO: 530261 - protein, 9 aa, Homo Sapiens
PTTSPPVLS

SEQ ID NO: 530262 - protein, 9 aa, Homo Sapiens
QGGQIEFQD

SEQ ID NO: 530263 - protein, 9 aa, Homo Sapiens
LLPTSILLV

SEQ ID NO: 530264 - protein, 9 aa, Homo Sapiens
LLLAAMAYY

SEQ ID NO: 530265 - protein, 9 aa, Homo Sapiens
SFVLLFNRQ

SEQ ID NO: 530266 - protein, 9 aa, Homo Sapiens
LTQGSYLWV

SEQ ID NO: 530267 - protein, 9 aa, Homo Sapiens
VDMQVMRNG

SEQ ID NO: 530268 - protein, 9 aa, Homo Sapiens
CTTPDGSIG

SEQ ID NO: 530269 - protein, 9 aa, Homo Sapiens
GGQIEFQDF

SEQ ID NO: 530270 - protein, 9 aa, Homo Sapiens
RGGTLNRKQ

SEQ ID NO: 530271 - protein, 9 aa, Homo Sapiens
MLPKRYMQG

SEQ ID NO: 530272 - protein, 9 aa, Homo Sapiens
QVLDLRTFV

SEQ ID NO: 530273 - protein, 9 aa, Homo Sapiens
YNILLLQAY

SEQ ID NO: 530274 - protein, 9 aa, Homo Sapiens
QDFGLRYRP

SEQ ID NO: 530275 - protein, 9 aa, Homo Sapiens
KKQHLKEEI

SEQ ID NO: 530276 - protein, 9 aa, Homo Sapiens
VGNERMQCL

SEQ ID NO: 530277 - protein, 9 aa, Homo Sapiens
LRIWGSSDS

SEQ ID NO: 530278 - protein, 9 aa, Homo Sapiens
PHASDCSGL

SEQ ID NO: 530279 - protein, 9 aa, Homo Sapiens
MLCFVIYRL

SEQ ID NO: 530280 - protein, 9 aa, Homo Sapiens
IDSPVEKRE

SEQ ID NO: 530281 - protein, 9 aa, Homo Sapiens
VQVLTQFVS

SEQ ID NO: 530282 - protein, 9 aa, Homo Sapiens
FFCDVPPIF

SEQ ID NO: 530283 - protein, 9 aa, Homo Sapiens
PSPHASDCS

SEQ ID NO: 530284 - protein, 9 aa, Homo Sapiens
IVKLWRSFR

SEQ ID NO: 530285 - protein, 9 aa, Homo Sapiens
DNWESGLHA

SEQ ID NO: 530286 - protein, 9 aa, Homo Sapiens
GPPPPGMHP

SEQ ID NO: 530287 - protein, 9 aa, Homo Sapiens
TVELARYEP

SEQ ID NO: 530288 - protein, 9 aa, Homo Sapiens
IAAENSIGV

SEQ ID NO: 530289 - protein, 9 aa, Homo Sapiens
EQQKHVVFG

SEQ ID NO: 530290 - protein, 9 aa, Homo Sapiens
QHQCVQYAL

SEQ ID NO: 530291 - protein, 9 aa, Homo Sapiens
PGAMRRFLP

SEQ ID NO: 530292 - protein, 9 aa, Homo Sapiens
THLVHYRID

SEQ ID NO: 530293 - protein, 9 aa, Homo Sapiens
PVGKEELVY

SEQ ID NO: 530294 - protein, 9 aa, Homo Sapiens
TVMYSQINR

SEQ ID NO: 530295 - protein, 9 aa, Homo Sapiens
FIPNLYLKQ

SEQ ID NO: 530296 - protein, 9 aa, Homo Sapiens
RYRGAIACK

SEQ ID NO: 530297 - protein, 9 aa, Homo Sapiens
HGNEVAGWE

SEQ ID NO: 530298 - protein, 9 aa, Homo Sapiens
METINKLKV

SEQ ID NO: 530299 - protein, 9 aa, Homo Sapiens
FVVHKRCRE

SEQ ID NO: 530300 - protein, 9 aa, Homo Sapiens
KENGTKLLP

SEQ ID NO: 530301 - protein, 9 aa, Homo Sapiens
MHTDKEPVG

SEQ ID NO: 530302 - protein, 9 aa, Homo Sapiens
DKDEDTFDW

SEQ ID NO: 530303 - protein, 9 aa, Homo Sapiens
RTYFYTNEA

SEQ ID NO: 530304 - protein, 9 aa, Homo Sapiens
EETLTLANK

SEQ ID NO: 530305 - protein, 9 aa, Homo Sapiens
SSPLEGQAK

SEQ ID NO: 530306 - protein, 9 aa, Homo Sapiens
VTITVAYLM

SEQ ID NO: 530307 - protein, 9 aa, Homo Sapiens
FINTRCAHP

SEQ ID NO: 530308 - protein, 9 aa, Homo Sapiens
SRFGGSTHN

SEQ ID NO: 530309 - protein, 9 aa, Homo Sapiens
EEAACLCAT

SEQ ID NO: 530310 - protein, 9 aa, Homo Sapiens
NTCADMLRY

SEQ ID NO: 530311 - protein, 9 aa, Homo Sapiens
CCAKPSAEL

SEQ ID NO: 530312 - protein, 9 aa, Homo Sapiens
HRIILHGID

SEQ ID NO: 530313 - protein, 9 aa, Homo Sapiens
KLSERRRKC

SEQ ID NO: 530314 - protein, 9 aa, Homo Sapiens
QLLHKADGV

SEQ ID NO: 530315 - protein, 9 aa, Homo Sapiens
QDGVSSLAA

SEQ ID NO: 530316 - protein, 9 aa, Homo Sapiens
ADTIGDDDE

SEQ ID NO: 530317 - protein, 9 aa, Homo Sapiens
WEFFESNIK

SEQ ID NO: 530318 - protein, 9 aa, Homo Sapiens
EPEVLQDSQ

SEQ ID NO: 530319 - protein, 9 aa, Homo Sapiens
SACHREAAL

SEQ ID NO: 530320 - protein, 9 aa, Homo Sapiens
ALSTDSACH

SEQ ID NO: 530321 - protein, 9 aa, Homo Sapiens
MFLCCGKKS

SEQ ID NO: 530322 - protein, 9 aa, Homo Sapiens
LMHISQARK

SEQ ID NO: 530323 - protein, 9 aa, Homo Sapiens
LGVLCLNLS

SEQ ID NO: 530324 - protein, 9 aa, Homo Sapiens
LLFLMGINR

SEQ ID NO: 530325 - protein, 9 aa, Homo Sapiens
NLRTVDPET

SEQ ID NO: 530326 - protein, 9 aa, Homo Sapiens
SVGTAGYNH

SEQ ID NO: 530327 - protein, 9 aa, Homo Sapiens
FQEGLLHVT

SEQ ID NO: 530328 - protein, 9 aa, Homo Sapiens
GGRTWCEDT

SEQ ID NO: 530329 - protein, 9 aa, Homo Sapiens
DDFWNTQKR

SEQ ID NO: 530330 - protein, 9 aa, Homo Sapiens
IRRDVPAGR

SEQ ID NO: 530331 - protein, 9 aa, Homo Sapiens
DHCFSSDRR

SEQ ID NO: 530332 - protein, 9 aa, Homo Sapiens
PVPIDDSFC

SEQ ID NO: 530333 - protein, 9 aa, Homo Sapiens
WKEEYQGVI

SEQ ID NO: 530334 - protein, 9 aa, Homo Sapiens
CKTVHHGFP

SEQ ID NO: 530335 - protein, 9 aa, Homo Sapiens
DRPETDILF

SEQ ID NO: 530336 - protein, 9 aa, Homo Sapiens
EAGPLCKSS

SEQ ID NO: 530337 - protein, 9 aa, Homo Sapiens
PDPYRQLQE

SEQ ID NO: 530338 - protein, 9 aa, Homo Sapiens
DLCKDEPTL

SEQ ID NO: 530339 - protein, 9 aa, Homo Sapiens
GSGALSWPG

SEQ ID NO: 530340 - protein, 9 aa, Homo Sapiens
GPDGHFVMG

SEQ ID NO: 530341 - protein, 9 aa, Homo Sapiens
QLLTAKKKV

SEQ ID NO: 530342 - protein, 9 aa, Homo Sapiens
AERFLAKTY

SEQ ID NO: 530343 - protein, 9 aa, Homo Sapiens
MGMALHKKA

SEQ ID NO: 530344 - protein, 9 aa, Homo Sapiens
MVVFGTMFF

SEQ ID NO: 530345 - protein, 9 aa, Homo Sapiens
LIAISRPLC

SEQ ID NO: 530346 - protein, 9 aa, Homo Sapiens
CRNEKMEVS

SEQ ID NO: 530347 - protein, 9 aa, Homo Sapiens
IIWTLFSTP

SEQ ID NO: 530348 - protein, 9 aa, Homo Sapiens
LLTWRPPWA

SEQ ID NO: 530349 - protein, 9 aa, Homo Sapiens
DIQKKQLIN

SEQ ID NO: 530350 - protein, 9 aa, Homo Sapiens
CVFIYIWPF

SEQ ID NO: 530351 - protein, 9 aa, Homo Sapiens
IGAVNLKYS

SEQ ID NO: 530352 - protein, 9 aa, Homo Sapiens
LRNPAVTSP

SEQ ID NO: 530353 - protein, 9 aa, Homo Sapiens
ECGEKPDMH

SEQ ID NO: 530354 - protein, 9 aa, Homo Sapiens
FTVFWNVFA

SEQ ID NO: 530355 - protein, 9 aa, Homo Sapiens
GDMVNVEIQ

SEQ ID NO: 530356 - protein, 9 aa, Homo Sapiens
VRECARSRG

SEQ ID NO: 530357 - protein, 9 aa, Homo Sapiens
NGTKLLPTN

SEQ ID NO: 530358 - protein, 9 aa, Homo Sapiens
GVSRSVTIT

SEQ ID NO: 530359 - protein, 9 aa, Homo Sapiens
QVLDRYHCF

SEQ ID NO: 530360 - protein, 9 aa, Homo Sapiens
TLWEREGEE

SEQ ID NO: 530361 - protein, 9 aa, Homo Sapiens
PLNNSSPGD

SEQ ID NO: 530362 - protein, 9 aa, Homo Sapiens
VGDLPEDPQ

SEQ ID NO: 530363 - protein, 9 aa, Homo Sapiens
TVKLWSLPK

SEQ ID NO: 530364 - protein, 9 aa, Homo Sapiens
NVPDMVLYS

SEQ ID NO: 530365 - protein, 9 aa, Homo Sapiens
LTSNQQHAR

SEQ ID NO: 530366 - protein, 9 aa, Homo Sapiens
QHLQRRKNS

SEQ ID NO: 530367 - protein, 9 aa, Homo Sapiens
LASTLQPTP

SEQ ID NO: 530368 - protein, 9 aa, Homo Sapiens
PEQDNWESG

SEQ ID NO: 530369 - protein, 9 aa, Homo Sapiens
VFLPLSPAV

SEQ ID NO: 530370 - protein, 9 aa, Homo Sapiens
FKSAHMPVI

SEQ ID NO: 530371 - protein, 9 aa, Homo Sapiens
WALWPRGAR

SEQ ID NO: 530372 - protein, 9 aa, Homo Sapiens
PVNDKREQK

SEQ ID NO: 530373 - protein, 9 aa, Homo Sapiens
EPFRQGTGV

SEQ ID NO: 530374 - protein, 9 aa, Homo Sapiens
GIGGATNLY

SEQ ID NO: 530375 - protein, 9 aa, Homo Sapiens
RVMEEKIAH

SEQ ID NO: 530376 - protein, 9 aa, Homo Sapiens
TDMSKAPLH

SEQ ID NO: 530377 - protein, 9 aa, Homo Sapiens
GISSWKKAV

SEQ ID NO: 530378 - protein, 9 aa, Homo Sapiens
APPREVGEK

SEQ ID NO: 530379 - protein, 9 aa, Homo Sapiens
HITNNTNKT

SEQ ID NO: 530380 - protein, 9 aa, Homo Sapiens
GFIANNGTQ

SEQ ID NO: 530381 - protein, 9 aa, Homo Sapiens
TFPAPWWGQ

SEQ ID NO: 530382 - protein, 9 aa, Homo Sapiens
CYEAACNRL

SEQ ID NO: 530383 - protein, 9 aa, Homo Sapiens
VQVIYTQLS

SEQ ID NO: 530384 - protein, 9 aa, Homo Sapiens
ESSVDCPTF

SEQ ID NO: 530385 - protein, 9 aa, Homo Sapiens
ISISAYTMP

SEQ ID NO: 530386 - protein, 9 aa, Homo Sapiens
KEGRREPRS

SEQ ID NO: 530387 - protein, 9 aa, Homo Sapiens
KFKDDLFWK

SEQ ID NO: 530388 - protein, 9 aa, Homo Sapiens
HHREFWFDL

SEQ ID NO: 530389 - protein, 9 aa, Homo Sapiens
VQETLHSHG

SEQ ID NO: 530390 - protein, 9 aa, Homo Sapiens
FGKSIPRIA

SEQ ID NO: 530391 - protein, 9 aa, Homo Sapiens
TDMGCFTFL

SEQ ID NO: 530392 - protein, 9 aa, Homo Sapiens
NNRQVCMLA

SEQ ID NO: 530393 - protein, 9 aa, Homo Sapiens
PSMEEDTLG

SEQ ID NO: 530394 - protein, 9 aa, Homo Sapiens
TERSRSLKR

SEQ ID NO: 530395 - protein, 9 aa, Homo Sapiens
PTTEVRWFF

SEQ ID NO: 530396 - protein, 9 aa, Homo Sapiens
KDDLFWKYV

SEQ ID NO: 530397 - protein, 9 aa, Homo Sapiens
RYHCFKELS

SEQ ID NO: 530398 - protein, 9 aa, Homo Sapiens
SSDSESSLD

SEQ ID NO: 530399 - protein, 9 aa, Homo Sapiens
EAGLDPSQQ

SEQ ID NO: 530400 - protein, 9 aa, Homo Sapiens
LGLWINGEL

SEQ ID NO: 530401 - protein, 9 aa, Homo Sapiens
WFCLLPFPR

SEQ ID NO: 530402 - protein, 9 aa, Homo Sapiens
LSEKWLDLV

SEQ ID NO: 530403 - protein, 9 aa, Homo Sapiens
PREGRRRRV

SEQ ID NO: 530404 - protein, 9 aa, Homo Sapiens
STGFPKAAK

SEQ ID NO: 530405 - protein, 9 aa, Homo Sapiens
PPWASVTGY

SEQ ID NO: 530406 - protein, 9 aa, Homo Sapiens
ASDDCKLPH

SEQ ID NO: 530407 - protein, 9 aa, Homo Sapiens
SIPMSPVRP

SEQ ID NO: 530408 - protein, 9 aa, Homo Sapiens
ITREAISRI

SEQ ID NO: 530409 - protein, 9 aa, Homo Sapiens
EKLRRAAKE

SEQ ID NO: 530410 - protein, 9 aa, Homo Sapiens
KDSLEYLDG

SEQ ID NO: 530411 - protein, 9 aa, Homo Sapiens
CHPLQYLAI

SEQ ID NO: 530412 - protein, 9 aa, Homo Sapiens
PGPSPHSFH

SEQ ID NO: 530413 - protein, 9 aa, Homo Sapiens
TCFATQRQC

SEQ ID NO: 530414 - protein, 9 aa, Homo Sapiens
PLRPWCRPI

SEQ ID NO: 530415 - protein, 9 aa, Homo Sapiens
PGRALYLLA

SEQ ID NO: 530416 - protein, 9 aa, Homo Sapiens
FRVGASDCG

SEQ ID NO: 530417 - protein, 9 aa, Homo Sapiens
SCNLEEPKH

SEQ ID NO: 530418 - protein, 9 aa, Homo Sapiens
IFQYYEKEV

SEQ ID NO: 530419 - protein, 9 aa, Homo Sapiens
GQLAVILAA

SEQ ID NO: 530420 - protein, 9 aa, Homo Sapiens
CPPDPSPRG

SEQ ID NO: 530421 - protein, 9 aa, Homo Sapiens
LEEVQLTPS

SEQ ID NO: 530422 - protein, 9 aa, Homo Sapiens
PSTNVRSTD

SEQ ID NO: 530423 - protein, 9 aa, Homo Sapiens
PYLLKRHHA

SEQ ID NO: 530424 - protein, 9 aa, Homo Sapiens
VLEEDHELF

SEQ ID NO: 530425 - protein, 9 aa, Homo Sapiens
FSPLQKVML

SEQ ID NO: 530426 - protein, 9 aa, Homo Sapiens
EHDHYPESQ

SEQ ID NO: 530427 - protein, 9 aa, Homo Sapiens
RQPCKKVSA

SEQ ID NO: 530428 - protein, 9 aa, Homo Sapiens
GLCGQLAVI

SEQ ID NO: 530429 - protein, 9 aa, Homo Sapiens
ERIHINGQP

SEQ ID NO: 530430 - protein, 9 aa, Homo Sapiens
GRLYAWGER

SEQ ID NO: 530431 - protein, 9 aa, Homo Sapiens
TKQNLVICR

SEQ ID NO: 530432 - protein, 9 aa, Homo Sapiens
NPLVTLGAI

SEQ ID NO: 530433 - protein, 9 aa, Homo Sapiens
LEGQAKGVE

SEQ ID NO: 530434 - protein, 9 aa, Homo Sapiens
DSVERNTTS

SEQ ID NO: 530435 - protein, 9 aa, Homo Sapiens
GERPHWEMS

SEQ ID NO: 530436 - protein, 9 aa, Homo Sapiens
RIDTACICT

SEQ ID NO: 530437 - protein, 9 aa, Homo Sapiens
EATHNEWYD

SEQ ID NO: 530438 - protein, 9 aa, Homo Sapiens
STLQPTPLP

SEQ ID NO: 530439 - protein, 9 aa, Homo Sapiens
LRIHFGTKG

SEQ ID NO: 530440 - protein, 9 aa, Homo Sapiens
EQDNWESGL

SEQ ID NO: 530441 - protein, 9 aa, Homo Sapiens
IMRRHVRSF

SEQ ID NO: 530442 - protein, 9 aa, Homo Sapiens
PTGEPILPR

SEQ ID NO: 530443 - protein, 9 aa, Homo Sapiens
RNRSLSDSD

SEQ ID NO: 530444 - protein, 9 aa, Homo Sapiens
GGFGTAGGF

SEQ ID NO: 530445 - protein, 9 aa, Homo Sapiens
WHWQPWTPC

SEQ ID NO: 530446 - protein, 9 aa, Homo Sapiens
VDMTLPSSY

SEQ ID NO: 530447 - protein, 9 aa, Homo Sapiens
LTGMGLSSF

SEQ ID NO: 530448 - protein, 9 aa, Homo Sapiens
KEPLRPWCR

SEQ ID NO: 530449 - protein, 9 aa, Homo Sapiens
GPGGTLAHA

SEQ ID NO: 530450 - protein, 9 aa, Homo Sapiens
YHIPHLVCS

SEQ ID NO: 530451 - protein, 9 aa, Homo Sapiens
RCMPGARYT

SEQ ID NO: 530452 - protein, 9 aa, Homo Sapiens
IPTLDSLTP

SEQ ID NO: 530453 - protein, 9 aa, Homo Sapiens
ADLQAKAVE

SEQ ID NO: 530454 - protein, 9 aa, Homo Sapiens
EKMKKCRNE

SEQ ID NO: 530455 - protein, 9 aa, Homo Sapiens
FLMGINRTE

SEQ ID NO: 530456 - protein, 9 aa, Homo Sapiens
RRCTQRYFM

SEQ ID NO: 530457 - protein, 9 aa, Homo Sapiens
PSGPASGPT

SEQ ID NO: 530458 - protein, 9 aa, Homo Sapiens
IDLDVAGTK

SEQ ID NO: 530459 - protein, 9 aa, Homo Sapiens
PSFKDGDCE

SEQ ID NO: 530460 - protein, 9 aa, Homo Sapiens
HRRIHMGEK

SEQ ID NO: 530461 - protein, 9 aa, Homo Sapiens
DGHSGMPLC

SEQ ID NO: 530462 - protein, 9 aa, Homo Sapiens
LLHLHPTGK

SEQ ID NO: 530463 - protein, 9 aa, Homo Sapiens
KLLPTNDPL

SEQ ID NO: 530464 - protein, 9 aa, Homo Sapiens
GHSGMPLCC

SEQ ID NO: 530465 - protein, 9 aa, Homo Sapiens
HQSSYLKIH

SEQ ID NO: 530466 - protein, 9 aa, Homo Sapiens
DEETLTLAN

SEQ ID NO: 530467 - protein, 9 aa, Homo Sapiens
GPTGLPGAP

SEQ ID NO: 530468 - protein, 9 aa, Homo Sapiens
TKAAVRRVV

SEQ ID NO: 530469 - protein, 9 aa, Homo Sapiens
CGFPPFHSP

SEQ ID NO: 530470 - protein, 9 aa, Homo Sapiens
MVLAYRPGL

SEQ ID NO: 530471 - protein, 9 aa, Homo Sapiens
LQNAIAGNP

SEQ ID NO: 530472 - protein, 9 aa, Homo Sapiens
ELFLTFSFL

SEQ ID NO: 530473 - protein, 9 aa, Homo Sapiens
DVCGISSWK

SEQ ID NO: 530474 - protein, 9 aa, Homo Sapiens
AASSGAWAL

SEQ ID NO: 530475 - protein, 9 aa, Homo Sapiens
FGTAGGFGG

SEQ ID NO: 530476 - protein, 9 aa, Homo Sapiens
EARGAGAMS

SEQ ID NO: 530477 - protein, 9 aa, Homo Sapiens
VPHAPDAVQ

SEQ ID NO: 530478 - protein, 9 aa, Homo Sapiens
GRSTGDEGP

SEQ ID NO: 530479 - protein, 9 aa, Homo Sapiens
GSSQPEAGA

SEQ ID NO: 530480 - protein, 9 aa, Homo Sapiens
INALAHSKR

SEQ ID NO: 530481 - protein, 9 aa, Homo Sapiens
LLGHRQRKS

SEQ ID NO: 530482 - protein, 9 aa, Homo Sapiens
VDSEATHNE

SEQ ID NO: 530483 - protein, 9 aa, Homo Sapiens
ELSQGFARL

SEQ ID NO: 530484 - protein, 9 aa, Homo Sapiens
DSLQEVLLD

SEQ ID NO: 530485 - protein, 9 aa, Homo Sapiens
ILVAINPFQ

SEQ ID NO: 530486 - protein, 9 aa, Homo Sapiens
STDMGCFTF

SEQ ID NO: 530487 - protein, 9 aa, Homo Sapiens
ASLCVRCSC

SEQ ID NO: 530488 - protein, 9 aa, Homo Sapiens
ATGICILTN

SEQ ID NO: 530489 - protein, 9 aa, Homo Sapiens
NNPRRYDSD

SEQ ID NO: 530490 - protein, 9 aa, Homo Sapiens
LSNVETWHK

SEQ ID NO: 530491 - protein, 9 aa, Homo Sapiens
ELRTCSSPE

SEQ ID NO: 530492 - protein, 9 aa, Homo Sapiens
SATHIVYPL

SEQ ID NO: 530493 - protein, 9 aa, Homo Sapiens
QLQFFQDIS

SEQ ID NO: 530494 - protein, 9 aa, Homo Sapiens
TNLYRQSAM

SEQ ID NO: 530495 - protein, 9 aa, Homo Sapiens
RSRERERHQ

SEQ ID NO: 530496 - protein, 9 aa, Homo Sapiens
CEVLPGEIV

SEQ ID NO: 530497 - protein, 9 aa, Homo Sapiens
SMLTMNPVS

SEQ ID NO: 530498 - protein, 9 aa, Homo Sapiens
SPHNVPDED

SEQ ID NO: 530499 - protein, 9 aa, Homo Sapiens
AREMWRSAS

SEQ ID NO: 530500 - protein, 9 aa, Homo Sapiens
VRERIHING

SEQ ID NO: 530501 - protein, 9 aa, Homo Sapiens
HYRIDLDVA

SEQ ID NO: 530502 - protein, 9 aa, Homo Sapiens
TREAISRIC

SEQ ID NO: 530503 - protein, 9 aa, Homo Sapiens
PSQQPKQKV

SEQ ID NO: 530504 - protein, 9 aa, Homo Sapiens
VQEQVCARL

SEQ ID NO: 530505 - protein, 9 aa, Homo Sapiens
VGKQSEQQK

SEQ ID NO: 530506 - protein, 9 aa, Homo Sapiens
RKQLAIKAA

SEQ ID NO: 530507 - protein, 9 aa, Homo Sapiens
SFKGHLPKV

SEQ ID NO: 530508 - protein, 9 aa, Homo Sapiens
SRPAVVLIR

SEQ ID NO: 530509 - protein, 9 aa, Homo Sapiens
CIFVELQFT

SEQ ID NO: 530510 - protein, 9 aa, Homo Sapiens
VFHTITESG

SEQ ID NO: 530511 - protein, 9 aa, Homo Sapiens
ENCSQVCPP

SEQ ID NO: 530512 - protein, 9 aa, Homo Sapiens
KFFSPLQKV

SEQ ID NO: 530513 - protein, 9 aa, Homo Sapiens
HILKLPSFE

SEQ ID NO: 530514 - protein, 9 aa, Homo Sapiens
HQGLVEELE

SEQ ID NO: 530515 - protein, 9 aa, Homo Sapiens
IPMHDSPSP

SEQ ID NO: 530516 - protein, 9 aa, Homo Sapiens
RIGKMPVYD

SEQ ID NO: 530517 - protein, 9 aa, Homo Sapiens
EAGAGGVAS

SEQ ID NO: 530518 - protein, 9 aa, Homo Sapiens
AHSKRKNQH

SEQ ID NO: 530519 - protein, 9 aa, Homo Sapiens
NREQKNNLQ

SEQ ID NO: 530520 - protein, 9 aa, Homo Sapiens
AQSLLPTVC

SEQ ID NO: 530521 - protein, 9 aa, Homo Sapiens
QDSVERNTT

SEQ ID NO: 530522 - protein, 9 aa, Homo Sapiens
VWRSPLGGE

SEQ ID NO: 530523 - protein, 9 aa, Homo Sapiens
PGSLKTEAD

SEQ ID NO: 530524 - protein, 9 aa, Homo Sapiens
GPRTPHRVL

SEQ ID NO: 530525 - protein, 9 aa, Homo Sapiens
LTSTGTNTN

SEQ ID NO: 530526 - protein, 9 aa, Homo Sapiens
GRRWLKGGV

SEQ ID NO: 530527 - protein, 9 aa, Homo Sapiens
HREAALEAA

SEQ ID NO: 530528 - protein, 9 aa, Homo Sapiens
APVPIDDSF

SEQ ID NO: 530529 - protein, 9 aa, Homo Sapiens
SLELMNQLV

SEQ ID NO: 530530 - protein, 9 aa, Homo Sapiens
AGAGGVASQ

SEQ ID NO: 530531 - protein, 9 aa, Homo Sapiens
RIDLDVAGT

SEQ ID NO: 530532 - protein, 9 aa, Homo Sapiens
IAGYARNFW

SEQ ID NO: 530533 - protein, 9 aa, Homo Sapiens
GEHGEKGDR

SEQ ID NO: 530534 - protein, 9 aa, Homo Sapiens
DVFLYNANR

SEQ ID NO: 530535 - protein, 9 aa, Homo Sapiens
NNHLYGTSI

SEQ ID NO: 530536 - protein, 9 aa, Homo Sapiens
EKMKMFIPN

SEQ ID NO: 530537 - protein, 9 aa, Homo Sapiens
RSMRKGIMA

SEQ ID NO: 530538 - protein, 9 aa, Homo Sapiens
TYFYTNEAK

SEQ ID NO: 530539 - protein, 9 aa, Homo Sapiens
VVQTMTEER

SEQ ID NO: 530540 - protein, 9 aa, Homo Sapiens
AVCHPMKAL

SEQ ID NO: 530541 - protein, 9 aa, Homo Sapiens
DSGARPVIW

SEQ ID NO: 530542 - protein, 9 aa, Homo Sapiens
EPVNDKREQ

SEQ ID NO: 530543 - protein, 9 aa, Homo Sapiens
CMYVRCMPG

SEQ ID NO: 530544 - protein, 9 aa, Homo Sapiens
QFGPPEDMP

SEQ ID NO: 530545 - protein, 9 aa, Homo Sapiens
APRPRSAVP

SEQ ID NO: 530546 - protein, 9 aa, Homo Sapiens
WRVDMTLPS

SEQ ID NO: 530547 - protein, 9 aa, Homo Sapiens
GSLKTEADV

SEQ ID NO: 530548 - protein, 9 aa, Homo Sapiens
PLHMPGLEY

SEQ ID NO: 530549 - protein, 9 aa, Homo Sapiens
QTCSWVLVF

SEQ ID NO: 530550 - protein, 9 aa, Homo Sapiens
GLDPSQQPK

SEQ ID NO: 530551 - protein, 9 aa, Homo Sapiens
TSPEAPPAL

SEQ ID NO: 530552 - protein, 9 aa, Homo Sapiens
SLTRFATAH

SEQ ID NO: 530553 - protein, 9 aa, Homo Sapiens
NSIPMSPVR

SEQ ID NO: 530554 - protein, 9 aa, Homo Sapiens
TCQVQTSYV

SEQ ID NO: 530555 - protein, 9 aa, Homo Sapiens
TFKCVGVPS

SEQ ID NO: 530556 - protein, 9 aa, Homo Sapiens
ATISTSPVL

SEQ ID NO: 530557 - protein, 9 aa, Homo Sapiens
CHPMKALDF

SEQ ID NO: 530558 - protein, 9 aa, Homo Sapiens
VKSKEKKSE

SEQ ID NO: 530559 - protein, 9 aa, Homo Sapiens
IEAELHQLL

SEQ ID NO: 530560 - protein, 9 aa, Homo Sapiens
RKERVKSKE

SEQ ID NO: 530561 - protein, 9 aa, Homo Sapiens
LKYHYQWCQ

SEQ ID NO: 530562 - protein, 9 aa, Homo Sapiens
EENKAREQR

SEQ ID NO: 530563 - protein, 9 aa, Homo Sapiens
SFDSLEKMK

SEQ ID NO: 530564 - protein, 9 aa, Homo Sapiens
SDLNFLFIH

SEQ ID NO: 530565 - protein, 9 aa, Homo Sapiens
DCPTFLDKD

SEQ ID NO: 530566 - protein, 9 aa, Homo Sapiens
VHALVRLAC

SEQ ID NO: 530567 - protein, 9 aa, Homo Sapiens
YLDFTNPKA

SEQ ID NO: 530568 - protein, 9 aa, Homo Sapiens
MEEDTLGNF

SEQ ID NO: 530569 - protein, 9 aa, Homo Sapiens
QGPASDESS

SEQ ID NO: 530570 - protein, 9 aa, Homo Sapiens
IGRKVFTKA

SEQ ID NO: 530571 - protein, 9 aa, Homo Sapiens
RTPHRVLGP

SEQ ID NO: 530572 - protein, 9 aa, Homo Sapiens
YTWTPVNDT

SEQ ID NO: 530573 - protein, 9 aa, Homo Sapiens
RKVYQAVQH

SEQ ID NO: 530574 - protein, 9 aa, Homo Sapiens
LCATFANHS

SEQ ID NO: 530575 - protein, 9 aa, Homo Sapiens
RGAGAMSGL

SEQ ID NO: 530576 - protein, 9 aa, Homo Sapiens
MILGGNNPL

SEQ ID NO: 530577 - protein, 9 aa, Homo Sapiens
ALETDLYKW

SEQ ID NO: 530578 - protein, 9 aa, Homo Sapiens
RAAPHRIIL

SEQ ID NO: 530579 - protein, 9 aa, Homo Sapiens
PVSIVVTTS

SEQ ID NO: 530580 - protein, 9 aa, Homo Sapiens
SEGSSQPEA

SEQ ID NO: 530581 - protein, 9 aa, Homo Sapiens
SDSESSLDS

SEQ ID NO: 530582 - protein, 9 aa, Homo Sapiens
VPKMTFNYL

SEQ ID NO: 530583 - protein, 9 aa, Homo Sapiens
GAQDGVSSL

SEQ ID NO: 530584 - protein, 9 aa, Homo Sapiens
YGARVACSE

SEQ ID NO: 530585 - protein, 9 aa, Homo Sapiens
PIWCGPLPS

SEQ ID NO: 530586 - protein, 9 aa, Homo Sapiens
GNKENGADV

SEQ ID NO: 530587 - protein, 9 aa, Homo Sapiens
GVVAAMEQL

SEQ ID NO: 530588 - protein, 9 aa, Homo Sapiens
QLKKKCQQL

SEQ ID NO: 530589 - protein, 9 aa, Homo Sapiens
WGTAPWVEE

SEQ ID NO: 530590 - protein, 9 aa, Homo Sapiens
DMTLPSSYH

SEQ ID NO: 530591 - protein, 9 aa, Homo Sapiens
AMKEVLVQV

SEQ ID NO: 530592 - protein, 9 aa, Homo Sapiens
LVLDLELLR

SEQ ID NO: 530593 - protein, 9 aa, Homo Sapiens
TVHHGFPYQ

SEQ ID NO: 530594 - protein, 9 aa, Homo Sapiens
KALRIHFGT

SEQ ID NO: 530595 - protein, 9 aa, Homo Sapiens
SQMGTAEEF

SEQ ID NO: 530596 - protein, 9 aa, Homo Sapiens
LQHIIAGVD

SEQ ID NO: 530597 - protein, 9 aa, Homo Sapiens
LATEQLLTA

SEQ ID NO: 530598 - protein, 9 aa, Homo Sapiens
DHYPESQML

SEQ ID NO: 530599 - protein, 9 aa, Homo Sapiens
SVMRYLTSH

SEQ ID NO: 530600 - protein, 9 aa, Homo Sapiens
IGPPGEHGE

SEQ ID NO: 530601 - protein, 9 aa, Homo Sapiens
DHYVQCSAY

SEQ ID NO: 530602 - protein, 9 aa, Homo Sapiens
KIDEYMHNF

SEQ ID NO: 530603 - protein, 9 aa, Homo Sapiens
DRPCTLTST

SEQ ID NO: 530604 - protein, 9 aa, Homo Sapiens
VWSSLRLLN

SEQ ID NO: 530605 - protein, 9 aa, Homo Sapiens
RRMRRLANM

SEQ ID NO: 530606 - protein, 9 aa, Homo Sapiens
APSADSWVW

SEQ ID NO: 530607 - protein, 9 aa, Homo Sapiens
FRVQLISRK

SEQ ID NO: 530608 - protein, 9 aa, Homo Sapiens
EPSTPWRSR

SEQ ID NO: 530609 - protein, 9 aa, Homo Sapiens
LEEAAQERD

SEQ ID NO: 530610 - protein, 9 aa, Homo Sapiens
LEGAPHTLP

SEQ ID NO: 530611 - protein, 9 aa, Homo Sapiens
LDSENAVLY

SEQ ID NO: 530612 - protein, 9 aa, Homo Sapiens
TMNLYEGHI

SEQ ID NO: 530613 - protein, 9 aa, Homo Sapiens
KDEDTFDWL

SEQ ID NO: 530614 - protein, 9 aa, Homo Sapiens
WQREPQQQL

SEQ ID NO: 530615 - protein, 9 aa, Homo Sapiens
KGFREQQAM

SEQ ID NO: 530616 - protein, 9 aa, Homo Sapiens
KEVLVQVEV

SEQ ID NO: 530617 - protein, 9 aa, Homo Sapiens
SSPEDIAQF

SEQ ID NO: 530618 - protein, 9 aa, Homo Sapiens
IDTTKQNLV

SEQ ID NO: 530619 - protein, 9 aa, Homo Sapiens
VPSSNIQQH

SEQ ID NO: 530620 - protein, 9 aa, Homo Sapiens
KTYSTKDQQ

SEQ ID NO: 530621 - protein, 9 aa, Homo Sapiens
SYLAAATIS

SEQ ID NO: 530622 - protein, 9 aa, Homo Sapiens
ASDCGSPAL

SEQ ID NO: 530623 - protein, 9 aa, Homo Sapiens
QSNVMFDIS

SEQ ID NO: 530624 - protein, 9 aa, Homo Sapiens
DDRPCTLTS

SEQ ID NO: 530625 - protein, 9 aa, Homo Sapiens
REAISRICE

SEQ ID NO: 530626 - protein, 9 aa, Homo Sapiens
TPVNDTDYS

SEQ ID NO: 530627 - protein, 9 aa, Homo Sapiens
SLLYVARLR

SEQ ID NO: 530628 - protein, 9 aa, Homo Sapiens
HEPFRQGTG

SEQ ID NO: 530629 - protein, 9 aa, Homo Sapiens
MNIRQSPTL

SEQ ID NO: 530630 - protein, 9 aa, Homo Sapiens
LQAKAVELE

SEQ ID NO: 530631 - protein, 9 aa, Homo Sapiens
FVKDLRIHK

SEQ ID NO: 530632 - protein, 9 aa, Homo Sapiens
RLWEKEKVQ

SEQ ID NO: 530633 - protein, 9 aa, Homo Sapiens
GPCRGLGAP

SEQ ID NO: 530634 - protein, 9 aa, Homo Sapiens
WPGRALYLL

SEQ ID NO: 530635 - protein, 9 aa, Homo Sapiens
LISLERQFQ

SEQ ID NO: 530636 - protein, 9 aa, Homo Sapiens
TQLALALSR

SEQ ID NO: 530637 - protein, 9 aa, Homo Sapiens
CDTFCAGAV

SEQ ID NO: 530638 - protein, 9 aa, Homo Sapiens
PETLNEAKP

SEQ ID NO: 530639 - protein, 9 aa, Homo Sapiens
MWAITCFAT

SEQ ID NO: 530640 - protein, 9 aa, Homo Sapiens
ICRGPDGHF

SEQ ID NO: 530641 - protein, 9 aa, Homo Sapiens
FQRALELSC

SEQ ID NO: 530642 - protein, 9 aa, Homo Sapiens
TTAEFLVYQ

SEQ ID NO: 530643 - protein, 9 aa, Homo Sapiens
ASSLLYVAR

SEQ ID NO: 530644 - protein, 9 aa, Homo Sapiens
TRKMVTVGE

SEQ ID NO: 530645 - protein, 9 aa, Homo Sapiens
FLSCNLEEP

SEQ ID NO: 530646 - protein, 9 aa, Homo Sapiens
VQLQHIIAG

SEQ ID NO: 530647 - protein, 9 aa, Homo Sapiens
KALNQTKYI

SEQ ID NO: 530648 - protein, 9 aa, Homo Sapiens
LFKWQYENH

SEQ ID NO: 530649 - protein, 9 aa, Homo Sapiens
TCEKRRTWG

SEQ ID NO: 530650 - protein, 9 aa, Homo Sapiens
EIKMWAITC

SEQ ID NO: 530651 - protein, 9 aa, Homo Sapiens
IDEYMHNFS

SEQ ID NO: 530652 - protein, 9 aa, Homo Sapiens
SPPSGDLQL

SEQ ID NO: 530653 - protein, 9 aa, Homo Sapiens
EGASFKGHL

SEQ ID NO: 530654 - protein, 9 aa, Homo Sapiens
PRWGNPCAL

SEQ ID NO: 530655 - protein, 9 aa, Homo Sapiens
DSSMDIFHL

SEQ ID NO: 530656 - protein, 9 aa, Homo Sapiens
TQHMSLMRH

SEQ ID NO: 530657 - protein, 9 aa, Homo Sapiens
QDMFLCCGK

SEQ ID NO: 530658 - protein, 9 aa, Homo Sapiens
PKNTDWTTA

SEQ ID NO: 530659 - protein, 9 aa, Homo Sapiens
HLARVENVL

SEQ ID NO: 530660 - protein, 9 aa, Homo Sapiens
LAVTMTQEA

SEQ ID NO: 530661 - protein, 9 aa, Homo Sapiens
HSKRKNQHI

SEQ ID NO: 530662 - protein, 9 aa, Homo Sapiens
GFGTAGGFG

SEQ ID NO: 530663 - protein, 9 aa, Homo Sapiens
GPASDESSY

SEQ ID NO: 530664 - protein, 9 aa, Homo Sapiens
CICTLLSRT

SEQ ID NO: 530665 - protein, 9 aa, Homo Sapiens
HIIAGVDIV

SEQ ID NO: 530666 - protein, 9 aa, Homo Sapiens
GRGKQHATK

SEQ ID NO: 530667 - protein, 9 aa, Homo Sapiens
PVVTLFDAH

SEQ ID NO: 530668 - protein, 9 aa, Homo Sapiens
GRQGPASDE

SEQ ID NO: 530669 - protein, 9 aa, Homo Sapiens
SSEEKTQHM

SEQ ID NO: 530670 - protein, 9 aa, Homo Sapiens
RCTAQQKGL

SEQ ID NO: 530671 - protein, 9 aa, Homo Sapiens
EKRRTWGLS

SEQ ID NO: 530672 - protein, 9 aa, Homo Sapiens
ELRRRRRSL

SEQ ID NO: 530673 - protein, 9 aa, Homo Sapiens
LMGVCKQGL

SEQ ID NO: 530674 - protein, 9 aa, Homo Sapiens
AADACYEAA

SEQ ID NO: 530675 - protein, 9 aa, Homo Sapiens
HSGHTPYKC

SEQ ID NO: 530676 - protein, 9 aa, Homo Sapiens
DRKCFLCKA

SEQ ID NO: 530677 - protein, 9 aa, Homo Sapiens
WKKAVEAKC

SEQ ID NO: 530678 - protein, 9 aa, Homo Sapiens
FYTNEAKCD

SEQ ID NO: 530679 - protein, 9 aa, Homo Sapiens
AYFFNNPRR

SEQ ID NO: 530680 - protein, 9 aa, Homo Sapiens
QWEQMEVLK

SEQ ID NO: 530681 - protein, 9 aa, Homo Sapiens
QTSGETMHT

SEQ ID NO: 530682 - protein, 9 aa, Homo Sapiens
EVPSSNIQQ

SEQ ID NO: 530683 - protein, 9 aa, Homo Sapiens
QPSITSQHH

SEQ ID NO: 530684 - protein, 9 aa, Homo Sapiens
LEAENTPME

SEQ ID NO: 530685 - protein, 9 aa, Homo Sapiens
GDTERTQLA

SEQ ID NO: 530686 - protein, 9 aa, Homo Sapiens
ELEVIDTTK

SEQ ID NO: 530687 - protein, 9 aa, Homo Sapiens
SISGFRVDG

SEQ ID NO: 530688 - protein, 9 aa, Homo Sapiens
DINTFCLSA

SEQ ID NO: 530689 - protein, 9 aa, Homo Sapiens
SQFINTRCA

SEQ ID NO: 530690 - protein, 9 aa, Homo Sapiens
PPPHPPPPV

SEQ ID NO: 530691 - protein, 9 aa, Homo Sapiens
ENELGITLV

SEQ ID NO: 530692 - protein, 9 aa, Homo Sapiens
DLIEEQYKA

SEQ ID NO: 530693 - protein, 9 aa, Homo Sapiens
AQALEEVGD

SEQ ID NO: 530694 - protein, 9 aa, Homo Sapiens
NRASRALDD

SEQ ID NO: 530695 - protein, 9 aa, Homo Sapiens
ELGITLVVS

SEQ ID NO: 530696 - protein, 9 aa, Homo Sapiens
VCGGGGQIW

SEQ ID NO: 530697 - protein, 9 aa, Homo Sapiens
MATLMHQIP

SEQ ID NO: 530698 - protein, 9 aa, Homo Sapiens
EGKSAADAC

SEQ ID NO: 530699 - protein, 9 aa, Homo Sapiens
SLDSENAVL

SEQ ID NO: 530700 - protein, 9 aa, Homo Sapiens
ERFLAKTYS

SEQ ID NO: 530701 - protein, 9 aa, Homo Sapiens
KFTLIGDNT

SEQ ID NO: 530702 - protein, 9 aa, Homo Sapiens
HNEWYDFYL

SEQ ID NO: 530703 - protein, 9 aa, Homo Sapiens
LVAINPFQV

SEQ ID NO: 530704 - protein, 9 aa, Homo Sapiens
LQALRQRSH

SEQ ID NO: 530705 - protein, 9 aa, Homo Sapiens
PQMLNLLLL

SEQ ID NO: 530706 - protein, 9 aa, Homo Sapiens
KESSVDCPT

SEQ ID NO: 530707 - protein, 9 aa, Homo Sapiens
GFREQQAMR

SEQ ID NO: 530708 - protein, 9 aa, Homo Sapiens
VRCSCPGAK

SEQ ID NO: 530709 - protein, 9 aa, Homo Sapiens
VTAATTESG

SEQ ID NO: 530710 - protein, 9 aa, Homo Sapiens
KSEGSSQPE

SEQ ID NO: 530711 - protein, 9 aa, Homo Sapiens
DCTVKLWSL

SEQ ID NO: 530712 - protein, 9 aa, Homo Sapiens
LPLPRRPRK

SEQ ID NO: 530713 - protein, 9 aa, Homo Sapiens
FLDDPIWCG

SEQ ID NO: 530714 - protein, 9 aa, Homo Sapiens
TCWPGRALY

SEQ ID NO: 530715 - protein, 9 aa, Homo Sapiens
RCCCCRHRC

SEQ ID NO: 530716 - protein, 9 aa, Homo Sapiens
QLMILADGR

SEQ ID NO: 530717 - protein, 9 aa, Homo Sapiens
VSCMYVRCM

SEQ ID NO: 530718 - protein, 9 aa, Homo Sapiens
LTLGSLLDN

SEQ ID NO: 530719 - protein, 9 aa, Homo Sapiens
LLSLSGHLA

SEQ ID NO: 530720 - protein, 9 aa, Homo Sapiens
DAPPPHPPP

SEQ ID NO: 530721 - protein, 9 aa, Homo Sapiens
GGTHWRSKK

SEQ ID NO: 530722 - protein, 9 aa, Homo Sapiens
KRCREFVTF

SEQ ID NO: 530723 - protein, 9 aa, Homo Sapiens
GISQVLTRC

SEQ ID NO: 530724 - protein, 9 aa, Homo Sapiens
MAGPLWRTT

SEQ ID NO: 530725 - protein, 9 aa, Homo Sapiens
SQQQGLRRV

SEQ ID NO: 530726 - protein, 9 aa, Homo Sapiens
KVSAAPAIC

SEQ ID NO: 530727 - protein, 9 aa, Homo Sapiens
ALDFVFTPD

SEQ ID NO: 530728 - protein, 9 aa, Homo Sapiens
SVERNTTSE

SEQ ID NO: 530729 - protein, 9 aa, Homo Sapiens
EHQLISLER

SEQ ID NO: 530730 - protein, 9 aa, Homo Sapiens
WNTQKRGES

SEQ ID NO: 530731 - protein, 9 aa, Homo Sapiens
LWSLPKALL

SEQ ID NO: 530732 - protein, 9 aa, Homo Sapiens
RQTFCKIIR

SEQ ID NO: 530733 - protein, 9 aa, Homo Sapiens
SPKVSDTMV

SEQ ID NO: 530734 - protein, 9 aa, Homo Sapiens
YQPPSFKDG

SEQ ID NO: 530735 - protein, 9 aa, Homo Sapiens
GHNKPKITA

SEQ ID NO: 530736 - protein, 9 aa, Homo Sapiens
QEEENKARE

SEQ ID NO: 530737 - protein, 9 aa, Homo Sapiens
EFAACLNKV

SEQ ID NO: 530738 - protein, 9 aa, Homo Sapiens
FKDDLFWKY

SEQ ID NO: 530739 - protein, 9 aa, Homo Sapiens
KLGYDPMEL

SEQ ID NO: 530740 - protein, 9 aa, Homo Sapiens
YTKRMTITS

SEQ ID NO: 530741 - protein, 9 aa, Homo Sapiens
CSQFINTRC

SEQ ID NO: 530742 - protein, 9 aa, Homo Sapiens
PCMLEPVFG

SEQ ID NO: 530743 - protein, 9 aa, Homo Sapiens
QSLLRRHRG

SEQ ID NO: 530744 - protein, 9 aa, Homo Sapiens
AVGPRDIHL

SEQ ID NO: 530745 - protein, 9 aa, Homo Sapiens
ERTWYPLGR

SEQ ID NO: 530746 - protein, 9 aa, Homo Sapiens
EVVKTTSRD

SEQ ID NO: 530747 - protein, 9 aa, Homo Sapiens
SLATCPDPE

SEQ ID NO: 530748 - protein, 9 aa, Homo Sapiens
TFSFLSGFQ

SEQ ID NO: 530749 - protein, 9 aa, Homo Sapiens
LPGESQLSK

SEQ ID NO: 530750 - protein, 9 aa, Homo Sapiens
TYSTKDQQF

SEQ ID NO: 530751 - protein, 9 aa, Homo Sapiens
PLLHLHPTG

SEQ ID NO: 530752 - protein, 9 aa, Homo Sapiens
LPEGASFKG

SEQ ID NO: 530753 - protein, 9 aa, Homo Sapiens
ATCQVQTSY

SEQ ID NO: 530754 - protein, 9 aa, Homo Sapiens
IQKKQLINP

SEQ ID NO: 530755 - protein, 9 aa, Homo Sapiens
SWEAQDSVE

SEQ ID NO: 530756 - protein, 9 aa, Homo Sapiens
MLEPVFGKM

SEQ ID NO: 530757 - protein, 9 aa, Homo Sapiens
LVSTDMGCF

SEQ ID NO: 530758 - protein, 9 aa, Homo Sapiens
TEHQLISLE

SEQ ID NO: 530759 - protein, 9 aa, Homo Sapiens
VHQGLVEEL

SEQ ID NO: 530760 - protein, 9 aa, Homo Sapiens
SMDIFHLEG

SEQ ID NO: 530761 - protein, 9 aa, Homo Sapiens
RIASSSVSH

SEQ ID NO: 530762 - protein, 9 aa, Homo Sapiens
IRCCCCRHR

SEQ ID NO: 530763 - protein, 9 aa, Homo Sapiens
FQYYEKEVR

SEQ ID NO: 530764 - protein, 9 aa, Homo Sapiens
RIHINGQPI

SEQ ID NO: 530765 - protein, 9 aa, Homo Sapiens
AQDGVSSLA

SEQ ID NO: 530766 - protein, 9 aa, Homo Sapiens
DSWVWYMDG

SEQ ID NO: 530767 - protein, 9 aa, Homo Sapiens
ETDLYKWFI

SEQ ID NO: 530768 - protein, 9 aa, Homo Sapiens
GEMKTAERD

SEQ ID NO: 530769 - protein, 9 aa, Homo Sapiens
QSQLSLVVI

SEQ ID NO: 530770 - protein, 9 aa, Homo Sapiens
TERTQLALA

SEQ ID NO: 530771 - protein, 9 aa, Homo Sapiens
CKAPKNTDW

SEQ ID NO: 530772 - protein, 9 aa, Homo Sapiens
WVRDRFWEF

SEQ ID NO: 530773 - protein, 9 aa, Homo Sapiens
PVSPSANAT

SEQ ID NO: 530774 - protein, 9 aa, Homo Sapiens
HSEEYEAEG

SEQ ID NO: 530775 - protein, 9 aa, Homo Sapiens
CLGVLCLNL

SEQ ID NO: 530776 - protein, 9 aa, Homo Sapiens
KAAKEVQEM

SEQ ID NO: 530777 - protein, 9 aa, Homo Sapiens
TGLALTGMG

SEQ ID NO: 530778 - protein, 9 aa, Homo Sapiens
KMFIPNLYL

SEQ ID NO: 530779 - protein, 9 aa, Homo Sapiens
GYNHAVDCW

SEQ ID NO: 530780 - protein, 9 aa, Homo Sapiens
QHQMSFASV

SEQ ID NO: 530781 - protein, 9 aa, Homo Sapiens
GYRLHRHQA

SEQ ID NO: 530782 - protein, 9 aa, Homo Sapiens
TPQMNTPVM

SEQ ID NO: 530783 - protein, 9 aa, Homo Sapiens
FCTQDGQSA

SEQ ID NO: 530784 - protein, 9 aa, Homo Sapiens
ALRIHFGTK

SEQ ID NO: 530785 - protein, 9 aa, Homo Sapiens
IHGNEVAGW

SEQ ID NO: 530786 - protein, 9 aa, Homo Sapiens
LCVRCSCPG

SEQ ID NO: 530787 - protein, 9 aa, Homo Sapiens
RAGTGPVSP

SEQ ID NO: 530788 - protein, 9 aa, Homo Sapiens
GKYRTFSAL

SEQ ID NO: 530789 - protein, 9 aa, Homo Sapiens
TTKLKVFLS

SEQ ID NO: 530790 - protein, 9 aa, Homo Sapiens
SPDCPLLHL

SEQ ID NO: 530791 - protein, 9 aa, Homo Sapiens
PGWALWPRG

SEQ ID NO: 530792 - protein, 9 aa, Homo Sapiens
RVIFNWDGC

SEQ ID NO: 530793 - protein, 9 aa, Homo Sapiens
NELGITLVV

SEQ ID NO: 530794 - protein, 9 aa, Homo Sapiens
PQLMHVTVR

SEQ ID NO: 530795 - protein, 9 aa, Homo Sapiens
PPTPHGKDP

SEQ ID NO: 530796 - protein, 9 aa, Homo Sapiens
FLSGFQESN

SEQ ID NO: 530797 - protein, 9 aa, Homo Sapiens
QHSIESQDN

SEQ ID NO: 530798 - protein, 9 aa, Homo Sapiens
EKLAHFRQA

SEQ ID NO: 530799 - protein, 9 aa, Homo Sapiens
AVTAPGADT

SEQ ID NO: 530800 - protein, 9 aa, Homo Sapiens
GDQATDSSL

SEQ ID NO: 530801 - protein, 9 aa, Homo Sapiens
GGEFGGHNK

SEQ ID NO: 530802 - protein, 9 aa, Homo Sapiens
QSPRNLGSF

SEQ ID NO: 530803 - protein, 9 aa, Homo Sapiens
CILTNWLMA

SEQ ID NO: 530804 - protein, 9 aa, Homo Sapiens
LEKYSFPME

SEQ ID NO: 530805 - protein, 9 aa, Homo Sapiens
DFRFLFIDL

SEQ ID NO: 530806 - protein, 9 aa, Homo Sapiens
SATCQVQTS

SEQ ID NO: 530807 - protein, 9 aa, Homo Sapiens
ADSWVWYMD

SEQ ID NO: 530808 - protein, 9 aa, Homo Sapiens
YFFYRNRPS

SEQ ID NO: 530809 - protein, 9 aa, Homo Sapiens
DERTWYPLG

SEQ ID NO: 530810 - protein, 9 aa, Homo Sapiens
CRSAAYLQH

SEQ ID NO: 530811 - protein, 9 aa, Homo Sapiens
TIRCCCCRH

SEQ ID NO: 530812 - protein, 9 aa, Homo Sapiens
AHYTKRMTI

SEQ ID NO: 530813 - protein, 9 aa, Homo Sapiens
YNHAVDCWS

SEQ ID NO: 530814 - protein, 9 aa, Homo Sapiens
LWMGAEIDE

SEQ ID NO: 530815 - protein, 9 aa, Homo Sapiens
DSATEVTGR

SEQ ID NO: 530816 - protein, 9 aa, Homo Sapiens
LGYTTASPQ

SEQ ID NO: 530817 - protein, 9 aa, Homo Sapiens
LRRHRGSGV

SEQ ID NO: 530818 - protein, 9 aa, Homo Sapiens
DRPGVALEG

SEQ ID NO: 530819 - protein, 9 aa, Homo Sapiens
QMLHLLDII

SEQ ID NO: 530820 - protein, 9 aa, Homo Sapiens
PGCPELSFY

SEQ ID NO: 530821 - protein, 9 aa, Homo Sapiens
LTWRPPWAS

SEQ ID NO: 530822 - protein, 9 aa, Homo Sapiens
DTPSYKRDN

SEQ ID NO: 530823 - protein, 9 aa, Homo Sapiens
VQCSAYCSI

SEQ ID NO: 530824 - protein, 9 aa, Homo Sapiens
CGSSDVDQL

SEQ ID NO: 530825 - protein, 9 aa, Homo Sapiens
SSLLYVARL

SEQ ID NO: 530826 - protein, 9 aa, Homo Sapiens
SFDESCPPD

SEQ ID NO: 530827 - protein, 9 aa, Homo Sapiens
ALDREKIPE

SEQ ID NO: 530828 - protein, 9 aa, Homo Sapiens
VAEPSTSEY

SEQ ID NO: 530829 - protein, 9 aa, Homo Sapiens
GVPRFQFGP

SEQ ID NO: 530830 - protein, 9 aa, Homo Sapiens
SGARPVIWW

SEQ ID NO: 530831 - protein, 9 aa, Homo Sapiens
LSDPSRNNC

SEQ ID NO: 530832 - protein, 9 aa, Homo Sapiens
KKCQQLTAE

SEQ ID NO: 530833 - protein, 9 aa, Homo Sapiens
NVIFVRDHG

SEQ ID NO: 530834 - protein, 9 aa, Homo Sapiens
KNQHQCVQY

SEQ ID NO: 530835 - protein, 9 aa, Homo Sapiens
VFYNKERTH

SEQ ID NO: 530836 - protein, 9 aa, Homo Sapiens
ENAVLYFPQ

SEQ ID NO: 530837 - protein, 9 aa, Homo Sapiens
LRSIRSGRI

SEQ ID NO: 530838 - protein, 9 aa, Homo Sapiens
QAKGVETTG

SEQ ID NO: 530839 - protein, 9 aa, Homo Sapiens
FFQDISDWL

SEQ ID NO: 530840 - protein, 9 aa, Homo Sapiens
DKSEGSSQP

SEQ ID NO: 530841 - protein, 9 aa, Homo Sapiens
WTLFSTPCR

SEQ ID NO: 530842 - protein, 9 aa, Homo Sapiens
DDSFCGLDI

SEQ ID NO: 530843 - protein, 9 aa, Homo Sapiens
SPDKTAPLP

SEQ ID NO: 530844 - protein, 9 aa, Homo Sapiens
TDISAHILK

SEQ ID NO: 530845 - protein, 9 aa, Homo Sapiens
AQDSVERNT

SEQ ID NO: 530846 - protein, 9 aa, Homo Sapiens
TETHTGPLG

SEQ ID NO: 530847 - protein, 9 aa, Homo Sapiens
LSCQETNRE

SEQ ID NO: 530848 - protein, 9 aa, Homo Sapiens
LTKKGEMKT

SEQ ID NO: 530849 - protein, 9 aa, Homo Sapiens
GLLHVTHSL

SEQ ID NO: 530850 - protein, 9 aa, Homo Sapiens
LKNLSNVET

SEQ ID NO: 530851 - protein, 9 aa, Homo Sapiens
AFHQSSYLK

SEQ ID NO: 530852 - protein, 9 aa, Homo Sapiens
GPFWVRKDD

SEQ ID NO: 530853 - protein, 9 aa, Homo Sapiens
RGGVAHLLS

SEQ ID NO: 530854 - protein, 9 aa, Homo Sapiens
NRRKLSLEL

SEQ ID NO: 530855 - protein, 9 aa, Homo Sapiens
RPHWEMSNQ

SEQ ID NO: 530856 - protein, 9 aa, Homo Sapiens
VYIYNRNSW

SEQ ID NO: 530857 - protein, 9 aa, Homo Sapiens
RLLDVNNQC

SEQ ID NO: 530858 - protein, 9 aa, Homo Sapiens
TRGVPETLN

SEQ ID NO: 530859 - protein, 9 aa, Homo Sapiens
WPKNILKQW

SEQ ID NO: 530860 - protein, 9 aa, Homo Sapiens
HLWKELEGL

SEQ ID NO: 530861 - protein, 9 aa, Homo Sapiens
KFNQDLGFH

SEQ ID NO: 530862 - protein, 9 aa, Homo Sapiens
QCEVWGKPR

SEQ ID NO: 530863 - protein, 9 aa, Homo Sapiens
KNLSNVETW

SEQ ID NO: 530864 - protein, 9 aa, Homo Sapiens
DEKLAHFRQ

SEQ ID NO: 530865 - protein, 9 aa, Homo Sapiens
CDANNFVLD

SEQ ID NO: 530866 - protein, 9 aa, Homo Sapiens
EHWKTQHSE

SEQ ID NO: 530867 - protein, 9 aa, Homo Sapiens
TDGALDREK

SEQ ID NO: 530868 - protein, 9 aa, Homo Sapiens
HACHSQQVW

SEQ ID NO: 530869 - protein, 9 aa, Homo Sapiens
DCGCCFSES

SEQ ID NO: 530870 - protein, 9 aa, Homo Sapiens
ALEGAPHTL

SEQ ID NO: 530871 - protein, 9 aa, Homo Sapiens
NLAEIYGWI

SEQ ID NO: 530872 - protein, 9 aa, Homo Sapiens
FQCNSRHMI

SEQ ID NO: 530873 - protein, 9 aa, Homo Sapiens
HYFQCRLGL

SEQ ID NO: 530874 - protein, 9 aa, Homo Sapiens
TETDIKMME

SEQ ID NO: 530875 - protein, 9 aa, Homo Sapiens
FYNKERTHN

SEQ ID NO: 530876 - protein, 9 aa, Homo Sapiens
PLTKKGEMK

SEQ ID NO: 530877 - protein, 9 aa, Homo Sapiens
EMLSLQSRA

SEQ ID NO: 530878 - protein, 9 aa, Homo Sapiens
WVWNIFIVT

SEQ ID NO: 530879 - protein, 9 aa, Homo Sapiens
TMTQEAIDE

SEQ ID NO: 530880 - protein, 9 aa, Homo Sapiens
DTTKQNLVI

SEQ ID NO: 530881 - protein, 9 aa, Homo Sapiens
CFKELSTLR

SEQ ID NO: 530882 - protein, 9 aa, Homo Sapiens
CTQDGQSAQ

SEQ ID NO: 530883 - protein, 9 aa, Homo Sapiens
TLFSTPCRM

SEQ ID NO: 530884 - protein, 9 aa, Homo Sapiens
IQMLRKLFT

SEQ ID NO: 530885 - protein, 9 aa, Homo Sapiens
LEELRTCSS

SEQ ID NO: 530886 - protein, 9 aa, Homo Sapiens
NPYFCLKKV

SEQ ID NO: 530887 - protein, 9 aa, Homo Sapiens
QNFLYILVN

SEQ ID NO: 530888 - protein, 9 aa, Homo Sapiens
SCRTKSSAL

SEQ ID NO: 530889 - protein, 9 aa, Homo Sapiens
ATNLYRQSA

SEQ ID NO: 530890 - protein, 9 aa, Homo Sapiens
RLHRHQAHS

SEQ ID NO: 530891 - protein, 9 aa, Homo Sapiens
EEVGDLPED

SEQ ID NO: 530892 - protein, 9 aa, Homo Sapiens
GPTESPAGS

SEQ ID NO: 530893 - protein, 9 aa, Homo Sapiens
LCYVTVMNT

SEQ ID NO: 530894 - protein, 9 aa, Homo Sapiens
RVGASDCGS

SEQ ID NO: 530895 - protein, 9 aa, Homo Sapiens
RCTQRYFME

SEQ ID NO: 530896 - protein, 9 aa, Homo Sapiens
ALKVVHFVS

SEQ ID NO: 530897 - protein, 9 aa, Homo Sapiens
STGDEGPAA

SEQ ID NO: 530898 - protein, 9 aa, Homo Sapiens
PLICDANNF

SEQ ID NO: 530899 - protein, 9 aa, Homo Sapiens
GMPLCCATL

SEQ ID NO: 530900 - protein, 9 aa, Homo Sapiens
RSQLTSNQQ

SEQ ID NO: 530901 - protein, 9 aa, Homo Sapiens
STEGCCAKP

SEQ ID NO: 530902 - protein, 9 aa, Homo Sapiens
ALEENPYFC

SEQ ID NO: 530903 - protein, 9 aa, Homo Sapiens
KGADLVIMD

SEQ ID NO: 530904 - protein, 9 aa, Homo Sapiens
ESQSLLRRH

SEQ ID NO: 530905 - protein, 9 aa, Homo Sapiens
HQCVQYALK

SEQ ID NO: 530906 - protein, 9 aa, Homo Sapiens
NRAEGRMDG

SEQ ID NO: 530907 - protein, 9 aa, Homo Sapiens
ELARYEPDL

SEQ ID NO: 530908 - protein, 9 aa, Homo Sapiens
LQFFQDISD

SEQ ID NO: 530909 - protein, 9 aa, Homo Sapiens
SLNDLIEEQ

SEQ ID NO: 530910 - protein, 9 aa, Homo Sapiens
TLPPKKKLP

SEQ ID NO: 530911 - protein, 9 aa, Homo Sapiens
RLANMAPAW

SEQ ID NO: 530912 - protein, 9 aa, Homo Sapiens
TTCWPGRAL

SEQ ID NO: 530913 - protein, 9 aa, Homo Sapiens
NFILPEEII

SEQ ID NO: 530914 - protein, 9 aa, Homo Sapiens
ARYYCEVLP

SEQ ID NO: 530915 - protein, 9 aa, Homo Sapiens
RYTDSGARP

SEQ ID NO: 530916 - protein, 9 aa, Homo Sapiens
CARSRGFPD

SEQ ID NO: 530917 - protein, 9 aa, Homo Sapiens
QMNTPVMLN

SEQ ID NO: 530918 - protein, 9 aa, Homo Sapiens
GVVCGGGGQ

SEQ ID NO: 530919 - protein, 9 aa, Homo Sapiens
QQLNIKEIY

SEQ ID NO: 530920 - protein, 9 aa, Homo Sapiens
KQPSGMNIR

SEQ ID NO: 530921 - protein, 9 aa, Homo Sapiens
ADAKKQLAN

SEQ ID NO: 530922 - protein, 9 aa, Homo Sapiens
IGQRLARVQ

SEQ ID NO: 530923 - protein, 9 aa, Homo Sapiens
HLTKQLMIL

SEQ ID NO: 530924 - protein, 9 aa, Homo Sapiens
QFDFAQPQH

SEQ ID NO: 530925 - protein, 9 aa, Homo Sapiens
RPWCRPINA

SEQ ID NO: 530926 - protein, 9 aa, Homo Sapiens
VEIVQSNVM

SEQ ID NO: 530927 - protein, 9 aa, Homo Sapiens
HSMTRQLLH

SEQ ID NO: 530928 - protein, 9 aa, Homo Sapiens
AGGVASQEQ

SEQ ID NO: 530929 - protein, 9 aa, Homo Sapiens
RSLTRFATA

SEQ ID NO: 530930 - protein, 9 aa, Homo Sapiens
LQSQLSLVV

SEQ ID NO: 530931 - protein, 9 aa, Homo Sapiens
LLKKRERQW

SEQ ID NO: 530932 - protein, 9 aa, Homo Sapiens
TTTLQKCFE

SEQ ID NO: 530933 - protein, 9 aa, Homo Sapiens
PPFTQRERF

SEQ ID NO: 530934 - protein, 9 aa, Homo Sapiens
RAGYRLHRH

SEQ ID NO: 530935 - protein, 9 aa, Homo Sapiens
LVVSAQAVV

SEQ ID NO: 530936 - protein, 9 aa, Homo Sapiens
SQQVWRSPL

SEQ ID NO: 530937 - protein, 9 aa, Homo Sapiens
SRSDGRGKQ

SEQ ID NO: 530938 - protein, 9 aa, Homo Sapiens
LLSIAAVVL

SEQ ID NO: 530939 - protein, 9 aa, Homo Sapiens
VSSCWGCNW

SEQ ID NO: 530940 - protein, 9 aa, Homo Sapiens
EVTGVVAAM

SEQ ID NO: 530941 - protein, 9 aa, Homo Sapiens
TLAMGLINM

SEQ ID NO: 530942 - protein, 9 aa, Homo Sapiens
IPLFFEQSD

SEQ ID NO: 530943 - protein, 9 aa, Homo Sapiens
VSPSANATT

SEQ ID NO: 530944 - protein, 9 aa, Homo Sapiens
AMQTLQIDV

SEQ ID NO: 530945 - protein, 9 aa, Homo Sapiens
KAVATQKKV

SEQ ID NO: 530946 - protein, 9 aa, Homo Sapiens
TVCHHPALP

SEQ ID NO: 530947 - protein, 9 aa, Homo Sapiens
NLQHLQRRK

SEQ ID NO: 530948 - protein, 9 aa, Homo Sapiens
HLVCSVYHM

SEQ ID NO: 530949 - protein, 9 aa, Homo Sapiens
MAIKFVDAL

SEQ ID NO: 530950 - protein, 9 aa, Homo Sapiens
KKRIASSSV

SEQ ID NO: 530951 - protein, 9 aa, Homo Sapiens
TRLGEAHVE

SEQ ID NO: 530952 - protein, 9 aa, Homo Sapiens
RIEAELHQL

SEQ ID NO: 530953 - protein, 9 aa, Homo Sapiens
HLTSSLTTK

SEQ ID NO: 530954 - protein, 9 aa, Homo Sapiens
DKREQKLKF

SEQ ID NO: 530955 - protein, 9 aa, Homo Sapiens
SFTTMQEQA

SEQ ID NO: 530956 - protein, 9 aa, Homo Sapiens
VCMLADLSL

SEQ ID NO: 530957 - protein, 9 aa, Homo Sapiens
SFKDGDCEG

SEQ ID NO: 530958 - protein, 9 aa, Homo Sapiens
YNISCILTM

SEQ ID NO: 530959 - protein, 9 aa, Homo Sapiens
LETDLYKWF

SEQ ID NO: 530960 - protein, 9 aa, Homo Sapiens
LTQTSGETM

SEQ ID NO: 530961 - protein, 9 aa, Homo Sapiens
DTLFRHSGT

SEQ ID NO: 530962 - protein, 9 aa, Homo Sapiens
KNNSHIKLS

SEQ ID NO: 530963 - protein, 9 aa, Homo Sapiens
PEGASFKGH

SEQ ID NO: 530964 - protein, 9 aa, Homo Sapiens
LAWKERQLH

SEQ ID NO: 530965 - protein, 9 aa, Homo Sapiens
LEEDHELFE

SEQ ID NO: 530966 - protein, 9 aa, Homo Sapiens
RHGTPLEEV

SEQ ID NO: 530967 - protein, 9 aa, Homo Sapiens
ENTPMELKT

SEQ ID NO: 530968 - protein, 9 aa, Homo Sapiens
SSPSPTTEV

SEQ ID NO: 530969 - protein, 9 aa, Homo Sapiens
DSACHREAA

SEQ ID NO: 530970 - protein, 9 aa, Homo Sapiens
QECYGAPYI

SEQ ID NO: 530971 - protein, 9 aa, Homo Sapiens
YNFCTQDGQ

SEQ ID NO: 530972 - protein, 9 aa, Homo Sapiens
KEECRAYIQ

SEQ ID NO: 530973 - protein, 9 aa, Homo Sapiens
HELFEISTA

SEQ ID NO: 530974 - protein, 9 aa, Homo Sapiens
EILRQPEQL

SEQ ID NO: 530975 - protein, 9 aa, Homo Sapiens
QNPLVTLGA

SEQ ID NO: 530976 - protein, 9 aa, Homo Sapiens
SSPHNVPDE

SEQ ID NO: 530977 - protein, 9 aa, Homo Sapiens
VSTDMGCFT

SEQ ID NO: 530978 - protein, 9 aa, Homo Sapiens
TLAHAFLPR

SEQ ID NO: 530979 - protein, 9 aa, Homo Sapiens
WTPVNDTDY

SEQ ID NO: 530980 - protein, 9 aa, Homo Sapiens
EGLLHVTHS

SEQ ID NO: 530981 - protein, 9 aa, Homo Sapiens
LRSLHRVQV

SEQ ID NO: 530982 - protein, 9 aa, Homo Sapiens
NHLYGTSIQ

SEQ ID NO: 530983 - protein, 9 aa, Homo Sapiens
TSRSVIVTR

SEQ ID NO: 530984 - protein, 9 aa, Homo Sapiens
PESQMLHLL

SEQ ID NO: 530985 - protein, 9 aa, Homo Sapiens
PAQRNSIPM

SEQ ID NO: 530986 - protein, 9 aa, Homo Sapiens
LLHLTSSLT

SEQ ID NO: 530987 - protein, 9 aa, Homo Sapiens
PEVLQDSQD

SEQ ID NO: 530988 - protein, 9 aa, Homo Sapiens
DCPLLHLHP

SEQ ID NO: 530989 - protein, 9 aa, Homo Sapiens
KKKCQQLTA

SEQ ID NO: 530990 - protein, 9 aa, Homo Sapiens
SIPWDLWGP

SEQ ID NO: 530991 - protein, 9 aa, Homo Sapiens
IESQDNDQP

SEQ ID NO: 530992 - protein, 9 aa, Homo Sapiens
VTETHTGPL

SEQ ID NO: 530993 - protein, 9 aa, Homo Sapiens
HLLSPDLWE

SEQ ID NO: 530994 - protein, 9 aa, Homo Sapiens
STSSYVPSS

SEQ ID NO: 530995 - protein, 9 aa, Homo Sapiens
ALLTWRPPW

SEQ ID NO: 530996 - protein, 9 aa, Homo Sapiens
VQSNVMFDI

SEQ ID NO: 530997 - protein, 9 aa, Homo Sapiens
LSIQWHWQP

SEQ ID NO: 530998 - protein, 9 aa, Homo Sapiens
HGCYPHTKK

SEQ ID NO: 530999 - protein, 9 aa, Homo Sapiens
VRDRFWEFF

SEQ ID NO: 531000 - protein, 9 aa, Homo Sapiens
AGGGGGFGT

SEQ ID NO: 531001 - protein, 9 aa, Homo Sapiens
EVQEMRRLQ

SEQ ID NO: 531002 - protein, 9 aa, Homo Sapiens
SENAVLYFP

SEQ ID NO: 531003 - protein, 9 aa, Homo Sapiens
IVQTVTAVA

SEQ ID NO: 531004 - protein, 9 aa, Homo Sapiens
LIEEQYKAS

SEQ ID NO: 531005 - protein, 9 aa, Homo Sapiens
TNVRSTDQE

SEQ ID NO: 531006 - protein, 9 aa, Homo Sapiens
SINNVLVSL

SEQ ID NO: 531007 - protein, 9 aa, Homo Sapiens
GATNLYRQS

SEQ ID NO: 531008 - protein, 9 aa, Homo Sapiens
LKKKCQQLT

SEQ ID NO: 531009 - protein, 9 aa, Homo Sapiens
WPNWASDDC

SEQ ID NO: 531010 - protein, 9 aa, Homo Sapiens
EPLTKKGEM

SEQ ID NO: 531011 - protein, 9 aa, Homo Sapiens
FQCRLGLAN

SEQ ID NO: 531012 - protein, 9 aa, Homo Sapiens
RRRRRSLAL

SEQ ID NO: 531013 - protein, 9 aa, Homo Sapiens
FYRNRPSFD

SEQ ID NO: 531014 - protein, 9 aa, Homo Sapiens
KLQGAVRTN

SEQ ID NO: 531015 - protein, 9 aa, Homo Sapiens
MALHKKAAE

SEQ ID NO: 531016 - protein, 9 aa, Homo Sapiens
LHLNNNEFT

SEQ ID NO: 531017 - protein, 9 aa, Homo Sapiens
LQKANSSAM

SEQ ID NO: 531018 - protein, 9 aa, Homo Sapiens
CEPSTPWRS

SEQ ID NO: 531019 - protein, 9 aa, Homo Sapiens
PEQLLFILD

SEQ ID NO: 531020 - protein, 9 aa, Homo Sapiens
VRGDGTRPY

SEQ ID NO: 531021 - protein, 9 aa, Homo Sapiens
LLPTVCHHP

SEQ ID NO: 531022 - protein, 9 aa, Homo Sapiens
CVRCSCPGA

SEQ ID NO: 531023 - protein, 9 aa, Homo Sapiens
TEILRQPEQ

SEQ ID NO: 531024 - protein, 9 aa, Homo Sapiens
ISTSPVLLS

SEQ ID NO: 531025 - protein, 9 aa, Homo Sapiens
LIGDNTFTG

SEQ ID NO: 531026 - protein, 9 aa, Homo Sapiens
SSMDIFHLE

SEQ ID NO: 531027 - protein, 9 aa, Homo Sapiens
KEKVSFVSG

SEQ ID NO: 531028 - protein, 9 aa, Homo Sapiens
GPRRRNRIH

SEQ ID NO: 531029 - protein, 9 aa, Homo Sapiens
QKERQCQFK

SEQ ID NO: 531030 - protein, 9 aa, Homo Sapiens
LPDHRRLMY

SEQ ID NO: 531031 - protein, 9 aa, Homo Sapiens
PDCPLLHLH

SEQ ID NO: 531032 - protein, 9 aa, Homo Sapiens
TFDWLLISI

SEQ ID NO: 531033 - protein, 9 aa, Homo Sapiens
MSGLPPSLQ

SEQ ID NO: 531034 - protein, 9 aa, Homo Sapiens
MRRFLPSTS

SEQ ID NO: 531035 - protein, 9 aa, Homo Sapiens
MLSLQSRAA

SEQ ID NO: 531036 - protein, 9 aa, Homo Sapiens
HIRSLKIEL

SEQ ID NO: 531037 - protein, 9 aa, Homo Sapiens
DAILQCGHV

SEQ ID NO: 531038 - protein, 9 aa, Homo Sapiens
AIKAARKSA

SEQ ID NO: 531039 - protein, 9 aa, Homo Sapiens
GLVAGLQHQ

SEQ ID NO: 531040 - protein, 9 aa, Homo Sapiens
TSVGSHPRA

SEQ ID NO: 531041 - protein, 9 aa, Homo Sapiens
LEENPYFCL

SEQ ID NO: 531042 - protein, 9 aa, Homo Sapiens
LGGSMAIKF

SEQ ID NO: 531043 - protein, 9 aa, Homo Sapiens
VERNTTSEE

SEQ ID NO: 531044 - protein, 9 aa, Homo Sapiens
LGSFPSPSI

SEQ ID NO: 531045 - protein, 9 aa, Homo Sapiens
YEKEVRGRG

SEQ ID NO: 531046 - protein, 9 aa, Homo Sapiens
GDNTFTGLS

SEQ ID NO: 531047 - protein, 9 aa, Homo Sapiens
LVWTMVSAT

SEQ ID NO: 531048 - protein, 9 aa, Homo Sapiens
AVVLMFMYY

SEQ ID NO: 531049 - protein, 9 aa, Homo Sapiens
AWGERFRVP

SEQ ID NO: 531050 - protein, 9 aa, Homo Sapiens
NRIHLFSEP

SEQ ID NO: 531051 - protein, 9 aa, Homo Sapiens
EECRAYIQM

SEQ ID NO: 531052 - protein, 9 aa, Homo Sapiens
CKIIRSHVL

SEQ ID NO: 531053 - protein, 9 aa, Homo Sapiens
AGPGWALWP

SEQ ID NO: 531054 - protein, 9 aa, Homo Sapiens
SPLEGQAKG

SEQ ID NO: 531055 - protein, 9 aa, Homo Sapiens
CQCQEGVVT

SEQ ID NO: 531056 - protein, 9 aa, Homo Sapiens
DLQAKAVEL

SEQ ID NO: 531057 - protein, 9 aa, Homo Sapiens
CSEHWKTQH

SEQ ID NO: 531058 - protein, 9 aa, Homo Sapiens
PSTIRRDVP

SEQ ID NO: 531059 - protein, 9 aa, Homo Sapiens
SSCWGCNWC

SEQ ID NO: 531060 - protein, 9 aa, Homo Sapiens
GHYFQCRLG

SEQ ID NO: 531061 - protein, 9 aa, Homo Sapiens
YSRLVALML

SEQ ID NO: 531062 - protein, 9 aa, Homo Sapiens
VALMLARKL

SEQ ID NO: 531063 - protein, 9 aa, Homo Sapiens
GHFVMGPTV

SEQ ID NO: 531064 - protein, 9 aa, Homo Sapiens
ATVLEEDHE

SEQ ID NO: 531065 - protein, 9 aa, Homo Sapiens
SIAAVVLMF

SEQ ID NO: 531066 - protein, 9 aa, Homo Sapiens
AELEQLCSS

SEQ ID NO: 531067 - protein, 9 aa, Homo Sapiens
SVQLQHIIA

SEQ ID NO: 531068 - protein, 9 aa, Homo Sapiens
LHRHQAHSS

SEQ ID NO: 531069 - protein, 9 aa, Homo Sapiens
FSRFRSQTP

SEQ ID NO: 531070 - protein, 9 aa, Homo Sapiens
SCQTLQDHT

SEQ ID NO: 531071 - protein, 9 aa, Homo Sapiens
HWEMSNQDV

SEQ ID NO: 531072 - protein, 9 aa, Homo Sapiens
MEYDEKLAH

SEQ ID NO: 531073 - protein, 9 aa, Homo Sapiens
WHADRIKCK

SEQ ID NO: 531074 - protein, 9 aa, Homo Sapiens
AEVLGEWGT

SEQ ID NO: 531075 - protein, 9 aa, Homo Sapiens
YTKGADLVI

SEQ ID NO: 531076 - protein, 9 aa, Homo Sapiens
TLAVSRGRL

SEQ ID NO: 531077 - protein, 9 aa, Homo Sapiens
SAGQTPRHL

SEQ ID NO: 531078 - protein, 9 aa, Homo Sapiens
KLGLKVDKD

SEQ ID NO: 531079 - protein, 9 aa, Homo Sapiens
YRGAIACKR

SEQ ID NO: 531080 - protein, 9 aa, Homo Sapiens
IQFPRRSIS

SEQ ID NO: 531081 - protein, 9 aa, Homo Sapiens
EIHFLLESK

SEQ ID NO: 531082 - protein, 9 aa, Homo Sapiens
TSNQQHARL

SEQ ID NO: 531083 - protein, 9 aa, Homo Sapiens
AMETINKLK

SEQ ID NO: 531084 - protein, 9 aa, Homo Sapiens
RCFGKTYDA

SEQ ID NO: 531085 - protein, 9 aa, Homo Sapiens
AKTYSTKDQ

SEQ ID NO: 531086 - protein, 9 aa, Homo Sapiens
QVWRSPLGG

SEQ ID NO: 531087 - protein, 9 aa, Homo Sapiens
SVTTLAVSR

SEQ ID NO: 531088 - protein, 9 aa, Homo Sapiens
RSTDQENGE

SEQ ID NO: 531089 - protein, 9 aa, Homo Sapiens
CGQLAVILA

SEQ ID NO: 531090 - protein, 9 aa, Homo Sapiens
YFCLKKVVK

SEQ ID NO: 531091 - protein, 9 aa, Homo Sapiens
VFGTMFFNF

SEQ ID NO: 531092 - protein, 9 aa, Homo Sapiens
SGDLQLVKS

SEQ ID NO: 531093 - protein, 9 aa, Homo Sapiens
PGIYVCAKC

SEQ ID NO: 531094 - protein, 9 aa, Homo Sapiens
GGSMAIKFV

SEQ ID NO: 531095 - protein, 9 aa, Homo Sapiens
LALQQQMAA

SEQ ID NO: 531096 - protein, 9 aa, Homo Sapiens
TLVVSAQAV

SEQ ID NO: 531097 - protein, 9 aa, Homo Sapiens
SDISQAYHS

SEQ ID NO: 531098 - protein, 9 aa, Homo Sapiens
PSGDLQLVK

SEQ ID NO: 531099 - protein, 9 aa, Homo Sapiens
HWPKNILKQ

SEQ ID NO: 531100 - protein, 9 aa, Homo Sapiens
RSVMRYLTS

SEQ ID NO: 531101 - protein, 9 aa, Homo Sapiens
KHLTKSQPC

SEQ ID NO: 531102 - protein, 9 aa, Homo Sapiens
AREWYSSLF

SEQ ID NO: 531103 - protein, 9 aa, Homo Sapiens
GINCYDCVC

SEQ ID NO: 531104 - protein, 9 aa, Homo Sapiens
DIKMMERVV

SEQ ID NO: 531105 - protein, 9 aa, Homo Sapiens
ERHAPWVWN

SEQ ID NO: 531106 - protein, 9 aa, Homo Sapiens
QEQAFGGEE

SEQ ID NO: 531107 - protein, 9 aa, Homo Sapiens
ELCADAKKQ

SEQ ID NO: 531108 - protein, 9 aa, Homo Sapiens
KDSTNRKHL

SEQ ID NO: 531109 - protein, 9 aa, Homo Sapiens
RARPAKAVA

SEQ ID NO: 531110 - protein, 9 aa, Homo Sapiens
LCYLLKKAD

SEQ ID NO: 531111 - protein, 9 aa, Homo Sapiens
ALAHSKRKN

SEQ ID NO: 531112 - protein, 9 aa, Homo Sapiens
AILGLEEVQ

SEQ ID NO: 531113 - protein, 9 aa, Homo Sapiens
LLLSLSGHL

SEQ ID NO: 531114 - protein, 9 aa, Homo Sapiens
GVEFQDMVL

SEQ ID NO: 531115 - protein, 9 aa, Homo Sapiens
ILVGSGILV

SEQ ID NO: 531116 - protein, 9 aa, Homo Sapiens
MIVQTVTAV

SEQ ID NO: 531117 - protein, 9 aa, Homo Sapiens
SVIHLKNLS

SEQ ID NO: 531118 - protein, 9 aa, Homo Sapiens
HLLFLMGIN

SEQ ID NO: 531119 - protein, 9 aa, Homo Sapiens
RQGPASDES

SEQ ID NO: 531120 - protein, 9 aa, Homo Sapiens
PPDPSPRGG

SEQ ID NO: 531121 - protein, 9 aa, Homo Sapiens
SQARKPAFI

SEQ ID NO: 531122 - protein, 9 aa, Homo Sapiens
GTGGGTHWR

SEQ ID NO: 531123 - protein, 9 aa, Homo Sapiens
SEATHNEWY

SEQ ID NO: 531124 - protein, 9 aa, Homo Sapiens
LCKSSLKKG

SEQ ID NO: 531125 - protein, 9 aa, Homo Sapiens
CLSLGLFYL

SEQ ID NO: 531126 - protein, 9 aa, Homo Sapiens
ELLVSPGVR

SEQ ID NO: 531127 - protein, 9 aa, Homo Sapiens
QSLPRPRVH

SEQ ID NO: 531128 - protein, 9 aa, Homo Sapiens
NLKYSNRTP

SEQ ID NO: 531129 - protein, 9 aa, Homo Sapiens
AEFIPMHDS

SEQ ID NO: 531130 - protein, 9 aa, Homo Sapiens
EEARPKHTL

SEQ ID NO: 531131 - protein, 9 aa, Homo Sapiens
THPGQQRPH

SEQ ID NO: 531132 - protein, 9 aa, Homo Sapiens
TADRSMRKG

SEQ ID NO: 531133 - protein, 9 aa, Homo Sapiens
TMAHQVRTH

SEQ ID NO: 531134 - protein, 9 aa, Homo Sapiens
NRNSWVREY

SEQ ID NO: 531135 - protein, 9 aa, Homo Sapiens
DGALDREKI

SEQ ID NO: 531136 - protein, 9 aa, Homo Sapiens
RAYFFNNPR

SEQ ID NO: 531137 - protein, 9 aa, Homo Sapiens
TTSPEAPPA

SEQ ID NO: 531138 - protein, 9 aa, Homo Sapiens
NLGLWINGE

SEQ ID NO: 531139 - protein, 9 aa, Homo Sapiens
GGTDSSMDI

SEQ ID NO: 531140 - protein, 9 aa, Homo Sapiens
AVYIYNRNS

SEQ ID NO: 531141 - protein, 9 aa, Homo Sapiens
DTSKAVLMG

SEQ ID NO: 531142 - protein, 9 aa, Homo Sapiens
PPHPPPPVR

SEQ ID NO: 531143 - protein, 9 aa, Homo Sapiens
DLVGGGHTK

SEQ ID NO: 531144 - protein, 9 aa, Homo Sapiens
FLAHLLFLM

SEQ ID NO: 531145 - protein, 9 aa, Homo Sapiens
VELLVSPGV

SEQ ID NO: 531146 - protein, 9 aa, Homo Sapiens
TLSPTMAHQ

SEQ ID NO: 531147 - protein, 9 aa, Homo Sapiens
QFSRWFSNP

SEQ ID NO: 531148 - protein, 9 aa, Homo Sapiens
VVIGLQSMG

SEQ ID NO: 531149 - protein, 9 aa, Homo Sapiens
PAVVLIRKL

SEQ ID NO: 531150 - protein, 9 aa, Homo Sapiens
CKRIRLGRK

SEQ ID NO: 531151 - protein, 9 aa, Homo Sapiens
HSAELEQLC

SEQ ID NO: 531152 - protein, 9 aa, Homo Sapiens
ALAMELARH

SEQ ID NO: 531153 - protein, 9 aa, Homo Sapiens
SDTMVEPYN

SEQ ID NO: 531154 - protein, 9 aa, Homo Sapiens
GAPHTLPLP

SEQ ID NO: 531155 - protein, 9 aa, Homo Sapiens
FLVYQCEKH

SEQ ID NO: 531156 - protein, 9 aa, Homo Sapiens
TTEVRWFFN

SEQ ID NO: 531157 - protein, 9 aa, Homo Sapiens
KENGADVFL

SEQ ID NO: 531158 - protein, 9 aa, Homo Sapiens
GWALWPRGA

SEQ ID NO: 531159 - protein, 9 aa, Homo Sapiens
LICDANNFV

SEQ ID NO: 531160 - protein, 9 aa, Homo Sapiens
HMDFLLAFS

SEQ ID NO: 531161 - protein, 9 aa, Homo Sapiens
IGGATNLYR

SEQ ID NO: 531162 - protein, 9 aa, Homo Sapiens
TWRPPWASV

SEQ ID NO: 531163 - protein, 9 aa, Homo Sapiens
TCADMLRYQ

SEQ ID NO: 531164 - protein, 9 aa, Homo Sapiens
DTRHTACLS

SEQ ID NO: 531165 - protein, 9 aa, Homo Sapiens
LREENRVLQ

SEQ ID NO: 531166 - protein, 9 aa, Homo Sapiens
GYGAAFSAT

SEQ ID NO: 531167 - protein, 9 aa, Homo Sapiens
QYAVSMASR

SEQ ID NO: 531168 - protein, 9 aa, Homo Sapiens
LEMLSLQSR

SEQ ID NO: 531169 - protein, 9 aa, Homo Sapiens
PQPPKCLES

SEQ ID NO: 531170 - protein, 9 aa, Homo Sapiens
CLCNTCADM

SEQ ID NO: 531171 - protein, 9 aa, Homo Sapiens
HPPPPVRPV

SEQ ID NO: 531172 - protein, 9 aa, Homo Sapiens
KMWAITCFA

SEQ ID NO: 531173 - protein, 9 aa, Homo Sapiens
SITSQHHDV

SEQ ID NO: 531174 - protein, 9 aa, Homo Sapiens
APIWGDMVN

SEQ ID NO: 531175 - protein, 9 aa, Homo Sapiens
IKAARKSAP

SEQ ID NO: 531176 - protein, 9 aa, Homo Sapiens
KPSAELPRL

SEQ ID NO: 531177 - protein, 9 aa, Homo Sapiens
FRHSGTAPR

SEQ ID NO: 531178 - protein, 9 aa, Homo Sapiens
VAPGSLKTE

SEQ ID NO: 531179 - protein, 9 aa, Homo Sapiens
TETLKKSTD

SEQ ID NO: 531180 - protein, 9 aa, Homo Sapiens
IDALQFDFA

SEQ ID NO: 531181 - protein, 9 aa, Homo Sapiens
LQCMLNRHL

SEQ ID NO: 531182 - protein, 9 aa, Homo Sapiens
LLAPQMLNL

SEQ ID NO: 531183 - protein, 9 aa, Homo Sapiens
GQAKGVETT

SEQ ID NO: 531184 - protein, 9 aa, Homo Sapiens
VSGIGGATN

SEQ ID NO: 531185 - protein, 9 aa, Homo Sapiens
NPANGSYPL

SEQ ID NO: 531186 - protein, 9 aa, Homo Sapiens
CTLTSTGTN

SEQ ID NO: 531187 - protein, 9 aa, Homo Sapiens
REAKTDPVT

SEQ ID NO: 531188 - protein, 9 aa, Homo Sapiens
TFCAGAVEQ

SEQ ID NO: 531189 - protein, 9 aa, Homo Sapiens
AQTKDILIR

SEQ ID NO: 531190 - protein, 9 aa, Homo Sapiens
LVYIACQGP

SEQ ID NO: 531191 - protein, 9 aa, Homo Sapiens
LLDLEMLSL

SEQ ID NO: 531192 - protein, 9 aa, Homo Sapiens
CGEKPDMHK

SEQ ID NO: 531193 - protein, 9 aa, Homo Sapiens
PGRTGDQAT

SEQ ID NO: 531194 - protein, 9 aa, Homo Sapiens
DTFCAGAVE

SEQ ID NO: 531195 - protein, 9 aa, Homo Sapiens
SSDRRSSDP

SEQ ID NO: 531196 - protein, 9 aa, Homo Sapiens
TVQPCNVSV

SEQ ID NO: 531197 - protein, 9 aa, Homo Sapiens
REVTGYVLM

SEQ ID NO: 531198 - protein, 9 aa, Homo Sapiens
KDGHSGMPL

SEQ ID NO: 531199 - protein, 9 aa, Homo Sapiens
TVRHLRSLH

SEQ ID NO: 531200 - protein, 9 aa, Homo Sapiens
RNRIHLFSE

SEQ ID NO: 531201 - protein, 9 aa, Homo Sapiens
AEAHVRIHL

SEQ ID NO: 531202 - protein, 9 aa, Homo Sapiens
PHLVCSVYH

SEQ ID NO: 531203 - protein, 9 aa, Homo Sapiens
GICILTNWL

SEQ ID NO: 531204 - protein, 9 aa, Homo Sapiens
SRPRSPSTF

SEQ ID NO: 531205 - protein, 9 aa, Homo Sapiens
SWEPPTPHG

SEQ ID NO: 531206 - protein, 9 aa, Homo Sapiens
AVQHNKATE

SEQ ID NO: 531207 - protein, 9 aa, Homo Sapiens
RSLHRVQVT

SEQ ID NO: 531208 - protein, 9 aa, Homo Sapiens
LARYEPDLL

SEQ ID NO: 531209 - protein, 9 aa, Homo Sapiens
HHNAEERYD

SEQ ID NO: 531210 - protein, 9 aa, Homo Sapiens
DMADSRCIN

SEQ ID NO: 531211 - protein, 9 aa, Homo Sapiens
SLDSEGTIN

SEQ ID NO: 531212 - protein, 9 aa, Homo Sapiens
TNSASCMTV

SEQ ID NO: 531213 - protein, 9 aa, Homo Sapiens
FGLGAGASC

SEQ ID NO: 531214 - protein, 9 aa, Homo Sapiens
PHAREMWRS

SEQ ID NO: 531215 - protein, 9 aa, Homo Sapiens
LNYQRMYYM

SEQ ID NO: 531216 - protein, 9 aa, Homo Sapiens
PAEVLGEWG

SEQ ID NO: 531217 - protein, 9 aa, Homo Sapiens
VVLIRKLIA

SEQ ID NO: 531218 - protein, 9 aa, Homo Sapiens
QTFLNKTMS

SEQ ID NO: 531219 - protein, 9 aa, Homo Sapiens
RSLQEEALQ

SEQ ID NO: 531220 - protein, 9 aa, Homo Sapiens
EAQHWVRGL

SEQ ID NO: 531221 - protein, 9 aa, Homo Sapiens
TRQLLHKAD

SEQ ID NO: 531222 - protein, 9 aa, Homo Sapiens
PGQSSPSCR

SEQ ID NO: 531223 - protein, 9 aa, Homo Sapiens
RRFLPSTSS

SEQ ID NO: 531224 - protein, 9 aa, Homo Sapiens
AYQQIVGGA

SEQ ID NO: 531225 - protein, 9 aa, Homo Sapiens
HSALPGCPE

SEQ ID NO: 531226 - protein, 9 aa, Homo Sapiens
LWHSKEASL

SEQ ID NO: 531227 - protein, 9 aa, Homo Sapiens
EPPTPHGKD

SEQ ID NO: 531228 - protein, 9 aa, Homo Sapiens
KAQTKDILI

SEQ ID NO: 531229 - protein, 9 aa, Homo Sapiens
EKTSYSVSI

SEQ ID NO: 531230 - protein, 9 aa, Homo Sapiens
LVGQLRWGP

SEQ ID NO: 531231 - protein, 9 aa, Homo Sapiens
AMPTKSKEE

SEQ ID NO: 531232 - protein, 9 aa, Homo Sapiens
HFRQAHLNP

SEQ ID NO: 531233 - protein, 9 aa, Homo Sapiens
YRLHRHQAH

SEQ ID NO: 531234 - protein, 9 aa, Homo Sapiens
EVQGLLAAL

SEQ ID NO: 531235 - protein, 9 aa, Homo Sapiens
PLQGESHTH

SEQ ID NO: 531236 - protein, 9 aa, Homo Sapiens
AGWEMLIYL

SEQ ID NO: 531237 - protein, 9 aa, Homo Sapiens
NACVIKWLY

SEQ ID NO: 531238 - protein, 9 aa, Homo Sapiens
RIHFGTKGF

SEQ ID NO: 531239 - protein, 9 aa, Homo Sapiens
NPQLHQAIE

SEQ ID NO: 531240 - protein, 9 aa, Homo Sapiens
QCSVCNECL

SEQ ID NO: 531241 - protein, 9 aa, Homo Sapiens
LFTVFWNVF

SEQ ID NO: 531242 - protein, 9 aa, Homo Sapiens
LHQEDSGKY

SEQ ID NO: 531243 - protein, 9 aa, Homo Sapiens
PLIMRRHVR

SEQ ID NO: 531244 - protein, 9 aa, Homo Sapiens
KPLFCGSSD

SEQ ID NO: 531245 - protein, 9 aa, Homo Sapiens
KVQVIYTQL

SEQ ID NO: 531246 - protein, 9 aa, Homo Sapiens
ARFLKHCFT

SEQ ID NO: 531247 - protein, 9 aa, Homo Sapiens
AVENPTAQE

SEQ ID NO: 531248 - protein, 9 aa, Homo Sapiens
ISLERQFQN

SEQ ID NO: 531249 - protein, 9 aa, Homo Sapiens
AAQERDGLE

SEQ ID NO: 531250 - protein, 9 aa, Homo Sapiens
TMQEQAFGG

SEQ ID NO: 531251 - protein, 9 aa, Homo Sapiens
QYVDRVFHT

SEQ ID NO: 531252 - protein, 9 aa, Homo Sapiens
AYVEWFNHL

SEQ ID NO: 531253 - protein, 9 aa, Homo Sapiens
ISGFRVDGF

SEQ ID NO: 531254 - protein, 9 aa, Homo Sapiens
ERTQLALAL

SEQ ID NO: 531255 - protein, 9 aa, Homo Sapiens
EQAFGGEEE

SEQ ID NO: 531256 - protein, 9 aa, Homo Sapiens
PLFFEQSDN

SEQ ID NO: 531257 - protein, 9 aa, Homo Sapiens
DRVFHTITE

SEQ ID NO: 531258 - protein, 9 aa, Homo Sapiens
GARVACSET

SEQ ID NO: 531259 - protein, 9 aa, Homo Sapiens
EGRREPRSQ

SEQ ID NO: 531260 - protein, 9 aa, Homo Sapiens
HFLLESKCV

SEQ ID NO: 531261 - protein, 9 aa, Homo Sapiens
GPPGEHGEK

SEQ ID NO: 531262 - protein, 9 aa, Homo Sapiens
QAPRWGNPC

SEQ ID NO: 531263 - protein, 9 aa, Homo Sapiens
VSIEENCLS

SEQ ID NO: 531264 - protein, 9 aa, Homo Sapiens
KVSFVSGGR

SEQ ID NO: 531265 - protein, 9 aa, Homo Sapiens
RQPSITSQH

SEQ ID NO: 531266 - protein, 9 aa, Homo Sapiens
SCGLGGMWH

SEQ ID NO: 531267 - protein, 9 aa, Homo Sapiens
TRIGKMPVY

SEQ ID NO: 531268 - protein, 9 aa, Homo Sapiens
GQCFSAETL

SEQ ID NO: 531269 - protein, 9 aa, Homo Sapiens
NNLQHLQRR

SEQ ID NO: 531270 - protein, 9 aa, Homo Sapiens
CEKRRTWGL

SEQ ID NO: 531271 - protein, 9 aa, Homo Sapiens
VLAVTMTQE

SEQ ID NO: 531272 - protein, 9 aa, Homo Sapiens
FSFLSGFQE

SEQ ID NO: 531273 - protein, 9 aa, Homo Sapiens
RTVEGIRSV

SEQ ID NO: 531274 - protein, 9 aa, Homo Sapiens
QGRFHLLSD

SEQ ID NO: 531275 - protein, 9 aa, Homo Sapiens
VILAAPGLQ

SEQ ID NO: 531276 - protein, 9 aa, Homo Sapiens
VHQLVVVDE

SEQ ID NO: 531277 - protein, 9 aa, Homo Sapiens
KDPSQCPSM

SEQ ID NO: 531278 - protein, 9 aa, Homo Sapiens
KTSSHLGVL

SEQ ID NO: 531279 - protein, 9 aa, Homo Sapiens
LLHKADGVV

SEQ ID NO: 531280 - protein, 9 aa, Homo Sapiens
TITESGVSC

SEQ ID NO: 531281 - protein, 9 aa, Homo Sapiens
GVAHLLSPD

SEQ ID NO: 531282 - protein, 9 aa, Homo Sapiens
CITKTFFWR

SEQ ID NO: 531283 - protein, 9 aa, Homo Sapiens
WFDLSKIPE

SEQ ID NO: 531284 - protein, 9 aa, Homo Sapiens
INTFCLSAD

SEQ ID NO: 531285 - protein, 9 aa, Homo Sapiens
AHLLSPDLW

SEQ ID NO: 531286 - protein, 9 aa, Homo Sapiens
MTQEAIDEF

SEQ ID NO: 531287 - protein, 9 aa, Homo Sapiens
FLKHCFTFM

SEQ ID NO: 531288 - protein, 9 aa, Homo Sapiens
AGVPRFQFG

SEQ ID NO: 531289 - protein, 9 aa, Homo Sapiens
DDDKSEGSS

SEQ ID NO: 531290 - protein, 9 aa, Homo Sapiens
DTFDWLLIS

SEQ ID NO: 531291 - protein, 9 aa, Homo Sapiens
TARRTHPGQ

SEQ ID NO: 531292 - protein, 9 aa, Homo Sapiens
SLPGSPDKT

SEQ ID NO: 531293 - protein, 9 aa, Homo Sapiens
KDEPTLDVI

SEQ ID NO: 531294 - protein, 9 aa, Homo Sapiens
FAPCVFIYI

SEQ ID NO: 531295 - protein, 9 aa, Homo Sapiens
PGCFQCSVC

SEQ ID NO: 531296 - protein, 9 aa, Homo Sapiens
VVLMFMYYT

SEQ ID NO: 531297 - protein, 9 aa, Homo Sapiens
EFGGHNKPK

SEQ ID NO: 531298 - protein, 9 aa, Homo Sapiens
NILEKGMEG

SEQ ID NO: 531299 - protein, 9 aa, Homo Sapiens
TAQQKGLPL

SEQ ID NO: 531300 - protein, 9 aa, Homo Sapiens
PCRGLGAPL

SEQ ID NO: 531301 - protein, 9 aa, Homo Sapiens
IASSSVSHG

SEQ ID NO: 531302 - protein, 9 aa, Homo Sapiens
SIGARYYCE

SEQ ID NO: 531303 - protein, 9 aa, Homo Sapiens
GEGPCRGLG

SEQ ID NO: 531304 - protein, 9 aa, Homo Sapiens
SHTHSHVLV

SEQ ID NO: 531305 - protein, 9 aa, Homo Sapiens
IEQGNLGLW

SEQ ID NO: 531306 - protein, 9 aa, Homo Sapiens
DEIVTAATT

SEQ ID NO: 531307 - protein, 9 aa, Homo Sapiens
EARPKHTLP

SEQ ID NO: 531308 - protein, 9 aa, Homo Sapiens
ERQCQFKLK

SEQ ID NO: 531309 - protein, 9 aa, Homo Sapiens
RLQCMLNRH

SEQ ID NO: 531310 - protein, 9 aa, Homo Sapiens
IVVTTSPEA

SEQ ID NO: 531311 - protein, 9 aa, Homo Sapiens
RCLLLDRRV

SEQ ID NO: 531312 - protein, 9 aa, Homo Sapiens
PTKDSLEYL

SEQ ID NO: 531313 - protein, 9 aa, Homo Sapiens
SPSCRTKSS

SEQ ID NO: 531314 - protein, 9 aa, Homo Sapiens
FDSLEKMKM

SEQ ID NO: 531315 - protein, 9 aa, Homo Sapiens
GLGGMWHNS

SEQ ID NO: 531316 - protein, 9 aa, Homo Sapiens
GASDCGSPA

SEQ ID NO: 531317 - protein, 9 aa, Homo Sapiens
VNDKREQKL

SEQ ID NO: 531318 - protein, 9 aa, Homo Sapiens
QQHARLRVC

SEQ ID NO: 531319 - protein, 9 aa, Homo Sapiens
HPGCFQCSV

SEQ ID NO: 531320 - protein, 9 aa, Homo Sapiens
ATGLALTGM

SEQ ID NO: 531321 - protein, 9 aa, Homo Sapiens
VGTTKLKVF

SEQ ID NO: 531322 - protein, 9 aa, Homo Sapiens
STEHQLISL

SEQ ID NO: 531323 - protein, 9 aa, Homo Sapiens
DMVLYSDDE

SEQ ID NO: 531324 - protein, 9 aa, Homo Sapiens
VTGVVAAME

SEQ ID NO: 531325 - protein, 9 aa, Homo Sapiens
YSFPMEMMI

SEQ ID NO: 531326 - protein, 9 aa, Homo Sapiens
DDLRSIRSG

SEQ ID NO: 531327 - protein, 9 aa, Homo Sapiens
ITLVVSAQA

SEQ ID NO: 531328 - protein, 9 aa, Homo Sapiens
IILHGIDLR

SEQ ID NO: 531329 - protein, 9 aa, Homo Sapiens
CVFLSCITM

SEQ ID NO: 531330 - protein, 9 aa, Homo Sapiens
QIDYAQQLI

SEQ ID NO: 531331 - protein, 9 aa, Homo Sapiens
CVGVPSTMD

SEQ ID NO: 531332 - protein, 9 aa, Homo Sapiens
STAEGANLR

SEQ ID NO: 531333 - protein, 9 aa, Homo Sapiens
SEHWKTQHS

SEQ ID NO: 531334 - protein, 9 aa, Homo Sapiens
EHIIWTLFS

SEQ ID NO: 531335 - protein, 9 aa, Homo Sapiens
YHQVCVYDP

SEQ ID NO: 531336 - protein, 9 aa, Homo Sapiens
QRALELSCQ

SEQ ID NO: 531337 - protein, 9 aa, Homo Sapiens
RRTARRTHP

SEQ ID NO: 531338 - protein, 9 aa, Homo Sapiens
LLFTVFWNV

SEQ ID NO: 531339 - protein, 9 aa, Homo Sapiens
QRLWADPGA

SEQ ID NO: 531340 - protein, 9 aa, Homo Sapiens
CTKIWTEKT

SEQ ID NO: 531341 - protein, 9 aa, Homo Sapiens
KTMKQTEVL

SEQ ID NO: 531342 - protein, 9 aa, Homo Sapiens
CFSAETLLD

SEQ ID NO: 531343 - protein, 9 aa, Homo Sapiens
HTGPLGCNS

SEQ ID NO: 531344 - protein, 9 aa, Homo Sapiens
GLSLRHAGL

SEQ ID NO: 531345 - protein, 9 aa, Homo Sapiens
SENREAKTD

SEQ ID NO: 531346 - protein, 9 aa, Homo Sapiens
AMEQLVLMA

SEQ ID NO: 531347 - protein, 9 aa, Homo Sapiens
RNACVIKWL

SEQ ID NO: 531348 - protein, 9 aa, Homo Sapiens
VLVLIDALQ

SEQ ID NO: 531349 - protein, 9 aa, Homo Sapiens
KLSQMAPED

SEQ ID NO: 531350 - protein, 9 aa, Homo Sapiens
ERVKSKEKK

SEQ ID NO: 531351 - protein, 9 aa, Homo Sapiens
EMKTAERDV

SEQ ID NO: 531352 - protein, 9 aa, Homo Sapiens
SPGAMRRFL

SEQ ID NO: 531353 - protein, 9 aa, Homo Sapiens
GTKLLPTND

SEQ ID NO: 531354 - protein, 9 aa, Homo Sapiens
LQTVVNTIT

SEQ ID NO: 531355 - protein, 9 aa, Homo Sapiens
PPDYQPPSF

SEQ ID NO: 531356 - protein, 9 aa, Homo Sapiens
KQSEQQKHV

SEQ ID NO: 531357 - protein, 9 aa, Homo Sapiens
SLSLDDFWN

SEQ ID NO: 531358 - protein, 9 aa, Homo Sapiens
EDDDKSEGS

SEQ ID NO: 531359 - protein, 9 aa, Homo Sapiens
LWPRGARRL

SEQ ID NO: 531360 - protein, 9 aa, Homo Sapiens
EKKVQVIYT

SEQ ID NO: 531361 - protein, 9 aa, Homo Sapiens
TSRSRRLQS

SEQ ID NO: 531362 - protein, 9 aa, Homo Sapiens
EEMWWQEEK

SEQ ID NO: 531363 - protein, 9 aa, Homo Sapiens
VSASQFSRW

SEQ ID NO: 531364 - protein, 9 aa, Homo Sapiens
AHVELDSLR

SEQ ID NO: 531365 - protein, 9 aa, Homo Sapiens
AALTGAKSH

SEQ ID NO: 531366 - protein, 9 aa, Homo Sapiens
KVSGIGGAT

SEQ ID NO: 531367 - protein, 9 aa, Homo Sapiens
LRIHKRTHT

SEQ ID NO: 531368 - protein, 9 aa, Homo Sapiens
CGRAYSCRS

SEQ ID NO: 531369 - protein, 9 aa, Homo Sapiens
PMEMMICLP

SEQ ID NO: 531370 - protein, 9 aa, Homo Sapiens
GTRIGKMPV

SEQ ID NO: 531371 - protein, 9 aa, Homo Sapiens
LHLHPTGKL

SEQ ID NO: 531372 - protein, 9 aa, Homo Sapiens
GHLARVENV

SEQ ID NO: 531373 - protein, 9 aa, Homo Sapiens
CTGYHQVCV

SEQ ID NO: 531374 - protein, 9 aa, Homo Sapiens
RVKSKEKKS

SEQ ID NO: 531375 - protein, 9 aa, Homo Sapiens
VHYRIDLDV

SEQ ID NO: 531376 - protein, 9 aa, Homo Sapiens
SEGCLGVLC

SEQ ID NO: 531377 - protein, 9 aa, Homo Sapiens
VCRDGINCY

SEQ ID NO: 531378 - protein, 9 aa, Homo Sapiens
QQAMREERK

SEQ ID NO: 531379 - protein, 9 aa, Homo Sapiens
GEKPDMHKQ

SEQ ID NO: 531380 - protein, 9 aa, Homo Sapiens
LGPTHHMDF

SEQ ID NO: 531381 - protein, 9 aa, Homo Sapiens
LQDLMHISQ

SEQ ID NO: 531382 - protein, 9 aa, Homo Sapiens
NLANNRQVC

SEQ ID NO: 531383 - protein, 9 aa, Homo Sapiens
SPEDIAQFL

SEQ ID NO: 531384 - protein, 9 aa, Homo Sapiens
RPALEPVWS

SEQ ID NO: 531385 - protein, 9 aa, Homo Sapiens
LPRPRVHAL

SEQ ID NO: 531386 - protein, 9 aa, Homo Sapiens
TDLYKWFIL

SEQ ID NO: 531387 - protein, 9 aa, Homo Sapiens
ISRGRGQCI

SEQ ID NO: 531388 - protein, 9 aa, Homo Sapiens
GANLRTVDP

SEQ ID NO: 531389 - protein, 9 aa, Homo Sapiens
PREVGEKSE

SEQ ID NO: 531390 - protein, 9 aa, Homo Sapiens
SDPSRNNCS

SEQ ID NO: 531391 - protein, 9 aa, Homo Sapiens
NQDLGFHML

SEQ ID NO: 531392 - protein, 9 aa, Homo Sapiens
PGRLYAWGE

SEQ ID NO: 531393 - protein, 9 aa, Homo Sapiens
FWFWSDLNF

SEQ ID NO: 531394 - protein, 9 aa, Homo Sapiens
GAIKVTETH

SEQ ID NO: 531395 - protein, 9 aa, Homo Sapiens
ANYYFNVKF

SEQ ID NO: 531396 - protein, 9 aa, Homo Sapiens
PSPKVSDTM

SEQ ID NO: 531397 - protein, 9 aa, Homo Sapiens
CPGAKRSEK

SEQ ID NO: 531398 - protein, 9 aa, Homo Sapiens
HTEKMKEIV

SEQ ID NO: 531399 - protein, 9 aa, Homo Sapiens
INAIGHLGN

SEQ ID NO: 531400 - protein, 9 aa, Homo Sapiens
ETLNEAKPI

SEQ ID NO: 531401 - protein, 9 aa, Homo Sapiens
LPVNKTDMS

SEQ ID NO: 531402 - protein, 9 aa, Homo Sapiens
YSINNVLVS

SEQ ID NO: 531403 - protein, 9 aa, Homo Sapiens
ASWEAQDSV

SEQ ID NO: 531404 - protein, 9 aa, Homo Sapiens
VSARDLFRV

SEQ ID NO: 531405 - protein, 9 aa, Homo Sapiens
DSTNRKHLT

SEQ ID NO: 531406 - protein, 9 aa, Homo Sapiens
GRMDGFHPR

SEQ ID NO: 531407 - protein, 9 aa, Homo Sapiens
EALLEWRAA

SEQ ID NO: 531408 - protein, 9 aa, Homo Sapiens
EVTGRRWLK

SEQ ID NO: 531409 - protein, 9 aa, Homo Sapiens
EDHELFEIS

SEQ ID NO: 531410 - protein, 9 aa, Homo Sapiens
HQAHSSSGM

SEQ ID NO: 531411 - protein, 9 aa, Homo Sapiens
IQDTSLIPN

SEQ ID NO: 531412 - protein, 9 aa, Homo Sapiens
WRTTAFVQR

SEQ ID NO: 531413 - protein, 9 aa, Homo Sapiens
SLPRPRVHA

SEQ ID NO: 531414 - protein, 9 aa, Homo Sapiens
YLLSIAAVV

SEQ ID NO: 531415 - protein, 9 aa, Homo Sapiens
LEELVGQLR

SEQ ID NO: 531416 - protein, 9 aa, Homo Sapiens
QDNWESGLH

SEQ ID NO: 531417 - protein, 9 aa, Homo Sapiens
AIKVTETHT

SEQ ID NO: 531418 - protein, 9 aa, Homo Sapiens
LNILEKGME

SEQ ID NO: 531419 - protein, 9 aa, Homo Sapiens
THLLHLTSS

SEQ ID NO: 531420 - protein, 9 aa, Homo Sapiens
SAHILKLPS

SEQ ID NO: 531421 - protein, 9 aa, Homo Sapiens
LILHRRIHM

SEQ ID NO: 531422 - protein, 9 aa, Homo Sapiens
YKAQTKDIL

SEQ ID NO: 531423 - protein, 9 aa, Homo Sapiens
KRERQWEQM

SEQ ID NO: 531424 - protein, 9 aa, Homo Sapiens
YECTNSASC

SEQ ID NO: 531425 - protein, 9 aa, Homo Sapiens
EEENKAREQ

SEQ ID NO: 531426 - protein, 9 aa, Homo Sapiens
EQNQTKHST

SEQ ID NO: 531427 - protein, 9 aa, Homo Sapiens
LTTAEFLVY

SEQ ID NO: 531428 - protein, 9 aa, Homo Sapiens
AGDTERTQL

SEQ ID NO: 531429 - protein, 9 aa, Homo Sapiens
QTNGQCFSA

SEQ ID NO: 531430 - protein, 9 aa, Homo Sapiens
FWVRKDDTG

SEQ ID NO: 531431 - protein, 9 aa, Homo Sapiens
VIGQEKVKK

SEQ ID NO: 531432 - protein, 9 aa, Homo Sapiens
RRNRIHLFS

SEQ ID NO: 531433 - protein, 9 aa, Homo Sapiens
GYVSGFRVM

SEQ ID NO: 531434 - protein, 9 aa, Homo Sapiens
LRTCSSPEL

SEQ ID NO: 531435 - protein, 9 aa, Homo Sapiens
VTFLSCNLE

SEQ ID NO: 531436 - protein, 9 aa, Homo Sapiens
DRLAVPPFT

SEQ ID NO: 531437 - protein, 9 aa, Homo Sapiens
SEKWLDLVT

SEQ ID NO: 531438 - protein, 9 aa, Homo Sapiens
RCREFVTFS

SEQ ID NO: 531439 - protein, 9 aa, Homo Sapiens
DRDNLKSSA

SEQ ID NO: 531440 - protein, 9 aa, Homo Sapiens
VQNFLYILV

SEQ ID NO: 531441 - protein, 9 aa, Homo Sapiens
QMAANQAAS

SEQ ID NO: 531442 - protein, 9 aa, Homo Sapiens
IERHAPWVW

SEQ ID NO: 531443 - protein, 9 aa, Homo Sapiens
EENRVLQQL

SEQ ID NO: 531444 - protein, 9 aa, Homo Sapiens
RDIHLTPRP

SEQ ID NO: 531445 - protein, 9 aa, Homo Sapiens
SLSGHLARV

SEQ ID NO: 531446 - protein, 9 aa, Homo Sapiens
RDVYADFQS

SEQ ID NO: 531447 - protein, 9 aa, Homo Sapiens
LKYSNRTPV

SEQ ID NO: 531448 - protein, 9 aa, Homo Sapiens
EAISRICEA

SEQ ID NO: 531449 - protein, 9 aa, Homo Sapiens
ILGYKTLAM

SEQ ID NO: 531450 - protein, 9 aa, Homo Sapiens
TLHNRELQD

SEQ ID NO: 531451 - protein, 9 aa, Homo Sapiens
AAKEVQEMR

SEQ ID NO: 531452 - protein, 9 aa, Homo Sapiens
TSGPHPVTV

SEQ ID NO: 531453 - protein, 9 aa, Homo Sapiens
IVQSNVMFD

SEQ ID NO: 531454 - protein, 9 aa, Homo Sapiens
MGYVSGFRV

SEQ ID NO: 531455 - protein, 9 aa, Homo Sapiens
DMSKAPLHF

SEQ ID NO: 531456 - protein, 9 aa, Homo Sapiens
VLEQEEAEA

SEQ ID NO: 531457 - protein, 9 aa, Homo Sapiens
VYQCEKHVL

SEQ ID NO: 531458 - protein, 9 aa, Homo Sapiens
SNQQHARLR

SEQ ID NO: 531459 - protein, 9 aa, Homo Sapiens
PRRSISGFR

SEQ ID NO: 531460 - protein, 9 aa, Homo Sapiens
GLWHSKEAS

SEQ ID NO: 531461 - protein, 9 aa, Homo Sapiens
MGKEGRREP

SEQ ID NO: 531462 - protein, 9 aa, Homo Sapiens
QVCARLLQL

SEQ ID NO: 531463 - protein, 9 aa, Homo Sapiens
EGSSPHNVP

SEQ ID NO: 531464 - protein, 9 aa, Homo Sapiens
CWGCNWCVW

SEQ ID NO: 531465 - protein, 9 aa, Homo Sapiens
DAWDVDTIF

SEQ ID NO: 531466 - protein, 9 aa, Homo Sapiens
VMLNSAAPA

SEQ ID NO: 531467 - protein, 9 aa, Homo Sapiens
SEEVQGLLA

SEQ ID NO: 531468 - protein, 9 aa, Homo Sapiens
KAPRKQLAI

SEQ ID NO: 531469 - protein, 9 aa, Homo Sapiens
EFRQTFCKI

SEQ ID NO: 531470 - protein, 9 aa, Homo Sapiens
GMEGRTGPV

SEQ ID NO: 531471 - protein, 9 aa, Homo Sapiens
TLTSTGTNT

SEQ ID NO: 531472 - protein, 9 aa, Homo Sapiens
MTRQLLHKA

SEQ ID NO: 531473 - protein, 9 aa, Homo Sapiens
LERERRCTQ

SEQ ID NO: 531474 - protein, 9 aa, Homo Sapiens
LRQPEQLLF

SEQ ID NO: 531475 - protein, 9 aa, Homo Sapiens
NVINALAHS

SEQ ID NO: 531476 - protein, 9 aa, Homo Sapiens
VPVHDQVLL

SEQ ID NO: 531477 - protein, 9 aa, Homo Sapiens
LEKTSYSVS

SEQ ID NO: 531478 - protein, 9 aa, Homo Sapiens
IAISRPLCY

SEQ ID NO: 531479 - protein, 9 aa, Homo Sapiens
GGSGALSWP

SEQ ID NO: 531480 - protein, 9 aa, Homo Sapiens
ENKAREQRI

SEQ ID NO: 531481 - protein, 9 aa, Homo Sapiens
IANNGTQEG

SEQ ID NO: 531482 - protein, 9 aa, Homo Sapiens
IRQSPTLNL

SEQ ID NO: 531483 - protein, 9 aa, Homo Sapiens
NQQHARLRV

SEQ ID NO: 531484 - protein, 9 aa, Homo Sapiens
NNGTQEGCA

SEQ ID NO: 531485 - protein, 9 aa, Homo Sapiens
YYKAQTKDI

SEQ ID NO: 531486 - protein, 9 aa, Homo Sapiens
LANNRQVCM

SEQ ID NO: 531487 - protein, 9 aa, Homo Sapiens
NSFDSLEKM

SEQ ID NO: 531488 - protein, 9 aa, Homo Sapiens
KQLAIKAAR

SEQ ID NO: 531489 - protein, 9 aa, Homo Sapiens
NLLLSLSGH

SEQ ID NO: 531490 - protein, 9 aa, Homo Sapiens
KMTFNYLSG

SEQ ID NO: 531491 - protein, 9 aa, Homo Sapiens
HQEDSGKYN

SEQ ID NO: 531492 - protein, 9 aa, Homo Sapiens
APGTLQRVP

SEQ ID NO: 531493 - protein, 9 aa, Homo Sapiens
GSSETVELA

SEQ ID NO: 531494 - protein, 9 aa, Homo Sapiens
GGGTHWRSK

SEQ ID NO: 531495 - protein, 9 aa, Homo Sapiens
VSRSVTITV

SEQ ID NO: 531496 - protein, 9 aa, Homo Sapiens
LKTILVSTD

SEQ ID NO: 531497 - protein, 9 aa, Homo Sapiens
RNPAVTSPP

SEQ ID NO: 531498 - protein, 9 aa, Homo Sapiens
SYVPSSSSN

SEQ ID NO: 531499 - protein, 9 aa, Homo Sapiens
DSRCINANI

SEQ ID NO: 531500 - protein, 9 aa, Homo Sapiens
NEVAGWEML

SEQ ID NO: 531501 - protein, 9 aa, Homo Sapiens
EVFKSAHMP

SEQ ID NO: 531502 - protein, 9 aa, Homo Sapiens
HPVTVLFPL

SEQ ID NO: 531503 - protein, 9 aa, Homo Sapiens
EVGEKSEWE

SEQ ID NO: 531504 - protein, 9 aa, Homo Sapiens
GAHVTNVCE

SEQ ID NO: 531505 - protein, 9 aa, Homo Sapiens
SPSHPEEPS

SEQ ID NO: 531506 - protein, 9 aa, Homo Sapiens
IVGTTKLKV

SEQ ID NO: 531507 - protein, 9 aa, Homo Sapiens
WCGGRRLPE

SEQ ID NO: 531508 - protein, 9 aa, Homo Sapiens
QSCGLGGMW

SEQ ID NO: 531509 - protein, 9 aa, Homo Sapiens
CYGAPYIPE

SEQ ID NO: 531510 - protein, 9 aa, Homo Sapiens
RFLAKTYST

SEQ ID NO: 531511 - protein, 9 aa, Homo Sapiens
TRPYFFTKG

SEQ ID NO: 531512 - protein, 9 aa, Homo Sapiens
VGKEELVYI

SEQ ID NO: 531513 - protein, 9 aa, Homo Sapiens
VGPFVETSE

SEQ ID NO: 531514 - protein, 9 aa, Homo Sapiens
INNQHSIES

SEQ ID NO: 531515 - protein, 9 aa, Homo Sapiens
ICHVLKQDK

SEQ ID NO: 531516 - protein, 9 aa, Homo Sapiens
VQGLLAALS

SEQ ID NO: 531517 - protein, 9 aa, Homo Sapiens
SLELTAAKK

SEQ ID NO: 531518 - protein, 9 aa, Homo Sapiens
QLHQAIEFA

SEQ ID NO: 531519 - protein, 9 aa, Homo Sapiens
VVTLFDAHV

SEQ ID NO: 531520 - protein, 9 aa, Homo Sapiens
GRTGDQATD

SEQ ID NO: 531521 - protein, 9 aa, Homo Sapiens
SLDLGGSMA

SEQ ID NO: 531522 - protein, 9 aa, Homo Sapiens
ELQCEVWGK

SEQ ID NO: 531523 - protein, 9 aa, Homo Sapiens
PKGFRLSPG

SEQ ID NO: 531524 - protein, 9 aa, Homo Sapiens
FHMLNCGRT

SEQ ID NO: 531525 - protein, 9 aa, Homo Sapiens
FLVWTMVSA

SEQ ID NO: 531526 - protein, 9 aa, Homo Sapiens
ALRHGTPLE

SEQ ID NO: 531527 - protein, 9 aa, Homo Sapiens
DNLKSSAMD

SEQ ID NO: 531528 - protein, 9 aa, Homo Sapiens
NTNDVETAH

SEQ ID NO: 531529 - protein, 9 aa, Homo Sapiens
QQVWRSPLG

SEQ ID NO: 531530 - protein, 9 aa, Homo Sapiens
ANLRTVDPE

SEQ ID NO: 531531 - protein, 9 aa, Homo Sapiens
PMSPVRPKP

SEQ ID NO: 531532 - protein, 9 aa, Homo Sapiens
STLSPTMAH

SEQ ID NO: 531533 - protein, 9 aa, Homo Sapiens
TCKAPKNTD

SEQ ID NO: 531534 - protein, 9 aa, Homo Sapiens
DVNNQCLEL

SEQ ID NO: 531535 - protein, 9 aa, Homo Sapiens
WGPTESPAG

SEQ ID NO: 531536 - protein, 9 aa, Homo Sapiens
MGPFWVRKD

SEQ ID NO: 531537 - protein, 9 aa, Homo Sapiens
VLFSRFRSQ

SEQ ID NO: 531538 - protein, 9 aa, Homo Sapiens
HSPERDQDE

SEQ ID NO: 531539 - protein, 9 aa, Homo Sapiens
TWTPVNDTD

SEQ ID NO: 531540 - protein, 9 aa, Homo Sapiens
RVYNFCTQD

SEQ ID NO: 531541 - protein, 9 aa, Homo Sapiens
GYHQVCVYD

SEQ ID NO: 531542 - protein, 9 aa, Homo Sapiens
HISRICHVL

SEQ ID NO: 531543 - protein, 9 aa, Homo Sapiens
LPQGIQEPL

SEQ ID NO: 531544 - protein, 9 aa, Homo Sapiens
KAGITFKCV

SEQ ID NO: 531545 - protein, 9 aa, Homo Sapiens
DGINCYDCV

SEQ ID NO: 531546 - protein, 9 aa, Homo Sapiens
TKEVIVAAE

SEQ ID NO: 531547 - protein, 9 aa, Homo Sapiens
CFVVHKRCR

SEQ ID NO: 531548 - protein, 9 aa, Homo Sapiens
ATAPVVTLF

SEQ ID NO: 531549 - protein, 9 aa, Homo Sapiens
HNKPKITAW

SEQ ID NO: 531550 - protein, 9 aa, Homo Sapiens
HAPWVWNIF

SEQ ID NO: 531551 - protein, 9 aa, Homo Sapiens
AGSKQKAVE

SEQ ID NO: 531552 - protein, 9 aa, Homo Sapiens
PQQIDYAQQ

SEQ ID NO: 531553 - protein, 9 aa, Homo Sapiens
IITHSGHTP

SEQ ID NO: 531554 - protein, 9 aa, Homo Sapiens
NRQVCMLAD

SEQ ID NO: 531555 - protein, 9 aa, Homo Sapiens
CNPPLNSPG

SEQ ID NO: 531556 - protein, 9 aa, Homo Sapiens
ACKKKRIAS

SEQ ID NO: 531557 - protein, 9 aa, Homo Sapiens
NHLMLEELR

SEQ ID NO: 531558 - protein, 9 aa, Homo Sapiens
KGEMKTAER

SEQ ID NO: 531559 - protein, 9 aa, Homo Sapiens
YIPCMLEPV

SEQ ID NO: 531560 - protein, 9 aa, Homo Sapiens
AGGLRCLLL

SEQ ID NO: 531561 - protein, 9 aa, Homo Sapiens
VTCEKRRTW

SEQ ID NO: 531562 - protein, 9 aa, Homo Sapiens
NRKVYQAVQ

SEQ ID NO: 531563 - protein, 9 aa, Homo Sapiens
STPWRSRGR

SEQ ID NO: 531564 - protein, 9 aa, Homo Sapiens
GVASQEQKL

SEQ ID NO: 531565 - protein, 9 aa, Homo Sapiens
GLWINGELI

SEQ ID NO: 531566 - protein, 9 aa, Homo Sapiens
VDKDCEECQ

SEQ ID NO: 531567 - protein, 9 aa, Homo Sapiens
TAELHLNNN

SEQ ID NO: 531568 - protein, 9 aa, Homo Sapiens
SFLDDPIWC

SEQ ID NO: 531569 - protein, 9 aa, Homo Sapiens
CLNKVEMER

SEQ ID NO: 531570 - protein, 9 aa, Homo Sapiens
SLSDSDMED

SEQ ID NO: 531571 - protein, 9 aa, Homo Sapiens
VAVGPRDIH

SEQ ID NO: 531572 - protein, 9 aa, Homo Sapiens
QVCPPKDTS

SEQ ID NO: 531573 - protein, 9 aa, Homo Sapiens
NKENGADVF

SEQ ID NO: 531574 - protein, 9 aa, Homo Sapiens
VRDHGMEDV

SEQ ID NO: 531575 - protein, 9 aa, Homo Sapiens
DVTGNTFEV

SEQ ID NO: 531576 - protein, 9 aa, Homo Sapiens
IKMMERVVE

SEQ ID NO: 531577 - protein, 9 aa, Homo Sapiens
VAGVPRFQF

SEQ ID NO: 531578 - protein, 9 aa, Homo Sapiens
QRVPVPTSH

SEQ ID NO: 531579 - protein, 9 aa, Homo Sapiens
LFDNRTWVH

SEQ ID NO: 531580 - protein, 9 aa, Homo Sapiens
AGYARNFWP

SEQ ID NO: 531581 - protein, 9 aa, Homo Sapiens
GVMQRLWAD

SEQ ID NO: 531582 - protein, 9 aa, Homo Sapiens
SQSEEVQGL

SEQ ID NO: 531583 - protein, 9 aa, Homo Sapiens
FQFGPPEDM

SEQ ID NO: 531584 - protein, 9 aa, Homo Sapiens
MHISQARKP

SEQ ID NO: 531585 - protein, 9 aa, Homo Sapiens
SATPVGALA

SEQ ID NO: 531586 - protein, 9 aa, Homo Sapiens
WRSPLGGEL

SEQ ID NO: 531587 - protein, 9 aa, Homo Sapiens
LGNLSAGQT

SEQ ID NO: 531588 - protein, 9 aa, Homo Sapiens
FTNPKAREW

SEQ ID NO: 531589 - protein, 9 aa, Homo Sapiens
TKGFIMINP

SEQ ID NO: 531590 - protein, 9 aa, Homo Sapiens
FGGSTHNIT

SEQ ID NO: 531591 - protein, 9 aa, Homo Sapiens
RFLKHCFTF

SEQ ID NO: 531592 - protein, 9 aa, Homo Sapiens
QCIEDRNAH

SEQ ID NO: 531593 - protein, 9 aa, Homo Sapiens
LKVVHFVSD

SEQ ID NO: 531594 - protein, 9 aa, Homo Sapiens
GGGHTKEVI

SEQ ID NO: 531595 - protein, 9 aa, Homo Sapiens
NVMFDISSL

SEQ ID NO: 531596 - protein, 9 aa, Homo Sapiens
EYDEKLAHF

SEQ ID NO: 531597 - protein, 9 aa, Homo Sapiens
RVHALVRLA

SEQ ID NO: 531598 - protein, 9 aa, Homo Sapiens
RFATAHWTV

SEQ ID NO: 531599 - protein, 9 aa, Homo Sapiens
DLGFHMLNC

SEQ ID NO: 531600 - protein, 9 aa, Homo Sapiens
HLLHLTSSL

SEQ ID NO: 531601 - protein, 9 aa, Homo Sapiens
HRGGVAHLL

SEQ ID NO: 531602 - protein, 9 aa, Homo Sapiens
VERLWEKEK

SEQ ID NO: 531603 - protein, 9 aa, Homo Sapiens
ADSRCINAN

SEQ ID NO: 531604 - protein, 9 aa, Homo Sapiens
MWRSASEQS

SEQ ID NO: 531605 - protein, 9 aa, Homo Sapiens
LEGSSPHNV

SEQ ID NO: 531606 - protein, 9 aa, Homo Sapiens
MGVCKQGLC

SEQ ID NO: 531607 - protein, 9 aa, Homo Sapiens
SRFRSQTPS

SEQ ID NO: 531608 - protein, 9 aa, Homo Sapiens
ALPGCPELS

SEQ ID NO: 531609 - protein, 9 aa, Homo Sapiens
CWSKDPSQC

SEQ ID NO: 531610 - protein, 9 aa, Homo Sapiens
GGGSGALSW

SEQ ID NO: 531611 - protein, 9 aa, Homo Sapiens
DHRCTAQQK

SEQ ID NO: 531612 - protein, 9 aa, Homo Sapiens
DVPRDVYAD

SEQ ID NO: 531613 - protein, 9 aa, Homo Sapiens
DSESSLDSE

SEQ ID NO: 531614 - protein, 9 aa, Homo Sapiens
DTERTQLAL

SEQ ID NO: 531615 - protein, 9 aa, Homo Sapiens
LRHGTPLEE

SEQ ID NO: 531616 - protein, 9 aa, Homo Sapiens
SSLAASPGH

SEQ ID NO: 531617 - protein, 9 aa, Homo Sapiens
SGADTIGDD

SEQ ID NO: 531618 - protein, 9 aa, Homo Sapiens
SGRVERLWE

SEQ ID NO: 531619 - protein, 9 aa, Homo Sapiens
SRAYVAPAP

SEQ ID NO: 531620 - protein, 9 aa, Homo Sapiens
ETAHCTAGT

SEQ ID NO: 531621 - protein, 9 aa, Homo Sapiens
RRTWGLSRI

SEQ ID NO: 531622 - protein, 9 aa, Homo Sapiens
GTNNIHGCY

SEQ ID NO: 531623 - protein, 9 aa, Homo Sapiens
SMASRPCNP

SEQ ID NO: 531624 - protein, 9 aa, Homo Sapiens
SLLDNQHWH

SEQ ID NO: 531625 - protein, 9 aa, Homo Sapiens
AELQCEVWG

SEQ ID NO: 531626 - protein, 9 aa, Homo Sapiens
TAGGFGGRG

SEQ ID NO: 531627 - protein, 9 aa, Homo Sapiens
VHHGFPYQP

SEQ ID NO: 531628 - protein, 9 aa, Homo Sapiens
ACDTFCAGA

SEQ ID NO: 531629 - protein, 9 aa, Homo Sapiens
SSVDHCFSS

SEQ ID NO: 531630 - protein, 9 aa, Homo Sapiens
CPELSFYGS

SEQ ID NO: 531631 - protein, 9 aa, Homo Sapiens
YTGSILVAI

SEQ ID NO: 531632 - protein, 9 aa, Homo Sapiens
AGPLCKSSL

SEQ ID NO: 531633 - protein, 9 aa, Homo Sapiens
NNQCLELGI

SEQ ID NO: 531634 - protein, 9 aa, Homo Sapiens
EISISAYTM

SEQ ID NO: 531635 - protein, 9 aa, Homo Sapiens
CKSSLKKGG

SEQ ID NO: 531636 - protein, 9 aa, Homo Sapiens
GQRLARVQE

SEQ ID NO: 531637 - protein, 9 aa, Homo Sapiens
TFCLSADDI

SEQ ID NO: 531638 - protein, 9 aa, Homo Sapiens
FLPSTSSTS

SEQ ID NO: 531639 - protein, 9 aa, Homo Sapiens
HAGLFLLLS

SEQ ID NO: 531640 - protein, 9 aa, Homo Sapiens
YLDGKFIDL

SEQ ID NO: 531641 - protein, 9 aa, Homo Sapiens
ISRICEAVP

SEQ ID NO: 531642 - protein, 9 aa, Homo Sapiens
ECRAYIQML

SEQ ID NO: 531643 - protein, 9 aa, Homo Sapiens
MSPVRPKPI

SEQ ID NO: 531644 - protein, 9 aa, Homo Sapiens
PDGHFVMGP

SEQ ID NO: 531645 - protein, 9 aa, Homo Sapiens
QAKAVELEH

SEQ ID NO: 531646 - protein, 9 aa, Homo Sapiens
CVCPKGFRL

SEQ ID NO: 531647 - protein, 9 aa, Homo Sapiens
SVSASQFSR

SEQ ID NO: 531648 - protein, 9 aa, Homo Sapiens
ISSEEKTQH

SEQ ID NO: 531649 - protein, 9 aa, Homo Sapiens
TQTSGETMH

SEQ ID NO: 531650 - protein, 9 aa, Homo Sapiens
GAPYIPEGQ

SEQ ID NO: 531651 - protein, 9 aa, Homo Sapiens
IGTNNIHGC

SEQ ID NO: 531652 - protein, 9 aa, Homo Sapiens
MLISKEVED

SEQ ID NO: 531653 - protein, 9 aa, Homo Sapiens
GSTGFPKAA

SEQ ID NO: 531654 - protein, 9 aa, Homo Sapiens
REENRVLQQ

SEQ ID NO: 531655 - protein, 9 aa, Homo Sapiens
ILPRTLTEA

SEQ ID NO: 531656 - protein, 9 aa, Homo Sapiens
ALKGPPRPQ

SEQ ID NO: 531657 - protein, 9 aa, Homo Sapiens
YSQINRASR

SEQ ID NO: 531658 - protein, 9 aa, Homo Sapiens
GEPILPRTL

SEQ ID NO: 531659 - protein, 9 aa, Homo Sapiens
TGDREDRPG

SEQ ID NO: 531660 - protein, 9 aa, Homo Sapiens
FLPLSPAVA

SEQ ID NO: 531661 - protein, 9 aa, Homo Sapiens
LEQLCSSLE

SEQ ID NO: 531662 - protein, 9 aa, Homo Sapiens
SGPTGLPGA

SEQ ID NO: 531663 - protein, 9 aa, Homo Sapiens
DRNAHLGES

SEQ ID NO: 531664 - protein, 9 aa, Homo Sapiens
LSAGQTPRH

SEQ ID NO: 531665 - protein, 9 aa, Homo Sapiens
NLSNVETWH

SEQ ID NO: 531666 - protein, 9 aa, Homo Sapiens
TPDHIWVFG

SEQ ID NO: 531667 - protein, 9 aa, Homo Sapiens
EYKGEKVFE

SEQ ID NO: 531668 - protein, 9 aa, Homo Sapiens
GGRRHIHIR

SEQ ID NO: 531669 - protein, 9 aa, Homo Sapiens
PRQNPLVTL

SEQ ID NO: 531670 - protein, 9 aa, Homo Sapiens
DLYKWFILV

SEQ ID NO: 531671 - protein, 9 aa, Homo Sapiens
TGICILTNW

SEQ ID NO: 531672 - protein, 9 aa, Homo Sapiens
QGTGVDLGQ

SEQ ID NO: 531673 - protein, 9 aa, Homo Sapiens
EHACLLKVK

SEQ ID NO: 531674 - protein, 9 aa, Homo Sapiens
MAHQVRTHQ

SEQ ID NO: 531675 - protein, 9 aa, Homo Sapiens
EDRKCFLCK

SEQ ID NO: 531676 - protein, 9 aa, Homo Sapiens
MHKQRGKAF

SEQ ID NO: 531677 - protein, 9 aa, Homo Sapiens
NNVLVSLSG

SEQ ID NO: 531678 - protein, 9 aa, Homo Sapiens
WDVDTIFCP

SEQ ID NO: 531679 - protein, 9 aa, Homo Sapiens
KQLMILADG

SEQ ID NO: 531680 - protein, 9 aa, Homo Sapiens
KTDMSKAPL

SEQ ID NO: 531681 - protein, 9 aa, Homo Sapiens
AAGLESAAM

SEQ ID NO: 531682 - protein, 9 aa, Homo Sapiens
HSIESQDND

SEQ ID NO: 531683 - protein, 9 aa, Homo Sapiens
ADPACRACG

SEQ ID NO: 531684 - protein, 9 aa, Homo Sapiens
FARIEAELH

SEQ ID NO: 531685 - protein, 9 aa, Homo Sapiens
NNSHIKLSL

SEQ ID NO: 531686 - protein, 9 aa, Homo Sapiens
CVTSFKDND

SEQ ID NO: 531687 - protein, 9 aa, Homo Sapiens
LIKPPTILQ

SEQ ID NO: 531688 - protein, 9 aa, Homo Sapiens
LVGGGHTKE

SEQ ID NO: 531689 - protein, 9 aa, Homo Sapiens
GKAFHQSSY

SEQ ID NO: 531690 - protein, 9 aa, Homo Sapiens
AKAAKEVQE

SEQ ID NO: 531691 - protein, 9 aa, Homo Sapiens
LAHSKRKNQ

SEQ ID NO: 531692 - protein, 9 aa, Homo Sapiens
LEVIDTTKQ

SEQ ID NO: 531693 - protein, 9 aa, Homo Sapiens
RGTERSRSL

SEQ ID NO: 531694 - protein, 9 aa, Homo Sapiens
DCDSKELRR

SEQ ID NO: 531695 - protein, 9 aa, Homo Sapiens
TAPRTEPMP

SEQ ID NO: 531696 - protein, 9 aa, Homo Sapiens
EKGMEGRTG

SEQ ID NO: 531697 - protein, 9 aa, Homo Sapiens
RVQEQVCAR

SEQ ID NO: 531698 - protein, 9 aa, Homo Sapiens
EYGTRIGKM

SEQ ID NO: 531699 - protein, 9 aa, Homo Sapiens
IDDSFCGLD

SEQ ID NO: 531700 - protein, 9 aa, Homo Sapiens
QEVLLDITD

SEQ ID NO: 531701 - protein, 9 aa, Homo Sapiens
MGLSSFTFA

SEQ ID NO: 531702 - protein, 9 aa, Homo Sapiens
EPISVNVHI

SEQ ID NO: 531703 - protein, 9 aa, Homo Sapiens
LLEWRAAFA

SEQ ID NO: 531704 - protein, 9 aa, Homo Sapiens
HTPYKCKVC

SEQ ID NO: 531705 - protein, 9 aa, Homo Sapiens
KNNLQHLQR

SEQ ID NO: 531706 - protein, 9 aa, Homo Sapiens
DELWHADRI

SEQ ID NO: 531707 - protein, 9 aa, Homo Sapiens
TPQQIDYAQ

SEQ ID NO: 531708 - protein, 9 aa, Homo Sapiens
FCLLPFPRA

SEQ ID NO: 531709 - protein, 9 aa, Homo Sapiens
CINANIREE

SEQ ID NO: 531710 - protein, 9 aa, Homo Sapiens
KDHSRSREK

SEQ ID NO: 531711 - protein, 9 aa, Homo Sapiens
TLDSLTPAN

SEQ ID NO: 531712 - protein, 9 aa, Homo Sapiens
ESHRKQAEA

SEQ ID NO: 531713 - protein, 9 aa, Homo Sapiens
GEAGAGGVA

SEQ ID NO: 531714 - protein, 9 aa, Homo Sapiens
PDPSPRGGN

SEQ ID NO: 531715 - protein, 9 aa, Homo Sapiens
KAKLGYDPM

SEQ ID NO: 531716 - protein, 9 aa, Homo Sapiens
AETLLDILI

SEQ ID NO: 531717 - protein, 9 aa, Homo Sapiens
SFHRGGVAH

SEQ ID NO: 531718 - protein, 9 aa, Homo Sapiens
QEQVCARLL

SEQ ID NO: 531719 - protein, 9 aa, Homo Sapiens
TFEVHIYSL

SEQ ID NO: 531720 - protein, 9 aa, Homo Sapiens
DNTFTGLSH

SEQ ID NO: 531721 - protein, 9 aa, Homo Sapiens
EVTGYVLMA

SEQ ID NO: 531722 - protein, 9 aa, Homo Sapiens
CQETNREDE

SEQ ID NO: 531723 - protein, 9 aa, Homo Sapiens
FCSQFINTR

SEQ ID NO: 531724 - protein, 9 aa, Homo Sapiens
LNEAKPIGF

SEQ ID NO: 531725 - protein, 9 aa, Homo Sapiens
CGGGGQIWG

SEQ ID NO: 531726 - protein, 9 aa, Homo Sapiens
WINGELITA

SEQ ID NO: 531727 - protein, 9 aa, Homo Sapiens
HRVLGPWGP

SEQ ID NO: 531728 - protein, 9 aa, Homo Sapiens
PPKGWFCLL

SEQ ID NO: 531729 - protein, 9 aa, Homo Sapiens
ATGDREDRP

SEQ ID NO: 531730 - protein, 9 aa, Homo Sapiens
SQGAHVTNV

SEQ ID NO: 531731 - protein, 9 aa, Homo Sapiens
FLNYNISCI

SEQ ID NO: 531732 - protein, 9 aa, Homo Sapiens
EGIRSVMRY

SEQ ID NO: 531733 - protein, 9 aa, Homo Sapiens
VGYTQDVHG

SEQ ID NO: 531734 - protein, 9 aa, Homo Sapiens
LQKVMLPPN

SEQ ID NO: 531735 - protein, 9 aa, Homo Sapiens
NDTFCLEFL

SEQ ID NO: 531736 - protein, 9 aa, Homo Sapiens
LDDFWNTQK

SEQ ID NO: 531737 - protein, 9 aa, Homo Sapiens
AKGVETTGS

SEQ ID NO: 531738 - protein, 9 aa, Homo Sapiens
SQAYHSAPE

SEQ ID NO: 531739 - protein, 9 aa, Homo Sapiens
LSTDSACHR

SEQ ID NO: 531740 - protein, 9 aa, Homo Sapiens
TGNTFEVHI

SEQ ID NO: 531741 - protein, 9 aa, Homo Sapiens
LCGFPPFHS

SEQ ID NO: 531742 - protein, 9 aa, Homo Sapiens
DYAQQLIEE

SEQ ID NO: 531743 - protein, 9 aa, Homo Sapiens
LDAKTSSHL

SEQ ID NO: 531744 - protein, 9 aa, Homo Sapiens
KGPPRPQGP

SEQ ID NO: 531745 - protein, 9 aa, Homo Sapiens
SPTTEVRWF

SEQ ID NO: 531746 - protein, 9 aa, Homo Sapiens
PGSPDKTAP

SEQ ID NO: 531747 - protein, 9 aa, Homo Sapiens
FQTFLNKTM

SEQ ID NO: 531748 - protein, 9 aa, Homo Sapiens
DPSQQPKQK

SEQ ID NO: 531749 - protein, 9 aa, Homo Sapiens
TAEEAQHWV

SEQ ID NO: 531750 - protein, 9 aa, Homo Sapiens
RICEAVPGA

SEQ ID NO: 531751 - protein, 9 aa, Homo Sapiens
PEEARPKHT

SEQ ID NO: 531752 - protein, 9 aa, Homo Sapiens
AEAEHLWKE

SEQ ID NO: 531753 - protein, 9 aa, Homo Sapiens
TDNFIAAMR

SEQ ID NO: 531754 - protein, 9 aa, Homo Sapiens
AFSATPVGA

SEQ ID NO: 531755 - protein, 9 aa, Homo Sapiens
CKRVMQEAC

SEQ ID NO: 531756 - protein, 9 aa, Homo Sapiens
GSYPLQALR

SEQ ID NO: 531757 - protein, 9 aa, Homo Sapiens
YLKQMCCLP

SEQ ID NO: 531758 - protein, 9 aa, Homo Sapiens
RVACSETAP

SEQ ID NO: 531759 - protein, 9 aa, Homo Sapiens
VMLPPNSFQ

SEQ ID NO: 531760 - protein, 9 aa, Homo Sapiens
TNEAKCDSH

SEQ ID NO: 531761 - protein, 9 aa, Homo Sapiens
KTLAMGLIN

SEQ ID NO: 531762 - protein, 9 aa, Homo Sapiens
RKNSFDSLE

SEQ ID NO: 531763 - protein, 9 aa, Homo Sapiens
KIWTEKTMK

SEQ ID NO: 531764 - protein, 9 aa, Homo Sapiens
VGGGHTKEV

SEQ ID NO: 531765 - protein, 9 aa, Homo Sapiens
SSLDSEGTI

SEQ ID NO: 531766 - protein, 9 aa, Homo Sapiens
SEFFLIQDT

SEQ ID NO: 531767 - protein, 9 aa, Homo Sapiens
HGWCGGRRL

SEQ ID NO: 531768 - protein, 9 aa, Homo Sapiens
RRRNRIHLF

SEQ ID NO: 531769 - protein, 9 aa, Homo Sapiens
YRPLICDAN

SEQ ID NO: 531770 - protein, 9 aa, Homo Sapiens
KEELVYIAC

SEQ ID NO: 531771 - protein, 9 aa, Homo Sapiens
CREFVTFSC

SEQ ID NO: 531772 - protein, 9 aa, Homo Sapiens
TTASPQAPE

SEQ ID NO: 531773 - protein, 9 aa, Homo Sapiens
FLTSDLSPY

SEQ ID NO: 531774 - protein, 9 aa, Homo Sapiens
ADKEKELQK

SEQ ID NO: 531775 - protein, 9 aa, Homo Sapiens
SRSLKRGSK

SEQ ID NO: 531776 - protein, 9 aa, Homo Sapiens
SDETETLKK

SEQ ID NO: 531777 - protein, 9 aa, Homo Sapiens
GETMHTDKE

SEQ ID NO: 531778 - protein, 9 aa, Homo Sapiens
KKGEMKTAE

SEQ ID NO: 531779 - protein, 9 aa, Homo Sapiens
TIFGLGAGA

SEQ ID NO: 531780 - protein, 9 aa, Homo Sapiens
NFIAAMRRR

SEQ ID NO: 531781 - protein, 9 aa, Homo Sapiens
TGMGLSSFT

SEQ ID NO: 531782 - protein, 9 aa, Homo Sapiens
QINRASRAL

SEQ ID NO: 531783 - protein, 9 aa, Homo Sapiens
HALVRLACR

SEQ ID NO: 531784 - protein, 9 aa, Homo Sapiens
NKTDMSKAP

SEQ ID NO: 531785 - protein, 9 aa, Homo Sapiens
KSAADACYE

SEQ ID NO: 531786 - protein, 9 aa, Homo Sapiens
WGNPCALSF

SEQ ID NO: 531787 - protein, 9 aa, Homo Sapiens
LLCPLGYEC

SEQ ID NO: 531788 - protein, 9 aa, Homo Sapiens
IFGLGAGAS

SEQ ID NO: 531789 - protein, 9 aa, Homo Sapiens
RGKQHATKP

SEQ ID NO: 531790 - protein, 9 aa, Homo Sapiens
FVRDHGMED

SEQ ID NO: 531791 - protein, 9 aa, Homo Sapiens
YLRIEPDTT

SEQ ID NO: 531792 - protein, 9 aa, Homo Sapiens
GESHTHSHV

SEQ ID NO: 531793 - protein, 9 aa, Homo Sapiens
AWDVDTIFC

SEQ ID NO: 531794 - protein, 9 aa, Homo Sapiens
ARYLAMQTL

SEQ ID NO: 531795 - protein, 9 aa, Homo Sapiens
VNVIFVRDH

SEQ ID NO: 531796 - protein, 9 aa, Homo Sapiens
ARLREGRRG

SEQ ID NO: 531797 - protein, 9 aa, Homo Sapiens
VQYAVSMAS

SEQ ID NO: 531798 - protein, 9 aa, Homo Sapiens
PVSEFFLIQ

SEQ ID NO: 531799 - protein, 9 aa, Homo Sapiens
LCKTVHHGF

SEQ ID NO: 531800 - protein, 9 aa, Homo Sapiens
IVVSWMIVQ

SEQ ID NO: 531801 - protein, 9 aa, Homo Sapiens
TINAIGHLG

SEQ ID NO: 531802 - protein, 9 aa, Homo Sapiens
EKTMKQTEV

SEQ ID NO: 531803 - protein, 9 aa, Homo Sapiens
RFGGSTHNI

SEQ ID NO: 531804 - protein, 9 aa, Homo Sapiens
ENPYFCLKK

SEQ ID NO: 531805 - protein, 9 aa, Homo Sapiens
NPKAREWYS

SEQ ID NO: 531806 - protein, 9 aa, Homo Sapiens
LGYECHILS

SEQ ID NO: 531807 - protein, 9 aa, Homo Sapiens
GSVSASQFS

SEQ ID NO: 531808 - protein, 9 aa, Homo Sapiens
VMSYGERPH

SEQ ID NO: 531809 - protein, 9 aa, Homo Sapiens
LAASPGHVV

SEQ ID NO: 531810 - protein, 9 aa, Homo Sapiens
TGLPGAPAS

SEQ ID NO: 531811 - protein, 9 aa, Homo Sapiens
VINALAHSK

SEQ ID NO: 531812 - protein, 9 aa, Homo Sapiens
QHNKATENK

SEQ ID NO: 531813 - protein, 9 aa, Homo Sapiens
DLWGPTESP

SEQ ID NO: 531814 - protein, 9 aa, Homo Sapiens
VTDLLGHRQ

SEQ ID NO: 531815 - protein, 9 aa, Homo Sapiens
RRLQSQLSL

SEQ ID NO: 531816 - protein, 9 aa, Homo Sapiens
PRTPHRVLG

SEQ ID NO: 531817 - protein, 9 aa, Homo Sapiens
CLPGESQLS

SEQ ID NO: 531818 - protein, 9 aa, Homo Sapiens
RIHLFSEPQ

SEQ ID NO: 531819 - protein, 9 aa, Homo Sapiens
TPCRMSMNS

SEQ ID NO: 531820 - protein, 9 aa, Homo Sapiens
SDDCKLPHV

SEQ ID NO: 531821 - protein, 9 aa, Homo Sapiens
SQCPSMEEI

SEQ ID NO: 531822 - protein, 9 aa, Homo Sapiens
RIAALGVEC

SEQ ID NO: 531823 - protein, 9 aa, Homo Sapiens
KKHQKERQC

SEQ ID NO: 531824 - protein, 9 aa, Homo Sapiens
FLLRNPAVT

SEQ ID NO: 531825 - protein, 9 aa, Homo Sapiens
AAKEAERQR

SEQ ID NO: 531826 - protein, 9 aa, Homo Sapiens
PILKEKVSF

SEQ ID NO: 531827 - protein, 9 aa, Homo Sapiens
RVERLWEKE

SEQ ID NO: 531828 - protein, 9 aa, Homo Sapiens
EQEEMWWQE

SEQ ID NO: 531829 - protein, 9 aa, Homo Sapiens
RVTFLSCNL

SEQ ID NO: 531830 - protein, 9 aa, Homo Sapiens
EAEVHQLVV

SEQ ID NO: 531831 - protein, 9 aa, Homo Sapiens
DRYRVLVYP

SEQ ID NO: 531832 - protein, 9 aa, Homo Sapiens
HGKDPLMYF

SEQ ID NO: 531833 - protein, 9 aa, Homo Sapiens
AVTLGNPDI

SEQ ID NO: 531834 - protein, 9 aa, Homo Sapiens
LDHHLYEAE

SEQ ID NO: 531835 - protein, 9 aa, Homo Sapiens
KEVRGRGNF

SEQ ID NO: 531836 - protein, 9 aa, Homo Sapiens
SSYVPSSSS

SEQ ID NO: 531837 - protein, 9 aa, Homo Sapiens
QNLGYTTAS

SEQ ID NO: 531838 - protein, 9 aa, Homo Sapiens
CQDGENQSM

SEQ ID NO: 531839 - protein, 9 aa, Homo Sapiens
HECGEKPDM

SEQ ID NO: 531840 - protein, 9 aa, Homo Sapiens
NLGDFRFLF

SEQ ID NO: 531841 - protein, 9 aa, Homo Sapiens
EQLLFILDG

SEQ ID NO: 531842 - protein, 9 aa, Homo Sapiens
WWQEEKIRE

SEQ ID NO: 531843 - protein, 9 aa, Homo Sapiens
YSVSIEENC

SEQ ID NO: 531844 - protein, 9 aa, Homo Sapiens
ELLDVPRDV

SEQ ID NO: 531845 - protein, 9 aa, Homo Sapiens
ASQFSRWFS

SEQ ID NO: 531846 - protein, 9 aa, Homo Sapiens
KTDPVTAEN

SEQ ID NO: 531847 - protein, 9 aa, Homo Sapiens
GGGGQIWGP

SEQ ID NO: 531848 - protein, 9 aa, Homo Sapiens
FYGSQMGTA

SEQ ID NO: 531849 - protein, 9 aa, Homo Sapiens
ERLWEKEKV

SEQ ID NO: 531850 - protein, 9 aa, Homo Sapiens
HHGFPYQPS

SEQ ID NO: 531851 - protein, 9 aa, Homo Sapiens
EWGTAPWVE

SEQ ID NO: 531852 - protein, 9 aa, Homo Sapiens
QKHVVFGSE

SEQ ID NO: 531853 - protein, 9 aa, Homo Sapiens
EKALNQTKY

SEQ ID NO: 531854 - protein, 9 aa, Homo Sapiens
DACYEAACN

SEQ ID NO: 531855 - protein, 9 aa, Homo Sapiens
MGTAEEFAN

SEQ ID NO: 531856 - protein, 9 aa, Homo Sapiens
SLLQAWEWQ

SEQ ID NO: 531857 - protein, 9 aa, Homo Sapiens
SCMYVRCMP

SEQ ID NO: 531858 - protein, 9 aa, Homo Sapiens
FEVHIYSLG

SEQ ID NO: 531859 - protein, 9 aa, Homo Sapiens
CCRHRCCGC

SEQ ID NO: 531860 - protein, 9 aa, Homo Sapiens
QVQTSYVPE

SEQ ID NO: 531861 - protein, 9 aa, Homo Sapiens
TLQDHTEKM

SEQ ID NO: 531862 - protein, 9 aa, Homo Sapiens
TEAGPGWAL

SEQ ID NO: 531863 - protein, 9 aa, Homo Sapiens
SLKTEADVE

SEQ ID NO: 531864 - protein, 9 aa, Homo Sapiens
CSAYCSIVV

SEQ ID NO: 531865 - protein, 9 aa, Homo Sapiens
NAIGHLGNQ

SEQ ID NO: 531866 - protein, 9 aa, Homo Sapiens
LDGKFIDLS

SEQ ID NO: 531867 - protein, 9 aa, Homo Sapiens
SKQKGDAIL

SEQ ID NO: 531868 - protein, 9 aa, Homo Sapiens
RDRFWEFFE

SEQ ID NO: 531869 - protein, 9 aa, Homo Sapiens
DHRRLMYRD

SEQ ID NO: 531870 - protein, 9 aa, Homo Sapiens
RSTGDEGPA

SEQ ID NO: 531871 - protein, 9 aa, Homo Sapiens
SSTSSYVPS

SEQ ID NO: 531872 - protein, 9 aa, Homo Sapiens
RNSIPMSPV

SEQ ID NO: 531873 - protein, 9 aa, Homo Sapiens
SGHLARVEN

SEQ ID NO: 531874 - protein, 9 aa, Homo Sapiens
SLEKMKMFI

SEQ ID NO: 531875 - protein, 9 aa, Homo Sapiens
AAENSIGVG

SEQ ID NO: 531876 - protein, 9 aa, Homo Sapiens
SESSLDSEG

SEQ ID NO: 531877 - protein, 9 aa, Homo Sapiens
SVVERNACV

SEQ ID NO: 531878 - protein, 9 aa, Homo Sapiens
ELFEISTAE

SEQ ID NO: 531879 - protein, 9 aa, Homo Sapiens
THSGHTPYK

SEQ ID NO: 531880 - protein, 9 aa, Homo Sapiens
SCTPDHIWV

SEQ ID NO: 531881 - protein, 9 aa, Homo Sapiens
PLYGLGELS

SEQ ID NO: 531882 - protein, 9 aa, Homo Sapiens
LMSGMILGG

SEQ ID NO: 531883 - protein, 9 aa, Homo Sapiens
KMSGADTIG

SEQ ID NO: 531884 - protein, 9 aa, Homo Sapiens
DSEATHNEW

SEQ ID NO: 531885 - protein, 9 aa, Homo Sapiens
GEAHVELDS

SEQ ID NO: 531886 - protein, 9 aa, Homo Sapiens
PPGEHGEKG

SEQ ID NO: 531887 - protein, 9 aa, Homo Sapiens
SGSGRSLVT

SEQ ID NO: 531888 - protein, 9 aa, Homo Sapiens
GSPDKTAPL

SEQ ID NO: 531889 - protein, 9 aa, Homo Sapiens
NCSQVCPPK

SEQ ID NO: 531890 - protein, 9 aa, Homo Sapiens
VLVSLSGKT

SEQ ID NO: 531891 - protein, 9 aa, Homo Sapiens
AVAPPPTSN

SEQ ID NO: 531892 - protein, 9 aa, Homo Sapiens
GHLTKQLMI

SEQ ID NO: 531893 - protein, 9 aa, Homo Sapiens
ITFKCVGVP

SEQ ID NO: 531894 - protein, 9 aa, Homo Sapiens
AMRRFLPST

SEQ ID NO: 531895 - protein, 9 aa, Homo Sapiens
LAAATISTS

SEQ ID NO: 531896 - protein, 9 aa, Homo Sapiens
LKEKVSFVS

SEQ ID NO: 531897 - protein, 9 aa, Homo Sapiens
PRKQLAIKA

SEQ ID NO: 531898 - protein, 9 aa, Homo Sapiens
EGCCAKPSA

SEQ ID NO: 531899 - protein, 9 aa, Homo Sapiens
CLLPFPRAE

SEQ ID NO: 531900 - protein, 9 aa, Homo Sapiens
HLTPRPGPN

SEQ ID NO: 531901 - protein, 9 aa, Homo Sapiens
STNVRSTDQ

SEQ ID NO: 531902 - protein, 9 aa, Homo Sapiens
EVRGRGNFP

SEQ ID NO: 531903 - protein, 9 aa, Homo Sapiens
GRYRNRSLS

SEQ ID NO: 531904 - protein, 9 aa, Homo Sapiens
RRKCLQELE

SEQ ID NO: 531905 - protein, 9 aa, Homo Sapiens
RQNPLVTLG

SEQ ID NO: 531906 - protein, 9 aa, Homo Sapiens
GGANYYFNV

SEQ ID NO: 531907 - protein, 9 aa, Homo Sapiens
QQLIEEKIG

SEQ ID NO: 531908 - protein, 9 aa, Homo Sapiens
RNSWVREYT

SEQ ID NO: 531909 - protein, 9 aa, Homo Sapiens
RSAASSGAW

SEQ ID NO: 531910 - protein, 9 aa, Homo Sapiens
YIAVCHPMK

SEQ ID NO: 531911 - protein, 9 aa, Homo Sapiens
PYACGDCGC

SEQ ID NO: 531912 - protein, 9 aa, Homo Sapiens
GGLRCLLLD

SEQ ID NO: 531913 - protein, 9 aa, Homo Sapiens
KIGLMSLTM

SEQ ID NO: 531914 - protein, 9 aa, Homo Sapiens
RAVKRMWHL

SEQ ID NO: 531915 - protein, 9 aa, Homo Sapiens
PILPRTLTE

SEQ ID NO: 531916 - protein, 9 aa, Homo Sapiens
QDVHGECID

SEQ ID NO: 531917 - protein, 9 aa, Homo Sapiens
DGTRPYFFT

SEQ ID NO: 531918 - protein, 9 aa, Homo Sapiens
SQSLLRRHR

SEQ ID NO: 531919 - protein, 9 aa, Homo Sapiens
ILTNWLMAF

SEQ ID NO: 531920 - protein, 9 aa, Homo Sapiens
NQSMYQNLC

SEQ ID NO: 531921 - protein, 9 aa, Homo Sapiens
GFHMLNCGR

SEQ ID NO: 531922 - protein, 9 aa, Homo Sapiens
DIYVIPRPH

SEQ ID NO: 531923 - protein, 9 aa, Homo Sapiens
VLGPWGPPE

SEQ ID NO: 531924 - protein, 9 aa, Homo Sapiens
VPRDVYADF

SEQ ID NO: 531925 - protein, 9 aa, Homo Sapiens
LMVGDRPET

SEQ ID NO: 531926 - protein, 9 aa, Homo Sapiens
QAFGGEEEE

SEQ ID NO: 531927 - protein, 9 aa, Homo Sapiens
SAHMPVIIS

SEQ ID NO: 531928 - protein, 9 aa, Homo Sapiens
TSEYLRIEP

SEQ ID NO: 531929 - protein, 9 aa, Homo Sapiens
ISSWKKAVE

SEQ ID NO: 531930 - protein, 9 aa, Homo Sapiens
SQLTSNQQH

SEQ ID NO: 531931 - protein, 9 aa, Homo Sapiens
MEQLVLMAP

SEQ ID NO: 531932 - protein, 9 aa, Homo Sapiens
VLCQCQEGV

SEQ ID NO: 531933 - protein, 9 aa, Homo Sapiens
RQLQEKDPK

SEQ ID NO: 531934 - protein, 9 aa, Homo Sapiens
ENFTETDIK

SEQ ID NO: 531935 - protein, 9 aa, Homo Sapiens
MIRMAEAHV

SEQ ID NO: 531936 - protein, 9 aa, Homo Sapiens
DDCKLPHVL

SEQ ID NO: 531937 - protein, 9 aa, Homo Sapiens
MCSSPSPTT

SEQ ID NO: 531938 - protein, 9 aa, Homo Sapiens
RVQLISRKT

SEQ ID NO: 531939 - protein, 9 aa, Homo Sapiens
LLTAKKKVL

SEQ ID NO: 531940 - protein, 9 aa, Homo Sapiens
QPEQLLFIL

SEQ ID NO: 531941 - protein, 9 aa, Homo Sapiens
KAFCRSAAY

SEQ ID NO: 531942 - protein, 9 aa, Homo Sapiens
TASPQAPEA

SEQ ID NO: 531943 - protein, 9 aa, Homo Sapiens
QKKLSQMAP

SEQ ID NO: 531944 - protein, 9 aa, Homo Sapiens
FNWDGCSVL

SEQ ID NO: 531945 - protein, 9 aa, Homo Sapiens
SRQLRHILL

SEQ ID NO: 531946 - protein, 9 aa, Homo Sapiens
RERRCTQRY

SEQ ID NO: 531947 - protein, 9 aa, Homo Sapiens
VYSINNVLV

SEQ ID NO: 531948 - protein, 9 aa, Homo Sapiens
LAHYTKRMT

SEQ ID NO: 531949 - protein, 9 aa, Homo Sapiens
ARTYFYTNE

SEQ ID NO: 531950 - protein, 9 aa, Homo Sapiens
QAVQHNKAT

SEQ ID NO: 531951 - protein, 9 aa, Homo Sapiens
VSATHIVYP

SEQ ID NO: 531952 - protein, 9 aa, Homo Sapiens
LYKWFILVL

SEQ ID NO: 531953 - protein, 9 aa, Homo Sapiens
APTAEEAQH

SEQ ID NO: 531954 - protein, 9 aa, Homo Sapiens
RKCFLCKAV

SEQ ID NO: 531955 - protein, 9 aa, Homo Sapiens
MQWASLELT

SEQ ID NO: 531956 - protein, 9 aa, Homo Sapiens
EELVYIACQ

SEQ ID NO: 531957 - protein, 9 aa, Homo Sapiens
QILSCNKCV

SEQ ID NO: 531958 - protein, 9 aa, Homo Sapiens
QQIVGGANY

SEQ ID NO: 531959 - protein, 9 aa, Homo Sapiens
ADVQYAVSM

SEQ ID NO: 531960 - protein, 9 aa, Homo Sapiens
SLRHAGLFL

SEQ ID NO: 531961 - protein, 9 aa, Homo Sapiens
GTKGFIMIN

SEQ ID NO: 531962 - protein, 9 aa, Homo Sapiens
RGPDGHFVM

SEQ ID NO: 531963 - protein, 9 aa, Homo Sapiens
TGVDTSKAV

SEQ ID NO: 531964 - protein, 9 aa, Homo Sapiens
VCHPMKALD

SEQ ID NO: 531965 - protein, 9 aa, Homo Sapiens
SSHLGVLTV

SEQ ID NO: 531966 - protein, 9 aa, Homo Sapiens
TKHSTAELM

SEQ ID NO: 531967 - protein, 9 aa, Homo Sapiens
KDKPLGEGR

SEQ ID NO: 531968 - protein, 9 aa, Homo Sapiens
SKLKLVHSL

SEQ ID NO: 531969 - protein, 9 aa, Homo Sapiens
CQECGRAYS

SEQ ID NO: 531970 - protein, 9 aa, Homo Sapiens
KVSDTMVEP

SEQ ID NO: 531971 - protein, 9 aa, Homo Sapiens
CNTCADMLR

SEQ ID NO: 531972 - protein, 9 aa, Homo Sapiens
LMSLTMNLY

SEQ ID NO: 531973 - protein, 9 aa, Homo Sapiens
VLQQLLEQK

SEQ ID NO: 531974 - protein, 9 aa, Homo Sapiens
TFCLEFLLV

SEQ ID NO: 531975 - protein, 9 aa, Homo Sapiens
RRRRVVLKR

SEQ ID NO: 531976 - protein, 9 aa, Homo Sapiens
HIVVSWMIV

SEQ ID NO: 531977 - protein, 9 aa, Homo Sapiens
TRLEAENTP

SEQ ID NO: 531978 - protein, 9 aa, Homo Sapiens
TAEGANLRT

SEQ ID NO: 531979 - protein, 9 aa, Homo Sapiens
STSEYLRIE

SEQ ID NO: 531980 - protein, 9 aa, Homo Sapiens
LTAAKKQEK

SEQ ID NO: 531981 - protein, 9 aa, Homo Sapiens
TKIWTEKTM

SEQ ID NO: 531982 - protein, 9 aa, Homo Sapiens
WALEEISIS

SEQ ID NO: 531983 - protein, 9 aa, Homo Sapiens
VDTSKAVLM

SEQ ID NO: 531984 - protein, 9 aa, Homo Sapiens
PLCKSSLKK

SEQ ID NO: 531985 - protein, 9 aa, Homo Sapiens
SVRECARSR

SEQ ID NO: 531986 - protein, 9 aa, Homo Sapiens
RNAHLGESV

SEQ ID NO: 531987 - protein, 9 aa, Homo Sapiens
LTGAKSHEL

SEQ ID NO: 531988 - protein, 9 aa, Homo Sapiens
ELAAIQDMF

SEQ ID NO: 531989 - protein, 9 aa, Homo Sapiens
PICNPPLNS

SEQ ID NO: 531990 - protein, 9 aa, Homo Sapiens
IQDMFLCCG

SEQ ID NO: 531991 - protein, 9 aa, Homo Sapiens
QEQEEMWWQ

SEQ ID NO: 531992 - protein, 9 aa, Homo Sapiens
YRTFSALWA

SEQ ID NO: 531993 - protein, 9 aa, Homo Sapiens
NSSLLDLEM

SEQ ID NO: 531994 - protein, 9 aa, Homo Sapiens
DSKQKGDAI

SEQ ID NO: 531995 - protein, 9 aa, Homo Sapiens
SGPASGPTG

SEQ ID NO: 531996 - protein, 9 aa, Homo Sapiens
VHIYSLGAT

SEQ ID NO: 531997 - protein, 9 aa, Homo Sapiens
NSIGVGPFV

SEQ ID NO: 531998 - protein, 9 aa, Homo Sapiens
GSSDSESSL

SEQ ID NO: 531999 - protein, 9 aa, Homo Sapiens
FIPMHDSPS

SEQ ID NO: 532000 - protein, 9 aa, Homo Sapiens
NEEKFARIE

SEQ ID NO: 532001 - protein, 9 aa, Homo Sapiens
LSCNLEEPK

SEQ ID NO: 532002 - protein, 9 aa, Homo Sapiens
VIFVRDHGM

SEQ ID NO: 532003 - protein, 9 aa, Homo Sapiens
HVTHSLQDE

SEQ ID NO: 532004 - protein, 9 aa, Homo Sapiens
CHIMLMGVC

SEQ ID NO: 532005 - protein, 9 aa, Homo Sapiens
SRSRRLQSQ

SEQ ID NO: 532006 - protein, 9 aa, Homo Sapiens
GPLPEGASF

SEQ ID NO: 532007 - protein, 9 aa, Homo Sapiens
MLEELRTCS

SEQ ID NO: 532008 - protein, 9 aa, Homo Sapiens
MILADGRVV

SEQ ID NO: 532009 - protein, 9 aa, Homo Sapiens
LVILATEQL

SEQ ID NO: 532010 - protein, 9 aa, Homo Sapiens
SSSSTSSYV

SEQ ID NO: 532011 - protein, 9 aa, Homo Sapiens
ILSCNKCVT

SEQ ID NO: 532012 - protein, 9 aa, Homo Sapiens
KYVDINTFC

SEQ ID NO: 532013 - protein, 9 aa, Homo Sapiens
GKSAADACY

SEQ ID NO: 532014 - protein, 9 aa, Homo Sapiens
MTLPSSYHG

SEQ ID NO: 532015 - protein, 9 aa, Homo Sapiens
ALKCLSLGL

SEQ ID NO: 532016 - protein, 9 aa, Homo Sapiens
QDLGFHMLN

SEQ ID NO: 532017 - protein, 9 aa, Homo Sapiens
ADRSMRKGI

SEQ ID NO: 532018 - protein, 9 aa, Homo Sapiens
NYCFQTFLN

SEQ ID NO: 532019 - protein, 9 aa, Homo Sapiens
RPLDRRVQS

SEQ ID NO: 532020 - protein, 9 aa, Homo Sapiens
ANKYGIVVI

SEQ ID NO: 532021 - protein, 9 aa, Homo Sapiens
LCPLGYECH

SEQ ID NO: 532022 - protein, 9 aa, Homo Sapiens
ALLEWRAAF

SEQ ID NO: 532023 - protein, 9 aa, Homo Sapiens
NDLIEEQYK

SEQ ID NO: 532024 - protein, 9 aa, Homo Sapiens
IQEPLNNSS

SEQ ID NO: 532025 - protein, 9 aa, Homo Sapiens
HHLYEAEEA

SEQ ID NO: 532026 - protein, 9 aa, Homo Sapiens
VMRYLTSHL

SEQ ID NO: 532027 - protein, 9 aa, Homo Sapiens
RVDMTLPSS

SEQ ID NO: 532028 - protein, 9 aa, Homo Sapiens
IPWDLWGPT

SEQ ID NO: 532029 - protein, 9 aa, Homo Sapiens
CFNPIVNKT

SEQ ID NO: 532030 - protein, 9 aa, Homo Sapiens
LHQAIEFAC

SEQ ID NO: 532031 - protein, 9 aa, Homo Sapiens
QIVGGANYY

SEQ ID NO: 532032 - protein, 9 aa, Homo Sapiens
YESNPQLHQ

SEQ ID NO: 532033 - protein, 9 aa, Homo Sapiens
PHPVTVLFP

SEQ ID NO: 532034 - protein, 9 aa, Homo Sapiens
CFQCSVCNE

SEQ ID NO: 532035 - protein, 9 aa, Homo Sapiens
TSGETMHTD

SEQ ID NO: 532036 - protein, 9 aa, Homo Sapiens
DGHFVMGPT

SEQ ID NO: 532037 - protein, 9 aa, Homo Sapiens
CLQELEGQI

SEQ ID NO: 532038 - protein, 9 aa, Homo Sapiens
GRRQPCKKV

SEQ ID NO: 532039 - protein, 9 aa, Homo Sapiens
VILATEQLL

SEQ ID NO: 532040 - protein, 9 aa, Homo Sapiens
MDADKEKEL

SEQ ID NO: 532041 - protein, 9 aa, Homo Sapiens
LNDLIEEQY

SEQ ID NO: 532042 - protein, 9 aa, Homo Sapiens
EIYGWIERE

SEQ ID NO: 532043 - protein, 9 aa, Homo Sapiens
TSIQSVREV

SEQ ID NO: 532044 - protein, 9 aa, Homo Sapiens
RVLQQLLEQ

SEQ ID NO: 532045 - protein, 9 aa, Homo Sapiens
QTGVDTSKA

SEQ ID NO: 532046 - protein, 9 aa, Homo Sapiens
CQFKLKLLL

SEQ ID NO: 532047 - protein, 9 aa, Homo Sapiens
FVLAVTMTQ

SEQ ID NO: 532048 - protein, 9 aa, Homo Sapiens
SNVETWHKD

SEQ ID NO: 532049 - protein, 9 aa, Homo Sapiens
WTDISAHIL

SEQ ID NO: 532050 - protein, 9 aa, Homo Sapiens
RREPRSQPS

SEQ ID NO: 532051 - protein, 9 aa, Homo Sapiens
LLPTNDPLE

SEQ ID NO: 532052 - protein, 9 aa, Homo Sapiens
WCEDTRHTA

SEQ ID NO: 532053 - protein, 9 aa, Homo Sapiens
CVYVIGQEK

SEQ ID NO: 532054 - protein, 9 aa, Homo Sapiens
FIYIWPFSR

SEQ ID NO: 532055 - protein, 9 aa, Homo Sapiens
VERNACVIK

SEQ ID NO: 532056 - protein, 9 aa, Homo Sapiens
RHILLPLYE

SEQ ID NO: 532057 - protein, 9 aa, Homo Sapiens
GATEAGPLC

SEQ ID NO: 532058 - protein, 9 aa, Homo Sapiens
GHTPYKCKV

SEQ ID NO: 532059 - protein, 9 aa, Homo Sapiens
EGRFSICRK

SEQ ID NO: 532060 - protein, 9 aa, Homo Sapiens
NVGYTQDVH

SEQ ID NO: 532061 - protein, 9 aa, Homo Sapiens
ARPLDRRVQ

SEQ ID NO: 532062 - protein, 9 aa, Homo Sapiens
PDYQPPSFK

SEQ ID NO: 532063 - protein, 9 aa, Homo Sapiens
LRCLLLDRR

SEQ ID NO: 532064 - protein, 9 aa, Homo Sapiens
ESHTHSHVL

SEQ ID NO: 532065 - protein, 9 aa, Homo Sapiens
DQDNYIPCM

SEQ ID NO: 532066 - protein, 9 aa, Homo Sapiens
SDYRPLICD

SEQ ID NO: 532067 - protein, 9 aa, Homo Sapiens
NSHIKLSLK

SEQ ID NO: 532068 - protein, 9 aa, Homo Sapiens
LDALKGPPR

SEQ ID NO: 532069 - protein, 9 aa, Homo Sapiens
VSVVERNAC

SEQ ID NO: 532070 - protein, 9 aa, Homo Sapiens
LWRTTAFVQ

SEQ ID NO: 532071 - protein, 9 aa, Homo Sapiens
LGPWGPPEP

SEQ ID NO: 532072 - protein, 9 aa, Homo Sapiens
SIGVGPFVE

SEQ ID NO: 532073 - protein, 9 aa, Homo Sapiens
SVQNFLYIL

SEQ ID NO: 532074 - protein, 9 aa, Homo Sapiens
KYSFPMEMM

SEQ ID NO: 532075 - protein, 9 aa, Homo Sapiens
ELVGQLRWG

SEQ ID NO: 532076 - protein, 9 aa, Homo Sapiens
TEAGPLCKS

SEQ ID NO: 532077 - protein, 9 aa, Homo Sapiens
VWGKPRPPV

SEQ ID NO: 532078 - protein, 9 aa, Homo Sapiens
VRSEHGRYL

SEQ ID NO: 532079 - protein, 9 aa, Homo Sapiens
VWRDNHGWC

SEQ ID NO: 532080 - protein, 9 aa, Homo Sapiens
TSTGTNTNE

SEQ ID NO: 532081 - protein, 9 aa, Homo Sapiens
YMLISKEVE

SEQ ID NO: 532082 - protein, 9 aa, Homo Sapiens
AETLWEREG

SEQ ID NO: 532083 - protein, 9 aa, Homo Sapiens
QEEIEHFGI

SEQ ID NO: 532084 - protein, 9 aa, Homo Sapiens
ERAVKRMWH

SEQ ID NO: 532085 - protein, 9 aa, Homo Sapiens
SAELEQLCS

SEQ ID NO: 532086 - protein, 9 aa, Homo Sapiens
PGESQLSKV

SEQ ID NO: 532087 - protein, 9 aa, Homo Sapiens
PHGKDPLMY

SEQ ID NO: 532088 - protein, 9 aa, Homo Sapiens
RTWVHQGLV

SEQ ID NO: 532089 - protein, 9 aa, Homo Sapiens
GGGQIWGPQ

SEQ ID NO: 532090 - protein, 9 aa, Homo Sapiens
SSGAWALKT

SEQ ID NO: 532091 - protein, 9 aa, Homo Sapiens
VTGRRWLKG

SEQ ID NO: 532092 - protein, 9 aa, Homo Sapiens
RDVPAGRKV

SEQ ID NO: 532093 - protein, 9 aa, Homo Sapiens
KCGLSEKWL

SEQ ID NO: 532094 - protein, 9 aa, Homo Sapiens
KDMADSRCI

SEQ ID NO: 532095 - protein, 9 aa, Homo Sapiens
CLLLDRRVL

SEQ ID NO: 532096 - protein, 9 aa, Homo Sapiens
LQQQMAANQ

SEQ ID NO: 532097 - protein, 9 aa, Homo Sapiens
LCADAKKQL

SEQ ID NO: 532098 - protein, 9 aa, Homo Sapiens
TGDEGPAAL

SEQ ID NO: 532099 - protein, 9 aa, Homo Sapiens
LKHCFTFMD

SEQ ID NO: 532100 - protein, 9 aa, Homo Sapiens
QHSEEYEAE

SEQ ID NO: 532101 - protein, 9 aa, Homo Sapiens
FQDISDWLE

SEQ ID NO: 532102 - protein, 9 aa, Homo Sapiens
EQGNLGLWI

SEQ ID NO: 532103 - protein, 9 aa, Homo Sapiens
GTERSRSLK

SEQ ID NO: 532104 - protein, 9 aa, Homo Sapiens
KKSTDEVQT

SEQ ID NO: 532105 - protein, 9 aa, Homo Sapiens
NFTETDIKM

SEQ ID NO: 532106 - protein, 9 aa, Homo Sapiens
DVDTIFCPR

SEQ ID NO: 532107 - protein, 9 aa, Homo Sapiens
VSMASRPCN

SEQ ID NO: 532108 - protein, 9 aa, Homo Sapiens
AISRPLCYV

SEQ ID NO: 532109 - protein, 9 aa, Homo Sapiens
APKNTDWTT

SEQ ID NO: 532110 - protein, 9 aa, Homo Sapiens
KVHWPKNIL

SEQ ID NO: 532111 - protein, 9 aa, Homo Sapiens
ERPHWEMSN

SEQ ID NO: 532112 - protein, 9 aa, Homo Sapiens
TGVVAAMEQ

SEQ ID NO: 532113 - protein, 9 aa, Homo Sapiens
IHFGTKGFI

SEQ ID NO: 532114 - protein, 9 aa, Homo Sapiens
SLQEVLLDI

SEQ ID NO: 532115 - protein, 9 aa, Homo Sapiens
QDISDWLEK

SEQ ID NO: 532116 - protein, 9 aa, Homo Sapiens
YTTASPQAP

SEQ ID NO: 532117 - protein, 9 aa, Homo Sapiens
QNPLIMRRH

SEQ ID NO: 532118 - protein, 9 aa, Homo Sapiens
PCVFIYIWP

SEQ ID NO: 532119 - protein, 9 aa, Homo Sapiens
MPGQSSPSC

SEQ ID NO: 532120 - protein, 9 aa, Homo Sapiens
QPCNVSVTM

SEQ ID NO: 532121 - protein, 9 aa, Homo Sapiens
MLKTAVSKK

SEQ ID NO: 532122 - protein, 9 aa, Homo Sapiens
LDRRVLLLG

SEQ ID NO: 532123 - protein, 9 aa, Homo Sapiens
HVRIHLRDY

SEQ ID NO: 532124 - protein, 9 aa, Homo Sapiens
MSPGAMRRF

SEQ ID NO: 532125 - protein, 9 aa, Homo Sapiens
GGTLAHAFL

SEQ ID NO: 532126 - protein, 9 aa, Homo Sapiens
KPDMHKQRG

SEQ ID NO: 532127 - protein, 9 aa, Homo Sapiens
EVVKYLLWM

SEQ ID NO: 532128 - protein, 9 aa, Homo Sapiens
TILVSTDMG

SEQ ID NO: 532129 - protein, 9 aa, Homo Sapiens
NAFDGPGGT

SEQ ID NO: 532130 - protein, 9 aa, Homo Sapiens
VVCGGGGQI

SEQ ID NO: 532131 - protein, 9 aa, Homo Sapiens
LNVAGEAGS

SEQ ID NO: 532132 - protein, 9 aa, Homo Sapiens
PERNFILPE

SEQ ID NO: 532133 - protein, 9 aa, Homo Sapiens
CAASTESLV

SEQ ID NO: 532134 - protein, 9 aa, Homo Sapiens
RFLFIDLAI

SEQ ID NO: 532135 - protein, 9 aa, Homo Sapiens
QTSYVPEEV

SEQ ID NO: 532136 - protein, 9 aa, Homo Sapiens
QGGVQYGAR

SEQ ID NO: 532137 - protein, 9 aa, Homo Sapiens
WRSRGRPPG

SEQ ID NO: 532138 - protein, 9 aa, Homo Sapiens
PANGSYPLQ

SEQ ID NO: 532139 - protein, 9 aa, Homo Sapiens
LPETLPSME

SEQ ID NO: 532140 - protein, 9 aa, Homo Sapiens
TPQEQNQTK

SEQ ID NO: 532141 - protein, 9 aa, Homo Sapiens
YKTLAMGLI

SEQ ID NO: 532142 - protein, 9 aa, Homo Sapiens
HCFKELSTL

SEQ ID NO: 532143 - protein, 9 aa, Homo Sapiens
FSSDRRSSD

SEQ ID NO: 532144 - protein, 9 aa, Homo Sapiens
HTHSHVLVD

SEQ ID NO: 532145 - protein, 9 aa, Homo Sapiens
TDQENGEIT

SEQ ID NO: 532146 - protein, 9 aa, Homo Sapiens
DLFWKYVQF

SEQ ID NO: 532147 - protein, 9 aa, Homo Sapiens
EAHVRIHLR

SEQ ID NO: 532148 - protein, 9 aa, Homo Sapiens
LALRHGTPL

SEQ ID NO: 532149 - protein, 9 aa, Homo Sapiens
YYCEVLPGE

SEQ ID NO: 532150 - protein, 9 aa, Homo Sapiens
VCKQGLCCT

SEQ ID NO: 532151 - protein, 9 aa, Homo Sapiens
DESRPAVVL

SEQ ID NO: 532152 - protein, 9 aa, Homo Sapiens
AIGHLGNQM

SEQ ID NO: 532153 - protein, 9 aa, Homo Sapiens
PLQSPRNLG

SEQ ID NO: 532154 - protein, 9 aa, Homo Sapiens
PHRIILHGI

SEQ ID NO: 532155 - protein, 9 aa, Homo Sapiens
KARPLDRRV

SEQ ID NO: 532156 - protein, 9 aa, Homo Sapiens
NYQELQEEH

SEQ ID NO: 532157 - protein, 9 aa, Homo Sapiens
NWFDERTWY

SEQ ID NO: 532158 - protein, 9 aa, Homo Sapiens
ATAHWTVAS

SEQ ID NO: 532159 - protein, 9 aa, Homo Sapiens
EVIDTTKQN

SEQ ID NO: 532160 - protein, 9 aa, Homo Sapiens
TKLKVFLSG

SEQ ID NO: 532161 - protein, 9 aa, Homo Sapiens
PTMAHQVRT

SEQ ID NO: 532162 - protein, 9 aa, Homo Sapiens
LSWEPPTPH

SEQ ID NO: 532163 - protein, 9 aa, Homo Sapiens
LDNQHWHSV

SEQ ID NO: 532164 - protein, 9 aa, Homo Sapiens
GLKVDKDCE

SEQ ID NO: 532165 - protein, 9 aa, Homo Sapiens
ISDDLRSIR

SEQ ID NO: 532166 - protein, 9 aa, Homo Sapiens
SMYQNLCRE

SEQ ID NO: 532167 - protein, 9 aa, Homo Sapiens
CVSSCWGCN

SEQ ID NO: 532168 - protein, 9 aa, Homo Sapiens
LDVPRDVYA

SEQ ID NO: 532169 - protein, 9 aa, Homo Sapiens
EPCVLCQCQ

SEQ ID NO: 532170 - protein, 9 aa, Homo Sapiens
VVTTSPEAP

SEQ ID NO: 532171 - protein, 9 aa, Homo Sapiens
FGTKGFIMI

SEQ ID NO: 532172 - protein, 9 aa, Homo Sapiens
CFQTFLNKT

SEQ ID NO: 532173 - protein, 9 aa, Homo Sapiens
TLTLANKYG

SEQ ID NO: 532174 - protein, 9 aa, Homo Sapiens
VGQLRWGPA

SEQ ID NO: 532175 - protein, 9 aa, Homo Sapiens
TGSILVAIN

SEQ ID NO: 532176 - protein, 9 aa, Homo Sapiens
WCRPINATL

SEQ ID NO: 532177 - protein, 9 aa, Homo Sapiens
MGSDDWDTS

SEQ ID NO: 532178 - protein, 9 aa, Homo Sapiens
LPTVCHHPA

SEQ ID NO: 532179 - protein, 9 aa, Homo Sapiens
PGLSLRHAG

SEQ ID NO: 532180 - protein, 9 aa, Homo Sapiens
FDSENDTFC

SEQ ID NO: 532181 - protein, 9 aa, Homo Sapiens
HLTKSQPCL

SEQ ID NO: 532182 - protein, 9 aa, Homo Sapiens
QKANSSAME

SEQ ID NO: 532183 - protein, 9 aa, Homo Sapiens
YQWCQGGAI

SEQ ID NO: 532184 - protein, 9 aa, Homo Sapiens
NHLSYLVAT

SEQ ID NO: 532185 - protein, 9 aa, Homo Sapiens
VASQEQKLA

SEQ ID NO: 532186 - protein, 9 aa, Homo Sapiens
ILGHYFQCR

SEQ ID NO: 532187 - protein, 9 aa, Homo Sapiens
LHNRELQDK

SEQ ID NO: 532188 - protein, 9 aa, Homo Sapiens
PSPPSGDLQ

SEQ ID NO: 532189 - protein, 9 aa, Homo Sapiens
LEYLDGKFI

SEQ ID NO: 532190 - protein, 9 aa, Homo Sapiens
NYIPCMLEP

SEQ ID NO: 532191 - protein, 9 aa, Homo Sapiens
QLTSNQQHA

SEQ ID NO: 532192 - protein, 9 aa, Homo Sapiens
NKYGIVVIQ

SEQ ID NO: 532193 - protein, 9 aa, Homo Sapiens
PFRQGTGVD

SEQ ID NO: 532194 - protein, 9 aa, Homo Sapiens
TTKQNLVIC

SEQ ID NO: 532195 - protein, 9 aa, Homo Sapiens
WLEELVGQL

SEQ ID NO: 532196 - protein, 9 aa, Homo Sapiens
VDDIYVIPR

SEQ ID NO: 532197 - protein, 9 aa, Homo Sapiens
TLNEAKPIG

SEQ ID NO: 532198 - protein, 9 aa, Homo Sapiens
VRSTDQENG

SEQ ID NO: 532199 - protein, 9 aa, Homo Sapiens
RRDVPAGRK

SEQ ID NO: 532200 - protein, 9 aa, Homo Sapiens
FWKYVQFHE

SEQ ID NO: 532201 - protein, 9 aa, Homo Sapiens
VNDTDYSLA

SEQ ID NO: 532202 - protein, 9 aa, Homo Sapiens
WTEKTMKQT

SEQ ID NO: 532203 - protein, 9 aa, Homo Sapiens
RGPPNPNVK

SEQ ID NO: 532204 - protein, 9 aa, Homo Sapiens
HINGQPISP

SEQ ID NO: 532205 - protein, 9 aa, Homo Sapiens
FPPINVPDM

SEQ ID NO: 532206 - protein, 9 aa, Homo Sapiens
SKEPLRPWC

SEQ ID NO: 532207 - protein, 9 aa, Homo Sapiens
LSQGFARLS

SEQ ID NO: 532208 - protein, 9 aa, Homo Sapiens
ECKRVMQEA

SEQ ID NO: 532209 - protein, 9 aa, Homo Sapiens
QSMYQNLCR

SEQ ID NO: 532210 - protein, 9 aa, Homo Sapiens
SLPKALLSK

SEQ ID NO: 532211 - protein, 9 aa, Homo Sapiens
EADLQAKAV

SEQ ID NO: 532212 - protein, 9 aa, Homo Sapiens
SCQETNRED

SEQ ID NO: 532213 - protein, 9 aa, Homo Sapiens
GLRNYGYHH

SEQ ID NO: 532214 - protein, 9 aa, Homo Sapiens
IWCGPLPSN

SEQ ID NO: 532215 - protein, 9 aa, Homo Sapiens
THNEWYDFY

SEQ ID NO: 532216 - protein, 9 aa, Homo Sapiens
AHFRQAHLN

SEQ ID NO: 532217 - protein, 9 aa, Homo Sapiens
LLENTGHLT

SEQ ID NO: 532218 - protein, 9 aa, Homo Sapiens
EQKNNLQHL

SEQ ID NO: 532219 - protein, 9 aa, Homo Sapiens
AVATQKKVE

SEQ ID NO: 532220 - protein, 9 aa, Homo Sapiens
AAVENPTAQ

SEQ ID NO: 532221 - protein, 9 aa, Homo Sapiens
CGPLPSNGV

SEQ ID NO: 532222 - protein, 9 aa, Homo Sapiens
WMIVQTVTA

SEQ ID NO: 532223 - protein, 9 aa, Homo Sapiens
ILQCGHVFE

SEQ ID NO: 532224 - protein, 9 aa, Homo Sapiens
ESRPAVVLI

SEQ ID NO: 532225 - protein, 9 aa, Homo Sapiens
LFLMGINRT

SEQ ID NO: 532226 - protein, 9 aa, Homo Sapiens
VEFQDMVLA

SEQ ID NO: 532227 - protein, 9 aa, Homo Sapiens
ETLWEREGE

SEQ ID NO: 532228 - protein, 9 aa, Homo Sapiens
KNSFDSLEK

SEQ ID NO: 532229 - protein, 9 aa, Homo Sapiens
QGSVTTLAV

SEQ ID NO: 532230 - protein, 9 aa, Homo Sapiens
TSRFGGSTH

SEQ ID NO: 532231 - protein, 9 aa, Homo Sapiens
VQHNKATEN

SEQ ID NO: 532232 - protein, 9 aa, Homo Sapiens
RACGAGQPK

SEQ ID NO: 532233 - protein, 9 aa, Homo Sapiens
EPREGRRRR

SEQ ID NO: 532234 - protein, 9 aa, Homo Sapiens
TNEGTTSML

SEQ ID NO: 532235 - protein, 9 aa, Homo Sapiens
LSPTMAHQV

SEQ ID NO: 532236 - protein, 9 aa, Homo Sapiens
LLQAWEWQR

SEQ ID NO: 532237 - protein, 9 aa, Homo Sapiens
FKWQYENHI

SEQ ID NO: 532238 - protein, 9 aa, Homo Sapiens
RKPLFCGSS

SEQ ID NO: 532239 - protein, 9 aa, Homo Sapiens
PIWGDMVNV

SEQ ID NO: 532240 - protein, 9 aa, Homo Sapiens
YYFATLDHH

SEQ ID NO: 532241 - protein, 9 aa, Homo Sapiens
QAPGTLQRV

SEQ ID NO: 532242 - protein, 9 aa, Homo Sapiens
MELDPEDMC

SEQ ID NO: 532243 - protein, 9 aa, Homo Sapiens
TQLSESHRK

SEQ ID NO: 532244 - protein, 9 aa, Homo Sapiens
TMTEERRKV

SEQ ID NO: 532245 - protein, 9 aa, Homo Sapiens
HWVRGLTKL

SEQ ID NO: 532246 - protein, 9 aa, Homo Sapiens
VEKNNSHIK

SEQ ID NO: 532247 - protein, 9 aa, Homo Sapiens
EGPCRGLGA

SEQ ID NO: 532248 - protein, 9 aa, Homo Sapiens
ADVFLYNAN

SEQ ID NO: 532249 - protein, 9 aa, Homo Sapiens
ESCPPDPSP

SEQ ID NO: 532250 - protein, 9 aa, Homo Sapiens
QVVINPQVS

SEQ ID NO: 532251 - protein, 9 aa, Homo Sapiens
YRARPAKAV

SEQ ID NO: 532252 - protein, 9 aa, Homo Sapiens
PIDDSFCGL

SEQ ID NO: 532253 - protein, 9 aa, Homo Sapiens
SAAMIRTKV

SEQ ID NO: 532254 - protein, 9 aa, Homo Sapiens
LTFSFLSGF

SEQ ID NO: 532255 - protein, 9 aa, Homo Sapiens
ARSRGFPDT

SEQ ID NO: 532256 - protein, 9 aa, Homo Sapiens
DFWNTQKRG

SEQ ID NO: 532257 - protein, 9 aa, Homo Sapiens
NYGYHHNAE

SEQ ID NO: 532258 - protein, 9 aa, Homo Sapiens
MPLCCATLQ

SEQ ID NO: 532259 - protein, 9 aa, Homo Sapiens
HQVRTHQET

SEQ ID NO: 532260 - protein, 9 aa, Homo Sapiens
LCKDEPTLD

SEQ ID NO: 532261 - protein, 9 aa, Homo Sapiens
VIDTTKQNL

SEQ ID NO: 532262 - protein, 9 aa, Homo Sapiens
AKLGYDPME

SEQ ID NO: 532263 - protein, 9 aa, Homo Sapiens
KMPVYDLLK

SEQ ID NO: 532264 - protein, 9 aa, Homo Sapiens
SWMIVQTVT

SEQ ID NO: 532265 - protein, 9 aa, Homo Sapiens
RQEQEEMWW

SEQ ID NO: 532266 - protein, 9 aa, Homo Sapiens
GEAGSKQKA

SEQ ID NO: 532267 - protein, 9 aa, Homo Sapiens
QCPSMEEIV

SEQ ID NO: 532268 - protein, 9 aa, Homo Sapiens
EPGIYVCAK

SEQ ID NO: 532269 - protein, 9 aa, Homo Sapiens
LVTSRSVIV

SEQ ID NO: 532270 - protein, 9 aa, Homo Sapiens
PGTLQRVPV

SEQ ID NO: 532271 - protein, 9 aa, Homo Sapiens
AINPFQVLP

SEQ ID NO: 532272 - protein, 9 aa, Homo Sapiens
TGFPKAAKL

SEQ ID NO: 532273 - protein, 9 aa, Homo Sapiens
LLWKEEYQG

SEQ ID NO: 532274 - protein, 9 aa, Homo Sapiens
YRYTDSGAR

SEQ ID NO: 532275 - protein, 9 aa, Homo Sapiens
DPSPRGGNL

SEQ ID NO: 532276 - protein, 9 aa, Homo Sapiens
PPLNSPGTI

SEQ ID NO: 532277 - protein, 9 aa, Homo Sapiens
QLLFILDGF

SEQ ID NO: 532278 - protein, 9 aa, Homo Sapiens
DLQLVKSVS

SEQ ID NO: 532279 - protein, 9 aa, Homo Sapiens
HTHLVHYRI

SEQ ID NO: 532280 - protein, 9 aa, Homo Sapiens
RDRRRKERV

SEQ ID NO: 532281 - protein, 9 aa, Homo Sapiens
TMVEPYNAT

SEQ ID NO: 532282 - protein, 9 aa, Homo Sapiens
YPESQMLHL

SEQ ID NO: 532283 - protein, 9 aa, Homo Sapiens
NAHEPFRQG

SEQ ID NO: 532284 - protein, 9 aa, Homo Sapiens
GLSEKWLDL

SEQ ID NO: 532285 - protein, 9 aa, Homo Sapiens
HLYEAEEAN

SEQ ID NO: 532286 - protein, 9 aa, Homo Sapiens
SRICHVLKQ

SEQ ID NO: 532287 - protein, 9 aa, Homo Sapiens
LHKADGVVL

SEQ ID NO: 532288 - protein, 9 aa, Homo Sapiens
LRAPCAAST

SEQ ID NO: 532289 - protein, 9 aa, Homo Sapiens
CTAQQKGLP

SEQ ID NO: 532290 - protein, 9 aa, Homo Sapiens
KCLQELEGQ

SEQ ID NO: 532291 - protein, 9 aa, Homo Sapiens
ARVQETLHS

SEQ ID NO: 532292 - protein, 9 aa, Homo Sapiens
ETHTGPLGC

SEQ ID NO: 532293 - protein, 9 aa, Homo Sapiens
PTAQEDDRL

SEQ ID NO: 532294 - protein, 9 aa, Homo Sapiens
SRGTERSRS

SEQ ID NO: 532295 - protein, 9 aa, Homo Sapiens
AMSGLPPSL

SEQ ID NO: 532296 - protein, 9 aa, Homo Sapiens
GEPREGRRR

SEQ ID NO: 532297 - protein, 9 aa, Homo Sapiens
DWLLISIEN

SEQ ID NO: 532298 - protein, 9 aa, Homo Sapiens
ADLVIMDLL

SEQ ID NO: 532299 - protein, 9 aa, Homo Sapiens
QSRPEALAM

SEQ ID NO: 532300 - protein, 9 aa, Homo Sapiens
DWNWRVDMT

SEQ ID NO: 532301 - protein, 9 aa, Homo Sapiens
GYARNFWPG

SEQ ID NO: 532302 - protein, 9 aa, Homo Sapiens
QLCKTVHHG

SEQ ID NO: 532303 - protein, 9 aa, Homo Sapiens
FFWFWSDLN

SEQ ID NO: 532304 - protein, 9 aa, Homo Sapiens
LLQSSPEDI

SEQ ID NO: 532305 - protein, 9 aa, Homo Sapiens
TYKYDMGSD

SEQ ID NO: 532306 - protein, 9 aa, Homo Sapiens
LANKYGIVV

SEQ ID NO: 532307 - protein, 9 aa, Homo Sapiens
TINNQHSIE

SEQ ID NO: 532308 - protein, 9 aa, Homo Sapiens
SPAEPCVLC

SEQ ID NO: 532309 - protein, 9 aa, Homo Sapiens
SYSVSIEEN

SEQ ID NO: 532310 - protein, 9 aa, Homo Sapiens
EYLRIEPDT

SEQ ID NO: 532311 - protein, 9 aa, Homo Sapiens
HFVSDATPQ

SEQ ID NO: 532312 - protein, 9 aa, Homo Sapiens
LVAGLQHQM

SEQ ID NO: 532313 - protein, 9 aa, Homo Sapiens
LLPDHRRLM

SEQ ID NO: 532314 - protein, 9 aa, Homo Sapiens
LQRVPVPTS

SEQ ID NO: 532315 - protein, 9 aa, Homo Sapiens
AVPPFTQRE

SEQ ID NO: 532316 - protein, 9 aa, Homo Sapiens
VGEVGRSTG

SEQ ID NO: 532317 - protein, 9 aa, Homo Sapiens
VLDLELLRD

SEQ ID NO: 532318 - protein, 9 aa, Homo Sapiens
LRNEYFFYR

SEQ ID NO: 532319 - protein, 9 aa, Homo Sapiens
VFLSCITMM

SEQ ID NO: 532320 - protein, 9 aa, Homo Sapiens
YGNRAEGRM

SEQ ID NO: 532321 - protein, 9 aa, Homo Sapiens
TDSSSASAV

SEQ ID NO: 532322 - protein, 9 aa, Homo Sapiens
IPCMLEPVF

SEQ ID NO: 532323 - protein, 9 aa, Homo Sapiens
KKKRIASSS

SEQ ID NO: 532324 - protein, 9 aa, Homo Sapiens
WFWSDLNFL

SEQ ID NO: 532325 - protein, 9 aa, Homo Sapiens
HRRLMYRDR

SEQ ID NO: 532326 - protein, 9 aa, Homo Sapiens
LGYDPMELD

SEQ ID NO: 532327 - protein, 9 aa, Homo Sapiens
AITCFATQR

SEQ ID NO: 532328 - protein, 9 aa, Homo Sapiens
GSKQKAVEE

SEQ ID NO: 532329 - protein, 9 aa, Homo Sapiens
WSSLRLLNA

SEQ ID NO: 532330 - protein, 9 aa, Homo Sapiens
HHMDFLLAF

SEQ ID NO: 532331 - protein, 9 aa, Homo Sapiens
TLQKCFEPT

SEQ ID NO: 532332 - protein, 9 aa, Homo Sapiens
TTMQEQAFG

SEQ ID NO: 532333 - protein, 9 aa, Homo Sapiens
GNVINALAH

SEQ ID NO: 532334 - protein, 9 aa, Homo Sapiens
GNQLRSLQE

SEQ ID NO: 532335 - protein, 9 aa, Homo Sapiens
YNRAGTGPV

SEQ ID NO: 532336 - protein, 9 aa, Homo Sapiens
DALKGPPRP

SEQ ID NO: 532337 - protein, 9 aa, Homo Sapiens
HSGMPLCCA

SEQ ID NO: 532338 - protein, 9 aa, Homo Sapiens
LSLRHAGLF

SEQ ID NO: 532339 - protein, 9 aa, Homo Sapiens
TSSHLGVLT

SEQ ID NO: 532340 - protein, 9 aa, Homo Sapiens
YGERPHWEM

SEQ ID NO: 532341 - protein, 9 aa, Homo Sapiens
QFPRRSISG

SEQ ID NO: 532342 - protein, 9 aa, Homo Sapiens
HIITHSGHT

SEQ ID NO: 532343 - protein, 9 aa, Homo Sapiens
LVHYRIDLD

SEQ ID NO: 532344 - protein, 9 aa, Homo Sapiens
SLPVNKTDM

SEQ ID NO: 532345 - protein, 9 aa, Homo Sapiens
FQCSVCNEC

SEQ ID NO: 532346 - protein, 9 aa, Homo Sapiens
EIVQSNVMF

SEQ ID NO: 532347 - protein, 9 aa, Homo Sapiens
PSITSQHHD

SEQ ID NO: 532348 - protein, 9 aa, Homo Sapiens
TVEGIRSVM

SEQ ID NO: 532349 - protein, 9 aa, Homo Sapiens
GTFLLFTVF

SEQ ID NO: 532350 - protein, 9 aa, Homo Sapiens
RVTIFGLGA

SEQ ID NO: 532351 - protein, 9 aa, Homo Sapiens
WGDMVNVEI

SEQ ID NO: 532352 - protein, 9 aa, Homo Sapiens
DSENAVLYF

SEQ ID NO: 532353 - protein, 9 aa, Homo Sapiens
NRTWVHQGL

SEQ ID NO: 532354 - protein, 9 aa, Homo Sapiens
DMLRYQANN

SEQ ID NO: 532355 - protein, 9 aa, Homo Sapiens
ACICTLLSR

SEQ ID NO: 532356 - protein, 9 aa, Homo Sapiens
ADACYEAAC

SEQ ID NO: 532357 - protein, 9 aa, Homo Sapiens
HVLKQDKGH

SEQ ID NO: 532358 - protein, 9 aa, Homo Sapiens
TQHSEEYEA

SEQ ID NO: 532359 - protein, 9 aa, Homo Sapiens
GRALYLLAP

SEQ ID NO: 532360 - protein, 9 aa, Homo Sapiens
IGLMSLTMN

SEQ ID NO: 532361 - protein, 9 aa, Homo Sapiens
SASCMTVSC

SEQ ID NO: 532362 - protein, 9 aa, Homo Sapiens
ILQTVVNTI

SEQ ID NO: 532363 - protein, 9 aa, Homo Sapiens
ELEKLQAKL

SEQ ID NO: 532364 - protein, 9 aa, Homo Sapiens
EGQAKGVET

SEQ ID NO: 532365 - protein, 9 aa, Homo Sapiens
KLPSVQLQH

SEQ ID NO: 532366 - protein, 9 aa, Homo Sapiens
QQIDYAQQL

SEQ ID NO: 532367 - protein, 9 aa, Homo Sapiens
EEAQHWVRG

SEQ ID NO: 532368 - protein, 9 aa, Homo Sapiens
PRSAVPHAP

SEQ ID NO: 532369 - protein, 9 aa, Homo Sapiens
IPRPHFSTD

SEQ ID NO: 532370 - protein, 9 aa, Homo Sapiens
SDCGSPALS

SEQ ID NO: 532371 - protein, 9 aa, Homo Sapiens
GLQHQMSFA

SEQ ID NO: 532372 - protein, 9 aa, Homo Sapiens
PLVTLGAIG

SEQ ID NO: 532373 - protein, 9 aa, Homo Sapiens
NRVLQQLLE

SEQ ID NO: 532374 - protein, 9 aa, Homo Sapiens
PLWRTTAFV

SEQ ID NO: 532375 - protein, 9 aa, Homo Sapiens
GTTHLLHLT

SEQ ID NO: 532376 - protein, 9 aa, Homo Sapiens
RDLFRVQLI

SEQ ID NO: 532377 - protein, 9 aa, Homo Sapiens
ACEPSTPWR

SEQ ID NO: 532378 - protein, 9 aa, Homo Sapiens
HSCQTLQDH

SEQ ID NO: 532379 - protein, 9 aa, Homo Sapiens
EKFARIEAE

SEQ ID NO: 532380 - protein, 9 aa, Homo Sapiens
AKKQLANIT

SEQ ID NO: 532381 - protein, 9 aa, Homo Sapiens
QAQALEEVG

SEQ ID NO: 532382 - protein, 9 aa, Homo Sapiens
RIHMGEKPY

SEQ ID NO: 532383 - protein, 9 aa, Homo Sapiens
GGGEFGGHN

SEQ ID NO: 532384 - protein, 9 aa, Homo Sapiens
RRHVRSFIS

SEQ ID NO: 532385 - protein, 9 aa, Homo Sapiens
ARDLFRVQL

SEQ ID NO: 532386 - protein, 9 aa, Homo Sapiens
KAVTDLLGH

SEQ ID NO: 532387 - protein, 9 aa, Homo Sapiens
ARPKHTLPP

SEQ ID NO: 532388 - protein, 9 aa, Homo Sapiens
ILADGRVVL

SEQ ID NO: 532389 - protein, 9 aa, Homo Sapiens
FDEIVTAAT

SEQ ID NO: 532390 - protein, 9 aa, Homo Sapiens
VQLTVQPCN

SEQ ID NO: 532391 - protein, 9 aa, Homo Sapiens
YQAVQHNKA

SEQ ID NO: 532392 - protein, 9 aa, Homo Sapiens
RPCTLTSTG

SEQ ID NO: 532393 - protein, 9 aa, Homo Sapiens
SIQWHWQPW

SEQ ID NO: 532394 - protein, 9 aa, Homo Sapiens
SAVAPPPTS

SEQ ID NO: 532395 - protein, 9 aa, Homo Sapiens
REFVTFSCP

SEQ ID NO: 532396 - protein, 9 aa, Homo Sapiens
HSAPERTED

SEQ ID NO: 532397 - protein, 9 aa, Homo Sapiens
LKKSTDEVQ

SEQ ID NO: 532398 - protein, 9 aa, Homo Sapiens
LPYHIPHLV

SEQ ID NO: 532399 - protein, 9 aa, Homo Sapiens
AICHPLQYL

SEQ ID NO: 532400 - protein, 9 aa, Homo Sapiens
VTSFKDNDT

SEQ ID NO: 532401 - protein, 9 aa, Homo Sapiens
KAREWYSSL

SEQ ID NO: 532402 - protein, 9 aa, Homo Sapiens
PAGEGPCRG

SEQ ID NO: 532403 - protein, 9 aa, Homo Sapiens
AGVSRSVTI

SEQ ID NO: 532404 - protein, 9 aa, Homo Sapiens
GPHPVTVLF

SEQ ID NO: 532405 - protein, 9 aa, Homo Sapiens
KSTDEVQTS

SEQ ID NO: 532406 - protein, 9 aa, Homo Sapiens
QQPKQKVAL

SEQ ID NO: 532407 - protein, 9 aa, Homo Sapiens
KQKGDAILQ

SEQ ID NO: 532408 - protein, 9 aa, Homo Sapiens
TAVSKKMLK

SEQ ID NO: 532409 - protein, 9 aa, Homo Sapiens
ALMLARKLQ

SEQ ID NO: 532410 - protein, 9 aa, Homo Sapiens
SEIVGTTKL

SEQ ID NO: 532411 - protein, 9 aa, Homo Sapiens
PSLDSENAV

SEQ ID NO: 532412 - protein, 9 aa, Homo Sapiens
AIKFVDALQ

SEQ ID NO: 532413 - protein, 9 aa, Homo Sapiens
ESPSHPEEP

SEQ ID NO: 532414 - protein, 9 aa, Homo Sapiens
SKDPSQCPS

SEQ ID NO: 532415 - protein, 9 aa, Homo Sapiens
INTRCAHPL

SEQ ID NO: 532416 - protein, 9 aa, Homo Sapiens
GAMSGLPPS

SEQ ID NO: 532417 - protein, 9 aa, Homo Sapiens
MVNVEIQAE

SEQ ID NO: 532418 - protein, 9 aa, Homo Sapiens
GSQGAHVTN

SEQ ID NO: 532419 - protein, 9 aa, Homo Sapiens
KKRERQWEQ

SEQ ID NO: 532420 - protein, 9 aa, Homo Sapiens
YRVLVYPMA

SEQ ID NO: 532421 - protein, 9 aa, Homo Sapiens
QCFSAETLL

SEQ ID NO: 532422 - protein, 9 aa, Homo Sapiens
QNQTKHSTA

SEQ ID NO: 532423 - protein, 9 aa, Homo Sapiens
QFPPLHMPG

SEQ ID NO: 532424 - protein, 9 aa, Homo Sapiens
HQLVVVDEN

SEQ ID NO: 532425 - protein, 9 aa, Homo Sapiens
LWEKEKVQG

SEQ ID NO: 532426 - protein, 9 aa, Homo Sapiens
YGLKYHYQW

SEQ ID NO: 532427 - protein, 9 aa, Homo Sapiens
YACGDCGCC

SEQ ID NO: 532428 - protein, 9 aa, Homo Sapiens
IDYAQQLIE

SEQ ID NO: 532429 - protein, 9 aa, Homo Sapiens
NPLIMRRHV

SEQ ID NO: 532430 - protein, 9 aa, Homo Sapiens
WDLWGPTES

SEQ ID NO: 532431 - protein, 9 aa, Homo Sapiens
PWRSRGRPP

SEQ ID NO: 532432 - protein, 9 aa, Homo Sapiens
EMWRSASEQ

SEQ ID NO: 532433 - protein, 9 aa, Homo Sapiens
TDSSLGSVK

SEQ ID NO: 532434 - protein, 9 aa, Homo Sapiens
GYKTLAMGL

SEQ ID NO: 532435 - protein, 9 aa, Homo Sapiens
KGDAILQCG

SEQ ID NO: 532436 - protein, 9 aa, Homo Sapiens
GQIWGPQSQ

SEQ ID NO: 532437 - protein, 9 aa, Homo Sapiens
CRSQLTSNQ

SEQ ID NO: 532438 - protein, 9 aa, Homo Sapiens
DRSMRKGIM

SEQ ID NO: 532439 - protein, 9 aa, Homo Sapiens
VTGYVLMAM

SEQ ID NO: 532440 - protein, 9 aa, Homo Sapiens
LSCITMMCN

SEQ ID NO: 532441 - protein, 9 aa, Homo Sapiens
RCINANIRE

SEQ ID NO: 532442 - protein, 9 aa, Homo Sapiens
EGRRRRVVL

SEQ ID NO: 532443 - protein, 9 aa, Homo Sapiens
VAGLQHQMS

SEQ ID NO: 532444 - protein, 9 aa, Homo Sapiens
PRYHHREFW

SEQ ID NO: 532445 - protein, 9 aa, Homo Sapiens
YNMGMALHK

SEQ ID NO: 532446 - protein, 9 aa, Homo Sapiens
CVYDPASPQ

SEQ ID NO: 532447 - protein, 9 aa, Homo Sapiens
KVTETHTGP

SEQ ID NO: 532448 - protein, 9 aa, Homo Sapiens
KSHELQDVL

SEQ ID NO: 532449 - protein, 9 aa, Homo Sapiens
TDPVTAENA

SEQ ID NO: 532450 - protein, 9 aa, Homo Sapiens
WEKEKVQGR

SEQ ID NO: 532451 - protein, 9 aa, Homo Sapiens
TYTWTPVND

SEQ ID NO: 532452 - protein, 9 aa, Homo Sapiens
AHILKLPSF

SEQ ID NO: 532453 - protein, 9 aa, Homo Sapiens
EVGRSTGDE

SEQ ID NO: 532454 - protein, 9 aa, Homo Sapiens
RLAVLEQEE

SEQ ID NO: 532455 - protein, 9 aa, Homo Sapiens
GGGGRRHIH

SEQ ID NO: 532456 - protein, 9 aa, Homo Sapiens
FRLQCMLNR

SEQ ID NO: 532457 - protein, 9 aa, Homo Sapiens
IYNRNSWVR

SEQ ID NO: 532458 - protein, 9 aa, Homo Sapiens
ALRRQPSIT

SEQ ID NO: 532459 - protein, 9 aa, Homo Sapiens
CALSFVLSS

SEQ ID NO: 532460 - protein, 9 aa, Homo Sapiens
RERQWEQME

SEQ ID NO: 532461 - protein, 9 aa, Homo Sapiens
GATGDREDR

SEQ ID NO: 532462 - protein, 9 aa, Homo Sapiens
GQCIFVELQ

SEQ ID NO: 532463 - protein, 9 aa, Homo Sapiens
PVMLNSAAP

SEQ ID NO: 532464 - protein, 9 aa, Homo Sapiens
VIGLQSMGE

SEQ ID NO: 532465 - protein, 9 aa, Homo Sapiens
RKMVTVGEK

SEQ ID NO: 532466 - protein, 9 aa, Homo Sapiens
EEKTQHMSL

SEQ ID NO: 532467 - protein, 9 aa, Homo Sapiens
RKLGLKVDK

SEQ ID NO: 532468 - protein, 9 aa, Homo Sapiens
TVVDSEATH

SEQ ID NO: 532469 - protein, 9 aa, Homo Sapiens
FLQTCSWVL

SEQ ID NO: 532470 - protein, 9 aa, Homo Sapiens
TAHCTAGTL

SEQ ID NO: 532471 - protein, 9 aa, Homo Sapiens
HMLNCGRTD

SEQ ID NO: 532472 - protein, 9 aa, Homo Sapiens
DQATDSSLG

SEQ ID NO: 532473 - protein, 9 aa, Homo Sapiens
MGAALTGAK

SEQ ID NO: 532474 - protein, 9 aa, Homo Sapiens
THHMDFLLA

SEQ ID NO: 532475 - protein, 9 aa, Homo Sapiens
HCTAGTLHN

SEQ ID NO: 532476 - protein, 9 aa, Homo Sapiens
HKADGVVLM

SEQ ID NO: 532477 - protein, 9 aa, Homo Sapiens
EDRPGVALE

SEQ ID NO: 532478 - protein, 9 aa, Homo Sapiens
KANSSAMET

SEQ ID NO: 532479 - protein, 9 aa, Homo Sapiens
GLEEVQLTP

SEQ ID NO: 532480 - protein, 9 aa, Homo Sapiens
QTQLSESHR

SEQ ID NO: 532481 - protein, 9 aa, Homo Sapiens
GNEVAGWEM

SEQ ID NO: 532482 - protein, 9 aa, Homo Sapiens
QCLELGIGP

SEQ ID NO: 532483 - protein, 9 aa, Homo Sapiens
TLFDAHVEF

SEQ ID NO: 532484 - protein, 9 aa, Homo Sapiens
EVLVQVEVS

SEQ ID NO: 532485 - protein, 9 aa, Homo Sapiens
LDDPIWCGP

SEQ ID NO: 532486 - protein, 9 aa, Homo Sapiens
SETVELARY

SEQ ID NO: 532487 - protein, 9 aa, Homo Sapiens
PSCRTKSSA

SEQ ID NO: 532488 - protein, 9 aa, Homo Sapiens
VSFVSGGRD

SEQ ID NO: 532489 - protein, 9 aa, Homo Sapiens
LFSTPCRMS

SEQ ID NO: 532490 - protein, 9 aa, Homo Sapiens
GILRAPCAA

SEQ ID NO: 532491 - protein, 9 aa, Homo Sapiens
ATPVGALAA

SEQ ID NO: 532492 - protein, 9 aa, Homo Sapiens
ALELSCQET

SEQ ID NO: 532493 - protein, 9 aa, Homo Sapiens
NNLAEIYGW

SEQ ID NO: 532494 - protein, 9 aa, Homo Sapiens
QDEVDGGDI

SEQ ID NO: 532495 - protein, 9 aa, Homo Sapiens
DTIFCPRMS

SEQ ID NO: 532496 - protein, 9 aa, Homo Sapiens
GAIACKRIR

SEQ ID NO: 532497 - protein, 9 aa, Homo Sapiens
NVHITNNTN

SEQ ID NO: 532498 - protein, 9 aa, Homo Sapiens
TFANHSGRP

SEQ ID NO: 532499 - protein, 9 aa, Homo Sapiens
TLFRHSGTA

SEQ ID NO: 532500 - protein, 9 aa, Homo Sapiens
ILRQPEQLL

SEQ ID NO: 532501 - protein, 9 aa, Homo Sapiens
ENPTAQEDD

SEQ ID NO: 532502 - protein, 9 aa, Homo Sapiens
NYQRMYYMF

SEQ ID NO: 532503 - protein, 9 aa, Homo Sapiens
GGMWHNSVV

SEQ ID NO: 532504 - protein, 9 aa, Homo Sapiens
ELHLNNNEF

SEQ ID NO: 532505 - protein, 9 aa, Homo Sapiens
QEAIDEFRR

SEQ ID NO: 532506 - protein, 9 aa, Homo Sapiens
FCLKKVVKW

SEQ ID NO: 532507 - protein, 9 aa, Homo Sapiens
YGILRAPCA

SEQ ID NO: 532508 - protein, 9 aa, Homo Sapiens
NAVLYFPQS

SEQ ID NO: 532509 - protein, 9 aa, Homo Sapiens
KYDMGSDDW

SEQ ID NO: 532510 - protein, 9 aa, Homo Sapiens
GAKSHELQD

SEQ ID NO: 532511 - protein, 9 aa, Homo Sapiens
FWFDLSKIP

SEQ ID NO: 532512 - protein, 9 aa, Homo Sapiens
WRSKKAKAP

SEQ ID NO: 532513 - protein, 9 aa, Homo Sapiens
GLRCLLLDR

SEQ ID NO: 532514 - protein, 9 aa, Homo Sapiens
DYESNPQLH

SEQ ID NO: 532515 - protein, 9 aa, Homo Sapiens
MPYDLCKDE

SEQ ID NO: 532516 - protein, 9 aa, Homo Sapiens
STSATCQVQ

SEQ ID NO: 532517 - protein, 9 aa, Homo Sapiens
SAMPTKSKE

SEQ ID NO: 532518 - protein, 9 aa, Homo Sapiens
CPLGYECHI

SEQ ID NO: 532519 - protein, 9 aa, Homo Sapiens
TGYVLMAMN

SEQ ID NO: 532520 - protein, 9 aa, Homo Sapiens
LGEWGTAPW

SEQ ID NO: 532521 - protein, 9 aa, Homo Sapiens
DPYRQLQEK

SEQ ID NO: 532522 - protein, 9 aa, Homo Sapiens
GAEPLLCPL

SEQ ID NO: 532523 - protein, 9 aa, Homo Sapiens
KGFRLQCML

SEQ ID NO: 532524 - protein, 9 aa, Homo Sapiens
QWHWQPWTP

SEQ ID NO: 532525 - protein, 9 aa, Homo Sapiens
GAEALLEWR

SEQ ID NO: 532526 - protein, 9 aa, Homo Sapiens
PHPPPPVRP

SEQ ID NO: 532527 - protein, 9 aa, Homo Sapiens
REQKLKFKD

SEQ ID NO: 532528 - protein, 9 aa, Homo Sapiens
QECKRVMQE

SEQ ID NO: 532529 - protein, 9 aa, Homo Sapiens
SPLQKVMLP

SEQ ID NO: 532530 - protein, 9 aa, Homo Sapiens
EKWLDLVTN

SEQ ID NO: 532531 - protein, 9 aa, Homo Sapiens
PNLYLKQMC

SEQ ID NO: 532532 - protein, 9 aa, Homo Sapiens
EPLNNSSPG

SEQ ID NO: 532533 - protein, 9 aa, Homo Sapiens
TLEKTSYSV

SEQ ID NO: 532534 - protein, 9 aa, Homo Sapiens
WGERFRVPS

SEQ ID NO: 532535 - protein, 9 aa, Homo Sapiens
GITLVVSAQ

SEQ ID NO: 532536 - protein, 9 aa, Homo Sapiens
TEVVKTTSR

SEQ ID NO: 532537 - protein, 9 aa, Homo Sapiens
VYPEVEWGS

SEQ ID NO: 532538 - protein, 9 aa, Homo Sapiens
GGVEFQDMV

SEQ ID NO: 532539 - protein, 9 aa, Homo Sapiens
QPTYKYDMG

SEQ ID NO: 532540 - protein, 9 aa, Homo Sapiens
TAFVQRHRT

SEQ ID NO: 532541 - protein, 9 aa, Homo Sapiens
QQLTAELQD

SEQ ID NO: 532542 - protein, 9 aa, Homo Sapiens
PKMTFNYLS

SEQ ID NO: 532543 - protein, 9 aa, Homo Sapiens
PISVNVHIT

SEQ ID NO: 532544 - protein, 9 aa, Homo Sapiens
DLLGHRQRK

SEQ ID NO: 532545 - protein, 9 aa, Homo Sapiens
VPRFQFGPP

SEQ ID NO: 532546 - protein, 9 aa, Homo Sapiens
AVILAAPGL

SEQ ID NO: 532547 - protein, 9 aa, Homo Sapiens
LGELSQGFA

SEQ ID NO: 532548 - protein, 9 aa, Homo Sapiens
CKKKRIASS

SEQ ID NO: 532549 - protein, 9 aa, Homo Sapiens
IAVCHPMKA

SEQ ID NO: 532550 - protein, 9 aa, Homo Sapiens
LSRQLRHIL

SEQ ID NO: 532551 - protein, 9 aa, Homo Sapiens
CMLADLSLV

SEQ ID NO: 532552 - protein, 9 aa, Homo Sapiens
RVLVYPMAS

SEQ ID NO: 532553 - protein, 9 aa, Homo Sapiens
HSDYRPLIC

SEQ ID NO: 532554 - protein, 9 aa, Homo Sapiens
EKLQAKLQG

SEQ ID NO: 532555 - protein, 9 aa, Homo Sapiens
NKERTHNIV

SEQ ID NO: 532556 - protein, 9 aa, Homo Sapiens
LENTGHLTS

SEQ ID NO: 532557 - protein, 9 aa, Homo Sapiens
TKKGEMKTA

SEQ ID NO: 532558 - protein, 9 aa, Homo Sapiens
RTWGLSRIV

SEQ ID NO: 532559 - protein, 9 aa, Homo Sapiens
LVSPGVRSE

SEQ ID NO: 532560 - protein, 9 aa, Homo Sapiens
PYFFTKGEV

SEQ ID NO: 532561 - protein, 9 aa, Homo Sapiens
VIFNWDGCS

SEQ ID NO: 532562 - protein, 9 aa, Homo Sapiens
GENFTETDI

SEQ ID NO: 532563 - protein, 9 aa, Homo Sapiens
RTHPGQQRP

SEQ ID NO: 532564 - protein, 9 aa, Homo Sapiens
RSTEHQLIS

SEQ ID NO: 532565 - protein, 9 aa, Homo Sapiens
LAVPPFTQR

SEQ ID NO: 532566 - protein, 9 aa, Homo Sapiens
QEKVKKGPE

SEQ ID NO: 532567 - protein, 9 aa, Homo Sapiens
GVEPMFSGG

SEQ ID NO: 532568 - protein, 9 aa, Homo Sapiens
YVLMAMNEF

SEQ ID NO: 532569 - protein, 9 aa, Homo Sapiens
SPITQQLCY

SEQ ID NO: 532570 - protein, 9 aa, Homo Sapiens
GALSWPGFE

SEQ ID NO: 532571 - protein, 9 aa, Homo Sapiens
PLPVAPGSL

SEQ ID NO: 532572 - protein, 9 aa, Homo Sapiens
PHWEMSNQD

SEQ ID NO: 532573 - protein, 9 aa, Homo Sapiens
ALTTAEFLV

SEQ ID NO: 532574 - protein, 9 aa, Homo Sapiens
VRAWSSLTH

SEQ ID NO: 532575 - protein, 9 aa, Homo Sapiens
HYTKRMTIT

SEQ ID NO: 532576 - protein, 9 aa, Homo Sapiens
WPGIGGPPV

SEQ ID NO: 532577 - protein, 9 aa, Homo Sapiens
PLNSPGTIS

SEQ ID NO: 532578 - protein, 9 aa, Homo Sapiens
LPILKEKVS

SEQ ID NO: 532579 - protein, 9 aa, Homo Sapiens
LDITDRPVP

SEQ ID NO: 532580 - protein, 9 aa, Homo Sapiens
HFQLCKTVH

SEQ ID NO: 532581 - protein, 9 aa, Homo Sapiens
VPAGRKVGL

SEQ ID NO: 532582 - protein, 9 aa, Homo Sapiens
MPGARYTVL

SEQ ID NO: 532583 - protein, 9 aa, Homo Sapiens
ALWHEEQPA

SEQ ID NO: 532584 - protein, 9 aa, Homo Sapiens
EKPDMHKQR

SEQ ID NO: 532585 - protein, 9 aa, Homo Sapiens
LKKRERQWE

SEQ ID NO: 532586 - protein, 9 aa, Homo Sapiens
FILELLWKE

SEQ ID NO: 532587 - protein, 9 aa, Homo Sapiens
REVGEKSEW

SEQ ID NO: 532588 - protein, 9 aa, Homo Sapiens
LNKTMSIEF

SEQ ID NO: 532589 - protein, 9 aa, Homo Sapiens
LWGPTESPA

SEQ ID NO: 532590 - protein, 9 aa, Homo Sapiens
VTLGNPDIL

SEQ ID NO: 532591 - protein, 9 aa, Homo Sapiens
GSTTTLQKC

SEQ ID NO: 532592 - protein, 9 aa, Homo Sapiens
CMLEPVFGK

SEQ ID NO: 532593 - protein, 9 aa, Homo Sapiens
FPNPERNFI

SEQ ID NO: 532594 - protein, 9 aa, Homo Sapiens
YMHNFSDLR

SEQ ID NO: 532595 - protein, 9 aa, Homo Sapiens
AFHAVRAPA

SEQ ID NO: 532596 - protein, 9 aa, Homo Sapiens
CADMLRYQA

SEQ ID NO: 532597 - protein, 9 aa, Homo Sapiens
DMVLAYRPG

SEQ ID NO: 532598 - protein, 9 aa, Homo Sapiens
LLRCIPTLD

SEQ ID NO: 532599 - protein, 9 aa, Homo Sapiens
QLCSSLEAK

SEQ ID NO: 532600 - protein, 9 aa, Homo Sapiens
SKKMLKPTG

SEQ ID NO: 532601 - protein, 9 aa, Homo Sapiens
SGLGNLSAG

SEQ ID NO: 532602 - protein, 9 aa, Homo Sapiens
SPYLLKRHH

SEQ ID NO: 532603 - protein, 9 aa, Homo Sapiens
STIRRDVPA

SEQ ID NO: 532604 - protein, 9 aa, Homo Sapiens
DMGSDDWDT

SEQ ID NO: 532605 - protein, 9 aa, Homo Sapiens
PAFHAVRAP

SEQ ID NO: 532606 - protein, 9 aa, Homo Sapiens
TQEGCAARR

SEQ ID NO: 532607 - protein, 9 aa, Homo Sapiens
SQLSKVHWP

SEQ ID NO: 532608 - protein, 9 aa, Homo Sapiens
CDRDNLKSS

SEQ ID NO: 532609 - protein, 9 aa, Homo Sapiens
SALWHEEQP

SEQ ID NO: 532610 - protein, 9 aa, Homo Sapiens
VKYLLWMGA

SEQ ID NO: 532611 - protein, 9 aa, Homo Sapiens
VSPSPAFHA

SEQ ID NO: 532612 - protein, 9 aa, Homo Sapiens
IACKRIRLG

SEQ ID NO: 532613 - protein, 9 aa, Homo Sapiens
NPNVKYIPF

SEQ ID NO: 532614 - protein, 9 aa, Homo Sapiens
GARYYCEVL

SEQ ID NO: 532615 - protein, 9 aa, Homo Sapiens
RHRGSGVFC

SEQ ID NO: 532616 - protein, 9 aa, Homo Sapiens
PLFKWQYEN

SEQ ID NO: 532617 - protein, 9 aa, Homo Sapiens
QALEEVGDL

SEQ ID NO: 532618 - protein, 9 aa, Homo Sapiens
LKCLSLGLF

SEQ ID NO: 532619 - protein, 9 aa, Homo Sapiens
RRWLKGGVV

SEQ ID NO: 532620 - protein, 9 aa, Homo Sapiens
RQWEQMEVL

SEQ ID NO: 532621 - protein, 9 aa, Homo Sapiens
FLSCITMMC

SEQ ID NO: 532622 - protein, 9 aa, Homo Sapiens
YDVEKNNSH

SEQ ID NO: 532623 - protein, 9 aa, Homo Sapiens
ARVACSETA

SEQ ID NO: 532624 - protein, 9 aa, Homo Sapiens
EAQDSVERN

SEQ ID NO: 532625 - protein, 9 aa, Homo Sapiens
PVTAVTAPG

SEQ ID NO: 532626 - protein, 9 aa, Homo Sapiens
GASFKGHLP

SEQ ID NO: 532627 - protein, 9 aa, Homo Sapiens
GTQEGCAAR

SEQ ID NO: 532628 - protein, 9 aa, Homo Sapiens
RLPETLPSM

SEQ ID NO: 532629 - protein, 9 aa, Homo Sapiens
QPLQGESHT

SEQ ID NO: 532630 - protein, 9 aa, Homo Sapiens
PKGWFCLLP

SEQ ID NO: 532631 - protein, 9 aa, Homo Sapiens
FSPITQQLC

SEQ ID NO: 532632 - protein, 9 aa, Homo Sapiens
CAKPSAELP

SEQ ID NO: 532633 - protein, 9 aa, Homo Sapiens
GAWALKTLR

SEQ ID NO: 532634 - protein, 9 aa, Homo Sapiens
AVLYFPQSD

SEQ ID NO: 532635 - protein, 9 aa, Homo Sapiens
QHIIAGVDI

SEQ ID NO: 532636 - protein, 9 aa, Homo Sapiens
GMGLSSFTF

SEQ ID NO: 532637 - protein, 9 aa, Homo Sapiens
GDIQKKQLI

SEQ ID NO: 532638 - protein, 9 aa, Homo Sapiens
SYGERPHWE

SEQ ID NO: 532639 - protein, 9 aa, Homo Sapiens
KCLSLGLFY

SEQ ID NO: 532640 - protein, 9 aa, Homo Sapiens
SPSPAFHAV

SEQ ID NO: 532641 - protein, 9 aa, Homo Sapiens
QARKPAFIL

SEQ ID NO: 532642 - protein, 9 aa, Homo Sapiens
HAREMWRSA

SEQ ID NO: 532643 - protein, 9 aa, Homo Sapiens
FRQVVINPQ

SEQ ID NO: 532644 - protein, 9 aa, Homo Sapiens
TVLEEDHEL

SEQ ID NO: 532645 - protein, 9 aa, Homo Sapiens
RSISGFRVD

SEQ ID NO: 532646 - protein, 9 aa, Homo Sapiens
PCITKTFFW

SEQ ID NO: 532647 - protein, 9 aa, Homo Sapiens
VPRVTFLSC

SEQ ID NO: 532648 - protein, 9 aa, Homo Sapiens
YAWGERFRV

SEQ ID NO: 532649 - protein, 9 aa, Homo Sapiens
KWLDLVTNW

SEQ ID NO: 532650 - protein, 9 aa, Homo Sapiens
THGYMLISK

SEQ ID NO: 532651 - protein, 9 aa, Homo Sapiens
RMDGFHPRR

SEQ ID NO: 532652 - protein, 9 aa, Homo Sapiens
QSEEVQGLL

SEQ ID NO: 532653 - protein, 9 aa, Homo Sapiens
LMAMNEFST

SEQ ID NO: 532654 - protein, 9 aa, Homo Sapiens
LDHYVQCSA

SEQ ID NO: 532655 - protein, 9 aa, Homo Sapiens
KIPEIHFLL

SEQ ID NO: 532656 - protein, 9 aa, Homo Sapiens
IRMAEAHVR

SEQ ID NO: 532657 - protein, 9 aa, Homo Sapiens
FKIPEIHFL

SEQ ID NO: 532658 - protein, 9 aa, Homo Sapiens
FILPEEIIQ

SEQ ID NO: 532659 - protein, 9 aa, Homo Sapiens
LSEIVGTTK

SEQ ID NO: 532660 - protein, 9 aa, Homo Sapiens
CVVIGLQSM

SEQ ID NO: 532661 - protein, 9 aa, Homo Sapiens
PDTPSYKRD

SEQ ID NO: 532662 - protein, 9 aa, Homo Sapiens
EDTFDWLLI

SEQ ID NO: 532663 - protein, 9 aa, Homo Sapiens
LSQMAPEDQ

SEQ ID NO: 532664 - protein, 9 aa, Homo Sapiens
VLQDSQDRC

SEQ ID NO: 532665 - protein, 9 aa, Homo Sapiens
NLGTTHLLH

SEQ ID NO: 532666 - protein, 9 aa, Homo Sapiens
GCCAKPSAE

SEQ ID NO: 532667 - protein, 9 aa, Homo Sapiens
LTKQLMILA

SEQ ID NO: 532668 - protein, 9 aa, Homo Sapiens
VCSVYHMTL

SEQ ID NO: 532669 - protein, 9 aa, Homo Sapiens
CWPGRALYL

SEQ ID NO: 532670 - protein, 9 aa, Homo Sapiens
QLTVQPCNV

SEQ ID NO: 532671 - protein, 9 aa, Homo Sapiens
KYSNRTPVV

SEQ ID NO: 532672 - protein, 9 aa, Homo Sapiens
PPFHSPERD

SEQ ID NO: 532673 - protein, 9 aa, Homo Sapiens
VTLFDAHVE

SEQ ID NO: 532674 - protein, 9 aa, Homo Sapiens
APYIPEGQW

SEQ ID NO: 532675 - protein, 9 aa, Homo Sapiens
NDTDYSLAL

SEQ ID NO: 532676 - protein, 9 aa, Homo Sapiens
VGEKSEWEE

SEQ ID NO: 532677 - protein, 9 aa, Homo Sapiens
CPKGFRLSP

SEQ ID NO: 532678 - protein, 9 aa, Homo Sapiens
SVNVHITNN

SEQ ID NO: 532679 - protein, 9 aa, Homo Sapiens
MLTMNPVSF

SEQ ID NO: 532680 - protein, 9 aa, Homo Sapiens
VSTADRSMR

SEQ ID NO: 532681 - protein, 9 aa, Homo Sapiens
LDLGGSMAI

SEQ ID NO: 532682 - protein, 9 aa, Homo Sapiens
HNVPDEDEG

SEQ ID NO: 532683 - protein, 9 aa, Homo Sapiens
AEIYGWIER

SEQ ID NO: 532684 - protein, 9 aa, Homo Sapiens
NEKMEVSRN

SEQ ID NO: 532685 - protein, 9 aa, Homo Sapiens
RGVPETLNE

SEQ ID NO: 532686 - protein, 9 aa, Homo Sapiens
HNFSDLRNG

SEQ ID NO: 532687 - protein, 9 aa, Homo Sapiens
SVGSHPRAA

SEQ ID NO: 532688 - protein, 9 aa, Homo Sapiens
IEDRNAHLG

SEQ ID NO: 532689 - protein, 9 aa, Homo Sapiens
LPSVQLQHI

SEQ ID NO: 532690 - protein, 9 aa, Homo Sapiens
SLTLHNREL

SEQ ID NO: 532691 - protein, 9 aa, Homo Sapiens
WEAQDSVER

SEQ ID NO: 532692 - protein, 9 aa, Homo Sapiens
AANQAASWR

SEQ ID NO: 532693 - protein, 9 aa, Homo Sapiens
RHVRSFISP

SEQ ID NO: 532694 - protein, 9 aa, Homo Sapiens
AENSIGVGP

SEQ ID NO: 532695 - protein, 9 aa, Homo Sapiens
IVFYGSQMG

SEQ ID NO: 532696 - protein, 9 aa, Homo Sapiens
ALKEDRKCF

SEQ ID NO: 532697 - protein, 9 aa, Homo Sapiens
NALAHSKRK

SEQ ID NO: 532698 - protein, 9 aa, Homo Sapiens
RRRKERVKS

SEQ ID NO: 532699 - protein, 9 aa, Homo Sapiens
AEPCVLCQC

SEQ ID NO: 532700 - protein, 9 aa, Homo Sapiens
GGGGGFGTA

SEQ ID NO: 532701 - protein, 9 aa, Homo Sapiens
DREKIPEYN

SEQ ID NO: 532702 - protein, 9 aa, Homo Sapiens
LLHVTHSLQ

SEQ ID NO: 532703 - protein, 9 aa, Homo Sapiens
SNVMFDISS

SEQ ID NO: 532704 - protein, 9 aa, Homo Sapiens
TWGLSRIVP

SEQ ID NO: 532705 - protein, 9 aa, Homo Sapiens
PLRNEYFFY

SEQ ID NO: 532706 - protein, 9 aa, Homo Sapiens
GYVLMAMNE

SEQ ID NO: 532707 - protein, 9 aa, Homo Sapiens
LKLVHSLAV

SEQ ID NO: 532708 - protein, 9 aa, Homo Sapiens
RPRSPSTFP

SEQ ID NO: 532709 - protein, 9 aa, Homo Sapiens
HIHIRSLKI

SEQ ID NO: 532710 - protein, 9 aa, Homo Sapiens
NHAVDCWSL

SEQ ID NO: 532711 - protein, 9 aa, Homo Sapiens
DRNKDHSRS

SEQ ID NO: 532712 - protein, 9 aa, Homo Sapiens
HQGSVTTLA

SEQ ID NO: 532713 - protein, 9 aa, Homo Sapiens
VAHLLSPDL

SEQ ID NO: 532714 - protein, 9 aa, Homo Sapiens
WEPPTPHGK

SEQ ID NO: 532715 - protein, 9 aa, Homo Sapiens
LAVLEQEEA

SEQ ID NO: 532716 - protein, 9 aa, Homo Sapiens
LSLELMNQL

SEQ ID NO: 532717 - protein, 9 aa, Homo Sapiens
AATTESGDL

SEQ ID NO: 532718 - protein, 9 aa, Homo Sapiens
RRKNSFDSL

SEQ ID NO: 532719 - protein, 9 aa, Homo Sapiens
GRPLLPDHR

SEQ ID NO: 532720 - protein, 9 aa, Homo Sapiens
GEGSVSASQ

SEQ ID NO: 532721 - protein, 9 aa, Homo Sapiens
KCFEPTGFQ

SEQ ID NO: 532722 - protein, 9 aa, Homo Sapiens
RTWCEDTRH

SEQ ID NO: 532723 - protein, 9 aa, Homo Sapiens
GPGLSLRHA

SEQ ID NO: 532724 - protein, 9 aa, Homo Sapiens
MRRHVRSFI

SEQ ID NO: 532725 - protein, 9 aa, Homo Sapiens
LFFEQSDNI

SEQ ID NO: 532726 - protein, 9 aa, Homo Sapiens
IYVCAKCGY

SEQ ID NO: 532727 - protein, 9 aa, Homo Sapiens
PSGMNIRQS

SEQ ID NO: 532728 - protein, 9 aa, Homo Sapiens
NPERNFILP

SEQ ID NO: 532729 - protein, 9 aa, Homo Sapiens
IHMGEKPYE

SEQ ID NO: 532730 - protein, 9 aa, Homo Sapiens
YFATLDHHL

SEQ ID NO: 532731 - protein, 9 aa, Homo Sapiens
SPPQLMHVT

SEQ ID NO: 532732 - protein, 9 aa, Homo Sapiens
FSAETLLDI

SEQ ID NO: 532733 - protein, 9 aa, Homo Sapiens
NEYFFYRNR

SEQ ID NO: 532734 - protein, 9 aa, Homo Sapiens
VLIRKLIAV

SEQ ID NO: 532735 - protein, 9 aa, Homo Sapiens
DCGSPALSS

SEQ ID NO: 532736 - protein, 9 aa, Homo Sapiens
NVAGEAGSK

SEQ ID NO: 532737 - protein, 9 aa, Homo Sapiens
KQMCCLPGE

SEQ ID NO: 532738 - protein, 9 aa, Homo Sapiens
EAEHLWKEL

SEQ ID NO: 532739 - protein, 9 aa, Homo Sapiens
TMVSATHIV

SEQ ID NO: 532740 - protein, 9 aa, Homo Sapiens
HNIVKYDLR

SEQ ID NO: 532741 - protein, 9 aa, Homo Sapiens
WNWRVDMTL

SEQ ID NO: 532742 - protein, 9 aa, Homo Sapiens
VFTKAAVRR

SEQ ID NO: 532743 - protein, 9 aa, Homo Sapiens
RSKTKVPVH

SEQ ID NO: 532744 - protein, 9 aa, Homo Sapiens
RPETDILFG

SEQ ID NO: 532745 - protein, 9 aa, Homo Sapiens
KPYQGSTGF

SEQ ID NO: 532746 - protein, 9 aa, Homo Sapiens
RQVVINPQV

SEQ ID NO: 532747 - protein, 9 aa, Homo Sapiens
NPDILVGSG

SEQ ID NO: 532748 - protein, 9 aa, Homo Sapiens
PKCLESPSH

SEQ ID NO: 532749 - protein, 9 aa, Homo Sapiens
REEKKCSLA

SEQ ID NO: 532750 - protein, 9 aa, Homo Sapiens
GPDTPSYKR

SEQ ID NO: 532751 - protein, 9 aa, Homo Sapiens
TNDVETAHC

SEQ ID NO: 532752 - protein, 9 aa, Homo Sapiens
PRVTFLSCN

SEQ ID NO: 532753 - protein, 9 aa, Homo Sapiens
PEVEWGSGT

SEQ ID NO: 532754 - protein, 9 aa, Homo Sapiens
HLQRRKNSF

SEQ ID NO: 532755 - protein, 9 aa, Homo Sapiens
NWRVDMTLP

SEQ ID NO: 532756 - protein, 9 aa, Homo Sapiens
PGAFLLRNP

SEQ ID NO: 532757 - protein, 9 aa, Homo Sapiens
RHISEGCLG

SEQ ID NO: 532758 - protein, 9 aa, Homo Sapiens
KNSFLNYNI

SEQ ID NO: 532759 - protein, 9 aa, Homo Sapiens
NREAKTDPV

SEQ ID NO: 532760 - protein, 9 aa, Homo Sapiens
EKELQKFLK

SEQ ID NO: 532761 - protein, 9 aa, Homo Sapiens
IVTAATTES

SEQ ID NO: 532762 - protein, 9 aa, Homo Sapiens
CYDCVCQPG

SEQ ID NO: 532763 - protein, 9 aa, Homo Sapiens
QQEEENKAR

SEQ ID NO: 532764 - protein, 9 aa, Homo Sapiens
FRVMEEKIA

SEQ ID NO: 532765 - protein, 9 aa, Homo Sapiens
APCVFIYIW

SEQ ID NO: 532766 - protein, 9 aa, Homo Sapiens
RNLGSFPSP

SEQ ID NO: 532767 - protein, 9 aa, Homo Sapiens
ERHQDRDRD

SEQ ID NO: 532768 - protein, 9 aa, Homo Sapiens
TLMVGDRPE

SEQ ID NO: 532769 - protein, 9 aa, Homo Sapiens
WHFILELLW

SEQ ID NO: 532770 - protein, 9 aa, Homo Sapiens
AMGLINMAE

SEQ ID NO: 532771 - protein, 9 aa, Homo Sapiens
GYHHNAEER

SEQ ID NO: 532772 - protein, 9 aa, Homo Sapiens
CFCSQFINT

SEQ ID NO: 532773 - protein, 9 aa, Homo Sapiens
IPSCTPDHI

SEQ ID NO: 532774 - protein, 9 aa, Homo Sapiens
RRHIHIRSL

SEQ ID NO: 532775 - protein, 9 aa, Homo Sapiens
SDRNKDHSR

SEQ ID NO: 532776 - protein, 9 aa, Homo Sapiens
AHCTAGTLH

SEQ ID NO: 532777 - protein, 9 aa, Homo Sapiens
RENCSQVCP

SEQ ID NO: 532778 - protein, 9 aa, Homo Sapiens
HLALRHGTP

SEQ ID NO: 532779 - protein, 9 aa, Homo Sapiens
QKNNLQHLQ

SEQ ID NO: 532780 - protein, 9 aa, Homo Sapiens
DGPGGTLAH

SEQ ID NO: 532781 - protein, 9 aa, Homo Sapiens
VDHCFSSDR

SEQ ID NO: 532782 - protein, 9 aa, Homo Sapiens
HIWVFGGAN

SEQ ID NO: 532783 - protein, 9 aa, Homo Sapiens
KELQKFLKN

SEQ ID NO: 532784 - protein, 9 aa, Homo Sapiens
ESQMLHLLD

SEQ ID NO: 532785 - protein, 9 aa, Homo Sapiens
SEYLRIEPD

SEQ ID NO: 532786 - protein, 9 aa, Homo Sapiens
ICHPLQYLA

SEQ ID NO: 532787 - protein, 9 aa, Homo Sapiens
QEPLNNSSP

SEQ ID NO: 532788 - protein, 9 aa, Homo Sapiens
SDLVGGGHT

SEQ ID NO: 532789 - protein, 9 aa, Homo Sapiens
AYHSAPERT

SEQ ID NO: 532790 - protein, 9 aa, Homo Sapiens
SGRSLVTSR

SEQ ID NO: 532791 - protein, 9 aa, Homo Sapiens
DRFWEFFES

SEQ ID NO: 532792 - protein, 9 aa, Homo Sapiens
LQCEVWGKP

SEQ ID NO: 532793 - protein, 9 aa, Homo Sapiens
RLVALMLAR

SEQ ID NO: 532794 - protein, 9 aa, Homo Sapiens
LQSSPEDIA

SEQ ID NO: 532795 - protein, 9 aa, Homo Sapiens
AGLDPSQQP

SEQ ID NO: 532796 - protein, 9 aa, Homo Sapiens
DHKKRKIQE

SEQ ID NO: 532797 - protein, 9 aa, Homo Sapiens
LTRGRQGPA

SEQ ID NO: 532798 - protein, 9 aa, Homo Sapiens
APGSLKTEA

SEQ ID NO: 532799 - protein, 9 aa, Homo Sapiens
GPLCKSSLK

SEQ ID NO: 532800 - protein, 9 aa, Homo Sapiens
VGASDCGSP

SEQ ID NO: 532801 - protein, 9 aa, Homo Sapiens
NWASDDCKL

SEQ ID NO: 532802 - protein, 9 aa, Homo Sapiens
KEKELQKFL

SEQ ID NO: 532803 - protein, 9 aa, Homo Sapiens
QERDGLEQA

SEQ ID NO: 532804 - protein, 9 aa, Homo Sapiens
VRIHLRDYV

SEQ ID NO: 532805 - protein, 9 aa, Homo Sapiens
EYLDGKFID

SEQ ID NO: 532806 - protein, 9 aa, Homo Sapiens
YDMGSDDWD

SEQ ID NO: 532807 - protein, 9 aa, Homo Sapiens
RSLLQAWEW

SEQ ID NO: 532808 - protein, 9 aa, Homo Sapiens
FEKKVQVIY

SEQ ID NO: 532809 - protein, 9 aa, Homo Sapiens
VKLWSLPKA

SEQ ID NO: 532810 - protein, 9 aa, Homo Sapiens
LQAEAEHLW

SEQ ID NO: 532811 - protein, 9 aa, Homo Sapiens
TAGVEPMFS

SEQ ID NO: 532812 - protein, 9 aa, Homo Sapiens
KLWSLPKAL

SEQ ID NO: 532813 - protein, 9 aa, Homo Sapiens
VAGWEMLIY

SEQ ID NO: 532814 - protein, 9 aa, Homo Sapiens
LGHRQRKSE

SEQ ID NO: 532815 - protein, 9 aa, Homo Sapiens
WRAAFAARL

SEQ ID NO: 532816 - protein, 9 aa, Homo Sapiens
ILPEEIIQE

SEQ ID NO: 532817 - protein, 9 aa, Homo Sapiens
GSSPHNVPD

SEQ ID NO: 532818 - protein, 9 aa, Homo Sapiens
AAMRRRDFA

SEQ ID NO: 532819 - protein, 9 aa, Homo Sapiens
PHNVPDEDE

SEQ ID NO: 532820 - protein, 9 aa, Homo Sapiens
EQYKASQDP

SEQ ID NO: 532821 - protein, 9 aa, Homo Sapiens
ALQFDFAQP

SEQ ID NO: 532822 - protein, 9 aa, Homo Sapiens
RIGRKVFTK

SEQ ID NO: 532823 - protein, 9 aa, Homo Sapiens
CQNLGYTTA

SEQ ID NO: 532824 - protein, 9 aa, Homo Sapiens
ETDIKMMER

SEQ ID NO: 532825 - protein, 9 aa, Homo Sapiens
RRENCSQVC

SEQ ID NO: 532826 - protein, 9 aa, Homo Sapiens
LNSPGTISF

SEQ ID NO: 532827 - protein, 9 aa, Homo Sapiens
QPSGMNIRQ

SEQ ID NO: 532828 - protein, 9 aa, Homo Sapiens
HWRSKKAKA

SEQ ID NO: 532829 - protein, 9 aa, Homo Sapiens
GLQSMGEAR

SEQ ID NO: 532830 - protein, 9 aa, Homo Sapiens
HHPHAREMW

SEQ ID NO: 532831 - protein, 9 aa, Homo Sapiens
GVCKQGLCC

SEQ ID NO: 532832 - protein, 9 aa, Homo Sapiens
AEHLWKELE

SEQ ID NO: 532833 - protein, 9 aa, Homo Sapiens
TAQEDDRLG

SEQ ID NO: 532834 - protein, 9 aa, Homo Sapiens
WRSASEQSP

SEQ ID NO: 532835 - protein, 9 aa, Homo Sapiens
WKERQLHSQ

SEQ ID NO: 532836 - protein, 9 aa, Homo Sapiens
RASRALDDV

SEQ ID NO: 532837 - protein, 9 aa, Homo Sapiens
EYMHNFSDL

SEQ ID NO: 532838 - protein, 9 aa, Homo Sapiens
SLLRRHRGS

SEQ ID NO: 532839 - protein, 9 aa, Homo Sapiens
QALDFVFTP

SEQ ID NO: 532840 - protein, 9 aa, Homo Sapiens
SCPPDPSPR

SEQ ID NO: 532841 - protein, 9 aa, Homo Sapiens
SAMETINKL

SEQ ID NO: 532842 - protein, 9 aa, Homo Sapiens
GKAFCRSAA

SEQ ID NO: 532843 - protein, 9 aa, Homo Sapiens
LNWFDERTW

SEQ ID NO: 532844 - protein, 9 aa, Homo Sapiens
HLGNQMGEY

SEQ ID NO: 532845 - protein, 9 aa, Homo Sapiens
TAPVVTLFD

SEQ ID NO: 532846 - protein, 9 aa, Homo Sapiens
LGTSEGTSV

SEQ ID NO: 532847 - protein, 9 aa, Homo Sapiens
DFRVGASDC

SEQ ID NO: 532848 - protein, 9 aa, Homo Sapiens
NDKREQKLK

SEQ ID NO: 532849 - protein, 9 aa, Homo Sapiens
QLTAELQDT

SEQ ID NO: 532850 - protein, 9 aa, Homo Sapiens
SACLEEAAQ

SEQ ID NO: 532851 - protein, 9 aa, Homo Sapiens
DMHKQRGKA

SEQ ID NO: 532852 - protein, 9 aa, Homo Sapiens
NLYLKQMCC

SEQ ID NO: 532853 - protein, 9 aa, Homo Sapiens
LPGCPELSF

SEQ ID NO: 532854 - protein, 9 aa, Homo Sapiens
YPLQALRQR

SEQ ID NO: 532855 - protein, 9 aa, Homo Sapiens
NVLDELWHA

SEQ ID NO: 532856 - protein, 9 aa, Homo Sapiens
SGPHPVTVL

SEQ ID NO: 532857 - protein, 9 aa, Homo Sapiens
IGARYYCEV

SEQ ID NO: 532858 - protein, 9 aa, Homo Sapiens
ALWPRGARR

SEQ ID NO: 532859 - protein, 9 aa, Homo Sapiens
AQHSAMPTK

SEQ ID NO: 532860 - protein, 9 aa, Homo Sapiens
MKEVLVQVE

SEQ ID NO: 532861 - protein, 9 aa, Homo Sapiens
VSIVVTTSP

SEQ ID NO: 532862 - protein, 9 aa, Homo Sapiens
LVYPMASRR

SEQ ID NO: 532863 - protein, 9 aa, Homo Sapiens
RLARVQETL

SEQ ID NO: 532864 - protein, 9 aa, Homo Sapiens
WQRQEERQQ

SEQ ID NO: 532865 - protein, 9 aa, Homo Sapiens
RKHLTKSQP

SEQ ID NO: 532866 - protein, 9 aa, Homo Sapiens
GTSEGTSVG

SEQ ID NO: 532867 - protein, 9 aa, Homo Sapiens
EAHVELDSL

SEQ ID NO: 532868 - protein, 9 aa, Homo Sapiens
VSDISQAYH

SEQ ID NO: 532869 - protein, 9 aa, Homo Sapiens
ARPAKAVAT

SEQ ID NO: 532870 - protein, 9 aa, Homo Sapiens
LHRRIHMGE

SEQ ID NO: 532871 - protein, 9 aa, Homo Sapiens
FHQSSYLKI

SEQ ID NO: 532872 - protein, 9 aa, Homo Sapiens
YSNRTPVVQ

SEQ ID NO: 532873 - protein, 9 aa, Homo Sapiens
VQTVTAVAG

SEQ ID NO: 532874 - protein, 9 aa, Homo Sapiens
QEEMWWQEE

SEQ ID NO: 532875 - protein, 9 aa, Homo Sapiens
VTMTQEAID

SEQ ID NO: 532876 - protein, 9 aa, Homo Sapiens
ASRAYVAPA

SEQ ID NO: 532877 - protein, 9 aa, Homo Sapiens
VTRLEAENT

SEQ ID NO: 532878 - protein, 9 aa, Homo Sapiens
AHMPVIISV

SEQ ID NO: 532879 - protein, 9 aa, Homo Sapiens
VLHALKVVH

SEQ ID NO: 532880 - protein, 9 aa, Homo Sapiens
SYHPGCFQC

SEQ ID NO: 532881 - protein, 9 aa, Homo Sapiens
VEIKMWAIT

SEQ ID NO: 532882 - protein, 9 aa, Homo Sapiens
RASALWHEE

SEQ ID NO: 532883 - protein, 9 aa, Homo Sapiens
CHSQQVWRS

SEQ ID NO: 532884 - protein, 9 aa, Homo Sapiens
QLALALSRA

SEQ ID NO: 532885 - protein, 9 aa, Homo Sapiens
HISQARKPA

SEQ ID NO: 532886 - protein, 9 aa, Homo Sapiens
HLVHYRIDL

SEQ ID NO: 532887 - protein, 9 aa, Homo Sapiens
IPQYTAELH

SEQ ID NO: 532888 - protein, 9 aa, Homo Sapiens
MTITSRDIQ

SEQ ID NO: 532889 - protein, 9 aa, Homo Sapiens
ISQARKPAF

SEQ ID NO: 532890 - protein, 9 aa, Homo Sapiens
KTLLENTGH

SEQ ID NO: 532891 - protein, 9 aa, Homo Sapiens
NWLEELVGQ

SEQ ID NO: 532892 - protein, 9 aa, Homo Sapiens
GHRQRKSEK

SEQ ID NO: 532893 - protein, 9 aa, Homo Sapiens
EQSDNIAHM

SEQ ID NO: 532894 - protein, 9 aa, Homo Sapiens
VWNIFIVTN

SEQ ID NO: 532895 - protein, 9 aa, Homo Sapiens
GQSSPSCRT

SEQ ID NO: 532896 - protein, 9 aa, Homo Sapiens
DTFCLEFLL

SEQ ID NO: 532897 - protein, 9 aa, Homo Sapiens
LQDSQDRCY

SEQ ID NO: 532898 - protein, 9 aa, Homo Sapiens
DSFCGLDIN

SEQ ID NO: 532899 - protein, 9 aa, Homo Sapiens
LSDSDMEDY

SEQ ID NO: 532900 - protein, 9 aa, Homo Sapiens
HMICLDCFH

SEQ ID NO: 532901 - protein, 9 aa, Homo Sapiens
GNLGLWING

SEQ ID NO: 532902 - protein, 9 aa, Homo Sapiens
TSDLSPYLL

SEQ ID NO: 532903 - protein, 9 aa, Homo Sapiens
TMKQTEVLL

SEQ ID NO: 532904 - protein, 9 aa, Homo Sapiens
DTIGDDDEA

SEQ ID NO: 532905 - protein, 9 aa, Homo Sapiens
NKAREQRIR

SEQ ID NO: 532906 - protein, 9 aa, Homo Sapiens
LFCGSSDVD

SEQ ID NO: 532907 - protein, 9 aa, Homo Sapiens
RYRVLVYPM

SEQ ID NO: 532908 - protein, 9 aa, Homo Sapiens
VQTSYVPEE

SEQ ID NO: 532909 - protein, 9 aa, Homo Sapiens
GRRHIHIRS

SEQ ID NO: 532910 - protein, 9 aa, Homo Sapiens
QVRERIHIN

SEQ ID NO: 532911 - protein, 9 aa, Homo Sapiens
EIVGTTKLK

SEQ ID NO: 532912 - protein, 9 aa, Homo Sapiens
NSRHMICLD

SEQ ID NO: 532913 - protein, 9 aa, Homo Sapiens
EGRPLLPDH

SEQ ID NO: 532914 - protein, 9 aa, Homo Sapiens
PKVSDTMVE

SEQ ID NO: 532915 - protein, 9 aa, Homo Sapiens
VHSLAVCEE

SEQ ID NO: 532916 - protein, 9 aa, Homo Sapiens
DGGDIQKKQ

SEQ ID NO: 532917 - protein, 9 aa, Homo Sapiens
RERHQDRDR

SEQ ID NO: 532918 - protein, 9 aa, Homo Sapiens
TAGYNHAVD

SEQ ID NO: 532919 - protein, 9 aa, Homo Sapiens
IRNVLDELW

SEQ ID NO: 532920 - protein, 9 aa, Homo Sapiens
IPALKCLSL

SEQ ID NO: 532921 - protein, 9 aa, Homo Sapiens
CNSRHMICL

SEQ ID NO: 532922 - protein, 9 aa, Homo Sapiens
TEKTMKQTE

SEQ ID NO: 532923 - protein, 9 aa, Homo Sapiens
KTKVPVHDQ

SEQ ID NO: 532924 - protein, 9 aa, Homo Sapiens
IIPALKCLS

SEQ ID NO: 532925 - protein, 9 aa, Homo Sapiens
NTPVMLNSA

SEQ ID NO: 532926 - protein, 9 aa, Homo Sapiens
VEAEVHQLV

SEQ ID NO: 532927 - protein, 9 aa, Homo Sapiens
KRDNSISPE

SEQ ID NO: 532928 - protein, 9 aa, Homo Sapiens
EEISISAYT

SEQ ID NO: 532929 - protein, 9 aa, Homo Sapiens
KCVYVIGQE

SEQ ID NO: 532930 - protein, 9 aa, Homo Sapiens
GLMSLTMNL

SEQ ID NO: 532931 - protein, 9 aa, Homo Sapiens
YGTRIGKMP

SEQ ID NO: 532932 - protein, 9 aa, Homo Sapiens
LSLSGHLAR

SEQ ID NO: 532933 - protein, 9 aa, Homo Sapiens
LSLPGSPDK

SEQ ID NO: 532934 - protein, 9 aa, Homo Sapiens
VDHKKRKIQ

SEQ ID NO: 532935 - protein, 9 aa, Homo Sapiens
TSSYVPSSS

SEQ ID NO: 532936 - protein, 9 aa, Homo Sapiens
IGDDDEASR

SEQ ID NO: 532937 - protein, 9 aa, Homo Sapiens
PAVPVTAVT

SEQ ID NO: 532938 - protein, 9 aa, Homo Sapiens
HQMSFASVR

SEQ ID NO: 532939 - protein, 9 aa, Homo Sapiens
AQHWVRGLT

SEQ ID NO: 532940 - protein, 9 aa, Homo Sapiens
FEALVTRKM

SEQ ID NO: 532941 - protein, 9 aa, Homo Sapiens
ALKDGHSGM

SEQ ID NO: 532942 - protein, 9 aa, Homo Sapiens
RGPPPPGMH

SEQ ID NO: 532943 - protein, 9 aa, Homo Sapiens
NGNQLRSLQ

SEQ ID NO: 532944 - protein, 9 aa, Homo Sapiens
TLANKYGIV

SEQ ID NO: 532945 - protein, 9 aa, Homo Sapiens
QSMGEARTR

SEQ ID NO: 532946 - protein, 9 aa, Homo Sapiens
QYGEPREGR

SEQ ID NO: 532947 - protein, 9 aa, Homo Sapiens
ATDSSLGSV

SEQ ID NO: 532948 - protein, 9 aa, Homo Sapiens
GDREDRPGV

SEQ ID NO: 532949 - protein, 9 aa, Homo Sapiens
ALSWPGFEK

SEQ ID NO: 532950 - protein, 9 aa, Homo Sapiens
TPHGKDPLM

SEQ ID NO: 532951 - protein, 9 aa, Homo Sapiens
YYELAWKER

SEQ ID NO: 532952 - protein, 9 aa, Homo Sapiens
YGWIEREHQ

SEQ ID NO: 532953 - protein, 9 aa, Homo Sapiens
HIMLMGVCK

SEQ ID NO: 532954 - protein, 9 aa, Homo Sapiens
CQDHRCTAQ

SEQ ID NO: 532955 - protein, 9 aa, Homo Sapiens
KPSTIRRDV

SEQ ID NO: 532956 - protein, 9 aa, Homo Sapiens
EPILPRTLT

SEQ ID NO: 532957 - protein, 9 aa, Homo Sapiens
KDCEECQKA

SEQ ID NO: 532958 - protein, 9 aa, Homo Sapiens
QTKDILIRF

SEQ ID NO: 532959 - protein, 9 aa, Homo Sapiens
HPGQQRPHP

SEQ ID NO: 532960 - protein, 9 aa, Homo Sapiens
STHNITQGI

SEQ ID NO: 532961 - protein, 9 aa, Homo Sapiens
FDNRTWVHQ

SEQ ID NO: 532962 - protein, 9 aa, Homo Sapiens
NGLVAGLQH

SEQ ID NO: 532963 - protein, 9 aa, Homo Sapiens
VVSWMIVQT

SEQ ID NO: 532964 - protein, 9 aa, Homo Sapiens
QVCMLADLS

SEQ ID NO: 532965 - protein, 9 aa, Homo Sapiens
HQVCVYDPA

SEQ ID NO: 532966 - protein, 9 aa, Homo Sapiens
TVSPSPAFH

SEQ ID NO: 532967 - protein, 9 aa, Homo Sapiens
ETMHTDKEP

SEQ ID NO: 532968 - protein, 9 aa, Homo Sapiens
QCMLNRHLK

SEQ ID NO: 532969 - protein, 9 aa, Homo Sapiens
RALKEDRKC

SEQ ID NO: 532970 - protein, 9 aa, Homo Sapiens
LIGAVNLKY

SEQ ID NO: 532971 - protein, 9 aa, Homo Sapiens
QDCTVKLWS

SEQ ID NO: 532972 - protein, 9 aa, Homo Sapiens
ASGPTGLPG

SEQ ID NO: 532973 - protein, 9 aa, Homo Sapiens
KLRRAAKEA

SEQ ID NO: 532974 - protein, 9 aa, Homo Sapiens
REPQQQLNI

SEQ ID NO: 532975 - protein, 9 aa, Homo Sapiens
QLRHILLPL

SEQ ID NO: 532976 - protein, 9 aa, Homo Sapiens
LFWKYVQFH

SEQ ID NO: 532977 - protein, 9 aa, Homo Sapiens
NSIIPALKC

SEQ ID NO: 532978 - protein, 9 aa, Homo Sapiens
RTFSALWAA

SEQ ID NO: 532979 - protein, 9 aa, Homo Sapiens
KKRKIQEEI

SEQ ID NO: 532980 - protein, 9 aa, Homo Sapiens
CQVQTSYVP

SEQ ID NO: 532981 - protein, 9 aa, Homo Sapiens
SLLPTVCHH

SEQ ID NO: 532982 - protein, 9 aa, Homo Sapiens
GENQSMYQN

SEQ ID NO: 532983 - protein, 9 aa, Homo Sapiens
LGDFRFLFI

SEQ ID NO: 532984 - protein, 9 aa, Homo Sapiens
SIIPALKCL

SEQ ID NO: 532985 - protein, 9 aa, Homo Sapiens
KTILVSTDM

SEQ ID NO: 532986 - protein, 9 aa, Homo Sapiens
KPPKGWFCL

SEQ ID NO: 532987 - protein, 9 aa, Homo Sapiens
AQRNSIPMS

SEQ ID NO: 532988 - protein, 9 aa, Homo Sapiens
VVDSEATHN

SEQ ID NO: 532989 - protein, 9 aa, Homo Sapiens
ERNFILPEE

SEQ ID NO: 532990 - protein, 9 aa, Homo Sapiens
RAYSCRSHL

SEQ ID NO: 532991 - protein, 9 aa, Homo Sapiens
PTLDSLTPA

SEQ ID NO: 532992 - protein, 9 aa, Homo Sapiens
PICRGPDGH

SEQ ID NO: 532993 - protein, 9 aa, Homo Sapiens
ECARSRGFP

SEQ ID NO: 532994 - protein, 9 aa, Homo Sapiens
TPMELKTAC

SEQ ID NO: 532995 - protein, 9 aa, Homo Sapiens
FSCVCPKGF

SEQ ID NO: 532996 - protein, 9 aa, Homo Sapiens
FHRGGVAHL

SEQ ID NO: 532997 - protein, 9 aa, Homo Sapiens
PRSPSTFPA

SEQ ID NO: 532998 - protein, 9 aa, Homo Sapiens
SIPRIAALG

SEQ ID NO: 532999 - protein, 9 aa, Homo Sapiens
LPTNDPLEA

SEQ ID NO: 533000 - protein, 9 aa, Homo Sapiens
TEGCCAKPS

SEQ ID NO: 533001 - protein, 9 aa, Homo Sapiens
HQKERQCQF

SEQ ID NO: 533002 - protein, 9 aa, Homo Sapiens
NHFEPGIYV

SEQ ID NO: 533003 - protein, 9 aa, Homo Sapiens
FAACLNKVE

SEQ ID NO: 533004 - protein, 9 aa, Homo Sapiens
TMFFNFDSF

SEQ ID NO: 533005 - protein, 9 aa, Homo Sapiens
KVMLPPNSF

SEQ ID NO: 533006 - protein, 9 aa, Homo Sapiens
VSAVYIYNR

SEQ ID NO: 533007 - protein, 9 aa, Homo Sapiens
KSYHPGCFQ

SEQ ID NO: 533008 - protein, 9 aa, Homo Sapiens
QREPQQQLN

SEQ ID NO: 533009 - protein, 9 aa, Homo Sapiens
LETHECFNP

SEQ ID NO: 533010 - protein, 9 aa, Homo Sapiens
YHYQWCQGG

SEQ ID NO: 533011 - protein, 9 aa, Homo Sapiens
RSAVPHAPD

SEQ ID NO: 533012 - protein, 9 aa, Homo Sapiens
KTVHHGFPY

SEQ ID NO: 533013 - protein, 9 aa, Homo Sapiens
GGQIWGPQS

SEQ ID NO: 533014 - protein, 9 aa, Homo Sapiens
NCDRDNLKS

SEQ ID NO: 533015 - protein, 9 aa, Homo Sapiens
AEPLLCPLG

SEQ ID NO: 533016 - protein, 9 aa, Homo Sapiens
LLDVPRDVY

SEQ ID NO: 533017 - protein, 9 aa, Homo Sapiens
RHSALPGCP

SEQ ID NO: 533018 - protein, 9 aa, Homo Sapiens
IIVFYGSQM

SEQ ID NO: 533019 - protein, 9 aa, Homo Sapiens
CLSLPGSPD

SEQ ID NO: 533020 - protein, 9 aa, Homo Sapiens
VTAPGADTA

SEQ ID NO: 533021 - protein, 9 aa, Homo Sapiens
QLVKSVSES

SEQ ID NO: 533022 - protein, 9 aa, Homo Sapiens
FLNKTMSIE

SEQ ID NO: 533023 - protein, 9 aa, Homo Sapiens
PYRQLQEKD

SEQ ID NO: 533024 - protein, 9 aa, Homo Sapiens
FCLEFLLVP

SEQ ID NO: 533025 - protein, 9 aa, Homo Sapiens
GTMFFNFDS

SEQ ID NO: 533026 - protein, 9 aa, Homo Sapiens
FDWLLISIE

SEQ ID NO: 533027 - protein, 9 aa, Homo Sapiens
RCSCPGAKR

SEQ ID NO: 533028 - protein, 9 aa, Homo Sapiens
GCCFSESST

SEQ ID NO: 533029 - protein, 9 aa, Homo Sapiens
RDHGMEDVT

SEQ ID NO: 533030 - protein, 9 aa, Homo Sapiens
LHALKVVHF

SEQ ID NO: 533031 - protein, 9 aa, Homo Sapiens
LSGHLARVE

SEQ ID NO: 533032 - protein, 9 aa, Homo Sapiens
SARTYFYTN

SEQ ID NO: 533033 - protein, 9 aa, Homo Sapiens
ITCFATQRQ

SEQ ID NO: 533034 - protein, 9 aa, Homo Sapiens
LLVSPGVRS

SEQ ID NO: 533035 - protein, 9 aa, Homo Sapiens
QMGTAEEFA

SEQ ID NO: 533036 - protein, 9 aa, Homo Sapiens
CFLCKAVEN

SEQ ID NO: 533037 - protein, 9 aa, Homo Sapiens
AFQEGLLHV

SEQ ID NO: 533038 - protein, 9 aa, Homo Sapiens
DTACICTLL

SEQ ID NO: 533039 - protein, 9 aa, Homo Sapiens
CGISSWKKA

SEQ ID NO: 533040 - protein, 9 aa, Homo Sapiens
TQDCTVAVI

SEQ ID NO: 533041 - protein, 9 aa, Homo Sapiens
RHAGLFLLL

SEQ ID NO: 533042 - protein, 9 aa, Homo Sapiens
TGEPILPRT

SEQ ID NO: 533043 - protein, 9 aa, Homo Sapiens
PVLASRAYV

SEQ ID NO: 533044 - protein, 9 aa, Homo Sapiens
KRVTIFGLG

SEQ ID NO: 533045 - protein, 9 aa, Homo Sapiens
MSYGERPHW

SEQ ID NO: 533046 - protein, 9 aa, Homo Sapiens
VYPMASRRQ

SEQ ID NO: 533047 - protein, 9 aa, Homo Sapiens
SQQPKQKVA

SEQ ID NO: 533048 - protein, 9 aa, Homo Sapiens
CRTKSSALK

SEQ ID NO: 533049 - protein, 9 aa, Homo Sapiens
PMHDSPSPL

SEQ ID NO: 533050 - protein, 9 aa, Homo Sapiens
QHSAMPTKS

SEQ ID NO: 533051 - protein, 9 aa, Homo Sapiens
HGEKGDRGL

SEQ ID NO: 533052 - protein, 9 aa, Homo Sapiens
LTHCLVTCA

SEQ ID NO: 533053 - protein, 9 aa, Homo Sapiens
RTWYPLGRI

SEQ ID NO: 533054 - protein, 9 aa, Homo Sapiens
EKIPEYNLT

SEQ ID NO: 533055 - protein, 9 aa, Homo Sapiens
TTLQKCFEP

SEQ ID NO: 533056 - protein, 9 aa, Homo Sapiens
DPVTAENAF

SEQ ID NO: 533057 - protein, 9 aa, Homo Sapiens
PRPRSAVPH

SEQ ID NO: 533058 - protein, 9 aa, Homo Sapiens
NRAGTGPVS

SEQ ID NO: 533059 - protein, 9 aa, Homo Sapiens
CRDGINCYD

SEQ ID NO: 533060 - protein, 9 aa, Homo Sapiens
IPHLVCSVY

SEQ ID NO: 533061 - protein, 9 aa, Homo Sapiens
DREDRPGVA

SEQ ID NO: 533062 - protein, 9 aa, Homo Sapiens
SFLNYNISC

SEQ ID NO: 533063 - protein, 9 aa, Homo Sapiens
IKMWAITCF

SEQ ID NO: 533064 - protein, 9 aa, Homo Sapiens
TLKKSTDEV

SEQ ID NO: 533065 - protein, 9 aa, Homo Sapiens
AHLGESVSL

SEQ ID NO: 533066 - protein, 9 aa, Homo Sapiens
RRIHMGEKP

SEQ ID NO: 533067 - protein, 9 aa, Homo Sapiens
NYNISCILT

SEQ ID NO: 533068 - protein, 9 aa, Homo Sapiens
HQAIEFACH

SEQ ID NO: 533069 - protein, 9 aa, Homo Sapiens
DNRTWVHQG

SEQ ID NO: 533070 - protein, 9 aa, Homo Sapiens
KVGKQSEQQ

SEQ ID NO: 533071 - protein, 9 aa, Homo Sapiens
LLWMGAEID

SEQ ID NO: 533072 - protein, 9 aa, Homo Sapiens
ARAAPHRII

SEQ ID NO: 533073 - protein, 9 aa, Homo Sapiens
LEEISISAY

SEQ ID NO: 533074 - protein, 9 aa, Homo Sapiens
GTRPYFFTK

SEQ ID NO: 533075 - protein, 9 aa, Homo Sapiens
YDWNWRVDM

SEQ ID NO: 533076 - protein, 9 aa, Homo Sapiens
KTINNQHSI

SEQ ID NO: 533077 - protein, 9 aa, Homo Sapiens
SGTAPRTEP

SEQ ID NO: 533078 - protein, 9 aa, Homo Sapiens
KKLSQMAPE

SEQ ID NO: 533079 - protein, 9 aa, Homo Sapiens
PQYTAELHL

SEQ ID NO: 533080 - protein, 9 aa, Homo Sapiens
SRCINANIR

SEQ ID NO: 533081 - protein, 9 aa, Homo Sapiens
LQAQSLLPT

SEQ ID NO: 533082 - protein, 9 aa, Homo Sapiens
APQMLNLLL

SEQ ID NO: 533083 - protein, 9 aa, Homo Sapiens
IEVVKYLLW

SEQ ID NO: 533084 - protein, 9 aa, Homo Sapiens
LMLEELRTC

SEQ ID NO: 533085 - protein, 9 aa, Homo Sapiens
ERSRSLKRG

SEQ ID NO: 533086 - protein, 9 aa, Homo Sapiens
LESPSHPEE

SEQ ID NO: 533087 - protein, 9 aa, Homo Sapiens
LWEREGEEF

SEQ ID NO: 533088 - protein, 9 aa, Homo Sapiens
LAAIQDMFL

SEQ ID NO: 533089 - protein, 9 aa, Homo Sapiens
TGPRRRNRI

SEQ ID NO: 533090 - protein, 9 aa, Homo Sapiens
HDSPSPLSA

SEQ ID NO: 533091 - protein, 9 aa, Homo Sapiens
FLLESKCVQ

SEQ ID NO: 533092 - protein, 9 aa, Homo Sapiens
ALWAALAHS

SEQ ID NO: 533093 - protein, 9 aa, Homo Sapiens
CFARYLAMQ

SEQ ID NO: 533094 - protein, 9 aa, Homo Sapiens
EKMEVSRNV

SEQ ID NO: 533095 - protein, 9 aa, Homo Sapiens
HLAEKALNQ

SEQ ID NO: 533096 - protein, 9 aa, Homo Sapiens
SGLPPSLQG

SEQ ID NO: 533097 - protein, 9 aa, Homo Sapiens
ATFANHSGR

SEQ ID NO: 533098 - protein, 9 aa, Homo Sapiens
HLHPTGKLG

SEQ ID NO: 533099 - protein, 9 aa, Homo Sapiens
LIQDTSLIP

SEQ ID NO: 533100 - protein, 9 aa, Homo Sapiens
GANYYFNVK

SEQ ID NO: 533101 - protein, 9 aa, Homo Sapiens
LQEEALQRL

SEQ ID NO: 533102 - protein, 9 aa, Homo Sapiens
LLELCADAK

SEQ ID NO: 533103 - protein, 9 aa, Homo Sapiens
SKEASLDAD

SEQ ID NO: 533104 - protein, 9 aa, Homo Sapiens
PYDLCKDEP

SEQ ID NO: 533105 - protein, 9 aa, Homo Sapiens
FWSDLNFLF

SEQ ID NO: 533106 - protein, 9 aa, Homo Sapiens
DRHSALPGC

SEQ ID NO: 533107 - protein, 9 aa, Homo Sapiens
FTTMQEQAF

SEQ ID NO: 533108 - protein, 9 aa, Homo Sapiens
ELWHADRIK

SEQ ID NO: 533109 - protein, 9 aa, Homo Sapiens
SMTRQLLHK

SEQ ID NO: 533110 - protein, 9 aa, Homo Sapiens
ILKEKVSFV

SEQ ID NO: 533111 - protein, 9 aa, Homo Sapiens
LSWPGFEKE

SEQ ID NO: 533112 - protein, 9 aa, Homo Sapiens
CGKGFRLQC

SEQ ID NO: 533113 - protein, 9 aa, Homo Sapiens
RTTAFVQRH

SEQ ID NO: 533114 - protein, 9 aa, Homo Sapiens
RYYCEVLPG

SEQ ID NO: 533115 - protein, 9 aa, Homo Sapiens
VQYGARVAC

SEQ ID NO: 533116 - protein, 9 aa, Homo Sapiens
EVHQLVVVD

SEQ ID NO: 533117 - protein, 9 aa, Homo Sapiens
DNYIPCMLE

SEQ ID NO: 533118 - protein, 9 aa, Homo Sapiens
PLQKVMLPP

SEQ ID NO: 533119 - protein, 9 aa, Homo Sapiens
SWPGFEKEE

SEQ ID NO: 533120 - protein, 9 aa, Homo Sapiens
QCQACVSSC

SEQ ID NO: 533121 - protein, 9 aa, Homo Sapiens
VRHLRSLHR

SEQ ID NO: 533122 - protein, 9 aa, Homo Sapiens
TDYECTNSA

SEQ ID NO: 533123 - protein, 9 aa, Homo Sapiens
ETLTLANKY

SEQ ID NO: 533124 - protein, 9 aa, Homo Sapiens
FIPSCTPDH

SEQ ID NO: 533125 - protein, 9 aa, Homo Sapiens
MAPSADSWV

SEQ ID NO: 533126 - protein, 9 aa, Homo Sapiens
RWGNPCALS

SEQ ID NO: 533127 - protein, 9 aa, Homo Sapiens
WLLISIENK

SEQ ID NO: 533128 - protein, 9 aa, Homo Sapiens
PQGIQEPLN

SEQ ID NO: 533129 - protein, 9 aa, Homo Sapiens
WMGAEIDEP

SEQ ID NO: 533130 - protein, 9 aa, Homo Sapiens
PWCRPINAT

SEQ ID NO: 533131 - protein, 9 aa, Homo Sapiens
EGAPHTLPL

SEQ ID NO: 533132 - protein, 9 aa, Homo Sapiens
ASSGAWALK

SEQ ID NO: 533133 - protein, 9 aa, Homo Sapiens
AFCRSAAYL

SEQ ID NO: 533134 - protein, 9 aa, Homo Sapiens
PLCYVTVMN

SEQ ID NO: 533135 - protein, 9 aa, Homo Sapiens
PSTPWRSRG

SEQ ID NO: 533136 - protein, 9 aa, Homo Sapiens
DMVNVEIQA

SEQ ID NO: 533137 - protein, 9 aa, Homo Sapiens
EPQQQLNIK

SEQ ID NO: 533138 - protein, 9 aa, Homo Sapiens
GEKSEWEEV

SEQ ID NO: 533139 - protein, 9 aa, Homo Sapiens
GAQHSAMPT

SEQ ID NO: 533140 - protein, 9 aa, Homo Sapiens
RFWEFFESN

SEQ ID NO: 533141 - protein, 9 aa, Homo Sapiens
WHNSVVLGW

SEQ ID NO: 533142 - protein, 9 aa, Homo Sapiens
QQQGLRRVR

SEQ ID NO: 533143 - protein, 9 aa, Homo Sapiens
VATGICILT

SEQ ID NO: 533144 - protein, 9 aa, Homo Sapiens
VEVPSSNIQ

SEQ ID NO: 533145 - protein, 9 aa, Homo Sapiens
PLQYLAIMT

SEQ ID NO: 533146 - protein, 9 aa, Homo Sapiens
AIAGNPASF

SEQ ID NO: 533147 - protein, 9 aa, Homo Sapiens
WDLTMATLM

SEQ ID NO: 533148 - protein, 9 aa, Homo Sapiens
PALEPVWSS

SEQ ID NO: 533149 - protein, 9 aa, Homo Sapiens
LVLIDALQF

SEQ ID NO: 533150 - protein, 9 aa, Homo Sapiens
HLKNLSNVE

SEQ ID NO: 533151 - protein, 9 aa, Homo Sapiens
FEPGIYVCA

SEQ ID NO: 533152 - protein, 9 aa, Homo Sapiens
KIPVGKEEL

SEQ ID NO: 533153 - protein, 9 aa, Homo Sapiens
AGDAPPPHP

SEQ ID NO: 533154 - protein, 9 aa, Homo Sapiens
VAINPFQVL

SEQ ID NO: 533155 - protein, 9 aa, Homo Sapiens
GDLQLVKSV

SEQ ID NO: 533156 - protein, 9 aa, Homo Sapiens
EVLQDSQDR

SEQ ID NO: 533157 - protein, 9 aa, Homo Sapiens
QAPRASALW

SEQ ID NO: 533158 - protein, 9 aa, Homo Sapiens
YSTKDQQFK

SEQ ID NO: 533159 - protein, 9 aa, Homo Sapiens
VRLSRQLRH

SEQ ID NO: 533160 - protein, 9 aa, Homo Sapiens
CADAKKQLA

SEQ ID NO: 533161 - protein, 9 aa, Homo Sapiens
LYWTHGYML

SEQ ID NO: 533162 - protein, 9 aa, Homo Sapiens
VTLGAIGEG

SEQ ID NO: 533163 - protein, 9 aa, Homo Sapiens
PRASALWHE

SEQ ID NO: 533164 - protein, 9 aa, Homo Sapiens
IYHLHQEDS

SEQ ID NO: 533165 - protein, 9 aa, Homo Sapiens
YSLTQDCTV

SEQ ID NO: 533166 - protein, 9 aa, Homo Sapiens
NGTQEGCAA

SEQ ID NO: 533167 - protein, 9 aa, Homo Sapiens
WLDLVTNWV

SEQ ID NO: 533168 - protein, 9 aa, Homo Sapiens
QEENREQKN

SEQ ID NO: 533169 - protein, 9 aa, Homo Sapiens
NIRQSPTLN

SEQ ID NO: 533170 - protein, 9 aa, Homo Sapiens
SSPSCRTKS

SEQ ID NO: 533171 - protein, 9 aa, Homo Sapiens
CGDCGCCFS

SEQ ID NO: 533172 - protein, 9 aa, Homo Sapiens
LSGFQESNV

SEQ ID NO: 533173 - protein, 9 aa, Homo Sapiens
LGSQGAHVT

SEQ ID NO: 533174 - protein, 9 aa, Homo Sapiens
STNRKHLTK

SEQ ID NO: 533175 - protein, 9 aa, Homo Sapiens
SKESSVDCP

SEQ ID NO: 533176 - protein, 9 aa, Homo Sapiens
KERTHNIVK

SEQ ID NO: 533177 - protein, 9 aa, Homo Sapiens
RCIPTLDSL

SEQ ID NO: 533178 - protein, 9 aa, Homo Sapiens
EEDHELFEI

SEQ ID NO: 533179 - protein, 9 aa, Homo Sapiens
LKEDRKCFL

SEQ ID NO: 533180 - protein, 9 aa, Homo Sapiens
SCVCPKGFR

SEQ ID NO: 533181 - protein, 9 aa, Homo Sapiens
RLQSQLSLV

SEQ ID NO: 533182 - protein, 9 aa, Homo Sapiens
PAPRPRSAV

SEQ ID NO: 533183 - protein, 9 aa, Homo Sapiens
KCVGVPSTM

SEQ ID NO: 533184 - protein, 9 aa, Homo Sapiens
RSRSLKRGS

SEQ ID NO: 533185 - protein, 9 aa, Homo Sapiens
ESVQKKLSQ

SEQ ID NO: 533186 - protein, 9 aa, Homo Sapiens
REGRRRRVV

SEQ ID NO: 533187 - protein, 9 aa, Homo Sapiens
EALAMELAR

SEQ ID NO: 533188 - protein, 9 aa, Homo Sapiens
AWKERQLHS

SEQ ID NO: 533189 - protein, 9 aa, Homo Sapiens
YKWFILVLN

SEQ ID NO: 533190 - protein, 9 aa, Homo Sapiens
SSRAYFFNN

SEQ ID NO: 533191 - protein, 9 aa, Homo Sapiens
QFFQDISDW

SEQ ID NO: 533192 - protein, 9 aa, Homo Sapiens
ACYEAACNR

SEQ ID NO: 533193 - protein, 9 aa, Homo Sapiens
WQPWTPCKM

SEQ ID NO: 533194 - protein, 9 aa, Homo Sapiens
LMHVTVRVA

SEQ ID NO: 533195 - protein, 9 aa, Homo Sapiens
PPREVGEKS

SEQ ID NO: 533196 - protein, 9 aa, Homo Sapiens
AHVTNVCES

SEQ ID NO: 533197 - protein, 9 aa, Homo Sapiens
HFGTKGFIM

SEQ ID NO: 533198 - protein, 9 aa, Homo Sapiens
HACLLKVKD

SEQ ID NO: 533199 - protein, 9 aa, Homo Sapiens
ALEPVWSSL

SEQ ID NO: 533200 - protein, 9 aa, Homo Sapiens
AAMIRTKVF

SEQ ID NO: 533201 - protein, 9 aa, Homo Sapiens
HWSQSEEVQ

SEQ ID NO: 533202 - protein, 9 aa, Homo Sapiens
IKCGLSEKW

SEQ ID NO: 533203 - protein, 9 aa, Homo Sapiens
HLGVLTVAY

SEQ ID NO: 533204 - protein, 9 aa, Homo Sapiens
QRRKNSFDS

SEQ ID NO: 533205 - protein, 9 aa, Homo Sapiens
QPKQKVALL

SEQ ID NO: 533206 - protein, 9 aa, Homo Sapiens
GDFRFLFID

SEQ ID NO: 533207 - protein, 9 aa, Homo Sapiens
WKTQHSEEY

SEQ ID NO: 533208 - protein, 9 aa, Homo Sapiens
AADPACRAC

SEQ ID NO: 533209 - protein, 9 aa, Homo Sapiens
CLEFLLVPV

SEQ ID NO: 533210 - protein, 9 aa, Homo Sapiens
EWRAAFAAR

SEQ ID NO: 533211 - protein, 9 aa, Homo Sapiens
AFDGPGGTL

SEQ ID NO: 533212 - protein, 9 aa, Homo Sapiens
RMWHLSTGT

SEQ ID NO: 533213 - protein, 9 aa, Homo Sapiens
CFSSDRRSS

SEQ ID NO: 533214 - protein, 9 aa, Homo Sapiens
HFVMGPTVA

SEQ ID NO: 533215 - protein, 9 aa, Homo Sapiens
MNLYEGHIE

SEQ ID NO: 533216 - protein, 9 aa, Homo Sapiens
MAMNEFSTL

SEQ ID NO: 533217 - protein, 9 aa, Homo Sapiens
WREEKKCSL

SEQ ID NO: 533218 - protein, 9 aa, Homo Sapiens
RFSICRKCV

SEQ ID NO: 533219 - protein, 9 aa, Homo Sapiens
RPRVHALVR

SEQ ID NO: 533220 - protein, 9 aa, Homo Sapiens
RPLICDANN

SEQ ID NO: 533221 - protein, 9 aa, Homo Sapiens
RLQQRLAVL

SEQ ID NO: 533222 - protein, 9 aa, Homo Sapiens
QCQFKLKLL

SEQ ID NO: 533223 - protein, 9 aa, Homo Sapiens
HYVQCSAYC

SEQ ID NO: 533224 - protein, 9 aa, Homo Sapiens
IRSGRIRQN

SEQ ID NO: 533225 - protein, 9 aa, Homo Sapiens
WKYVQFHES

SEQ ID NO: 533226 - protein, 9 aa, Homo Sapiens
GSGRSLVTS

SEQ ID NO: 533227 - protein, 9 aa, Homo Sapiens
WQYENHIFV

SEQ ID NO: 533228 - protein, 9 aa, Homo Sapiens
HAVDCWSLG

SEQ ID NO: 533229 - protein, 9 aa, Homo Sapiens
HFILELLWK

SEQ ID NO: 533230 - protein, 9 aa, Homo Sapiens
HIKLSLKSL

SEQ ID NO: 533231 - protein, 9 aa, Homo Sapiens
QLSKVHWPK

SEQ ID NO: 533232 - protein, 9 aa, Homo Sapiens
APCAASTES

SEQ ID NO: 533233 - protein, 9 aa, Homo Sapiens
TAATTESGD

SEQ ID NO: 533234 - protein, 9 aa, Homo Sapiens
ELLWKEEYQ

SEQ ID NO: 533235 - protein, 9 aa, Homo Sapiens
ELTAAKKQE

SEQ ID NO: 533236 - protein, 9 aa, Homo Sapiens
AEGRMDGFH

SEQ ID NO: 533237 - protein, 9 aa, Homo Sapiens
ESQLSKVHW

SEQ ID NO: 533238 - protein, 9 aa, Homo Sapiens
GFPPFHSPE

SEQ ID NO: 533239 - protein, 9 aa, Homo Sapiens
VHKRCREFV

SEQ ID NO: 533240 - protein, 9 aa, Homo Sapiens
CNKCVTSFK

SEQ ID NO: 533241 - protein, 9 aa, Homo Sapiens
TDSACHREA

SEQ ID NO: 533242 - protein, 9 aa, Homo Sapiens
GNMPYDLCK

SEQ ID NO: 533243 - protein, 9 aa, Homo Sapiens
NTPMELKTA

SEQ ID NO: 533244 - protein, 9 aa, Homo Sapiens
AGTGPVSPS

SEQ ID NO: 533245 - protein, 9 aa, Homo Sapiens
EEHACLLKV

SEQ ID NO: 533246 - protein, 9 aa, Homo Sapiens
VKDLRIHKR

SEQ ID NO: 533247 - protein, 9 aa, Homo Sapiens
CALLRCIPT

SEQ ID NO: 533248 - protein, 9 aa, Homo Sapiens
PTGLPGAPA

SEQ ID NO: 533249 - protein, 9 aa, Homo Sapiens
KTAVSKKML

SEQ ID NO: 533250 - protein, 9 aa, Homo Sapiens
FFYRNRPSF

SEQ ID NO: 533251 - protein, 9 aa, Homo Sapiens
AAATISTSP

SEQ ID NO: 533252 - protein, 9 aa, Homo Sapiens
FFEQSDNIA

SEQ ID NO: 533253 - protein, 9 aa, Homo Sapiens
LFSRFRSQT

SEQ ID NO: 533254 - protein, 9 aa, Homo Sapiens
GTHWRSKKA

SEQ ID NO: 533255 - protein, 9 aa, Homo Sapiens
LLRNPAVTS

SEQ ID NO: 533256 - protein, 9 aa, Homo Sapiens
GCFQCSVCN

SEQ ID NO: 533257 - protein, 9 aa, Homo Sapiens
DHIWVFGGA

SEQ ID NO: 533258 - protein, 9 aa, Homo Sapiens
ESSLDSEGT

SEQ ID NO: 533259 - protein, 9 aa, Homo Sapiens
DGENQSMYQ

SEQ ID NO: 533260 - protein, 9 aa, Homo Sapiens
FEYKGEKVF

SEQ ID NO: 533261 - protein, 9 aa, Homo Sapiens
PLQALRQRS

SEQ ID NO: 533262 - protein, 9 aa, Homo Sapiens
RLYAWGERF

SEQ ID NO: 533263 - protein, 9 aa, Homo Sapiens
SHIKLSLKS

SEQ ID NO: 533264 - protein, 9 aa, Homo Sapiens
LLCGFPPFH

SEQ ID NO: 533265 - protein, 9 aa, Homo Sapiens
VYADFQSTS

SEQ ID NO: 533266 - protein, 9 aa, Homo Sapiens
SSLTHCLVT

SEQ ID NO: 533267 - protein, 9 aa, Homo Sapiens
HLYGTSIQS

SEQ ID NO: 533268 - protein, 9 aa, Homo Sapiens
MFSGGQAVA

SEQ ID NO: 533269 - protein, 9 aa, Homo Sapiens
TPWRSRGRP

SEQ ID NO: 533270 - protein, 9 aa, Homo Sapiens
SFPMEMMIC

SEQ ID NO: 533271 - protein, 9 aa, Homo Sapiens
CIPTLDSLT

SEQ ID NO: 533272 - protein, 9 aa, Homo Sapiens
ERTHNIVKY

SEQ ID NO: 533273 - protein, 9 aa, Homo Sapiens
DLRIHKRTH

SEQ ID NO: 533274 - protein, 9 aa, Homo Sapiens
ICILTNWLM

SEQ ID NO: 533275 - protein, 9 aa, Homo Sapiens
PSCTPDHIW

SEQ ID NO: 533276 - protein, 9 aa, Homo Sapiens
QQLMSGMIL

SEQ ID NO: 533277 - protein, 9 aa, Homo Sapiens
ACLCATFAN

SEQ ID NO: 533278 - protein, 9 aa, Homo Sapiens
KGLCGQLAV

SEQ ID NO: 533279 - protein, 9 aa, Homo Sapiens
LDELWHADR

SEQ ID NO: 533280 - protein, 9 aa, Homo Sapiens
KCFLCKAVE

SEQ ID NO: 533281 - protein, 9 aa, Homo Sapiens
GMNIRQSPT

SEQ ID NO: 533282 - protein, 9 aa, Homo Sapiens
ENQSMYQNL

SEQ ID NO: 533283 - protein, 9 aa, Homo Sapiens
QVAGVPRFQ

SEQ ID NO: 533284 - protein, 9 aa, Homo Sapiens
RACEPSTPW

SEQ ID NO: 533285 - protein, 9 aa, Homo Sapiens
KTQHSEEYE

SEQ ID NO: 533286 - protein, 9 aa, Homo Sapiens
TFCLETHEC

SEQ ID NO: 533287 - protein, 9 aa, Homo Sapiens
LQTQLSESH

SEQ ID NO: 533288 - protein, 9 aa, Homo Sapiens
RKLSLELMN

SEQ ID NO: 533289 - protein, 9 aa, Homo Sapiens
WAITCFATQ

SEQ ID NO: 533290 - protein, 9 aa, Homo Sapiens
MNTPVMLNS

SEQ ID NO: 533291 - protein, 9 aa, Homo Sapiens
RTARRTHPG

SEQ ID NO: 533292 - protein, 9 aa, Homo Sapiens
ELDKNQHQC

SEQ ID NO: 533293 - protein, 9 aa, Homo Sapiens
KTQHMSLMR

SEQ ID NO: 533294 - protein, 9 aa, Homo Sapiens
GIQEPLNNS

SEQ ID NO: 533295 - protein, 9 aa, Homo Sapiens
ALYLLAPSF

SEQ ID NO: 533296 - protein, 9 aa, Homo Sapiens
KLQAKLQGA

SEQ ID NO: 533297 - protein, 9 aa, Homo Sapiens
PHTLPLPRR

SEQ ID NO: 533298 - protein, 9 aa, Homo Sapiens
SYPLQALRQ

SEQ ID NO: 533299 - protein, 9 aa, Homo Sapiens
FDESCPPDP

SEQ ID NO: 533300 - protein, 9 aa, Homo Sapiens
FGGRTWCED

SEQ ID NO: 533301 - protein, 9 aa, Homo Sapiens
GTAGGFGGR

SEQ ID NO: 533302 - protein, 9 aa, Homo Sapiens
ENAEFIPMH

SEQ ID NO: 533303 - protein, 9 aa, Homo Sapiens
LPGSPDKTA

SEQ ID NO: 533304 - protein, 9 aa, Homo Sapiens
GYTQDVHGE

SEQ ID NO: 533305 - protein, 9 aa, Homo Sapiens
RQLRHILLP

SEQ ID NO: 533306 - protein, 9 aa, Homo Sapiens
CRLGLANGV

SEQ ID NO: 533307 - protein, 9 aa, Homo Sapiens
LIGPPGEHG

SEQ ID NO: 533308 - protein, 9 aa, Homo Sapiens
RAYIQMLRK

SEQ ID NO: 533309 - protein, 9 aa, Homo Sapiens
TPPDYQPPS

SEQ ID NO: 533310 - protein, 9 aa, Homo Sapiens
YAVSMASRP

SEQ ID NO: 533311 - protein, 9 aa, Homo Sapiens
VNRRKLSLE

SEQ ID NO: 533312 - protein, 9 aa, Homo Sapiens
KRMTITSRD

SEQ ID NO: 533313 - protein, 9 aa, Homo Sapiens
ECGKAFCRS

SEQ ID NO: 533314 - protein, 9 aa, Homo Sapiens
CNVSVTMSQ

SEQ ID NO: 533315 - protein, 9 aa, Homo Sapiens
GSQMGTAEE

SEQ ID NO: 533316 - protein, 9 aa, Homo Sapiens
VLGEWGTAP

SEQ ID NO: 533317 - protein, 9 aa, Homo Sapiens
EHLWKELEG

SEQ ID NO: 533318 - protein, 9 aa, Homo Sapiens
PPGMHPPRP

SEQ ID NO: 533319 - protein, 9 aa, Homo Sapiens
SDLSPYLLK

SEQ ID NO: 533320 - protein, 9 aa, Homo Sapiens
QQQLNIKEI

SEQ ID NO: 533321 - protein, 9 aa, Homo Sapiens
QDHTEKMKE

SEQ ID NO: 533322 - protein, 9 aa, Homo Sapiens
YLLKRHHAR

SEQ ID NO: 533323 - protein, 9 aa, Homo Sapiens
VTWFFWFWS

SEQ ID NO: 533324 - protein, 9 aa, Homo Sapiens
GDVCGISSW

SEQ ID NO: 533325 - protein, 9 aa, Homo Sapiens
LAIKAARKS

SEQ ID NO: 533326 - protein, 9 aa, Homo Sapiens
MGLINMAEV

SEQ ID NO: 533327 - protein, 9 aa, Homo Sapiens
MKMFIPNLY

SEQ ID NO: 533328 - protein, 9 aa, Homo Sapiens
SSRGTERSR

SEQ ID NO: 533329 - protein, 9 aa, Homo Sapiens
EELRTCSSP

SEQ ID NO: 533330 - protein, 9 aa, Homo Sapiens
IGLQSMGEA

SEQ ID NO: 533331 - protein, 9 aa, Homo Sapiens
LSKVHWPKN

SEQ ID NO: 533332 - protein, 9 aa, Homo Sapiens
YRNRSLSDS

SEQ ID NO: 533333 - protein, 9 aa, Homo Sapiens
IWGDMVNVE

SEQ ID NO: 533334 - protein, 9 aa, Homo Sapiens
VLTRCFGKT

SEQ ID NO: 533335 - protein, 9 aa, Homo Sapiens
LKTEADVEQ

SEQ ID NO: 533336 - protein, 9 aa, Homo Sapiens
PTYKYDMGS

SEQ ID NO: 533337 - protein, 9 aa, Homo Sapiens
LHMPGLEYP

SEQ ID NO: 533338 - protein, 9 aa, Homo Sapiens
LAHFRQAHL

SEQ ID NO: 533339 - protein, 9 aa, Homo Sapiens
LELMNQLVP

SEQ ID NO: 533340 - protein, 9 aa, Homo Sapiens
NAIAGNPAS

SEQ ID NO: 533341 - protein, 9 aa, Homo Sapiens
PRPRVHALV

SEQ ID NO: 533342 - protein, 9 aa, Homo Sapiens
FGYGLWHSK

SEQ ID NO: 533343 - protein, 9 aa, Homo Sapiens
LMLARKLQS

SEQ ID NO: 533344 - protein, 9 aa, Homo Sapiens
WSLPKALLS

SEQ ID NO: 533345 - protein, 9 aa, Homo Sapiens
VERAVKRMW

SEQ ID NO: 533346 - protein, 9 aa, Homo Sapiens
QFINTRCAH

SEQ ID NO: 533347 - protein, 9 aa, Homo Sapiens
SLDDFWNTQ

SEQ ID NO: 533348 - protein, 9 aa, Homo Sapiens
NPCALSFVL

SEQ ID NO: 533349 - protein, 9 aa, Homo Sapiens
RLSRQLRHI

SEQ ID NO: 533350 - protein, 9 aa, Homo Sapiens
TNVCESKSK

SEQ ID NO: 533351 - protein, 9 aa, Homo Sapiens
LQGESHTHS

SEQ ID NO: 533352 - protein, 9 aa, Homo Sapiens
SRERERHQD

SEQ ID NO: 533353 - protein, 9 aa, Homo Sapiens
MDGFHPRRL

SEQ ID NO: 533354 - protein, 9 aa, Homo Sapiens
KEHSAELEQ

SEQ ID NO: 533355 - protein, 9 aa, Homo Sapiens
HKKRKIQEE

SEQ ID NO: 533356 - protein, 9 aa, Homo Sapiens
YCFQTFLNK

SEQ ID NO: 533357 - protein, 9 aa, Homo Sapiens
ASKEPLRPW

SEQ ID NO: 533358 - protein, 9 aa, Homo Sapiens
PLLPDHRRL

SEQ ID NO: 533359 - protein, 9 aa, Homo Sapiens
TNRKHLTKS

SEQ ID NO: 533360 - protein, 9 aa, Homo Sapiens
HYQWCQGGA

SEQ ID NO: 533361 - protein, 9 aa, Homo Sapiens
RKIQEEIEH

SEQ ID NO: 533362 - protein, 9 aa, Homo Sapiens
SEEKTQHMS

SEQ ID NO: 533363 - protein, 9 aa, Homo Sapiens
GEKVFERMN

SEQ ID NO: 533364 - protein, 9 aa, Homo Sapiens
KEDRKCFLC

SEQ ID NO: 533365 - protein, 9 aa, Homo Sapiens
SRHMICLDC

SEQ ID NO: 533366 - protein, 9 aa, Homo Sapiens
VLYFPQSDS

SEQ ID NO: 533367 - protein, 9 aa, Homo Sapiens
VINPQVSRE

SEQ ID NO: 533368 - protein, 9 aa, Homo Sapiens
RECARSRGF

SEQ ID NO: 533369 - protein, 9 aa, Homo Sapiens
PRFQFGPPE

SEQ ID NO: 533370 - protein, 9 aa, Homo Sapiens
LTLHNRELQ

SEQ ID NO: 533371 - protein, 9 aa, Homo Sapiens
EYQLVVQTM

SEQ ID NO: 533372 - protein, 9 aa, Homo Sapiens
CLCATFANH

SEQ ID NO: 533373 - protein, 9 aa, Homo Sapiens
WALKTLRSW

SEQ ID NO: 533374 - protein, 9 aa, Homo Sapiens
TGDQATDSS

SEQ ID NO: 533375 - protein, 9 aa, Homo Sapiens
YDPMELDPE

SEQ ID NO: 533376 - protein, 9 aa, Homo Sapiens
MFIQMLSSG

SEQ ID NO: 533377 - protein, 9 aa, Homo Sapiens
CPLLHLHPT

SEQ ID NO: 533378 - protein, 9 aa, Homo Sapiens
AAFQEGLLH

SEQ ID NO: 533379 - protein, 9 aa, Homo Sapiens
TRCFGKTYD

SEQ ID NO: 533380 - protein, 9 aa, Homo Sapiens
REQQAMREE

SEQ ID NO: 533381 - protein, 9 aa, Homo Sapiens
LQFDFAQPQ

SEQ ID NO: 533382 - protein, 9 aa, Homo Sapiens
DMFLCCGKK

SEQ ID NO: 533383 - protein, 9 aa, Homo Sapiens
DAKTSSHLG

SEQ ID NO: 533384 - protein, 9 aa, Homo Sapiens
KHCFTFMDR

SEQ ID NO: 533385 - protein, 9 aa, Homo Sapiens
MEMMICLPN

SEQ ID NO: 533386 - protein, 9 aa, Homo Sapiens
VKRMWHLST

SEQ ID NO: 533387 - protein, 9 aa, Homo Sapiens
PAELQCEVW

SEQ ID NO: 533388 - protein, 9 aa, Homo Sapiens
VGTAGYNHA

SEQ ID NO: 533389 - protein, 9 aa, Homo Sapiens
SSTAEGANL

SEQ ID NO: 533390 - protein, 9 aa, Homo Sapiens
REKIPEYNL

SEQ ID NO: 533391 - protein, 9 aa, Homo Sapiens
SVQKKLSQM

SEQ ID NO: 533392 - protein, 9 aa, Homo Sapiens
DDESRPAVV

SEQ ID NO: 533393 - protein, 9 aa, Homo Sapiens
ELLGVMQRL

SEQ ID NO: 533394 - protein, 9 aa, Homo Sapiens
LGHYFQCRL

SEQ ID NO: 533395 - protein, 9 aa, Homo Sapiens
LVYQCEKHV

SEQ ID NO: 533396 - protein, 9 aa, Homo Sapiens
RHMICLDCF

SEQ ID NO: 533397 - protein, 9 aa, Homo Sapiens
GTDSSMDIF

SEQ ID NO: 533398 - protein, 9 aa, Homo Sapiens
TNNIHGCYP

SEQ ID NO: 533399 - protein, 9 aa, Homo Sapiens
LVQVRERIH

SEQ ID NO: 533400 - protein, 9 aa, Homo Sapiens
LRRQPSITS

SEQ ID NO: 533401 - protein, 9 aa, Homo Sapiens
QYYEKEVRG

SEQ ID NO: 533402 - protein, 9 aa, Homo Sapiens
MHNFSDLRN

SEQ ID NO: 533403 - protein, 9 aa, Homo Sapiens
HDYVLDLVL

SEQ ID NO: 533404 - protein, 9 aa, Homo Sapiens
MAANQAASW

SEQ ID NO: 533405 - protein, 9 aa, Homo Sapiens
CEDTRHTAC

SEQ ID NO: 533406 - protein, 9 aa, Homo Sapiens
PSVQLQHII

SEQ ID NO: 533407 - protein, 9 aa, Homo Sapiens
GYMLISKEV

SEQ ID NO: 533408 - protein, 9 aa, Homo Sapiens
PYHIPHLVC

SEQ ID NO: 533409 - protein, 9 aa, Homo Sapiens
ILLYYKAQT

SEQ ID NO: 533410 - protein, 9 aa, Homo Sapiens
LQRRKNSFD

SEQ ID NO: 533411 - protein, 9 aa, Homo Sapiens
DEDTFDWLL

SEQ ID NO: 533412 - protein, 9 aa, Homo Sapiens
LTSDLSPYL

SEQ ID NO: 533413 - protein, 9 aa, Homo Sapiens
LALALSRAR

SEQ ID NO: 533414 - protein, 9 aa, Homo Sapiens
SQINRASRA

SEQ ID NO: 533415 - protein, 9 aa, Homo Sapiens
KGFRLSPGL

SEQ ID NO: 533416 - protein, 9 aa, Homo Sapiens
PKRVTIFGL

SEQ ID NO: 533417 - protein, 9 aa, Homo Sapiens
FFSPLQKVM

SEQ ID NO: 533418 - protein, 9 aa, Homo Sapiens
RRHRGSGVF

SEQ ID NO: 533419 - protein, 9 aa, Homo Sapiens
KMKKCRNEK

SEQ ID NO: 533420 - protein, 9 aa, Homo Sapiens
RSRRLQSQL

SEQ ID NO: 533421 - protein, 9 aa, Homo Sapiens
TTAFVQRHR

SEQ ID NO: 533422 - protein, 9 aa, Homo Sapiens
SDCDSKELR

SEQ ID NO: 533423 - protein, 9 aa, Homo Sapiens
GQAQALEEV

SEQ ID NO: 533424 - protein, 9 aa, Homo Sapiens
LQTCSWVLV

SEQ ID NO: 533425 - protein, 9 aa, Homo Sapiens
TLQPTPLPF

SEQ ID NO: 533426 - protein, 9 aa, Homo Sapiens
GSFSCVCPK

SEQ ID NO: 533427 - protein, 9 aa, Homo Sapiens
VTNEGTTSM

SEQ ID NO: 533428 - protein, 9 aa, Homo Sapiens
LDFVFTPDP

SEQ ID NO: 533429 - protein, 9 aa, Homo Sapiens
RERERHQDR

SEQ ID NO: 533430 - protein, 9 aa, Homo Sapiens
LPYRYTDSG

SEQ ID NO: 533431 - protein, 9 aa, Homo Sapiens
DTMVEPYNA

SEQ ID NO: 533432 - protein, 9 aa, Homo Sapiens
PPSFKDGDC

SEQ ID NO: 533433 - protein, 9 aa, Homo Sapiens
VPAGEGPCR

SEQ ID NO: 533434 - protein, 9 aa, Homo Sapiens
GGRYRNRSL

SEQ ID NO: 533435 - protein, 9 aa, Homo Sapiens
VNKTDMSKA

SEQ ID NO: 533436 - protein, 9 aa, Homo Sapiens
PFTQRERFH

SEQ ID NO: 533437 - protein, 9 aa, Homo Sapiens
NVKYIPFDE

SEQ ID NO: 533438 - protein, 9 aa, Homo Sapiens
TPHRVLGPW

SEQ ID NO: 533439 - protein, 9 aa, Homo Sapiens
SQFSRWFSN

SEQ ID NO: 533440 - protein, 9 aa, Homo Sapiens
QAKAAKEVQ

SEQ ID NO: 533441 - protein, 9 aa, Homo Sapiens
MQTLQIDVW

SEQ ID NO: 533442 - protein, 9 aa, Homo Sapiens
LDLELLRDF

SEQ ID NO: 533443 - protein, 9 aa, Homo Sapiens
RHCLGPTHH

SEQ ID NO: 533444 - protein, 9 aa, Homo Sapiens
NGSYPLQAL

SEQ ID NO: 533445 - protein, 9 aa, Homo Sapiens
CITMMCNEF

SEQ ID NO: 533446 - protein, 9 aa, Homo Sapiens
KPEQDNWES

SEQ ID NO: 533447 - protein, 9 aa, Homo Sapiens
HGTPLEEVA

SEQ ID NO: 533448 - protein, 9 aa, Homo Sapiens
GTTKLKVFL

SEQ ID NO: 533449 - protein, 9 aa, Homo Sapiens
TSNGNLLYI

SEQ ID NO: 533450 - protein, 9 aa, Homo Sapiens
INVPDMVLY

SEQ ID NO: 533451 - protein, 9 aa, Homo Sapiens
CSQVCPPKD

SEQ ID NO: 533452 - protein, 9 aa, Homo Sapiens
NKTMSIEFP

SEQ ID NO: 533453 - protein, 9 aa, Homo Sapiens
PEDIAQFLY

SEQ ID NO: 533454 - protein, 9 aa, Homo Sapiens
PFPPINVPD

SEQ ID NO: 533455 - protein, 9 aa, Homo Sapiens
VCGISSWKK

SEQ ID NO: 533456 - protein, 9 aa, Homo Sapiens
EYFFYRNRP

SEQ ID NO: 533457 - protein, 9 aa, Homo Sapiens
HREFWFDLS

SEQ ID NO: 533458 - protein, 9 aa, Homo Sapiens
ARVIFNWDG

SEQ ID NO: 533459 - protein, 9 aa, Homo Sapiens
MSLTMNLYE

SEQ ID NO: 533460 - protein, 9 aa, Homo Sapiens
AKEVQEMRR

SEQ ID NO: 533461 - protein, 9 aa, Homo Sapiens
EPMFSGGQA

SEQ ID NO: 533462 - protein, 9 aa, Homo Sapiens
DVETAHCTA

SEQ ID NO: 533463 - protein, 9 aa, Homo Sapiens
LLLAPQMLN

SEQ ID NO: 533464 - protein, 9 aa, Homo Sapiens
DGGPGPSPH

SEQ ID NO: 533465 - protein, 9 aa, Homo Sapiens
CFEPTGFQN

SEQ ID NO: 533466 - protein, 9 aa, Homo Sapiens
PPRPQGPPG

SEQ ID NO: 533467 - protein, 9 aa, Homo Sapiens
LGITLVVSA

SEQ ID NO: 533468 - protein, 9 aa, Homo Sapiens
VSEFFLIQD

SEQ ID NO: 533469 - protein, 9 aa, Homo Sapiens
SSLLDLEML

SEQ ID NO: 533470 - protein, 9 aa, Homo Sapiens
GNLSAGQTP

SEQ ID NO: 533471 - protein, 9 aa, Homo Sapiens
HTTCWPGRA

SEQ ID NO: 533472 - protein, 9 aa, Homo Sapiens
GTLQRVPVP

SEQ ID NO: 533473 - protein, 9 aa, Homo Sapiens
VPVTAVTAP

SEQ ID NO: 533474 - protein, 9 aa, Homo Sapiens
NNQHSIESQ

SEQ ID NO: 533475 - protein, 9 aa, Homo Sapiens
SIVVTTSPE

SEQ ID NO: 533476 - protein, 9 aa, Homo Sapiens
LVTRKMVTV

SEQ ID NO: 533477 - protein, 9 aa, Homo Sapiens
RAEGRMDGF

SEQ ID NO: 533478 - protein, 9 aa, Homo Sapiens
SARDLFRVQ

SEQ ID NO: 533479 - protein, 9 aa, Homo Sapiens
KSEWEEVII

SEQ ID NO: 533480 - protein, 9 aa, Homo Sapiens
FNQDLGFHM

SEQ ID NO: 533481 - protein, 9 aa, Homo Sapiens
IFHLEGMTT

SEQ ID NO: 533482 - protein, 9 aa, Homo Sapiens
GMALHKKAA

SEQ ID NO: 533483 - protein, 9 aa, Homo Sapiens
MQRLWADPG

SEQ ID NO: 533484 - protein, 9 aa, Homo Sapiens
TAEFLVYQC

SEQ ID NO: 533485 - protein, 9 aa, Homo Sapiens
VIGQRLARV

SEQ ID NO: 533486 - protein, 9 aa, Homo Sapiens
REFRQTFCK

SEQ ID NO: 533487 - protein, 9 aa, Homo Sapiens
PCAASTESL

SEQ ID NO: 533488 - protein, 9 aa, Homo Sapiens
WIRIDTACI

SEQ ID NO: 533489 - protein, 9 aa, Homo Sapiens
VQLTPSMRN

SEQ ID NO: 533490 - protein, 9 aa, Homo Sapiens
HIIWTLFST

SEQ ID NO: 533491 - protein, 9 aa, Homo Sapiens
EQQAMREER

SEQ ID NO: 533492 - protein, 9 aa, Homo Sapiens
ADMLRYQAN

SEQ ID NO: 533493 - protein, 9 aa, Homo Sapiens
QLAIKAARK

SEQ ID NO: 533494 - protein, 9 aa, Homo Sapiens
MFDISSLML

SEQ ID NO: 533495 - protein, 9 aa, Homo Sapiens
LFLTFSFLS

SEQ ID NO: 533496 - protein, 9 aa, Homo Sapiens
EWQRQEERQ

SEQ ID NO: 533497 - protein, 9 aa, Homo Sapiens
NRELQDKLQ

SEQ ID NO: 533498 - protein, 9 aa, Homo Sapiens
LVEAEVHQL

SEQ ID NO: 533499 - protein, 9 aa, Homo Sapiens
PTVCHHPAL

SEQ ID NO: 533500 - protein, 9 aa, Homo Sapiens
RHLRSLHRV

SEQ ID NO: 533501 - protein, 9 aa, Homo Sapiens
PPPPGMHPP

SEQ ID NO: 533502 - protein, 9 aa, Homo Sapiens
LELCADAKK

SEQ ID NO: 533503 - protein, 9 aa, Homo Sapiens
QATDSSLGS

SEQ ID NO: 533504 - protein, 9 aa, Homo Sapiens
GDAILQCGH

SEQ ID NO: 533505 - protein, 9 aa, Homo Sapiens
ACHREAALE

SEQ ID NO: 533506 - protein, 9 aa, Homo Sapiens
LWINGELIT

SEQ ID NO: 533507 - protein, 9 aa, Homo Sapiens
MELARHQNG

SEQ ID NO: 533508 - protein, 9 aa, Homo Sapiens
RPPWASVTG

SEQ ID NO: 533509 - protein, 9 aa, Homo Sapiens
DPMELDPED

SEQ ID NO: 533510 - protein, 9 aa, Homo Sapiens
MYYMFIQML

SEQ ID NO: 533511 - protein, 9 aa, Homo Sapiens
TGPVSPSAN

SEQ ID NO: 533512 - protein, 9 aa, Homo Sapiens
PPINVPDMV

SEQ ID NO: 533513 - protein, 9 aa, Homo Sapiens
RPLCYVTVM

SEQ ID NO: 533514 - protein, 9 aa, Homo Sapiens
RQLLHKADG

SEQ ID NO: 533515 - protein, 9 aa, Homo Sapiens
EKYSFPMEM

SEQ ID NO: 533516 - protein, 9 aa, Homo Sapiens
VGDRPETDI

SEQ ID NO: 533517 - protein, 9 aa, Homo Sapiens
SFEKKVQVI

SEQ ID NO: 533518 - protein, 9 aa, Homo Sapiens
IKVTETHTG

SEQ ID NO: 533519 - protein, 9 aa, Homo Sapiens
LMGYVSGFR

SEQ ID NO: 533520 - protein, 9 aa, Homo Sapiens
FCLSADDIR

SEQ ID NO: 533521 - protein, 9 aa, Homo Sapiens
LEDDDKSEG

SEQ ID NO: 533522 - protein, 9 aa, Homo Sapiens
APWVWNIFI

SEQ ID NO: 533523 - protein, 9 aa, Homo Sapiens
EGRMDGFHP

SEQ ID NO: 533524 - protein, 9 aa, Homo Sapiens
LDVNNQCLE

SEQ ID NO: 533525 - protein, 9 aa, Homo Sapiens
WFFWFWSDL

SEQ ID NO: 533526 - protein, 9 aa, Homo Sapiens
CCCCRHRCC

SEQ ID NO: 533527 - protein, 9 aa, Homo Sapiens
RVQETLHSH

SEQ ID NO: 533528 - protein, 9 aa, Homo Sapiens
WVLVFCLLP

SEQ ID NO: 533529 - protein, 9 aa, Homo Sapiens
SVARFLKHC

SEQ ID NO: 533530 - protein, 9 aa, Homo Sapiens
PRDVYADFQ

SEQ ID NO: 533531 - protein, 9 aa, Homo Sapiens
LKIYHLHQE

SEQ ID NO: 533532 - protein, 9 aa, Homo Sapiens
FHLLSDPSR

SEQ ID NO: 533533 - protein, 9 aa, Homo Sapiens
WGLSRIVPK

SEQ ID NO: 533534 - protein, 9 aa, Homo Sapiens
ARVQEQVCA

SEQ ID NO: 533535 - protein, 9 aa, Homo Sapiens
TQEAIDEFR

SEQ ID NO: 533536 - protein, 9 aa, Homo Sapiens
LQEEHACLL

SEQ ID NO: 533537 - protein, 9 aa, Homo Sapiens
LSPYLLKRH

SEQ ID NO: 533538 - protein, 9 aa, Homo Sapiens
LFRVQLISR

SEQ ID NO: 533539 - protein, 9 aa, Homo Sapiens
HSQQVWRSP

SEQ ID NO: 533540 - protein, 9 aa, Homo Sapiens
SQMLHLLDI

SEQ ID NO: 533541 - protein, 9 aa, Homo Sapiens
WSKDPSQCP

SEQ ID NO: 533542 - protein, 9 aa, Homo Sapiens
GKSIPRIAA

SEQ ID NO: 533543 - protein, 9 aa, Homo Sapiens
TMMCNEFFE

SEQ ID NO: 533544 - protein, 9 aa, Homo Sapiens
AYIQMLRKL

SEQ ID NO: 533545 - protein, 9 aa, Homo Sapiens
SRRLQSQLS

SEQ ID NO: 533546 - protein, 9 aa, Homo Sapiens
CSSPSPTTE

SEQ ID NO: 533547 - protein, 9 aa, Homo Sapiens
VHQECYGAP

SEQ ID NO: 533548 - protein, 9 aa, Homo Sapiens
VASLTLHNR

SEQ ID NO: 533549 - protein, 9 aa, Homo Sapiens
ELVYIACQG

SEQ ID NO: 533550 - protein, 9 aa, Homo Sapiens
WGKPRPPVL

SEQ ID NO: 533551 - protein, 9 aa, Homo Sapiens
ITSQHHDVT

SEQ ID NO: 533552 - protein, 9 aa, Homo Sapiens
IHFLLESKC

SEQ ID NO: 533553 - protein, 9 aa, Homo Sapiens
EKTQHMSLM

SEQ ID NO: 533554 - protein, 9 aa, Homo Sapiens
SVDHCFSSD

SEQ ID NO: 533555 - protein, 9 aa, Homo Sapiens
KIPEYNLTI

SEQ ID NO: 533556 - protein, 9 aa, Homo Sapiens
TDIKMMERV

SEQ ID NO: 533557 - protein, 9 aa, Homo Sapiens
GLALTGMGL

SEQ ID NO: 533558 - protein, 9 aa, Homo Sapiens
KERVKSKEK

SEQ ID NO: 533559 - protein, 9 aa, Homo Sapiens
MWHNSVVLG

SEQ ID NO: 533560 - protein, 9 aa, Homo Sapiens
TMAPSADSW

SEQ ID NO: 533561 - protein, 9 aa, Homo Sapiens
RAAKEAERQ

SEQ ID NO: 533562 - protein, 9 aa, Homo Sapiens
GQEKVKKGP

SEQ ID NO: 533563 - protein, 9 aa, Homo Sapiens
WISRGRGQC

SEQ ID NO: 533564 - protein, 9 aa, Homo Sapiens
DRRVQSKDW

SEQ ID NO: 533565 - protein, 9 aa, Homo Sapiens
PEALAMELA

SEQ ID NO: 533566 - protein, 9 aa, Homo Sapiens
KLKLVHSLA

SEQ ID NO: 533567 - protein, 9 aa, Homo Sapiens
LELTAAKKQ

SEQ ID NO: 533568 - protein, 9 aa, Homo Sapiens
RGRGQCIFV

SEQ ID NO: 533569 - protein, 9 aa, Homo Sapiens
WASLELTAA

SEQ ID NO: 533570 - protein, 9 aa, Homo Sapiens
DSLEYLDGK

SEQ ID NO: 533571 - protein, 9 aa, Homo Sapiens
GFLVWTMVS

SEQ ID NO: 533572 - protein, 9 aa, Homo Sapiens
PGEMGKEGR

SEQ ID NO: 533573 - protein, 9 aa, Homo Sapiens
TDSGARPVI

SEQ ID NO: 533574 - protein, 9 aa, Homo Sapiens
AAFSATPVG

SEQ ID NO: 533575 - protein, 9 aa, Homo Sapiens
SAADACYEA

SEQ ID NO: 533576 - protein, 9 aa, Homo Sapiens
TQGRFHLLS

SEQ ID NO: 533577 - protein, 9 aa, Homo Sapiens
QGLRRVRDL

SEQ ID NO: 533578 - protein, 9 aa, Homo Sapiens
LQQRLAVLE

SEQ ID NO: 533579 - protein, 9 aa, Homo Sapiens
WPGFEKEEA

SEQ ID NO: 533580 - protein, 9 aa, Homo Sapiens
NNGVFLPLS

SEQ ID NO: 533581 - protein, 9 aa, Homo Sapiens
FFNNPRRYD

SEQ ID NO: 533582 - protein, 9 aa, Homo Sapiens
AGEGPCRGL

SEQ ID NO: 533583 - protein, 9 aa, Homo Sapiens
RGRQGPASD

SEQ ID NO: 533584 - protein, 9 aa, Homo Sapiens
GNPASFIGG

SEQ ID NO: 533585 - protein, 9 aa, Homo Sapiens
WYNMGMALH

SEQ ID NO: 533586 - protein, 9 aa, Homo Sapiens
ALTGAKSHE

SEQ ID NO: 533587 - protein, 9 aa, Homo Sapiens
TQDGQSAQQ

SEQ ID NO: 533588 - protein, 9 aa, Homo Sapiens
QMQSEFAAC

SEQ ID NO: 533589 - protein, 9 aa, Homo Sapiens
DKEKELQKF

SEQ ID NO: 533590 - protein, 9 aa, Homo Sapiens
VRFLQTCSW

SEQ ID NO: 533591 - protein, 9 aa, Homo Sapiens
HSFHAAAYV

SEQ ID NO: 533592 - protein, 9 aa, Homo Sapiens
ILRAPCAAS

SEQ ID NO: 533593 - protein, 9 aa, Homo Sapiens
VTPSKKKSL

SEQ ID NO: 533594 - protein, 9 aa, Homo Sapiens
YQCQECGRA

SEQ ID NO: 533595 - protein, 9 aa, Homo Sapiens
MGINRTEPE

SEQ ID NO: 533596 - protein, 9 aa, Homo Sapiens
RSQQQGLRR

SEQ ID NO: 533597 - protein, 9 aa, Homo Sapiens
LWHEEQPAP

SEQ ID NO: 533598 - protein, 9 aa, Homo Sapiens
ACLEEAAQE

SEQ ID NO: 533599 - protein, 9 aa, Homo Sapiens
QSSPSCRTK

SEQ ID NO: 533600 - protein, 9 aa, Homo Sapiens
TKSKEELSE

SEQ ID NO: 533601 - protein, 9 aa, Homo Sapiens
HLEKYSFPM

SEQ ID NO: 533602 - protein, 9 aa, Homo Sapiens
RPQGPPGPP

SEQ ID NO: 533603 - protein, 9 aa, Homo Sapiens
AKYYELAWK

SEQ ID NO: 533604 - protein, 9 aa, Homo Sapiens
KNTDWTTAT

SEQ ID NO: 533605 - protein, 9 aa, Homo Sapiens
WTHGYMLIS

SEQ ID NO: 533606 - protein, 9 aa, Homo Sapiens
EKNNSHIKL

SEQ ID NO: 533607 - protein, 9 aa, Homo Sapiens
MQSEFAACL

SEQ ID NO: 533608 - protein, 9 aa, Homo Sapiens
PSSNIQQHQ

SEQ ID NO: 533609 - protein, 9 aa, Homo Sapiens
PPPTSNGNL

SEQ ID NO: 533610 - protein, 9 aa, Homo Sapiens
SLTQDCTVA

SEQ ID NO: 533611 - protein, 9 aa, Homo Sapiens
EAETLWERE

SEQ ID NO: 533612 - protein, 9 aa, Homo Sapiens
DLVLDLELL

SEQ ID NO: 533613 - protein, 9 aa, Homo Sapiens
VLVQVEVSC

SEQ ID NO: 533614 - protein, 9 aa, Homo Sapiens
RSDGRGKQH

SEQ ID NO: 533615 - protein, 9 aa, Homo Sapiens
YPMASRRQQ

SEQ ID NO: 533616 - protein, 9 aa, Homo Sapiens
QTMTEERRK

SEQ ID NO: 533617 - protein, 9 aa, Homo Sapiens
GADTIGDDD

SEQ ID NO: 533618 - protein, 9 aa, Homo Sapiens
IYVIPRPHF

SEQ ID NO: 533619 - protein, 9 aa, Homo Sapiens
TNGQCFSAE

SEQ ID NO: 533620 - protein, 9 aa, Homo Sapiens
ETLPSMEED

SEQ ID NO: 533621 - protein, 9 aa, Homo Sapiens
QQLCYLLKK

SEQ ID NO: 533622 - protein, 9 aa, Homo Sapiens
LPLSPAVAN

SEQ ID NO: 533623 - protein, 9 aa, Homo Sapiens
QLVVQTMTE

SEQ ID NO: 533624 - protein, 9 aa, Homo Sapiens
ITQQLCYLL

SEQ ID NO: 533625 - protein, 9 aa, Homo Sapiens
QWASLELTA

SEQ ID NO: 533626 - protein, 9 aa, Homo Sapiens
ENRVLQQLL

SEQ ID NO: 533627 - protein, 9 aa, Homo Sapiens
CELDKNQHQ

SEQ ID NO: 533628 - protein, 9 aa, Homo Sapiens
SFSCVCPKG

SEQ ID NO: 533629 - protein, 9 aa, Homo Sapiens
SSYSLTQDC

SEQ ID NO: 533630 - protein, 9 aa, Homo Sapiens
LDREKIPEY

SEQ ID NO: 533631 - protein, 9 aa, Homo Sapiens
YDLCKDEPT

SEQ ID NO: 533632 - protein, 9 aa, Homo Sapiens
PLPQGIQEP

SEQ ID NO: 533633 - protein, 9 aa, Homo Sapiens
ENTGHLTSP

SEQ ID NO: 533634 - protein, 9 aa, Homo Sapiens
PLEGQAKGV

SEQ ID NO: 533635 - protein, 9 aa, Homo Sapiens
ACGDCGCCF

SEQ ID NO: 533636 - protein, 9 aa, Homo Sapiens
KQNLVICRN

SEQ ID NO: 533637 - protein, 9 aa, Homo Sapiens
GVDTSKAVL

SEQ ID NO: 533638 - protein, 9 aa, Homo Sapiens
TACICTLLS

SEQ ID NO: 533639 - protein, 9 aa, Homo Sapiens
YDEKLAHFR

SEQ ID NO: 533640 - protein, 9 aa, Homo Sapiens
TPSYKRDNS

SEQ ID NO: 533641 - protein, 9 aa, Homo Sapiens
GADLVIMDL

SEQ ID NO: 533642 - protein, 9 aa, Homo Sapiens
DDIYVIPRP

SEQ ID NO: 533643 - protein, 9 aa, Homo Sapiens
GWCGGRRLP

SEQ ID NO: 533644 - protein, 9 aa, Homo Sapiens
TLPSMEEDT

SEQ ID NO: 533645 - protein, 9 aa, Homo Sapiens
VLDLVLDLE

SEQ ID NO: 533646 - protein, 9 aa, Homo Sapiens
KTRGVPETL

SEQ ID NO: 533647 - protein, 9 aa, Homo Sapiens
ILATEQLLT

SEQ ID NO: 533648 - protein, 9 aa, Homo Sapiens
YCVFLSCIT

SEQ ID NO: 533649 - protein, 9 aa, Homo Sapiens
CPSMEEIVK

SEQ ID NO: 533650 - protein, 9 aa, Homo Sapiens
QGSTGFPKA

SEQ ID NO: 533651 - protein, 9 aa, Homo Sapiens
LHRVQVTAA

SEQ ID NO: 533652 - protein, 9 aa, Homo Sapiens
SSVDCPTFL

SEQ ID NO: 533653 - protein, 9 aa, Homo Sapiens
SCFEYKGEK

SEQ ID NO: 533654 - protein, 9 aa, Homo Sapiens
GAVNLKYSN

SEQ ID NO: 533655 - protein, 9 aa, Homo Sapiens
RPKHTLPPK

SEQ ID NO: 533656 - protein, 9 aa, Homo Sapiens
LTLANKYGI

SEQ ID NO: 533657 - protein, 9 aa, Homo Sapiens
REDRPGVAL

SEQ ID NO: 533658 - protein, 9 aa, Homo Sapiens
RMTITSRDI

SEQ ID NO: 533659 - protein, 9 aa, Homo Sapiens
WASVTGYLL

SEQ ID NO: 533660 - protein, 9 aa, Homo Sapiens
SLVTSRSVI

SEQ ID NO: 533661 - protein, 9 aa, Homo Sapiens
MPTKSKEEL

SEQ ID NO: 533662 - protein, 9 aa, Homo Sapiens
EEVQLTPSM

SEQ ID NO: 533663 - protein, 9 aa, Homo Sapiens
KKCSLATCP

SEQ ID NO: 533664 - protein, 9 aa, Homo Sapiens
AEVHQLVVV

SEQ ID NO: 533665 - protein, 9 aa, Homo Sapiens
VTSRSVIVT

SEQ ID NO: 533666 - protein, 9 aa, Homo Sapiens
DCTVAVIYT

SEQ ID NO: 533667 - protein, 9 aa, Homo Sapiens
HRCTAQQKG

SEQ ID NO: 533668 - protein, 9 aa, Homo Sapiens
FREQQAMRE

SEQ ID NO: 533669 - protein, 9 aa, Homo Sapiens
ISDWLEKES

SEQ ID NO: 533670 - protein, 9 aa, Homo Sapiens
YGYHHNAEE

SEQ ID NO: 533671 - protein, 9 aa, Homo Sapiens
ETETLKKST

SEQ ID NO: 533672 - protein, 9 aa, Homo Sapiens
VDTIFCPRM

SEQ ID NO: 533673 - protein, 9 aa, Homo Sapiens
GIRSVMRYL

SEQ ID NO: 533674 - protein, 9 aa, Homo Sapiens
PSPHSFHAA

SEQ ID NO: 533675 - protein, 9 aa, Homo Sapiens
WEMLIYLAQ

SEQ ID NO: 533676 - protein, 9 aa, Homo Sapiens
FPPFHSPER

SEQ ID NO: 533677 - protein, 9 aa, Homo Sapiens
VTTLAVSRG

SEQ ID NO: 533678 - protein, 9 aa, Homo Sapiens
RHAPWVWNI

SEQ ID NO: 533679 - protein, 9 aa, Homo Sapiens
WTMVSATHI

SEQ ID NO: 533680 - protein, 9 aa, Homo Sapiens
QEEHACLLK

SEQ ID NO: 533681 - protein, 9 aa, Homo Sapiens
QLLREENRV

SEQ ID NO: 533682 - protein, 9 aa, Homo Sapiens
MVEPYNATL

SEQ ID NO: 533683 - protein, 9 aa, Homo Sapiens
VQKKLSQMA

SEQ ID NO: 533684 - protein, 9 aa, Homo Sapiens
HRKQAEAEC

SEQ ID NO: 533685 - protein, 9 aa, Homo Sapiens
QLSESHRKQ

SEQ ID NO: 533686 - protein, 9 aa, Homo Sapiens
PKCVYVIGQ

SEQ ID NO: 533687 - protein, 9 aa, Homo Sapiens
VNLKYSNRT

SEQ ID NO: 533688 - protein, 9 aa, Homo Sapiens
THNIVKYDL

SEQ ID NO: 533689 - protein, 9 aa, Homo Sapiens
IHLTPRPGP

SEQ ID NO: 533690 - protein, 9 aa, Homo Sapiens
TSACKKKRI

SEQ ID NO: 533691 - protein, 9 aa, Homo Sapiens
NPQHARSVQ

SEQ ID NO: 533692 - protein, 9 aa, Homo Sapiens
PVGEVGRST

SEQ ID NO: 533693 - protein, 9 aa, Homo Sapiens
FCGSSDVDQ

SEQ ID NO: 533694 - protein, 9 aa, Homo Sapiens
SRPLCYVTV

SEQ ID NO: 533695 - protein, 9 aa, Homo Sapiens
RNEYFFYRN

SEQ ID NO: 533696 - protein, 9 aa, Homo Sapiens
LKTAVSKKM

SEQ ID NO: 533697 - protein, 9 aa, Homo Sapiens
TPLEEVAKK

SEQ ID NO: 533698 - protein, 9 aa, Homo Sapiens
PINVPDMVL

SEQ ID NO: 533699 - protein, 9 aa, Homo Sapiens
CSCPGAKRS

SEQ ID NO: 533700 - protein, 9 aa, Homo Sapiens
VMYSQINRA

SEQ ID NO: 533701 - protein, 9 aa, Homo Sapiens
IPRIAALGV

SEQ ID NO: 533702 - protein, 9 aa, Homo Sapiens
CGLSEKWLD

SEQ ID NO: 533703 - protein, 9 aa, Homo Sapiens
GRFHLLSDP

SEQ ID NO: 533704 - protein, 9 aa, Homo Sapiens
LSLDDFWNT

SEQ ID NO: 533705 - protein, 9 aa, Homo Sapiens
AGYNHAVDC

SEQ ID NO: 533706 - protein, 9 aa, Homo Sapiens
EVHIYSLGA

SEQ ID NO: 533707 - protein, 9 aa, Homo Sapiens
GEFGGHNKP

SEQ ID NO: 533708 - protein, 9 aa, Homo Sapiens
CSWVLVFCL

SEQ ID NO: 533709 - protein, 9 aa, Homo Sapiens
HDQVLLLGS

SEQ ID NO: 533710 - protein, 9 aa, Homo Sapiens
FHAVRAPAL

SEQ ID NO: 533711 - protein, 9 aa, Homo Sapiens
CCFSESSTL

SEQ ID NO: 533712 - protein, 9 aa, Homo Sapiens
MWHLSTGTM

SEQ ID NO: 533713 - protein, 9 aa, Homo Sapiens
YFFNNPRRY

SEQ ID NO: 533714 - protein, 9 aa, Homo Sapiens
NLKSSAMDC

SEQ ID NO: 533715 - protein, 9 aa, Homo Sapiens
QSEFAACLN

SEQ ID NO: 533716 - protein, 9 aa, Homo Sapiens
GHTKEVIVA

SEQ ID NO: 533717 - protein, 9 aa, Homo Sapiens
QHMSLMRHH

SEQ ID NO: 533718 - protein, 9 aa, Homo Sapiens
RPAVVLIRK

SEQ ID NO: 533719 - protein, 9 aa, Homo Sapiens
HTKEVIVAA

SEQ ID NO: 533720 - protein, 9 aa, Homo Sapiens
LFDEIVTAA

SEQ ID NO: 533721 - protein, 9 aa, Homo Sapiens
PLASTLQPT

SEQ ID NO: 533722 - protein, 9 aa, Homo Sapiens
QQKHVVFGS

SEQ ID NO: 533723 - protein, 9 aa, Homo Sapiens
SVTITVAYL

SEQ ID NO: 533724 - protein, 9 aa, Homo Sapiens
QYKASQDPF

SEQ ID NO: 533725 - protein, 9 aa, Homo Sapiens
IKKPEQDNW

SEQ ID NO: 533726 - protein, 9 aa, Homo Sapiens
ENSIGVGPF

SEQ ID NO: 533727 - protein, 9 aa, Homo Sapiens
LEEVGDLPE

SEQ ID NO: 533728 - protein, 9 aa, Homo Sapiens
IWPFSRYSV

SEQ ID NO: 533729 - protein, 9 aa, Homo Sapiens
RRKLSLELM

SEQ ID NO: 533730 - protein, 9 aa, Homo Sapiens
KYYELAWKE

SEQ ID NO: 533731 - protein, 9 aa, Homo Sapiens
FSTPCRMSM

SEQ ID NO: 533732 - protein, 9 aa, Homo Sapiens
RSVTITVAY

SEQ ID NO: 533733 - protein, 9 aa, Homo Sapiens
LTRFATAHW

SEQ ID NO: 533734 - protein, 9 aa, Homo Sapiens
VLVYPMASR

SEQ ID NO: 533735 - protein, 9 aa, Homo Sapiens
PKAREWYSS

SEQ ID NO: 533736 - protein, 9 aa, Homo Sapiens
RDNHGWCGG

SEQ ID NO: 533737 - protein, 9 aa, Homo Sapiens
AVSMASRPC

SEQ ID NO: 533738 - protein, 9 aa, Homo Sapiens
PTSNGNLLY

SEQ ID NO: 533739 - protein, 9 aa, Homo Sapiens
LDKNQHQCV

SEQ ID NO: 533740 - protein, 9 aa, Homo Sapiens
EKEVRGRGN

SEQ ID NO: 533741 - protein, 9 aa, Homo Sapiens
SAVTPSKKK

SEQ ID NO: 533742 - protein, 9 aa, Homo Sapiens
CTTVPKMTF

SEQ ID NO: 533743 - protein, 9 aa, Homo Sapiens
QHATKPCPN

SEQ ID NO: 533744 - protein, 9 aa, Homo Sapiens
HLMLEELRT

SEQ ID NO: 533745 - protein, 9 aa, Homo Sapiens
NKPKITAWE

SEQ ID NO: 533746 - protein, 9 aa, Homo Sapiens
PSADSWVWY

SEQ ID NO: 533747 - protein, 9 aa, Homo Sapiens
GFRVMEEKI

SEQ ID NO: 533748 - protein, 9 aa, Homo Sapiens
DGVSSLAAS

SEQ ID NO: 533749 - protein, 9 aa, Homo Sapiens
SGFRVMEEK

SEQ ID NO: 533750 - protein, 9 aa, Homo Sapiens
ILHGIDLRW

SEQ ID NO: 533751 - protein, 9 aa, Homo Sapiens
LQLVKSVSE

SEQ ID NO: 533752 - protein, 9 aa, Homo Sapiens
EQKLKFKDQ

SEQ ID NO: 533753 - protein, 9 aa, Homo Sapiens
VLKIYHLHQ

SEQ ID NO: 533754 - protein, 9 aa, Homo Sapiens
SNPQLHQAI

SEQ ID NO: 533755 - protein, 9 aa, Homo Sapiens
SPGVRSEHG

SEQ ID NO: 533756 - protein, 9 aa, Homo Sapiens
LGVMQRLWA

SEQ ID NO: 533757 - protein, 9 aa, Homo Sapiens
RMLKTAVSK

SEQ ID NO: 533758 - protein, 9 aa, Homo Sapiens
ENDTFCLEF

SEQ ID NO: 533759 - protein, 9 aa, Homo Sapiens
GMWHNSVVL

SEQ ID NO: 533760 - protein, 9 aa, Homo Sapiens
LVVQTMTEE

SEQ ID NO: 533761 - protein, 9 aa, Homo Sapiens
ERRRKCLQE

SEQ ID NO: 533762 - protein, 9 aa, Homo Sapiens
LPPGRLYAW

SEQ ID NO: 533763 - protein, 9 aa, Homo Sapiens
ALQQQEEEN

SEQ ID NO: 533764 - protein, 9 aa, Homo Sapiens
DLRSIRSGR

SEQ ID NO: 533765 - protein, 9 aa, Homo Sapiens
SAASSGAWA

SEQ ID NO: 533766 - protein, 9 aa, Homo Sapiens
AVNLKYSNR

SEQ ID NO: 533767 - protein, 9 aa, Homo Sapiens
CSLATCPDP

SEQ ID NO: 533768 - protein, 9 aa, Homo Sapiens
CGLGGMWHN

SEQ ID NO: 533769 - protein, 9 aa, Homo Sapiens
AYGTFLLFT

SEQ ID NO: 533770 - protein, 9 aa, Homo Sapiens
CTNSASCMT

SEQ ID NO: 533771 - protein, 9 aa, Homo Sapiens
SWVWYMDGY

SEQ ID NO: 533772 - protein, 9 aa, Homo Sapiens
CTVKLWSLP

SEQ ID NO: 533773 - protein, 9 aa, Homo Sapiens
GNPDILVGS

SEQ ID NO: 533774 - protein, 9 aa, Homo Sapiens
TEVTGRRWL

SEQ ID NO: 533775 - protein, 9 aa, Homo Sapiens
MFFNFDSFI

SEQ ID NO: 533776 - protein, 9 aa, Homo Sapiens
WNIFIVTNG

SEQ ID NO: 533777 - protein, 9 aa, Homo Sapiens
TRCAHPLCL

SEQ ID NO: 533778 - protein, 9 aa, Homo Sapiens
GCPELSFYG

SEQ ID NO: 533779 - protein, 9 aa, Homo Sapiens
LDPSQQPKQ

SEQ ID NO: 533780 - protein, 9 aa, Homo Sapiens
KSAHMPVII

SEQ ID NO: 533781 - protein, 9 aa, Homo Sapiens
QRNSIPMSP

SEQ ID NO: 533782 - protein, 9 aa, Homo Sapiens
PRPHFSTDQ

SEQ ID NO: 533783 - protein, 9 aa, Homo Sapiens
LLLDRRVLL

SEQ ID NO: 533784 - protein, 9 aa, Homo Sapiens
QMLNLLLLA

SEQ ID NO: 533785 - protein, 9 aa, Homo Sapiens
QLMHVTVRV

SEQ ID NO: 533786 - protein, 9 aa, Homo Sapiens
GLGAGASCV

SEQ ID NO: 533787 - protein, 9 aa, Homo Sapiens
GCYPHTKKI

SEQ ID NO: 533788 - protein, 9 aa, Homo Sapiens
YRNRPSFDA

SEQ ID NO: 533789 - protein, 9 aa, Homo Sapiens
CYVTVMNTQ

SEQ ID NO: 533790 - protein, 9 aa, Homo Sapiens
QSEQQKHVV

SEQ ID NO: 533791 - protein, 9 aa, Homo Sapiens
QGAHVTNVC

SEQ ID NO: 533792 - protein, 9 aa, Homo Sapiens
MRHISEGCL

SEQ ID NO: 533793 - protein, 9 aa, Homo Sapiens
ISCILTMPQ

SEQ ID NO: 533794 - protein, 9 aa, Homo Sapiens
RCVNVIFVR

SEQ ID NO: 533795 - protein, 9 aa, Homo Sapiens
TAMKEVLVQ

SEQ ID NO: 533796 - protein, 9 aa, Homo Sapiens
IFVRDHGME

SEQ ID NO: 533797 - protein, 9 aa, Homo Sapiens
AWSSLTHCL

SEQ ID NO: 533798 - protein, 9 aa, Homo Sapiens
SSSTSSYVP

SEQ ID NO: 533799 - protein, 9 aa, Homo Sapiens
DISQAYHSA

SEQ ID NO: 533800 - protein, 9 aa, Homo Sapiens
TSYSVSIEE

SEQ ID NO: 533801 - protein, 9 aa, Homo Sapiens
DGEAGAGGV

SEQ ID NO: 533802 - protein, 9 aa, Homo Sapiens
ETLKKSTDE

SEQ ID NO: 533803 - protein, 9 aa, Homo Sapiens
RFLQTCSWV

SEQ ID NO: 533804 - protein, 9 aa, Homo Sapiens
NPTAQEDDR

SEQ ID NO: 533805 - protein, 9 aa, Homo Sapiens
SYKRDNSIS

SEQ ID NO: 533806 - protein, 9 aa, Homo Sapiens
VVKYLLWMG

SEQ ID NO: 533807 - protein, 9 aa, Homo Sapiens
FIAAMRRRD

SEQ ID NO: 533808 - protein, 9 aa, Homo Sapiens
VIHLKNLSN

SEQ ID NO: 533809 - protein, 9 aa, Homo Sapiens
YCEVLPGEI

SEQ ID NO: 533810 - protein, 9 aa, Homo Sapiens
PITQQLCYL

SEQ ID NO: 533811 - protein, 9 aa, Homo Sapiens
KEASLDADQ

SEQ ID NO: 533812 - protein, 9 aa, Homo Sapiens
SATEVTGRR

SEQ ID NO: 533813 - protein, 9 aa, Homo Sapiens
PRVHALVRL

SEQ ID NO: 533814 - protein, 9 aa, Homo Sapiens
QAKYYELAW

SEQ ID NO: 533815 - protein, 9 aa, Homo Sapiens
SQMAPEDQE

SEQ ID NO: 533816 - protein, 9 aa, Homo Sapiens
RLVEAEVHQ

SEQ ID NO: 533817 - protein, 9 aa, Homo Sapiens
VRCMPGARY

SEQ ID NO: 533818 - protein, 9 aa, Homo Sapiens
TGAKSHELQ

SEQ ID NO: 533819 - protein, 9 aa, Homo Sapiens
GKQSEQQKH

SEQ ID NO: 533820 - protein, 9 aa, Homo Sapiens
LLDITDRPV

SEQ ID NO: 533821 - protein, 9 aa, Homo Sapiens
KERQCQFKL

SEQ ID NO: 533822 - protein, 9 aa, Homo Sapiens
QLRWGPAPL

SEQ ID NO: 533823 - protein, 9 aa, Homo Sapiens
LGFHMLNCG

SEQ ID NO: 533824 - protein, 9 aa, Homo Sapiens
PRIAALGVE

SEQ ID NO: 533825 - protein, 9 aa, Homo Sapiens
WSSLTHCLV

SEQ ID NO: 533826 - protein, 9 aa, Homo Sapiens
FQLCKTVHH

SEQ ID NO: 533827 - protein, 9 aa, Homo Sapiens
QPCKKVSAA

SEQ ID NO: 533828 - protein, 9 aa, Homo Sapiens
CGSPALSSE

SEQ ID NO: 533829 - protein, 9 aa, Homo Sapiens
DIFHLEGMT

SEQ ID NO: 533830 - protein, 9 aa, Homo Sapiens
AKPSAELPR

SEQ ID NO: 533831 - protein, 9 aa, Homo Sapiens
WSQSEEVQG

SEQ ID NO: 533832 - protein, 9 aa, Homo Sapiens
FPRRSISGF

SEQ ID NO: 533833 - protein, 9 aa, Homo Sapiens
LTQDCTVAV

SEQ ID NO: 533834 - protein, 9 aa, Homo Sapiens
FNNPRRYDS

SEQ ID NO: 533835 - protein, 9 aa, Homo Sapiens
PDMVLYSDD

SEQ ID NO: 533836 - protein, 9 aa, Homo Sapiens
LGEGRFSIC

SEQ ID NO: 533837 - protein, 9 aa, Homo Sapiens
RYIAVCHPM

SEQ ID NO: 533838 - protein, 9 aa, Homo Sapiens
AARVQEQVC

SEQ ID NO: 533839 - protein, 9 aa, Homo Sapiens
SADSWVWYM

SEQ ID NO: 533840 - protein, 9 aa, Homo Sapiens
TGHLTSPSA

SEQ ID NO: 533841 - protein, 9 aa, Homo Sapiens
PASGPTGLP

SEQ ID NO: 533842 - protein, 9 aa, Homo Sapiens
GRVERLWEK

SEQ ID NO: 533843 - protein, 9 aa, Homo Sapiens
NPPLNSPGT

SEQ ID NO: 533844 - protein, 9 aa, Homo Sapiens
RLREGRRGR

SEQ ID NO: 533845 - protein, 9 aa, Homo Sapiens
GGPGPSPHS

SEQ ID NO: 533846 - protein, 9 aa, Homo Sapiens
FFLIQDTSL

SEQ ID NO: 533847 - protein, 9 aa, Homo Sapiens
PTHHMDFLL

SEQ ID NO: 533848 - protein, 9 aa, Homo Sapiens
MARVIFNWD

SEQ ID NO: 533849 - protein, 9 aa, Homo Sapiens
SSASAVTPS

SEQ ID NO: 533850 - protein, 9 aa, Homo Sapiens
YLAMQTLQI

SEQ ID NO: 533851 - protein, 9 aa, Homo Sapiens
GTSVGSHPR

SEQ ID NO: 533852 - protein, 9 aa, Homo Sapiens
ALTGMGLSS

SEQ ID NO: 533853 - protein, 9 aa, Homo Sapiens
CHVLKQDKG

SEQ ID NO: 533854 - protein, 9 aa, Homo Sapiens
FEQSDNIAH

SEQ ID NO: 533855 - protein, 9 aa, Homo Sapiens
SMEEDTLGN

SEQ ID NO: 533856 - protein, 9 aa, Homo Sapiens
GPGPSPHSF

SEQ ID NO: 533857 - protein, 9 aa, Homo Sapiens
LVTLGAIGE

SEQ ID NO: 533858 - protein, 9 aa, Homo Sapiens
RQALDFVFT

SEQ ID NO: 533859 - protein, 9 aa, Homo Sapiens
GEVGRSTGD

SEQ ID NO: 533860 - protein, 9 aa, Homo Sapiens
ILNILEKGM

SEQ ID NO: 533861 - protein, 9 aa, Homo Sapiens
FRQTFCKII

SEQ ID NO: 533862 - protein, 9 aa, Homo Sapiens
EAKTDPVTA

SEQ ID NO: 533863 - protein, 9 aa, Homo Sapiens
SPHSFHAAA

SEQ ID NO: 533864 - protein, 9 aa, Homo Sapiens
YIWPFSRYS

SEQ ID NO: 533865 - protein, 9 aa, Homo Sapiens
CCLPGESQL

SEQ ID NO: 533866 - protein, 9 aa, Homo Sapiens
RSPSTFPAP

SEQ ID NO: 533867 - protein, 9 aa, Homo Sapiens
KFARIEAEL

SEQ ID NO: 533868 - protein, 9 aa, Homo Sapiens
QRSTEHQLI

SEQ ID NO: 533869 - protein, 9 aa, Homo Sapiens
KRKIQEEIE

SEQ ID NO: 533870 - protein, 9 aa, Homo Sapiens
QAEAEHLWK

SEQ ID NO: 533871 - protein, 9 aa, Homo Sapiens
LRSLTRFAT

SEQ ID NO: 533872 - protein, 9 aa, Homo Sapiens
YVSGFRVME

SEQ ID NO: 533873 - protein, 9 aa, Homo Sapiens
EAGPGWALW

SEQ ID NO: 533874 - protein, 9 aa, Homo Sapiens
YTAELHLNN

SEQ ID NO: 533875 - protein, 9 aa, Homo Sapiens
MRKGIMAYS

SEQ ID NO: 533876 - protein, 9 aa, Homo Sapiens
YHLHQEDSG

SEQ ID NO: 533877 - protein, 9 aa, Homo Sapiens
GVATGICIL

SEQ ID NO: 533878 - protein, 9 aa, Homo Sapiens
AISRICEAV

SEQ ID NO: 533879 - protein, 9 aa, Homo Sapiens
LISDDLRSI

SEQ ID NO: 533880 - protein, 9 aa, Homo Sapiens
IAGNPASFI

SEQ ID NO: 533881 - protein, 9 aa, Homo Sapiens
AVTDLLGHR

SEQ ID NO: 533882 - protein, 9 aa, Homo Sapiens
KSSAMDCED

SEQ ID NO: 533883 - protein, 9 aa, Homo Sapiens
ANQAASWRK

SEQ ID NO: 533884 - protein, 9 aa, Homo Sapiens
GEGRFSICR

SEQ ID NO: 533885 - protein, 9 aa, Homo Sapiens
KAFHQSSYL

SEQ ID NO: 533886 - protein, 9 aa, Homo Sapiens
RRYRGAIAC

SEQ ID NO: 533887 - protein, 9 aa, Homo Sapiens
ECTNSASCM

SEQ ID NO: 533888 - protein, 9 aa, Homo Sapiens
LSIAAVVLM

SEQ ID NO: 533889 - protein, 9 aa, Homo Sapiens
SPAFHAVRA

SEQ ID NO: 533890 - protein, 9 aa, Homo Sapiens
AAVVLMFMY

SEQ ID NO: 533891 - protein, 9 aa, Homo Sapiens
LSCNKCVTS

SEQ ID NO: 533892 - protein, 9 aa, Homo Sapiens
YFGKSIPRI

SEQ ID NO: 533893 - protein, 9 aa, Homo Sapiens
RAYVAPAPG

SEQ ID NO: 533894 - protein, 9 aa, Homo Sapiens
YARNFWPGI

SEQ ID NO: 533895 - protein, 9 aa, Homo Sapiens
ASDESSYQP

SEQ ID NO: 533896 - protein, 9 aa, Homo Sapiens
AEEAQHWVR

SEQ ID NO: 533897 - protein, 9 aa, Homo Sapiens
LQAKLQGAV

SEQ ID NO: 533898 - protein, 9 aa, Homo Sapiens
KLYWTHGYM

SEQ ID NO: 533899 - protein, 9 aa, Homo Sapiens
HILLPLYEV

SEQ ID NO: 533900 - protein, 9 aa, Homo Sapiens
YWTHGYMLI

SEQ ID NO: 533901 - protein, 9 aa, Homo Sapiens
KMVTVGEKL

SEQ ID NO: 533902 - protein, 9 aa, Homo Sapiens
VQTMTEERR

SEQ ID NO: 533903 - protein, 9 aa, Homo Sapiens
CRGLGAPLT

SEQ ID NO: 533904 - protein, 9 aa, Homo Sapiens
EQLCSSLEA

SEQ ID NO: 533905 - protein, 9 aa, Homo Sapiens
MFIPNLYLK

SEQ ID NO: 533906 - protein, 9 aa, Homo Sapiens
LELSCQETN

SEQ ID NO: 533907 - protein, 9 aa, Homo Sapiens
VSYLAAATI

SEQ ID NO: 533908 - protein, 9 aa, Homo Sapiens
NQHSIESQD

SEQ ID NO: 533909 - protein, 9 aa, Homo Sapiens
TAHWTVASV

SEQ ID NO: 533910 - protein, 9 aa, Homo Sapiens
SIQSVREVA

SEQ ID NO: 533911 - protein, 9 aa, Homo Sapiens
DPSQCPSME

SEQ ID NO: 533912 - protein, 9 aa, Homo Sapiens
AGEAGSKQK

SEQ ID NO: 533913 - protein, 9 aa, Homo Sapiens
PELLGVMQR

SEQ ID NO: 533914 - protein, 9 aa, Homo Sapiens
HGECIDVDE

SEQ ID NO: 533915 - protein, 9 aa, Homo Sapiens
PACRACGAG

SEQ ID NO: 533916 - protein, 9 aa, Homo Sapiens
MASRPCNPE

SEQ ID NO: 533917 - protein, 9 aa, Homo Sapiens
RFRSQTPSC

SEQ ID NO: 533918 - protein, 9 aa, Homo Sapiens
KKQLANITM

SEQ ID NO: 533919 - protein, 9 aa, Homo Sapiens
GDAPPPHPP

SEQ ID NO: 533920 - protein, 9 aa, Homo Sapiens
RMRRLANMA

SEQ ID NO: 533921 - protein, 9 aa, Homo Sapiens
YHWSQSEEV

SEQ ID NO: 533922 - protein, 9 aa, Homo Sapiens
KRVYNFCTQ

SEQ ID NO: 533923 - protein, 9 aa, Homo Sapiens
KYRTFSALW

SEQ ID NO: 533924 - protein, 9 aa, Homo Sapiens
RFLPSTSST

SEQ ID NO: 533925 - protein, 9 aa, Homo Sapiens
CVLCQCQEG

SEQ ID NO: 533926 - protein, 9 aa, Homo Sapiens
QDWVRDRFW

SEQ ID NO: 533927 - protein, 9 aa, Homo Sapiens
TKVPVHDQV

SEQ ID NO: 533928 - protein, 9 aa, Homo Sapiens
HPLQYLAIM

SEQ ID NO: 533929 - protein, 9 aa, Homo Sapiens
WFDERTWYP

SEQ ID NO: 533930 - protein, 9 aa, Homo Sapiens
VHDQVLLLG

SEQ ID NO: 533931 - protein, 9 aa, Homo Sapiens
YGLGELSQG

SEQ ID NO: 533932 - protein, 9 aa, Homo Sapiens
PTNDPLEAA

SEQ ID NO: 533933 - protein, 9 aa, Homo Sapiens
VPDMVLYSD

SEQ ID NO: 533934 - protein, 9 aa, Homo Sapiens
CQACVSSCW

SEQ ID NO: 533935 - protein, 9 aa, Homo Sapiens
FCKIIRSHV

SEQ ID NO: 533936 - protein, 9 aa, Homo Sapiens
RSAAVENPT

SEQ ID NO: 533937 - protein, 9 aa, Homo Sapiens
EVGDLPEDP

SEQ ID NO: 533938 - protein, 9 aa, Homo Sapiens
DLTMATLMH

SEQ ID NO: 533939 - protein, 9 aa, Homo Sapiens
HVELDSLRH

SEQ ID NO: 533940 - protein, 9 aa, Homo Sapiens
LKPYQGSTG

SEQ ID NO: 533941 - protein, 9 aa, Homo Sapiens
ARSVQNFLY

SEQ ID NO: 533942 - protein, 9 aa, Homo Sapiens
DHTEKMKEI

SEQ ID NO: 533943 - protein, 9 aa, Homo Sapiens
EGTSVGSHP

SEQ ID NO: 533944 - protein, 9 aa, Homo Sapiens
DMGCFTFLG

SEQ ID NO: 533945 - protein, 9 aa, Homo Sapiens
EFWFDLSKI

SEQ ID NO: 533946 - protein, 9 aa, Homo Sapiens
RQCQFKLKL

SEQ ID NO: 533947 - protein, 9 aa, Homo Sapiens
LWHADRIKC

SEQ ID NO: 533948 - protein, 9 aa, Homo Sapiens
LKVDKDCEE

SEQ ID NO: 533949 - protein, 9 aa, Homo Sapiens
HSKEASLDA

SEQ ID NO: 533950 - protein, 9 aa, Homo Sapiens
KEVQEMRRL

SEQ ID NO: 533951 - protein, 9 aa, Homo Sapiens
DKPLGEGRF

SEQ ID NO: 533952 - protein, 9 aa, Homo Sapiens
AKTSSHLGV

SEQ ID NO: 533953 - protein, 9 aa, Homo Sapiens
SIRSGRIRQ

SEQ ID NO: 533954 - protein, 9 aa, Homo Sapiens
DESCPPDPS

SEQ ID NO: 533955 - protein, 9 aa, Homo Sapiens
HIPHLVCSV

SEQ ID NO: 533956 - protein, 9 aa, Homo Sapiens
QQLKKKCQQ

SEQ ID NO: 533957 - protein, 9 aa, Homo Sapiens
VLDRYHCFK

SEQ ID NO: 533958 - protein, 9 aa, Homo Sapiens
DYECTNSAS

SEQ ID NO: 533959 - protein, 9 aa, Homo Sapiens
QCIFVELQF

SEQ ID NO: 533960 - protein, 9 aa, Homo Sapiens
KQHATKPCP

SEQ ID NO: 533961 - protein, 9 aa, Homo Sapiens
APHRIILHG

SEQ ID NO: 533962 - protein, 9 aa, Homo Sapiens
EGTTSMLTM

SEQ ID NO: 533963 - protein, 9 aa, Homo Sapiens
IREFRQTFC

SEQ ID NO: 533964 - protein, 9 aa, Homo Sapiens
AKSHELQDV

SEQ ID NO: 533965 - protein, 9 aa, Homo Sapiens
QRLARVQET

SEQ ID NO: 533966 - protein, 9 aa, Homo Sapiens
NWTAMKEVL

SEQ ID NO: 533967 - protein, 9 aa, Homo Sapiens
LKDGHSGMP

SEQ ID NO: 533968 - protein, 9 aa, Homo Sapiens
YTQDVHGEC

SEQ ID NO: 533969 - protein, 9 aa, Homo Sapiens
NTFCLSADD

SEQ ID NO: 533970 - protein, 9 aa, Homo Sapiens
RDNLKSSAM

SEQ ID NO: 533971 - protein, 9 aa, Homo Sapiens
TRFATAHWT

SEQ ID NO: 533972 - protein, 9 aa, Homo Sapiens
GRKVFTKAA

SEQ ID NO: 533973 - protein, 9 aa, Homo Sapiens
GVPETLNEA

SEQ ID NO: 533974 - protein, 9 aa, Homo Sapiens
SPEAPPALG

SEQ ID NO: 533975 - protein, 9 aa, Homo Sapiens
QHWVRGLTK

SEQ ID NO: 533976 - protein, 9 aa, Homo Sapiens
VARLREGRR

SEQ ID NO: 533977 - protein, 9 aa, Homo Sapiens
GPRDIHLTP

SEQ ID NO: 533978 - protein, 9 aa, Homo Sapiens
YQRMYYMFI

SEQ ID NO: 533979 - protein, 9 aa, Homo Sapiens
AIQDMFLCC

SEQ ID NO: 533980 - protein, 9 aa, Homo Sapiens
ARGAGAMSG

SEQ ID NO: 533981 - protein, 9 aa, Homo Sapiens
GWEMLIYLA

SEQ ID NO: 533982 - protein, 9 aa, Homo Sapiens
TSRDYVVMS

SEQ ID NO: 533983 - protein, 9 aa, Homo Sapiens
PPSTNVRST

SEQ ID NO: 533984 - protein, 9 aa, Homo Sapiens
RHIITHSGH

SEQ ID NO: 533985 - protein, 9 aa, Homo Sapiens
KEVFKSAHM

SEQ ID NO: 533986 - protein, 9 aa, Homo Sapiens
SACKKKRIA

SEQ ID NO: 533987 - protein, 9 aa, Homo Sapiens
FQPTYKYDM

SEQ ID NO: 533988 - protein, 9 aa, Homo Sapiens
KVDKDCEEC

SEQ ID NO: 533989 - protein, 9 aa, Homo Sapiens
SASQFSRWF

SEQ ID NO: 533990 - protein, 9 aa, Homo Sapiens
GYDPMELDP

SEQ ID NO: 533991 - protein, 9 aa, Homo Sapiens
FNAHEPFRQ

SEQ ID NO: 533992 - protein, 9 aa, Homo Sapiens
REAETLWER

SEQ ID NO: 533993 - protein, 9 aa, Homo Sapiens
AHEPFRQGT

SEQ ID NO: 533994 - protein, 9 aa, Homo Sapiens
LALTGMGLS

SEQ ID NO: 533995 - protein, 9 aa, Homo Sapiens
MSGMILGGN

SEQ ID NO: 533996 - protein, 9 aa, Homo Sapiens
TPVMLNSAA

SEQ ID NO: 533997 - protein, 9 aa, Homo Sapiens
TGYHQVCVY

SEQ ID NO: 533998 - protein, 9 aa, Homo Sapiens
QLMSGMILG

SEQ ID NO: 533999 - protein, 9 aa, Homo Sapiens
NIWDLTMAT

SEQ ID NO: 534000 - protein, 9 aa, Homo Sapiens
SNWTAMKEV

SEQ ID NO: 534001 - protein, 9 aa, Homo Sapiens
VAAMEQLVL

SEQ ID NO: 534002 - protein, 9 aa, Homo Sapiens
SKRVYNFCT

SEQ ID NO: 534003 - protein, 9 aa, Homo Sapiens
GRREPRSQP

SEQ ID NO: 534004 - protein, 9 aa, Homo Sapiens
ISQVLTRCF

SEQ ID NO: 534005 - protein, 9 aa, Homo Sapiens
EEKKCSLAT

SEQ ID NO: 534006 - protein, 9 aa, Homo Sapiens
EWFNHLSYL

SEQ ID NO: 534007 - protein, 9 aa, Homo Sapiens
YHHNAEERY

SEQ ID NO: 534008 - protein, 9 aa, Homo Sapiens
DHELFEIST

SEQ ID NO: 534009 - protein, 9 aa, Homo Sapiens
HTLPLPRRP

SEQ ID NO: 534010 - protein, 9 aa, Homo Sapiens
CDSKELRRR

SEQ ID NO: 534011 - protein, 9 aa, Homo Sapiens
MPAVPVTAV

SEQ ID NO: 534012 - protein, 9 aa, Homo Sapiens
PLGYECHIL

SEQ ID NO: 534013 - protein, 9 aa, Homo Sapiens
MDIFHLEGM

SEQ ID NO: 534014 - protein, 9 aa, Homo Sapiens
DISDWLEKE

SEQ ID NO: 534015 - protein, 9 aa, Homo Sapiens
VILGHYFQC

SEQ ID NO: 534016 - protein, 9 aa, Homo Sapiens
KCSLATCPD

SEQ ID NO: 534017 - protein, 9 aa, Homo Sapiens
HLRSLHRVQ

SEQ ID NO: 534018 - protein, 9 aa, Homo Sapiens
GTAGYNHAV

SEQ ID NO: 534019 - protein, 9 aa, Homo Sapiens
QKEECRAYI

SEQ ID NO: 534020 - protein, 9 aa, Homo Sapiens
HARSVQNFL

SEQ ID NO: 534021 - protein, 9 aa, Homo Sapiens
ILSNLGDFR

SEQ ID NO: 534022 - protein, 9 aa, Homo Sapiens
QMARVIFNW

SEQ ID NO: 534023 - protein, 9 aa, Homo Sapiens
GPTHHMDFL

SEQ ID NO: 534024 - protein, 9 aa, Homo Sapiens
PLPEGASFK

SEQ ID NO: 534025 - protein, 9 aa, Homo Sapiens
WQEEKIREQ

SEQ ID NO: 534026 - protein, 9 aa, Homo Sapiens
LGTTHLLHL

SEQ ID NO: 534027 - protein, 9 aa, Homo Sapiens
IYIWPFSRY

SEQ ID NO: 534028 - protein, 9 aa, Homo Sapiens
KLAHFRQAH

SEQ ID NO: 534029 - protein, 9 aa, Homo Sapiens
KGVETTGSQ

SEQ ID NO: 534030 - protein, 9 aa, Homo Sapiens
VETAHCTAG

SEQ ID NO: 534031 - protein, 9 aa, Homo Sapiens
GRTWCEDTR

SEQ ID NO: 534032 - protein, 9 aa, Homo Sapiens
PALKCLSLG

SEQ ID NO: 534033 - protein, 9 aa, Homo Sapiens
FLAKTYSTK

SEQ ID NO: 534034 - protein, 9 aa, Homo Sapiens
QLTPSMRNR

SEQ ID NO: 534035 - protein, 9 aa, Homo Sapiens
MSAVAPPPT

SEQ ID NO: 534036 - protein, 9 aa, Homo Sapiens
LGNPDILVG

SEQ ID NO: 534037 - protein, 9 aa, Homo Sapiens
RTQLALALS

SEQ ID NO: 534038 - protein, 9 aa, Homo Sapiens
EENREQKNN

SEQ ID NO: 534039 - protein, 9 aa, Homo Sapiens
AAPHRIILH

SEQ ID NO: 534040 - protein, 9 aa, Homo Sapiens
LGEAHVELD

SEQ ID NO: 534041 - protein, 9 aa, Homo Sapiens
STADRSMRK

SEQ ID NO: 534042 - protein, 9 aa, Homo Sapiens
TKDSTNRKH

SEQ ID NO: 534043 - protein, 9 aa, Homo Sapiens
DVPAGRKVG

SEQ ID NO: 534044 - protein, 9 aa, Homo Sapiens
NFCTQDGQS

SEQ ID NO: 534045 - protein, 9 aa, Homo Sapiens
DCKLPHVLS

SEQ ID NO: 534046 - protein, 9 aa, Homo Sapiens
KGVATGICI

SEQ ID NO: 534047 - protein, 9 aa, Homo Sapiens
SIESQDNDQ

SEQ ID NO: 534048 - protein, 9 aa, Homo Sapiens
WDGCSVLQR

SEQ ID NO: 534049 - protein, 9 aa, Homo Sapiens
HLTSPSAIP

SEQ ID NO: 534050 - protein, 9 aa, Homo Sapiens
SLCVRCSCP

SEQ ID NO: 534051 - protein, 9 aa, Homo Sapiens
SKVHWPKNI

SEQ ID NO: 534052 - protein, 9 aa, Homo Sapiens
YHSAPERTE

SEQ ID NO: 534053 - protein, 9 aa, Homo Sapiens
FIANNGTQE

SEQ ID NO: 534054 - protein, 9 aa, Homo Sapiens
EHSAELEQL

SEQ ID NO: 534055 - protein, 9 aa, Homo Sapiens
LRCIPTLDS

SEQ ID NO: 534056 - protein, 9 aa, Homo Sapiens
CWQREPQQQ

SEQ ID NO: 534057 - protein, 9 aa, Homo Sapiens
RVSTADRSM

SEQ ID NO: 534058 - protein, 9 aa, Homo Sapiens
QDHRCTAQQ

SEQ ID NO: 534059 - protein, 9 aa, Homo Sapiens
LMILADGRV

SEQ ID NO: 534060 - protein, 9 aa, Homo Sapiens
DSSSASAVT

SEQ ID NO: 534061 - protein, 9 aa, Homo Sapiens
EDTRHTACL

SEQ ID NO: 534062 - protein, 9 aa, Homo Sapiens
GVQYGARVA

SEQ ID NO: 534063 - protein, 9 aa, Homo Sapiens
PVHDQVLLL

SEQ ID NO: 534064 - protein, 9 aa, Homo Sapiens
HLLSDPSRN

SEQ ID NO: 534065 - protein, 9 aa, Homo Sapiens
FLKIDEYMH

SEQ ID NO: 534066 - protein, 9 aa, Homo Sapiens
GGVAHLLSP

SEQ ID NO: 534067 - protein, 9 aa, Homo Sapiens
HFEPGIYVC

SEQ ID NO: 534068 - protein, 9 aa, Homo Sapiens
LQKCFEPTG

SEQ ID NO: 534069 - protein, 9 aa, Homo Sapiens
GTSIQSVRE

SEQ ID NO: 534070 - protein, 9 aa, Homo Sapiens
TFCKIIRSH

SEQ ID NO: 534071 - protein, 9 aa, Homo Sapiens
GGHNKPKIT

SEQ ID NO: 534072 - protein, 9 aa, Homo Sapiens
ATEAGPLCK

SEQ ID NO: 534073 - protein, 9 aa, Homo Sapiens
LYYKAQTKD

SEQ ID NO: 534074 - protein, 9 aa, Homo Sapiens
TWCEDTRHT

SEQ ID NO: 534075 - protein, 9 aa, Homo Sapiens
HSVARFLKH

SEQ ID NO: 534076 - protein, 9 aa, Homo Sapiens
YTDSGARPV

SEQ ID NO: 534077 - protein, 9 aa, Homo Sapiens
ALLRCIPTL

SEQ ID NO: 534078 - protein, 9 aa, Homo Sapiens
SFVSGGRDK

SEQ ID NO: 534079 - protein, 9 aa, Homo Sapiens
GPGWALWPR

SEQ ID NO: 534080 - protein, 9 aa, Homo Sapiens
SCNKCVTSF

SEQ ID NO: 534081 - protein, 9 aa, Homo Sapiens
LQQQEEENK

SEQ ID NO: 534082 - protein, 9 aa, Homo Sapiens
GIYVCAKCG

SEQ ID NO: 534083 - protein, 9 aa, Homo Sapiens
TPELLGVMQ

SEQ ID NO: 534084 - protein, 9 aa, Homo Sapiens
HTLPPKKKL

SEQ ID NO: 534085 - protein, 9 aa, Homo Sapiens
DLVIMDLLE

SEQ ID NO: 534086 - protein, 9 aa, Homo Sapiens
AEFLVYQCE

SEQ ID NO: 534087 - protein, 9 aa, Homo Sapiens
RPAKAVATQ

SEQ ID NO: 534088 - protein, 9 aa, Homo Sapiens
LWKEEYQGV

SEQ ID NO: 534089 - protein, 9 aa, Homo Sapiens
GHLGNQMGE

SEQ ID NO: 534090 - protein, 9 aa, Homo Sapiens
RHSGTAPRT

SEQ ID NO: 534091 - protein, 9 aa, Homo Sapiens
KECGKAFCR

SEQ ID NO: 534092 - protein, 9 aa, Homo Sapiens
FCLETHECF

SEQ ID NO: 534093 - protein, 9 aa, Homo Sapiens
LHVTHSLQD

SEQ ID NO: 534094 - protein, 9 aa, Homo Sapiens
EIVTAATTE

SEQ ID NO: 534095 - protein, 9 aa, Homo Sapiens
QECGRAYSC

SEQ ID NO: 534096 - protein, 9 aa, Homo Sapiens
PSTSEYLRI

SEQ ID NO: 534097 - protein, 9 aa, Homo Sapiens
AACDTFCAG

SEQ ID NO: 534098 - protein, 9 aa, Homo Sapiens
NTRCAHPLC

SEQ ID NO: 534099 - protein, 9 aa, Homo Sapiens
PQQQLNIKE

SEQ ID NO: 534100 - protein, 9 aa, Homo Sapiens
RKLQEENRE

SEQ ID NO: 534101 - protein, 9 aa, Homo Sapiens
KREQKLKFK

SEQ ID NO: 534102 - protein, 9 aa, Homo Sapiens
QLAVILAAP

SEQ ID NO: 534103 - protein, 9 aa, Homo Sapiens
RRAAKEAER

SEQ ID NO: 534104 - protein, 9 aa, Homo Sapiens
QMAPEDQEK

SEQ ID NO: 534105 - protein, 9 aa, Homo Sapiens
LQEVLLDIT

SEQ ID NO: 534106 - protein, 9 aa, Homo Sapiens
STDQENGEI

SEQ ID NO: 534107 - protein, 9 aa, Homo Sapiens
CLEEAAQER

SEQ ID NO: 534108 - protein, 9 aa, Homo Sapiens
IAAMRRRDF

SEQ ID NO: 534109 - protein, 9 aa, Homo Sapiens
RSRGFPDTY

SEQ ID NO: 534110 - protein, 9 aa, Homo Sapiens
SLQEEALQR

SEQ ID NO: 534111 - protein, 9 aa, Homo Sapiens
ATAGVEPMF

SEQ ID NO: 534112 - protein, 9 aa, Homo Sapiens
RAATAPVVT

SEQ ID NO: 534113 - protein, 9 aa, Homo Sapiens
LPLASTLQP

SEQ ID NO: 534114 - protein, 9 aa, Homo Sapiens
GAGGVASQE

SEQ ID NO: 534115 - protein, 9 aa, Homo Sapiens
NFWPGIGGP

SEQ ID NO: 534116 - protein, 9 aa, Homo Sapiens
RAWSSLTHC

SEQ ID NO: 534117 - protein, 9 aa, Homo Sapiens
GADVFLYNA

SEQ ID NO: 534118 - protein, 9 aa, Homo Sapiens
LKQMCCLPG

SEQ ID NO: 534119 - protein, 9 aa, Homo Sapiens
HECFNPIVN

SEQ ID NO: 534120 - protein, 9 aa, Homo Sapiens
AVPHAPDAV

SEQ ID NO: 534121 - protein, 9 aa, Homo Sapiens
SQVLTRCFG

SEQ ID NO: 534122 - protein, 9 aa, Homo Sapiens
SLTHCLVTC

SEQ ID NO: 534123 - protein, 9 aa, Homo Sapiens
LHRSQQECK

SEQ ID NO: 534124 - protein, 9 aa, Homo Sapiens
CPPKDTSTQ

SEQ ID NO: 534125 - protein, 9 aa, Homo Sapiens
NLGYTTASP

SEQ ID NO: 534126 - protein, 9 aa, Homo Sapiens
LESAAMIRT

SEQ ID NO: 534127 - protein, 9 aa, Homo Sapiens
QEGCAARRN

SEQ ID NO: 534128 - protein, 9 aa, Homo Sapiens
PRNLGSFPS

SEQ ID NO: 534129 - protein, 9 aa, Homo Sapiens
WTINAIGHL

SEQ ID NO: 534130 - protein, 9 aa, Homo Sapiens
LEKLQAKLQ

SEQ ID NO: 534131 - protein, 9 aa, Homo Sapiens
DVQYAVSMA

SEQ ID NO: 534132 - protein, 9 aa, Homo Sapiens
RRKPLFCGS

SEQ ID NO: 534133 - protein, 9 aa, Homo Sapiens
FQDMVLAYR

SEQ ID NO: 534134 - protein, 9 aa, Homo Sapiens
CYPHTKKIK

SEQ ID NO: 534135 - protein, 9 aa, Homo Sapiens
RGSPPQLMH

SEQ ID NO: 534136 - protein, 9 aa, Homo Sapiens
RSSDRNKDH

SEQ ID NO: 534137 - protein, 9 aa, Homo Sapiens
ELEQLCSSL

SEQ ID NO: 534138 - protein, 9 aa, Homo Sapiens
NIHGCYPHT

SEQ ID NO: 534139 - protein, 9 aa, Homo Sapiens
RYRNRSLSD

SEQ ID NO: 534140 - protein, 9 aa, Homo Sapiens
GKMPVYDLL

SEQ ID NO: 534141 - protein, 9 aa, Homo Sapiens
LGLEEVQLT

SEQ ID NO: 534142 - protein, 9 aa, Homo Sapiens
EVDGGDIQK

SEQ ID NO: 534143 - protein, 9 aa, Homo Sapiens
LASRAYVAP

SEQ ID NO: 534144 - protein, 9 aa, Homo Sapiens
MKTAERDVV

SEQ ID NO: 534145 - protein, 9 aa, Homo Sapiens
SRAYFFNNP

SEQ ID NO: 534146 - protein, 9 aa, Homo Sapiens
SKELRRRRR

SEQ ID NO: 534147 - protein, 9 aa, Homo Sapiens
ILEKGMEGR

SEQ ID NO: 534148 - protein, 9 aa, Homo Sapiens
TVSQFPPLH

SEQ ID NO: 534149 - protein, 9 aa, Homo Sapiens
NAEFIPMHD

SEQ ID NO: 534150 - protein, 9 aa, Homo Sapiens
PWVWNIFIV

SEQ ID NO: 534151 - protein, 9 aa, Homo Sapiens
PCKKVSAAP

SEQ ID NO: 534152 - protein, 9 aa, Homo Sapiens
TVFWNVFAY

SEQ ID NO: 534153 - protein, 9 aa, Homo Sapiens
NKCVTSFKD

SEQ ID NO: 534154 - protein, 9 aa, Homo Sapiens
IPMSPVRPK

SEQ ID NO: 534155 - protein, 9 aa, Homo Sapiens
RCFARYLAM

SEQ ID NO: 534156 - protein, 9 aa, Homo Sapiens
IEEQYKASQ

SEQ ID NO: 534157 - protein, 9 aa, Homo Sapiens
PPLHMPGLE

SEQ ID NO: 534158 - protein, 9 aa, Homo Sapiens
VTGNTFEVH

SEQ ID NO: 534159 - protein, 9 aa, Homo Sapiens
QDRDRDRDR

SEQ ID NO: 534160 - protein, 9 aa, Homo Sapiens
KCVTSFKDN

SEQ ID NO: 534161 - protein, 9 aa, Homo Sapiens
AKLQGAVRT

SEQ ID NO: 534162 - protein, 9 aa, Homo Sapiens
FPMEMMICL

SEQ ID NO: 534163 - protein, 9 aa, Homo Sapiens
PFHSPERDQ

SEQ ID NO: 534164 - protein, 9 aa, Homo Sapiens
RNEKMEVSR

SEQ ID NO: 534165 - protein, 9 aa, Homo Sapiens
VGPRDIHLT

SEQ ID NO: 534166 - protein, 9 aa, Homo Sapiens
PKNILKQWL

SEQ ID NO: 534167 - protein, 9 aa, Homo Sapiens
NSASCMTVS

SEQ ID NO: 534168 - protein, 9 aa, Homo Sapiens
SVEVPSSNI

SEQ ID NO: 534169 - protein, 9 aa, Homo Sapiens
QYTAELHLN

SEQ ID NO: 534170 - protein, 9 aa, Homo Sapiens
LKREAETLW

SEQ ID NO: 534171 - protein, 9 aa, Homo Sapiens
EGSVSASQF

SEQ ID NO: 534172 - protein, 9 aa, Homo Sapiens
VEPMFSGGQ

SEQ ID NO: 534173 - protein, 9 aa, Homo Sapiens
SGIGGATNL

SEQ ID NO: 534174 - protein, 9 aa, Homo Sapiens
PSTFPAPWW

SEQ ID NO: 534175 - protein, 9 aa, Homo Sapiens
WASDDCKLP

SEQ ID NO: 534176 - protein, 9 aa, Homo Sapiens
NFFRQVVIN

SEQ ID NO: 534177 - protein, 9 aa, Homo Sapiens
CFEYKGEKV

SEQ ID NO: 534178 - protein, 9 aa, Homo Sapiens
VDCPTFLDK

SEQ ID NO: 534179 - protein, 9 aa, Homo Sapiens
GPASGPTGL

SEQ ID NO: 534180 - protein, 9 aa, Homo Sapiens
VVFGTMFFN

SEQ ID NO: 534181 - protein, 9 aa, Homo Sapiens
PAEPCVLCQ

SEQ ID NO: 534182 - protein, 9 aa, Homo Sapiens
NVRSTDQEN

SEQ ID NO: 534183 - protein, 9 aa, Homo Sapiens
NHGWCGGRR

SEQ ID NO: 534184 - protein, 9 aa, Homo Sapiens
GAAFSATPV

SEQ ID NO: 534185 - protein, 9 aa, Homo Sapiens
INRASRALD

SEQ ID NO: 534186 - protein, 9 aa, Homo Sapiens
YVDRVFHTI

SEQ ID NO: 534187 - protein, 9 aa, Homo Sapiens
PPNPNVKYI

SEQ ID NO: 534188 - protein, 9 aa, Homo Sapiens
YFYTNEAKC

SEQ ID NO: 534189 - protein, 9 aa, Homo Sapiens
VTVLFPLAL

SEQ ID NO: 534190 - protein, 9 aa, Homo Sapiens
INCYDCVCQ

SEQ ID NO: 534191 - protein, 9 aa, Homo Sapiens
PQMNTPVML

SEQ ID NO: 534192 - protein, 9 aa, Homo Sapiens
EHGEKGDRG

SEQ ID NO: 534193 - protein, 9 aa, Homo Sapiens
KRMWHLSTG

SEQ ID NO: 534194 - protein, 9 aa, Homo Sapiens
PPGRLYAWG

SEQ ID NO: 534195 - protein, 9 aa, Homo Sapiens
WGSGTEEAN

SEQ ID NO: 534196 - protein, 9 aa, Homo Sapiens
DNFIAAMRR

SEQ ID NO: 534197 - protein, 9 aa, Homo Sapiens
PDKTAPLPG

SEQ ID NO: 534198 - protein, 9 aa, Homo Sapiens
VATQKKVER

SEQ ID NO: 534199 - protein, 9 aa, Homo Sapiens
SLTMNLYEG

SEQ ID NO: 534200 - protein, 9 aa, Homo Sapiens
PTPHGKDPL

SEQ ID NO: 534201 - protein, 9 aa, Homo Sapiens
PGRRQPCKK

SEQ ID NO: 534202 - protein, 9 aa, Homo Sapiens
FLTFSFLSG

SEQ ID NO: 534203 - protein, 9 aa, Homo Sapiens
VHITNNTNK

SEQ ID NO: 534204 - protein, 9 aa, Homo Sapiens
GMILGGNNP

SEQ ID NO: 534205 - protein, 9 aa, Homo Sapiens
KKMLKPTGR

SEQ ID NO: 534206 - protein, 9 aa, Homo Sapiens
PDMHKQRGK

SEQ ID NO: 534207 - protein, 9 aa, Homo Sapiens
PAQAPGTLQ

SEQ ID NO: 534208 - protein, 9 aa, Homo Sapiens
GAMRRFLPS

SEQ ID NO: 534209 - protein, 9 aa, Homo Sapiens
YVIGQEKVK

SEQ ID NO: 534210 - protein, 9 aa, Homo Sapiens
SASAVTPSK

SEQ ID NO: 534211 - protein, 9 aa, Homo Sapiens
GSLSLDDFW

SEQ ID NO: 534212 - protein, 9 aa, Homo Sapiens
CKQGLCCTY

SEQ ID NO: 534213 - protein, 9 aa, Homo Sapiens
VQEMRRLQL

SEQ ID NO: 534214 - protein, 9 aa, Homo Sapiens
EKKCSLATC

SEQ ID NO: 534215 - protein, 9 aa, Homo Sapiens
VVERNACVI

SEQ ID NO: 534216 - protein, 9 aa, Homo Sapiens
ECQDHRCTA

SEQ ID NO: 534217 - protein, 9 aa, Homo Sapiens
LGLKVDKDC

SEQ ID NO: 534218 - protein, 9 aa, Homo Sapiens
IYGWIEREH

SEQ ID NO: 534219 - protein, 9 aa, Homo Sapiens
FFRQVVINP

SEQ ID NO: 534220 - protein, 9 aa, Homo Sapiens
RSVQNFLYI

SEQ ID NO: 534221 - protein, 9 aa, Homo Sapiens
KKCRNEKME

SEQ ID NO: 534222 - protein, 9 aa, Homo Sapiens
MLRYQANNC

SEQ ID NO: 534223 - protein, 9 aa, Homo Sapiens
SQVCPPKDT

SEQ ID NO: 534224 - protein, 9 aa, Homo Sapiens
NGADVFLYN

SEQ ID NO: 534225 - protein, 9 aa, Homo Sapiens
LVALMLARK

SEQ ID NO: 534226 - protein, 9 aa, Homo Sapiens
IFNWDGCSV

SEQ ID NO: 534227 - protein, 9 aa, Homo Sapiens
NPASFIGGQ

SEQ ID NO: 534228 - protein, 9 aa, Homo Sapiens
VYTKGADLV

SEQ ID NO: 534229 - protein, 9 aa, Homo Sapiens
PPSGDLQLV

SEQ ID NO: 534230 - protein, 9 aa, Homo Sapiens
LAEKALNQT

SEQ ID NO: 534231 - protein, 9 aa, Homo Sapiens
MHDSPSPLS

SEQ ID NO: 534232 - protein, 9 aa, Homo Sapiens
CRHRCCGCN

SEQ ID NO: 534233 - protein, 9 aa, Homo Sapiens
GRGQCIFVE

SEQ ID NO: 534234 - protein, 9 aa, Homo Sapiens
WRDNHGWCG

SEQ ID NO: 534235 - protein, 9 aa, Homo Sapiens
MREERKQAR

SEQ ID NO: 534236 - protein, 9 aa, Homo Sapiens
LRHQGSVTT

SEQ ID NO: 534237 - protein, 9 aa, Homo Sapiens
YIQMLRKLF

SEQ ID NO: 534238 - protein, 9 aa, Homo Sapiens
ICEAVPGAK

SEQ ID NO: 534239 - protein, 9 aa, Homo Sapiens
WFILVLNEK

SEQ ID NO: 534240 - protein, 9 aa, Homo Sapiens
RTGDQATDS

SEQ ID NO: 534241 - protein, 9 aa, Homo Sapiens
EMGKEGRRE

SEQ ID NO: 534242 - protein, 9 aa, Homo Sapiens
DDKSEGSSQ

SEQ ID NO: 534243 - protein, 9 aa, Homo Sapiens
PLGEGRFSI

SEQ ID NO: 534244 - protein, 9 aa, Homo Sapiens
KADAWDVDT

SEQ ID NO: 534245 - protein, 9 aa, Homo Sapiens
NQCLELGIG

SEQ ID NO: 534246 - protein, 9 aa, Homo Sapiens
EMWWQEEKI

SEQ ID NO: 534247 - protein, 9 aa, Homo Sapiens
GYTTASPQA

SEQ ID NO: 534248 - protein, 9 aa, Homo Sapiens
PLDRRVQSK

SEQ ID NO: 534249 - protein, 9 aa, Homo Sapiens
IQWHWQPWT

SEQ ID NO: 534250 - protein, 9 aa, Homo Sapiens
TSATCQVQT

SEQ ID NO: 534251 - protein, 9 aa, Homo Sapiens
VCPKGFRLS

SEQ ID NO: 534252 - protein, 9 aa, Homo Sapiens
VCPPKDTST

SEQ ID NO: 534253 - protein, 9 aa, Homo Sapiens
THSHVLVDS

SEQ ID NO: 534254 - protein, 9 aa, Homo Sapiens
GYSRLVALM

SEQ ID NO: 534255 - protein, 9 aa, Homo Sapiens
FTQRERFHR

SEQ ID NO: 534256 - protein, 9 aa, Homo Sapiens
YVLDLVLDL

SEQ ID NO: 534257 - protein, 9 aa, Homo Sapiens
ELQEEHACL

SEQ ID NO: 534258 - protein, 9 aa, Homo Sapiens
VELARYEPD

SEQ ID NO: 534259 - protein, 9 aa, Homo Sapiens
REMWRSASE

SEQ ID NO: 534260 - protein, 9 aa, Homo Sapiens
YVARLREGR

SEQ ID NO: 534261 - protein, 9 aa, Homo Sapiens
TLGNPDILV

SEQ ID NO: 534262 - protein, 9 aa, Homo Sapiens
LAKTYSTKD

SEQ ID NO: 534263 - protein, 9 aa, Homo Sapiens
RHIHIRSLK

SEQ ID NO: 534264 - protein, 9 aa, Homo Sapiens
FWNTQKRGE

SEQ ID NO: 534265 - protein, 9 aa, Homo Sapiens
RTLMVGDRP

SEQ ID NO: 534266 - protein, 9 aa, Homo Sapiens
HLSYLVATE

SEQ ID NO: 534267 - protein, 9 aa, Homo Sapiens
TCSWVLVFC

SEQ ID NO: 534268 - protein, 9 aa, Homo Sapiens
GVGPFVETS

SEQ ID NO: 534269 - protein, 9 aa, Homo Sapiens
ICTTVPKMT

SEQ ID NO: 534270 - protein, 9 aa, Homo Sapiens
SLDAKTSSH

SEQ ID NO: 534271 - protein, 9 aa, Homo Sapiens
QIWGPQSQP

SEQ ID NO: 534272 - protein, 9 aa, Homo Sapiens
HNRELQDKL

SEQ ID NO: 534273 - protein, 9 aa, Homo Sapiens
YVIPRPHFS

SEQ ID NO: 534274 - protein, 9 aa, Homo Sapiens
ICDANNFVL

SEQ ID NO: 534275 - protein, 9 aa, Homo Sapiens
KGWFCLLPF

SEQ ID NO: 534276 - protein, 9 aa, Homo Sapiens
TMHTDKEPV

SEQ ID NO: 534277 - protein, 9 aa, Homo Sapiens
YHHREFWFD

SEQ ID NO: 534278 - protein, 9 aa, Homo Sapiens
VVHKRCREF

SEQ ID NO: 534279 - protein, 9 aa, Homo Sapiens
INNVLVSLS

SEQ ID NO: 534280 - protein, 9 aa, Homo Sapiens
KMKMFIPNL

SEQ ID NO: 534281 - protein, 9 aa, Homo Sapiens
LLDVNNQCL

SEQ ID NO: 534282 - protein, 9 aa, Homo Sapiens
KELRRRRRS

SEQ ID NO: 534283 - protein, 9 aa, Homo Sapiens
ANNGTQEGC

SEQ ID NO: 534284 - protein, 9 aa, Homo Sapiens
AWALKTLRS

SEQ ID NO: 534285 - protein, 9 aa, Homo Sapiens
HLNNNEFTV

SEQ ID NO: 534286 - protein, 9 aa, Homo Sapiens
EAYVEWFNH

SEQ ID NO: 534287 - protein, 9 aa, Homo Sapiens
EPLRPWCRP

SEQ ID NO: 534288 - protein, 9 aa, Homo Sapiens
HQLISLERQ

SEQ ID NO: 534289 - protein, 9 aa, Homo Sapiens
ITMMCNEFF

SEQ ID NO: 534290 - protein, 9 aa, Homo Sapiens
LLSEIVGTT

SEQ ID NO: 534291 - protein, 9 aa, Homo Sapiens
QKLKFKDQL

SEQ ID NO: 534292 - protein, 9 aa, Homo Sapiens
SHLGVLTVA

SEQ ID NO: 534293 - protein, 9 aa, Homo Sapiens
AQERDGLEQ

SEQ ID NO: 534294 - protein, 9 aa, Homo Sapiens
QQVLDRYHC

SEQ ID NO: 534295 - protein, 9 aa, Homo Sapiens
GQLRWGPAP

SEQ ID NO: 534296 - protein, 9 aa, Homo Sapiens
THNITQGIV

SEQ ID NO: 534297 - protein, 9 aa, Homo Sapiens
WRPPWASVT

SEQ ID NO: 534298 - protein, 9 aa, Homo Sapiens
MTFNYLSGS

SEQ ID NO: 534299 - protein, 9 aa, Homo Sapiens
RTRLGEAHV

SEQ ID NO: 534300 - protein, 9 aa, Homo Sapiens
IGQEKVKKG

SEQ ID NO: 534301 - protein, 9 aa, Homo Sapiens
IPVGKEELV

SEQ ID NO: 534302 - protein, 9 aa, Homo Sapiens
LIAACDTFC

SEQ ID NO: 534303 - protein, 9 aa, Homo Sapiens
RPLLPDHRR

SEQ ID NO: 534304 - protein, 9 aa, Homo Sapiens
RALYLLAPS

SEQ ID NO: 534305 - protein, 9 aa, Homo Sapiens
PQEQNQTKH

SEQ ID NO: 534306 - protein, 9 aa, Homo Sapiens
PLLCPLGYE

SEQ ID NO: 534307 - protein, 9 aa, Homo Sapiens
VAPPPTSNG

SEQ ID NO: 534308 - protein, 9 aa, Homo Sapiens
SRLVALMLA

SEQ ID NO: 534309 - protein, 9 aa, Homo Sapiens
INEEKFARI

SEQ ID NO: 534310 - protein, 9 aa, Homo Sapiens
SESHRKQAE

SEQ ID NO: 534311 - protein, 9 aa, Homo Sapiens
AAMEQLVLM

SEQ ID NO: 534312 - protein, 9 aa, Homo Sapiens
ACKRIRLGR

SEQ ID NO: 534313 - protein, 9 aa, Homo Sapiens
YMFIQMLSS

SEQ ID NO: 534314 - protein, 9 aa, Homo Sapiens
NQHWHSVLI

SEQ ID NO: 534315 - protein, 9 aa, Homo Sapiens
PETLPSMEE

SEQ ID NO: 534316 - protein, 9 aa, Homo Sapiens
QDTSLIPNV

SEQ ID NO: 534317 - protein, 9 aa, Homo Sapiens
FNHLSYLVA

SEQ ID NO: 534318 - protein, 9 aa, Homo Sapiens
NKDHSRSRE

SEQ ID NO: 534319 - protein, 9 aa, Homo Sapiens
DEVDGGDIQ

SEQ ID NO: 534320 - protein, 9 aa, Homo Sapiens
DFTNPKARE

SEQ ID NO: 534321 - protein, 9 aa, Homo Sapiens
VWTMVSATH

SEQ ID NO: 534322 - protein, 9 aa, Homo Sapiens
LQHLQRRKN

SEQ ID NO: 534323 - protein, 9 aa, Homo Sapiens
AFGGEEEEQ

SEQ ID NO: 534324 - protein, 9 aa, Homo Sapiens
YELAWKERQ

SEQ ID NO: 534325 - protein, 9 aa, Homo Sapiens
SPSPTTEVR

SEQ ID NO: 534326 - protein, 9 aa, Homo Sapiens
RAPCAASTE

SEQ ID NO: 534327 - protein, 9 aa, Homo Sapiens
FTGPRRRNR

SEQ ID NO: 534328 - protein, 9 aa, Homo Sapiens
RAPIWGDMV

SEQ ID NO: 534329 - protein, 9 aa, Homo Sapiens
GTAPRTEPM

SEQ ID NO: 534330 - protein, 9 aa, Homo Sapiens
NQLRSLQEE

SEQ ID NO: 534331 - protein, 9 aa, Homo Sapiens
QLNIKEIYK

SEQ ID NO: 534332 - protein, 9 aa, Homo Sapiens
AEGANLRTV

SEQ ID NO: 534333 - protein, 9 aa, Homo Sapiens
TTHLLHLTS

SEQ ID NO: 534334 - protein, 9 aa, Homo Sapiens
VEWFNHLSY

SEQ ID NO: 534335 - protein, 9 aa, Homo Sapiens
SNSKLKLVH

SEQ ID NO: 534336 - protein, 9 aa, Homo Sapiens
GRAYSCRSH

SEQ ID NO: 534337 - protein, 9 aa, Homo Sapiens
SLVLFSRFR

SEQ ID NO: 534338 - protein, 9 aa, Homo Sapiens
GITFKCVGV

SEQ ID NO: 534339 - protein, 9 aa, Homo Sapiens
VSCFEYKGE

SEQ ID NO: 534340 - protein, 9 aa, Homo Sapiens
MTEERRKVG

SEQ ID NO: 534341 - protein, 9 aa, Homo Sapiens
LLESKCVQA

SEQ ID NO: 534342 - protein, 9 aa, Homo Sapiens
CVIKWLYGL

SEQ ID NO: 534343 - protein, 9 aa, Homo Sapiens
VIPRPHFST

SEQ ID NO: 534344 - protein, 9 aa, Homo Sapiens
QKAGITFKC

SEQ ID NO: 534345 - protein, 9 aa, Homo Sapiens
QQQEEENKA

SEQ ID NO: 534346 - protein, 9 aa, Homo Sapiens
VCVYDPASP

SEQ ID NO: 534347 - protein, 9 aa, Homo Sapiens
ELSCQETNR

SEQ ID NO: 534348 - protein, 9 aa, Homo Sapiens
GESQLSKVH

SEQ ID NO: 534349 - protein, 9 aa, Homo Sapiens
FSATPVGAL

SEQ ID NO: 534350 - protein, 9 aa, Homo Sapiens
VLKPYQGST

SEQ ID NO: 534351 - protein, 9 aa, Homo Sapiens
LQHQMSFAS

SEQ ID NO: 534352 - protein, 9 aa, Homo Sapiens
GKEGRREPR

SEQ ID NO: 534353 - protein, 9 aa, Homo Sapiens
QAKLQGAVR

SEQ ID NO: 534354 - protein, 9 aa, Homo Sapiens
SNLGDFRFL

SEQ ID NO: 534355 - protein, 9 aa, Homo Sapiens
EVWGKPRPP

SEQ ID NO: 534356 - protein, 9 aa, Homo Sapiens
VLMAMNEFS

SEQ ID NO: 534357 - protein, 9 aa, Homo Sapiens
QKCFEPTGF

SEQ ID NO: 534358 - protein, 9 aa, Homo Sapiens
SFLSGFQES

SEQ ID NO: 534359 - protein, 9 aa, Homo Sapiens
RGFPDTYRL

SEQ ID NO: 534360 - protein, 9 aa, Homo Sapiens
RRQPCKKVS

SEQ ID NO: 534361 - protein, 9 aa, Homo Sapiens
IVGGANYYF

SEQ ID NO: 534362 - protein, 9 aa, Homo Sapiens
GLWTDISAH

SEQ ID NO: 534363 - protein, 9 aa, Homo Sapiens
QVCVYDPAS

SEQ ID NO: 534364 - protein, 9 aa, Homo Sapiens
DAKKQLANI

SEQ ID NO: 534365 - protein, 9 aa, Homo Sapiens
GNTFEVHIY

SEQ ID NO: 534366 - protein, 9 aa, Homo Sapiens
GLGELSQGF

SEQ ID NO: 534367 - protein, 9 aa, Homo Sapiens
AATISTSPV

SEQ ID NO: 534368 - protein, 9 aa, Homo Sapiens
NMGMALHKK

SEQ ID NO: 534369 - protein, 9 aa, Homo Sapiens
IGDNTFTGL

SEQ ID NO: 534370 - protein, 9 aa, Homo Sapiens
VQLISRKTL

SEQ ID NO: 534371 - protein, 9 aa, Homo Sapiens
QDGENQSMY

SEQ ID NO: 534372 - protein, 9 aa, Homo Sapiens
PSPAFHAVR

SEQ ID NO: 534373 - protein, 9 aa, Homo Sapiens
AVKRMWHLS

SEQ ID NO: 534374 - protein, 9 aa, Homo Sapiens
QLAHYTKRM

SEQ ID NO: 534375 - protein, 9 aa, Homo Sapiens
DRKLQEENR

SEQ ID NO: 534376 - protein, 9 aa, Homo Sapiens
DEADLQAKA

SEQ ID NO: 534377 - protein, 9 aa, Homo Sapiens
AEPSTSEYL

SEQ ID NO: 534378 - protein, 9 aa, Homo Sapiens
LQYLAIMTW

SEQ ID NO: 534379 - protein, 9 aa, Homo Sapiens
RHRCCGCNC

SEQ ID NO: 534380 - protein, 9 aa, Homo Sapiens
MSGADTIGD

SEQ ID NO: 534381 - protein, 9 aa, Homo Sapiens
TLDHHLYEA

SEQ ID NO: 534382 - protein, 9 aa, Homo Sapiens
MTSRSRRLQ

SEQ ID NO: 534383 - protein, 9 aa, Homo Sapiens
SWVLVFCLL

SEQ ID NO: 534384 - protein, 9 aa, Homo Sapiens
YNRNSWVRE

SEQ ID NO: 534385 - protein, 9 aa, Homo Sapiens
CQQLTAELQ

SEQ ID NO: 534386 - protein, 9 aa, Homo Sapiens
GTTSMLTMN

SEQ ID NO: 534387 - protein, 9 aa, Homo Sapiens
RRKERVKSK

SEQ ID NO: 534388 - protein, 9 aa, Homo Sapiens
QLISLERQF

SEQ ID NO: 534389 - protein, 9 aa, Homo Sapiens
MHVTVRVAV

SEQ ID NO: 534390 - protein, 9 aa, Homo Sapiens
RRVQSKDWP

SEQ ID NO: 534391 - protein, 9 aa, Homo Sapiens
LVLFSRFRS

SEQ ID NO: 534392 - protein, 9 aa, Homo Sapiens
DRYHCFKEL

SEQ ID NO: 534393 - protein, 9 aa, Homo Sapiens
STPGAFLLR

SEQ ID NO: 534394 - protein, 9 aa, Homo Sapiens
ADSLQEVLL

SEQ ID NO: 534395 - protein, 9 aa, Homo Sapiens
SGHTPYKCK

SEQ ID NO: 534396 - protein, 9 aa, Homo Sapiens
VVHFVSDAT

SEQ ID NO: 534397 - protein, 9 aa, Homo Sapiens
ASALWHEEQ

SEQ ID NO: 534398 - protein, 9 aa, Homo Sapiens
LSPAVANER

SEQ ID NO: 534399 - protein, 9 aa, Homo Sapiens
VAGEAGSKQ

SEQ ID NO: 534400 - protein, 9 aa, Homo Sapiens
YAQQLIEEK

SEQ ID NO: 534401 - protein, 9 aa, Homo Sapiens
SAAVENPTA

SEQ ID NO: 534402 - protein, 9 aa, Homo Sapiens
VPSSSSNLS

SEQ ID NO: 534403 - protein, 9 aa, Homo Sapiens
EEAAQERDG

SEQ ID NO: 534404 - protein, 9 aa, Homo Sapiens
ENREAKTDP

SEQ ID NO: 534405 - protein, 9 aa, Homo Sapiens
PCNVSVTMS

SEQ ID NO: 534406 - protein, 9 aa, Homo Sapiens
CLGPTHHMD

SEQ ID NO: 534407 - protein, 9 aa, Homo Sapiens
HWQPWTPCK

SEQ ID NO: 534408 - protein, 9 aa, Homo Sapiens
KRRTWGLSR

SEQ ID NO: 534409 - protein, 9 aa, Homo Sapiens
VKTTSRDYV

SEQ ID NO: 534410 - protein, 9 aa, Homo Sapiens
LSERRRKCL

SEQ ID NO: 534411 - protein, 9 aa, Homo Sapiens
DKDCEECQK

SEQ ID NO: 534412 - protein, 9 aa, Homo Sapiens
HRQRKSEKR

SEQ ID NO: 534413 - protein, 9 aa, Homo Sapiens
AKEAERQRQ

SEQ ID NO: 534414 - protein, 9 aa, Homo Sapiens
PECQDHRCT

SEQ ID NO: 534415 - protein, 9 aa, Homo Sapiens
GLKYHYQWC

SEQ ID NO: 534416 - protein, 9 aa, Homo Sapiens
SCQNLGYTT

SEQ ID NO: 534417 - protein, 9 aa, Homo Sapiens
HWKTQHSEE

SEQ ID NO: 534418 - protein, 9 aa, Homo Sapiens
VLASRAYVA

SEQ ID NO: 534419 - protein, 9 aa, Homo Sapiens
CAGAVEQLR

SEQ ID NO: 534420 - protein, 9 aa, Homo Sapiens
ATTESGDLE

SEQ ID NO: 534421 - protein, 9 aa, Homo Sapiens
ITNNTNKTV

SEQ ID NO: 534422 - protein, 9 aa, Homo Sapiens
LYAWGERFR

SEQ ID NO: 534423 - protein, 9 aa, Homo Sapiens
DTDYSLALV

SEQ ID NO: 534424 - protein, 9 aa, Homo Sapiens
CVNVIFVRD

SEQ ID NO: 534425 - protein, 9 aa, Homo Sapiens
LSIGARYYC

SEQ ID NO: 534426 - protein, 9 aa, Homo Sapiens
SSSRGTERS

SEQ ID NO: 534427 - protein, 9 aa, Homo Sapiens
KVFTKAAVR

SEQ ID NO: 534428 - protein, 9 aa, Homo Sapiens
TSKAVLMGT

SEQ ID NO: 534429 - protein, 9 aa, Homo Sapiens
AGYRLHRHQ

SEQ ID NO: 534430 - protein, 9 aa, Homo Sapiens
KVVHFVSDA

SEQ ID NO: 534431 - protein, 9 aa, Homo Sapiens
RNKDHSRSR

SEQ ID NO: 534432 - protein, 9 aa, Homo Sapiens
RNGNQLRSL

SEQ ID NO: 534433 - protein, 9 aa, Homo Sapiens
PLSPAVANE

SEQ ID NO: 534434 - protein, 9 aa, Homo Sapiens
KTTSRDYVV

SEQ ID NO: 534435 - protein, 9 aa, Homo Sapiens
IGHLGNQMG

SEQ ID NO: 534436 - protein, 9 aa, Homo Sapiens
GAFLLRNPA

SEQ ID NO: 534437 - protein, 9 aa, Homo Sapiens
SKTKVPVHD

SEQ ID NO: 534438 - protein, 9 aa, Homo Sapiens
HLGESVSLN

SEQ ID NO: 534439 - protein, 9 aa, Homo Sapiens
QQQMAANQA

SEQ ID NO: 534440 - protein, 9 aa, Homo Sapiens
LGYKTLAMG

SEQ ID NO: 534441 - protein, 9 aa, Homo Sapiens
FHSPERDQD

SEQ ID NO: 534442 - protein, 9 aa, Homo Sapiens
NSFLNYNIS

SEQ ID NO: 534443 - protein, 9 aa, Homo Sapiens
IQSVREVAE

SEQ ID NO: 534444 - protein, 9 aa, Homo Sapiens
WEWQRQEER

SEQ ID NO: 534445 - protein, 9 aa, Homo Sapiens
RKCLQELEG

SEQ ID NO: 534446 - protein, 9 aa, Homo Sapiens
MWWQEEKIR

SEQ ID NO: 534447 - protein, 9 aa, Homo Sapiens
EVEWGSGTE

SEQ ID NO: 534448 - protein, 9 aa, Homo Sapiens
DADKEKELQ

SEQ ID NO: 534449 - protein, 9 aa, Homo Sapiens
AEALLEWRA

SEQ ID NO: 534450 - protein, 9 aa, Homo Sapiens
HRGSGVFCA

SEQ ID NO: 534451 - protein, 9 aa, Homo Sapiens
FCAGAVEQL

SEQ ID NO: 534452 - protein, 9 aa, Homo Sapiens
KIYHLHQED

SEQ ID NO: 534453 - protein, 9 aa, Homo Sapiens
RERIHINGQ

SEQ ID NO: 534454 - protein, 9 aa, Homo Sapiens
AMELARHQN

SEQ ID NO: 534455 - protein, 9 aa, Homo Sapiens
TKLLPTNDP

SEQ ID NO: 534456 - protein, 9 aa, Homo Sapiens
PWDLWGPTE

SEQ ID NO: 534457 - protein, 9 aa, Homo Sapiens
AGAMSGLPP

SEQ ID NO: 534458 - protein, 9 aa, Homo Sapiens
RMYYMFIQM

SEQ ID NO: 534459 - protein, 9 aa, Homo Sapiens
LDFTNPKAR

SEQ ID NO: 534460 - protein, 9 aa, Homo Sapiens
DLSPYLLKR

SEQ ID NO: 534461 - protein, 9 aa, Homo Sapiens
LAMQTLQID

SEQ ID NO: 534462 - protein, 9 aa, Homo Sapiens
HQECYGAPY

SEQ ID NO: 534463 - protein, 9 aa, Homo Sapiens
GLESAAMIR

SEQ ID NO: 534464 - protein, 9 aa, Homo Sapiens
MIRTKVFVW

SEQ ID NO: 534465 - protein, 9 aa, Homo Sapiens
LDLEMLSLQ

SEQ ID NO: 534466 - protein, 9 aa, Homo Sapiens
IHGCYPHTK

SEQ ID NO: 534467 - protein, 9 aa, Homo Sapiens
YIYNRNSWV

SEQ ID NO: 534468 - protein, 9 aa, Homo Sapiens
GKEELVYIA

SEQ ID NO: 534469 - protein, 9 aa, Homo Sapiens
RFQFGPPED

SEQ ID NO: 534470 - protein, 9 aa, Homo Sapiens
TLGSLLDNQ

SEQ ID NO: 534471 - protein, 9 aa, Homo Sapiens
RIILHGIDL

SEQ ID NO: 534472 - protein, 9 aa, Homo Sapiens
GGGRRHIHI

SEQ ID NO: 534473 - protein, 9 aa, Homo Sapiens
FTETDIKMM

SEQ ID NO: 534474 - protein, 9 aa, Homo Sapiens
ALHKKAAED

SEQ ID NO: 534475 - protein, 9 aa, Homo Sapiens
AELEKLQAK

SEQ ID NO: 534476 - protein, 9 aa, Homo Sapiens
ICTLLSRTG

SEQ ID NO: 534477 - protein, 9 aa, Homo Sapiens
TGGGTHWRS

SEQ ID NO: 534478 - protein, 9 aa, Homo Sapiens
PAKAVATQK

SEQ ID NO: 534479 - protein, 9 aa, Homo Sapiens
PNVKYIPFD

SEQ ID NO: 534480 - protein, 9 aa, Homo Sapiens
AQQLIEEKI

SEQ ID NO: 534481 - protein, 9 aa, Homo Sapiens
VTNVCESKS

SEQ ID NO: 534482 - protein, 9 aa, Homo Sapiens
ETVELARYE

SEQ ID NO: 534483 - protein, 9 aa, Homo Sapiens
QYGARVACS

SEQ ID NO: 534484 - protein, 9 aa, Homo Sapiens
TIGDDDEAS

SEQ ID NO: 534485 - protein, 9 aa, Homo Sapiens
ATEQLLTAK

SEQ ID NO: 534486 - protein, 9 aa, Homo Sapiens
DLGGSMAIK

SEQ ID NO: 534487 - protein, 9 aa, Homo Sapiens
QDRYRVLVY

SEQ ID NO: 534488 - protein, 9 aa, Homo Sapiens
CTQRYFMEA

SEQ ID NO: 534489 - protein, 9 aa, Homo Sapiens
GAALTGAKS

SEQ ID NO: 534490 - protein, 9 aa, Homo Sapiens
DRRRKERVK

SEQ ID NO: 534491 - protein, 9 aa, Homo Sapiens
FWEFFESNI

SEQ ID NO: 534492 - protein, 9 aa, Homo Sapiens
ELQKFLKNV

SEQ ID NO: 534493 - protein, 9 aa, Homo Sapiens
RSQQECKRV

SEQ ID NO: 534494 - protein, 9 aa, Homo Sapiens
ALQQQMAAN

SEQ ID NO: 534495 - protein, 9 aa, Homo Sapiens
VPPFTQRER

SEQ ID NO: 534496 - protein, 9 aa, Homo Sapiens
NVLVSLSGK

SEQ ID NO: 534497 - protein, 9 aa, Homo Sapiens
LTMATLMHQ

SEQ ID NO: 534498 - protein, 9 aa, Homo Sapiens
GGATNLYRQ

SEQ ID NO: 534499 - protein, 9 aa, Homo Sapiens
SSDRNKDHS

SEQ ID NO: 534500 - protein, 9 aa, Homo Sapiens
MGEKPYECN

SEQ ID NO: 534501 - protein, 9 aa, Homo Sapiens
LPVAPGSLK

SEQ ID NO: 534502 - protein, 9 aa, Homo Sapiens
FHTITESGV

SEQ ID NO: 534503 - protein, 9 aa, Homo Sapiens
VHWPKNILK

SEQ ID NO: 534504 - protein, 9 aa, Homo Sapiens
PMFSGGQAV

SEQ ID NO: 534505 - protein, 9 aa, Homo Sapiens
HRHQAHSSS

SEQ ID NO: 534506 - protein, 9 aa, Homo Sapiens
VMQRLWADP

SEQ ID NO: 534507 - protein, 9 aa, Homo Sapiens
ALQNAIAGN

SEQ ID NO: 534508 - protein, 9 aa, Homo Sapiens
LEWRAAFAA

SEQ ID NO: 534509 - protein, 9 aa, Homo Sapiens
CRACGAGQP

SEQ ID NO: 534510 - protein, 9 aa, Homo Sapiens
AVTPSKKKS

SEQ ID NO: 534511 - protein, 9 aa, Homo Sapiens
LVCSVYHMT

SEQ ID NO: 534512 - protein, 9 aa, Homo Sapiens
LQAWEWQRQ

SEQ ID NO: 534513 - protein, 9 aa, Homo Sapiens
GCLGVLCLN

SEQ ID NO: 534514 - protein, 9 aa, Homo Sapiens
CMLNRHLKC

SEQ ID NO: 534515 - protein, 9 aa, Homo Sapiens
VPETLNEAK

SEQ ID NO: 534516 - protein, 9 aa, Homo Sapiens
VLLDITDRP

SEQ ID NO: 534517 - protein, 9 aa, Homo Sapiens
SQGFARLSA

SEQ ID NO: 534518 - protein, 9 aa, Homo Sapiens
STDSACHRE

SEQ ID NO: 534519 - protein, 9 aa, Homo Sapiens
HRSQQECKR

SEQ ID NO: 534520 - protein, 9 aa, Homo Sapiens
FRSQTPSCQ

SEQ ID NO: 534521 - protein, 9 aa, Homo Sapiens
MADSRCINA

SEQ ID NO: 534522 - protein, 9 aa, Homo Sapiens
VNNQCLELG

SEQ ID NO: 534523 - protein, 9 aa, Homo Sapiens
PCTLTSTGT

SEQ ID NO: 534524 - protein, 9 aa, Homo Sapiens
VENPTAQED

SEQ ID NO: 534525 - protein, 9 aa, Homo Sapiens
GPLWRTTAF

SEQ ID NO: 534526 - protein, 9 aa, Homo Sapiens
MWTINAIGH

SEQ ID NO: 534527 - protein, 9 aa, Homo Sapiens
ENGADVFLY

SEQ ID NO: 534528 - protein, 9 aa, Homo Sapiens
LRHAGLFLL

SEQ ID NO: 534529 - protein, 9 aa, Homo Sapiens
DVEKNNSHI

SEQ ID NO: 534530 - protein, 9 aa, Homo Sapiens
LFRHSGTAP

SEQ ID NO: 534531 - protein, 9 aa, Homo Sapiens
MPVYDLLKA

SEQ ID NO: 534532 - protein, 9 aa, Homo Sapiens
FATLDHHLY

SEQ ID NO: 534533 - protein, 9 aa, Homo Sapiens
KCLESPSHP

SEQ ID NO: 534534 - protein, 9 aa, Homo Sapiens
HYPESQMLH

SEQ ID NO: 534535 - protein, 9 aa, Homo Sapiens
LLYVARLRE

SEQ ID NO: 534536 - protein, 9 aa, Homo Sapiens
PVNKTDMSK

SEQ ID NO: 534537 - protein, 9 aa, Homo Sapiens
KGMEGRTGP

SEQ ID NO: 534538 - protein, 9 aa, Homo Sapiens
QCSAYCSIV

SEQ ID NO: 534539 - protein, 9 aa, Homo Sapiens
AQAPGTLQR

SEQ ID NO: 534540 - protein, 9 aa, Homo Sapiens
QCQECGRAY

SEQ ID NO: 534541 - protein, 9 aa, Homo Sapiens
LPRTLTEAG

SEQ ID NO: 534542 - protein, 9 aa, Homo Sapiens
VARFLKHCF

SEQ ID NO: 534543 - protein, 9 aa, Homo Sapiens
CFGKTYDAP

SEQ ID NO: 534544 - protein, 9 aa, Homo Sapiens
EALVTRKMV

SEQ ID NO: 534545 - protein, 9 aa, Homo Sapiens
QGNLGLWIN

SEQ ID NO: 534546 - protein, 9 aa, Homo Sapiens
APRKQLAIK

SEQ ID NO: 534547 - protein, 9 aa, Homo Sapiens
CKDEPTLDV

SEQ ID NO: 534548 - protein, 9 aa, Homo Sapiens
AACLCATFA

SEQ ID NO: 534549 - protein, 9 aa, Homo Sapiens
SMGEARTRE

SEQ ID NO: 534550 - protein, 9 aa, Homo Sapiens
APRWGNPCA

SEQ ID NO: 534551 - protein, 9 aa, Homo Sapiens
RLAVPPFTQ

SEQ ID NO: 534552 - protein, 9 aa, Homo Sapiens
MPVIISVLN

SEQ ID NO: 534553 - protein, 9 aa, Homo Sapiens
TFNYLSGSK

SEQ ID NO: 534554 - protein, 9 aa, Homo Sapiens
RNFILPEEI

SEQ ID NO: 534555 - protein, 9 aa, Homo Sapiens
FATAHWTVA

SEQ ID NO: 534556 - protein, 9 aa, Homo Sapiens
QDDRPCTLT

SEQ ID NO: 534557 - protein, 9 aa, Homo Sapiens
QDNYIPCML

SEQ ID NO: 534558 - protein, 9 aa, Homo Sapiens
IAACDTFCA

SEQ ID NO: 534559 - protein, 9 aa, Homo Sapiens
EWGSGTEEA

SEQ ID NO: 534560 - protein, 9 aa, Homo Sapiens
PQLHQAIEF

SEQ ID NO: 534561 - protein, 9 aa, Homo Sapiens
CGCCFSESS

SEQ ID NO: 534562 - protein, 9 aa, Homo Sapiens
RDGINCYDC

SEQ ID NO: 534563 - protein, 9 aa, Homo Sapiens
PYFCLKKVV

SEQ ID NO: 534564 - protein, 9 aa, Homo Sapiens
KYLLWMGAE

SEQ ID NO: 534565 - protein, 9 aa, Homo Sapiens
INPFQVLPL

SEQ ID NO: 534566 - protein, 9 aa, Homo Sapiens
LATCPDPEP

SEQ ID NO: 534567 - protein, 9 aa, Homo Sapiens
KQLQFFQDI

SEQ ID NO: 534568 - protein, 9 aa, Homo Sapiens
GPSPHSFHA

SEQ ID NO: 534569 - protein, 9 aa, Homo Sapiens
ALEEVGDLP

SEQ ID NO: 534570 - protein, 9 aa, Homo Sapiens
VKARPLDRR

SEQ ID NO: 534571 - protein, 9 aa, Homo Sapiens
MCCLPGESQ

SEQ ID NO: 534572 - protein, 9 aa, Homo Sapiens
VKYIPFDEM

SEQ ID NO: 534573 - protein, 9 aa, Homo Sapiens
QVSRSQQQG

SEQ ID NO: 534574 - protein, 9 aa, Homo Sapiens
YKYDMGSDD

SEQ ID NO: 534575 - protein, 9 aa, Homo Sapiens
IAAVVLMFM

SEQ ID NO: 534576 - protein, 9 aa, Homo Sapiens
ECYGAPYIP

SEQ ID NO: 534577 - protein, 9 aa, Homo Sapiens
SKQKAVEEE

SEQ ID NO: 534578 - protein, 9 aa, Homo Sapiens
THWRSKKAK

SEQ ID NO: 534579 - protein, 9 aa, Homo Sapiens
LIDALQFDF

SEQ ID NO: 534580 - protein, 9 aa, Homo Sapiens
SGAWALKTL

SEQ ID NO: 534581 - protein, 9 aa, Homo Sapiens
KREAETLWE

SEQ ID NO: 534582 - protein, 9 aa, Homo Sapiens
GSPPQLMHV

SEQ ID NO: 534583 - protein, 9 aa, Homo Sapiens
KGAEALLEW

SEQ ID NO: 534584 - protein, 9 aa, Homo Sapiens
LGGMWHNSV

SEQ ID NO: 534585 - protein, 9 aa, Homo Sapiens
LSPDCPLLH

SEQ ID NO: 534586 - protein, 9 aa, Homo Sapiens
LWAALAHSR

SEQ ID NO: 534587 - protein, 9 aa, Homo Sapiens
PVWSSLRLL

SEQ ID NO: 534588 - protein, 9 aa, Homo Sapiens
AWEWQRQEE

SEQ ID NO: 534589 - protein, 9 aa, Homo Sapiens
ASFKGHLPK

SEQ ID NO: 534590 - protein, 9 aa, Homo Sapiens
QGESHTHSH

SEQ ID NO: 534591 - protein, 9 aa, Homo Sapiens
IQEEIEHFG

SEQ ID NO: 534592 - protein, 9 aa, Homo Sapiens
STPCRMSMN

SEQ ID NO: 534593 - protein, 9 aa, Homo Sapiens
LQSPRNLGS

SEQ ID NO: 534594 - protein, 9 aa, Homo Sapiens
HCFSSDRRS

SEQ ID NO: 534595 - protein, 9 aa, Homo Sapiens
ERRCTQRYF

SEQ ID NO: 534596 - protein, 9 aa, Homo Sapiens
AGLQHQMSF

SEQ ID NO: 534597 - protein, 9 aa, Homo Sapiens
GPPRPQGPP

SEQ ID NO: 534598 - protein, 9 aa, Homo Sapiens
LCQCQEGVV

SEQ ID NO: 534599 - protein, 9 aa, Homo Sapiens
DKLPLFKWQ

SEQ ID NO: 534600 - protein, 9 aa, Homo Sapiens
FCRSAAYLQ

SEQ ID NO: 534601 - protein, 9 aa, Homo Sapiens
TRAPIWGDM

SEQ ID NO: 534602 - protein, 9 aa, Homo Sapiens
ECGRAYSCR

SEQ ID NO: 534603 - protein, 9 aa, Homo Sapiens
LVSLSGKTP

SEQ ID NO: 534604 - protein, 9 aa, Homo Sapiens
SLEYLDGKF

SEQ ID NO: 534605 - protein, 9 aa, Homo Sapiens
GNRAEGRMD

SEQ ID NO: 534606 - protein, 9 aa, Homo Sapiens
QNAIAGNPA

SEQ ID NO: 534607 - protein, 9 aa, Homo Sapiens
VFLYNANRI

SEQ ID NO: 534608 - protein, 9 aa, Homo Sapiens
QLVVVDEND

SEQ ID NO: 534609 - protein, 9 aa, Homo Sapiens
KIQEEIEHF

SEQ ID NO: 534610 - protein, 9 aa, Homo Sapiens
PDHIWVFGG

SEQ ID NO: 534611 - protein, 9 aa, Homo Sapiens
VRKDDTGCP

SEQ ID NO: 534612 - protein, 9 aa, Homo Sapiens
LLLLPLAST

SEQ ID NO: 534613 - protein, 9 aa, Homo Sapiens
VLIDALQFD

SEQ ID NO: 534614 - protein, 9 aa, Homo Sapiens
GSLLDNQHW

SEQ ID NO: 534615 - protein, 9 aa, Homo Sapiens
AENTPMELK

SEQ ID NO: 534616 - protein, 9 aa, Homo Sapiens
CCCRHRCCG

SEQ ID NO: 534617 - protein, 9 aa, Homo Sapiens
EHISRICHV

SEQ ID NO: 534618 - protein, 9 aa, Homo Sapiens
IGVGPFVET

SEQ ID NO: 534619 - protein, 9 aa, Homo Sapiens
GLIGPPGEH

SEQ ID NO: 534620 - protein, 9 aa, Homo Sapiens
AKAVATQKK

SEQ ID NO: 534621 - protein, 9 aa, Homo Sapiens
GRSLVTSRS

SEQ ID NO: 534622 - protein, 9 aa, Homo Sapiens
GEWGTAPWV

SEQ ID NO: 534623 - protein, 9 aa, Homo Sapiens
KLPLFKWQY

SEQ ID NO: 534624 - protein, 9 aa, Homo Sapiens
GVSSLAASP

SEQ ID NO: 534625 - protein, 9 aa, Homo Sapiens
NSKLKLVHS

SEQ ID NO: 534626 - protein, 9 aa, Homo Sapiens
WEQMEVLKQ

SEQ ID NO: 534627 - protein, 9 aa, Homo Sapiens
QQECKRVMQ

SEQ ID NO: 534628 - protein, 9 aa, Homo Sapiens
CKLPHVLSS

SEQ ID NO: 534629 - protein, 9 aa, Homo Sapiens
MEGRTGPVA

SEQ ID NO: 534630 - protein, 9 aa, Homo Sapiens
CVQLTVQPC

SEQ ID NO: 534631 - protein, 9 aa, Homo Sapiens
DSENDTFCL

SEQ ID NO: 534632 - protein, 9 aa, Homo Sapiens
LRRAAKEAE

SEQ ID NO: 534633 - protein, 9 aa, Homo Sapiens
FSALWAALA

SEQ ID NO: 534634 - protein, 9 aa, Homo Sapiens
ERERHQDRD

SEQ ID NO: 534635 - protein, 9 aa, Homo Sapiens
SSWKKAVEA

SEQ ID NO: 534636 - protein, 9 aa, Homo Sapiens
GTPLEEVAK

SEQ ID NO: 534637 - protein, 9 aa, Homo Sapiens
CLELGIGPG

SEQ ID NO: 534638 - protein, 9 aa, Homo Sapiens
LKIDEYMHN

SEQ ID NO: 534639 - protein, 9 aa, Homo Sapiens
TGRRWLKGG

SEQ ID NO: 534640 - protein, 9 aa, Homo Sapiens
FQNHFEPGI

SEQ ID NO: 534641 - protein, 9 aa, Homo Sapiens
WIEREHQIS

SEQ ID NO: 534642 - protein, 9 aa, Homo Sapiens
QGGVEFQDM

SEQ ID NO: 534643 - protein, 9 aa, Homo Sapiens
PPTSNGNLL

SEQ ID NO: 534644 - protein, 9 aa, Homo Sapiens
IPLQSPRNL

SEQ ID NO: 534645 - protein, 9 aa, Homo Sapiens
SFCGLDINQ

SEQ ID NO: 534646 - protein, 9 aa, Homo Sapiens
AELHLNNNE

SEQ ID NO: 534647 - protein, 9 aa, Homo Sapiens
SSAMETINK

SEQ ID NO: 534648 - protein, 9 aa, Homo Sapiens
EKVFERMNS

SEQ ID NO: 534649 - protein, 9 aa, Homo Sapiens
IWTEKTMKQ

SEQ ID NO: 534650 - protein, 9 aa, Homo Sapiens
TFLSCNLEE

SEQ ID NO: 534651 - protein, 9 aa, Homo Sapiens
WKELEGLAG

SEQ ID NO: 534652 - protein, 9 aa, Homo Sapiens
TPVGALAAA

SEQ ID NO: 534653 - protein, 9 aa, Homo Sapiens
SVSIEENCL

SEQ ID NO: 534654 - protein, 9 aa, Homo Sapiens
LSESHRKQA

SEQ ID NO: 534655 - protein, 9 aa, Homo Sapiens
SPRQNPLVT

SEQ ID NO: 534656 - protein, 9 aa, Homo Sapiens
LNYNISCIL

SEQ ID NO: 534657 - protein, 9 aa, Homo Sapiens
EAGSKQKAV

SEQ ID NO: 534658 - protein, 9 aa, Homo Sapiens
LLPLASTLQ

SEQ ID NO: 534659 - protein, 9 aa, Homo Sapiens
HGYMLISKE

SEQ ID NO: 534660 - protein, 9 aa, Homo Sapiens
PDKLPLFKW

SEQ ID NO: 534661 - protein, 9 aa, Homo Sapiens
VHFVSDATP

SEQ ID NO: 534662 - protein, 9 aa, Homo Sapiens
QTKHSTAEL

SEQ ID NO: 534663 - protein, 9 aa, Homo Sapiens
AGVEPMFSG

SEQ ID NO: 534664 - protein, 9 aa, Homo Sapiens
HRRTARRTH

SEQ ID NO: 534665 - protein, 9 aa, Homo Sapiens
PGSGLGNLS

SEQ ID NO: 534666 - protein, 9 aa, Homo Sapiens
CYLLKKADD

SEQ ID NO: 534667 - protein, 9 aa, Homo Sapiens
HPHAREMWR

SEQ ID NO: 534668 - protein, 9 aa, Homo Sapiens
GPPNPNVKY

SEQ ID NO: 534669 - protein, 9 aa, Homo Sapiens
YGEPREGRR

SEQ ID NO: 534670 - protein, 9 aa, Homo Sapiens
NTFTGLSHL

SEQ ID NO: 534671 - protein, 9 aa, Homo Sapiens
WEREGEEFD

SEQ ID NO: 534672 - protein, 9 aa, Homo Sapiens
ISVNVHITN

SEQ ID NO: 534673 - protein, 9 aa, Homo Sapiens
CARLLQLGQ

SEQ ID NO: 534674 - protein, 9 aa, Homo Sapiens
ARNFWPGIG

SEQ ID NO: 534675 - protein, 9 aa, Homo Sapiens
YGLWHSKEA

SEQ ID NO: 534676 - protein, 9 aa, Homo Sapiens
VFYGSQMGT

SEQ ID NO: 534677 - protein, 9 aa, Homo Sapiens
QNHFEPGIY

SEQ ID NO: 534678 - protein, 9 aa, Homo Sapiens
ANNRQVCML

SEQ ID NO: 534679 - protein, 9 aa, Homo Sapiens
DILVGSGIL

SEQ ID NO: 534680 - protein, 9 aa, Homo Sapiens
KTSYSVSIE

SEQ ID NO: 534681 - protein, 9 aa, Homo Sapiens
LKGPPRPQG

SEQ ID NO: 534682 - protein, 9 aa, Homo Sapiens
VLDELWHAD

SEQ ID NO: 534683 - protein, 9 aa, Homo Sapiens
GATAGVEPM

SEQ ID NO: 534684 - protein, 9 aa, Homo Sapiens
SLAASPGHV

SEQ ID NO: 534685 - protein, 9 aa, Homo Sapiens
FTKAAVRRV

SEQ ID NO: 534686 - protein, 9 aa, Homo Sapiens
RQVCMLADL

SEQ ID NO: 534687 - protein, 9 aa, Homo Sapiens
PPTILQTVV

SEQ ID NO: 534688 - protein, 9 aa, Homo Sapiens
NRSLSDSDM

SEQ ID NO: 534689 - protein, 9 aa, Homo Sapiens
PYQCQECGR

SEQ ID NO: 534690 - protein, 9 aa, Homo Sapiens
QEGLLHVTH

SEQ ID NO: 534691 - protein, 9 aa, Homo Sapiens
HSGTAPRTE

SEQ ID NO: 534692 - protein, 9 aa, Homo Sapiens
VGSHPRAAY

SEQ ID NO: 534693 - protein, 9 aa, Homo Sapiens
MICLDCFHL

SEQ ID NO: 534694 - protein, 9 aa, Homo Sapiens
LVIMDLLED

SEQ ID NO: 534695 - protein, 9 aa, Homo Sapiens
LLYYKAQTK

SEQ ID NO: 534696 - protein, 9 aa, Homo Sapiens
MRRLANMAP

SEQ ID NO: 534697 - protein, 9 aa, Homo Sapiens
LGSLLDNQH

SEQ ID NO: 534698 - protein, 9 aa, Homo Sapiens
VSPGVRSEH

SEQ ID NO: 534699 - protein, 9 aa, Homo Sapiens
LLPYRYTDS

SEQ ID NO: 534700 - protein, 9 aa, Homo Sapiens
VGIPLFFEQ

SEQ ID NO: 534701 - protein, 9 aa, Homo Sapiens
QRLQQRLAV

SEQ ID NO: 534702 - protein, 9 aa, Homo Sapiens
QCRLGLANG

SEQ ID NO: 534703 - protein, 9 aa, Homo Sapiens
KWFILVLNE

SEQ ID NO: 534704 - protein, 9 aa, Homo Sapiens
MKALDFRTP

SEQ ID NO: 534705 - protein, 9 aa, Homo Sapiens
KKLERERRC

SEQ ID NO: 534706 - protein, 9 aa, Homo Sapiens
LSSTAEGAN

SEQ ID NO: 534707 - protein, 9 aa, Homo Sapiens
PDHRRLMYR

SEQ ID NO: 534708 - protein, 9 aa, Homo Sapiens
LYVARLREG

SEQ ID NO: 534709 - protein, 9 aa, Homo Sapiens
NPTGEPILP

SEQ ID NO: 534710 - protein, 9 aa, Homo Sapiens
YGAAFSATP

SEQ ID NO: 534711 - protein, 9 aa, Homo Sapiens
NISCILTMP

SEQ ID NO: 534712 - protein, 9 aa, Homo Sapiens
GDCGCCFSE

SEQ ID NO: 534713 - protein, 9 aa, Homo Sapiens
LYGLGELSQ

SEQ ID NO: 534714 - protein, 9 aa, Homo Sapiens
FRQGTGVDL

SEQ ID NO: 534715 - protein, 9 aa, Homo Sapiens
SLLDLEMLS

SEQ ID NO: 534716 - protein, 9 aa, Homo Sapiens
VSKKMLKPT

SEQ ID NO: 534717 - protein, 9 aa, Homo Sapiens
TGPGLSLRH

SEQ ID NO: 534718 - protein, 9 aa, Homo Sapiens
FVLKIYHLH

SEQ ID NO: 534719 - protein, 9 aa, Homo Sapiens
TSQHHDVTN

SEQ ID NO: 534720 - protein, 9 aa, Homo Sapiens
ISRPLCYVT

SEQ ID NO: 534721 - protein, 9 aa, Homo Sapiens
NSSAMETIN

SEQ ID NO: 534722 - protein, 9 aa, Homo Sapiens
VSSLAASPG

SEQ ID NO: 534723 - protein, 9 aa, Homo Sapiens
DGRGKQHAT

SEQ ID NO: 534724 - protein, 9 aa, Homo Sapiens
RSLSDSDME

SEQ ID NO: 534725 - protein, 9 aa, Homo Sapiens
PDILVGSGI

SEQ ID NO: 534726 - protein, 9 aa, Homo Sapiens
TKRMTITSR

SEQ ID NO: 534727 - protein, 9 aa, Homo Sapiens
EFQDMVLAY

SEQ ID NO: 534728 - protein, 9 aa, Homo Sapiens
ASLTLHNRE

SEQ ID NO: 534729 - protein, 9 aa, Homo Sapiens
ACLNKVEME

SEQ ID NO: 534730 - protein, 9 aa, Homo Sapiens
FTLIGDNTF

SEQ ID NO: 534731 - protein, 9 aa, Homo Sapiens
DNHGWCGGR

SEQ ID NO: 534732 - protein, 9 aa, Homo Sapiens
PKHTLPPKK

SEQ ID NO: 534733 - protein, 9 aa, Homo Sapiens
AMRRRDFAN

SEQ ID NO: 534734 - protein, 9 aa, Homo Sapiens
FWPGIGGPP

SEQ ID NO: 534735 - protein, 9 aa, Homo Sapiens
AVSKKMLKP

SEQ ID NO: 534736 - protein, 9 aa, Homo Sapiens
RTADEADLQ

SEQ ID NO: 534737 - protein, 9 aa, Homo Sapiens
TRGRQGPAS

SEQ ID NO: 534738 - protein, 9 aa, Homo Sapiens
VFQCNSRHM

SEQ ID NO: 534739 - protein, 9 aa, Homo Sapiens
SALPGCPEL

SEQ ID NO: 534740 - protein, 9 aa, Homo Sapiens
DYVLDLVLD

SEQ ID NO: 534741 - protein, 9 aa, Homo Sapiens
GIPLFFEQS

SEQ ID NO: 534742 - protein, 9 aa, Homo Sapiens
CTPDHIWVF

SEQ ID NO: 534743 - protein, 9 aa, Homo Sapiens
EQVCARLLQ

SEQ ID NO: 534744 - protein, 9 aa, Homo Sapiens
TIRRDVPAG

SEQ ID NO: 534745 - protein, 9 aa, Homo Sapiens
CLESPSHPE

SEQ ID NO: 534746 - protein, 9 aa, Homo Sapiens
YGAPYIPEG

SEQ ID NO: 534747 - protein, 9 aa, Homo Sapiens
EPVWSSLRL

SEQ ID NO: 534748 - protein, 9 aa, Homo Sapiens
ILDHYVQCS

SEQ ID NO: 534749 - protein, 9 aa, Homo Sapiens
RQAKAAKEV

SEQ ID NO: 534750 - protein, 9 aa, Homo Sapiens
GGSTHNITQ

SEQ ID NO: 534751 - protein, 9 aa, Homo Sapiens
DSLEKMKMF

SEQ ID NO: 534752 - protein, 9 aa, Homo Sapiens
ARYEPDLLR

SEQ ID NO: 534753 - protein, 9 aa, Homo Sapiens
QSSPEDIAQ

SEQ ID NO: 534754 - protein, 9 aa, Homo Sapiens
LQSMGEART

SEQ ID NO: 534755 - protein, 9 aa, Homo Sapiens
RYLAMQTLQ

SEQ ID NO: 534756 - protein, 9 aa, Homo Sapiens
LEKGMEGRT

SEQ ID NO: 534757 - protein, 9 aa, Homo Sapiens
EPSTSEYLR

SEQ ID NO: 534758 - protein, 9 aa, Homo Sapiens
EDRNAHLGE

SEQ ID NO: 534759 - protein, 9 aa, Homo Sapiens
QPPKCLESP

SEQ ID NO: 534760 - protein, 9 aa, Homo Sapiens
TLIGDNTFT

SEQ ID NO: 534761 - protein, 9 aa, Homo Sapiens
STTTLQKCF

SEQ ID NO: 534762 - protein, 9 aa, Homo Sapiens
TADEADLQA

SEQ ID NO: 534763 - protein, 9 aa, Homo Sapiens
HLHQEDSGK

SEQ ID NO: 534764 - protein, 9 aa, Homo Sapiens
GWFCLLPFP

SEQ ID NO: 534765 - protein, 9 aa, Homo Sapiens
ISEGCLGVL

SEQ ID NO: 534766 - protein, 9 aa, Homo Sapiens
ILVSTDMGC

SEQ ID NO: 534767 - protein, 9 aa, Homo Sapiens
LAPQMLNLL

SEQ ID NO: 534768 - protein, 9 aa, Homo Sapiens
CHREAALEA

SEQ ID NO: 534769 - protein, 9 aa, Homo Sapiens
MKKCRNEKM

SEQ ID NO: 534770 - protein, 9 aa, Homo Sapiens
TKFKDDLFW

SEQ ID NO: 534771 - protein, 9 aa, Homo Sapiens
RPRSAVPHA

SEQ ID NO: 534772 - protein, 9 aa, Homo Sapiens
YGSQMGTAE

SEQ ID NO: 534773 - protein, 9 aa, Homo Sapiens
RGAIACKRI

SEQ ID NO: 534774 - protein, 9 aa, Homo Sapiens
EGSSQPEAG

SEQ ID NO: 534775 - protein, 9 aa, Homo Sapiens
HMPVIISVL

SEQ ID NO: 534776 - protein, 9 aa, Homo Sapiens
APPPTSNGN

SEQ ID NO: 534777 - protein, 9 aa, Homo Sapiens
FLNWFDERT

SEQ ID NO: 534778 - protein, 9 aa, Homo Sapiens
VEWGSGTEE

SEQ ID NO: 534779 - protein, 9 aa, Homo Sapiens
QLCYLLKKA

SEQ ID NO: 534780 - protein, 9 aa, Homo Sapiens
TEQLLTAKK

SEQ ID NO: 534781 - protein, 9 aa, Homo Sapiens
TTLAVSRGR

SEQ ID NO: 534782 - protein, 9 aa, Homo Sapiens
IRSVMRYLT

SEQ ID NO: 534783 - protein, 9 aa, Homo Sapiens
SVDCPTFLD

SEQ ID NO: 534784 - protein, 9 aa, Homo Sapiens
TQQLCYLLK

SEQ ID NO: 534785 - protein, 9 aa, Homo Sapiens
IPEIHFLLE

SEQ ID NO: 534786 - protein, 9 aa, Homo Sapiens
GGDIQKKQL

SEQ ID NO: 534787 - protein, 9 aa, Homo Sapiens
VQVRERIHI

SEQ ID NO: 534788 - protein, 9 aa, Homo Sapiens
VVAAMEQLV

SEQ ID NO: 534789 - protein, 9 aa, Homo Sapiens
DALQFDFAQ

SEQ ID NO: 534790 - protein, 9 aa, Homo Sapiens
PMELDPEDM

SEQ ID NO: 534791 - protein, 9 aa, Homo Sapiens
VSGFRVMEE

SEQ ID NO: 534792 - protein, 9 aa, Homo Sapiens
WVHQGLVEE

SEQ ID NO: 534793 - protein, 9 aa, Homo Sapiens
PHRVLGPWG

SEQ ID NO: 534794 - protein, 9 aa, Homo Sapiens
RLEAENTPM

SEQ ID NO: 534795 - protein, 9 aa, Homo Sapiens
TKGADLVIM

SEQ ID NO: 534796 - protein, 9 aa, Homo Sapiens
GNPCALSFV

SEQ ID NO: 534797 - protein, 9 aa, Homo Sapiens
TCTGYHQVC

SEQ ID NO: 534798 - protein, 9 aa, Homo Sapiens
CHLALRHGT

SEQ ID NO: 534799 - protein, 9 aa, Homo Sapiens
CLKKVVKWY

SEQ ID NO: 534800 - protein, 9 aa, Homo Sapiens
LLGVMQRLW

SEQ ID NO: 534801 - protein, 9 aa, Homo Sapiens
VRGRGNFPD

SEQ ID NO: 534802 - protein, 9 aa, Homo Sapiens
SRGFPDTYR

SEQ ID NO: 534803 - protein, 9 aa, Homo Sapiens
GKQHATKPC

SEQ ID NO: 534804 - protein, 9 aa, Homo Sapiens
QLQHIIAGV

SEQ ID NO: 534805 - protein, 9 aa, Homo Sapiens
QPPSFKDGD

SEQ ID NO: 534806 - protein, 9 aa, Homo Sapiens
GSVTTLAVS

SEQ ID NO: 534807 - protein, 9 aa, Homo Sapiens
YRIDLDVAG

SEQ ID NO: 534808 - protein, 9 aa, Homo Sapiens
RRLANMAPA

SEQ ID NO: 534809 - protein, 9 aa, Homo Sapiens
VFKSAHMPV

SEQ ID NO: 534810 - protein, 9 aa, Homo Sapiens
SRICEAVPG

SEQ ID NO: 534811 - protein, 9 aa, Homo Sapiens
ADAWDVDTI

SEQ ID NO: 534812 - protein, 9 aa, Homo Sapiens
SVNRRKLSL

SEQ ID NO: 534813 - protein, 9 aa, Homo Sapiens
ERQWEQMEV

SEQ ID NO: 534814 - protein, 9 aa, Homo Sapiens
FLIQDTSLI

SEQ ID NO: 534815 - protein, 9 aa, Homo Sapiens
KRPALEPVW

SEQ ID NO: 534816 - protein, 9 aa, Homo Sapiens
NWDGCSVLQ

SEQ ID NO: 534817 - protein, 9 aa, Homo Sapiens
TFSALWAAL

SEQ ID NO: 534818 - protein, 9 aa, Homo Sapiens
GRRRRVVLK

SEQ ID NO: 534819 - protein, 9 aa, Homo Sapiens
HISEGCLGV

SEQ ID NO: 534820 - protein, 9 aa, Homo Sapiens
GGHTKEVIV

SEQ ID NO: 534821 - protein, 9 aa, Homo Sapiens
IWDLTMATL

SEQ ID NO: 534822 - protein, 9 aa, Homo Sapiens
VSRSQQQGL

SEQ ID NO: 534823 - protein, 9 aa, Homo Sapiens
DVHGECIDV

SEQ ID NO: 534824 - protein, 9 aa, Homo Sapiens
DHHLYEAEE

SEQ ID NO: 534825 - protein, 9 aa, Homo Sapiens
HCLGPTHHM

SEQ ID NO: 534826 - protein, 9 aa, Homo Sapiens
DYQPPSFKD

SEQ ID NO: 534827 - protein, 9 aa, Homo Sapiens
QLRSLQEEA

SEQ ID NO: 534828 - protein, 9 aa, Homo Sapiens
RKVFTKAAV

SEQ ID NO: 534829 - protein, 9 aa, Homo Sapiens
LEAADPACR

SEQ ID NO: 534830 - protein, 9 aa, Homo Sapiens
AHVRIHLRD

SEQ ID NO: 534831 - protein, 9 aa, Homo Sapiens
PYRYTDSGA

SEQ ID NO: 534832 - protein, 9 aa, Homo Sapiens
LAVILAAPG

SEQ ID NO: 534833 - protein, 9 aa, Homo Sapiens
RNYGYHHNA

SEQ ID NO: 534834 - protein, 9 aa, Homo Sapiens
VNVHITNNT

SEQ ID NO: 534835 - protein, 9 aa, Homo Sapiens
LAEIYGWIE

SEQ ID NO: 534836 - protein, 9 aa, Homo Sapiens
APVVTLFDA

SEQ ID NO: 534837 - protein, 9 aa, Homo Sapiens
ILGGNNPLG

SEQ ID NO: 534838 - protein, 9 aa, Homo Sapiens
LLDNQHWHS

SEQ ID NO: 534839 - protein, 9 aa, Homo Sapiens
QKGDAILQC

SEQ ID NO: 534840 - protein, 9 aa, Homo Sapiens
NMPYDLCKD

SEQ ID NO: 534841 - protein, 9 aa, Homo Sapiens
ETHECFNPI

SEQ ID NO: 534842 - protein, 9 aa, Homo Sapiens
TWYPLGRIV

SEQ ID NO: 534843 - protein, 9 aa, Homo Sapiens
LLLPLASTL

SEQ ID NO: 534844 - protein, 9 aa, Homo Sapiens
GEMGKEGRR

SEQ ID NO: 534845 - protein, 9 aa, Homo Sapiens
VDRVFHTIT

SEQ ID NO: 534846 - protein, 9 aa, Homo Sapiens
VSRPRSPST

SEQ ID NO: 534847 - protein, 9 aa, Homo Sapiens
MVGDRPETD

SEQ ID NO: 534848 - protein, 9 aa, Homo Sapiens
NLSAGQTPR

SEQ ID NO: 534849 - protein, 9 aa, Homo Sapiens
LEPVWSSLR

SEQ ID NO: 534850 - protein, 9 aa, Homo Sapiens
DPIWCGPLP

SEQ ID NO: 534851 - protein, 9 aa, Homo Sapiens
HCFTFMDRG

SEQ ID NO: 534852 - protein, 9 aa, Homo Sapiens
DEYMHNFSD

SEQ ID NO: 534853 - protein, 9 aa, Homo Sapiens
LGAGASCVS

SEQ ID NO: 534854 - protein, 9 aa, Homo Sapiens
LHLTSSLTT

SEQ ID NO: 534855 - protein, 9 aa, Homo Sapiens
EELVGQLRW

SEQ ID NO: 534856 - protein, 9 aa, Homo Sapiens
GGVASQEQK

SEQ ID NO: 534857 - protein, 9 aa, Homo Sapiens
WTAMKEVLV

SEQ ID NO: 534858 - protein, 9 aa, Homo Sapiens
QVLTRCFGK

SEQ ID NO: 534859 - protein, 9 aa, Homo Sapiens
EAAQERDGL

SEQ ID NO: 534860 - protein, 9 aa, Homo Sapiens
VELDSLRHQ

SEQ ID NO: 534861 - protein, 9 aa, Homo Sapiens
EGPDTPSYK

SEQ ID NO: 534862 - protein, 9 aa, Homo Sapiens
GHLTSPSAI

SEQ ID NO: 534863 - protein, 9 aa, Homo Sapiens
QSFEKKVQV

SEQ ID NO: 534864 - protein, 9 aa, Homo Sapiens
NNTWALEEI

SEQ ID NO: 534865 - protein, 9 aa, Homo Sapiens
PTSRFGGST

SEQ ID NO: 534866 - protein, 9 aa, Homo Sapiens
PETDILFGH

SEQ ID NO: 534867 - protein, 9 aa, Homo Sapiens
PMKALDFRT

SEQ ID NO: 534868 - protein, 9 aa, Homo Sapiens
WHLSTGTMT

SEQ ID NO: 534869 - protein, 9 aa, Homo Sapiens
FDERTWYPL

SEQ ID NO: 534870 - protein, 9 aa, Homo Sapiens
INPQVSRED

SEQ ID NO: 534871 - protein, 9 aa, Homo Sapiens
AENELGITL

SEQ ID NO: 534872 - protein, 9 aa, Homo Sapiens
ANGSYPLQA

SEQ ID NO: 534873 - protein, 9 aa, Homo Sapiens
GALDREKIP

SEQ ID NO: 534874 - protein, 9 aa, Homo Sapiens
PQHARSVQN

SEQ ID NO: 534875 - protein, 9 aa, Homo Sapiens
VFIYIWPFS

SEQ ID NO: 534876 - protein, 9 aa, Homo Sapiens
LYLKQMCCL

SEQ ID NO: 534877 - protein, 9 aa, Homo Sapiens
RRQPSITSQ

SEQ ID NO: 534878 - protein, 9 aa, Homo Sapiens
GWIEREHQI

SEQ ID NO: 534879 - protein, 9 aa, Homo Sapiens
DDLFWKYVQ

SEQ ID NO: 534880 - protein, 9 aa, Homo Sapiens
LDRYHCFKE

SEQ ID NO: 534881 - protein, 9 aa, Homo Sapiens
TSEGTSVGS

SEQ ID NO: 534882 - protein, 9 aa, Homo Sapiens
LLSDPSRNN

SEQ ID NO: 534883 - protein, 9 aa, Homo Sapiens
LRHILLPLY

SEQ ID NO: 534884 - protein, 9 aa, Homo Sapiens
CPTFLDKDG

SEQ ID NO: 534885 - protein, 9 aa, Homo Sapiens
RQGTGVDLG

SEQ ID NO: 534886 - protein, 9 aa, Homo Sapiens
LELLWKEEY

SEQ ID NO: 534887 - protein, 9 aa, Homo Sapiens
PLSIQWHWQ

SEQ ID NO: 534888 - protein, 9 aa, Homo Sapiens
GFRLQCMLN

SEQ ID NO: 534889 - protein, 9 aa, Homo Sapiens
QVIYTQLSK

SEQ ID NO: 534890 - protein, 9 aa, Homo Sapiens
YLAAATIST

SEQ ID NO: 534891 - protein, 9 aa, Homo Sapiens
PYQGSTGFP

SEQ ID NO: 534892 - protein, 9 aa, Homo Sapiens
ARIEAELHQ

SEQ ID NO: 534893 - protein, 9 aa, Homo Sapiens
CKKVSAAPA

SEQ ID NO: 534894 - protein, 9 aa, Homo Sapiens
CNLEEPKHQ

SEQ ID NO: 534895 - protein, 9 aa, Homo Sapiens
EVLLDITDR

SEQ ID NO: 534896 - protein, 9 aa, Homo Sapiens
LQDHTEKMK

SEQ ID NO: 534897 - protein, 9 aa, Homo Sapiens
TTSMLTMNP

SEQ ID NO: 534898 - protein, 9 aa, Homo Sapiens
EVQLTPSMR

SEQ ID NO: 534899 - protein, 9 aa, Homo Sapiens
EKSEWEEVI

SEQ ID NO: 534900 - protein, 9 aa, Homo Sapiens
RQPEQLLFI

SEQ ID NO: 534901 - protein, 9 aa, Homo Sapiens
TQRERFHRF

SEQ ID NO: 534902 - protein, 9 aa, Homo Sapiens
EVLGEWGTA

SEQ ID NO: 534903 - protein, 9 aa, Homo Sapiens
ILHRRIHMG

SEQ ID NO: 534904 - protein, 9 aa, Homo Sapiens
LRRRRRSLA

SEQ ID NO: 534905 - protein, 9 aa, Homo Sapiens
AHLLFLMGI

SEQ ID NO: 534906 - protein, 9 aa, Homo Sapiens
VSLSGKTPH

SEQ ID NO: 534907 - protein, 9 aa, Homo Sapiens
PPQLMHVTV

SEQ ID NO: 534908 - protein, 9 aa, Homo Sapiens
SDRRSSDPH

SEQ ID NO: 534909 - protein, 9 aa, Homo Sapiens
QQGLRRVRD

SEQ ID NO: 534910 - protein, 9 aa, Homo Sapiens
MVTVGEKLI

SEQ ID NO: 534911 - protein, 9 aa, Homo Sapiens
AILQCGHVF

SEQ ID NO: 534912 - protein, 9 aa, Homo Sapiens
AACLNKVEM

SEQ ID NO: 534913 - protein, 9 aa, Homo Sapiens
CTVAVIYTV

SEQ ID NO: 534914 - protein, 9 aa, Homo Sapiens
GGGGFGTAG

SEQ ID NO: 534915 - protein, 9 aa, Homo Sapiens
IRIDTACIC

SEQ ID NO: 534916 - protein, 9 aa, Homo Sapiens
VNCDRDNLK

SEQ ID NO: 534917 - protein, 9 aa, Homo Sapiens
YQELQEEHA

SEQ ID NO: 534918 - protein, 9 aa, Homo Sapiens
TEVRWFFNG

SEQ ID NO: 534919 - protein, 9 aa, Homo Sapiens
TWVHQGLVE

SEQ ID NO: 534920 - protein, 9 aa, Homo Sapiens
PLFCGSSDV

SEQ ID NO: 534921 - protein, 9 aa, Homo Sapiens
MYVRCMPGA

SEQ ID NO: 534922 - protein, 9 aa, Homo Sapiens
PNPERNFIL

SEQ ID NO: 534923 - protein, 9 aa, Homo Sapiens
TIFCPRMSA

SEQ ID NO: 534924 - protein, 9 aa, Homo Sapiens
AVTMTQEAI

SEQ ID NO: 534925 - protein, 9 aa, Homo Sapiens
RHQGSVTTL

SEQ ID NO: 534926 - protein, 9 aa, Homo Sapiens
ERERRCTQR

SEQ ID NO: 534927 - protein, 9 aa, Homo Sapiens
AVLEQEEAE

SEQ ID NO: 534928 - protein, 9 aa, Homo Sapiens
YVDINTFCL

SEQ ID NO: 534929 - protein, 9 aa, Homo Sapiens
HVRSFISPI

SEQ ID NO: 534930 - protein, 9 aa, Homo Sapiens
VTIFGLGAG

SEQ ID NO: 534931 - protein, 9 aa, Homo Sapiens
SMAIKFVDA

SEQ ID NO: 534932 - protein, 9 aa, Homo Sapiens
PVTVLFPLA

SEQ ID NO: 534933 - protein, 9 aa, Homo Sapiens
PPPGMHPPR

SEQ ID NO: 534934 - protein, 9 aa, Homo Sapiens
YGTFLLFTV

SEQ ID NO: 534935 - protein, 9 aa, Homo Sapiens
SEGTSVGSH

SEQ ID NO: 534936 - protein, 9 aa, Homo Sapiens
LTRCFGKTY

SEQ ID NO: 534937 - protein, 9 aa, Homo Sapiens
EAADPACRA

SEQ ID NO: 534938 - protein, 9 aa, Homo Sapiens
FLLFTVFWN

SEQ ID NO: 534939 - protein, 9 aa, Homo Sapiens
PPKCLESPS

SEQ ID NO: 534940 - protein, 9 aa, Homo Sapiens
QAMREERKQ

SEQ ID NO: 534941 - protein, 9 aa, Homo Sapiens
PTSGPHPVT

SEQ ID NO: 534942 - protein, 9 aa, Homo Sapiens
DPACRACGA

SEQ ID NO: 534943 - protein, 9 aa, Homo Sapiens
DRGSPPQLM

SEQ ID NO: 534944 - protein, 9 aa, Homo Sapiens
VDGGDIQKK

SEQ ID NO: 534945 - protein, 9 aa, Homo Sapiens
LAMELARHQ

SEQ ID NO: 534946 - protein, 9 aa, Homo Sapiens
NTGHLTSPS

SEQ ID NO: 534947 - protein, 9 aa, Homo Sapiens
QKVMLPPNS

SEQ ID NO: 534948 - protein, 9 aa, Homo Sapiens
NSPGTISFS

SEQ ID NO: 534949 - protein, 9 aa, Homo Sapiens
QHARSVQNF

SEQ ID NO: 534950 - protein, 9 aa, Homo Sapiens
TLEGSSPHN

SEQ ID NO: 534951 - protein, 9 aa, Homo Sapiens
GPDPYRQLQ

SEQ ID NO: 534952 - protein, 9 aa, Homo Sapiens
RRRKCLQEL

SEQ ID NO: 534953 - protein, 9 aa, Homo Sapiens
RICHVLKQD

SEQ ID NO: 534954 - protein, 9 aa, Homo Sapiens
TWALEEISI

SEQ ID NO: 534955 - protein, 9 aa, Homo Sapiens
TMATLMHQI

SEQ ID NO: 534956 - protein, 9 aa, Homo Sapiens
NNIHGCYPH

SEQ ID NO: 534957 - protein, 9 aa, Homo Sapiens
KKVSAAPAI

SEQ ID NO: 534958 - protein, 9 aa, Homo Sapiens
QSIPWDLWG

SEQ ID NO: 534959 - protein, 9 aa, Homo Sapiens
QELAAIQDM

SEQ ID NO: 534960 - protein, 9 aa, Homo Sapiens
EQLLTAKKK

SEQ ID NO: 534961 - protein, 9 aa, Homo Sapiens
FPPLHMPGL

SEQ ID NO: 534962 - protein, 9 aa, Homo Sapiens
SDDLRSIRS

SEQ ID NO: 534963 - protein, 9 aa, Homo Sapiens
VVYPEVEWG

SEQ ID NO: 534964 - protein, 9 aa, Homo Sapiens
LMGINRTEP

SEQ ID NO: 534965 - protein, 9 aa, Homo Sapiens
IGKMPVYDL

SEQ ID NO: 534966 - protein, 9 aa, Homo Sapiens
NGQCFSAET

SEQ ID NO: 534967 - protein, 9 aa, Homo Sapiens
LRNYGYHHN

SEQ ID NO: 534968 - protein, 9 aa, Homo Sapiens
QCNSRHMIC

SEQ ID NO: 534969 - protein, 9 aa, Homo Sapiens
RMAEAHVRI

SEQ ID NO: 534970 - protein, 9 aa, Homo Sapiens
IHINGQPIS

SEQ ID NO: 534971 - protein, 9 aa, Homo Sapiens
PTKSKEELS

SEQ ID NO: 534972 - protein, 9 aa, Homo Sapiens
VYVIGQEKV

SEQ ID NO: 534973 - protein, 9 aa, Homo Sapiens
APRASALWH

SEQ ID NO: 534974 - protein, 9 aa, Homo Sapiens
YVPSSSSNL

SEQ ID NO: 534975 - protein, 9 aa, Homo Sapiens
ILELLWKEE

SEQ ID NO: 534976 - protein, 9 aa, Homo Sapiens
VSQFPPLHM

SEQ ID NO: 534977 - protein, 9 aa, Homo Sapiens
VYNFCTQDG

SEQ ID NO: 534978 - protein, 9 aa, Homo Sapiens
QLQEKDPKY

SEQ ID NO: 534979 - protein, 9 aa, Homo Sapiens
PFWVRKDDT

SEQ ID NO: 534980 - protein, 9 aa, Homo Sapiens
SRDYVVMSV

SEQ ID NO: 534981 - protein, 9 aa, Homo Sapiens
RLGEAHVEL

SEQ ID NO: 534982 - protein, 9 aa, Homo Sapiens
KEAERQRQI

SEQ ID NO: 534983 - protein, 9 aa, Homo Sapiens
CRAYIQMLR

SEQ ID NO: 534984 - protein, 9 aa, Homo Sapiens
CMPGARYTV

SEQ ID NO: 534985 - protein, 9 aa, Homo Sapiens
MLARKLQSR

SEQ ID NO: 534986 - protein, 9 aa, Homo Sapiens
ISRICHVLK

SEQ ID NO: 534987 - protein, 9 aa, Homo Sapiens
VMFDISSLM

SEQ ID NO: 534988 - protein, 9 aa, Homo Sapiens
TLLENTGHL

SEQ ID NO: 534989 - protein, 9 aa, Homo Sapiens
REFWFDLSK

SEQ ID NO: 534990 - protein, 9 aa, Homo Sapiens
AMREERKQA

SEQ ID NO: 534991 - protein, 9 aa, Homo Sapiens
YQGSTGFPK

SEQ ID NO: 534992 - protein, 9 aa, Homo Sapiens
ITVAYLMQK

SEQ ID NO: 534993 - protein, 9 aa, Homo Sapiens
VYQAVQHNK

SEQ ID NO: 534994 - protein, 9 aa, Homo Sapiens
KLQEENREQ

SEQ ID NO: 534995 - protein, 9 aa, Homo Sapiens
HRVQVTAAL

SEQ ID NO: 534996 - protein, 9 aa, Homo Sapiens
GNHLMLEEL

SEQ ID NO: 534997 - protein, 9 aa, Homo Sapiens
VEGIRSVMR

SEQ ID NO: 534998 - protein, 9 aa, Homo Sapiens
ERNACVIKW

SEQ ID NO: 534999 - protein, 9 aa, Homo Sapiens
YVRCMPGAR

SEQ ID NO: 535000 - protein, 9 aa, Homo Sapiens
TVNIWDLTM

SEQ ID NO: 535001 - protein, 9 aa, Homo Sapiens
AGLESAAMI

SEQ ID NO: 535002 - protein, 9 aa, Homo Sapiens
REQKNNLQH

SEQ ID NO: 535003 - protein, 9 aa, Homo Sapiens
PGVRSEHGR

SEQ ID NO: 535004 - protein, 9 aa, Homo Sapiens
AVPVTAVTA

SEQ ID NO: 535005 - protein, 9 aa, Homo Sapiens
ATLDHHLYE

SEQ ID NO: 535006 - protein, 9 aa, Homo Sapiens
LPSMEEDTL

SEQ ID NO: 535007 - protein, 9 aa, Homo Sapiens
MQEQAFGGE

SEQ ID NO: 535008 - protein, 9 aa, Homo Sapiens
WCGPLPSNG

SEQ ID NO: 535009 - protein, 9 aa, Homo Sapiens
ASLELTAAK

SEQ ID NO: 535010 - protein, 9 aa, Homo Sapiens
WVWYMDGYY

SEQ ID NO: 535011 - protein, 9 aa, Homo Sapiens
YKRDNSISP

SEQ ID NO: 535012 - protein, 9 aa, Homo Sapiens
MYSQINRAS

SEQ ID NO: 535013 - protein, 9 aa, Homo Sapiens
THTGPLGCN

SEQ ID NO: 535014 - protein, 9 aa, Homo Sapiens
QMCCLPGES

SEQ ID NO: 535015 - protein, 9 aa, Homo Sapiens
HMPGLEYPN

SEQ ID NO: 535016 - protein, 9 aa, Homo Sapiens
KNPTGEPIL

SEQ ID NO: 535017 - protein, 9 aa, Homo Sapiens
QACVSSCWG

SEQ ID NO: 535018 - protein, 9 aa, Homo Sapiens
CLSADDIRG

SEQ ID NO: 535019 - protein, 9 aa, Homo Sapiens
NQHQCVQYA

SEQ ID NO: 535020 - protein, 9 aa, Homo Sapiens
ESAAMIRTK

SEQ ID NO: 535021 - protein, 9 aa, Homo Sapiens
VHGECIDVD

SEQ ID NO: 535022 - protein, 9 aa, Homo Sapiens
PRRRNRIHL

SEQ ID NO: 535023 - protein, 9 aa, Homo Sapiens
KLERERRCT

SEQ ID NO: 535024 - protein, 9 aa, Homo Sapiens
PSQCPSMEE

SEQ ID NO: 535025 - protein, 9 aa, Homo Sapiens
KLVHSLAVC

SEQ ID NO: 535026 - protein, 9 aa, Homo Sapiens
IHLKNLSNV

SEQ ID NO: 535027 - protein, 9 aa, Homo Sapiens
QRMYYMFIQ

SEQ ID NO: 535028 - protein, 9 aa, Homo Sapiens
THECFNPIV

SEQ ID NO: 535029 - protein, 9 aa, Homo Sapiens
GTGPVSPSA

SEQ ID NO: 535030 - protein, 9 aa, Homo Sapiens
NWESGLHAM

SEQ ID NO: 535031 - protein, 9 aa, Homo Sapiens
AVHQECYGA

SEQ ID NO: 535032 - protein, 9 aa, Homo Sapiens
ACRACGAGQ

SEQ ID NO: 535033 - protein, 9 aa, Homo Sapiens
TKDSLEYLD

SEQ ID NO: 535034 - protein, 9 aa, Homo Sapiens
MGEARTREV

SEQ ID NO: 535035 - protein, 9 aa, Homo Sapiens
RELQDKLQA

SEQ ID NO: 535036 - protein, 9 aa, Homo Sapiens
QGIQEPLNN

SEQ ID NO: 535037 - protein, 9 aa, Homo Sapiens
RPYFFTKGE

SEQ ID NO: 535038 - protein, 9 aa, Homo Sapiens
RRTHPGQQR

SEQ ID NO: 535039 - protein, 9 aa, Homo Sapiens
EPLLCPLGY

SEQ ID NO: 535040 - protein, 9 aa, Homo Sapiens
NQTKHSTAE

SEQ ID NO: 535041 - protein, 9 aa, Homo Sapiens
SGALSWPGF

SEQ ID NO: 535042 - protein, 9 aa, Homo Sapiens
ACVIKWLYG

SEQ ID NO: 535043 - protein, 9 aa, Homo Sapiens
PWASVTGYL

SEQ ID NO: 535044 - protein, 9 aa, Homo Sapiens
LAMGLINMA

SEQ ID NO: 535045 - protein, 9 aa, Homo Sapiens
EEQYKASQD

SEQ ID NO: 535046 - protein, 9 aa, Homo Sapiens
TTVPKMTFN

SEQ ID NO: 535047 - protein, 9 aa, Homo Sapiens
RFHLLSDPS

SEQ ID NO: 535048 - protein, 9 aa, Homo Sapiens
YVQCSAYCS

SEQ ID NO: 535049 - protein, 9 aa, Homo Sapiens
RALELSCQE

SEQ ID NO: 535050 - protein, 9 aa, Homo Sapiens
RRSISGFRV

SEQ ID NO: 535051 - protein, 9 aa, Homo Sapiens
GPVSPSANA

SEQ ID NO: 535052 - protein, 9 aa, Homo Sapiens
TAAKKQEKQ

SEQ ID NO: 535053 - protein, 9 aa, Homo Sapiens
RGQCIFVEL

SEQ ID NO: 535054 - protein, 9 aa, Homo Sapiens
YYEKEVRGR

SEQ ID NO: 535055 - protein, 9 aa, Homo Sapiens
QEQNQTKHS

SEQ ID NO: 535056 - protein, 9 aa, Homo Sapiens
KSTEGCCAK

SEQ ID NO: 535057 - protein, 9 aa, Homo Sapiens
LLRRHRGSG

SEQ ID NO: 535058 - protein, 9 aa, Homo Sapiens
KKVQVIYTQ

SEQ ID NO: 535059 - protein, 9 aa, Homo Sapiens
TDSSMDIFH

SEQ ID NO: 535060 - protein, 9 aa, Homo Sapiens
SPSTFPAPW

SEQ ID NO: 535061 - protein, 9 aa, Homo Sapiens
LWTDISAHI

SEQ ID NO: 535062 - protein, 9 aa, Homo Sapiens
WVRKDDTGC

SEQ ID NO: 535063 - protein, 9 aa, Homo Sapiens
KCQQLTAEL

SEQ ID NO: 535064 - protein, 9 aa, Homo Sapiens
VTTSPEAPP

SEQ ID NO: 535065 - protein, 9 aa, Homo Sapiens
AVVLIRKLI

SEQ ID NO: 535066 - protein, 9 aa, Homo Sapiens
RPGVALEGP

SEQ ID NO: 535067 - protein, 9 aa, Homo Sapiens
KSIPRIAAL

SEQ ID NO: 535068 - protein, 9 aa, Homo Sapiens
GVRSEHGRY

SEQ ID NO: 535069 - protein, 9 aa, Homo Sapiens
PGEHGEKGD

SEQ ID NO: 535070 - protein, 9 aa, Homo Sapiens
RYHHREFWF

SEQ ID NO: 535071 - protein, 9 aa, Homo Sapiens
ATEVTGRRW

SEQ ID NO: 535072 - protein, 9 aa, Homo Sapiens
GDGTRPYFF

SEQ ID NO: 535073 - protein, 9 aa, Homo Sapiens
ALEEISISA

SEQ ID NO: 535074 - protein, 9 aa, Homo Sapiens
QTVVNTITG

SEQ ID NO: 535075 - protein, 9 aa, Homo Sapiens
ELAWKERQL

SEQ ID NO: 535076 - protein, 9 aa, Homo Sapiens
KPPTILQTV

SEQ ID NO: 535077 - protein, 9 aa, Homo Sapiens
TFLNKTMSI

SEQ ID NO: 535078 - protein, 9 aa, Homo Sapiens
RPHFSTDQP

SEQ ID NO: 535079 - protein, 9 aa, Homo Sapiens
VTRKMVTVG

SEQ ID NO: 535080 - protein, 9 aa, Homo Sapiens
TLGAIGEGF

SEQ ID NO: 535081 - protein, 9 aa, Homo Sapiens
QKPPKGWFC

SEQ ID NO: 535082 - protein, 9 aa, Homo Sapiens
TDLLGHRQR

SEQ ID NO: 535083 - protein, 9 aa, Homo Sapiens
DKTAPLPGP

SEQ ID NO: 535084 - protein, 9 aa, Homo Sapiens
QAYHSAPER

SEQ ID NO: 535085 - protein, 9 aa, Homo Sapiens
QEKDPKYSA

SEQ ID NO: 535086 - protein, 9 aa, Homo Sapiens
SMRKGIMAY

SEQ ID NO: 535087 - protein, 9 aa, Homo Sapiens
SRPEALAME

SEQ ID NO: 535088 - protein, 9 aa, Homo Sapiens
PVKARPLDR

SEQ ID NO: 535089 - protein, 9 aa, Homo Sapiens
RPEALAMEL

SEQ ID NO: 535090 - protein, 9 aa, Homo Sapiens
VQPCNVSVT

SEQ ID NO: 535091 - protein, 9 aa, Homo Sapiens
AHQVRTHQE

SEQ ID NO: 535092 - protein, 9 aa, Homo Sapiens
SHRKQAEAE

SEQ ID NO: 535093 - protein, 9 aa, Homo Sapiens
QELQEEHAC

SEQ ID NO: 535094 - protein, 9 aa, Homo Sapiens
TLQRVPVPT

SEQ ID NO: 535095 - protein, 9 aa, Homo Sapiens
EEVQGLLAA

SEQ ID NO: 535096 - protein, 9 aa, Homo Sapiens
SEFAACLNK

SEQ ID NO: 535097 - protein, 9 aa, Homo Sapiens
MYQNLCREA

SEQ ID NO: 535098 - protein, 9 aa, Homo Sapiens
ISKESSVDC

SEQ ID NO: 535099 - protein, 9 aa, Homo Sapiens
ASAVTPSKK

SEQ ID NO: 535100 - protein, 9 aa, Homo Sapiens
LDRRVQSKD

SEQ ID NO: 535101 - protein, 9 aa, Homo Sapiens
DYRPLICDA

SEQ ID NO: 535102 - protein, 9 aa, Homo Sapiens
ENREQKNNL

SEQ ID NO: 535103 - protein, 9 aa, Homo Sapiens
PSYKRDNSI

SEQ ID NO: 535104 - protein, 9 aa, Homo Sapiens
GYGLWHSKE

SEQ ID NO: 535105 - protein, 9 aa, Homo Sapiens
GLGNLSAGQ

SEQ ID NO: 535106 - protein, 9 aa, Homo Sapiens
PRDIHLTPR

SEQ ID NO: 535107 - protein, 9 aa, Homo Sapiens
NTFEVHIYS

SEQ ID NO: 535108 - protein, 9 aa, Homo Sapiens
YLLWMGAEI

SEQ ID NO: 535109 - protein, 9 aa, Homo Sapiens
ISARTYFYT

SEQ ID NO: 535110 - protein, 9 aa, Homo Sapiens
LARVQETLH

SEQ ID NO: 535111 - protein, 9 aa, Homo Sapiens
DKNQHQCVQ

SEQ ID NO: 535112 - protein, 9 aa, Homo Sapiens
LQEENREQK

SEQ ID NO: 535113 - protein, 9 aa, Homo Sapiens
LRPWCRPIN

SEQ ID NO: 535114 - protein, 9 aa, Homo Sapiens
TLPLPRRPR

SEQ ID NO: 535115 - protein, 9 aa, Homo Sapiens
QNNGVFLPL

SEQ ID NO: 535116 - protein, 9 aa, Homo Sapiens
REKLRRAAK

SEQ ID NO: 535117 - protein, 9 aa, Homo Sapiens
TQDVHGECI

SEQ ID NO: 535118 - protein, 9 aa, Homo Sapiens
KRIASSSVS

SEQ ID NO: 535119 - protein, 9 aa, Homo Sapiens
KLSLELMNQ

SEQ ID NO: 535120 - protein, 9 aa, Homo Sapiens
SCPGAKRSE

SEQ ID NO: 535121 - protein, 9 aa, Homo Sapiens
IPNLYLKQM

SEQ ID NO: 535122 - protein, 9 aa, Homo Sapiens
KHTLPPKKK

SEQ ID NO: 535123 - protein, 9 aa, Homo Sapiens
DISAHILKL

SEQ ID NO: 535124 - protein, 9 aa, Homo Sapiens
QYLAIMTWR

SEQ ID NO: 535125 - protein, 9 aa, Homo Sapiens
PTILQTVVN

SEQ ID NO: 535126 - protein, 9 aa, Homo Sapiens
ISAHILKLP

SEQ ID NO: 535127 - protein, 9 aa, Homo Sapiens
SPRNLGSFP

SEQ ID NO: 535128 - protein, 9 aa, Homo Sapiens
HTITESGVS

SEQ ID NO: 535129 - protein, 9 aa, Homo Sapiens
WHEEQPAPG

SEQ ID NO: 535130 - protein, 9 aa, Homo Sapiens
IWTLFSTPC

SEQ ID NO: 535131 - protein, 9 aa, Homo Sapiens
TWFFWFWSD

SEQ ID NO: 535132 - protein, 9 aa, Homo Sapiens
KGEKVFERM

SEQ ID NO: 535133 - protein, 9 aa, Homo Sapiens
ITHSGHTPY

SEQ ID NO: 535134 - protein, 9 aa, Homo Sapiens
NRKHLTKSQ

SEQ ID NO: 535135 - protein, 9 aa, Homo Sapiens
RVLGPWGPP

SEQ ID NO: 535136 - protein, 9 aa, Homo Sapiens
SGMNIRQSP

SEQ ID NO: 535137 - protein, 9 aa, Homo Sapiens
LDSEGTINA

SEQ ID NO: 535138 - protein, 9 aa, Homo Sapiens
LWKELEGLA

SEQ ID NO: 535139 - protein, 9 aa, Homo Sapiens
IDTACICTL

SEQ ID NO: 535140 - protein, 9 aa, Homo Sapiens
SCWGCNWCV

SEQ ID NO: 535141 - protein, 9 aa, Homo Sapiens
NAHLGESVS

SEQ ID NO: 535142 - protein, 9 aa, Homo Sapiens
VLMFMYYTE

SEQ ID NO: 535143 - protein, 9 aa, Homo Sapiens
AGNPASFIG

SEQ ID NO: 535144 - protein, 9 aa, Homo Sapiens
STFPAPWWG

SEQ ID NO: 535145 - protein, 9 aa, Homo Sapiens
QWCQGGAIS

SEQ ID NO: 535146 - protein, 9 aa, Homo Sapiens
NLGSFPSPS

SEQ ID NO: 535147 - protein, 9 aa, Homo Sapiens
VGRSTGDEG

SEQ ID NO: 535148 - protein, 9 aa, Homo Sapiens
QSLLPTVCH

SEQ ID NO: 535149 - protein, 9 aa, Homo Sapiens
LCGQLAVIL

SEQ ID NO: 535150 - protein, 9 aa, Homo Sapiens
FGTMFFNFD

SEQ ID NO: 535151 - protein, 9 aa, Homo Sapiens
SQQECKRVM

SEQ ID NO: 535152 - protein, 9 aa, Homo Sapiens
WHSKEASLD

SEQ ID NO: 535153 - protein, 9 aa, Homo Sapiens
CEVWGKPRP

SEQ ID NO: 535154 - protein, 9 aa, Homo Sapiens
GTLAHAFLP

SEQ ID NO: 535155 - protein, 9 aa, Homo Sapiens
CQTLQDHTE

SEQ ID NO: 535156 - protein, 9 aa, Homo Sapiens
AIQFPRRSI

SEQ ID NO: 535157 - protein, 9 aa, Homo Sapiens
IEHISRICH

SEQ ID NO: 535158 - protein, 9 aa, Homo Sapiens
HMSLMRHHM

SEQ ID NO: 535159 - protein, 9 aa, Homo Sapiens
RGDGTRPYF

SEQ ID NO: 535160 - protein, 9 aa, Homo Sapiens
YHPGCFQCS

SEQ ID NO: 535161 - protein, 9 aa, Homo Sapiens
IHIRSLKIE

SEQ ID NO: 535162 - protein, 9 aa, Homo Sapiens
APHTLPLPR

SEQ ID NO: 535163 - protein, 9 aa, Homo Sapiens
PCALSFVLS

SEQ ID NO: 535164 - protein, 9 aa, Homo Sapiens
KVYQAVQHN

SEQ ID NO: 535165 - protein, 9 aa, Homo Sapiens
RKMSGADTI

SEQ ID NO: 535166 - protein, 9 aa, Homo Sapiens
RHQDRDRDR

SEQ ID NO: 535167 - protein, 9 aa, Homo Sapiens
IKPPTILQT

SEQ ID NO: 535168 - protein, 9 aa, Homo Sapiens
MVGIPLFFE

SEQ ID NO: 535169 - protein, 9 aa, Homo Sapiens
MLNSAAPAS

SEQ ID NO: 535170 - protein, 9 aa, Homo Sapiens
PCVLCQCQE

SEQ ID NO: 535171 - protein, 9 aa, Homo Sapiens
YHCFKELST

SEQ ID NO: 535172 - protein, 9 aa, Homo Sapiens
SAVPHAPDA

SEQ ID NO: 535173 - protein, 9 aa, Homo Sapiens
MSKAPLHFP

SEQ ID NO: 535174 - protein, 9 aa, Homo Sapiens
SSETVELAR

SEQ ID NO: 535175 - protein, 9 aa, Homo Sapiens
ACHSQQVWR

SEQ ID NO: 535176 - protein, 9 aa, Homo Sapiens
ICNPPLNSP

SEQ ID NO: 535177 - protein, 9 aa, Homo Sapiens
SEQQKHVVF

SEQ ID NO: 535178 - protein, 9 aa, Homo Sapiens
RVFHTITES

SEQ ID NO: 535179 - protein, 9 aa, Homo Sapiens
LQEKDPKYS

SEQ ID NO: 535180 - protein, 9 aa, Homo Sapiens
ARRTHPGQQ

SEQ ID NO: 535181 - protein, 9 aa, Homo Sapiens
AKTDPVTAE

SEQ ID NO: 535182 - protein, 9 aa, Homo Sapiens
NTWALEEIS

SEQ ID NO: 535183 - protein, 9 aa, Homo Sapiens
DDPIWCGPL

SEQ ID NO: 535184 - protein, 9 aa, Homo Sapiens
PSPTTEVRW

SEQ ID NO: 535185 - protein, 9 aa, Homo Sapiens
EFFLIQDTS

SEQ ID NO: 535186 - protein, 9 aa, Homo Sapiens
DLMHISQAR

SEQ ID NO: 535187 - protein, 9 aa, Homo Sapiens
HSAMPTKSK

SEQ ID NO: 535188 - protein, 9 aa, Homo Sapiens
MRRRDFANM

SEQ ID NO: 535189 - protein, 9 aa, Homo Sapiens
LSNLGDFRF

SEQ ID NO: 535190 - protein, 9 aa, Homo Sapiens
CIEDRNAHL

SEQ ID NO: 535191 - protein, 9 aa, Homo Sapiens
VYGILRAPC

SEQ ID NO: 535192 - protein, 9 aa, Homo Sapiens
VVYTKGADL

SEQ ID NO: 535193 - protein, 9 aa, Homo Sapiens
QQRLAVLEQ

SEQ ID NO: 535194 - protein, 9 aa, Homo Sapiens
QDCTVAVIY

SEQ ID NO: 535195 - protein, 9 aa, Homo Sapiens
NEGTTSMLT

SEQ ID NO: 535196 - protein, 9 aa, Homo Sapiens
RHQAHSSSG

SEQ ID NO: 535197 - protein, 9 aa, Homo Sapiens
LKDMADSRC

SEQ ID NO: 535198 - protein, 9 aa, Homo Sapiens
TAVTAPGAD

SEQ ID NO: 535199 - protein, 9 aa, Homo Sapiens
KCRNEKMEV

SEQ ID NO: 535200 - protein, 9 aa, Homo Sapiens
YRQLQEKDP

SEQ ID NO: 535201 - protein, 9 aa, Homo Sapiens
FDGPGGTLA

SEQ ID NO: 535202 - protein, 9 aa, Homo Sapiens
MLMGVCKQG

SEQ ID NO: 535203 - protein, 9 aa, Homo Sapiens
VSDTMVEPY

SEQ ID NO: 535204 - protein, 9 aa, Homo Sapiens
VDINTFCLS

SEQ ID NO: 535205 - protein, 9 aa, Homo Sapiens
VPIDDSFCG

SEQ ID NO: 535206 - protein, 9 aa, Homo Sapiens
DETETLKKS

SEQ ID NO: 535207 - protein, 9 aa, Homo Sapiens
TFTGLSHLQ

SEQ ID NO: 535208 - protein, 9 aa, Homo Sapiens
EAACLCATF

SEQ ID NO: 535209 - protein, 9 aa, Homo Sapiens
YYMFIQMLS

SEQ ID NO: 535210 - protein, 9 aa, Homo Sapiens
VSWMIVQTV

SEQ ID NO: 535211 - protein, 9 aa, Homo Sapiens
DIHLTPRPG

SEQ ID NO: 535212 - protein, 9 aa, Homo Sapiens
QPWTPCKMF

SEQ ID NO: 535213 - protein, 9 aa, Homo Sapiens
PEIHFLLES

SEQ ID NO: 535214 - protein, 9 aa, Homo Sapiens
FGGHNKPKI

SEQ ID NO: 535215 - protein, 9 aa, Homo Sapiens
KHSTAELMA

SEQ ID NO: 535216 - protein, 9 aa, Homo Sapiens
EVPAGEGPC

SEQ ID NO: 535217 - protein, 9 aa, Homo Sapiens
GVCRDGINC

SEQ ID NO: 535218 - protein, 9 aa, Homo Sapiens
AAIQDMFLC

SEQ ID NO: 535219 - protein, 9 aa, Homo Sapiens
AATAPVVTL

SEQ ID NO: 535220 - protein, 9 aa, Homo Sapiens
NGVFLPLSP

SEQ ID NO: 535221 - protein, 9 aa, Homo Sapiens
SYSLTQDCT

SEQ ID NO: 535222 - protein, 9 aa, Homo Sapiens
VTAVTAPGA

SEQ ID NO: 535223 - protein, 9 aa, Homo Sapiens
YFQCRLGLA

SEQ ID NO: 535224 - protein, 9 aa, Homo Sapiens
NCYDCVCQP

SEQ ID NO: 535225 - protein, 9 aa, Homo Sapiens
NCELDKNQH

SEQ ID NO: 535226 - protein, 9 aa, Homo Sapiens
TKQLMILAD

SEQ ID NO: 535227 - protein, 9 aa, Homo Sapiens
CATFANHSG

SEQ ID NO: 535228 - protein, 9 aa, Homo Sapiens
AMIRTKVFV

SEQ ID NO: 535229 - protein, 9 aa, Homo Sapiens
SERRRKCLQ

SEQ ID NO: 535230 - protein, 9 aa, Homo Sapiens
YPEVEWGSG

SEQ ID NO: 535231 - protein, 9 aa, Homo Sapiens
LLREENRVL

SEQ ID NO: 535232 - protein, 9 aa, Homo Sapiens
SGETMHTDK

SEQ ID NO: 535233 - protein, 9 aa, Homo Sapiens
DPAEVLGEW

SEQ ID NO: 535234 - protein, 9 aa, Homo Sapiens
EEKFARIEA

SEQ ID NO: 535235 - protein, 9 aa, Homo Sapiens
YVEWFNHLS

SEQ ID NO: 535236 - protein, 9 aa, Homo Sapiens
LCNTCADML

SEQ ID NO: 535237 - protein, 9 aa, Homo Sapiens
SCITMMCNE

SEQ ID NO: 535238 - protein, 9 aa, Homo Sapiens
FKCVGVPST

SEQ ID NO: 535239 - protein, 9 aa, Homo Sapiens
ESNPQLHQA

SEQ ID NO: 535240 - protein, 9 aa, Homo Sapiens
PHSFHAAAY

SEQ ID NO: 535241 - protein, 9 aa, Homo Sapiens
SENDTFCLE

SEQ ID NO: 535242 - protein, 9 aa, Homo Sapiens
LEKMKMFIP

SEQ ID NO: 535243 - protein, 9 aa, Homo Sapiens
EKVSFVSGG

SEQ ID NO: 535244 - protein, 9 aa, Homo Sapiens
ANSSAMETI

SEQ ID NO: 535245 - protein, 9 aa, Homo Sapiens
LPLFKWQYE

SEQ ID NO: 535246 - protein, 9 aa, Homo Sapiens
SAETLLDIL

SEQ ID NO: 535247 - protein, 9 aa, Homo Sapiens
EQVSRSQQQ

SEQ ID NO: 535248 - protein, 9 aa, Homo Sapiens
GSGLGNLSA

SEQ ID NO: 535249 - protein, 9 aa, Homo Sapiens
MVSATHIVY

SEQ ID NO: 535250 - protein, 9 aa, Homo Sapiens
ENGTKLLPT

SEQ ID NO: 535251 - protein, 9 aa, Homo Sapiens
ASCMTVSCP

SEQ ID NO: 535252 - protein, 9 aa, Homo Sapiens
WFNHLSYLV

SEQ ID NO: 535253 - protein, 9 aa, Homo Sapiens
DVYADFQST

SEQ ID NO: 535254 - protein, 9 aa, Homo Sapiens
DIKKPEQDN

SEQ ID NO: 535255 - protein, 9 aa, Homo Sapiens
SRSVTITVA

SEQ ID NO: 535256 - protein, 9 aa, Homo Sapiens
SGMPLCCAT

SEQ ID NO: 535257 - protein, 9 aa, Homo Sapiens
DLFRVQLIS

SEQ ID NO: 535258 - protein, 9 aa, Homo Sapiens
KAPKNTDWT

SEQ ID NO: 535259 - protein, 9 aa, Homo Sapiens
HKRCREFVT

SEQ ID NO: 535260 - protein, 9 aa, Homo Sapiens
LLDRRVLLL

SEQ ID NO: 535261 - protein, 9 aa, Homo Sapiens
PRPQGPPGP

SEQ ID NO: 535262 - protein, 9 aa, Homo Sapiens
HAVRAPALP

SEQ ID NO: 535263 - protein, 9 aa, Homo Sapiens
LRSLQEEAL

SEQ ID NO: 535264 - protein, 9 aa, Homo Sapiens
IMLMGVCKQ

SEQ ID NO: 535265 - protein, 9 aa, Homo Sapiens
LKSSAMDCE

SEQ ID NO: 535266 - protein, 9 aa, Homo Sapiens
QQMAANQAA

SEQ ID NO: 535267 - protein, 9 aa, Homo Sapiens
YQQIVGGAN

SEQ ID NO: 535268 - protein, 9 aa, Homo Sapiens
DWVRDRFWE

SEQ ID NO: 535269 - protein, 9 aa, Homo Sapiens
RDYVVMSVY

SEQ ID NO: 535270 - protein, 9 aa, Homo Sapiens
THCLVTCAG

SEQ ID NO: 535271 - protein, 9 aa, Homo Sapiens
SWKKAVEAK

SEQ ID NO: 535272 - protein, 9 aa, Homo Sapiens
KPLGEGRFS

SEQ ID NO: 535273 - protein, 9 aa, Homo Sapiens
HDHYPESQM

SEQ ID NO: 535274 - protein, 9 aa, Homo Sapiens
LGGNNPLGT

SEQ ID NO: 535275 - protein, 9 aa, Homo Sapiens
EFLVYQCEK

SEQ ID NO: 535276 - protein, 9 aa, Homo Sapiens
HPMKALDFR

SEQ ID NO: 535277 - protein, 9 aa, Homo Sapiens
SQFPPLHMP

SEQ ID NO: 535278 - protein, 9 aa, Homo Sapiens
DVRAWSSLT

SEQ ID NO: 535279 - protein, 9 aa, Homo Sapiens
QDMVLAYRP

SEQ ID NO: 535280 - protein, 9 aa, Homo Sapiens
DNQHWHSVL

SEQ ID NO: 535281 - protein, 9 aa, Homo Sapiens
QTLQDHTEK

SEQ ID NO: 535282 - protein, 9 aa, Homo Sapiens
QDLMHISQA

SEQ ID NO: 535283 - protein, 9 aa, Homo Sapiens
CRGPDGHFV

SEQ ID NO: 535284 - protein, 9 aa, Homo Sapiens
GGVQYGARV

SEQ ID NO: 535285 - protein, 9 aa, Homo Sapiens
SPTMAHQVR

SEQ ID NO: 535286 - protein, 9 aa, Homo Sapiens
AFLLRNPAV

SEQ ID NO: 535287 - protein, 9 aa, Homo Sapiens
SSSASAVTP

SEQ ID NO: 535288 - protein, 9 aa, Homo Sapiens
AIACKRIRL

SEQ ID NO: 535289 - protein, 9 aa, Homo Sapiens
EENPYFCLK

SEQ ID NO: 535290 - protein, 9 aa, Homo Sapiens
TITVAYLMQ

SEQ ID NO: 535291 - protein, 9 aa, Homo Sapiens
RNVLDELWH

SEQ ID NO: 535292 - protein, 9 aa, Homo Sapiens
HRCCGCNCC

SEQ ID NO: 535293 - protein, 9 aa, Homo Sapiens
HALKVVHFV

SEQ ID NO: 535294 - protein, 9 aa, Homo Sapiens
VCARLLQLG

SEQ ID NO: 535295 - protein, 9 aa, Homo Sapiens
ISQAYHSAP

SEQ ID NO: 535296 - protein, 9 aa, Homo Sapiens
PVNDTDYSL

SEQ ID NO: 535297 - protein, 9 aa, Homo Sapiens
PNWASDDCK

SEQ ID NO: 535298 - protein, 9 aa, Homo Sapiens
YNKERTHNI

SEQ ID NO: 535299 - protein, 9 aa, Homo Sapiens
TSMLTMNPV

SEQ ID NO: 535300 - protein, 9 aa, Homo Sapiens
TILQTVVNT

SEQ ID NO: 535301 - protein, 9 aa, Homo Sapiens
EAENTPMEL

SEQ ID NO: 535302 - protein, 9 aa, Homo Sapiens
LIMRRHVRS

SEQ ID NO: 535303 - protein, 9 aa, Homo Sapiens
SRSQQQGLR

SEQ ID NO: 535304 - protein, 9 aa, Homo Sapiens
VVKTTSRDY

SEQ ID NO: 535305 - protein, 9 aa, Homo Sapiens
GAGAMSGLP

SEQ ID NO: 535306 - protein, 9 aa, Homo Sapiens
ADEADLQAK

SEQ ID NO: 535307 - protein, 9 aa, Homo Sapiens
RNFWPGIGG

SEQ ID NO: 535308 - protein, 9 aa, Homo Sapiens
ARIGRKVFT

SEQ ID NO: 535309 - protein, 9 aa, Homo Sapiens
LTDNFIAAM

SEQ ID NO: 535310 - protein, 9 aa, Homo Sapiens
PNPNVKYIP

SEQ ID NO: 535311 - protein, 9 aa, Homo Sapiens
LTVQPCNVS

SEQ ID NO: 535312 - protein, 9 aa, Homo Sapiens
GELSQGFAR

SEQ ID NO: 535313 - protein, 9 aa, Homo Sapiens
KVPVHDQVL

SEQ ID NO: 535314 - protein, 9 aa, Homo Sapiens
LVHSLAVCE

SEQ ID NO: 535315 - protein, 9 aa, Homo Sapiens
HVTNVCESK

SEQ ID NO: 535316 - protein, 9 aa, Homo Sapiens
SAVYIYNRN

SEQ ID NO: 535317 - protein, 9 aa, Homo Sapiens
YTNEAKCDS

SEQ ID NO: 535318 - protein, 9 aa, Homo Sapiens
AGPLWRTTA

SEQ ID NO: 535319 - protein, 9 aa, Homo Sapiens
KWQYENHIF

SEQ ID NO: 535320 - protein, 9 aa, Homo Sapiens
AEKALNQTK

SEQ ID NO: 535321 - protein, 9 aa, Homo Sapiens
TVPKMTFNY

SEQ ID NO: 535322 - protein, 9 aa, Homo Sapiens
LTMNLYEGH

SEQ ID NO: 535323 - protein, 9 aa, Homo Sapiens
NDVETAHCT

SEQ ID NO: 535324 - protein, 9 aa, Homo Sapiens
GKGFRLQCM

SEQ ID NO: 535325 - protein, 9 aa, Homo Sapiens
TTSRDYVVM

SEQ ID NO: 535326 - protein, 9 aa, Homo Sapiens
GGGFGTAGG

SEQ ID NO: 535327 - protein, 9 aa, Homo Sapiens
SGMILGGNN

SEQ ID NO: 535328 - protein, 9 aa, Homo Sapiens
ILGLEEVQL

SEQ ID NO: 535329 - protein, 9 aa, Homo Sapiens
AGITFKCVG

SEQ ID NO: 535330 - protein, 9 aa, Homo Sapiens
GDRPETDIL

SEQ ID NO: 535331 - protein, 9 aa, Homo Sapiens
CLETHECFN

SEQ ID NO: 535332 - protein, 9 aa, Homo Sapiens
LAGDAPPPH

SEQ ID NO: 535333 - protein, 9 aa, Homo Sapiens
PTAEEAQHW

SEQ ID NO: 535334 - protein, 9 aa, Homo Sapiens
SLHRVQVTA

SEQ ID NO: 535335 - protein, 9 aa, Homo Sapiens
HTCKAPKNT

SEQ ID NO: 535336 - protein, 9 aa, Homo Sapiens
ATHNEWYDF

SEQ ID NO: 535337 - protein, 9 aa, Homo Sapiens
YILDHYVQC

SEQ ID NO: 535338 - protein, 9 aa, Homo Sapiens
QAWEWQRQE

SEQ ID NO: 535339 - protein, 9 aa, Homo Sapiens
LAHLLFLMG

SEQ ID NO: 535340 - protein, 9 aa, Homo Sapiens
IAALGVECV

SEQ ID NO: 535341 - protein, 9 aa, Homo Sapiens
WSDLNFLFI

SEQ ID NO: 535342 - protein, 9 aa, Homo Sapiens
YSSRAYFFN

SEQ ID NO: 535343 - protein, 9 aa, Homo Sapiens
PASDESSYQ

SEQ ID NO: 535344 - protein, 9 aa, Homo Sapiens
PGGTLAHAF

SEQ ID NO: 535345 - protein, 9 aa, Homo Sapiens
VVINPQVSR

SEQ ID NO: 535346 - protein, 9 aa, Homo Sapiens
ESGRVERLW

SEQ ID NO: 535347 - protein, 9 aa, Homo Sapiens
SRGRGQCIF

SEQ ID NO: 535348 - protein, 9 aa, Homo Sapiens
EGANLRTVD

SEQ ID NO: 535349 - protein, 9 aa, Homo Sapiens
YVRGDGTRP

SEQ ID NO: 535350 - protein, 9 aa, Homo Sapiens
VVVYPEVEW

SEQ ID NO: 535351 - protein, 9 aa, Homo Sapiens
DLEMLSLQS

SEQ ID NO: 535352 - protein, 9 aa, Homo Sapiens
VNIWDLTMA

SEQ ID NO: 535353 - protein, 9 aa, Homo Sapiens
HSLAVCEES

SEQ ID NO: 535354 - protein, 9 aa, Homo Sapiens
EGCLGVLCL

SEQ ID NO: 535355 - protein, 9 aa, Homo Sapiens
PVAPGSLKT

SEQ ID NO: 535356 - protein, 9 aa, Homo Sapiens
TPGAFLLRN

SEQ ID NO: 535357 - protein, 9 aa, Homo Sapiens
QTFCKIIRS

SEQ ID NO: 535358 - protein, 9 aa, Homo Sapiens
YQLVVQTMT

SEQ ID NO: 535359 - protein, 9 aa, Homo Sapiens
SALWAALAH

SEQ ID NO: 535360 - protein, 9 aa, Homo Sapiens
TISTSPVLL

SEQ ID NO: 535361 - protein, 9 aa, Homo Sapiens
QAQSLLPTV

SEQ ID NO: 535362 - protein, 9 aa, Homo Sapiens
IQSFEKKVQ

SEQ ID NO: 535363 - protein, 9 aa, Homo Sapiens
EFIPMHDSP

SEQ ID NO: 535364 - protein, 9 aa, Homo Sapiens
LDLVLDLEL

SEQ ID NO: 535365 - protein, 9 aa, Homo Sapiens
ACVSSCWGC

SEQ ID NO: 535366 - protein, 9 aa, Homo Sapiens
HQDRDRDRD

SEQ ID NO: 535367 - protein, 9 aa, Homo Sapiens
VGGANYYFN

SEQ ID NO: 535368 - protein, 9 aa, Homo Sapiens
GRFSICRKC

SEQ ID NO: 535369 - protein, 9 aa, Homo Sapiens
RSLVLFSRF

SEQ ID NO: 535370 - protein, 9 aa, Homo Sapiens
MAEAHVRIH

SEQ ID NO: 535371 - protein, 9 aa, Homo Sapiens
RTHNIVKYD

SEQ ID NO: 535372 - protein, 9 aa, Homo Sapiens
TPICNPPLN

SEQ ID NO: 535373 - protein, 9 aa, Homo Sapiens
KILLYYKAQ

SEQ ID NO: 535374 - protein, 9 aa, Homo Sapiens
ALVTRKMVT

SEQ ID NO: 535375 - protein, 9 aa, Homo Sapiens
EVAGWEMLI

SEQ ID NO: 535376 - protein, 9 aa, Homo Sapiens
GVFLPLSPA

SEQ ID NO: 535377 - protein, 9 aa, Homo Sapiens
DSKELRRRR

SEQ ID NO: 535378 - protein, 9 aa, Homo Sapiens
TVLFPLALS

SEQ ID NO: 535379 - protein, 9 aa, Homo Sapiens
TNPKAREWY

SEQ ID NO: 535380 - protein, 9 aa, Homo Sapiens
ECFNPIVNK

SEQ ID NO: 535381 - protein, 9 aa, Homo Sapiens
NPQVSREDM

SEQ ID NO: 535382 - protein, 9 aa, Homo Sapiens
RSIRSGRIR

SEQ ID NO: 535383 - protein, 9 aa, Homo Sapiens
KDLRIHKRT

SEQ ID NO: 535384 - protein, 9 aa, Homo Sapiens
QRLAVLEQE

SEQ ID NO: 535385 - protein, 9 aa, Homo Sapiens
SDGRGKQHA

SEQ ID NO: 535386 - protein, 9 aa, Homo Sapiens
FARYLAMQT

SEQ ID NO: 535387 - protein, 9 aa, Homo Sapiens
ASTLQPTPL

SEQ ID NO: 535388 - protein, 9 aa, Homo Sapiens
KYHYQWCQG

SEQ ID NO: 535389 - protein, 9 aa, Homo Sapiens
KAPVPIDDS

SEQ ID NO: 535390 - protein, 9 aa, Homo Sapiens
KHQKERQCQ

SEQ ID NO: 535391 - protein, 9 aa, Homo Sapiens
FRFLFIDLA

SEQ ID NO: 535392 - protein, 9 aa, Homo Sapiens
GSMAIKFVD

SEQ ID NO: 535393 - protein, 9 aa, Homo Sapiens
WCQGGAISD

SEQ ID NO: 535394 - protein, 9 aa, Homo Sapiens
CGTGGGTHW

SEQ ID NO: 535395 - protein, 9 aa, Homo Sapiens
YKGEKVFER

SEQ ID NO: 535396 - protein, 9 aa, Homo Sapiens
RSLVTSRSV

SEQ ID NO: 535397 - protein, 9 aa, Homo Sapiens
KYIPFDEMK

SEQ ID NO: 535398 - protein, 9 aa, Homo Sapiens
KKPEQDNWE

SEQ ID NO: 535399 - protein, 9 aa, Homo Sapiens
GSTHNITQG

SEQ ID NO: 535400 - protein, 9 aa, Homo Sapiens
GGLRNYGYH

SEQ ID NO: 535401 - protein, 9 aa, Homo Sapiens
SLHRSQQEC

SEQ ID NO: 535402 - protein, 9 aa, Homo Sapiens
TFLLFTVFW

SEQ ID NO: 535403 - protein, 9 aa, Homo Sapiens
NVPDEDEGW

SEQ ID NO: 535404 - protein, 9 aa, Homo Sapiens
SKMVKFLLE

SEQ ID NO: 535405 - protein, 9 aa, Homo Sapiens
VRADSGQER

SEQ ID NO: 535406 - protein, 9 aa, Homo Sapiens
RAGPPGATG

SEQ ID NO: 535407 - protein, 9 aa, Homo Sapiens
SYYSRVLAE

SEQ ID NO: 535408 - protein, 9 aa, Homo Sapiens
LFPLRCPPL

SEQ ID NO: 535409 - protein, 9 aa, Homo Sapiens
VKPDEEVIP

SEQ ID NO: 535410 - protein, 9 aa, Homo Sapiens
KHRKSLKQK

SEQ ID NO: 535411 - protein, 9 aa, Homo Sapiens
LQEGCSYYS

SEQ ID NO: 535412 - protein, 9 aa, Homo Sapiens
HQDIKPDNI

SEQ ID NO: 535413 - protein, 9 aa, Homo Sapiens
LMLSFFRPT

SEQ ID NO: 535414 - protein, 9 aa, Homo Sapiens
SSHHTGRTS

SEQ ID NO: 535415 - protein, 9 aa, Homo Sapiens
QQDRSETTR

SEQ ID NO: 535416 - protein, 9 aa, Homo Sapiens
NRAGGDVRV

SEQ ID NO: 535417 - protein, 9 aa, Homo Sapiens
VTVQVGKTT

SEQ ID NO: 535418 - protein, 9 aa, Homo Sapiens
DLPTTESER

SEQ ID NO: 535419 - protein, 9 aa, Homo Sapiens
TQFTGAIGA

SEQ ID NO: 535420 - protein, 9 aa, Homo Sapiens
AMLSCQVAQ

SEQ ID NO: 535421 - protein, 9 aa, Homo Sapiens
HFDQENIKE

SEQ ID NO: 535422 - protein, 9 aa, Homo Sapiens
QDRSETTRV

SEQ ID NO: 535423 - protein, 9 aa, Homo Sapiens
KWMCVAAWQ

SEQ ID NO: 535424 - protein, 9 aa, Homo Sapiens
KFKTGGEWW

SEQ ID NO: 535425 - protein, 9 aa, Homo Sapiens
ASQVCLRTQ

SEQ ID NO: 535426 - protein, 9 aa, Homo Sapiens
GGDVRVTPL

SEQ ID NO: 535427 - protein, 9 aa, Homo Sapiens
AHFLEAGEE

SEQ ID NO: 535428 - protein, 9 aa, Homo Sapiens
VSVKPDEEV

SEQ ID NO: 535429 - protein, 9 aa, Homo Sapiens
ERMTPKPVL

SEQ ID NO: 535430 - protein, 9 aa, Homo Sapiens
KKINTGEKP

SEQ ID NO: 535431 - protein, 9 aa, Homo Sapiens
EQLNIIEMK

SEQ ID NO: 535432 - protein, 9 aa, Homo Sapiens
SELEIYAKD

SEQ ID NO: 535433 - protein, 9 aa, Homo Sapiens
RRNKCPPPP

SEQ ID NO: 535434 - protein, 9 aa, Homo Sapiens
VERMTPKPV

SEQ ID NO: 535435 - protein, 9 aa, Homo Sapiens
PTGTSLTPD

SEQ ID NO: 535436 - protein, 9 aa, Homo Sapiens
APALPGLLS

SEQ ID NO: 535437 - protein, 9 aa, Homo Sapiens
CFDLPTTES

SEQ ID NO: 535438 - protein, 9 aa, Homo Sapiens
SVKPDEEVI

SEQ ID NO: 535439 - protein, 9 aa, Homo Sapiens
KQPEKLTQT

SEQ ID NO: 535440 - protein, 9 aa, Homo Sapiens
RNRWTYEEF

SEQ ID NO: 535441 - protein, 9 aa, Homo Sapiens
MGVCFDLPT

SEQ ID NO: 535442 - protein, 9 aa, Homo Sapiens
AGKEEYSAM

SEQ ID NO: 535443 - protein, 9 aa, Homo Sapiens
KLPTSELEI

SEQ ID NO: 535444 - protein, 9 aa, Homo Sapiens
MLSFFRPTP

SEQ ID NO: 535445 - protein, 9 aa, Homo Sapiens
GSSIEMGSV

SEQ ID NO: 535446 - protein, 9 aa, Homo Sapiens
VLIDRRAEE

SEQ ID NO: 535447 - protein, 9 aa, Homo Sapiens
HKKINTGEK

SEQ ID NO: 535448 - protein, 9 aa, Homo Sapiens
HRKSLKQKK

SEQ ID NO: 535449 - protein, 9 aa, Homo Sapiens
IDRRAEEIK

SEQ ID NO: 535450 - protein, 9 aa, Homo Sapiens
SHHTGRTSK

SEQ ID NO: 535451 - protein, 9 aa, Homo Sapiens
VEQDSSHHT

SEQ ID NO: 535452 - protein, 9 aa, Homo Sapiens
YSRVLAENE

SEQ ID NO: 535453 - protein, 9 aa, Homo Sapiens
SLYVLIDRR

SEQ ID NO: 535454 - protein, 9 aa, Homo Sapiens
LASQVCLRT

SEQ ID NO: 535455 - protein, 9 aa, Homo Sapiens
YVLIDRRAE

SEQ ID NO: 535456 - protein, 9 aa, Homo Sapiens
AAPALPGLL

SEQ ID NO: 535457 - protein, 9 aa, Homo Sapiens
AVSEVSFLA

SEQ ID NO: 535458 - protein, 9 aa, Homo Sapiens
SSGLKYNAR

SEQ ID NO: 535459 - protein, 9 aa, Homo Sapiens
KEEYSAMRD

SEQ ID NO: 535460 - protein, 9 aa, Homo Sapiens
FQRIAGEAS

SEQ ID NO: 535461 - protein, 9 aa, Homo Sapiens
AYKAVRADS

SEQ ID NO: 535462 - protein, 9 aa, Homo Sapiens
LTQTPGCCR

SEQ ID NO: 535463 - protein, 9 aa, Homo Sapiens
MTFSFGGIF

SEQ ID NO: 535464 - protein, 9 aa, Homo Sapiens
RAGGDVRVT

SEQ ID NO: 535465 - protein, 9 aa, Homo Sapiens
RPTPKRYKI

SEQ ID NO: 535466 - protein, 9 aa, Homo Sapiens
LIDRRAEEI

SEQ ID NO: 535467 - protein, 9 aa, Homo Sapiens
HHTGRTSKQ

SEQ ID NO: 535468 - protein, 9 aa, Homo Sapiens
HLLMLSFFR

SEQ ID NO: 535469 - protein, 9 aa, Homo Sapiens
FGGIFLFTL

SEQ ID NO: 535470 - protein, 9 aa, Homo Sapiens
EQQVERMTP

SEQ ID NO: 535471 - protein, 9 aa, Homo Sapiens
YEMDICITI

SEQ ID NO: 535472 - protein, 9 aa, Homo Sapiens
RRAEEIKQG

SEQ ID NO: 535473 - protein, 9 aa, Homo Sapiens
VHMYVQMYA

SEQ ID NO: 535474 - protein, 9 aa, Homo Sapiens
AVRADSGQE

SEQ ID NO: 535475 - protein, 9 aa, Homo Sapiens
PLRCPPLRN

SEQ ID NO: 535476 - protein, 9 aa, Homo Sapiens
KINTGEKPY

SEQ ID NO: 535477 - protein, 9 aa, Homo Sapiens
QVGKTTKRT

SEQ ID NO: 535478 - protein, 9 aa, Homo Sapiens
EMILKHRKS

SEQ ID NO: 535479 - protein, 9 aa, Homo Sapiens
VHKMGFIHQ

SEQ ID NO: 535480 - protein, 9 aa, Homo Sapiens
PKITPTGTS

SEQ ID NO: 535481 - protein, 9 aa, Homo Sapiens
IFQRIAGEA

SEQ ID NO: 535482 - protein, 9 aa, Homo Sapiens
FLEAGEEVR

SEQ ID NO: 535483 - protein, 9 aa, Homo Sapiens
RNKCPPPPL

SEQ ID NO: 535484 - protein, 9 aa, Homo Sapiens
TGAIGAIMT

SEQ ID NO: 535485 - protein, 9 aa, Homo Sapiens
TKLPTSELE

SEQ ID NO: 535486 - protein, 9 aa, Homo Sapiens
AVINNNSKM

SEQ ID NO: 535487 - protein, 9 aa, Homo Sapiens
KLFPLRCPP

SEQ ID NO: 535488 - protein, 9 aa, Homo Sapiens
ISRMHYHMS

SEQ ID NO: 535489 - protein, 9 aa, Homo Sapiens
VATVGSAAM

SEQ ID NO: 535490 - protein, 9 aa, Homo Sapiens
YKAVRADSG

SEQ ID NO: 535491 - protein, 9 aa, Homo Sapiens
FRPTPKRYK

SEQ ID NO: 535492 - protein, 9 aa, Homo Sapiens
EMDICITIQ

SEQ ID NO: 535493 - protein, 9 aa, Homo Sapiens
EVYDPFHFD

SEQ ID NO: 535494 - protein, 9 aa, Homo Sapiens
LNIIEMKNK

SEQ ID NO: 535495 - protein, 9 aa, Homo Sapiens
GARGRAGPP

SEQ ID NO: 535496 - protein, 9 aa, Homo Sapiens
GLGSSIEMG

SEQ ID NO: 535497 - protein, 9 aa, Homo Sapiens
SFVNDIFQR

SEQ ID NO: 535498 - protein, 9 aa, Homo Sapiens
AWQREPGYT

SEQ ID NO: 535499 - protein, 9 aa, Homo Sapiens
PKYLKILSS

SEQ ID NO: 535500 - protein, 9 aa, Homo Sapiens
QLNIIEMKN

SEQ ID NO: 535501 - protein, 9 aa, Homo Sapiens
LGSSIEMGS

SEQ ID NO: 535502 - protein, 9 aa, Homo Sapiens
QQVERMTPK

SEQ ID NO: 535503 - protein, 9 aa, Homo Sapiens
TVQVGKTTK

SEQ ID NO: 535504 - protein, 9 aa, Homo Sapiens
TTAMLSCQV

SEQ ID NO: 535505 - protein, 9 aa, Homo Sapiens
SCQVAQPQT

SEQ ID NO: 535506 - protein, 9 aa, Homo Sapiens
ADSGQERFN

SEQ ID NO: 535507 - protein, 9 aa, Homo Sapiens
RAEEIKQGN

SEQ ID NO: 535508 - protein, 9 aa, Homo Sapiens
ESEDVEAQE

SEQ ID NO: 535509 - protein, 9 aa, Homo Sapiens
TVEQDSSHH

SEQ ID NO: 535510 - protein, 9 aa, Homo Sapiens
ATVGSAAMG

SEQ ID NO: 535511 - protein, 9 aa, Homo Sapiens
TFSFGGIFL

SEQ ID NO: 535512 - protein, 9 aa, Homo Sapiens
NNNSKMVKF

SEQ ID NO: 535513 - protein, 9 aa, Homo Sapiens
YEYVHMYVQ

SEQ ID NO: 535514 - protein, 9 aa, Homo Sapiens
PFHFDQENI

SEQ ID NO: 535515 - protein, 9 aa, Homo Sapiens
QRIAGEASR

SEQ ID NO: 535516 - protein, 9 aa, Homo Sapiens
PVATVGSAA

SEQ ID NO: 535517 - protein, 9 aa, Homo Sapiens
DATSEATKS

SEQ ID NO: 535518 - protein, 9 aa, Homo Sapiens
AGGDVRVTP

SEQ ID NO: 535519 - protein, 9 aa, Homo Sapiens
RMHYHMSSK

SEQ ID NO: 535520 - protein, 9 aa, Homo Sapiens
CEGRRNKCP

SEQ ID NO: 535521 - protein, 9 aa, Homo Sapiens
RCPPLRNSP

SEQ ID NO: 535522 - protein, 9 aa, Homo Sapiens
NGPVATVGS

SEQ ID NO: 535523 - protein, 9 aa, Homo Sapiens
NSFVNDIFQ

SEQ ID NO: 535524 - protein, 9 aa, Homo Sapiens
HFPVSVKPD

SEQ ID NO: 535525 - protein, 9 aa, Homo Sapiens
PEKLTQTPG

SEQ ID NO: 535526 - protein, 9 aa, Homo Sapiens
WTYEEFLDH

SEQ ID NO: 535527 - protein, 9 aa, Homo Sapiens
TPTGTSLTP

SEQ ID NO: 535528 - protein, 9 aa, Homo Sapiens
PTYEYVHMY

SEQ ID NO: 535529 - protein, 9 aa, Homo Sapiens
EAGEEVRCH

SEQ ID NO: 535530 - protein, 9 aa, Homo Sapiens
GGIFLFTLL

SEQ ID NO: 535531 - protein, 9 aa, Homo Sapiens
EGRRNKCPP

SEQ ID NO: 535532 - protein, 9 aa, Homo Sapiens
HTGRTSKQT

SEQ ID NO: 535533 - protein, 9 aa, Homo Sapiens
AKGARGRAG

SEQ ID NO: 535534 - protein, 9 aa, Homo Sapiens
GDVRVTPLP

SEQ ID NO: 535535 - protein, 9 aa, Homo Sapiens
DGKHPDAGL

SEQ ID NO: 535536 - protein, 9 aa, Homo Sapiens
LMIAKPHVA

SEQ ID NO: 535537 - protein, 9 aa, Homo Sapiens
DVEAQEAEG

SEQ ID NO: 535538 - protein, 9 aa, Homo Sapiens
FLMIAKPHV

SEQ ID NO: 535539 - protein, 9 aa, Homo Sapiens
RSETTRVPT

SEQ ID NO: 535540 - protein, 9 aa, Homo Sapiens
EGCSYYSRV

SEQ ID NO: 535541 - protein, 9 aa, Homo Sapiens
SLPKITPTG

SEQ ID NO: 535542 - protein, 9 aa, Homo Sapiens
FHFDQENIK

SEQ ID NO: 535543 - protein, 9 aa, Homo Sapiens
RGRAGPPGA

SEQ ID NO: 535544 - protein, 9 aa, Homo Sapiens
IHQDIKPDN

SEQ ID NO: 535545 - protein, 9 aa, Homo Sapiens
ISSYISINE

SEQ ID NO: 535546 - protein, 9 aa, Homo Sapiens
VGAHFLEAG

SEQ ID NO: 535547 - protein, 9 aa, Homo Sapiens
DAGLYNKGP

SEQ ID NO: 535548 - protein, 9 aa, Homo Sapiens
DSSHHTGRT

SEQ ID NO: 535549 - protein, 9 aa, Homo Sapiens
CSYYSRVLA

SEQ ID NO: 535550 - protein, 9 aa, Homo Sapiens
AIGAIMTTE

SEQ ID NO: 535551 - protein, 9 aa, Homo Sapiens
EKQPEKLTQ

SEQ ID NO: 535552 - protein, 9 aa, Homo Sapiens
LGLQVQQDR

SEQ ID NO: 535553 - protein, 9 aa, Homo Sapiens
DGGAWTAYE

SEQ ID NO: 535554 - protein, 9 aa, Homo Sapiens
QVAQPQTEV

SEQ ID NO: 535555 - protein, 9 aa, Homo Sapiens
GEDATSEAT

SEQ ID NO: 535556 - protein, 9 aa, Homo Sapiens
VAVINNNSK

SEQ ID NO: 535557 - protein, 9 aa, Homo Sapiens
NRWTYEEFL

SEQ ID NO: 535558 - protein, 9 aa, Homo Sapiens
MIAKPHVAV

SEQ ID NO: 535559 - protein, 9 aa, Homo Sapiens
HFLEAGEEV

SEQ ID NO: 535560 - protein, 9 aa, Homo Sapiens
GAWTAYEMD

SEQ ID NO: 535561 - protein, 9 aa, Homo Sapiens
NSKMVKFLL

SEQ ID NO: 535562 - protein, 9 aa, Homo Sapiens
LSCQVAQPQ

SEQ ID NO: 535563 - protein, 9 aa, Homo Sapiens
INTGEKPYK

SEQ ID NO: 535564 - protein, 9 aa, Homo Sapiens
MLSCQVAQP

SEQ ID NO: 535565 - protein, 9 aa, Homo Sapiens
YPKLFPLRC

SEQ ID NO: 535566 - protein, 9 aa, Homo Sapiens
EQDSSHHTG

SEQ ID NO: 535567 - protein, 9 aa, Homo Sapiens
SFFRPTPKR

SEQ ID NO: 535568 - protein, 9 aa, Homo Sapiens
GNRAGGDVR

SEQ ID NO: 535569 - protein, 9 aa, Homo Sapiens
GAKGARGRA

SEQ ID NO: 535570 - protein, 9 aa, Homo Sapiens
GFIHQDIKP

SEQ ID NO: 535571 - protein, 9 aa, Homo Sapiens
HVAVCSFRR

SEQ ID NO: 535572 - protein, 9 aa, Homo Sapiens
GKHPDAGLY

SEQ ID NO: 535573 - protein, 9 aa, Homo Sapiens
IGAIMTTET

SEQ ID NO: 535574 - protein, 9 aa, Homo Sapiens
DILDTAGKE

SEQ ID NO: 535575 - protein, 9 aa, Homo Sapiens
LIAHRKFKT

SEQ ID NO: 535576 - protein, 9 aa, Homo Sapiens
AHRKFKTGG

SEQ ID NO: 535577 - protein, 9 aa, Homo Sapiens
PESEDVEAQ

SEQ ID NO: 535578 - protein, 9 aa, Homo Sapiens
RGERNRWTY

SEQ ID NO: 535579 - protein, 9 aa, Homo Sapiens
NDIFQRIAG

SEQ ID NO: 535580 - protein, 9 aa, Homo Sapiens
YLKILSSGL

SEQ ID NO: 535581 - protein, 9 aa, Homo Sapiens
YEMILKHRK

SEQ ID NO: 535582 - protein, 9 aa, Homo Sapiens
LYVLIDRRA

SEQ ID NO: 535583 - protein, 9 aa, Homo Sapiens
KAVRADSGQ

SEQ ID NO: 535584 - protein, 9 aa, Homo Sapiens
WTAYEMDIC

SEQ ID NO: 535585 - protein, 9 aa, Homo Sapiens
PVSVKPDEE

SEQ ID NO: 535586 - protein, 9 aa, Homo Sapiens
APKYLKILS

SEQ ID NO: 535587 - protein, 9 aa, Homo Sapiens
RATQFTGAI

SEQ ID NO: 535588 - protein, 9 aa, Homo Sapiens
GAHFLEAGE

SEQ ID NO: 535589 - protein, 9 aa, Homo Sapiens
SYISINEGN

SEQ ID NO: 535590 - protein, 9 aa, Homo Sapiens
SPTYEYVHM

SEQ ID NO: 535591 - protein, 9 aa, Homo Sapiens
FIRPISRMH

SEQ ID NO: 535592 - protein, 9 aa, Homo Sapiens
FSFGGIFLF

SEQ ID NO: 535593 - protein, 9 aa, Homo Sapiens
VEQLNIIEM

SEQ ID NO: 535594 - protein, 9 aa, Homo Sapiens
KGARGRAGP

SEQ ID NO: 535595 - protein, 9 aa, Homo Sapiens
EAQEAEGEA

SEQ ID NO: 535596 - protein, 9 aa, Homo Sapiens
HPESEDVEA

SEQ ID NO: 535597 - protein, 9 aa, Homo Sapiens
RKFKTGGEW

SEQ ID NO: 535598 - protein, 9 aa, Homo Sapiens
PTSELEIYA

SEQ ID NO: 535599 - protein, 9 aa, Homo Sapiens
SRMHYHMSS

SEQ ID NO: 535600 - protein, 9 aa, Homo Sapiens
LEDLASQVC

SEQ ID NO: 535601 - protein, 9 aa, Homo Sapiens
RPISRMHYH

SEQ ID NO: 535602 - protein, 9 aa, Homo Sapiens
GLQVQQDRS

SEQ ID NO: 535603 - protein, 9 aa, Homo Sapiens
LDILDTAGK

SEQ ID NO: 535604 - protein, 9 aa, Homo Sapiens
TYEEFLDHP

SEQ ID NO: 535605 - protein, 9 aa, Homo Sapiens
SSIEMGSVN

SEQ ID NO: 535606 - protein, 9 aa, Homo Sapiens
RWTYEEFLD

SEQ ID NO: 535607 - protein, 9 aa, Homo Sapiens
SSYISINEG

SEQ ID NO: 535608 - protein, 9 aa, Homo Sapiens
GKEEYSAMR

SEQ ID NO: 535609 - protein, 9 aa, Homo Sapiens
ATSEATKSC

SEQ ID NO: 535610 - protein, 9 aa, Homo Sapiens
SSLPKITPT

SEQ ID NO: 535611 - protein, 9 aa, Homo Sapiens
ELEIYAKDI

SEQ ID NO: 535612 - protein, 9 aa, Homo Sapiens
LRYHKKINT

SEQ ID NO: 535613 - protein, 9 aa, Homo Sapiens
QDIKPDNIL

SEQ ID NO: 535614 - protein, 9 aa, Homo Sapiens
PALPGLLSR

SEQ ID NO: 535615 - protein, 9 aa, Homo Sapiens
VCLRTQDTI

SEQ ID NO: 535616 - protein, 9 aa, Homo Sapiens
HPDAGLYNK

SEQ ID NO: 535617 - protein, 9 aa, Homo Sapiens
SVDGEDATS

SEQ ID NO: 535618 - protein, 9 aa, Homo Sapiens
YVHMYVQMY

SEQ ID NO: 535619 - protein, 9 aa, Homo Sapiens
EDATSEATK

SEQ ID NO: 535620 - protein, 9 aa, Homo Sapiens
CLRTQDTIN

SEQ ID NO: 535621 - protein, 9 aa, Homo Sapiens
SGQERFNII

SEQ ID NO: 535622 - protein, 9 aa, Homo Sapiens
MKNKIFTLC

SEQ ID NO: 535623 - protein, 9 aa, Homo Sapiens
GCSYYSRVL

SEQ ID NO: 535624 - protein, 9 aa, Homo Sapiens
IEMKNKIFT

SEQ ID NO: 535625 - protein, 9 aa, Homo Sapiens
GRAGPPGAT

SEQ ID NO: 535626 - protein, 9 aa, Homo Sapiens
MILKHRKSL

SEQ ID NO: 535627 - protein, 9 aa, Homo Sapiens
AGEEVRCHL

SEQ ID NO: 535628 - protein, 9 aa, Homo Sapiens
EDVEAQEAE

SEQ ID NO: 535629 - protein, 9 aa, Homo Sapiens
GGAWTAYEM

SEQ ID NO: 535630 - protein, 9 aa, Homo Sapiens
TQTPGCCRA

SEQ ID NO: 535631 - protein, 9 aa, Homo Sapiens
LEAGEEVRC

SEQ ID NO: 535632 - protein, 9 aa, Homo Sapiens
KHPDAGLYN

SEQ ID NO: 535633 - protein, 9 aa, Homo Sapiens
GAIGAIMTT

SEQ ID NO: 535634 - protein, 9 aa, Homo Sapiens
MYVQMYAHT

SEQ ID NO: 535635 - protein, 9 aa, Homo Sapiens
LRCPPLRNS

SEQ ID NO: 535636 - protein, 9 aa, Homo Sapiens
ILDTAGKEE

SEQ ID NO: 535637 - protein, 9 aa, Homo Sapiens
LPTTESERL

SEQ ID NO: 535638 - protein, 9 aa, Homo Sapiens
VQVGKTTKR

SEQ ID NO: 535639 - protein, 9 aa, Homo Sapiens
FKTGGEWWT

SEQ ID NO: 535640 - protein, 9 aa, Homo Sapiens
LKHRKSLKQ

SEQ ID NO: 535641 - protein, 9 aa, Homo Sapiens
YHKKINTGE

SEQ ID NO: 535642 - protein, 9 aa, Homo Sapiens
TYEYVHMYV

SEQ ID NO: 535643 - protein, 9 aa, Homo Sapiens
HMYVQMYAH

SEQ ID NO: 535644 - protein, 9 aa, Homo Sapiens
DIFQRIAGE

SEQ ID NO: 535645 - protein, 9 aa, Homo Sapiens
PISRMHYHM

SEQ ID NO: 535646 - protein, 9 aa, Homo Sapiens
CAGNRAGGD

SEQ ID NO: 535647 - protein, 9 aa, Homo Sapiens
PDAGLYNKG

SEQ ID NO: 535648 - protein, 9 aa, Homo Sapiens
IEMGSVNEA

SEQ ID NO: 535649 - protein, 9 aa, Homo Sapiens
ARNGPVATV

SEQ ID NO: 535650 - protein, 9 aa, Homo Sapiens
LYEMILKHR

SEQ ID NO: 535651 - protein, 9 aa, Homo Sapiens
LLMLSFFRP

SEQ ID NO: 535652 - protein, 9 aa, Homo Sapiens
NTGEKPYKC

SEQ ID NO: 535653 - protein, 9 aa, Homo Sapiens
PDDGKHPDA

SEQ ID NO: 535654 - protein, 9 aa, Homo Sapiens
RNGPVATVG

SEQ ID NO: 535655 - protein, 9 aa, Homo Sapiens
VDGEDATSE

SEQ ID NO: 535656 - protein, 9 aa, Homo Sapiens
KSVDGEDAT

SEQ ID NO: 535657 - protein, 9 aa, Homo Sapiens
IVEISSYIS

SEQ ID NO: 535658 - protein, 9 aa, Homo Sapiens
ATQFTGAIG

SEQ ID NO: 535659 - protein, 9 aa, Homo Sapiens
TGGEWWTWI

SEQ ID NO: 535660 - protein, 9 aa, Homo Sapiens
FPLRCPPLR

SEQ ID NO: 535661 - protein, 9 aa, Homo Sapiens
LVAVINNNS

SEQ ID NO: 535662 - protein, 9 aa, Homo Sapiens
AAWQREPGY

SEQ ID NO: 535663 - protein, 9 aa, Homo Sapiens
KPHVAVCSF

SEQ ID NO: 535664 - protein, 9 aa, Homo Sapiens
SEKQPEKLT

SEQ ID NO: 535665 - protein, 9 aa, Homo Sapiens
IAKPHVAVC

SEQ ID NO: 535666 - protein, 9 aa, Homo Sapiens
RGDEQQVER

SEQ ID NO: 535667 - protein, 9 aa, Homo Sapiens
KYLKILSSG

SEQ ID NO: 535668 - protein, 9 aa, Homo Sapiens
VCEGRRNKC

SEQ ID NO: 535669 - protein, 9 aa, Homo Sapiens
VINNNSKMV

SEQ ID NO: 535670 - protein, 9 aa, Homo Sapiens
EISSYISIN

SEQ ID NO: 535671 - protein, 9 aa, Homo Sapiens
KMGFIHQDI

SEQ ID NO: 535672 - protein, 9 aa, Homo Sapiens
KLTQTPGCC

SEQ ID NO: 535673 - protein, 9 aa, Homo Sapiens
DPEVYDPFH

SEQ ID NO: 535674 - protein, 9 aa, Homo Sapiens
TLRYHKKIN

SEQ ID NO: 535675 - protein, 9 aa, Homo Sapiens
AGNRAGGDV

SEQ ID NO: 535676 - protein, 9 aa, Homo Sapiens
NMGVCFDLP

SEQ ID NO: 535677 - protein, 9 aa, Homo Sapiens
SEDVEAQEA

SEQ ID NO: 535678 - protein, 9 aa, Homo Sapiens
ILSSGLKYN

SEQ ID NO: 535679 - protein, 9 aa, Homo Sapiens
RYHKKINTG

SEQ ID NO: 535680 - protein, 9 aa, Homo Sapiens
PVCEGRRNK

SEQ ID NO: 535681 - protein, 9 aa, Homo Sapiens
QREPGYTAF

SEQ ID NO: 535682 - protein, 9 aa, Homo Sapiens
TVGSAAMGG

SEQ ID NO: 535683 - protein, 9 aa, Homo Sapiens
IIEMKNKIF

SEQ ID NO: 535684 - protein, 9 aa, Homo Sapiens
VAAWQREPG

SEQ ID NO: 535685 - protein, 9 aa, Homo Sapiens
DLASQVCLR

SEQ ID NO: 535686 - protein, 9 aa, Homo Sapiens
EMKNKIFTL

SEQ ID NO: 535687 - protein, 9 aa, Homo Sapiens
SEVSFLAFF

SEQ ID NO: 535688 - protein, 9 aa, Homo Sapiens
RDGLGSSIE

SEQ ID NO: 535689 - protein, 9 aa, Homo Sapiens
DGLGSSIEM

SEQ ID NO: 535690 - protein, 9 aa, Homo Sapiens
IRPISRMHY

SEQ ID NO: 535691 - protein, 9 aa, Homo Sapiens
TFLMIAKPH

SEQ ID NO: 535692 - protein, 9 aa, Homo Sapiens
LKILSSGLK

SEQ ID NO: 535693 - protein, 9 aa, Homo Sapiens
RMTPKPVLQ

SEQ ID NO: 535694 - protein, 9 aa, Homo Sapiens
EDLASQVCL

SEQ ID NO: 535695 - protein, 9 aa, Homo Sapiens
TAMLSCQVA

SEQ ID NO: 535696 - protein, 9 aa, Homo Sapiens
ITPTGTSLT

SEQ ID NO: 535697 - protein, 9 aa, Homo Sapiens
LSFFRPTPK

SEQ ID NO: 535698 - protein, 9 aa, Homo Sapiens
TSEATKSCG

SEQ ID NO: 535699 - protein, 9 aa, Homo Sapiens
AHPESEDVE

SEQ ID NO: 535700 - protein, 9 aa, Homo Sapiens
RADSGQERF

SEQ ID NO: 535701 - protein, 9 aa, Homo Sapiens
PKLFPLRCP

SEQ ID NO: 535702 - protein, 9 aa, Homo Sapiens
AARNGPVAT

SEQ ID NO: 535703 - protein, 9 aa, Homo Sapiens
PKIVEISSY

SEQ ID NO: 535704 - protein, 9 aa, Homo Sapiens
AWTAYEMDI

SEQ ID NO: 535705 - protein, 9 aa, Homo Sapiens
KITPTGTSL

SEQ ID NO: 535706 - protein, 9 aa, Homo Sapiens
YISINEGNN

SEQ ID NO: 535707 - protein, 9 aa, Homo Sapiens
TTKRTKTIY

SEQ ID NO: 535708 - protein, 9 aa, Homo Sapiens
WMCVAAWQR

SEQ ID NO: 535709 - protein, 9 aa, Homo Sapiens
HRKFKTGGE

SEQ ID NO: 535710 - protein, 9 aa, Homo Sapiens
LSSGLKYNA

SEQ ID NO: 535711 - protein, 9 aa, Homo Sapiens
INNNSKMVK

SEQ ID NO: 535712 - protein, 9 aa, Homo Sapiens
NNSKMVKFL

SEQ ID NO: 535713 - protein, 9 aa, Homo Sapiens
LPTSELEIY

SEQ ID NO: 535714 - protein, 9 aa, Homo Sapiens
YYSRVLAEN

SEQ ID NO: 535715 - protein, 9 aa, Homo Sapiens
DGEDATSEA

SEQ ID NO: 535716 - protein, 9 aa, Homo Sapiens
CQVAQPQTE

SEQ ID NO: 535717 - protein, 9 aa, Homo Sapiens
NIIEMKNKI

SEQ ID NO: 535718 - protein, 9 aa, Homo Sapiens
KCPPPPLPI

SEQ ID NO: 535719 - protein, 9 aa, Homo Sapiens
PEVYDPFHF

SEQ ID NO: 535720 - protein, 9 aa, Homo Sapiens
DRRAEEIKQ

SEQ ID NO: 535721 - protein, 9 aa, Homo Sapiens
VQQDRSETT

SEQ ID NO: 535722 - protein, 9 aa, Homo Sapiens
TGTSLTPDS

SEQ ID NO: 535723 - protein, 9 aa, Homo Sapiens
TKRTKTIYG

SEQ ID NO: 535724 - protein, 9 aa, Homo Sapiens
ILKHRKSLK

SEQ ID NO: 535725 - protein, 9 aa, Homo Sapiens
VEAQEAEGE

SEQ ID NO: 535726 - protein, 9 aa, Homo Sapiens
SQVCLRTQD

SEQ ID NO: 535727 - protein, 9 aa, Homo Sapiens
MHYHMSSKA

SEQ ID NO: 535728 - protein, 9 aa, Homo Sapiens
QVERMTPKP

SEQ ID NO: 535729 - protein, 9 aa, Homo Sapiens
LPGLLSRGV

SEQ ID NO: 535730 - protein, 9 aa, Homo Sapiens
GERNRWTYE

SEQ ID NO: 535731 - protein, 9 aa, Homo Sapiens
VNDIFQRIA

SEQ ID NO: 535732 - protein, 9 aa, Homo Sapiens
GIFLFTLLK

SEQ ID NO: 535733 - protein, 9 aa, Homo Sapiens
EYVHMYVQM

SEQ ID NO: 535734 - protein, 9 aa, Homo Sapiens
VYDPFHFDQ

SEQ ID NO: 535735 - protein, 9 aa, Homo Sapiens
DSGQERFNI

SEQ ID NO: 535736 - protein, 9 aa, Homo Sapiens
GNMGVCFDL

SEQ ID NO: 535737 - protein, 9 aa, Homo Sapiens
QVQQDRSET

SEQ ID NO: 535738 - protein, 9 aa, Homo Sapiens
SRVLAENEY

SEQ ID NO: 535739 - protein, 9 aa, Homo Sapiens
SFGGIFLFT

SEQ ID NO: 535740 - protein, 9 aa, Homo Sapiens
SAVSEVSFL

SEQ ID NO: 535741 - protein, 9 aa, Homo Sapiens
DRSETTRVP

SEQ ID NO: 535742 - protein, 9 aa, Homo Sapiens
DPFHFDQEN

SEQ ID NO: 535743 - protein, 9 aa, Homo Sapiens
VEISSYISI

SEQ ID NO: 535744 - protein, 9 aa, Homo Sapiens
WQREPGYTA

SEQ ID NO: 535745 - protein, 9 aa, Homo Sapiens
DDGKHPDAG

SEQ ID NO: 535746 - protein, 9 aa, Homo Sapiens
FDLPTTESE

SEQ ID NO: 535747 - protein, 9 aa, Homo Sapiens
KLYEMILKH

SEQ ID NO: 535748 - protein, 9 aa, Homo Sapiens
VSEVSFLAF

SEQ ID NO: 535749 - protein, 9 aa, Homo Sapiens
FRDGLGSSI

SEQ ID NO: 535750 - protein, 9 aa, Homo Sapiens
QPEKLTQTP

SEQ ID NO: 535751 - protein, 9 aa, Homo Sapiens
DEEVIPKDE

SEQ ID NO: 535752 - protein, 9 aa, Homo Sapiens
TAGKEEYSA

SEQ ID NO: 535753 - protein, 9 aa, Homo Sapiens
IMTFSFGGI

SEQ ID NO: 535754 - protein, 9 aa, Homo Sapiens
EIYAKDIII

SEQ ID NO: 535755 - protein, 9 aa, Homo Sapiens
GDEQQVERM

SEQ ID NO: 535756 - protein, 9 aa, Homo Sapiens
GIMTFSFGG

SEQ ID NO: 535757 - protein, 9 aa, Homo Sapiens
DTAGKEEYS

SEQ ID NO: 535758 - protein, 9 aa, Homo Sapiens
FVNDIFQRI

SEQ ID NO: 535759 - protein, 9 aa, Homo Sapiens
LPKITPTGT

SEQ ID NO: 535760 - protein, 9 aa, Homo Sapiens
GTTAMLSCQ

SEQ ID NO: 535761 - protein, 9 aa, Homo Sapiens
LEIYAKDII

SEQ ID NO: 535762 - protein, 9 aa, Homo Sapiens
EKLTQTPGC

SEQ ID NO: 535763 - protein, 9 aa, Homo Sapiens
KPDEEVIPK

SEQ ID NO: 535764 - protein, 9 aa, Homo Sapiens
TAYEMDICI

SEQ ID NO: 535765 - protein, 9 aa, Homo Sapiens
ALPGLLSRG

SEQ ID NO: 535766 - protein, 9 aa, Homo Sapiens
SIEMGSVNE

SEQ ID NO: 535767 - protein, 9 aa, Homo Sapiens
AGLYNKGPS

SEQ ID NO: 535768 - protein, 9 aa, Homo Sapiens
ARGRAGPPG

SEQ ID NO: 535769 - protein, 9 aa, Homo Sapiens
KTGGEWWTW

SEQ ID NO: 535770 - protein, 9 aa, Homo Sapiens
MCVAAWQRE

SEQ ID NO: 535771 - protein, 9 aa, Homo Sapiens
QDSSHHTGR

SEQ ID NO: 535772 - protein, 9 aa, Homo Sapiens
HKMGFIHQD

SEQ ID NO: 535773 - protein, 9 aa, Homo Sapiens
PGAKGARGR

SEQ ID NO: 535774 - protein, 9 aa, Homo Sapiens
WYPKLFPLR

SEQ ID NO: 535775 - protein, 9 aa, Homo Sapiens
CVAAWQREP

SEQ ID NO: 535776 - protein, 9 aa, Homo Sapiens
QVCLRTQDT

SEQ ID NO: 535777 - protein, 9 aa, Homo Sapiens
VGKTTKRTK

SEQ ID NO: 535778 - protein, 9 aa, Homo Sapiens
GKTTKRTKT

SEQ ID NO: 535779 - protein, 9 aa, Homo Sapiens
VCFDLPTTE

SEQ ID NO: 535780 - protein, 9 aa, Homo Sapiens
YDPFHFDQE

SEQ ID NO: 535781 - protein, 9 aa, Homo Sapiens
IAHRKFKTG

SEQ ID NO: 535782 - protein, 9 aa, Homo Sapiens
GRRNKCPPP

SEQ ID NO: 535783 - protein, 9 aa, Homo Sapiens
QEGCSYYSR

SEQ ID NO: 535784 - protein, 9 aa, Homo Sapiens
ECAGNRAGG

SEQ ID NO: 535785 - protein, 9 aa, Homo Sapiens
GVCFDLPTT

SEQ ID NO: 535786 - protein, 9 aa, Homo Sapiens
FIHQDIKPD

SEQ ID NO: 535787 - protein, 9 aa, Homo Sapiens
PHVAVCSFR

SEQ ID NO: 535788 - protein, 9 aa, Homo Sapiens
MGFIHQDIK

SEQ ID NO: 535789 - protein, 9 aa, Homo Sapiens
DEQQVERMT

SEQ ID NO: 535790 - protein, 9 aa, Homo Sapiens
QFTGAIGAI

SEQ ID NO: 535791 - protein, 9 aa, Homo Sapiens
KTTKRTKTI

SEQ ID NO: 535792 - protein, 9 aa, Homo Sapiens
FFRPTPKRY

SEQ ID NO: 535793 - protein, 9 aa, Homo Sapiens
PDEEVIPKD

SEQ ID NO: 535794 - protein, 9 aa, Homo Sapiens
FPVSVKPDE

SEQ ID NO: 535795 - protein, 9 aa, Homo Sapiens
KILSSGLKY

SEQ ID NO: 535796 - protein, 9 aa, Homo Sapiens
PRGERNRWT

SEQ ID NO: 535797 - protein, 9 aa, Homo Sapiens
FTGAIGAIM

SEQ ID NO: 535798 - protein, 9 aa, Homo Sapiens
AKPHVAVCS

SEQ ID NO: 535799 - protein, 9 aa, Homo Sapiens
KIVEISSYI

SEQ ID NO: 535800 - protein, 9 aa, Homo Sapiens
LDTAGKEEY

SEQ ID NO: 535801 - protein, 9 aa, Homo Sapiens
NKCPPPPLP

SEQ ID NO: 535802 - protein, 9 aa, Homo Sapiens
AYEMDICIT

SEQ ID NO: 535803 - protein, 9 aa, Homo Sapiens
GPVATVGSA

SEQ ID NO: 535804 - protein, 9 aa, Homo Sapiens
ERNRWTYEE

SEQ ID NO: 535805 - protein, 9 aa, Homo Sapiens
LQVQQDRSE

SEQ ID NO: 535806 - protein, 9 aa, Homo Sapiens
TSELEIYAK

SEQ ID NO: 535807 - protein, 9 aa, Homo Sapiens
GPGSSPGPG

SEQ ID NO: 535808 - protein, 9 aa, Homo Sapiens
NLPSSSPVD

SEQ ID NO: 535809 - protein, 9 aa, Homo Sapiens
SSSPVDSYP

SEQ ID NO: 535810 - protein, 9 aa, Homo Sapiens
KLRENLAGP

SEQ ID NO: 535811 - protein, 9 aa, Homo Sapiens
RDLAPKDRD

SEQ ID NO: 535812 - protein, 9 aa, Homo Sapiens
SPSWFRSCS

SEQ ID NO: 535813 - protein, 9 aa, Homo Sapiens
SSCYFFLPL

SEQ ID NO: 535814 - protein, 9 aa, Homo Sapiens
WDSALRLWE

SEQ ID NO: 535815 - protein, 9 aa, Homo Sapiens
NQGPPPMTG

SEQ ID NO: 535816 - protein, 9 aa, Homo Sapiens
SSHPLVLPN

SEQ ID NO: 535817 - protein, 9 aa, Homo Sapiens
GPRMLSPTT

SEQ ID NO: 535818 - protein, 9 aa, Homo Sapiens
YNTTLSVHQ

SEQ ID NO: 535819 - protein, 9 aa, Homo Sapiens
NTTLSVHQL

SEQ ID NO: 535820 - protein, 9 aa, Homo Sapiens
RRRQWGSFP

SEQ ID NO: 535821 - protein, 9 aa, Homo Sapiens
PITLLGPRM

SEQ ID NO: 535822 - protein, 9 aa, Homo Sapiens
VEPYNTTLS

SEQ ID NO: 535823 - protein, 9 aa, Homo Sapiens
APKDRDGTS

SEQ ID NO: 535824 - protein, 9 aa, Homo Sapiens
CVGRRRQWG

SEQ ID NO: 535825 - protein, 9 aa, Homo Sapiens
GNQGPPPMT

SEQ ID NO: 535826 - protein, 9 aa, Homo Sapiens
PLQCWGRRR

SEQ ID NO: 535827 - protein, 9 aa, Homo Sapiens
ARCLDIPKV

SEQ ID NO: 535828 - protein, 9 aa, Homo Sapiens
PLQCVGRRR

SEQ ID NO: 535829 - protein, 9 aa, Homo Sapiens
LGPRMLSPT

SEQ ID NO: 535830 - protein, 9 aa, Homo Sapiens
FFLPLAPAS

SEQ ID NO: 535831 - protein, 9 aa, Homo Sapiens
MYLNVMRIF

SEQ ID NO: 535832 - protein, 9 aa, Homo Sapiens
SCSWDSALR

SEQ ID NO: 535833 - protein, 9 aa, Homo Sapiens
PSPGPGPGS

SEQ ID NO: 535834 - protein, 9 aa, Homo Sapiens
DTVVEPYNT

SEQ ID NO: 535835 - protein, 9 aa, Homo Sapiens
TTLSVHQLV

SEQ ID NO: 535836 - protein, 9 aa, Homo Sapiens
DVAARCLDI

SEQ ID NO: 535837 - protein, 9 aa, Homo Sapiens
LNVMRIFSQ

SEQ ID NO: 535838 - protein, 9 aa, Homo Sapiens
APGSSCYFF

SEQ ID NO: 535839 - protein, 9 aa, Homo Sapiens
PPAPGSSCY

SEQ ID NO: 535840 - protein, 9 aa, Homo Sapiens
STLEHRPPA

SEQ ID NO: 535841 - protein, 9 aa, Homo Sapiens
RMLSPTTSR

SEQ ID NO: 535842 - protein, 9 aa, Homo Sapiens
RIFSQALLK

SEQ ID NO: 535843 - protein, 9 aa, Homo Sapiens
TGMNMNNRA

SEQ ID NO: 535844 - protein, 9 aa, Homo Sapiens
ALRLWEGPV

SEQ ID NO: 535845 - protein, 9 aa, Homo Sapiens
RLWEGPVQE

SEQ ID NO: 535846 - protein, 9 aa, Homo Sapiens
ILLISYIFI

SEQ ID NO: 535847 - protein, 9 aa, Homo Sapiens
PGSSCYFFL

SEQ ID NO: 535848 - protein, 9 aa, Homo Sapiens
EPYNTTLSV

SEQ ID NO: 535849 - protein, 9 aa, Homo Sapiens
TPAERLPGP

SEQ ID NO: 535850 - protein, 9 aa, Homo Sapiens
QGPPPMTGM

SEQ ID NO: 535851 - protein, 9 aa, Homo Sapiens
VAARCLDIP

SEQ ID NO: 535852 - protein, 9 aa, Homo Sapiens
VVEPYNTTL

SEQ ID NO: 535853 - protein, 9 aa, Homo Sapiens
YDVPGIHHV

SEQ ID NO: 535854 - protein, 9 aa, Homo Sapiens
GPPPMTGMN

SEQ ID NO: 535855 - protein, 9 aa, Homo Sapiens
ELRKLRENL

SEQ ID NO: 535856 - protein, 9 aa, Homo Sapiens
PVDSYPGLC

SEQ ID NO: 535857 - protein, 9 aa, Homo Sapiens
VDSYPGLCQ

SEQ ID NO: 535858 - protein, 9 aa, Homo Sapiens
WSSEAWDSE

SEQ ID NO: 535859 - protein, 9 aa, Homo Sapiens
WGSFPQHCA

SEQ ID NO: 535860 - protein, 9 aa, Homo Sapiens
LAPASSHPL

SEQ ID NO: 535861 - protein, 9 aa, Homo Sapiens
FAKNLRSLL

SEQ ID NO: 535862 - protein, 9 aa, Homo Sapiens
SEGMKRSST

SEQ ID NO: 535863 - protein, 9 aa, Homo Sapiens
PKDRDGTSD

SEQ ID NO: 535864 - protein, 9 aa, Homo Sapiens
KTPAERLPG

SEQ ID NO: 535865 - protein, 9 aa, Homo Sapiens
SSPVDSYPG

SEQ ID NO: 535866 - protein, 9 aa, Homo Sapiens
NVMRIFSQA

SEQ ID NO: 535867 - protein, 9 aa, Homo Sapiens
IHHVHPNGT

SEQ ID NO: 535868 - protein, 9 aa, Homo Sapiens
FVATFLFER

SEQ ID NO: 535869 - protein, 9 aa, Homo Sapiens
APASSHPLV

SEQ ID NO: 535870 - protein, 9 aa, Homo Sapiens
MKRSSTLEH

SEQ ID NO: 535871 - protein, 9 aa, Homo Sapiens
GPWSSEAWD

SEQ ID NO: 535872 - protein, 9 aa, Homo Sapiens
PQHCAGRRR

SEQ ID NO: 535873 - protein, 9 aa, Homo Sapiens
PGPGPGSSP

SEQ ID NO: 535874 - protein, 9 aa, Homo Sapiens
EGPVQELRK

SEQ ID NO: 535875 - protein, 9 aa, Homo Sapiens
RQDCARPSP

SEQ ID NO: 535876 - protein, 9 aa, Homo Sapiens
YFFLPLAPA

SEQ ID NO: 535877 - protein, 9 aa, Homo Sapiens
WEGPVQELR

SEQ ID NO: 535878 - protein, 9 aa, Homo Sapiens
CSWDSALRL

SEQ ID NO: 535879 - protein, 9 aa, Homo Sapiens
MRIFSQALL

SEQ ID NO: 535880 - protein, 9 aa, Homo Sapiens
RRQDCARPS

SEQ ID NO: 535881 - protein, 9 aa, Homo Sapiens
AKNLRSLLH

SEQ ID NO: 535882 - protein, 9 aa, Homo Sapiens
EGMKRSSTL

SEQ ID NO: 535883 - protein, 9 aa, Homo Sapiens
SLYLFAKNL

SEQ ID NO: 535884 - protein, 9 aa, Homo Sapiens
PPPMTGMNM

SEQ ID NO: 535885 - protein, 9 aa, Homo Sapiens
PAERLPGPL

SEQ ID NO: 535886 - protein, 9 aa, Homo Sapiens
RENLAGPWS

SEQ ID NO: 535887 - protein, 9 aa, Homo Sapiens
CAGRRRQDC

SEQ ID NO: 535888 - protein, 9 aa, Homo Sapiens
QWGSFPQHC

SEQ ID NO: 535889 - protein, 9 aa, Homo Sapiens
RRRRQWGSF

SEQ ID NO: 535890 - protein, 9 aa, Homo Sapiens
RCLDIPKVQ

SEQ ID NO: 535891 - protein, 9 aa, Homo Sapiens
LRLWEGPVQ

SEQ ID NO: 535892 - protein, 9 aa, Homo Sapiens
NLAGPWSSE

SEQ ID NO: 535893 - protein, 9 aa, Homo Sapiens
CWGRRRRQW

SEQ ID NO: 535894 - protein, 9 aa, Homo Sapiens
ENLAGPWSS

SEQ ID NO: 535895 - protein, 9 aa, Homo Sapiens
LFFVATFLF

SEQ ID NO: 535896 - protein, 9 aa, Homo Sapiens
GSSCYFFLP

SEQ ID NO: 535897 - protein, 9 aa, Homo Sapiens
RPSPSWFRS

SEQ ID NO: 535898 - protein, 9 aa, Homo Sapiens
SCYFFLPLA

SEQ ID NO: 535899 - protein, 9 aa, Homo Sapiens
HPLVLPNKL

SEQ ID NO: 535900 - protein, 9 aa, Homo Sapiens
FPLQCVGRR

SEQ ID NO: 535901 - protein, 9 aa, Homo Sapiens
ILFFVATFL

SEQ ID NO: 535902 - protein, 9 aa, Homo Sapiens
WGRRRRQWG

SEQ ID NO: 535903 - protein, 9 aa, Homo Sapiens
WDSEGMKRS

SEQ ID NO: 535904 - protein, 9 aa, Homo Sapiens
DRDGTSDPF

SEQ ID NO: 535905 - protein, 9 aa, Homo Sapiens
IKTPAERLP

SEQ ID NO: 535906 - protein, 9 aa, Homo Sapiens
KRSSTLEHR

SEQ ID NO: 535907 - protein, 9 aa, Homo Sapiens
QDCARPSPS

SEQ ID NO: 535908 - protein, 9 aa, Homo Sapiens
GMKRSSTLE

SEQ ID NO: 535909 - protein, 9 aa, Homo Sapiens
LYLFAKNLR

SEQ ID NO: 535910 - protein, 9 aa, Homo Sapiens
YLFAKNLRS

SEQ ID NO: 535911 - protein, 9 aa, Homo Sapiens
RQWGSFPQH

SEQ ID NO: 535912 - protein, 9 aa, Homo Sapiens
PGIHHVHPN

SEQ ID NO: 535913 - protein, 9 aa, Homo Sapiens
EHRPPAPGS

SEQ ID NO: 535914 - protein, 9 aa, Homo Sapiens
FILLISYIF

SEQ ID NO: 535915 - protein, 9 aa, Homo Sapiens
GSSPGPGPG

SEQ ID NO: 535916 - protein, 9 aa, Homo Sapiens
LLCYILFFV

SEQ ID NO: 535917 - protein, 9 aa, Homo Sapiens
FLPLAPASS

SEQ ID NO: 535918 - protein, 9 aa, Homo Sapiens
PVQELRKLR

SEQ ID NO: 535919 - protein, 9 aa, Homo Sapiens
TVVEPYNTT

SEQ ID NO: 535920 - protein, 9 aa, Homo Sapiens
AWDSEGMKR

SEQ ID NO: 535921 - protein, 9 aa, Homo Sapiens
PSWFRSCSW

SEQ ID NO: 535922 - protein, 9 aa, Homo Sapiens
LQCVGRRRQ

SEQ ID NO: 535923 - protein, 9 aa, Homo Sapiens
PAPGSSCYF

SEQ ID NO: 535924 - protein, 9 aa, Homo Sapiens
SALRLWEGP

SEQ ID NO: 535925 - protein, 9 aa, Homo Sapiens
LAPKDRDGT

SEQ ID NO: 535926 - protein, 9 aa, Homo Sapiens
ERLPGPLPP

SEQ ID NO: 535927 - protein, 9 aa, Homo Sapiens
DCARPSPSW

SEQ ID NO: 535928 - protein, 9 aa, Homo Sapiens
PRMLSPTTS

SEQ ID NO: 535929 - protein, 9 aa, Homo Sapiens
LPSSSPVDS

SEQ ID NO: 535930 - protein, 9 aa, Homo Sapiens
LQCWGRRRR

SEQ ID NO: 535931 - protein, 9 aa, Homo Sapiens
TLEHRPPAP

SEQ ID NO: 535932 - protein, 9 aa, Homo Sapiens
SWDSALRLW

SEQ ID NO: 535933 - protein, 9 aa, Homo Sapiens
LCYILFFVA

SEQ ID NO: 535934 - protein, 9 aa, Homo Sapiens
SSTLEHRPP

SEQ ID NO: 535935 - protein, 9 aa, Homo Sapiens
PPMTGMNMN

SEQ ID NO: 535936 - protein, 9 aa, Homo Sapiens
GNLPSSSPV

SEQ ID NO: 535937 - protein, 9 aa, Homo Sapiens
PGPLPPSAD

SEQ ID NO: 535938 - protein, 9 aa, Homo Sapiens
FFVATFLFE

SEQ ID NO: 535939 - protein, 9 aa, Homo Sapiens
ITLLGPRML

SEQ ID NO: 535940 - protein, 9 aa, Homo Sapiens
RKLRENLAG

SEQ ID NO: 535941 - protein, 9 aa, Homo Sapiens
GIHHVHPNG

SEQ ID NO: 535942 - protein, 9 aa, Homo Sapiens
CLDIPKVQH

SEQ ID NO: 535943 - protein, 9 aa, Homo Sapiens
SPGPGPGSS

SEQ ID NO: 535944 - protein, 9 aa, Homo Sapiens
KNLRSLLHT

SEQ ID NO: 535945 - protein, 9 aa, Homo Sapiens
ATDVAARCL

SEQ ID NO: 535946 - protein, 9 aa, Homo Sapiens
CYILFFVAT

SEQ ID NO: 535947 - protein, 9 aa, Homo Sapiens
LEHRPPAPG

SEQ ID NO: 535948 - protein, 9 aa, Homo Sapiens
VGRRRQWGS

SEQ ID NO: 535949 - protein, 9 aa, Homo Sapiens
SFPLQCVGR

SEQ ID NO: 535950 - protein, 9 aa, Homo Sapiens
EMYLNVMRI

SEQ ID NO: 535951 - protein, 9 aa, Homo Sapiens
DGTSDPFVR

SEQ ID NO: 535952 - protein, 9 aa, Homo Sapiens
LWEGPVQEL

SEQ ID NO: 535953 - protein, 9 aa, Homo Sapiens
FRSCSWDSA

SEQ ID NO: 535954 - protein, 9 aa, Homo Sapiens
LAGPWSSEA

SEQ ID NO: 535955 - protein, 9 aa, Homo Sapiens
LLGPRMLSP

SEQ ID NO: 535956 - protein, 9 aa, Homo Sapiens
MLSPTTSRL

SEQ ID NO: 535957 - protein, 9 aa, Homo Sapiens
GRRRRQWGS

SEQ ID NO: 535958 - protein, 9 aa, Homo Sapiens
GPVQELRKL

SEQ ID NO: 535959 - protein, 9 aa, Homo Sapiens
PWSSEAWDS

SEQ ID NO: 535960 - protein, 9 aa, Homo Sapiens
VPGIHHVHP

SEQ ID NO: 535961 - protein, 9 aa, Homo Sapiens
IFSQALLKG

SEQ ID NO: 535962 - protein, 9 aa, Homo Sapiens
RRQWGSFPL

SEQ ID NO: 535963 - protein, 9 aa, Homo Sapiens
YLNVMRIFS

SEQ ID NO: 535964 - protein, 9 aa, Homo Sapiens
DSEGMKRSS

SEQ ID NO: 535965 - protein, 9 aa, Homo Sapiens
DSALRLWEG

SEQ ID NO: 535966 - protein, 9 aa, Homo Sapiens
VQELRKLRE

SEQ ID NO: 535967 - protein, 9 aa, Homo Sapiens
QELRKLREN

SEQ ID NO: 535968 - protein, 9 aa, Homo Sapiens
IYDVPGIHH

SEQ ID NO: 535969 - protein, 9 aa, Homo Sapiens
DLAPKDRDG

SEQ ID NO: 535970 - protein, 9 aa, Homo Sapiens
SWFRSCSWD

SEQ ID NO: 535971 - protein, 9 aa, Homo Sapiens
LPGPLPPSA

SEQ ID NO: 535972 - protein, 9 aa, Homo Sapiens
RRQWGSFPQ

SEQ ID NO: 535973 - protein, 9 aa, Homo Sapiens
PASSHPLVL

SEQ ID NO: 535974 - protein, 9 aa, Homo Sapiens
GPGPGSSPG

SEQ ID NO: 535975 - protein, 9 aa, Homo Sapiens
EIYDVPGIH

SEQ ID NO: 535976 - protein, 9 aa, Homo Sapiens
LLISYIFIL

SEQ ID NO: 535977 - protein, 9 aa, Homo Sapiens
GRRRQDCAR

SEQ ID NO: 535978 - protein, 9 aa, Homo Sapiens
TDVAARCLD

SEQ ID NO: 535979 - protein, 9 aa, Homo Sapiens
DVPGIHHVH

SEQ ID NO: 535980 - protein, 9 aa, Homo Sapiens
PLAPASSHP

SEQ ID NO: 535981 - protein, 9 aa, Homo Sapiens
LPLAPASSH

SEQ ID NO: 535982 - protein, 9 aa, Homo Sapiens
LISYIFILF

SEQ ID NO: 535983 - protein, 9 aa, Homo Sapiens
SFPQHCAGR

SEQ ID NO: 535984 - protein, 9 aa, Homo Sapiens
GSFPLQCWG

SEQ ID NO: 535985 - protein, 9 aa, Homo Sapiens
TLLGPRMLS

SEQ ID NO: 535986 - protein, 9 aa, Homo Sapiens
PGPGSSPGP

SEQ ID NO: 535987 - protein, 9 aa, Homo Sapiens
GSFPQHCAG

SEQ ID NO: 535988 - protein, 9 aa, Homo Sapiens
LFAKNLRSL

SEQ ID NO: 535989 - protein, 9 aa, Homo Sapiens
CARPSPSWF

SEQ ID NO: 535990 - protein, 9 aa, Homo Sapiens
LRKLRENLA

SEQ ID NO: 535991 - protein, 9 aa, Homo Sapiens
AARCLDIPK

SEQ ID NO: 535992 - protein, 9 aa, Homo Sapiens
AGRRRQDCA

SEQ ID NO: 535993 - protein, 9 aa, Homo Sapiens
SEAWDSEGM

SEQ ID NO: 535994 - protein, 9 aa, Homo Sapiens
PGSSPGPGP

SEQ ID NO: 535995 - protein, 9 aa, Homo Sapiens
LRENLAGPW

SEQ ID NO: 535996 - protein, 9 aa, Homo Sapiens
PSPSWFRSC

SEQ ID NO: 535997 - protein, 9 aa, Homo Sapiens
GRRRQWGSF

SEQ ID NO: 535998 - protein, 9 aa, Homo Sapiens
CYFFLPLAP

SEQ ID NO: 535999 - protein, 9 aa, Homo Sapiens
QHCAGRRRQ

SEQ ID NO: 536000 - protein, 9 aa, Homo Sapiens
FPQHCAGRR

SEQ ID NO: 536001 - protein, 9 aa, Homo Sapiens
YILFFVATF

SEQ ID NO: 536002 - protein, 9 aa, Homo Sapiens
RSCSWDSAL

SEQ ID NO: 536003 - protein, 9 aa, Homo Sapiens
HRPPAPGSS

SEQ ID NO: 536004 - protein, 9 aa, Homo Sapiens
AERLPGPLP

SEQ ID NO: 536005 - protein, 9 aa, Homo Sapiens
VATFLFERV

SEQ ID NO: 536006 - protein, 9 aa, Homo Sapiens
SSPGPGPGP

SEQ ID NO: 536007 - protein, 9 aa, Homo Sapiens
EAWDSEGMK

SEQ ID NO: 536008 - protein, 9 aa, Homo Sapiens
AGPWSSEAW

SEQ ID NO: 536009 - protein, 9 aa, Homo Sapiens
VMRIFSQAL

SEQ ID NO: 536010 - protein, 9 aa, Homo Sapiens
RSSTLEHRP

SEQ ID NO: 536011 - protein, 9 aa, Homo Sapiens
RPPAPGSSC

SEQ ID NO: 536012 - protein, 9 aa, Homo Sapiens
PMTGMNMNN

SEQ ID NO: 536013 - protein, 9 aa, Homo Sapiens
HHVHPNGTL

SEQ ID NO: 536014 - protein, 9 aa, Homo Sapiens
WGSFPLQCV

SEQ ID NO: 536015 - protein, 9 aa, Homo Sapiens
WGSFPLQCW

SEQ ID NO: 536016 - protein, 9 aa, Homo Sapiens
KDRDGTSDP

SEQ ID NO: 536017 - protein, 9 aa, Homo Sapiens
HCAGRRRQD

SEQ ID NO: 536018 - protein, 9 aa, Homo Sapiens
LRSLLHTYH

SEQ ID NO: 536019 - protein, 9 aa, Homo Sapiens
GSFPLQCVG

SEQ ID NO: 536020 - protein, 9 aa, Homo Sapiens
PYNTTLSVH

SEQ ID NO: 536021 - protein, 9 aa, Homo Sapiens
WFRSCSWDS

SEQ ID NO: 536022 - protein, 9 aa, Homo Sapiens
QCVGRRRQW

SEQ ID NO: 536023 - protein, 9 aa, Homo Sapiens
ARPSPSWFR

SEQ ID NO: 536024 - protein, 9 aa, Homo Sapiens
SSEAWDSEG

SEQ ID NO: 536025 - protein, 9 aa, Homo Sapiens
QCWGRRRRQ

SEQ ID NO: 536026 - protein, 9 aa, Homo Sapiens
SFPLQCWGR

SEQ ID NO: 536027 - protein, 9 aa, Homo Sapiens
MTGMNMNNR

SEQ ID NO: 536028 - protein, 9 aa, Homo Sapiens
PSSSPVDSY

SEQ ID NO: 536029 - protein, 9 aa, Homo Sapiens
RRRQDCARP

SEQ ID NO: 536030 - protein, 9 aa, Homo Sapiens
RDGTSDPFV

SEQ ID NO: 536031 - protein, 9 aa, Homo Sapiens
RQWGSFPLQ

SEQ ID NO: 536032 - protein, 9 aa, Homo Sapiens
LATDVAARC

SEQ ID NO: 536033 - protein, 9 aa, Homo Sapiens
SHPLVLPNK

SEQ ID NO: 536034 - protein, 9 aa, Homo Sapiens
SPVDSYPGL

SEQ ID NO: 536035 - protein, 9 aa, Homo Sapiens
NLRSLLHTY

SEQ ID NO: 536036 - protein, 9 aa, Homo Sapiens
ASSHPLVLP

SEQ ID NO: 536037 - protein, 9 aa, Homo Sapiens
FPLQCWGRR

SEQ ID NO: 536038 - protein, 9 aa, Homo Sapiens
FFILLISYI

SEQ ID NO: 536039 - protein, 9 aa, Homo Sapiens
QWGSFPLQC

SEQ ID NO: 536040 - protein, 9 aa, Homo Sapiens
EGEIPILQS

SEQ ID NO: 536041 - protein, 9 aa, Homo Sapiens
LSLHAVLHQ

SEQ ID NO: 536042 - protein, 9 aa, Homo Sapiens
GKRNVGASG

SEQ ID NO: 536043 - protein, 9 aa, Homo Sapiens
LGQMGSLWP

SEQ ID NO: 536044 - protein, 9 aa, Homo Sapiens
VHQPHPCQR

SEQ ID NO: 536045 - protein, 9 aa, Homo Sapiens
EIPILQSGA

SEQ ID NO: 536046 - protein, 9 aa, Homo Sapiens
MRESALERE

SEQ ID NO: 536047 - protein, 9 aa, Homo Sapiens
GQALPQRGL

SEQ ID NO: 536048 - protein, 9 aa, Homo Sapiens
KRNVGASGD

SEQ ID NO: 536049 - protein, 9 aa, Homo Sapiens
PQLSLRKEL

SEQ ID NO: 536050 - protein, 9 aa, Homo Sapiens
GRWHQLWRG

SEQ ID NO: 536051 - protein, 9 aa, Homo Sapiens
LQSGALPQL

SEQ ID NO: 536052 - protein, 9 aa, Homo Sapiens
SQNESRPLF

SEQ ID NO: 536053 - protein, 9 aa, Homo Sapiens
TLSQQCEQA

SEQ ID NO: 536054 - protein, 9 aa, Homo Sapiens
RGSEGEIPI

SEQ ID NO: 536055 - protein, 9 aa, Homo Sapiens
LTDACSKLQ

SEQ ID NO: 536056 - protein, 9 aa, Homo Sapiens
TQPQQAQGG

SEQ ID NO: 536057 - protein, 9 aa, Homo Sapiens
HAVLHQAVV

SEQ ID NO: 536058 - protein, 9 aa, Homo Sapiens
REGQGTDGV

SEQ ID NO: 536059 - protein, 9 aa, Homo Sapiens
LPQLSLRKE

SEQ ID NO: 536060 - protein, 9 aa, Homo Sapiens
ETQPQQAQG

SEQ ID NO: 536061 - protein, 9 aa, Homo Sapiens
SLRKELPGG

SEQ ID NO: 536062 - protein, 9 aa, Homo Sapiens
TKEEIDILT

SEQ ID NO: 536063 - protein, 9 aa, Homo Sapiens
EGQGTDGVP

SEQ ID NO: 536064 - protein, 9 aa, Homo Sapiens
LRGSEGEIP

SEQ ID NO: 536065 - protein, 9 aa, Homo Sapiens
KAFSSVSTL

SEQ ID NO: 536066 - protein, 9 aa, Homo Sapiens
CGKAFSSVS

SEQ ID NO: 536067 - protein, 9 aa, Homo Sapiens
ESRPLFLIE

SEQ ID NO: 536068 - protein, 9 aa, Homo Sapiens
RGETQPQQA

SEQ ID NO: 536069 - protein, 9 aa, Homo Sapiens
WHQLWRGQA

SEQ ID NO: 536070 - protein, 9 aa, Homo Sapiens
GQGTDGVPD

SEQ ID NO: 536071 - protein, 9 aa, Homo Sapiens
GEIPILQSG

SEQ ID NO: 536072 - protein, 9 aa, Homo Sapiens
PQRGLRGET

SEQ ID NO: 536073 - protein, 9 aa, Homo Sapiens
QAQGGWFLG

SEQ ID NO: 536074 - protein, 9 aa, Homo Sapiens
SQQCEQALS

SEQ ID NO: 536075 - protein, 9 aa, Homo Sapiens
HQLWRGQAL

SEQ ID NO: 536076 - protein, 9 aa, Homo Sapiens
TDGVPDPPL

SEQ ID NO: 536077 - protein, 9 aa, Homo Sapiens
SSMSAYVSG

SEQ ID NO: 536078 - protein, 9 aa, Homo Sapiens
GTDGVPDPP

SEQ ID NO: 536079 - protein, 9 aa, Homo Sapiens
QQAQGGWFL

SEQ ID NO: 536080 - protein, 9 aa, Homo Sapiens
SALEREPVP

SEQ ID NO: 536081 - protein, 9 aa, Homo Sapiens
GWFLGQMGS

SEQ ID NO: 536082 - protein, 9 aa, Homo Sapiens
VVHREGQGT

SEQ ID NO: 536083 - protein, 9 aa, Homo Sapiens
ALSLHAVLH

SEQ ID NO: 536084 - protein, 9 aa, Homo Sapiens
EIDILTDAC

SEQ ID NO: 536085 - protein, 9 aa, Homo Sapiens
RNVGASGDH

SEQ ID NO: 536086 - protein, 9 aa, Homo Sapiens
QEAVHQPHP

SEQ ID NO: 536087 - protein, 9 aa, Homo Sapiens
SGKRNVGAS

SEQ ID NO: 536088 - protein, 9 aa, Homo Sapiens
MLPHKTKQG

SEQ ID NO: 536089 - protein, 9 aa, Homo Sapiens
IPILQSGAL

SEQ ID NO: 536090 - protein, 9 aa, Homo Sapiens
GKAFSSVST

SEQ ID NO: 536091 - protein, 9 aa, Homo Sapiens
SLHAVLHQA

SEQ ID NO: 536092 - protein, 9 aa, Homo Sapiens
RWHQLWRGQ

SEQ ID NO: 536093 - protein, 9 aa, Homo Sapiens
VPDPPLPLG

SEQ ID NO: 536094 - protein, 9 aa, Homo Sapiens
AVVHREGQG

SEQ ID NO: 536095 - protein, 9 aa, Homo Sapiens
AFSSVSTLN

SEQ ID NO: 536096 - protein, 9 aa, Homo Sapiens
IDILTDACS

SEQ ID NO: 536097 - protein, 9 aa, Homo Sapiens
SMSAYVSGG

SEQ ID NO: 536098 - protein, 9 aa, Homo Sapiens
HMWWGRAAG

SEQ ID NO: 536099 - protein, 9 aa, Homo Sapiens
PLLAHMWWG

SEQ ID NO: 536100 - protein, 9 aa, Homo Sapiens
LWRGQALPQ

SEQ ID NO: 536101 - protein, 9 aa, Homo Sapiens
PLPLGRWHQ

SEQ ID NO: 536102 - protein, 9 aa, Homo Sapiens
QRGQVLRGS

SEQ ID NO: 536103 - protein, 9 aa, Homo Sapiens
CEQALSLHA

SEQ ID NO: 536104 - protein, 9 aa, Homo Sapiens
PILQSGALP

SEQ ID NO: 536105 - protein, 9 aa, Homo Sapiens
PLGRWHQLW

SEQ ID NO: 536106 - protein, 9 aa, Homo Sapiens
GRAAGQEAV

SEQ ID NO: 536107 - protein, 9 aa, Homo Sapiens
QGTDGVPDP

SEQ ID NO: 536108 - protein, 9 aa, Homo Sapiens
ALEREPVPE

SEQ ID NO: 536109 - protein, 9 aa, Homo Sapiens
YTLSQQCEQ

SEQ ID NO: 536110 - protein, 9 aa, Homo Sapiens
GQEAVHQPH

SEQ ID NO: 536111 - protein, 9 aa, Homo Sapiens
GSEGEIPIL

SEQ ID NO: 536112 - protein, 9 aa, Homo Sapiens
LSSMSAYVS

SEQ ID NO: 536113 - protein, 9 aa, Homo Sapiens
ILQSGALPQ

SEQ ID NO: 536114 - protein, 9 aa, Homo Sapiens
QAVVHREGQ

SEQ ID NO: 536115 - protein, 9 aa, Homo Sapiens
ILTDACSKL

SEQ ID NO: 536116 - protein, 9 aa, Homo Sapiens
PPLPLGRWH

SEQ ID NO: 536117 - protein, 9 aa, Homo Sapiens
WWGRAAGQE

SEQ ID NO: 536118 - protein, 9 aa, Homo Sapiens
PCCRGSGKR

SEQ ID NO: 536119 - protein, 9 aa, Homo Sapiens
DPPLPLGRW

SEQ ID NO: 536120 - protein, 9 aa, Homo Sapiens
QQCEQALSL

SEQ ID NO: 536121 - protein, 9 aa, Homo Sapiens
NESRPLFLI

SEQ ID NO: 536122 - protein, 9 aa, Homo Sapiens
PQQAQGGWF

SEQ ID NO: 536123 - protein, 9 aa, Homo Sapiens
QCEQALSLH

SEQ ID NO: 536124 - protein, 9 aa, Homo Sapiens
PDPPLPLGR

SEQ ID NO: 536125 - protein, 9 aa, Homo Sapiens
ISQNESRPL

SEQ ID NO: 536126 - protein, 9 aa, Homo Sapiens
EQALSLHAV

SEQ ID NO: 536127 - protein, 9 aa, Homo Sapiens
QRGLRGETQ

SEQ ID NO: 536128 - protein, 9 aa, Homo Sapiens
LAHMWWGRA

SEQ ID NO: 536129 - protein, 9 aa, Homo Sapiens
HREGQGTDG

SEQ ID NO: 536130 - protein, 9 aa, Homo Sapiens
AVHQPHPCQ

SEQ ID NO: 536131 - protein, 9 aa, Homo Sapiens
LFLIELFHE

SEQ ID NO: 536132 - protein, 9 aa, Homo Sapiens
AHMWWGRAA

SEQ ID NO: 536133 - protein, 9 aa, Homo Sapiens
GQMGSLWPL

SEQ ID NO: 536134 - protein, 9 aa, Homo Sapiens
RGSGKRNVG

SEQ ID NO: 536135 - protein, 9 aa, Homo Sapiens
RPLFLIELF

SEQ ID NO: 536136 - protein, 9 aa, Homo Sapiens
LEREPVPEA

SEQ ID NO: 536137 - protein, 9 aa, Homo Sapiens
RGQALPQRG

SEQ ID NO: 536138 - protein, 9 aa, Homo Sapiens
AQGGWFLGQ

SEQ ID NO: 536139 - protein, 9 aa, Homo Sapiens
MGSLWPLLA

SEQ ID NO: 536140 - protein, 9 aa, Homo Sapiens
CCRGSGKRN

SEQ ID NO: 536141 - protein, 9 aa, Homo Sapiens
QVLRGSEGE

SEQ ID NO: 536142 - protein, 9 aa, Homo Sapiens
LRGETQPQQ

SEQ ID NO: 536143 - protein, 9 aa, Homo Sapiens
HQPHPCQRG

SEQ ID NO: 536144 - protein, 9 aa, Homo Sapiens
ECGKAFSSV

SEQ ID NO: 536145 - protein, 9 aa, Homo Sapiens
LRKELPGGA

SEQ ID NO: 536146 - protein, 9 aa, Homo Sapiens
PCQRGQVLR

SEQ ID NO: 536147 - protein, 9 aa, Homo Sapiens
KEEIDILTD

SEQ ID NO: 536148 - protein, 9 aa, Homo Sapiens
SMLPHKTKQ

SEQ ID NO: 536149 - protein, 9 aa, Homo Sapiens
FLSSMSAYV

SEQ ID NO: 536150 - protein, 9 aa, Homo Sapiens
VLRGSEGEI

SEQ ID NO: 536151 - protein, 9 aa, Homo Sapiens
SAYVSGGSP

SEQ ID NO: 536152 - protein, 9 aa, Homo Sapiens
RESALEREP

SEQ ID NO: 536153 - protein, 9 aa, Homo Sapiens
MWWGRAAGQ

SEQ ID NO: 536154 - protein, 9 aa, Homo Sapiens
HQAVVHREG

SEQ ID NO: 536155 - protein, 9 aa, Homo Sapiens
SRPLFLIEL

SEQ ID NO: 536156 - protein, 9 aa, Homo Sapiens
GETQPQQAQ

SEQ ID NO: 536157 - protein, 9 aa, Homo Sapiens
VLHQAVVHR

SEQ ID NO: 536158 - protein, 9 aa, Homo Sapiens
LPHKTKQGQ

SEQ ID NO: 536159 - protein, 9 aa, Homo Sapiens
AGQEAVHQP

SEQ ID NO: 536160 - protein, 9 aa, Homo Sapiens
KTKQGQAAL

SEQ ID NO: 536161 - protein, 9 aa, Homo Sapiens
CQRGQVLRG

SEQ ID NO: 536162 - protein, 9 aa, Homo Sapiens
RKELPGGAV

SEQ ID NO: 536163 - protein, 9 aa, Homo Sapiens
SEGEIPILQ

SEQ ID NO: 536164 - protein, 9 aa, Homo Sapiens
QGGWFLGQM

SEQ ID NO: 536165 - protein, 9 aa, Homo Sapiens
TKQGQAALD

SEQ ID NO: 536166 - protein, 9 aa, Homo Sapiens
LGRWHQLWR

SEQ ID NO: 536167 - protein, 9 aa, Homo Sapiens
GGWFLGQMG

SEQ ID NO: 536168 - protein, 9 aa, Homo Sapiens
LPQRGLRGE

SEQ ID NO: 536169 - protein, 9 aa, Homo Sapiens
SGALPQLSL

SEQ ID NO: 536170 - protein, 9 aa, Homo Sapiens
QALSLHAVL

SEQ ID NO: 536171 - protein, 9 aa, Homo Sapiens
ALPQLSLRK

SEQ ID NO: 536172 - protein, 9 aa, Homo Sapiens
MSAYVSGGS

SEQ ID NO: 536173 - protein, 9 aa, Homo Sapiens
EAVHQPHPC

SEQ ID NO: 536174 - protein, 9 aa, Homo Sapiens
QGQAALDRL

SEQ ID NO: 536175 - protein, 9 aa, Homo Sapiens
GSLWPLLAH

SEQ ID NO: 536176 - protein, 9 aa, Homo Sapiens
EEIDILTDA

SEQ ID NO: 536177 - protein, 9 aa, Homo Sapiens
KQGQAALDR

SEQ ID NO: 536178 - protein, 9 aa, Homo Sapiens
PHKTKQGQA

SEQ ID NO: 536179 - protein, 9 aa, Homo Sapiens
GVPDPPLPL

SEQ ID NO: 536180 - protein, 9 aa, Homo Sapiens
SLWPLLAHM

SEQ ID NO: 536181 - protein, 9 aa, Homo Sapiens
EECGKAFSS

SEQ ID NO: 536182 - protein, 9 aa, Homo Sapiens
LNSFLSSMS

SEQ ID NO: 536183 - protein, 9 aa, Homo Sapiens
LHQAVVHRE

SEQ ID NO: 536184 - protein, 9 aa, Homo Sapiens
GALPQLSLR

SEQ ID NO: 536185 - protein, 9 aa, Homo Sapiens
WPLLAHMWW

SEQ ID NO: 536186 - protein, 9 aa, Homo Sapiens
EPVPEAPAG

SEQ ID NO: 536187 - protein, 9 aa, Homo Sapiens
LWPLLAHMW

SEQ ID NO: 536188 - protein, 9 aa, Homo Sapiens
SFLSSMSAY

SEQ ID NO: 536189 - protein, 9 aa, Homo Sapiens
QALPQRGLR

SEQ ID NO: 536190 - protein, 9 aa, Homo Sapiens
LLAHMWWGR

SEQ ID NO: 536191 - protein, 9 aa, Homo Sapiens
QNESRPLFL

SEQ ID NO: 536192 - protein, 9 aa, Homo Sapiens
RAAGQEAVH

SEQ ID NO: 536193 - protein, 9 aa, Homo Sapiens
QPHPCQRGQ

SEQ ID NO: 536194 - protein, 9 aa, Homo Sapiens
TDACSKLQE

SEQ ID NO: 536195 - protein, 9 aa, Homo Sapiens
VHREGQGTD

SEQ ID NO: 536196 - protein, 9 aa, Homo Sapiens
AAGQEAVHQ

SEQ ID NO: 536197 - protein, 9 aa, Homo Sapiens
GSGKRNVGA

SEQ ID NO: 536198 - protein, 9 aa, Homo Sapiens
HPCQRGQVL

SEQ ID NO: 536199 - protein, 9 aa, Homo Sapiens
NSFLSSMSA

SEQ ID NO: 536200 - protein, 9 aa, Homo Sapiens
LSQQCEQAL

SEQ ID NO: 536201 - protein, 9 aa, Homo Sapiens
QLSLRKELP

SEQ ID NO: 536202 - protein, 9 aa, Homo Sapiens
QMGSLWPLL

SEQ ID NO: 536203 - protein, 9 aa, Homo Sapiens
DGVPDPPLP

SEQ ID NO: 536204 - protein, 9 aa, Homo Sapiens
QSGALPQLS

SEQ ID NO: 536205 - protein, 9 aa, Homo Sapiens
PHPCQRGQV

SEQ ID NO: 536206 - protein, 9 aa, Homo Sapiens
FLGQMGSLW

SEQ ID NO: 536207 - protein, 9 aa, Homo Sapiens
REPVPEAPA

SEQ ID NO: 536208 - protein, 9 aa, Homo Sapiens
LSLRKELPG

SEQ ID NO: 536209 - protein, 9 aa, Homo Sapiens
HKTKQGQAA

SEQ ID NO: 536210 - protein, 9 aa, Homo Sapiens
PLFLIELFH

SEQ ID NO: 536211 - protein, 9 aa, Homo Sapiens
QLWRGQALP

SEQ ID NO: 536212 - protein, 9 aa, Homo Sapiens
WFLGQMGSL

SEQ ID NO: 536213 - protein, 9 aa, Homo Sapiens
ALPQRGLRG

SEQ ID NO: 536214 - protein, 9 aa, Homo Sapiens
ESALEREPV

SEQ ID NO: 536215 - protein, 9 aa, Homo Sapiens
RGLRGETQP

SEQ ID NO: 536216 - protein, 9 aa, Homo Sapiens
LPLGRWHQL

SEQ ID NO: 536217 - protein, 9 aa, Homo Sapiens
LHAVLHQAV

SEQ ID NO: 536218 - protein, 9 aa, Homo Sapiens
GQVLRGSEG

SEQ ID NO: 536219 - protein, 9 aa, Homo Sapiens
AVLHQAVVH

SEQ ID NO: 536220 - protein, 9 aa, Homo Sapiens
EREPVPEAP

SEQ ID NO: 536221 - protein, 9 aa, Homo Sapiens
RGQVLRGSE

SEQ ID NO: 536222 - protein, 9 aa, Homo Sapiens
DILTDACSK

SEQ ID NO: 536223 - protein, 9 aa, Homo Sapiens
WGRAAGQEA

SEQ ID NO: 536224 - protein, 9 aa, Homo Sapiens
WRGQALPQR

SEQ ID NO: 536225 - protein, 9 aa, Homo Sapiens
GLRGETQPQ

SEQ ID NO: 536226 - protein, 9 aa, Homo Sapiens
CRGSGKRNV

SEQ ID NO: 536227 - protein, 9 aa, Homo Sapiens
QPQQAQGGW

SEQ ID NO: 536228 - protein, 9 aa, Homo Sapiens
SYAGPGSDG

SEQ ID NO: 536229 - protein, 9 aa, Homo Sapiens
LGAHCRWAA

SEQ ID NO: 536230 - protein, 9 aa, Homo Sapiens
QLKEIEEMI

SEQ ID NO: 536231 - protein, 9 aa, Homo Sapiens
SIGKQWKDQ

SEQ ID NO: 536232 - protein, 9 aa, Homo Sapiens
ANLERGRRG

SEQ ID NO: 536233 - protein, 9 aa, Homo Sapiens
FPDGHKFDS

SEQ ID NO: 536234 - protein, 9 aa, Homo Sapiens
AEEAQLKEI

SEQ ID NO: 536235 - protein, 9 aa, Homo Sapiens
VSKTLVGME

SEQ ID NO: 536236 - protein, 9 aa, Homo Sapiens
RRSHLKQAV

SEQ ID NO: 536237 - protein, 9 aa, Homo Sapiens
AECYCGRKI

SEQ ID NO: 536238 - protein, 9 aa, Homo Sapiens
LASIGKQWK

SEQ ID NO: 536239 - protein, 9 aa, Homo Sapiens
SHLKQAVAK

SEQ ID NO: 536240 - protein, 9 aa, Homo Sapiens
LPRYSHSVS

SEQ ID NO: 536241 - protein, 9 aa, Homo Sapiens
RRLHEMRIA

SEQ ID NO: 536242 - protein, 9 aa, Homo Sapiens
DSQLNFLQH

SEQ ID NO: 536243 - protein, 9 aa, Homo Sapiens
DVSKTLVGM

SEQ ID NO: 536244 - protein, 9 aa, Homo Sapiens
KVDRLNGVA

SEQ ID NO: 536245 - protein, 9 aa, Homo Sapiens
KQWKDQNIK

SEQ ID NO: 536246 - protein, 9 aa, Homo Sapiens
SPLSYAGPG

SEQ ID NO: 536247 - protein, 9 aa, Homo Sapiens
SKTLVGMEG

SEQ ID NO: 536248 - protein, 9 aa, Homo Sapiens
SGAAEGGRG

SEQ ID NO: 536249 - protein, 9 aa, Homo Sapiens
GGRGQDDLP

SEQ ID NO: 536250 - protein, 9 aa, Homo Sapiens
TTICDLDTH

SEQ ID NO: 536251 - protein, 9 aa, Homo Sapiens
EGMSDSQLN

SEQ ID NO: 536252 - protein, 9 aa, Homo Sapiens
YAGPGSDGK

SEQ ID NO: 536253 - protein, 9 aa, Homo Sapiens
PSGAAEGGR

SEQ ID NO: 536254 - protein, 9 aa, Homo Sapiens
HTLVWEGGS

SEQ ID NO: 536255 - protein, 9 aa, Homo Sapiens
GVPLPMADR

SEQ ID NO: 536256 - protein, 9 aa, Homo Sapiens
TELANLERG

SEQ ID NO: 536257 - protein, 9 aa, Homo Sapiens
MEGAPATRL

SEQ ID NO: 536258 - protein, 9 aa, Homo Sapiens
ASIGKQWKD

SEQ ID NO: 536259 - protein, 9 aa, Homo Sapiens
EAQLKEIEE

SEQ ID NO: 536260 - protein, 9 aa, Homo Sapiens
VSSSPDTKV

SEQ ID NO: 536261 - protein, 9 aa, Homo Sapiens
ECYCGRKIQ

SEQ ID NO: 536262 - protein, 9 aa, Homo Sapiens
SVSSSPDTK

SEQ ID NO: 536263 - protein, 9 aa, Homo Sapiens
HCRWAACNI

SEQ ID NO: 536264 - protein, 9 aa, Homo Sapiens
QLNFLQHLR

SEQ ID NO: 536265 - protein, 9 aa, Homo Sapiens
TGAEEAQLK

SEQ ID NO: 536266 - protein, 9 aa, Homo Sapiens
CYCGRKIQA

SEQ ID NO: 536267 - protein, 9 aa, Homo Sapiens
RGQDDLPDL

SEQ ID NO: 536268 - protein, 9 aa, Homo Sapiens
LANLERGRR

SEQ ID NO: 536269 - protein, 9 aa, Homo Sapiens
LLSKRRSHL

SEQ ID NO: 536270 - protein, 9 aa, Homo Sapiens
SHSVSSSPD

SEQ ID NO: 536271 - protein, 9 aa, Homo Sapiens
GALGAHCRW

SEQ ID NO: 536272 - protein, 9 aa, Homo Sapiens
THFRCQESG

SEQ ID NO: 536273 - protein, 9 aa, Homo Sapiens
LSKRRSHLK

SEQ ID NO: 536274 - protein, 9 aa, Homo Sapiens
MSDSQLNFL

SEQ ID NO: 536275 - protein, 9 aa, Homo Sapiens
GAHCRWAAC

SEQ ID NO: 536276 - protein, 9 aa, Homo Sapiens
LERGRRGLE

SEQ ID NO: 536277 - protein, 9 aa, Homo Sapiens
TFPDGHKFD

SEQ ID NO: 536278 - protein, 9 aa, Homo Sapiens
DLTHTLVWE

SEQ ID NO: 536279 - protein, 9 aa, Homo Sapiens
WDGVPLPMA

SEQ ID NO: 536280 - protein, 9 aa, Homo Sapiens
VPLPMADRL

SEQ ID NO: 536281 - protein, 9 aa, Homo Sapiens
NLASIGKQW

SEQ ID NO: 536282 - protein, 9 aa, Homo Sapiens
GTFPDGHKF

SEQ ID NO: 536283 - protein, 9 aa, Homo Sapiens
MLLSKRRSH

SEQ ID NO: 536284 - protein, 9 aa, Homo Sapiens
ICDLDTHFR

SEQ ID NO: 536285 - protein, 9 aa, Homo Sapiens
GAECYCGRK

SEQ ID NO: 536286 - protein, 9 aa, Homo Sapiens
DLDTHFRCQ

SEQ ID NO: 536287 - protein, 9 aa, Homo Sapiens
HLKQAVAKM

SEQ ID NO: 536288 - protein, 9 aa, Homo Sapiens
CDLDTHFRC

SEQ ID NO: 536289 - protein, 9 aa, Homo Sapiens
LHEMRIARL

SEQ ID NO: 536290 - protein, 9 aa, Homo Sapiens
RKIQATNVS

SEQ ID NO: 536291 - protein, 9 aa, Homo Sapiens
GKQWKDQNI

SEQ ID NO: 536292 - protein, 9 aa, Homo Sapiens
PRYSHSVSS

SEQ ID NO: 536293 - protein, 9 aa, Homo Sapiens
AHCRWAACN

SEQ ID NO: 536294 - protein, 9 aa, Homo Sapiens
RSHLKQAVA

SEQ ID NO: 536295 - protein, 9 aa, Homo Sapiens
IMVWDGVPL

SEQ ID NO: 536296 - protein, 9 aa, Homo Sapiens
ETLGALGAH

SEQ ID NO: 536297 - protein, 9 aa, Homo Sapiens
VDRLNGVAF

SEQ ID NO: 536298 - protein, 9 aa, Homo Sapiens
FTELANLER

SEQ ID NO: 536299 - protein, 9 aa, Homo Sapiens
THTLVWEGG

SEQ ID NO: 536300 - protein, 9 aa, Homo Sapiens
LKEIEEMIT

SEQ ID NO: 536301 - protein, 9 aa, Homo Sapiens
YSHSVSSSP

SEQ ID NO: 536302 - protein, 9 aa, Homo Sapiens
NLERGRRGL

SEQ ID NO: 536303 - protein, 9 aa, Homo Sapiens
MRIARLRQE

SEQ ID NO: 536304 - protein, 9 aa, Homo Sapiens
PLSYAGPGS

SEQ ID NO: 536305 - protein, 9 aa, Homo Sapiens
VGMEGAPAT

SEQ ID NO: 536306 - protein, 9 aa, Homo Sapiens
RREDLTHTL

SEQ ID NO: 536307 - protein, 9 aa, Homo Sapiens
GMEGAPATR

SEQ ID NO: 536308 - protein, 9 aa, Homo Sapiens
SQLNFLQHL

SEQ ID NO: 536309 - protein, 9 aa, Homo Sapiens
HKFDSSYDR

SEQ ID NO: 536310 - protein, 9 aa, Homo Sapiens
LVGMEGAPA

SEQ ID NO: 536311 - protein, 9 aa, Homo Sapiens
DGHKFDSSY

SEQ ID NO: 536312 - protein, 9 aa, Homo Sapiens
KEIEEMITA

SEQ ID NO: 536313 - protein, 9 aa, Homo Sapiens
AEGGRGQDD

SEQ ID NO: 536314 - protein, 9 aa, Homo Sapiens
SVEGMSDSQ

SEQ ID NO: 536315 - protein, 9 aa, Homo Sapiens
TLVGMEGAP

SEQ ID NO: 536316 - protein, 9 aa, Homo Sapiens
GHKFDSSYD

SEQ ID NO: 536317 - protein, 9 aa, Homo Sapiens
GRGQDDLPD

SEQ ID NO: 536318 - protein, 9 aa, Homo Sapiens
HEMRIARLR

SEQ ID NO: 536319 - protein, 9 aa, Homo Sapiens
REDLTHTLV

SEQ ID NO: 536320 - protein, 9 aa, Homo Sapiens
VGTFPDGHK

SEQ ID NO: 536321 - protein, 9 aa, Homo Sapiens
VLIMVWDGV

SEQ ID NO: 536322 - protein, 9 aa, Homo Sapiens
TICDLDTHF

SEQ ID NO: 536323 - protein, 9 aa, Homo Sapiens
MVWDGVPLP

SEQ ID NO: 536324 - protein, 9 aa, Homo Sapiens
GRKIQATNV

SEQ ID NO: 536325 - protein, 9 aa, Homo Sapiens
ENRRLHEMR

SEQ ID NO: 536326 - protein, 9 aa, Homo Sapiens
LDTHFRCQE

SEQ ID NO: 536327 - protein, 9 aa, Homo Sapiens
KTLVGMEGA

SEQ ID NO: 536328 - protein, 9 aa, Homo Sapiens
SEKVDRLNG

SEQ ID NO: 536329 - protein, 9 aa, Homo Sapiens
GAAEGGRGQ

SEQ ID NO: 536330 - protein, 9 aa, Homo Sapiens
ALGAHCRWA

SEQ ID NO: 536331 - protein, 9 aa, Homo Sapiens
DGVPLPMAD

SEQ ID NO: 536332 - protein, 9 aa, Homo Sapiens
QWKDQNIKD

SEQ ID NO: 536333 - protein, 9 aa, Homo Sapiens
LTHTLVWEG

SEQ ID NO: 536334 - protein, 9 aa, Homo Sapiens
VWDGVPLPM

SEQ ID NO: 536335 - protein, 9 aa, Homo Sapiens
RYSHSVSSS

SEQ ID NO: 536336 - protein, 9 aa, Homo Sapiens
DSEKVDRLN

SEQ ID NO: 536337 - protein, 9 aa, Homo Sapiens
VEGMSDSQL

SEQ ID NO: 536338 - protein, 9 aa, Homo Sapiens
TLVWEGGSD

SEQ ID NO: 536339 - protein, 9 aa, Homo Sapiens
CSPLSYAGP

SEQ ID NO: 536340 - protein, 9 aa, Homo Sapiens
TRREDLTHT

SEQ ID NO: 536341 - protein, 9 aa, Homo Sapiens
RLHEMRIAR

SEQ ID NO: 536342 - protein, 9 aa, Homo Sapiens
DTHFRCQES

SEQ ID NO: 536343 - protein, 9 aa, Homo Sapiens
TLGALGAHC

SEQ ID NO: 536344 - protein, 9 aa, Homo Sapiens
YVGTFPDGH

SEQ ID NO: 536345 - protein, 9 aa, Homo Sapiens
AENRRLHEM

SEQ ID NO: 536346 - protein, 9 aa, Homo Sapiens
GMSDSQLNF

SEQ ID NO: 536347 - protein, 9 aa, Homo Sapiens
RNLASIGKQ

SEQ ID NO: 536348 - protein, 9 aa, Homo Sapiens
EMRIARLRQ

SEQ ID NO: 536349 - protein, 9 aa, Homo Sapiens
ELANLERGR

SEQ ID NO: 536350 - protein, 9 aa, Homo Sapiens
NRRLHEMRI

SEQ ID NO: 536351 - protein, 9 aa, Homo Sapiens
EGGRGQDDL

SEQ ID NO: 536352 - protein, 9 aa, Homo Sapiens
SKRRSHLKQ

SEQ ID NO: 536353 - protein, 9 aa, Homo Sapiens
AAEGGRGQD

SEQ ID NO: 536354 - protein, 9 aa, Homo Sapiens
PGSDGKWNL

SEQ ID NO: 536355 - protein, 9 aa, Homo Sapiens
GPGSDGKWN

SEQ ID NO: 536356 - protein, 9 aa, Homo Sapiens
EKVDRLNGV

SEQ ID NO: 536357 - protein, 9 aa, Homo Sapiens
LSYAGPGSD

SEQ ID NO: 536358 - protein, 9 aa, Homo Sapiens
HSVSSSPDT

SEQ ID NO: 536359 - protein, 9 aa, Homo Sapiens
LIMVWDGVP

SEQ ID NO: 536360 - protein, 9 aa, Homo Sapiens
EDLTHTLVW

SEQ ID NO: 536361 - protein, 9 aa, Homo Sapiens
AGPGSDGKW

SEQ ID NO: 536362 - protein, 9 aa, Homo Sapiens
HFRCQESGT

SEQ ID NO: 536363 - protein, 9 aa, Homo Sapiens
IGKQWKDQN

SEQ ID NO: 536364 - protein, 9 aa, Homo Sapiens
KRRSHLKQA

SEQ ID NO: 536365 - protein, 9 aa, Homo Sapiens
LGALGAHCR

SEQ ID NO: 536366 - protein, 9 aa, Homo Sapiens
EEAQLKEIE

SEQ ID NO: 536367 - protein, 9 aa, Homo Sapiens
CGRKIQATN

SEQ ID NO: 536368 - protein, 9 aa, Homo Sapiens
GAEEAQLKE

SEQ ID NO: 536369 - protein, 9 aa, Homo Sapiens
PDGHKFDSS

SEQ ID NO: 536370 - protein, 9 aa, Homo Sapiens
AQLKEIEEM

SEQ ID NO: 536371 - protein, 9 aa, Homo Sapiens
SDSQLNFLQ

SEQ ID NO: 536372 - protein, 9 aa, Homo Sapiens
FGAECYCGR

SEQ ID NO: 536373 - protein, 9 aa, Homo Sapiens
LLPRYSHSV

SEQ ID NO: 536374 - protein, 9 aa, Homo Sapiens
YCGRKIQAT

SEQ ID NO: 536375 - protein, 9 aa, Homo Sapiens
DFSKLTKSS

SEQ ID NO: 536376 - protein, 9 aa, Homo Sapiens
SGDWKTSVW

SEQ ID NO: 536377 - protein, 9 aa, Homo Sapiens
KLDCSPSVS

SEQ ID NO: 536378 - protein, 9 aa, Homo Sapiens
VQEATTYKL

SEQ ID NO: 536379 - protein, 9 aa, Homo Sapiens
GGEAVGTGE

SEQ ID NO: 536380 - protein, 9 aa, Homo Sapiens
RINKKEIFI

SEQ ID NO: 536381 - protein, 9 aa, Homo Sapiens
TKSSANYNL

SEQ ID NO: 536382 - protein, 9 aa, Homo Sapiens
NWKVCRWSS

SEQ ID NO: 536383 - protein, 9 aa, Homo Sapiens
EQKQLTQRI

SEQ ID NO: 536384 - protein, 9 aa, Homo Sapiens
EATTYKLLP

SEQ ID NO: 536385 - protein, 9 aa, Homo Sapiens
GSPYKAHVV

SEQ ID NO: 536386 - protein, 9 aa, Homo Sapiens
RDGFRKELE

SEQ ID NO: 536387 - protein, 9 aa, Homo Sapiens
SALITTIVG

SEQ ID NO: 536388 - protein, 9 aa, Homo Sapiens
LGRDGFRKE

SEQ ID NO: 536389 - protein, 9 aa, Homo Sapiens
TPVSHMLVA

SEQ ID NO: 536390 - protein, 9 aa, Homo Sapiens
MPLPRSTAS

SEQ ID NO: 536391 - protein, 9 aa, Homo Sapiens
TEFKSQNNH

SEQ ID NO: 536392 - protein, 9 aa, Homo Sapiens
PGSPYKAHV

SEQ ID NO: 536393 - protein, 9 aa, Homo Sapiens
DFFKEIFHE

SEQ ID NO: 536394 - protein, 9 aa, Homo Sapiens
CSPSVSSTL

SEQ ID NO: 536395 - protein, 9 aa, Homo Sapiens
AEESANKDN

SEQ ID NO: 536396 - protein, 9 aa, Homo Sapiens
VRICCSLGR

SEQ ID NO: 536397 - protein, 9 aa, Homo Sapiens
ATPTEGACV

SEQ ID NO: 536398 - protein, 9 aa, Homo Sapiens
NKNVTNRNK

SEQ ID NO: 536399 - protein, 9 aa, Homo Sapiens
EFKSQNNHF

SEQ ID NO: 536400 - protein, 9 aa, Homo Sapiens
QYNSALITT

SEQ ID NO: 536401 - protein, 9 aa, Homo Sapiens
TEGACVPGK

SEQ ID NO: 536402 - protein, 9 aa, Homo Sapiens
LVKVKEKQL

SEQ ID NO: 536403 - protein, 9 aa, Homo Sapiens
KQVNWKVCR

SEQ ID NO: 536404 - protein, 9 aa, Homo Sapiens
SANYNLQRA

SEQ ID NO: 536405 - protein, 9 aa, Homo Sapiens
YKAHVVPCF

SEQ ID NO: 536406 - protein, 9 aa, Homo Sapiens
IPLTLQQAQ

SEQ ID NO: 536407 - protein, 9 aa, Homo Sapiens
MLVANSEAS

SEQ ID NO: 536408 - protein, 9 aa, Homo Sapiens
AVFYTLILK

SEQ ID NO: 536409 - protein, 9 aa, Homo Sapiens
IAVFYTLIL

SEQ ID NO: 536410 - protein, 9 aa, Homo Sapiens
NKGTAEKLK

SEQ ID NO: 536411 - protein, 9 aa, Homo Sapiens
RNKGTAEKL

SEQ ID NO: 536412 - protein, 9 aa, Homo Sapiens
AKQCLKIGR

SEQ ID NO: 536413 - protein, 9 aa, Homo Sapiens
LLGLVNNAG

SEQ ID NO: 536414 - protein, 9 aa, Homo Sapiens
FKSQNNHFV

SEQ ID NO: 536415 - protein, 9 aa, Homo Sapiens
EEELVKVKE

SEQ ID NO: 536416 - protein, 9 aa, Homo Sapiens
RSTASGCGM

SEQ ID NO: 536417 - protein, 9 aa, Homo Sapiens
TPKLDCSPS

SEQ ID NO: 536418 - protein, 9 aa, Homo Sapiens
VSGVTTHSL

SEQ ID NO: 536419 - protein, 9 aa, Homo Sapiens
GLGGEAVGT

SEQ ID NO: 536420 - protein, 9 aa, Homo Sapiens
SKLTKSSAN

SEQ ID NO: 536421 - protein, 9 aa, Homo Sapiens
SDPPSPGVL

SEQ ID NO: 536422 - protein, 9 aa, Homo Sapiens
PPVRICCSL

SEQ ID NO: 536423 - protein, 9 aa, Homo Sapiens
QNNHFVVLD

SEQ ID NO: 536424 - protein, 9 aa, Homo Sapiens
LGIPLTLQQ

SEQ ID NO: 536425 - protein, 9 aa, Homo Sapiens
PLTLQQAQQ

SEQ ID NO: 536426 - protein, 9 aa, Homo Sapiens
DTHIPGSPY

SEQ ID NO: 536427 - protein, 9 aa, Homo Sapiens
PKLDCSPSV

SEQ ID NO: 536428 - protein, 9 aa, Homo Sapiens
DDFFKEIFH

SEQ ID NO: 536429 - protein, 9 aa, Homo Sapiens
RKQVNWKVC

SEQ ID NO: 536430 - protein, 9 aa, Homo Sapiens
GRRLDFAEE

SEQ ID NO: 536431 - protein, 9 aa, Homo Sapiens
NGCTEFKSQ

SEQ ID NO: 536432 - protein, 9 aa, Homo Sapiens
ILIAVFYTL

SEQ ID NO: 536433 - protein, 9 aa, Homo Sapiens
PNDKERLEG

SEQ ID NO: 536434 - protein, 9 aa, Homo Sapiens
GVTTHSLED

SEQ ID NO: 536435 - protein, 9 aa, Homo Sapiens
SKPPVRICC

SEQ ID NO: 536436 - protein, 9 aa, Homo Sapiens
ATTYKLLPF

SEQ ID NO: 536437 - protein, 9 aa, Homo Sapiens
FSDPPSPGV

SEQ ID NO: 536438 - protein, 9 aa, Homo Sapiens
PMPLPRSTA

SEQ ID NO: 536439 - protein, 9 aa, Homo Sapiens
VSHMLVANS

SEQ ID NO: 536440 - protein, 9 aa, Homo Sapiens
VNWKVCRWS

SEQ ID NO: 536441 - protein, 9 aa, Homo Sapiens
KNKNVTNRN

SEQ ID NO: 536442 - protein, 9 aa, Homo Sapiens
PLPRSTASG

SEQ ID NO: 536443 - protein, 9 aa, Homo Sapiens
VLLMMSFDC

SEQ ID NO: 536444 - protein, 9 aa, Homo Sapiens
ESKPPVRIC

SEQ ID NO: 536445 - protein, 9 aa, Homo Sapiens
FFKEIFHER

SEQ ID NO: 536446 - protein, 9 aa, Homo Sapiens
DFAEESANK

SEQ ID NO: 536447 - protein, 9 aa, Homo Sapiens
CVPGKPTLV

SEQ ID NO: 536448 - protein, 9 aa, Homo Sapiens
EEQKQLTQR

SEQ ID NO: 536449 - protein, 9 aa, Homo Sapiens
GLLGLVNNA

SEQ ID NO: 536450 - protein, 9 aa, Homo Sapiens
TFHKPDDFF

SEQ ID NO: 536451 - protein, 9 aa, Homo Sapiens
PVQEATTYK

SEQ ID NO: 536452 - protein, 9 aa, Homo Sapiens
KVKEKQLAA

SEQ ID NO: 536453 - protein, 9 aa, Homo Sapiens
SPYKAHVVP

SEQ ID NO: 536454 - protein, 9 aa, Homo Sapiens
PYKAHVVPC

SEQ ID NO: 536455 - protein, 9 aa, Homo Sapiens
PTEGACVPG

SEQ ID NO: 536456 - protein, 9 aa, Homo Sapiens
WKVCRWSSS

SEQ ID NO: 536457 - protein, 9 aa, Homo Sapiens
GDWKTSVWI

SEQ ID NO: 536458 - protein, 9 aa, Homo Sapiens
ACVPGKPTL

SEQ ID NO: 536459 - protein, 9 aa, Homo Sapiens
SLEDHTKLP

SEQ ID NO: 536460 - protein, 9 aa, Homo Sapiens
CTQYNSALI

SEQ ID NO: 536461 - protein, 9 aa, Homo Sapiens
RLDFAEESA

SEQ ID NO: 536462 - protein, 9 aa, Homo Sapiens
FDCLVAICH

SEQ ID NO: 536463 - protein, 9 aa, Homo Sapiens
TTHSLEDHT

SEQ ID NO: 536464 - protein, 9 aa, Homo Sapiens
LPRSTASGC

SEQ ID NO: 536465 - protein, 9 aa, Homo Sapiens
ERLGRDGFR

SEQ ID NO: 536466 - protein, 9 aa, Homo Sapiens
CLVAICHPL

SEQ ID NO: 536467 - protein, 9 aa, Homo Sapiens
SHMLVANSE

SEQ ID NO: 536468 - protein, 9 aa, Homo Sapiens
PVSHMLVAN

SEQ ID NO: 536469 - protein, 9 aa, Homo Sapiens
ECVRDKGLL

SEQ ID NO: 536470 - protein, 9 aa, Homo Sapiens
HPGLGGEAV

SEQ ID NO: 536471 - protein, 9 aa, Homo Sapiens
THSLEDHTK

SEQ ID NO: 536472 - protein, 9 aa, Homo Sapiens
SKSGDWKTS

SEQ ID NO: 536473 - protein, 9 aa, Homo Sapiens
LEGGAVPAA

SEQ ID NO: 536474 - protein, 9 aa, Homo Sapiens
KPPVRICCS

SEQ ID NO: 536475 - protein, 9 aa, Homo Sapiens
PGLGGEAVG

SEQ ID NO: 536476 - protein, 9 aa, Homo Sapiens
THIPGSPYK

SEQ ID NO: 536477 - protein, 9 aa, Homo Sapiens
KFSDPPSPG

SEQ ID NO: 536478 - protein, 9 aa, Homo Sapiens
ALGIPLTLQ

SEQ ID NO: 536479 - protein, 9 aa, Homo Sapiens
AADAKQCLK

SEQ ID NO: 536480 - protein, 9 aa, Homo Sapiens
FILIAVFYT

SEQ ID NO: 536481 - protein, 9 aa, Homo Sapiens
TTYKLLPFD

SEQ ID NO: 536482 - protein, 9 aa, Homo Sapiens
KLTKSSANY

SEQ ID NO: 536483 - protein, 9 aa, Homo Sapiens
VRDKGLLGL

SEQ ID NO: 536484 - protein, 9 aa, Homo Sapiens
QTPNDKERL

SEQ ID NO: 536485 - protein, 9 aa, Homo Sapiens
PQEHPGLGG

SEQ ID NO: 536486 - protein, 9 aa, Homo Sapiens
CVRDKGLLG

SEQ ID NO: 536487 - protein, 9 aa, Homo Sapiens
VKVKEKQLA

SEQ ID NO: 536488 - protein, 9 aa, Homo Sapiens
LITTIVGCI

SEQ ID NO: 536489 - protein, 9 aa, Homo Sapiens
VERLGRDGF

SEQ ID NO: 536490 - protein, 9 aa, Homo Sapiens
ICCSLGRCP

SEQ ID NO: 536491 - protein, 9 aa, Homo Sapiens
QRKQVNWKV

SEQ ID NO: 536492 - protein, 9 aa, Homo Sapiens
TPTEGACVP

SEQ ID NO: 536493 - protein, 9 aa, Homo Sapiens
HKPDDFFKE

SEQ ID NO: 536494 - protein, 9 aa, Homo Sapiens
KEKQLAAEN

SEQ ID NO: 536495 - protein, 9 aa, Homo Sapiens
VTTHSLEDH

SEQ ID NO: 536496 - protein, 9 aa, Homo Sapiens
LGGEAVGTG

SEQ ID NO: 536497 - protein, 9 aa, Homo Sapiens
GCTEFKSQN

SEQ ID NO: 536498 - protein, 9 aa, Homo Sapiens
SGVTTHSLE

SEQ ID NO: 536499 - protein, 9 aa, Homo Sapiens
DVERLGRDG

SEQ ID NO: 536500 - protein, 9 aa, Homo Sapiens
TYKLLPFDS

SEQ ID NO: 536501 - protein, 9 aa, Homo Sapiens
TQRINKKEI

SEQ ID NO: 536502 - protein, 9 aa, Homo Sapiens
ALITTIVGC

SEQ ID NO: 536503 - protein, 9 aa, Homo Sapiens
EESANKDNA

SEQ ID NO: 536504 - protein, 9 aa, Homo Sapiens
PDDFFKEIF

SEQ ID NO: 536505 - protein, 9 aa, Homo Sapiens
DCLVAICHP

SEQ ID NO: 536506 - protein, 9 aa, Homo Sapiens
KPVQEATTY

SEQ ID NO: 536507 - protein, 9 aa, Homo Sapiens
DAKQCLKIG

SEQ ID NO: 536508 - protein, 9 aa, Homo Sapiens
QKQLTQRIN

SEQ ID NO: 536509 - protein, 9 aa, Homo Sapiens
RICCSLGRC

SEQ ID NO: 536510 - protein, 9 aa, Homo Sapiens
VTNRNKGTA

SEQ ID NO: 536511 - protein, 9 aa, Homo Sapiens
EGACVPGKP

SEQ ID NO: 536512 - protein, 9 aa, Homo Sapiens
VKEKQLAAE

SEQ ID NO: 536513 - protein, 9 aa, Homo Sapiens
VCRWSSSGV

SEQ ID NO: 536514 - protein, 9 aa, Homo Sapiens
PPSPGVLPK

SEQ ID NO: 536515 - protein, 9 aa, Homo Sapiens
SMPMPLPRS

SEQ ID NO: 536516 - protein, 9 aa, Homo Sapiens
TPQEHPGLG

SEQ ID NO: 536517 - protein, 9 aa, Homo Sapiens
DCSPSVSST

SEQ ID NO: 536518 - protein, 9 aa, Homo Sapiens
PRSTASGCG

SEQ ID NO: 536519 - protein, 9 aa, Homo Sapiens
LTKSSANYN

SEQ ID NO: 536520 - protein, 9 aa, Homo Sapiens
QRINKKEIF

SEQ ID NO: 536521 - protein, 9 aa, Homo Sapiens
GRDGFRKEL

SEQ ID NO: 536522 - protein, 9 aa, Homo Sapiens
EELVKVKEK

SEQ ID NO: 536523 - protein, 9 aa, Homo Sapiens
QLTQRINKK

SEQ ID NO: 536524 - protein, 9 aa, Homo Sapiens
ITTIVGCIK

SEQ ID NO: 536525 - protein, 9 aa, Homo Sapiens
TQYNSALIT

SEQ ID NO: 536526 - protein, 9 aa, Homo Sapiens
KATPKLDCS

SEQ ID NO: 536527 - protein, 9 aa, Homo Sapiens
ELVKVKEKQ

SEQ ID NO: 536528 - protein, 9 aa, Homo Sapiens
TNRNKGTAE

SEQ ID NO: 536529 - protein, 9 aa, Homo Sapiens
STPVSHMLV

SEQ ID NO: 536530 - protein, 9 aa, Homo Sapiens
KGLLGLVNN

SEQ ID NO: 536531 - protein, 9 aa, Homo Sapiens
VDFILIAVF

SEQ ID NO: 536532 - protein, 9 aa, Homo Sapiens
IPGSPYKAH

SEQ ID NO: 536533 - protein, 9 aa, Homo Sapiens
NDKERLEGG

SEQ ID NO: 536534 - protein, 9 aa, Homo Sapiens
KEEELVKVK

SEQ ID NO: 536535 - protein, 9 aa, Homo Sapiens
SKATPKLDC

SEQ ID NO: 536536 - protein, 9 aa, Homo Sapiens
CTEFKSQNN

SEQ ID NO: 536537 - protein, 9 aa, Homo Sapiens
DKERLEGGA

SEQ ID NO: 536538 - protein, 9 aa, Homo Sapiens
ADAKQCLKI

SEQ ID NO: 536539 - protein, 9 aa, Homo Sapiens
VAADAKQCL

SEQ ID NO: 536540 - protein, 9 aa, Homo Sapiens
GFRKELERH

SEQ ID NO: 536541 - protein, 9 aa, Homo Sapiens
FSKLTKSSA

SEQ ID NO: 536542 - protein, 9 aa, Homo Sapiens
LKIGRDALR

SEQ ID NO: 536543 - protein, 9 aa, Homo Sapiens
DPPSPGVLP

SEQ ID NO: 536544 - protein, 9 aa, Homo Sapiens
RLEGGAVPA

SEQ ID NO: 536545 - protein, 9 aa, Homo Sapiens
NSALITTIV

SEQ ID NO: 536546 - protein, 9 aa, Homo Sapiens
HMLVANSEA

SEQ ID NO: 536547 - protein, 9 aa, Homo Sapiens
MMSFDCLVA

SEQ ID NO: 536548 - protein, 9 aa, Homo Sapiens
EHPGLGGEA

SEQ ID NO: 536549 - protein, 9 aa, Homo Sapiens
YKLLPFDSL

SEQ ID NO: 536550 - protein, 9 aa, Homo Sapiens
FYTLILKTV

SEQ ID NO: 536551 - protein, 9 aa, Homo Sapiens
HSLEDHTKL

SEQ ID NO: 536552 - protein, 9 aa, Homo Sapiens
KERLEGGAV

SEQ ID NO: 536553 - protein, 9 aa, Homo Sapiens
NVSGVTTHS

SEQ ID NO: 536554 - protein, 9 aa, Homo Sapiens
FHKPDDFFK

SEQ ID NO: 536555 - protein, 9 aa, Homo Sapiens
DFILIAVFY

SEQ ID NO: 536556 - protein, 9 aa, Homo Sapiens
MPMPLPRST

SEQ ID NO: 536557 - protein, 9 aa, Homo Sapiens
LIAVFYTLI

SEQ ID NO: 536558 - protein, 9 aa, Homo Sapiens
FTFHKPDDF

SEQ ID NO: 536559 - protein, 9 aa, Homo Sapiens
KSGDWKTSV

SEQ ID NO: 536560 - protein, 9 aa, Homo Sapiens
KQCLKIGRD

SEQ ID NO: 536561 - protein, 9 aa, Homo Sapiens
DKGLLGLVN

SEQ ID NO: 536562 - protein, 9 aa, Homo Sapiens
SQNNHFVVL

SEQ ID NO: 536563 - protein, 9 aa, Homo Sapiens
PGVLPKPPS

SEQ ID NO: 536564 - protein, 9 aa, Homo Sapiens
GGRRLDFAE

SEQ ID NO: 536565 - protein, 9 aa, Homo Sapiens
SPGVLPKPP

SEQ ID NO: 536566 - protein, 9 aa, Homo Sapiens
GVLPKPPSH

SEQ ID NO: 536567 - protein, 9 aa, Homo Sapiens
ASSKSGDWK

SEQ ID NO: 536568 - protein, 9 aa, Homo Sapiens
ERLEGGAVP

SEQ ID NO: 536569 - protein, 9 aa, Homo Sapiens
HIPGSPYKA

SEQ ID NO: 536570 - protein, 9 aa, Homo Sapiens
YNSALITTI

SEQ ID NO: 536571 - protein, 9 aa, Homo Sapiens
SSKSGDWKT

SEQ ID NO: 536572 - protein, 9 aa, Homo Sapiens
SSANYNLQR

SEQ ID NO: 536573 - protein, 9 aa, Homo Sapiens
QEHPGLGGE

SEQ ID NO: 536574 - protein, 9 aa, Homo Sapiens
TPNDKERLE

SEQ ID NO: 536575 - protein, 9 aa, Homo Sapiens
RLGRDGFRK

SEQ ID NO: 536576 - protein, 9 aa, Homo Sapiens
MSFDCLVAI

SEQ ID NO: 536577 - protein, 9 aa, Homo Sapiens
GIPLTLQQA

SEQ ID NO: 536578 - protein, 9 aa, Homo Sapiens
LLMMSFDCL

SEQ ID NO: 536579 - protein, 9 aa, Homo Sapiens
NRNKGTAEK

SEQ ID NO: 536580 - protein, 9 aa, Homo Sapiens
PVRICCSLG

SEQ ID NO: 536581 - protein, 9 aa, Homo Sapiens
SFDCLVAIC

SEQ ID NO: 536582 - protein, 9 aa, Homo Sapiens
FAEESANKD

SEQ ID NO: 536583 - protein, 9 aa, Homo Sapiens
PSPGVLPKP

SEQ ID NO: 536584 - protein, 9 aa, Homo Sapiens
TSTPVSHML

SEQ ID NO: 536585 - protein, 9 aa, Homo Sapiens
GACVPGKPT

SEQ ID NO: 536586 - protein, 9 aa, Homo Sapiens
KVCRWSSSG

SEQ ID NO: 536587 - protein, 9 aa, Homo Sapiens
QCLKIGRDA

SEQ ID NO: 536588 - protein, 9 aa, Homo Sapiens
LMMSFDCLV

SEQ ID NO: 536589 - protein, 9 aa, Homo Sapiens
QEATTYKLL

SEQ ID NO: 536590 - protein, 9 aa, Homo Sapiens
KSQNNHFVV

SEQ ID NO: 536591 - protein, 9 aa, Homo Sapiens
LTSTPVSHM

SEQ ID NO: 536592 - protein, 9 aa, Homo Sapiens
STASGCGMG

SEQ ID NO: 536593 - protein, 9 aa, Homo Sapiens
DGFRKELER

SEQ ID NO: 536594 - protein, 9 aa, Homo Sapiens
QALGIPLTL

SEQ ID NO: 536595 - protein, 9 aa, Homo Sapiens
RDKGLLGLV

SEQ ID NO: 536596 - protein, 9 aa, Homo Sapiens
RRLDFAEES

SEQ ID NO: 536597 - protein, 9 aa, Homo Sapiens
KPDDFFKEI

SEQ ID NO: 536598 - protein, 9 aa, Homo Sapiens
LGLVNNAGI

SEQ ID NO: 536599 - protein, 9 aa, Homo Sapiens
LDFAEESAN

SEQ ID NO: 536600 - protein, 9 aa, Homo Sapiens
KSSANYNLQ

SEQ ID NO: 536601 - protein, 9 aa, Homo Sapiens
LDCSPSVSS

SEQ ID NO: 536602 - protein, 9 aa, Homo Sapiens
QVNWKVCRW

SEQ ID NO: 536603 - protein, 9 aa, Homo Sapiens
LTQRINKKE

SEQ ID NO: 536604 - protein, 9 aa, Homo Sapiens
KQLTQRINK

SEQ ID NO: 536605 - protein, 9 aa, Homo Sapiens
VFYTLILKT

SEQ ID NO: 536606 - protein, 9 aa, Homo Sapiens
CLKIGRDAL

SEQ ID NO: 536607 - protein, 9 aa, Homo Sapiens
ATPKLDCSP

SEQ ID NO: 536608 - protein, 9 aa, Homo Sapiens
TASSKSGDW

SEQ ID NO: 536609 - protein, 9 aa, Homo Sapiens
NVTNRNKGT

SEQ ID NO: 536610 - protein, 9 aa, Homo Sapiens
KNVTNRNKG

SEQ ID NO: 536611 - protein, 9 aa, Homo Sapiens
CCSLGRCPP

SEQ ID NO: 536612 - protein, 9 aa, Homo Sapiens
DFRTESPLS

SEQ ID NO: 536613 - protein, 9 aa, Homo Sapiens
SVMEAIEFA

SEQ ID NO: 536614 - protein, 9 aa, Homo Sapiens
MLLAPQGRA

SEQ ID NO: 536615 - protein, 9 aa, Homo Sapiens
AFSKKRMGL

SEQ ID NO: 536616 - protein, 9 aa, Homo Sapiens
LVEFFLKEL

SEQ ID NO: 536617 - protein, 9 aa, Homo Sapiens
RSGLFGQVF

SEQ ID NO: 536618 - protein, 9 aa, Homo Sapiens
HPNASDHED

SEQ ID NO: 536619 - protein, 9 aa, Homo Sapiens
SVGRARDGI

SEQ ID NO: 536620 - protein, 9 aa, Homo Sapiens
PSPWRETFV

SEQ ID NO: 536621 - protein, 9 aa, Homo Sapiens
TDSSVMEAI

SEQ ID NO: 536622 - protein, 9 aa, Homo Sapiens
VQHIDRSDL

SEQ ID NO: 536623 - protein, 9 aa, Homo Sapiens
EPHRGHSGP

SEQ ID NO: 536624 - protein, 9 aa, Homo Sapiens
AGSTFWPMQ

SEQ ID NO: 536625 - protein, 9 aa, Homo Sapiens
SSVMEAIEF

SEQ ID NO: 536626 - protein, 9 aa, Homo Sapiens
WRETFVLKD

SEQ ID NO: 536627 - protein, 9 aa, Homo Sapiens
LLLSAIVSI

SEQ ID NO: 536628 - protein, 9 aa, Homo Sapiens
TVIIHISIP

SEQ ID NO: 536629 - protein, 9 aa, Homo Sapiens
SGLFGQVFR

SEQ ID NO: 536630 - protein, 9 aa, Homo Sapiens
SDHEDEAFD

SEQ ID NO: 536631 - protein, 9 aa, Homo Sapiens
LLAPQGRAF

SEQ ID NO: 536632 - protein, 9 aa, Homo Sapiens
ITFPLSLKL

SEQ ID NO: 536633 - protein, 9 aa, Homo Sapiens
VEFFLKELS

SEQ ID NO: 536634 - protein, 9 aa, Homo Sapiens
AEVSGGGRG

SEQ ID NO: 536635 - protein, 9 aa, Homo Sapiens
TMDSVRSGL

SEQ ID NO: 536636 - protein, 9 aa, Homo Sapiens
NASDHEDEA

SEQ ID NO: 536637 - protein, 9 aa, Homo Sapiens
TESPLSPSS

SEQ ID NO: 536638 - protein, 9 aa, Homo Sapiens
GEAEPHRGH

SEQ ID NO: 536639 - protein, 9 aa, Homo Sapiens
LLVLLLEYG

SEQ ID NO: 536640 - protein, 9 aa, Homo Sapiens
GRHCSLIPS

SEQ ID NO: 536641 - protein, 9 aa, Homo Sapiens
IHISIPKKR

SEQ ID NO: 536642 - protein, 9 aa, Homo Sapiens
VLLLEYGLV

SEQ ID NO: 536643 - protein, 9 aa, Homo Sapiens
ATVIIHISI

SEQ ID NO: 536644 - protein, 9 aa, Homo Sapiens
VGRVGAAEV

SEQ ID NO: 536645 - protein, 9 aa, Homo Sapiens
VGAAEVSGG

SEQ ID NO: 536646 - protein, 9 aa, Homo Sapiens
AHGEAEPHR

SEQ ID NO: 536647 - protein, 9 aa, Homo Sapiens
GLFGQVFRP

SEQ ID NO: 536648 - protein, 9 aa, Homo Sapiens
RDGITFPLS

SEQ ID NO: 536649 - protein, 9 aa, Homo Sapiens
WPMQKSRLG

SEQ ID NO: 536650 - protein, 9 aa, Homo Sapiens
ESPLSPSSD

SEQ ID NO: 536651 - protein, 9 aa, Homo Sapiens
SPWRETFVL

SEQ ID NO: 536652 - protein, 9 aa, Homo Sapiens
QVHPNASDH

SEQ ID NO: 536653 - protein, 9 aa, Homo Sapiens
GITFPLSLK

SEQ ID NO: 536654 - protein, 9 aa, Homo Sapiens
RVGAAEVSG

SEQ ID NO: 536655 - protein, 9 aa, Homo Sapiens
LVLLLEYGL

SEQ ID NO: 536656 - protein, 9 aa, Homo Sapiens
MDSVRSGLF

SEQ ID NO: 536657 - protein, 9 aa, Homo Sapiens
IPSPWSVPV

SEQ ID NO: 536658 - protein, 9 aa, Homo Sapiens
IIHISIPKK

SEQ ID NO: 536659 - protein, 9 aa, Homo Sapiens
HCSLIPSPW

SEQ ID NO: 536660 - protein, 9 aa, Homo Sapiens
RAFSKKRMG

SEQ ID NO: 536661 - protein, 9 aa, Homo Sapiens
MATVIIHIS

SEQ ID NO: 536662 - protein, 9 aa, Homo Sapiens
RGHSGPELQ

SEQ ID NO: 536663 - protein, 9 aa, Homo Sapiens
ILVEFFLKE

SEQ ID NO: 536664 - protein, 9 aa, Homo Sapiens
EFFLKELSG

SEQ ID NO: 536665 - protein, 9 aa, Homo Sapiens
CSLIPSPWS

SEQ ID NO: 536666 - protein, 9 aa, Homo Sapiens
DSSVMEAIE

SEQ ID NO: 536667 - protein, 9 aa, Homo Sapiens
PQGRAFSKK

SEQ ID NO: 536668 - protein, 9 aa, Homo Sapiens
LFGQVFRPD

SEQ ID NO: 536669 - protein, 9 aa, Homo Sapiens
LLEYGLVEI

SEQ ID NO: 536670 - protein, 9 aa, Homo Sapiens
PLSPSSDVE

SEQ ID NO: 536671 - protein, 9 aa, Homo Sapiens
LIPSPWSVP

SEQ ID NO: 536672 - protein, 9 aa, Homo Sapiens
SVRSGLFGQ

SEQ ID NO: 536673 - protein, 9 aa, Homo Sapiens
SLIPSPWSV

SEQ ID NO: 536674 - protein, 9 aa, Homo Sapiens
AEPHRGHSG

SEQ ID NO: 536675 - protein, 9 aa, Homo Sapiens
EDFRTESPL

SEQ ID NO: 536676 - protein, 9 aa, Homo Sapiens
FLKELSGHP

SEQ ID NO: 536677 - protein, 9 aa, Homo Sapiens
RVQHIDRSD

SEQ ID NO: 536678 - protein, 9 aa, Homo Sapiens
KELSGHPRL

SEQ ID NO: 536679 - protein, 9 aa, Homo Sapiens
WAGSTFWPM

SEQ ID NO: 536680 - protein, 9 aa, Homo Sapiens
QWAGSTFWP

SEQ ID NO: 536681 - protein, 9 aa, Homo Sapiens
TFWPMQKSR

SEQ ID NO: 536682 - protein, 9 aa, Homo Sapiens
HEDEAFDPY

SEQ ID NO: 536683 - protein, 9 aa, Homo Sapiens
ELSGHPRLE

SEQ ID NO: 536684 - protein, 9 aa, Homo Sapiens
VKPSPWRET

SEQ ID NO: 536685 - protein, 9 aa, Homo Sapiens
SPLSPSSDV

SEQ ID NO: 536686 - protein, 9 aa, Homo Sapiens
VMEAIEFAQ

SEQ ID NO: 536687 - protein, 9 aa, Homo Sapiens
AIVSISALS

SEQ ID NO: 536688 - protein, 9 aa, Homo Sapiens
LSPSSDVED

SEQ ID NO: 536689 - protein, 9 aa, Homo Sapiens
FVLLLSAIV

SEQ ID NO: 536690 - protein, 9 aa, Homo Sapiens
LEYGLVEIP

SEQ ID NO: 536691 - protein, 9 aa, Homo Sapiens
LLLEYGLVE

SEQ ID NO: 536692 - protein, 9 aa, Homo Sapiens
LFLLVLLLE

SEQ ID NO: 536693 - protein, 9 aa, Homo Sapiens
GRVGAAEVS

SEQ ID NO: 536694 - protein, 9 aa, Homo Sapiens
LSAIVSISA

SEQ ID NO: 536695 - protein, 9 aa, Homo Sapiens
PHRGHSGPE

SEQ ID NO: 536696 - protein, 9 aa, Homo Sapiens
ARDGITFPL

SEQ ID NO: 536697 - protein, 9 aa, Homo Sapiens
EPTDSSVME

SEQ ID NO: 536698 - protein, 9 aa, Homo Sapiens
LKELSGHPR

SEQ ID NO: 536699 - protein, 9 aa, Homo Sapiens
PVGRVGAAE

SEQ ID NO: 536700 - protein, 9 aa, Homo Sapiens
FLLVLLLEY

SEQ ID NO: 536701 - protein, 9 aa, Homo Sapiens
VEPTDSSVM

SEQ ID NO: 536702 - protein, 9 aa, Homo Sapiens
ISIPKKRTH

SEQ ID NO: 536703 - protein, 9 aa, Homo Sapiens
EVSGGGRGL

SEQ ID NO: 536704 - protein, 9 aa, Homo Sapiens
GSTFWPMQK

SEQ ID NO: 536705 - protein, 9 aa, Homo Sapiens
HIDRSDLSP

SEQ ID NO: 536706 - protein, 9 aa, Homo Sapiens
AAEVSGGGR

SEQ ID NO: 536707 - protein, 9 aa, Homo Sapiens
IDRSDLSPR

SEQ ID NO: 536708 - protein, 9 aa, Homo Sapiens
PTDSSVMEA

SEQ ID NO: 536709 - protein, 9 aa, Homo Sapiens
DHEDEAFDP

SEQ ID NO: 536710 - protein, 9 aa, Homo Sapiens
IIFVLLLSA

SEQ ID NO: 536711 - protein, 9 aa, Homo Sapiens
RHCSLIPSP

SEQ ID NO: 536712 - protein, 9 aa, Homo Sapiens
DGITFPLSL

SEQ ID NO: 536713 - protein, 9 aa, Homo Sapiens
RSDLSPRAS

SEQ ID NO: 536714 - protein, 9 aa, Homo Sapiens
PNASDHEDE

SEQ ID NO: 536715 - protein, 9 aa, Homo Sapiens
LAPQGRAFS

SEQ ID NO: 536716 - protein, 9 aa, Homo Sapiens
SDLSPRASP

SEQ ID NO: 536717 - protein, 9 aa, Homo Sapiens
VIIHISIPK

SEQ ID NO: 536718 - protein, 9 aa, Homo Sapiens
PWRETFVLK

SEQ ID NO: 536719 - protein, 9 aa, Homo Sapiens
ASDHEDEAF

SEQ ID NO: 536720 - protein, 9 aa, Homo Sapiens
GRAFSKKRM

SEQ ID NO: 536721 - protein, 9 aa, Homo Sapiens
RRVKPSPWR

SEQ ID NO: 536722 - protein, 9 aa, Homo Sapiens
IFVLLLSAI

SEQ ID NO: 536723 - protein, 9 aa, Homo Sapiens
RTESPLSPS

SEQ ID NO: 536724 - protein, 9 aa, Homo Sapiens
RVEPTDSSV

SEQ ID NO: 536725 - protein, 9 aa, Homo Sapiens
HISIPKKRT

SEQ ID NO: 536726 - protein, 9 aa, Homo Sapiens
APQGRAFSK

SEQ ID NO: 536727 - protein, 9 aa, Homo Sapiens
QHIDRSDLS

SEQ ID NO: 536728 - protein, 9 aa, Homo Sapiens
EYGLVEIPR

SEQ ID NO: 536729 - protein, 9 aa, Homo Sapiens
QGRAFSKKR

SEQ ID NO: 536730 - protein, 9 aa, Homo Sapiens
FRTESPLSP

SEQ ID NO: 536731 - protein, 9 aa, Homo Sapiens
LLSAIVSIS

SEQ ID NO: 536732 - protein, 9 aa, Homo Sapiens
HRGHSGPEL

SEQ ID NO: 536733 - protein, 9 aa, Homo Sapiens
FFLKELSGH

SEQ ID NO: 536734 - protein, 9 aa, Homo Sapiens
TLGIPLTPQ

SEQ ID NO: 536735 - protein, 9 aa, Homo Sapiens
PSPWSVPVP

SEQ ID NO: 536736 - protein, 9 aa, Homo Sapiens
GRARDGITF

SEQ ID NO: 536737 - protein, 9 aa, Homo Sapiens
VQWAGSTFW

SEQ ID NO: 536738 - protein, 9 aa, Homo Sapiens
RARDGITFP

SEQ ID NO: 536739 - protein, 9 aa, Homo Sapiens
VRSGLFGQV

SEQ ID NO: 536740 - protein, 9 aa, Homo Sapiens
PRRVKPSPW

SEQ ID NO: 536741 - protein, 9 aa, Homo Sapiens
KPSPWRETF

SEQ ID NO: 536742 - protein, 9 aa, Homo Sapiens
DSVRSGLFG

SEQ ID NO: 536743 - protein, 9 aa, Homo Sapiens
DRSDLSPRA

SEQ ID NO: 536744 - protein, 9 aa, Homo Sapiens
GAAEVSGGG

SEQ ID NO: 536745 - protein, 9 aa, Homo Sapiens
RVKPSPWRE

SEQ ID NO: 536746 - protein, 9 aa, Homo Sapiens
STFWPMQKS

SEQ ID NO: 536747 - protein, 9 aa, Homo Sapiens
FWPMQKSRL

SEQ ID NO: 536748 - protein, 9 aa, Homo Sapiens
VHPNASDHE

SEQ ID NO: 536749 - protein, 9 aa, Homo Sapiens
SAIVSISAL

SEQ ID NO: 536750 - protein, 9 aa, Homo Sapiens
VLLLSAIVS

SEQ ID NO: 536751 - protein, 9 aa, Homo Sapiens
HGEAEPHRG

SEQ ID NO: 536752 - protein, 9 aa, Homo Sapiens
PGRHCSLIP

SEQ ID NO: 536753 - protein, 9 aa, Homo Sapiens
EAEPHRGHS

SEQ ID NO: 536754 - protein, 9 aa, Homo Sapiens
DLSPRASPE

SEQ ID NO: 536755 - protein, 9 aa, Homo Sapiens
VGRARDGIT

SEQ ID NO: 536756 - protein, 9 aa, Homo Sapiens
SHCEKAFSQ

SEQ ID NO: 536757 - protein, 9 aa, Homo Sapiens
WGGRLDPAG

SEQ ID NO: 536758 - protein, 9 aa, Homo Sapiens
LSKCESTSQ

SEQ ID NO: 536759 - protein, 9 aa, Homo Sapiens
TCGQPGSQV

SEQ ID NO: 536760 - protein, 9 aa, Homo Sapiens
STRPLLPAC

SEQ ID NO: 536761 - protein, 9 aa, Homo Sapiens
GVEAQEAEG

SEQ ID NO: 536762 - protein, 9 aa, Homo Sapiens
FSQNPALMY

SEQ ID NO: 536763 - protein, 9 aa, Homo Sapiens
LLPACNSCA

SEQ ID NO: 536764 - protein, 9 aa, Homo Sapiens
RPLLPACNS

SEQ ID NO: 536765 - protein, 9 aa, Homo Sapiens
SSPVHNQVL

SEQ ID NO: 536766 - protein, 9 aa, Homo Sapiens
VPQSSPVHN

SEQ ID NO: 536767 - protein, 9 aa, Homo Sapiens
SGETEDTFF

SEQ ID NO: 536768 - protein, 9 aa, Homo Sapiens
RRKAVATCS

SEQ ID NO: 536769 - protein, 9 aa, Homo Sapiens
CGQPGSQVP

SEQ ID NO: 536770 - protein, 9 aa, Homo Sapiens
SEAEGRRKA

SEQ ID NO: 536771 - protein, 9 aa, Homo Sapiens
CPVPQSSPV

SEQ ID NO: 536772 - protein, 9 aa, Homo Sapiens
RLDPAGSWT

SEQ ID NO: 536773 - protein, 9 aa, Homo Sapiens
HCEKAFSQN

SEQ ID NO: 536774 - protein, 9 aa, Homo Sapiens
EDTFFADLV

SEQ ID NO: 536775 - protein, 9 aa, Homo Sapiens
FADLVVGLC

SEQ ID NO: 536776 - protein, 9 aa, Homo Sapiens
EGVEAQEAE

SEQ ID NO: 536777 - protein, 9 aa, Homo Sapiens
TEDTFFADL

SEQ ID NO: 536778 - protein, 9 aa, Homo Sapiens
EFFGLSKCE

SEQ ID NO: 536779 - protein, 9 aa, Homo Sapiens
PLLPACNSC

SEQ ID NO: 536780 - protein, 9 aa, Homo Sapiens
EKAFSQNPA

SEQ ID NO: 536781 - protein, 9 aa, Homo Sapiens
ESEGVEAQE

SEQ ID NO: 536782 - protein, 9 aa, Homo Sapiens
KAFSQNPAL

SEQ ID NO: 536783 - protein, 9 aa, Homo Sapiens
GLSKCESTS

SEQ ID NO: 536784 - protein, 9 aa, Homo Sapiens
SPVHNQVLP

SEQ ID NO: 536785 - protein, 9 aa, Homo Sapiens
VVIFNIKNN

SEQ ID NO: 536786 - protein, 9 aa, Homo Sapiens
GQPGSQVPD

SEQ ID NO: 536787 - protein, 9 aa, Homo Sapiens
EGRRKAVAT

SEQ ID NO: 536788 - protein, 9 aa, Homo Sapiens
DPAGSWTCG

SEQ ID NO: 536789 - protein, 9 aa, Homo Sapiens
ETEDTFFAD

SEQ ID NO: 536790 - protein, 9 aa, Homo Sapiens
PQSSPVHNQ

SEQ ID NO: 536791 - protein, 9 aa, Homo Sapiens
LANGTVVIF

SEQ ID NO: 536792 - protein, 9 aa, Homo Sapiens
EAEGRRKAV

SEQ ID NO: 536793 - protein, 9 aa, Homo Sapiens
GRRKAVATC

SEQ ID NO: 536794 - protein, 9 aa, Homo Sapiens
KCESTSQLD

SEQ ID NO: 536795 - protein, 9 aa, Homo Sapiens
DTFFADLVV

SEQ ID NO: 536796 - protein, 9 aa, Homo Sapiens
PVHNQVLPP

SEQ ID NO: 536797 - protein, 9 aa, Homo Sapiens
YTSSTRPLL

SEQ ID NO: 536798 - protein, 9 aa, Homo Sapiens
WTCGQPGSQ

SEQ ID NO: 536799 - protein, 9 aa, Homo Sapiens
ANGTVVIFN

SEQ ID NO: 536800 - protein, 9 aa, Homo Sapiens
GETEDTFFA

SEQ ID NO: 536801 - protein, 9 aa, Homo Sapiens
PVPQSSPVH

SEQ ID NO: 536802 - protein, 9 aa, Homo Sapiens
LDPAGSWTC

SEQ ID NO: 536803 - protein, 9 aa, Homo Sapiens
AFSQNPALM

SEQ ID NO: 536804 - protein, 9 aa, Homo Sapiens
NGTVVIFNI

SEQ ID NO: 536805 - protein, 9 aa, Homo Sapiens
RMSEAEGRR

SEQ ID NO: 536806 - protein, 9 aa, Homo Sapiens
TFFADLVVG

SEQ ID NO: 536807 - protein, 9 aa, Homo Sapiens
TRPLLPACN

SEQ ID NO: 536808 - protein, 9 aa, Homo Sapiens
SSTRPLLPA

SEQ ID NO: 536809 - protein, 9 aa, Homo Sapiens
FFADLVVGL

SEQ ID NO: 536810 - protein, 9 aa, Homo Sapiens
SEGVEAQEA

SEQ ID NO: 536811 - protein, 9 aa, Homo Sapiens
GLANGTVVI

SEQ ID NO: 536812 - protein, 9 aa, Homo Sapiens
GGRLDPAGS

SEQ ID NO: 536813 - protein, 9 aa, Homo Sapiens
QSSPVHNQV

SEQ ID NO: 536814 - protein, 9 aa, Homo Sapiens
VHNQVLPPP

SEQ ID NO: 536815 - protein, 9 aa, Homo Sapiens
FGLSKCEST

SEQ ID NO: 536816 - protein, 9 aa, Homo Sapiens
QEFFGLSKC

SEQ ID NO: 536817 - protein, 9 aa, Homo Sapiens
GRLDPAGSW

SEQ ID NO: 536818 - protein, 9 aa, Homo Sapiens
PAGSWTCGQ

SEQ ID NO: 536819 - protein, 9 aa, Homo Sapiens
TSSTRPLLP

SEQ ID NO: 536820 - protein, 9 aa, Homo Sapiens
TVVIFNIKN

SEQ ID NO: 536821 - protein, 9 aa, Homo Sapiens
AEGRRKAVA

SEQ ID NO: 536822 - protein, 9 aa, Homo Sapiens
SWTCGQPGS

SEQ ID NO: 536823 - protein, 9 aa, Homo Sapiens
IFNIKNNKR

SEQ ID NO: 536824 - protein, 9 aa, Homo Sapiens
TLGIPLTPQ

SEQ ID NO: 536825 - protein, 9 aa, Homo Sapiens
FFGLSKCES

SEQ ID NO: 536826 - protein, 9 aa, Homo Sapiens
LPACNSCAR

SEQ ID NO: 536827 - protein, 9 aa, Homo Sapiens
CEKAFSQNP

SEQ ID NO: 536828 - protein, 9 aa, Homo Sapiens
AGSWTCGQP

SEQ ID NO: 536829 - protein, 9 aa, Homo Sapiens
RKAVATCSS

SEQ ID NO: 536830 - protein, 9 aa, Homo Sapiens
EAQEAEGEA

SEQ ID NO: 536831 - protein, 9 aa, Homo Sapiens
GSWTCGQPG

SEQ ID NO: 536832 - protein, 9 aa, Homo Sapiens
SQNPALMYK

SEQ ID NO: 536833 - protein, 9 aa, Homo Sapiens
MSEAEGRRK

SEQ ID NO: 536834 - protein, 9 aa, Homo Sapiens
GTVVIFNIK

SEQ ID NO: 536835 - protein, 9 aa, Homo Sapiens
QPGSQVPDL

SEQ ID NO: 536836 - protein, 9 aa, Homo Sapiens
CSHCEKAFS

SEQ ID NO: 536837 - protein, 9 aa, Homo Sapiens
PGSQVPDLQ

SEQ ID NO: 536838 - protein, 9 aa, Homo Sapiens
FQEFFGLSK

SEQ ID NO: 536839 - protein, 9 aa, Homo Sapiens
VIFNIKNNK

SEQ ID NO: 536840 - protein, 9 aa, Homo Sapiens
VEAQEAEGE

SEQ ID NO: 536841 - protein, 9 aa, Homo Sapiens
SKCESTSQL

SEQ ID NO: 536842 - protein, 9 aa, Homo Sapiens
SSAEMGSVN

SEQ ID NO: 536843 - protein, 9 aa, Homo Sapiens
LEKNHVGFS

SEQ ID NO: 536844 - protein, 9 aa, Homo Sapiens
FYALEKNHV

SEQ ID NO: 536845 - protein, 9 aa, Homo Sapiens
QQQQLPQHQ

SEQ ID NO: 536846 - protein, 9 aa, Homo Sapiens
VSDTMVEPY

SEQ ID NO: 536847 - protein, 9 aa, Homo Sapiens
RDGLGSSAE

SEQ ID NO: 536848 - protein, 9 aa, Homo Sapiens
QLEQQEGQL

SEQ ID NO: 536849 - protein, 9 aa, Homo Sapiens
KSTHRERQL

SEQ ID NO: 536850 - protein, 9 aa, Homo Sapiens
TMVEPYNAT

SEQ ID NO: 536851 - protein, 9 aa, Homo Sapiens
NLCANLMQL

SEQ ID NO: 536852 - protein, 9 aa, Homo Sapiens
GQLEQLEQQ

SEQ ID NO: 536853 - protein, 9 aa, Homo Sapiens
GLGSSAEMG

SEQ ID NO: 536854 - protein, 9 aa, Homo Sapiens
PQHQQQQPP

SEQ ID NO: 536855 - protein, 9 aa, Homo Sapiens
SSFYALEKN

SEQ ID NO: 536856 - protein, 9 aa, Homo Sapiens
SSLMKSTHR

SEQ ID NO: 536857 - protein, 9 aa, Homo Sapiens
SLMKSTHRE

SEQ ID NO: 536858 - protein, 9 aa, Homo Sapiens
EAFVYDPLR

SEQ ID NO: 536859 - protein, 9 aa, Homo Sapiens
PKVSDTMVE

SEQ ID NO: 536860 - protein, 9 aa, Homo Sapiens
AFVYDPLRN

SEQ ID NO: 536861 - protein, 9 aa, Homo Sapiens
MVEPYNATL

SEQ ID NO: 536862 - protein, 9 aa, Homo Sapiens
LMKSTHRER

SEQ ID NO: 536863 - protein, 9 aa, Homo Sapiens
LEQLEQQEG

SEQ ID NO: 536864 - protein, 9 aa, Homo Sapiens
DENLCANLM

SEQ ID NO: 536865 - protein, 9 aa, Homo Sapiens
DGLGSSAEM

SEQ ID NO: 536866 - protein, 9 aa, Homo Sapiens
AEMGSVNEA

SEQ ID NO: 536867 - protein, 9 aa, Homo Sapiens
LRNWRLMDT

SEQ ID NO: 536868 - protein, 9 aa, Homo Sapiens
SFYALEKNH

SEQ ID NO: 536869 - protein, 9 aa, Homo Sapiens
QQQLPQHQQ

SEQ ID NO: 536870 - protein, 9 aa, Homo Sapiens
LSDPEDENL

SEQ ID NO: 536871 - protein, 9 aa, Homo Sapiens
DTMVEPYNA

SEQ ID NO: 536872 - protein, 9 aa, Homo Sapiens
LENSSLMKS

SEQ ID NO: 536873 - protein, 9 aa, Homo Sapiens
DPEDENLCA

SEQ ID NO: 536874 - protein, 9 aa, Homo Sapiens
NSSLMKSTH

SEQ ID NO: 536875 - protein, 9 aa, Homo Sapiens
PEDENLCAN

SEQ ID NO: 536876 - protein, 9 aa, Homo Sapiens
EDENLCANL

SEQ ID NO: 536877 - protein, 9 aa, Homo Sapiens
EQLEQQEGQ

SEQ ID NO: 536878 - protein, 9 aa, Homo Sapiens
SFMDICYTT

SEQ ID NO: 536879 - protein, 9 aa, Homo Sapiens
QQLPQHQQQ

SEQ ID NO: 536880 - protein, 9 aa, Homo Sapiens
DPLRNWRLM

SEQ ID NO: 536881 - protein, 9 aa, Homo Sapiens
RQQQQLPQH

SEQ ID NO: 536882 - protein, 9 aa, Homo Sapiens
QLPQHQQQQ

SEQ ID NO: 536883 - protein, 9 aa, Homo Sapiens
MDICYTTTS

SEQ ID NO: 536884 - protein, 9 aa, Homo Sapiens
SDPEDENLC

SEQ ID NO: 536885 - protein, 9 aa, Homo Sapiens
PLRNWRLMD

SEQ ID NO: 536886 - protein, 9 aa, Homo Sapiens
STHRERQLL

SEQ ID NO: 536887 - protein, 9 aa, Homo Sapiens
LGSSAEMGS

SEQ ID NO: 536888 - protein, 9 aa, Homo Sapiens
YDPLRNWRL

SEQ ID NO: 536889 - protein, 9 aa, Homo Sapiens
MKSTHRERQ

SEQ ID NO: 536890 - protein, 9 aa, Homo Sapiens
GSSFYALEK

SEQ ID NO: 536891 - protein, 9 aa, Homo Sapiens
RNWRLMDTN

SEQ ID NO: 536892 - protein, 9 aa, Homo Sapiens
FMDICYTTT

SEQ ID NO: 536893 - protein, 9 aa, Homo Sapiens
ENSSLMKST

SEQ ID NO: 536894 - protein, 9 aa, Homo Sapiens
VYDPLRNWR

SEQ ID NO: 536895 - protein, 9 aa, Homo Sapiens
LLSDPEDEN

SEQ ID NO: 536896 - protein, 9 aa, Homo Sapiens
FVYDPLRNW

SEQ ID NO: 536897 - protein, 9 aa, Homo Sapiens
FFLGNLSFM

SEQ ID NO: 536898 - protein, 9 aa, Homo Sapiens
YALEKNHVG

SEQ ID NO: 536899 - protein, 9 aa, Homo Sapiens
GSSAEMGSV

SEQ ID NO: 536900 - protein, 9 aa, Homo Sapiens
EKNHVGFSL

SEQ ID NO: 536901 - protein, 9 aa, Homo Sapiens
EGQLEQLEQ

SEQ ID NO: 536902 - protein, 9 aa, Homo Sapiens
SAEMGSVNE

SEQ ID NO: 536903 - protein, 9 aa, Homo Sapiens
ENLCANLMQ

SEQ ID NO: 536904 - protein, 9 aa, Homo Sapiens
ALEKNHVGF

SEQ ID NO: 536905 - protein, 9 aa, Homo Sapiens
KNHVGFSLD

SEQ ID NO: 536906 - protein, 9 aa, Homo Sapiens
SPKVSDTMV

SEQ ID NO: 536907 - protein, 9 aa, Homo Sapiens
FRDGLGSSA

SEQ ID NO: 536908 - protein, 9 aa, Homo Sapiens
PSPKVSDTM

SEQ ID NO: 536909 - protein, 9 aa, Homo Sapiens
LPQHQQQQP

SEQ ID NO: 536910 - protein, 9 aa, Homo Sapiens
SDTMVEPYN

SEQ ID NO: 536911 - protein, 9 aa, Homo Sapiens
QLEQLEQQE

SEQ ID NO: 536912 - protein, 9 aa, Homo Sapiens
KVSDTMVEP

SEQ ID NO: 536913 - protein, 9 aa, Homo Sapiens
VTQPKYLSA

SEQ ID NO: 536914 - protein, 9 aa, Homo Sapiens
YLSASMGGS

SEQ ID NO: 536915 - protein, 9 aa, Homo Sapiens
PKYLSASMG

SEQ ID NO: 536916 - protein, 9 aa, Homo Sapiens
SSLQSQTPG

SEQ ID NO: 536917 - protein, 9 aa, Homo Sapiens
LVLCALQTV

SEQ ID NO: 536918 - protein, 9 aa, Homo Sapiens
FHSNCIVPW

SEQ ID NO: 536919 - protein, 9 aa, Homo Sapiens
EDSARDIRE

SEQ ID NO: 536920 - protein, 9 aa, Homo Sapiens
KEVSREKSF

SEQ ID NO: 536921 - protein, 9 aa, Homo Sapiens
KFLLAGGRT

SEQ ID NO: 536922 - protein, 9 aa, Homo Sapiens
PCNHFFHSN

SEQ ID NO: 536923 - protein, 9 aa, Homo Sapiens
SREKSFQLP

SEQ ID NO: 536924 - protein, 9 aa, Homo Sapiens
HSHGRFELV

SEQ ID NO: 536925 - protein, 9 aa, Homo Sapiens
SKFNPCGNV

SEQ ID NO: 536926 - protein, 9 aa, Homo Sapiens
GVKMPHYCL

SEQ ID NO: 536927 - protein, 9 aa, Homo Sapiens
WLFWILQLL

SEQ ID NO: 536928 - protein, 9 aa, Homo Sapiens
SVTNMLRES

SEQ ID NO: 536929 - protein, 9 aa, Homo Sapiens
VKMPHYCLF

SEQ ID NO: 536930 - protein, 9 aa, Homo Sapiens
AHSHGRFEL

SEQ ID NO: 536931 - protein, 9 aa, Homo Sapiens
GLSFQWLFW

SEQ ID NO: 536932 - protein, 9 aa, Homo Sapiens
HLGESHSHS

SEQ ID NO: 536933 - protein, 9 aa, Homo Sapiens
KKEVSREKS

SEQ ID NO: 536934 - protein, 9 aa, Homo Sapiens
NHFFHSNCI

SEQ ID NO: 536935 - protein, 9 aa, Homo Sapiens
LQNLVLCAL

SEQ ID NO: 536936 - protein, 9 aa, Homo Sapiens
NPCGNVFTL

SEQ ID NO: 536937 - protein, 9 aa, Homo Sapiens
HWLRNSTHL

SEQ ID NO: 536938 - protein, 9 aa, Homo Sapiens
PKEMVHLGE

SEQ ID NO: 536939 - protein, 9 aa, Homo Sapiens
NCIVPWLEL

SEQ ID NO: 536940 - protein, 9 aa, Homo Sapiens
ARDIREALH

SEQ ID NO: 536941 - protein, 9 aa, Homo Sapiens
HGRFELVFS

SEQ ID NO: 536942 - protein, 9 aa, Homo Sapiens
QWLFWILQL

SEQ ID NO: 536943 - protein, 9 aa, Homo Sapiens
SHGRFELVF

SEQ ID NO: 536944 - protein, 9 aa, Homo Sapiens
SNCIVPWLE

SEQ ID NO: 536945 - protein, 9 aa, Homo Sapiens
SARDIREAL

SEQ ID NO: 536946 - protein, 9 aa, Homo Sapiens
VGPAHSHGR

SEQ ID NO: 536947 - protein, 9 aa, Homo Sapiens
PHYCLFGNN

SEQ ID NO: 536948 - protein, 9 aa, Homo Sapiens
TLELQNLVL

SEQ ID NO: 536949 - protein, 9 aa, Homo Sapiens
GPAHSHGRF

SEQ ID NO: 536950 - protein, 9 aa, Homo Sapiens
QPKYLSASM

SEQ ID NO: 536951 - protein, 9 aa, Homo Sapiens
VPKRSPVGK

SEQ ID NO: 536952 - protein, 9 aa, Homo Sapiens
NLVLCALQT

SEQ ID NO: 536953 - protein, 9 aa, Homo Sapiens
ETSVTNMLR

SEQ ID NO: 536954 - protein, 9 aa, Homo Sapiens
KYLSASMGG

SEQ ID NO: 536955 - protein, 9 aa, Homo Sapiens
LYGVTQPKY

SEQ ID NO: 536956 - protein, 9 aa, Homo Sapiens
VHQRIHSGE

SEQ ID NO: 536957 - protein, 9 aa, Homo Sapiens
LSKFNPCGN

SEQ ID NO: 536958 - protein, 9 aa, Homo Sapiens
VSREKSFQL

SEQ ID NO: 536959 - protein, 9 aa, Homo Sapiens
TQPKYLSAS

SEQ ID NO: 536960 - protein, 9 aa, Homo Sapiens
ETLELQNLV

SEQ ID NO: 536961 - protein, 9 aa, Homo Sapiens
MLRESGSGA

SEQ ID NO: 536962 - protein, 9 aa, Homo Sapiens
AETSVTNML

SEQ ID NO: 536963 - protein, 9 aa, Homo Sapiens
GLHWLRNST

SEQ ID NO: 536964 - protein, 9 aa, Homo Sapiens
PAHSHGRFE

SEQ ID NO: 536965 - protein, 9 aa, Homo Sapiens
LEDSARDIR

SEQ ID NO: 536966 - protein, 9 aa, Homo Sapiens
QNLVLCALQ

SEQ ID NO: 536967 - protein, 9 aa, Homo Sapiens
HSNCIVPWL

SEQ ID NO: 536968 - protein, 9 aa, Homo Sapiens
ELQNLVLCA

SEQ ID NO: 536969 - protein, 9 aa, Homo Sapiens
MPHYCLFGN

SEQ ID NO: 536970 - protein, 9 aa, Homo Sapiens
QTPGFKRSF

SEQ ID NO: 536971 - protein, 9 aa, Homo Sapiens
KRSPVGKFL

SEQ ID NO: 536972 - protein, 9 aa, Homo Sapiens
SSKKEVSRE

SEQ ID NO: 536973 - protein, 9 aa, Homo Sapiens
EMVHLGESH

SEQ ID NO: 536974 - protein, 9 aa, Homo Sapiens
DRSSLQSQT

SEQ ID NO: 536975 - protein, 9 aa, Homo Sapiens
MVHLGESHS

SEQ ID NO: 536976 - protein, 9 aa, Homo Sapiens
FNPCGNVFT

SEQ ID NO: 536977 - protein, 9 aa, Homo Sapiens
RSSLQSQTP

SEQ ID NO: 536978 - protein, 9 aa, Homo Sapiens
TSVTNMLRE

SEQ ID NO: 536979 - protein, 9 aa, Homo Sapiens
CNHFFHSNC

SEQ ID NO: 536980 - protein, 9 aa, Homo Sapiens
PMMPKEMVH

SEQ ID NO: 536981 - protein, 9 aa, Homo Sapiens
PVGKFLLAG

SEQ ID NO: 536982 - protein, 9 aa, Homo Sapiens
PCGNVFTLT

SEQ ID NO: 536983 - protein, 9 aa, Homo Sapiens
VAETSVTNM

SEQ ID NO: 536984 - protein, 9 aa, Homo Sapiens
FFHSNCIVP

SEQ ID NO: 536985 - protein, 9 aa, Homo Sapiens
RSPVGKFLL

SEQ ID NO: 536986 - protein, 9 aa, Homo Sapiens
PKRSPVGKF

SEQ ID NO: 536987 - protein, 9 aa, Homo Sapiens
LFWILQLLG

SEQ ID NO: 536988 - protein, 9 aa, Homo Sapiens
NVFTLTPDL

SEQ ID NO: 536989 - protein, 9 aa, Homo Sapiens
LSFQWLFWI

SEQ ID NO: 536990 - protein, 9 aa, Homo Sapiens
FQWLFWILQ

SEQ ID NO: 536991 - protein, 9 aa, Homo Sapiens
GVVGVKMPH

SEQ ID NO: 536992 - protein, 9 aa, Homo Sapiens
VTNMLRESG

SEQ ID NO: 536993 - protein, 9 aa, Homo Sapiens
VHLGESHSH

SEQ ID NO: 536994 - protein, 9 aa, Homo Sapiens
LQSQTPGFK

SEQ ID NO: 536995 - protein, 9 aa, Homo Sapiens
SQTPGFKRS

SEQ ID NO: 536996 - protein, 9 aa, Homo Sapiens
GKFLLAGGR

SEQ ID NO: 536997 - protein, 9 aa, Homo Sapiens
FWILQLLGH

SEQ ID NO: 536998 - protein, 9 aa, Homo Sapiens
SLQSQTPGF

SEQ ID NO: 536999 - protein, 9 aa, Homo Sapiens
WILQLLGHA

SEQ ID NO: 537000 - protein, 9 aa, Homo Sapiens
SPVGKFLLA

SEQ ID NO: 537001 - protein, 9 aa, Homo Sapiens
SVGPAHSHG

SEQ ID NO: 537002 - protein, 9 aa, Homo Sapiens
LAVLEDSAR

SEQ ID NO: 537003 - protein, 9 aa, Homo Sapiens
VLCALQTVN

SEQ ID NO: 537004 - protein, 9 aa, Homo Sapiens
VGVKMPHYC

SEQ ID NO: 537005 - protein, 9 aa, Homo Sapiens
VGKFLLAGG

SEQ ID NO: 537006 - protein, 9 aa, Homo Sapiens
SFQWLFWIL

SEQ ID NO: 537007 - protein, 9 aa, Homo Sapiens
MPKEMVHLG

SEQ ID NO: 537008 - protein, 9 aa, Homo Sapiens
EVSREKSFQ

SEQ ID NO: 537009 - protein, 9 aa, Homo Sapiens
DSARDIREA

SEQ ID NO: 537010 - protein, 9 aa, Homo Sapiens
GNVFTLTPD

SEQ ID NO: 537011 - protein, 9 aa, Homo Sapiens
HFFHSNCIV

SEQ ID NO: 537012 - protein, 9 aa, Homo Sapiens
QSQTPGFKR

SEQ ID NO: 537013 - protein, 9 aa, Homo Sapiens
NMLRESGSG

SEQ ID NO: 537014 - protein, 9 aa, Homo Sapiens
SKKEVSREK

SEQ ID NO: 537015 - protein, 9 aa, Homo Sapiens
ASSKKEVSR

SEQ ID NO: 537016 - protein, 9 aa, Homo Sapiens
KMPHYCLFG

SEQ ID NO: 537017 - protein, 9 aa, Homo Sapiens
GVTQPKYLS

SEQ ID NO: 537018 - protein, 9 aa, Homo Sapiens
TNMLRESGS

SEQ ID NO: 537019 - protein, 9 aa, Homo Sapiens
CGNVFTLTP

SEQ ID NO: 537020 - protein, 9 aa, Homo Sapiens
LELQNLVLC

SEQ ID NO: 537021 - protein, 9 aa, Homo Sapiens
HYCLFGNNV

SEQ ID NO: 537022 - protein, 9 aa, Homo Sapiens
LHWLRNSTH

SEQ ID NO: 537023 - protein, 9 aa, Homo Sapiens
YGVTQPKYL

SEQ ID NO: 537024 - protein, 9 aa, Homo Sapiens
VLAVLEDSA

SEQ ID NO: 537025 - protein, 9 aa, Homo Sapiens
ESVGPAHSH

SEQ ID NO: 537026 - protein, 9 aa, Homo Sapiens
REKSFQLPA

SEQ ID NO: 537027 - protein, 9 aa, Homo Sapiens
CDRSSLQSQ

SEQ ID NO: 537028 - protein, 9 aa, Homo Sapiens
KEMVHLGES

SEQ ID NO: 537029 - protein, 9 aa, Homo Sapiens
VLEDSARDI

SEQ ID NO: 537030 - protein, 9 aa, Homo Sapiens
AVLEDSARD

SEQ ID NO: 537031 - protein, 9 aa, Homo Sapiens
WLRNSTHLS

SEQ ID NO: 537032 - protein, 9 aa, Homo Sapiens
KFNPCGNVF

SEQ ID NO: 537033 - protein, 9 aa, Homo Sapiens
MMPKEMVHL

SEQ ID NO: 537034 - protein, 9 aa, Homo Sapiens
VVGVKMPHY

SEQ ID NO: 537035 - protein, 9 aa, Homo Sapiens
QYGCIITSR

SEQ ID NO: 537036 - protein, 9 aa, Homo Sapiens
AKLWRKSSS

SEQ ID NO: 537037 - protein, 9 aa, Homo Sapiens
RTTSSGAGT

SEQ ID NO: 537038 - protein, 9 aa, Homo Sapiens
LVAEPQKLN

SEQ ID NO: 537039 - protein, 9 aa, Homo Sapiens
SESRTTSSG

SEQ ID NO: 537040 - protein, 9 aa, Homo Sapiens
VPGISGLDG

SEQ ID NO: 537041 - protein, 9 aa, Homo Sapiens
SGLDGSNSQ

SEQ ID NO: 537042 - protein, 9 aa, Homo Sapiens
QIAKLWRKS

SEQ ID NO: 537043 - protein, 9 aa, Homo Sapiens
EPQKLNKIE

SEQ ID NO: 537044 - protein, 9 aa, Homo Sapiens
EAQARRATL

SEQ ID NO: 537045 - protein, 9 aa, Homo Sapiens
PKGGEWRQA

SEQ ID NO: 537046 - protein, 9 aa, Homo Sapiens
NLAVKFLVL

SEQ ID NO: 537047 - protein, 9 aa, Homo Sapiens
LDGSNSQVS

SEQ ID NO: 537048 - protein, 9 aa, Homo Sapiens
EWRQAAPGR

SEQ ID NO: 537049 - protein, 9 aa, Homo Sapiens
VQNLAVKFL

SEQ ID NO: 537050 - protein, 9 aa, Homo Sapiens
KLNKIEIHY

SEQ ID NO: 537051 - protein, 9 aa, Homo Sapiens
LWRKSSSQE

SEQ ID NO: 537052 - protein, 9 aa, Homo Sapiens
RQDSSGKRT

SEQ ID NO: 537053 - protein, 9 aa, Homo Sapiens
SRTTSSGAG

SEQ ID NO: 537054 - protein, 9 aa, Homo Sapiens
EPLPKGGEW

SEQ ID NO: 537055 - protein, 9 aa, Homo Sapiens
GTRQDSSGK

SEQ ID NO: 537056 - protein, 9 aa, Homo Sapiens
WRQAAPGRF

SEQ ID NO: 537057 - protein, 9 aa, Homo Sapiens
ESRTTSSGA

SEQ ID NO: 537058 - protein, 9 aa, Homo Sapiens
NLVAEPQKL

SEQ ID NO: 537059 - protein, 9 aa, Homo Sapiens
LGTRQDSSG

SEQ ID NO: 537060 - protein, 9 aa, Homo Sapiens
AVPHPEEQR

SEQ ID NO: 537061 - protein, 9 aa, Homo Sapiens
DGSNSQVSA

SEQ ID NO: 537062 - protein, 9 aa, Homo Sapiens
KSRDLGTRQ

SEQ ID NO: 537063 - protein, 9 aa, Homo Sapiens
PGISGLDGS

SEQ ID NO: 537064 - protein, 9 aa, Homo Sapiens
PLPKGGEWR

SEQ ID NO: 537065 - protein, 9 aa, Homo Sapiens
SQYGCIITS

SEQ ID NO: 537066 - protein, 9 aa, Homo Sapiens
NSESRTTSS

SEQ ID NO: 537067 - protein, 9 aa, Homo Sapiens
PEWAVPHPE

SEQ ID NO: 537068 - protein, 9 aa, Homo Sapiens
GELQAQVKN

SEQ ID NO: 537069 - protein, 9 aa, Homo Sapiens
RSRQEGLRS

SEQ ID NO: 537070 - protein, 9 aa, Homo Sapiens
GGEWRQAAP

SEQ ID NO: 537071 - protein, 9 aa, Homo Sapiens
KSSSQERAP

SEQ ID NO: 537072 - protein, 9 aa, Homo Sapiens
LNKIEIHYA

SEQ ID NO: 537073 - protein, 9 aa, Homo Sapiens
QEAQARRAT

SEQ ID NO: 537074 - protein, 9 aa, Homo Sapiens
YGCIITSRI

SEQ ID NO: 537075 - protein, 9 aa, Homo Sapiens
SRDLGTRQD

SEQ ID NO: 537076 - protein, 9 aa, Homo Sapiens
WAVPHPEEQ

SEQ ID NO: 537077 - protein, 9 aa, Homo Sapiens
WRSNRSRQE

SEQ ID NO: 537078 - protein, 9 aa, Homo Sapiens
GSLFEVQWQ

SEQ ID NO: 537079 - protein, 9 aa, Homo Sapiens
PQKLNKIEI

SEQ ID NO: 537080 - protein, 9 aa, Homo Sapiens
VAEPQKLNK

SEQ ID NO: 537081 - protein, 9 aa, Homo Sapiens
KLWRKSSSQ

SEQ ID NO: 537082 - protein, 9 aa, Homo Sapiens
WQLAQLEAR

SEQ ID NO: 537083 - protein, 9 aa, Homo Sapiens
DLGTRQDSS

SEQ ID NO: 537084 - protein, 9 aa, Homo Sapiens
EGSLFEVQW

SEQ ID NO: 537085 - protein, 9 aa, Homo Sapiens
EWAVPHPEE

SEQ ID NO: 537086 - protein, 9 aa, Homo Sapiens
SSSQERAPY

SEQ ID NO: 537087 - protein, 9 aa, Homo Sapiens
GAPEWAVPH

SEQ ID NO: 537088 - protein, 9 aa, Homo Sapiens
RFFYSQEAQ

SEQ ID NO: 537089 - protein, 9 aa, Homo Sapiens
GCIITSRIL

SEQ ID NO: 537090 - protein, 9 aa, Homo Sapiens
TRQDSSGKR

SEQ ID NO: 537091 - protein, 9 aa, Homo Sapiens
CIITSRILV

SEQ ID NO: 537092 - protein, 9 aa, Homo Sapiens
GEWRQAAPG

SEQ ID NO: 537093 - protein, 9 aa, Homo Sapiens
YSQEAQARR

SEQ ID NO: 537094 - protein, 9 aa, Homo Sapiens
VQWQLAQLE

SEQ ID NO: 537095 - protein, 9 aa, Homo Sapiens
DKSRDLGTR

SEQ ID NO: 537096 - protein, 9 aa, Homo Sapiens
EGAPEWAVP

SEQ ID NO: 537097 - protein, 9 aa, Homo Sapiens
GISGLDGSN

SEQ ID NO: 537098 - protein, 9 aa, Homo Sapiens
RSNRSRQEG

SEQ ID NO: 537099 - protein, 9 aa, Homo Sapiens
SLFEVQWQL

SEQ ID NO: 537100 - protein, 9 aa, Homo Sapiens
WRKSSSQER

SEQ ID NO: 537101 - protein, 9 aa, Homo Sapiens
SNRSRQEGL

SEQ ID NO: 537102 - protein, 9 aa, Homo Sapiens
LFSQYGCII

SEQ ID NO: 537103 - protein, 9 aa, Homo Sapiens
FYSQEAQAR

SEQ ID NO: 537104 - protein, 9 aa, Homo Sapiens
LFEVQWQLA

SEQ ID NO: 537105 - protein, 9 aa, Homo Sapiens
SVPGISGLD

SEQ ID NO: 537106 - protein, 9 aa, Homo Sapiens
RDLGTRQDS

SEQ ID NO: 537107 - protein, 9 aa, Homo Sapiens
FSQYGCIIT

SEQ ID NO: 537108 - protein, 9 aa, Homo Sapiens
KGGEWRQAA

SEQ ID NO: 537109 - protein, 9 aa, Homo Sapiens
ISGLDGSNS

SEQ ID NO: 537110 - protein, 9 aa, Homo Sapiens
RKSSSQERA

SEQ ID NO: 537111 - protein, 9 aa, Homo Sapiens
VPHPEEQRR

SEQ ID NO: 537112 - protein, 9 aa, Homo Sapiens
QKLNKIEIH

SEQ ID NO: 537113 - protein, 9 aa, Homo Sapiens
QLFSQYGCI

SEQ ID NO: 537114 - protein, 9 aa, Homo Sapiens
SQEAQARRA

SEQ ID NO: 537115 - protein, 9 aa, Homo Sapiens
QNLAVKFLV

SEQ ID NO: 537116 - protein, 9 aa, Homo Sapiens
IAKLWRKSS

SEQ ID NO: 537117 - protein, 9 aa, Homo Sapiens
QWQLAQLEA

SEQ ID NO: 537118 - protein, 9 aa, Homo Sapiens
AEPQKLNKI

SEQ ID NO: 537119 - protein, 9 aa, Homo Sapiens
AQRFFYSQE

SEQ ID NO: 537120 - protein, 9 aa, Homo Sapiens
FEVQWQLAQ

SEQ ID NO: 537121 - protein, 9 aa, Homo Sapiens
GLDGSNSQV

SEQ ID NO: 537122 - protein, 9 aa, Homo Sapiens
QRFFYSQEA

SEQ ID NO: 537123 - protein, 9 aa, Homo Sapiens
EVQWQLAQL

SEQ ID NO: 537124 - protein, 9 aa, Homo Sapiens
APEWAVPHP

SEQ ID NO: 537125 - protein, 9 aa, Homo Sapiens
FFYSQEAQA

SEQ ID NO: 537126 - protein, 9 aa, Homo Sapiens
LPKGGEWRQ

SEQ ID NO: 537127 - protein, 9 aa, Homo Sapiens
LEGAPEWAV

SEQ ID NO: 537128 - protein, 9 aa, Homo Sapiens
EQLFSQYGC

SEQ ID NO: 537129 - protein, 9 aa, Homo Sapiens
SRQEGLRSI

SEQ ID NO: 537130 - protein, 9 aa, Homo Sapiens
ELQAQVKNN

SEQ ID NO: 537131 - protein, 9 aa, Homo Sapiens
EVQNLAVKF

SEQ ID NO: 537132 - protein, 9 aa, Homo Sapiens
NRSRQEGLR

SEQ ID NO: 537133 - protein, 9 aa, Homo Sapiens
LGFYPGIEG

SEQ ID NO: 537134 - protein, 9 aa, Homo Sapiens
SCLGFYPGI

SEQ ID NO: 537135 - protein, 9 aa, Homo Sapiens
PLVVAKGGT

SEQ ID NO: 537136 - protein, 9 aa, Homo Sapiens
EAWSTHNTV

SEQ ID NO: 537137 - protein, 9 aa, Homo Sapiens
TPSSNSTYQ

SEQ ID NO: 537138 - protein, 9 aa, Homo Sapiens
GTAFANNTC

SEQ ID NO: 537139 - protein, 9 aa, Homo Sapiens
QQTHLREDP

SEQ ID NO: 537140 - protein, 9 aa, Homo Sapiens
HQQTHLRED

SEQ ID NO: 537141 - protein, 9 aa, Homo Sapiens
CLGFYPGIE

SEQ ID NO: 537142 - protein, 9 aa, Homo Sapiens
KGGTAWLEW

SEQ ID NO: 537143 - protein, 9 aa, Homo Sapiens
GHTTILDHM

SEQ ID NO: 537144 - protein, 9 aa, Homo Sapiens
AFANNTCQL

SEQ ID NO: 537145 - protein, 9 aa, Homo Sapiens
VAKGGTAWL

SEQ ID NO: 537146 - protein, 9 aa, Homo Sapiens
GRPRSKQEA

SEQ ID NO: 537147 - protein, 9 aa, Homo Sapiens
GMNSAAGRK

SEQ ID NO: 537148 - protein, 9 aa, Homo Sapiens
NNEAGHTTI

SEQ ID NO: 537149 - protein, 9 aa, Homo Sapiens
NKHNNEAGH

SEQ ID NO: 537150 - protein, 9 aa, Homo Sapiens
KHQQTHLRE

SEQ ID NO: 537151 - protein, 9 aa, Homo Sapiens
TLIKHQQTH

SEQ ID NO: 537152 - protein, 9 aa, Homo Sapiens
SPLVVAKGG

SEQ ID NO: 537153 - protein, 9 aa, Homo Sapiens
MNSAAGRKK

SEQ ID NO: 537154 - protein, 9 aa, Homo Sapiens
KHNNEAGHT

SEQ ID NO: 537155 - protein, 9 aa, Homo Sapiens
HGMNSAAGR

SEQ ID NO: 537156 - protein, 9 aa, Homo Sapiens
ANNTCQLIV

SEQ ID NO: 537157 - protein, 9 aa, Homo Sapiens
NNTCQLIVC

SEQ ID NO: 537158 - protein, 9 aa, Homo Sapiens
AKGGTAWLE

SEQ ID NO: 537159 - protein, 9 aa, Homo Sapiens
TADGTPSSN

SEQ ID NO: 537160 - protein, 9 aa, Homo Sapiens
VGTAFANNT

SEQ ID NO: 537161 - protein, 9 aa, Homo Sapiens
RSKQEAWST

SEQ ID NO: 537162 - protein, 9 aa, Homo Sapiens
NTCQLIVCQ

SEQ ID NO: 537163 - protein, 9 aa, Homo Sapiens
SSNSTYQLQ

SEQ ID NO: 537164 - protein, 9 aa, Homo Sapiens
LIKHQQTHL

SEQ ID NO: 537165 - protein, 9 aa, Homo Sapiens
HTTILDHMH

SEQ ID NO: 537166 - protein, 9 aa, Homo Sapiens
LVVAKGGTA

SEQ ID NO: 537167 - protein, 9 aa, Homo Sapiens
ISPLVVAKG

SEQ ID NO: 537168 - protein, 9 aa, Homo Sapiens
VFSCLGFYP

SEQ ID NO: 537169 - protein, 9 aa, Homo Sapiens
EAGHTTILD

SEQ ID NO: 537170 - protein, 9 aa, Homo Sapiens
QTHLREDPF

SEQ ID NO: 537171 - protein, 9 aa, Homo Sapiens
FYPGIEGAG

SEQ ID NO: 537172 - protein, 9 aa, Homo Sapiens
CRVFSCLGF

SEQ ID NO: 537173 - protein, 9 aa, Homo Sapiens
TAFANNTCQ

SEQ ID NO: 537174 - protein, 9 aa, Homo Sapiens
PSSNSTYQL

SEQ ID NO: 537175 - protein, 9 aa, Homo Sapiens
TISPLVVAK

SEQ ID NO: 537176 - protein, 9 aa, Homo Sapiens
IKHQQTHLR

SEQ ID NO: 537177 - protein, 9 aa, Homo Sapiens
FSCLGFYPG

SEQ ID NO: 537178 - protein, 9 aa, Homo Sapiens
NEAGHTTIL

SEQ ID NO: 537179 - protein, 9 aa, Homo Sapiens
HNNEAGHTT

SEQ ID NO: 537180 - protein, 9 aa, Homo Sapiens
MVGTAFANN

SEQ ID NO: 537181 - protein, 9 aa, Homo Sapiens
KQEAWSTHN

SEQ ID NO: 537182 - protein, 9 aa, Homo Sapiens
TIHGMNSAA

SEQ ID NO: 537183 - protein, 9 aa, Homo Sapiens
SKQEAWSTH

SEQ ID NO: 537184 - protein, 9 aa, Homo Sapiens
VVAKGGTAW

SEQ ID NO: 537185 - protein, 9 aa, Homo Sapiens
PRSKQEAWS

SEQ ID NO: 537186 - protein, 9 aa, Homo Sapiens
QEAWSTHNT

SEQ ID NO: 537187 - protein, 9 aa, Homo Sapiens
IHGMNSAAG

SEQ ID NO: 537188 - protein, 9 aa, Homo Sapiens
GFYPGIEGA

SEQ ID NO: 537189 - protein, 9 aa, Homo Sapiens
FANNTCQLI

SEQ ID NO: 537190 - protein, 9 aa, Homo Sapiens
NSAAGRKKA

SEQ ID NO: 537191 - protein, 9 aa, Homo Sapiens
NSTYQLQES

SEQ ID NO: 537192 - protein, 9 aa, Homo Sapiens
SAAGRKKAF

SEQ ID NO: 537193 - protein, 9 aa, Homo Sapiens
RPRSKQEAW

SEQ ID NO: 537194 - protein, 9 aa, Homo Sapiens
RVFSCLGFY

SEQ ID NO: 537195 - protein, 9 aa, Homo Sapiens
PGRPRSKQE

SEQ ID NO: 537196 - protein, 9 aa, Homo Sapiens
ADGTPSSNS

SEQ ID NO: 537197 - protein, 9 aa, Homo Sapiens
AAGRKKAFA

SEQ ID NO: 537198 - protein, 9 aa, Homo Sapiens
GTPSSNSTY

SEQ ID NO: 537199 - protein, 9 aa, Homo Sapiens
SSTLIKHQQ

SEQ ID NO: 537200 - protein, 9 aa, Homo Sapiens
STLIKHQQT

SEQ ID NO: 537201 - protein, 9 aa, Homo Sapiens
DGTPSSNST

SEQ ID NO: 537202 - protein, 9 aa, Homo Sapiens
SNSTYQLQE

SEQ ID NO: 537203 - protein, 9 aa, Homo Sapiens
AGHTTILDH

SEQ ID NO: 537204 - protein, 9 aa, Homo Sapiens
AGRKKAFAT

SEQ ID NO: 537205 - protein, 9 aa, Homo Sapiens
ALAGRTAGG

SEQ ID NO: 537206 - protein, 9 aa, Homo Sapiens
RQPHVVSQW

SEQ ID NO: 537207 - protein, 9 aa, Homo Sapiens
LLIDENYSF

SEQ ID NO: 537208 - protein, 9 aa, Homo Sapiens
SCAAGAGTF

SEQ ID NO: 537209 - protein, 9 aa, Homo Sapiens
INEEEENKK

SEQ ID NO: 537210 - protein, 9 aa, Homo Sapiens
SHAENVETH

SEQ ID NO: 537211 - protein, 9 aa, Homo Sapiens
QPAGLTFPT

SEQ ID NO: 537212 - protein, 9 aa, Homo Sapiens
CFECIKTTQ

SEQ ID NO: 537213 - protein, 9 aa, Homo Sapiens
FGANRQPAG

SEQ ID NO: 537214 - protein, 9 aa, Homo Sapiens
ILTLALAGR

SEQ ID NO: 537215 - protein, 9 aa, Homo Sapiens
MQDMMTRRN

SEQ ID NO: 537216 - protein, 9 aa, Homo Sapiens
AENVETHII

SEQ ID NO: 537217 - protein, 9 aa, Homo Sapiens
ECIKTTQQR

SEQ ID NO: 537218 - protein, 9 aa, Homo Sapiens
FFFFLSCQT

SEQ ID NO: 537219 - protein, 9 aa, Homo Sapiens
SAALGMVCL

SEQ ID NO: 537220 - protein, 9 aa, Homo Sapiens
LLPLPLPLL

SEQ ID NO: 537221 - protein, 9 aa, Homo Sapiens
NKSGWGTSD

SEQ ID NO: 537222 - protein, 9 aa, Homo Sapiens
RHPRYLSSV

SEQ ID NO: 537223 - protein, 9 aa, Homo Sapiens
TRAPHNPGH

SEQ ID NO: 537224 - protein, 9 aa, Homo Sapiens
GVLQLLLLP

SEQ ID NO: 537225 - protein, 9 aa, Homo Sapiens
VLQLLLLPL

SEQ ID NO: 537226 - protein, 9 aa, Homo Sapiens
NEEEENKKE

SEQ ID NO: 537227 - protein, 9 aa, Homo Sapiens
CLGARSDSA

SEQ ID NO: 537228 - protein, 9 aa, Homo Sapiens
THSTSHAEN

SEQ ID NO: 537229 - protein, 9 aa, Homo Sapiens
ALGMVCLGA

SEQ ID NO: 537230 - protein, 9 aa, Homo Sapiens
TLESKDSGM

SEQ ID NO: 537231 - protein, 9 aa, Homo Sapiens
QMYHYSCAA

SEQ ID NO: 537232 - protein, 9 aa, Homo Sapiens
FFFFFFLSC

SEQ ID NO: 537233 - protein, 9 aa, Homo Sapiens
GWGTSDRKT

SEQ ID NO: 537234 - protein, 9 aa, Homo Sapiens
DYFGANRQP

SEQ ID NO: 537235 - protein, 9 aa, Homo Sapiens
MTRRNLGLL

SEQ ID NO: 537236 - protein, 9 aa, Homo Sapiens
HPRYLSSVM

SEQ ID NO: 537237 - protein, 9 aa, Homo Sapiens
TLISTSSVV

SEQ ID NO: 537238 - protein, 9 aa, Homo Sapiens
SKDSGMIAT

SEQ ID NO: 537239 - protein, 9 aa, Homo Sapiens
SRRQPHVVS

SEQ ID NO: 537240 - protein, 9 aa, Homo Sapiens
ESKDSGMIA

SEQ ID NO: 537241 - protein, 9 aa, Homo Sapiens
KSGWGTSDR

SEQ ID NO: 537242 - protein, 9 aa, Homo Sapiens
WPIWYHCRH

SEQ ID NO: 537243 - protein, 9 aa, Homo Sapiens
LLLPLPLPL

SEQ ID NO: 537244 - protein, 9 aa, Homo Sapiens
GMIATITSS

SEQ ID NO: 537245 - protein, 9 aa, Homo Sapiens
QCFECIKTT

SEQ ID NO: 537246 - protein, 9 aa, Homo Sapiens
ENVETHIIK

SEQ ID NO: 537247 - protein, 9 aa, Homo Sapiens
IKTTQQRNL

SEQ ID NO: 537248 - protein, 9 aa, Homo Sapiens
PHVVSQWSR

SEQ ID NO: 537249 - protein, 9 aa, Homo Sapiens
MVEVKCRDK

SEQ ID NO: 537250 - protein, 9 aa, Homo Sapiens
HSTSHAENV

SEQ ID NO: 537251 - protein, 9 aa, Homo Sapiens
RINEEEENK

SEQ ID NO: 537252 - protein, 9 aa, Homo Sapiens
GANRQPAGL

SEQ ID NO: 537253 - protein, 9 aa, Homo Sapiens
WYHCRHPRY

SEQ ID NO: 537254 - protein, 9 aa, Homo Sapiens
STSRLLIDE

SEQ ID NO: 537255 - protein, 9 aa, Homo Sapiens
PHNPGHVIQ

SEQ ID NO: 537256 - protein, 9 aa, Homo Sapiens
NKKEKSKEK

SEQ ID NO: 537257 - protein, 9 aa, Homo Sapiens
VCLGARSDS

SEQ ID NO: 537258 - protein, 9 aa, Homo Sapiens
RAPHNPGHV

SEQ ID NO: 537259 - protein, 9 aa, Homo Sapiens
APHNPGHVI

SEQ ID NO: 537260 - protein, 9 aa, Homo Sapiens
FFFLSCQTQ

SEQ ID NO: 537261 - protein, 9 aa, Homo Sapiens
YHYSCAAGA

SEQ ID NO: 537262 - protein, 9 aa, Homo Sapiens
DRKTIVVNF

SEQ ID NO: 537263 - protein, 9 aa, Homo Sapiens
MQAHITRAP

SEQ ID NO: 537264 - protein, 9 aa, Homo Sapiens
IWYHCRHPR

SEQ ID NO: 537265 - protein, 9 aa, Homo Sapiens
KDFHSGTFG

SEQ ID NO: 537266 - protein, 9 aa, Homo Sapiens
LTLALAGRT

SEQ ID NO: 537267 - protein, 9 aa, Homo Sapiens
LIDENYSFE

SEQ ID NO: 537268 - protein, 9 aa, Homo Sapiens
NRQPAGLTF

SEQ ID NO: 537269 - protein, 9 aa, Homo Sapiens
FFFFFLSCQ

SEQ ID NO: 537270 - protein, 9 aa, Homo Sapiens
CIKTTQQRN

SEQ ID NO: 537271 - protein, 9 aa, Homo Sapiens
QAHITRAPH

SEQ ID NO: 537272 - protein, 9 aa, Homo Sapiens
QPHVVSQWS

SEQ ID NO: 537273 - protein, 9 aa, Homo Sapiens
GMVCLGARS

SEQ ID NO: 537274 - protein, 9 aa, Homo Sapiens
FECIKTTQQ

SEQ ID NO: 537275 - protein, 9 aa, Homo Sapiens
EMQDMMTRR

SEQ ID NO: 537276 - protein, 9 aa, Homo Sapiens
LSAALGMVC

SEQ ID NO: 537277 - protein, 9 aa, Homo Sapiens
LALAGRTAG

SEQ ID NO: 537278 - protein, 9 aa, Homo Sapiens
CRDKDFHSG

SEQ ID NO: 537279 - protein, 9 aa, Homo Sapiens
TSHAENVET

SEQ ID NO: 537280 - protein, 9 aa, Homo Sapiens
HCRHPRYLS

SEQ ID NO: 537281 - protein, 9 aa, Homo Sapiens
TLALAGRTA

SEQ ID NO: 537282 - protein, 9 aa, Homo Sapiens
VEVKCRDKD

SEQ ID NO: 537283 - protein, 9 aa, Homo Sapiens
KCRDKDFHS

SEQ ID NO: 537284 - protein, 9 aa, Homo Sapiens
VKCRDKDFH

SEQ ID NO: 537285 - protein, 9 aa, Homo Sapiens
HVVSQWSRS

SEQ ID NO: 537286 - protein, 9 aa, Homo Sapiens
SRLLIDENY

SEQ ID NO: 537287 - protein, 9 aa, Homo Sapiens
EEENKKEKS

SEQ ID NO: 537288 - protein, 9 aa, Homo Sapiens
RRGVLQLLL

SEQ ID NO: 537289 - protein, 9 aa, Homo Sapiens
EEEENKKEK

SEQ ID NO: 537290 - protein, 9 aa, Homo Sapiens
MYHYSCAAG

SEQ ID NO: 537291 - protein, 9 aa, Homo Sapiens
TSDRKTIVV

SEQ ID NO: 537292 - protein, 9 aa, Homo Sapiens
MIATITSSS

SEQ ID NO: 537293 - protein, 9 aa, Homo Sapiens
RNLGLLEQA

SEQ ID NO: 537294 - protein, 9 aa, Homo Sapiens
RLLIDENYS

SEQ ID NO: 537295 - protein, 9 aa, Homo Sapiens
EVKCRDKDF

SEQ ID NO: 537296 - protein, 9 aa, Homo Sapiens
QDMMTRRNL

SEQ ID NO: 537297 - protein, 9 aa, Homo Sapiens
CTQMYHYSC

SEQ ID NO: 537298 - protein, 9 aa, Homo Sapiens
FFFFFFFLS

SEQ ID NO: 537299 - protein, 9 aa, Homo Sapiens
PIWYHCRHP

SEQ ID NO: 537300 - protein, 9 aa, Homo Sapiens
IDENYSFEM

SEQ ID NO: 537301 - protein, 9 aa, Homo Sapiens
LAGRTAGGS

SEQ ID NO: 537302 - protein, 9 aa, Homo Sapiens
HAENVETHI

SEQ ID NO: 537303 - protein, 9 aa, Homo Sapiens
LLGILTLAL

SEQ ID NO: 537304 - protein, 9 aa, Homo Sapiens
LISTSSVVL

SEQ ID NO: 537305 - protein, 9 aa, Homo Sapiens
AALGMVCLG

SEQ ID NO: 537306 - protein, 9 aa, Homo Sapiens
CRHPRYLSS

SEQ ID NO: 537307 - protein, 9 aa, Homo Sapiens
TQMYHYSCA

SEQ ID NO: 537308 - protein, 9 aa, Homo Sapiens
WSTSRLLID

SEQ ID NO: 537309 - protein, 9 aa, Homo Sapiens
FTHSTSHAE

SEQ ID NO: 537310 - protein, 9 aa, Homo Sapiens
STSHAENVE

SEQ ID NO: 537311 - protein, 9 aa, Homo Sapiens
MMTRRNLGL

SEQ ID NO: 537312 - protein, 9 aa, Homo Sapiens
LQLLLLPLP

SEQ ID NO: 537313 - protein, 9 aa, Homo Sapiens
FLSCQTQFS

SEQ ID NO: 537314 - protein, 9 aa, Homo Sapiens
LGMVCLGAR

SEQ ID NO: 537315 - protein, 9 aa, Homo Sapiens
YFGANRQPA

SEQ ID NO: 537316 - protein, 9 aa, Homo Sapiens
HITRAPHNP

SEQ ID NO: 537317 - protein, 9 aa, Homo Sapiens
SGMIATITS

SEQ ID NO: 537318 - protein, 9 aa, Homo Sapiens
ENKKEKSKE

SEQ ID NO: 537319 - protein, 9 aa, Homo Sapiens
RRNLGLLEQ

SEQ ID NO: 537320 - protein, 9 aa, Homo Sapiens
SGWGTSDRK

SEQ ID NO: 537321 - protein, 9 aa, Homo Sapiens
MVCLGARSD

SEQ ID NO: 537322 - protein, 9 aa, Homo Sapiens
GTSDRKTIV

SEQ ID NO: 537323 - protein, 9 aa, Homo Sapiens
SDRKTIVVN

SEQ ID NO: 537324 - protein, 9 aa, Homo Sapiens
YSCAAGAGT

SEQ ID NO: 537325 - protein, 9 aa, Homo Sapiens
DKDFHSGTF

SEQ ID NO: 537326 - protein, 9 aa, Homo Sapiens
TSRLLIDEN

SEQ ID NO: 537327 - protein, 9 aa, Homo Sapiens
FFLSCQTQF

SEQ ID NO: 537328 - protein, 9 aa, Homo Sapiens
KCTQMYHYS

SEQ ID NO: 537329 - protein, 9 aa, Homo Sapiens
LSCQTQFSI

SEQ ID NO: 537330 - protein, 9 aa, Homo Sapiens
VVSQWSRSA

SEQ ID NO: 537331 - protein, 9 aa, Homo Sapiens
LGILTLALA

SEQ ID NO: 537332 - protein, 9 aa, Homo Sapiens
RDKDFHSGT

SEQ ID NO: 537333 - protein, 9 aa, Homo Sapiens
HSRRQPHVV

SEQ ID NO: 537334 - protein, 9 aa, Homo Sapiens
QLLLLPLPL

SEQ ID NO: 537335 - protein, 9 aa, Homo Sapiens
DSGMIATIT

SEQ ID NO: 537336 - protein, 9 aa, Homo Sapiens
KRINEEEEN

SEQ ID NO: 537337 - protein, 9 aa, Homo Sapiens
GILTLALAG

SEQ ID NO: 537338 - protein, 9 aa, Homo Sapiens
WGTSDRKTI

SEQ ID NO: 537339 - protein, 9 aa, Homo Sapiens
LESKDSGMI

SEQ ID NO: 537340 - protein, 9 aa, Homo Sapiens
VSQWSRSAS

SEQ ID NO: 537341 - protein, 9 aa, Homo Sapiens
FTLISTSSV

SEQ ID NO: 537342 - protein, 9 aa, Homo Sapiens
AHITRAPHN

SEQ ID NO: 537343 - protein, 9 aa, Homo Sapiens
DMMTRRNLG

SEQ ID NO: 537344 - protein, 9 aa, Homo Sapiens
TRRNLGLLE

SEQ ID NO: 537345 - protein, 9 aa, Homo Sapiens
RGVLQLLLL

SEQ ID NO: 537346 - protein, 9 aa, Homo Sapiens
EENKKEKSK

SEQ ID NO: 537347 - protein, 9 aa, Homo Sapiens
ADYFGANRQ

SEQ ID NO: 537348 - protein, 9 aa, Homo Sapiens
RRQPHVVSQ

SEQ ID NO: 537349 - protein, 9 aa, Homo Sapiens
KDSGMIATI

SEQ ID NO: 537350 - protein, 9 aa, Homo Sapiens
ANRQPAGLT

SEQ ID NO: 537351 - protein, 9 aa, Homo Sapiens
ITRAPHNPG

SEQ ID NO: 537352 - protein, 9 aa, Homo Sapiens
HYSCAAGAG

SEQ ID NO: 537353 - protein, 9 aa, Homo Sapiens
RQPAGLTFP

SEQ ID NO: 537354 - protein, 9 aa, Homo Sapiens
ISTSSVVLL

SEQ ID NO: 537355 - protein, 9 aa, Homo Sapiens
KWSTSRLLI

SEQ ID NO: 537356 - protein, 9 aa, Homo Sapiens
YHCRHPRYL

SEQ ID NO: 537357 - protein, 9 aa, Homo Sapiens
EKCLNLTHL

SEQ ID NO: 537358 - protein, 9 aa, Homo Sapiens
RRTTTRHPT

SEQ ID NO: 537359 - protein, 9 aa, Homo Sapiens
HSLSIQHSP

SEQ ID NO: 537360 - protein, 9 aa, Homo Sapiens
AETTTKPQA

SEQ ID NO: 537361 - protein, 9 aa, Homo Sapiens
PGALAYLDC

SEQ ID NO: 537362 - protein, 9 aa, Homo Sapiens
EERRLSAET

SEQ ID NO: 537363 - protein, 9 aa, Homo Sapiens
RKKRRRRQQ

SEQ ID NO: 537364 - protein, 9 aa, Homo Sapiens
SQHSLSIQH

SEQ ID NO: 537365 - protein, 9 aa, Homo Sapiens
NYLDGKIKK

SEQ ID NO: 537366 - protein, 9 aa, Homo Sapiens
FSQCSNLTV

SEQ ID NO: 537367 - protein, 9 aa, Homo Sapiens
PADRPNFTS

SEQ ID NO: 537368 - protein, 9 aa, Homo Sapiens
YIARFTRSS

SEQ ID NO: 537369 - protein, 9 aa, Homo Sapiens
LKSQHKWKL

SEQ ID NO: 537370 - protein, 9 aa, Homo Sapiens
RRRRQQYCI

SEQ ID NO: 537371 - protein, 9 aa, Homo Sapiens
QHKWKLANQ

SEQ ID NO: 537372 - protein, 9 aa, Homo Sapiens
EVLAASKQA

SEQ ID NO: 537373 - protein, 9 aa, Homo Sapiens
CLNLTHLNL

SEQ ID NO: 537374 - protein, 9 aa, Homo Sapiens
TTLTISGCF

SEQ ID NO: 537375 - protein, 9 aa, Homo Sapiens
LEVLAEKCL

SEQ ID NO: 537376 - protein, 9 aa, Homo Sapiens
LLKSQHKWK

SEQ ID NO: 537377 - protein, 9 aa, Homo Sapiens
FDEDDRQLM

SEQ ID NO: 537378 - protein, 9 aa, Homo Sapiens
IARFTRSSF

SEQ ID NO: 537379 - protein, 9 aa, Homo Sapiens
DEDDRQLMR

SEQ ID NO: 537380 - protein, 9 aa, Homo Sapiens
AALLKSQHK

SEQ ID NO: 537381 - protein, 9 aa, Homo Sapiens
SPPRQVARS

SEQ ID NO: 537382 - protein, 9 aa, Homo Sapiens
SGCFFDQTD

SEQ ID NO: 537383 - protein, 9 aa, Homo Sapiens
AEERRLSAE

SEQ ID NO: 537384 - protein, 9 aa, Homo Sapiens
ISGCFFDQT

SEQ ID NO: 537385 - protein, 9 aa, Homo Sapiens
QVARSPSSL

SEQ ID NO: 537386 - protein, 9 aa, Homo Sapiens
EEVLAASKQ

SEQ ID NO: 537387 - protein, 9 aa, Homo Sapiens
LMRKKRRRR

SEQ ID NO: 537388 - protein, 9 aa, Homo Sapiens
RRLSAETFG

SEQ ID NO: 537389 - protein, 9 aa, Homo Sapiens
LSGCRLLFL

SEQ ID NO: 537390 - protein, 9 aa, Homo Sapiens
RASCSPPSY

SEQ ID NO: 537391 - protein, 9 aa, Homo Sapiens
RQVARSPSS

SEQ ID NO: 537392 - protein, 9 aa, Homo Sapiens
NLHAAKMAQ

SEQ ID NO: 537393 - protein, 9 aa, Homo Sapiens
LHAAKMAQE

SEQ ID NO: 537394 - protein, 9 aa, Homo Sapiens
AKNCAVCDC

SEQ ID NO: 537395 - protein, 9 aa, Homo Sapiens
TRRTTTRHP

SEQ ID NO: 537396 - protein, 9 aa, Homo Sapiens
YSSSPPRQV

SEQ ID NO: 537397 - protein, 9 aa, Homo Sapiens
NCAVCDCGG

SEQ ID NO: 537398 - protein, 9 aa, Homo Sapiens
LSAETFGIP

SEQ ID NO: 537399 - protein, 9 aa, Homo Sapiens
AASPARSAV

SEQ ID NO: 537400 - protein, 9 aa, Homo Sapiens
GHLSGCRLL

SEQ ID NO: 537401 - protein, 9 aa, Homo Sapiens
MRMGDMGPC

SEQ ID NO: 537402 - protein, 9 aa, Homo Sapiens
SGCRLLFLF

SEQ ID NO: 537403 - protein, 9 aa, Homo Sapiens
CFFDQTDFP

SEQ ID NO: 537404 - protein, 9 aa, Homo Sapiens
LPLRTNYLD

SEQ ID NO: 537405 - protein, 9 aa, Homo Sapiens
ARSAVLALT

SEQ ID NO: 537406 - protein, 9 aa, Homo Sapiens
HAAKMAQEK

SEQ ID NO: 537407 - protein, 9 aa, Homo Sapiens
RQLMRKKRR

SEQ ID NO: 537408 - protein, 9 aa, Homo Sapiens
GPCGAINMG

SEQ ID NO: 537409 - protein, 9 aa, Homo Sapiens
SKLPADRPN

SEQ ID NO: 537410 - protein, 9 aa, Homo Sapiens
LLRLKADVF

SEQ ID NO: 537411 - protein, 9 aa, Homo Sapiens
CSNLTVHQR

SEQ ID NO: 537412 - protein, 9 aa, Homo Sapiens
IFYRRNLHA

SEQ ID NO: 537413 - protein, 9 aa, Homo Sapiens
KKRRRRQQY

SEQ ID NO: 537414 - protein, 9 aa, Homo Sapiens
LPADRPNFT

SEQ ID NO: 537415 - protein, 9 aa, Homo Sapiens
ASKQAAQKL

SEQ ID NO: 537416 - protein, 9 aa, Homo Sapiens
TPSQHSLSI

SEQ ID NO: 537417 - protein, 9 aa, Homo Sapiens
SGPGALAYL

SEQ ID NO: 537418 - protein, 9 aa, Homo Sapiens
TLQAETTTK

SEQ ID NO: 537419 - protein, 9 aa, Homo Sapiens
HQPLPYIAR

SEQ ID NO: 537420 - protein, 9 aa, Homo Sapiens
NTPSQHSLS

SEQ ID NO: 537421 - protein, 9 aa, Homo Sapiens
VARSPSSLP

SEQ ID NO: 537422 - protein, 9 aa, Homo Sapiens
ETTTKPQAT

SEQ ID NO: 537423 - protein, 9 aa, Homo Sapiens
FYRRNLHAA

SEQ ID NO: 537424 - protein, 9 aa, Homo Sapiens
SQCSNLTVH

SEQ ID NO: 537425 - protein, 9 aa, Homo Sapiens
DCGGGPCDS

SEQ ID NO: 537426 - protein, 9 aa, Homo Sapiens
LQAETTTKP

SEQ ID NO: 537427 - protein, 9 aa, Homo Sapiens
MGPCGAINM

SEQ ID NO: 537428 - protein, 9 aa, Homo Sapiens
TTRHPTTTV

SEQ ID NO: 537429 - protein, 9 aa, Homo Sapiens
MRKKRRRRQ

SEQ ID NO: 537430 - protein, 9 aa, Homo Sapiens
PCGAINMGD

SEQ ID NO: 537431 - protein, 9 aa, Homo Sapiens
PTLQAETTT

SEQ ID NO: 537432 - protein, 9 aa, Homo Sapiens
NHQPLPYIA

SEQ ID NO: 537433 - protein, 9 aa, Homo Sapiens
ADRPNFTSI

SEQ ID NO: 537434 - protein, 9 aa, Homo Sapiens
QPLPYIARF

SEQ ID NO: 537435 - protein, 9 aa, Homo Sapiens
CRLLFLFLS

SEQ ID NO: 537436 - protein, 9 aa, Homo Sapiens
PRQVARSPS

SEQ ID NO: 537437 - protein, 9 aa, Homo Sapiens
GCFFDQTDF

SEQ ID NO: 537438 - protein, 9 aa, Homo Sapiens
YRRNLHAAK

SEQ ID NO: 537439 - protein, 9 aa, Homo Sapiens
TNYLDGKIK

SEQ ID NO: 537440 - protein, 9 aa, Homo Sapiens
HPTTTVRTT

SEQ ID NO: 537441 - protein, 9 aa, Homo Sapiens
NFTSIHRIL

SEQ ID NO: 537442 - protein, 9 aa, Homo Sapiens
RRRQQYCIK

SEQ ID NO: 537443 - protein, 9 aa, Homo Sapiens
RHPTTTVRT

SEQ ID NO: 537444 - protein, 9 aa, Homo Sapiens
CGAINMGDA

SEQ ID NO: 537445 - protein, 9 aa, Homo Sapiens
PHMLLRLKA

SEQ ID NO: 537446 - protein, 9 aa, Homo Sapiens
SAVLALTGL

SEQ ID NO: 537447 - protein, 9 aa, Homo Sapiens
MGDMGPCGA

SEQ ID NO: 537448 - protein, 9 aa, Homo Sapiens
LNLTHLNLS

SEQ ID NO: 537449 - protein, 9 aa, Homo Sapiens
SSSPPRQVA

SEQ ID NO: 537450 - protein, 9 aa, Homo Sapiens
PSQHSLSIQ

SEQ ID NO: 537451 - protein, 9 aa, Homo Sapiens
HKWKLANQY

SEQ ID NO: 537452 - protein, 9 aa, Homo Sapiens
NHEEVLAAS

SEQ ID NO: 537453 - protein, 9 aa, Homo Sapiens
RRASCSPPS

SEQ ID NO: 537454 - protein, 9 aa, Homo Sapiens
DGKIKKTLP

SEQ ID NO: 537455 - protein, 9 aa, Homo Sapiens
QAETTTKPQ

SEQ ID NO: 537456 - protein, 9 aa, Homo Sapiens
SSPPRQVAR

SEQ ID NO: 537457 - protein, 9 aa, Homo Sapiens
AYLDCSSSS

SEQ ID NO: 537458 - protein, 9 aa, Homo Sapiens
TLTISGCFF

SEQ ID NO: 537459 - protein, 9 aa, Homo Sapiens
AEKCLNLTH

SEQ ID NO: 537460 - protein, 9 aa, Homo Sapiens
LPYIARFTR

SEQ ID NO: 537461 - protein, 9 aa, Homo Sapiens
KNTPSQHSL

SEQ ID NO: 537462 - protein, 9 aa, Homo Sapiens
AASKQAAQK

SEQ ID NO: 537463 - protein, 9 aa, Homo Sapiens
ALAYLDCSS

SEQ ID NO: 537464 - protein, 9 aa, Homo Sapiens
LAASKQAAQ

SEQ ID NO: 537465 - protein, 9 aa, Homo Sapiens
LRLKADVFK

SEQ ID NO: 537466 - protein, 9 aa, Homo Sapiens
GKAFSQCSN

SEQ ID NO: 537467 - protein, 9 aa, Homo Sapiens
KAFSQCSNL

SEQ ID NO: 537468 - protein, 9 aa, Homo Sapiens
KLPADRPNF

SEQ ID NO: 537469 - protein, 9 aa, Homo Sapiens
GPGALAYLD

SEQ ID NO: 537470 - protein, 9 aa, Homo Sapiens
RPNFTSIHR

SEQ ID NO: 537471 - protein, 9 aa, Homo Sapiens
HEEVLAASK

SEQ ID NO: 537472 - protein, 9 aa, Homo Sapiens
MLGPHMLLR

SEQ ID NO: 537473 - protein, 9 aa, Homo Sapiens
TTRRTTTRH

SEQ ID NO: 537474 - protein, 9 aa, Homo Sapiens
HMLLRLKAD

SEQ ID NO: 537475 - protein, 9 aa, Homo Sapiens
SKQAAQKLE

SEQ ID NO: 537476 - protein, 9 aa, Homo Sapiens
AFSQCSNLT

SEQ ID NO: 537477 - protein, 9 aa, Homo Sapiens
RLLFLFLSP

SEQ ID NO: 537478 - protein, 9 aa, Homo Sapiens
WAEERRLSA

SEQ ID NO: 537479 - protein, 9 aa, Homo Sapiens
AVCDCGGGP

SEQ ID NO: 537480 - protein, 9 aa, Homo Sapiens
DRPNFTSIH

SEQ ID NO: 537481 - protein, 9 aa, Homo Sapiens
KNCAVCDCG

SEQ ID NO: 537482 - protein, 9 aa, Homo Sapiens
TWAEERRLS

SEQ ID NO: 537483 - protein, 9 aa, Homo Sapiens
QCSNLTVHQ

SEQ ID NO: 537484 - protein, 9 aa, Homo Sapiens
PYIARFTRS

SEQ ID NO: 537485 - protein, 9 aa, Homo Sapiens
PLPYIARFT

SEQ ID NO: 537486 - protein, 9 aa, Homo Sapiens
LAYLDCSSS

SEQ ID NO: 537487 - protein, 9 aa, Homo Sapiens
MLLRLKADV

SEQ ID NO: 537488 - protein, 9 aa, Homo Sapiens
LSIQHSPER

SEQ ID NO: 537489 - protein, 9 aa, Homo Sapiens
GTTLTISGC

SEQ ID NO: 537490 - protein, 9 aa, Homo Sapiens
ARFTRSSFL

SEQ ID NO: 537491 - protein, 9 aa, Homo Sapiens
EDDRQLMRK

SEQ ID NO: 537492 - protein, 9 aa, Homo Sapiens
SAETFGIPL

SEQ ID NO: 537493 - protein, 9 aa, Homo Sapiens
TRHPTTTVR

SEQ ID NO: 537494 - protein, 9 aa, Homo Sapiens
GPHMLLRLK

SEQ ID NO: 537495 - protein, 9 aa, Homo Sapiens
VLAASKQAA

SEQ ID NO: 537496 - protein, 9 aa, Homo Sapiens
ALLKSQHKW

SEQ ID NO: 537497 - protein, 9 aa, Homo Sapiens
IAKNCAVCD

SEQ ID NO: 537498 - protein, 9 aa, Homo Sapiens
RSAVLALTG

SEQ ID NO: 537499 - protein, 9 aa, Homo Sapiens
YLDGKIKKT

SEQ ID NO: 537500 - protein, 9 aa, Homo Sapiens
DMLGPHMLL

SEQ ID NO: 537501 - protein, 9 aa, Homo Sapiens
KRRRRQQYC

SEQ ID NO: 537502 - protein, 9 aa, Homo Sapiens
LAEKCLNLT

SEQ ID NO: 537503 - protein, 9 aa, Homo Sapiens
GDMGPCGAI

SEQ ID NO: 537504 - protein, 9 aa, Homo Sapiens
DDRQLMRKK

SEQ ID NO: 537505 - protein, 9 aa, Homo Sapiens
RTTTRHPTT

SEQ ID NO: 537506 - protein, 9 aa, Homo Sapiens
PNFTSIHRI

SEQ ID NO: 537507 - protein, 9 aa, Homo Sapiens
PARSAVLAL

SEQ ID NO: 537508 - protein, 9 aa, Homo Sapiens
RNLHAAKMA

SEQ ID NO: 537509 - protein, 9 aa, Homo Sapiens
RTNYLDGKI

SEQ ID NO: 537510 - protein, 9 aa, Homo Sapiens
CAVCDCGGG

SEQ ID NO: 537511 - protein, 9 aa, Homo Sapiens
GALAYLDCS

SEQ ID NO: 537512 - protein, 9 aa, Homo Sapiens
QRRASCSPP

SEQ ID NO: 537513 - protein, 9 aa, Homo Sapiens
VLAEKCLNL

SEQ ID NO: 537514 - protein, 9 aa, Homo Sapiens
LRTNYLDGK

SEQ ID NO: 537515 - protein, 9 aa, Homo Sapiens
LTISGCFFD

SEQ ID NO: 537516 - protein, 9 aa, Homo Sapiens
LDGKIKKTL

SEQ ID NO: 537517 - protein, 9 aa, Homo Sapiens
MNFDEDDRQ

SEQ ID NO: 537518 - protein, 9 aa, Homo Sapiens
RRNLHAAKM

SEQ ID NO: 537519 - protein, 9 aa, Homo Sapiens
QHSLSIQHS

SEQ ID NO: 537520 - protein, 9 aa, Homo Sapiens
RQQYCIKEI

SEQ ID NO: 537521 - protein, 9 aa, Homo Sapiens
ESGPGALAY

SEQ ID NO: 537522 - protein, 9 aa, Homo Sapiens
ASPARSAVL

SEQ ID NO: 537523 - protein, 9 aa, Homo Sapiens
SQHKWKLAN

SEQ ID NO: 537524 - protein, 9 aa, Homo Sapiens
SPARSAVLA

SEQ ID NO: 537525 - protein, 9 aa, Homo Sapiens
HLSGCRLLF

SEQ ID NO: 537526 - protein, 9 aa, Homo Sapiens
LGPHMLLRL

SEQ ID NO: 537527 - protein, 9 aa, Homo Sapiens
DRQLMRKKR

SEQ ID NO: 537528 - protein, 9 aa, Homo Sapiens
ERRLSAETF

SEQ ID NO: 537529 - protein, 9 aa, Homo Sapiens
TTKPQATSA

SEQ ID NO: 537530 - protein, 9 aa, Homo Sapiens
YLDCSSSSQ

SEQ ID NO: 537531 - protein, 9 aa, Homo Sapiens
KSQHKWKLA

SEQ ID NO: 537532 - protein, 9 aa, Homo Sapiens
TTTRHPTTT

SEQ ID NO: 537533 - protein, 9 aa, Homo Sapiens
NFDEDDRQL

SEQ ID NO: 537534 - protein, 9 aa, Homo Sapiens
PLRTNYLDG

SEQ ID NO: 537535 - protein, 9 aa, Homo Sapiens
RMGDMGPCG

SEQ ID NO: 537536 - protein, 9 aa, Homo Sapiens
CDCGGGPCD

SEQ ID NO: 537537 - protein, 9 aa, Homo Sapiens
EVLAEKCLN

SEQ ID NO: 537538 - protein, 9 aa, Homo Sapiens
SLSIQHSPE

SEQ ID NO: 537539 - protein, 9 aa, Homo Sapiens
KIFYRRNLH

SEQ ID NO: 537540 - protein, 9 aa, Homo Sapiens
QLMRKKRRR

SEQ ID NO: 537541 - protein, 9 aa, Homo Sapiens
TTTKPQATS

SEQ ID NO: 537542 - protein, 9 aa, Homo Sapiens
TISGCFFDQ

SEQ ID NO: 537543 - protein, 9 aa, Homo Sapiens
DMGPCGAIN

SEQ ID NO: 537544 - protein, 9 aa, Homo Sapiens
RRQQYCIKE

SEQ ID NO: 537545 - protein, 9 aa, Homo Sapiens
MAASPARSA

SEQ ID NO: 537546 - protein, 9 aa, Homo Sapiens
RLSAETFGI

SEQ ID NO: 537547 - protein, 9 aa, Homo Sapiens
GCRLLFLFL

SEQ ID NO: 537548 - protein, 9 aa, Homo Sapiens
KCLNLTHLN

SEQ ID NO: 537549 - protein, 9 aa, Homo Sapiens
PPTLQAETT

SEQ ID NO: 537550 - protein, 9 aa, Homo Sapiens
PPRQVARSP

SEQ ID NO: 537551 - protein, 9 aa, Homo Sapiens
VCDCGGGPC

SEQ ID NO: 537552 - protein, 9 aa, Homo Sapiens
LNFYHVNME

SEQ ID NO: 537553 - protein, 9 aa, Homo Sapiens
FFLYFKHTH

SEQ ID NO: 537554 - protein, 9 aa, Homo Sapiens
YWAPIHIFV

SEQ ID NO: 537555 - protein, 9 aa, Homo Sapiens
PGTSANCCR

SEQ ID NO: 537556 - protein, 9 aa, Homo Sapiens
KHTHIFSHA

SEQ ID NO: 537557 - protein, 9 aa, Homo Sapiens
DRRLAPCSR

SEQ ID NO: 537558 - protein, 9 aa, Homo Sapiens
QFENALTVR

SEQ ID NO: 537559 - protein, 9 aa, Homo Sapiens
PALPGTSAN

SEQ ID NO: 537560 - protein, 9 aa, Homo Sapiens
QPALPGTSA

SEQ ID NO: 537561 - protein, 9 aa, Homo Sapiens
VARVHPHRK

SEQ ID NO: 537562 - protein, 9 aa, Homo Sapiens
CCRLPPRLP

SEQ ID NO: 537563 - protein, 9 aa, Homo Sapiens
ELARMEAGQ

SEQ ID NO: 537564 - protein, 9 aa, Homo Sapiens
RRLAPCSRW

SEQ ID NO: 537565 - protein, 9 aa, Homo Sapiens
YRHASFFFF

SEQ ID NO: 537566 - protein, 9 aa, Homo Sapiens
LEVQNDIVS

SEQ ID NO: 537567 - protein, 9 aa, Homo Sapiens
AFVVYWAPI

SEQ ID NO: 537568 - protein, 9 aa, Homo Sapiens
WQHTSLLSG

SEQ ID NO: 537569 - protein, 9 aa, Homo Sapiens
DPNIIPVLV

SEQ ID NO: 537570 - protein, 9 aa, Homo Sapiens
CLRSPQCQL

SEQ ID NO: 537571 - protein, 9 aa, Homo Sapiens
SPQCQLGGE

SEQ ID NO: 537572 - protein, 9 aa, Homo Sapiens
TPSPHPWQH

SEQ ID NO: 537573 - protein, 9 aa, Homo Sapiens
GELARMEAG

SEQ ID NO: 537574 - protein, 9 aa, Homo Sapiens
ARIHLPQPA

SEQ ID NO: 537575 - protein, 9 aa, Homo Sapiens
VAKGVGLVG

SEQ ID NO: 537576 - protein, 9 aa, Homo Sapiens
NIIPVLVFM

SEQ ID NO: 537577 - protein, 9 aa, Homo Sapiens
HITRAISKG

SEQ ID NO: 537578 - protein, 9 aa, Homo Sapiens
RIHLPQPAL

SEQ ID NO: 537579 - protein, 9 aa, Homo Sapiens
IGVQFSSDV

SEQ ID NO: 537580 - protein, 9 aa, Homo Sapiens
VGFVDRRLA

SEQ ID NO: 537581 - protein, 9 aa, Homo Sapiens
IAVGFVDRR

SEQ ID NO: 537582 - protein, 9 aa, Homo Sapiens
SPHPWQHTS

SEQ ID NO: 537583 - protein, 9 aa, Homo Sapiens
VGITALLGC

SEQ ID NO: 537584 - protein, 9 aa, Homo Sapiens
HASFFFFLY

SEQ ID NO: 537585 - protein, 9 aa, Homo Sapiens
QPVTIGVQF

SEQ ID NO: 537586 - protein, 9 aa, Homo Sapiens
IHLPQPALP

SEQ ID NO: 537587 - protein, 9 aa, Homo Sapiens
WQHITRAIS

SEQ ID NO: 537588 - protein, 9 aa, Homo Sapiens
SPCLRSPQC

SEQ ID NO: 537589 - protein, 9 aa, Homo Sapiens
VGLITRSGR

SEQ ID NO: 537590 - protein, 9 aa, Homo Sapiens
PGSTNLRIG

SEQ ID NO: 537591 - protein, 9 aa, Homo Sapiens
EVQNDIVSG

SEQ ID NO: 537592 - protein, 9 aa, Homo Sapiens
VQNDIVSGS

SEQ ID NO: 537593 - protein, 9 aa, Homo Sapiens
TSVARVHPH

SEQ ID NO: 537594 - protein, 9 aa, Homo Sapiens
IEPRNGELQ

SEQ ID NO: 537595 - protein, 9 aa, Homo Sapiens
PHPWQHTSL

SEQ ID NO: 537596 - protein, 9 aa, Homo Sapiens
MEIEDINDH

SEQ ID NO: 537597 - protein, 9 aa, Homo Sapiens
LITRSGRYV

SEQ ID NO: 537598 - protein, 9 aa, Homo Sapiens
PSSSPCLRS

SEQ ID NO: 537599 - protein, 9 aa, Homo Sapiens
GFVDRRLAP

SEQ ID NO: 537600 - protein, 9 aa, Homo Sapiens
KQPVTIGVQ

SEQ ID NO: 537601 - protein, 9 aa, Homo Sapiens
THIFSHAHT

SEQ ID NO: 537602 - protein, 9 aa, Homo Sapiens
KREIMFVFS

SEQ ID NO: 537603 - protein, 9 aa, Homo Sapiens
RLAPCSRWH

SEQ ID NO: 537604 - protein, 9 aa, Homo Sapiens
RSGRYVCAV

SEQ ID NO: 537605 - protein, 9 aa, Homo Sapiens
ARVHPHRKL

SEQ ID NO: 537606 - protein, 9 aa, Homo Sapiens
VHPHRKLPA

SEQ ID NO: 537607 - protein, 9 aa, Homo Sapiens
VVGAFVVYW

SEQ ID NO: 537608 - protein, 9 aa, Homo Sapiens
KTVVVMRTA

SEQ ID NO: 537609 - protein, 9 aa, Homo Sapiens
WCDWRLNTP

SEQ ID NO: 537610 - protein, 9 aa, Homo Sapiens
GAFVVYWAP

SEQ ID NO: 537611 - protein, 9 aa, Homo Sapiens
EKREIMFVF

SEQ ID NO: 537612 - protein, 9 aa, Homo Sapiens
PVLVFMLHQ

SEQ ID NO: 537613 - protein, 9 aa, Homo Sapiens
PVTIGVQFS

SEQ ID NO: 537614 - protein, 9 aa, Homo Sapiens
VGAFVVYWA

SEQ ID NO: 537615 - protein, 9 aa, Homo Sapiens
ESERLWQHI

SEQ ID NO: 537616 - protein, 9 aa, Homo Sapiens
YHVNMEIED

SEQ ID NO: 537617 - protein, 9 aa, Homo Sapiens
ERLWQHITR

SEQ ID NO: 537618 - protein, 9 aa, Homo Sapiens
IVIHPGSTN

SEQ ID NO: 537619 - protein, 9 aa, Homo Sapiens
IEKREIMFV

SEQ ID NO: 537620 - protein, 9 aa, Homo Sapiens
RLNTPMYMF

SEQ ID NO: 537621 - protein, 9 aa, Homo Sapiens
NFYHVNMEI

SEQ ID NO: 537622 - protein, 9 aa, Homo Sapiens
FSHAHTPSP

SEQ ID NO: 537623 - protein, 9 aa, Homo Sapiens
VLEVQNDIV

SEQ ID NO: 537624 - protein, 9 aa, Homo Sapiens
RVHPHRKLP

SEQ ID NO: 537625 - protein, 9 aa, Homo Sapiens
HIFSHAHTP

SEQ ID NO: 537626 - protein, 9 aa, Homo Sapiens
PNIIPVLVF

SEQ ID NO: 537627 - protein, 9 aa, Homo Sapiens
LRSPQCQLG

SEQ ID NO: 537628 - protein, 9 aa, Homo Sapiens
YGDKQPVTI

SEQ ID NO: 537629 - protein, 9 aa, Homo Sapiens
ITRAISKGD

SEQ ID NO: 537630 - protein, 9 aa, Homo Sapiens
SGRYVCAVT

SEQ ID NO: 537631 - protein, 9 aa, Homo Sapiens
EALVLEVQN

SEQ ID NO: 537632 - protein, 9 aa, Homo Sapiens
NLRIGRATD

SEQ ID NO: 537633 - protein, 9 aa, Homo Sapiens
GVGLVGITA

SEQ ID NO: 537634 - protein, 9 aa, Homo Sapiens
SRWHTSVAR

SEQ ID NO: 537635 - protein, 9 aa, Homo Sapiens
FFFFLYFKH

SEQ ID NO: 537636 - protein, 9 aa, Homo Sapiens
CQLGGELAR

SEQ ID NO: 537637 - protein, 9 aa, Homo Sapiens
VVVMRTANA

SEQ ID NO: 537638 - protein, 9 aa, Homo Sapiens
PQCQLGGEL

SEQ ID NO: 537639 - protein, 9 aa, Homo Sapiens
NTPMYMFLG

SEQ ID NO: 537640 - protein, 9 aa, Homo Sapiens
VYWAPIHIF

SEQ ID NO: 537641 - protein, 9 aa, Homo Sapiens
LPGTSANCC

SEQ ID NO: 537642 - protein, 9 aa, Homo Sapiens
HTSLLSGAD

SEQ ID NO: 537643 - protein, 9 aa, Homo Sapiens
QKQFENALT

SEQ ID NO: 537644 - protein, 9 aa, Homo Sapiens
AKGVGLVGI

SEQ ID NO: 537645 - protein, 9 aa, Homo Sapiens
RLPAIAVGF

SEQ ID NO: 537646 - protein, 9 aa, Homo Sapiens
PHRKLPAPS

SEQ ID NO: 537647 - protein, 9 aa, Homo Sapiens
SHAHTPSPH

SEQ ID NO: 537648 - protein, 9 aa, Homo Sapiens
PRLPAIAVG

SEQ ID NO: 537649 - protein, 9 aa, Homo Sapiens
FYHVNMEIE

SEQ ID NO: 537650 - protein, 9 aa, Homo Sapiens
AAEYRHASF

SEQ ID NO: 537651 - protein, 9 aa, Homo Sapiens
LPAIAVGFV

SEQ ID NO: 537652 - protein, 9 aa, Homo Sapiens
MRTANAQEL

SEQ ID NO: 537653 - protein, 9 aa, Homo Sapiens
LWQHITRAI

SEQ ID NO: 537654 - protein, 9 aa, Homo Sapiens
IIPVLVFML

SEQ ID NO: 537655 - protein, 9 aa, Homo Sapiens
VDRRLAPCS

SEQ ID NO: 537656 - protein, 9 aa, Homo Sapiens
NLLSKEIEP

SEQ ID NO: 537657 - protein, 9 aa, Homo Sapiens
WRLNTPMYM

SEQ ID NO: 537658 - protein, 9 aa, Homo Sapiens
HPHRKLPAP

SEQ ID NO: 537659 - protein, 9 aa, Homo Sapiens
VVYWAPIHI

SEQ ID NO: 537660 - protein, 9 aa, Homo Sapiens
GQRLAAEYR

SEQ ID NO: 537661 - protein, 9 aa, Homo Sapiens
HLPQPALPG

SEQ ID NO: 537662 - protein, 9 aa, Homo Sapiens
HPWQHTSLL

SEQ ID NO: 537663 - protein, 9 aa, Homo Sapiens
LVFMLHQDL

SEQ ID NO: 537664 - protein, 9 aa, Homo Sapiens
PKTVVVMRT

SEQ ID NO: 537665 - protein, 9 aa, Homo Sapiens
SVARVHPHR

SEQ ID NO: 537666 - protein, 9 aa, Homo Sapiens
TVVVMRTAN

SEQ ID NO: 537667 - protein, 9 aa, Homo Sapiens
KGVGLVGIT

SEQ ID NO: 537668 - protein, 9 aa, Homo Sapiens
PPRLPAIAV

SEQ ID NO: 537669 - protein, 9 aa, Homo Sapiens
ITRSGRYVC

SEQ ID NO: 537670 - protein, 9 aa, Homo Sapiens
GTSANCCRL

SEQ ID NO: 537671 - protein, 9 aa, Homo Sapiens
NCCRLPPRL

SEQ ID NO: 537672 - protein, 9 aa, Homo Sapiens
EIMFVFSSD

SEQ ID NO: 537673 - protein, 9 aa, Homo Sapiens
RLPPRLPAI

SEQ ID NO: 537674 - protein, 9 aa, Homo Sapiens
ASFFFFLYF

SEQ ID NO: 537675 - protein, 9 aa, Homo Sapiens
SERLWQHIT

SEQ ID NO: 537676 - protein, 9 aa, Homo Sapiens
RVGLITRSG

SEQ ID NO: 537677 - protein, 9 aa, Homo Sapiens
LARMEAGQR

SEQ ID NO: 537678 - protein, 9 aa, Homo Sapiens
RLGQKQFEN

SEQ ID NO: 537679 - protein, 9 aa, Homo Sapiens
QCQLGGELA

SEQ ID NO: 537680 - protein, 9 aa, Homo Sapiens
RSPQCQLGG

SEQ ID NO: 537681 - protein, 9 aa, Homo Sapiens
RSPKTVVVM

SEQ ID NO: 537682 - protein, 9 aa, Homo Sapiens
PLNFYHVNM

SEQ ID NO: 537683 - protein, 9 aa, Homo Sapiens
TNLRIGRAT

SEQ ID NO: 537684 - protein, 9 aa, Homo Sapiens
VLVFMLHQD

SEQ ID NO: 537685 - protein, 9 aa, Homo Sapiens
PWQHTSLLS

SEQ ID NO: 537686 - protein, 9 aa, Homo Sapiens
GLVGITALL

SEQ ID NO: 537687 - protein, 9 aa, Homo Sapiens
GDKQPVTIG

SEQ ID NO: 537688 - protein, 9 aa, Homo Sapiens
DKQPVTIGV

SEQ ID NO: 537689 - protein, 9 aa, Homo Sapiens
FLYFKHTHI

SEQ ID NO: 537690 - protein, 9 aa, Homo Sapiens
RFEIEKREI

SEQ ID NO: 537691 - protein, 9 aa, Homo Sapiens
AGQRLAAEY

SEQ ID NO: 537692 - protein, 9 aa, Homo Sapiens
FVDRRLAPC

SEQ ID NO: 537693 - protein, 9 aa, Homo Sapiens
RLAAEYRHA

SEQ ID NO: 537694 - protein, 9 aa, Homo Sapiens
IFSHAHTPS

SEQ ID NO: 537695 - protein, 9 aa, Homo Sapiens
PAPSSSPCL

SEQ ID NO: 537696 - protein, 9 aa, Homo Sapiens
HRKLPAPSS

SEQ ID NO: 537697 - protein, 9 aa, Homo Sapiens
VGLVGITAL

SEQ ID NO: 537698 - protein, 9 aa, Homo Sapiens
APCSRWHTS

SEQ ID NO: 537699 - protein, 9 aa, Homo Sapiens
HVNMEIEDI

SEQ ID NO: 537700 - protein, 9 aa, Homo Sapiens
VVMRTANAQ

SEQ ID NO: 537701 - protein, 9 aa, Homo Sapiens
LVGITALLG

SEQ ID NO: 537702 - protein, 9 aa, Homo Sapiens
AEYRHASFF

SEQ ID NO: 537703 - protein, 9 aa, Homo Sapiens
YFKHTHIFS

SEQ ID NO: 537704 - protein, 9 aa, Homo Sapiens
WHTSVARVH

SEQ ID NO: 537705 - protein, 9 aa, Homo Sapiens
LAPCSRWHT

SEQ ID NO: 537706 - protein, 9 aa, Homo Sapiens
LPQPALPGT

SEQ ID NO: 537707 - protein, 9 aa, Homo Sapiens
AVGFVDRRL

SEQ ID NO: 537708 - protein, 9 aa, Homo Sapiens
VMRTANAQE

SEQ ID NO: 537709 - protein, 9 aa, Homo Sapiens
SPKTVVVMR

SEQ ID NO: 537710 - protein, 9 aa, Homo Sapiens
PRNGELQSD

SEQ ID NO: 537711 - protein, 9 aa, Homo Sapiens
HTHIFSHAH

SEQ ID NO: 537712 - protein, 9 aa, Homo Sapiens
EYRHASFFF

SEQ ID NO: 537713 - protein, 9 aa, Homo Sapiens
VLWCDWRLN

SEQ ID NO: 537714 - protein, 9 aa, Homo Sapiens
FENALTVRL

SEQ ID NO: 537715 - protein, 9 aa, Homo Sapiens
QHTSLLSGA

SEQ ID NO: 537716 - protein, 9 aa, Homo Sapiens
HTPSPHPWQ

SEQ ID NO: 537717 - protein, 9 aa, Homo Sapiens
QHITRAISK

SEQ ID NO: 537718 - protein, 9 aa, Homo Sapiens
PCSRWHTSV

SEQ ID NO: 537719 - protein, 9 aa, Homo Sapiens
LAAEYRHAS

SEQ ID NO: 537720 - protein, 9 aa, Homo Sapiens
HAHTPSPHP

SEQ ID NO: 537721 - protein, 9 aa, Homo Sapiens
CSRWHTSVA

SEQ ID NO: 537722 - protein, 9 aa, Homo Sapiens
EIEPRNGEL

SEQ ID NO: 537723 - protein, 9 aa, Homo Sapiens
RWHTSVARV

SEQ ID NO: 537724 - protein, 9 aa, Homo Sapiens
KQFENALTV

SEQ ID NO: 537725 - protein, 9 aa, Homo Sapiens
REIMFVFSS

SEQ ID NO: 537726 - protein, 9 aa, Homo Sapiens
LVLEVQNDI

SEQ ID NO: 537727 - protein, 9 aa, Homo Sapiens
AHTPSPHPW

SEQ ID NO: 537728 - protein, 9 aa, Homo Sapiens
PCLRSPQCQ

SEQ ID NO: 537729 - protein, 9 aa, Homo Sapiens
RHASFFFFL

SEQ ID NO: 537730 - protein, 9 aa, Homo Sapiens
EPRNGELQS

SEQ ID NO: 537731 - protein, 9 aa, Homo Sapiens
APSSSPCLR

SEQ ID NO: 537732 - protein, 9 aa, Homo Sapiens
GQKQFENAL

SEQ ID NO: 537733 - protein, 9 aa, Homo Sapiens
SANCCRLPP

SEQ ID NO: 537734 - protein, 9 aa, Homo Sapiens
SSPCLRSPQ

SEQ ID NO: 537735 - protein, 9 aa, Homo Sapiens
EAGQRLAAE

SEQ ID NO: 537736 - protein, 9 aa, Homo Sapiens
HTSVARVHP

SEQ ID NO: 537737 - protein, 9 aa, Homo Sapiens
VTIGVQFSS

SEQ ID NO: 537738 - protein, 9 aa, Homo Sapiens
KLPAPSSSP

SEQ ID NO: 537739 - protein, 9 aa, Homo Sapiens
NMEIEDIND

SEQ ID NO: 537740 - protein, 9 aa, Homo Sapiens
NDIVSGSKL

SEQ ID NO: 537741 - protein, 9 aa, Homo Sapiens
LGQKQFENA

SEQ ID NO: 537742 - protein, 9 aa, Homo Sapiens
PAIAVGFVD

SEQ ID NO: 537743 - protein, 9 aa, Homo Sapiens
VIHPGSTNL

SEQ ID NO: 537744 - protein, 9 aa, Homo Sapiens
GGELARMEA

SEQ ID NO: 537745 - protein, 9 aa, Homo Sapiens
HPGSTNLRI

SEQ ID NO: 537746 - protein, 9 aa, Homo Sapiens
TIGVQFSSD

SEQ ID NO: 537747 - protein, 9 aa, Homo Sapiens
TRSGRYVCA

SEQ ID NO: 537748 - protein, 9 aa, Homo Sapiens
GRYVCAVTR

SEQ ID NO: 537749 - protein, 9 aa, Homo Sapiens
FEIEKREIM

SEQ ID NO: 537750 - protein, 9 aa, Homo Sapiens
GSTNLRIGR

SEQ ID NO: 537751 - protein, 9 aa, Homo Sapiens
SFFFFLYFK

SEQ ID NO: 537752 - protein, 9 aa, Homo Sapiens
PQPALPGTS

SEQ ID NO: 537753 - protein, 9 aa, Homo Sapiens
CDWRLNTPM

SEQ ID NO: 537754 - protein, 9 aa, Homo Sapiens
IHPGSTNLR

SEQ ID NO: 537755 - protein, 9 aa, Homo Sapiens
KEIEPRNGE

SEQ ID NO: 537756 - protein, 9 aa, Homo Sapiens
GVRLGQKQF

SEQ ID NO: 537757 - protein, 9 aa, Homo Sapiens
QLGGELARM

SEQ ID NO: 537758 - protein, 9 aa, Homo Sapiens
SKEIEPRNG

SEQ ID NO: 537759 - protein, 9 aa, Homo Sapiens
SSSPCLRSP

SEQ ID NO: 537760 - protein, 9 aa, Homo Sapiens
LWCDWRLNT

SEQ ID NO: 537761 - protein, 9 aa, Homo Sapiens
LLSKEIEPR

SEQ ID NO: 537762 - protein, 9 aa, Homo Sapiens
LGGELARME

SEQ ID NO: 537763 - protein, 9 aa, Homo Sapiens
GITALLGCF

SEQ ID NO: 537764 - protein, 9 aa, Homo Sapiens
FVVYWAPIH

SEQ ID NO: 537765 - protein, 9 aa, Homo Sapiens
MEAGQRLAA

SEQ ID NO: 537766 - protein, 9 aa, Homo Sapiens
DWRLNTPMY

SEQ ID NO: 537767 - protein, 9 aa, Homo Sapiens
CRLPPRLPA

SEQ ID NO: 537768 - protein, 9 aa, Homo Sapiens
RLWQHITRA

SEQ ID NO: 537769 - protein, 9 aa, Homo Sapiens
ANCCRLPPR

SEQ ID NO: 537770 - protein, 9 aa, Homo Sapiens
AIAVGFVDR

SEQ ID NO: 537771 - protein, 9 aa, Homo Sapiens
STNLRIGRA

SEQ ID NO: 537772 - protein, 9 aa, Homo Sapiens
QRLAAEYRH

SEQ ID NO: 537773 - protein, 9 aa, Homo Sapiens
GLITRSGRY

SEQ ID NO: 537774 - protein, 9 aa, Homo Sapiens
RKLPAPSSS

SEQ ID NO: 537775 - protein, 9 aa, Homo Sapiens
ARMEAGQRL

SEQ ID NO: 537776 - protein, 9 aa, Homo Sapiens
ALVLEVQND

SEQ ID NO: 537777 - protein, 9 aa, Homo Sapiens
ALPGTSANC

SEQ ID NO: 537778 - protein, 9 aa, Homo Sapiens
IMFVFSSDD

SEQ ID NO: 537779 - protein, 9 aa, Homo Sapiens
PSPHPWQHT

SEQ ID NO: 537780 - protein, 9 aa, Homo Sapiens
FKHTHIFSH

SEQ ID NO: 537781 - protein, 9 aa, Homo Sapiens
TSANCCRLP

SEQ ID NO: 537782 - protein, 9 aa, Homo Sapiens
VNMEIEDIN

SEQ ID NO: 537783 - protein, 9 aa, Homo Sapiens
LPPRLPAIA

SEQ ID NO: 537784 - protein, 9 aa, Homo Sapiens
FFFLYFKHT

SEQ ID NO: 537785 - protein, 9 aa, Homo Sapiens
LYFKHTHIF

SEQ ID NO: 537786 - protein, 9 aa, Homo Sapiens
LSKEIEPRN

SEQ ID NO: 537787 - protein, 9 aa, Homo Sapiens
LNTPMYMFL

SEQ ID NO: 537788 - protein, 9 aa, Homo Sapiens
IPVLVFMLH

SEQ ID NO: 537789 - protein, 9 aa, Homo Sapiens
VRLGQKQFE

SEQ ID NO: 537790 - protein, 9 aa, Homo Sapiens
CDPNIIPVL

SEQ ID NO: 537791 - protein, 9 aa, Homo Sapiens
VVVGAFVVY

SEQ ID NO: 537792 - protein, 9 aa, Homo Sapiens
EIEKREIMF

SEQ ID NO: 537793 - protein, 9 aa, Homo Sapiens
QNDIVSGSK

SEQ ID NO: 537794 - protein, 9 aa, Homo Sapiens
LPAPSSSPC

SEQ ID NO: 537795 - protein, 9 aa, Homo Sapiens
RMEAGQRLA

SEQ ID NO: 537796 - protein, 9 aa, Homo Sapiens
YARDGLCTL

SEQ ID NO: 537797 - protein, 9 aa, Homo Sapiens
VTSMTSMTS

SEQ ID NO: 537798 - protein, 9 aa, Homo Sapiens
NKEFKSALQ

SEQ ID NO: 537799 - protein, 9 aa, Homo Sapiens
QDHSLSSSS

SEQ ID NO: 537800 - protein, 9 aa, Homo Sapiens
HVDKPPSVL

SEQ ID NO: 537801 - protein, 9 aa, Homo Sapiens
SALQRTIGQ

SEQ ID NO: 537802 - protein, 9 aa, Homo Sapiens
KLDGTTPVW

SEQ ID NO: 537803 - protein, 9 aa, Homo Sapiens
RRGHIQWLN

SEQ ID NO: 537804 - protein, 9 aa, Homo Sapiens
PRKPGQEAL

SEQ ID NO: 537805 - protein, 9 aa, Homo Sapiens
NGKDPVVGA

SEQ ID NO: 537806 - protein, 9 aa, Homo Sapiens
DAGKDLVSR

SEQ ID NO: 537807 - protein, 9 aa, Homo Sapiens
GTTPVWYGL

SEQ ID NO: 537808 - protein, 9 aa, Homo Sapiens
SMTSMTSMS

SEQ ID NO: 537809 - protein, 9 aa, Homo Sapiens
SAHVDKPPS

SEQ ID NO: 537810 - protein, 9 aa, Homo Sapiens
CTLCIAKKV

SEQ ID NO: 537811 - protein, 9 aa, Homo Sapiens
VWYGLRLNM

SEQ ID NO: 537812 - protein, 9 aa, Homo Sapiens
SLRRGHIQW

SEQ ID NO: 537813 - protein, 9 aa, Homo Sapiens
ALQRTIGQT

SEQ ID NO: 537814 - protein, 9 aa, Homo Sapiens
HKREQDHSL

SEQ ID NO: 537815 - protein, 9 aa, Homo Sapiens
KREQDHSLS

SEQ ID NO: 537816 - protein, 9 aa, Homo Sapiens
CWALSFYPA

SEQ ID NO: 537817 - protein, 9 aa, Homo Sapiens
ATLRCWALS

SEQ ID NO: 537818 - protein, 9 aa, Homo Sapiens
KNGKDPVVG

SEQ ID NO: 537819 - protein, 9 aa, Homo Sapiens
LSGCRLLFL

SEQ ID NO: 537820 - protein, 9 aa, Homo Sapiens
RGHIQWLNL

SEQ ID NO: 537821 - protein, 9 aa, Homo Sapiens
SKQEAWSTH

SEQ ID NO: 537822 - protein, 9 aa, Homo Sapiens
ALSFYPAEI

SEQ ID NO: 537823 - protein, 9 aa, Homo Sapiens
QEAWSTHNT

SEQ ID NO: 537824 - protein, 9 aa, Homo Sapiens
DLYARDGLC

SEQ ID NO: 537825 - protein, 9 aa, Homo Sapiens
VNPMTPVTS

SEQ ID NO: 537826 - protein, 9 aa, Homo Sapiens
GHLSGCRLL

SEQ ID NO: 537827 - protein, 9 aa, Homo Sapiens
RISLENVGC

SEQ ID NO: 537828 - protein, 9 aa, Homo Sapiens
EQDHSLSSS

SEQ ID NO: 537829 - protein, 9 aa, Homo Sapiens
SGCRLLFLF

SEQ ID NO: 537830 - protein, 9 aa, Homo Sapiens
KYGKPIPRI

SEQ ID NO: 537831 - protein, 9 aa, Homo Sapiens
PGRPRSKQE

SEQ ID NO: 537832 - protein, 9 aa, Homo Sapiens
LDGTTPVWY

SEQ ID NO: 537833 - protein, 9 aa, Homo Sapiens
GKDLVSRLL

SEQ ID NO: 537834 - protein, 9 aa, Homo Sapiens
TRDPTRRRP

SEQ ID NO: 537835 - protein, 9 aa, Homo Sapiens
EFKSALQRT

SEQ ID NO: 537836 - protein, 9 aa, Homo Sapiens
WLAANPKTQ

SEQ ID NO: 537837 - protein, 9 aa, Homo Sapiens
EAWSTHNTV

SEQ ID NO: 537838 - protein, 9 aa, Homo Sapiens
TSMTSMTSM

SEQ ID NO: 537839 - protein, 9 aa, Homo Sapiens
HSLSSSSSA

SEQ ID NO: 537840 - protein, 9 aa, Homo Sapiens
RKPGQEALE

SEQ ID NO: 537841 - protein, 9 aa, Homo Sapiens
QRAKNGKDP

SEQ ID NO: 537842 - protein, 9 aa, Homo Sapiens
GRPRSKQEA

SEQ ID NO: 537843 - protein, 9 aa, Homo Sapiens
KTQESEAKA

SEQ ID NO: 537844 - protein, 9 aa, Homo Sapiens
ENLVPSSAH

SEQ ID NO: 537845 - protein, 9 aa, Homo Sapiens
LCTLCIAKK

SEQ ID NO: 537846 - protein, 9 aa, Homo Sapiens
MTPVTSMTS

SEQ ID NO: 537847 - protein, 9 aa, Homo Sapiens
PVTSMTSMT

SEQ ID NO: 537848 - protein, 9 aa, Homo Sapiens
EGTQRAKNG

SEQ ID NO: 537849 - protein, 9 aa, Homo Sapiens
GHIQWLNLR

SEQ ID NO: 537850 - protein, 9 aa, Homo Sapiens
DGLCTLCIA

SEQ ID NO: 537851 - protein, 9 aa, Homo Sapiens
MAAAAAAAQ

SEQ ID NO: 537852 - protein, 9 aa, Homo Sapiens
RDPTRRRPV

SEQ ID NO: 537853 - protein, 9 aa, Homo Sapiens
WYGLRLNMD

SEQ ID NO: 537854 - protein, 9 aa, Homo Sapiens
GKPIPRISL

SEQ ID NO: 537855 - protein, 9 aa, Homo Sapiens
PTRRRPVYA

SEQ ID NO: 537856 - protein, 9 aa, Homo Sapiens
PVWYGLRLN

SEQ ID NO: 537857 - protein, 9 aa, Homo Sapiens
EGPPQQGIG

SEQ ID NO: 537858 - protein, 9 aa, Homo Sapiens
RDGLCTLCI

SEQ ID NO: 537859 - protein, 9 aa, Homo Sapiens
LHRPPFCVP

SEQ ID NO: 537860 - protein, 9 aa, Homo Sapiens
IPSGPRKPG

SEQ ID NO: 537861 - protein, 9 aa, Homo Sapiens
VPPPHGPLH

SEQ ID NO: 537862 - protein, 9 aa, Homo Sapiens
DGTTPVWYG

SEQ ID NO: 537863 - protein, 9 aa, Homo Sapiens
DNISDAGKD

SEQ ID NO: 537864 - protein, 9 aa, Homo Sapiens
KPIPRISLE

SEQ ID NO: 537865 - protein, 9 aa, Homo Sapiens
CRLLFLFLS

SEQ ID NO: 537866 - protein, 9 aa, Homo Sapiens
LSFYPAEIT

SEQ ID NO: 537867 - protein, 9 aa, Homo Sapiens
KQEAWSTHN

SEQ ID NO: 537868 - protein, 9 aa, Homo Sapiens
QQGIGGITL

SEQ ID NO: 537869 - protein, 9 aa, Homo Sapiens
TPVWYGLRL

SEQ ID NO: 537870 - protein, 9 aa, Homo Sapiens
EEGTQRAKN

SEQ ID NO: 537871 - protein, 9 aa, Homo Sapiens
YWDNISDAG

SEQ ID NO: 537872 - protein, 9 aa, Homo Sapiens
PPFCVPPPH

SEQ ID NO: 537873 - protein, 9 aa, Homo Sapiens
GTQRAKNGK

SEQ ID NO: 537874 - protein, 9 aa, Homo Sapiens
PSSAHVDKP

SEQ ID NO: 537875 - protein, 9 aa, Homo Sapiens
SSAHVDKPP

SEQ ID NO: 537876 - protein, 9 aa, Homo Sapiens
RCWALSFYP

SEQ ID NO: 537877 - protein, 9 aa, Homo Sapiens
HIQWLNLRY

SEQ ID NO: 537878 - protein, 9 aa, Homo Sapiens
PSGPRKPGQ

SEQ ID NO: 537879 - protein, 9 aa, Homo Sapiens
TRRRPVYAR

SEQ ID NO: 537880 - protein, 9 aa, Homo Sapiens
RCWLAANPK

SEQ ID NO: 537881 - protein, 9 aa, Homo Sapiens
NISDAGKDL

SEQ ID NO: 537882 - protein, 9 aa, Homo Sapiens
QWLNLRYTQ

SEQ ID NO: 537883 - protein, 9 aa, Homo Sapiens
PKTQESEAK

SEQ ID NO: 537884 - protein, 9 aa, Homo Sapiens
AANPKTQES

SEQ ID NO: 537885 - protein, 9 aa, Homo Sapiens
LRRGHIQWL

SEQ ID NO: 537886 - protein, 9 aa, Homo Sapiens
LVPSSAHVD

SEQ ID NO: 537887 - protein, 9 aa, Homo Sapiens
SLSSSSSAS

SEQ ID NO: 537888 - protein, 9 aa, Homo Sapiens
FKSALQRTI

SEQ ID NO: 537889 - protein, 9 aa, Homo Sapiens
NPKTQESEA

SEQ ID NO: 537890 - protein, 9 aa, Homo Sapiens
RPPFCVPPP

SEQ ID NO: 537891 - protein, 9 aa, Homo Sapiens
AHVDKPPSV

SEQ ID NO: 537892 - protein, 9 aa, Homo Sapiens
RAKNGKDPV

SEQ ID NO: 537893 - protein, 9 aa, Homo Sapiens
ANPKTQESE

SEQ ID NO: 537894 - protein, 9 aa, Homo Sapiens
NPMTPVTSM

SEQ ID NO: 537895 - protein, 9 aa, Homo Sapiens
NLVPSSAHV

SEQ ID NO: 537896 - protein, 9 aa, Homo Sapiens
PMTPVTSMT

SEQ ID NO: 537897 - protein, 9 aa, Homo Sapiens
GIGGITLLT

SEQ ID NO: 537898 - protein, 9 aa, Homo Sapiens
ISDAGKDLV

SEQ ID NO: 537899 - protein, 9 aa, Homo Sapiens
AKNGKDPVV

SEQ ID NO: 537900 - protein, 9 aa, Homo Sapiens
KSALQRTIG

SEQ ID NO: 537901 - protein, 9 aa, Homo Sapiens
LRCWALSFY

SEQ ID NO: 537902 - protein, 9 aa, Homo Sapiens
PGTRDPTRR

SEQ ID NO: 537903 - protein, 9 aa, Homo Sapiens
WALSFYPAE

SEQ ID NO: 537904 - protein, 9 aa, Homo Sapiens
IQGLPGPQG

SEQ ID NO: 537905 - protein, 9 aa, Homo Sapiens
LQRTIGQTF

SEQ ID NO: 537906 - protein, 9 aa, Homo Sapiens
PRISLENVG

SEQ ID NO: 537907 - protein, 9 aa, Homo Sapiens
PRSKQEAWS

SEQ ID NO: 537908 - protein, 9 aa, Homo Sapiens
ARDGLCTLC

SEQ ID NO: 537909 - protein, 9 aa, Homo Sapiens
DPTRRRPVY

SEQ ID NO: 537910 - protein, 9 aa, Homo Sapiens
AGKDLVSRL

SEQ ID NO: 537911 - protein, 9 aa, Homo Sapiens
RPRSKQEAW

SEQ ID NO: 537912 - protein, 9 aa, Homo Sapiens
IQWLNLRYT

SEQ ID NO: 537913 - protein, 9 aa, Homo Sapiens
RSKQEAWST

SEQ ID NO: 537914 - protein, 9 aa, Homo Sapiens
KEFKSALQR

SEQ ID NO: 537915 - protein, 9 aa, Homo Sapiens
RLLFLFLSP

SEQ ID NO: 537916 - protein, 9 aa, Homo Sapiens
HRPPFCVPP

SEQ ID NO: 537917 - protein, 9 aa, Homo Sapiens
KPGQEALET

SEQ ID NO: 537918 - protein, 9 aa, Homo Sapiens
TTPVWYGLR

SEQ ID NO: 537919 - protein, 9 aa, Homo Sapiens
PQQGIGGIT

SEQ ID NO: 537920 - protein, 9 aa, Homo Sapiens
LYARDGLCT

SEQ ID NO: 537921 - protein, 9 aa, Homo Sapiens
GPPQQGIGG

SEQ ID NO: 537922 - protein, 9 aa, Homo Sapiens
SFYPAEITL

SEQ ID NO: 537923 - protein, 9 aa, Homo Sapiens
CVPPPHGPL

SEQ ID NO: 537924 - protein, 9 aa, Homo Sapiens
GLCTLCIAK

SEQ ID NO: 537925 - protein, 9 aa, Homo Sapiens
SGPRKPGQE

SEQ ID NO: 537926 - protein, 9 aa, Homo Sapiens
IGGITLLTL

SEQ ID NO: 537927 - protein, 9 aa, Homo Sapiens
RRPVYARAG

SEQ ID NO: 537928 - protein, 9 aa, Homo Sapiens
SDAGKDLVS

SEQ ID NO: 537929 - protein, 9 aa, Homo Sapiens
YGKPIPRIS

SEQ ID NO: 537930 - protein, 9 aa, Homo Sapiens
LEGPPQQGI

SEQ ID NO: 537931 - protein, 9 aa, Homo Sapiens
GLHRPPFCV

SEQ ID NO: 537932 - protein, 9 aa, Homo Sapiens
QRTIGQTFY

SEQ ID NO: 537933 - protein, 9 aa, Homo Sapiens
IIPSGPRKP

SEQ ID NO: 537934 - protein, 9 aa, Homo Sapiens
GPRKPGQEA

SEQ ID NO: 537935 - protein, 9 aa, Homo Sapiens
FCVPPPHGP

SEQ ID NO: 537936 - protein, 9 aa, Homo Sapiens
PGQEALETS

SEQ ID NO: 537937 - protein, 9 aa, Homo Sapiens
HLSGCRLLF

SEQ ID NO: 537938 - protein, 9 aa, Homo Sapiens
REQDHSLSS

SEQ ID NO: 537939 - protein, 9 aa, Homo Sapiens
QGIGGITLL

SEQ ID NO: 537940 - protein, 9 aa, Homo Sapiens
QGPPGPTGE

SEQ ID NO: 537941 - protein, 9 aa, Homo Sapiens
WDNISDAGK

SEQ ID NO: 537942 - protein, 9 aa, Homo Sapiens
TLRCWALSF

SEQ ID NO: 537943 - protein, 9 aa, Homo Sapiens
IPRISLENV

SEQ ID NO: 537944 - protein, 9 aa, Homo Sapiens
LAANPKTQE

SEQ ID NO: 537945 - protein, 9 aa, Homo Sapiens
GIQGLPGPQ

SEQ ID NO: 537946 - protein, 9 aa, Homo Sapiens
RRRPVYARA

SEQ ID NO: 537947 - protein, 9 aa, Homo Sapiens
PFCVPPPHG

SEQ ID NO: 537948 - protein, 9 aa, Homo Sapiens
PPQQGIGGI

SEQ ID NO: 537949 - protein, 9 aa, Homo Sapiens
TPVTSMTSM

SEQ ID NO: 537950 - protein, 9 aa, Homo Sapiens
LSSSSSASP

SEQ ID NO: 537951 - protein, 9 aa, Homo Sapiens
CWLAANPKT

SEQ ID NO: 537952 - protein, 9 aa, Homo Sapiens
DHSLSSSSS

SEQ ID NO: 537953 - protein, 9 aa, Homo Sapiens
WLNLRYTQV

SEQ ID NO: 537954 - protein, 9 aa, Homo Sapiens
VPSSAHVDK

SEQ ID NO: 537955 - protein, 9 aa, Homo Sapiens
PIPRISLEN

SEQ ID NO: 537956 - protein, 9 aa, Homo Sapiens
GCRLLFLFL

SEQ ID NO: 537957 - protein, 9 aa, Homo Sapiens
GTRDPTRRR

SEQ ID NO: 537958 - protein, 9 aa, Homo Sapiens
TQRAKNGKD

SEQ ID NO: 537959 - protein, 9 aa, Homo Sapiens
IKYGKPIPR

SEQ ID NO: 537960 - protein, 9 aa, Homo Sapiens
LGSGYEQDI

SEQ ID NO: 537961 - protein, 9 aa, Homo Sapiens
VLSHLPSHH

SEQ ID NO: 537962 - protein, 9 aa, Homo Sapiens
QTIWGLHHL

SEQ ID NO: 537963 - protein, 9 aa, Homo Sapiens
FLHALHELR

SEQ ID NO: 537964 - protein, 9 aa, Homo Sapiens
IPGDSDRYH

SEQ ID NO: 537965 - protein, 9 aa, Homo Sapiens
CKEAINVLS

SEQ ID NO: 537966 - protein, 9 aa, Homo Sapiens
DSDRYHEQV

SEQ ID NO: 537967 - protein, 9 aa, Homo Sapiens
FYDIKQSDL

SEQ ID NO: 537968 - protein, 9 aa, Homo Sapiens
EFFYDIKQS

SEQ ID NO: 537969 - protein, 9 aa, Homo Sapiens
KSNRQKIDF

SEQ ID NO: 537970 - protein, 9 aa, Homo Sapiens
QSDLAKKSL

SEQ ID NO: 537971 - protein, 9 aa, Homo Sapiens
VSHRQRLLQ

SEQ ID NO: 537972 - protein, 9 aa, Homo Sapiens
SNRQKIDFS

SEQ ID NO: 537973 - protein, 9 aa, Homo Sapiens
SMLNIYQEF

SEQ ID NO: 537974 - protein, 9 aa, Homo Sapiens
TVSHRQRLL

SEQ ID NO: 537975 - protein, 9 aa, Homo Sapiens
DISGGREIF

SEQ ID NO: 537976 - protein, 9 aa, Homo Sapiens
VKHPAVQML

SEQ ID NO: 537977 - protein, 9 aa, Homo Sapiens
HALHELRLY

SEQ ID NO: 537978 - protein, 9 aa, Homo Sapiens
ISGGREIFK

SEQ ID NO: 537979 - protein, 9 aa, Homo Sapiens
SGGREIFKP

SEQ ID NO: 537980 - protein, 9 aa, Homo Sapiens
EIPGDSDRY

SEQ ID NO: 537981 - protein, 9 aa, Homo Sapiens
FDILLSMLN

SEQ ID NO: 537982 - protein, 9 aa, Homo Sapiens
NNLSKCKLL

SEQ ID NO: 537983 - protein, 9 aa, Homo Sapiens
SFLHALHEL

SEQ ID NO: 537984 - protein, 9 aa, Homo Sapiens
GYEQDIWKA

SEQ ID NO: 537985 - protein, 9 aa, Homo Sapiens
PSQVKHPAV

SEQ ID NO: 537986 - protein, 9 aa, Homo Sapiens
GSGYEQDIW

SEQ ID NO: 537987 - protein, 9 aa, Homo Sapiens
GPNNLSKCK

SEQ ID NO: 537988 - protein, 9 aa, Homo Sapiens
LSKCKLLPA

SEQ ID NO: 537989 - protein, 9 aa, Homo Sapiens
AINVLSHLP

SEQ ID NO: 537990 - protein, 9 aa, Homo Sapiens
IKQSDLAKK

SEQ ID NO: 537991 - protein, 9 aa, Homo Sapiens
IMGVYNRHI

SEQ ID NO: 537992 - protein, 9 aa, Homo Sapiens
TQTIWGLHH

SEQ ID NO: 537993 - protein, 9 aa, Homo Sapiens
SQVKHPAVQ

SEQ ID NO: 537994 - protein, 9 aa, Homo Sapiens
VYIMGVYNR

SEQ ID NO: 537995 - protein, 9 aa, Homo Sapiens
KHPAVQMLF

SEQ ID NO: 537996 - protein, 9 aa, Homo Sapiens
ECWKHLTQT

SEQ ID NO: 537997 - protein, 9 aa, Homo Sapiens
PDISGGREI

SEQ ID NO: 537998 - protein, 9 aa, Homo Sapiens
DIKQSDLAK

SEQ ID NO: 537999 - protein, 9 aa, Homo Sapiens
PSWSPDISG

SEQ ID NO: 538000 - protein, 9 aa, Homo Sapiens
DILLSMLNI

SEQ ID NO: 538001 - protein, 9 aa, Homo Sapiens
SGISEESTT

SEQ ID NO: 538002 - protein, 9 aa, Homo Sapiens
YIMGVYNRH

SEQ ID NO: 538003 - protein, 9 aa, Homo Sapiens
NLSKCKLLP

SEQ ID NO: 538004 - protein, 9 aa, Homo Sapiens
AALGSGYEQ

SEQ ID NO: 538005 - protein, 9 aa, Homo Sapiens
EEFFYDIKQ

SEQ ID NO: 538006 - protein, 9 aa, Homo Sapiens
TLKSNRQKI

SEQ ID NO: 538007 - protein, 9 aa, Homo Sapiens
FIVVIILKM

SEQ ID NO: 538008 - protein, 9 aa, Homo Sapiens
LHELRLYQT

SEQ ID NO: 538009 - protein, 9 aa, Homo Sapiens
EAINVLSHL

SEQ ID NO: 538010 - protein, 9 aa, Homo Sapiens
CKLLPAVRA

SEQ ID NO: 538011 - protein, 9 aa, Homo Sapiens
KGPNNLSKC

SEQ ID NO: 538012 - protein, 9 aa, Homo Sapiens
DKRVYIMGV

SEQ ID NO: 538013 - protein, 9 aa, Homo Sapiens
RVYIMGVYN

SEQ ID NO: 538014 - protein, 9 aa, Homo Sapiens
LITVITQTV

SEQ ID NO: 538015 - protein, 9 aa, Homo Sapiens
YNCKEAINV

SEQ ID NO: 538016 - protein, 9 aa, Homo Sapiens
FFYDIKQSD

SEQ ID NO: 538017 - protein, 9 aa, Homo Sapiens
GPSQVKHPA

SEQ ID NO: 538018 - protein, 9 aa, Homo Sapiens
VVIILKMRS

SEQ ID NO: 538019 - protein, 9 aa, Homo Sapiens
WKHLTQTIW

SEQ ID NO: 538020 - protein, 9 aa, Homo Sapiens
SPDISGGRE

SEQ ID NO: 538021 - protein, 9 aa, Homo Sapiens
ISEESTTSR

SEQ ID NO: 538022 - protein, 9 aa, Homo Sapiens
SYAFIVVII

SEQ ID NO: 538023 - protein, 9 aa, Homo Sapiens
TTSSGISEE

SEQ ID NO: 538024 - protein, 9 aa, Homo Sapiens
TSSGISEES

SEQ ID NO: 538025 - protein, 9 aa, Homo Sapiens
ASEIPGDSD

SEQ ID NO: 538026 - protein, 9 aa, Homo Sapiens
LLSMLNIYQ

SEQ ID NO: 538027 - protein, 9 aa, Homo Sapiens
SKCKLLPAV

SEQ ID NO: 538028 - protein, 9 aa, Homo Sapiens
ALHELRLYQ

SEQ ID NO: 538029 - protein, 9 aa, Homo Sapiens
YEQDIWKAG

SEQ ID NO: 538030 - protein, 9 aa, Homo Sapiens
TVITQTVSH

SEQ ID NO: 538031 - protein, 9 aa, Homo Sapiens
QKIDFSKKL

SEQ ID NO: 538032 - protein, 9 aa, Homo Sapiens
IDFSKKLRM

SEQ ID NO: 538033 - protein, 9 aa, Homo Sapiens
GDSDRYHEQ

SEQ ID NO: 538034 - protein, 9 aa, Homo Sapiens
CWKHLTQTI

SEQ ID NO: 538035 - protein, 9 aa, Homo Sapiens
KEAINVLSH

SEQ ID NO: 538036 - protein, 9 aa, Homo Sapiens
ALGSGYEQD

SEQ ID NO: 538037 - protein, 9 aa, Homo Sapiens
YDIKQSDLA

SEQ ID NO: 538038 - protein, 9 aa, Homo Sapiens
ADLFDILLS

SEQ ID NO: 538039 - protein, 9 aa, Homo Sapiens
RQKIDFSKK

SEQ ID NO: 538040 - protein, 9 aa, Homo Sapiens
INVLSHLPS

SEQ ID NO: 538041 - protein, 9 aa, Homo Sapiens
GGREIFKPR

SEQ ID NO: 538042 - protein, 9 aa, Homo Sapiens
EQDIWKAGP

SEQ ID NO: 538043 - protein, 9 aa, Homo Sapiens
WSPDISGGR

SEQ ID NO: 538044 - protein, 9 aa, Homo Sapiens
LHALHELRL

SEQ ID NO: 538045 - protein, 9 aa, Homo Sapiens
LFDILLSML

SEQ ID NO: 538046 - protein, 9 aa, Homo Sapiens
PNNLSKCKL

SEQ ID NO: 538047 - protein, 9 aa, Homo Sapiens
IILKMRSVS

SEQ ID NO: 538048 - protein, 9 aa, Homo Sapiens
TQTVSHRQR

SEQ ID NO: 538049 - protein, 9 aa, Homo Sapiens
YGPSQVKHP

SEQ ID NO: 538050 - protein, 9 aa, Homo Sapiens
VIILKMRSV

SEQ ID NO: 538051 - protein, 9 aa, Homo Sapiens
TIWGLHHLE

SEQ ID NO: 538052 - protein, 9 aa, Homo Sapiens
IVVIILKMR

SEQ ID NO: 538053 - protein, 9 aa, Homo Sapiens
SGYEQDIWK

SEQ ID NO: 538054 - protein, 9 aa, Homo Sapiens
QTVSHRQRL

SEQ ID NO: 538055 - protein, 9 aa, Homo Sapiens
HLTQTIWGL

SEQ ID NO: 538056 - protein, 9 aa, Homo Sapiens
HELRLYQTD

SEQ ID NO: 538057 - protein, 9 aa, Homo Sapiens
SSGISEEST

SEQ ID NO: 538058 - protein, 9 aa, Homo Sapiens
ITQTVSHRQ

SEQ ID NO: 538059 - protein, 9 aa, Homo Sapiens
YAFIVVIIL

SEQ ID NO: 538060 - protein, 9 aa, Homo Sapiens
VVSFLHALH

SEQ ID NO: 538061 - protein, 9 aa, Homo Sapiens
SEIPGDSDR

SEQ ID NO: 538062 - protein, 9 aa, Homo Sapiens
QVKHPAVQM

SEQ ID NO: 538063 - protein, 9 aa, Homo Sapiens
PGDSDRYHE

SEQ ID NO: 538064 - protein, 9 aa, Homo Sapiens
NRQKIDFSK

SEQ ID NO: 538065 - protein, 9 aa, Homo Sapiens
GVYNRHIYP

SEQ ID NO: 538066 - protein, 9 aa, Homo Sapiens
KHLTQTIWG

SEQ ID NO: 538067 - protein, 9 aa, Homo Sapiens
SWSPDISGG

SEQ ID NO: 538068 - protein, 9 aa, Homo Sapiens
LSMLNIYQE

SEQ ID NO: 538069 - protein, 9 aa, Homo Sapiens
NCKEAINVL

SEQ ID NO: 538070 - protein, 9 aa, Homo Sapiens
KRVYIMGVY

SEQ ID NO: 538071 - protein, 9 aa, Homo Sapiens
DDKRVYIMG

SEQ ID NO: 538072 - protein, 9 aa, Homo Sapiens
MGVYNRHIY

SEQ ID NO: 538073 - protein, 9 aa, Homo Sapiens
LTQTIWGLH

SEQ ID NO: 538074 - protein, 9 aa, Homo Sapiens
AFIVVIILK

SEQ ID NO: 538075 - protein, 9 aa, Homo Sapiens
QDIWKAGPG

SEQ ID NO: 538076 - protein, 9 aa, Homo Sapiens
AYGPSQVKH

SEQ ID NO: 538077 - protein, 9 aa, Homo Sapiens
KIDFSKKLR

SEQ ID NO: 538078 - protein, 9 aa, Homo Sapiens
DLFDILLSM

SEQ ID NO: 538079 - protein, 9 aa, Homo Sapiens
PASTTSSGI

SEQ ID NO: 538080 - protein, 9 aa, Homo Sapiens
STTSSGISE

SEQ ID NO: 538081 - protein, 9 aa, Homo Sapiens
GISEESTTS

SEQ ID NO: 538082 - protein, 9 aa, Homo Sapiens
LKSNRQKID

SEQ ID NO: 538083 - protein, 9 aa, Homo Sapiens
ASTTSSGIS

SEQ ID NO: 538084 - protein, 9 aa, Homo Sapiens
TSYAFIVVI

SEQ ID NO: 538085 - protein, 9 aa, Homo Sapiens
HPAVQMLFH

SEQ ID NO: 538086 - protein, 9 aa, Homo Sapiens
KQSDLAKKS

SEQ ID NO: 538087 - protein, 9 aa, Homo Sapiens
ITVITQTVS

SEQ ID NO: 538088 - protein, 9 aa, Homo Sapiens
ILLSMLNIY

SEQ ID NO: 538089 - protein, 9 aa, Homo Sapiens
NVLSHLPSH

SEQ ID NO: 538090 - protein, 9 aa, Homo Sapiens
VITQTVSHR

SEQ ID NO: 538091 - protein, 9 aa, Homo Sapiens
VSFLHALHE

SEQ ID NO: 538092 - protein, 9 aa, Homo Sapiens
KCKLLPAVR

SEQ ID NO: 538093 - protein, 9 aa, Homo Sapiens
GSMGPHGPA

SEQ ID NO: 538094 - protein, 9 aa, Homo Sapiens
GNKKLEKES

SEQ ID NO: 538095 - protein, 9 aa, Homo Sapiens
VLSHLPSHH

SEQ ID NO: 538096 - protein, 9 aa, Homo Sapiens
GMLKLYFRE

SEQ ID NO: 538097 - protein, 9 aa, Homo Sapiens
EIIYAITFV

SEQ ID NO: 538098 - protein, 9 aa, Homo Sapiens
PGSMGPHGD

SEQ ID NO: 538099 - protein, 9 aa, Homo Sapiens
CKEAINVLS

SEQ ID NO: 538100 - protein, 9 aa, Homo Sapiens
PDRSSQEKR

SEQ ID NO: 538101 - protein, 9 aa, Homo Sapiens
RSSQEKRKT

SEQ ID NO: 538102 - protein, 9 aa, Homo Sapiens
EVLPHTGLS

SEQ ID NO: 538103 - protein, 9 aa, Homo Sapiens
AESAAFKHL

SEQ ID NO: 538104 - protein, 9 aa, Homo Sapiens
MLQNVSAGL

SEQ ID NO: 538105 - protein, 9 aa, Homo Sapiens
FLSVKEDAP

SEQ ID NO: 538106 - protein, 9 aa, Homo Sapiens
YAITFVILA

SEQ ID NO: 538107 - protein, 9 aa, Homo Sapiens
IKNENKRSS

SEQ ID NO: 538108 - protein, 9 aa, Homo Sapiens
RARQLSPQL

SEQ ID NO: 538109 - protein, 9 aa, Homo Sapiens
AETLVIETR

SEQ ID NO: 538110 - protein, 9 aa, Homo Sapiens
EQHEIKNEN

SEQ ID NO: 538111 - protein, 9 aa, Homo Sapiens
GCNSLGHLS

SEQ ID NO: 538112 - protein, 9 aa, Homo Sapiens
IAGMLKLYF

SEQ ID NO: 538113 - protein, 9 aa, Homo Sapiens
SPDPKSFAE

SEQ ID NO: 538114 - protein, 9 aa, Homo Sapiens
TFCMLILAI

SEQ ID NO: 538115 - protein, 9 aa, Homo Sapiens
REWEFQKCG

SEQ ID NO: 538116 - protein, 9 aa, Homo Sapiens
ITTLFLSVK

SEQ ID NO: 538117 - protein, 9 aa, Homo Sapiens
SHVAGGRVS

SEQ ID NO: 538118 - protein, 9 aa, Homo Sapiens
GEARARQLS

SEQ ID NO: 538119 - protein, 9 aa, Homo Sapiens
QYDQFIPSE

SEQ ID NO: 538120 - protein, 9 aa, Homo Sapiens
GGYCAPAAL

SEQ ID NO: 538121 - protein, 9 aa, Homo Sapiens
GPVPLRVHC

SEQ ID NO: 538122 - protein, 9 aa, Homo Sapiens
SGLFGQVFR

SEQ ID NO: 538123 - protein, 9 aa, Homo Sapiens
CAPAALWRS

SEQ ID NO: 538124 - protein, 9 aa, Homo Sapiens
IYAITFVIL

SEQ ID NO: 538125 - protein, 9 aa, Homo Sapiens
HWGRVRSSH

SEQ ID NO: 538126 - protein, 9 aa, Homo Sapiens
ITSPDPKSF

SEQ ID NO: 538127 - protein, 9 aa, Homo Sapiens
AIAGMLKLY

SEQ ID NO: 538128 - protein, 9 aa, Homo Sapiens
HVAGGRVSQ

SEQ ID NO: 538129 - protein, 9 aa, Homo Sapiens
DCIMLQNVS

SEQ ID NO: 538130 - protein, 9 aa, Homo Sapiens
MLMDKEKKG

SEQ ID NO: 538131 - protein, 9 aa, Homo Sapiens
PQCDCIMLQ

SEQ ID NO: 538132 - protein, 9 aa, Homo Sapiens
LVIETRDKE

SEQ ID NO: 538133 - protein, 9 aa, Homo Sapiens
YDQFIPSEE

SEQ ID NO: 538134 - protein, 9 aa, Homo Sapiens
VSQQPRQAE

SEQ ID NO: 538135 - protein, 9 aa, Homo Sapiens
TMDSVRSGL

SEQ ID NO: 538136 - protein, 9 aa, Homo Sapiens
ELLIGDPIT

SEQ ID NO: 538137 - protein, 9 aa, Homo Sapiens
AINVLSHLP

SEQ ID NO: 538138 - protein, 9 aa, Homo Sapiens
DPKSFAERK

SEQ ID NO: 538139 - protein, 9 aa, Homo Sapiens
RSSHVAGGR

SEQ ID NO: 538140 - protein, 9 aa, Homo Sapiens
ESPRRHHNR

SEQ ID NO: 538141 - protein, 9 aa, Homo Sapiens
HEIKNENKR

SEQ ID NO: 538142 - protein, 9 aa, Homo Sapiens
YATVLTFCM

SEQ ID NO: 538143 - protein, 9 aa, Homo Sapiens
SVKEDAPLS

SEQ ID NO: 538144 - protein, 9 aa, Homo Sapiens
EKRKTGVQR

SEQ ID NO: 538145 - protein, 9 aa, Homo Sapiens
PVPLRVHCP

SEQ ID NO: 538146 - protein, 9 aa, Homo Sapiens
LPDRSSQEK

SEQ ID NO: 538147 - protein, 9 aa, Homo Sapiens
SASPGGYCA

SEQ ID NO: 538148 - protein, 9 aa, Homo Sapiens
QPRQAEVLP

SEQ ID NO: 538149 - protein, 9 aa, Homo Sapiens
LTFCMLILA

SEQ ID NO: 538150 - protein, 9 aa, Homo Sapiens
RQAEVLPHT

SEQ ID NO: 538151 - protein, 9 aa, Homo Sapiens
HQYDQFIPS

SEQ ID NO: 538152 - protein, 9 aa, Homo Sapiens
TSASPGGYC

SEQ ID NO: 538153 - protein, 9 aa, Homo Sapiens
RCPQCDCIM

SEQ ID NO: 538154 - protein, 9 aa, Homo Sapiens
LRPAGPVPL

SEQ ID NO: 538155 - protein, 9 aa, Homo Sapiens
GLFGQVFRP

SEQ ID NO: 538156 - protein, 9 aa, Homo Sapiens
TFVILASVS

SEQ ID NO: 538157 - protein, 9 aa, Homo Sapiens
ILLAMLMDK

SEQ ID NO: 538158 - protein, 9 aa, Homo Sapiens
LGNKKLEKE

SEQ ID NO: 538159 - protein, 9 aa, Homo Sapiens
MGPHGDTGP

SEQ ID NO: 538160 - protein, 9 aa, Homo Sapiens
ETRDKEDSS

SEQ ID NO: 538161 - protein, 9 aa, Homo Sapiens
TLVIETRDK

SEQ ID NO: 538162 - protein, 9 aa, Homo Sapiens
RSGLFGQVF

SEQ ID NO: 538163 - protein, 9 aa, Homo Sapiens
GYCAPAALW

SEQ ID NO: 538164 - protein, 9 aa, Homo Sapiens
AGMLKLYFR

SEQ ID NO: 538165 - protein, 9 aa, Homo Sapiens
SLGHLSRKT

SEQ ID NO: 538166 - protein, 9 aa, Homo Sapiens
RHHNRGSPH

SEQ ID NO: 538167 - protein, 9 aa, Homo Sapiens
ETLVIETRD

SEQ ID NO: 538168 - protein, 9 aa, Homo Sapiens
MDSVRSGLF

SEQ ID NO: 538169 - protein, 9 aa, Homo Sapiens
ENKRSSTVD

SEQ ID NO: 538170 - protein, 9 aa, Homo Sapiens
EILLAMLMD

SEQ ID NO: 538171 - protein, 9 aa, Homo Sapiens
MDVNAIAGM

SEQ ID NO: 538172 - protein, 9 aa, Homo Sapiens
PGGYCAPAA

SEQ ID NO: 538173 - protein, 9 aa, Homo Sapiens
EAINVLSHL

SEQ ID NO: 538174 - protein, 9 aa, Homo Sapiens
HAETLVIET

SEQ ID NO: 538175 - protein, 9 aa, Homo Sapiens
VHFPLSSCG

SEQ ID NO: 538176 - protein, 9 aa, Homo Sapiens
HFPLSSCGW

SEQ ID NO: 538177 - protein, 9 aa, Homo Sapiens
KSFAERKLD

SEQ ID NO: 538178 - protein, 9 aa, Homo Sapiens
LFGQVFRPD

SEQ ID NO: 538179 - protein, 9 aa, Homo Sapiens
HNRGSPHLK

SEQ ID NO: 538180 - protein, 9 aa, Homo Sapiens
IIYAITFVI

SEQ ID NO: 538181 - protein, 9 aa, Homo Sapiens
IPSEENMDL

SEQ ID NO: 538182 - protein, 9 aa, Homo Sapiens
VIETRDKED

SEQ ID NO: 538183 - protein, 9 aa, Homo Sapiens
YNCKEAINV

SEQ ID NO: 538184 - protein, 9 aa, Homo Sapiens
ALRPAGPVP

SEQ ID NO: 538185 - protein, 9 aa, Homo Sapiens
HLFRTWSEK

SEQ ID NO: 538186 - protein, 9 aa, Homo Sapiens
SVRSGLFGQ

SEQ ID NO: 538187 - protein, 9 aa, Homo Sapiens
SAAFKHLFR

SEQ ID NO: 538188 - protein, 9 aa, Homo Sapiens
VHQYDQFIP

SEQ ID NO: 538189 - protein, 9 aa, Homo Sapiens
MDKEKKGYV

SEQ ID NO: 538190 - protein, 9 aa, Homo Sapiens
GAESAAFKH

SEQ ID NO: 538191 - protein, 9 aa, Homo Sapiens
MAVHFPLSS

SEQ ID NO: 538192 - protein, 9 aa, Homo Sapiens
ENSEGEQQL

SEQ ID NO: 538193 - protein, 9 aa, Homo Sapiens
TRDKEDSSW

SEQ ID NO: 538194 - protein, 9 aa, Homo Sapiens
MRLTENSEG

SEQ ID NO: 538195 - protein, 9 aa, Homo Sapiens
FIPSEENMD

SEQ ID NO: 538196 - protein, 9 aa, Homo Sapiens
DNGNIELGN

SEQ ID NO: 538197 - protein, 9 aa, Homo Sapiens
IETRDKEDS

SEQ ID NO: 538198 - protein, 9 aa, Homo Sapiens
KDNGNIELG

SEQ ID NO: 538199 - protein, 9 aa, Homo Sapiens
ESAAFKHLF

SEQ ID NO: 538200 - protein, 9 aa, Homo Sapiens
ASPGGYCAP

SEQ ID NO: 538201 - protein, 9 aa, Homo Sapiens
QFIPSEENM

SEQ ID NO: 538202 - protein, 9 aa, Homo Sapiens
DQFIPSEEN

SEQ ID NO: 538203 - protein, 9 aa, Homo Sapiens
VPLRVHCPS

SEQ ID NO: 538204 - protein, 9 aa, Homo Sapiens
KNENKRSST

SEQ ID NO: 538205 - protein, 9 aa, Homo Sapiens
KHLFRTWSE

SEQ ID NO: 538206 - protein, 9 aa, Homo Sapiens
ATVLTFCML

SEQ ID NO: 538207 - protein, 9 aa, Homo Sapiens
AITTLFLSV

SEQ ID NO: 538208 - protein, 9 aa, Homo Sapiens
CMLILAILH

SEQ ID NO: 538209 - protein, 9 aa, Homo Sapiens
CIMLQNVSA

SEQ ID NO: 538210 - protein, 9 aa, Homo Sapiens
LTENSEGEQ

SEQ ID NO: 538211 - protein, 9 aa, Homo Sapiens
TDGSMGPHG

SEQ ID NO: 538212 - protein, 9 aa, Homo Sapiens
QQPRQAEVL

SEQ ID NO: 538213 - protein, 9 aa, Homo Sapiens
NIELGNKKL

SEQ ID NO: 538214 - protein, 9 aa, Homo Sapiens
IELGNKKLE

SEQ ID NO: 538215 - protein, 9 aa, Homo Sapiens
WGRVRSSHV

SEQ ID NO: 538216 - protein, 9 aa, Homo Sapiens
VNAIAGMLK

SEQ ID NO: 538217 - protein, 9 aa, Homo Sapiens
QAEVLPHTG

SEQ ID NO: 538218 - protein, 9 aa, Homo Sapiens
TTLFLSVKE

SEQ ID NO: 538219 - protein, 9 aa, Homo Sapiens
AITFVILAS

SEQ ID NO: 538220 - protein, 9 aa, Homo Sapiens
KVHQYDQFI

SEQ ID NO: 538221 - protein, 9 aa, Homo Sapiens
GPHGDTGPA

SEQ ID NO: 538222 - protein, 9 aa, Homo Sapiens
TLFLSVKED

SEQ ID NO: 538223 - protein, 9 aa, Homo Sapiens
AVHFPLSSC

SEQ ID NO: 538224 - protein, 9 aa, Homo Sapiens
NRGSPHLKA

SEQ ID NO: 538225 - protein, 9 aa, Homo Sapiens
PHGDTGPAG

SEQ ID NO: 538226 - protein, 9 aa, Homo Sapiens
LAMLMDKEK

SEQ ID NO: 538227 - protein, 9 aa, Homo Sapiens
FCMLILAIL

SEQ ID NO: 538228 - protein, 9 aa, Homo Sapiens
RGSPHLKAK

SEQ ID NO: 538229 - protein, 9 aa, Homo Sapiens
ELGNKKLEK

SEQ ID NO: 538230 - protein, 9 aa, Homo Sapiens
FKHLFRTWS

SEQ ID NO: 538231 - protein, 9 aa, Homo Sapiens
SMGPHGPAG

SEQ ID NO: 538232 - protein, 9 aa, Homo Sapiens
PKGTDGSMG

SEQ ID NO: 538233 - protein, 9 aa, Homo Sapiens
TVLTFCMLI

SEQ ID NO: 538234 - protein, 9 aa, Homo Sapiens
QCDCIMLQN

SEQ ID NO: 538235 - protein, 9 aa, Homo Sapiens
PKSFAERKL

SEQ ID NO: 538236 - protein, 9 aa, Homo Sapiens
NREWEFQKC

SEQ ID NO: 538237 - protein, 9 aa, Homo Sapiens
SPRRHHNRG

SEQ ID NO: 538238 - protein, 9 aa, Homo Sapiens
INVLSHLPS

SEQ ID NO: 538239 - protein, 9 aa, Homo Sapiens
ITFVILASV

SEQ ID NO: 538240 - protein, 9 aa, Homo Sapiens
DVNAIAGML

SEQ ID NO: 538241 - protein, 9 aa, Homo Sapiens
FAERKLDSD

SEQ ID NO: 538242 - protein, 9 aa, Homo Sapiens
LLPDRSSQE

SEQ ID NO: 538243 - protein, 9 aa, Homo Sapiens
GRVRSSHVA

SEQ ID NO: 538244 - protein, 9 aa, Homo Sapiens
PRQAEVLPH

SEQ ID NO: 538245 - protein, 9 aa, Homo Sapiens
SQQPRQAEV

SEQ ID NO: 538246 - protein, 9 aa, Homo Sapiens
EARARQLSP

SEQ ID NO: 538247 - protein, 9 aa, Homo Sapiens
KGTDGSMGP

SEQ ID NO: 538248 - protein, 9 aa, Homo Sapiens
RRHHNRGSP

SEQ ID NO: 538249 - protein, 9 aa, Homo Sapiens
CNSLGHLSR

SEQ ID NO: 538250 - protein, 9 aa, Homo Sapiens
TSPDPKSFA

SEQ ID NO: 538251 - protein, 9 aa, Homo Sapiens
SCGEARARQ

SEQ ID NO: 538252 - protein, 9 aa, Homo Sapiens
MELLIGDPI

SEQ ID NO: 538253 - protein, 9 aa, Homo Sapiens
AAFKHLFRT

SEQ ID NO: 538254 - protein, 9 aa, Homo Sapiens
AMLMDKEKK

SEQ ID NO: 538255 - protein, 9 aa, Homo Sapiens
QEKRKTGVQ

SEQ ID NO: 538256 - protein, 9 aa, Homo Sapiens
NSEGEQQLK

SEQ ID NO: 538257 - protein, 9 aa, Homo Sapiens
LSVKEDAPL

SEQ ID NO: 538258 - protein, 9 aa, Homo Sapiens
PDPKSFAER

SEQ ID NO: 538259 - protein, 9 aa, Homo Sapiens
GPKGTDGSM

SEQ ID NO: 538260 - protein, 9 aa, Homo Sapiens
VLTFCMLIL

SEQ ID NO: 538261 - protein, 9 aa, Homo Sapiens
NENKRSSTV

SEQ ID NO: 538262 - protein, 9 aa, Homo Sapiens
PRRHHNRGS

SEQ ID NO: 538263 - protein, 9 aa, Homo Sapiens
CPQCDCIML

SEQ ID NO: 538264 - protein, 9 aa, Homo Sapiens
SPGGYCAPA

SEQ ID NO: 538265 - protein, 9 aa, Homo Sapiens
GSPGSMGPH

SEQ ID NO: 538266 - protein, 9 aa, Homo Sapiens
IMLQNVSAG

SEQ ID NO: 538267 - protein, 9 aa, Homo Sapiens
YCAPAALWR

SEQ ID NO: 538268 - protein, 9 aa, Homo Sapiens
LMDKEKKGY

SEQ ID NO: 538269 - protein, 9 aa, Homo Sapiens
IEIIYAITF

SEQ ID NO: 538270 - protein, 9 aa, Homo Sapiens
QALRPAGPV

SEQ ID NO: 538271 - protein, 9 aa, Homo Sapiens
NAIAGMLKL

SEQ ID NO: 538272 - protein, 9 aa, Homo Sapiens
CDCIMLQNV

SEQ ID NO: 538273 - protein, 9 aa, Homo Sapiens
HHNRGSPHL

SEQ ID NO: 538274 - protein, 9 aa, Homo Sapiens
GTDGSMGPH

SEQ ID NO: 538275 - protein, 9 aa, Homo Sapiens
HGDTGPAGP

SEQ ID NO: 538276 - protein, 9 aa, Homo Sapiens
ARARQLSPQ

SEQ ID NO: 538277 - protein, 9 aa, Homo Sapiens
ARQLSPQLG

SEQ ID NO: 538278 - protein, 9 aa, Homo Sapiens
GNIELGNKK

SEQ ID NO: 538279 - protein, 9 aa, Homo Sapiens
DRSSQEKRK

SEQ ID NO: 538280 - protein, 9 aa, Homo Sapiens
RLTENSEGE

SEQ ID NO: 538281 - protein, 9 aa, Homo Sapiens
RVRSSHVAG

SEQ ID NO: 538282 - protein, 9 aa, Homo Sapiens
RPAGPVPLR

SEQ ID NO: 538283 - protein, 9 aa, Homo Sapiens
NKRSSTVDG

SEQ ID NO: 538284 - protein, 9 aa, Homo Sapiens
DGSMGPHGP

SEQ ID NO: 538285 - protein, 9 aa, Homo Sapiens
NGNIELGNK

SEQ ID NO: 538286 - protein, 9 aa, Homo Sapiens
EIKNENKRS

SEQ ID NO: 538287 - protein, 9 aa, Homo Sapiens
LLAMLMDKE

SEQ ID NO: 538288 - protein, 9 aa, Homo Sapiens
AGPVPLRVH

SEQ ID NO: 538289 - protein, 9 aa, Homo Sapiens
LLIGDPITT

SEQ ID NO: 538290 - protein, 9 aa, Homo Sapiens
NCKEAINVL

SEQ ID NO: 538291 - protein, 9 aa, Homo Sapiens
VRSGLFGQV

SEQ ID NO: 538292 - protein, 9 aa, Homo Sapiens
LFLSVKEDA

SEQ ID NO: 538293 - protein, 9 aa, Homo Sapiens
PGPKGTDGS

SEQ ID NO: 538294 - protein, 9 aa, Homo Sapiens
TENSEGEQQ

SEQ ID NO: 538295 - protein, 9 aa, Homo Sapiens
SSQEKRKTG

SEQ ID NO: 538296 - protein, 9 aa, Homo Sapiens
VRSSHVAGG

SEQ ID NO: 538297 - protein, 9 aa, Homo Sapiens
MLKLYFREL

SEQ ID NO: 538298 - protein, 9 aa, Homo Sapiens
SPGSMGPHG

SEQ ID NO: 538299 - protein, 9 aa, Homo Sapiens
GSMGPHGDT

SEQ ID NO: 538300 - protein, 9 aa, Homo Sapiens
QHEIKNENK

SEQ ID NO: 538301 - protein, 9 aa, Homo Sapiens
RQLSPQLGP

SEQ ID NO: 538302 - protein, 9 aa, Homo Sapiens
AEVLPHTGL

SEQ ID NO: 538303 - protein, 9 aa, Homo Sapiens
SSHVAGGRV

SEQ ID NO: 538304 - protein, 9 aa, Homo Sapiens
KEAINVLSH

SEQ ID NO: 538305 - protein, 9 aa, Homo Sapiens
NSLGHLSRK

SEQ ID NO: 538306 - protein, 9 aa, Homo Sapiens
AFKHLFRTW

SEQ ID NO: 538307 - protein, 9 aa, Homo Sapiens
CGEARARQL

SEQ ID NO: 538308 - protein, 9 aa, Homo Sapiens
PAGPVPLRV

SEQ ID NO: 538309 - protein, 9 aa, Homo Sapiens
SMGPHGDTG

SEQ ID NO: 538310 - protein, 9 aa, Homo Sapiens
EWEFQKCGH

SEQ ID NO: 538311 - protein, 9 aa, Homo Sapiens
SQEKRKTGV

SEQ ID NO: 538312 - protein, 9 aa, Homo Sapiens
SFAERKLDS

SEQ ID NO: 538313 - protein, 9 aa, Homo Sapiens
NVLSHLPSH

SEQ ID NO: 538314 - protein, 9 aa, Homo Sapiens
DSVRSGLFG

SEQ ID NO: 538315 - protein, 9 aa, Homo Sapiens
RSCGEARAR

SEQ ID NO: 538316 - protein, 9 aa, Homo Sapiens
MAITTLFLS

SEQ ID NO: 538317 - protein, 9 aa, Homo Sapiens
FVILASVSV

SEQ ID NO: 538318 - protein, 9 aa, Homo Sapiens
MLILAILHH

SEQ ID NO: 538319 - protein, 9 aa, Homo Sapiens
SAWPCSGPS

SEQ ID NO: 538320 - protein, 9 aa, Homo Sapiens
LRWGAGYSS

SEQ ID NO: 538321 - protein, 9 aa, Homo Sapiens
SQCRSAWWC

SEQ ID NO: 538322 - protein, 9 aa, Homo Sapiens
LRMNIKSKT

SEQ ID NO: 538323 - protein, 9 aa, Homo Sapiens
GPPGLLYIP

SEQ ID NO: 538324 - protein, 9 aa, Homo Sapiens
AARNEEESG

SEQ ID NO: 538325 - protein, 9 aa, Homo Sapiens
LEGETARFH

SEQ ID NO: 538326 - protein, 9 aa, Homo Sapiens
NEEESGCRE

SEQ ID NO: 538327 - protein, 9 aa, Homo Sapiens
WVDFFVPKF

SEQ ID NO: 538328 - protein, 9 aa, Homo Sapiens
RFHCRVTGY

SEQ ID NO: 538329 - protein, 9 aa, Homo Sapiens
ITMAARNEE

SEQ ID NO: 538330 - protein, 9 aa, Homo Sapiens
WSDSGVSSS

SEQ ID NO: 538331 - protein, 9 aa, Homo Sapiens
WGAGYSSED

SEQ ID NO: 538332 - protein, 9 aa, Homo Sapiens
QWRLKDQDQ

SEQ ID NO: 538333 - protein, 9 aa, Homo Sapiens
SRSFSSTLV

SEQ ID NO: 538334 - protein, 9 aa, Homo Sapiens
SLQIPVSRS

SEQ ID NO: 538335 - protein, 9 aa, Homo Sapiens
KINLTNGSN

SEQ ID NO: 538336 - protein, 9 aa, Homo Sapiens
TGIMSTTSF

SEQ ID NO: 538337 - protein, 9 aa, Homo Sapiens
FTCTSSLLQ

SEQ ID NO: 538338 - protein, 9 aa, Homo Sapiens
DSMCFFPEG

SEQ ID NO: 538339 - protein, 9 aa, Homo Sapiens
LLRYHQKHL

SEQ ID NO: 538340 - protein, 9 aa, Homo Sapiens
LRYHQKHLR

SEQ ID NO: 538341 - protein, 9 aa, Homo Sapiens
ECGKAFTCT

SEQ ID NO: 538342 - protein, 9 aa, Homo Sapiens
SATTENRGG

SEQ ID NO: 538343 - protein, 9 aa, Homo Sapiens
YFVVSATTE

SEQ ID NO: 538344 - protein, 9 aa, Homo Sapiens
LQKGWVDFF

SEQ ID NO: 538345 - protein, 9 aa, Homo Sapiens
ETARFHCRV

SEQ ID NO: 538346 - protein, 9 aa, Homo Sapiens
RPCSCSAWP

SEQ ID NO: 538347 - protein, 9 aa, Homo Sapiens
HHPDVTSRR

SEQ ID NO: 538348 - protein, 9 aa, Homo Sapiens
DSGVSSSSG

SEQ ID NO: 538349 - protein, 9 aa, Homo Sapiens
RPAGAVGPE

SEQ ID NO: 538350 - protein, 9 aa, Homo Sapiens
IFKSQIEKI

SEQ ID NO: 538351 - protein, 9 aa, Homo Sapiens
CGKAFTCTS

SEQ ID NO: 538352 - protein, 9 aa, Homo Sapiens
CPQLPPWPS

SEQ ID NO: 538353 - protein, 9 aa, Homo Sapiens
SEEASWSDS

SEQ ID NO: 538354 - protein, 9 aa, Homo Sapiens
IKCLDSMCF

SEQ ID NO: 538355 - protein, 9 aa, Homo Sapiens
PCSCSAWPC

SEQ ID NO: 538356 - protein, 9 aa, Homo Sapiens
CTCSRPCSC

SEQ ID NO: 538357 - protein, 9 aa, Homo Sapiens
QGLLLSDLR

SEQ ID NO: 538358 - protein, 9 aa, Homo Sapiens
DIFPEGWDK

SEQ ID NO: 538359 - protein, 9 aa, Homo Sapiens
PWPSPSSSS

SEQ ID NO: 538360 - protein, 9 aa, Homo Sapiens
KSEEASWSD

SEQ ID NO: 538361 - protein, 9 aa, Homo Sapiens
VTSRRSGPS

SEQ ID NO: 538362 - protein, 9 aa, Homo Sapiens
SSLQIPVSR

SEQ ID NO: 538363 - protein, 9 aa, Homo Sapiens
VAFMVLSPA

SEQ ID NO: 538364 - protein, 9 aa, Homo Sapiens
HQKHLRMNI

SEQ ID NO: 538365 - protein, 9 aa, Homo Sapiens
ARNEEESGC

SEQ ID NO: 538366 - protein, 9 aa, Homo Sapiens
GPSCPQLPP

SEQ ID NO: 538367 - protein, 9 aa, Homo Sapiens
ASWSDSGVS

SEQ ID NO: 538368 - protein, 9 aa, Homo Sapiens
PSCPQLPPW

SEQ ID NO: 538369 - protein, 9 aa, Homo Sapiens
SLLRYHQKH

SEQ ID NO: 538370 - protein, 9 aa, Homo Sapiens
AVGPEPKDQ

SEQ ID NO: 538371 - protein, 9 aa, Homo Sapiens
HCRVTGYPQ

SEQ ID NO: 538372 - protein, 9 aa, Homo Sapiens
VVSATTENR

SEQ ID NO: 538373 - protein, 9 aa, Homo Sapiens
PGLLYIPHL

SEQ ID NO: 538374 - protein, 9 aa, Homo Sapiens
RNEEESGCR

SEQ ID NO: 538375 - protein, 9 aa, Homo Sapiens
HPDVTSRRS

SEQ ID NO: 538376 - protein, 9 aa, Homo Sapiens
QQWRLKDQD

SEQ ID NO: 538377 - protein, 9 aa, Homo Sapiens
IPHLLLCLL

SEQ ID NO: 538378 - protein, 9 aa, Homo Sapiens
HPHAFYQVH

SEQ ID NO: 538379 - protein, 9 aa, Homo Sapiens
SDLRRLRTE

SEQ ID NO: 538380 - protein, 9 aa, Homo Sapiens
PKHHPDVTS

SEQ ID NO: 538381 - protein, 9 aa, Homo Sapiens
MNIKSKTCI

SEQ ID NO: 538382 - protein, 9 aa, Homo Sapiens
KIFKSQIEK

SEQ ID NO: 538383 - protein, 9 aa, Homo Sapiens
GLLYIPHLL

SEQ ID NO: 538384 - protein, 9 aa, Homo Sapiens
GKAFTCTSS

SEQ ID NO: 538385 - protein, 9 aa, Homo Sapiens
TPPPFSSTS

SEQ ID NO: 538386 - protein, 9 aa, Homo Sapiens
ARFHCRVTG

SEQ ID NO: 538387 - protein, 9 aa, Homo Sapiens
DDRLLHPHA

SEQ ID NO: 538388 - protein, 9 aa, Homo Sapiens
LYIPHLLLC

SEQ ID NO: 538389 - protein, 9 aa, Homo Sapiens
FVVSATTEN

SEQ ID NO: 538390 - protein, 9 aa, Homo Sapiens
EEESGCREC

SEQ ID NO: 538391 - protein, 9 aa, Homo Sapiens
YSSEDPFSV

SEQ ID NO: 538392 - protein, 9 aa, Homo Sapiens
GTADDRLLH

SEQ ID NO: 538393 - protein, 9 aa, Homo Sapiens
SGYSLLRYH

SEQ ID NO: 538394 - protein, 9 aa, Homo Sapiens
HFSIMQQWR

SEQ ID NO: 538395 - protein, 9 aa, Homo Sapiens
RSGPSVCTC

SEQ ID NO: 538396 - protein, 9 aa, Homo Sapiens
LLLSDLRRL

SEQ ID NO: 538397 - protein, 9 aa, Homo Sapiens
MAARNEEES

SEQ ID NO: 538398 - protein, 9 aa, Homo Sapiens
DRLLHPHAF

SEQ ID NO: 538399 - protein, 9 aa, Homo Sapiens
GYSSEDPFS

SEQ ID NO: 538400 - protein, 9 aa, Homo Sapiens
EDYMIHIIE

SEQ ID NO: 538401 - protein, 9 aa, Homo Sapiens
SDSGVSSSS

SEQ ID NO: 538402 - protein, 9 aa, Homo Sapiens
CTSSLLQHQ

SEQ ID NO: 538403 - protein, 9 aa, Homo Sapiens
SSSQCRSAW

SEQ ID NO: 538404 - protein, 9 aa, Homo Sapiens
QIEKINLTN

SEQ ID NO: 538405 - protein, 9 aa, Homo Sapiens
CSRPCSCSA

SEQ ID NO: 538406 - protein, 9 aa, Homo Sapiens
WPSPSSSSS

SEQ ID NO: 538407 - protein, 9 aa, Homo Sapiens
NLSGYSLLR

SEQ ID NO: 538408 - protein, 9 aa, Homo Sapiens
LSGYSLLRY

SEQ ID NO: 538409 - protein, 9 aa, Homo Sapiens
RGGMISFDI

SEQ ID NO: 538410 - protein, 9 aa, Homo Sapiens
CSPVSSPTE

SEQ ID NO: 538411 - protein, 9 aa, Homo Sapiens
TADDRLLHP

SEQ ID NO: 538412 - protein, 9 aa, Homo Sapiens
FFVPKFSIS

SEQ ID NO: 538413 - protein, 9 aa, Homo Sapiens
PSSSSSQCR

SEQ ID NO: 538414 - protein, 9 aa, Homo Sapiens
CRSAWWCSP

SEQ ID NO: 538415 - protein, 9 aa, Homo Sapiens
DECGKAFTC

SEQ ID NO: 538416 - protein, 9 aa, Homo Sapiens
EESGCRECG

SEQ ID NO: 538417 - protein, 9 aa, Homo Sapiens
YQGLLLSDL

SEQ ID NO: 538418 - protein, 9 aa, Homo Sapiens
SKTCIHPGF

SEQ ID NO: 538419 - protein, 9 aa, Homo Sapiens
TARFHCRVT

SEQ ID NO: 538420 - protein, 9 aa, Homo Sapiens
SEDPFSVLL

SEQ ID NO: 538421 - protein, 9 aa, Homo Sapiens
SGCRECGHC

SEQ ID NO: 538422 - protein, 9 aa, Homo Sapiens
SPSSSSSQC

SEQ ID NO: 538423 - protein, 9 aa, Homo Sapiens
PPWPSPSSS

SEQ ID NO: 538424 - protein, 9 aa, Homo Sapiens
LLHPHAFYQ

SEQ ID NO: 538425 - protein, 9 aa, Homo Sapiens
IMQQWRLKD

SEQ ID NO: 538426 - protein, 9 aa, Homo Sapiens
IKSKTCIHP

SEQ ID NO: 538427 - protein, 9 aa, Homo Sapiens
DFFVPKFSI

SEQ ID NO: 538428 - protein, 9 aa, Homo Sapiens
SAWWCSPVS

SEQ ID NO: 538429 - protein, 9 aa, Homo Sapiens
PQLPPWPSP

SEQ ID NO: 538430 - protein, 9 aa, Homo Sapiens
KSKTCIHPG

SEQ ID NO: 538431 - protein, 9 aa, Homo Sapiens
IMSTTSFVY

SEQ ID NO: 538432 - protein, 9 aa, Homo Sapiens
RLLHPHAFY

SEQ ID NO: 538433 - protein, 9 aa, Homo Sapiens
SQIEKINLT

SEQ ID NO: 538434 - protein, 9 aa, Homo Sapiens
GLIEEPTGG

SEQ ID NO: 538435 - protein, 9 aa, Homo Sapiens
IEKINLTNG

SEQ ID NO: 538436 - protein, 9 aa, Homo Sapiens
DVTSRRSGP

SEQ ID NO: 538437 - protein, 9 aa, Homo Sapiens
GGITMAARN

SEQ ID NO: 538438 - protein, 9 aa, Homo Sapiens
TTSFVYGES

SEQ ID NO: 538439 - protein, 9 aa, Homo Sapiens
FKSQIEKIN

SEQ ID NO: 538440 - protein, 9 aa, Homo Sapiens
QKGWVDFFV

SEQ ID NO: 538441 - protein, 9 aa, Homo Sapiens
GAVGPEPKD

SEQ ID NO: 538442 - protein, 9 aa, Homo Sapiens
KSQIEKINL

SEQ ID NO: 538443 - protein, 9 aa, Homo Sapiens
KHLRMNIKS

SEQ ID NO: 538444 - protein, 9 aa, Homo Sapiens
KAFTCTSSL

SEQ ID NO: 538445 - protein, 9 aa, Homo Sapiens
GITMAARNE

SEQ ID NO: 538446 - protein, 9 aa, Homo Sapiens
SWSDSGVSS

SEQ ID NO: 538447 - protein, 9 aa, Homo Sapiens
VSATTENRG

SEQ ID NO: 538448 - protein, 9 aa, Homo Sapiens
EQMVAFMVL

SEQ ID NO: 538449 - protein, 9 aa, Homo Sapiens
EEASWSDSG

SEQ ID NO: 538450 - protein, 9 aa, Homo Sapiens
RRSGPSVCT

SEQ ID NO: 538451 - protein, 9 aa, Homo Sapiens
PDVTSRRSG

SEQ ID NO: 538452 - protein, 9 aa, Homo Sapiens
DLRRLRTES

SEQ ID NO: 538453 - protein, 9 aa, Homo Sapiens
TMAARNEEE

SEQ ID NO: 538454 - protein, 9 aa, Homo Sapiens
SRRSGPSVC

SEQ ID NO: 538455 - protein, 9 aa, Homo Sapiens
WCSPVSSPT

SEQ ID NO: 538456 - protein, 9 aa, Homo Sapiens
SSSSSQCRS

SEQ ID NO: 538457 - protein, 9 aa, Homo Sapiens
KGWVDFFVP

SEQ ID NO: 538458 - protein, 9 aa, Homo Sapiens
LLQKGWVDF

SEQ ID NO: 538459 - protein, 9 aa, Homo Sapiens
ESGCRECGH

SEQ ID NO: 538460 - protein, 9 aa, Homo Sapiens
GLLLSDLRR

SEQ ID NO: 538461 - protein, 9 aa, Homo Sapiens
RMNIKSKTC

SEQ ID NO: 538462 - protein, 9 aa, Homo Sapiens
MISFDIFPE

SEQ ID NO: 538463 - protein, 9 aa, Homo Sapiens
YMIHIIEKW

SEQ ID NO: 538464 - protein, 9 aa, Homo Sapiens
SVCTCSRPC

SEQ ID NO: 538465 - protein, 9 aa, Homo Sapiens
GGMISFDIF

SEQ ID NO: 538466 - protein, 9 aa, Homo Sapiens
VEQMVAFMV

SEQ ID NO: 538467 - protein, 9 aa, Homo Sapiens
PPPFSSTSQ

SEQ ID NO: 538468 - protein, 9 aa, Homo Sapiens
RSFSSTLVS

SEQ ID NO: 538469 - protein, 9 aa, Homo Sapiens
AGAVGPEPK

SEQ ID NO: 538470 - protein, 9 aa, Homo Sapiens
AFTCTSSLL

SEQ ID NO: 538471 - protein, 9 aa, Homo Sapiens
SIMQQWRLK

SEQ ID NO: 538472 - protein, 9 aa, Homo Sapiens
SCSAWPCSG

SEQ ID NO: 538473 - protein, 9 aa, Homo Sapiens
STTSFVYGE

SEQ ID NO: 538474 - protein, 9 aa, Homo Sapiens
FSIMQQWRL

SEQ ID NO: 538475 - protein, 9 aa, Homo Sapiens
EASWSDSGV

SEQ ID NO: 538476 - protein, 9 aa, Homo Sapiens
NHFSIMQQW

SEQ ID NO: 538477 - protein, 9 aa, Homo Sapiens
EKINLTNGS

SEQ ID NO: 538478 - protein, 9 aa, Homo Sapiens
LSDLRRLRT

SEQ ID NO: 538479 - protein, 9 aa, Homo Sapiens
SGPSCPQLP

SEQ ID NO: 538480 - protein, 9 aa, Homo Sapiens
TEDYMIHII

SEQ ID NO: 538481 - protein, 9 aa, Homo Sapiens
LDSMCFFPE

SEQ ID NO: 538482 - protein, 9 aa, Homo Sapiens
YSLLRYHQK

SEQ ID NO: 538483 - protein, 9 aa, Homo Sapiens
WPCSGPSCP

SEQ ID NO: 538484 - protein, 9 aa, Homo Sapiens
ADDRLLHPH

SEQ ID NO: 538485 - protein, 9 aa, Homo Sapiens
CLDSMCFFP

SEQ ID NO: 538486 - protein, 9 aa, Homo Sapiens
VPTEDYMIH

SEQ ID NO: 538487 - protein, 9 aa, Homo Sapiens
MSTTSFVYG

SEQ ID NO: 538488 - protein, 9 aa, Homo Sapiens
MVAFMVLSP

SEQ ID NO: 538489 - protein, 9 aa, Homo Sapiens
PPGLLYIPH

SEQ ID NO: 538490 - protein, 9 aa, Homo Sapiens
WRLKDQDQD

SEQ ID NO: 538491 - protein, 9 aa, Homo Sapiens
FFPEGEAAC

SEQ ID NO: 538492 - protein, 9 aa, Homo Sapiens
NIKSKTCIH

SEQ ID NO: 538493 - protein, 9 aa, Homo Sapiens
FHCRVTGYP

SEQ ID NO: 538494 - protein, 9 aa, Homo Sapiens
IVEQMVAFM

SEQ ID NO: 538495 - protein, 9 aa, Homo Sapiens
LLYIPHLLL

SEQ ID NO: 538496 - protein, 9 aa, Homo Sapiens
CFFPEGEAA

SEQ ID NO: 538497 - protein, 9 aa, Homo Sapiens
HFYRPAGAV

SEQ ID NO: 538498 - protein, 9 aa, Homo Sapiens
SYFVVSATT

SEQ ID NO: 538499 - protein, 9 aa, Homo Sapiens
PSPSSSSSQ

SEQ ID NO: 538500 - protein, 9 aa, Homo Sapiens
CSCSAWPCS

SEQ ID NO: 538501 - protein, 9 aa, Homo Sapiens
SPVSSPTER

SEQ ID NO: 538502 - protein, 9 aa, Homo Sapiens
SCPQLPPWP

SEQ ID NO: 538503 - protein, 9 aa, Homo Sapiens
QLPPWPSPS

SEQ ID NO: 538504 - protein, 9 aa, Homo Sapiens
YRPAGAVGP

SEQ ID NO: 538505 - protein, 9 aa, Homo Sapiens
RSAWWCSPV

SEQ ID NO: 538506 - protein, 9 aa, Homo Sapiens
FYRPAGAVG

SEQ ID NO: 538507 - protein, 9 aa, Homo Sapiens
MCFFPEGEA

SEQ ID NO: 538508 - protein, 9 aa, Homo Sapiens
TTENRGGIL

SEQ ID NO: 538509 - protein, 9 aa, Homo Sapiens
IFPEGWDKR

SEQ ID NO: 538510 - protein, 9 aa, Homo Sapiens
EGETARFHC

SEQ ID NO: 538511 - protein, 9 aa, Homo Sapiens
SSQCRSAWW

SEQ ID NO: 538512 - protein, 9 aa, Homo Sapiens
RVPTEDYMI

SEQ ID NO: 538513 - protein, 9 aa, Homo Sapiens
DYMIHIIEK

SEQ ID NO: 538514 - protein, 9 aa, Homo Sapiens
TSRRSGPSV

SEQ ID NO: 538515 - protein, 9 aa, Homo Sapiens
AWPCSGPSC

SEQ ID NO: 538516 - protein, 9 aa, Homo Sapiens
CSGPSCPQL

SEQ ID NO: 538517 - protein, 9 aa, Homo Sapiens
LHPHAFYQV

SEQ ID NO: 538518 - protein, 9 aa, Homo Sapiens
QCRSAWWCS

SEQ ID NO: 538519 - protein, 9 aa, Homo Sapiens
GETARFHCR

SEQ ID NO: 538520 - protein, 9 aa, Homo Sapiens
PPFSSTSQI

SEQ ID NO: 538521 - protein, 9 aa, Homo Sapiens
AGYSSEDPF

SEQ ID NO: 538522 - protein, 9 aa, Homo Sapiens
RWGAGYSSE

SEQ ID NO: 538523 - protein, 9 aa, Homo Sapiens
PCSGPSCPQ

SEQ ID NO: 538524 - protein, 9 aa, Homo Sapiens
QKHLRMNIK

SEQ ID NO: 538525 - protein, 9 aa, Homo Sapiens
VCTCSRPCS

SEQ ID NO: 538526 - protein, 9 aa, Homo Sapiens
SSEDPFSVL

SEQ ID NO: 538527 - protein, 9 aa, Homo Sapiens
GAGYSSEDP

SEQ ID NO: 538528 - protein, 9 aa, Homo Sapiens
PSVCTCSRP

SEQ ID NO: 538529 - protein, 9 aa, Homo Sapiens
GWVDFFVPK

SEQ ID NO: 538530 - protein, 9 aa, Homo Sapiens
CSAWPCSGP

SEQ ID NO: 538531 - protein, 9 aa, Homo Sapiens
TCTSSLLQH

SEQ ID NO: 538532 - protein, 9 aa, Homo Sapiens
TENRGGILE

SEQ ID NO: 538533 - protein, 9 aa, Homo Sapiens
SGPPGLLYI

SEQ ID NO: 538534 - protein, 9 aa, Homo Sapiens
LPPWPSPSS

SEQ ID NO: 538535 - protein, 9 aa, Homo Sapiens
QMVAFMVLS

SEQ ID NO: 538536 - protein, 9 aa, Homo Sapiens
KHHPDVTSR

SEQ ID NO: 538537 - protein, 9 aa, Homo Sapiens
GIMSTTSFV

SEQ ID NO: 538538 - protein, 9 aa, Homo Sapiens
LRRLRTESI

SEQ ID NO: 538539 - protein, 9 aa, Homo Sapiens
MQQWRLKDQ

SEQ ID NO: 538540 - protein, 9 aa, Homo Sapiens
WWCSPVSSP

SEQ ID NO: 538541 - protein, 9 aa, Homo Sapiens
ISFDIFPEG

SEQ ID NO: 538542 - protein, 9 aa, Homo Sapiens
HLRMNIKSK

SEQ ID NO: 538543 - protein, 9 aa, Homo Sapiens
TSITGIMST

SEQ ID NO: 538544 - protein, 9 aa, Homo Sapiens
SITGIMSTT

SEQ ID NO: 538545 - protein, 9 aa, Homo Sapiens
SSSSQCRSA

SEQ ID NO: 538546 - protein, 9 aa, Homo Sapiens
LLSDLRRLR

SEQ ID NO: 538547 - protein, 9 aa, Homo Sapiens
GMISFDIFP

SEQ ID NO: 538548 - protein, 9 aa, Homo Sapiens
VDFFVPKFS

SEQ ID NO: 538549 - protein, 9 aa, Homo Sapiens
YHQKHLRMN

SEQ ID NO: 538550 - protein, 9 aa, Homo Sapiens
ATTENRGGI

SEQ ID NO: 538551 - protein, 9 aa, Homo Sapiens
ITGIMSTTS

SEQ ID NO: 538552 - protein, 9 aa, Homo Sapiens
AWWCSPVSS

SEQ ID NO: 538553 - protein, 9 aa, Homo Sapiens
TCSRPCSCS

SEQ ID NO: 538554 - protein, 9 aa, Homo Sapiens
PTEDYMIHI

SEQ ID NO: 538555 - protein, 9 aa, Homo Sapiens
KCLDSMCFF

SEQ ID NO: 538556 - protein, 9 aa, Homo Sapiens
GYSLLRYHQ

SEQ ID NO: 538557 - protein, 9 aa, Homo Sapiens
YIPHLLLCL

SEQ ID NO: 538558 - protein, 9 aa, Homo Sapiens
RYHQKHLRM

SEQ ID NO: 538559 - protein, 9 aa, Homo Sapiens
VGPEPKDQG

SEQ ID NO: 538560 - protein, 9 aa, Homo Sapiens
GPSVCTCSR

SEQ ID NO: 538561 - protein, 9 aa, Homo Sapiens
SFDIFPEGW

SEQ ID NO: 538562 - protein, 9 aa, Homo Sapiens
SMCFFPEGE

SEQ ID NO: 538563 - protein, 9 aa, Homo Sapiens
FDIFPEGWD

SEQ ID NO: 538564 - protein, 9 aa, Homo Sapiens
SGPSVCTCS

SEQ ID NO: 538565 - protein, 9 aa, Homo Sapiens
SRPCSCSAW

SEQ ID NO: 538566 - protein, 9 aa, Homo Sapiens
GVPASGAPQ

SEQ ID NO: 538567 - protein, 9 aa, Homo Sapiens
ASGAPQRDS

SEQ ID NO: 538568 - protein, 9 aa, Homo Sapiens
KKEQEIPKK

SEQ ID NO: 538569 - protein, 9 aa, Homo Sapiens
VNAALGREG

SEQ ID NO: 538570 - protein, 9 aa, Homo Sapiens
EQEIPKKVI

SEQ ID NO: 538571 - protein, 9 aa, Homo Sapiens
KLSLPESLK

SEQ ID NO: 538572 - protein, 9 aa, Homo Sapiens
RDLPKKEQE

SEQ ID NO: 538573 - protein, 9 aa, Homo Sapiens
YHDNVVALW

SEQ ID NO: 538574 - protein, 9 aa, Homo Sapiens
SGLRRLRPA

SEQ ID NO: 538575 - protein, 9 aa, Homo Sapiens
IMKLSLPES

SEQ ID NO: 538576 - protein, 9 aa, Homo Sapiens
ALGVPASGA

SEQ ID NO: 538577 - protein, 9 aa, Homo Sapiens
WIEKKMAAI

SEQ ID NO: 538578 - protein, 9 aa, Homo Sapiens
VTLEYRAVI

SEQ ID NO: 538579 - protein, 9 aa, Homo Sapiens
TVTNSDSST

SEQ ID NO: 538580 - protein, 9 aa, Homo Sapiens
KEQEIPKKV

SEQ ID NO: 538581 - protein, 9 aa, Homo Sapiens
RRLRPATGT

SEQ ID NO: 538582 - protein, 9 aa, Homo Sapiens
KAEGTQNQG

SEQ ID NO: 538583 - protein, 9 aa, Homo Sapiens
ALHTHSLPN

SEQ ID NO: 538584 - protein, 9 aa, Homo Sapiens
DISGGREIF

SEQ ID NO: 538585 - protein, 9 aa, Homo Sapiens
GGREIFKPR

SEQ ID NO: 538586 - protein, 9 aa, Homo Sapiens
ILVPQETEN

SEQ ID NO: 538587 - protein, 9 aa, Homo Sapiens
ISGGREIFK

SEQ ID NO: 538588 - protein, 9 aa, Homo Sapiens
GAGFQHVRA

SEQ ID NO: 538589 - protein, 9 aa, Homo Sapiens
SGGREIFKP

SEQ ID NO: 538590 - protein, 9 aa, Homo Sapiens
LVEKHKEIH

SEQ ID NO: 538591 - protein, 9 aa, Homo Sapiens
TLPRPPYFP

SEQ ID NO: 538592 - protein, 9 aa, Homo Sapiens
GKVTLEYRA

SEQ ID NO: 538593 - protein, 9 aa, Homo Sapiens
EIPKKVILV

SEQ ID NO: 538594 - protein, 9 aa, Homo Sapiens
ASTVTNSDS

SEQ ID NO: 538595 - protein, 9 aa, Homo Sapiens
AGHSGLRRL

SEQ ID NO: 538596 - protein, 9 aa, Homo Sapiens
HQQILDEKP

SEQ ID NO: 538597 - protein, 9 aa, Homo Sapiens
NGQMKRQNL

SEQ ID NO: 538598 - protein, 9 aa, Homo Sapiens
PPDPALHTH

SEQ ID NO: 538599 - protein, 9 aa, Homo Sapiens
AAGHSGLRR

SEQ ID NO: 538600 - protein, 9 aa, Homo Sapiens
LGVMVSAYM

SEQ ID NO: 538601 - protein, 9 aa, Homo Sapiens
PRDLDMFPD

SEQ ID NO: 538602 - protein, 9 aa, Homo Sapiens
AVIDKTLNE

SEQ ID NO: 538603 - protein, 9 aa, Homo Sapiens
ALDYECTSS

SEQ ID NO: 538604 - protein, 9 aa, Homo Sapiens
RDSHGAPGQ

SEQ ID NO: 538605 - protein, 9 aa, Homo Sapiens
LREKIMKLS

SEQ ID NO: 538606 - protein, 9 aa, Homo Sapiens
LMITKPLMI

SEQ ID NO: 538607 - protein, 9 aa, Homo Sapiens
EIHQQILDE

SEQ ID NO: 538608 - protein, 9 aa, Homo Sapiens
VMVSAYMHY

SEQ ID NO: 538609 - protein, 9 aa, Homo Sapiens
EVLSLGYHD

SEQ ID NO: 538610 - protein, 9 aa, Homo Sapiens
LGREGAGFQ

SEQ ID NO: 538611 - protein, 9 aa, Homo Sapiens
DQRGCPSNF

SEQ ID NO: 538612 - protein, 9 aa, Homo Sapiens
KMAAILFGK

SEQ ID NO: 538613 - protein, 9 aa, Homo Sapiens
GLRRLRPAT

SEQ ID NO: 538614 - protein, 9 aa, Homo Sapiens
FRKLTPRDL

SEQ ID NO: 538615 - protein, 9 aa, Homo Sapiens
KVTLEYRAV

SEQ ID NO: 538616 - protein, 9 aa, Homo Sapiens
KPLMILNGQ

SEQ ID NO: 538617 - protein, 9 aa, Homo Sapiens
LGVPASGAP

SEQ ID NO: 538618 - protein, 9 aa, Homo Sapiens
GVMVSAYMH

SEQ ID NO: 538619 - protein, 9 aa, Homo Sapiens
KLTPRDLDM

SEQ ID NO: 538620 - protein, 9 aa, Homo Sapiens
REGAGFQHV

SEQ ID NO: 538621 - protein, 9 aa, Homo Sapiens
RGCPSNFLE

SEQ ID NO: 538622 - protein, 9 aa, Homo Sapiens
HTHSLPNRP

SEQ ID NO: 538623 - protein, 9 aa, Homo Sapiens
QRGCPSNFL

SEQ ID NO: 538624 - protein, 9 aa, Homo Sapiens
LEATVLVTI

SEQ ID NO: 538625 - protein, 9 aa, Homo Sapiens
PDISGGREI

SEQ ID NO: 538626 - protein, 9 aa, Homo Sapiens
TKPLMILNG

SEQ ID NO: 538627 - protein, 9 aa, Homo Sapiens
LPRPPYFPR

SEQ ID NO: 538628 - protein, 9 aa, Homo Sapiens
PSWSPDISG

SEQ ID NO: 538629 - protein, 9 aa, Homo Sapiens
HVRAAGHSG

SEQ ID NO: 538630 - protein, 9 aa, Homo Sapiens
KIMKLSLPE

SEQ ID NO: 538631 - protein, 9 aa, Homo Sapiens
KHKEIHQQI

SEQ ID NO: 538632 - protein, 9 aa, Homo Sapiens
TQKALDYEC

SEQ ID NO: 538633 - protein, 9 aa, Homo Sapiens
LSLPESLKA

SEQ ID NO: 538634 - protein, 9 aa, Homo Sapiens
FSPPDPALH

SEQ ID NO: 538635 - protein, 9 aa, Homo Sapiens
PPYFPRGHG

SEQ ID NO: 538636 - protein, 9 aa, Homo Sapiens
FQHVRAAGH

SEQ ID NO: 538637 - protein, 9 aa, Homo Sapiens
EKHKEIHQQ

SEQ ID NO: 538638 - protein, 9 aa, Homo Sapiens
AGFQHVRAA

SEQ ID NO: 538639 - protein, 9 aa, Homo Sapiens
LPKKEQEIP

SEQ ID NO: 538640 - protein, 9 aa, Homo Sapiens
YRAVIDKTL

SEQ ID NO: 538641 - protein, 9 aa, Homo Sapiens
KKVILVPQE

SEQ ID NO: 538642 - protein, 9 aa, Homo Sapiens
RPPYFPRGH

SEQ ID NO: 538643 - protein, 9 aa, Homo Sapiens
SSVPLEATV

SEQ ID NO: 538644 - protein, 9 aa, Homo Sapiens
VLSLGYHDN

SEQ ID NO: 538645 - protein, 9 aa, Homo Sapiens
REKIMKLSL

SEQ ID NO: 538646 - protein, 9 aa, Homo Sapiens
SNFLELMKL

SEQ ID NO: 538647 - protein, 9 aa, Homo Sapiens
LALGVPASG

SEQ ID NO: 538648 - protein, 9 aa, Homo Sapiens
IHQQILDEK

SEQ ID NO: 538649 - protein, 9 aa, Homo Sapiens
HSGLRRLRP

SEQ ID NO: 538650 - protein, 9 aa, Homo Sapiens
PRGHGQPSV

SEQ ID NO: 538651 - protein, 9 aa, Homo Sapiens
QEIPKKVIL

SEQ ID NO: 538652 - protein, 9 aa, Homo Sapiens
PYFPRGHGQ

SEQ ID NO: 538653 - protein, 9 aa, Homo Sapiens
VPQETENLM

SEQ ID NO: 538654 - protein, 9 aa, Homo Sapiens
GASTVTNSD

SEQ ID NO: 538655 - protein, 9 aa, Homo Sapiens
GFRKLTPRD

SEQ ID NO: 538656 - protein, 9 aa, Homo Sapiens
NLMITKPLM

SEQ ID NO: 538657 - protein, 9 aa, Homo Sapiens
TLEYRAVID

SEQ ID NO: 538658 - protein, 9 aa, Homo Sapiens
ERDLPKKEQ

SEQ ID NO: 538659 - protein, 9 aa, Homo Sapiens
SPDISGGRE

SEQ ID NO: 538660 - protein, 9 aa, Homo Sapiens
MILNGQMKR

SEQ ID NO: 538661 - protein, 9 aa, Homo Sapiens
ILNGQMKRQ

SEQ ID NO: 538662 - protein, 9 aa, Homo Sapiens
GYHDNVVAL

SEQ ID NO: 538663 - protein, 9 aa, Homo Sapiens
AILFGKIPS

SEQ ID NO: 538664 - protein, 9 aa, Homo Sapiens
VILVPQETE

SEQ ID NO: 538665 - protein, 9 aa, Homo Sapiens
EKIMKLSLP

SEQ ID NO: 538666 - protein, 9 aa, Homo Sapiens
SVLALGVPA

SEQ ID NO: 538667 - protein, 9 aa, Homo Sapiens
MKLSLPESL

SEQ ID NO: 538668 - protein, 9 aa, Homo Sapiens
PQETENLMI

SEQ ID NO: 538669 - protein, 9 aa, Homo Sapiens
LMILNGQMK

SEQ ID NO: 538670 - protein, 9 aa, Homo Sapiens
EERDLPKKE

SEQ ID NO: 538671 - protein, 9 aa, Homo Sapiens
MITKPLMIL

SEQ ID NO: 538672 - protein, 9 aa, Homo Sapiens
VPLEATVLV

SEQ ID NO: 538673 - protein, 9 aa, Homo Sapiens
SGASTVTNS

SEQ ID NO: 538674 - protein, 9 aa, Homo Sapiens
LGYHDNVVA

SEQ ID NO: 538675 - protein, 9 aa, Homo Sapiens
ECTSSYQLI

SEQ ID NO: 538676 - protein, 9 aa, Homo Sapiens
MVSAYMHYS

SEQ ID NO: 538677 - protein, 9 aa, Homo Sapiens
GTLPRPPYF

SEQ ID NO: 538678 - protein, 9 aa, Homo Sapiens
RDLDMFPDY

SEQ ID NO: 538679 - protein, 9 aa, Homo Sapiens
QKALDYECT

SEQ ID NO: 538680 - protein, 9 aa, Homo Sapiens
ATVLVTIEP

SEQ ID NO: 538681 - protein, 9 aa, Homo Sapiens
SLPESLKAY

SEQ ID NO: 538682 - protein, 9 aa, Homo Sapiens
ATGTLPRPP

SEQ ID NO: 538683 - protein, 9 aa, Homo Sapiens
VPASGAPQR

SEQ ID NO: 538684 - protein, 9 aa, Homo Sapiens
HGQPSVLAL

SEQ ID NO: 538685 - protein, 9 aa, Homo Sapiens
EGAGFQHVR

SEQ ID NO: 538686 - protein, 9 aa, Homo Sapiens
LHTHSLPNR

SEQ ID NO: 538687 - protein, 9 aa, Homo Sapiens
IPKKVILVP

SEQ ID NO: 538688 - protein, 9 aa, Homo Sapiens
NKGKLGVMV

SEQ ID NO: 538689 - protein, 9 aa, Homo Sapiens
CPSNFLELM

SEQ ID NO: 538690 - protein, 9 aa, Homo Sapiens
DLPKKEQEI

SEQ ID NO: 538691 - protein, 9 aa, Homo Sapiens
RPATGTLPR

SEQ ID NO: 538692 - protein, 9 aa, Homo Sapiens
KVILVPQET

SEQ ID NO: 538693 - protein, 9 aa, Homo Sapiens
TENLMITKP

SEQ ID NO: 538694 - protein, 9 aa, Homo Sapiens
GTQNQGKKA

SEQ ID NO: 538695 - protein, 9 aa, Homo Sapiens
ETENLMITK

SEQ ID NO: 538696 - protein, 9 aa, Homo Sapiens
DYECTSSYQ

SEQ ID NO: 538697 - protein, 9 aa, Homo Sapiens
EKKMAAILF

SEQ ID NO: 538698 - protein, 9 aa, Homo Sapiens
EYRAVIDKT

SEQ ID NO: 538699 - protein, 9 aa, Homo Sapiens
GFQHVRAAG

SEQ ID NO: 538700 - protein, 9 aa, Homo Sapiens
VTNSDSSTT

SEQ ID NO: 538701 - protein, 9 aa, Homo Sapiens
LRRLRPATG

SEQ ID NO: 538702 - protein, 9 aa, Homo Sapiens
TPRDLDMFP

SEQ ID NO: 538703 - protein, 9 aa, Homo Sapiens
PLMILNGQM

SEQ ID NO: 538704 - protein, 9 aa, Homo Sapiens
TVLVTIEPA

SEQ ID NO: 538705 - protein, 9 aa, Homo Sapiens
GKLGVMVSA

SEQ ID NO: 538706 - protein, 9 aa, Homo Sapiens
FPRGHGQPS

SEQ ID NO: 538707 - protein, 9 aa, Homo Sapiens
WSPDISGGR

SEQ ID NO: 538708 - protein, 9 aa, Homo Sapiens
EGTQNQGKK

SEQ ID NO: 538709 - protein, 9 aa, Homo Sapiens
VLALGVPAS

SEQ ID NO: 538710 - protein, 9 aa, Homo Sapiens
LNGQMKRQN

SEQ ID NO: 538711 - protein, 9 aa, Homo Sapiens
TPSSGASTV

SEQ ID NO: 538712 - protein, 9 aa, Homo Sapiens
GSSVPLEAT

SEQ ID NO: 538713 - protein, 9 aa, Homo Sapiens
HKEIHQQIL

SEQ ID NO: 538714 - protein, 9 aa, Homo Sapiens
MAAILFGKI

SEQ ID NO: 538715 - protein, 9 aa, Homo Sapiens
DPALHTHSL

SEQ ID NO: 538716 - protein, 9 aa, Homo Sapiens
LDQRGCPSN

SEQ ID NO: 538717 - protein, 9 aa, Homo Sapiens
TQNQGKKAE

SEQ ID NO: 538718 - protein, 9 aa, Homo Sapiens
KEIHQQILD

SEQ ID NO: 538719 - protein, 9 aa, Homo Sapiens
LDYECTSSY

SEQ ID NO: 538720 - protein, 9 aa, Homo Sapiens
TGTLPRPPY

SEQ ID NO: 538721 - protein, 9 aa, Homo Sapiens
GHGQPSVLA

SEQ ID NO: 538722 - protein, 9 aa, Homo Sapiens
LTPRDLDMF

SEQ ID NO: 538723 - protein, 9 aa, Homo Sapiens
SVPLEATVL

SEQ ID NO: 538724 - protein, 9 aa, Homo Sapiens
SHGAPGQGF

SEQ ID NO: 538725 - protein, 9 aa, Homo Sapiens
GHSGLRRLR

SEQ ID NO: 538726 - protein, 9 aa, Homo Sapiens
YECTSSYQL

SEQ ID NO: 538727 - protein, 9 aa, Homo Sapiens
LSLGYHDNV

SEQ ID NO: 538728 - protein, 9 aa, Homo Sapiens
ESTEKKKRS

SEQ ID NO: 538729 - protein, 9 aa, Homo Sapiens
ENLMITKPL

SEQ ID NO: 538730 - protein, 9 aa, Homo Sapiens
STVTNSDSS

SEQ ID NO: 538731 - protein, 9 aa, Homo Sapiens
DSHGAPGQG

SEQ ID NO: 538732 - protein, 9 aa, Homo Sapiens
RKLTPRDLD

SEQ ID NO: 538733 - protein, 9 aa, Homo Sapiens
KGKLGVMVS

SEQ ID NO: 538734 - protein, 9 aa, Homo Sapiens
SSGASTVTN

SEQ ID NO: 538735 - protein, 9 aa, Homo Sapiens
RLRPATGTL

SEQ ID NO: 538736 - protein, 9 aa, Homo Sapiens
GCPSNFLEL

SEQ ID NO: 538737 - protein, 9 aa, Homo Sapiens
LVPQETENL

SEQ ID NO: 538738 - protein, 9 aa, Homo Sapiens
KALDYECTS

SEQ ID NO: 538739 - protein, 9 aa, Homo Sapiens
PATGTLPRP

SEQ ID NO: 538740 - protein, 9 aa, Homo Sapiens
PKKVILVPQ

SEQ ID NO: 538741 - protein, 9 aa, Homo Sapiens
GAPQRDSHG

SEQ ID NO: 538742 - protein, 9 aa, Homo Sapiens
SPPDPALHT

SEQ ID NO: 538743 - protein, 9 aa, Homo Sapiens
PSVLALGVP

SEQ ID NO: 538744 - protein, 9 aa, Homo Sapiens
LLDQRGCPS

SEQ ID NO: 538745 - protein, 9 aa, Homo Sapiens
PLEATVLVT

SEQ ID NO: 538746 - protein, 9 aa, Homo Sapiens
LRPATGTLP

SEQ ID NO: 538747 - protein, 9 aa, Homo Sapiens
VEKHKEIHQ

SEQ ID NO: 538748 - protein, 9 aa, Homo Sapiens
ILFGKIPSS

SEQ ID NO: 538749 - protein, 9 aa, Homo Sapiens
GNKGKLGVM

SEQ ID NO: 538750 - protein, 9 aa, Homo Sapiens
PDPALHTHS

SEQ ID NO: 538751 - protein, 9 aa, Homo Sapiens
DNVVALWER

SEQ ID NO: 538752 - protein, 9 aa, Homo Sapiens
QPSVLALGV

SEQ ID NO: 538753 - protein, 9 aa, Homo Sapiens
SWSPDISGG

SEQ ID NO: 538754 - protein, 9 aa, Homo Sapiens
PASGAPQRD

SEQ ID NO: 538755 - protein, 9 aa, Homo Sapiens
PKKEQEIPK

SEQ ID NO: 538756 - protein, 9 aa, Homo Sapiens
YFPRGHGQP

SEQ ID NO: 538757 - protein, 9 aa, Homo Sapiens
IEKKMAAIL

SEQ ID NO: 538758 - protein, 9 aa, Homo Sapiens
SLGYHDNVV

SEQ ID NO: 538759 - protein, 9 aa, Homo Sapiens
SGAPQRDSH

SEQ ID NO: 538760 - protein, 9 aa, Homo Sapiens
PSNFLELMK

SEQ ID NO: 538761 - protein, 9 aa, Homo Sapiens
VRAAGHSGL

SEQ ID NO: 538762 - protein, 9 aa, Homo Sapiens
PQRDSHGAP

SEQ ID NO: 538763 - protein, 9 aa, Homo Sapiens
CTSSYQLII

SEQ ID NO: 538764 - protein, 9 aa, Homo Sapiens
HDNVVALWE

SEQ ID NO: 538765 - protein, 9 aa, Homo Sapiens
GREGAGFQH

SEQ ID NO: 538766 - protein, 9 aa, Homo Sapiens
RGHGQPSVL

SEQ ID NO: 538767 - protein, 9 aa, Homo Sapiens
AEGTQNQGK

SEQ ID NO: 538768 - protein, 9 aa, Homo Sapiens
LEYRAVIDK

SEQ ID NO: 538769 - protein, 9 aa, Homo Sapiens
EATVLVTIE

SEQ ID NO: 538770 - protein, 9 aa, Homo Sapiens
NAALGREGA

SEQ ID NO: 538771 - protein, 9 aa, Homo Sapiens
AALGREGAG

SEQ ID NO: 538772 - protein, 9 aa, Homo Sapiens
RAVIDKTLN

SEQ ID NO: 538773 - protein, 9 aa, Homo Sapiens
PSSGASTVT

SEQ ID NO: 538774 - protein, 9 aa, Homo Sapiens
RAAGHSGLR

SEQ ID NO: 538775 - protein, 9 aa, Homo Sapiens
PALHTHSLP

SEQ ID NO: 538776 - protein, 9 aa, Homo Sapiens
APQRDSHGA

SEQ ID NO: 538777 - protein, 9 aa, Homo Sapiens
EESTEKKKR

SEQ ID NO: 538778 - protein, 9 aa, Homo Sapiens
AAILFGKIP

SEQ ID NO: 538779 - protein, 9 aa, Homo Sapiens
KLGVMVSAY

SEQ ID NO: 538780 - protein, 9 aa, Homo Sapiens
PRPPYFPRG

SEQ ID NO: 538781 - protein, 9 aa, Homo Sapiens
ALGREGAGF

SEQ ID NO: 538782 - protein, 9 aa, Homo Sapiens
QETENLMIT

SEQ ID NO: 538783 - protein, 9 aa, Homo Sapiens
QHVRAAGHS

SEQ ID NO: 538784 - protein, 9 aa, Homo Sapiens
ITKPLMILN

SEQ ID NO: 538785 - protein, 9 aa, Homo Sapiens
QRDSHGAPG

SEQ ID NO: 538786 - protein, 9 aa, Homo Sapiens
KKMAAILFG

SEQ ID NO: 538787 - protein, 9 aa, Homo Sapiens
DLDMFPDYG

SEQ ID NO: 538788 - protein, 9 aa, Homo Sapiens
GQPSVLALG

SEQ ID NO: 538789 - protein, 9 aa, Homo Sapiens
KWKEEFLDQ

SEQ ID NO: 538790 - protein, 9 aa, Homo Sapiens
TLHDEEANN

SEQ ID NO: 538791 - protein, 9 aa, Homo Sapiens
EEFQSLARP

SEQ ID NO: 538792 - protein, 9 aa, Homo Sapiens
APENRTQTP

SEQ ID NO: 538793 - protein, 9 aa, Homo Sapiens
VSRGVKVDF

SEQ ID NO: 538794 - protein, 9 aa, Homo Sapiens
IKPLDIATI

SEQ ID NO: 538795 - protein, 9 aa, Homo Sapiens
CTHRPEPKS

SEQ ID NO: 538796 - protein, 9 aa, Homo Sapiens
TNSQPCLTS

SEQ ID NO: 538797 - protein, 9 aa, Homo Sapiens
EPKSPGLDR

SEQ ID NO: 538798 - protein, 9 aa, Homo Sapiens
NRTQTPSPP

SEQ ID NO: 538799 - protein, 9 aa, Homo Sapiens
GKKPYKYEE

SEQ ID NO: 538800 - protein, 9 aa, Homo Sapiens
PLKLAGWQC

SEQ ID NO: 538801 - protein, 9 aa, Homo Sapiens
GQIAPENRT

SEQ ID NO: 538802 - protein, 9 aa, Homo Sapiens
PLDIATIVS

SEQ ID NO: 538803 - protein, 9 aa, Homo Sapiens
VSLPELEDR

SEQ ID NO: 538804 - protein, 9 aa, Homo Sapiens
SRGVKVDFL

SEQ ID NO: 538805 - protein, 9 aa, Homo Sapiens
PELEDRLQC

SEQ ID NO: 538806 - protein, 9 aa, Homo Sapiens
THRPEPKSP

SEQ ID NO: 538807 - protein, 9 aa, Homo Sapiens
EFQSLARPW

SEQ ID NO: 538808 - protein, 9 aa, Homo Sapiens
NGQIIKRVC

SEQ ID NO: 538809 - protein, 9 aa, Homo Sapiens
DIATIVSSA

SEQ ID NO: 538810 - protein, 9 aa, Homo Sapiens
LPNGFYTTN

SEQ ID NO: 538811 - protein, 9 aa, Homo Sapiens
STNRKPLTN

SEQ ID NO: 538812 - protein, 9 aa, Homo Sapiens
FLTPDFPSL

SEQ ID NO: 538813 - protein, 9 aa, Homo Sapiens
VCTHRPEPK

SEQ ID NO: 538814 - protein, 9 aa, Homo Sapiens
LTLVFGPYT

SEQ ID NO: 538815 - protein, 9 aa, Homo Sapiens
LQPSSCTCP

SEQ ID NO: 538816 - protein, 9 aa, Homo Sapiens
HRPEPKSPG

SEQ ID NO: 538817 - protein, 9 aa, Homo Sapiens
EPNSPMMVP

SEQ ID NO: 538818 - protein, 9 aa, Homo Sapiens
RTQTPSPPS

SEQ ID NO: 538819 - protein, 9 aa, Homo Sapiens
PNSPMMVPA

SEQ ID NO: 538820 - protein, 9 aa, Homo Sapiens
TRVAILWHE

SEQ ID NO: 538821 - protein, 9 aa, Homo Sapiens
FRVHITLHD

SEQ ID NO: 538822 - protein, 9 aa, Homo Sapiens
NSPMMVPAA

SEQ ID NO: 538823 - protein, 9 aa, Homo Sapiens
PLTNSQPCL

SEQ ID NO: 538824 - protein, 9 aa, Homo Sapiens
WVQNRVIHY

SEQ ID NO: 538825 - protein, 9 aa, Homo Sapiens
KVDFLTPDF

SEQ ID NO: 538826 - protein, 9 aa, Homo Sapiens
NSQPCLTSF

SEQ ID NO: 538827 - protein, 9 aa, Homo Sapiens
VTPLKLAGW

SEQ ID NO: 538828 - protein, 9 aa, Homo Sapiens
HITLHDEEA

SEQ ID NO: 538829 - protein, 9 aa, Homo Sapiens
SEEFQSLAR

SEQ ID NO: 538830 - protein, 9 aa, Homo Sapiens
RVHITLHDE

SEQ ID NO: 538831 - protein, 9 aa, Homo Sapiens
GDGESLAER

SEQ ID NO: 538832 - protein, 9 aa, Homo Sapiens
EKEPNSPMM

SEQ ID NO: 538833 - protein, 9 aa, Homo Sapiens
DFLTPDFPS

SEQ ID NO: 538834 - protein, 9 aa, Homo Sapiens
IATIVSSAK

SEQ ID NO: 538835 - protein, 9 aa, Homo Sapiens
QASEEFQSL

SEQ ID NO: 538836 - protein, 9 aa, Homo Sapiens
HTGKKPYKY

SEQ ID NO: 538837 - protein, 9 aa, Homo Sapiens
FSRGLTLVF

SEQ ID NO: 538838 - protein, 9 aa, Homo Sapiens
DIAVTPLKL

SEQ ID NO: 538839 - protein, 9 aa, Homo Sapiens
TWVQNRVIH

SEQ ID NO: 538840 - protein, 9 aa, Homo Sapiens
QPSSCTCPS

SEQ ID NO: 538841 - protein, 9 aa, Homo Sapiens
AERPSKIKA

SEQ ID NO: 538842 - protein, 9 aa, Homo Sapiens
SDTWVQNRV

SEQ ID NO: 538843 - protein, 9 aa, Homo Sapiens
TIKPLDIAT

SEQ ID NO: 538844 - protein, 9 aa, Homo Sapiens
ALLTGRLPN

SEQ ID NO: 538845 - protein, 9 aa, Homo Sapiens
DTWVQNRVI

SEQ ID NO: 538846 - protein, 9 aa, Homo Sapiens
VKVDFLTPD

SEQ ID NO: 538847 - protein, 9 aa, Homo Sapiens
RKPLTNSQP

SEQ ID NO: 538848 - protein, 9 aa, Homo Sapiens
LFTIKPLDI

SEQ ID NO: 538849 - protein, 9 aa, Homo Sapiens
SSCTCPSRA

SEQ ID NO: 538850 - protein, 9 aa, Homo Sapiens
VRKWKEEFL

SEQ ID NO: 538851 - protein, 9 aa, Homo Sapiens
SCTCPSRAS

SEQ ID NO: 538852 - protein, 9 aa, Homo Sapiens
FVFSRGLTL

SEQ ID NO: 538853 - protein, 9 aa, Homo Sapiens
IAVTPLKLA

SEQ ID NO: 538854 - protein, 9 aa, Homo Sapiens
PNGFYTTNA

SEQ ID NO: 538855 - protein, 9 aa, Homo Sapiens
FQSLARPWR

SEQ ID NO: 538856 - protein, 9 aa, Homo Sapiens
PEPKSPGLD

SEQ ID NO: 538857 - protein, 9 aa, Homo Sapiens
QVSLPELED

SEQ ID NO: 538858 - protein, 9 aa, Homo Sapiens
KLAGWQCPE

SEQ ID NO: 538859 - protein, 9 aa, Homo Sapiens
MAWQVSLPE

SEQ ID NO: 538860 - protein, 9 aa, Homo Sapiens
AVTPLKLAG

SEQ ID NO: 538861 - protein, 9 aa, Homo Sapiens
LHDEEANND

SEQ ID NO: 538862 - protein, 9 aa, Homo Sapiens
KEEFLDQRR

SEQ ID NO: 538863 - protein, 9 aa, Homo Sapiens
SLAERPSKI

SEQ ID NO: 538864 - protein, 9 aa, Homo Sapiens
QIAPENRTQ

SEQ ID NO: 538865 - protein, 9 aa, Homo Sapiens
RGLTLVFGP

SEQ ID NO: 538866 - protein, 9 aa, Homo Sapiens
EELTRVAIL

SEQ ID NO: 538867 - protein, 9 aa, Homo Sapiens
EEFLDQRRR

SEQ ID NO: 538868 - protein, 9 aa, Homo Sapiens
VFSRGLTLV

SEQ ID NO: 538869 - protein, 9 aa, Homo Sapiens
TLQPSSCTC

SEQ ID NO: 538870 - protein, 9 aa, Homo Sapiens
TGRLPNGFY

SEQ ID NO: 538871 - protein, 9 aa, Homo Sapiens
FHSLMRESG

SEQ ID NO: 538872 - protein, 9 aa, Homo Sapiens
AVCTHRPEP

SEQ ID NO: 538873 - protein, 9 aa, Homo Sapiens
LTGRLPNGF

SEQ ID NO: 538874 - protein, 9 aa, Homo Sapiens
TPLKLAGWQ

SEQ ID NO: 538875 - protein, 9 aa, Homo Sapiens
VSEELTRVA

SEQ ID NO: 538876 - protein, 9 aa, Homo Sapiens
RLPNGFYTT

SEQ ID NO: 538877 - protein, 9 aa, Homo Sapiens
SLARPWRAT

SEQ ID NO: 538878 - protein, 9 aa, Homo Sapiens
DAVCTHRPE

SEQ ID NO: 538879 - protein, 9 aa, Homo Sapiens
AWQVSLPEL

SEQ ID NO: 538880 - protein, 9 aa, Homo Sapiens
YPVKEKVFH

SEQ ID NO: 538881 - protein, 9 aa, Homo Sapiens
ETLQPSSCT

SEQ ID NO: 538882 - protein, 9 aa, Homo Sapiens
LTRVAILWH

SEQ ID NO: 538883 - protein, 9 aa, Homo Sapiens
LTNSQPCLT

SEQ ID NO: 538884 - protein, 9 aa, Homo Sapiens
HDEEANNDI

SEQ ID NO: 538885 - protein, 9 aa, Homo Sapiens
EFLDQRRRM

SEQ ID NO: 538886 - protein, 9 aa, Homo Sapiens
VRILSDTWV

SEQ ID NO: 538887 - protein, 9 aa, Homo Sapiens
MVSEELTRV

SEQ ID NO: 538888 - protein, 9 aa, Homo Sapiens
ILSDTWVQN

SEQ ID NO: 538889 - protein, 9 aa, Homo Sapiens
MDICYTTTS

SEQ ID NO: 538890 - protein, 9 aa, Homo Sapiens
RGVKVDFLT

SEQ ID NO: 538891 - protein, 9 aa, Homo Sapiens
WKEEFLDQR

SEQ ID NO: 538892 - protein, 9 aa, Homo Sapiens
PMMVPAADI

SEQ ID NO: 538893 - protein, 9 aa, Homo Sapiens
LKLAGWQCP

SEQ ID NO: 538894 - protein, 9 aa, Homo Sapiens
GGDGESLAE

SEQ ID NO: 538895 - protein, 9 aa, Homo Sapiens
LVFGPYTRP

SEQ ID NO: 538896 - protein, 9 aa, Homo Sapiens
MVMAPSPSL

SEQ ID NO: 538897 - protein, 9 aa, Homo Sapiens
GDNRNGQII

SEQ ID NO: 538898 - protein, 9 aa, Homo Sapiens
FMDICYTTT

SEQ ID NO: 538899 - protein, 9 aa, Homo Sapiens
PSSCTCPSR

SEQ ID NO: 538900 - protein, 9 aa, Homo Sapiens
ESLAERPSK

SEQ ID NO: 538901 - protein, 9 aa, Homo Sapiens
NRKPLTNSQ

SEQ ID NO: 538902 - protein, 9 aa, Homo Sapiens
TNRKPLTNS

SEQ ID NO: 538903 - protein, 9 aa, Homo Sapiens
LSDTWVQNR

SEQ ID NO: 538904 - protein, 9 aa, Homo Sapiens
VFHSLMRES

SEQ ID NO: 538905 - protein, 9 aa, Homo Sapiens
SRGLTLVFG

SEQ ID NO: 538906 - protein, 9 aa, Homo Sapiens
ERPSKIKAS

SEQ ID NO: 538907 - protein, 9 aa, Homo Sapiens
FFVETLQPS

SEQ ID NO: 538908 - protein, 9 aa, Homo Sapiens
RPEPKSPGL

SEQ ID NO: 538909 - protein, 9 aa, Homo Sapiens
ITLHDEEAN

SEQ ID NO: 538910 - protein, 9 aa, Homo Sapiens
FLDQRRRMM

SEQ ID NO: 538911 - protein, 9 aa, Homo Sapiens
AMMVSEELT

SEQ ID NO: 538912 - protein, 9 aa, Homo Sapiens
VDFLTPDFP

SEQ ID NO: 538913 - protein, 9 aa, Homo Sapiens
FFLGNLSFM

SEQ ID NO: 538914 - protein, 9 aa, Homo Sapiens
RDGDNRNGQ

SEQ ID NO: 538915 - protein, 9 aa, Homo Sapiens
SEELTRVAI

SEQ ID NO: 538916 - protein, 9 aa, Homo Sapiens
KVFHSLMRE

SEQ ID NO: 538917 - protein, 9 aa, Homo Sapiens
TGKKPYKYE

SEQ ID NO: 538918 - protein, 9 aa, Homo Sapiens
DNRNGQIIK

SEQ ID NO: 538919 - protein, 9 aa, Homo Sapiens
SLPELEDRL

SEQ ID NO: 538920 - protein, 9 aa, Homo Sapiens
FVETLQPSS

SEQ ID NO: 538921 - protein, 9 aa, Homo Sapiens
FTIKPLDIA

SEQ ID NO: 538922 - protein, 9 aa, Homo Sapiens
VKEKVFHSL

SEQ ID NO: 538923 - protein, 9 aa, Homo Sapiens
LLTGRLPNG

SEQ ID NO: 538924 - protein, 9 aa, Homo Sapiens
VHITLHDEE

SEQ ID NO: 538925 - protein, 9 aa, Homo Sapiens
LAGWQCPEC

SEQ ID NO: 538926 - protein, 9 aa, Homo Sapiens
WQVSLPELE

SEQ ID NO: 538927 - protein, 9 aa, Homo Sapiens
ENRTQTPSP

SEQ ID NO: 538928 - protein, 9 aa, Homo Sapiens
VRDGDNRNG

SEQ ID NO: 538929 - protein, 9 aa, Homo Sapiens
GVKVDFLTP

SEQ ID NO: 538930 - protein, 9 aa, Homo Sapiens
KEPNSPMMV

SEQ ID NO: 538931 - protein, 9 aa, Homo Sapiens
PVKEKVFHS

SEQ ID NO: 538932 - protein, 9 aa, Homo Sapiens
LDIATIVSS

SEQ ID NO: 538933 - protein, 9 aa, Homo Sapiens
TLVFGPYTR

SEQ ID NO: 538934 - protein, 9 aa, Homo Sapiens
QSLARPWRA

SEQ ID NO: 538935 - protein, 9 aa, Homo Sapiens
VMAPSPSLV

SEQ ID NO: 538936 - protein, 9 aa, Homo Sapiens
GLTLVFGPY

SEQ ID NO: 538937 - protein, 9 aa, Homo Sapiens
EKVFHSLMR

SEQ ID NO: 538938 - protein, 9 aa, Homo Sapiens
DEKEPNSPM

SEQ ID NO: 538939 - protein, 9 aa, Homo Sapiens
DEEANNDIF

SEQ ID NO: 538940 - protein, 9 aa, Homo Sapiens
VETLQPSSC

SEQ ID NO: 538941 - protein, 9 aa, Homo Sapiens
KPLDIATIV

SEQ ID NO: 538942 - protein, 9 aa, Homo Sapiens
SFMDICYTT

SEQ ID NO: 538943 - protein, 9 aa, Homo Sapiens
ELTRVAILW

SEQ ID NO: 538944 - protein, 9 aa, Homo Sapiens
KPLTNSQPC

SEQ ID NO: 538945 - protein, 9 aa, Homo Sapiens
NGQIAPENR

SEQ ID NO: 538946 - protein, 9 aa, Homo Sapiens
VQNRVIHYS

SEQ ID NO: 538947 - protein, 9 aa, Homo Sapiens
KEKVFHSLM

SEQ ID NO: 538948 - protein, 9 aa, Homo Sapiens
EVRDGDNRN

SEQ ID NO: 538949 - protein, 9 aa, Homo Sapiens
LAERPSKIK

SEQ ID NO: 538950 - protein, 9 aa, Homo Sapiens
DVRKWKEEF

SEQ ID NO: 538951 - protein, 9 aa, Homo Sapiens
IAPENRTQT

SEQ ID NO: 538952 - protein, 9 aa, Homo Sapiens
SPMMVPAAD

SEQ ID NO: 538953 - protein, 9 aa, Homo Sapiens
NRNGQIIKR

SEQ ID NO: 538954 - protein, 9 aa, Homo Sapiens
RKWKEEFLD

SEQ ID NO: 538955 - protein, 9 aa, Homo Sapiens
GESLAERPS

SEQ ID NO: 538956 - protein, 9 aa, Homo Sapiens
GRLPNGFYT

SEQ ID NO: 538957 - protein, 9 aa, Homo Sapiens
GQASEEFQS

SEQ ID NO: 538958 - protein, 9 aa, Homo Sapiens
DGDNRNGQI

SEQ ID NO: 538959 - protein, 9 aa, Homo Sapiens
MMVSEELTR

SEQ ID NO: 538960 - protein, 9 aa, Homo Sapiens
LPELEDRLQ

SEQ ID NO: 538961 - protein, 9 aa, Homo Sapiens
MMVPAADIL

SEQ ID NO: 538962 - protein, 9 aa, Homo Sapiens
ASEEFQSLA

SEQ ID NO: 538963 - protein, 9 aa, Homo Sapiens
DGESLAERP

SEQ ID NO: 538964 - protein, 9 aa, Homo Sapiens
RILSDTWVQ

SEQ ID NO: 538965 - protein, 9 aa, Homo Sapiens
PENRTQTPS

SEQ ID NO: 538966 - protein, 9 aa, Homo Sapiens
RNGQIIKRV

SEQ ID NO: 538967 - protein, 9 aa, Homo Sapiens
KKPYKYEEC

SEQ ID NO: 538968 - protein, 9 aa, Homo Sapiens
HSLMRESGY

SEQ ID NO: 538969 - protein, 9 aa, Homo Sapiens
KCNQCVKVF

SEQ ID NO: 538970 - protein, 9 aa, Homo Sapiens
SLQLASATP

SEQ ID NO: 538971 - protein, 9 aa, Homo Sapiens
MMLALWLWG

SEQ ID NO: 538972 - protein, 9 aa, Homo Sapiens
QRLNLSATN

SEQ ID NO: 538973 - protein, 9 aa, Homo Sapiens
VLFIVVTPM

SEQ ID NO: 538974 - protein, 9 aa, Homo Sapiens
PACCPRPLY

SEQ ID NO: 538975 - protein, 9 aa, Homo Sapiens
HSAPGPVIQ

SEQ ID NO: 538976 - protein, 9 aa, Homo Sapiens
NQCVKVFNQ

SEQ ID NO: 538977 - protein, 9 aa, Homo Sapiens
NNSTWSNQI

SEQ ID NO: 538978 - protein, 9 aa, Homo Sapiens
DEPACCPRP

SEQ ID NO: 538979 - protein, 9 aa, Homo Sapiens
IMATVWSEC

SEQ ID NO: 538980 - protein, 9 aa, Homo Sapiens
IVVTPMMNP

SEQ ID NO: 538981 - protein, 9 aa, Homo Sapiens
RSDGDKEDE

SEQ ID NO: 538982 - protein, 9 aa, Homo Sapiens
VWSECSLHT

SEQ ID NO: 538983 - protein, 9 aa, Homo Sapiens
CPTHACDLP

SEQ ID NO: 538984 - protein, 9 aa, Homo Sapiens
TNAAVAELK

SEQ ID NO: 538985 - protein, 9 aa, Homo Sapiens
DREQDIGMR

SEQ ID NO: 538986 - protein, 9 aa, Homo Sapiens
TCTRVGTTR

SEQ ID NO: 538987 - protein, 9 aa, Homo Sapiens
MATVWSECS

SEQ ID NO: 538988 - protein, 9 aa, Homo Sapiens
DDEPACCPR

SEQ ID NO: 538989 - protein, 9 aa, Homo Sapiens
DLPCDLKLS

SEQ ID NO: 538990 - protein, 9 aa, Homo Sapiens
EHGLLTTVS

SEQ ID NO: 538991 - protein, 9 aa, Homo Sapiens
RVAYLPGCP

SEQ ID NO: 538992 - protein, 9 aa, Homo Sapiens
PTCTRVGTT

SEQ ID NO: 538993 - protein, 9 aa, Homo Sapiens
PDDEPACCP

SEQ ID NO: 538994 - protein, 9 aa, Homo Sapiens
ECSLHTPMY

SEQ ID NO: 538995 - protein, 9 aa, Homo Sapiens
DLLGRRRWL

SEQ ID NO: 538996 - protein, 9 aa, Homo Sapiens
TVSYKLGRE

SEQ ID NO: 538997 - protein, 9 aa, Homo Sapiens
ALGITLTPQ

SEQ ID NO: 538998 - protein, 9 aa, Homo Sapiens
CDLKLSFRI

SEQ ID NO: 538999 - protein, 9 aa, Homo Sapiens
LLGRRRWLS

SEQ ID NO: 539000 - protein, 9 aa, Homo Sapiens
ATVWSECSL

SEQ ID NO: 539001 - protein, 9 aa, Homo Sapiens
DSPSHIKHT

SEQ ID NO: 539002 - protein, 9 aa, Homo Sapiens
PQACPTHAC

SEQ ID NO: 539003 - protein, 9 aa, Homo Sapiens
RSSSPSTSS

SEQ ID NO: 539004 - protein, 9 aa, Homo Sapiens
CSLHTPMYL

SEQ ID NO: 539005 - protein, 9 aa, Homo Sapiens
GKKYQRLGR

SEQ ID NO: 539006 - protein, 9 aa, Homo Sapiens
KEDELVGSN

SEQ ID NO: 539007 - protein, 9 aa, Homo Sapiens
PRSSSPSTS

SEQ ID NO: 539008 - protein, 9 aa, Homo Sapiens
QIQNIQSWS

SEQ ID NO: 539009 - protein, 9 aa, Homo Sapiens
CDLPCDLKL

SEQ ID NO: 539010 - protein, 9 aa, Homo Sapiens
FQVWELQWS

SEQ ID NO: 539011 - protein, 9 aa, Homo Sapiens
AFSSARSVI

SEQ ID NO: 539012 - protein, 9 aa, Homo Sapiens
LQLASATPA

SEQ ID NO: 539013 - protein, 9 aa, Homo Sapiens
ACPTHACDL

SEQ ID NO: 539014 - protein, 9 aa, Homo Sapiens
TVWSECSLH

SEQ ID NO: 539015 - protein, 9 aa, Homo Sapiens
LASATPAIS

SEQ ID NO: 539016 - protein, 9 aa, Homo Sapiens
PPPPQDLLG

SEQ ID NO: 539017 - protein, 9 aa, Homo Sapiens
VGTTRHSWR

SEQ ID NO: 539018 - protein, 9 aa, Homo Sapiens
LWLWGFVHS

SEQ ID NO: 539019 - protein, 9 aa, Homo Sapiens
PCDLKLSFR

SEQ ID NO: 539020 - protein, 9 aa, Homo Sapiens
MLALWLWGF

SEQ ID NO: 539021 - protein, 9 aa, Homo Sapiens
DGDKEDELV

SEQ ID NO: 539022 - protein, 9 aa, Homo Sapiens
VIQPAPCPG

SEQ ID NO: 539023 - protein, 9 aa, Homo Sapiens
SATPAISST

SEQ ID NO: 539024 - protein, 9 aa, Homo Sapiens
QDLLGRRRW

SEQ ID NO: 539025 - protein, 9 aa, Homo Sapiens
YLPGCPEGN

SEQ ID NO: 539026 - protein, 9 aa, Homo Sapiens
SPSHIKHTS

SEQ ID NO: 539027 - protein, 9 aa, Homo Sapiens
QPAPCPGQA

SEQ ID NO: 539028 - protein, 9 aa, Homo Sapiens
TTRHSWRSR

SEQ ID NO: 539029 - protein, 9 aa, Homo Sapiens
MCVCVPHPQ

SEQ ID NO: 539030 - protein, 9 aa, Homo Sapiens
IKHTSHESA

SEQ ID NO: 539031 - protein, 9 aa, Homo Sapiens
WLWGFVHSI

SEQ ID NO: 539032 - protein, 9 aa, Homo Sapiens
YQARSDGDK

SEQ ID NO: 539033 - protein, 9 aa, Homo Sapiens
RKKTGSSST

SEQ ID NO: 539034 - protein, 9 aa, Homo Sapiens
ATPAISSTP

SEQ ID NO: 539035 - protein, 9 aa, Homo Sapiens
NLSATNAAV

SEQ ID NO: 539036 - protein, 9 aa, Homo Sapiens
IGMRKKTGS

SEQ ID NO: 539037 - protein, 9 aa, Homo Sapiens
RLGRASPAF

SEQ ID NO: 539038 - protein, 9 aa, Homo Sapiens
GMTPTAFSS

SEQ ID NO: 539039 - protein, 9 aa, Homo Sapiens
ATNAAVAEL

SEQ ID NO: 539040 - protein, 9 aa, Homo Sapiens
NSTWSNQIQ

SEQ ID NO: 539041 - protein, 9 aa, Homo Sapiens
VKVFNQASY

SEQ ID NO: 539042 - protein, 9 aa, Homo Sapiens
TRVAYLPGC

SEQ ID NO: 539043 - protein, 9 aa, Homo Sapiens
LWGFVHSII

SEQ ID NO: 539044 - protein, 9 aa, Homo Sapiens
TRHSWRSRQ

SEQ ID NO: 539045 - protein, 9 aa, Homo Sapiens
DLKLSFRIT

SEQ ID NO: 539046 - protein, 9 aa, Homo Sapiens
QPPPPQDLL

SEQ ID NO: 539047 - protein, 9 aa, Homo Sapiens
REQDIGMRK

SEQ ID NO: 539048 - protein, 9 aa, Homo Sapiens
DKEDELVGS

SEQ ID NO: 539049 - protein, 9 aa, Homo Sapiens
EQDIGMRKK

SEQ ID NO: 539050 - protein, 9 aa, Homo Sapiens
PPDDEPACC

SEQ ID NO: 539051 - protein, 9 aa, Homo Sapiens
IQNIQSWSN

SEQ ID NO: 539052 - protein, 9 aa, Homo Sapiens
AQPPPPQDL

SEQ ID NO: 539053 - protein, 9 aa, Homo Sapiens
WSECSLHTP

SEQ ID NO: 539054 - protein, 9 aa, Homo Sapiens
ASATPAISS

SEQ ID NO: 539055 - protein, 9 aa, Homo Sapiens
SSSPSTSSS

SEQ ID NO: 539056 - protein, 9 aa, Homo Sapiens
SPSTSSSST

SEQ ID NO: 539057 - protein, 9 aa, Homo Sapiens
SDGDKEDEL

SEQ ID NO: 539058 - protein, 9 aa, Homo Sapiens
MRKKTGSSS

SEQ ID NO: 539059 - protein, 9 aa, Homo Sapiens
CCPRPLYQY

SEQ ID NO: 539060 - protein, 9 aa, Homo Sapiens
GRASPAFDY

SEQ ID NO: 539061 - protein, 9 aa, Homo Sapiens
APGPVIQPA

SEQ ID NO: 539062 - protein, 9 aa, Homo Sapiens
CNQCVKVFN

SEQ ID NO: 539063 - protein, 9 aa, Homo Sapiens
IQPAPCPGQ

SEQ ID NO: 539064 - protein, 9 aa, Homo Sapiens
VPPDDEPAC

SEQ ID NO: 539065 - protein, 9 aa, Homo Sapiens
AFSSQHTAG

SEQ ID NO: 539066 - protein, 9 aa, Homo Sapiens
EDSPSHIKH

SEQ ID NO: 539067 - protein, 9 aa, Homo Sapiens
TPAISSTPY

SEQ ID NO: 539068 - protein, 9 aa, Homo Sapiens
ILPLFQVWE

SEQ ID NO: 539069 - protein, 9 aa, Homo Sapiens
QACPTHACD

SEQ ID NO: 539070 - protein, 9 aa, Homo Sapiens
VCVPHPQAC

SEQ ID NO: 539071 - protein, 9 aa, Homo Sapiens
GMRKKTGSS

SEQ ID NO: 539072 - protein, 9 aa, Homo Sapiens
PSHIKHTSH

SEQ ID NO: 539073 - protein, 9 aa, Homo Sapiens
RVGTTRHSW

SEQ ID NO: 539074 - protein, 9 aa, Homo Sapiens
KPYKCNQCV

SEQ ID NO: 539075 - protein, 9 aa, Homo Sapiens
THACDLPCD

SEQ ID NO: 539076 - protein, 9 aa, Homo Sapiens
LLTTVSYKL

SEQ ID NO: 539077 - protein, 9 aa, Homo Sapiens
TPTAFSSQH

SEQ ID NO: 539078 - protein, 9 aa, Homo Sapiens
LAFSSARSV

SEQ ID NO: 539079 - protein, 9 aa, Homo Sapiens
ACCPRPLYQ

SEQ ID NO: 539080 - protein, 9 aa, Homo Sapiens
ACDLPCDLK

SEQ ID NO: 539081 - protein, 9 aa, Homo Sapiens
SAPGPVIQP

SEQ ID NO: 539082 - protein, 9 aa, Homo Sapiens
TTRVAYLPG

SEQ ID NO: 539083 - protein, 9 aa, Homo Sapiens
QCVKVFNQA

SEQ ID NO: 539084 - protein, 9 aa, Homo Sapiens
TSSSSTSSP

SEQ ID NO: 539085 - protein, 9 aa, Homo Sapiens
LPCDLKLSF

SEQ ID NO: 539086 - protein, 9 aa, Homo Sapiens
KYQRLGRAS

SEQ ID NO: 539087 - protein, 9 aa, Homo Sapiens
SPRSSSPST

SEQ ID NO: 539088 - protein, 9 aa, Homo Sapiens
KKYQRLGRA

SEQ ID NO: 539089 - protein, 9 aa, Homo Sapiens
SNQIQNIQS

SEQ ID NO: 539090 - protein, 9 aa, Homo Sapiens
TWSNQIQNI

SEQ ID NO: 539091 - protein, 9 aa, Homo Sapiens
WRILPLFQV

SEQ ID NO: 539092 - protein, 9 aa, Homo Sapiens
GTTRHSWRS

SEQ ID NO: 539093 - protein, 9 aa, Homo Sapiens
RILPLFQVW

SEQ ID NO: 539094 - protein, 9 aa, Homo Sapiens
WGFVHSIIQ

SEQ ID NO: 539095 - protein, 9 aa, Homo Sapiens
PGPVIQPAP

SEQ ID NO: 539096 - protein, 9 aa, Homo Sapiens
ARSDGDKED

SEQ ID NO: 539097 - protein, 9 aa, Homo Sapiens
AGGMTPTAF

SEQ ID NO: 539098 - protein, 9 aa, Homo Sapiens
HPQACPTHA

SEQ ID NO: 539099 - protein, 9 aa, Homo Sapiens
WSNQIQNIQ

SEQ ID NO: 539100 - protein, 9 aa, Homo Sapiens
LGRASPAFD

SEQ ID NO: 539101 - protein, 9 aa, Homo Sapiens
PYKCNQCVK

SEQ ID NO: 539102 - protein, 9 aa, Homo Sapiens
QRLGRASPA

SEQ ID NO: 539103 - protein, 9 aa, Homo Sapiens
PSTSSSSTS

SEQ ID NO: 539104 - protein, 9 aa, Homo Sapiens
LKLSFRITI

SEQ ID NO: 539105 - protein, 9 aa, Homo Sapiens
NQIQNIQSW

SEQ ID NO: 539106 - protein, 9 aa, Homo Sapiens
SSPSTSSSS

SEQ ID NO: 539107 - protein, 9 aa, Homo Sapiens
LFIVVTPMM

SEQ ID NO: 539108 - protein, 9 aa, Homo Sapiens
VSYKLGREK

SEQ ID NO: 539109 - protein, 9 aa, Homo Sapiens
CVCVPHPQA

SEQ ID NO: 539110 - protein, 9 aa, Homo Sapiens
PQDLLGRRR

SEQ ID NO: 539111 - protein, 9 aa, Homo Sapiens
LTTVSYKLG

SEQ ID NO: 539112 - protein, 9 aa, Homo Sapiens
TAFSSQHTA

SEQ ID NO: 539113 - protein, 9 aa, Homo Sapiens
DIGMRKKTG

SEQ ID NO: 539114 - protein, 9 aa, Homo Sapiens
GLLTTVSYK

SEQ ID NO: 539115 - protein, 9 aa, Homo Sapiens
LSFRITISG

SEQ ID NO: 539116 - protein, 9 aa, Homo Sapiens
SYKLGREKP

SEQ ID NO: 539117 - protein, 9 aa, Homo Sapiens
LSATNAAVA

SEQ ID NO: 539118 - protein, 9 aa, Homo Sapiens
PTHACDLPC

SEQ ID NO: 539119 - protein, 9 aa, Homo Sapiens
TTVSYKLGR

SEQ ID NO: 539120 - protein, 9 aa, Homo Sapiens
SHIKHTSHE

SEQ ID NO: 539121 - protein, 9 aa, Homo Sapiens
RLNLSATNA

SEQ ID NO: 539122 - protein, 9 aa, Homo Sapiens
GCPEGNKVL

SEQ ID NO: 539123 - protein, 9 aa, Homo Sapiens
NLAFSSARS

SEQ ID NO: 539124 - protein, 9 aa, Homo Sapiens
STSSSSTSS

SEQ ID NO: 539125 - protein, 9 aa, Homo Sapiens
PLFQVWELQ

SEQ ID NO: 539126 - protein, 9 aa, Homo Sapiens
IGAVLFIVV

SEQ ID NO: 539127 - protein, 9 aa, Homo Sapiens
FSSQHTAGV

SEQ ID NO: 539128 - protein, 9 aa, Homo Sapiens
LALWLWGFV

SEQ ID NO: 539129 - protein, 9 aa, Homo Sapiens
KSLQLASAT

SEQ ID NO: 539130 - protein, 9 aa, Homo Sapiens
LPGCPEGNK

SEQ ID NO: 539131 - protein, 9 aa, Homo Sapiens
PTAFSSQHT

SEQ ID NO: 539132 - protein, 9 aa, Homo Sapiens
GAVLFIVVT

SEQ ID NO: 539133 - protein, 9 aa, Homo Sapiens
GDKEDELVG

SEQ ID NO: 539134 - protein, 9 aa, Homo Sapiens
HGLLTTVSY

SEQ ID NO: 539135 - protein, 9 aa, Homo Sapiens
TRVGTTRHS

SEQ ID NO: 539136 - protein, 9 aa, Homo Sapiens
FIVVTPMMN

SEQ ID NO: 539137 - protein, 9 aa, Homo Sapiens
SQRLNLSAT

SEQ ID NO: 539138 - protein, 9 aa, Homo Sapiens
SGMCVCVPH

SEQ ID NO: 539139 - protein, 9 aa, Homo Sapiens
VAYLPGCPE

SEQ ID NO: 539140 - protein, 9 aa, Homo Sapiens
PPPQDLLGR

SEQ ID NO: 539141 - protein, 9 aa, Homo Sapiens
HSGMCVCVP

SEQ ID NO: 539142 - protein, 9 aa, Homo Sapiens
EKKLNLAFS

SEQ ID NO: 539143 - protein, 9 aa, Homo Sapiens
CTRVGTTRH

SEQ ID NO: 539144 - protein, 9 aa, Homo Sapiens
MTPTAFSSQ

SEQ ID NO: 539145 - protein, 9 aa, Homo Sapiens
AYLPGCPEG

SEQ ID NO: 539146 - protein, 9 aa, Homo Sapiens
PHPQACPTH

SEQ ID NO: 539147 - protein, 9 aa, Homo Sapiens
PVIQPAPCP

SEQ ID NO: 539148 - protein, 9 aa, Homo Sapiens
LFQVWELQW

SEQ ID NO: 539149 - protein, 9 aa, Homo Sapiens
YQRLGRASP

SEQ ID NO: 539150 - protein, 9 aa, Homo Sapiens
AVLFIVVTP

SEQ ID NO: 539151 - protein, 9 aa, Homo Sapiens
PGCPEGNKV

SEQ ID NO: 539152 - protein, 9 aa, Homo Sapiens
VPHPQACPT

SEQ ID NO: 539153 - protein, 9 aa, Homo Sapiens
AMMLALWLW

SEQ ID NO: 539154 - protein, 9 aa, Homo Sapiens
FSSARSVIL

SEQ ID NO: 539155 - protein, 9 aa, Homo Sapiens
QDIGMRKKT

SEQ ID NO: 539156 - protein, 9 aa, Homo Sapiens
SECSLHTPM

SEQ ID NO: 539157 - protein, 9 aa, Homo Sapiens
LPLFQVWEL

SEQ ID NO: 539158 - protein, 9 aa, Homo Sapiens
KIGAVLFIV

SEQ ID NO: 539159 - protein, 9 aa, Homo Sapiens
STWSNQIQN

SEQ ID NO: 539160 - protein, 9 aa, Homo Sapiens
EPACCPRPL

SEQ ID NO: 539161 - protein, 9 aa, Homo Sapiens
SSARSVILI

SEQ ID NO: 539162 - protein, 9 aa, Homo Sapiens
SATNAAVAE

SEQ ID NO: 539163 - protein, 9 aa, Homo Sapiens
KKLNLAFSS

SEQ ID NO: 539164 - protein, 9 aa, Homo Sapiens
QLASATPAI

SEQ ID NO: 539165 - protein, 9 aa, Homo Sapiens
RGKKYQRLG

SEQ ID NO: 539166 - protein, 9 aa, Homo Sapiens
KLNLAFSSA

SEQ ID NO: 539167 - protein, 9 aa, Homo Sapiens
LNLAFSSAR

SEQ ID NO: 539168 - protein, 9 aa, Homo Sapiens
KLSFRITIS

SEQ ID NO: 539169 - protein, 9 aa, Homo Sapiens
LNLSATNAA

SEQ ID NO: 539170 - protein, 9 aa, Homo Sapiens
GGMTPTAFS

SEQ ID NO: 539171 - protein, 9 aa, Homo Sapiens
HIKHTSHES

SEQ ID NO: 539172 - protein, 9 aa, Homo Sapiens
QARSDGDKE

SEQ ID NO: 539173 - protein, 9 aa, Homo Sapiens
ALWLWGFVH

SEQ ID NO: 539174 - protein, 9 aa, Homo Sapiens
HACDLPCDL

SEQ ID NO: 539175 - protein, 9 aa, Homo Sapiens
PPQDLLGRR

SEQ ID NO: 539176 - protein, 9 aa, Homo Sapiens
CVKVFNQAS

SEQ ID NO: 539177 - protein, 9 aa, Homo Sapiens
GMCVCVPHP

SEQ ID NO: 539178 - protein, 9 aa, Homo Sapiens
YKCNQCVKV

SEQ ID NO: 539179 - protein, 9 aa, Homo Sapiens
GPVIQPAPC

SEQ ID NO: 539180 - protein, 9 aa, Homo Sapiens
CVPHPQACP

SEQ ID NO: 539181 - protein, 9 aa, Homo Sapiens
SFRITISGP

SEQ ID NO: 539182 - protein, 9 aa, Homo Sapiens
DKIGAVLFI

SEQ ID NO: 539183 - protein, 9 aa, Homo Sapiens
EKMWEQVER

SEQ ID NO: 539184 - protein, 9 aa, Homo Sapiens
HIKGIRDKQ

SEQ ID NO: 539185 - protein, 9 aa, Homo Sapiens
AGRVPINKE

SEQ ID NO: 539186 - protein, 9 aa, Homo Sapiens
GMLGLSAGP

SEQ ID NO: 539187 - protein, 9 aa, Homo Sapiens
TSQTLKNSL

SEQ ID NO: 539188 - protein, 9 aa, Homo Sapiens
RVPINKELA

SEQ ID NO: 539189 - protein, 9 aa, Homo Sapiens
RDHYKSKGH

SEQ ID NO: 539190 - protein, 9 aa, Homo Sapiens
VESVLRYGF

SEQ ID NO: 539191 - protein, 9 aa, Homo Sapiens
SVLRYGFPV

SEQ ID NO: 539192 - protein, 9 aa, Homo Sapiens
RYGAQAPVS

SEQ ID NO: 539193 - protein, 9 aa, Homo Sapiens
NVAKTSITL

SEQ ID NO: 539194 - protein, 9 aa, Homo Sapiens
IEDLHEVYN

SEQ ID NO: 539195 - protein, 9 aa, Homo Sapiens
KTTLAATTT

SEQ ID NO: 539196 - protein, 9 aa, Homo Sapiens
PLSTPSSCL

SEQ ID NO: 539197 - protein, 9 aa, Homo Sapiens
HTTYDEHQV

SEQ ID NO: 539198 - protein, 9 aa, Homo Sapiens
EDLHEVYNA

SEQ ID NO: 539199 - protein, 9 aa, Homo Sapiens
TMFPLSTPS

SEQ ID NO: 539200 - protein, 9 aa, Homo Sapiens
VERMREEKK

SEQ ID NO: 539201 - protein, 9 aa, Homo Sapiens
MLGLSAGPT

SEQ ID NO: 539202 - protein, 9 aa, Homo Sapiens
GFPVNFQAM

SEQ ID NO: 539203 - protein, 9 aa, Homo Sapiens
DNNTSQTLK

SEQ ID NO: 539204 - protein, 9 aa, Homo Sapiens
DVHTTYDEH

SEQ ID NO: 539205 - protein, 9 aa, Homo Sapiens
VLRYGFPVN

SEQ ID NO: 539206 - protein, 9 aa, Homo Sapiens
NEQCCFDFG

SEQ ID NO: 539207 - protein, 9 aa, Homo Sapiens
QEGRDHYKS

SEQ ID NO: 539208 - protein, 9 aa, Homo Sapiens
PPLQSPEFI

SEQ ID NO: 539209 - protein, 9 aa, Homo Sapiens
VTQPPLQSP

SEQ ID NO: 539210 - protein, 9 aa, Homo Sapiens
TIEDLHEVY

SEQ ID NO: 539211 - protein, 9 aa, Homo Sapiens
VITIEDLHE

SEQ ID NO: 539212 - protein, 9 aa, Homo Sapiens
KHRFPKLPK

SEQ ID NO: 539213 - protein, 9 aa, Homo Sapiens
WEQVERMRE

SEQ ID NO: 539214 - protein, 9 aa, Homo Sapiens
YSMNEQCCF

SEQ ID NO: 539215 - protein, 9 aa, Homo Sapiens
CFDFGLGYM

SEQ ID NO: 539216 - protein, 9 aa, Homo Sapiens
LAGMLGLSA

SEQ ID NO: 539217 - protein, 9 aa, Homo Sapiens
LFKNTSVSP

SEQ ID NO: 539218 - protein, 9 aa, Homo Sapiens
VHTTYDEHQ

SEQ ID NO: 539219 - protein, 9 aa, Homo Sapiens
TTMFPLSTP

SEQ ID NO: 539220 - protein, 9 aa, Homo Sapiens
RKTTLAATT

SEQ ID NO: 539221 - protein, 9 aa, Homo Sapiens
FPLSTPSSC

SEQ ID NO: 539222 - protein, 9 aa, Homo Sapiens
KDKHRFPKL

SEQ ID NO: 539223 - protein, 9 aa, Homo Sapiens
ANVAKTSIT

SEQ ID NO: 539224 - protein, 9 aa, Homo Sapiens
SHMLCIRYG

SEQ ID NO: 539225 - protein, 9 aa, Homo Sapiens
LHEVYNAKH

SEQ ID NO: 539226 - protein, 9 aa, Homo Sapiens
PLQSPEFIL

SEQ ID NO: 539227 - protein, 9 aa, Homo Sapiens
VEADNNTSQ

SEQ ID NO: 539228 - protein, 9 aa, Homo Sapiens
MFPLSTPSS

SEQ ID NO: 539229 - protein, 9 aa, Homo Sapiens
RMREEKKMQ

SEQ ID NO: 539230 - protein, 9 aa, Homo Sapiens
EGRDHYKSK

SEQ ID NO: 539231 - protein, 9 aa, Homo Sapiens
LQTRKTTLA

SEQ ID NO: 539232 - protein, 9 aa, Homo Sapiens
KNTSVSPLY

SEQ ID NO: 539233 - protein, 9 aa, Homo Sapiens
SVSPLYSGC

SEQ ID NO: 539234 - protein, 9 aa, Homo Sapiens
TQPPLQSPE

SEQ ID NO: 539235 - protein, 9 aa, Homo Sapiens
SPEFILTQS

SEQ ID NO: 539236 - protein, 9 aa, Homo Sapiens
HMLCIRYGA

SEQ ID NO: 539237 - protein, 9 aa, Homo Sapiens
EGMDVHTTY

SEQ ID NO: 539238 - protein, 9 aa, Homo Sapiens
ADNNTSQTL

SEQ ID NO: 539239 - protein, 9 aa, Homo Sapiens
DFKDKHRFP

SEQ ID NO: 539240 - protein, 9 aa, Homo Sapiens
GRDHYKSKG

SEQ ID NO: 539241 - protein, 9 aa, Homo Sapiens
RDKQEKPLW

SEQ ID NO: 539242 - protein, 9 aa, Homo Sapiens
AMSHMLCIR

SEQ ID NO: 539243 - protein, 9 aa, Homo Sapiens
TRKTTLAAT

SEQ ID NO: 539244 - protein, 9 aa, Homo Sapiens
VPINKELAL

SEQ ID NO: 539245 - protein, 9 aa, Homo Sapiens
SPLYSGCRL

SEQ ID NO: 539246 - protein, 9 aa, Homo Sapiens
QTLKNSLLA

SEQ ID NO: 539247 - protein, 9 aa, Homo Sapiens
CIRYGAQAP

SEQ ID NO: 539248 - protein, 9 aa, Homo Sapiens
LAATTTTTT

SEQ ID NO: 539249 - protein, 9 aa, Homo Sapiens
KGIRDKQEK

SEQ ID NO: 539250 - protein, 9 aa, Homo Sapiens
YGFPVNFQA

SEQ ID NO: 539251 - protein, 9 aa, Homo Sapiens
YTTMFPLST

SEQ ID NO: 539252 - protein, 9 aa, Homo Sapiens
RFSGVTEAN

SEQ ID NO: 539253 - protein, 9 aa, Homo Sapiens
MDVHTTYDE

SEQ ID NO: 539254 - protein, 9 aa, Homo Sapiens
LSTPSSCLH

SEQ ID NO: 539255 - protein, 9 aa, Homo Sapiens
MNEQCCFDF

SEQ ID NO: 539256 - protein, 9 aa, Homo Sapiens
AGMLGLSAG

SEQ ID NO: 539257 - protein, 9 aa, Homo Sapiens
SMNEQCCFD

SEQ ID NO: 539258 - protein, 9 aa, Homo Sapiens
VIGRKKPGQ

SEQ ID NO: 539259 - protein, 9 aa, Homo Sapiens
NTSQTLKNS

SEQ ID NO: 539260 - protein, 9 aa, Homo Sapiens
VRFVIGRKK

SEQ ID NO: 539261 - protein, 9 aa, Homo Sapiens
KQEGRDHYK

SEQ ID NO: 539262 - protein, 9 aa, Homo Sapiens
NNTSQTLKN

SEQ ID NO: 539263 - protein, 9 aa, Homo Sapiens
GVITIEDLH

SEQ ID NO: 539264 - protein, 9 aa, Homo Sapiens
EQCCFDFGL

SEQ ID NO: 539265 - protein, 9 aa, Homo Sapiens
IVAGRVPIN

SEQ ID NO: 539266 - protein, 9 aa, Homo Sapiens
QPPLQSPEF

SEQ ID NO: 539267 - protein, 9 aa, Homo Sapiens
DSHLAGMLG

SEQ ID NO: 539268 - protein, 9 aa, Homo Sapiens
DKHRFPKLP

SEQ ID NO: 539269 - protein, 9 aa, Homo Sapiens
LRYGFPVNF

SEQ ID NO: 539270 - protein, 9 aa, Homo Sapiens
IGRKKPGQV

SEQ ID NO: 539271 - protein, 9 aa, Homo Sapiens
FSGVTEANV

SEQ ID NO: 539272 - protein, 9 aa, Homo Sapiens
GIRDKQEKP

SEQ ID NO: 539273 - protein, 9 aa, Homo Sapiens
YKSKGHFHR

SEQ ID NO: 539274 - protein, 9 aa, Homo Sapiens
TTLAATTTT

SEQ ID NO: 539275 - protein, 9 aa, Homo Sapiens
ITIEDLHEV

SEQ ID NO: 539276 - protein, 9 aa, Homo Sapiens
ACEGMDVHT

SEQ ID NO: 539277 - protein, 9 aa, Homo Sapiens
EDSHLAGML

SEQ ID NO: 539278 - protein, 9 aa, Homo Sapiens
HYSMNEQCC

SEQ ID NO: 539279 - protein, 9 aa, Homo Sapiens
DFWDFKDKH

SEQ ID NO: 539280 - protein, 9 aa, Homo Sapiens
QTRKTTLAA

SEQ ID NO: 539281 - protein, 9 aa, Homo Sapiens
IRDKQEKPL

SEQ ID NO: 539282 - protein, 9 aa, Homo Sapiens
TPSSCLHWH

SEQ ID NO: 539283 - protein, 9 aa, Homo Sapiens
MLCIRYGAQ

SEQ ID NO: 539284 - protein, 9 aa, Homo Sapiens
HYKSKGHFH

SEQ ID NO: 539285 - protein, 9 aa, Homo Sapiens
STPSSCLHW

SEQ ID NO: 539286 - protein, 9 aa, Homo Sapiens
CCFDFGLGY

SEQ ID NO: 539287 - protein, 9 aa, Homo Sapiens
SQTLKNSLL

SEQ ID NO: 539288 - protein, 9 aa, Homo Sapiens
ILQTRKTTL

SEQ ID NO: 539289 - protein, 9 aa, Homo Sapiens
ESVLRYGFP

SEQ ID NO: 539290 - protein, 9 aa, Homo Sapiens
TSVSPLYSG

SEQ ID NO: 539291 - protein, 9 aa, Homo Sapiens
NKQEGRDHY

SEQ ID NO: 539292 - protein, 9 aa, Homo Sapiens
FVIGRKKPG

SEQ ID NO: 539293 - protein, 9 aa, Homo Sapiens
DHIKGIRDK

SEQ ID NO: 539294 - protein, 9 aa, Homo Sapiens
HLAGMLGLS

SEQ ID NO: 539295 - protein, 9 aa, Homo Sapiens
GRVPINKEL

SEQ ID NO: 539296 - protein, 9 aa, Homo Sapiens
REIVAGRVP

SEQ ID NO: 539297 - protein, 9 aa, Homo Sapiens
NVRFVIGRK

SEQ ID NO: 539298 - protein, 9 aa, Homo Sapiens
SGVTEANVA

SEQ ID NO: 539299 - protein, 9 aa, Homo Sapiens
EEDSHLAGM

SEQ ID NO: 539300 - protein, 9 aa, Homo Sapiens
DLHEVYNAK

SEQ ID NO: 539301 - protein, 9 aa, Homo Sapiens
VAGRVPINK

SEQ ID NO: 539302 - protein, 9 aa, Homo Sapiens
HRFPKLPKL

SEQ ID NO: 539303 - protein, 9 aa, Homo Sapiens
WDFKDKHRF

SEQ ID NO: 539304 - protein, 9 aa, Homo Sapiens
IKGIRDKQE

SEQ ID NO: 539305 - protein, 9 aa, Homo Sapiens
GRKKPGQVS

SEQ ID NO: 539306 - protein, 9 aa, Homo Sapiens
FPVNFQAML

SEQ ID NO: 539307 - protein, 9 aa, Homo Sapiens
MSHMLCIRY

SEQ ID NO: 539308 - protein, 9 aa, Homo Sapiens
EANVAKTSI

SEQ ID NO: 539309 - protein, 9 aa, Homo Sapiens
SREIVAGRV

SEQ ID NO: 539310 - protein, 9 aa, Homo Sapiens
VDHIKGIRD

SEQ ID NO: 539311 - protein, 9 aa, Homo Sapiens
EQVERMREE

SEQ ID NO: 539312 - protein, 9 aa, Homo Sapiens
TEANVAKTS

SEQ ID NO: 539313 - protein, 9 aa, Homo Sapiens
QVERMREEK

SEQ ID NO: 539314 - protein, 9 aa, Homo Sapiens
SHLAGMLGL

SEQ ID NO: 539315 - protein, 9 aa, Homo Sapiens
GMDVHTTYD

SEQ ID NO: 539316 - protein, 9 aa, Homo Sapiens
TLAATTTTT

SEQ ID NO: 539317 - protein, 9 aa, Homo Sapiens
KKPGQVSEV

SEQ ID NO: 539318 - protein, 9 aa, Homo Sapiens
LCIRYGAQA

SEQ ID NO: 539319 - protein, 9 aa, Homo Sapiens
QCCFDFGLG

SEQ ID NO: 539320 - protein, 9 aa, Homo Sapiens
CEGMDVHTT

SEQ ID NO: 539321 - protein, 9 aa, Homo Sapiens
LVTQPPLQS

SEQ ID NO: 539322 - protein, 9 aa, Homo Sapiens
EIVAGRVPI

SEQ ID NO: 539323 - protein, 9 aa, Homo Sapiens
HEVYNAKHH

SEQ ID NO: 539324 - protein, 9 aa, Homo Sapiens
DHYKSKGHF

SEQ ID NO: 539325 - protein, 9 aa, Homo Sapiens
VTEANVAKT

SEQ ID NO: 539326 - protein, 9 aa, Homo Sapiens
TTYDEHQVT

SEQ ID NO: 539327 - protein, 9 aa, Homo Sapiens
IRYGAQAPV

SEQ ID NO: 539328 - protein, 9 aa, Homo Sapiens
KMWEQVERM

SEQ ID NO: 539329 - protein, 9 aa, Homo Sapiens
GVTEANVAK

SEQ ID NO: 539330 - protein, 9 aa, Homo Sapiens
LQSPEFILT

SEQ ID NO: 539331 - protein, 9 aa, Homo Sapiens
FKDKHRFPK

SEQ ID NO: 539332 - protein, 9 aa, Homo Sapiens
MWEQVERMR

SEQ ID NO: 539333 - protein, 9 aa, Homo Sapiens
ERMREEKKM

SEQ ID NO: 539334 - protein, 9 aa, Homo Sapiens
NTSVSPLYS

SEQ ID NO: 539335 - protein, 9 aa, Homo Sapiens
DKQEKPLWQ

SEQ ID NO: 539336 - protein, 9 aa, Homo Sapiens
QSPEFILTQ

SEQ ID NO: 539337 - protein, 9 aa, Homo Sapiens
VSPLYSGCR

SEQ ID NO: 539338 - protein, 9 aa, Homo Sapiens
EADNNTSQT

SEQ ID NO: 539339 - protein, 9 aa, Homo Sapiens
FKNTSVSPL

SEQ ID NO: 539340 - protein, 9 aa, Homo Sapiens
RKKPGQVSE

SEQ ID NO: 539341 - protein, 9 aa, Homo Sapiens
RYGFPVNFQ

SEQ ID NO: 539342 - protein, 9 aa, Homo Sapiens
RFVIGRKKP

SEQ ID NO: 539343 - protein, 9 aa, Homo Sapiens
FWDFKDKHR

SEQ ID NO: 539344 - protein, 9 aa, Homo Sapiens
EIRRKFGSF

SEQ ID NO: 539345 - protein, 9 aa, Homo Sapiens
CIFNLLVKF

SEQ ID NO: 539346 - protein, 9 aa, Homo Sapiens
LLAAQTKVI

SEQ ID NO: 539347 - protein, 9 aa, Homo Sapiens
GKCGAGKSA

SEQ ID NO: 539348 - protein, 9 aa, Homo Sapiens
DREKQEEMT

SEQ ID NO: 539349 - protein, 9 aa, Homo Sapiens
QSHGCNSAF

SEQ ID NO: 539350 - protein, 9 aa, Homo Sapiens
TSSFCCQSH

SEQ ID NO: 539351 - protein, 9 aa, Homo Sapiens
KPDKAMWAP

SEQ ID NO: 539352 - protein, 9 aa, Homo Sapiens
YPMPGPMYR

SEQ ID NO: 539353 - protein, 9 aa, Homo Sapiens
PFHRLPLRP

SEQ ID NO: 539354 - protein, 9 aa, Homo Sapiens
GSLRRMTYF

SEQ ID NO: 539355 - protein, 9 aa, Homo Sapiens
QAWPFHRLP

SEQ ID NO: 539356 - protein, 9 aa, Homo Sapiens
FVLLLSAIV

SEQ ID NO: 539357 - protein, 9 aa, Homo Sapiens
FHRLPLRPL

SEQ ID NO: 539358 - protein, 9 aa, Homo Sapiens
VQAWPFHRL

SEQ ID NO: 539359 - protein, 9 aa, Homo Sapiens
EALWHFLLM

SEQ ID NO: 539360 - protein, 9 aa, Homo Sapiens
GHPQCLDYR

SEQ ID NO: 539361 - protein, 9 aa, Homo Sapiens
SSDSSDSND

SEQ ID NO: 539362 - protein, 9 aa, Homo Sapiens
SFCCQSHGC

SEQ ID NO: 539363 - protein, 9 aa, Homo Sapiens
QLNSYYYPY

SEQ ID NO: 539364 - protein, 9 aa, Homo Sapiens
HYEALWHFL

SEQ ID NO: 539365 - protein, 9 aa, Homo Sapiens
IFNLLVKFV

SEQ ID NO: 539366 - protein, 9 aa, Homo Sapiens
WPFHRLPLR

SEQ ID NO: 539367 - protein, 9 aa, Homo Sapiens
NSYYYPYPM

SEQ ID NO: 539368 - protein, 9 aa, Homo Sapiens
DSNDSSDSS

SEQ ID NO: 539369 - protein, 9 aa, Homo Sapiens
GGGERMTRF

SEQ ID NO: 539370 - protein, 9 aa, Homo Sapiens
LLLSAIVSI

SEQ ID NO: 539371 - protein, 9 aa, Homo Sapiens
DYRPPFQPP

SEQ ID NO: 539372 - protein, 9 aa, Homo Sapiens
ASFYDAGLL

SEQ ID NO: 539373 - protein, 9 aa, Homo Sapiens
TYFLFLSEL

SEQ ID NO: 539374 - protein, 9 aa, Homo Sapiens
TVLLVGKCG

SEQ ID NO: 539375 - protein, 9 aa, Homo Sapiens
LDYRPPFQP

SEQ ID NO: 539376 - protein, 9 aa, Homo Sapiens
AQTKVIHRL

SEQ ID NO: 539377 - protein, 9 aa, Homo Sapiens
LEAHYEALW

SEQ ID NO: 539378 - protein, 9 aa, Homo Sapiens
HPQCLDYRP

SEQ ID NO: 539379 - protein, 9 aa, Homo Sapiens
ALWHFLLME

SEQ ID NO: 539380 - protein, 9 aa, Homo Sapiens
CLDYRPPFQ

SEQ ID NO: 539381 - protein, 9 aa, Homo Sapiens
QKEIRRKFG

SEQ ID NO: 539382 - protein, 9 aa, Homo Sapiens
YEALWHFLL

SEQ ID NO: 539383 - protein, 9 aa, Homo Sapiens
DKAMWAPSS

SEQ ID NO: 539384 - protein, 9 aa, Homo Sapiens
SQVAASFYD

SEQ ID NO: 539385 - protein, 9 aa, Homo Sapiens
LRRMTYFLF

SEQ ID NO: 539386 - protein, 9 aa, Homo Sapiens
ASSQVAASF

SEQ ID NO: 539387 - protein, 9 aa, Homo Sapiens
SSQVAASFY

SEQ ID NO: 539388 - protein, 9 aa, Homo Sapiens
WHFLLMEDG

SEQ ID NO: 539389 - protein, 9 aa, Homo Sapiens
SSDSNDSSD

SEQ ID NO: 539390 - protein, 9 aa, Homo Sapiens
HRLPLRPLI

SEQ ID NO: 539391 - protein, 9 aa, Homo Sapiens
MTYFLFLSE

SEQ ID NO: 539392 - protein, 9 aa, Homo Sapiens
FYDAGLLLV

SEQ ID NO: 539393 - protein, 9 aa, Homo Sapiens
LQKEIRRKF

SEQ ID NO: 539394 - protein, 9 aa, Homo Sapiens
FCCQSHGCN

SEQ ID NO: 539395 - protein, 9 aa, Homo Sapiens
LGGGERMTR

SEQ ID NO: 539396 - protein, 9 aa, Homo Sapiens
GWKDREKQE

SEQ ID NO: 539397 - protein, 9 aa, Homo Sapiens
AMWAPSSAG

SEQ ID NO: 539398 - protein, 9 aa, Homo Sapiens
SLRRMTYFL

SEQ ID NO: 539399 - protein, 9 aa, Homo Sapiens
LVKFVSSRI

SEQ ID NO: 539400 - protein, 9 aa, Homo Sapiens
SDSNDSSDS

SEQ ID NO: 539401 - protein, 9 aa, Homo Sapiens
RKFGSFIWE

SEQ ID NO: 539402 - protein, 9 aa, Homo Sapiens
AHYEALWHF

SEQ ID NO: 539403 - protein, 9 aa, Homo Sapiens
KQEEMTDDR

SEQ ID NO: 539404 - protein, 9 aa, Homo Sapiens
YFLFLSELD

SEQ ID NO: 539405 - protein, 9 aa, Homo Sapiens
EAHYEALWH

SEQ ID NO: 539406 - protein, 9 aa, Homo Sapiens
TRFELTEGV

SEQ ID NO: 539407 - protein, 9 aa, Homo Sapiens
VKFVSSRIE

SEQ ID NO: 539408 - protein, 9 aa, Homo Sapiens
YYYPYPMPG

SEQ ID NO: 539409 - protein, 9 aa, Homo Sapiens
AAQTKVIHR

SEQ ID NO: 539410 - protein, 9 aa, Homo Sapiens
KFGSFIWEQ

SEQ ID NO: 539411 - protein, 9 aa, Homo Sapiens
LLVGKCGAG

SEQ ID NO: 539412 - protein, 9 aa, Homo Sapiens
KFVSSRIEA

SEQ ID NO: 539413 - protein, 9 aa, Homo Sapiens
YPYPMPGPM

SEQ ID NO: 539414 - protein, 9 aa, Homo Sapiens
PDKAMWAPS

SEQ ID NO: 539415 - protein, 9 aa, Homo Sapiens
WAPSSAGGL

SEQ ID NO: 539416 - protein, 9 aa, Homo Sapiens
ALLAAQTKV

SEQ ID NO: 539417 - protein, 9 aa, Homo Sapiens
SDSSDSNDS

SEQ ID NO: 539418 - protein, 9 aa, Homo Sapiens
PCIFNLLVK

SEQ ID NO: 539419 - protein, 9 aa, Homo Sapiens
FNLLVKFVS

SEQ ID NO: 539420 - protein, 9 aa, Homo Sapiens
AIVSISALS

SEQ ID NO: 539421 - protein, 9 aa, Homo Sapiens
CGAGKSAAG

SEQ ID NO: 539422 - protein, 9 aa, Homo Sapiens
QEEMTDDRA

SEQ ID NO: 539423 - protein, 9 aa, Homo Sapiens
RRKFGSFIW

SEQ ID NO: 539424 - protein, 9 aa, Homo Sapiens
MTRFELTEG

SEQ ID NO: 539425 - protein, 9 aa, Homo Sapiens
KCGAGKSAA

SEQ ID NO: 539426 - protein, 9 aa, Homo Sapiens
LMVQAWPFH

SEQ ID NO: 539427 - protein, 9 aa, Homo Sapiens
NLLVKFVSS

SEQ ID NO: 539428 - protein, 9 aa, Homo Sapiens
LAAQTKVIH

SEQ ID NO: 539429 - protein, 9 aa, Homo Sapiens
IRRKFGSFI

SEQ ID NO: 539430 - protein, 9 aa, Homo Sapiens
LSAIVSISA

SEQ ID NO: 539431 - protein, 9 aa, Homo Sapiens
PPKPDKAMW

SEQ ID NO: 539432 - protein, 9 aa, Homo Sapiens
FLFLSELDT

SEQ ID NO: 539433 - protein, 9 aa, Homo Sapiens
WKDREKQEE

SEQ ID NO: 539434 - protein, 9 aa, Homo Sapiens
TLVALLAAQ

SEQ ID NO: 539435 - protein, 9 aa, Homo Sapiens
NDSSDSSDS

SEQ ID NO: 539436 - protein, 9 aa, Homo Sapiens
GGERMTRFE

SEQ ID NO: 539437 - protein, 9 aa, Homo Sapiens
YYPYPMPGP

SEQ ID NO: 539438 - protein, 9 aa, Homo Sapiens
VGKCGAGKS

SEQ ID NO: 539439 - protein, 9 aa, Homo Sapiens
LVGKCGAGK

SEQ ID NO: 539440 - protein, 9 aa, Homo Sapiens
SFYDAGLLL

SEQ ID NO: 539441 - protein, 9 aa, Homo Sapiens
CCQSHGCNS

SEQ ID NO: 539442 - protein, 9 aa, Homo Sapiens
SYYYPYPMP

SEQ ID NO: 539443 - protein, 9 aa, Homo Sapiens
DSSDSNDSS

SEQ ID NO: 539444 - protein, 9 aa, Homo Sapiens
VAASFYDAG

SEQ ID NO: 539445 - protein, 9 aa, Homo Sapiens
RPPFQPPLH

SEQ ID NO: 539446 - protein, 9 aa, Homo Sapiens
MVQAWPFHR

SEQ ID NO: 539447 - protein, 9 aa, Homo Sapiens
KAMWAPSSA

SEQ ID NO: 539448 - protein, 9 aa, Homo Sapiens
ERMTRFELT

SEQ ID NO: 539449 - protein, 9 aa, Homo Sapiens
IIFVLLLSA

SEQ ID NO: 539450 - protein, 9 aa, Homo Sapiens
QTKVIHRLQ

SEQ ID NO: 539451 - protein, 9 aa, Homo Sapiens
CQSHGCNSA

SEQ ID NO: 539452 - protein, 9 aa, Homo Sapiens
KEIRRKFGS

SEQ ID NO: 539453 - protein, 9 aa, Homo Sapiens
LNSYYYPYP

SEQ ID NO: 539454 - protein, 9 aa, Homo Sapiens
RMTRFELTE

SEQ ID NO: 539455 - protein, 9 aa, Homo Sapiens
PYPMPGPMY

SEQ ID NO: 539456 - protein, 9 aa, Homo Sapiens
QCLDYRPPF

SEQ ID NO: 539457 - protein, 9 aa, Homo Sapiens
GERMTRFEL

SEQ ID NO: 539458 - protein, 9 aa, Homo Sapiens
IFVLLLSAI

SEQ ID NO: 539459 - protein, 9 aa, Homo Sapiens
RRMTYFLFL

SEQ ID NO: 539460 - protein, 9 aa, Homo Sapiens
SNDSSDSSD

SEQ ID NO: 539461 - protein, 9 aa, Homo Sapiens
MWAPSSAGG

SEQ ID NO: 539462 - protein, 9 aa, Homo Sapiens
AASFYDAGL

SEQ ID NO: 539463 - protein, 9 aa, Homo Sapiens
LTVLLVGKC

SEQ ID NO: 539464 - protein, 9 aa, Homo Sapiens
LLSAIVSIS

SEQ ID NO: 539465 - protein, 9 aa, Homo Sapiens
PQCLDYRPP

SEQ ID NO: 539466 - protein, 9 aa, Homo Sapiens
YRPPFQPPL

SEQ ID NO: 539467 - protein, 9 aa, Homo Sapiens
QVAASFYDA

SEQ ID NO: 539468 - protein, 9 aa, Homo Sapiens
EKQEEMTDD

SEQ ID NO: 539469 - protein, 9 aa, Homo Sapiens
FGSFIWEQD

SEQ ID NO: 539470 - protein, 9 aa, Homo Sapiens
RFELTEGVK

SEQ ID NO: 539471 - protein, 9 aa, Homo Sapiens
WGWKDREKQ

SEQ ID NO: 539472 - protein, 9 aa, Homo Sapiens
KDREKQEEM

SEQ ID NO: 539473 - protein, 9 aa, Homo Sapiens
LLVKFVSSR

SEQ ID NO: 539474 - protein, 9 aa, Homo Sapiens
REKQEEMTD

SEQ ID NO: 539475 - protein, 9 aa, Homo Sapiens
VALLAAQTK

SEQ ID NO: 539476 - protein, 9 aa, Homo Sapiens
SSFCCQSHG

SEQ ID NO: 539477 - protein, 9 aa, Homo Sapiens
LWHFLLMED

SEQ ID NO: 539478 - protein, 9 aa, Homo Sapiens
RMTYFLFLS

SEQ ID NO: 539479 - protein, 9 aa, Homo Sapiens
PKPDKAMWA

SEQ ID NO: 539480 - protein, 9 aa, Homo Sapiens
HGCNSAFLS

SEQ ID NO: 539481 - protein, 9 aa, Homo Sapiens
AWPFHRLPL

SEQ ID NO: 539482 - protein, 9 aa, Homo Sapiens
SAIVSISAL

SEQ ID NO: 539483 - protein, 9 aa, Homo Sapiens
VLLLSAIVS

SEQ ID NO: 539484 - protein, 9 aa, Homo Sapiens
VLLVGKCGA

SEQ ID NO: 539485 - protein, 9 aa, Homo Sapiens
SHGCNSAFL

SEQ ID NO: 539486 - protein, 9 aa, Homo Sapiens
LVALLAAQT

SEQ ID NO: 539487 - protein, 9 aa, Homo Sapiens
SKWAWTDVF

SEQ ID NO: 539488 - protein, 9 aa, Homo Sapiens
ASAGGAGAG

SEQ ID NO: 539489 - protein, 9 aa, Homo Sapiens
SCCRPSCCL

SEQ ID NO: 539490 - protein, 9 aa, Homo Sapiens
VPNMTPSAV

SEQ ID NO: 539491 - protein, 9 aa, Homo Sapiens
HALGPQGPL

SEQ ID NO: 539492 - protein, 9 aa, Homo Sapiens
CPGAPVCFD

SEQ ID NO: 539493 - protein, 9 aa, Homo Sapiens
RHQPQYVEK

SEQ ID NO: 539494 - protein, 9 aa, Homo Sapiens
LRSPVHSSC

SEQ ID NO: 539495 - protein, 9 aa, Homo Sapiens
KKSEEDLFL

SEQ ID NO: 539496 - protein, 9 aa, Homo Sapiens
SHKMMFETI

SEQ ID NO: 539497 - protein, 9 aa, Homo Sapiens
KFEAWSKWA

SEQ ID NO: 539498 - protein, 9 aa, Homo Sapiens
DVVLVAVAA

SEQ ID NO: 539499 - protein, 9 aa, Homo Sapiens
VVSLCYGPL

SEQ ID NO: 539500 - protein, 9 aa, Homo Sapiens
RPVALLSHK

SEQ ID NO: 539501 - protein, 9 aa, Homo Sapiens
DSRHQPQYV

SEQ ID NO: 539502 - protein, 9 aa, Homo Sapiens
RPSCCLTTC

SEQ ID NO: 539503 - protein, 9 aa, Homo Sapiens
RSPVHSSCI

SEQ ID NO: 539504 - protein, 9 aa, Homo Sapiens
NMTPSAVGR

SEQ ID NO: 539505 - protein, 9 aa, Homo Sapiens
VVLVAVAAL

SEQ ID NO: 539506 - protein, 9 aa, Homo Sapiens
LPEPSTADQ

SEQ ID NO: 539507 - protein, 9 aa, Homo Sapiens
CLGTTPSVY

SEQ ID NO: 539508 - protein, 9 aa, Homo Sapiens
PSTADQPHR

SEQ ID NO: 539509 - protein, 9 aa, Homo Sapiens
LQVILKSIM

SEQ ID NO: 539510 - protein, 9 aa, Homo Sapiens
VILKSIMKA

SEQ ID NO: 539511 - protein, 9 aa, Homo Sapiens
RTLGLRSPV

SEQ ID NO: 539512 - protein, 9 aa, Homo Sapiens
VLSVALWLS

SEQ ID NO: 539513 - protein, 9 aa, Homo Sapiens
AWIHTLLKD

SEQ ID NO: 539514 - protein, 9 aa, Homo Sapiens
FLPEPSTAD

SEQ ID NO: 539515 - protein, 9 aa, Homo Sapiens
EPVLSVALW

SEQ ID NO: 539516 - protein, 9 aa, Homo Sapiens
IVLRDSRHQ

SEQ ID NO: 539517 - protein, 9 aa, Homo Sapiens
AVVSLCYGP

SEQ ID NO: 539518 - protein, 9 aa, Homo Sapiens
LSIVLRDSR

SEQ ID NO: 539519 - protein, 9 aa, Homo Sapiens
NLSAFSEWT

SEQ ID NO: 539520 - protein, 9 aa, Homo Sapiens
GLGGTETYL

SEQ ID NO: 539521 - protein, 9 aa, Homo Sapiens
SPLVVAKGG

SEQ ID NO: 539522 - protein, 9 aa, Homo Sapiens
EVGLGGTET

SEQ ID NO: 539523 - protein, 9 aa, Homo Sapiens
GLETSESVS

SEQ ID NO: 539524 - protein, 9 aa, Homo Sapiens
SAFSEWTLG

SEQ ID NO: 539525 - protein, 9 aa, Homo Sapiens
RVNLTFCKI

SEQ ID NO: 539526 - protein, 9 aa, Homo Sapiens
EAWSKWAWT

SEQ ID NO: 539527 - protein, 9 aa, Homo Sapiens
LGPQGPLGL

SEQ ID NO: 539528 - protein, 9 aa, Homo Sapiens
GMQCLGTTP

SEQ ID NO: 539529 - protein, 9 aa, Homo Sapiens
VSDSLYDSL

SEQ ID NO: 539530 - protein, 9 aa, Homo Sapiens
MTPSAVGRE

SEQ ID NO: 539531 - protein, 9 aa, Homo Sapiens
CFDLGLGLP

SEQ ID NO: 539532 - protein, 9 aa, Homo Sapiens
IARTLGLRS

SEQ ID NO: 539533 - protein, 9 aa, Homo Sapiens
LETSESVSD

SEQ ID NO: 539534 - protein, 9 aa, Homo Sapiens
SESVSDSLY

SEQ ID NO: 539535 - protein, 9 aa, Homo Sapiens
VCCVHQTTG

SEQ ID NO: 539536 - protein, 9 aa, Homo Sapiens
GGPVREPVL

SEQ ID NO: 539537 - protein, 9 aa, Homo Sapiens
PCEDPASAG

SEQ ID NO: 539538 - protein, 9 aa, Homo Sapiens
ARTLGLRSP

SEQ ID NO: 539539 - protein, 9 aa, Homo Sapiens
NLTFCKILL

SEQ ID NO: 539540 - protein, 9 aa, Homo Sapiens
AFSEWTLGL

SEQ ID NO: 539541 - protein, 9 aa, Homo Sapiens
STGDGAWIH

SEQ ID NO: 539542 - protein, 9 aa, Homo Sapiens
DLGLGLPVD

SEQ ID NO: 539543 - protein, 9 aa, Homo Sapiens
HPGLVCCVH

SEQ ID NO: 539544 - protein, 9 aa, Homo Sapiens
LTTCCRTTC

SEQ ID NO: 539545 - protein, 9 aa, Homo Sapiens
PKSLSVAPL

SEQ ID NO: 539546 - protein, 9 aa, Homo Sapiens
VHQTTGVPL

SEQ ID NO: 539547 - protein, 9 aa, Homo Sapiens
LGLRSPVHS

SEQ ID NO: 539548 - protein, 9 aa, Homo Sapiens
APLAVNVMG

SEQ ID NO: 539549 - protein, 9 aa, Homo Sapiens
LVCCVHQTT

SEQ ID NO: 539550 - protein, 9 aa, Homo Sapiens
PGVLWDVVL

SEQ ID NO: 539551 - protein, 9 aa, Homo Sapiens
SLSVAPLAV

SEQ ID NO: 539552 - protein, 9 aa, Homo Sapiens
LWDVVLVAV

SEQ ID NO: 539553 - protein, 9 aa, Homo Sapiens
RPGVLWDVV

SEQ ID NO: 539554 - protein, 9 aa, Homo Sapiens
LSVAPLAVN

SEQ ID NO: 539555 - protein, 9 aa, Homo Sapiens
FDLGLGLPV

SEQ ID NO: 539556 - protein, 9 aa, Homo Sapiens
PEPSTADQP

SEQ ID NO: 539557 - protein, 9 aa, Homo Sapiens
WTLGLGPLS

SEQ ID NO: 539558 - protein, 9 aa, Homo Sapiens
YLDGKKSEE

SEQ ID NO: 539559 - protein, 9 aa, Homo Sapiens
QSPQTTQAT

SEQ ID NO: 539560 - protein, 9 aa, Homo Sapiens
CVHQTTGVP

SEQ ID NO: 539561 - protein, 9 aa, Homo Sapiens
APVCFDLGL

SEQ ID NO: 539562 - protein, 9 aa, Homo Sapiens
VLVAVAALG

SEQ ID NO: 539563 - protein, 9 aa, Homo Sapiens
EVVYLDGKK

SEQ ID NO: 539564 - protein, 9 aa, Homo Sapiens
LSAFSEWTL

SEQ ID NO: 539565 - protein, 9 aa, Homo Sapiens
PLAVNVMGT

SEQ ID NO: 539566 - protein, 9 aa, Homo Sapiens
SGIPSLQVI

SEQ ID NO: 539567 - protein, 9 aa, Homo Sapiens
LLSHKMMFE

SEQ ID NO: 539568 - protein, 9 aa, Homo Sapiens
GPVREPVLS

SEQ ID NO: 539569 - protein, 9 aa, Homo Sapiens
SLQVILKSI

SEQ ID NO: 539570 - protein, 9 aa, Homo Sapiens
DYRPVALLS

SEQ ID NO: 539571 - protein, 9 aa, Homo Sapiens
TFCKILLTK

SEQ ID NO: 539572 - protein, 9 aa, Homo Sapiens
PASAGGAGA

SEQ ID NO: 539573 - protein, 9 aa, Homo Sapiens
VSLCYGPLM

SEQ ID NO: 539574 - protein, 9 aa, Homo Sapiens
GLVCCVHQT

SEQ ID NO: 539575 - protein, 9 aa, Homo Sapiens
VGHALGPQG

SEQ ID NO: 539576 - protein, 9 aa, Homo Sapiens
GAWIHTLLK

SEQ ID NO: 539577 - protein, 9 aa, Homo Sapiens
VNLTFCKIL

SEQ ID NO: 539578 - protein, 9 aa, Homo Sapiens
GIPSLQVIL

SEQ ID NO: 539579 - protein, 9 aa, Homo Sapiens
DGAWIHTLL

SEQ ID NO: 539580 - protein, 9 aa, Homo Sapiens
QVHEVGLGG

SEQ ID NO: 539581 - protein, 9 aa, Homo Sapiens
ILKSIMKAM

SEQ ID NO: 539582 - protein, 9 aa, Homo Sapiens
DPASAGGAG

SEQ ID NO: 539583 - protein, 9 aa, Homo Sapiens
SKFEAWSKW

SEQ ID NO: 539584 - protein, 9 aa, Homo Sapiens
LCYGPLMVM

SEQ ID NO: 539585 - protein, 9 aa, Homo Sapiens
CHPSHSSGC

SEQ ID NO: 539586 - protein, 9 aa, Homo Sapiens
WAWTDVFLQ

SEQ ID NO: 539587 - protein, 9 aa, Homo Sapiens
VVSTVGMQC

SEQ ID NO: 539588 - protein, 9 aa, Homo Sapiens
VVYLDGKKS

SEQ ID NO: 539589 - protein, 9 aa, Homo Sapiens
HQTTGVPLV

SEQ ID NO: 539590 - protein, 9 aa, Homo Sapiens
TSESVSDSL

SEQ ID NO: 539591 - protein, 9 aa, Homo Sapiens
DGKKSEEDL

SEQ ID NO: 539592 - protein, 9 aa, Homo Sapiens
VSTVGMQCL

SEQ ID NO: 539593 - protein, 9 aa, Homo Sapiens
SVSDSLYDS

SEQ ID NO: 539594 - protein, 9 aa, Homo Sapiens
VLWDVVLVA

SEQ ID NO: 539595 - protein, 9 aa, Homo Sapiens
STADQPHRG

SEQ ID NO: 539596 - protein, 9 aa, Homo Sapiens
MQCLGTTPS

SEQ ID NO: 539597 - protein, 9 aa, Homo Sapiens
EWTLGLGPL

SEQ ID NO: 539598 - protein, 9 aa, Homo Sapiens
PGLETSESV

SEQ ID NO: 539599 - protein, 9 aa, Homo Sapiens
QTTQATHPC

SEQ ID NO: 539600 - protein, 9 aa, Homo Sapiens
ESVSDSLYD

SEQ ID NO: 539601 - protein, 9 aa, Homo Sapiens
FSEWTLGLG

SEQ ID NO: 539602 - protein, 9 aa, Homo Sapiens
GVLWDVVLV

SEQ ID NO: 539603 - protein, 9 aa, Homo Sapiens
QFPCCQSPQ

SEQ ID NO: 539604 - protein, 9 aa, Homo Sapiens
CRPSCCLTT

SEQ ID NO: 539605 - protein, 9 aa, Homo Sapiens
PGPCEDPAS

SEQ ID NO: 539606 - protein, 9 aa, Homo Sapiens
QVILKSIMK

SEQ ID NO: 539607 - protein, 9 aa, Homo Sapiens
GDGAWIHTL

SEQ ID NO: 539608 - protein, 9 aa, Homo Sapiens
PLVVAKGGT

SEQ ID NO: 539609 - protein, 9 aa, Homo Sapiens
SRHQPQYVE

SEQ ID NO: 539610 - protein, 9 aa, Homo Sapiens
GKKSEEDLF

SEQ ID NO: 539611 - protein, 9 aa, Homo Sapiens
AVGRERHSC

SEQ ID NO: 539612 - protein, 9 aa, Homo Sapiens
KWAWTDVFL

SEQ ID NO: 539613 - protein, 9 aa, Homo Sapiens
PSAVGRERH

SEQ ID NO: 539614 - protein, 9 aa, Homo Sapiens
CCRPSCCLT

SEQ ID NO: 539615 - protein, 9 aa, Homo Sapiens
PRVNLTFCK

SEQ ID NO: 539616 - protein, 9 aa, Homo Sapiens
SVAPLAVNV

SEQ ID NO: 539617 - protein, 9 aa, Homo Sapiens
GGTETYLPP

SEQ ID NO: 539618 - protein, 9 aa, Homo Sapiens
CEDPASAGG

SEQ ID NO: 539619 - protein, 9 aa, Homo Sapiens
CCVHQTTGV

SEQ ID NO: 539620 - protein, 9 aa, Homo Sapiens
FPCCQSPQT

SEQ ID NO: 539621 - protein, 9 aa, Homo Sapiens
ETSESVSDS

SEQ ID NO: 539622 - protein, 9 aa, Homo Sapiens
PCCQSPQTT

SEQ ID NO: 539623 - protein, 9 aa, Homo Sapiens
STVGMQCLG

SEQ ID NO: 539624 - protein, 9 aa, Homo Sapiens
TVGMQCLGT

SEQ ID NO: 539625 - protein, 9 aa, Homo Sapiens
PGLVCCVHQ

SEQ ID NO: 539626 - protein, 9 aa, Homo Sapiens
QGPLGLFRP

SEQ ID NO: 539627 - protein, 9 aa, Homo Sapiens
APRVNLTFC

SEQ ID NO: 539628 - protein, 9 aa, Homo Sapiens
LPKSLSVAP

SEQ ID NO: 539629 - protein, 9 aa, Homo Sapiens
CLTTCCRTT

SEQ ID NO: 539630 - protein, 9 aa, Homo Sapiens
PSLQVILKS

SEQ ID NO: 539631 - protein, 9 aa, Homo Sapiens
CCQSPQTTQ

SEQ ID NO: 539632 - protein, 9 aa, Homo Sapiens
LGGTETYLP

SEQ ID NO: 539633 - protein, 9 aa, Homo Sapiens
PVPNMTPSA

SEQ ID NO: 539634 - protein, 9 aa, Homo Sapiens
GPQGPLGLF

SEQ ID NO: 539635 - protein, 9 aa, Homo Sapiens
PVLSVALWL

SEQ ID NO: 539636 - protein, 9 aa, Homo Sapiens
PSSTGDGAW

SEQ ID NO: 539637 - protein, 9 aa, Homo Sapiens
SLCYGPLMV

SEQ ID NO: 539638 - protein, 9 aa, Homo Sapiens
VYLDGKKSE

SEQ ID NO: 539639 - protein, 9 aa, Homo Sapiens
LAVVSLCYG

SEQ ID NO: 539640 - protein, 9 aa, Homo Sapiens
PVALLSHKM

SEQ ID NO: 539641 - protein, 9 aa, Homo Sapiens
AWSKWAWTD

SEQ ID NO: 539642 - protein, 9 aa, Homo Sapiens
VREPVLSVA

SEQ ID NO: 539643 - protein, 9 aa, Homo Sapiens
MGGPVREPV

SEQ ID NO: 539644 - protein, 9 aa, Homo Sapiens
GHALGPQGP

SEQ ID NO: 539645 - protein, 9 aa, Homo Sapiens
QCLGTTPSV

SEQ ID NO: 539646 - protein, 9 aa, Homo Sapiens
FEAWSKWAW

SEQ ID NO: 539647 - protein, 9 aa, Homo Sapiens
TGDGAWIHT

SEQ ID NO: 539648 - protein, 9 aa, Homo Sapiens
GPLMVMYVS

SEQ ID NO: 539649 - protein, 9 aa, Homo Sapiens
MCHPSHSSG

SEQ ID NO: 539650 - protein, 9 aa, Homo Sapiens
SAVGRERHS

SEQ ID NO: 539651 - protein, 9 aa, Homo Sapiens
RDSRHQPQY

SEQ ID NO: 539652 - protein, 9 aa, Homo Sapiens
PGAPVCFDL

SEQ ID NO: 539653 - protein, 9 aa, Homo Sapiens
YRPVALLSH

SEQ ID NO: 539654 - protein, 9 aa, Homo Sapiens
LDGKKSEED

SEQ ID NO: 539655 - protein, 9 aa, Homo Sapiens
SEWTLGLGP

SEQ ID NO: 539656 - protein, 9 aa, Homo Sapiens
SVGHALGPQ

SEQ ID NO: 539657 - protein, 9 aa, Homo Sapiens
GAPVCFDLG

SEQ ID NO: 539658 - protein, 9 aa, Homo Sapiens
WIHTLLKDL

SEQ ID NO: 539659 - protein, 9 aa, Homo Sapiens
PVREPVLSV

SEQ ID NO: 539660 - protein, 9 aa, Homo Sapiens
LVVAKGGTA

SEQ ID NO: 539661 - protein, 9 aa, Homo Sapiens
ALLSHKMMF

SEQ ID NO: 539662 - protein, 9 aa, Homo Sapiens
LTFCKILLT

SEQ ID NO: 539663 - protein, 9 aa, Homo Sapiens
SPQTTQATH

SEQ ID NO: 539664 - protein, 9 aa, Homo Sapiens
GPCEDPASA

SEQ ID NO: 539665 - protein, 9 aa, Homo Sapiens
SIVLRDSRH

SEQ ID NO: 539666 - protein, 9 aa, Homo Sapiens
VALLSHKMM

SEQ ID NO: 539667 - protein, 9 aa, Homo Sapiens
CQSPQTTQA

SEQ ID NO: 539668 - protein, 9 aa, Homo Sapiens
SSTGDGAWI

SEQ ID NO: 539669 - protein, 9 aa, Homo Sapiens
TISPLVVAK

SEQ ID NO: 539670 - protein, 9 aa, Homo Sapiens
VAKGGTAWL

SEQ ID NO: 539671 - protein, 9 aa, Homo Sapiens
KQVHEVGLG

SEQ ID NO: 539672 - protein, 9 aa, Homo Sapiens
REPVLSVAL

SEQ ID NO: 539673 - protein, 9 aa, Homo Sapiens
FCKILLTKK

SEQ ID NO: 539674 - protein, 9 aa, Homo Sapiens
CYGPLMVMY

SEQ ID NO: 539675 - protein, 9 aa, Homo Sapiens
HEVGLGGTE

SEQ ID NO: 539676 - protein, 9 aa, Homo Sapiens
VCFDLGLGL

SEQ ID NO: 539677 - protein, 9 aa, Homo Sapiens
ISPLVVAKG

SEQ ID NO: 539678 - protein, 9 aa, Homo Sapiens
EPSTADQPH

SEQ ID NO: 539679 - protein, 9 aa, Homo Sapiens
SAGGAGAGG

SEQ ID NO: 539680 - protein, 9 aa, Homo Sapiens
IPSLQVILK

SEQ ID NO: 539681 - protein, 9 aa, Homo Sapiens
PQTTQATHP

SEQ ID NO: 539682 - protein, 9 aa, Homo Sapiens
SPVHSSCIP

SEQ ID NO: 539683 - protein, 9 aa, Homo Sapiens
VVAKGGTAW

SEQ ID NO: 539684 - protein, 9 aa, Homo Sapiens
RGGFLPEPS

SEQ ID NO: 539685 - protein, 9 aa, Homo Sapiens
TPSAVGRER

SEQ ID NO: 539686 - protein, 9 aa, Homo Sapiens
WEVVYLDGK

SEQ ID NO: 539687 - protein, 9 aa, Homo Sapiens
GGFLPEPST

SEQ ID NO: 539688 - protein, 9 aa, Homo Sapiens
WSKWAWTDV

SEQ ID NO: 539689 - protein, 9 aa, Homo Sapiens
LRDSRHQPQ

SEQ ID NO: 539690 - protein, 9 aa, Homo Sapiens
RNLSAFSEW

SEQ ID NO: 539691 - protein, 9 aa, Homo Sapiens
PQGPLGLFR

SEQ ID NO: 539692 - protein, 9 aa, Homo Sapiens
VAPLAVNVM

SEQ ID NO: 539693 - protein, 9 aa, Homo Sapiens
PVCFDLGLG

SEQ ID NO: 539694 - protein, 9 aa, Homo Sapiens
LSHKMMFET

SEQ ID NO: 539695 - protein, 9 aa, Homo Sapiens
PSCCLTTCC

SEQ ID NO: 539696 - protein, 9 aa, Homo Sapiens
PSHSSGCPM

SEQ ID NO: 539697 - protein, 9 aa, Homo Sapiens
ALGPQGPLG

SEQ ID NO: 539698 - protein, 9 aa, Homo Sapiens
KSLSVAPLA

SEQ ID NO: 539699 - protein, 9 aa, Homo Sapiens
KGGTAWLEW

SEQ ID NO: 539700 - protein, 9 aa, Homo Sapiens
YGPLMVMYV

SEQ ID NO: 539701 - protein, 9 aa, Homo Sapiens
VHEVGLGGT

SEQ ID NO: 539702 - protein, 9 aa, Homo Sapiens
HPSHSSGCP

SEQ ID NO: 539703 - protein, 9 aa, Homo Sapiens
TLGLRSPVH

SEQ ID NO: 539704 - protein, 9 aa, Homo Sapiens
WDVVLVAVA

SEQ ID NO: 539705 - protein, 9 aa, Homo Sapiens
CCLTTCCRT

SEQ ID NO: 539706 - protein, 9 aa, Homo Sapiens
VGLGGTETY

SEQ ID NO: 539707 - protein, 9 aa, Homo Sapiens
EDPASAGGA

SEQ ID NO: 539708 - protein, 9 aa, Homo Sapiens
SCCLTTCCR

SEQ ID NO: 539709 - protein, 9 aa, Homo Sapiens
GLRSPVHSS

SEQ ID NO: 539710 - protein, 9 aa, Homo Sapiens
GFLPEPSTA

SEQ ID NO: 539711 - protein, 9 aa, Homo Sapiens
VGMQCLGTT

SEQ ID NO: 539712 - protein, 9 aa, Homo Sapiens
VLRDSRHQP

SEQ ID NO: 539713 - protein, 9 aa, Homo Sapiens
AKGGTAWLE

SEQ ID NO: 539714 - protein, 9 aa, Homo Sapiens
PNMTPSAVG

SEQ ID NO: 539715 - protein, 9 aa, Homo Sapiens
YENRSVFKS

SEQ ID NO: 539716 - protein, 9 aa, Homo Sapiens
TKNEIITKF

SEQ ID NO: 539717 - protein, 9 aa, Homo Sapiens
DLGSPGALA

SEQ ID NO: 539718 - protein, 9 aa, Homo Sapiens
SRDLTEAVP

SEQ ID NO: 539719 - protein, 9 aa, Homo Sapiens
PLPRTLTTR

SEQ ID NO: 539720 - protein, 9 aa, Homo Sapiens
KLSLPESLK

SEQ ID NO: 539721 - protein, 9 aa, Homo Sapiens
TYHFRVTIL

SEQ ID NO: 539722 - protein, 9 aa, Homo Sapiens
RTSRDGVSR

SEQ ID NO: 539723 - protein, 9 aa, Homo Sapiens
MASNDNANN

SEQ ID NO: 539724 - protein, 9 aa, Homo Sapiens
YHFRVTILP

SEQ ID NO: 539725 - protein, 9 aa, Homo Sapiens
PVPLPVPVP

SEQ ID NO: 539726 - protein, 9 aa, Homo Sapiens
KAQGFGNAK

SEQ ID NO: 539727 - protein, 9 aa, Homo Sapiens
VQEALRLLR

SEQ ID NO: 539728 - protein, 9 aa, Homo Sapiens
QGFGNAKSR

SEQ ID NO: 539729 - protein, 9 aa, Homo Sapiens
QPLPRTLTT

SEQ ID NO: 539730 - protein, 9 aa, Homo Sapiens
SGPGASPQP

SEQ ID NO: 539731 - protein, 9 aa, Homo Sapiens
PPPGTGTPR

SEQ ID NO: 539732 - protein, 9 aa, Homo Sapiens
GVSRDLTEA

SEQ ID NO: 539733 - protein, 9 aa, Homo Sapiens
SANKTNKQT

SEQ ID NO: 539734 - protein, 9 aa, Homo Sapiens
FGNAKSRAR

SEQ ID NO: 539735 - protein, 9 aa, Homo Sapiens
RLLRGLGGR

SEQ ID NO: 539736 - protein, 9 aa, Homo Sapiens
AAKAQGFGN

SEQ ID NO: 539737 - protein, 9 aa, Homo Sapiens
VYCQGHEPA

SEQ ID NO: 539738 - protein, 9 aa, Homo Sapiens
FKSLDLGWK

SEQ ID NO: 539739 - protein, 9 aa, Homo Sapiens
SWAERNCSV

SEQ ID NO: 539740 - protein, 9 aa, Homo Sapiens
ENRSVFKSL

SEQ ID NO: 539741 - protein, 9 aa, Homo Sapiens
NNTCKMMLA

SEQ ID NO: 539742 - protein, 9 aa, Homo Sapiens
SDLKSHEIS

SEQ ID NO: 539743 - protein, 9 aa, Homo Sapiens
TGTPRASGP

SEQ ID NO: 539744 - protein, 9 aa, Homo Sapiens
GTYHFRVTI

SEQ ID NO: 539745 - protein, 9 aa, Homo Sapiens
PGALALPSA

SEQ ID NO: 539746 - protein, 9 aa, Homo Sapiens
GKEFIGRHS

SEQ ID NO: 539747 - protein, 9 aa, Homo Sapiens
LALPSAVPD

SEQ ID NO: 539748 - protein, 9 aa, Homo Sapiens
RIQLEPLPS

SEQ ID NO: 539749 - protein, 9 aa, Homo Sapiens
NAKSRARYG

SEQ ID NO: 539750 - protein, 9 aa, Homo Sapiens
EADPSSNAA

SEQ ID NO: 539751 - protein, 9 aa, Homo Sapiens
CTACRTSDS

SEQ ID NO: 539752 - protein, 9 aa, Homo Sapiens
MTIEELLTC

SEQ ID NO: 539753 - protein, 9 aa, Homo Sapiens
TTYFPWNLH

SEQ ID NO: 539754 - protein, 9 aa, Homo Sapiens
CRTSDSSAR

SEQ ID NO: 539755 - protein, 9 aa, Homo Sapiens
RTLTTRSAR

SEQ ID NO: 539756 - protein, 9 aa, Homo Sapiens
ITATVTAPH

SEQ ID NO: 539757 - protein, 9 aa, Homo Sapiens
KFEKINEGR

SEQ ID NO: 539758 - protein, 9 aa, Homo Sapiens
LREKIMKLS

SEQ ID NO: 539759 - protein, 9 aa, Homo Sapiens
ERNCSVINS

SEQ ID NO: 539760 - protein, 9 aa, Homo Sapiens
RSLTPSRHR

SEQ ID NO: 539761 - protein, 9 aa, Homo Sapiens
ANNTCKMML

SEQ ID NO: 539762 - protein, 9 aa, Homo Sapiens
PPGTGTPRA

SEQ ID NO: 539763 - protein, 9 aa, Homo Sapiens
PRASGPGAS

SEQ ID NO: 539764 - protein, 9 aa, Homo Sapiens
SVFKSLDLG

SEQ ID NO: 539765 - protein, 9 aa, Homo Sapiens
SSCTACRTS

SEQ ID NO: 539766 - protein, 9 aa, Homo Sapiens
LTCYGQNCH

SEQ ID NO: 539767 - protein, 9 aa, Homo Sapiens
SLSSHQRKH

SEQ ID NO: 539768 - protein, 9 aa, Homo Sapiens
GASPQPLPR

SEQ ID NO: 539769 - protein, 9 aa, Homo Sapiens
IQSDLKSHE

SEQ ID NO: 539770 - protein, 9 aa, Homo Sapiens
TACRTSDSS

SEQ ID NO: 539771 - protein, 9 aa, Homo Sapiens
ISTITATVT

SEQ ID NO: 539772 - protein, 9 aa, Homo Sapiens
NTLTTYFPW

SEQ ID NO: 539773 - protein, 9 aa, Homo Sapiens
FPWNLHEPE

SEQ ID NO: 539774 - protein, 9 aa, Homo Sapiens
PLPSLTPKF

SEQ ID NO: 539775 - protein, 9 aa, Homo Sapiens
TIEELLTCY

SEQ ID NO: 539776 - protein, 9 aa, Homo Sapiens
RLSKKFEKI

SEQ ID NO: 539777 - protein, 9 aa, Homo Sapiens
FEKINEGRM

SEQ ID NO: 539778 - protein, 9 aa, Homo Sapiens
KDLGSPGAL

SEQ ID NO: 539779 - protein, 9 aa, Homo Sapiens
EELLTCYGQ

SEQ ID NO: 539780 - protein, 9 aa, Homo Sapiens
EKVTSANKT

SEQ ID NO: 539781 - protein, 9 aa, Homo Sapiens
KIMKLSLPE

SEQ ID NO: 539782 - protein, 9 aa, Homo Sapiens
SAPLPVPLP

SEQ ID NO: 539783 - protein, 9 aa, Homo Sapiens
KEADPSSNA

SEQ ID NO: 539784 - protein, 9 aa, Homo Sapiens
MGTSLPTTW

SEQ ID NO: 539785 - protein, 9 aa, Homo Sapiens
PLPVPLPVP

SEQ ID NO: 539786 - protein, 9 aa, Homo Sapiens
HSLSSHQRK

SEQ ID NO: 539787 - protein, 9 aa, Homo Sapiens
SARMGTSLP

SEQ ID NO: 539788 - protein, 9 aa, Homo Sapiens
IEELLTCYG

SEQ ID NO: 539789 - protein, 9 aa, Homo Sapiens
NKTNKQTTT

SEQ ID NO: 539790 - protein, 9 aa, Homo Sapiens
GTPRASGPG

SEQ ID NO: 539791 - protein, 9 aa, Homo Sapiens
LPVPVPSYG

SEQ ID NO: 539792 - protein, 9 aa, Homo Sapiens
IMKLSLPES

SEQ ID NO: 539793 - protein, 9 aa, Homo Sapiens
NEIITKFLQ

SEQ ID NO: 539794 - protein, 9 aa, Homo Sapiens
LDDISLKPD

SEQ ID NO: 539795 - protein, 9 aa, Homo Sapiens
LDSVYCQGH

SEQ ID NO: 539796 - protein, 9 aa, Homo Sapiens
WAERNCSVI

SEQ ID NO: 539797 - protein, 9 aa, Homo Sapiens
RRSWAERNC

SEQ ID NO: 539798 - protein, 9 aa, Homo Sapiens
LPSLTPKFL

SEQ ID NO: 539799 - protein, 9 aa, Homo Sapiens
TLTTRSARM

SEQ ID NO: 539800 - protein, 9 aa, Homo Sapiens
VTILPPVEK

SEQ ID NO: 539801 - protein, 9 aa, Homo Sapiens
LKEADPSSN

SEQ ID NO: 539802 - protein, 9 aa, Homo Sapiens
SPQPLPRTL

SEQ ID NO: 539803 - protein, 9 aa, Homo Sapiens
FRRSWAERN

SEQ ID NO: 539804 - protein, 9 aa, Homo Sapiens
LSSCTACRT

SEQ ID NO: 539805 - protein, 9 aa, Homo Sapiens
RASGPGASP

SEQ ID NO: 539806 - protein, 9 aa, Homo Sapiens
REGTYHFRV

SEQ ID NO: 539807 - protein, 9 aa, Homo Sapiens
QSAPLPVPL

SEQ ID NO: 539808 - protein, 9 aa, Homo Sapiens
APLPVPLPV

SEQ ID NO: 539809 - protein, 9 aa, Homo Sapiens
REKIMKLSL

SEQ ID NO: 539810 - protein, 9 aa, Homo Sapiens
DSVYCQGHE

SEQ ID NO: 539811 - protein, 9 aa, Homo Sapiens
TATVTAPHS

SEQ ID NO: 539812 - protein, 9 aa, Homo Sapiens
AKSTKNEII

SEQ ID NO: 539813 - protein, 9 aa, Homo Sapiens
SSNAAMRRK

SEQ ID NO: 539814 - protein, 9 aa, Homo Sapiens
RSVFKSLDL

SEQ ID NO: 539815 - protein, 9 aa, Homo Sapiens
RDGVSRDLT

SEQ ID NO: 539816 - protein, 9 aa, Homo Sapiens
TSRDGVSRD

SEQ ID NO: 539817 - protein, 9 aa, Homo Sapiens
PTTWRSLTP

SEQ ID NO: 539818 - protein, 9 aa, Homo Sapiens
PLPVPVPSY

SEQ ID NO: 539819 - protein, 9 aa, Homo Sapiens
GLNTLTTYF

SEQ ID NO: 539820 - protein, 9 aa, Homo Sapiens
VPLPVPVPS

SEQ ID NO: 539821 - protein, 9 aa, Homo Sapiens
NRSVFKSLD

SEQ ID NO: 539822 - protein, 9 aa, Homo Sapiens
TLTTYFPWN

SEQ ID NO: 539823 - protein, 9 aa, Homo Sapiens
EIITKFLQL

SEQ ID NO: 539824 - protein, 9 aa, Homo Sapiens
TWRSLTPSR

SEQ ID NO: 539825 - protein, 9 aa, Homo Sapiens
SLTPKFLNI

SEQ ID NO: 539826 - protein, 9 aa, Homo Sapiens
SNAAMRRKD

SEQ ID NO: 539827 - protein, 9 aa, Homo Sapiens
EKIMKLSLP

SEQ ID NO: 539828 - protein, 9 aa, Homo Sapiens
LSLPESLKA

SEQ ID NO: 539829 - protein, 9 aa, Homo Sapiens
MKLSLPESL

SEQ ID NO: 539830 - protein, 9 aa, Homo Sapiens
QSDLKSHEI

SEQ ID NO: 539831 - protein, 9 aa, Homo Sapiens
IGRHSLSSH

SEQ ID NO: 539832 - protein, 9 aa, Homo Sapiens
ARMGTSLPT

SEQ ID NO: 539833 - protein, 9 aa, Homo Sapiens
ASGPGASPQ

SEQ ID NO: 539834 - protein, 9 aa, Homo Sapiens
TITATVTAP

SEQ ID NO: 539835 - protein, 9 aa, Homo Sapiens
WRSLTPSRH

SEQ ID NO: 539836 - protein, 9 aa, Homo Sapiens
EKINEGRMP

SEQ ID NO: 539837 - protein, 9 aa, Homo Sapiens
AQGFGNAKS

SEQ ID NO: 539838 - protein, 9 aa, Homo Sapiens
TSANKTNKQ

SEQ ID NO: 539839 - protein, 9 aa, Homo Sapiens
HIWLDSVYC

SEQ ID NO: 539840 - protein, 9 aa, Homo Sapiens
AERNCSVIN

SEQ ID NO: 539841 - protein, 9 aa, Homo Sapiens
EPLPSLTPK

SEQ ID NO: 539842 - protein, 9 aa, Homo Sapiens
RSWAERNCS

SEQ ID NO: 539843 - protein, 9 aa, Homo Sapiens
PTHTISTIT

SEQ ID NO: 539844 - protein, 9 aa, Homo Sapiens
LPTTWRSLT

SEQ ID NO: 539845 - protein, 9 aa, Homo Sapiens
SKKFEKINE

SEQ ID NO: 539846 - protein, 9 aa, Homo Sapiens
SLPESLKAY

SEQ ID NO: 539847 - protein, 9 aa, Homo Sapiens
EGTYHFRVT

SEQ ID NO: 539848 - protein, 9 aa, Homo Sapiens
SLTPSRHRP

SEQ ID NO: 539849 - protein, 9 aa, Homo Sapiens
LKSHEISLE

SEQ ID NO: 539850 - protein, 9 aa, Homo Sapiens
STKNEIITK

SEQ ID NO: 539851 - protein, 9 aa, Homo Sapiens
ANKTNKQTT

SEQ ID NO: 539852 - protein, 9 aa, Homo Sapiens
VRLSKKFEK

SEQ ID NO: 539853 - protein, 9 aa, Homo Sapiens
VSRDLTEAV

SEQ ID NO: 539854 - protein, 9 aa, Homo Sapiens
KIQSDLKSH

SEQ ID NO: 539855 - protein, 9 aa, Homo Sapiens
GTSLPTTWR

SEQ ID NO: 539856 - protein, 9 aa, Homo Sapiens
STITATVTA

SEQ ID NO: 539857 - protein, 9 aa, Homo Sapiens
KVTSANKTN

SEQ ID NO: 539858 - protein, 9 aa, Homo Sapiens
YCQGHEPAI

SEQ ID NO: 539859 - protein, 9 aa, Homo Sapiens
TRSARMGTS

SEQ ID NO: 539860 - protein, 9 aa, Homo Sapiens
LPVPLPVPV

SEQ ID NO: 539861 - protein, 9 aa, Homo Sapiens
RNCSVINSQ

SEQ ID NO: 539862 - protein, 9 aa, Homo Sapiens
DPSSNAAMR

SEQ ID NO: 539863 - protein, 9 aa, Homo Sapiens
RELDDISLK

SEQ ID NO: 539864 - protein, 9 aa, Homo Sapiens
SLPTTWRSL

SEQ ID NO: 539865 - protein, 9 aa, Homo Sapiens
IQLEPLPSL

SEQ ID NO: 539866 - protein, 9 aa, Homo Sapiens
YFPWNLHEP

SEQ ID NO: 539867 - protein, 9 aa, Homo Sapiens
SNDNANNTC

SEQ ID NO: 539868 - protein, 9 aa, Homo Sapiens
LTTRSARMG

SEQ ID NO: 539869 - protein, 9 aa, Homo Sapiens
HTISTITAT

SEQ ID NO: 539870 - protein, 9 aa, Homo Sapiens
KEFIGRHSL

SEQ ID NO: 539871 - protein, 9 aa, Homo Sapiens
THTISTITA

SEQ ID NO: 539872 - protein, 9 aa, Homo Sapiens
SPEKVTSAN

SEQ ID NO: 539873 - protein, 9 aa, Homo Sapiens
EFIGRHSLS

SEQ ID NO: 539874 - protein, 9 aa, Homo Sapiens
GHIWLDSVY

SEQ ID NO: 539875 - protein, 9 aa, Homo Sapiens
ALRLLRGLG

SEQ ID NO: 539876 - protein, 9 aa, Homo Sapiens
NDNANNTCK

SEQ ID NO: 539877 - protein, 9 aa, Homo Sapiens
RHSLSSHQR

SEQ ID NO: 539878 - protein, 9 aa, Homo Sapiens
PRTLTTRSA

SEQ ID NO: 539879 - protein, 9 aa, Homo Sapiens
GNAKSRARY

SEQ ID NO: 539880 - protein, 9 aa, Homo Sapiens
TISTITATV

SEQ ID NO: 539881 - protein, 9 aa, Homo Sapiens
GPGASPQPL

SEQ ID NO: 539882 - protein, 9 aa, Homo Sapiens
PSLTPKFLN

SEQ ID NO: 539883 - protein, 9 aa, Homo Sapiens
RTSDSSARS

SEQ ID NO: 539884 - protein, 9 aa, Homo Sapiens
PYENRSVFK

SEQ ID NO: 539885 - protein, 9 aa, Homo Sapiens
RVTILPPVE

SEQ ID NO: 539886 - protein, 9 aa, Homo Sapiens
SPGALALPS

SEQ ID NO: 539887 - protein, 9 aa, Homo Sapiens
SLKPDPEPT

SEQ ID NO: 539888 - protein, 9 aa, Homo Sapiens
LTTYFPWNL

SEQ ID NO: 539889 - protein, 9 aa, Homo Sapiens
FIGRHSLSS

SEQ ID NO: 539890 - protein, 9 aa, Homo Sapiens
SCTACRTSD

SEQ ID NO: 539891 - protein, 9 aa, Homo Sapiens
GRHSLSSHQ

SEQ ID NO: 539892 - protein, 9 aa, Homo Sapiens
ALALPSAVP

SEQ ID NO: 539893 - protein, 9 aa, Homo Sapiens
DDISLKPDP

SEQ ID NO: 539894 - protein, 9 aa, Homo Sapiens
DGVSRDLTE

SEQ ID NO: 539895 - protein, 9 aa, Homo Sapiens
TCYGQNCHK

SEQ ID NO: 539896 - protein, 9 aa, Homo Sapiens
PEKVTSANK

SEQ ID NO: 539897 - protein, 9 aa, Homo Sapiens
TTWRSLTPS

SEQ ID NO: 539898 - protein, 9 aa, Homo Sapiens
DLKSHEISL

SEQ ID NO: 539899 - protein, 9 aa, Homo Sapiens
VTSANKTNK

SEQ ID NO: 539900 - protein, 9 aa, Homo Sapiens
KPDPEPTHE

SEQ ID NO: 539901 - protein, 9 aa, Homo Sapiens
SVYCQGHEP

SEQ ID NO: 539902 - protein, 9 aa, Homo Sapiens
EALRLLRGL

SEQ ID NO: 539903 - protein, 9 aa, Homo Sapiens
ACRTSDSSA

SEQ ID NO: 539904 - protein, 9 aa, Homo Sapiens
KSHEISLEE

SEQ ID NO: 539905 - protein, 9 aa, Homo Sapiens
TSDSSARSS

SEQ ID NO: 539906 - protein, 9 aa, Homo Sapiens
GPPPGTGTP

SEQ ID NO: 539907 - protein, 9 aa, Homo Sapiens
RMGTSLPTT

SEQ ID NO: 539908 - protein, 9 aa, Homo Sapiens
HFRVTILPP

SEQ ID NO: 539909 - protein, 9 aa, Homo Sapiens
NANNTCKMM

SEQ ID NO: 539910 - protein, 9 aa, Homo Sapiens
GFGNAKSRA

SEQ ID NO: 539911 - protein, 9 aa, Homo Sapiens
ELDDISLKP

SEQ ID NO: 539912 - protein, 9 aa, Homo Sapiens
KRTSRDGVS

SEQ ID NO: 539913 - protein, 9 aa, Homo Sapiens
ASPQPLPRT

SEQ ID NO: 539914 - protein, 9 aa, Homo Sapiens
IITKFLQLC

SEQ ID NO: 539915 - protein, 9 aa, Homo Sapiens
CYGQNCHKG

SEQ ID NO: 539916 - protein, 9 aa, Homo Sapiens
WLDSVYCQG

SEQ ID NO: 539917 - protein, 9 aa, Homo Sapiens
LEPLPSLTP

SEQ ID NO: 539918 - protein, 9 aa, Homo Sapiens
RGLGGRVDG

SEQ ID NO: 539919 - protein, 9 aa, Homo Sapiens
GALALPSAV

SEQ ID NO: 539920 - protein, 9 aa, Homo Sapiens
TYFPWNLHE

SEQ ID NO: 539921 - protein, 9 aa, Homo Sapiens
ELLTCYGQN

SEQ ID NO: 539922 - protein, 9 aa, Homo Sapiens
KSTKNEIIT

SEQ ID NO: 539923 - protein, 9 aa, Homo Sapiens
LAKSTKNEI

SEQ ID NO: 539924 - protein, 9 aa, Homo Sapiens
NCSVINSQT

SEQ ID NO: 539925 - protein, 9 aa, Homo Sapiens
SRDGVSRDL

SEQ ID NO: 539926 - protein, 9 aa, Homo Sapiens
AKAQGFGNA

SEQ ID NO: 539927 - protein, 9 aa, Homo Sapiens
PGASPQPLP

SEQ ID NO: 539928 - protein, 9 aa, Homo Sapiens
LLTCYGQNC

SEQ ID NO: 539929 - protein, 9 aa, Homo Sapiens
GTGTPRASG

SEQ ID NO: 539930 - protein, 9 aa, Homo Sapiens
PGPPPGTGT

SEQ ID NO: 539931 - protein, 9 aa, Homo Sapiens
TTRSARMGT

SEQ ID NO: 539932 - protein, 9 aa, Homo Sapiens
KNEIITKFL

SEQ ID NO: 539933 - protein, 9 aa, Homo Sapiens
RSARMGTSL

SEQ ID NO: 539934 - protein, 9 aa, Homo Sapiens
QLEPLPSLT

SEQ ID NO: 539935 - protein, 9 aa, Homo Sapiens
IWLDSVYCQ

SEQ ID NO: 539936 - protein, 9 aa, Homo Sapiens
LPRTLTTRS

SEQ ID NO: 539937 - protein, 9 aa, Homo Sapiens
ISLKPDPEP

SEQ ID NO: 539938 - protein, 9 aa, Homo Sapiens
AQKIQSDLK

SEQ ID NO: 539939 - protein, 9 aa, Homo Sapiens
DNANNTCKM

SEQ ID NO: 539940 - protein, 9 aa, Homo Sapiens
KSLDLGWKL

SEQ ID NO: 539941 - protein, 9 aa, Homo Sapiens
VFKSLDLGW

SEQ ID NO: 539942 - protein, 9 aa, Homo Sapiens
ASNDNANNT

SEQ ID NO: 539943 - protein, 9 aa, Homo Sapiens
ADPSSNAAM

SEQ ID NO: 539944 - protein, 9 aa, Homo Sapiens
PQPLPRTLT

SEQ ID NO: 539945 - protein, 9 aa, Homo Sapiens
NAAMRRKDS

SEQ ID NO: 539946 - protein, 9 aa, Homo Sapiens
LRGLGGRVD

SEQ ID NO: 539947 - protein, 9 aa, Homo Sapiens
QEALRLLRG

SEQ ID NO: 539948 - protein, 9 aa, Homo Sapiens
PSSNAAMRR

SEQ ID NO: 539949 - protein, 9 aa, Homo Sapiens
DISLKPDPE

SEQ ID NO: 539950 - protein, 9 aa, Homo Sapiens
LGSPGALAL

SEQ ID NO: 539951 - protein, 9 aa, Homo Sapiens
LSKKFEKIN

SEQ ID NO: 539952 - protein, 9 aa, Homo Sapiens
PGTGTPRAS

SEQ ID NO: 539953 - protein, 9 aa, Homo Sapiens
LLRGLGGRV

SEQ ID NO: 539954 - protein, 9 aa, Homo Sapiens
FRVTILPPV

SEQ ID NO: 539955 - protein, 9 aa, Homo Sapiens
TSLPTTWRS

SEQ ID NO: 539956 - protein, 9 aa, Homo Sapiens
NTCKMMLAT

SEQ ID NO: 539957 - protein, 9 aa, Homo Sapiens
KINEGRMPG

SEQ ID NO: 539958 - protein, 9 aa, Homo Sapiens
LNTLTTYFP

SEQ ID NO: 539959 - protein, 9 aa, Homo Sapiens
KKFEKINEG

SEQ ID NO: 539960 - protein, 9 aa, Homo Sapiens
TPRASGPGA

SEQ ID NO: 539961 - protein, 9 aa, Homo Sapiens
LKPDPEPTH

SEQ ID NO: 539962 - protein, 9 aa, Homo Sapiens
LRLLRGLGG

SEQ ID NO: 539963 - protein, 9 aa, Homo Sapiens
QKIQSDLKS

SEQ ID NO: 539964 - protein, 9 aa, Homo Sapiens
GSPGALALP

SEQ ID NO: 539965 - protein, 9 aa, Homo Sapiens
CVFCWWHHT

SEQ ID NO: 539966 - protein, 9 aa, Homo Sapiens
AQVEYNQSI

SEQ ID NO: 539967 - protein, 9 aa, Homo Sapiens
LEAQVSTGD

SEQ ID NO: 539968 - protein, 9 aa, Homo Sapiens
PSTSGKRPR

SEQ ID NO: 539969 - protein, 9 aa, Homo Sapiens
MSCGGGRSF

SEQ ID NO: 539970 - protein, 9 aa, Homo Sapiens
LFKTKEDCD

SEQ ID NO: 539971 - protein, 9 aa, Homo Sapiens
PPAERLRGP

SEQ ID NO: 539972 - protein, 9 aa, Homo Sapiens
GLKPQRLTE

SEQ ID NO: 539973 - protein, 9 aa, Homo Sapiens
HLKGTPMKT

SEQ ID NO: 539974 - protein, 9 aa, Homo Sapiens
FKTKEDCDC

SEQ ID NO: 539975 - protein, 9 aa, Homo Sapiens
QHLKGTPMK

SEQ ID NO: 539976 - protein, 9 aa, Homo Sapiens
VDFAGEAQI

SEQ ID NO: 539977 - protein, 9 aa, Homo Sapiens
GSETTPAST

SEQ ID NO: 539978 - protein, 9 aa, Homo Sapiens
GKRPREGEA

SEQ ID NO: 539979 - protein, 9 aa, Homo Sapiens
NQSISLLNE

SEQ ID NO: 539980 - protein, 9 aa, Homo Sapiens
VFCWWHHTN

SEQ ID NO: 539981 - protein, 9 aa, Homo Sapiens
LKPQRLTEP

SEQ ID NO: 539982 - protein, 9 aa, Homo Sapiens
DLEFVDFAG

SEQ ID NO: 539983 - protein, 9 aa, Homo Sapiens
TTPASTAGS

SEQ ID NO: 539984 - protein, 9 aa, Homo Sapiens
RMSCGGGRS

SEQ ID NO: 539985 - protein, 9 aa, Homo Sapiens
AQVSTGDII

SEQ ID NO: 539986 - protein, 9 aa, Homo Sapiens
AHWPKEQPS

SEQ ID NO: 539987 - protein, 9 aa, Homo Sapiens
CWWHHTNPV

SEQ ID NO: 539988 - protein, 9 aa, Homo Sapiens
SEGSKMAHW

SEQ ID NO: 539989 - protein, 9 aa, Homo Sapiens
ETTPASTAG

SEQ ID NO: 539990 - protein, 9 aa, Homo Sapiens
LPLLFKTKE

SEQ ID NO: 539991 - protein, 9 aa, Homo Sapiens
TSGKRPREG

SEQ ID NO: 539992 - protein, 9 aa, Homo Sapiens
SGKRPREGE

SEQ ID NO: 539993 - protein, 9 aa, Homo Sapiens
QPSTSGKRP

SEQ ID NO: 539994 - protein, 9 aa, Homo Sapiens
VLAQPSTSG

SEQ ID NO: 539995 - protein, 9 aa, Homo Sapiens
DFAGEAQIS

SEQ ID NO: 539996 - protein, 9 aa, Homo Sapiens
VDLEFVDFA

SEQ ID NO: 539997 - protein, 9 aa, Homo Sapiens
FAYDGLKPQ

SEQ ID NO: 539998 - protein, 9 aa, Homo Sapiens
YNQSISLLN

SEQ ID NO: 539999 - protein, 9 aa, Homo Sapiens
KEDCDCGGA

SEQ ID NO: 540000 - protein, 9 aa, Homo Sapiens
QAQVEYNQS

SEQ ID NO: 540001 - protein, 9 aa, Homo Sapiens
KPPAERLRG

SEQ ID NO: 540002 - protein, 9 aa, Homo Sapiens
GGGRSFCPP

SEQ ID NO: 540003 - protein, 9 aa, Homo Sapiens
ADDNIKPPA

SEQ ID NO: 540004 - protein, 9 aa, Homo Sapiens
GGRSFCPPG

SEQ ID NO: 540005 - protein, 9 aa, Homo Sapiens
IKPPAERLR

SEQ ID NO: 540006 - protein, 9 aa, Homo Sapiens
VSTGDIIDP

SEQ ID NO: 540007 - protein, 9 aa, Homo Sapiens
EYNQSISLL

SEQ ID NO: 540008 - protein, 9 aa, Homo Sapiens
GSKMAHWPK

SEQ ID NO: 540009 - protein, 9 aa, Homo Sapiens
LEFVDFAGE

SEQ ID NO: 540010 - protein, 9 aa, Homo Sapiens
PLPLLFKTK

SEQ ID NO: 540011 - protein, 9 aa, Homo Sapiens
SQHLKGTPM

SEQ ID NO: 540012 - protein, 9 aa, Homo Sapiens
TVFHIIAKC

SEQ ID NO: 540013 - protein, 9 aa, Homo Sapiens
VFHIIAKCS

SEQ ID NO: 540014 - protein, 9 aa, Homo Sapiens
DNIKPPAER

SEQ ID NO: 540015 - protein, 9 aa, Homo Sapiens
FCWWHHTNP

SEQ ID NO: 540016 - protein, 9 aa, Homo Sapiens
QSISLLNEG

SEQ ID NO: 540017 - protein, 9 aa, Homo Sapiens
SHLSQHLKG

SEQ ID NO: 540018 - protein, 9 aa, Homo Sapiens
AQPSTSGKR

SEQ ID NO: 540019 - protein, 9 aa, Homo Sapiens
SADDNIKPP

SEQ ID NO: 540020 - protein, 9 aa, Homo Sapiens
QVDLEFVDF

SEQ ID NO: 540021 - protein, 9 aa, Homo Sapiens
KSEGSKMAH

SEQ ID NO: 540022 - protein, 9 aa, Homo Sapiens
TPASTAGSE

SEQ ID NO: 540023 - protein, 9 aa, Homo Sapiens
SFCPPGHPL

SEQ ID NO: 540024 - protein, 9 aa, Homo Sapiens
AKCSTFANP

SEQ ID NO: 540025 - protein, 9 aa, Homo Sapiens
QVSTGDIID

SEQ ID NO: 540026 - protein, 9 aa, Homo Sapiens
GDIIDPLTG

SEQ ID NO: 540027 - protein, 9 aa, Homo Sapiens
TKEDCDCGG

SEQ ID NO: 540028 - protein, 9 aa, Homo Sapiens
LAQPSTSGK

SEQ ID NO: 540029 - protein, 9 aa, Homo Sapiens
HWPKEQPST

SEQ ID NO: 540030 - protein, 9 aa, Homo Sapiens
WHHTNPVGT

SEQ ID NO: 540031 - protein, 9 aa, Homo Sapiens
HLSQHLKGT

SEQ ID NO: 540032 - protein, 9 aa, Homo Sapiens
SCGGGRSFC

SEQ ID NO: 540033 - protein, 9 aa, Homo Sapiens
PLLFKTKED

SEQ ID NO: 540034 - protein, 9 aa, Homo Sapiens
KMAHWPKEQ

SEQ ID NO: 540035 - protein, 9 aa, Homo Sapiens
AYDGLKPQR

SEQ ID NO: 540036 - protein, 9 aa, Homo Sapiens
GRSFCPPGH

SEQ ID NO: 540037 - protein, 9 aa, Homo Sapiens
AGSETTPAS

SEQ ID NO: 540038 - protein, 9 aa, Homo Sapiens
KCSTFANPL

SEQ ID NO: 540039 - protein, 9 aa, Homo Sapiens
EFVDFAGEA

SEQ ID NO: 540040 - protein, 9 aa, Homo Sapiens
TGDIIDPLT

SEQ ID NO: 540041 - protein, 9 aa, Homo Sapiens
HIIAKCSTF

SEQ ID NO: 540042 - protein, 9 aa, Homo Sapiens
WWHHTNPVG

SEQ ID NO: 540043 - protein, 9 aa, Homo Sapiens
KPQRLTEPM

SEQ ID NO: 540044 - protein, 9 aa, Homo Sapiens
FTVFHIIAK

SEQ ID NO: 540045 - protein, 9 aa, Homo Sapiens
QSHLSQHLK

SEQ ID NO: 540046 - protein, 9 aa, Homo Sapiens
LKGTPMKTQ

SEQ ID NO: 540047 - protein, 9 aa, Homo Sapiens
STGDIIDPL

SEQ ID NO: 540048 - protein, 9 aa, Homo Sapiens
STSGKRPRE

SEQ ID NO: 540049 - protein, 9 aa, Homo Sapiens
IAKCSTFAN

SEQ ID NO: 540050 - protein, 9 aa, Homo Sapiens
LLFKTKEDC

SEQ ID NO: 540051 - protein, 9 aa, Homo Sapiens
PSADDNIKP

SEQ ID NO: 540052 - protein, 9 aa, Homo Sapiens
EAQVSTGDI

SEQ ID NO: 540053 - protein, 9 aa, Homo Sapiens
RFAYDGLKP

SEQ ID NO: 540054 - protein, 9 aa, Homo Sapiens
KTKEDCDCG

SEQ ID NO: 540055 - protein, 9 aa, Homo Sapiens
LSQHLKGTP

SEQ ID NO: 540056 - protein, 9 aa, Homo Sapiens
TAGSETTPA

SEQ ID NO: 540057 - protein, 9 aa, Homo Sapiens
DDNIKPPAE

SEQ ID NO: 540058 - protein, 9 aa, Homo Sapiens
FVDFAGEAQ

SEQ ID NO: 540059 - protein, 9 aa, Homo Sapiens
CGGGRSFCP

SEQ ID NO: 540060 - protein, 9 aa, Homo Sapiens
SKMAHWPKE

SEQ ID NO: 540061 - protein, 9 aa, Homo Sapiens
EGSKMAHWP

SEQ ID NO: 540062 - protein, 9 aa, Homo Sapiens
STAGSETTP

SEQ ID NO: 540063 - protein, 9 aa, Homo Sapiens
NIKPPAERL

SEQ ID NO: 540064 - protein, 9 aa, Homo Sapiens
VEYNQSISL

SEQ ID NO: 540065 - protein, 9 aa, Homo Sapiens
FHIIAKCST

SEQ ID NO: 540066 - protein, 9 aa, Homo Sapiens
RSFCPPGHP

SEQ ID NO: 540067 - protein, 9 aa, Homo Sapiens
DGLKPQRLT

SEQ ID NO: 540068 - protein, 9 aa, Homo Sapiens
YDGLKPQRL

SEQ ID NO: 540069 - protein, 9 aa, Homo Sapiens
PQRLTEPMV

SEQ ID NO: 540070 - protein, 9 aa, Homo Sapiens
IIAKCSTFA

SEQ ID NO: 540071 - protein, 9 aa, Homo Sapiens
SISLLNEGQ

SEQ ID NO: 540072 - protein, 9 aa, Homo Sapiens
SETTPASTA

SEQ ID NO: 540073 - protein, 9 aa, Homo Sapiens
MAHWPKEQP

SEQ ID NO: 540074 - protein, 9 aa, Homo Sapiens
DIIDPLTGK

SEQ ID NO: 540075 - protein, 9 aa, Homo Sapiens
QVEYNQSIS

SEQ ID NO: 540076 - protein, 9 aa, Homo Sapiens
CTCHTGFMG

SEQ ID NO: 540077 - protein, 9 aa, Homo Sapiens
ESQQKIRDQ

SEQ ID NO: 540078 - protein, 9 aa, Homo Sapiens
EAPGDIFFD

SEQ ID NO: 540079 - protein, 9 aa, Homo Sapiens
SLILPESEG

SEQ ID NO: 540080 - protein, 9 aa, Homo Sapiens
IEAVSYDEA

SEQ ID NO: 540081 - protein, 9 aa, Homo Sapiens
GQCTCHTGF

SEQ ID NO: 540082 - protein, 9 aa, Homo Sapiens
LSPVHRFDK

SEQ ID NO: 540083 - protein, 9 aa, Homo Sapiens
SPLPVTDAS

SEQ ID NO: 540084 - protein, 9 aa, Homo Sapiens
QGESLEVAN

SEQ ID NO: 540085 - protein, 9 aa, Homo Sapiens
SRGDTSPLP

SEQ ID NO: 540086 - protein, 9 aa, Homo Sapiens
NNLEEATLQ

SEQ ID NO: 540087 - protein, 9 aa, Homo Sapiens
ASRGDTSPL

SEQ ID NO: 540088 - protein, 9 aa, Homo Sapiens
GDTSPLPVT

SEQ ID NO: 540089 - protein, 9 aa, Homo Sapiens
LELFEAPGD

SEQ ID NO: 540090 - protein, 9 aa, Homo Sapiens
PMASLILPE

SEQ ID NO: 540091 - protein, 9 aa, Homo Sapiens
NLEEATLQN

SEQ ID NO: 540092 - protein, 9 aa, Homo Sapiens
SKQEAWSTH

SEQ ID NO: 540093 - protein, 9 aa, Homo Sapiens
VSYDEALVD

SEQ ID NO: 540094 - protein, 9 aa, Homo Sapiens
QEAWSTHNT

SEQ ID NO: 540095 - protein, 9 aa, Homo Sapiens
MKNPMASLI

SEQ ID NO: 540096 - protein, 9 aa, Homo Sapiens
QCTCHTGFM

SEQ ID NO: 540097 - protein, 9 aa, Homo Sapiens
AESQQKIRD

SEQ ID NO: 540098 - protein, 9 aa, Homo Sapiens
ILPESEGEF

SEQ ID NO: 540099 - protein, 9 aa, Homo Sapiens
VLRLRQQIL

SEQ ID NO: 540100 - protein, 9 aa, Homo Sapiens
ASLILPESE

SEQ ID NO: 540101 - protein, 9 aa, Homo Sapiens
PGRPRSKQE

SEQ ID NO: 540102 - protein, 9 aa, Homo Sapiens
GESLEVANS

SEQ ID NO: 540103 - protein, 9 aa, Homo Sapiens
YDEALVDIT

SEQ ID NO: 540104 - protein, 9 aa, Homo Sapiens
TSNNLEEAT

SEQ ID NO: 540105 - protein, 9 aa, Homo Sapiens
LEEATLQNL

SEQ ID NO: 540106 - protein, 9 aa, Homo Sapiens
EAWSTHNTV

SEQ ID NO: 540107 - protein, 9 aa, Homo Sapiens
TCHTGFMGR

SEQ ID NO: 540108 - protein, 9 aa, Homo Sapiens
IGVWNYRSP

SEQ ID NO: 540109 - protein, 9 aa, Homo Sapiens
NPMASLILP

SEQ ID NO: 540110 - protein, 9 aa, Homo Sapiens
GRPRSKQEA

SEQ ID NO: 540111 - protein, 9 aa, Homo Sapiens
SFEEVLRLR

SEQ ID NO: 540112 - protein, 9 aa, Homo Sapiens
EAVSYDEAL

SEQ ID NO: 540113 - protein, 9 aa, Homo Sapiens
LILPESEGE

SEQ ID NO: 540114 - protein, 9 aa, Homo Sapiens
HNIEAVSYD

SEQ ID NO: 540115 - protein, 9 aa, Homo Sapiens
APGDIFFDG

SEQ ID NO: 540116 - protein, 9 aa, Homo Sapiens
DSFEEVLRL

SEQ ID NO: 540117 - protein, 9 aa, Homo Sapiens
TTSNNLEEA

SEQ ID NO: 540118 - protein, 9 aa, Homo Sapiens
YDIVLVQGE

SEQ ID NO: 540119 - protein, 9 aa, Homo Sapiens
GGTTTSNNL

SEQ ID NO: 540120 - protein, 9 aa, Homo Sapiens
KQEAWSTHN

SEQ ID NO: 540121 - protein, 9 aa, Homo Sapiens
EVLRLRQQI

SEQ ID NO: 540122 - protein, 9 aa, Homo Sapiens
TTTSNNLEE

SEQ ID NO: 540123 - protein, 9 aa, Homo Sapiens
FEEVLRLRQ

SEQ ID NO: 540124 - protein, 9 aa, Homo Sapiens
SYDIVLVQG

SEQ ID NO: 540125 - protein, 9 aa, Homo Sapiens
SPVHRFDKE

SEQ ID NO: 540126 - protein, 9 aa, Homo Sapiens
SGQCTCHTG

SEQ ID NO: 540127 - protein, 9 aa, Homo Sapiens
VHRFDKECF

SEQ ID NO: 540128 - protein, 9 aa, Homo Sapiens
PGDIFFDGA

SEQ ID NO: 540129 - protein, 9 aa, Homo Sapiens
RDSFEEVLR

SEQ ID NO: 540130 - protein, 9 aa, Homo Sapiens
HTGFMGRHC

SEQ ID NO: 540131 - protein, 9 aa, Homo Sapiens
LVQGESLEV

SEQ ID NO: 540132 - protein, 9 aa, Homo Sapiens
SIGVWNYRS

SEQ ID NO: 540133 - protein, 9 aa, Homo Sapiens
EILSPVHRF

SEQ ID NO: 540134 - protein, 9 aa, Homo Sapiens
ELFEAPGDI

SEQ ID NO: 540135 - protein, 9 aa, Homo Sapiens
RSPKLGGIG

SEQ ID NO: 540136 - protein, 9 aa, Homo Sapiens
FFEILSPVH

SEQ ID NO: 540137 - protein, 9 aa, Homo Sapiens
VWNYRSPKL

SEQ ID NO: 540138 - protein, 9 aa, Homo Sapiens
MASLILPES

SEQ ID NO: 540139 - protein, 9 aa, Homo Sapiens
GSIGVWNYR

SEQ ID NO: 540140 - protein, 9 aa, Homo Sapiens
GTTTSNNLE

SEQ ID NO: 540141 - protein, 9 aa, Homo Sapiens
PRSKQEAWS

SEQ ID NO: 540142 - protein, 9 aa, Homo Sapiens
YRSPKLGGI

SEQ ID NO: 540143 - protein, 9 aa, Homo Sapiens
SASRGDTSP

SEQ ID NO: 540144 - protein, 9 aa, Homo Sapiens
GLELFEAPG

SEQ ID NO: 540145 - protein, 9 aa, Homo Sapiens
LFEAPGDIF

SEQ ID NO: 540146 - protein, 9 aa, Homo Sapiens
EEVLRLRQQ

SEQ ID NO: 540147 - protein, 9 aa, Homo Sapiens
THNIEAVSY

SEQ ID NO: 540148 - protein, 9 aa, Homo Sapiens
RPRSKQEAW

SEQ ID NO: 540149 - protein, 9 aa, Homo Sapiens
VQGESLEVA

SEQ ID NO: 540150 - protein, 9 aa, Homo Sapiens
RSKQEAWST

SEQ ID NO: 540151 - protein, 9 aa, Homo Sapiens
VGDMLRKAE

SEQ ID NO: 540152 - protein, 9 aa, Homo Sapiens
RKAESQQKI

SEQ ID NO: 540153 - protein, 9 aa, Homo Sapiens
LGLELFEAP

SEQ ID NO: 540154 - protein, 9 aa, Homo Sapiens
KNPMASLIL

SEQ ID NO: 540155 - protein, 9 aa, Homo Sapiens
GDMLRKAES

SEQ ID NO: 540156 - protein, 9 aa, Homo Sapiens
LRLRQQILD

SEQ ID NO: 540157 - protein, 9 aa, Homo Sapiens
TSPLPVTDA

SEQ ID NO: 540158 - protein, 9 aa, Homo Sapiens
DMLRKAESQ

SEQ ID NO: 540159 - protein, 9 aa, Homo Sapiens
MLRKAESQQ

SEQ ID NO: 540160 - protein, 9 aa, Homo Sapiens
ILSPVHRFD

SEQ ID NO: 540161 - protein, 9 aa, Homo Sapiens
AVSYDEALV

SEQ ID NO: 540162 - protein, 9 aa, Homo Sapiens
IVLVQGESL

SEQ ID NO: 540163 - protein, 9 aa, Homo Sapiens
HRFDKECFK

SEQ ID NO: 540164 - protein, 9 aa, Homo Sapiens
VLVQGESLE

SEQ ID NO: 540165 - protein, 9 aa, Homo Sapiens
FEILSPVHR

SEQ ID NO: 540166 - protein, 9 aa, Homo Sapiens
GVWNYRSPK

SEQ ID NO: 540167 - protein, 9 aa, Homo Sapiens
NYRSPKLGG

SEQ ID NO: 540168 - protein, 9 aa, Homo Sapiens
FEAPGDIFF

SEQ ID NO: 540169 - protein, 9 aa, Homo Sapiens
SNNLEEATL

SEQ ID NO: 540170 - protein, 9 aa, Homo Sapiens
RGDTSPLPV

SEQ ID NO: 540171 - protein, 9 aa, Homo Sapiens
KAESQQKIR

SEQ ID NO: 540172 - protein, 9 aa, Homo Sapiens
CHTGFMGRH

SEQ ID NO: 540173 - protein, 9 aa, Homo Sapiens
HISGQCTCH

SEQ ID NO: 540174 - protein, 9 aa, Homo Sapiens
NRDSFEEVL

SEQ ID NO: 540175 - protein, 9 aa, Homo Sapiens
PVHRFDKEC

SEQ ID NO: 540176 - protein, 9 aa, Homo Sapiens
ISGQCTCHT

SEQ ID NO: 540177 - protein, 9 aa, Homo Sapiens
DIVLVQGES

SEQ ID NO: 540178 - protein, 9 aa, Homo Sapiens
NIEAVSYDE

SEQ ID NO: 540179 - protein, 9 aa, Homo Sapiens
WNYRSPKLG

SEQ ID NO: 540180 - protein, 9 aa, Homo Sapiens
LRKAESQQK

SEQ ID NO: 540181 - protein, 9 aa, Homo Sapiens
DTSPLPVTD

SEQ ID NO: 540182 - protein, 9 aa, Homo Sapiens
SYDEALVDI

SEQ ID NO: 540183 - protein, 9 aa, Homo Sapiens
RATISEDAL

SEQ ID NO: 540184 - protein, 9 aa, Homo Sapiens
ITSINNPLV

SEQ ID NO: 540185 - protein, 9 aa, Homo Sapiens
LLGGVPYLP

SEQ ID NO: 540186 - protein, 9 aa, Homo Sapiens
ALDPMSMLS

SEQ ID NO: 540187 - protein, 9 aa, Homo Sapiens
QKATGSCCG

SEQ ID NO: 540188 - protein, 9 aa, Homo Sapiens
RQIFGPDFC

SEQ ID NO: 540189 - protein, 9 aa, Homo Sapiens
NPWTGTSHS

SEQ ID NO: 540190 - protein, 9 aa, Homo Sapiens
PQHAALQAA

SEQ ID NO: 540191 - protein, 9 aa, Homo Sapiens
PRHLVQLLR

SEQ ID NO: 540192 - protein, 9 aa, Homo Sapiens
WYGLRLNMD

SEQ ID NO: 540193 - protein, 9 aa, Homo Sapiens
RALFTDRLA

SEQ ID NO: 540194 - protein, 9 aa, Homo Sapiens
LEGYEDSHV

SEQ ID NO: 540195 - protein, 9 aa, Homo Sapiens
IVPCHTAVK

SEQ ID NO: 540196 - protein, 9 aa, Homo Sapiens
PQATGPHLQ

SEQ ID NO: 540197 - protein, 9 aa, Homo Sapiens
KLDGTTPVW

SEQ ID NO: 540198 - protein, 9 aa, Homo Sapiens
ASMIAVTRC

SEQ ID NO: 540199 - protein, 9 aa, Homo Sapiens
RLATRSTTQ

SEQ ID NO: 540200 - protein, 9 aa, Homo Sapiens
HDLPECRHF

SEQ ID NO: 540201 - protein, 9 aa, Homo Sapiens
VTRCFAQPN

SEQ ID NO: 540202 - protein, 9 aa, Homo Sapiens
GLLKNLSNG

SEQ ID NO: 540203 - protein, 9 aa, Homo Sapiens
DRLATRSTT

SEQ ID NO: 540204 - protein, 9 aa, Homo Sapiens
LVCYKDHGN

SEQ ID NO: 540205 - protein, 9 aa, Homo Sapiens
VGLLKNLSN

SEQ ID NO: 540206 - protein, 9 aa, Homo Sapiens
LQPPQHAAL

SEQ ID NO: 540207 - protein, 9 aa, Homo Sapiens
LGGVPYLPE

SEQ ID NO: 540208 - protein, 9 aa, Homo Sapiens
TPHDLPECR

SEQ ID NO: 540209 - protein, 9 aa, Homo Sapiens
QLLRLCVER

SEQ ID NO: 540210 - protein, 9 aa, Homo Sapiens
WLGATLVRE

SEQ ID NO: 540211 - protein, 9 aa, Homo Sapiens
SMLSKMSNS

SEQ ID NO: 540212 - protein, 9 aa, Homo Sapiens
LRATISEDA

SEQ ID NO: 540213 - protein, 9 aa, Homo Sapiens
EINLSQWKV

SEQ ID NO: 540214 - protein, 9 aa, Homo Sapiens
LDPMSMLSK

SEQ ID NO: 540215 - protein, 9 aa, Homo Sapiens
RKLGKGPEK

SEQ ID NO: 540216 - protein, 9 aa, Homo Sapiens
TGSCCGRRG

SEQ ID NO: 540217 - protein, 9 aa, Homo Sapiens
VWYGLRLNM

SEQ ID NO: 540218 - protein, 9 aa, Homo Sapiens
LCLAPYFQL

SEQ ID NO: 540219 - protein, 9 aa, Homo Sapiens
GLQPPQHAA

SEQ ID NO: 540220 - protein, 9 aa, Homo Sapiens
FTDRLATRS

SEQ ID NO: 540221 - protein, 9 aa, Homo Sapiens
MLSKMSNSL

SEQ ID NO: 540222 - protein, 9 aa, Homo Sapiens
LLRQNKKTV

SEQ ID NO: 540223 - protein, 9 aa, Homo Sapiens
GSCCGRRGH

SEQ ID NO: 540224 - protein, 9 aa, Homo Sapiens
DPMSMLSKM

SEQ ID NO: 540225 - protein, 9 aa, Homo Sapiens
LEIISAIHS

SEQ ID NO: 540226 - protein, 9 aa, Homo Sapiens
GPHLQTPHD

SEQ ID NO: 540227 - protein, 9 aa, Homo Sapiens
VRKLGKGPE

SEQ ID NO: 540228 - protein, 9 aa, Homo Sapiens
ISAIHSHGP

SEQ ID NO: 540229 - protein, 9 aa, Homo Sapiens
FCHCPNTSA

SEQ ID NO: 540230 - protein, 9 aa, Homo Sapiens
KSASKMDTM

SEQ ID NO: 540231 - protein, 9 aa, Homo Sapiens
LQTPHDLPE

SEQ ID NO: 540232 - protein, 9 aa, Homo Sapiens
RTLRATISE

SEQ ID NO: 540233 - protein, 9 aa, Homo Sapiens
SAIHSHGPQ

SEQ ID NO: 540234 - protein, 9 aa, Homo Sapiens
VPCHTAVKL

SEQ ID NO: 540235 - protein, 9 aa, Homo Sapiens
LATRSTTQS

SEQ ID NO: 540236 - protein, 9 aa, Homo Sapiens
MPGNLVCYK

SEQ ID NO: 540237 - protein, 9 aa, Homo Sapiens
CLAPYFQLL

SEQ ID NO: 540238 - protein, 9 aa, Homo Sapiens
TGTSHSQKP

SEQ ID NO: 540239 - protein, 9 aa, Homo Sapiens
CRHFCTKRH

SEQ ID NO: 540240 - protein, 9 aa, Homo Sapiens
LDGTTPVWY

SEQ ID NO: 540241 - protein, 9 aa, Homo Sapiens
RAGQKATGS

SEQ ID NO: 540242 - protein, 9 aa, Homo Sapiens
LAPYFQLLR

SEQ ID NO: 540243 - protein, 9 aa, Homo Sapiens
SKLLRQNKK

SEQ ID NO: 540244 - protein, 9 aa, Homo Sapiens
LNPWTGTSH

SEQ ID NO: 540245 - protein, 9 aa, Homo Sapiens
EEAFEVESS

SEQ ID NO: 540246 - protein, 9 aa, Homo Sapiens
SYIKSNLEI

SEQ ID NO: 540247 - protein, 9 aa, Homo Sapiens
PWNLVCNNG

SEQ ID NO: 540248 - protein, 9 aa, Homo Sapiens
HLVQLLRQH

SEQ ID NO: 540249 - protein, 9 aa, Homo Sapiens
QGLRVSIDA

SEQ ID NO: 540250 - protein, 9 aa, Homo Sapiens
PRAGQKATG

SEQ ID NO: 540251 - protein, 9 aa, Homo Sapiens
AGQKATGSC

SEQ ID NO: 540252 - protein, 9 aa, Homo Sapiens
ESNNVGLLK

SEQ ID NO: 540253 - protein, 9 aa, Homo Sapiens
AALQAAGEP

SEQ ID NO: 540254 - protein, 9 aa, Homo Sapiens
ASKMDTMLI

SEQ ID NO: 540255 - protein, 9 aa, Homo Sapiens
LLKNLSNGV

SEQ ID NO: 540256 - protein, 9 aa, Homo Sapiens
GQKATGSCC

SEQ ID NO: 540257 - protein, 9 aa, Homo Sapiens
LVREQVQAS

SEQ ID NO: 540258 - protein, 9 aa, Homo Sapiens
NNGANCRTR

SEQ ID NO: 540259 - protein, 9 aa, Homo Sapiens
DDTEEAFEV

SEQ ID NO: 540260 - protein, 9 aa, Homo Sapiens
TSHSQKPRA

SEQ ID NO: 540261 - protein, 9 aa, Homo Sapiens
IKSNLEIIS

SEQ ID NO: 540262 - protein, 9 aa, Homo Sapiens
VREQVQASG

SEQ ID NO: 540263 - protein, 9 aa, Homo Sapiens
SMIAVTRCF

SEQ ID NO: 540264 - protein, 9 aa, Homo Sapiens
GLRVSIDAY

SEQ ID NO: 540265 - protein, 9 aa, Homo Sapiens
TTQLRTLRA

SEQ ID NO: 540266 - protein, 9 aa, Homo Sapiens
DTMLINISA

SEQ ID NO: 540267 - protein, 9 aa, Homo Sapiens
YQGLRVSID

SEQ ID NO: 540268 - protein, 9 aa, Homo Sapiens
YFQLLRLCV

SEQ ID NO: 540269 - protein, 9 aa, Homo Sapiens
ATGSCCGRR

SEQ ID NO: 540270 - protein, 9 aa, Homo Sapiens
EGYEDSHVP

SEQ ID NO: 540271 - protein, 9 aa, Homo Sapiens
NGANCRTRG

SEQ ID NO: 540272 - protein, 9 aa, Homo Sapiens
PWTGTSHSQ

SEQ ID NO: 540273 - protein, 9 aa, Homo Sapiens
GPDFCHCPN

SEQ ID NO: 540274 - protein, 9 aa, Homo Sapiens
WNLVCNNGA

SEQ ID NO: 540275 - protein, 9 aa, Homo Sapiens
DGTTPVWYG

SEQ ID NO: 540276 - protein, 9 aa, Homo Sapiens
HGPQATGPH

SEQ ID NO: 540277 - protein, 9 aa, Homo Sapiens
SHSQKPRAG

SEQ ID NO: 540278 - protein, 9 aa, Homo Sapiens
GVRKLGKGP

SEQ ID NO: 540279 - protein, 9 aa, Homo Sapiens
ACQMPGNLV

SEQ ID NO: 540280 - protein, 9 aa, Homo Sapiens
CHCPNTSAQ

SEQ ID NO: 540281 - protein, 9 aa, Homo Sapiens
LQQVKITSI

SEQ ID NO: 540282 - protein, 9 aa, Homo Sapiens
RHFCTKRHQ

SEQ ID NO: 540283 - protein, 9 aa, Homo Sapiens
AVTRCFAQP

SEQ ID NO: 540284 - protein, 9 aa, Homo Sapiens
RVSIDAYDN

SEQ ID NO: 540285 - protein, 9 aa, Homo Sapiens
PECRHFCTK

SEQ ID NO: 540286 - protein, 9 aa, Homo Sapiens
TRCFAQPNF

SEQ ID NO: 540287 - protein, 9 aa, Homo Sapiens
QQVKITSIN

SEQ ID NO: 540288 - protein, 9 aa, Homo Sapiens
PLCLAPYFQ

SEQ ID NO: 540289 - protein, 9 aa, Homo Sapiens
QATGPHLQT

SEQ ID NO: 540290 - protein, 9 aa, Homo Sapiens
QHAALQAAG

SEQ ID NO: 540291 - protein, 9 aa, Homo Sapiens
DYQGLRVSI

SEQ ID NO: 540292 - protein, 9 aa, Homo Sapiens
WLWLGATLV

SEQ ID NO: 540293 - protein, 9 aa, Homo Sapiens
TDRLATRST

SEQ ID NO: 540294 - protein, 9 aa, Homo Sapiens
TMLINISAV

SEQ ID NO: 540295 - protein, 9 aa, Homo Sapiens
TEEAFEVES

SEQ ID NO: 540296 - protein, 9 aa, Homo Sapiens
TPVWYGLRL

SEQ ID NO: 540297 - protein, 9 aa, Homo Sapiens
YEDSHVPNV

SEQ ID NO: 540298 - protein, 9 aa, Homo Sapiens
EEDTDPRHL

SEQ ID NO: 540299 - protein, 9 aa, Homo Sapiens
ISRGIVPCH

SEQ ID NO: 540300 - protein, 9 aa, Homo Sapiens
ETLQQVKIT

SEQ ID NO: 540301 - protein, 9 aa, Homo Sapiens
YFPDDTEEA

SEQ ID NO: 540302 - protein, 9 aa, Homo Sapiens
GYEDSHVPN

SEQ ID NO: 540303 - protein, 9 aa, Homo Sapiens
GKDIYEINL

SEQ ID NO: 540304 - protein, 9 aa, Homo Sapiens
SPWNLVCNN

SEQ ID NO: 540305 - protein, 9 aa, Homo Sapiens
TQLRTLRAT

SEQ ID NO: 540306 - protein, 9 aa, Homo Sapiens
ATLVREQVQ

SEQ ID NO: 540307 - protein, 9 aa, Homo Sapiens
ATGPHLQTP

SEQ ID NO: 540308 - protein, 9 aa, Homo Sapiens
HAALQAAGE

SEQ ID NO: 540309 - protein, 9 aa, Homo Sapiens
PDFCHCPNT

SEQ ID NO: 540310 - protein, 9 aa, Homo Sapiens
LFTDRLATR

SEQ ID NO: 540311 - protein, 9 aa, Homo Sapiens
VPYLPESFP

SEQ ID NO: 540312 - protein, 9 aa, Homo Sapiens
IAVTRCFAQ

SEQ ID NO: 540313 - protein, 9 aa, Homo Sapiens
QPPPAGVRK

SEQ ID NO: 540314 - protein, 9 aa, Homo Sapiens
PLLLGGVPY

SEQ ID NO: 540315 - protein, 9 aa, Homo Sapiens
KITSINNPL

SEQ ID NO: 540316 - protein, 9 aa, Homo Sapiens
AISRGIVPC

SEQ ID NO: 540317 - protein, 9 aa, Homo Sapiens
PPPAGVRKL

SEQ ID NO: 540318 - protein, 9 aa, Homo Sapiens
DTEEAFEVE

SEQ ID NO: 540319 - protein, 9 aa, Homo Sapiens
RQNKKTVHS

SEQ ID NO: 540320 - protein, 9 aa, Homo Sapiens
DLPECRHFC

SEQ ID NO: 540321 - protein, 9 aa, Homo Sapiens
TGPHLQTPH

SEQ ID NO: 540322 - protein, 9 aa, Homo Sapiens
MIAVTRCFA

SEQ ID NO: 540323 - protein, 9 aa, Homo Sapiens
AIHSHGPQA

SEQ ID NO: 540324 - protein, 9 aa, Homo Sapiens
KVYFPDDTE

SEQ ID NO: 540325 - protein, 9 aa, Homo Sapiens
NNVGLLKNL

SEQ ID NO: 540326 - protein, 9 aa, Homo Sapiens
LPECRHFCT

SEQ ID NO: 540327 - protein, 9 aa, Homo Sapiens
CTKRHQKHL

SEQ ID NO: 540328 - protein, 9 aa, Homo Sapiens
LWLGATLVR

SEQ ID NO: 540329 - protein, 9 aa, Homo Sapiens
IISAIHSHG

SEQ ID NO: 540330 - protein, 9 aa, Homo Sapiens
HFCTKRHQK

SEQ ID NO: 540331 - protein, 9 aa, Homo Sapiens
QNKKTVHSY

SEQ ID NO: 540332 - protein, 9 aa, Homo Sapiens
TQQLLNPWT

SEQ ID NO: 540333 - protein, 9 aa, Homo Sapiens
MSMLSKMSN

SEQ ID NO: 540334 - protein, 9 aa, Homo Sapiens
KNLSNGVTA

SEQ ID NO: 540335 - protein, 9 aa, Homo Sapiens
PGNLVCYKD

SEQ ID NO: 540336 - protein, 9 aa, Homo Sapiens
FPDDTEEAF

SEQ ID NO: 540337 - protein, 9 aa, Homo Sapiens
HLQTPHDLP

SEQ ID NO: 540338 - protein, 9 aa, Homo Sapiens
MLINISAVC

SEQ ID NO: 540339 - protein, 9 aa, Homo Sapiens
APYFQLLRL

SEQ ID NO: 540340 - protein, 9 aa, Homo Sapiens
QKPRAGQKA

SEQ ID NO: 540341 - protein, 9 aa, Homo Sapiens
WTGTSHSQK

SEQ ID NO: 540342 - protein, 9 aa, Homo Sapiens
LGATLVREQ

SEQ ID NO: 540343 - protein, 9 aa, Homo Sapiens
ALQAAGEPG

SEQ ID NO: 540344 - protein, 9 aa, Homo Sapiens
KPRAGQKAT

SEQ ID NO: 540345 - protein, 9 aa, Homo Sapiens
PHLQTPHDL

SEQ ID NO: 540346 - protein, 9 aa, Homo Sapiens
LSKMSNSLA

SEQ ID NO: 540347 - protein, 9 aa, Homo Sapiens
GTTPVWYGL

SEQ ID NO: 540348 - protein, 9 aa, Homo Sapiens
CHTAVKLME

SEQ ID NO: 540349 - protein, 9 aa, Homo Sapiens
ECRHFCTKR

SEQ ID NO: 540350 - protein, 9 aa, Homo Sapiens
GATLVREQV

SEQ ID NO: 540351 - protein, 9 aa, Homo Sapiens
QVKITSINN

SEQ ID NO: 540352 - protein, 9 aa, Homo Sapiens
GVPYLPESF

SEQ ID NO: 540353 - protein, 9 aa, Homo Sapiens
QLLNPWTGT

SEQ ID NO: 540354 - protein, 9 aa, Homo Sapiens
TRRDLEGYE

SEQ ID NO: 540355 - protein, 9 aa, Homo Sapiens
YIKSNLEII

SEQ ID NO: 540356 - protein, 9 aa, Homo Sapiens
SASKMDTML

SEQ ID NO: 540357 - protein, 9 aa, Homo Sapiens
NLEIISAIH

SEQ ID NO: 540358 - protein, 9 aa, Homo Sapiens
PCHTAVKLM

SEQ ID NO: 540359 - protein, 9 aa, Homo Sapiens
DTDPRHLVQ

SEQ ID NO: 540360 - protein, 9 aa, Homo Sapiens
NLVCNNGAN

SEQ ID NO: 540361 - protein, 9 aa, Homo Sapiens
TASMIAVTR

SEQ ID NO: 540362 - protein, 9 aa, Homo Sapiens
GTSHSQKPR

SEQ ID NO: 540363 - protein, 9 aa, Homo Sapiens
ETRRDLEGY

SEQ ID NO: 540364 - protein, 9 aa, Homo Sapiens
QMPGNLVCY

SEQ ID NO: 540365 - protein, 9 aa, Homo Sapiens
HSQKPRAGQ

SEQ ID NO: 540366 - protein, 9 aa, Homo Sapiens
QTPHDLPEC

SEQ ID NO: 540367 - protein, 9 aa, Homo Sapiens
CNNGANCRT

SEQ ID NO: 540368 - protein, 9 aa, Homo Sapiens
PHDLPECRH

SEQ ID NO: 540369 - protein, 9 aa, Homo Sapiens
ERALFTDRL

SEQ ID NO: 540370 - protein, 9 aa, Homo Sapiens
SNNVGLLKN

SEQ ID NO: 540371 - protein, 9 aa, Homo Sapiens
DLEGYEDSH

SEQ ID NO: 540372 - protein, 9 aa, Homo Sapiens
EEEDTDPRH

SEQ ID NO: 540373 - protein, 9 aa, Homo Sapiens
GGVPYLPES

SEQ ID NO: 540374 - protein, 9 aa, Homo Sapiens
PYLPESFPV

SEQ ID NO: 540375 - protein, 9 aa, Homo Sapiens
KDIYEINLS

SEQ ID NO: 540376 - protein, 9 aa, Homo Sapiens
ATISEDALP

SEQ ID NO: 540377 - protein, 9 aa, Homo Sapiens
QPPQHAALQ

SEQ ID NO: 540378 - protein, 9 aa, Homo Sapiens
TTPVWYGLR

SEQ ID NO: 540379 - protein, 9 aa, Homo Sapiens
KLGKGPEKS

SEQ ID NO: 540380 - protein, 9 aa, Homo Sapiens
SHGPQATGP

SEQ ID NO: 540381 - protein, 9 aa, Homo Sapiens
VYFPDDTEE

SEQ ID NO: 540382 - protein, 9 aa, Homo Sapiens
EDYQGLRVS

SEQ ID NO: 540383 - protein, 9 aa, Homo Sapiens
HSHGPQATG

SEQ ID NO: 540384 - protein, 9 aa, Homo Sapiens
DPRHLVQLL

SEQ ID NO: 540385 - protein, 9 aa, Homo Sapiens
LLNPWTGTS

SEQ ID NO: 540386 - protein, 9 aa, Homo Sapiens
MDTMLINIS

SEQ ID NO: 540387 - protein, 9 aa, Homo Sapiens
VCNNGANCR

SEQ ID NO: 540388 - protein, 9 aa, Homo Sapiens
SSKLLRQNK

SEQ ID NO: 540389 - protein, 9 aa, Homo Sapiens
RDLEGYEDS

SEQ ID NO: 540390 - protein, 9 aa, Homo Sapiens
NLVCYKDHG

SEQ ID NO: 540391 - protein, 9 aa, Homo Sapiens
IHSHGPQAT

SEQ ID NO: 540392 - protein, 9 aa, Homo Sapiens
EIISAIHSH

SEQ ID NO: 540393 - protein, 9 aa, Homo Sapiens
NVGLLKNLS

SEQ ID NO: 540394 - protein, 9 aa, Homo Sapiens
TLVREQVQA

SEQ ID NO: 540395 - protein, 9 aa, Homo Sapiens
LRQNKKTVH

SEQ ID NO: 540396 - protein, 9 aa, Homo Sapiens
FCTKRHQKH

SEQ ID NO: 540397 - protein, 9 aa, Homo Sapiens
RRDLEGYED

SEQ ID NO: 540398 - protein, 9 aa, Homo Sapiens
SQKPRAGQK

SEQ ID NO: 540399 - protein, 9 aa, Homo Sapiens
LVCNNGANC

SEQ ID NO: 540400 - protein, 9 aa, Homo Sapiens
SKMSNSLAE

SEQ ID NO: 540401 - protein, 9 aa, Homo Sapiens
RGIVPCHTA

SEQ ID NO: 540402 - protein, 9 aa, Homo Sapiens
PMSMLSKMS

SEQ ID NO: 540403 - protein, 9 aa, Homo Sapiens
EEDYQGLRV

SEQ ID NO: 540404 - protein, 9 aa, Homo Sapiens
IFGPDFCHC

SEQ ID NO: 540405 - protein, 9 aa, Homo Sapiens
FQGKDIYEI

SEQ ID NO: 540406 - protein, 9 aa, Homo Sapiens
FGPDFCHCP

SEQ ID NO: 540407 - protein, 9 aa, Homo Sapiens
TSINNPLVF

SEQ ID NO: 540408 - protein, 9 aa, Homo Sapiens
PPQHAALQA

SEQ ID NO: 540409 - protein, 9 aa, Homo Sapiens
FQLLRLCVE

SEQ ID NO: 540410 - protein, 9 aa, Homo Sapiens
INLSQWKVM

SEQ ID NO: 540411 - protein, 9 aa, Homo Sapiens
KATGSCCGR

SEQ ID NO: 540412 - protein, 9 aa, Homo Sapiens
PYFQLLRLC

SEQ ID NO: 540413 - protein, 9 aa, Homo Sapiens
VCYKDHGNP

SEQ ID NO: 540414 - protein, 9 aa, Homo Sapiens
LKNLSNGVT

SEQ ID NO: 540415 - protein, 9 aa, Homo Sapiens
TLQQVKITS

SEQ ID NO: 540416 - protein, 9 aa, Homo Sapiens
PDDTEEAFE

SEQ ID NO: 540417 - protein, 9 aa, Homo Sapiens
KSNLEIISA

SEQ ID NO: 540418 - protein, 9 aa, Homo Sapiens
GIVPCHTAV

SEQ ID NO: 540419 - protein, 9 aa, Homo Sapiens
LRTLRATIS

SEQ ID NO: 540420 - protein, 9 aa, Homo Sapiens
RHLVQLLRQ

SEQ ID NO: 540421 - protein, 9 aa, Homo Sapiens
AGVRKLGKG

SEQ ID NO: 540422 - protein, 9 aa, Homo Sapiens
GNLVCYKDH

SEQ ID NO: 540423 - protein, 9 aa, Homo Sapiens
SNLEIISAI

SEQ ID NO: 540424 - protein, 9 aa, Homo Sapiens
LLLGGVPYL

SEQ ID NO: 540425 - protein, 9 aa, Homo Sapiens
KMDTMLINI

SEQ ID NO: 540426 - protein, 9 aa, Homo Sapiens
LTASMIAVT

SEQ ID NO: 540427 - protein, 9 aa, Homo Sapiens
SRGIVPCHT

SEQ ID NO: 540428 - protein, 9 aa, Homo Sapiens
LRVSIDAYD

SEQ ID NO: 540429 - protein, 9 aa, Homo Sapiens
CQMPGNLVC

SEQ ID NO: 540430 - protein, 9 aa, Homo Sapiens
PPAGVRKLG

SEQ ID NO: 540431 - protein, 9 aa, Homo Sapiens
NKKTVHSYL

SEQ ID NO: 540432 - protein, 9 aa, Homo Sapiens
VKITSINNP

SEQ ID NO: 540433 - protein, 9 aa, Homo Sapiens
SKMDTMLIN

SEQ ID NO: 540434 - protein, 9 aa, Homo Sapiens
TLRATISED

SEQ ID NO: 540435 - protein, 9 aa, Homo Sapiens
QGKDIYEIN

SEQ ID NO: 540436 - protein, 9 aa, Homo Sapiens
VSIDAYDNF

SEQ ID NO: 540437 - protein, 9 aa, Homo Sapiens
PAGVRKLGK

SEQ ID NO: 540438 - protein, 9 aa, Homo Sapiens
FSSKLLRQN

SEQ ID NO: 540439 - protein, 9 aa, Homo Sapiens
KTQQLLNPW

SEQ ID NO: 540440 - protein, 9 aa, Homo Sapiens
EDTDPRHLV

SEQ ID NO: 540441 - protein, 9 aa, Homo Sapiens
YLPESFPVR

SEQ ID NO: 540442 - protein, 9 aa, Homo Sapiens
ALFTDRLAT

SEQ ID NO: 540443 - protein, 9 aa, Homo Sapiens
GPQATGPHL

SEQ ID NO: 540444 - protein, 9 aa, Homo Sapiens
DFCHCPNTS

SEQ ID NO: 540445 - protein, 9 aa, Homo Sapiens
KLLRQNKKT

SEQ ID NO: 540446 - protein, 9 aa, Homo Sapiens
QLRTLRATI

SEQ ID NO: 540447 - protein, 9 aa, Homo Sapiens
TDPRHLVQL

SEQ ID NO: 540448 - protein, 9 aa, Homo Sapiens
PVWYGLRLN

SEQ ID NO: 540449 - protein, 9 aa, Homo Sapiens
QIFGPDFCH

SEQ ID NO: 540450 - protein, 9 aa, Homo Sapiens
QQLLNPWTG

SEQ ID NO: 540451 - protein, 9 aa, Homo Sapiens
IEPDKNADL

SEQ ID NO: 540452 - protein, 9 aa, Homo Sapiens
FLSELIKKQ

SEQ ID NO: 540453 - protein, 9 aa, Homo Sapiens
SPPGVPLPH

SEQ ID NO: 540454 - protein, 9 aa, Homo Sapiens
NFFYDIEVE

SEQ ID NO: 540455 - protein, 9 aa, Homo Sapiens
ASAKLRLPQ

SEQ ID NO: 540456 - protein, 9 aa, Homo Sapiens
HEPSLCAHV

SEQ ID NO: 540457 - protein, 9 aa, Homo Sapiens
ISSGHGAGR

SEQ ID NO: 540458 - protein, 9 aa, Homo Sapiens
DTPAVISDF

SEQ ID NO: 540459 - protein, 9 aa, Homo Sapiens
AATSPPGVP

SEQ ID NO: 540460 - protein, 9 aa, Homo Sapiens
KQEAVHTEP

SEQ ID NO: 540461 - protein, 9 aa, Homo Sapiens
PSGPAGGRS

SEQ ID NO: 540462 - protein, 9 aa, Homo Sapiens
DSLVLPIEP

SEQ ID NO: 540463 - protein, 9 aa, Homo Sapiens
QEAVHTEPL

SEQ ID NO: 540464 - protein, 9 aa, Homo Sapiens
DDPNFFYDI

SEQ ID NO: 540465 - protein, 9 aa, Homo Sapiens
PSYKRDNSI

SEQ ID NO: 540466 - protein, 9 aa, Homo Sapiens
LVLPIEPDK

SEQ ID NO: 540467 - protein, 9 aa, Homo Sapiens
GREGVQSPE

SEQ ID NO: 540468 - protein, 9 aa, Homo Sapiens
HGAGREGVQ

SEQ ID NO: 540469 - protein, 9 aa, Homo Sapiens
PAGGRSSDS

SEQ ID NO: 540470 - protein, 9 aa, Homo Sapiens
YKRDNSISP

SEQ ID NO: 540471 - protein, 9 aa, Homo Sapiens
LCAHVECPP

SEQ ID NO: 540472 - protein, 9 aa, Homo Sapiens
TSPPGVPLP

SEQ ID NO: 540473 - protein, 9 aa, Homo Sapiens
RSSDSEWPC

SEQ ID NO: 540474 - protein, 9 aa, Homo Sapiens
IDHSYTGSL

SEQ ID NO: 540475 - protein, 9 aa, Homo Sapiens
SSDSLVLPI

SEQ ID NO: 540476 - protein, 9 aa, Homo Sapiens
VVFTSAGLR

SEQ ID NO: 540477 - protein, 9 aa, Homo Sapiens
TNYTYCVVF

SEQ ID NO: 540478 - protein, 9 aa, Homo Sapiens
SYKRDNSIS

SEQ ID NO: 540479 - protein, 9 aa, Homo Sapiens
GNSEEEEDT

SEQ ID NO: 540480 - protein, 9 aa, Homo Sapiens
SGHGAGREG

SEQ ID NO: 540481 - protein, 9 aa, Homo Sapiens
DPNFFYDIE

SEQ ID NO: 540482 - protein, 9 aa, Homo Sapiens
EPSLCAHVE

SEQ ID NO: 540483 - protein, 9 aa, Homo Sapiens
PQFIEELLE

SEQ ID NO: 540484 - protein, 9 aa, Homo Sapiens
SYTGSLWYT

SEQ ID NO: 540485 - protein, 9 aa, Homo Sapiens
GGIDHSYTG

SEQ ID NO: 540486 - protein, 9 aa, Homo Sapiens
SELIKKQEA

SEQ ID NO: 540487 - protein, 9 aa, Homo Sapiens
VPLPHYLGA

SEQ ID NO: 540488 - protein, 9 aa, Homo Sapiens
MHEPSLCAH

SEQ ID NO: 540489 - protein, 9 aa, Homo Sapiens
SEEEEDTPA

SEQ ID NO: 540490 - protein, 9 aa, Homo Sapiens
TYCVVFTSA

SEQ ID NO: 540491 - protein, 9 aa, Homo Sapiens
PSLCAHVEC

SEQ ID NO: 540492 - protein, 9 aa, Homo Sapiens
FYDIEVEFP

SEQ ID NO: 540493 - protein, 9 aa, Homo Sapiens
SSDSEWPCW

SEQ ID NO: 540494 - protein, 9 aa, Homo Sapiens
LPQFIEELL

SEQ ID NO: 540495 - protein, 9 aa, Homo Sapiens
EASAKLRLP

SEQ ID NO: 540496 - protein, 9 aa, Homo Sapiens
LSELIKKQE

SEQ ID NO: 540497 - protein, 9 aa, Homo Sapiens
EGPDTPSYK

SEQ ID NO: 540498 - protein, 9 aa, Homo Sapiens
KKQEAVHTE

SEQ ID NO: 540499 - protein, 9 aa, Homo Sapiens
FFYDIEVEF

SEQ ID NO: 540500 - protein, 9 aa, Homo Sapiens
ATSPPGVPL

SEQ ID NO: 540501 - protein, 9 aa, Homo Sapiens
PPGVPLPHY

SEQ ID NO: 540502 - protein, 9 aa, Homo Sapiens
DHSYTGSLW

SEQ ID NO: 540503 - protein, 9 aa, Homo Sapiens
SSGHGAGRE

SEQ ID NO: 540504 - protein, 9 aa, Homo Sapiens
GRSSDSEWP

SEQ ID NO: 540505 - protein, 9 aa, Homo Sapiens
NYTYCVVFT

SEQ ID NO: 540506 - protein, 9 aa, Homo Sapiens
HSYTGSLWY

SEQ ID NO: 540507 - protein, 9 aa, Homo Sapiens
GVPLPHYLG

SEQ ID NO: 540508 - protein, 9 aa, Homo Sapiens
IIGGIDHSY

SEQ ID NO: 540509 - protein, 9 aa, Homo Sapiens
EDTPAVISD

SEQ ID NO: 540510 - protein, 9 aa, Homo Sapiens
IKKQEAVHT

SEQ ID NO: 540511 - protein, 9 aa, Homo Sapiens
REGVQSPER

SEQ ID NO: 540512 - protein, 9 aa, Homo Sapiens
AGREGVQSP

SEQ ID NO: 540513 - protein, 9 aa, Homo Sapiens
EEEEDTPAV

SEQ ID NO: 540514 - protein, 9 aa, Homo Sapiens
SLCAHVECP

SEQ ID NO: 540515 - protein, 9 aa, Homo Sapiens
LRLPQFIEE

SEQ ID NO: 540516 - protein, 9 aa, Homo Sapiens
KRDNSISPE

SEQ ID NO: 540517 - protein, 9 aa, Homo Sapiens
GPAGGRSSD

SEQ ID NO: 540518 - protein, 9 aa, Homo Sapiens
VFTSAGLRH

SEQ ID NO: 540519 - protein, 9 aa, Homo Sapiens
EEEDTPAVI

SEQ ID NO: 540520 - protein, 9 aa, Homo Sapiens
IGGIDHSYT

SEQ ID NO: 540521 - protein, 9 aa, Homo Sapiens
AGGRSSDSE

SEQ ID NO: 540522 - protein, 9 aa, Homo Sapiens
SDSLVLPIE

SEQ ID NO: 540523 - protein, 9 aa, Homo Sapiens
KLRLPQFIE

SEQ ID NO: 540524 - protein, 9 aa, Homo Sapiens
LPIEPDKNA

SEQ ID NO: 540525 - protein, 9 aa, Homo Sapiens
GHGAGREGV

SEQ ID NO: 540526 - protein, 9 aa, Homo Sapiens
SLVLPIEPD

SEQ ID NO: 540527 - protein, 9 aa, Homo Sapiens
RLPQFIEEL

SEQ ID NO: 540528 - protein, 9 aa, Homo Sapiens
YWPYLTAEA

SEQ ID NO: 540529 - protein, 9 aa, Homo Sapiens
PDTPSYKRD

SEQ ID NO: 540530 - protein, 9 aa, Homo Sapiens
TPSYKRDNS

SEQ ID NO: 540531 - protein, 9 aa, Homo Sapiens
DTPSYKRDN

SEQ ID NO: 540532 - protein, 9 aa, Homo Sapiens
PAATSPPGV

SEQ ID NO: 540533 - protein, 9 aa, Homo Sapiens
GIDHSYTGS

SEQ ID NO: 540534 - protein, 9 aa, Homo Sapiens
ELIKKQEAV

SEQ ID NO: 540535 - protein, 9 aa, Homo Sapiens
CVVFTSAGL

SEQ ID NO: 540536 - protein, 9 aa, Homo Sapiens
FTSAGLRHN

SEQ ID NO: 540537 - protein, 9 aa, Homo Sapiens
SAKLRLPQF

SEQ ID NO: 540538 - protein, 9 aa, Homo Sapiens
KKKDDPNFF

SEQ ID NO: 540539 - protein, 9 aa, Homo Sapiens
PGVPLPHYL

SEQ ID NO: 540540 - protein, 9 aa, Homo Sapiens
YCVVFTSAG

SEQ ID NO: 540541 - protein, 9 aa, Homo Sapiens
GAGREGVQS

SEQ ID NO: 540542 - protein, 9 aa, Homo Sapiens
KDDPNFFYD

SEQ ID NO: 540543 - protein, 9 aa, Homo Sapiens
LIKKQEAVH

SEQ ID NO: 540544 - protein, 9 aa, Homo Sapiens
AKLRLPQFI

SEQ ID NO: 540545 - protein, 9 aa, Homo Sapiens
EEDTPAVIS

SEQ ID NO: 540546 - protein, 9 aa, Homo Sapiens
VLPIEPDKN

SEQ ID NO: 540547 - protein, 9 aa, Homo Sapiens
GGRSSDSEW

SEQ ID NO: 540548 - protein, 9 aa, Homo Sapiens
KKDDPNFFY

SEQ ID NO: 540549 - protein, 9 aa, Homo Sapiens
SGPAGGRSS

SEQ ID NO: 540550 - protein, 9 aa, Homo Sapiens
TPAVISDFI

SEQ ID NO: 540551 - protein, 9 aa, Homo Sapiens
PNFFYDIEV

SEQ ID NO: 540552 - protein, 9 aa, Homo Sapiens
GPDTPSYKR

SEQ ID NO: 540553 - protein, 9 aa, Homo Sapiens
PIEPDKNAD

SEQ ID NO: 540554 - protein, 9 aa, Homo Sapiens
YTYCVVFTS

SEQ ID NO: 540555 - protein, 9 aa, Homo Sapiens
NSEEEEDTP

SEQ ID NO: 540556 - protein, 9 aa, Homo Sapiens
SLTDSSETE

SEQ ID NO: 540557 - protein, 9 aa, Homo Sapiens
GTGMVMNLA

SEQ ID NO: 540558 - protein, 9 aa, Homo Sapiens
QACPHAYYA

SEQ ID NO: 540559 - protein, 9 aa, Homo Sapiens
YNVCYELAR

SEQ ID NO: 540560 - protein, 9 aa, Homo Sapiens
LASDASSQS

SEQ ID NO: 540561 - protein, 9 aa, Homo Sapiens
QPGSQVPDL

SEQ ID NO: 540562 - protein, 9 aa, Homo Sapiens
EIDPGTGMV

SEQ ID NO: 540563 - protein, 9 aa, Homo Sapiens
GGSLRYNVC

SEQ ID NO: 540564 - protein, 9 aa, Homo Sapiens
PAYLLGIVS

SEQ ID NO: 540565 - protein, 9 aa, Homo Sapiens
EEAILSAFH

SEQ ID NO: 540566 - protein, 9 aa, Homo Sapiens
KNKDVNTNL

SEQ ID NO: 540567 - protein, 9 aa, Homo Sapiens
WGGRLDPAG

SEQ ID NO: 540568 - protein, 9 aa, Homo Sapiens
IVSGRLQEK

SEQ ID NO: 540569 - protein, 9 aa, Homo Sapiens
SKLEKNKDV

SEQ ID NO: 540570 - protein, 9 aa, Homo Sapiens
KKQKTRAVF

SEQ ID NO: 540571 - protein, 9 aa, Homo Sapiens
VASMSTASV

SEQ ID NO: 540572 - protein, 9 aa, Homo Sapiens
SLRYNVCYE

SEQ ID NO: 540573 - protein, 9 aa, Homo Sapiens
TCGQPGSQV

SEQ ID NO: 540574 - protein, 9 aa, Homo Sapiens
RDAYLIVYS

SEQ ID NO: 540575 - protein, 9 aa, Homo Sapiens
DCNGIKILA

SEQ ID NO: 540576 - protein, 9 aa, Homo Sapiens
MQVRDAYLI

SEQ ID NO: 540577 - protein, 9 aa, Homo Sapiens
SQACPHAYY

SEQ ID NO: 540578 - protein, 9 aa, Homo Sapiens
HMFDPSGKG

SEQ ID NO: 540579 - protein, 9 aa, Homo Sapiens
ACPHAYYAL

SEQ ID NO: 540580 - protein, 9 aa, Homo Sapiens
DLKDMLRTM

SEQ ID NO: 540581 - protein, 9 aa, Homo Sapiens
MATTLVVIC

SEQ ID NO: 540582 - protein, 9 aa, Homo Sapiens
IPDVLRSIP

SEQ ID NO: 540583 - protein, 9 aa, Homo Sapiens
EESYDLKDM

SEQ ID NO: 540584 - protein, 9 aa, Homo Sapiens
ASQACPHAY

SEQ ID NO: 540585 - protein, 9 aa, Homo Sapiens
ELSECLDLQ

SEQ ID NO: 540586 - protein, 9 aa, Homo Sapiens
EEEHKDESR

SEQ ID NO: 540587 - protein, 9 aa, Homo Sapiens
PAGSATHTW

SEQ ID NO: 540588 - protein, 9 aa, Homo Sapiens
SMSTASVAT

SEQ ID NO: 540589 - protein, 9 aa, Homo Sapiens
SPRNNPFPP

SEQ ID NO: 540590 - protein, 9 aa, Homo Sapiens
SSQSRMVHA

SEQ ID NO: 540591 - protein, 9 aa, Homo Sapiens
VLTGDKAKQ

SEQ ID NO: 540592 - protein, 9 aa, Homo Sapiens
RSNSSDINV

SEQ ID NO: 540593 - protein, 9 aa, Homo Sapiens
KDVNTNLTH

SEQ ID NO: 540594 - protein, 9 aa, Homo Sapiens
TVHGEIDPG

SEQ ID NO: 540595 - protein, 9 aa, Homo Sapiens
NARHDIIKI

SEQ ID NO: 540596 - protein, 9 aa, Homo Sapiens
DSSETEKRI

SEQ ID NO: 540597 - protein, 9 aa, Homo Sapiens
RDRVEEEHK

SEQ ID NO: 540598 - protein, 9 aa, Homo Sapiens
SHMEGVASM

SEQ ID NO: 540599 - protein, 9 aa, Homo Sapiens
SGVERLKNP

SEQ ID NO: 540600 - protein, 9 aa, Homo Sapiens
LTWRSNSSD

SEQ ID NO: 540601 - protein, 9 aa, Homo Sapiens
AVFSSTQLC

SEQ ID NO: 540602 - protein, 9 aa, Homo Sapiens
DRVEEEHKD

SEQ ID NO: 540603 - protein, 9 aa, Homo Sapiens
ILIPDVLRS

SEQ ID NO: 540604 - protein, 9 aa, Homo Sapiens
SATHTWCDL

SEQ ID NO: 540605 - protein, 9 aa, Homo Sapiens
FQPAGSATH

SEQ ID NO: 540606 - protein, 9 aa, Homo Sapiens
ICIICQDLL

SEQ ID NO: 540607 - protein, 9 aa, Homo Sapiens
SETEKRIIQ

SEQ ID NO: 540608 - protein, 9 aa, Homo Sapiens
SECLDLQRF

SEQ ID NO: 540609 - protein, 9 aa, Homo Sapiens
TSYPYVKVW

SEQ ID NO: 540610 - protein, 9 aa, Homo Sapiens
LIGDVYIER

SEQ ID NO: 540611 - protein, 9 aa, Homo Sapiens
VERLKNPDL

SEQ ID NO: 540612 - protein, 9 aa, Homo Sapiens
HDIIKIFNA

SEQ ID NO: 540613 - protein, 9 aa, Homo Sapiens
RAVFSSTQL

SEQ ID NO: 540614 - protein, 9 aa, Homo Sapiens
RLDPAGSWT

SEQ ID NO: 540615 - protein, 9 aa, Homo Sapiens
NSTGASQAC

SEQ ID NO: 540616 - protein, 9 aa, Homo Sapiens
WTCGQPGSQ

SEQ ID NO: 540617 - protein, 9 aa, Homo Sapiens
RSPRNNPFP

SEQ ID NO: 540618 - protein, 9 aa, Homo Sapiens
TLICIICQD

SEQ ID NO: 540619 - protein, 9 aa, Homo Sapiens
MVLTGDKAK

SEQ ID NO: 540620 - protein, 9 aa, Homo Sapiens
SSDINVCRM

SEQ ID NO: 540621 - protein, 9 aa, Homo Sapiens
VLRSIPSAL

SEQ ID NO: 540622 - protein, 9 aa, Homo Sapiens
FPAYLLGIV

SEQ ID NO: 540623 - protein, 9 aa, Homo Sapiens
RPMVLTGDK

SEQ ID NO: 540624 - protein, 9 aa, Homo Sapiens
CGQPGSQVP

SEQ ID NO: 540625 - protein, 9 aa, Homo Sapiens
PRNNPFPPE

SEQ ID NO: 540626 - protein, 9 aa, Homo Sapiens
GSLRYNVCY

SEQ ID NO: 540627 - protein, 9 aa, Homo Sapiens
KTRAVFSST

SEQ ID NO: 540628 - protein, 9 aa, Homo Sapiens
GVERLKNPD

SEQ ID NO: 540629 - protein, 9 aa, Homo Sapiens
NGIKILAVY

SEQ ID NO: 540630 - protein, 9 aa, Homo Sapiens
IPLLGAMAT

SEQ ID NO: 540631 - protein, 9 aa, Homo Sapiens
RNNPFPPEA

SEQ ID NO: 540632 - protein, 9 aa, Homo Sapiens
MEGVASMST

SEQ ID NO: 540633 - protein, 9 aa, Homo Sapiens
ASSQSRMVH

SEQ ID NO: 540634 - protein, 9 aa, Homo Sapiens
ASLTDSSET

SEQ ID NO: 540635 - protein, 9 aa, Homo Sapiens
TRAVFSSTQ

SEQ ID NO: 540636 - protein, 9 aa, Homo Sapiens
PLLGAMATT

SEQ ID NO: 540637 - protein, 9 aa, Homo Sapiens
TNSEDCNGI

SEQ ID NO: 540638 - protein, 9 aa, Homo Sapiens
TWRSNSSDI

SEQ ID NO: 540639 - protein, 9 aa, Homo Sapiens
TGASQACPH

SEQ ID NO: 540640 - protein, 9 aa, Homo Sapiens
YPYVKVWLM

SEQ ID NO: 540641 - protein, 9 aa, Homo Sapiens
TLNTFIAKV

SEQ ID NO: 540642 - protein, 9 aa, Homo Sapiens
RFQPAGSAT

SEQ ID NO: 540643 - protein, 9 aa, Homo Sapiens
DVYIERIIV

SEQ ID NO: 540644 - protein, 9 aa, Homo Sapiens
VYIERIIVR

SEQ ID NO: 540645 - protein, 9 aa, Homo Sapiens
DSSRHSGSR

SEQ ID NO: 540646 - protein, 9 aa, Homo Sapiens
LRSIPSALT

SEQ ID NO: 540647 - protein, 9 aa, Homo Sapiens
SYDLKDMLR

SEQ ID NO: 540648 - protein, 9 aa, Homo Sapiens
PMVLTGDKA

SEQ ID NO: 540649 - protein, 9 aa, Homo Sapiens
LGIVSGRLQ

SEQ ID NO: 540650 - protein, 9 aa, Homo Sapiens
ESYDLKDML

SEQ ID NO: 540651 - protein, 9 aa, Homo Sapiens
GQPGSQVPD

SEQ ID NO: 540652 - protein, 9 aa, Homo Sapiens
LRYNVCYEL

SEQ ID NO: 540653 - protein, 9 aa, Homo Sapiens
LHDHCMQVR

SEQ ID NO: 540654 - protein, 9 aa, Homo Sapiens
DYLIGDVYI

SEQ ID NO: 540655 - protein, 9 aa, Homo Sapiens
SAFHMFDPS

SEQ ID NO: 540656 - protein, 9 aa, Homo Sapiens
LTLNTFIAK

SEQ ID NO: 540657 - protein, 9 aa, Homo Sapiens
LSGVERLKN

SEQ ID NO: 540658 - protein, 9 aa, Homo Sapiens
CMQVRDAYL

SEQ ID NO: 540659 - protein, 9 aa, Homo Sapiens
VHGEIDPGT

SEQ ID NO: 540660 - protein, 9 aa, Homo Sapiens
DPAGSWTCG

SEQ ID NO: 540661 - protein, 9 aa, Homo Sapiens
DKMEETLIC

SEQ ID NO: 540662 - protein, 9 aa, Homo Sapiens
RVEEEHKDE

SEQ ID NO: 540663 - protein, 9 aa, Homo Sapiens
EYLTLNTFI

SEQ ID NO: 540664 - protein, 9 aa, Homo Sapiens
SIPSALTQA

SEQ ID NO: 540665 - protein, 9 aa, Homo Sapiens
CNGIKILAV

SEQ ID NO: 540666 - protein, 9 aa, Homo Sapiens
ATTLVVICT

SEQ ID NO: 540667 - protein, 9 aa, Homo Sapiens
DIGGTSYPY

SEQ ID NO: 540668 - protein, 9 aa, Homo Sapiens
ARHDIIKIF

SEQ ID NO: 540669 - protein, 9 aa, Homo Sapiens
MDIGGTSYP

SEQ ID NO: 540670 - protein, 9 aa, Homo Sapiens
LTGDKAKQV

SEQ ID NO: 540671 - protein, 9 aa, Homo Sapiens
KMEETLICI

SEQ ID NO: 540672 - protein, 9 aa, Homo Sapiens
KLTWRSNSS

SEQ ID NO: 540673 - protein, 9 aa, Homo Sapiens
DILELSECL

SEQ ID NO: 540674 - protein, 9 aa, Homo Sapiens
IGGTSYPYV

SEQ ID NO: 540675 - protein, 9 aa, Homo Sapiens
PDKMEETLI

SEQ ID NO: 540676 - protein, 9 aa, Homo Sapiens
WRSNSSDIN

SEQ ID NO: 540677 - protein, 9 aa, Homo Sapiens
DASSQSRMV

SEQ ID NO: 540678 - protein, 9 aa, Homo Sapiens
VLKEYLTLN

SEQ ID NO: 540679 - protein, 9 aa, Homo Sapiens
KLEKNKDVN

SEQ ID NO: 540680 - protein, 9 aa, Homo Sapiens
GSWTCGQPG

SEQ ID NO: 540681 - protein, 9 aa, Homo Sapiens
PDVLRSIPS

SEQ ID NO: 540682 - protein, 9 aa, Homo Sapiens
EETLICIIC

SEQ ID NO: 540683 - protein, 9 aa, Homo Sapiens
GQQNARHDI

SEQ ID NO: 540684 - protein, 9 aa, Homo Sapiens
EEHKDESRA

SEQ ID NO: 540685 - protein, 9 aa, Homo Sapiens
CPHAYYALS

SEQ ID NO: 540686 - protein, 9 aa, Homo Sapiens
TEKRIIQEL

SEQ ID NO: 540687 - protein, 9 aa, Homo Sapiens
KEYLTLNTF

SEQ ID NO: 540688 - protein, 9 aa, Homo Sapiens
GEIDPGTGM

SEQ ID NO: 540689 - protein, 9 aa, Homo Sapiens
ECLDLQRFH

SEQ ID NO: 540690 - protein, 9 aa, Homo Sapiens
QKTRAVFSS

SEQ ID NO: 540691 - protein, 9 aa, Homo Sapiens
PSKLEKNKD

SEQ ID NO: 540692 - protein, 9 aa, Homo Sapiens
EAILSAFHM

SEQ ID NO: 540693 - protein, 9 aa, Homo Sapiens
AMATTLVVI

SEQ ID NO: 540694 - protein, 9 aa, Homo Sapiens
SDASSQSRM

SEQ ID NO: 540695 - protein, 9 aa, Homo Sapiens
AGSATHTWC

SEQ ID NO: 540696 - protein, 9 aa, Homo Sapiens
HDHCMQVRD

SEQ ID NO: 540697 - protein, 9 aa, Homo Sapiens
HKDESRAGS

SEQ ID NO: 540698 - protein, 9 aa, Homo Sapiens
LIPDVLRSI

SEQ ID NO: 540699 - protein, 9 aa, Homo Sapiens
GAMATTLVV

SEQ ID NO: 540700 - protein, 9 aa, Homo Sapiens
MEETLICII

SEQ ID NO: 540701 - protein, 9 aa, Homo Sapiens
NVCYELARG

SEQ ID NO: 540702 - protein, 9 aa, Homo Sapiens
PVKKQKTRA

SEQ ID NO: 540703 - protein, 9 aa, Homo Sapiens
EKNKDVNTN

SEQ ID NO: 540704 - protein, 9 aa, Homo Sapiens
EDCNGIKIL

SEQ ID NO: 540705 - protein, 9 aa, Homo Sapiens
LICIICQDL

SEQ ID NO: 540706 - protein, 9 aa, Homo Sapiens
LDPAGSWTC

SEQ ID NO: 540707 - protein, 9 aa, Homo Sapiens
VRDAYLIVY

SEQ ID NO: 540708 - protein, 9 aa, Homo Sapiens
SSETEKRII

SEQ ID NO: 540709 - protein, 9 aa, Homo Sapiens
LKEYLTLNT

SEQ ID NO: 540710 - protein, 9 aa, Homo Sapiens
SGDSSRHSG

SEQ ID NO: 540711 - protein, 9 aa, Homo Sapiens
RYNVCYELA

SEQ ID NO: 540712 - protein, 9 aa, Homo Sapiens
DHCMQVRDA

SEQ ID NO: 540713 - protein, 9 aa, Homo Sapiens
SNSSDINVC

SEQ ID NO: 540714 - protein, 9 aa, Homo Sapiens
LNTFIAKVI

SEQ ID NO: 540715 - protein, 9 aa, Homo Sapiens
KQKTRAVFS

SEQ ID NO: 540716 - protein, 9 aa, Homo Sapiens
FPPEAKSPV

SEQ ID NO: 540717 - protein, 9 aa, Homo Sapiens
QSRMVHASA

SEQ ID NO: 540718 - protein, 9 aa, Homo Sapiens
LGAMATTLV

SEQ ID NO: 540719 - protein, 9 aa, Homo Sapiens
KDESRAGSE

SEQ ID NO: 540720 - protein, 9 aa, Homo Sapiens
ASMSTASVA

SEQ ID NO: 540721 - protein, 9 aa, Homo Sapiens
TTLVVICTA

SEQ ID NO: 540722 - protein, 9 aa, Homo Sapiens
YLTLNTFIA

SEQ ID NO: 540723 - protein, 9 aa, Homo Sapiens
SPSKLEKNK

SEQ ID NO: 540724 - protein, 9 aa, Homo Sapiens
GHRFQPAGS

SEQ ID NO: 540725 - protein, 9 aa, Homo Sapiens
DPGTGMVMN

SEQ ID NO: 540726 - protein, 9 aa, Homo Sapiens
DMLRTMGMV

SEQ ID NO: 540727 - protein, 9 aa, Homo Sapiens
GGRLDPAGS

SEQ ID NO: 540728 - protein, 9 aa, Homo Sapiens
SQSRMVHAS

SEQ ID NO: 540729 - protein, 9 aa, Homo Sapiens
KDMLRTMGM

SEQ ID NO: 540730 - protein, 9 aa, Homo Sapiens
MSTASVATS

SEQ ID NO: 540731 - protein, 9 aa, Homo Sapiens
IKILAVYCS

SEQ ID NO: 540732 - protein, 9 aa, Homo Sapiens
CLDLQRFHS

SEQ ID NO: 540733 - protein, 9 aa, Homo Sapiens
NNPFPPEAK

SEQ ID NO: 540734 - protein, 9 aa, Homo Sapiens
EGVASMSTA

SEQ ID NO: 540735 - protein, 9 aa, Homo Sapiens
GGTSYPYVK

SEQ ID NO: 540736 - protein, 9 aa, Homo Sapiens
GASQACPHA

SEQ ID NO: 540737 - protein, 9 aa, Homo Sapiens
SYPYVKVWL

SEQ ID NO: 540738 - protein, 9 aa, Homo Sapiens
IERIIVRLH

SEQ ID NO: 540739 - protein, 9 aa, Homo Sapiens
VSGRLQEKL

SEQ ID NO: 540740 - protein, 9 aa, Homo Sapiens
GRLDPAGSW

SEQ ID NO: 540741 - protein, 9 aa, Homo Sapiens
PGSQVPDLQ

SEQ ID NO: 540742 - protein, 9 aa, Homo Sapiens
SEDCNGIKI

SEQ ID NO: 540743 - protein, 9 aa, Homo Sapiens
ETEKRIIQE

SEQ ID NO: 540744 - protein, 9 aa, Homo Sapiens
PRSPRNNPF

SEQ ID NO: 540745 - protein, 9 aa, Homo Sapiens
RKLTWRSNS

SEQ ID NO: 540746 - protein, 9 aa, Homo Sapiens
DVLRSIPSA

SEQ ID NO: 540747 - protein, 9 aa, Homo Sapiens
STGASQACP

SEQ ID NO: 540748 - protein, 9 aa, Homo Sapiens
PAGSWTCGQ

SEQ ID NO: 540749 - protein, 9 aa, Homo Sapiens
YLIGDVYIE

SEQ ID NO: 540750 - protein, 9 aa, Homo Sapiens
NKDVNTNLT

SEQ ID NO: 540751 - protein, 9 aa, Homo Sapiens
QQNARHDII

SEQ ID NO: 540752 - protein, 9 aa, Homo Sapiens
ASDASSQSR

SEQ ID NO: 540753 - protein, 9 aa, Homo Sapiens
YIERIIVRL

SEQ ID NO: 540754 - protein, 9 aa, Homo Sapiens
MLRTMGMVD

SEQ ID NO: 540755 - protein, 9 aa, Homo Sapiens
RSIPSALTQ

SEQ ID NO: 540756 - protein, 9 aa, Homo Sapiens
GTSYPYVKV

SEQ ID NO: 540757 - protein, 9 aa, Homo Sapiens
PFPPEAKSP

SEQ ID NO: 540758 - protein, 9 aa, Homo Sapiens
TDSSETEKR

SEQ ID NO: 540759 - protein, 9 aa, Homo Sapiens
IGDVYIERI

SEQ ID NO: 540760 - protein, 9 aa, Homo Sapiens
AILSAFHMF

SEQ ID NO: 540761 - protein, 9 aa, Homo Sapiens
FHMFDPSGK

SEQ ID NO: 540762 - protein, 9 aa, Homo Sapiens
ETLICIICQ

SEQ ID NO: 540763 - protein, 9 aa, Homo Sapiens
HCMQVRDAY

SEQ ID NO: 540764 - protein, 9 aa, Homo Sapiens
VKKQKTRAV

SEQ ID NO: 540765 - protein, 9 aa, Homo Sapiens
NSSDINVCR

SEQ ID NO: 540766 - protein, 9 aa, Homo Sapiens
QPAGSATHT

SEQ ID NO: 540767 - protein, 9 aa, Homo Sapiens
AFHMFDPSG

SEQ ID NO: 540768 - protein, 9 aa, Homo Sapiens
ILELSECLD

SEQ ID NO: 540769 - protein, 9 aa, Homo Sapiens
LLGAMATTL

SEQ ID NO: 540770 - protein, 9 aa, Homo Sapiens
SWTCGQPGS

SEQ ID NO: 540771 - protein, 9 aa, Homo Sapiens
CYELARGML

SEQ ID NO: 540772 - protein, 9 aa, Homo Sapiens
YDLKDMLRT

SEQ ID NO: 540773 - protein, 9 aa, Homo Sapiens
AMDIGGTSY

SEQ ID NO: 540774 - protein, 9 aa, Homo Sapiens
HMEGVASMS

SEQ ID NO: 540775 - protein, 9 aa, Homo Sapiens
TGDKAKQVQ

SEQ ID NO: 540776 - protein, 9 aa, Homo Sapiens
LSAFHMFDP

SEQ ID NO: 540777 - protein, 9 aa, Homo Sapiens
VLGRPMVLT

SEQ ID NO: 540778 - protein, 9 aa, Homo Sapiens
GDVYIERII

SEQ ID NO: 540779 - protein, 9 aa, Homo Sapiens
AGSWTCGQP

SEQ ID NO: 540780 - protein, 9 aa, Homo Sapiens
EHKDESRAG

SEQ ID NO: 540781 - protein, 9 aa, Homo Sapiens
NSEDCNGIK

SEQ ID NO: 540782 - protein, 9 aa, Homo Sapiens
IDPGTGMVM

SEQ ID NO: 540783 - protein, 9 aa, Homo Sapiens
QVRDAYLIV

SEQ ID NO: 540784 - protein, 9 aa, Homo Sapiens
DIIKIFNAL

SEQ ID NO: 540785 - protein, 9 aa, Homo Sapiens
LLSGVERLK

SEQ ID NO: 540786 - protein, 9 aa, Homo Sapiens
VEEEHKDES

SEQ ID NO: 540787 - protein, 9 aa, Homo Sapiens
GVASMSTAS

SEQ ID NO: 540788 - protein, 9 aa, Homo Sapiens
RHDIIKIFN

SEQ ID NO: 540789 - protein, 9 aa, Homo Sapiens
SRMVHASAS

SEQ ID NO: 540790 - protein, 9 aa, Homo Sapiens
VCYELARGM

SEQ ID NO: 540791 - protein, 9 aa, Homo Sapiens
GSATHTWCD

SEQ ID NO: 540792 - protein, 9 aa, Homo Sapiens
LELSECLDL

SEQ ID NO: 540793 - protein, 9 aa, Homo Sapiens
LTDSSETEK

SEQ ID NO: 540794 - protein, 9 aa, Homo Sapiens
LGRPMVLTG

SEQ ID NO: 540795 - protein, 9 aa, Homo Sapiens
PGTGMVMNL

SEQ ID NO: 540796 - protein, 9 aa, Homo Sapiens
NPFPPEAKS

SEQ ID NO: 540797 - protein, 9 aa, Homo Sapiens
NTFIAKVIG

SEQ ID NO: 540798 - protein, 9 aa, Homo Sapiens
LKDMLRTMG

SEQ ID NO: 540799 - protein, 9 aa, Homo Sapiens
SSRHSGSRH

SEQ ID NO: 540800 - protein, 9 aa, Homo Sapiens
AYLLGIVSG

SEQ ID NO: 540801 - protein, 9 aa, Homo Sapiens
QNARHDIIK

SEQ ID NO: 540802 - protein, 9 aa, Homo Sapiens
HRFQPAGSA

SEQ ID NO: 540803 - protein, 9 aa, Homo Sapiens
HGEIDPGTG

SEQ ID NO: 540804 - protein, 9 aa, Homo Sapiens
GDSSRHSGS

SEQ ID NO: 540805 - protein, 9 aa, Homo Sapiens
ILSAFHMFD

SEQ ID NO: 540806 - protein, 9 aa, Homo Sapiens
YLLGIVSGR

SEQ ID NO: 540807 - protein, 9 aa, Homo Sapiens
VGQQNARHD

SEQ ID NO: 540808 - protein, 9 aa, Homo Sapiens
LEKNKDVNT

SEQ ID NO: 540809 - protein, 9 aa, Homo Sapiens
GIKILAVYC

SEQ ID NO: 540810 - protein, 9 aa, Homo Sapiens
LLGIVSGRL

SEQ ID NO: 540811 - protein, 9 aa, Homo Sapiens
MDILELSEC

SEQ ID NO: 540812 - protein, 9 aa, Homo Sapiens
GIVSGRLQE

SEQ ID NO: 540813 - protein, 9 aa, Homo Sapiens
GRPMVLTGD

SEQ ID NO: 540814 - protein, 9 aa, Homo Sapiens
LSECLDLQR

SEQ ID NO: 540815 - protein, 9 aa, Homo Sapiens
YSGIIFSIL

SEQ ID NO: 540816 - protein, 9 aa, Homo Sapiens
DNIHYSVRF

SEQ ID NO: 540817 - protein, 9 aa, Homo Sapiens
VVFKSCTQV

SEQ ID NO: 540818 - protein, 9 aa, Homo Sapiens
PDSKITGSS

SEQ ID NO: 540819 - protein, 9 aa, Homo Sapiens
VYMRDFNLK

SEQ ID NO: 540820 - protein, 9 aa, Homo Sapiens
YSGTVNSDP

SEQ ID NO: 540821 - protein, 9 aa, Homo Sapiens
GCSDNIHYS

SEQ ID NO: 540822 - protein, 9 aa, Homo Sapiens
VQHIDRSDL

SEQ ID NO: 540823 - protein, 9 aa, Homo Sapiens
HQQQHQQQQ

SEQ ID NO: 540824 - protein, 9 aa, Homo Sapiens
LEWWHVQPT

SEQ ID NO: 540825 - protein, 9 aa, Homo Sapiens
APDSKITGS

SEQ ID NO: 540826 - protein, 9 aa, Homo Sapiens
AQVYMRDFN

SEQ ID NO: 540827 - protein, 9 aa, Homo Sapiens
VNSDPSSAA

SEQ ID NO: 540828 - protein, 9 aa, Homo Sapiens
YPPVVFKSC

SEQ ID NO: 540829 - protein, 9 aa, Homo Sapiens
VAPDSKITG

SEQ ID NO: 540830 - protein, 9 aa, Homo Sapiens
PAGGRSSDS

SEQ ID NO: 540831 - protein, 9 aa, Homo Sapiens
DTMVEPYNA

SEQ ID NO: 540832 - protein, 9 aa, Homo Sapiens
ETMTEIHLE

SEQ ID NO: 540833 - protein, 9 aa, Homo Sapiens
MTEIHLELN

SEQ ID NO: 540834 - protein, 9 aa, Homo Sapiens
GCCVGILQS

SEQ ID NO: 540835 - protein, 9 aa, Homo Sapiens
RCQNWYHGC

SEQ ID NO: 540836 - protein, 9 aa, Homo Sapiens
TTTPISTTT

SEQ ID NO: 540837 - protein, 9 aa, Homo Sapiens
KIPMVLRLF

SEQ ID NO: 540838 - protein, 9 aa, Homo Sapiens
QNWYHGCCV

SEQ ID NO: 540839 - protein, 9 aa, Homo Sapiens
TTPISTTTT

SEQ ID NO: 540840 - protein, 9 aa, Homo Sapiens
PETMTEIHL

SEQ ID NO: 540841 - protein, 9 aa, Homo Sapiens
SGTVNSDPS

SEQ ID NO: 540842 - protein, 9 aa, Homo Sapiens
HIDRSDLSP

SEQ ID NO: 540843 - protein, 9 aa, Homo Sapiens
RSSDSEWPC

SEQ ID NO: 540844 - protein, 9 aa, Homo Sapiens
SCTQVVHES

SEQ ID NO: 540845 - protein, 9 aa, Homo Sapiens
PTTTPISTT

SEQ ID NO: 540846 - protein, 9 aa, Homo Sapiens
QVYMRDFNL

SEQ ID NO: 540847 - protein, 9 aa, Homo Sapiens
PVVFKSCTQ

SEQ ID NO: 540848 - protein, 9 aa, Homo Sapiens
HQHQQQHQQ

SEQ ID NO: 540849 - protein, 9 aa, Homo Sapiens
VTVQPGCYL

SEQ ID NO: 540850 - protein, 9 aa, Homo Sapiens
EIHLELNGI

SEQ ID NO: 540851 - protein, 9 aa, Homo Sapiens
IHYSVRFAK

SEQ ID NO: 540852 - protein, 9 aa, Homo Sapiens
AWLEWWHVQ

SEQ ID NO: 540853 - protein, 9 aa, Homo Sapiens
PVSPDQLPC

SEQ ID NO: 540854 - protein, 9 aa, Homo Sapiens
LPETMTEIH

SEQ ID NO: 540855 - protein, 9 aa, Homo Sapiens
IPMVLRLFD

SEQ ID NO: 540856 - protein, 9 aa, Homo Sapiens
SSDSEWPCW

SEQ ID NO: 540857 - protein, 9 aa, Homo Sapiens
SYSGIIFSI

SEQ ID NO: 540858 - protein, 9 aa, Homo Sapiens
SKITGSSYP

SEQ ID NO: 540859 - protein, 9 aa, Homo Sapiens
TSYSGIIFS

SEQ ID NO: 540860 - protein, 9 aa, Homo Sapiens
TVQPGCYLP

SEQ ID NO: 540861 - protein, 9 aa, Homo Sapiens
HYSVRFAKA

SEQ ID NO: 540862 - protein, 9 aa, Homo Sapiens
VSDTMVEPY

SEQ ID NO: 540863 - protein, 9 aa, Homo Sapiens
PMVLRLFDT

SEQ ID NO: 540864 - protein, 9 aa, Homo Sapiens
CFYSGTVNS

SEQ ID NO: 540865 - protein, 9 aa, Homo Sapiens
EAQVYMRDF

SEQ ID NO: 540866 - protein, 9 aa, Homo Sapiens
CSDNIHYSV

SEQ ID NO: 540867 - protein, 9 aa, Homo Sapiens
MRDFNLKTA

SEQ ID NO: 540868 - protein, 9 aa, Homo Sapiens
SDPSSAAAL

SEQ ID NO: 540869 - protein, 9 aa, Homo Sapiens
RVQHIDRSD

SEQ ID NO: 540870 - protein, 9 aa, Homo Sapiens
KITGSSYPF

SEQ ID NO: 540871 - protein, 9 aa, Homo Sapiens
GVAPDSKIT

SEQ ID NO: 540872 - protein, 9 aa, Homo Sapiens
VLRLFDTLH

SEQ ID NO: 540873 - protein, 9 aa, Homo Sapiens
HGCCVGILQ

SEQ ID NO: 540874 - protein, 9 aa, Homo Sapiens
GRSSDSEWP

SEQ ID NO: 540875 - protein, 9 aa, Homo Sapiens
IKEAQVYMR

SEQ ID NO: 540876 - protein, 9 aa, Homo Sapiens
SPKVSDTMV

SEQ ID NO: 540877 - protein, 9 aa, Homo Sapiens
QHQQQHQQQ

SEQ ID NO: 540878 - protein, 9 aa, Homo Sapiens
SDTMVEPYN

SEQ ID NO: 540879 - protein, 9 aa, Homo Sapiens
GTAWLEWWH

SEQ ID NO: 540880 - protein, 9 aa, Homo Sapiens
CCVGILQSE

SEQ ID NO: 540881 - protein, 9 aa, Homo Sapiens
IHLELNGIK

SEQ ID NO: 540882 - protein, 9 aa, Homo Sapiens
TAWLEWWHV

SEQ ID NO: 540883 - protein, 9 aa, Homo Sapiens
MTLPVSPDQ

SEQ ID NO: 540884 - protein, 9 aa, Homo Sapiens
CTQVVHESF

SEQ ID NO: 540885 - protein, 9 aa, Homo Sapiens
TMVEPYNAT

SEQ ID NO: 540886 - protein, 9 aa, Homo Sapiens
QHQHQQQHQ

SEQ ID NO: 540887 - protein, 9 aa, Homo Sapiens
WWHVQPTLD

SEQ ID NO: 540888 - protein, 9 aa, Homo Sapiens
TVNSDPSSA

SEQ ID NO: 540889 - protein, 9 aa, Homo Sapiens
WYHGCCVGI

SEQ ID NO: 540890 - protein, 9 aa, Homo Sapiens
PKVSDTMVE

SEQ ID NO: 540891 - protein, 9 aa, Homo Sapiens
EWWHVQPTL

SEQ ID NO: 540892 - protein, 9 aa, Homo Sapiens
LRLFDTLHA

SEQ ID NO: 540893 - protein, 9 aa, Homo Sapiens
YSVRFAKAF

SEQ ID NO: 540894 - protein, 9 aa, Homo Sapiens
SDNIHYSVR

SEQ ID NO: 540895 - protein, 9 aa, Homo Sapiens
NIHYSVRFA

SEQ ID NO: 540896 - protein, 9 aa, Homo Sapiens
GPAGGRSSD

SEQ ID NO: 540897 - protein, 9 aa, Homo Sapiens
RDFNLKTAP

SEQ ID NO: 540898 - protein, 9 aa, Homo Sapiens
FYSGTVNSD

SEQ ID NO: 540899 - protein, 9 aa, Homo Sapiens
DGHYMTLPV

SEQ ID NO: 540900 - protein, 9 aa, Homo Sapiens
TLPVSPDQL

SEQ ID NO: 540901 - protein, 9 aa, Homo Sapiens
AGGRSSDSE

SEQ ID NO: 540902 - protein, 9 aa, Homo Sapiens
LTSYSGIIF

SEQ ID NO: 540903 - protein, 9 aa, Homo Sapiens
DFKIPMVLR

SEQ ID NO: 540904 - protein, 9 aa, Homo Sapiens
CQNWYHGCC

SEQ ID NO: 540905 - protein, 9 aa, Homo Sapiens
NWYHGCCVG

SEQ ID NO: 540906 - protein, 9 aa, Homo Sapiens
DSKITGSSY

SEQ ID NO: 540907 - protein, 9 aa, Homo Sapiens
PPVVFKSCT

SEQ ID NO: 540908 - protein, 9 aa, Homo Sapiens
RGVAPDSKI

SEQ ID NO: 540909 - protein, 9 aa, Homo Sapiens
SVRFAKAFV

SEQ ID NO: 540910 - protein, 9 aa, Homo Sapiens
KSCTQVVHE

SEQ ID NO: 540911 - protein, 9 aa, Homo Sapiens
ITGSSYPFQ

SEQ ID NO: 540912 - protein, 9 aa, Homo Sapiens
GGTAWLEWW

SEQ ID NO: 540913 - protein, 9 aa, Homo Sapiens
RSDLSPRAS

SEQ ID NO: 540914 - protein, 9 aa, Homo Sapiens
PSPKVSDTM

SEQ ID NO: 540915 - protein, 9 aa, Homo Sapiens
WLEWWHVQP

SEQ ID NO: 540916 - protein, 9 aa, Homo Sapiens
SDLSPRASP

SEQ ID NO: 540917 - protein, 9 aa, Homo Sapiens
FKIPMVLRL

SEQ ID NO: 540918 - protein, 9 aa, Homo Sapiens
YHGCCVGIL

SEQ ID NO: 540919 - protein, 9 aa, Homo Sapiens
HLELNGIKS

SEQ ID NO: 540920 - protein, 9 aa, Homo Sapiens
VSPDQLPCG

SEQ ID NO: 540921 - protein, 9 aa, Homo Sapiens
ILTSYSGII

SEQ ID NO: 540922 - protein, 9 aa, Homo Sapiens
TPTTTPIST

SEQ ID NO: 540923 - protein, 9 aa, Homo Sapiens
KEAQVYMRD

SEQ ID NO: 540924 - protein, 9 aa, Homo Sapiens
LPVSPDQLP

SEQ ID NO: 540925 - protein, 9 aa, Homo Sapiens
GHYMTLPVS

SEQ ID NO: 540926 - protein, 9 aa, Homo Sapiens
YMTLPVSPD

SEQ ID NO: 540927 - protein, 9 aa, Homo Sapiens
YMRDFNLKT

SEQ ID NO: 540928 - protein, 9 aa, Homo Sapiens
QHIDRSDLS

SEQ ID NO: 540929 - protein, 9 aa, Homo Sapiens
QQHQHQQQH

SEQ ID NO: 540930 - protein, 9 aa, Homo Sapiens
VFKSCTQVV

SEQ ID NO: 540931 - protein, 9 aa, Homo Sapiens
IDRSDLSPR

SEQ ID NO: 540932 - protein, 9 aa, Homo Sapiens
PSGPAGGRS

SEQ ID NO: 540933 - protein, 9 aa, Homo Sapiens
MVLRLFDTL

SEQ ID NO: 540934 - protein, 9 aa, Homo Sapiens
MVEPYNATL

SEQ ID NO: 540935 - protein, 9 aa, Homo Sapiens
DRSDLSPRA

SEQ ID NO: 540936 - protein, 9 aa, Homo Sapiens
GTVNSDPSS

SEQ ID NO: 540937 - protein, 9 aa, Homo Sapiens
GGRSSDSEW

SEQ ID NO: 540938 - protein, 9 aa, Homo Sapiens
KVSDTMVEP

SEQ ID NO: 540939 - protein, 9 aa, Homo Sapiens
WHVQPTLDL

SEQ ID NO: 540940 - protein, 9 aa, Homo Sapiens
HYMTLPVSP

SEQ ID NO: 540941 - protein, 9 aa, Homo Sapiens
SGPAGGRSS

SEQ ID NO: 540942 - protein, 9 aa, Homo Sapiens
QTPTTTPIS

SEQ ID NO: 540943 - protein, 9 aa, Homo Sapiens
FKSCTQVVH

SEQ ID NO: 540944 - protein, 9 aa, Homo Sapiens
RLFDTLHAL

SEQ ID NO: 540945 - protein, 9 aa, Homo Sapiens
EVTVQPGCY

SEQ ID NO: 540946 - protein, 9 aa, Homo Sapiens
TEIHLELNG

SEQ ID NO: 540947 - protein, 9 aa, Homo Sapiens
NSDPSSAAA

SEQ ID NO: 540948 - protein, 9 aa, Homo Sapiens
DLSPRASPE

SEQ ID NO: 540949 - protein, 9 aa, Homo Sapiens
TMTEIHLEL

SEQ ID NO: 540950 - protein, 9 aa, Homo Sapiens
SVEKYVMDE

SEQ ID NO: 540951 - protein, 9 aa, Homo Sapiens
GPMASVGNI

SEQ ID NO: 540952 - protein, 9 aa, Homo Sapiens
VELSFRAKK

SEQ ID NO: 540953 - protein, 9 aa, Homo Sapiens
YIEQYQFLY

SEQ ID NO: 540954 - protein, 9 aa, Homo Sapiens
TQSAILYAL

SEQ ID NO: 540955 - protein, 9 aa, Homo Sapiens
GSSVEKYVM

SEQ ID NO: 540956 - protein, 9 aa, Homo Sapiens
FQGTNYLGL

SEQ ID NO: 540957 - protein, 9 aa, Homo Sapiens
PLKLAGWQC

SEQ ID NO: 540958 - protein, 9 aa, Homo Sapiens
PVEGPQCSA

SEQ ID NO: 540959 - protein, 9 aa, Homo Sapiens
AGELTGFAG

SEQ ID NO: 540960 - protein, 9 aa, Homo Sapiens
REMPPSEKT

SEQ ID NO: 540961 - protein, 9 aa, Homo Sapiens
LSLQVLLSH

SEQ ID NO: 540962 - protein, 9 aa, Homo Sapiens
GELTGFAGN

SEQ ID NO: 540963 - protein, 9 aa, Homo Sapiens
PMASVGNID

SEQ ID NO: 540964 - protein, 9 aa, Homo Sapiens
GNIDEKSNK

SEQ ID NO: 540965 - protein, 9 aa, Homo Sapiens
GMEWNRMEW

SEQ ID NO: 540966 - protein, 9 aa, Homo Sapiens
KSENDVKAL

SEQ ID NO: 540967 - protein, 9 aa, Homo Sapiens
WNRMEWNRI

SEQ ID NO: 540968 - protein, 9 aa, Homo Sapiens
FQPQNNVVT

SEQ ID NO: 540969 - protein, 9 aa, Homo Sapiens
IILFQPQNN

SEQ ID NO: 540970 - protein, 9 aa, Homo Sapiens
RCCSPTEAA

SEQ ID NO: 540971 - protein, 9 aa, Homo Sapiens
KGEVGRCGK

SEQ ID NO: 540972 - protein, 9 aa, Homo Sapiens
IDEKSNKLL

SEQ ID NO: 540973 - protein, 9 aa, Homo Sapiens
QPQNNVVTH

SEQ ID NO: 540974 - protein, 9 aa, Homo Sapiens
PGMRVGFCY

SEQ ID NO: 540975 - protein, 9 aa, Homo Sapiens
SAGAMPEPW

SEQ ID NO: 540976 - protein, 9 aa, Homo Sapiens
PGVFAYIEQ

SEQ ID NO: 540977 - protein, 9 aa, Homo Sapiens
ELTGFAGNK

SEQ ID NO: 540978 - protein, 9 aa, Homo Sapiens
LMRPGVFAY

SEQ ID NO: 540979 - protein, 9 aa, Homo Sapiens
VKRRDSTTS

SEQ ID NO: 540980 - protein, 9 aa, Homo Sapiens
LTREMPPSE

SEQ ID NO: 540981 - protein, 9 aa, Homo Sapiens
GEVGRCGKA

SEQ ID NO: 540982 - protein, 9 aa, Homo Sapiens
SFRAKKLDD

SEQ ID NO: 540983 - protein, 9 aa, Homo Sapiens
LTGFAGNKF

SEQ ID NO: 540984 - protein, 9 aa, Homo Sapiens
ILFQPQNNV

SEQ ID NO: 540985 - protein, 9 aa, Homo Sapiens
MEWNRMEWN

SEQ ID NO: 540986 - protein, 9 aa, Homo Sapiens
VTPLKLAGW

SEQ ID NO: 540987 - protein, 9 aa, Homo Sapiens
VVPVEGPQC

SEQ ID NO: 540988 - protein, 9 aa, Homo Sapiens
EEMGSVNEA

SEQ ID NO: 540989 - protein, 9 aa, Homo Sapiens
VNASQEVEP

SEQ ID NO: 540990 - protein, 9 aa, Homo Sapiens
ALGMPLTPQ

SEQ ID NO: 540991 - protein, 9 aa, Homo Sapiens
EGPQCSAVI

SEQ ID NO: 540992 - protein, 9 aa, Homo Sapiens
QGTNYLGLK

SEQ ID NO: 540993 - protein, 9 aa, Homo Sapiens
QALGMPLTP

SEQ ID NO: 540994 - protein, 9 aa, Homo Sapiens
GTNYLGLKS

SEQ ID NO: 540995 - protein, 9 aa, Homo Sapiens
RPGMRVGFC

SEQ ID NO: 540996 - protein, 9 aa, Homo Sapiens
RVNASQEVE

SEQ ID NO: 540997 - protein, 9 aa, Homo Sapiens
PQRESLRPK

SEQ ID NO: 540998 - protein, 9 aa, Homo Sapiens
SLQVLLSHV

SEQ ID NO: 540999 - protein, 9 aa, Homo Sapiens
MDESDYMSF

SEQ ID NO: 541000 - protein, 9 aa, Homo Sapiens
NRMEWNRIE

SEQ ID NO: 541001 - protein, 9 aa, Homo Sapiens
RRDSTTSFS

SEQ ID NO: 541002 - protein, 9 aa, Homo Sapiens
EWNRMEWNR

SEQ ID NO: 541003 - protein, 9 aa, Homo Sapiens
LFQPQNNVV

SEQ ID NO: 541004 - protein, 9 aa, Homo Sapiens
HEDISAGAM

SEQ ID NO: 541005 - protein, 9 aa, Homo Sapiens
DIAVTPLKL

SEQ ID NO: 541006 - protein, 9 aa, Homo Sapiens
PRRCCSPTE

SEQ ID NO: 541007 - protein, 9 aa, Homo Sapiens
ELSFRAKKL

SEQ ID NO: 541008 - protein, 9 aa, Homo Sapiens
GFAGNKFSR

SEQ ID NO: 541009 - protein, 9 aa, Homo Sapiens
SVGNIDEKS

SEQ ID NO: 541010 - protein, 9 aa, Homo Sapiens
ILYALRVEL

SEQ ID NO: 541011 - protein, 9 aa, Homo Sapiens
ERVNASQEV

SEQ ID NO: 541012 - protein, 9 aa, Homo Sapiens
RMEWNRIES

SEQ ID NO: 541013 - protein, 9 aa, Homo Sapiens
LRPGMRVGF

SEQ ID NO: 541014 - protein, 9 aa, Homo Sapiens
ISTQSAILY

SEQ ID NO: 541015 - protein, 9 aa, Homo Sapiens
RPRRCCSPT

SEQ ID NO: 541016 - protein, 9 aa, Homo Sapiens
SEKTPLHCV

SEQ ID NO: 541017 - protein, 9 aa, Homo Sapiens
TREMPPSEK

SEQ ID NO: 541018 - protein, 9 aa, Homo Sapiens
QNNVVTHRL

SEQ ID NO: 541019 - protein, 9 aa, Homo Sapiens
QSAILYALR

SEQ ID NO: 541020 - protein, 9 aa, Homo Sapiens
GMPLTPQQA

SEQ ID NO: 541021 - protein, 9 aa, Homo Sapiens
IAVTPLKLA

SEQ ID NO: 541022 - protein, 9 aa, Homo Sapiens
KKLDDKDLF

SEQ ID NO: 541023 - protein, 9 aa, Homo Sapiens
VVKRRDSTT

SEQ ID NO: 541024 - protein, 9 aa, Homo Sapiens
EVGRCGKAG

SEQ ID NO: 541025 - protein, 9 aa, Homo Sapiens
CGKAGLRGP

SEQ ID NO: 541026 - protein, 9 aa, Homo Sapiens
QQVFQGTNY

SEQ ID NO: 541027 - protein, 9 aa, Homo Sapiens
QRESLRPKR

SEQ ID NO: 541028 - protein, 9 aa, Homo Sapiens
NNVVTHRLH

SEQ ID NO: 541029 - protein, 9 aa, Homo Sapiens
LAGWQCPEC

SEQ ID NO: 541030 - protein, 9 aa, Homo Sapiens
KWNGMEWNR

SEQ ID NO: 541031 - protein, 9 aa, Homo Sapiens
EDKLPQRES

SEQ ID NO: 541032 - protein, 9 aa, Homo Sapiens
TNYLGLKSS

SEQ ID NO: 541033 - protein, 9 aa, Homo Sapiens
AGAMPEPWG

SEQ ID NO: 541034 - protein, 9 aa, Homo Sapiens
AVTPLKLAG

SEQ ID NO: 541035 - protein, 9 aa, Homo Sapiens
VPVEGPQCS

SEQ ID NO: 541036 - protein, 9 aa, Homo Sapiens
ASVGNIDEK

SEQ ID NO: 541037 - protein, 9 aa, Homo Sapiens
GVFAYIEQY

SEQ ID NO: 541038 - protein, 9 aa, Homo Sapiens
GAKGEVGRC

SEQ ID NO: 541039 - protein, 9 aa, Homo Sapiens
SAILYALRV

SEQ ID NO: 541040 - protein, 9 aa, Homo Sapiens
VKALQSVGQ

SEQ ID NO: 541041 - protein, 9 aa, Homo Sapiens
VMDESDYMS

SEQ ID NO: 541042 - protein, 9 aa, Homo Sapiens
LYALRVELE

SEQ ID NO: 541043 - protein, 9 aa, Homo Sapiens
FRAKKLDDK

SEQ ID NO: 541044 - protein, 9 aa, Homo Sapiens
YVELSFRAK

SEQ ID NO: 541045 - protein, 9 aa, Homo Sapiens
ASKLSLQVL

SEQ ID NO: 541046 - protein, 9 aa, Homo Sapiens
LSFRAKKLD

SEQ ID NO: 541047 - protein, 9 aa, Homo Sapiens
AKKLDDKDL

SEQ ID NO: 541048 - protein, 9 aa, Homo Sapiens
IFHTASKLS

SEQ ID NO: 541049 - protein, 9 aa, Homo Sapiens
SENDVKALQ

SEQ ID NO: 541050 - protein, 9 aa, Homo Sapiens
STTSFSLDF

SEQ ID NO: 541051 - protein, 9 aa, Homo Sapiens
TPLKLAGWQ

SEQ ID NO: 541052 - protein, 9 aa, Homo Sapiens
RPGVFAYIE

SEQ ID NO: 541053 - protein, 9 aa, Homo Sapiens
GPQCSAVIT

SEQ ID NO: 541054 - protein, 9 aa, Homo Sapiens
VFQGTNYLG

SEQ ID NO: 541055 - protein, 9 aa, Homo Sapiens
TLRPGMRVG

SEQ ID NO: 541056 - protein, 9 aa, Homo Sapiens
LISTQSAIL

SEQ ID NO: 541057 - protein, 9 aa, Homo Sapiens
DSTTSFSLD

SEQ ID NO: 541058 - protein, 9 aa, Homo Sapiens
TASKLSLQV

SEQ ID NO: 541059 - protein, 9 aa, Homo Sapiens
EVEDKLPQR

SEQ ID NO: 541060 - protein, 9 aa, Homo Sapiens
EKTPLHCVM

SEQ ID NO: 541061 - protein, 9 aa, Homo Sapiens
PSEKTPLHC

SEQ ID NO: 541062 - protein, 9 aa, Homo Sapiens
EMPPSEKTP

SEQ ID NO: 541063 - protein, 9 aa, Homo Sapiens
AILYALRVE

SEQ ID NO: 541064 - protein, 9 aa, Homo Sapiens
NGMEWNRME

SEQ ID NO: 541065 - protein, 9 aa, Homo Sapiens
YEKSENDVK

SEQ ID NO: 541066 - protein, 9 aa, Homo Sapiens
FAYIEQYQF

SEQ ID NO: 541067 - protein, 9 aa, Homo Sapiens
GMRVGFCYQ

SEQ ID NO: 541068 - protein, 9 aa, Homo Sapiens
TGFAGNKFS

SEQ ID NO: 541069 - protein, 9 aa, Homo Sapiens
ASQEVEPVE

SEQ ID NO: 541070 - protein, 9 aa, Homo Sapiens
VEGPQCSAV

SEQ ID NO: 541071 - protein, 9 aa, Homo Sapiens
ENDVKALQS

SEQ ID NO: 541072 - protein, 9 aa, Homo Sapiens
LKLAGWQCP

SEQ ID NO: 541073 - protein, 9 aa, Homo Sapiens
ISRPRRCCS

SEQ ID NO: 541074 - protein, 9 aa, Homo Sapiens
NDVKALQSV

SEQ ID NO: 541075 - protein, 9 aa, Homo Sapiens
KLAGWQCPE

SEQ ID NO: 541076 - protein, 9 aa, Homo Sapiens
HIILFQPQN

SEQ ID NO: 541077 - protein, 9 aa, Homo Sapiens
GRCGKAGLR

SEQ ID NO: 541078 - protein, 9 aa, Homo Sapiens
RDSTTSFSL

SEQ ID NO: 541079 - protein, 9 aa, Homo Sapiens
WNGMEWNRM

SEQ ID NO: 541080 - protein, 9 aa, Homo Sapiens
SQEVEPVEP

SEQ ID NO: 541081 - protein, 9 aa, Homo Sapiens
RCGKAGLRG

SEQ ID NO: 541082 - protein, 9 aa, Homo Sapiens
FHTASKLSL

SEQ ID NO: 541083 - protein, 9 aa, Homo Sapiens
MPEPWGNPP

SEQ ID NO: 541084 - protein, 9 aa, Homo Sapiens
RERVNASQE

SEQ ID NO: 541085 - protein, 9 aa, Homo Sapiens
STQSAILYA

SEQ ID NO: 541086 - protein, 9 aa, Homo Sapiens
MPPSEKTPL

SEQ ID NO: 541087 - protein, 9 aa, Homo Sapiens
FRERVNASQ

SEQ ID NO: 541088 - protein, 9 aa, Homo Sapiens
HTASKLSLQ

SEQ ID NO: 541089 - protein, 9 aa, Homo Sapiens
PISRPRRCC

SEQ ID NO: 541090 - protein, 9 aa, Homo Sapiens
DVKALQSVG

SEQ ID NO: 541091 - protein, 9 aa, Homo Sapiens
VGNIDEKSN

SEQ ID NO: 541092 - protein, 9 aa, Homo Sapiens
YVVKRRDST

SEQ ID NO: 541093 - protein, 9 aa, Homo Sapiens
QVFQGTNYL

SEQ ID NO: 541094 - protein, 9 aa, Homo Sapiens
SRPRRCCSP

SEQ ID NO: 541095 - protein, 9 aa, Homo Sapiens
PQNNVVTHR

SEQ ID NO: 541096 - protein, 9 aa, Homo Sapiens
EEVEDKLPQ

SEQ ID NO: 541097 - protein, 9 aa, Homo Sapiens
AGNKFSRAL

SEQ ID NO: 541098 - protein, 9 aa, Homo Sapiens
YVMDESDYM

SEQ ID NO: 541099 - protein, 9 aa, Homo Sapiens
DISAGAMPE

SEQ ID NO: 541100 - protein, 9 aa, Homo Sapiens
RAKKLDDKD

SEQ ID NO: 541101 - protein, 9 aa, Homo Sapiens
KYVMDESDY

SEQ ID NO: 541102 - protein, 9 aa, Homo Sapiens
AYIEQYQFL

SEQ ID NO: 541103 - protein, 9 aa, Homo Sapiens
QEVEPVEPE

SEQ ID NO: 541104 - protein, 9 aa, Homo Sapiens
LGMPLTPQQ

SEQ ID NO: 541105 - protein, 9 aa, Homo Sapiens
NIDEKSNKL

SEQ ID NO: 541106 - protein, 9 aa, Homo Sapiens
MASVGNIDE

SEQ ID NO: 541107 - protein, 9 aa, Homo Sapiens
GAMPEPWGN

SEQ ID NO: 541108 - protein, 9 aa, Homo Sapiens
RRCCSPTEA

SEQ ID NO: 541109 - protein, 9 aa, Homo Sapiens
MRPGVFAYI

SEQ ID NO: 541110 - protein, 9 aa, Homo Sapiens
KLPQRESLR

SEQ ID NO: 541111 - protein, 9 aa, Homo Sapiens
QYEKSENDV

SEQ ID NO: 541112 - protein, 9 aa, Homo Sapiens
VGRCGKAGL

SEQ ID NO: 541113 - protein, 9 aa, Homo Sapiens
MPLTPQQAQ

SEQ ID NO: 541114 - protein, 9 aa, Homo Sapiens
YPISRPRRC

SEQ ID NO: 541115 - protein, 9 aa, Homo Sapiens
PPSEKTPLH

SEQ ID NO: 541116 - protein, 9 aa, Homo Sapiens
CCSPTEAAV

SEQ ID NO: 541117 - protein, 9 aa, Homo Sapiens
MRVGFCYQI

SEQ ID NO: 541118 - protein, 9 aa, Homo Sapiens
EDISAGAMP

SEQ ID NO: 541119 - protein, 9 aa, Homo Sapiens
KLSLQVLLS

SEQ ID NO: 541120 - protein, 9 aa, Homo Sapiens
SEEMGSVNE

SEQ ID NO: 541121 - protein, 9 aa, Homo Sapiens
KRRDSTTSF

SEQ ID NO: 541122 - protein, 9 aa, Homo Sapiens
LPQRESLRP

SEQ ID NO: 541123 - protein, 9 aa, Homo Sapiens
SKLSLQVLL

SEQ ID NO: 541124 - protein, 9 aa, Homo Sapiens
MAGCIQEAP

SEQ ID NO: 541125 - protein, 9 aa, Homo Sapiens
FTLRPGMRV

SEQ ID NO: 541126 - protein, 9 aa, Homo Sapiens
TTSFSLDFG

SEQ ID NO: 541127 - protein, 9 aa, Homo Sapiens
DKLPQRESL

SEQ ID NO: 541128 - protein, 9 aa, Homo Sapiens
FAGNKFSRA

SEQ ID NO: 541129 - protein, 9 aa, Homo Sapiens
PQCSAVITS

SEQ ID NO: 541130 - protein, 9 aa, Homo Sapiens
NASQEVEPV

SEQ ID NO: 541131 - protein, 9 aa, Homo Sapiens
CSAVITSLD

SEQ ID NO: 541132 - protein, 9 aa, Homo Sapiens
VEKYVMDES

SEQ ID NO: 541133 - protein, 9 aa, Homo Sapiens
VFAYIEQYQ

SEQ ID NO: 541134 - protein, 9 aa, Homo Sapiens
QCSAVITSL

SEQ ID NO: 541135 - protein, 9 aa, Homo Sapiens
AKGEVGRCG

SEQ ID NO: 541136 - protein, 9 aa, Homo Sapiens
ISAGAMPEP

SEQ ID NO: 541137 - protein, 9 aa, Homo Sapiens
EKSENDVKA

SEQ ID NO: 541138 - protein, 9 aa, Homo Sapiens
EKYVMDESD

SEQ ID NO: 541139 - protein, 9 aa, Homo Sapiens
LAGELTGFA

SEQ ID NO: 541140 - protein, 9 aa, Homo Sapiens
YLGLKSSQS

SEQ ID NO: 541141 - protein, 9 aa, Homo Sapiens
SSVEKYVMD

SEQ ID NO: 541142 - protein, 9 aa, Homo Sapiens
VEDKLPQRE

SEQ ID NO: 541143 - protein, 9 aa, Homo Sapiens
NYLGLKSSQ

SEQ ID NO: 541144 - protein, 9 aa, Homo Sapiens
RITNYQLLL

SEQ ID NO: 541145 - protein, 9 aa, Homo Sapiens
RSRTAFTRQ

SEQ ID NO: 541146 - protein, 9 aa, Homo Sapiens
PLHYLNQHN

SEQ ID NO: 541147 - protein, 9 aa, Homo Sapiens
VFTLKKGRS

SEQ ID NO: 541148 - protein, 9 aa, Homo Sapiens
LRDPPRRAG

SEQ ID NO: 541149 - protein, 9 aa, Homo Sapiens
YFLERSHKC

SEQ ID NO: 541150 - protein, 9 aa, Homo Sapiens
TIPIMHQVS

SEQ ID NO: 541151 - protein, 9 aa, Homo Sapiens
SVFTLKKGR

SEQ ID NO: 541152 - protein, 9 aa, Homo Sapiens
RTAFTRQQV

SEQ ID NO: 541153 - protein, 9 aa, Homo Sapiens
LHYLNQHNQ

SEQ ID NO: 541154 - protein, 9 aa, Homo Sapiens
PPRRAGIFL

SEQ ID NO: 541155 - protein, 9 aa, Homo Sapiens
MRETSVFTL

SEQ ID NO: 541156 - protein, 9 aa, Homo Sapiens
LSGCRLLFL

SEQ ID NO: 541157 - protein, 9 aa, Homo Sapiens
HQELLSMRK

SEQ ID NO: 541158 - protein, 9 aa, Homo Sapiens
MHMHTYMYI

SEQ ID NO: 541159 - protein, 9 aa, Homo Sapiens
AGIFLDYEA

SEQ ID NO: 541160 - protein, 9 aa, Homo Sapiens
GHLSGCRLL

SEQ ID NO: 541161 - protein, 9 aa, Homo Sapiens
SGCRLLFLF

SEQ ID NO: 541162 - protein, 9 aa, Homo Sapiens
EIQLLQMAS

SEQ ID NO: 541163 - protein, 9 aa, Homo Sapiens
RAGIFLDYE

SEQ ID NO: 541164 - protein, 9 aa, Homo Sapiens
LNQHNQNCL

SEQ ID NO: 541165 - protein, 9 aa, Homo Sapiens
TAFTRQQVL

SEQ ID NO: 541166 - protein, 9 aa, Homo Sapiens
IQLLQMASE

SEQ ID NO: 541167 - protein, 9 aa, Homo Sapiens
NYQLLLKEL

SEQ ID NO: 541168 - protein, 9 aa, Homo Sapiens
ITNYQLLLK

SEQ ID NO: 541169 - protein, 9 aa, Homo Sapiens
LSMRKVQEK

SEQ ID NO: 541170 - protein, 9 aa, Homo Sapiens
QLLQMASEK

SEQ ID NO: 541171 - protein, 9 aa, Homo Sapiens
RKVQEKCEK

SEQ ID NO: 541172 - protein, 9 aa, Homo Sapiens
RDPPRRAGI

SEQ ID NO: 541173 - protein, 9 aa, Homo Sapiens
LQMASEKAL

SEQ ID NO: 541174 - protein, 9 aa, Homo Sapiens
IFIYMHMHT

SEQ ID NO: 541175 - protein, 9 aa, Homo Sapiens
ASEKALKQK

SEQ ID NO: 541176 - protein, 9 aa, Homo Sapiens
ETSVFTLKK

SEQ ID NO: 541177 - protein, 9 aa, Homo Sapiens
PPLHYLNQH

SEQ ID NO: 541178 - protein, 9 aa, Homo Sapiens
PSTIPIMHQ

SEQ ID NO: 541179 - protein, 9 aa, Homo Sapiens
CRLLFLFLS

SEQ ID NO: 541180 - protein, 9 aa, Homo Sapiens
TNQAAPSTI

SEQ ID NO: 541181 - protein, 9 aa, Homo Sapiens
LLSMRKVQE

SEQ ID NO: 541182 - protein, 9 aa, Homo Sapiens
LLQMASEKA

SEQ ID NO: 541183 - protein, 9 aa, Homo Sapiens
KPVQRITNY

SEQ ID NO: 541184 - protein, 9 aa, Homo Sapiens
SEKALKQKG

SEQ ID NO: 541185 - protein, 9 aa, Homo Sapiens
AAPSTIPIM

SEQ ID NO: 541186 - protein, 9 aa, Homo Sapiens
NQAAPSTIP

SEQ ID NO: 541187 - protein, 9 aa, Homo Sapiens
QAAPSTIPI

SEQ ID NO: 541188 - protein, 9 aa, Homo Sapiens
QELLSMRKV

SEQ ID NO: 541189 - protein, 9 aa, Homo Sapiens
EPKRSRTAF

SEQ ID NO: 541190 - protein, 9 aa, Homo Sapiens
DPPRRAGIF

SEQ ID NO: 541191 - protein, 9 aa, Homo Sapiens
SRTAFTRQQ

SEQ ID NO: 541192 - protein, 9 aa, Homo Sapiens
ICIFIYMHM

SEQ ID NO: 541193 - protein, 9 aa, Homo Sapiens
MRKVQEKCE

SEQ ID NO: 541194 - protein, 9 aa, Homo Sapiens
QMASEKALK

SEQ ID NO: 541195 - protein, 9 aa, Homo Sapiens
IHICIFIYM

SEQ ID NO: 541196 - protein, 9 aa, Homo Sapiens
TSVFTLKKG

SEQ ID NO: 541197 - protein, 9 aa, Homo Sapiens
LPPLHYLNQ

SEQ ID NO: 541198 - protein, 9 aa, Homo Sapiens
KRSRTAFTR

SEQ ID NO: 541199 - protein, 9 aa, Homo Sapiens
PVQRITNYQ

SEQ ID NO: 541200 - protein, 9 aa, Homo Sapiens
RLLFLFLSP

SEQ ID NO: 541201 - protein, 9 aa, Homo Sapiens
STIPIMHQV

SEQ ID NO: 541202 - protein, 9 aa, Homo Sapiens
IPIMHQVSA

SEQ ID NO: 541203 - protein, 9 aa, Homo Sapiens
MHMRETSVF

SEQ ID NO: 541204 - protein, 9 aa, Homo Sapiens
HMRETSVFT

SEQ ID NO: 541205 - protein, 9 aa, Homo Sapiens
YMHMHTYMY

SEQ ID NO: 541206 - protein, 9 aa, Homo Sapiens
AFTRQQVLE

SEQ ID NO: 541207 - protein, 9 aa, Homo Sapiens
PRRAGIFLD

SEQ ID NO: 541208 - protein, 9 aa, Homo Sapiens
IYMHMHTYM

SEQ ID NO: 541209 - protein, 9 aa, Homo Sapiens
PKRSRTAFT

SEQ ID NO: 541210 - protein, 9 aa, Homo Sapiens
PLRDPPRRA

SEQ ID NO: 541211 - protein, 9 aa, Homo Sapiens
FTRQQVLEL

SEQ ID NO: 541212 - protein, 9 aa, Homo Sapiens
IKPVQRITN

SEQ ID NO: 541213 - protein, 9 aa, Homo Sapiens
RETSVFTLK

SEQ ID NO: 541214 - protein, 9 aa, Homo Sapiens
MASEKALKQ

SEQ ID NO: 541215 - protein, 9 aa, Homo Sapiens
HYLNQHNQN

SEQ ID NO: 541216 - protein, 9 aa, Homo Sapiens
SMRKVQEKC

SEQ ID NO: 541217 - protein, 9 aa, Homo Sapiens
ELLSMRKVQ

SEQ ID NO: 541218 - protein, 9 aa, Homo Sapiens
YLNQHNQNC

SEQ ID NO: 541219 - protein, 9 aa, Homo Sapiens
FIYMHMHTY

SEQ ID NO: 541220 - protein, 9 aa, Homo Sapiens
HICIFIYMH

SEQ ID NO: 541221 - protein, 9 aa, Homo Sapiens
NQHNQNCLY

SEQ ID NO: 541222 - protein, 9 aa, Homo Sapiens
VQRITNYQL

SEQ ID NO: 541223 - protein, 9 aa, Homo Sapiens
GYFLERSHK

SEQ ID NO: 541224 - protein, 9 aa, Homo Sapiens
NLPPLHYLN

SEQ ID NO: 541225 - protein, 9 aa, Homo Sapiens
HLSGCRLLF

SEQ ID NO: 541226 - protein, 9 aa, Homo Sapiens
TNYQLLLKE

SEQ ID NO: 541227 - protein, 9 aa, Homo Sapiens
GCRLLFLFL

SEQ ID NO: 541228 - protein, 9 aa, Homo Sapiens
APSTIPIMH

SEQ ID NO: 541229 - protein, 9 aa, Homo Sapiens
RRAGIFLDY

SEQ ID NO: 541230 - protein, 9 aa, Homo Sapiens
QRITNYQLL

SEQ ID NO: 541231 - protein, 9 aa, Homo Sapiens
CIFIYMHMH

SEQ ID NO: 541232 - protein, 9 aa, Homo Sapiens
RRNNFLNSL

SEQ ID NO: 541233 - protein, 9 aa, Homo Sapiens
RCVGKVLGK

SEQ ID NO: 541234 - protein, 9 aa, Homo Sapiens
AKGYEEWLL

SEQ ID NO: 541235 - protein, 9 aa, Homo Sapiens
LESLRVSDG

SEQ ID NO: 541236 - protein, 9 aa, Homo Sapiens
RNALLIRSS

SEQ ID NO: 541237 - protein, 9 aa, Homo Sapiens
VLSLWKKLN

SEQ ID NO: 541238 - protein, 9 aa, Homo Sapiens
RSSIQALNS

SEQ ID NO: 541239 - protein, 9 aa, Homo Sapiens
DKLHPGLLE

SEQ ID NO: 541240 - protein, 9 aa, Homo Sapiens
PVLSLWKKL

SEQ ID NO: 541241 - protein, 9 aa, Homo Sapiens
YCRRTMRKI

SEQ ID NO: 541242 - protein, 9 aa, Homo Sapiens
PETFGDFWH

SEQ ID NO: 541243 - protein, 9 aa, Homo Sapiens
KDTWRRSKS

SEQ ID NO: 541244 - protein, 9 aa, Homo Sapiens
LSLWKKLNQ

SEQ ID NO: 541245 - protein, 9 aa, Homo Sapiens
LLIRSSIQA

SEQ ID NO: 541246 - protein, 9 aa, Homo Sapiens
ENSDCAPNP

SEQ ID NO: 541247 - protein, 9 aa, Homo Sapiens
FKERFHDSV

SEQ ID NO: 541248 - protein, 9 aa, Homo Sapiens
LCKYWRDLC

SEQ ID NO: 541249 - protein, 9 aa, Homo Sapiens
KICTLLRNA

SEQ ID NO: 541250 - protein, 9 aa, Homo Sapiens
PSENSDCAP

SEQ ID NO: 541251 - protein, 9 aa, Homo Sapiens
ILGTPRFTS

SEQ ID NO: 541252 - protein, 9 aa, Homo Sapiens
LAVYSPRNI

SEQ ID NO: 541253 - protein, 9 aa, Homo Sapiens
SLLCKYWRD

SEQ ID NO: 541254 - protein, 9 aa, Homo Sapiens
QKLTFLDRR

SEQ ID NO: 541255 - protein, 9 aa, Homo Sapiens
TCPMCNKKF

SEQ ID NO: 541256 - protein, 9 aa, Homo Sapiens
KMRLRDHSC

SEQ ID NO: 541257 - protein, 9 aa, Homo Sapiens
EWKDTWRRS

SEQ ID NO: 541258 - protein, 9 aa, Homo Sapiens
ALCQLAVYS

SEQ ID NO: 541259 - protein, 9 aa, Homo Sapiens
TWRRSKSPK

SEQ ID NO: 541260 - protein, 9 aa, Homo Sapiens
VAVGRCVGK

SEQ ID NO: 541261 - protein, 9 aa, Homo Sapiens
SPGRASPGQ

SEQ ID NO: 541262 - protein, 9 aa, Homo Sapiens
TASVYSERA

SEQ ID NO: 541263 - protein, 9 aa, Homo Sapiens
SNELSPVLS

SEQ ID NO: 541264 - protein, 9 aa, Homo Sapiens
VSDGRLEAS

SEQ ID NO: 541265 - protein, 9 aa, Homo Sapiens
ERCLSASLL

SEQ ID NO: 541266 - protein, 9 aa, Homo Sapiens
ETFGDFWHM

SEQ ID NO: 541267 - protein, 9 aa, Homo Sapiens
ALCILGTPR

SEQ ID NO: 541268 - protein, 9 aa, Homo Sapiens
CLSIFDNIY

SEQ ID NO: 541269 - protein, 9 aa, Homo Sapiens
VGKVLGKVV

SEQ ID NO: 541270 - protein, 9 aa, Homo Sapiens
LNVDGQPYF

SEQ ID NO: 541271 - protein, 9 aa, Homo Sapiens
AQTEKVTVI

SEQ ID NO: 541272 - protein, 9 aa, Homo Sapiens
NAAIIEEQK

SEQ ID NO: 541273 - protein, 9 aa, Homo Sapiens
GDFWHMVWE

SEQ ID NO: 541274 - protein, 9 aa, Homo Sapiens
PTCPMCNKK

SEQ ID NO: 541275 - protein, 9 aa, Homo Sapiens
ALSIMRMLQ

SEQ ID NO: 541276 - protein, 9 aa, Homo Sapiens
GCLEQVAKG

SEQ ID NO: 541277 - protein, 9 aa, Homo Sapiens
LSIMRMLQA

SEQ ID NO: 541278 - protein, 9 aa, Homo Sapiens
SLRVSDGRL

SEQ ID NO: 541279 - protein, 9 aa, Homo Sapiens
PEPHIRLFR

SEQ ID NO: 541280 - protein, 9 aa, Homo Sapiens
KRADEWKDT

SEQ ID NO: 541281 - protein, 9 aa, Homo Sapiens
QVAKGYEEW

SEQ ID NO: 541282 - protein, 9 aa, Homo Sapiens
CAPNPSRSE

SEQ ID NO: 541283 - protein, 9 aa, Homo Sapiens
CERSEVLKH

SEQ ID NO: 541284 - protein, 9 aa, Homo Sapiens
RTMRKIKRR

SEQ ID NO: 541285 - protein, 9 aa, Homo Sapiens
GPALSIMRM

SEQ ID NO: 541286 - protein, 9 aa, Homo Sapiens
TAQIQAALP

SEQ ID NO: 541287 - protein, 9 aa, Homo Sapiens
LFIFDEADK

SEQ ID NO: 541288 - protein, 9 aa, Homo Sapiens
SDCAPNPSR

SEQ ID NO: 541289 - protein, 9 aa, Homo Sapiens
FDEADKLHP

SEQ ID NO: 541290 - protein, 9 aa, Homo Sapiens
CLEQVAKGY

SEQ ID NO: 541291 - protein, 9 aa, Homo Sapiens
DEWKDTWRR

SEQ ID NO: 541292 - protein, 9 aa, Homo Sapiens
SENSDCAPN

SEQ ID NO: 541293 - protein, 9 aa, Homo Sapiens
VAYYRQETT

SEQ ID NO: 541294 - protein, 9 aa, Homo Sapiens
ESLRVSDGR

SEQ ID NO: 541295 - protein, 9 aa, Homo Sapiens
SASLLCKYW

SEQ ID NO: 541296 - protein, 9 aa, Homo Sapiens
SVYSERAMP

SEQ ID NO: 541297 - protein, 9 aa, Homo Sapiens
LRVSDGRLE

SEQ ID NO: 541298 - protein, 9 aa, Homo Sapiens
SCERSEVLK

SEQ ID NO: 541299 - protein, 9 aa, Homo Sapiens
ASPGRASPG

SEQ ID NO: 541300 - protein, 9 aa, Homo Sapiens
SGAGNAIGL

SEQ ID NO: 541301 - protein, 9 aa, Homo Sapiens
EQVAKGYEE

SEQ ID NO: 541302 - protein, 9 aa, Homo Sapiens
DCAPNPSRS

SEQ ID NO: 541303 - protein, 9 aa, Homo Sapiens
LEQVAKGYE

SEQ ID NO: 541304 - protein, 9 aa, Homo Sapiens
TALCILGTP

SEQ ID NO: 541305 - protein, 9 aa, Homo Sapiens
KLTFLDRRN

SEQ ID NO: 541306 - protein, 9 aa, Homo Sapiens
EADKLHPGL

SEQ ID NO: 541307 - protein, 9 aa, Homo Sapiens
HEPEPHIRL

SEQ ID NO: 541308 - protein, 9 aa, Homo Sapiens
TEKVTVIQD

SEQ ID NO: 541309 - protein, 9 aa, Homo Sapiens
QYHTASVYS

SEQ ID NO: 541310 - protein, 9 aa, Homo Sapiens
EPEPHIRLF

SEQ ID NO: 541311 - protein, 9 aa, Homo Sapiens
WGCLEQVAK

SEQ ID NO: 541312 - protein, 9 aa, Homo Sapiens
RLFRRPLPK

SEQ ID NO: 541313 - protein, 9 aa, Homo Sapiens
IQALNSLDH

SEQ ID NO: 541314 - protein, 9 aa, Homo Sapiens
RPAAPPHFI

SEQ ID NO: 541315 - protein, 9 aa, Homo Sapiens
VTVIQDFVK

SEQ ID NO: 541316 - protein, 9 aa, Homo Sapiens
EKVTVIQDF

SEQ ID NO: 541317 - protein, 9 aa, Homo Sapiens
MRKIKRRTD

SEQ ID NO: 541318 - protein, 9 aa, Homo Sapiens
SLNVDGQPY

SEQ ID NO: 541319 - protein, 9 aa, Homo Sapiens
RFHDSVRRL

SEQ ID NO: 541320 - protein, 9 aa, Homo Sapiens
ASLLCKYWR

SEQ ID NO: 541321 - protein, 9 aa, Homo Sapiens
PPHFILLSH

SEQ ID NO: 541322 - protein, 9 aa, Homo Sapiens
PALSIMRML

SEQ ID NO: 541323 - protein, 9 aa, Homo Sapiens
DEADKLHPG

SEQ ID NO: 541324 - protein, 9 aa, Homo Sapiens
DHSCERSEV

SEQ ID NO: 541325 - protein, 9 aa, Homo Sapiens
PGCPEPSQA

SEQ ID NO: 541326 - protein, 9 aa, Homo Sapiens
TTHSEDWGK

SEQ ID NO: 541327 - protein, 9 aa, Homo Sapiens
FGDFWHMVW

SEQ ID NO: 541328 - protein, 9 aa, Homo Sapiens
CVGKVLGKV

SEQ ID NO: 541329 - protein, 9 aa, Homo Sapiens
FLDRRNNFL

SEQ ID NO: 541330 - protein, 9 aa, Homo Sapiens
VALCQLAVY

SEQ ID NO: 541331 - protein, 9 aa, Homo Sapiens
GQASPAQAS

SEQ ID NO: 541332 - protein, 9 aa, Homo Sapiens
GRLEASSSQ

SEQ ID NO: 541333 - protein, 9 aa, Homo Sapiens
IHEPEPHIR

SEQ ID NO: 541334 - protein, 9 aa, Homo Sapiens
YYRQETTRK

SEQ ID NO: 541335 - protein, 9 aa, Homo Sapiens
LSIFDNIYG

SEQ ID NO: 541336 - protein, 9 aa, Homo Sapiens
RMLQANNDS

SEQ ID NO: 541337 - protein, 9 aa, Homo Sapiens
HTQDISTTH

SEQ ID NO: 541338 - protein, 9 aa, Homo Sapiens
HSCERSEVL

SEQ ID NO: 541339 - protein, 9 aa, Homo Sapiens
ELSPVLSLW

SEQ ID NO: 541340 - protein, 9 aa, Homo Sapiens
DISTTHSED

SEQ ID NO: 541341 - protein, 9 aa, Homo Sapiens
WHMVWEQRS

SEQ ID NO: 541342 - protein, 9 aa, Homo Sapiens
SPVLSLWKK

SEQ ID NO: 541343 - protein, 9 aa, Homo Sapiens
YSERAMPPG

SEQ ID NO: 541344 - protein, 9 aa, Homo Sapiens
ISTTHSEDW

SEQ ID NO: 541345 - protein, 9 aa, Homo Sapiens
VDGQPYFCQ

SEQ ID NO: 541346 - protein, 9 aa, Homo Sapiens
IFDEADKLH

SEQ ID NO: 541347 - protein, 9 aa, Homo Sapiens
KTAQIQAAL

SEQ ID NO: 541348 - protein, 9 aa, Homo Sapiens
TQDISTTHS

SEQ ID NO: 541349 - protein, 9 aa, Homo Sapiens
GRPAAPPHF

SEQ ID NO: 541350 - protein, 9 aa, Homo Sapiens
EDPTCPMCN

SEQ ID NO: 541351 - protein, 9 aa, Homo Sapiens
QLAVYSPRN

SEQ ID NO: 541352 - protein, 9 aa, Homo Sapiens
LLRNALLIR

SEQ ID NO: 541353 - protein, 9 aa, Homo Sapiens
HIRLFRRPL

SEQ ID NO: 541354 - protein, 9 aa, Homo Sapiens
PHFILLSHL

SEQ ID NO: 541355 - protein, 9 aa, Homo Sapiens
AAPPHFILL

SEQ ID NO: 541356 - protein, 9 aa, Homo Sapiens
RADEWKDTW

SEQ ID NO: 541357 - protein, 9 aa, Homo Sapiens
YHTASVYSE

SEQ ID NO: 541358 - protein, 9 aa, Homo Sapiens
FHDSVRRLT

SEQ ID NO: 541359 - protein, 9 aa, Homo Sapiens
PGRASPGQA

SEQ ID NO: 541360 - protein, 9 aa, Homo Sapiens
HVAYYRQET

SEQ ID NO: 541361 - protein, 9 aa, Homo Sapiens
QIQAALPAA

SEQ ID NO: 541362 - protein, 9 aa, Homo Sapiens
PAAPPHFIL

SEQ ID NO: 541363 - protein, 9 aa, Homo Sapiens
DTWRRSKSP

SEQ ID NO: 541364 - protein, 9 aa, Homo Sapiens
RASPGQASP

SEQ ID NO: 541365 - protein, 9 aa, Homo Sapiens
AMHVAYYRQ

SEQ ID NO: 541366 - protein, 9 aa, Homo Sapiens
FDTALCILG

SEQ ID NO: 541367 - protein, 9 aa, Homo Sapiens
HGRPAAPPH

SEQ ID NO: 541368 - protein, 9 aa, Homo Sapiens
DIKICTLLR

SEQ ID NO: 541369 - protein, 9 aa, Homo Sapiens
TMRKIKRRT

SEQ ID NO: 541370 - protein, 9 aa, Homo Sapiens
NAIGLADIT

SEQ ID NO: 541371 - protein, 9 aa, Homo Sapiens
KVTVIQDFV

SEQ ID NO: 541372 - protein, 9 aa, Homo Sapiens
ESGAGNAIG

SEQ ID NO: 541373 - protein, 9 aa, Homo Sapiens
CRRTMRKIK

SEQ ID NO: 541374 - protein, 9 aa, Homo Sapiens
HTASVYSER

SEQ ID NO: 541375 - protein, 9 aa, Homo Sapiens
YYCRRTMRK

SEQ ID NO: 541376 - protein, 9 aa, Homo Sapiens
STAQTEKVT

SEQ ID NO: 541377 - protein, 9 aa, Homo Sapiens
CPMCNKKFS

SEQ ID NO: 541378 - protein, 9 aa, Homo Sapiens
RFDTALCIL

SEQ ID NO: 541379 - protein, 9 aa, Homo Sapiens
LDRRNNFLN

SEQ ID NO: 541380 - protein, 9 aa, Homo Sapiens
CILGTPRFT

SEQ ID NO: 541381 - protein, 9 aa, Homo Sapiens
FWHMVWEQR

SEQ ID NO: 541382 - protein, 9 aa, Homo Sapiens
AGNAIGLAD

SEQ ID NO: 541383 - protein, 9 aa, Homo Sapiens
VHTQDISTT

SEQ ID NO: 541384 - protein, 9 aa, Homo Sapiens
LQKLTFLDR

SEQ ID NO: 541385 - protein, 9 aa, Homo Sapiens
RKIKRRTDT

SEQ ID NO: 541386 - protein, 9 aa, Homo Sapiens
THSEDWGKE

SEQ ID NO: 541387 - protein, 9 aa, Homo Sapiens
ICLSIFDNI

SEQ ID NO: 541388 - protein, 9 aa, Homo Sapiens
QPYFCQYHT

SEQ ID NO: 541389 - protein, 9 aa, Homo Sapiens
AQIQAALPA

SEQ ID NO: 541390 - protein, 9 aa, Homo Sapiens
RLRDHSCER

SEQ ID NO: 541391 - protein, 9 aa, Homo Sapiens
ALLIRSSIQ

SEQ ID NO: 541392 - protein, 9 aa, Homo Sapiens
LRNALLIRS

SEQ ID NO: 541393 - protein, 9 aa, Homo Sapiens
RRTMRKIKR

SEQ ID NO: 541394 - protein, 9 aa, Homo Sapiens
SPSENSDCA

SEQ ID NO: 541395 - protein, 9 aa, Homo Sapiens
QETTRKFRR

SEQ ID NO: 541396 - protein, 9 aa, Homo Sapiens
IRSSIQALN

SEQ ID NO: 541397 - protein, 9 aa, Homo Sapiens
IFDNIYGFI

SEQ ID NO: 541398 - protein, 9 aa, Homo Sapiens
FCQYHTASV

SEQ ID NO: 541399 - protein, 9 aa, Homo Sapiens
AVYSPRNIR

SEQ ID NO: 541400 - protein, 9 aa, Homo Sapiens
TVNAAIIEE

SEQ ID NO: 541401 - protein, 9 aa, Homo Sapiens
SPGQASPAQ

SEQ ID NO: 541402 - protein, 9 aa, Homo Sapiens
NSDCAPNPS

SEQ ID NO: 541403 - protein, 9 aa, Homo Sapiens
LTFLDRRNN

SEQ ID NO: 541404 - protein, 9 aa, Homo Sapiens
FIFDEADKL

SEQ ID NO: 541405 - protein, 9 aa, Homo Sapiens
DGRLEASSS

SEQ ID NO: 541406 - protein, 9 aa, Homo Sapiens
VAKGYEEWL

SEQ ID NO: 541407 - protein, 9 aa, Homo Sapiens
LSPVLSLWK

SEQ ID NO: 541408 - protein, 9 aa, Homo Sapiens
KISQETVNA

SEQ ID NO: 541409 - protein, 9 aa, Homo Sapiens
AWGCLEQVA

SEQ ID NO: 541410 - protein, 9 aa, Homo Sapiens
RVSDGRLEA

SEQ ID NO: 541411 - protein, 9 aa, Homo Sapiens
TLLRNALLI

SEQ ID NO: 541412 - protein, 9 aa, Homo Sapiens
IMRMLQANN

SEQ ID NO: 541413 - protein, 9 aa, Homo Sapiens
ICTLLRNAL

SEQ ID NO: 541414 - protein, 9 aa, Homo Sapiens
SIFDNIYGF

SEQ ID NO: 541415 - protein, 9 aa, Homo Sapiens
IRLFRRPLP

SEQ ID NO: 541416 - protein, 9 aa, Homo Sapiens
SERAMPPGC

SEQ ID NO: 541417 - protein, 9 aa, Homo Sapiens
ADEWKDTWR

SEQ ID NO: 541418 - protein, 9 aa, Homo Sapiens
TICLSIFDN

SEQ ID NO: 541419 - protein, 9 aa, Homo Sapiens
APPHFILLS

SEQ ID NO: 541420 - protein, 9 aa, Homo Sapiens
MCNKKFSRV

SEQ ID NO: 541421 - protein, 9 aa, Homo Sapiens
NELSPVLSL

SEQ ID NO: 541422 - protein, 9 aa, Homo Sapiens
YRQETTRKF

SEQ ID NO: 541423 - protein, 9 aa, Homo Sapiens
FDNIYGFIC

SEQ ID NO: 541424 - protein, 9 aa, Homo Sapiens
AVGRCVGKV

SEQ ID NO: 541425 - protein, 9 aa, Homo Sapiens
TTICLSIFD

SEQ ID NO: 541426 - protein, 9 aa, Homo Sapiens
LIRSSIQAL

SEQ ID NO: 541427 - protein, 9 aa, Homo Sapiens
AYYRQETTR

SEQ ID NO: 541428 - protein, 9 aa, Homo Sapiens
DDIKICTLL

SEQ ID NO: 541429 - protein, 9 aa, Homo Sapiens
ADKLHPGLL

SEQ ID NO: 541430 - protein, 9 aa, Homo Sapiens
DGQPYFCQY

SEQ ID NO: 541431 - protein, 9 aa, Homo Sapiens
MHVAYYRQE

SEQ ID NO: 541432 - protein, 9 aa, Homo Sapiens
RKISQETVN

SEQ ID NO: 541433 - protein, 9 aa, Homo Sapiens
MRMLQANND

SEQ ID NO: 541434 - protein, 9 aa, Homo Sapiens
VSPSENSDC

SEQ ID NO: 541435 - protein, 9 aa, Homo Sapiens
GEDPTCPMC

SEQ ID NO: 541436 - protein, 9 aa, Homo Sapiens
AVALCQLAV

SEQ ID NO: 541437 - protein, 9 aa, Homo Sapiens
IKICTLLRN

SEQ ID NO: 541438 - protein, 9 aa, Homo Sapiens
DPTCPMCNK

SEQ ID NO: 541439 - protein, 9 aa, Homo Sapiens
TLFIFDEAD

SEQ ID NO: 541440 - protein, 9 aa, Homo Sapiens
TFLDRRNNF

SEQ ID NO: 541441 - protein, 9 aa, Homo Sapiens
TVIQDFVKM

SEQ ID NO: 541442 - protein, 9 aa, Homo Sapiens
AMPPGCPEP

SEQ ID NO: 541443 - protein, 9 aa, Homo Sapiens
SFKERFHDS

SEQ ID NO: 541444 - protein, 9 aa, Homo Sapiens
GRASPGQAS

SEQ ID NO: 541445 - protein, 9 aa, Homo Sapiens
VYSPRNIRV

SEQ ID NO: 541446 - protein, 9 aa, Homo Sapiens
PGQASPAQA

SEQ ID NO: 541447 - protein, 9 aa, Homo Sapiens
SIMRMLQAN

SEQ ID NO: 541448 - protein, 9 aa, Homo Sapiens
SSIQALNSL

SEQ ID NO: 541449 - protein, 9 aa, Homo Sapiens
VNAAIIEEQ

SEQ ID NO: 541450 - protein, 9 aa, Homo Sapiens
ERFDTALCI

SEQ ID NO: 541451 - protein, 9 aa, Homo Sapiens
HDSVRRLTP

SEQ ID NO: 541452 - protein, 9 aa, Homo Sapiens
STTHSEDWG

SEQ ID NO: 541453 - protein, 9 aa, Homo Sapiens
YKFRMLFQH

SEQ ID NO: 541454 - protein, 9 aa, Homo Sapiens
PSFKERFHD

SEQ ID NO: 541455 - protein, 9 aa, Homo Sapiens
AECTKTAQI

SEQ ID NO: 541456 - protein, 9 aa, Homo Sapiens
VESGAGNAI

SEQ ID NO: 541457 - protein, 9 aa, Homo Sapiens
QAECTKTAQ

SEQ ID NO: 541458 - protein, 9 aa, Homo Sapiens
MPPGCPEPS

SEQ ID NO: 541459 - protein, 9 aa, Homo Sapiens
ETVNAAIIE

SEQ ID NO: 541460 - protein, 9 aa, Homo Sapiens
CTLLRNALL

SEQ ID NO: 541461 - protein, 9 aa, Homo Sapiens
GAGNAIGLA

SEQ ID NO: 541462 - protein, 9 aa, Homo Sapiens
RCLSASLLC

SEQ ID NO: 541463 - protein, 9 aa, Homo Sapiens
ISQETVNAA

SEQ ID NO: 541464 - protein, 9 aa, Homo Sapiens
PPGCPEPSQ

SEQ ID NO: 541465 - protein, 9 aa, Homo Sapiens
DSVRRLTPS

SEQ ID NO: 541466 - protein, 9 aa, Homo Sapiens
GRCVGKVLG

SEQ ID NO: 541467 - protein, 9 aa, Homo Sapiens
TKTAQIQAA

SEQ ID NO: 541468 - protein, 9 aa, Homo Sapiens
KERFHDSVR

SEQ ID NO: 541469 - protein, 9 aa, Homo Sapiens
RDHSCERSE

SEQ ID NO: 541470 - protein, 9 aa, Homo Sapiens
GAALTVLGT

SEQ ID NO: 541471 - protein, 9 aa, Homo Sapiens
VYSERAMPP

SEQ ID NO: 541472 - protein, 9 aa, Homo Sapiens
GNAIGLADI

SEQ ID NO: 541473 - protein, 9 aa, Homo Sapiens
LLCKYWRDL

SEQ ID NO: 541474 - protein, 9 aa, Homo Sapiens
ECTKTAQIQ

SEQ ID NO: 541475 - protein, 9 aa, Homo Sapiens
MYKFRMLFQ

SEQ ID NO: 541476 - protein, 9 aa, Homo Sapiens
DYYCRRTMR

SEQ ID NO: 541477 - protein, 9 aa, Homo Sapiens
SLWKKLNQN

SEQ ID NO: 541478 - protein, 9 aa, Homo Sapiens
QETVNAAII

SEQ ID NO: 541479 - protein, 9 aa, Homo Sapiens
TFGDFWHMV

SEQ ID NO: 541480 - protein, 9 aa, Homo Sapiens
DNIYGFICS

SEQ ID NO: 541481 - protein, 9 aa, Homo Sapiens
NVDGQPYFC

SEQ ID NO: 541482 - protein, 9 aa, Homo Sapiens
VGRCVGKVL

SEQ ID NO: 541483 - protein, 9 aa, Homo Sapiens
GQPYFCQYH

SEQ ID NO: 541484 - protein, 9 aa, Homo Sapiens
TAQTEKVTV

SEQ ID NO: 541485 - protein, 9 aa, Homo Sapiens
PMCNKKFSR

SEQ ID NO: 541486 - protein, 9 aa, Homo Sapiens
CLSASLLCK

SEQ ID NO: 541487 - protein, 9 aa, Homo Sapiens
RQETTRKFR

SEQ ID NO: 541488 - protein, 9 aa, Homo Sapiens
QDISTTHSE

SEQ ID NO: 541489 - protein, 9 aa, Homo Sapiens
DFWHMVWEQ

SEQ ID NO: 541490 - protein, 9 aa, Homo Sapiens
KVLGKVVGL

SEQ ID NO: 541491 - protein, 9 aa, Homo Sapiens
LCILGTPRF

SEQ ID NO: 541492 - protein, 9 aa, Homo Sapiens
CQYHTASVY

SEQ ID NO: 541493 - protein, 9 aa, Homo Sapiens
PHIRLFRRP

SEQ ID NO: 541494 - protein, 9 aa, Homo Sapiens
DRRNNFLNS

SEQ ID NO: 541495 - protein, 9 aa, Homo Sapiens
EPHIRLFRR

SEQ ID NO: 541496 - protein, 9 aa, Homo Sapiens
CTKTAQIQA

SEQ ID NO: 541497 - protein, 9 aa, Homo Sapiens
PYFCQYHTA

SEQ ID NO: 541498 - protein, 9 aa, Homo Sapiens
GKVLGKVVG

SEQ ID NO: 541499 - protein, 9 aa, Homo Sapiens
SQETVNAAI

SEQ ID NO: 541500 - protein, 9 aa, Homo Sapiens
ERFHDSVRR

SEQ ID NO: 541501 - protein, 9 aa, Homo Sapiens
ASPGQASPA

SEQ ID NO: 541502 - protein, 9 aa, Homo Sapiens
MRLRDHSCE

SEQ ID NO: 541503 - protein, 9 aa, Homo Sapiens
LCQLAVYSP

SEQ ID NO: 541504 - protein, 9 aa, Homo Sapiens
NALLIRSSI

SEQ ID NO: 541505 - protein, 9 aa, Homo Sapiens
MLQANNDSI

SEQ ID NO: 541506 - protein, 9 aa, Homo Sapiens
WKDTWRRSK

SEQ ID NO: 541507 - protein, 9 aa, Homo Sapiens
ERAMPPGCP

SEQ ID NO: 541508 - protein, 9 aa, Homo Sapiens
SIQALNSLD

SEQ ID NO: 541509 - protein, 9 aa, Homo Sapiens
LSASLLCKY

SEQ ID NO: 541510 - protein, 9 aa, Homo Sapiens
ASVYSERAM

SEQ ID NO: 541511 - protein, 9 aa, Homo Sapiens
GKVESGAGN

SEQ ID NO: 541512 - protein, 9 aa, Homo Sapiens
LRDHSCERS

SEQ ID NO: 541513 - protein, 9 aa, Homo Sapiens
KVESGAGNA

SEQ ID NO: 541514 - protein, 9 aa, Homo Sapiens
DTALCILGT

SEQ ID NO: 541515 - protein, 9 aa, Homo Sapiens
RAMPPGCPE

SEQ ID NO: 541516 - protein, 9 aa, Homo Sapiens
SDGRLEASS

SEQ ID NO: 541517 - protein, 9 aa, Homo Sapiens
CQLAVYSPR

SEQ ID NO: 541518 - protein, 9 aa, Homo Sapiens
HFILLSHLQ

SEQ ID NO: 541519 - protein, 9 aa, Homo Sapiens
SGEDPTCPM

SEQ ID NO: 541520 - protein, 9 aa, Homo Sapiens
QTEKVTVIQ

SEQ ID NO: 541521 - protein, 9 aa, Homo Sapiens
HMVWEQRSA

SEQ ID NO: 541522 - protein, 9 aa, Homo Sapiens
YFCQYHTAS

SEQ ID NO: 541523 - protein, 9 aa, Homo Sapiens
LPPQPPPAW

SEQ ID NO: 541524 - protein, 9 aa, Homo Sapiens
RLEEAGGTA

SEQ ID NO: 541525 - protein, 9 aa, Homo Sapiens
VHTVQPQPL

SEQ ID NO: 541526 - protein, 9 aa, Homo Sapiens
AIGVVVKGP

SEQ ID NO: 541527 - protein, 9 aa, Homo Sapiens
VALRQKAGL

SEQ ID NO: 541528 - protein, 9 aa, Homo Sapiens
IKGGSRSTA

SEQ ID NO: 541529 - protein, 9 aa, Homo Sapiens
ALHLPVGHP

SEQ ID NO: 541530 - protein, 9 aa, Homo Sapiens
EGRKELFAL

SEQ ID NO: 541531 - protein, 9 aa, Homo Sapiens
MFAAFSPDV

SEQ ID NO: 541532 - protein, 9 aa, Homo Sapiens
LPVQSGGHV

SEQ ID NO: 541533 - protein, 9 aa, Homo Sapiens
QVQAGAVQT

SEQ ID NO: 541534 - protein, 9 aa, Homo Sapiens
LCLLDWIIA

SEQ ID NO: 541535 - protein, 9 aa, Homo Sapiens
LHGDRLEEA

SEQ ID NO: 541536 - protein, 9 aa, Homo Sapiens
EERRQNYVS

SEQ ID NO: 541537 - protein, 9 aa, Homo Sapiens
TYSDYLRCE

SEQ ID NO: 541538 - protein, 9 aa, Homo Sapiens
LHYKREVSV

SEQ ID NO: 541539 - protein, 9 aa, Homo Sapiens
DYTSYCYTL

SEQ ID NO: 541540 - protein, 9 aa, Homo Sapiens
GHVYLLHIL

SEQ ID NO: 541541 - protein, 9 aa, Homo Sapiens
GAPVPLQQP

SEQ ID NO: 541542 - protein, 9 aa, Homo Sapiens
ALDQVQRLG

SEQ ID NO: 541543 - protein, 9 aa, Homo Sapiens
IFQKKLAQA

SEQ ID NO: 541544 - protein, 9 aa, Homo Sapiens
KSRQLDGQS

SEQ ID NO: 541545 - protein, 9 aa, Homo Sapiens
QGEASPPPW

SEQ ID NO: 541546 - protein, 9 aa, Homo Sapiens
STDSKKVLQ

SEQ ID NO: 541547 - protein, 9 aa, Homo Sapiens
REARLWRGR

SEQ ID NO: 541548 - protein, 9 aa, Homo Sapiens
LLDWIIALP

SEQ ID NO: 541549 - protein, 9 aa, Homo Sapiens
VQVGELQDH

SEQ ID NO: 541550 - protein, 9 aa, Homo Sapiens
PLQSDEVHT

SEQ ID NO: 541551 - protein, 9 aa, Homo Sapiens
VCMVSDLED

SEQ ID NO: 541552 - protein, 9 aa, Homo Sapiens
VQPQPLPGL

SEQ ID NO: 541553 - protein, 9 aa, Homo Sapiens
QPLPGLPSQ

SEQ ID NO: 541554 - protein, 9 aa, Homo Sapiens
CLQLNNIKL

SEQ ID NO: 541555 - protein, 9 aa, Homo Sapiens
PRLPFAPLH

SEQ ID NO: 541556 - protein, 9 aa, Homo Sapiens
ACDARGQRQ

SEQ ID NO: 541557 - protein, 9 aa, Homo Sapiens
GLNVIDAKF

SEQ ID NO: 541558 - protein, 9 aa, Homo Sapiens
KQMFAAFSP

SEQ ID NO: 541559 - protein, 9 aa, Homo Sapiens
LGAGVAHDE

SEQ ID NO: 541560 - protein, 9 aa, Homo Sapiens
NPIHESTWE

SEQ ID NO: 541561 - protein, 9 aa, Homo Sapiens
VHLVSGQAL

SEQ ID NO: 541562 - protein, 9 aa, Homo Sapiens
EPVPGEVCD

SEQ ID NO: 541563 - protein, 9 aa, Homo Sapiens
LGISQIQGC

SEQ ID NO: 541564 - protein, 9 aa, Homo Sapiens
DIEYGDKER

SEQ ID NO: 541565 - protein, 9 aa, Homo Sapiens
GSSQVIFTN

SEQ ID NO: 541566 - protein, 9 aa, Homo Sapiens
QQEEMALTL

SEQ ID NO: 541567 - protein, 9 aa, Homo Sapiens
MAFDQYIAI

SEQ ID NO: 541568 - protein, 9 aa, Homo Sapiens
GHGWPVQTQ

SEQ ID NO: 541569 - protein, 9 aa, Homo Sapiens
QSQDAGVRC

SEQ ID NO: 541570 - protein, 9 aa, Homo Sapiens
KFCMKGEDL

SEQ ID NO: 541571 - protein, 9 aa, Homo Sapiens
QIIPELVPD

SEQ ID NO: 541572 - protein, 9 aa, Homo Sapiens
GQGPPLPPQ

SEQ ID NO: 541573 - protein, 9 aa, Homo Sapiens
MGRVLKKEL

SEQ ID NO: 541574 - protein, 9 aa, Homo Sapiens
DNMGRVLKK

SEQ ID NO: 541575 - protein, 9 aa, Homo Sapiens
VRGLGAPVP

SEQ ID NO: 541576 - protein, 9 aa, Homo Sapiens
DSALHTVRA

SEQ ID NO: 541577 - protein, 9 aa, Homo Sapiens
PEPVPGEVC

SEQ ID NO: 541578 - protein, 9 aa, Homo Sapiens
TSQSSRVCD

SEQ ID NO: 541579 - protein, 9 aa, Homo Sapiens
HAYLGAGVA

SEQ ID NO: 541580 - protein, 9 aa, Homo Sapiens
LPVGHPQVQ

SEQ ID NO: 541581 - protein, 9 aa, Homo Sapiens
HRATVEGHL

SEQ ID NO: 541582 - protein, 9 aa, Homo Sapiens
RAGIGLPSE

SEQ ID NO: 541583 - protein, 9 aa, Homo Sapiens
SPWSPWLAC

SEQ ID NO: 541584 - protein, 9 aa, Homo Sapiens
GTEVCMVSD

SEQ ID NO: 541585 - protein, 9 aa, Homo Sapiens
VMAFDQYIA

SEQ ID NO: 541586 - protein, 9 aa, Homo Sapiens
RHRATVEGH

SEQ ID NO: 541587 - protein, 9 aa, Homo Sapiens
QVRVEDKAD

SEQ ID NO: 541588 - protein, 9 aa, Homo Sapiens
SFSGTIVQE

SEQ ID NO: 541589 - protein, 9 aa, Homo Sapiens
IPCPRCRQS

SEQ ID NO: 541590 - protein, 9 aa, Homo Sapiens
EMRNYRGRQ

SEQ ID NO: 541591 - protein, 9 aa, Homo Sapiens
NMEYCDYRK

SEQ ID NO: 541592 - protein, 9 aa, Homo Sapiens
LIQIIPELV

SEQ ID NO: 541593 - protein, 9 aa, Homo Sapiens
ARLWRGRQT

SEQ ID NO: 541594 - protein, 9 aa, Homo Sapiens
EGHLAPHSL

SEQ ID NO: 541595 - protein, 9 aa, Homo Sapiens
KELFALEHL

SEQ ID NO: 541596 - protein, 9 aa, Homo Sapiens
LDWIIALPL

SEQ ID NO: 541597 - protein, 9 aa, Homo Sapiens
TMEVVGSSG

SEQ ID NO: 541598 - protein, 9 aa, Homo Sapiens
TSTTRFIFQ

SEQ ID NO: 541599 - protein, 9 aa, Homo Sapiens
PSQASHTVL

SEQ ID NO: 541600 - protein, 9 aa, Homo Sapiens
NMGRVLKKE

SEQ ID NO: 541601 - protein, 9 aa, Homo Sapiens
DHLSCDVIP

SEQ ID NO: 541602 - protein, 9 aa, Homo Sapiens
SCVRESSCF

SEQ ID NO: 541603 - protein, 9 aa, Homo Sapiens
EVCDLEACV

SEQ ID NO: 541604 - protein, 9 aa, Homo Sapiens
PAKSQESTD

SEQ ID NO: 541605 - protein, 9 aa, Homo Sapiens
ACVQVGELQ

SEQ ID NO: 541606 - protein, 9 aa, Homo Sapiens
SKSRQLDGQ

SEQ ID NO: 541607 - protein, 9 aa, Homo Sapiens
LYAMRGINI

SEQ ID NO: 541608 - protein, 9 aa, Homo Sapiens
QQDLLRVPA

SEQ ID NO: 541609 - protein, 9 aa, Homo Sapiens
RASSFSGTI

SEQ ID NO: 541610 - protein, 9 aa, Homo Sapiens
PWSPWLACT

SEQ ID NO: 541611 - protein, 9 aa, Homo Sapiens
NTTMEVVGS

SEQ ID NO: 541612 - protein, 9 aa, Homo Sapiens
KSQESTDSK

SEQ ID NO: 541613 - protein, 9 aa, Homo Sapiens
DLGRGGRAP

SEQ ID NO: 541614 - protein, 9 aa, Homo Sapiens
GSWILYEMR

SEQ ID NO: 541615 - protein, 9 aa, Homo Sapiens
GLPSQASHT

SEQ ID NO: 541616 - protein, 9 aa, Homo Sapiens
TPTLLAHLR

SEQ ID NO: 541617 - protein, 9 aa, Homo Sapiens
AFVHTPTLL

SEQ ID NO: 541618 - protein, 9 aa, Homo Sapiens
LFALEHLHR

SEQ ID NO: 541619 - protein, 9 aa, Homo Sapiens
LVPDALHLP

SEQ ID NO: 541620 - protein, 9 aa, Homo Sapiens
GIGLPSEAS

SEQ ID NO: 541621 - protein, 9 aa, Homo Sapiens
VDAALEGRK

SEQ ID NO: 541622 - protein, 9 aa, Homo Sapiens
VYLLHILQV

SEQ ID NO: 541623 - protein, 9 aa, Homo Sapiens
GVCALPLPG

SEQ ID NO: 541624 - protein, 9 aa, Homo Sapiens
PLPGSLSLL

SEQ ID NO: 541625 - protein, 9 aa, Homo Sapiens
VSIHVDAAL

SEQ ID NO: 541626 - protein, 9 aa, Homo Sapiens
IDQQQEEMA

SEQ ID NO: 541627 - protein, 9 aa, Homo Sapiens
SQASHTVLG

SEQ ID NO: 541628 - protein, 9 aa, Homo Sapiens
RESSCFTEC

SEQ ID NO: 541629 - protein, 9 aa, Homo Sapiens
LRQKAGLGI

SEQ ID NO: 541630 - protein, 9 aa, Homo Sapiens
HESTWELEV

SEQ ID NO: 541631 - protein, 9 aa, Homo Sapiens
GDRLEEAGG

SEQ ID NO: 541632 - protein, 9 aa, Homo Sapiens
ALPLPGSLS

SEQ ID NO: 541633 - protein, 9 aa, Homo Sapiens
AVQTEACDA

SEQ ID NO: 541634 - protein, 9 aa, Homo Sapiens
LEGRKELFA

SEQ ID NO: 541635 - protein, 9 aa, Homo Sapiens
LGGLLDYTS

SEQ ID NO: 541636 - protein, 9 aa, Homo Sapiens
EGRAEWAVA

SEQ ID NO: 541637 - protein, 9 aa, Homo Sapiens
SLSLLGHPH

SEQ ID NO: 541638 - protein, 9 aa, Homo Sapiens
VKQMFAAFS

SEQ ID NO: 541639 - protein, 9 aa, Homo Sapiens
ALASPTDRM

SEQ ID NO: 541640 - protein, 9 aa, Homo Sapiens
HGDRLEEAG

SEQ ID NO: 541641 - protein, 9 aa, Homo Sapiens
TNTTMEVVG

SEQ ID NO: 541642 - protein, 9 aa, Homo Sapiens
IHESTWELE

SEQ ID NO: 541643 - protein, 9 aa, Homo Sapiens
KESGIQFNE

SEQ ID NO: 541644 - protein, 9 aa, Homo Sapiens
HPHHAYLGA

SEQ ID NO: 541645 - protein, 9 aa, Homo Sapiens
EVCMVSDLE

SEQ ID NO: 541646 - protein, 9 aa, Homo Sapiens
GLGAPVPLQ

SEQ ID NO: 541647 - protein, 9 aa, Homo Sapiens
GVFSIKGGS

SEQ ID NO: 541648 - protein, 9 aa, Homo Sapiens
RKELFALEH

SEQ ID NO: 541649 - protein, 9 aa, Homo Sapiens
VQSGGHVYL

SEQ ID NO: 541650 - protein, 9 aa, Homo Sapiens
LPGSLSLLG

SEQ ID NO: 541651 - protein, 9 aa, Homo Sapiens
APLQSDEVH

SEQ ID NO: 541652 - protein, 9 aa, Homo Sapiens
LHLPVGHPQ

SEQ ID NO: 541653 - protein, 9 aa, Homo Sapiens
CTPTNTTME

SEQ ID NO: 541654 - protein, 9 aa, Homo Sapiens
AGYICTQLM

SEQ ID NO: 541655 - protein, 9 aa, Homo Sapiens
VVKKGSISS

SEQ ID NO: 541656 - protein, 9 aa, Homo Sapiens
HVYLLHILQ

SEQ ID NO: 541657 - protein, 9 aa, Homo Sapiens
ALEGRKELF

SEQ ID NO: 541658 - protein, 9 aa, Homo Sapiens
AILAFEYSP

SEQ ID NO: 541659 - protein, 9 aa, Homo Sapiens
EACVQVGEL

SEQ ID NO: 541660 - protein, 9 aa, Homo Sapiens
PVVCSYFAQ

SEQ ID NO: 541661 - protein, 9 aa, Homo Sapiens
VVCSYFAQD

SEQ ID NO: 541662 - protein, 9 aa, Homo Sapiens
TVSNGEQED

SEQ ID NO: 541663 - protein, 9 aa, Homo Sapiens
SQESTDSKK

SEQ ID NO: 541664 - protein, 9 aa, Homo Sapiens
QLNNIKLND

SEQ ID NO: 541665 - protein, 9 aa, Homo Sapiens
LHILQVRVE

SEQ ID NO: 541666 - protein, 9 aa, Homo Sapiens
DYLRCESFL

SEQ ID NO: 541667 - protein, 9 aa, Homo Sapiens
EEDRASSFS

SEQ ID NO: 541668 - protein, 9 aa, Homo Sapiens
QVALRQKAG

SEQ ID NO: 541669 - protein, 9 aa, Homo Sapiens
PVQSGGHVY

SEQ ID NO: 541670 - protein, 9 aa, Homo Sapiens
GSTWHEAGL

SEQ ID NO: 541671 - protein, 9 aa, Homo Sapiens
SHTQQVALR

SEQ ID NO: 541672 - protein, 9 aa, Homo Sapiens
DLEACVQVG

SEQ ID NO: 541673 - protein, 9 aa, Homo Sapiens
HKDPRVQEN

SEQ ID NO: 541674 - protein, 9 aa, Homo Sapiens
GLKPPSRTW

SEQ ID NO: 541675 - protein, 9 aa, Homo Sapiens
FNELEGQVL

SEQ ID NO: 541676 - protein, 9 aa, Homo Sapiens
RWLAAGRPG

SEQ ID NO: 541677 - protein, 9 aa, Homo Sapiens
ARLSPRLPF

SEQ ID NO: 541678 - protein, 9 aa, Homo Sapiens
FLGGLLDYT

SEQ ID NO: 541679 - protein, 9 aa, Homo Sapiens
PLAVDEMHQ

SEQ ID NO: 541680 - protein, 9 aa, Homo Sapiens
PDALHLPVG

SEQ ID NO: 541681 - protein, 9 aa, Homo Sapiens
CLLDWIIAL

SEQ ID NO: 541682 - protein, 9 aa, Homo Sapiens
RQLDGQSGH

SEQ ID NO: 541683 - protein, 9 aa, Homo Sapiens
PMSPAPCPT

SEQ ID NO: 541684 - protein, 9 aa, Homo Sapiens
SRVCDCDQQ

SEQ ID NO: 541685 - protein, 9 aa, Homo Sapiens
GFTEFIQYE

SEQ ID NO: 541686 - protein, 9 aa, Homo Sapiens
QGPPLPPQP

SEQ ID NO: 541687 - protein, 9 aa, Homo Sapiens
LGAPVPLQQ

SEQ ID NO: 541688 - protein, 9 aa, Homo Sapiens
SIKGGSRST

SEQ ID NO: 541689 - protein, 9 aa, Homo Sapiens
QKAGLGISQ

SEQ ID NO: 541690 - protein, 9 aa, Homo Sapiens
GHPHRHRAT

SEQ ID NO: 541691 - protein, 9 aa, Homo Sapiens
STWELEVED

SEQ ID NO: 541692 - protein, 9 aa, Homo Sapiens
RCESFLQQQ

SEQ ID NO: 541693 - protein, 9 aa, Homo Sapiens
VQTQTPSHT

SEQ ID NO: 541694 - protein, 9 aa, Homo Sapiens
EWAVAVSGM

SEQ ID NO: 541695 - protein, 9 aa, Homo Sapiens
PKGGVHLVS

SEQ ID NO: 541696 - protein, 9 aa, Homo Sapiens
GRGGRAPVG

SEQ ID NO: 541697 - protein, 9 aa, Homo Sapiens
ARMMAAEVL

SEQ ID NO: 541698 - protein, 9 aa, Homo Sapiens
QTYSDYLRC

SEQ ID NO: 541699 - protein, 9 aa, Homo Sapiens
LACTVTCAG

SEQ ID NO: 541700 - protein, 9 aa, Homo Sapiens
VSNGEQEDL

SEQ ID NO: 541701 - protein, 9 aa, Homo Sapiens
PPWPLGPSK

SEQ ID NO: 541702 - protein, 9 aa, Homo Sapiens
QLHGDRLEE

SEQ ID NO: 541703 - protein, 9 aa, Homo Sapiens
LGRGGRAPV

SEQ ID NO: 541704 - protein, 9 aa, Homo Sapiens
DNPKYATEQ

SEQ ID NO: 541705 - protein, 9 aa, Homo Sapiens
NPKYATEQS

SEQ ID NO: 541706 - protein, 9 aa, Homo Sapiens
ELVPDALHL

SEQ ID NO: 541707 - protein, 9 aa, Homo Sapiens
LTAGSTWHE

SEQ ID NO: 541708 - protein, 9 aa, Homo Sapiens
RLDLGRGGR

SEQ ID NO: 541709 - protein, 9 aa, Homo Sapiens
VSDLEDLSA

SEQ ID NO: 541710 - protein, 9 aa, Homo Sapiens
LRVPAPLQS

SEQ ID NO: 541711 - protein, 9 aa, Homo Sapiens
DQYIAICYP

SEQ ID NO: 541712 - protein, 9 aa, Homo Sapiens
HSYLAMNRL

SEQ ID NO: 541713 - protein, 9 aa, Homo Sapiens
PSHTQQVAL

SEQ ID NO: 541714 - protein, 9 aa, Homo Sapiens
VLKKELKVG

SEQ ID NO: 541715 - protein, 9 aa, Homo Sapiens
LFATVSNGE

SEQ ID NO: 541716 - protein, 9 aa, Homo Sapiens
VCDLEACVQ

SEQ ID NO: 541717 - protein, 9 aa, Homo Sapiens
SQSQDAGVR

SEQ ID NO: 541718 - protein, 9 aa, Homo Sapiens
APVPLQQPP

SEQ ID NO: 541719 - protein, 9 aa, Homo Sapiens
LGGVPEPVP

SEQ ID NO: 541720 - protein, 9 aa, Homo Sapiens
HLHRVRGLG

SEQ ID NO: 541721 - protein, 9 aa, Homo Sapiens
QQVALRQKA

SEQ ID NO: 541722 - protein, 9 aa, Homo Sapiens
PVGHPQVQG

SEQ ID NO: 541723 - protein, 9 aa, Homo Sapiens
SSVLLRLPA

SEQ ID NO: 541724 - protein, 9 aa, Homo Sapiens
QQPPKGGVH

SEQ ID NO: 541725 - protein, 9 aa, Homo Sapiens
ILLVMAFDQ

SEQ ID NO: 541726 - protein, 9 aa, Homo Sapiens
RLPFAPLHS

SEQ ID NO: 541727 - protein, 9 aa, Homo Sapiens
GRKELFALE

SEQ ID NO: 541728 - protein, 9 aa, Homo Sapiens
VQAGAVQTE

SEQ ID NO: 541729 - protein, 9 aa, Homo Sapiens
NELEGQVLQ

SEQ ID NO: 541730 - protein, 9 aa, Homo Sapiens
ESTWELEVE

SEQ ID NO: 541731 - protein, 9 aa, Homo Sapiens
GSISSEDLK

SEQ ID NO: 541732 - protein, 9 aa, Homo Sapiens
ILQVRVEDK

SEQ ID NO: 541733 - protein, 9 aa, Homo Sapiens
CVRESSCFT

SEQ ID NO: 541734 - protein, 9 aa, Homo Sapiens
RVRGLGAPV

SEQ ID NO: 541735 - protein, 9 aa, Homo Sapiens
WILYEMRNY

SEQ ID NO: 541736 - protein, 9 aa, Homo Sapiens
CMVSDLEDL

SEQ ID NO: 541737 - protein, 9 aa, Homo Sapiens
QLDGQSGHP

SEQ ID NO: 541738 - protein, 9 aa, Homo Sapiens
RVCDCDQQI

SEQ ID NO: 541739 - protein, 9 aa, Homo Sapiens
PSKSRQLDG

SEQ ID NO: 541740 - protein, 9 aa, Homo Sapiens
MSSAGYICT

SEQ ID NO: 541741 - protein, 9 aa, Homo Sapiens
PHHAYLGAG

SEQ ID NO: 541742 - protein, 9 aa, Homo Sapiens
LGPSKSRQL

SEQ ID NO: 541743 - protein, 9 aa, Homo Sapiens
VRAVSIHVD

SEQ ID NO: 541744 - protein, 9 aa, Homo Sapiens
ATVEGHLAP

SEQ ID NO: 541745 - protein, 9 aa, Homo Sapiens
VHNPRNTET

SEQ ID NO: 541746 - protein, 9 aa, Homo Sapiens
LLVMAFDQY

SEQ ID NO: 541747 - protein, 9 aa, Homo Sapiens
RCRQSTPTP

SEQ ID NO: 541748 - protein, 9 aa, Homo Sapiens
VQQVQAGAV

SEQ ID NO: 541749 - protein, 9 aa, Homo Sapiens
SAGYICTQL

SEQ ID NO: 541750 - protein, 9 aa, Homo Sapiens
DLLRVPAPL

SEQ ID NO: 541751 - protein, 9 aa, Homo Sapiens
RGQRQLHGD

SEQ ID NO: 541752 - protein, 9 aa, Homo Sapiens
PHPHHAYLG

SEQ ID NO: 541753 - protein, 9 aa, Homo Sapiens
FAVRSGGAI

SEQ ID NO: 541754 - protein, 9 aa, Homo Sapiens
AVSSVLLRL

SEQ ID NO: 541755 - protein, 9 aa, Homo Sapiens
AGSSQVIFT

SEQ ID NO: 541756 - protein, 9 aa, Homo Sapiens
HILQVRVED

SEQ ID NO: 541757 - protein, 9 aa, Homo Sapiens
QGCQGEASP

SEQ ID NO: 541758 - protein, 9 aa, Homo Sapiens
RQKAGLGIS

SEQ ID NO: 541759 - protein, 9 aa, Homo Sapiens
REACGGHSY

SEQ ID NO: 541760 - protein, 9 aa, Homo Sapiens
VQRLGSLPP

SEQ ID NO: 541761 - protein, 9 aa, Homo Sapiens
VPGEVCDLE

SEQ ID NO: 541762 - protein, 9 aa, Homo Sapiens
IKDCPYRSS

SEQ ID NO: 541763 - protein, 9 aa, Homo Sapiens
AALASPTDR

SEQ ID NO: 541764 - protein, 9 aa, Homo Sapiens
FIFQKKLAQ

SEQ ID NO: 541765 - protein, 9 aa, Homo Sapiens
KGVFSIKGG

SEQ ID NO: 541766 - protein, 9 aa, Homo Sapiens
DQQQEEMAL

SEQ ID NO: 541767 - protein, 9 aa, Homo Sapiens
ALQQDLLRV

SEQ ID NO: 541768 - protein, 9 aa, Homo Sapiens
IHVDAALEG

SEQ ID NO: 541769 - protein, 9 aa, Homo Sapiens
LLHQLITIM

SEQ ID NO: 541770 - protein, 9 aa, Homo Sapiens
RNYRGRQYL

SEQ ID NO: 541771 - protein, 9 aa, Homo Sapiens
TATQFVHYA

SEQ ID NO: 541772 - protein, 9 aa, Homo Sapiens
DAALEGRKE

SEQ ID NO: 541773 - protein, 9 aa, Homo Sapiens
PPPWPLGPS

SEQ ID NO: 541774 - protein, 9 aa, Homo Sapiens
IIALPLKTL

SEQ ID NO: 541775 - protein, 9 aa, Homo Sapiens
VPEPVPGEV

SEQ ID NO: 541776 - protein, 9 aa, Homo Sapiens
VIDAKFCMK

SEQ ID NO: 541777 - protein, 9 aa, Homo Sapiens
LQDHLSCDV

SEQ ID NO: 541778 - protein, 9 aa, Homo Sapiens
ATQFVHYAL

SEQ ID NO: 541779 - protein, 9 aa, Homo Sapiens
YPRPQNMEY

SEQ ID NO: 541780 - protein, 9 aa, Homo Sapiens
MDTLDIEYG

SEQ ID NO: 541781 - protein, 9 aa, Homo Sapiens
TVEGHLAPH

SEQ ID NO: 541782 - protein, 9 aa, Homo Sapiens
YSPSPPRLQ

SEQ ID NO: 541783 - protein, 9 aa, Homo Sapiens
SGGHVYLLH

SEQ ID NO: 541784 - protein, 9 aa, Homo Sapiens
GGCRRGPVQ

SEQ ID NO: 541785 - protein, 9 aa, Homo Sapiens
KADSALHTV

SEQ ID NO: 541786 - protein, 9 aa, Homo Sapiens
VFSIKGGSR

SEQ ID NO: 541787 - protein, 9 aa, Homo Sapiens
SQIQGCQGE

SEQ ID NO: 541788 - protein, 9 aa, Homo Sapiens
TQGLGSNQK

SEQ ID NO: 541789 - protein, 9 aa, Homo Sapiens
QYEADRTDD

SEQ ID NO: 541790 - protein, 9 aa, Homo Sapiens
GWPVQTQTP

SEQ ID NO: 541791 - protein, 9 aa, Homo Sapiens
GVPEPVPGE

SEQ ID NO: 541792 - protein, 9 aa, Homo Sapiens
LKPPSRTWS

SEQ ID NO: 541793 - protein, 9 aa, Homo Sapiens
LASPTDRML

SEQ ID NO: 541794 - protein, 9 aa, Homo Sapiens
ELQDHLSCD

SEQ ID NO: 541795 - protein, 9 aa, Homo Sapiens
DLEDLSASI

SEQ ID NO: 541796 - protein, 9 aa, Homo Sapiens
DTLDIEYGD

SEQ ID NO: 541797 - protein, 9 aa, Homo Sapiens
DWIIALPLK

SEQ ID NO: 541798 - protein, 9 aa, Homo Sapiens
CQGEASPPP

SEQ ID NO: 541799 - protein, 9 aa, Homo Sapiens
AVLNTEARM

SEQ ID NO: 541800 - protein, 9 aa, Homo Sapiens
EIDQQQEEM

SEQ ID NO: 541801 - protein, 9 aa, Homo Sapiens
APFLSCYLG

SEQ ID NO: 541802 - protein, 9 aa, Homo Sapiens
TAQDNPKYA

SEQ ID NO: 541803 - protein, 9 aa, Homo Sapiens
VSSVLLRLP

SEQ ID NO: 541804 - protein, 9 aa, Homo Sapiens
CDVIPGGCR

SEQ ID NO: 541805 - protein, 9 aa, Homo Sapiens
SCFTECRGY

SEQ ID NO: 541806 - protein, 9 aa, Homo Sapiens
FVHTPTLLA

SEQ ID NO: 541807 - protein, 9 aa, Homo Sapiens
GCQGEASPP

SEQ ID NO: 541808 - protein, 9 aa, Homo Sapiens
MVTEPPVVC

SEQ ID NO: 541809 - protein, 9 aa, Homo Sapiens
DARGQRQLH

SEQ ID NO: 541810 - protein, 9 aa, Homo Sapiens
SCYLGLGHL

SEQ ID NO: 541811 - protein, 9 aa, Homo Sapiens
QFNELEGQV

SEQ ID NO: 541812 - protein, 9 aa, Homo Sapiens
AEWAVAVSG

SEQ ID NO: 541813 - protein, 9 aa, Homo Sapiens
DGQSGHPQG

SEQ ID NO: 541814 - protein, 9 aa, Homo Sapiens
RKAILAFEY

SEQ ID NO: 541815 - protein, 9 aa, Homo Sapiens
PVPGEVCDL

SEQ ID NO: 541816 - protein, 9 aa, Homo Sapiens
CYQGTFQAY

SEQ ID NO: 541817 - protein, 9 aa, Homo Sapiens
LAFEYSPSP

SEQ ID NO: 541818 - protein, 9 aa, Homo Sapiens
YVSDFPPPA

SEQ ID NO: 541819 - protein, 9 aa, Homo Sapiens
LLGHPHRHR

SEQ ID NO: 541820 - protein, 9 aa, Homo Sapiens
SRPAKSQES

SEQ ID NO: 541821 - protein, 9 aa, Homo Sapiens
RNLQVSPLA

SEQ ID NO: 541822 - protein, 9 aa, Homo Sapiens
TETVTLNFR

SEQ ID NO: 541823 - protein, 9 aa, Homo Sapiens
YEMRNYRGR

SEQ ID NO: 541824 - protein, 9 aa, Homo Sapiens
PTNTTMEVV

SEQ ID NO: 541825 - protein, 9 aa, Homo Sapiens
DAFVHTPTL

SEQ ID NO: 541826 - protein, 9 aa, Homo Sapiens
LLCLLDWII

SEQ ID NO: 541827 - protein, 9 aa, Homo Sapiens
LPLPGSLSL

SEQ ID NO: 541828 - protein, 9 aa, Homo Sapiens
STTRFIFQK

SEQ ID NO: 541829 - protein, 9 aa, Homo Sapiens
LDTSQSSRV

SEQ ID NO: 541830 - protein, 9 aa, Homo Sapiens
GHPQGVCAL

SEQ ID NO: 541831 - protein, 9 aa, Homo Sapiens
IALPLKTLL

SEQ ID NO: 541832 - protein, 9 aa, Homo Sapiens
LEACVQVGE

SEQ ID NO: 541833 - protein, 9 aa, Homo Sapiens
LSPRLPFAP

SEQ ID NO: 541834 - protein, 9 aa, Homo Sapiens
FCTQRFCIK

SEQ ID NO: 541835 - protein, 9 aa, Homo Sapiens
IMSSAGYIC

SEQ ID NO: 541836 - protein, 9 aa, Homo Sapiens
DLLHQLITI

SEQ ID NO: 541837 - protein, 9 aa, Homo Sapiens
SLSLPVQSG

SEQ ID NO: 541838 - protein, 9 aa, Homo Sapiens
GGVPEPVPG

SEQ ID NO: 541839 - protein, 9 aa, Homo Sapiens
TQTPSHTQQ

SEQ ID NO: 541840 - protein, 9 aa, Homo Sapiens
SVLLRLPAA

SEQ ID NO: 541841 - protein, 9 aa, Homo Sapiens
TTRFIFQKK

SEQ ID NO: 541842 - protein, 9 aa, Homo Sapiens
LQQPPKGGV

SEQ ID NO: 541843 - protein, 9 aa, Homo Sapiens
LEHLHRVRG

SEQ ID NO: 541844 - protein, 9 aa, Homo Sapiens
LPSEASDSV

SEQ ID NO: 541845 - protein, 9 aa, Homo Sapiens
HLSCDVIPG

SEQ ID NO: 541846 - protein, 9 aa, Homo Sapiens
MVSDLEDLS

SEQ ID NO: 541847 - protein, 9 aa, Homo Sapiens
WCGPRPPMS

SEQ ID NO: 541848 - protein, 9 aa, Homo Sapiens
QLITIMNPN

SEQ ID NO: 541849 - protein, 9 aa, Homo Sapiens
FSGTIVQEA

SEQ ID NO: 541850 - protein, 9 aa, Homo Sapiens
GGAIGVVVK

SEQ ID NO: 541851 - protein, 9 aa, Homo Sapiens
TLGCLQLNN

SEQ ID NO: 541852 - protein, 9 aa, Homo Sapiens
AVRSGGAIG

SEQ ID NO: 541853 - protein, 9 aa, Homo Sapiens
LLRVPAPLQ

SEQ ID NO: 541854 - protein, 9 aa, Homo Sapiens
AVSIHVDAA

SEQ ID NO: 541855 - protein, 9 aa, Homo Sapiens
YCLKGLKPP

SEQ ID NO: 541856 - protein, 9 aa, Homo Sapiens
LSLPVQSGG

SEQ ID NO: 541857 - protein, 9 aa, Homo Sapiens
LSERFTSYQ

SEQ ID NO: 541858 - protein, 9 aa, Homo Sapiens
YLGAGVAHD

SEQ ID NO: 541859 - protein, 9 aa, Homo Sapiens
TVRAVSIHV

SEQ ID NO: 541860 - protein, 9 aa, Homo Sapiens
SALDQVQRL

SEQ ID NO: 541861 - protein, 9 aa, Homo Sapiens
GRPGHPPGL

SEQ ID NO: 541862 - protein, 9 aa, Homo Sapiens
PLQQPPKGG

SEQ ID NO: 541863 - protein, 9 aa, Homo Sapiens
EQRWIPCPR

SEQ ID NO: 541864 - protein, 9 aa, Homo Sapiens
RGGRAPVGT

SEQ ID NO: 541865 - protein, 9 aa, Homo Sapiens
YKREVSVSD

SEQ ID NO: 541866 - protein, 9 aa, Homo Sapiens
SDEVHTVQP

SEQ ID NO: 541867 - protein, 9 aa, Homo Sapiens
QRLGSLPPR

SEQ ID NO: 541868 - protein, 9 aa, Homo Sapiens
AGSTWHEAG

SEQ ID NO: 541869 - protein, 9 aa, Homo Sapiens
RVLKKELKV

SEQ ID NO: 541870 - protein, 9 aa, Homo Sapiens
VKKGSISSE

SEQ ID NO: 541871 - protein, 9 aa, Homo Sapiens
GTFQAYKTV

SEQ ID NO: 541872 - protein, 9 aa, Homo Sapiens
ACGGHSYLA

SEQ ID NO: 541873 - protein, 9 aa, Homo Sapiens
VHTPTLLAH

SEQ ID NO: 541874 - protein, 9 aa, Homo Sapiens
PRPPMSPAP

SEQ ID NO: 541875 - protein, 9 aa, Homo Sapiens
LLHYKREVS

SEQ ID NO: 541876 - protein, 9 aa, Homo Sapiens
FLSCYLGLG

SEQ ID NO: 541877 - protein, 9 aa, Homo Sapiens
HTVRAVSIH

SEQ ID NO: 541878 - protein, 9 aa, Homo Sapiens
LLAALASPT

SEQ ID NO: 541879 - protein, 9 aa, Homo Sapiens
ATAQDNPKY

SEQ ID NO: 541880 - protein, 9 aa, Homo Sapiens
LKGLKPPSR

SEQ ID NO: 541881 - protein, 9 aa, Homo Sapiens
EVHTVQPQP

SEQ ID NO: 541882 - protein, 9 aa, Homo Sapiens
PWLACTVTC

SEQ ID NO: 541883 - protein, 9 aa, Homo Sapiens
RDEIDQQQE

SEQ ID NO: 541884 - protein, 9 aa, Homo Sapiens
SGIQFNELE

SEQ ID NO: 541885 - protein, 9 aa, Homo Sapiens
WSPWLACTV

SEQ ID NO: 541886 - protein, 9 aa, Homo Sapiens
GLGISQIQG

SEQ ID NO: 541887 - protein, 9 aa, Homo Sapiens
GYICTQLME

SEQ ID NO: 541888 - protein, 9 aa, Homo Sapiens
EYSPSPPRL

SEQ ID NO: 541889 - protein, 9 aa, Homo Sapiens
VGHPQVQGH

SEQ ID NO: 541890 - protein, 9 aa, Homo Sapiens
WIPCPRCRQ

SEQ ID NO: 541891 - protein, 9 aa, Homo Sapiens
SPWLACTVT

SEQ ID NO: 541892 - protein, 9 aa, Homo Sapiens
AGGCAGSSQ

SEQ ID NO: 541893 - protein, 9 aa, Homo Sapiens
AFDQYIAIC

SEQ ID NO: 541894 - protein, 9 aa, Homo Sapiens
GLLDYTSYC

SEQ ID NO: 541895 - protein, 9 aa, Homo Sapiens
VDRNLQVSP

SEQ ID NO: 541896 - protein, 9 aa, Homo Sapiens
AFEYSPSPP

SEQ ID NO: 541897 - protein, 9 aa, Homo Sapiens
SLPVQSGGH

SEQ ID NO: 541898 - protein, 9 aa, Homo Sapiens
QTPSHTQQV

SEQ ID NO: 541899 - protein, 9 aa, Homo Sapiens
GEVCDLEAC

SEQ ID NO: 541900 - protein, 9 aa, Homo Sapiens
QPPKGGVHL

SEQ ID NO: 541901 - protein, 9 aa, Homo Sapiens
QGHGWPVQT

SEQ ID NO: 541902 - protein, 9 aa, Homo Sapiens
GCLQLNNIK

SEQ ID NO: 541903 - protein, 9 aa, Homo Sapiens
KAILAFEYS

SEQ ID NO: 541904 - protein, 9 aa, Homo Sapiens
IGVVVKGPD

SEQ ID NO: 541905 - protein, 9 aa, Homo Sapiens
SDNPIHEST

SEQ ID NO: 541906 - protein, 9 aa, Homo Sapiens
ILYEMRNYR

SEQ ID NO: 541907 - protein, 9 aa, Homo Sapiens
PGLPSQASH

SEQ ID NO: 541908 - protein, 9 aa, Homo Sapiens
SGHPQGVCA

SEQ ID NO: 541909 - protein, 9 aa, Homo Sapiens
HTVQPQPLP

SEQ ID NO: 541910 - protein, 9 aa, Homo Sapiens
CTQLMEEAS

SEQ ID NO: 541911 - protein, 9 aa, Homo Sapiens
MPEQHKDPR

SEQ ID NO: 541912 - protein, 9 aa, Homo Sapiens
REVSVSDQM

SEQ ID NO: 541913 - protein, 9 aa, Homo Sapiens
AFSPDVCGN

SEQ ID NO: 541914 - protein, 9 aa, Homo Sapiens
MEVVGSSGQ

SEQ ID NO: 541915 - protein, 9 aa, Homo Sapiens
IKESGIQFN

SEQ ID NO: 541916 - protein, 9 aa, Homo Sapiens
GAGRLDLGR

SEQ ID NO: 541917 - protein, 9 aa, Homo Sapiens
IDAKFCMKG

SEQ ID NO: 541918 - protein, 9 aa, Homo Sapiens
DVIPGGCRR

SEQ ID NO: 541919 - protein, 9 aa, Homo Sapiens
LKKELKVGP

SEQ ID NO: 541920 - protein, 9 aa, Homo Sapiens
PPSRTWSPP

SEQ ID NO: 541921 - protein, 9 aa, Homo Sapiens
SPDVCGNLD

SEQ ID NO: 541922 - protein, 9 aa, Homo Sapiens
SCDVIPGGC

SEQ ID NO: 541923 - protein, 9 aa, Homo Sapiens
GPSKSRQLD

SEQ ID NO: 541924 - protein, 9 aa, Homo Sapiens
ISSEDLKAQ

SEQ ID NO: 541925 - protein, 9 aa, Homo Sapiens
HLVSGQALQ

SEQ ID NO: 541926 - protein, 9 aa, Homo Sapiens
RAMDTLDIE

SEQ ID NO: 541927 - protein, 9 aa, Homo Sapiens
FAPLHSALG

SEQ ID NO: 541928 - protein, 9 aa, Homo Sapiens
IGLPSEASD

SEQ ID NO: 541929 - protein, 9 aa, Homo Sapiens
CTQRFCIKD

SEQ ID NO: 541930 - protein, 9 aa, Homo Sapiens
NTETVTLNF

SEQ ID NO: 541931 - protein, 9 aa, Homo Sapiens
TVQPQPLPG

SEQ ID NO: 541932 - protein, 9 aa, Homo Sapiens
RPPMSPAPC

SEQ ID NO: 541933 - protein, 9 aa, Homo Sapiens
HLPVGHPQV

SEQ ID NO: 541934 - protein, 9 aa, Homo Sapiens
QHKDPRVQE

SEQ ID NO: 541935 - protein, 9 aa, Homo Sapiens
ELFALEHLH

SEQ ID NO: 541936 - protein, 9 aa, Homo Sapiens
VLLRLPAAR

SEQ ID NO: 541937 - protein, 9 aa, Homo Sapiens
FLFATVSNG

SEQ ID NO: 541938 - protein, 9 aa, Homo Sapiens
AGRLDLGRG

SEQ ID NO: 541939 - protein, 9 aa, Homo Sapiens
KREVSVSDQ

SEQ ID NO: 541940 - protein, 9 aa, Homo Sapiens
RSCVRESSC

SEQ ID NO: 541941 - protein, 9 aa, Homo Sapiens
PRNTETVTL

SEQ ID NO: 541942 - protein, 9 aa, Homo Sapiens
GSNQKALKY

SEQ ID NO: 541943 - protein, 9 aa, Homo Sapiens
QYIAICYPL

SEQ ID NO: 541944 - protein, 9 aa, Homo Sapiens
DNPIHESTW

SEQ ID NO: 541945 - protein, 9 aa, Homo Sapiens
EACGGHSYL

SEQ ID NO: 541946 - protein, 9 aa, Homo Sapiens
QIQGCQGEA

SEQ ID NO: 541947 - protein, 9 aa, Homo Sapiens
QDLLRVPAP

SEQ ID NO: 541948 - protein, 9 aa, Homo Sapiens
PQGVCALPL

SEQ ID NO: 541949 - protein, 9 aa, Homo Sapiens
RGLGAPVPL

SEQ ID NO: 541950 - protein, 9 aa, Homo Sapiens
EFIQYEADR

SEQ ID NO: 541951 - protein, 9 aa, Homo Sapiens
LPFAPLHSA

SEQ ID NO: 541952 - protein, 9 aa, Homo Sapiens
VRAMDTLDI

SEQ ID NO: 541953 - protein, 9 aa, Homo Sapiens
VPLQQPPKG

SEQ ID NO: 541954 - protein, 9 aa, Homo Sapiens
QYDNMGRVL

SEQ ID NO: 541955 - protein, 9 aa, Homo Sapiens
CRRGPVQQV

SEQ ID NO: 541956 - protein, 9 aa, Homo Sapiens
GGLLDYTSY

SEQ ID NO: 541957 - protein, 9 aa, Homo Sapiens
RFIFQKKLA

SEQ ID NO: 541958 - protein, 9 aa, Homo Sapiens
HTQQVALRQ

SEQ ID NO: 541959 - protein, 9 aa, Homo Sapiens
QVQGHGWPV

SEQ ID NO: 541960 - protein, 9 aa, Homo Sapiens
QKKLAQALL

SEQ ID NO: 541961 - protein, 9 aa, Homo Sapiens
CESFLQQQL

SEQ ID NO: 541962 - protein, 9 aa, Homo Sapiens
YICTQLMEE

SEQ ID NO: 541963 - protein, 9 aa, Homo Sapiens
QNMEYCDYR

SEQ ID NO: 541964 - protein, 9 aa, Homo Sapiens
AYLGAGVAH

SEQ ID NO: 541965 - protein, 9 aa, Homo Sapiens
NFFLLHYKR

SEQ ID NO: 541966 - protein, 9 aa, Homo Sapiens
QRWIPCPRC

SEQ ID NO: 541967 - protein, 9 aa, Homo Sapiens
YLLHILQVR

SEQ ID NO: 541968 - protein, 9 aa, Homo Sapiens
FSIKGGSRS

SEQ ID NO: 541969 - protein, 9 aa, Homo Sapiens
RQLHGDRLE

SEQ ID NO: 541970 - protein, 9 aa, Homo Sapiens
TDRMLSALQ

SEQ ID NO: 541971 - protein, 9 aa, Homo Sapiens
HPQVQGHGW

SEQ ID NO: 541972 - protein, 9 aa, Homo Sapiens
LAGGCAGSS

SEQ ID NO: 541973 - protein, 9 aa, Homo Sapiens
PHSLSLPVQ

SEQ ID NO: 541974 - protein, 9 aa, Homo Sapiens
GAVQTEACD

SEQ ID NO: 541975 - protein, 9 aa, Homo Sapiens
TLLAHLRAL

SEQ ID NO: 541976 - protein, 9 aa, Homo Sapiens
KGLKPPSRT

SEQ ID NO: 541977 - protein, 9 aa, Homo Sapiens
VRESSCFTE

SEQ ID NO: 541978 - protein, 9 aa, Homo Sapiens
AQDNPKYAT

SEQ ID NO: 541979 - protein, 9 aa, Homo Sapiens
QRWLAAGRP

SEQ ID NO: 541980 - protein, 9 aa, Homo Sapiens
SSFSGTIVQ

SEQ ID NO: 541981 - protein, 9 aa, Homo Sapiens
TAGSTWHEA

SEQ ID NO: 541982 - protein, 9 aa, Homo Sapiens
MTLSERFTS

SEQ ID NO: 541983 - protein, 9 aa, Homo Sapiens
PGSLSLLGH

SEQ ID NO: 541984 - protein, 9 aa, Homo Sapiens
NPRNTETVT

SEQ ID NO: 541985 - protein, 9 aa, Homo Sapiens
PQPLPGLPS

SEQ ID NO: 541986 - protein, 9 aa, Homo Sapiens
TQQVALRQK

SEQ ID NO: 541987 - protein, 9 aa, Homo Sapiens
KPPSRTWSP

SEQ ID NO: 541988 - protein, 9 aa, Homo Sapiens
HPHRHRATV

SEQ ID NO: 541989 - protein, 9 aa, Homo Sapiens
GCAGSSQVI

SEQ ID NO: 541990 - protein, 9 aa, Homo Sapiens
LLHILQVRV

SEQ ID NO: 541991 - protein, 9 aa, Homo Sapiens
QASHTVLGG

SEQ ID NO: 541992 - protein, 9 aa, Homo Sapiens
LAAGRPGHP

SEQ ID NO: 541993 - protein, 9 aa, Homo Sapiens
VRSGGAIGV

SEQ ID NO: 541994 - protein, 9 aa, Homo Sapiens
IQYEADRTD

SEQ ID NO: 541995 - protein, 9 aa, Homo Sapiens
KYATEQSGT

SEQ ID NO: 541996 - protein, 9 aa, Homo Sapiens
VPAPLQSDE

SEQ ID NO: 541997 - protein, 9 aa, Homo Sapiens
ILAFEYSPS

SEQ ID NO: 541998 - protein, 9 aa, Homo Sapiens
NVIDAKFCM

SEQ ID NO: 541999 - protein, 9 aa, Homo Sapiens
MRNYRGRQY

SEQ ID NO: 542000 - protein, 9 aa, Homo Sapiens
YSDYLRCES

SEQ ID NO: 542001 - protein, 9 aa, Homo Sapiens
ETVTLNFRG

SEQ ID NO: 542002 - protein, 9 aa, Homo Sapiens
TEARMMAAE

SEQ ID NO: 542003 - protein, 9 aa, Homo Sapiens
SPEERRQNY

SEQ ID NO: 542004 - protein, 9 aa, Homo Sapiens
AGLGISQIQ

SEQ ID NO: 542005 - protein, 9 aa, Homo Sapiens
YALKDSILK

SEQ ID NO: 542006 - protein, 9 aa, Homo Sapiens
RGKGVFSIK

SEQ ID NO: 542007 - protein, 9 aa, Homo Sapiens
LPSQASHTV

SEQ ID NO: 542008 - protein, 9 aa, Homo Sapiens
LVSGQALQQ

SEQ ID NO: 542009 - protein, 9 aa, Homo Sapiens
SNGEQEDLC

SEQ ID NO: 542010 - protein, 9 aa, Homo Sapiens
IPELVPDAL

SEQ ID NO: 542011 - protein, 9 aa, Homo Sapiens
QFVHYALKD

SEQ ID NO: 542012 - protein, 9 aa, Homo Sapiens
CFTECRGYF

SEQ ID NO: 542013 - protein, 9 aa, Homo Sapiens
PELVPDALH

SEQ ID NO: 542014 - protein, 9 aa, Homo Sapiens
SPRLPFAPL

SEQ ID NO: 542015 - protein, 9 aa, Homo Sapiens
LRCESFLQQ

SEQ ID NO: 542016 - protein, 9 aa, Homo Sapiens
GELQDHLSC

SEQ ID NO: 542017 - protein, 9 aa, Homo Sapiens
SALHTVRAV

SEQ ID NO: 542018 - protein, 9 aa, Homo Sapiens
VHYALKDSI

SEQ ID NO: 542019 - protein, 9 aa, Homo Sapiens
DCSQSQDAG

SEQ ID NO: 542020 - protein, 9 aa, Homo Sapiens
QAYKTVGPG

SEQ ID NO: 542021 - protein, 9 aa, Homo Sapiens
AMTLSERFT

SEQ ID NO: 542022 - protein, 9 aa, Homo Sapiens
ALRQKAGLG

SEQ ID NO: 542023 - protein, 9 aa, Homo Sapiens
PPMSPAPCP

SEQ ID NO: 542024 - protein, 9 aa, Homo Sapiens
VCDCDQQID

SEQ ID NO: 542025 - protein, 9 aa, Homo Sapiens
VLLYAMRGI

SEQ ID NO: 542026 - protein, 9 aa, Homo Sapiens
CYLGLGHLD

SEQ ID NO: 542027 - protein, 9 aa, Homo Sapiens
NLQVSPLAV

SEQ ID NO: 542028 - protein, 9 aa, Homo Sapiens
IPGGCRRGP

SEQ ID NO: 542029 - protein, 9 aa, Homo Sapiens
HTVLGGVPE

SEQ ID NO: 542030 - protein, 9 aa, Homo Sapiens
TWELEVEDL

SEQ ID NO: 542031 - protein, 9 aa, Homo Sapiens
LSCDVIPGG

SEQ ID NO: 542032 - protein, 9 aa, Homo Sapiens
SGGAIGVVV

SEQ ID NO: 542033 - protein, 9 aa, Homo Sapiens
NRAGIGLPS

SEQ ID NO: 542034 - protein, 9 aa, Homo Sapiens
GGHSYLAMN

SEQ ID NO: 542035 - protein, 9 aa, Homo Sapiens
GPVQQVQAG

SEQ ID NO: 542036 - protein, 9 aa, Homo Sapiens
IQFNELEGQ

SEQ ID NO: 542037 - protein, 9 aa, Homo Sapiens
QVSPLAVDE

SEQ ID NO: 542038 - protein, 9 aa, Homo Sapiens
GVHLVSGQA

SEQ ID NO: 542039 - protein, 9 aa, Homo Sapiens
CDLEACVQV

SEQ ID NO: 542040 - protein, 9 aa, Homo Sapiens
FYPRPQNME

SEQ ID NO: 542041 - protein, 9 aa, Homo Sapiens
AAMTLSERF

SEQ ID NO: 542042 - protein, 9 aa, Homo Sapiens
TWHEAGLTT

SEQ ID NO: 542043 - protein, 9 aa, Homo Sapiens
YEADRTDDI

SEQ ID NO: 542044 - protein, 9 aa, Homo Sapiens
EASPPPWPL

SEQ ID NO: 542045 - protein, 9 aa, Homo Sapiens
TLDIEYGDK

SEQ ID NO: 542046 - protein, 9 aa, Homo Sapiens
TPSHTQQVA

SEQ ID NO: 542047 - protein, 9 aa, Homo Sapiens
HGWPVQTQT

SEQ ID NO: 542048 - protein, 9 aa, Homo Sapiens
CLKGLKPPS

SEQ ID NO: 542049 - protein, 9 aa, Homo Sapiens
HEAGLTTYF

SEQ ID NO: 542050 - protein, 9 aa, Homo Sapiens
PRCRQSTPT

SEQ ID NO: 542051 - protein, 9 aa, Homo Sapiens
QALQQDLLR

SEQ ID NO: 542052 - protein, 9 aa, Homo Sapiens
AKSQESTDS

SEQ ID NO: 542053 - protein, 9 aa, Homo Sapiens
SSRVCDCDQ

SEQ ID NO: 542054 - protein, 9 aa, Homo Sapiens
SNQKALKYL

SEQ ID NO: 542055 - protein, 9 aa, Homo Sapiens
LVMAFDQYI

SEQ ID NO: 542056 - protein, 9 aa, Homo Sapiens
QKALKYLGQ

SEQ ID NO: 542057 - protein, 9 aa, Homo Sapiens
YWCGPRPPM

SEQ ID NO: 542058 - protein, 9 aa, Homo Sapiens
TTMEVVGSS

SEQ ID NO: 542059 - protein, 9 aa, Homo Sapiens
ALEHLHRVR

SEQ ID NO: 542060 - protein, 9 aa, Homo Sapiens
AALEGRKEL

SEQ ID NO: 542061 - protein, 9 aa, Homo Sapiens
LRLPAARLL

SEQ ID NO: 542062 - protein, 9 aa, Homo Sapiens
RMMAAEVLS

SEQ ID NO: 542063 - protein, 9 aa, Homo Sapiens
TPTNTTMEV

SEQ ID NO: 542064 - protein, 9 aa, Homo Sapiens
NQKALKYLG

SEQ ID NO: 542065 - protein, 9 aa, Homo Sapiens
PKYATEQSG

SEQ ID NO: 542066 - protein, 9 aa, Homo Sapiens
CGPRPPMSP

SEQ ID NO: 542067 - protein, 9 aa, Homo Sapiens
QVGELQDHL

SEQ ID NO: 542068 - protein, 9 aa, Homo Sapiens
LDQVQRLGS

SEQ ID NO: 542069 - protein, 9 aa, Homo Sapiens
AMDTLDIEY

SEQ ID NO: 542070 - protein, 9 aa, Homo Sapiens
LQVSPLAVD

SEQ ID NO: 542071 - protein, 9 aa, Homo Sapiens
SSCFTECRG

SEQ ID NO: 542072 - protein, 9 aa, Homo Sapiens
HYALKDSIL

SEQ ID NO: 542073 - protein, 9 aa, Homo Sapiens
LNVIDAKFC

SEQ ID NO: 542074 - protein, 9 aa, Homo Sapiens
QPQPLPGLP

SEQ ID NO: 542075 - protein, 9 aa, Homo Sapiens
EDRASSFSG

SEQ ID NO: 542076 - protein, 9 aa, Homo Sapiens
ENRAGIGLP

SEQ ID NO: 542077 - protein, 9 aa, Homo Sapiens
PIHESTWEL

SEQ ID NO: 542078 - protein, 9 aa, Homo Sapiens
QGVCALPLP

SEQ ID NO: 542079 - protein, 9 aa, Homo Sapiens
TVTLNFRGE

SEQ ID NO: 542080 - protein, 9 aa, Homo Sapiens
QMFAAFSPD

SEQ ID NO: 542081 - protein, 9 aa, Homo Sapiens
YLRCESFLQ

SEQ ID NO: 542082 - protein, 9 aa, Homo Sapiens
HHAYLGAGV

SEQ ID NO: 542083 - protein, 9 aa, Homo Sapiens
VQTEACDAR

SEQ ID NO: 542084 - protein, 9 aa, Homo Sapiens
FFLLHYKRE

SEQ ID NO: 542085 - protein, 9 aa, Homo Sapiens
WSPWSPWLA

SEQ ID NO: 542086 - protein, 9 aa, Homo Sapiens
CGGHSYLAM

SEQ ID NO: 542087 - protein, 9 aa, Homo Sapiens
HYKREVSVS

SEQ ID NO: 542088 - protein, 9 aa, Homo Sapiens
ASPPPWPLG

SEQ ID NO: 542089 - protein, 9 aa, Homo Sapiens
EDKADSALH

SEQ ID NO: 542090 - protein, 9 aa, Homo Sapiens
GKGVFSIKG

SEQ ID NO: 542091 - protein, 9 aa, Homo Sapiens
AAGRPGHPP

SEQ ID NO: 542092 - protein, 9 aa, Homo Sapiens
WPLGPSKSR

SEQ ID NO: 542093 - protein, 9 aa, Homo Sapiens
PRPQNMEYC

SEQ ID NO: 542094 - protein, 9 aa, Homo Sapiens
ERRQNYVSD

SEQ ID NO: 542095 - protein, 9 aa, Homo Sapiens
GIQFNELEG

SEQ ID NO: 542096 - protein, 9 aa, Homo Sapiens
MSPAPCPTP

SEQ ID NO: 542097 - protein, 9 aa, Homo Sapiens
PDLLHQLIT

SEQ ID NO: 542098 - protein, 9 aa, Homo Sapiens
YTSYCYTLE

SEQ ID NO: 542099 - protein, 9 aa, Homo Sapiens
LLDYTSYCY

SEQ ID NO: 542100 - protein, 9 aa, Homo Sapiens
DALHLPVGH

SEQ ID NO: 542101 - protein, 9 aa, Homo Sapiens
NTEARMMAA

SEQ ID NO: 542102 - protein, 9 aa, Homo Sapiens
HRVRGLGAP

SEQ ID NO: 542103 - protein, 9 aa, Homo Sapiens
PGEVCDLEA

SEQ ID NO: 542104 - protein, 9 aa, Homo Sapiens
TEPPVVCSY

SEQ ID NO: 542105 - protein, 9 aa, Homo Sapiens
NTLGCLQLN

SEQ ID NO: 542106 - protein, 9 aa, Homo Sapiens
YATEQSGTG

SEQ ID NO: 542107 - protein, 9 aa, Homo Sapiens
RPQNMEYCD

SEQ ID NO: 542108 - protein, 9 aa, Homo Sapiens
IIPELVPDA

SEQ ID NO: 542109 - protein, 9 aa, Homo Sapiens
IQIIPELVP

SEQ ID NO: 542110 - protein, 9 aa, Homo Sapiens
HNPRNTETV

SEQ ID NO: 542111 - protein, 9 aa, Homo Sapiens
PTLLAHLRA

SEQ ID NO: 542112 - protein, 9 aa, Homo Sapiens
TVLGGVPEP

SEQ ID NO: 542113 - protein, 9 aa, Homo Sapiens
TEVCMVSDL

SEQ ID NO: 542114 - protein, 9 aa, Homo Sapiens
YKTVGPGIL

SEQ ID NO: 542115 - protein, 9 aa, Homo Sapiens
LLYAMRGIN

SEQ ID NO: 542116 - protein, 9 aa, Homo Sapiens
AGRPGHPPG

SEQ ID NO: 542117 - protein, 9 aa, Homo Sapiens
ARGQRQLHG

SEQ ID NO: 542118 - protein, 9 aa, Homo Sapiens
ESTDSKKVL

SEQ ID NO: 542119 - protein, 9 aa, Homo Sapiens
GISQIQGCQ

SEQ ID NO: 542120 - protein, 9 aa, Homo Sapiens
LDIEYGDKE

SEQ ID NO: 542121 - protein, 9 aa, Homo Sapiens
WLAAGRPGH

SEQ ID NO: 542122 - protein, 9 aa, Homo Sapiens
GGVHLVSGQ

SEQ ID NO: 542123 - protein, 9 aa, Homo Sapiens
GRLDLGRGG

SEQ ID NO: 542124 - protein, 9 aa, Homo Sapiens
DTSQSSRVC

SEQ ID NO: 542125 - protein, 9 aa, Homo Sapiens
VSGQALQQD

SEQ ID NO: 542126 - protein, 9 aa, Homo Sapiens
QSGHPQGVC

SEQ ID NO: 542127 - protein, 9 aa, Homo Sapiens
ATATQFVHY

SEQ ID NO: 542128 - protein, 9 aa, Homo Sapiens
PFAPLHSAL

SEQ ID NO: 542129 - protein, 9 aa, Homo Sapiens
LGCLQLNNI

SEQ ID NO: 542130 - protein, 9 aa, Homo Sapiens
SSQVIFTNP

SEQ ID NO: 542131 - protein, 9 aa, Homo Sapiens
FIQYEADRT

SEQ ID NO: 542132 - protein, 9 aa, Homo Sapiens
WPVQTQTPS

SEQ ID NO: 542133 - protein, 9 aa, Homo Sapiens
IQGCQGEAS

SEQ ID NO: 542134 - protein, 9 aa, Homo Sapiens
GSLSLLGHP

SEQ ID NO: 542135 - protein, 9 aa, Homo Sapiens
EARLWRGRQ

SEQ ID NO: 542136 - protein, 9 aa, Homo Sapiens
NGEQEDLCR

SEQ ID NO: 542137 - protein, 9 aa, Homo Sapiens
PHRHRATVE

SEQ ID NO: 542138 - protein, 9 aa, Homo Sapiens
KGSISSEDL

SEQ ID NO: 542139 - protein, 9 aa, Homo Sapiens
GAIGVVVKG

SEQ ID NO: 542140 - protein, 9 aa, Homo Sapiens
AGIGLPSEA

SEQ ID NO: 542141 - protein, 9 aa, Homo Sapiens
PVQTQTPSH

SEQ ID NO: 542142 - protein, 9 aa, Homo Sapiens
DRASSFSGT

SEQ ID NO: 542143 - protein, 9 aa, Homo Sapiens
KAGLGISQI

SEQ ID NO: 542144 - protein, 9 aa, Homo Sapiens
RLSPRLPFA

SEQ ID NO: 542145 - protein, 9 aa, Homo Sapiens
LGHPHRHRA

SEQ ID NO: 542146 - protein, 9 aa, Homo Sapiens
SHTVLGGVP

SEQ ID NO: 542147 - protein, 9 aa, Homo Sapiens
TQFVHYALK

SEQ ID NO: 542148 - protein, 9 aa, Homo Sapiens
TQRDEIDQQ

SEQ ID NO: 542149 - protein, 9 aa, Homo Sapiens
ALHTVRAVS

SEQ ID NO: 542150 - protein, 9 aa, Homo Sapiens
TRFIFQKKL

SEQ ID NO: 542151 - protein, 9 aa, Homo Sapiens
ILAGGCAGS

SEQ ID NO: 542152 - protein, 9 aa, Homo Sapiens
NYVSDFPPP

SEQ ID NO: 542153 - protein, 9 aa, Homo Sapiens
DYCLKGLKP

SEQ ID NO: 542154 - protein, 9 aa, Homo Sapiens
VIPGGCRRG

SEQ ID NO: 542155 - protein, 9 aa, Homo Sapiens
SLLGHPHRH

SEQ ID NO: 542156 - protein, 9 aa, Homo Sapiens
RNTETVTLN

SEQ ID NO: 542157 - protein, 9 aa, Homo Sapiens
LAALASPTD

SEQ ID NO: 542158 - protein, 9 aa, Homo Sapiens
HPHPHHAYL

SEQ ID NO: 542159 - protein, 9 aa, Homo Sapiens
QSDEVHTVQ

SEQ ID NO: 542160 - protein, 9 aa, Homo Sapiens
FLLHYKREV

SEQ ID NO: 542161 - protein, 9 aa, Homo Sapiens
GGHVYLLHI

SEQ ID NO: 542162 - protein, 9 aa, Homo Sapiens
QTQTPSHTQ

SEQ ID NO: 542163 - protein, 9 aa, Homo Sapiens
PGGCRRGPV

SEQ ID NO: 542164 - protein, 9 aa, Homo Sapiens
VTEPPVVCS

SEQ ID NO: 542165 - protein, 9 aa, Homo Sapiens
WIIALPLKT

SEQ ID NO: 542166 - protein, 9 aa, Homo Sapiens
FDQYIAICY

SEQ ID NO: 542167 - protein, 9 aa, Homo Sapiens
SISSEDLKA

SEQ ID NO: 542168 - protein, 9 aa, Homo Sapiens
TEFIQYEAD

SEQ ID NO: 542169 - protein, 9 aa, Homo Sapiens
QSSRVCDCD

SEQ ID NO: 542170 - protein, 9 aa, Homo Sapiens
FALEHLHRV

SEQ ID NO: 542171 - protein, 9 aa, Homo Sapiens
QNYVSDFPP

SEQ ID NO: 542172 - protein, 9 aa, Homo Sapiens
PEERRQNYV

SEQ ID NO: 542173 - protein, 9 aa, Homo Sapiens
ESSCFTECR

SEQ ID NO: 542174 - protein, 9 aa, Homo Sapiens
LDYTSYCYT

SEQ ID NO: 542175 - protein, 9 aa, Homo Sapiens
PFLSCYLGL

SEQ ID NO: 542176 - protein, 9 aa, Homo Sapiens
RFCIKDCPY

SEQ ID NO: 542177 - protein, 9 aa, Homo Sapiens
AMRGINISN

SEQ ID NO: 542178 - protein, 9 aa, Homo Sapiens
LAPHSLSLP

SEQ ID NO: 542179 - protein, 9 aa, Homo Sapiens
SPLAVDEMH

SEQ ID NO: 542180 - protein, 9 aa, Homo Sapiens
SQSSRVCDC

SEQ ID NO: 542181 - protein, 9 aa, Homo Sapiens
CDARGQRQL

SEQ ID NO: 542182 - protein, 9 aa, Homo Sapiens
GPRPPMSPA

SEQ ID NO: 542183 - protein, 9 aa, Homo Sapiens
QVQRLGSLP

SEQ ID NO: 542184 - protein, 9 aa, Homo Sapiens
HQLITIMNP

SEQ ID NO: 542185 - protein, 9 aa, Homo Sapiens
DEVHTVQPQ

SEQ ID NO: 542186 - protein, 9 aa, Homo Sapiens
NNIKLNDDN

SEQ ID NO: 542187 - protein, 9 aa, Homo Sapiens
KALKYLGQD

SEQ ID NO: 542188 - protein, 9 aa, Homo Sapiens
VCSYFAQDL

SEQ ID NO: 542189 - protein, 9 aa, Homo Sapiens
MRGINISNR

SEQ ID NO: 542190 - protein, 9 aa, Homo Sapiens
GEQEDLCRG

SEQ ID NO: 542191 - protein, 9 aa, Homo Sapiens
PAPLQSDEV

SEQ ID NO: 542192 - protein, 9 aa, Homo Sapiens
RRGPVQQVQ

SEQ ID NO: 542193 - protein, 9 aa, Homo Sapiens
ITIMNPNVL

SEQ ID NO: 542194 - protein, 9 aa, Homo Sapiens
EEGRAEWAV

SEQ ID NO: 542195 - protein, 9 aa, Homo Sapiens
LQSDEVHTV

SEQ ID NO: 542196 - protein, 9 aa, Homo Sapiens
SERFTSYQK

SEQ ID NO: 542197 - protein, 9 aa, Homo Sapiens
GQALQQDLL

SEQ ID NO: 542198 - protein, 9 aa, Homo Sapiens
IFYPRPQNM

SEQ ID NO: 542199 - protein, 9 aa, Homo Sapiens
RGINISNRI

SEQ ID NO: 542200 - protein, 9 aa, Homo Sapiens
NITAEDCSQ

SEQ ID NO: 542201 - protein, 9 aa, Homo Sapiens
QQQEEMALT

SEQ ID NO: 542202 - protein, 9 aa, Homo Sapiens
QRDEIDQQQ

SEQ ID NO: 542203 - protein, 9 aa, Homo Sapiens
SIHVDAALE

SEQ ID NO: 542204 - protein, 9 aa, Homo Sapiens
QGTFQAYKT

SEQ ID NO: 542205 - protein, 9 aa, Homo Sapiens
RVEDKADSA

SEQ ID NO: 542206 - protein, 9 aa, Homo Sapiens
SAVSSVLLR

SEQ ID NO: 542207 - protein, 9 aa, Homo Sapiens
TEACDARGQ

SEQ ID NO: 542208 - protein, 9 aa, Homo Sapiens
VLGGVPEPV

SEQ ID NO: 542209 - protein, 9 aa, Homo Sapiens
CSYFAQDLW

SEQ ID NO: 542210 - protein, 9 aa, Homo Sapiens
QESTDSKKV

SEQ ID NO: 542211 - protein, 9 aa, Homo Sapiens
SWILYEMRN

SEQ ID NO: 542212 - protein, 9 aa, Homo Sapiens
FCIKDCPYR

SEQ ID NO: 542213 - protein, 9 aa, Homo Sapiens
RSGGAIGVV

SEQ ID NO: 542214 - protein, 9 aa, Homo Sapiens
LQVRVEDKA

SEQ ID NO: 542215 - protein, 9 aa, Homo Sapiens
QRFCIKDCP

SEQ ID NO: 542216 - protein, 9 aa, Homo Sapiens
PLPGLPSQA

SEQ ID NO: 542217 - protein, 9 aa, Homo Sapiens
SPPPWPLGP

SEQ ID NO: 542218 - protein, 9 aa, Homo Sapiens
MMAAEVLSR

SEQ ID NO: 542219 - protein, 9 aa, Homo Sapiens
LLIQIIPEL

SEQ ID NO: 542220 - protein, 9 aa, Homo Sapiens
RPAKSQEST

SEQ ID NO: 542221 - protein, 9 aa, Homo Sapiens
MEYCDYRKH

SEQ ID NO: 542222 - protein, 9 aa, Homo Sapiens
AENRAGIGL

SEQ ID NO: 542223 - protein, 9 aa, Homo Sapiens
LHTVRAVSI

SEQ ID NO: 542224 - protein, 9 aa, Homo Sapiens
SSEDLKAQS

SEQ ID NO: 542225 - protein, 9 aa, Homo Sapiens
FAAFSPDVC

SEQ ID NO: 542226 - protein, 9 aa, Homo Sapiens
YQGTFQAYK

SEQ ID NO: 542227 - protein, 9 aa, Homo Sapiens
LLRLPAARL

SEQ ID NO: 542228 - protein, 9 aa, Homo Sapiens
LQRWLAAGR

SEQ ID NO: 542229 - protein, 9 aa, Homo Sapiens
WLACTVTCA

SEQ ID NO: 542230 - protein, 9 aa, Homo Sapiens
RLWRGRQTP

SEQ ID NO: 542231 - protein, 9 aa, Homo Sapiens
RLGSLPPRQ

SEQ ID NO: 542232 - protein, 9 aa, Homo Sapiens
VEGHLAPHS

SEQ ID NO: 542233 - protein, 9 aa, Homo Sapiens
ADSALHTVR

SEQ ID NO: 542234 - protein, 9 aa, Homo Sapiens
RLPAARLLE

SEQ ID NO: 542235 - protein, 9 aa, Homo Sapiens
GGCAGSSQV

SEQ ID NO: 542236 - protein, 9 aa, Homo Sapiens
TAEDCSQSQ

SEQ ID NO: 542237 - protein, 9 aa, Homo Sapiens
EQHKDPRVQ

SEQ ID NO: 542238 - protein, 9 aa, Homo Sapiens
VLNTEARMM

SEQ ID NO: 542239 - protein, 9 aa, Homo Sapiens
YDNMGRVLK

SEQ ID NO: 542240 - protein, 9 aa, Homo Sapiens
TFQAYKTVG

SEQ ID NO: 542241 - protein, 9 aa, Homo Sapiens
GEASPPPWP

SEQ ID NO: 542242 - protein, 9 aa, Homo Sapiens
FKSAAMTLS

SEQ ID NO: 542243 - protein, 9 aa, Homo Sapiens
AEDCSQSQD

SEQ ID NO: 542244 - protein, 9 aa, Homo Sapiens
WAVAVSGMQ

SEQ ID NO: 542245 - protein, 9 aa, Homo Sapiens
FQKKLAQAL

SEQ ID NO: 542246 - protein, 9 aa, Homo Sapiens
RGPVQQVQA

SEQ ID NO: 542247 - protein, 9 aa, Homo Sapiens
RQNYVSDFP

SEQ ID NO: 542248 - protein, 9 aa, Homo Sapiens
VSPLAVDEM

SEQ ID NO: 542249 - protein, 9 aa, Homo Sapiens
CVQVGELQD

SEQ ID NO: 542250 - protein, 9 aa, Homo Sapiens
AYKTVGPGI

SEQ ID NO: 542251 - protein, 9 aa, Homo Sapiens
LHQLITIMN

SEQ ID NO: 542252 - protein, 9 aa, Homo Sapiens
GPPLPPQPP

SEQ ID NO: 542253 - protein, 9 aa, Homo Sapiens
PQPPPAWRH

SEQ ID NO: 542254 - protein, 9 aa, Homo Sapiens
FVHYALKDS

SEQ ID NO: 542255 - protein, 9 aa, Homo Sapiens
SDYLRCESF

SEQ ID NO: 542256 - protein, 9 aa, Homo Sapiens
HTPTLLAHL

SEQ ID NO: 542257 - protein, 9 aa, Homo Sapiens
SAAMTLSER

SEQ ID NO: 542258 - protein, 9 aa, Homo Sapiens
RVPAPLQSD

SEQ ID NO: 542259 - protein, 9 aa, Homo Sapiens
VCALPLPGS

SEQ ID NO: 542260 - protein, 9 aa, Homo Sapiens
RFLGGLLDY

SEQ ID NO: 542261 - protein, 9 aa, Homo Sapiens
ATVSNGEQE

SEQ ID NO: 542262 - protein, 9 aa, Homo Sapiens
ASPTDRMLS

SEQ ID NO: 542263 - protein, 9 aa, Homo Sapiens
AGAVQTEAC

SEQ ID NO: 542264 - protein, 9 aa, Homo Sapiens
QSGGHVYLL

SEQ ID NO: 542265 - protein, 9 aa, Homo Sapiens
STWHEAGLT

SEQ ID NO: 542266 - protein, 9 aa, Homo Sapiens
LWRGRQTPG

SEQ ID NO: 542267 - protein, 9 aa, Homo Sapiens
LGSLPPRQV

SEQ ID NO: 542268 - protein, 9 aa, Homo Sapiens
LYEMRNYRG

SEQ ID NO: 542269 - protein, 9 aa, Homo Sapiens
ESGIQFNEL

SEQ ID NO: 542270 - protein, 9 aa, Homo Sapiens
VGELQDHLS

SEQ ID NO: 542271 - protein, 9 aa, Homo Sapiens
SDLEDLSAS

SEQ ID NO: 542272 - protein, 9 aa, Homo Sapiens
FEYSPSPPR

SEQ ID NO: 542273 - protein, 9 aa, Homo Sapiens
ICTQLMEEA

SEQ ID NO: 542274 - protein, 9 aa, Homo Sapiens
SEDLKAQSN

SEQ ID NO: 542275 - protein, 9 aa, Homo Sapiens
HVDAALEGR

SEQ ID NO: 542276 - protein, 9 aa, Homo Sapiens
ASHAPFLSC

SEQ ID NO: 542277 - protein, 9 aa, Homo Sapiens
ISQIQGCQG

SEQ ID NO: 542278 - protein, 9 aa, Homo Sapiens
LHRVRGLGA

SEQ ID NO: 542279 - protein, 9 aa, Homo Sapiens
PVQQVQAGA

SEQ ID NO: 542280 - protein, 9 aa, Homo Sapiens
APHSLSLPV

SEQ ID NO: 542281 - protein, 9 aa, Homo Sapiens
PPKGGVHLV

SEQ ID NO: 542282 - protein, 9 aa, Homo Sapiens
TLSERFTSY

SEQ ID NO: 542283 - protein, 9 aa, Homo Sapiens
ASHTVLGGV

SEQ ID NO: 542284 - protein, 9 aa, Homo Sapiens
RWSPWSPWL

SEQ ID NO: 542285 - protein, 9 aa, Homo Sapiens
DRLEEAGGT

SEQ ID NO: 542286 - protein, 9 aa, Homo Sapiens
CIKDCPYRS

SEQ ID NO: 542287 - protein, 9 aa, Homo Sapiens
PPQPPPAWR

SEQ ID NO: 542288 - protein, 9 aa, Homo Sapiens
CALPLPGSL

SEQ ID NO: 542289 - protein, 9 aa, Homo Sapiens
GLPSEASDS

SEQ ID NO: 542290 - protein, 9 aa, Homo Sapiens
GRVLKKELK

SEQ ID NO: 542291 - protein, 9 aa, Homo Sapiens
PCPRCRQST

SEQ ID NO: 542292 - protein, 9 aa, Homo Sapiens
DRNLQVSPL

SEQ ID NO: 542293 - protein, 9 aa, Homo Sapiens
LDGQSGHPQ

SEQ ID NO: 542294 - protein, 9 aa, Homo Sapiens
LITIMNPNV

SEQ ID NO: 542295 - protein, 9 aa, Homo Sapiens
RAEWAVAVS

SEQ ID NO: 542296 - protein, 9 aa, Homo Sapiens
GQRQLHGDR

SEQ ID NO: 542297 - protein, 9 aa, Homo Sapiens
LSCYLGLGH

SEQ ID NO: 542298 - protein, 9 aa, Homo Sapiens
MEEDRASSF

SEQ ID NO: 542299 - protein, 9 aa, Homo Sapiens
LNTEARMMA

SEQ ID NO: 542300 - protein, 9 aa, Homo Sapiens
PQVQGHGWP

SEQ ID NO: 542301 - protein, 9 aa, Homo Sapiens
QTEACDARG

SEQ ID NO: 542302 - protein, 9 aa, Homo Sapiens
GRAEWAVAV

SEQ ID NO: 542303 - protein, 9 aa, Homo Sapiens
HSLSLPVQS

SEQ ID NO: 542304 - protein, 9 aa, Homo Sapiens
EARMMAAEV

SEQ ID NO: 542305 - protein, 9 aa, Homo Sapiens
PVPLQQPPK

SEQ ID NO: 542306 - protein, 9 aa, Homo Sapiens
GHSYLAMNR

SEQ ID NO: 542307 - protein, 9 aa, Homo Sapiens
SSAGYICTQ

SEQ ID NO: 542308 - protein, 9 aa, Homo Sapiens
PLGPSKSRQ

SEQ ID NO: 542309 - protein, 9 aa, Homo Sapiens
LDLGRGGRA

SEQ ID NO: 542310 - protein, 9 aa, Homo Sapiens
RRGKGVFSI

SEQ ID NO: 542311 - protein, 9 aa, Homo Sapiens
SCTPTNTTM

SEQ ID NO: 542312 - protein, 9 aa, Homo Sapiens
YAMRGINIS

SEQ ID NO: 542313 - protein, 9 aa, Homo Sapiens
KKGSISSED

SEQ ID NO: 542314 - protein, 9 aa, Homo Sapiens
QDNPKYATE

SEQ ID NO: 542315 - protein, 9 aa, Homo Sapiens
QRQLHGDRL

SEQ ID NO: 542316 - protein, 9 aa, Homo Sapiens
TQRFCIKDC

SEQ ID NO: 542317 - protein, 9 aa, Homo Sapiens
PQNMEYCDY

SEQ ID NO: 542318 - protein, 9 aa, Homo Sapiens
LQQDLLRVP

SEQ ID NO: 542319 - protein, 9 aa, Homo Sapiens
QDHLSCDVI

SEQ ID NO: 542320 - protein, 9 aa, Homo Sapiens
EDCSQSQDA

SEQ ID NO: 542321 - protein, 9 aa, Homo Sapiens
QGLGSNQKA

SEQ ID NO: 542322 - protein, 9 aa, Homo Sapiens
ASSFSGTIV

SEQ ID NO: 542323 - protein, 9 aa, Homo Sapiens
KDCPYRSSH

SEQ ID NO: 542324 - protein, 9 aa, Homo Sapiens
AVLLYAMRG

SEQ ID NO: 542325 - protein, 9 aa, Homo Sapiens
SPTDRMLSA

SEQ ID NO: 542326 - protein, 9 aa, Homo Sapiens
DDAFVHTPT

SEQ ID NO: 542327 - protein, 9 aa, Homo Sapiens
SRQLDGQSG

SEQ ID NO: 542328 - protein, 9 aa, Homo Sapiens
CREACGGHS

SEQ ID NO: 542329 - protein, 9 aa, Homo Sapiens
KGGVHLVSG

SEQ ID NO: 542330 - protein, 9 aa, Homo Sapiens
RATVEGHLA

SEQ ID NO: 542331 - protein, 9 aa, Homo Sapiens
CSQSQDAGV

SEQ ID NO: 542332 - protein, 9 aa, Homo Sapiens
CAGSSQVIF

SEQ ID NO: 542333 - protein, 9 aa, Homo Sapiens
EAGLTTYFH

SEQ ID NO: 542334 - protein, 9 aa, Homo Sapiens
LPGLPSQAS

SEQ ID NO: 542335 - protein, 9 aa, Homo Sapiens
SGQALQQDL

SEQ ID NO: 542336 - protein, 9 aa, Homo Sapiens
PLPPQPPPA

SEQ ID NO: 542337 - protein, 9 aa, Homo Sapiens
KSAAMTLSE

SEQ ID NO: 542338 - protein, 9 aa, Homo Sapiens
RWIPCPRCR

SEQ ID NO: 542339 - protein, 9 aa, Homo Sapiens
HLAPHSLSL

SEQ ID NO: 542340 - protein, 9 aa, Homo Sapiens
FTEFIQYEA

SEQ ID NO: 542341 - protein, 9 aa, Homo Sapiens
QAGAVQTEA

SEQ ID NO: 542342 - protein, 9 aa, Homo Sapiens
TSLGQLRAH

SEQ ID NO: 542343 - protein, 9 aa, Homo Sapiens
HAPFLSCYL

SEQ ID NO: 542344 - protein, 9 aa, Homo Sapiens
WHEAGLTTY

SEQ ID NO: 542345 - protein, 9 aa, Homo Sapiens
VEDKADSAL

SEQ ID NO: 542346 - protein, 9 aa, Homo Sapiens
EACDARGQR

SEQ ID NO: 542347 - protein, 9 aa, Homo Sapiens
FQAYKTVGP

SEQ ID NO: 542348 - protein, 9 aa, Homo Sapiens
GCRRGPVQQ

SEQ ID NO: 542349 - protein, 9 aa, Homo Sapiens
EADRTDDID

SEQ ID NO: 542350 - protein, 9 aa, Homo Sapiens
IGQGPPLPP

SEQ ID NO: 542351 - protein, 9 aa, Homo Sapiens
IVRAMDTLD

SEQ ID NO: 542352 - protein, 9 aa, Homo Sapiens
VPDALHLPV

SEQ ID NO: 542353 - protein, 9 aa, Homo Sapiens
EHLHRVRGL

SEQ ID NO: 542354 - protein, 9 aa, Homo Sapiens
LSLLGHPHR

SEQ ID NO: 542355 - protein, 9 aa, Homo Sapiens
SYLAMNRLG

SEQ ID NO: 542356 - protein, 9 aa, Homo Sapiens
VQGHGWPVQ

SEQ ID NO: 542357 - protein, 9 aa, Homo Sapiens
ITAEDCSQS

SEQ ID NO: 542358 - protein, 9 aa, Homo Sapiens
GHLAPHSLS

SEQ ID NO: 542359 - protein, 9 aa, Homo Sapiens
LGSNQKALK

SEQ ID NO: 542360 - protein, 9 aa, Homo Sapiens
AAFSPDVCG

SEQ ID NO: 542361 - protein, 9 aa, Homo Sapiens
DKADSALHT

SEQ ID NO: 542362 - protein, 9 aa, Homo Sapiens
SHAPFLSCY

SEQ ID NO: 542363 - protein, 9 aa, Homo Sapiens
RAVSIHVDA

SEQ ID NO: 542364 - protein, 9 aa, Homo Sapiens
CPRCRQSTP

SEQ ID NO: 542365 - protein, 9 aa, Homo Sapiens
PEQHKDPRV

SEQ ID NO: 542366 - protein, 9 aa, Homo Sapiens
PWPLGPSKS

SEQ ID NO: 542367 - protein, 9 aa, Homo Sapiens
VRVEDKADS

SEQ ID NO: 542368 - protein, 9 aa, Homo Sapiens
LQLNNIKLN

SEQ ID NO: 542369 - protein, 9 aa, Homo Sapiens
GQSGHPQGV

SEQ ID NO: 542370 - protein, 9 aa, Homo Sapiens
QEEGRAEWA

SEQ ID NO: 542371 - protein, 9 aa, Homo Sapiens
GHPQVQGHG

SEQ ID NO: 542372 - protein, 9 aa, Homo Sapiens
LEEAGGTAL

SEQ ID NO: 542373 - protein, 9 aa, Homo Sapiens
PTDRMLSAL

SEQ ID NO: 542374 - protein, 9 aa, Homo Sapiens
LNNIKLNDD

SEQ ID NO: 542375 - protein, 9 aa, Homo Sapiens
VGLNVIDAK

SEQ ID NO: 542376 - protein, 9 aa, Homo Sapiens
AQEEGRAEW

SEQ ID NO: 542377 - protein, 9 aa, Homo Sapiens
FSPDVCGNL

SEQ ID NO: 542378 - protein, 9 aa, Homo Sapiens
HRHRATVEG

SEQ ID NO: 542379 - protein, 9 aa, Homo Sapiens
HPQGVCALP

SEQ ID NO: 542380 - protein, 9 aa, Homo Sapiens
DAKFCMKGE

SEQ ID NO: 542381 - protein, 9 aa, Homo Sapiens
AKFCMKGED

SEQ ID NO: 542382 - protein, 9 aa, Homo Sapiens
QPDLLHQLI

SEQ ID NO: 542383 - protein, 9 aa, Homo Sapiens
RRQNYVSDF

SEQ ID NO: 542384 - protein, 9 aa, Homo Sapiens
DQVQRLGSL

SEQ ID NO: 542385 - protein, 9 aa, Homo Sapiens
DEIDQQQEE

SEQ ID NO: 542386 - protein, 9 aa, Homo Sapiens
QQVQAGAVQ

SEQ ID NO: 542387 - protein, 9 aa, Homo Sapiens
FATVSNGEQ

SEQ ID NO: 542388 - protein, 9 aa, Homo Sapiens
GLGSNQKAL

SEQ ID NO: 542389 - protein, 9 aa, Homo Sapiens
SAPQLAPQV

SEQ ID NO: 542390 - protein, 9 aa, Homo Sapiens
TYQASSVAF

SEQ ID NO: 542391 - protein, 9 aa, Homo Sapiens
ILTLMGNLL

SEQ ID NO: 542392 - protein, 9 aa, Homo Sapiens
AVKVPTPPG

SEQ ID NO: 542393 - protein, 9 aa, Homo Sapiens
NRQLDDARV

SEQ ID NO: 542394 - protein, 9 aa, Homo Sapiens
ETQKEEETE

SEQ ID NO: 542395 - protein, 9 aa, Homo Sapiens
IPQSTLSDF

SEQ ID NO: 542396 - protein, 9 aa, Homo Sapiens
LRIVSEILK

SEQ ID NO: 542397 - protein, 9 aa, Homo Sapiens
KEIRIWAWK

SEQ ID NO: 542398 - protein, 9 aa, Homo Sapiens
NPDSLCLPR

SEQ ID NO: 542399 - protein, 9 aa, Homo Sapiens
PITAAAVKV

SEQ ID NO: 542400 - protein, 9 aa, Homo Sapiens
PQSTLSDFY

SEQ ID NO: 542401 - protein, 9 aa, Homo Sapiens
LQIRAIKKP

SEQ ID NO: 542402 - protein, 9 aa, Homo Sapiens
QSTLSDFYP

SEQ ID NO: 542403 - protein, 9 aa, Homo Sapiens
ILAIHIVAE

SEQ ID NO: 542404 - protein, 9 aa, Homo Sapiens
FGYILAIHI

SEQ ID NO: 542405 - protein, 9 aa, Homo Sapiens
GYILAIHIV

SEQ ID NO: 542406 - protein, 9 aa, Homo Sapiens
VPVRDKYHS

SEQ ID NO: 542407 - protein, 9 aa, Homo Sapiens
INEAVNYLT

SEQ ID NO: 542408 - protein, 9 aa, Homo Sapiens
AQIGPEKVK

SEQ ID NO: 542409 - protein, 9 aa, Homo Sapiens
VSLAIHFNT

SEQ ID NO: 542410 - protein, 9 aa, Homo Sapiens
SPITAAAVK

SEQ ID NO: 542411 - protein, 9 aa, Homo Sapiens
VLFLSFYIL

SEQ ID NO: 542412 - protein, 9 aa, Homo Sapiens
HTKISLSIQ

SEQ ID NO: 542413 - protein, 9 aa, Homo Sapiens
KEEETEKKD

SEQ ID NO: 542414 - protein, 9 aa, Homo Sapiens
YQASSVAFR

SEQ ID NO: 542415 - protein, 9 aa, Homo Sapiens
EILKDHSKA

SEQ ID NO: 542416 - protein, 9 aa, Homo Sapiens
LLLRIVSEI

SEQ ID NO: 542417 - protein, 9 aa, Homo Sapiens
RIWAWKDAI

SEQ ID NO: 542418 - protein, 9 aa, Homo Sapiens
FLSFYILTL

SEQ ID NO: 542419 - protein, 9 aa, Homo Sapiens
SFKLMETQK

SEQ ID NO: 542420 - protein, 9 aa, Homo Sapiens
KCTVSLHFI

SEQ ID NO: 542421 - protein, 9 aa, Homo Sapiens
KGEKFRPFA

SEQ ID NO: 542422 - protein, 9 aa, Homo Sapiens
LHFIRAIAR

SEQ ID NO: 542423 - protein, 9 aa, Homo Sapiens
ILKDHSKAA

SEQ ID NO: 542424 - protein, 9 aa, Homo Sapiens
CLDEADRDK

SEQ ID NO: 542425 - protein, 9 aa, Homo Sapiens
RCLDEADRD

SEQ ID NO: 542426 - protein, 9 aa, Homo Sapiens
PVRDKYHSL

SEQ ID NO: 542427 - protein, 9 aa, Homo Sapiens
TLVSLAIHF

SEQ ID NO: 542428 - protein, 9 aa, Homo Sapiens
PLLALLRPL

SEQ ID NO: 542429 - protein, 9 aa, Homo Sapiens
EIPNFSRST

SEQ ID NO: 542430 - protein, 9 aa, Homo Sapiens
LAIHFNTVS

SEQ ID NO: 542431 - protein, 9 aa, Homo Sapiens
SLAIHFNTV

SEQ ID NO: 542432 - protein, 9 aa, Homo Sapiens
SSLASSQAK

SEQ ID NO: 542433 - protein, 9 aa, Homo Sapiens
PEDVRVPVR

SEQ ID NO: 542434 - protein, 9 aa, Homo Sapiens
SPASPVRYS

SEQ ID NO: 542435 - protein, 9 aa, Homo Sapiens
LLRIVSEIL

SEQ ID NO: 542436 - protein, 9 aa, Homo Sapiens
KFRPFAGEK

SEQ ID NO: 542437 - protein, 9 aa, Homo Sapiens
VPPQLAPQV

SEQ ID NO: 542438 - protein, 9 aa, Homo Sapiens
IHFNTVSHE

SEQ ID NO: 542439 - protein, 9 aa, Homo Sapiens
PPLSTPQSA

SEQ ID NO: 542440 - protein, 9 aa, Homo Sapiens
IWAWKDAIA

SEQ ID NO: 542441 - protein, 9 aa, Homo Sapiens
PEEKQRCLD

SEQ ID NO: 542442 - protein, 9 aa, Homo Sapiens
EKQRCLDEA

SEQ ID NO: 542443 - protein, 9 aa, Homo Sapiens
AAVKVPTPP

SEQ ID NO: 542444 - protein, 9 aa, Homo Sapiens
LELNRYLPS

SEQ ID NO: 542445 - protein, 9 aa, Homo Sapiens
QVPPLLALL

SEQ ID NO: 542446 - protein, 9 aa, Homo Sapiens
RHCEHTKIS

SEQ ID NO: 542447 - protein, 9 aa, Homo Sapiens
QQVDDFEGS

SEQ ID NO: 542448 - protein, 9 aa, Homo Sapiens
KYKCTVSLH

SEQ ID NO: 542449 - protein, 9 aa, Homo Sapiens
RCSKLELNR

SEQ ID NO: 542450 - protein, 9 aa, Homo Sapiens
DYGEIPNFS

SEQ ID NO: 542451 - protein, 9 aa, Homo Sapiens
LSFYILTLM

SEQ ID NO: 542452 - protein, 9 aa, Homo Sapiens
DFEGSLEQE

SEQ ID NO: 542453 - protein, 9 aa, Homo Sapiens
LSTPQSAPQ

SEQ ID NO: 542454 - protein, 9 aa, Homo Sapiens
KLEQQVDDF

SEQ ID NO: 542455 - protein, 9 aa, Homo Sapiens
VRVPVRDKY

SEQ ID NO: 542456 - protein, 9 aa, Homo Sapiens
TGPPLSTPQ

SEQ ID NO: 542457 - protein, 9 aa, Homo Sapiens
NEAVNYLTK

SEQ ID NO: 542458 - protein, 9 aa, Homo Sapiens
DFYPRDSAK

SEQ ID NO: 542459 - protein, 9 aa, Homo Sapiens
YGEIPNFSR

SEQ ID NO: 542460 - protein, 9 aa, Homo Sapiens
SVAFRYTAG

SEQ ID NO: 542461 - protein, 9 aa, Homo Sapiens
YILTLMGNL

SEQ ID NO: 542462 - protein, 9 aa, Homo Sapiens
EHTKISLSI

SEQ ID NO: 542463 - protein, 9 aa, Homo Sapiens
RINEAVNYL

SEQ ID NO: 542464 - protein, 9 aa, Homo Sapiens
SPVRYSILP

SEQ ID NO: 542465 - protein, 9 aa, Homo Sapiens
ELNRYLPSY

SEQ ID NO: 542466 - protein, 9 aa, Homo Sapiens
AVNYLTKAI

SEQ ID NO: 542467 - protein, 9 aa, Homo Sapiens
EYKCYCDNL

SEQ ID NO: 542468 - protein, 9 aa, Homo Sapiens
PPEEKQRCL

SEQ ID NO: 542469 - protein, 9 aa, Homo Sapiens
DNRQLDDAR

SEQ ID NO: 542470 - protein, 9 aa, Homo Sapiens
KITASLQIR

SEQ ID NO: 542471 - protein, 9 aa, Homo Sapiens
QVDDFEGSL

SEQ ID NO: 542472 - protein, 9 aa, Homo Sapiens
PQVPPQLAP

SEQ ID NO: 542473 - protein, 9 aa, Homo Sapiens
QDDSLGTFQ

SEQ ID NO: 542474 - protein, 9 aa, Homo Sapiens
ESSLASSQA

SEQ ID NO: 542475 - protein, 9 aa, Homo Sapiens
HGESSLASS

SEQ ID NO: 542476 - protein, 9 aa, Homo Sapiens
KTTGSTHTA

SEQ ID NO: 542477 - protein, 9 aa, Homo Sapiens
VSLHFIRAI

SEQ ID NO: 542478 - protein, 9 aa, Homo Sapiens
PSPITAAAV

SEQ ID NO: 542479 - protein, 9 aa, Homo Sapiens
STLSDFYPR

SEQ ID NO: 542480 - protein, 9 aa, Homo Sapiens
INPDSLCLP

SEQ ID NO: 542481 - protein, 9 aa, Homo Sapiens
VLYARTDRR

SEQ ID NO: 542482 - protein, 9 aa, Homo Sapiens
KIRRDINPD

SEQ ID NO: 542483 - protein, 9 aa, Homo Sapiens
WPQGAHGES

SEQ ID NO: 542484 - protein, 9 aa, Homo Sapiens
QLAPQVPPQ

SEQ ID NO: 542485 - protein, 9 aa, Homo Sapiens
NKIRRDINP

SEQ ID NO: 542486 - protein, 9 aa, Homo Sapiens
QGAHGESSL

SEQ ID NO: 542487 - protein, 9 aa, Homo Sapiens
VAQIGPEKV

SEQ ID NO: 542488 - protein, 9 aa, Homo Sapiens
AHGESSLAS

SEQ ID NO: 542489 - protein, 9 aa, Homo Sapiens
GKEIRIWAW

SEQ ID NO: 542490 - protein, 9 aa, Homo Sapiens
FSPFGYILA

SEQ ID NO: 542491 - protein, 9 aa, Homo Sapiens
IPPPTTLKT

SEQ ID NO: 542492 - protein, 9 aa, Homo Sapiens
EDVRVPVRD

SEQ ID NO: 542493 - protein, 9 aa, Homo Sapiens
GRINEAVNY

SEQ ID NO: 542494 - protein, 9 aa, Homo Sapiens
EVYDEYKCY

SEQ ID NO: 542495 - protein, 9 aa, Homo Sapiens
PTGPPLSTP

SEQ ID NO: 542496 - protein, 9 aa, Homo Sapiens
IRRDINPDS

SEQ ID NO: 542497 - protein, 9 aa, Homo Sapiens
LGKITASLQ

SEQ ID NO: 542498 - protein, 9 aa, Homo Sapiens
EQQVDDFEG

SEQ ID NO: 542499 - protein, 9 aa, Homo Sapiens
FEGSLEQEK

SEQ ID NO: 542500 - protein, 9 aa, Homo Sapiens
QLAPQVPPL

SEQ ID NO: 542501 - protein, 9 aa, Homo Sapiens
SRSTVPGHA

SEQ ID NO: 542502 - protein, 9 aa, Homo Sapiens
LAPQVPPQL

SEQ ID NO: 542503 - protein, 9 aa, Homo Sapiens
APQVPPLLA

SEQ ID NO: 542504 - protein, 9 aa, Homo Sapiens
EIRIWAWKD

SEQ ID NO: 542505 - protein, 9 aa, Homo Sapiens
RVPVRDKYH

SEQ ID NO: 542506 - protein, 9 aa, Homo Sapiens
QASSVAFRY

SEQ ID NO: 542507 - protein, 9 aa, Homo Sapiens
ASLQIRAIK

SEQ ID NO: 542508 - protein, 9 aa, Homo Sapiens
NRYLPSYDC

SEQ ID NO: 542509 - protein, 9 aa, Homo Sapiens
TTGSTHTAP

SEQ ID NO: 542510 - protein, 9 aa, Homo Sapiens
KVVLYARTD

SEQ ID NO: 542511 - protein, 9 aa, Homo Sapiens
IVSEILKDH

SEQ ID NO: 542512 - protein, 9 aa, Homo Sapiens
LLALLRPLL

SEQ ID NO: 542513 - protein, 9 aa, Homo Sapiens
LPPEEKQRC

SEQ ID NO: 542514 - protein, 9 aa, Homo Sapiens
TAAAVKVPT

SEQ ID NO: 542515 - protein, 9 aa, Homo Sapiens
METQKEEET

SEQ ID NO: 542516 - protein, 9 aa, Homo Sapiens
VKVPTPPGV

SEQ ID NO: 542517 - protein, 9 aa, Homo Sapiens
YDEYKCYCD

SEQ ID NO: 542518 - protein, 9 aa, Homo Sapiens
FKLMETQKE

SEQ ID NO: 542519 - protein, 9 aa, Homo Sapiens
TQKEEETEK

SEQ ID NO: 542520 - protein, 9 aa, Homo Sapiens
ALQQVAQIG

SEQ ID NO: 542521 - protein, 9 aa, Homo Sapiens
YLTKAIQLQ

SEQ ID NO: 542522 - protein, 9 aa, Homo Sapiens
RSEKVVLYA

SEQ ID NO: 542523 - protein, 9 aa, Homo Sapiens
GPPLSTPQS

SEQ ID NO: 542524 - protein, 9 aa, Homo Sapiens
RQLDDARVI

SEQ ID NO: 542525 - protein, 9 aa, Homo Sapiens
FAKFYEDNR

SEQ ID NO: 542526 - protein, 9 aa, Homo Sapiens
PVRYSILPH

SEQ ID NO: 542527 - protein, 9 aa, Homo Sapiens
YEDNRQLDD

SEQ ID NO: 542528 - protein, 9 aa, Homo Sapiens
PDYRSEKVV

SEQ ID NO: 542529 - protein, 9 aa, Homo Sapiens
PPPTTLKTT

SEQ ID NO: 542530 - protein, 9 aa, Homo Sapiens
SEILKDHSK

SEQ ID NO: 542531 - protein, 9 aa, Homo Sapiens
TTLKTTGST

SEQ ID NO: 542532 - protein, 9 aa, Homo Sapiens
HFNTVSHER

SEQ ID NO: 542533 - protein, 9 aa, Homo Sapiens
APQLAPQVP

SEQ ID NO: 542534 - protein, 9 aa, Homo Sapiens
EAVNYLTKA

SEQ ID NO: 542535 - protein, 9 aa, Homo Sapiens
QQVAQIGPE

SEQ ID NO: 542536 - protein, 9 aa, Homo Sapiens
VCPTGPPLS

SEQ ID NO: 542537 - protein, 9 aa, Homo Sapiens
QIRAIKKPI

SEQ ID NO: 542538 - protein, 9 aa, Homo Sapiens
EKVVLYART

SEQ ID NO: 542539 - protein, 9 aa, Homo Sapiens
QIGPEKVKY

SEQ ID NO: 542540 - protein, 9 aa, Homo Sapiens
VAFRYTAGT

SEQ ID NO: 542541 - protein, 9 aa, Homo Sapiens
VRKGEKFRP

SEQ ID NO: 542542 - protein, 9 aa, Homo Sapiens
VNYLTKAIQ

SEQ ID NO: 542543 - protein, 9 aa, Homo Sapiens
AWKDAIANG

SEQ ID NO: 542544 - protein, 9 aa, Homo Sapiens
YILAIHIVA

SEQ ID NO: 542545 - protein, 9 aa, Homo Sapiens
TLSDFYPRD

SEQ ID NO: 542546 - protein, 9 aa, Homo Sapiens
QEVYDEYKC

SEQ ID NO: 542547 - protein, 9 aa, Homo Sapiens
DEYKCYCDN

SEQ ID NO: 542548 - protein, 9 aa, Homo Sapiens
KQRCLDEAD

SEQ ID NO: 542549 - protein, 9 aa, Homo Sapiens
PLSTPQSAP

SEQ ID NO: 542550 - protein, 9 aa, Homo Sapiens
GESSLASSQ

SEQ ID NO: 542551 - protein, 9 aa, Homo Sapiens
SRCSKLELN

SEQ ID NO: 542552 - protein, 9 aa, Homo Sapiens
PNFSRSTVP

SEQ ID NO: 542553 - protein, 9 aa, Homo Sapiens
RTYQASSVA

SEQ ID NO: 542554 - protein, 9 aa, Homo Sapiens
EEKQRCLDE

SEQ ID NO: 542555 - protein, 9 aa, Homo Sapiens
DSLGTFQLH

SEQ ID NO: 542556 - protein, 9 aa, Homo Sapiens
NRTYQASSV

SEQ ID NO: 542557 - protein, 9 aa, Homo Sapiens
HFIRAIART

SEQ ID NO: 542558 - protein, 9 aa, Homo Sapiens
VRDKYHSLH

SEQ ID NO: 542559 - protein, 9 aa, Homo Sapiens
CYCDNLGYH

SEQ ID NO: 542560 - protein, 9 aa, Homo Sapiens
SPFGYILAI

SEQ ID NO: 542561 - protein, 9 aa, Homo Sapiens
RPFAGEKRM

SEQ ID NO: 542562 - protein, 9 aa, Homo Sapiens
KFYEDNRQL

SEQ ID NO: 542563 - protein, 9 aa, Homo Sapiens
PQLAPQVPP

SEQ ID NO: 542564 - protein, 9 aa, Homo Sapiens
TASLQIRAI

SEQ ID NO: 542565 - protein, 9 aa, Homo Sapiens
TFQDDSLGT

SEQ ID NO: 542566 - protein, 9 aa, Homo Sapiens
FYEDNRQLD

SEQ ID NO: 542567 - protein, 9 aa, Homo Sapiens
PPQLAPQVP

SEQ ID NO: 542568 - protein, 9 aa, Homo Sapiens
LTLMGNLLI

SEQ ID NO: 542569 - protein, 9 aa, Homo Sapiens
ENKIRRDIN

SEQ ID NO: 542570 - protein, 9 aa, Homo Sapiens
QKEEETEKK

SEQ ID NO: 542571 - protein, 9 aa, Homo Sapiens
EDNRQLDDA

SEQ ID NO: 542572 - protein, 9 aa, Homo Sapiens
ALLRPLLCL

SEQ ID NO: 542573 - protein, 9 aa, Homo Sapiens
LKTTGSTHT

SEQ ID NO: 542574 - protein, 9 aa, Homo Sapiens
RRDINPDSL

SEQ ID NO: 542575 - protein, 9 aa, Homo Sapiens
EALQQVAQI

SEQ ID NO: 542576 - protein, 9 aa, Homo Sapiens
AKFYEDNRQ

SEQ ID NO: 542577 - protein, 9 aa, Homo Sapiens
STPQSAPQL

SEQ ID NO: 542578 - protein, 9 aa, Homo Sapiens
DDFEGSLEQ

SEQ ID NO: 542579 - protein, 9 aa, Homo Sapiens
QRCLDEADR

SEQ ID NO: 542580 - protein, 9 aa, Homo Sapiens
PASPVRYSI

SEQ ID NO: 542581 - protein, 9 aa, Homo Sapiens
FRPFAGEKR

SEQ ID NO: 542582 - protein, 9 aa, Homo Sapiens
FQDDSLGTF

SEQ ID NO: 542583 - protein, 9 aa, Homo Sapiens
QVPPQLAPQ

SEQ ID NO: 542584 - protein, 9 aa, Homo Sapiens
SKLELNRYL

SEQ ID NO: 542585 - protein, 9 aa, Homo Sapiens
PFGYILAIH

SEQ ID NO: 542586 - protein, 9 aa, Homo Sapiens
EKFRPFAGE

SEQ ID NO: 542587 - protein, 9 aa, Homo Sapiens
VSEILKDHS

SEQ ID NO: 542588 - protein, 9 aa, Homo Sapiens
KCYCDNLGY

SEQ ID NO: 542589 - protein, 9 aa, Homo Sapiens
ASPVRYSIL

SEQ ID NO: 542590 - protein, 9 aa, Homo Sapiens
TVCPTGPPL

SEQ ID NO: 542591 - protein, 9 aa, Homo Sapiens
AFSPFGYIL

SEQ ID NO: 542592 - protein, 9 aa, Homo Sapiens
RTFQDDSLG

SEQ ID NO: 542593 - protein, 9 aa, Homo Sapiens
LAPQVPPLL

SEQ ID NO: 542594 - protein, 9 aa, Homo Sapiens
PQGAHGESS

SEQ ID NO: 542595 - protein, 9 aa, Homo Sapiens
CSKLELNRY

SEQ ID NO: 542596 - protein, 9 aa, Homo Sapiens
SLQIRAIKK

SEQ ID NO: 542597 - protein, 9 aa, Homo Sapiens
IPNFSRSTV

SEQ ID NO: 542598 - protein, 9 aa, Homo Sapiens
DLDSPASPV

SEQ ID NO: 542599 - protein, 9 aa, Homo Sapiens
VDDFEGSLE

SEQ ID NO: 542600 - protein, 9 aa, Homo Sapiens
DINPDSLCL

SEQ ID NO: 542601 - protein, 9 aa, Homo Sapiens
KLELNRYLP

SEQ ID NO: 542602 - protein, 9 aa, Homo Sapiens
DDSLGTFQL

SEQ ID NO: 542603 - protein, 9 aa, Homo Sapiens
SDFYPRDSA

SEQ ID NO: 542604 - protein, 9 aa, Homo Sapiens
SEKVVLYAR

SEQ ID NO: 542605 - protein, 9 aa, Homo Sapiens
APQVPPQLA

SEQ ID NO: 542606 - protein, 9 aa, Homo Sapiens
GEKFRPFAG

SEQ ID NO: 542607 - protein, 9 aa, Homo Sapiens
CTVSLHFIR

SEQ ID NO: 542608 - protein, 9 aa, Homo Sapiens
YRSEKVVLY

SEQ ID NO: 542609 - protein, 9 aa, Homo Sapiens
VRYSILPHS

SEQ ID NO: 542610 - protein, 9 aa, Homo Sapiens
ITAAAVKVP

SEQ ID NO: 542611 - protein, 9 aa, Homo Sapiens
IGPEKVKYE

SEQ ID NO: 542612 - protein, 9 aa, Homo Sapiens
FRTFQDDSL

SEQ ID NO: 542613 - protein, 9 aa, Homo Sapiens
AAAVKVPTP

SEQ ID NO: 542614 - protein, 9 aa, Homo Sapiens
RIVSEILKD

SEQ ID NO: 542615 - protein, 9 aa, Homo Sapiens
LVSLAIHFN

SEQ ID NO: 542616 - protein, 9 aa, Homo Sapiens
YKCYCDNLG

SEQ ID NO: 542617 - protein, 9 aa, Homo Sapiens
GEIPNFSRS

SEQ ID NO: 542618 - protein, 9 aa, Homo Sapiens
PQVPPLLAL

SEQ ID NO: 542619 - protein, 9 aa, Homo Sapiens
DVRVPVRDK

SEQ ID NO: 542620 - protein, 9 aa, Homo Sapiens
IRIWAWKDA

SEQ ID NO: 542621 - protein, 9 aa, Homo Sapiens
DSPASPVRY

SEQ ID NO: 542622 - protein, 9 aa, Homo Sapiens
YFRTFQDDS

SEQ ID NO: 542623 - protein, 9 aa, Homo Sapiens
ITASLQIRA

SEQ ID NO: 542624 - protein, 9 aa, Homo Sapiens
TVSLHFIRA

SEQ ID NO: 542625 - protein, 9 aa, Homo Sapiens
CPTGPPLST

SEQ ID NO: 542626 - protein, 9 aa, Homo Sapiens
TLKTTGSTH

SEQ ID NO: 542627 - protein, 9 aa, Homo Sapiens
PQSAPQLAP

SEQ ID NO: 542628 - protein, 9 aa, Homo Sapiens
RVRKGEKFR

SEQ ID NO: 542629 - protein, 9 aa, Homo Sapiens
SLGTFQLHY

SEQ ID NO: 542630 - protein, 9 aa, Homo Sapiens
SFYILTLMG

SEQ ID NO: 542631 - protein, 9 aa, Homo Sapiens
FYILTLMGN

SEQ ID NO: 542632 - protein, 9 aa, Homo Sapiens
NFSRSTVPG

SEQ ID NO: 542633 - protein, 9 aa, Homo Sapiens
LEQQVDDFE

SEQ ID NO: 542634 - protein, 9 aa, Homo Sapiens
NYLTKAIQL

SEQ ID NO: 542635 - protein, 9 aa, Homo Sapiens
RKGEKFRPF

SEQ ID NO: 542636 - protein, 9 aa, Homo Sapiens
FSRSTVPGH

SEQ ID NO: 542637 - protein, 9 aa, Homo Sapiens
TPQSAPQLA

SEQ ID NO: 542638 - protein, 9 aa, Homo Sapiens
VYDEYKCYC

SEQ ID NO: 542639 - protein, 9 aa, Homo Sapiens
GAHGESSLA

SEQ ID NO: 542640 - protein, 9 aa, Homo Sapiens
QSAPQLAPQ

SEQ ID NO: 542641 - protein, 9 aa, Homo Sapiens
HCEHTKISL

SEQ ID NO: 542642 - protein, 9 aa, Homo Sapiens
ASSVAFRYT

SEQ ID NO: 542643 - protein, 9 aa, Homo Sapiens
KLMETQKEE

SEQ ID NO: 542644 - protein, 9 aa, Homo Sapiens
SLHFIRAIA

SEQ ID NO: 542645 - protein, 9 aa, Homo Sapiens
YPEDVRVPV

SEQ ID NO: 542646 - protein, 9 aa, Homo Sapiens
LDSPASPVR

SEQ ID NO: 542647 - protein, 9 aa, Homo Sapiens
IAFSPFGYI

SEQ ID NO: 542648 - protein, 9 aa, Homo Sapiens
LFLSFYILT

SEQ ID NO: 542649 - protein, 9 aa, Homo Sapiens
VVLYARTDR

SEQ ID NO: 542650 - protein, 9 aa, Homo Sapiens
AIHFNTVSH

SEQ ID NO: 542651 - protein, 9 aa, Homo Sapiens
DYRSEKVVL

SEQ ID NO: 542652 - protein, 9 aa, Homo Sapiens
PPTTLKTTG

SEQ ID NO: 542653 - protein, 9 aa, Homo Sapiens
SSVAFRYTA

SEQ ID NO: 542654 - protein, 9 aa, Homo Sapiens
RIPQSTLSD

SEQ ID NO: 542655 - protein, 9 aa, Homo Sapiens
PPLLALLRP

SEQ ID NO: 542656 - protein, 9 aa, Homo Sapiens
LSDFYPRDS

SEQ ID NO: 542657 - protein, 9 aa, Homo Sapiens
WKDAIANGS

SEQ ID NO: 542658 - protein, 9 aa, Homo Sapiens
YKCTVSLHF

SEQ ID NO: 542659 - protein, 9 aa, Homo Sapiens
LMETQKEEE

SEQ ID NO: 542660 - protein, 9 aa, Homo Sapiens
PTTLKTTGS

SEQ ID NO: 542661 - protein, 9 aa, Homo Sapiens
QRHCEHTKI

SEQ ID NO: 542662 - protein, 9 aa, Homo Sapiens
ETLVSLAIH

SEQ ID NO: 542663 - protein, 9 aa, Homo Sapiens
CEHTKISLS

SEQ ID NO: 542664 - protein, 9 aa, Homo Sapiens
WAWKDAIAN

SEQ ID NO: 542665 - protein, 9 aa, Homo Sapiens
VPPLLALLR

SEQ ID NO: 542666 - protein, 9 aa, Homo Sapiens
LQQVAQIGP

SEQ ID NO: 542667 - protein, 9 aa, Homo Sapiens
GKITASLQI

SEQ ID NO: 542668 - protein, 9 aa, Homo Sapiens
LNRYLPSYD

SEQ ID NO: 542669 - protein, 9 aa, Homo Sapiens
QVAQIGPEK

SEQ ID NO: 542670 - protein, 9 aa, Homo Sapiens
RDINPDSLC

SEQ ID NO: 542671 - protein, 9 aa, Homo Sapiens
LALLRPLLC

SEQ ID NO: 542672 - protein, 9 aa, Homo Sapiens
ILEKNPISV

SEQ ID NO: 542673 - protein, 9 aa, Homo Sapiens
LLEMKDGRN

SEQ ID NO: 542674 - protein, 9 aa, Homo Sapiens
ERHHLPALG

SEQ ID NO: 542675 - protein, 9 aa, Homo Sapiens
EEALKEYDF

SEQ ID NO: 542676 - protein, 9 aa, Homo Sapiens
TLGRNPTSA

SEQ ID NO: 542677 - protein, 9 aa, Homo Sapiens
APSNLQRQG

SEQ ID NO: 542678 - protein, 9 aa, Homo Sapiens
KMKEPDWKL

SEQ ID NO: 542679 - protein, 9 aa, Homo Sapiens
SPYPWVKID

SEQ ID NO: 542680 - protein, 9 aa, Homo Sapiens
QNTGPWGLL

SEQ ID NO: 542681 - protein, 9 aa, Homo Sapiens
WVKIDEEFC

SEQ ID NO: 542682 - protein, 9 aa, Homo Sapiens
LISFSIDGS

SEQ ID NO: 542683 - protein, 9 aa, Homo Sapiens
ARDPPDGHR

SEQ ID NO: 542684 - protein, 9 aa, Homo Sapiens
GNGYVSAQA

SEQ ID NO: 542685 - protein, 9 aa, Homo Sapiens
FGPLDNESL

SEQ ID NO: 542686 - protein, 9 aa, Homo Sapiens
TPTHAASPI

SEQ ID NO: 542687 - protein, 9 aa, Homo Sapiens
SKQKKALMD

SEQ ID NO: 542688 - protein, 9 aa, Homo Sapiens
DHLALHGKR

SEQ ID NO: 542689 - protein, 9 aa, Homo Sapiens
EEDGALAKV

SEQ ID NO: 542690 - protein, 9 aa, Homo Sapiens
PMPAAILTM

SEQ ID NO: 542691 - protein, 9 aa, Homo Sapiens
SHFGFQMCG

SEQ ID NO: 542692 - protein, 9 aa, Homo Sapiens
GKVGPAPSN

SEQ ID NO: 542693 - protein, 9 aa, Homo Sapiens
LGRNPTSAV

SEQ ID NO: 542694 - protein, 9 aa, Homo Sapiens
EEVVWVVGP

SEQ ID NO: 542695 - protein, 9 aa, Homo Sapiens
PAAARARDP

SEQ ID NO: 542696 - protein, 9 aa, Homo Sapiens
RVLISFSID

SEQ ID NO: 542697 - protein, 9 aa, Homo Sapiens
RRSLDDKPI

SEQ ID NO: 542698 - protein, 9 aa, Homo Sapiens
HWGYEETKN

SEQ ID NO: 542699 - protein, 9 aa, Homo Sapiens
SAQASPGLL

SEQ ID NO: 542700 - protein, 9 aa, Homo Sapiens
LGGDPEHLP

SEQ ID NO: 542701 - protein, 9 aa, Homo Sapiens
SDHLALHGK

SEQ ID NO: 542702 - protein, 9 aa, Homo Sapiens
ISVMSVAGV

SEQ ID NO: 542703 - protein, 9 aa, Homo Sapiens
NRAQISFST

SEQ ID NO: 542704 - protein, 9 aa, Homo Sapiens
GPLDNESLQ

SEQ ID NO: 542705 - protein, 9 aa, Homo Sapiens
VWVVGPSPA

SEQ ID NO: 542706 - protein, 9 aa, Homo Sapiens
LSSGPGRGI

SEQ ID NO: 542707 - protein, 9 aa, Homo Sapiens
TAEWVDVTF

SEQ ID NO: 542708 - protein, 9 aa, Homo Sapiens
HGPGPVLQE

SEQ ID NO: 542709 - protein, 9 aa, Homo Sapiens
MKEPDWKLS

SEQ ID NO: 542710 - protein, 9 aa, Homo Sapiens
RPEGDIDIL

SEQ ID NO: 542711 - protein, 9 aa, Homo Sapiens
KGKRLPEVD

SEQ ID NO: 542712 - protein, 9 aa, Homo Sapiens
SKKKAAEVL

SEQ ID NO: 542713 - protein, 9 aa, Homo Sapiens
WTVPMPAAI

SEQ ID NO: 542714 - protein, 9 aa, Homo Sapiens
KSPTNVMSV

SEQ ID NO: 542715 - protein, 9 aa, Homo Sapiens
AQASPGLLP

SEQ ID NO: 542716 - protein, 9 aa, Homo Sapiens
FSLKEEDGA

SEQ ID NO: 542717 - protein, 9 aa, Homo Sapiens
GDYQRKKGS

SEQ ID NO: 542718 - protein, 9 aa, Homo Sapiens
VLNVKRVSV

SEQ ID NO: 542719 - protein, 9 aa, Homo Sapiens
WPGGSMMRA

SEQ ID NO: 542720 - protein, 9 aa, Homo Sapiens
INVLIVGKV

SEQ ID NO: 542721 - protein, 9 aa, Homo Sapiens
RNPTSAVNV

SEQ ID NO: 542722 - protein, 9 aa, Homo Sapiens
APTLFNIRE

SEQ ID NO: 542723 - protein, 9 aa, Homo Sapiens
WTTAQSTSL

SEQ ID NO: 542724 - protein, 9 aa, Homo Sapiens
TRRLQLQTP

SEQ ID NO: 542725 - protein, 9 aa, Homo Sapiens
WGYEETKNF

SEQ ID NO: 542726 - protein, 9 aa, Homo Sapiens
EKRKRQMSV

SEQ ID NO: 542727 - protein, 9 aa, Homo Sapiens
SILERHHLP

SEQ ID NO: 542728 - protein, 9 aa, Homo Sapiens
FILEKNPIS

SEQ ID NO: 542729 - protein, 9 aa, Homo Sapiens
LGDYQRKKG

SEQ ID NO: 542730 - protein, 9 aa, Homo Sapiens
GRFLVLICF

SEQ ID NO: 542731 - protein, 9 aa, Homo Sapiens
RLGELLTVQ

SEQ ID NO: 542732 - protein, 9 aa, Homo Sapiens
GILIWFLCF

SEQ ID NO: 542733 - protein, 9 aa, Homo Sapiens
DTGAHCTST

SEQ ID NO: 542734 - protein, 9 aa, Homo Sapiens
GYVSAQASP

SEQ ID NO: 542735 - protein, 9 aa, Homo Sapiens
LRPEGDIDI

SEQ ID NO: 542736 - protein, 9 aa, Homo Sapiens
DWKLSPPKR

SEQ ID NO: 542737 - protein, 9 aa, Homo Sapiens
KMEESKKKA

SEQ ID NO: 542738 - protein, 9 aa, Homo Sapiens
LPALGGDPE

SEQ ID NO: 542739 - protein, 9 aa, Homo Sapiens
EFILEKNPI

SEQ ID NO: 542740 - protein, 9 aa, Homo Sapiens
KRLGELLTV

SEQ ID NO: 542741 - protein, 9 aa, Homo Sapiens
LPEVDCMVS

SEQ ID NO: 542742 - protein, 9 aa, Homo Sapiens
DTAITRRLQ

SEQ ID NO: 542743 - protein, 9 aa, Homo Sapiens
RAFQHTSTL

SEQ ID NO: 542744 - protein, 9 aa, Homo Sapiens
GIQDVVEAY

SEQ ID NO: 542745 - protein, 9 aa, Homo Sapiens
EHLPEPEPA

SEQ ID NO: 542746 - protein, 9 aa, Homo Sapiens
TSQTAAHWH

SEQ ID NO: 542747 - protein, 9 aa, Homo Sapiens
GDIMRDLSH

SEQ ID NO: 542748 - protein, 9 aa, Homo Sapiens
ASNRAQISF

SEQ ID NO: 542749 - protein, 9 aa, Homo Sapiens
CEGIQDVVE

SEQ ID NO: 542750 - protein, 9 aa, Homo Sapiens
RSDHLALHG

SEQ ID NO: 542751 - protein, 9 aa, Homo Sapiens
VNVANVSVR

SEQ ID NO: 542752 - protein, 9 aa, Homo Sapiens
ILQTHRALL

SEQ ID NO: 542753 - protein, 9 aa, Homo Sapiens
AFQHTSTLA

SEQ ID NO: 542754 - protein, 9 aa, Homo Sapiens
AEELQNTGP

SEQ ID NO: 542755 - protein, 9 aa, Homo Sapiens
FVENGILIW

SEQ ID NO: 542756 - protein, 9 aa, Homo Sapiens
SSKYGTDFI

SEQ ID NO: 542757 - protein, 9 aa, Homo Sapiens
ANVSVRALI

SEQ ID NO: 542758 - protein, 9 aa, Homo Sapiens
PINVLNVKR

SEQ ID NO: 542759 - protein, 9 aa, Homo Sapiens
VFIQDIDSG

SEQ ID NO: 542760 - protein, 9 aa, Homo Sapiens
PIYRRYKHF

SEQ ID NO: 542761 - protein, 9 aa, Homo Sapiens
NVLIVGKVS

SEQ ID NO: 542762 - protein, 9 aa, Homo Sapiens
GDPEHLPEP

SEQ ID NO: 542763 - protein, 9 aa, Homo Sapiens
LERHHLPAL

SEQ ID NO: 542764 - protein, 9 aa, Homo Sapiens
AAHWHGLLC

SEQ ID NO: 542765 - protein, 9 aa, Homo Sapiens
EVPGVFSRS

SEQ ID NO: 542766 - protein, 9 aa, Homo Sapiens
EEKMKEPDW

SEQ ID NO: 542767 - protein, 9 aa, Homo Sapiens
VAKADRQPR

SEQ ID NO: 542768 - protein, 9 aa, Homo Sapiens
KEYDFLVTA

SEQ ID NO: 542769 - protein, 9 aa, Homo Sapiens
TTVWTTAQS

SEQ ID NO: 542770 - protein, 9 aa, Homo Sapiens
GPVLQEESD

SEQ ID NO: 542771 - protein, 9 aa, Homo Sapiens
HLALHGKRH

SEQ ID NO: 542772 - protein, 9 aa, Homo Sapiens
AGLTEKANW

SEQ ID NO: 542773 - protein, 9 aa, Homo Sapiens
RAQISFSTR

SEQ ID NO: 542774 - protein, 9 aa, Homo Sapiens
EFKMEESKK

SEQ ID NO: 542775 - protein, 9 aa, Homo Sapiens
VMVFIQDID

SEQ ID NO: 542776 - protein, 9 aa, Homo Sapiens
HRHGPGPVL

SEQ ID NO: 542777 - protein, 9 aa, Homo Sapiens
PSNLQRQGS

SEQ ID NO: 542778 - protein, 9 aa, Homo Sapiens
EEKRKRQMS

SEQ ID NO: 542779 - protein, 9 aa, Homo Sapiens
WVDVTFQQE

SEQ ID NO: 542780 - protein, 9 aa, Homo Sapiens
RHSFGPLDN

SEQ ID NO: 542781 - protein, 9 aa, Homo Sapiens
HHLPALGGD

SEQ ID NO: 542782 - protein, 9 aa, Homo Sapiens
DDECEGIQD

SEQ ID NO: 542783 - protein, 9 aa, Homo Sapiens
THAASPIYR

SEQ ID NO: 542784 - protein, 9 aa, Homo Sapiens
PLDNESLQQ

SEQ ID NO: 542785 - protein, 9 aa, Homo Sapiens
PPTGLELQA

SEQ ID NO: 542786 - protein, 9 aa, Homo Sapiens
GAFFSTLRP

SEQ ID NO: 542787 - protein, 9 aa, Homo Sapiens
VSEEVLVAN

SEQ ID NO: 542788 - protein, 9 aa, Homo Sapiens
DGSIRGKSP

SEQ ID NO: 542789 - protein, 9 aa, Homo Sapiens
GGDPEHLPE

SEQ ID NO: 542790 - protein, 9 aa, Homo Sapiens
RNPINVLIV

SEQ ID NO: 542791 - protein, 9 aa, Homo Sapiens
LNVKRVSVR

SEQ ID NO: 542792 - protein, 9 aa, Homo Sapiens
TAQSTSLSK

SEQ ID NO: 542793 - protein, 9 aa, Homo Sapiens
LLLRVEIHW

SEQ ID NO: 542794 - protein, 9 aa, Homo Sapiens
GILQTHRAL

SEQ ID NO: 542795 - protein, 9 aa, Homo Sapiens
LGELLTVQA

SEQ ID NO: 542796 - protein, 9 aa, Homo Sapiens
NPINVLIVG

SEQ ID NO: 542797 - protein, 9 aa, Homo Sapiens
PEPAAARAR

SEQ ID NO: 542798 - protein, 9 aa, Homo Sapiens
NIREPTLGR

SEQ ID NO: 542799 - protein, 9 aa, Homo Sapiens
RFLVLICFQ

SEQ ID NO: 542800 - protein, 9 aa, Homo Sapiens
TNVMSVEKA

SEQ ID NO: 542801 - protein, 9 aa, Homo Sapiens
ESKKKAAEV

SEQ ID NO: 542802 - protein, 9 aa, Homo Sapiens
EEVPGVFSR

SEQ ID NO: 542803 - protein, 9 aa, Homo Sapiens
KGGILFSHC

SEQ ID NO: 542804 - protein, 9 aa, Homo Sapiens
GHRHHRHGP

SEQ ID NO: 542805 - protein, 9 aa, Homo Sapiens
CGLCRSTVT

SEQ ID NO: 542806 - protein, 9 aa, Homo Sapiens
ALKEYDFLV

SEQ ID NO: 542807 - protein, 9 aa, Homo Sapiens
HRHHRHGPG

SEQ ID NO: 542808 - protein, 9 aa, Homo Sapiens
LFSHCSGTI

SEQ ID NO: 542809 - protein, 9 aa, Homo Sapiens
NDDRIVFWT

SEQ ID NO: 542810 - protein, 9 aa, Homo Sapiens
YQLCACFDT

SEQ ID NO: 542811 - protein, 9 aa, Homo Sapiens
QKKALMDKL

SEQ ID NO: 542812 - protein, 9 aa, Homo Sapiens
HLPALGGDP

SEQ ID NO: 542813 - protein, 9 aa, Homo Sapiens
SGPGRGIHS

SEQ ID NO: 542814 - protein, 9 aa, Homo Sapiens
LICFQGDEG

SEQ ID NO: 542815 - protein, 9 aa, Homo Sapiens
EPTLGRNPT

SEQ ID NO: 542816 - protein, 9 aa, Homo Sapiens
PGRGIHSRG

SEQ ID NO: 542817 - protein, 9 aa, Homo Sapiens
TESLGDYQR

SEQ ID NO: 542818 - protein, 9 aa, Homo Sapiens
SILERNPIN

SEQ ID NO: 542819 - protein, 9 aa, Homo Sapiens
RKSVDQTEG

SEQ ID NO: 542820 - protein, 9 aa, Homo Sapiens
YDFLVTAED

SEQ ID NO: 542821 - protein, 9 aa, Homo Sapiens
AVNVANVSV

SEQ ID NO: 542822 - protein, 9 aa, Homo Sapiens
TTAQSTSLS

SEQ ID NO: 542823 - protein, 9 aa, Homo Sapiens
IYQLCACFD

SEQ ID NO: 542824 - protein, 9 aa, Homo Sapiens
LVANCASEA

SEQ ID NO: 542825 - protein, 9 aa, Homo Sapiens
LCRSTVTHG

SEQ ID NO: 542826 - protein, 9 aa, Homo Sapiens
LWTVPMPAA

SEQ ID NO: 542827 - protein, 9 aa, Homo Sapiens
ACFDTSGPT

SEQ ID NO: 542828 - protein, 9 aa, Homo Sapiens
TEKANWPGG

SEQ ID NO: 542829 - protein, 9 aa, Homo Sapiens
ALLEMKDGR

SEQ ID NO: 542830 - protein, 9 aa, Homo Sapiens
PTLGRNPTS

SEQ ID NO: 542831 - protein, 9 aa, Homo Sapiens
PTHAASPIY

SEQ ID NO: 542832 - protein, 9 aa, Homo Sapiens
GCFNDDRIV

SEQ ID NO: 542833 - protein, 9 aa, Homo Sapiens
PEDEEVVWV

SEQ ID NO: 542834 - protein, 9 aa, Homo Sapiens
KEEDGALAK

SEQ ID NO: 542835 - protein, 9 aa, Homo Sapiens
HFGFQMCGL

SEQ ID NO: 542836 - protein, 9 aa, Homo Sapiens
RLTSQTAAH

SEQ ID NO: 542837 - protein, 9 aa, Homo Sapiens
VDCMVSRLG

SEQ ID NO: 542838 - protein, 9 aa, Homo Sapiens
AEPPTGLEL

SEQ ID NO: 542839 - protein, 9 aa, Homo Sapiens
LPEPEPAAA

SEQ ID NO: 542840 - protein, 9 aa, Homo Sapiens
SPIYRRYKH

SEQ ID NO: 542841 - protein, 9 aa, Homo Sapiens
VLIVGKVSF

SEQ ID NO: 542842 - protein, 9 aa, Homo Sapiens
ILFSHCSGT

SEQ ID NO: 542843 - protein, 9 aa, Homo Sapiens
KGKKLWTVP

SEQ ID NO: 542844 - protein, 9 aa, Homo Sapiens
ETVVMVFIQ

SEQ ID NO: 542845 - protein, 9 aa, Homo Sapiens
QTEGTPVEL

SEQ ID NO: 542846 - protein, 9 aa, Homo Sapiens
TGAHCTSTD

SEQ ID NO: 542847 - protein, 9 aa, Homo Sapiens
DVVEAYQNC

SEQ ID NO: 542848 - protein, 9 aa, Homo Sapiens
VRAFQHTST

SEQ ID NO: 542849 - protein, 9 aa, Homo Sapiens
QASPGLLPV

SEQ ID NO: 542850 - protein, 9 aa, Homo Sapiens
RSTVTHGAG

SEQ ID NO: 542851 - protein, 9 aa, Homo Sapiens
EKANWPGGS

SEQ ID NO: 542852 - protein, 9 aa, Homo Sapiens
NESLQQELA

SEQ ID NO: 542853 - protein, 9 aa, Homo Sapiens
TEGTPVELY

SEQ ID NO: 542854 - protein, 9 aa, Homo Sapiens
REEVPGVFS

SEQ ID NO: 542855 - protein, 9 aa, Homo Sapiens
ALGGDPEHL

SEQ ID NO: 542856 - protein, 9 aa, Homo Sapiens
LPEDEEVVW

SEQ ID NO: 542857 - protein, 9 aa, Homo Sapiens
VSFRVLISF

SEQ ID NO: 542858 - protein, 9 aa, Homo Sapiens
DDKPINVLN

SEQ ID NO: 542859 - protein, 9 aa, Homo Sapiens
FSHCSGTIY

SEQ ID NO: 542860 - protein, 9 aa, Homo Sapiens
DLSEVSSKL

SEQ ID NO: 542861 - protein, 9 aa, Homo Sapiens
GFQMCGLCR

SEQ ID NO: 542862 - protein, 9 aa, Homo Sapiens
KVALLLRVE

SEQ ID NO: 542863 - protein, 9 aa, Homo Sapiens
ALDTAITRR

SEQ ID NO: 542864 - protein, 9 aa, Homo Sapiens
GSIRGKSPT

SEQ ID NO: 542865 - protein, 9 aa, Homo Sapiens
DQTEGTPVE

SEQ ID NO: 542866 - protein, 9 aa, Homo Sapiens
TREFILEKN

SEQ ID NO: 542867 - protein, 9 aa, Homo Sapiens
QISFSTREF

SEQ ID NO: 542868 - protein, 9 aa, Homo Sapiens
VRVQLFFNT

SEQ ID NO: 542869 - protein, 9 aa, Homo Sapiens
KTHVSSKYG

SEQ ID NO: 542870 - protein, 9 aa, Homo Sapiens
HLPEPEPAA

SEQ ID NO: 542871 - protein, 9 aa, Homo Sapiens
FQHTSTLAA

SEQ ID NO: 542872 - protein, 9 aa, Homo Sapiens
SIDGSIRGK

SEQ ID NO: 542873 - protein, 9 aa, Homo Sapiens
SFRVLISFS

SEQ ID NO: 542874 - protein, 9 aa, Homo Sapiens
ILERHHLPA

SEQ ID NO: 542875 - protein, 9 aa, Homo Sapiens
HAASPIYRR

SEQ ID NO: 542876 - protein, 9 aa, Homo Sapiens
TSDCATYAF

SEQ ID NO: 542877 - protein, 9 aa, Homo Sapiens
SVDQTEGTP

SEQ ID NO: 542878 - protein, 9 aa, Homo Sapiens
THVSSKYGT

SEQ ID NO: 542879 - protein, 9 aa, Homo Sapiens
SDCATYAFS

SEQ ID NO: 542880 - protein, 9 aa, Homo Sapiens
ESLGDYQRK

SEQ ID NO: 542881 - protein, 9 aa, Homo Sapiens
MSVAGVSAR

SEQ ID NO: 542882 - protein, 9 aa, Homo Sapiens
GPAPSNLQR

SEQ ID NO: 542883 - protein, 9 aa, Homo Sapiens
HGAGLTEKA

SEQ ID NO: 542884 - protein, 9 aa, Homo Sapiens
SEEVLVANC

SEQ ID NO: 542885 - protein, 9 aa, Homo Sapiens
STREFILEK

SEQ ID NO: 542886 - protein, 9 aa, Homo Sapiens
FSTLRPEGD

SEQ ID NO: 542887 - protein, 9 aa, Homo Sapiens
MCGLCRSTV

SEQ ID NO: 542888 - protein, 9 aa, Homo Sapiens
ILERNPINV

SEQ ID NO: 542889 - protein, 9 aa, Homo Sapiens
TVTHGAGLT

SEQ ID NO: 542890 - protein, 9 aa, Homo Sapiens
IKTHVSSKY

SEQ ID NO: 542891 - protein, 9 aa, Homo Sapiens
PDWKLSPPK

SEQ ID NO: 542892 - protein, 9 aa, Homo Sapiens
RSLDDKPIN

SEQ ID NO: 542893 - protein, 9 aa, Homo Sapiens
LFFNTRRSI

SEQ ID NO: 542894 - protein, 9 aa, Homo Sapiens
NPTSAVNVA

SEQ ID NO: 542895 - protein, 9 aa, Homo Sapiens
TVWTTAQST

SEQ ID NO: 542896 - protein, 9 aa, Homo Sapiens
FNIREPTLG

SEQ ID NO: 542897 - protein, 9 aa, Homo Sapiens
VIYQLCACF

SEQ ID NO: 542898 - protein, 9 aa, Homo Sapiens
DCMVSRLGC

SEQ ID NO: 542899 - protein, 9 aa, Homo Sapiens
SLGDYQRKK

SEQ ID NO: 542900 - protein, 9 aa, Homo Sapiens
AFFSTLRPE

SEQ ID NO: 542901 - protein, 9 aa, Homo Sapiens
LLRVEIHWG

SEQ ID NO: 542902 - protein, 9 aa, Homo Sapiens
YEETKNFLA

SEQ ID NO: 542903 - protein, 9 aa, Homo Sapiens
YPWVKIDEE

SEQ ID NO: 542904 - protein, 9 aa, Homo Sapiens
LQEESDVSE

SEQ ID NO: 542905 - protein, 9 aa, Homo Sapiens
RDPPDGHRH

SEQ ID NO: 542906 - protein, 9 aa, Homo Sapiens
ARARDPPDG

SEQ ID NO: 542907 - protein, 9 aa, Homo Sapiens
DCATYAFSS

SEQ ID NO: 542908 - protein, 9 aa, Homo Sapiens
QPVAKADRQ

SEQ ID NO: 542909 - protein, 9 aa, Homo Sapiens
GVRAEPPTG

SEQ ID NO: 542910 - protein, 9 aa, Homo Sapiens
KVSKQKKAL

SEQ ID NO: 542911 - protein, 9 aa, Homo Sapiens
EPEPAAARA

SEQ ID NO: 542912 - protein, 9 aa, Homo Sapiens
AAARARDPP

SEQ ID NO: 542913 - protein, 9 aa, Homo Sapiens
ENGILIWFL

SEQ ID NO: 542914 - protein, 9 aa, Homo Sapiens
AQSTSLSKS

SEQ ID NO: 542915 - protein, 9 aa, Homo Sapiens
ELQNTGPWG

SEQ ID NO: 542916 - protein, 9 aa, Homo Sapiens
THRALLEMK

SEQ ID NO: 542917 - protein, 9 aa, Homo Sapiens
GAGLTEKAN

SEQ ID NO: 542918 - protein, 9 aa, Homo Sapiens
MRDLSHFGF

SEQ ID NO: 542919 - protein, 9 aa, Homo Sapiens
DEEKRKRQM

SEQ ID NO: 542920 - protein, 9 aa, Homo Sapiens
EPPTGLELQ

SEQ ID NO: 542921 - protein, 9 aa, Homo Sapiens
EALKEYDFL

SEQ ID NO: 542922 - protein, 9 aa, Homo Sapiens
SVRVQLFFN

SEQ ID NO: 542923 - protein, 9 aa, Homo Sapiens
IYRRYKHFD

SEQ ID NO: 542924 - protein, 9 aa, Homo Sapiens
EESDVSEDR

SEQ ID NO: 542925 - protein, 9 aa, Homo Sapiens
IMRDLSHFG

SEQ ID NO: 542926 - protein, 9 aa, Homo Sapiens
GELLTVQAF

SEQ ID NO: 542927 - protein, 9 aa, Homo Sapiens
GGSMMRATV

SEQ ID NO: 542928 - protein, 9 aa, Homo Sapiens
DPPDGHRHH

SEQ ID NO: 542929 - protein, 9 aa, Homo Sapiens
KQKKALMDK

SEQ ID NO: 542930 - protein, 9 aa, Homo Sapiens
SPTNVMSVE

SEQ ID NO: 542931 - protein, 9 aa, Homo Sapiens
VGNGYVSAQ

SEQ ID NO: 542932 - protein, 9 aa, Homo Sapiens
GASPYPWVK

SEQ ID NO: 542933 - protein, 9 aa, Homo Sapiens
NCASEAVID

SEQ ID NO: 542934 - protein, 9 aa, Homo Sapiens
YAFSSGINA

SEQ ID NO: 542935 - protein, 9 aa, Homo Sapiens
VEFKMEESK

SEQ ID NO: 542936 - protein, 9 aa, Homo Sapiens
GYEETKNFL

SEQ ID NO: 542937 - protein, 9 aa, Homo Sapiens
EKASNRAQI

SEQ ID NO: 542938 - protein, 9 aa, Homo Sapiens
TAAHWHGLL

SEQ ID NO: 542939 - protein, 9 aa, Homo Sapiens
PPDGHRHHR

SEQ ID NO: 542940 - protein, 9 aa, Homo Sapiens
SIRGKSPTN

SEQ ID NO: 542941 - protein, 9 aa, Homo Sapiens
SQVRAFQHT

SEQ ID NO: 542942 - protein, 9 aa, Homo Sapiens
MEESKKKAA

SEQ ID NO: 542943 - protein, 9 aa, Homo Sapiens
NVANVSVRA

SEQ ID NO: 542944 - protein, 9 aa, Homo Sapiens
SARAPTLFN

SEQ ID NO: 542945 - protein, 9 aa, Homo Sapiens
ATYAFSSGI

SEQ ID NO: 542946 - protein, 9 aa, Homo Sapiens
LDTGAHCTS

SEQ ID NO: 542947 - protein, 9 aa, Homo Sapiens
PTLFNIREP

SEQ ID NO: 542948 - protein, 9 aa, Homo Sapiens
ADEEKRKRQ

SEQ ID NO: 542949 - protein, 9 aa, Homo Sapiens
ANCASEAVI

SEQ ID NO: 542950 - protein, 9 aa, Homo Sapiens
KGRFLVLIC

SEQ ID NO: 542951 - protein, 9 aa, Homo Sapiens
KRGILSSGP

SEQ ID NO: 542952 - protein, 9 aa, Homo Sapiens
VSSKYGTDF

SEQ ID NO: 542953 - protein, 9 aa, Homo Sapiens
EETKNFLAI

SEQ ID NO: 542954 - protein, 9 aa, Homo Sapiens
SFGPLDNES

SEQ ID NO: 542955 - protein, 9 aa, Homo Sapiens
TFQQEDEAP

SEQ ID NO: 542956 - protein, 9 aa, Homo Sapiens
PVLQEESDV

SEQ ID NO: 542957 - protein, 9 aa, Homo Sapiens
LHGKRHMLV

SEQ ID NO: 542958 - protein, 9 aa, Homo Sapiens
DIMRDLSHF

SEQ ID NO: 542959 - protein, 9 aa, Homo Sapiens
KNPISVMSV

SEQ ID NO: 542960 - protein, 9 aa, Homo Sapiens
FLVLICFQG

SEQ ID NO: 542961 - protein, 9 aa, Homo Sapiens
RLPEVDCMV

SEQ ID NO: 542962 - protein, 9 aa, Homo Sapiens
GFVENGILI

SEQ ID NO: 542963 - protein, 9 aa, Homo Sapiens
SLGASPYPW

SEQ ID NO: 542964 - protein, 9 aa, Homo Sapiens
VANVSVRAL

SEQ ID NO: 542965 - protein, 9 aa, Homo Sapiens
KVSFRVLIS

SEQ ID NO: 542966 - protein, 9 aa, Homo Sapiens
KKLWTVPMP

SEQ ID NO: 542967 - protein, 9 aa, Homo Sapiens
LIVGKVSFR

SEQ ID NO: 542968 - protein, 9 aa, Homo Sapiens
VSAQASPGL

SEQ ID NO: 542969 - protein, 9 aa, Homo Sapiens
FRLTSQTAA

SEQ ID NO: 542970 - protein, 9 aa, Homo Sapiens
QKDLERLDT

SEQ ID NO: 542971 - protein, 9 aa, Homo Sapiens
HVSSKYGTD

SEQ ID NO: 542972 - protein, 9 aa, Homo Sapiens
IQDVVEAYQ

SEQ ID NO: 542973 - protein, 9 aa, Homo Sapiens
KRVSVRVQL

SEQ ID NO: 542974 - protein, 9 aa, Homo Sapiens
IREPTLGRN

SEQ ID NO: 542975 - protein, 9 aa, Homo Sapiens
SDSQVRAFQ

SEQ ID NO: 542976 - protein, 9 aa, Homo Sapiens
ISFSTREFI

SEQ ID NO: 542977 - protein, 9 aa, Homo Sapiens
AITRRLQLQ

SEQ ID NO: 542978 - protein, 9 aa, Homo Sapiens
KKKAAEVLN

SEQ ID NO: 542979 - protein, 9 aa, Homo Sapiens
EVLVANCAS

SEQ ID NO: 542980 - protein, 9 aa, Homo Sapiens
VDLSEVSSK

SEQ ID NO: 542981 - protein, 9 aa, Homo Sapiens
GKVSFRVLI

SEQ ID NO: 542982 - protein, 9 aa, Homo Sapiens
DECEGIQDV

SEQ ID NO: 542983 - protein, 9 aa, Homo Sapiens
VPGVFSRSV

SEQ ID NO: 542984 - protein, 9 aa, Homo Sapiens
EVVWVVGPS

SEQ ID NO: 542985 - protein, 9 aa, Homo Sapiens
MVFIQDIDS

SEQ ID NO: 542986 - protein, 9 aa, Homo Sapiens
AKVSKQKKA

SEQ ID NO: 542987 - protein, 9 aa, Homo Sapiens
DRQPRHPSA

SEQ ID NO: 542988 - protein, 9 aa, Homo Sapiens
LIFSLKEED

SEQ ID NO: 542989 - protein, 9 aa, Homo Sapiens
DPEHLPEPE

SEQ ID NO: 542990 - protein, 9 aa, Homo Sapiens
ETKNFLAIL

SEQ ID NO: 542991 - protein, 9 aa, Homo Sapiens
VMSVEKASN

SEQ ID NO: 542992 - protein, 9 aa, Homo Sapiens
TRRSILERN

SEQ ID NO: 542993 - protein, 9 aa, Homo Sapiens
DGALAKVLR

SEQ ID NO: 542994 - protein, 9 aa, Homo Sapiens
AEWVDVTFQ

SEQ ID NO: 542995 - protein, 9 aa, Homo Sapiens
EELQNTGPW

SEQ ID NO: 542996 - protein, 9 aa, Homo Sapiens
KEPDWKLSP

SEQ ID NO: 542997 - protein, 9 aa, Homo Sapiens
SFSTREFIL

SEQ ID NO: 542998 - protein, 9 aa, Homo Sapiens
LREEVPGVF

SEQ ID NO: 542999 - protein, 9 aa, Homo Sapiens
LQTHRALLE

SEQ ID NO: 543000 - protein, 9 aa, Homo Sapiens
DEEVVWVVG

SEQ ID NO: 543001 - protein, 9 aa, Homo Sapiens
VWTTAQSTS

SEQ ID NO: 543002 - protein, 9 aa, Homo Sapiens
IRGKSPTNV

SEQ ID NO: 543003 - protein, 9 aa, Homo Sapiens
CSMGCFNDD

SEQ ID NO: 543004 - protein, 9 aa, Homo Sapiens
CACFDTSGP

SEQ ID NO: 543005 - protein, 9 aa, Homo Sapiens
LSEVSSKLG

SEQ ID NO: 543006 - protein, 9 aa, Homo Sapiens
VLQEESDVS

SEQ ID NO: 543007 - protein, 9 aa, Homo Sapiens
ARAPTLFNI

SEQ ID NO: 543008 - protein, 9 aa, Homo Sapiens
QDVVEAYQN

SEQ ID NO: 543009 - protein, 9 aa, Homo Sapiens
RVQPVAKAD

SEQ ID NO: 543010 - protein, 9 aa, Homo Sapiens
FSTREFILE

SEQ ID NO: 543011 - protein, 9 aa, Homo Sapiens
KRLPEVDCM

SEQ ID NO: 543012 - protein, 9 aa, Homo Sapiens
SGCSMGCFN

SEQ ID NO: 543013 - protein, 9 aa, Homo Sapiens
ALHGKRHML

SEQ ID NO: 543014 - protein, 9 aa, Homo Sapiens
RALLEMKDG

SEQ ID NO: 543015 - protein, 9 aa, Homo Sapiens
STSLSKSYI

SEQ ID NO: 543016 - protein, 9 aa, Homo Sapiens
DTEEALKEY

SEQ ID NO: 543017 - protein, 9 aa, Homo Sapiens
ERNPINVLI

SEQ ID NO: 543018 - protein, 9 aa, Homo Sapiens
FQQEDEAPP

SEQ ID NO: 543019 - protein, 9 aa, Homo Sapiens
RGILSSGPG

SEQ ID NO: 543020 - protein, 9 aa, Homo Sapiens
LSLIEKRLG

SEQ ID NO: 543021 - protein, 9 aa, Homo Sapiens
EGIQDVVEA

SEQ ID NO: 543022 - protein, 9 aa, Homo Sapiens
EVDCMVSRL

SEQ ID NO: 543023 - protein, 9 aa, Homo Sapiens
RDLSHFGFQ

SEQ ID NO: 543024 - protein, 9 aa, Homo Sapiens
IDGSIRGKS

SEQ ID NO: 543025 - protein, 9 aa, Homo Sapiens
THGAGLTEK

SEQ ID NO: 543026 - protein, 9 aa, Homo Sapiens
ASPIYRRYK

SEQ ID NO: 543027 - protein, 9 aa, Homo Sapiens
GKGRFLVLI

SEQ ID NO: 543028 - protein, 9 aa, Homo Sapiens
EPDWKLSPP

SEQ ID NO: 543029 - protein, 9 aa, Homo Sapiens
ADGDIMRDL

SEQ ID NO: 543030 - protein, 9 aa, Homo Sapiens
WKLSPPKRA

SEQ ID NO: 543031 - protein, 9 aa, Homo Sapiens
REFILEKNP

SEQ ID NO: 543032 - protein, 9 aa, Homo Sapiens
EDEEVVWVV

SEQ ID NO: 543033 - protein, 9 aa, Homo Sapiens
PISVMSVAG

SEQ ID NO: 543034 - protein, 9 aa, Homo Sapiens
LFNIREPTL

SEQ ID NO: 543035 - protein, 9 aa, Homo Sapiens
GRRKSVDQT

SEQ ID NO: 543036 - protein, 9 aa, Homo Sapiens
DGHRHHRHG

SEQ ID NO: 543037 - protein, 9 aa, Homo Sapiens
RAEELQNTG

SEQ ID NO: 543038 - protein, 9 aa, Homo Sapiens
SLIEKRLGE

SEQ ID NO: 543039 - protein, 9 aa, Homo Sapiens
TVVMVFIQD

SEQ ID NO: 543040 - protein, 9 aa, Homo Sapiens
GCSMGCFND

SEQ ID NO: 543041 - protein, 9 aa, Homo Sapiens
VSARAPTLF

SEQ ID NO: 543042 - protein, 9 aa, Homo Sapiens
VVMVFIQDI

SEQ ID NO: 543043 - protein, 9 aa, Homo Sapiens
LDNESLQQE

SEQ ID NO: 543044 - protein, 9 aa, Homo Sapiens
DLSHFGFQM

SEQ ID NO: 543045 - protein, 9 aa, Homo Sapiens
EKMKEPDWK

SEQ ID NO: 543046 - protein, 9 aa, Homo Sapiens
RRLQLQTPP

SEQ ID NO: 543047 - protein, 9 aa, Homo Sapiens
ETSVDLSEV

SEQ ID NO: 543048 - protein, 9 aa, Homo Sapiens
VVWVVGPSP

SEQ ID NO: 543049 - protein, 9 aa, Homo Sapiens
SQTAAHWHG

SEQ ID NO: 543050 - protein, 9 aa, Homo Sapiens
HRALLEMKD

SEQ ID NO: 543051 - protein, 9 aa, Homo Sapiens
GLCRSTVTH

SEQ ID NO: 543052 - protein, 9 aa, Homo Sapiens
MSVEKASNR

SEQ ID NO: 543053 - protein, 9 aa, Homo Sapiens
KPINVLNVK

SEQ ID NO: 543054 - protein, 9 aa, Homo Sapiens
DNESLQQEL

SEQ ID NO: 543055 - protein, 9 aa, Homo Sapiens
VENGILIWF

SEQ ID NO: 543056 - protein, 9 aa, Homo Sapiens
SAVNVANVS

SEQ ID NO: 543057 - protein, 9 aa, Homo Sapiens
ESDVSEDRG

SEQ ID NO: 543058 - protein, 9 aa, Homo Sapiens
GKRLPEVDC

SEQ ID NO: 543059 - protein, 9 aa, Homo Sapiens
RQADEEKRK

SEQ ID NO: 543060 - protein, 9 aa, Homo Sapiens
PAPSNLQRQ

SEQ ID NO: 543061 - protein, 9 aa, Homo Sapiens
KNFLAILSE

SEQ ID NO: 543062 - protein, 9 aa, Homo Sapiens
SMGCFNDDR

SEQ ID NO: 543063 - protein, 9 aa, Homo Sapiens
FFNTRRSIL

SEQ ID NO: 543064 - protein, 9 aa, Homo Sapiens
RVQLFFNTR

SEQ ID NO: 543065 - protein, 9 aa, Homo Sapiens
NWPGGSMMR

SEQ ID NO: 543066 - protein, 9 aa, Homo Sapiens
LTSQTAAHW

SEQ ID NO: 543067 - protein, 9 aa, Homo Sapiens
TLRPEGDID

SEQ ID NO: 543068 - protein, 9 aa, Homo Sapiens
VALLLRVEI

SEQ ID NO: 543069 - protein, 9 aa, Homo Sapiens
VQPVAKADR

SEQ ID NO: 543070 - protein, 9 aa, Homo Sapiens
CRSTVTHGA

SEQ ID NO: 543071 - protein, 9 aa, Homo Sapiens
NPISVMSVA

SEQ ID NO: 543072 - protein, 9 aa, Homo Sapiens
ITRRLQLQT

SEQ ID NO: 543073 - protein, 9 aa, Homo Sapiens
VDVTFQQED

SEQ ID NO: 543074 - protein, 9 aa, Homo Sapiens
LDDKPINVL

SEQ ID NO: 543075 - protein, 9 aa, Homo Sapiens
RHHRHGPGP

SEQ ID NO: 543076 - protein, 9 aa, Homo Sapiens
LDTAITRRL

SEQ ID NO: 543077 - protein, 9 aa, Homo Sapiens
SNRAQISFS

SEQ ID NO: 543078 - protein, 9 aa, Homo Sapiens
AASPIYRRY

SEQ ID NO: 543079 - protein, 9 aa, Homo Sapiens
WAKVSKQKK

SEQ ID NO: 543080 - protein, 9 aa, Homo Sapiens
IFSLKEEDG

SEQ ID NO: 543081 - protein, 9 aa, Homo Sapiens
TYAFSSGIN

SEQ ID NO: 543082 - protein, 9 aa, Homo Sapiens
INVLNVKRV

SEQ ID NO: 543083 - protein, 9 aa, Homo Sapiens
SVDLSEVSS

SEQ ID NO: 543084 - protein, 9 aa, Homo Sapiens
EKNPISVMS

SEQ ID NO: 543085 - protein, 9 aa, Homo Sapiens
RLDTGAHCT

SEQ ID NO: 543086 - protein, 9 aa, Homo Sapiens
FGFQMCGLC

SEQ ID NO: 543087 - protein, 9 aa, Homo Sapiens
VQLFFNTRR

SEQ ID NO: 543088 - protein, 9 aa, Homo Sapiens
AKADRQPRH

SEQ ID NO: 543089 - protein, 9 aa, Homo Sapiens
VLICFQGDE

SEQ ID NO: 543090 - protein, 9 aa, Homo Sapiens
AQISFSTRE

SEQ ID NO: 543091 - protein, 9 aa, Homo Sapiens
SVAGVSARA

SEQ ID NO: 543092 - protein, 9 aa, Homo Sapiens
PALDTAITR

SEQ ID NO: 543093 - protein, 9 aa, Homo Sapiens
EESKKKAAE

SEQ ID NO: 543094 - protein, 9 aa, Homo Sapiens
GGILFSHCS

SEQ ID NO: 543095 - protein, 9 aa, Homo Sapiens
FQMCGLCRS

SEQ ID NO: 543096 - protein, 9 aa, Homo Sapiens
VSKQKKALM

SEQ ID NO: 543097 - protein, 9 aa, Homo Sapiens
RRAEELQNT

SEQ ID NO: 543098 - protein, 9 aa, Homo Sapiens
PTSAVNVAN

SEQ ID NO: 543099 - protein, 9 aa, Homo Sapiens
IWFLCFRMR

SEQ ID NO: 543100 - protein, 9 aa, Homo Sapiens
LSHFGFQMC

SEQ ID NO: 543101 - protein, 9 aa, Homo Sapiens
RVEIHWGVT

SEQ ID NO: 543102 - protein, 9 aa, Homo Sapiens
ALLLRVEIH

SEQ ID NO: 543103 - protein, 9 aa, Homo Sapiens
DKPINVLNV

SEQ ID NO: 543104 - protein, 9 aa, Homo Sapiens
HSFGPLDNE

SEQ ID NO: 543105 - protein, 9 aa, Homo Sapiens
PDGHRHHRH

SEQ ID NO: 543106 - protein, 9 aa, Homo Sapiens
VPMPAAILT

SEQ ID NO: 543107 - protein, 9 aa, Homo Sapiens
DGDIMRDLS

SEQ ID NO: 543108 - protein, 9 aa, Homo Sapiens
NTRRSILER

SEQ ID NO: 543109 - protein, 9 aa, Homo Sapiens
SVEKASNRA

SEQ ID NO: 543110 - protein, 9 aa, Homo Sapiens
RSILERNPI

SEQ ID NO: 543111 - protein, 9 aa, Homo Sapiens
GLELQAVKS

SEQ ID NO: 543112 - protein, 9 aa, Homo Sapiens
ECEGIQDVV

SEQ ID NO: 543113 - protein, 9 aa, Homo Sapiens
SMMRATVML

SEQ ID NO: 543114 - protein, 9 aa, Homo Sapiens
SSGPGRGIH

SEQ ID NO: 543115 - protein, 9 aa, Homo Sapiens
CADGDIMRD

SEQ ID NO: 543116 - protein, 9 aa, Homo Sapiens
RKRQMSVPG

SEQ ID NO: 543117 - protein, 9 aa, Homo Sapiens
KASNRAQIS

SEQ ID NO: 543118 - protein, 9 aa, Homo Sapiens
NVMSVEKAS

SEQ ID NO: 543119 - protein, 9 aa, Homo Sapiens
KSVDQTEGT

SEQ ID NO: 543120 - protein, 9 aa, Homo Sapiens
RAEPPTGLE

SEQ ID NO: 543121 - protein, 9 aa, Homo Sapiens
NFLAILSES

SEQ ID NO: 543122 - protein, 9 aa, Homo Sapiens
VSSKLGSTQ

SEQ ID NO: 543123 - protein, 9 aa, Homo Sapiens
FRVLISFSI

SEQ ID NO: 543124 - protein, 9 aa, Homo Sapiens
TSAVNVANV

SEQ ID NO: 543125 - protein, 9 aa, Homo Sapiens
VEKASNRAQ

SEQ ID NO: 543126 - protein, 9 aa, Homo Sapiens
QTAAHWHGL

SEQ ID NO: 543127 - protein, 9 aa, Homo Sapiens
LLKVALLLR

SEQ ID NO: 543128 - protein, 9 aa, Homo Sapiens
PYPWVKIDE

SEQ ID NO: 543129 - protein, 9 aa, Homo Sapiens
QTHRALLEM

SEQ ID NO: 543130 - protein, 9 aa, Homo Sapiens
VTFQQEDEA

SEQ ID NO: 543131 - protein, 9 aa, Homo Sapiens
VLISFSIDG

SEQ ID NO: 543132 - protein, 9 aa, Homo Sapiens
GILSSGPGR

SEQ ID NO: 543133 - protein, 9 aa, Homo Sapiens
PETVVMVFI

SEQ ID NO: 543134 - protein, 9 aa, Homo Sapiens
QADEEKRKR

SEQ ID NO: 543135 - protein, 9 aa, Homo Sapiens
SNLQRQGSR

SEQ ID NO: 543136 - protein, 9 aa, Homo Sapiens
ACADGDIMR

SEQ ID NO: 543137 - protein, 9 aa, Homo Sapiens
GPGRGIHSR

SEQ ID NO: 543138 - protein, 9 aa, Homo Sapiens
TIKTHVSSK

SEQ ID NO: 543139 - protein, 9 aa, Homo Sapiens
EYDFLVTAE

SEQ ID NO: 543140 - protein, 9 aa, Homo Sapiens
KVGPAPSNL

SEQ ID NO: 543141 - protein, 9 aa, Homo Sapiens
LIEKRLGEL

SEQ ID NO: 543142 - protein, 9 aa, Homo Sapiens
STLRPEGDI

SEQ ID NO: 543143 - protein, 9 aa, Homo Sapiens
GKSPTNVMS

SEQ ID NO: 543144 - protein, 9 aa, Homo Sapiens
QEESDVSED

SEQ ID NO: 543145 - protein, 9 aa, Homo Sapiens
IVGKVSFRV

SEQ ID NO: 543146 - protein, 9 aa, Homo Sapiens
LGASPYPWV

SEQ ID NO: 543147 - protein, 9 aa, Homo Sapiens
DLERLDTGA

SEQ ID NO: 543148 - protein, 9 aa, Homo Sapiens
TSVDLSEVS

SEQ ID NO: 543149 - protein, 9 aa, Homo Sapiens
KDLERLDTG

SEQ ID NO: 543150 - protein, 9 aa, Homo Sapiens
VRAEPPTGL

SEQ ID NO: 543151 - protein, 9 aa, Homo Sapiens
ANWPGGSMM

SEQ ID NO: 543152 - protein, 9 aa, Homo Sapiens
QLFFNTRRS

SEQ ID NO: 543153 - protein, 9 aa, Homo Sapiens
SFSIDGSIR

SEQ ID NO: 543154 - protein, 9 aa, Homo Sapiens
FSIDGSIRG

SEQ ID NO: 543155 - protein, 9 aa, Homo Sapiens
LALHGKRHM

SEQ ID NO: 543156 - protein, 9 aa, Homo Sapiens
NGILIWFLC

SEQ ID NO: 543157 - protein, 9 aa, Homo Sapiens
QLCACFDTS

SEQ ID NO: 543158 - protein, 9 aa, Homo Sapiens
LIWFLCFRM

SEQ ID NO: 543159 - protein, 9 aa, Homo Sapiens
FDTSGPTMR

SEQ ID NO: 543160 - protein, 9 aa, Homo Sapiens
LERNPINVL

SEQ ID NO: 543161 - protein, 9 aa, Homo Sapiens
VDQTEGTPV

SEQ ID NO: 543162 - protein, 9 aa, Homo Sapiens
FKMEESKKK

SEQ ID NO: 543163 - protein, 9 aa, Homo Sapiens
SEVSSKLGS

SEQ ID NO: 543164 - protein, 9 aa, Homo Sapiens
DSQVRAFQH

SEQ ID NO: 543165 - protein, 9 aa, Homo Sapiens
RHGPGPVLQ

SEQ ID NO: 543166 - protein, 9 aa, Homo Sapiens
CATYAFSSG

SEQ ID NO: 543167 - protein, 9 aa, Homo Sapiens
GRNPTSAVN

SEQ ID NO: 543168 - protein, 9 aa, Homo Sapiens
GSMMRATVM

SEQ ID NO: 543169 - protein, 9 aa, Homo Sapiens
LQNTGPWGL

SEQ ID NO: 543170 - protein, 9 aa, Homo Sapiens
PGKVGPAPS

SEQ ID NO: 543171 - protein, 9 aa, Homo Sapiens
RGKSPTNVM

SEQ ID NO: 543172 - protein, 9 aa, Homo Sapiens
PGGSMMRAT

SEQ ID NO: 543173 - protein, 9 aa, Homo Sapiens
GLTEKANWP

SEQ ID NO: 543174 - protein, 9 aa, Homo Sapiens
PALGGDPEH

SEQ ID NO: 543175 - protein, 9 aa, Homo Sapiens
LEKNPISVM

SEQ ID NO: 543176 - protein, 9 aa, Homo Sapiens
YVSAQASPG

SEQ ID NO: 543177 - protein, 9 aa, Homo Sapiens
LVLICFQGD

SEQ ID NO: 543178 - protein, 9 aa, Homo Sapiens
FIQDIDSGD

SEQ ID NO: 543179 - protein, 9 aa, Homo Sapiens
TKNFLAILS

SEQ ID NO: 543180 - protein, 9 aa, Homo Sapiens
LTEKANWPG

SEQ ID NO: 543181 - protein, 9 aa, Homo Sapiens
GILFSHCSG

SEQ ID NO: 543182 - protein, 9 aa, Homo Sapiens
VKRVSVRVQ

SEQ ID NO: 543183 - protein, 9 aa, Homo Sapiens
VTHGAGLTE

SEQ ID NO: 543184 - protein, 9 aa, Homo Sapiens
RAPTLFNIR

SEQ ID NO: 543185 - protein, 9 aa, Homo Sapiens
QMCGLCRST

SEQ ID NO: 543186 - protein, 9 aa, Homo Sapiens
LGAFFSTLR

SEQ ID NO: 543187 - protein, 9 aa, Homo Sapiens
SLKEEDGAL

SEQ ID NO: 543188 - protein, 9 aa, Homo Sapiens
SKYGTDFIC

SEQ ID NO: 543189 - protein, 9 aa, Homo Sapiens
TVPMPAAIL

SEQ ID NO: 543190 - protein, 9 aa, Homo Sapiens
PVAKADRQP

SEQ ID NO: 543191 - protein, 9 aa, Homo Sapiens
EWVDVTFQQ

SEQ ID NO: 543192 - protein, 9 aa, Homo Sapiens
VMSVAGVSA

SEQ ID NO: 543193 - protein, 9 aa, Homo Sapiens
LKVALLLRV

SEQ ID NO: 543194 - protein, 9 aa, Homo Sapiens
MGCFNDDRI

SEQ ID NO: 543195 - protein, 9 aa, Homo Sapiens
NVLNVKRVS

SEQ ID NO: 543196 - protein, 9 aa, Homo Sapiens
GKKLWTVPM

SEQ ID NO: 543197 - protein, 9 aa, Homo Sapiens
RHHLPALGG

SEQ ID NO: 543198 - protein, 9 aa, Homo Sapiens
ILSSGPGRG

SEQ ID NO: 543199 - protein, 9 aa, Homo Sapiens
TAITRRLQL

SEQ ID NO: 543200 - protein, 9 aa, Homo Sapiens
EEVLVANCA

SEQ ID NO: 543201 - protein, 9 aa, Homo Sapiens
AFSSGINAI

SEQ ID NO: 543202 - protein, 9 aa, Homo Sapiens
LERLDTGAH

SEQ ID NO: 543203 - protein, 9 aa, Homo Sapiens
PEHLPEPEP

SEQ ID NO: 543204 - protein, 9 aa, Homo Sapiens
VSVRVQLFF

SEQ ID NO: 543205 - protein, 9 aa, Homo Sapiens
PGKGRFLVL

SEQ ID NO: 543206 - protein, 9 aa, Homo Sapiens
AGVSARAPT

SEQ ID NO: 543207 - protein, 9 aa, Homo Sapiens
GAHCTSTDG

SEQ ID NO: 543208 - protein, 9 aa, Homo Sapiens
KLWTVPMPA

SEQ ID NO: 543209 - protein, 9 aa, Homo Sapiens
STVTHGAGL

SEQ ID NO: 543210 - protein, 9 aa, Homo Sapiens
FNDDRIVFW

SEQ ID NO: 543211 - protein, 9 aa, Homo Sapiens
PEVDCMVSR

SEQ ID NO: 543212 - protein, 9 aa, Homo Sapiens
TLFNIREPT

SEQ ID NO: 543213 - protein, 9 aa, Homo Sapiens
LRVEIHWGV

SEQ ID NO: 543214 - protein, 9 aa, Homo Sapiens
ATESLGDYQ

SEQ ID NO: 543215 - protein, 9 aa, Homo Sapiens
AHCTSTDGR

SEQ ID NO: 543216 - protein, 9 aa, Homo Sapiens
NGYVSAQAS

SEQ ID NO: 543217 - protein, 9 aa, Homo Sapiens
KRKRQMSVP

SEQ ID NO: 543218 - protein, 9 aa, Homo Sapiens
KANWPGGSM

SEQ ID NO: 543219 - protein, 9 aa, Homo Sapiens
REPTLGRNP

SEQ ID NO: 543220 - protein, 9 aa, Homo Sapiens
LKEYDFLVT

SEQ ID NO: 543221 - protein, 9 aa, Homo Sapiens
CFDTSGPTM

SEQ ID NO: 543222 - protein, 9 aa, Homo Sapiens
PGPVLQEES

SEQ ID NO: 543223 - protein, 9 aa, Homo Sapiens
PWVKIDEEF

SEQ ID NO: 543224 - protein, 9 aa, Homo Sapiens
PTNVMSVEK

SEQ ID NO: 543225 - protein, 9 aa, Homo Sapiens
KADRQPRHP

SEQ ID NO: 543226 - protein, 9 aa, Homo Sapiens
DTSDCATYA

SEQ ID NO: 543227 - protein, 9 aa, Homo Sapiens
RRSILERNP

SEQ ID NO: 543228 - protein, 9 aa, Homo Sapiens
AARARDPPD

SEQ ID NO: 543229 - protein, 9 aa, Homo Sapiens
KKALMDKLQ

SEQ ID NO: 543230 - protein, 9 aa, Homo Sapiens
EPAAARARD

SEQ ID NO: 543231 - protein, 9 aa, Homo Sapiens
FNTRRSILE

SEQ ID NO: 543232 - protein, 9 aa, Homo Sapiens
EVSSKLGST

SEQ ID NO: 543233 - protein, 9 aa, Homo Sapiens
PLPEDEEVV

SEQ ID NO: 543234 - protein, 9 aa, Homo Sapiens
GVSARAPTL

SEQ ID NO: 543235 - protein, 9 aa, Homo Sapiens
ASPYPWVKI

SEQ ID NO: 543236 - protein, 9 aa, Homo Sapiens
HHRHGPGPV

SEQ ID NO: 543237 - protein, 9 aa, Homo Sapiens
RRKSVDQTE

SEQ ID NO: 543238 - protein, 9 aa, Homo Sapiens
SLDDKPINV

SEQ ID NO: 543239 - protein, 9 aa, Homo Sapiens
VGPAPSNLQ

SEQ ID NO: 543240 - protein, 9 aa, Homo Sapiens
EDGALAKVL

SEQ ID NO: 543241 - protein, 9 aa, Homo Sapiens
QRRAEELQN

SEQ ID NO: 543242 - protein, 9 aa, Homo Sapiens
RARDPPDGH

SEQ ID NO: 543243 - protein, 9 aa, Homo Sapiens
VQKDLERLD

SEQ ID NO: 543244 - protein, 9 aa, Homo Sapiens
HCSGTIYAE

SEQ ID NO: 543245 - protein, 9 aa, Homo Sapiens
QSTSLSKSY

SEQ ID NO: 543246 - protein, 9 aa, Homo Sapiens
ERLDTGAHC

SEQ ID NO: 543247 - protein, 9 aa, Homo Sapiens
VAGVSARAP

SEQ ID NO: 543248 - protein, 9 aa, Homo Sapiens
VGKVSFRVL

SEQ ID NO: 543249 - protein, 9 aa, Homo Sapiens
LKEEDGALA

SEQ ID NO: 543250 - protein, 9 aa, Homo Sapiens
QVRAFQHTS

SEQ ID NO: 543251 - protein, 9 aa, Homo Sapiens
EKRLGELLT

SEQ ID NO: 543252 - protein, 9 aa, Homo Sapiens
PEPEPAAAR

SEQ ID NO: 543253 - protein, 9 aa, Homo Sapiens
SVMSVAGVS

SEQ ID NO: 543254 - protein, 9 aa, Homo Sapiens
SHCSGTIYA

SEQ ID NO: 543255 - protein, 9 aa, Homo Sapiens
VLVANCASE

SEQ ID NO: 543256 - protein, 9 aa, Homo Sapiens
DVTFQQEDE

SEQ ID NO: 543257 - protein, 9 aa, Homo Sapiens
IQRRAEELQ

SEQ ID NO: 543258 - protein, 9 aa, Homo Sapiens
NVKRVSVRV

SEQ ID NO: 543259 - protein, 9 aa, Homo Sapiens
RVSVRVQLF

SEQ ID NO: 543260 - protein, 9 aa, Homo Sapiens
ADRQPRHPS

SEQ ID NO: 543261 - protein, 9 aa, Homo Sapiens
ISFSIDGSI

SEQ ID NO: 543262 - protein, 9 aa, Homo Sapiens
TGLELQAVK

SEQ ID NO: 543263 - protein, 9 aa, Homo Sapiens
PINVLIVGK

SEQ ID NO: 543264 - protein, 9 aa, Homo Sapiens
FFSTLRPEG

SEQ ID NO: 543265 - protein, 9 aa, Homo Sapiens
IEKRLGELL

SEQ ID NO: 543266 - protein, 9 aa, Homo Sapiens
TEEALKEYD

SEQ ID NO: 543267 - protein, 9 aa, Homo Sapiens
CFNDDRIVF

SEQ ID NO: 543268 - protein, 9 aa, Homo Sapiens
ILIWFLCFR

SEQ ID NO: 543269 - protein, 9 aa, Homo Sapiens
HCTSTDGRL

SEQ ID NO: 543270 - protein, 9 aa, Homo Sapiens
RKGGILFSH

SEQ ID NO: 543271 - protein, 9 aa, Homo Sapiens
PTGLELQAV

SEQ ID NO: 543272 - protein, 9 aa, Homo Sapiens
HFRLTSQTA

SEQ ID NO: 543273 - protein, 9 aa, Homo Sapiens
QHTSTLAAM

SEQ ID NO: 543274 - protein, 9 aa, Homo Sapiens
LRQADEEKR

SEQ ID NO: 543275 - protein, 9 aa, Homo Sapiens
GPGPVLQEE

SEQ ID NO: 543276 - protein, 9 aa, Homo Sapiens
LCACFDTSG

SEQ ID NO: 543277 - protein, 9 aa, Homo Sapiens
STIKTHVSS

SEQ ID NO: 543278 - protein, 9 aa, Homo Sapiens
VANCASEAV

SEQ ID NO: 543279 - protein, 9 aa, Homo Sapiens
TWAKVSKQK

SEQ ID NO: 543280 - protein, 9 aa, Homo Sapiens
FSTIREAAG

SEQ ID NO: 543281 - protein, 9 aa, Homo Sapiens
SSSVTFQGT

SEQ ID NO: 543282 - protein, 9 aa, Homo Sapiens
HFFDTYQGL

SEQ ID NO: 543283 - protein, 9 aa, Homo Sapiens
PEPPHVLAP

SEQ ID NO: 543284 - protein, 9 aa, Homo Sapiens
HVAQLGNFE

SEQ ID NO: 543285 - protein, 9 aa, Homo Sapiens
AESDGEEKR

SEQ ID NO: 543286 - protein, 9 aa, Homo Sapiens
SQKLTPAHR

SEQ ID NO: 543287 - protein, 9 aa, Homo Sapiens
EDENYVMKL

SEQ ID NO: 543288 - protein, 9 aa, Homo Sapiens
LLMCIGDKE

SEQ ID NO: 543289 - protein, 9 aa, Homo Sapiens
RYSQKLTPA

SEQ ID NO: 543290 - protein, 9 aa, Homo Sapiens
ALAPAQDSV

SEQ ID NO: 543291 - protein, 9 aa, Homo Sapiens
EILNGTKCI

SEQ ID NO: 543292 - protein, 9 aa, Homo Sapiens
LSAAENLPC

SEQ ID NO: 543293 - protein, 9 aa, Homo Sapiens
SISQGVGRI

SEQ ID NO: 543294 - protein, 9 aa, Homo Sapiens
AEESTGKPL

SEQ ID NO: 543295 - protein, 9 aa, Homo Sapiens
NLHEWEDAL

SEQ ID NO: 543296 - protein, 9 aa, Homo Sapiens
PWDTACGTQ

SEQ ID NO: 543297 - protein, 9 aa, Homo Sapiens
NGTKCIWVK

SEQ ID NO: 543298 - protein, 9 aa, Homo Sapiens
RLSAAENLP

SEQ ID NO: 543299 - protein, 9 aa, Homo Sapiens
MEKILEEKT

SEQ ID NO: 543300 - protein, 9 aa, Homo Sapiens
IGGRLLMCI

SEQ ID NO: 543301 - protein, 9 aa, Homo Sapiens
LEEKTRQRE

SEQ ID NO: 543302 - protein, 9 aa, Homo Sapiens
FQPEPPHVL

SEQ ID NO: 543303 - protein, 9 aa, Homo Sapiens
GRLLMCIGD

SEQ ID NO: 543304 - protein, 9 aa, Homo Sapiens
VEQLQPAPS

SEQ ID NO: 543305 - protein, 9 aa, Homo Sapiens
HRLSAAENL

SEQ ID NO: 543306 - protein, 9 aa, Homo Sapiens
CSDTCAPNE

SEQ ID NO: 543307 - protein, 9 aa, Homo Sapiens
EESTGKPLN

SEQ ID NO: 543308 - protein, 9 aa, Homo Sapiens
CHPHRLFQP

SEQ ID NO: 543309 - protein, 9 aa, Homo Sapiens
NKREPQHVA

SEQ ID NO: 543310 - protein, 9 aa, Homo Sapiens
NEDEEEDDD

SEQ ID NO: 543311 - protein, 9 aa, Homo Sapiens
ISQGVGRIQ

SEQ ID NO: 543312 - protein, 9 aa, Homo Sapiens
GSYQSGISD

SEQ ID NO: 543313 - protein, 9 aa, Homo Sapiens
ALPWPSEAV

SEQ ID NO: 543314 - protein, 9 aa, Homo Sapiens
HEPDSLQFS

SEQ ID NO: 543315 - protein, 9 aa, Homo Sapiens
GYNLATKRT

SEQ ID NO: 543316 - protein, 9 aa, Homo Sapiens
NLATKRTPK

SEQ ID NO: 543317 - protein, 9 aa, Homo Sapiens
VFKFLIRLH

SEQ ID NO: 543318 - protein, 9 aa, Homo Sapiens
QVFKFLIRL

SEQ ID NO: 543319 - protein, 9 aa, Homo Sapiens
IVRSLYEDP

SEQ ID NO: 543320 - protein, 9 aa, Homo Sapiens
EFSGNPLYF

SEQ ID NO: 543321 - protein, 9 aa, Homo Sapiens
QKSIQMELL

SEQ ID NO: 543322 - protein, 9 aa, Homo Sapiens
TKRTPKEGV

SEQ ID NO: 543323 - protein, 9 aa, Homo Sapiens
ECVLGFCQL

SEQ ID NO: 543324 - protein, 9 aa, Homo Sapiens
EPDSLQFST

SEQ ID NO: 543325 - protein, 9 aa, Homo Sapiens
VGSYQSGIS

SEQ ID NO: 543326 - protein, 9 aa, Homo Sapiens
LLNFPGSFH

SEQ ID NO: 543327 - protein, 9 aa, Homo Sapiens
DVVGYVVDW

SEQ ID NO: 543328 - protein, 9 aa, Homo Sapiens
FFDTYQGLL

SEQ ID NO: 543329 - protein, 9 aa, Homo Sapiens
RYIDQSGFV

SEQ ID NO: 543330 - protein, 9 aa, Homo Sapiens
CHVEGGTRP

SEQ ID NO: 543331 - protein, 9 aa, Homo Sapiens
LGECVLGFC

SEQ ID NO: 543332 - protein, 9 aa, Homo Sapiens
RSLYEDPED

SEQ ID NO: 543333 - protein, 9 aa, Homo Sapiens
QMELLKHEK

SEQ ID NO: 543334 - protein, 9 aa, Homo Sapiens
NYVMKLQGE

SEQ ID NO: 543335 - protein, 9 aa, Homo Sapiens
TRPAYQWLK

SEQ ID NO: 543336 - protein, 9 aa, Homo Sapiens
LYEDPEDHP

SEQ ID NO: 543337 - protein, 9 aa, Homo Sapiens
STGKPLNTT

SEQ ID NO: 543338 - protein, 9 aa, Homo Sapiens
VQFVDWCPA

SEQ ID NO: 543339 - protein, 9 aa, Homo Sapiens
SPALAPAQD

SEQ ID NO: 543340 - protein, 9 aa, Homo Sapiens
VKDLTNFSD

SEQ ID NO: 543341 - protein, 9 aa, Homo Sapiens
WPSEAVPQD

SEQ ID NO: 543342 - protein, 9 aa, Homo Sapiens
EKILEEKTR

SEQ ID NO: 543343 - protein, 9 aa, Homo Sapiens
QFGIHDNTM

SEQ ID NO: 543344 - protein, 9 aa, Homo Sapiens
SAAENLPCC

SEQ ID NO: 543345 - protein, 9 aa, Homo Sapiens
QKLTPAHRL

SEQ ID NO: 543346 - protein, 9 aa, Homo Sapiens
SVTFQGTRE

SEQ ID NO: 543347 - protein, 9 aa, Homo Sapiens
PALAPAQDS

SEQ ID NO: 543348 - protein, 9 aa, Homo Sapiens
CKFQVVILK

SEQ ID NO: 543349 - protein, 9 aa, Homo Sapiens
AENLPCCHP

SEQ ID NO: 543350 - protein, 9 aa, Homo Sapiens
LVKNQVFKF

SEQ ID NO: 543351 - protein, 9 aa, Homo Sapiens
NTMEAERAE

SEQ ID NO: 543352 - protein, 9 aa, Homo Sapiens
DQSGFVKAL

SEQ ID NO: 543353 - protein, 9 aa, Homo Sapiens
YEDPEDHPN

SEQ ID NO: 543354 - protein, 9 aa, Homo Sapiens
TCAPNEMKN

SEQ ID NO: 543355 - protein, 9 aa, Homo Sapiens
EDPEDHPNV

SEQ ID NO: 543356 - protein, 9 aa, Homo Sapiens
TNFSDNVDQ

SEQ ID NO: 543357 - protein, 9 aa, Homo Sapiens
SLQFSTVGG

SEQ ID NO: 543358 - protein, 9 aa, Homo Sapiens
PAPSGLTSQ

SEQ ID NO: 543359 - protein, 9 aa, Homo Sapiens
KFLIRLHSA

SEQ ID NO: 543360 - protein, 9 aa, Homo Sapiens
WEFSGNPLY

SEQ ID NO: 543361 - protein, 9 aa, Homo Sapiens
DSERLLNFP

SEQ ID NO: 543362 - protein, 9 aa, Homo Sapiens
SEDENYVMK

SEQ ID NO: 543363 - protein, 9 aa, Homo Sapiens
DTACGTQLP

SEQ ID NO: 543364 - protein, 9 aa, Homo Sapiens
MELGGLGEC

SEQ ID NO: 543365 - protein, 9 aa, Homo Sapiens
PTQFGIHDN

SEQ ID NO: 543366 - protein, 9 aa, Homo Sapiens
VRSLYEDPE

SEQ ID NO: 543367 - protein, 9 aa, Homo Sapiens
GTRPAYQWL

SEQ ID NO: 543368 - protein, 9 aa, Homo Sapiens
GGTRPAYQW

SEQ ID NO: 543369 - protein, 9 aa, Homo Sapiens
KSIQMELLK

SEQ ID NO: 543370 - protein, 9 aa, Homo Sapiens
EEEDDDEED

SEQ ID NO: 543371 - protein, 9 aa, Homo Sapiens
TQMLNVFFT

SEQ ID NO: 543372 - protein, 9 aa, Homo Sapiens
RLFQPEPPH

SEQ ID NO: 543373 - protein, 9 aa, Homo Sapiens
PAHRLSAAE

SEQ ID NO: 543374 - protein, 9 aa, Homo Sapiens
CPAGFKVGI

SEQ ID NO: 543375 - protein, 9 aa, Homo Sapiens
KERKEILNG

SEQ ID NO: 543376 - protein, 9 aa, Homo Sapiens
MELLKHEKV

SEQ ID NO: 543377 - protein, 9 aa, Homo Sapiens
APSGLTSQS

SEQ ID NO: 543378 - protein, 9 aa, Homo Sapiens
TIREAAGLF

SEQ ID NO: 543379 - protein, 9 aa, Homo Sapiens
LTPAHRLSA

SEQ ID NO: 543380 - protein, 9 aa, Homo Sapiens
AGCVAGVLL

SEQ ID NO: 543381 - protein, 9 aa, Homo Sapiens
QHVAQLGNF

SEQ ID NO: 543382 - protein, 9 aa, Homo Sapiens
VFFTRMENQ

SEQ ID NO: 543383 - protein, 9 aa, Homo Sapiens
WYENLHEWE

SEQ ID NO: 543384 - protein, 9 aa, Homo Sapiens
VKACLWGAG

SEQ ID NO: 543385 - protein, 9 aa, Homo Sapiens
TLTQMLNVF

SEQ ID NO: 543386 - protein, 9 aa, Homo Sapiens
KFQVVILKS

SEQ ID NO: 543387 - protein, 9 aa, Homo Sapiens
QPGDVVGYV

SEQ ID NO: 543388 - protein, 9 aa, Homo Sapiens
KTRQRERKE

SEQ ID NO: 543389 - protein, 9 aa, Homo Sapiens
CLAMLLHFF

SEQ ID NO: 543390 - protein, 9 aa, Homo Sapiens
EEKTRQRER

SEQ ID NO: 543391 - protein, 9 aa, Homo Sapiens
KNQVFKFLI

SEQ ID NO: 543392 - protein, 9 aa, Homo Sapiens
LAPAQDSVE

SEQ ID NO: 543393 - protein, 9 aa, Homo Sapiens
KEILNGTKC

SEQ ID NO: 543394 - protein, 9 aa, Homo Sapiens
AMLLHFFDT

SEQ ID NO: 543395 - protein, 9 aa, Homo Sapiens
TVKDLTNFS

SEQ ID NO: 543396 - protein, 9 aa, Homo Sapiens
EGGTRPAYQ

SEQ ID NO: 543397 - protein, 9 aa, Homo Sapiens
VAQLGNFEQ

SEQ ID NO: 543398 - protein, 9 aa, Homo Sapiens
LGGLGECVL

SEQ ID NO: 543399 - protein, 9 aa, Homo Sapiens
REPQHVAQL

SEQ ID NO: 543400 - protein, 9 aa, Homo Sapiens
DDKQKSIQM

SEQ ID NO: 543401 - protein, 9 aa, Homo Sapiens
KRTPKEGVK

SEQ ID NO: 543402 - protein, 9 aa, Homo Sapiens
HTVILRAQP

SEQ ID NO: 543403 - protein, 9 aa, Homo Sapiens
EQLQPAPSG

SEQ ID NO: 543404 - protein, 9 aa, Homo Sapiens
DWCPAGFKV

SEQ ID NO: 543405 - protein, 9 aa, Homo Sapiens
GVGRIQLKG

SEQ ID NO: 543406 - protein, 9 aa, Homo Sapiens
YNLATKRTP

SEQ ID NO: 543407 - protein, 9 aa, Homo Sapiens
GAGCVAGVL

SEQ ID NO: 543408 - protein, 9 aa, Homo Sapiens
ESISQGVGR

SEQ ID NO: 543409 - protein, 9 aa, Homo Sapiens
IHDNTMEAE

SEQ ID NO: 543410 - protein, 9 aa, Homo Sapiens
RPAYQWLKN

SEQ ID NO: 543411 - protein, 9 aa, Homo Sapiens
EIQATWYEN

SEQ ID NO: 543412 - protein, 9 aa, Homo Sapiens
ENLPCCHPH

SEQ ID NO: 543413 - protein, 9 aa, Homo Sapiens
AHRLSAAEN

SEQ ID NO: 543414 - protein, 9 aa, Homo Sapiens
IQMELLKHE

SEQ ID NO: 543415 - protein, 9 aa, Homo Sapiens
IQATWYENL

SEQ ID NO: 543416 - protein, 9 aa, Homo Sapiens
SGLTSQSRA

SEQ ID NO: 543417 - protein, 9 aa, Homo Sapiens
SGISDYHSE

SEQ ID NO: 543418 - protein, 9 aa, Homo Sapiens
SLYEDPEDH

SEQ ID NO: 543419 - protein, 9 aa, Homo Sapiens
LQFSTVGGW

SEQ ID NO: 543420 - protein, 9 aa, Homo Sapiens
PCCHPHRLF

SEQ ID NO: 543421 - protein, 9 aa, Homo Sapiens
RRYIDQSGF

SEQ ID NO: 543422 - protein, 9 aa, Homo Sapiens
CCHPHRLFQ

SEQ ID NO: 543423 - protein, 9 aa, Homo Sapiens
NSNRRYIDQ

SEQ ID NO: 543424 - protein, 9 aa, Homo Sapiens
PLVKNQVFK

SEQ ID NO: 543425 - protein, 9 aa, Homo Sapiens
QGVGRIQLK

SEQ ID NO: 543426 - protein, 9 aa, Homo Sapiens
CLWGAGCVA

SEQ ID NO: 543427 - protein, 9 aa, Homo Sapiens
DPEDHPNVQ

SEQ ID NO: 543428 - protein, 9 aa, Homo Sapiens
MKLQGESSN

SEQ ID NO: 543429 - protein, 9 aa, Homo Sapiens
LAMLLHFFD

SEQ ID NO: 543430 - protein, 9 aa, Homo Sapiens
FKFLIRLHS

SEQ ID NO: 543431 - protein, 9 aa, Homo Sapiens
YVMKLQGES

SEQ ID NO: 543432 - protein, 9 aa, Homo Sapiens
SQCSDTCAP

SEQ ID NO: 543433 - protein, 9 aa, Homo Sapiens
YIDQSGFVK

SEQ ID NO: 543434 - protein, 9 aa, Homo Sapiens
RLLNFPGSF

SEQ ID NO: 543435 - protein, 9 aa, Homo Sapiens
PDSLQFSTV

SEQ ID NO: 543436 - protein, 9 aa, Homo Sapiens
FSDNVDQQE

SEQ ID NO: 543437 - protein, 9 aa, Homo Sapiens
ATWYENLHE

SEQ ID NO: 543438 - protein, 9 aa, Homo Sapiens
RTPKEGVKV

SEQ ID NO: 543439 - protein, 9 aa, Homo Sapiens
MCIGDKEVE

SEQ ID NO: 543440 - protein, 9 aa, Homo Sapiens
PEDHPNVQK

SEQ ID NO: 543441 - protein, 9 aa, Homo Sapiens
HPHRLFQPE

SEQ ID NO: 543442 - protein, 9 aa, Homo Sapiens
VTFQGTRED

SEQ ID NO: 543443 - protein, 9 aa, Homo Sapiens
LHFFDTYQG

SEQ ID NO: 543444 - protein, 9 aa, Homo Sapiens
IDQSGFVKA

SEQ ID NO: 543445 - protein, 9 aa, Homo Sapiens
LRGHTVILR

SEQ ID NO: 543446 - protein, 9 aa, Homo Sapiens
HVLAPWDTA

SEQ ID NO: 543447 - protein, 9 aa, Homo Sapiens
GGLGECVLG

SEQ ID NO: 543448 - protein, 9 aa, Homo Sapiens
EKTRQRERK

SEQ ID NO: 543449 - protein, 9 aa, Homo Sapiens
ENYVMKLQG

SEQ ID NO: 543450 - protein, 9 aa, Homo Sapiens
VVGYVVDWC

SEQ ID NO: 543451 - protein, 9 aa, Homo Sapiens
RAQPGLQVL

SEQ ID NO: 543452 - protein, 9 aa, Homo Sapiens
LQPAPSGLT

SEQ ID NO: 543453 - protein, 9 aa, Homo Sapiens
WGAGCVAGV

SEQ ID NO: 543454 - protein, 9 aa, Homo Sapiens
VKNQVFKFL

SEQ ID NO: 543455 - protein, 9 aa, Homo Sapiens
DSLQFSTVG

SEQ ID NO: 543456 - protein, 9 aa, Homo Sapiens
VWEFSGNPL

SEQ ID NO: 543457 - protein, 9 aa, Homo Sapiens
HSSVGSYQS

SEQ ID NO: 543458 - protein, 9 aa, Homo Sapiens
SERLLNFPG

SEQ ID NO: 543459 - protein, 9 aa, Homo Sapiens
GHTVILRAQ

SEQ ID NO: 543460 - protein, 9 aa, Homo Sapiens
KQKSIQMEL

SEQ ID NO: 543461 - protein, 9 aa, Homo Sapiens
RRYSQKLTP

SEQ ID NO: 543462 - protein, 9 aa, Homo Sapiens
QSGISDYHS

SEQ ID NO: 543463 - protein, 9 aa, Homo Sapiens
TPAHRLSAA

SEQ ID NO: 543464 - protein, 9 aa, Homo Sapiens
WDTACGTQL

SEQ ID NO: 543465 - protein, 9 aa, Homo Sapiens
FQGTREDDG

SEQ ID NO: 543466 - protein, 9 aa, Homo Sapiens
LNFPGSFHE

SEQ ID NO: 543467 - protein, 9 aa, Homo Sapiens
PAQDSVEQL

SEQ ID NO: 543468 - protein, 9 aa, Homo Sapiens
SQGVGRIQL

SEQ ID NO: 543469 - protein, 9 aa, Homo Sapiens
RIQLKGDIL

SEQ ID NO: 543470 - protein, 9 aa, Homo Sapiens
VSEDENYVM

SEQ ID NO: 543471 - protein, 9 aa, Homo Sapiens
MLLHFFDTY

SEQ ID NO: 543472 - protein, 9 aa, Homo Sapiens
QPAPSGLTS

SEQ ID NO: 543473 - protein, 9 aa, Homo Sapiens
TRQRERKEQ

SEQ ID NO: 543474 - protein, 9 aa, Homo Sapiens
SYQSGISDY

SEQ ID NO: 543475 - protein, 9 aa, Homo Sapiens
LAPWDTACG

SEQ ID NO: 543476 - protein, 9 aa, Homo Sapiens
RLLMCIGDK

SEQ ID NO: 543477 - protein, 9 aa, Homo Sapiens
QSGFVKALG

SEQ ID NO: 543478 - protein, 9 aa, Homo Sapiens
QGTREDDGA

SEQ ID NO: 543479 - protein, 9 aa, Homo Sapiens
DKQKSIQME

SEQ ID NO: 543480 - protein, 9 aa, Homo Sapiens
ELGGLGECV

SEQ ID NO: 543481 - protein, 9 aa, Homo Sapiens
NRRYIDQSG

SEQ ID NO: 543482 - protein, 9 aa, Homo Sapiens
LLHFFDTYQ

SEQ ID NO: 543483 - protein, 9 aa, Homo Sapiens
HKERKEILN

SEQ ID NO: 543484 - protein, 9 aa, Homo Sapiens
GDVVGYVVD

SEQ ID NO: 543485 - protein, 9 aa, Homo Sapiens
PSGLTSQSR

SEQ ID NO: 543486 - protein, 9 aa, Homo Sapiens
HRLFQPEPP

SEQ ID NO: 543487 - protein, 9 aa, Homo Sapiens
EDEEEDDDE

SEQ ID NO: 543488 - protein, 9 aa, Homo Sapiens
KREPQHVAQ

SEQ ID NO: 543489 - protein, 9 aa, Homo Sapiens
LWGAGCVAG

SEQ ID NO: 543490 - protein, 9 aa, Homo Sapiens
APAQDSVEQ

SEQ ID NO: 543491 - protein, 9 aa, Homo Sapiens
AAEESTGKP

SEQ ID NO: 543492 - protein, 9 aa, Homo Sapiens
QDSVEQLRK

SEQ ID NO: 543493 - protein, 9 aa, Homo Sapiens
HVEGGTRPA

SEQ ID NO: 543494 - protein, 9 aa, Homo Sapiens
GRIQLKGDI

SEQ ID NO: 543495 - protein, 9 aa, Homo Sapiens
QFVDWCPAG

SEQ ID NO: 543496 - protein, 9 aa, Homo Sapiens
DLTNFSDNV

SEQ ID NO: 543497 - protein, 9 aa, Homo Sapiens
VLAPWDTAC

SEQ ID NO: 543498 - protein, 9 aa, Homo Sapiens
ILEEKTRQR

SEQ ID NO: 543499 - protein, 9 aa, Homo Sapiens
PWPSEAVPQ

SEQ ID NO: 543500 - protein, 9 aa, Homo Sapiens
TVILRAQPG

SEQ ID NO: 543501 - protein, 9 aa, Homo Sapiens
VMKLQGESS

SEQ ID NO: 543502 - protein, 9 aa, Homo Sapiens
CVLGFCQLN

SEQ ID NO: 543503 - protein, 9 aa, Homo Sapiens
GTREDDGAS

SEQ ID NO: 543504 - protein, 9 aa, Homo Sapiens
INKREPQHV

SEQ ID NO: 543505 - protein, 9 aa, Homo Sapiens
EFSTIREAA

SEQ ID NO: 543506 - protein, 9 aa, Homo Sapiens
RKEILNGTK

SEQ ID NO: 543507 - protein, 9 aa, Homo Sapiens
LPWPSEAVP

SEQ ID NO: 543508 - protein, 9 aa, Homo Sapiens
TFQGTREDD

SEQ ID NO: 543509 - protein, 9 aa, Homo Sapiens
PLYFCCYDY

SEQ ID NO: 543510 - protein, 9 aa, Homo Sapiens
FDTYQGLLQ

SEQ ID NO: 543511 - protein, 9 aa, Homo Sapiens
LATKRTPKE

SEQ ID NO: 543512 - protein, 9 aa, Homo Sapiens
ATKRTPKEG

SEQ ID NO: 543513 - protein, 9 aa, Homo Sapiens
ERKEILNGT

SEQ ID NO: 543514 - protein, 9 aa, Homo Sapiens
DTCAPNEMK

SEQ ID NO: 543515 - protein, 9 aa, Homo Sapiens
GLGECVLGF

SEQ ID NO: 543516 - protein, 9 aa, Homo Sapiens
DNTMEAERA

SEQ ID NO: 543517 - protein, 9 aa, Homo Sapiens
PGSFHEAWG

SEQ ID NO: 543518 - protein, 9 aa, Homo Sapiens
MALPWPSEA

SEQ ID NO: 543519 - protein, 9 aa, Homo Sapiens
EPPHVLAPW

SEQ ID NO: 543520 - protein, 9 aa, Homo Sapiens
LRAQPGLQV

SEQ ID NO: 543521 - protein, 9 aa, Homo Sapiens
TQFGIHDNT

SEQ ID NO: 543522 - protein, 9 aa, Homo Sapiens
PHRLFQPEP

SEQ ID NO: 543523 - protein, 9 aa, Homo Sapiens
RGHTVILRA

SEQ ID NO: 543524 - protein, 9 aa, Homo Sapiens
GGRLLMCIG

SEQ ID NO: 543525 - protein, 9 aa, Homo Sapiens
LYFCCYDYF

SEQ ID NO: 543526 - protein, 9 aa, Homo Sapiens
LPCCHPHRL

SEQ ID NO: 543527 - protein, 9 aa, Homo Sapiens
NFSDNVDQQ

SEQ ID NO: 543528 - protein, 9 aa, Homo Sapiens
VCKFQVVIL

SEQ ID NO: 543529 - protein, 9 aa, Homo Sapiens
TGKPLNTTS

SEQ ID NO: 543530 - protein, 9 aa, Homo Sapiens
VPTSQCSDT

SEQ ID NO: 543531 - protein, 9 aa, Homo Sapiens
VEGGTRPAY

SEQ ID NO: 543532 - protein, 9 aa, Homo Sapiens
NFPGSFHEA

SEQ ID NO: 543533 - protein, 9 aa, Homo Sapiens
GNPLYFCCY

SEQ ID NO: 543534 - protein, 9 aa, Homo Sapiens
KILEEKTRQ

SEQ ID NO: 543535 - protein, 9 aa, Homo Sapiens
STIREAAGL

SEQ ID NO: 543536 - protein, 9 aa, Homo Sapiens
FFTRMENQV

SEQ ID NO: 543537 - protein, 9 aa, Homo Sapiens
DENYVMKLQ

SEQ ID NO: 543538 - protein, 9 aa, Homo Sapiens
SDNVDQQEE

SEQ ID NO: 543539 - protein, 9 aa, Homo Sapiens
WCPAGFKVG

SEQ ID NO: 543540 - protein, 9 aa, Homo Sapiens
AFCIEFSTI

SEQ ID NO: 543541 - protein, 9 aa, Homo Sapiens
PTSQCSDTC

SEQ ID NO: 543542 - protein, 9 aa, Homo Sapiens
PPHVLAPWD

SEQ ID NO: 543543 - protein, 9 aa, Homo Sapiens
FCIEFSTIR

SEQ ID NO: 543544 - protein, 9 aa, Homo Sapiens
FSGNPLYFC

SEQ ID NO: 543545 - protein, 9 aa, Homo Sapiens
NQVFKFLIR

SEQ ID NO: 543546 - protein, 9 aa, Homo Sapiens
ILNGTKCIW

SEQ ID NO: 543547 - protein, 9 aa, Homo Sapiens
FPGSFHEAW

SEQ ID NO: 543548 - protein, 9 aa, Homo Sapiens
SSVGSYQSG

SEQ ID NO: 543549 - protein, 9 aa, Homo Sapiens
WKPQPGDVV

SEQ ID NO: 543550 - protein, 9 aa, Homo Sapiens
SVGSYQSGI

SEQ ID NO: 543551 - protein, 9 aa, Homo Sapiens
PAYQWLKNG

SEQ ID NO: 543552 - protein, 9 aa, Homo Sapiens
KPQPGDVVG

SEQ ID NO: 543553 - protein, 9 aa, Homo Sapiens
TWYENLHEW

SEQ ID NO: 543554 - protein, 9 aa, Homo Sapiens
QMLNVFFTR

SEQ ID NO: 543555 - protein, 9 aa, Homo Sapiens
LTQMLNVFF

SEQ ID NO: 543556 - protein, 9 aa, Homo Sapiens
ACLWGAGCV

SEQ ID NO: 543557 - protein, 9 aa, Homo Sapiens
LNVFFTRME

SEQ ID NO: 543558 - protein, 9 aa, Homo Sapiens
SDTCAPNEM

SEQ ID NO: 543559 - protein, 9 aa, Homo Sapiens
PQHVAQLGN

SEQ ID NO: 543560 - protein, 9 aa, Homo Sapiens
PAGFKVGIN

SEQ ID NO: 543561 - protein, 9 aa, Homo Sapiens
YENLHEWED

SEQ ID NO: 543562 - protein, 9 aa, Homo Sapiens
KACLWGAGC

SEQ ID NO: 543563 - protein, 9 aa, Homo Sapiens
VGRIQLKGD

SEQ ID NO: 543564 - protein, 9 aa, Homo Sapiens
HDNTMEAER

SEQ ID NO: 543565 - protein, 9 aa, Homo Sapiens
NVFFTRMEN

SEQ ID NO: 543566 - protein, 9 aa, Homo Sapiens
SNRRYIDQS

SEQ ID NO: 543567 - protein, 9 aa, Homo Sapiens
AGFKVGINN

SEQ ID NO: 543568 - protein, 9 aa, Homo Sapiens
IEFSTIREA

SEQ ID NO: 543569 - protein, 9 aa, Homo Sapiens
SSVTFQGTR

SEQ ID NO: 543570 - protein, 9 aa, Homo Sapiens
LTNFSDNVD

SEQ ID NO: 543571 - protein, 9 aa, Homo Sapiens
KDLTNFSDN

SEQ ID NO: 543572 - protein, 9 aa, Homo Sapiens
QCSDTCAPN

SEQ ID NO: 543573 - protein, 9 aa, Homo Sapiens
CIGDKEVEY

SEQ ID NO: 543574 - protein, 9 aa, Homo Sapiens
CIEFSTIRE

SEQ ID NO: 543575 - protein, 9 aa, Homo Sapiens
KLTPAHRLS

SEQ ID NO: 543576 - protein, 9 aa, Homo Sapiens
DEEEDDDEE

SEQ ID NO: 543577 - protein, 9 aa, Homo Sapiens
PHVLAPWDT

SEQ ID NO: 543578 - protein, 9 aa, Homo Sapiens
AVKACLWGA

SEQ ID NO: 543579 - protein, 9 aa, Homo Sapiens
NPLYFCCYD

SEQ ID NO: 543580 - protein, 9 aa, Homo Sapiens
YSQKLTPAH

SEQ ID NO: 543581 - protein, 9 aa, Homo Sapiens
TGHEPDSLQ

SEQ ID NO: 543582 - protein, 9 aa, Homo Sapiens
QPEPPHVLA

SEQ ID NO: 543583 - protein, 9 aa, Homo Sapiens
QLQPAPSGL

SEQ ID NO: 543584 - protein, 9 aa, Homo Sapiens
PGDVVGYVV

SEQ ID NO: 543585 - protein, 9 aa, Homo Sapiens
LMCIGDKEV

SEQ ID NO: 543586 - protein, 9 aa, Homo Sapiens
VSSSVTFQG

SEQ ID NO: 543587 - protein, 9 aa, Homo Sapiens
PSPALAPAQ

SEQ ID NO: 543588 - protein, 9 aa, Homo Sapiens
SGNPLYFCC

SEQ ID NO: 543589 - protein, 9 aa, Homo Sapiens
ESTGKPLNT

SEQ ID NO: 543590 - protein, 9 aa, Homo Sapiens
GIHDNTMEA

SEQ ID NO: 543591 - protein, 9 aa, Homo Sapiens
QATWYENLH

SEQ ID NO: 543592 - protein, 9 aa, Homo Sapiens
GKPLNTTSC

SEQ ID NO: 543593 - protein, 9 aa, Homo Sapiens
QAFCIEFST

SEQ ID NO: 543594 - protein, 9 aa, Homo Sapiens
YQSGISDYH

SEQ ID NO: 543595 - protein, 9 aa, Homo Sapiens
VILRAQPGL

SEQ ID NO: 543596 - protein, 9 aa, Homo Sapiens
LFQPEPPHV

SEQ ID NO: 543597 - protein, 9 aa, Homo Sapiens
AAENLPCCH

SEQ ID NO: 543598 - protein, 9 aa, Homo Sapiens
VDWCPAGFK

SEQ ID NO: 543599 - protein, 9 aa, Homo Sapiens
QFSTVGGWV

SEQ ID NO: 543600 - protein, 9 aa, Homo Sapiens
PQPGDVVGY

SEQ ID NO: 543601 - protein, 9 aa, Homo Sapiens
LNGTKCIWV

SEQ ID NO: 543602 - protein, 9 aa, Homo Sapiens
NLPCCHPHR

SEQ ID NO: 543603 - protein, 9 aa, Homo Sapiens
RIGGRLLMC

SEQ ID NO: 543604 - protein, 9 aa, Homo Sapiens
ERLLNFPGS

SEQ ID NO: 543605 - protein, 9 aa, Homo Sapiens
MLNVFFTRM

SEQ ID NO: 543606 - protein, 9 aa, Homo Sapiens
AQDSVEQLR

SEQ ID NO: 543607 - protein, 9 aa, Homo Sapiens
APWDTACGT

SEQ ID NO: 543608 - protein, 9 aa, Homo Sapiens
GECVLGFCQ

SEQ ID NO: 543609 - protein, 9 aa, Homo Sapiens
FVDWCPAGF

SEQ ID NO: 543610 - protein, 9 aa, Homo Sapiens
ENLHEWEDA

SEQ ID NO: 543611 - protein, 9 aa, Homo Sapiens
SIQMELLKH

SEQ ID NO: 543612 - protein, 9 aa, Homo Sapiens
EEDDDEEDE

SEQ ID NO: 543613 - protein, 9 aa, Homo Sapiens
VGYVVDWCD

SEQ ID NO: 543614 - protein, 9 aa, Homo Sapiens
ILRAQPGLQ

SEQ ID NO: 543615 - protein, 9 aa, Homo Sapiens
TSQCSDTCA

SEQ ID NO: 543616 - protein, 9 aa, Homo Sapiens
IGYNLATKR

SEQ ID NO: 543617 - protein, 9 aa, Homo Sapiens
TACGTQLPD

SEQ ID NO: 543618 - protein, 9 aa, Homo Sapiens
GHEPDSLQF

SEQ ID NO: 543619 - protein, 9 aa, Homo Sapiens
EPQHVAQLG

SEQ ID NO: 543620 - protein, 9 aa, Homo Sapiens
FGIHDNTME

SEQ ID NO: 543621 - protein, 9 aa, Homo Sapiens
NSTLPVHQG

SEQ ID NO: 543622 - protein, 9 aa, Homo Sapiens
GDMSSNPAI

SEQ ID NO: 543623 - protein, 9 aa, Homo Sapiens
SSVRSGGVG

SEQ ID NO: 543624 - protein, 9 aa, Homo Sapiens
EIFSKTTNN

SEQ ID NO: 543625 - protein, 9 aa, Homo Sapiens
FEEDQQFML

SEQ ID NO: 543626 - protein, 9 aa, Homo Sapiens
SHHALEFRS

SEQ ID NO: 543627 - protein, 9 aa, Homo Sapiens
KALGVSNFR

SEQ ID NO: 543628 - protein, 9 aa, Homo Sapiens
CPTMPCSNA

SEQ ID NO: 543629 - protein, 9 aa, Homo Sapiens
HHALEFRSS

SEQ ID NO: 543630 - protein, 9 aa, Homo Sapiens
LERLTGAHC

SEQ ID NO: 543631 - protein, 9 aa, Homo Sapiens
EEIFSKTTN

SEQ ID NO: 543632 - protein, 9 aa, Homo Sapiens
GLRLSISSA

SEQ ID NO: 543633 - protein, 9 aa, Homo Sapiens
VHQGTHATD

SEQ ID NO: 543634 - protein, 9 aa, Homo Sapiens
GGVGGAGAP

SEQ ID NO: 543635 - protein, 9 aa, Homo Sapiens
SSKHNKEAL

SEQ ID NO: 543636 - protein, 9 aa, Homo Sapiens
LRLHSRLTA

SEQ ID NO: 543637 - protein, 9 aa, Homo Sapiens
QRTPTKQVC

SEQ ID NO: 543638 - protein, 9 aa, Homo Sapiens
TGAHCTSTD

SEQ ID NO: 543639 - protein, 9 aa, Homo Sapiens
NTSRDFEKD

SEQ ID NO: 543640 - protein, 9 aa, Homo Sapiens
GTHATDKYS

SEQ ID NO: 543641 - protein, 9 aa, Homo Sapiens
GVVTFLCDL

SEQ ID NO: 543642 - protein, 9 aa, Homo Sapiens
TKQVCIDID

SEQ ID NO: 543643 - protein, 9 aa, Homo Sapiens
SLPFLSSLS

SEQ ID NO: 543644 - protein, 9 aa, Homo Sapiens
CQVCPNNEW

SEQ ID NO: 543645 - protein, 9 aa, Homo Sapiens
QSSVTEWNA

SEQ ID NO: 543646 - protein, 9 aa, Homo Sapiens
YFSSKHNKE

SEQ ID NO: 543647 - protein, 9 aa, Homo Sapiens
RGELGDCWL

SEQ ID NO: 543648 - protein, 9 aa, Homo Sapiens
SYLIIHKRI

SEQ ID NO: 543649 - protein, 9 aa, Homo Sapiens
VCIDIDECI

SEQ ID NO: 543650 - protein, 9 aa, Homo Sapiens
SRDFEKDDD

SEQ ID NO: 543651 - protein, 9 aa, Homo Sapiens
SSNPAIETF

SEQ ID NO: 543652 - protein, 9 aa, Homo Sapiens
VTEWNAMQD

SEQ ID NO: 543653 - protein, 9 aa, Homo Sapiens
GGRSFCPPG

SEQ ID NO: 543654 - protein, 9 aa, Homo Sapiens
HNKEALSPP

SEQ ID NO: 543655 - protein, 9 aa, Homo Sapiens
SGKEGSPGP

SEQ ID NO: 543656 - protein, 9 aa, Homo Sapiens
ATMAMRYNR

SEQ ID NO: 543657 - protein, 9 aa, Homo Sapiens
PVKKECGVA

SEQ ID NO: 543658 - protein, 9 aa, Homo Sapiens
WLGVVTFLC

SEQ ID NO: 543659 - protein, 9 aa, Homo Sapiens
DVQPFLMGC

SEQ ID NO: 543660 - protein, 9 aa, Homo Sapiens
ICRGELGDC

SEQ ID NO: 543661 - protein, 9 aa, Homo Sapiens
KANTSLPFL

SEQ ID NO: 543662 - protein, 9 aa, Homo Sapiens
CRGELGDCW

SEQ ID NO: 543663 - protein, 9 aa, Homo Sapiens
ALGVSNFRH

SEQ ID NO: 543664 - protein, 9 aa, Homo Sapiens
KVSCPTMPC

SEQ ID NO: 543665 - protein, 9 aa, Homo Sapiens
TAEPERALN

SEQ ID NO: 543666 - protein, 9 aa, Homo Sapiens
LVPVDYYIL

SEQ ID NO: 543667 - protein, 9 aa, Homo Sapiens
QKLEGTDGP

SEQ ID NO: 543668 - protein, 9 aa, Homo Sapiens
QAHIYWAHF

SEQ ID NO: 543669 - protein, 9 aa, Homo Sapiens
CHPEASCSS

SEQ ID NO: 543670 - protein, 9 aa, Homo Sapiens
LEFRSSETQ

SEQ ID NO: 543671 - protein, 9 aa, Homo Sapiens
GAHCTSTDG

SEQ ID NO: 543672 - protein, 9 aa, Homo Sapiens
RSGPWAAQE

SEQ ID NO: 543673 - protein, 9 aa, Homo Sapiens
GLGETAPSG

SEQ ID NO: 543674 - protein, 9 aa, Homo Sapiens
FLCDLLLLY

SEQ ID NO: 543675 - protein, 9 aa, Homo Sapiens
KDLERLTGA

SEQ ID NO: 543676 - protein, 9 aa, Homo Sapiens
SQPEIDTSD

SEQ ID NO: 543677 - protein, 9 aa, Homo Sapiens
LRLSISSAN

SEQ ID NO: 543678 - protein, 9 aa, Homo Sapiens
EDEYECQVC

SEQ ID NO: 543679 - protein, 9 aa, Homo Sapiens
RHFQIEKLL

SEQ ID NO: 543680 - protein, 9 aa, Homo Sapiens
FRSSETQQP

SEQ ID NO: 543681 - protein, 9 aa, Homo Sapiens
IAATMAMRY

SEQ ID NO: 543682 - protein, 9 aa, Homo Sapiens
LGLGETAPS

SEQ ID NO: 543683 - protein, 9 aa, Homo Sapiens
AEPERALNA

SEQ ID NO: 543684 - protein, 9 aa, Homo Sapiens
HSRLTAEPE

SEQ ID NO: 543685 - protein, 9 aa, Homo Sapiens
NARAKSPLG

SEQ ID NO: 543686 - protein, 9 aa, Homo Sapiens
KEGSPGPLG

SEQ ID NO: 543687 - protein, 9 aa, Homo Sapiens
VRSGGVGGA

SEQ ID NO: 543688 - protein, 9 aa, Homo Sapiens
TEWNAMQDV

SEQ ID NO: 543689 - protein, 9 aa, Homo Sapiens
SPGPLGPIG

SEQ ID NO: 543690 - protein, 9 aa, Homo Sapiens
SSEDVQPFL

SEQ ID NO: 543691 - protein, 9 aa, Homo Sapiens
EGSPGPLGP

SEQ ID NO: 543692 - protein, 9 aa, Homo Sapiens
LTAEPERAL

SEQ ID NO: 543693 - protein, 9 aa, Homo Sapiens
EMFHKAEEI

SEQ ID NO: 543694 - protein, 9 aa, Homo Sapiens
AAAVLRICS

SEQ ID NO: 543695 - protein, 9 aa, Homo Sapiens
TKRDLLYHL

SEQ ID NO: 543696 - protein, 9 aa, Homo Sapiens
GETAPSGRG

SEQ ID NO: 543697 - protein, 9 aa, Homo Sapiens
NIIRTPSVA

SEQ ID NO: 543698 - protein, 9 aa, Homo Sapiens
GVGGAGAPG

SEQ ID NO: 543699 - protein, 9 aa, Homo Sapiens
DICRGELGD

SEQ ID NO: 543700 - protein, 9 aa, Homo Sapiens
YALFCIGFA

SEQ ID NO: 543701 - protein, 9 aa, Homo Sapiens
SSPERVRMV

SEQ ID NO: 543702 - protein, 9 aa, Homo Sapiens
PALAQADIG

SEQ ID NO: 543703 - protein, 9 aa, Homo Sapiens
ANTSLPFLS

SEQ ID NO: 543704 - protein, 9 aa, Homo Sapiens
FRHFQIEKL

SEQ ID NO: 543705 - protein, 9 aa, Homo Sapiens
PSGKEGSPG

SEQ ID NO: 543706 - protein, 9 aa, Homo Sapiens
ITKRDLLYH

SEQ ID NO: 543707 - protein, 9 aa, Homo Sapiens
VAAAVLRIC

SEQ ID NO: 543708 - protein, 9 aa, Homo Sapiens
HALEFRSSE

SEQ ID NO: 543709 - protein, 9 aa, Homo Sapiens
SNPITKRDL

SEQ ID NO: 543710 - protein, 9 aa, Homo Sapiens
FIAATMAMR

SEQ ID NO: 543711 - protein, 9 aa, Homo Sapiens
APSGRGRWV

SEQ ID NO: 543712 - protein, 9 aa, Homo Sapiens
RLSISSANG

SEQ ID NO: 543713 - protein, 9 aa, Homo Sapiens
TFLCDLLLL

SEQ ID NO: 543714 - protein, 9 aa, Homo Sapiens
LRICSVEGR

SEQ ID NO: 543715 - protein, 9 aa, Homo Sapiens
SNPAIETFT

SEQ ID NO: 543716 - protein, 9 aa, Homo Sapiens
KKVSCPTMP

SEQ ID NO: 543717 - protein, 9 aa, Homo Sapiens
ERVRMVTLH

SEQ ID NO: 543718 - protein, 9 aa, Homo Sapiens
GVSNFRHFQ

SEQ ID NO: 543719 - protein, 9 aa, Homo Sapiens
AATMAMRYN

SEQ ID NO: 543720 - protein, 9 aa, Homo Sapiens
DEYECQVCP

SEQ ID NO: 543721 - protein, 9 aa, Homo Sapiens
ICKKVSCPT

SEQ ID NO: 543722 - protein, 9 aa, Homo Sapiens
CIGFACLLW

SEQ ID NO: 543723 - protein, 9 aa, Homo Sapiens
ENSSEDVQP

SEQ ID NO: 543724 - protein, 9 aa, Homo Sapiens
RYALFCIGF

SEQ ID NO: 543725 - protein, 9 aa, Homo Sapiens
MKIPETFEE

SEQ ID NO: 543726 - protein, 9 aa, Homo Sapiens
RICSVEGRK

SEQ ID NO: 543727 - protein, 9 aa, Homo Sapiens
PEASCSSTL

SEQ ID NO: 543728 - protein, 9 aa, Homo Sapiens
DYYILSIGL

SEQ ID NO: 543729 - protein, 9 aa, Homo Sapiens
TLPVHQGTH

SEQ ID NO: 543730 - protein, 9 aa, Homo Sapiens
AIETFTTGL

SEQ ID NO: 543731 - protein, 9 aa, Homo Sapiens
NTSLPFLSS

SEQ ID NO: 543732 - protein, 9 aa, Homo Sapiens
PAIETFTTG

SEQ ID NO: 543733 - protein, 9 aa, Homo Sapiens
PFGAMNIIR

SEQ ID NO: 543734 - protein, 9 aa, Homo Sapiens
ESQPEIDTS

SEQ ID NO: 543735 - protein, 9 aa, Homo Sapiens
ILSIGLVML

SEQ ID NO: 543736 - protein, 9 aa, Homo Sapiens
ARAKSPLGF

SEQ ID NO: 543737 - protein, 9 aa, Homo Sapiens
TMPCSNATV

SEQ ID NO: 543738 - protein, 9 aa, Homo Sapiens
RAKSPLGFY

SEQ ID NO: 543739 - protein, 9 aa, Homo Sapiens
VDYYILSIG

SEQ ID NO: 543740 - protein, 9 aa, Homo Sapiens
HKAEEIFSK

SEQ ID NO: 543741 - protein, 9 aa, Homo Sapiens
YECQVCPNN

SEQ ID NO: 543742 - protein, 9 aa, Homo Sapiens
ADPVKKECG

SEQ ID NO: 543743 - protein, 9 aa, Homo Sapiens
RLTAEPERA

SEQ ID NO: 543744 - protein, 9 aa, Homo Sapiens
FSSPERVRM

SEQ ID NO: 543745 - protein, 9 aa, Homo Sapiens
SCPTMPCSN

SEQ ID NO: 543746 - protein, 9 aa, Homo Sapiens
EYECQVCPN

SEQ ID NO: 543747 - protein, 9 aa, Homo Sapiens
ALKENSSED

SEQ ID NO: 543748 - protein, 9 aa, Homo Sapiens
RSGGVGGAG

SEQ ID NO: 543749 - protein, 9 aa, Homo Sapiens
QGTHATDKY

SEQ ID NO: 543750 - protein, 9 aa, Homo Sapiens
HLFHVQAHI

SEQ ID NO: 543751 - protein, 9 aa, Homo Sapiens
GTGKVTVEY

SEQ ID NO: 543752 - protein, 9 aa, Homo Sapiens
FHKAEEIFS

SEQ ID NO: 543753 - protein, 9 aa, Homo Sapiens
TFEEDQQFM

SEQ ID NO: 543754 - protein, 9 aa, Homo Sapiens
RLTGAHCTS

SEQ ID NO: 543755 - protein, 9 aa, Homo Sapiens
SKHNKEALS

SEQ ID NO: 543756 - protein, 9 aa, Homo Sapiens
GARSGPWAA

SEQ ID NO: 543757 - protein, 9 aa, Homo Sapiens
IETFTTGLD

SEQ ID NO: 543758 - protein, 9 aa, Homo Sapiens
DVGTGKVTV

SEQ ID NO: 543759 - protein, 9 aa, Homo Sapiens
IHKRIHSGE

SEQ ID NO: 543760 - protein, 9 aa, Homo Sapiens
FQRTPTKQV

SEQ ID NO: 543761 - protein, 9 aa, Homo Sapiens
ALEFRSSET

SEQ ID NO: 543762 - protein, 9 aa, Homo Sapiens
SSANGARRK

SEQ ID NO: 543763 - protein, 9 aa, Homo Sapiens
ECGVAHAGW

SEQ ID NO: 543764 - protein, 9 aa, Homo Sapiens
EDVQPFLMG

SEQ ID NO: 543765 - protein, 9 aa, Homo Sapiens
ICRHLFHVQ

SEQ ID NO: 543766 - protein, 9 aa, Homo Sapiens
QSSNPITKR

SEQ ID NO: 543767 - protein, 9 aa, Homo Sapiens
RVRMVTLHG

SEQ ID NO: 543768 - protein, 9 aa, Homo Sapiens
AWLGVVTFL

SEQ ID NO: 543769 - protein, 9 aa, Homo Sapiens
VKKECGVAH

SEQ ID NO: 543770 - protein, 9 aa, Homo Sapiens
EIDTSDMDP

SEQ ID NO: 543771 - protein, 9 aa, Homo Sapiens
RTPTKQVCI

SEQ ID NO: 543772 - protein, 9 aa, Homo Sapiens
FSSKHNKEA

SEQ ID NO: 543773 - protein, 9 aa, Homo Sapiens
SLYFSSKHN

SEQ ID NO: 543774 - protein, 9 aa, Homo Sapiens
KSPLGFYYG

SEQ ID NO: 543775 - protein, 9 aa, Homo Sapiens
MSSNPAIET

SEQ ID NO: 543776 - protein, 9 aa, Homo Sapiens
YILSIGLVM

SEQ ID NO: 543777 - protein, 9 aa, Homo Sapiens
PTKQVCIDI

SEQ ID NO: 543778 - protein, 9 aa, Homo Sapiens
SGGVGGAGA

SEQ ID NO: 543779 - protein, 9 aa, Homo Sapiens
LIIHKRIHS

SEQ ID NO: 543780 - protein, 9 aa, Homo Sapiens
TQTQKLEGT

SEQ ID NO: 543781 - protein, 9 aa, Homo Sapiens
KENSSEDVQ

SEQ ID NO: 543782 - protein, 9 aa, Homo Sapiens
VSNFRHFQI

SEQ ID NO: 543783 - protein, 9 aa, Homo Sapiens
STNARAKSP

SEQ ID NO: 543784 - protein, 9 aa, Homo Sapiens
ARSGPWAAQ

SEQ ID NO: 543785 - protein, 9 aa, Homo Sapiens
VQAHIYWAH

SEQ ID NO: 543786 - protein, 9 aa, Homo Sapiens
PETFEEDQQ

SEQ ID NO: 543787 - protein, 9 aa, Homo Sapiens
IIHKRIHSG

SEQ ID NO: 543788 - protein, 9 aa, Homo Sapiens
VSCPTMPCS

SEQ ID NO: 543789 - protein, 9 aa, Homo Sapiens
GSTNARAKS

SEQ ID NO: 543790 - protein, 9 aa, Homo Sapiens
ADIGVAIGT

SEQ ID NO: 543791 - protein, 9 aa, Homo Sapiens
MANKANTSR

SEQ ID NO: 543792 - protein, 9 aa, Homo Sapiens
LRSYLIIHK

SEQ ID NO: 543793 - protein, 9 aa, Homo Sapiens
PITKRDLLY

SEQ ID NO: 543794 - protein, 9 aa, Homo Sapiens
ICSVEGRKK

SEQ ID NO: 543795 - protein, 9 aa, Homo Sapiens
SPALAQADI

SEQ ID NO: 543796 - protein, 9 aa, Homo Sapiens
LGVSNFRHF

SEQ ID NO: 543797 - protein, 9 aa, Homo Sapiens
MSCGGGRSF

SEQ ID NO: 543798 - protein, 9 aa, Homo Sapiens
QTQTQKLEG

SEQ ID NO: 543799 - protein, 9 aa, Homo Sapiens
RRFRYALFC

SEQ ID NO: 543800 - protein, 9 aa, Homo Sapiens
TFFIAATMA

SEQ ID NO: 543801 - protein, 9 aa, Homo Sapiens
ESSVRSGGV

SEQ ID NO: 543802 - protein, 9 aa, Homo Sapiens
DIGVAIGTG

SEQ ID NO: 543803 - protein, 9 aa, Homo Sapiens
FLSSLSIQI

SEQ ID NO: 543804 - protein, 9 aa, Homo Sapiens
KTFFIAATM

SEQ ID NO: 543805 - protein, 9 aa, Homo Sapiens
KIPETFEED

SEQ ID NO: 543806 - protein, 9 aa, Homo Sapiens
AQADIGVAI

SEQ ID NO: 543807 - protein, 9 aa, Homo Sapiens
RMKIPETFE

SEQ ID NO: 543808 - protein, 9 aa, Homo Sapiens
PERVRMVTL

SEQ ID NO: 543809 - protein, 9 aa, Homo Sapiens
VVTFLCDLL

SEQ ID NO: 543810 - protein, 9 aa, Homo Sapiens
PSGRGRWVA

SEQ ID NO: 543811 - protein, 9 aa, Homo Sapiens
IQQSSNPIT

SEQ ID NO: 543812 - protein, 9 aa, Homo Sapiens
IDTSDMDPL

SEQ ID NO: 543813 - protein, 9 aa, Homo Sapiens
AAGARSGPW

SEQ ID NO: 543814 - protein, 9 aa, Homo Sapiens
GKEGSPGPL

SEQ ID NO: 543815 - protein, 9 aa, Homo Sapiens
SVTEWNAMQ

SEQ ID NO: 543816 - protein, 9 aa, Homo Sapiens
LAQADIGVA

SEQ ID NO: 543817 - protein, 9 aa, Homo Sapiens
PVHQGTHAT

SEQ ID NO: 543818 - protein, 9 aa, Homo Sapiens
ETAPSGRGR

SEQ ID NO: 543819 - protein, 9 aa, Homo Sapiens
AAVLRICSV

SEQ ID NO: 543820 - protein, 9 aa, Homo Sapiens
MAAAAAGAR

SEQ ID NO: 543821 - protein, 9 aa, Homo Sapiens
SPERVRMVT

SEQ ID NO: 543822 - protein, 9 aa, Homo Sapiens
MNIIRTPSV

SEQ ID NO: 543823 - protein, 9 aa, Homo Sapiens
VTFLCDLLL

SEQ ID NO: 543824 - protein, 9 aa, Homo Sapiens
VGPSGKEGS

SEQ ID NO: 543825 - protein, 9 aa, Homo Sapiens
GATRTDICR

SEQ ID NO: 543826 - protein, 9 aa, Homo Sapiens
AGARSGPWA

SEQ ID NO: 543827 - protein, 9 aa, Homo Sapiens
FGAMNIIRT

SEQ ID NO: 543828 - protein, 9 aa, Homo Sapiens
SVRSGGVGG

SEQ ID NO: 543829 - protein, 9 aa, Homo Sapiens
FCIGFACLL

SEQ ID NO: 543830 - protein, 9 aa, Homo Sapiens
VRMVTLHGY

SEQ ID NO: 543831 - protein, 9 aa, Homo Sapiens
GGCHPEASC

SEQ ID NO: 543832 - protein, 9 aa, Homo Sapiens
SDQSSVTEW

SEQ ID NO: 543833 - protein, 9 aa, Homo Sapiens
AVLRICSVE

SEQ ID NO: 543834 - protein, 9 aa, Homo Sapiens
LFHVQAHIY

SEQ ID NO: 543835 - protein, 9 aa, Homo Sapiens
GPEESQPEI

SEQ ID NO: 543836 - protein, 9 aa, Homo Sapiens
VLRICSVEG

SEQ ID NO: 543837 - protein, 9 aa, Homo Sapiens
TEDEYECQV

SEQ ID NO: 543838 - protein, 9 aa, Homo Sapiens
GGGRSFCPP

SEQ ID NO: 543839 - protein, 9 aa, Homo Sapiens
LPFLSSLSI

SEQ ID NO: 543840 - protein, 9 aa, Homo Sapiens
PFSSPERVR

SEQ ID NO: 543841 - protein, 9 aa, Homo Sapiens
HQGTHATDK

SEQ ID NO: 543842 - protein, 9 aa, Homo Sapiens
VPVDYYILS

SEQ ID NO: 543843 - protein, 9 aa, Homo Sapiens
NPSHHALEF

SEQ ID NO: 543844 - protein, 9 aa, Homo Sapiens
ISSANGARR

SEQ ID NO: 543845 - protein, 9 aa, Homo Sapiens
DKTFFIAAT

SEQ ID NO: 543846 - protein, 9 aa, Homo Sapiens
NSDQSSVTE

SEQ ID NO: 543847 - protein, 9 aa, Homo Sapiens
ALAQADIGV

SEQ ID NO: 543848 - protein, 9 aa, Homo Sapiens
RDFEKDDDA

SEQ ID NO: 543849 - protein, 9 aa, Homo Sapiens
QTQKLEGTD

SEQ ID NO: 543850 - protein, 9 aa, Homo Sapiens
QQSSNPITK

SEQ ID NO: 543851 - protein, 9 aa, Homo Sapiens
VSNGGCHPE

SEQ ID NO: 543852 - protein, 9 aa, Homo Sapiens
LHSRLTAEP

SEQ ID NO: 543853 - protein, 9 aa, Homo Sapiens
SLGLGETAP

SEQ ID NO: 543854 - protein, 9 aa, Homo Sapiens
GCHPEASCS

SEQ ID NO: 543855 - protein, 9 aa, Homo Sapiens
LSSLSIQIA

SEQ ID NO: 543856 - protein, 9 aa, Homo Sapiens
VFADPVKKE

SEQ ID NO: 543857 - protein, 9 aa, Homo Sapiens
TPFSSPERV

SEQ ID NO: 543858 - protein, 9 aa, Homo Sapiens
SCGGGRSFC

SEQ ID NO: 543859 - protein, 9 aa, Homo Sapiens
QVCPNNEWS

SEQ ID NO: 543860 - protein, 9 aa, Homo Sapiens
SNGGCHPEA

SEQ ID NO: 543861 - protein, 9 aa, Homo Sapiens
LGETAPSGR

SEQ ID NO: 543862 - protein, 9 aa, Homo Sapiens
GRSFCPPGH

SEQ ID NO: 543863 - protein, 9 aa, Homo Sapiens
CRHLFHVQA

SEQ ID NO: 543864 - protein, 9 aa, Homo Sapiens
TRTDICRGE

SEQ ID NO: 543865 - protein, 9 aa, Homo Sapiens
HPFGAMNII

SEQ ID NO: 543866 - protein, 9 aa, Homo Sapiens
YLIIHKRIH

SEQ ID NO: 543867 - protein, 9 aa, Homo Sapiens
KQVCIDIDE

SEQ ID NO: 543868 - protein, 9 aa, Homo Sapiens
INSDQSSVT

SEQ ID NO: 543869 - protein, 9 aa, Homo Sapiens
QVCIDIDEC

SEQ ID NO: 543870 - protein, 9 aa, Homo Sapiens
PQTQTQKLE

SEQ ID NO: 543871 - protein, 9 aa, Homo Sapiens
TSLPFLSSL

SEQ ID NO: 543872 - protein, 9 aa, Homo Sapiens
LYFSSKHNK

SEQ ID NO: 543873 - protein, 9 aa, Homo Sapiens
PQPQTQTQK

SEQ ID NO: 543874 - protein, 9 aa, Homo Sapiens
AKSPLGFYY

SEQ ID NO: 543875 - protein, 9 aa, Homo Sapiens
EESQPEIDT

SEQ ID NO: 543876 - protein, 9 aa, Homo Sapiens
PSHHALEFR

SEQ ID NO: 543877 - protein, 9 aa, Homo Sapiens
RHLFHVQAH

SEQ ID NO: 543878 - protein, 9 aa, Homo Sapiens
ANKANTSRD

SEQ ID NO: 543879 - protein, 9 aa, Homo Sapiens
GSPGPLGPI

SEQ ID NO: 543880 - protein, 9 aa, Homo Sapiens
HPEASCSST

SEQ ID NO: 543881 - protein, 9 aa, Homo Sapiens
QADIGVAIG

SEQ ID NO: 543882 - protein, 9 aa, Homo Sapiens
RSYLIIHKR

SEQ ID NO: 543883 - protein, 9 aa, Homo Sapiens
GAMNIIRTP

SEQ ID NO: 543884 - protein, 9 aa, Homo Sapiens
KAEEIFSKT

SEQ ID NO: 543885 - protein, 9 aa, Homo Sapiens
EFRSSETQQ

SEQ ID NO: 543886 - protein, 9 aa, Homo Sapiens
LTGAHCTST

SEQ ID NO: 543887 - protein, 9 aa, Homo Sapiens
AAAGARSGP

SEQ ID NO: 543888 - protein, 9 aa, Homo Sapiens
LSISSANGA

SEQ ID NO: 543889 - protein, 9 aa, Homo Sapiens
ERLTGAHCT

SEQ ID NO: 543890 - protein, 9 aa, Homo Sapiens
TSRDFEKDD

SEQ ID NO: 543891 - protein, 9 aa, Homo Sapiens
NGGCHPEAS

SEQ ID NO: 543892 - protein, 9 aa, Homo Sapiens
LFCIGFACL

SEQ ID NO: 543893 - protein, 9 aa, Homo Sapiens
IRTPSVAQI

SEQ ID NO: 543894 - protein, 9 aa, Homo Sapiens
TQKLEGTDG

SEQ ID NO: 543895 - protein, 9 aa, Homo Sapiens
YYILSIGLV

SEQ ID NO: 543896 - protein, 9 aa, Homo Sapiens
LKENSSEDV

SEQ ID NO: 543897 - protein, 9 aa, Homo Sapiens
VGTGKVTVE

SEQ ID NO: 543898 - protein, 9 aa, Homo Sapiens
NPAIETFTT

SEQ ID NO: 543899 - protein, 9 aa, Homo Sapiens
KRIHSGEKA

SEQ ID NO: 543900 - protein, 9 aa, Homo Sapiens
TPTKQVCID

SEQ ID NO: 543901 - protein, 9 aa, Homo Sapiens
HVQAHIYWA

SEQ ID NO: 543902 - protein, 9 aa, Homo Sapiens
FADPVKKEC

SEQ ID NO: 543903 - protein, 9 aa, Homo Sapiens
LPVHQGTHA

SEQ ID NO: 543904 - protein, 9 aa, Homo Sapiens
ECQVCPNNE

SEQ ID NO: 543905 - protein, 9 aa, Homo Sapiens
CKKVSCPTM

SEQ ID NO: 543906 - protein, 9 aa, Homo Sapiens
ANTSRDFEK

SEQ ID NO: 543907 - protein, 9 aa, Homo Sapiens
RMSCGGGRS

SEQ ID NO: 543908 - protein, 9 aa, Homo Sapiens
SRLTAEPER

SEQ ID NO: 543909 - protein, 9 aa, Homo Sapiens
TNARAKSPL

SEQ ID NO: 543910 - protein, 9 aa, Homo Sapiens
KHNKEALSP

SEQ ID NO: 543911 - protein, 9 aa, Homo Sapiens
TAPSGRGRW

SEQ ID NO: 543912 - protein, 9 aa, Homo Sapiens
NKANTSRDF

SEQ ID NO: 543913 - protein, 9 aa, Homo Sapiens
VCPNNEWSY

SEQ ID NO: 543914 - protein, 9 aa, Homo Sapiens
KANTSRDFE

SEQ ID NO: 543915 - protein, 9 aa, Homo Sapiens
IPETFEEDQ

SEQ ID NO: 543916 - protein, 9 aa, Homo Sapiens
SANGARRKG

SEQ ID NO: 543917 - protein, 9 aa, Homo Sapiens
DPVKKECGV

SEQ ID NO: 543918 - protein, 9 aa, Homo Sapiens
MFHKAEEIF

SEQ ID NO: 543919 - protein, 9 aa, Homo Sapiens
TSLYFSSKH

SEQ ID NO: 543920 - protein, 9 aa, Homo Sapiens
CSVEGRKKA

SEQ ID NO: 543921 - protein, 9 aa, Homo Sapiens
FFIAATMAM

SEQ ID NO: 543922 - protein, 9 aa, Homo Sapiens
PVDYYILSI

SEQ ID NO: 543923 - protein, 9 aa, Homo Sapiens
EASCSSTLG

SEQ ID NO: 543924 - protein, 9 aa, Homo Sapiens
FHVQAHIYW

SEQ ID NO: 543925 - protein, 9 aa, Homo Sapiens
AMNIIRTPS

SEQ ID NO: 543926 - protein, 9 aa, Homo Sapiens
IFSKTTNNE

SEQ ID NO: 543927 - protein, 9 aa, Homo Sapiens
PTMPCSNAT

SEQ ID NO: 543928 - protein, 9 aa, Homo Sapiens
IIRTPSVAQ

SEQ ID NO: 543929 - protein, 9 aa, Homo Sapiens
RSFCPPGHP

SEQ ID NO: 543930 - protein, 9 aa, Homo Sapiens
NFRHFQIEK

SEQ ID NO: 543931 - protein, 9 aa, Homo Sapiens
DQSSVTEWN

SEQ ID NO: 543932 - protein, 9 aa, Homo Sapiens
KLEGTDGPL

SEQ ID NO: 543933 - protein, 9 aa, Homo Sapiens
SFCPPGHPL

SEQ ID NO: 543934 - protein, 9 aa, Homo Sapiens
ATRTDICRG

SEQ ID NO: 543935 - protein, 9 aa, Homo Sapiens
VGGAGAPGA

SEQ ID NO: 543936 - protein, 9 aa, Homo Sapiens
AHCTSTDGR

SEQ ID NO: 543937 - protein, 9 aa, Homo Sapiens
STLPVHQGT

SEQ ID NO: 543938 - protein, 9 aa, Homo Sapiens
SSVTEWNAM

SEQ ID NO: 543939 - protein, 9 aa, Homo Sapiens
QPQTQTQKL

SEQ ID NO: 543940 - protein, 9 aa, Homo Sapiens
IGVAIGTGT

SEQ ID NO: 543941 - protein, 9 aa, Homo Sapiens
AEEIFSKTT

SEQ ID NO: 543942 - protein, 9 aa, Homo Sapiens
SPLGFYYGH

SEQ ID NO: 543943 - protein, 9 aa, Homo Sapiens
RFRYALFCI

SEQ ID NO: 543944 - protein, 9 aa, Homo Sapiens
PEIDTSDMD

SEQ ID NO: 543945 - protein, 9 aa, Homo Sapiens
PEESQPEID

SEQ ID NO: 543946 - protein, 9 aa, Homo Sapiens
RGLRLSISS

SEQ ID NO: 543947 - protein, 9 aa, Homo Sapiens
NSSEDVQPF

SEQ ID NO: 543948 - protein, 9 aa, Homo Sapiens
QKDLERLTG

SEQ ID NO: 543949 - protein, 9 aa, Homo Sapiens
TMAMRYNRL

SEQ ID NO: 543950 - protein, 9 aa, Homo Sapiens
FRYALFCIG

SEQ ID NO: 543951 - protein, 9 aa, Homo Sapiens
GPSGKEGSP

SEQ ID NO: 543952 - protein, 9 aa, Homo Sapiens
NPITKRDLL

SEQ ID NO: 543953 - protein, 9 aa, Homo Sapiens
PFLSSLSIQ

SEQ ID NO: 543954 - protein, 9 aa, Homo Sapiens
CGGGRSFCP

SEQ ID NO: 543955 - protein, 9 aa, Homo Sapiens
SNFRHFQIE

SEQ ID NO: 543956 - protein, 9 aa, Homo Sapiens
ALFCIGFAC

SEQ ID NO: 543957 - protein, 9 aa, Homo Sapiens
QLVPVDYYI

SEQ ID NO: 543958 - protein, 9 aa, Homo Sapiens
SISSANGAR

SEQ ID NO: 543959 - protein, 9 aa, Homo Sapiens
QPEIDTSDM

SEQ ID NO: 543960 - protein, 9 aa, Homo Sapiens
AAAAAGARS

SEQ ID NO: 543961 - protein, 9 aa, Homo Sapiens
LCDLLLLYV

SEQ ID NO: 543962 - protein, 9 aa, Homo Sapiens
RLHSRLTAE

SEQ ID NO: 543963 - protein, 9 aa, Homo Sapiens
TDICRGELG

SEQ ID NO: 543964 - protein, 9 aa, Homo Sapiens
DMSSNPAIE

SEQ ID NO: 543965 - protein, 9 aa, Homo Sapiens
DLERLTGAH

SEQ ID NO: 543966 - protein, 9 aa, Homo Sapiens
ETFEEDQQF

SEQ ID NO: 543967 - protein, 9 aa, Homo Sapiens
KKECGVAHA

SEQ ID NO: 543968 - protein, 9 aa, Homo Sapiens
SEDVQPFLM

SEQ ID NO: 543969 - protein, 9 aa, Homo Sapiens
ARMKIPETF

SEQ ID NO: 543970 - protein, 9 aa, Homo Sapiens
KECGVAHAG

SEQ ID NO: 543971 - protein, 9 aa, Homo Sapiens
HCTSTDGRL

SEQ ID NO: 543972 - protein, 9 aa, Homo Sapiens
RTDICRGEL

SEQ ID NO: 543973 - protein, 9 aa, Homo Sapiens
SSNPITKRD

SEQ ID NO: 543974 - protein, 9 aa, Homo Sapiens
LGVVTFLCD

SEQ ID NO: 543975 - protein, 9 aa, Homo Sapiens
AAAAGARSG

SEQ ID NO: 543976 - protein, 9 aa, Homo Sapiens
LSICQRRPQ

SEQ ID NO: 543977 - protein, 9 aa, Homo Sapiens
NANTIDFSR

SEQ ID NO: 543978 - protein, 9 aa, Homo Sapiens
PMTAKAIAK

SEQ ID NO: 543979 - protein, 9 aa, Homo Sapiens
PPRQRLNQV

SEQ ID NO: 543980 - protein, 9 aa, Homo Sapiens
KCSANGVAS

SEQ ID NO: 543981 - protein, 9 aa, Homo Sapiens
QDPNGSSTD

SEQ ID NO: 543982 - protein, 9 aa, Homo Sapiens
VVSRAEKGM

SEQ ID NO: 543983 - protein, 9 aa, Homo Sapiens
PPTWLQGGA

SEQ ID NO: 543984 - protein, 9 aa, Homo Sapiens
KWKAHDEAV

SEQ ID NO: 543985 - protein, 9 aa, Homo Sapiens
RNGNVILRV

SEQ ID NO: 543986 - protein, 9 aa, Homo Sapiens
NGAVFLAVK

SEQ ID NO: 543987 - protein, 9 aa, Homo Sapiens
CRNGNVILR

SEQ ID NO: 543988 - protein, 9 aa, Homo Sapiens
HTEQNTEAA

SEQ ID NO: 543989 - protein, 9 aa, Homo Sapiens
VVTYDAYPK

SEQ ID NO: 543990 - protein, 9 aa, Homo Sapiens
FVNHHYYIF

SEQ ID NO: 543991 - protein, 9 aa, Homo Sapiens
MLGDLLSEK

SEQ ID NO: 543992 - protein, 9 aa, Homo Sapiens
GAVFLAVKD

SEQ ID NO: 543993 - protein, 9 aa, Homo Sapiens
ATEYKHEEY

SEQ ID NO: 543994 - protein, 9 aa, Homo Sapiens
SAAPLGCRS

SEQ ID NO: 543995 - protein, 9 aa, Homo Sapiens
SATEYKHEE

SEQ ID NO: 543996 - protein, 9 aa, Homo Sapiens
YDHVVAVPC

SEQ ID NO: 543997 - protein, 9 aa, Homo Sapiens
EANKLAEKW

SEQ ID NO: 543998 - protein, 9 aa, Homo Sapiens
RRGQFYENK

SEQ ID NO: 543999 - protein, 9 aa, Homo Sapiens
LLSICQRRP

SEQ ID NO: 544000 - protein, 9 aa, Homo Sapiens
YLKCSANGV

SEQ ID NO: 544001 - protein, 9 aa, Homo Sapiens
LPASSEGVC

SEQ ID NO: 544002 - protein, 9 aa, Homo Sapiens
TYLKCSANG

SEQ ID NO: 544003 - protein, 9 aa, Homo Sapiens
CHFELCLTL

SEQ ID NO: 544004 - protein, 9 aa, Homo Sapiens
MTSRCWSWR

SEQ ID NO: 544005 - protein, 9 aa, Homo Sapiens
GLAGRVRGV

SEQ ID NO: 544006 - protein, 9 aa, Homo Sapiens
AKLLKDIRP

SEQ ID NO: 544007 - protein, 9 aa, Homo Sapiens
VRMGYQCTL

SEQ ID NO: 544008 - protein, 9 aa, Homo Sapiens
RFPDNSLYD

SEQ ID NO: 544009 - protein, 9 aa, Homo Sapiens
SPPRQRLNQ

SEQ ID NO: 544010 - protein, 9 aa, Homo Sapiens
SLEQQVIER

SEQ ID NO: 544011 - protein, 9 aa, Homo Sapiens
VDDDIYYFR

SEQ ID NO: 544012 - protein, 9 aa, Homo Sapiens
WQGCGHTDR

SEQ ID NO: 544013 - protein, 9 aa, Homo Sapiens
TSAVLPSSL

SEQ ID NO: 544014 - protein, 9 aa, Homo Sapiens
SVVRFPDNS

SEQ ID NO: 544015 - protein, 9 aa, Homo Sapiens
GIVVPAGRV

SEQ ID NO: 544016 - protein, 9 aa, Homo Sapiens
NSLYDHVVA

SEQ ID NO: 544017 - protein, 9 aa, Homo Sapiens
LVGLVVILA

SEQ ID NO: 544018 - protein, 9 aa, Homo Sapiens
WHLGVCRES

SEQ ID NO: 544019 - protein, 9 aa, Homo Sapiens
RSGRPSWAC

SEQ ID NO: 544020 - protein, 9 aa, Homo Sapiens
YQCTLGVLQ

SEQ ID NO: 544021 - protein, 9 aa, Homo Sapiens
ASNLLGRNA

SEQ ID NO: 544022 - protein, 9 aa, Homo Sapiens
LTVDLSAIR

SEQ ID NO: 544023 - protein, 9 aa, Homo Sapiens
AAQCIQKNG

SEQ ID NO: 544024 - protein, 9 aa, Homo Sapiens
GRIYMQKQD

SEQ ID NO: 544025 - protein, 9 aa, Homo Sapiens
CRSAGSSAS

SEQ ID NO: 544026 - protein, 9 aa, Homo Sapiens
HPERLENNP

SEQ ID NO: 544027 - protein, 9 aa, Homo Sapiens
APAPPQLGP

SEQ ID NO: 544028 - protein, 9 aa, Homo Sapiens
LEQQVIERN

SEQ ID NO: 544029 - protein, 9 aa, Homo Sapiens
DNSLYDHVV

SEQ ID NO: 544030 - protein, 9 aa, Homo Sapiens
QCTLGVLQA

SEQ ID NO: 544031 - protein, 9 aa, Homo Sapiens
SDGSSSSEE

SEQ ID NO: 544032 - protein, 9 aa, Homo Sapiens
EDMLLFTSV

SEQ ID NO: 544033 - protein, 9 aa, Homo Sapiens
SFIGYGIQS

SEQ ID NO: 544034 - protein, 9 aa, Homo Sapiens
GQATSAVLP

SEQ ID NO: 544035 - protein, 9 aa, Homo Sapiens
TYDAYPKAE

SEQ ID NO: 544036 - protein, 9 aa, Homo Sapiens
ENGRKVLAS

SEQ ID NO: 544037 - protein, 9 aa, Homo Sapiens
SRAEKGMYN

SEQ ID NO: 544038 - protein, 9 aa, Homo Sapiens
LGVLQAGQY

SEQ ID NO: 544039 - protein, 9 aa, Homo Sapiens
IFPPMPTPS

SEQ ID NO: 544040 - protein, 9 aa, Homo Sapiens
SAKVVDDDI

SEQ ID NO: 544041 - protein, 9 aa, Homo Sapiens
TPSSMTSPS

SEQ ID NO: 544042 - protein, 9 aa, Homo Sapiens
EDSGTQTPR

SEQ ID NO: 544043 - protein, 9 aa, Homo Sapiens
IERNLNPKA

SEQ ID NO: 544044 - protein, 9 aa, Homo Sapiens
YMQKQDLSK

SEQ ID NO: 544045 - protein, 9 aa, Homo Sapiens
KVVDDDIYY

SEQ ID NO: 544046 - protein, 9 aa, Homo Sapiens
VIFCSRSPR

SEQ ID NO: 544047 - protein, 9 aa, Homo Sapiens
RLENNPSVL

SEQ ID NO: 544048 - protein, 9 aa, Homo Sapiens
PNGSSTDIT

SEQ ID NO: 544049 - protein, 9 aa, Homo Sapiens
YENKGITYL

SEQ ID NO: 544050 - protein, 9 aa, Homo Sapiens
LPHTATSMT

SEQ ID NO: 544051 - protein, 9 aa, Homo Sapiens
IRAGDITSD

SEQ ID NO: 544052 - protein, 9 aa, Homo Sapiens
DCHFELCLT

SEQ ID NO: 544053 - protein, 9 aa, Homo Sapiens
SRLLAKLLK

SEQ ID NO: 544054 - protein, 9 aa, Homo Sapiens
LRAHWLWAL

SEQ ID NO: 544055 - protein, 9 aa, Homo Sapiens
IYMQKQDLS

SEQ ID NO: 544056 - protein, 9 aa, Homo Sapiens
LSQGLHLAD

SEQ ID NO: 544057 - protein, 9 aa, Homo Sapiens
RPSWACTTR

SEQ ID NO: 544058 - protein, 9 aa, Homo Sapiens
FPELFFAVV

SEQ ID NO: 544059 - protein, 9 aa, Homo Sapiens
QNTEAAGSQ

SEQ ID NO: 544060 - protein, 9 aa, Homo Sapiens
VKVPLQDLI

SEQ ID NO: 544061 - protein, 9 aa, Homo Sapiens
KGSSMTFLA

SEQ ID NO: 544062 - protein, 9 aa, Homo Sapiens
PRSGRPSWA

SEQ ID NO: 544063 - protein, 9 aa, Homo Sapiens
GISYPGAIL

SEQ ID NO: 544064 - protein, 9 aa, Homo Sapiens
VVILALLWC

SEQ ID NO: 544065 - protein, 9 aa, Homo Sapiens
GTQTPRSGR

SEQ ID NO: 544066 - protein, 9 aa, Homo Sapiens
ATSAVLPSS

SEQ ID NO: 544067 - protein, 9 aa, Homo Sapiens
GYQCTLGVL

SEQ ID NO: 544068 - protein, 9 aa, Homo Sapiens
WALPASSEG

SEQ ID NO: 544069 - protein, 9 aa, Homo Sapiens
TTYGRIYMQ

SEQ ID NO: 544070 - protein, 9 aa, Homo Sapiens
HMKNSKHSN

SEQ ID NO: 544071 - protein, 9 aa, Homo Sapiens
PTWLQGGAP

SEQ ID NO: 544072 - protein, 9 aa, Homo Sapiens
TPKMLGDLL

SEQ ID NO: 544073 - protein, 9 aa, Homo Sapiens
ELCLTLKAE

SEQ ID NO: 544074 - protein, 9 aa, Homo Sapiens
VVRFPDNSL

SEQ ID NO: 544075 - protein, 9 aa, Homo Sapiens
ALPASSEGV

SEQ ID NO: 544076 - protein, 9 aa, Homo Sapiens
KDYTEVWVE

SEQ ID NO: 544077 - protein, 9 aa, Homo Sapiens
GSSTDITER

SEQ ID NO: 544078 - protein, 9 aa, Homo Sapiens
GSSSSEEEP

SEQ ID NO: 544079 - protein, 9 aa, Homo Sapiens
ILALLWCWW

SEQ ID NO: 544080 - protein, 9 aa, Homo Sapiens
NASIWQGCG

SEQ ID NO: 544081 - protein, 9 aa, Homo Sapiens
IWPQVITSD

SEQ ID NO: 544082 - protein, 9 aa, Homo Sapiens
TFAIFPPMP

SEQ ID NO: 544083 - protein, 9 aa, Homo Sapiens
KNKVHSVYE

SEQ ID NO: 544084 - protein, 9 aa, Homo Sapiens
LKNKVHSVY

SEQ ID NO: 544085 - protein, 9 aa, Homo Sapiens
MVNYSHAAD

SEQ ID NO: 544086 - protein, 9 aa, Homo Sapiens
LENNPSVLG

SEQ ID NO: 544087 - protein, 9 aa, Homo Sapiens
CIQKNGAVF

SEQ ID NO: 544088 - protein, 9 aa, Homo Sapiens
VLTVDLSAI

SEQ ID NO: 544089 - protein, 9 aa, Homo Sapiens
SSPTPSSMT

SEQ ID NO: 544090 - protein, 9 aa, Homo Sapiens
PTGWSLPHT

SEQ ID NO: 544091 - protein, 9 aa, Homo Sapiens
CTLGVLQAG

SEQ ID NO: 544092 - protein, 9 aa, Homo Sapiens
AKVVDDDIY

SEQ ID NO: 544093 - protein, 9 aa, Homo Sapiens
PGAILPQGF

SEQ ID NO: 544094 - protein, 9 aa, Homo Sapiens
QCIQKNGAV

SEQ ID NO: 544095 - protein, 9 aa, Homo Sapiens
WKAHDEAVR

SEQ ID NO: 544096 - protein, 9 aa, Homo Sapiens
SSFIRAGDI

SEQ ID NO: 544097 - protein, 9 aa, Homo Sapiens
DHPMTAKAI

SEQ ID NO: 544098 - protein, 9 aa, Homo Sapiens
ASAAPLGCR

SEQ ID NO: 544099 - protein, 9 aa, Homo Sapiens
YKHEEYQRS

SEQ ID NO: 544100 - protein, 9 aa, Homo Sapiens
KQCLPLVEL

SEQ ID NO: 544101 - protein, 9 aa, Homo Sapiens
PLMDEDMLL

SEQ ID NO: 544102 - protein, 9 aa, Homo Sapiens
FIRLLPPTW

SEQ ID NO: 544103 - protein, 9 aa, Homo Sapiens
SASSPTPSS

SEQ ID NO: 544104 - protein, 9 aa, Homo Sapiens
NELTDCHFE

SEQ ID NO: 544105 - protein, 9 aa, Homo Sapiens
FNELTDCHF

SEQ ID NO: 544106 - protein, 9 aa, Homo Sapiens
SANGVASKA

SEQ ID NO: 544107 - protein, 9 aa, Homo Sapiens
LCLTLKAEN

SEQ ID NO: 544108 - protein, 9 aa, Homo Sapiens
VGGLSQGLH

SEQ ID NO: 544109 - protein, 9 aa, Homo Sapiens
VPHSVPQST

SEQ ID NO: 544110 - protein, 9 aa, Homo Sapiens
NALNHTEQN

SEQ ID NO: 544111 - protein, 9 aa, Homo Sapiens
AKSAIRAQP

SEQ ID NO: 544112 - protein, 9 aa, Homo Sapiens
IQKNGAVFL

SEQ ID NO: 544113 - protein, 9 aa, Homo Sapiens
LASNLLGRN

SEQ ID NO: 544114 - protein, 9 aa, Homo Sapiens
TEWHLGVCR

SEQ ID NO: 544115 - protein, 9 aa, Homo Sapiens
RGESRFQGM

SEQ ID NO: 544116 - protein, 9 aa, Homo Sapiens
KHEEYQRSE

SEQ ID NO: 544117 - protein, 9 aa, Homo Sapiens
TIWPQVITS

SEQ ID NO: 544118 - protein, 9 aa, Homo Sapiens
VGTSTEWHL

SEQ ID NO: 544119 - protein, 9 aa, Homo Sapiens
DTPSMEALA

SEQ ID NO: 544120 - protein, 9 aa, Homo Sapiens
SACRTPPMS

SEQ ID NO: 544121 - protein, 9 aa, Homo Sapiens
LLFLTWCRV

SEQ ID NO: 544122 - protein, 9 aa, Homo Sapiens
PSVLGLNGN

SEQ ID NO: 544123 - protein, 9 aa, Homo Sapiens
AILPQGFWA

SEQ ID NO: 544124 - protein, 9 aa, Homo Sapiens
ELIWCHLLE

SEQ ID NO: 544125 - protein, 9 aa, Homo Sapiens
LIVIPRSHE

SEQ ID NO: 544126 - protein, 9 aa, Homo Sapiens
SHQEVATAS

SEQ ID NO: 544127 - protein, 9 aa, Homo Sapiens
AGRVSCAFN

SEQ ID NO: 544128 - protein, 9 aa, Homo Sapiens
LFLLFLTWC

SEQ ID NO: 544129 - protein, 9 aa, Homo Sapiens
FAIFPPMPT

SEQ ID NO: 544130 - protein, 9 aa, Homo Sapiens
ILPQGFWAA

SEQ ID NO: 544131 - protein, 9 aa, Homo Sapiens
TFFPELFFA

SEQ ID NO: 544132 - protein, 9 aa, Homo Sapiens
VPAGRVSCA

SEQ ID NO: 544133 - protein, 9 aa, Homo Sapiens
HFELCLTLK

SEQ ID NO: 544134 - protein, 9 aa, Homo Sapiens
VRFPDNSLY

SEQ ID NO: 544135 - protein, 9 aa, Homo Sapiens
LRVVHMQVF

SEQ ID NO: 544136 - protein, 9 aa, Homo Sapiens
YGRIYMQKQ

SEQ ID NO: 544137 - protein, 9 aa, Homo Sapiens
CLPLVELIQ

SEQ ID NO: 544138 - protein, 9 aa, Homo Sapiens
FLLFLTWCR

SEQ ID NO: 544139 - protein, 9 aa, Homo Sapiens
SISFIGYGI

SEQ ID NO: 544140 - protein, 9 aa, Homo Sapiens
HSVPQSTTA

SEQ ID NO: 544141 - protein, 9 aa, Homo Sapiens
NKVHSVYEA

SEQ ID NO: 544142 - protein, 9 aa, Homo Sapiens
RVSCAFNEL

SEQ ID NO: 544143 - protein, 9 aa, Homo Sapiens
QGCGHTDRG

SEQ ID NO: 544144 - protein, 9 aa, Homo Sapiens
LFTSVVRFP

SEQ ID NO: 544145 - protein, 9 aa, Homo Sapiens
LQDLIVRND

SEQ ID NO: 544146 - protein, 9 aa, Homo Sapiens
TSTEWHLGV

SEQ ID NO: 544147 - protein, 9 aa, Homo Sapiens
TEDSGTQTP

SEQ ID NO: 544148 - protein, 9 aa, Homo Sapiens
VSLHALGQA

SEQ ID NO: 544149 - protein, 9 aa, Homo Sapiens
NNPSVLGLN

SEQ ID NO: 544150 - protein, 9 aa, Homo Sapiens
GLSQGLHLA

SEQ ID NO: 544151 - protein, 9 aa, Homo Sapiens
SSSSEEEPE

SEQ ID NO: 544152 - protein, 9 aa, Homo Sapiens
SLYDHVVAV

SEQ ID NO: 544153 - protein, 9 aa, Homo Sapiens
EGRGESRFQ

SEQ ID NO: 544154 - protein, 9 aa, Homo Sapiens
KSISFIGYG

SEQ ID NO: 544155 - protein, 9 aa, Homo Sapiens
VVLTVDLSA

SEQ ID NO: 544156 - protein, 9 aa, Homo Sapiens
WDAAELIWC

SEQ ID NO: 544157 - protein, 9 aa, Homo Sapiens
YVRTFFPEL

SEQ ID NO: 544158 - protein, 9 aa, Homo Sapiens
LKCSANGVA

SEQ ID NO: 544159 - protein, 9 aa, Homo Sapiens
SWRNRQSTA

SEQ ID NO: 544160 - protein, 9 aa, Homo Sapiens
AEKWKAHDE

SEQ ID NO: 544161 - protein, 9 aa, Homo Sapiens
RLLPPTWLQ

SEQ ID NO: 544162 - protein, 9 aa, Homo Sapiens
KSATEYKHE

SEQ ID NO: 544163 - protein, 9 aa, Homo Sapiens
RTPPMSSLP

SEQ ID NO: 544164 - protein, 9 aa, Homo Sapiens
DLLQDPNGS

SEQ ID NO: 544165 - protein, 9 aa, Homo Sapiens
GRASPARAS

SEQ ID NO: 544166 - protein, 9 aa, Homo Sapiens
RAEKGMYNE

SEQ ID NO: 544167 - protein, 9 aa, Homo Sapiens
GFVNHHYYI

SEQ ID NO: 544168 - protein, 9 aa, Homo Sapiens
LMDEDMLLF

SEQ ID NO: 544169 - protein, 9 aa, Homo Sapiens
EPSQVIFCS

SEQ ID NO: 544170 - protein, 9 aa, Homo Sapiens
NTIDFSRPL

SEQ ID NO: 544171 - protein, 9 aa, Homo Sapiens
LLPPTWLQG

SEQ ID NO: 544172 - protein, 9 aa, Homo Sapiens
SSSVSASDP

SEQ ID NO: 544173 - protein, 9 aa, Homo Sapiens
DFSRPLMDE

SEQ ID NO: 544174 - protein, 9 aa, Homo Sapiens
LFFPVVSLS

SEQ ID NO: 544175 - protein, 9 aa, Homo Sapiens
VSSSVSASD

SEQ ID NO: 544176 - protein, 9 aa, Homo Sapiens
FCSRSPRVV

SEQ ID NO: 544177 - protein, 9 aa, Homo Sapiens
NGNVILRVV

SEQ ID NO: 544178 - protein, 9 aa, Homo Sapiens
KSAIRAQPQ

SEQ ID NO: 544179 - protein, 9 aa, Homo Sapiens
GEVVEVMKG

SEQ ID NO: 544180 - protein, 9 aa, Homo Sapiens
TGISYPGAI

SEQ ID NO: 544181 - protein, 9 aa, Homo Sapiens
LLAKLLKDI

SEQ ID NO: 544182 - protein, 9 aa, Homo Sapiens
SHEDDAHNV

SEQ ID NO: 544183 - protein, 9 aa, Homo Sapiens
CSRSPRVVL

SEQ ID NO: 544184 - protein, 9 aa, Homo Sapiens
QQVIERNLN

SEQ ID NO: 544185 - protein, 9 aa, Homo Sapiens
PSVVLTVDL

SEQ ID NO: 544186 - protein, 9 aa, Homo Sapiens
CAFNELTDC

SEQ ID NO: 544187 - protein, 9 aa, Homo Sapiens
LLGRNANTI

SEQ ID NO: 544188 - protein, 9 aa, Homo Sapiens
ILSLEQQVI

SEQ ID NO: 544189 - protein, 9 aa, Homo Sapiens
NQVSAGQTS

SEQ ID NO: 544190 - protein, 9 aa, Homo Sapiens
SSASSPTPS

SEQ ID NO: 544191 - protein, 9 aa, Homo Sapiens
SPARASPAQ

SEQ ID NO: 544192 - protein, 9 aa, Homo Sapiens
QAPAGLAGR

SEQ ID NO: 544193 - protein, 9 aa, Homo Sapiens
APLGCRSAG

SEQ ID NO: 544194 - protein, 9 aa, Homo Sapiens
LPSSLPTGW

SEQ ID NO: 544195 - protein, 9 aa, Homo Sapiens
GDTPSMEAL

SEQ ID NO: 544196 - protein, 9 aa, Homo Sapiens
STAPWCGPS

SEQ ID NO: 544197 - protein, 9 aa, Homo Sapiens
WCHLLEHDL

SEQ ID NO: 544198 - protein, 9 aa, Homo Sapiens
SRFQGMHEG

SEQ ID NO: 544199 - protein, 9 aa, Homo Sapiens
SSVSASDPS

SEQ ID NO: 544200 - protein, 9 aa, Homo Sapiens
VSLSAGIKV

SEQ ID NO: 544201 - protein, 9 aa, Homo Sapiens
HPMTAKAIA

SEQ ID NO: 544202 - protein, 9 aa, Homo Sapiens
AENGRKVLA

SEQ ID NO: 544203 - protein, 9 aa, Homo Sapiens
IRGLKLPSV

SEQ ID NO: 544204 - protein, 9 aa, Homo Sapiens
GRKVLASNL

SEQ ID NO: 544205 - protein, 9 aa, Homo Sapiens
FLPQLLAFP

SEQ ID NO: 544206 - protein, 9 aa, Homo Sapiens
TDCHFELCL

SEQ ID NO: 544207 - protein, 9 aa, Homo Sapiens
DSGTQTPRS

SEQ ID NO: 544208 - protein, 9 aa, Homo Sapiens
ICQRRPQAL

SEQ ID NO: 544209 - protein, 9 aa, Homo Sapiens
ALGQATSAV

SEQ ID NO: 544210 - protein, 9 aa, Homo Sapiens
TAPWCGPSA

SEQ ID NO: 544211 - protein, 9 aa, Homo Sapiens
ALNHTEQNT

SEQ ID NO: 544212 - protein, 9 aa, Homo Sapiens
LGQATSAVL

SEQ ID NO: 544213 - protein, 9 aa, Homo Sapiens
TASLAWASV

SEQ ID NO: 544214 - protein, 9 aa, Homo Sapiens
QGLHLADLR

SEQ ID NO: 544215 - protein, 9 aa, Homo Sapiens
YTKDYTEVW

SEQ ID NO: 544216 - protein, 9 aa, Homo Sapiens
STEWHLGVC

SEQ ID NO: 544217 - protein, 9 aa, Homo Sapiens
QVITSDKNK

SEQ ID NO: 544218 - protein, 9 aa, Homo Sapiens
RGLKLPSVL

SEQ ID NO: 544219 - protein, 9 aa, Homo Sapiens
MEASSESES

SEQ ID NO: 544220 - protein, 9 aa, Homo Sapiens
VVPAGRVSC

SEQ ID NO: 544221 - protein, 9 aa, Homo Sapiens
FIRAGDITS

SEQ ID NO: 544222 - protein, 9 aa, Homo Sapiens
LPTGWSLPH

SEQ ID NO: 544223 - protein, 9 aa, Homo Sapiens
GYGIQSFFF

SEQ ID NO: 544224 - protein, 9 aa, Homo Sapiens
VILRVVHMQ

SEQ ID NO: 544225 - protein, 9 aa, Homo Sapiens
PQSTTAIPA

SEQ ID NO: 544226 - protein, 9 aa, Homo Sapiens
GRVRGVGGP

SEQ ID NO: 544227 - protein, 9 aa, Homo Sapiens
KVPLQDLIV

SEQ ID NO: 544228 - protein, 9 aa, Homo Sapiens
FPDNSLYDH

SEQ ID NO: 544229 - protein, 9 aa, Homo Sapiens
GPSACRTPP

SEQ ID NO: 544230 - protein, 9 aa, Homo Sapiens
QRRPQALLR

SEQ ID NO: 544231 - protein, 9 aa, Homo Sapiens
PDNSLYDHV

SEQ ID NO: 544232 - protein, 9 aa, Homo Sapiens
VIPRSHEDD

SEQ ID NO: 544233 - protein, 9 aa, Homo Sapiens
NKLKNKVHS

SEQ ID NO: 544234 - protein, 9 aa, Homo Sapiens
DMLLFTSVV

SEQ ID NO: 544235 - protein, 9 aa, Homo Sapiens
HAVAGVQVS

SEQ ID NO: 544236 - protein, 9 aa, Homo Sapiens
TEQNTEAAG

SEQ ID NO: 544237 - protein, 9 aa, Homo Sapiens
GGLSQGLHL

SEQ ID NO: 544238 - protein, 9 aa, Homo Sapiens
LAGRVRGVG

SEQ ID NO: 544239 - protein, 9 aa, Homo Sapiens
GAILPQGFW

SEQ ID NO: 544240 - protein, 9 aa, Homo Sapiens
PSTMTSRCW

SEQ ID NO: 544241 - protein, 9 aa, Homo Sapiens
HLGVCRESV

SEQ ID NO: 544242 - protein, 9 aa, Homo Sapiens
SLHALGQAT

SEQ ID NO: 544243 - protein, 9 aa, Homo Sapiens
RFIRLLPPT

SEQ ID NO: 544244 - protein, 9 aa, Homo Sapiens
KVLASNLLG

SEQ ID NO: 544245 - protein, 9 aa, Homo Sapiens
LYDHVVAVP

SEQ ID NO: 544246 - protein, 9 aa, Homo Sapiens
SGSRAGDTP

SEQ ID NO: 544247 - protein, 9 aa, Homo Sapiens
NGSSTDITE

SEQ ID NO: 544248 - protein, 9 aa, Homo Sapiens
RAGDTPSME

SEQ ID NO: 544249 - protein, 9 aa, Homo Sapiens
LPARPSGSR

SEQ ID NO: 544250 - protein, 9 aa, Homo Sapiens
TKDYTEVWV

SEQ ID NO: 544251 - protein, 9 aa, Homo Sapiens
DVGTSTEWH

SEQ ID NO: 544252 - protein, 9 aa, Homo Sapiens
LHLADLRAH

SEQ ID NO: 544253 - protein, 9 aa, Homo Sapiens
NKLAEKWKA

SEQ ID NO: 544254 - protein, 9 aa, Homo Sapiens
WTGRCIGFV

SEQ ID NO: 544255 - protein, 9 aa, Homo Sapiens
DITSDTNKK

SEQ ID NO: 544256 - protein, 9 aa, Homo Sapiens
RIYMQKQDL

SEQ ID NO: 544257 - protein, 9 aa, Homo Sapiens
LNHTEQNTE

SEQ ID NO: 544258 - protein, 9 aa, Homo Sapiens
IVRNDTPCG

SEQ ID NO: 544259 - protein, 9 aa, Homo Sapiens
LPPTWLQGG

SEQ ID NO: 544260 - protein, 9 aa, Homo Sapiens
SSLPTGWSL

SEQ ID NO: 544261 - protein, 9 aa, Homo Sapiens
SRCWSWRNR

SEQ ID NO: 544262 - protein, 9 aa, Homo Sapiens
AELIWCHLL

SEQ ID NO: 544263 - protein, 9 aa, Homo Sapiens
LLFTSVVRF

SEQ ID NO: 544264 - protein, 9 aa, Homo Sapiens
RWVSSSVSA

SEQ ID NO: 544265 - protein, 9 aa, Homo Sapiens
WPQVITSDK

SEQ ID NO: 544266 - protein, 9 aa, Homo Sapiens
GRGESRFQG

SEQ ID NO: 544267 - protein, 9 aa, Homo Sapiens
EQQVIERNL

SEQ ID NO: 544268 - protein, 9 aa, Homo Sapiens
GRCIGFVNH

SEQ ID NO: 544269 - protein, 9 aa, Homo Sapiens
EQHMKNSKH

SEQ ID NO: 544270 - protein, 9 aa, Homo Sapiens
PFEQHMKNS

SEQ ID NO: 544271 - protein, 9 aa, Homo Sapiens
GDITSDTNK

SEQ ID NO: 544272 - protein, 9 aa, Homo Sapiens
GQFYENKGI

SEQ ID NO: 544273 - protein, 9 aa, Homo Sapiens
MKNSKHSNK

SEQ ID NO: 544274 - protein, 9 aa, Homo Sapiens
MLLFTSVVR

SEQ ID NO: 544275 - protein, 9 aa, Homo Sapiens
ERRGQFYEN

SEQ ID NO: 544276 - protein, 9 aa, Homo Sapiens
VMKGSSMTF

SEQ ID NO: 544277 - protein, 9 aa, Homo Sapiens
PLCGGIVVP

SEQ ID NO: 544278 - protein, 9 aa, Homo Sapiens
PPGRASPAR

SEQ ID NO: 544279 - protein, 9 aa, Homo Sapiens
CTYLKCSAN

SEQ ID NO: 544280 - protein, 9 aa, Homo Sapiens
FGTTYGRIY

SEQ ID NO: 544281 - protein, 9 aa, Homo Sapiens
KLLKDIRPE

SEQ ID NO: 544282 - protein, 9 aa, Homo Sapiens
NLLGRNANT

SEQ ID NO: 544283 - protein, 9 aa, Homo Sapiens
GKSATEYKH

SEQ ID NO: 544284 - protein, 9 aa, Homo Sapiens
PLVELIQQL

SEQ ID NO: 544285 - protein, 9 aa, Homo Sapiens
PAGLAGRVR

SEQ ID NO: 544286 - protein, 9 aa, Homo Sapiens
GTSTEWHLG

SEQ ID NO: 544287 - protein, 9 aa, Homo Sapiens
EVWVEFRDK

SEQ ID NO: 544288 - protein, 9 aa, Homo Sapiens
ASIWQGCGH

SEQ ID NO: 544289 - protein, 9 aa, Homo Sapiens
QHMKNSKHS

SEQ ID NO: 544290 - protein, 9 aa, Homo Sapiens
LSAKVVDDD

SEQ ID NO: 544291 - protein, 9 aa, Homo Sapiens
TAEKDVKRK

SEQ ID NO: 544292 - protein, 9 aa, Homo Sapiens
IFCSRSPRV

SEQ ID NO: 544293 - protein, 9 aa, Homo Sapiens
ASSPTPSSM

SEQ ID NO: 544294 - protein, 9 aa, Homo Sapiens
HEDDAHNVQ

SEQ ID NO: 544295 - protein, 9 aa, Homo Sapiens
IGYGIQSFF

SEQ ID NO: 544296 - protein, 9 aa, Homo Sapiens
LKEFAKSAI

SEQ ID NO: 544297 - protein, 9 aa, Homo Sapiens
DPNGSSTDI

SEQ ID NO: 544298 - protein, 9 aa, Homo Sapiens
DGSSSSEEE

SEQ ID NO: 544299 - protein, 9 aa, Homo Sapiens
KDVKRKRSH

SEQ ID NO: 544300 - protein, 9 aa, Homo Sapiens
PARASPAQA

SEQ ID NO: 544301 - protein, 9 aa, Homo Sapiens
MLKEFAKSA

SEQ ID NO: 544302 - protein, 9 aa, Homo Sapiens
SIWQGCGHT

SEQ ID NO: 544303 - protein, 9 aa, Homo Sapiens
TSPSTMTSR

SEQ ID NO: 544304 - protein, 9 aa, Homo Sapiens
AGSSASSPT

SEQ ID NO: 544305 - protein, 9 aa, Homo Sapiens
TEYKHEEYQ

SEQ ID NO: 544306 - protein, 9 aa, Homo Sapiens
AVPHSVPQS

SEQ ID NO: 544307 - protein, 9 aa, Homo Sapiens
AGDTPSMEA

SEQ ID NO: 544308 - protein, 9 aa, Homo Sapiens
VTYDAYPKA

SEQ ID NO: 544309 - protein, 9 aa, Homo Sapiens
KVHSVYEAP

SEQ ID NO: 544310 - protein, 9 aa, Homo Sapiens
PSACRTPPM

SEQ ID NO: 544311 - protein, 9 aa, Homo Sapiens
CIGFVNHHY

SEQ ID NO: 544312 - protein, 9 aa, Homo Sapiens
STTAIPAFP

SEQ ID NO: 544313 - protein, 9 aa, Homo Sapiens
SCAFNELTD

SEQ ID NO: 544314 - protein, 9 aa, Homo Sapiens
LALLWCWWA

SEQ ID NO: 544315 - protein, 9 aa, Homo Sapiens
PRSHEDDAH

SEQ ID NO: 544316 - protein, 9 aa, Homo Sapiens
FSSFIRAGD

SEQ ID NO: 544317 - protein, 9 aa, Homo Sapiens
SLSAGIKVR

SEQ ID NO: 544318 - protein, 9 aa, Homo Sapiens
GSRAGDTPS

SEQ ID NO: 544319 - protein, 9 aa, Homo Sapiens
AERRGQFYE

SEQ ID NO: 544320 - protein, 9 aa, Homo Sapiens
QCLPLVELI

SEQ ID NO: 544321 - protein, 9 aa, Homo Sapiens
CGPSACRTP

SEQ ID NO: 544322 - protein, 9 aa, Homo Sapiens
RKVLASNLL

SEQ ID NO: 544323 - protein, 9 aa, Homo Sapiens
ASLAWASVA

SEQ ID NO: 544324 - protein, 9 aa, Homo Sapiens
RCIGFVNHH

SEQ ID NO: 544325 - protein, 9 aa, Homo Sapiens
KATVGGLSQ

SEQ ID NO: 544326 - protein, 9 aa, Homo Sapiens
WSWRNRQST

SEQ ID NO: 544327 - protein, 9 aa, Homo Sapiens
ANKLAEKWK

SEQ ID NO: 544328 - protein, 9 aa, Homo Sapiens
VNHHYYIFF

SEQ ID NO: 544329 - protein, 9 aa, Homo Sapiens
AEKDVKRKR

SEQ ID NO: 544330 - protein, 9 aa, Homo Sapiens
VQVSGVTHI

SEQ ID NO: 544331 - protein, 9 aa, Homo Sapiens
DHVVAVPCR

SEQ ID NO: 544332 - protein, 9 aa, Homo Sapiens
ASSESESES

SEQ ID NO: 544333 - protein, 9 aa, Homo Sapiens
SRAGDTPSM

SEQ ID NO: 544334 - protein, 9 aa, Homo Sapiens
LVVILALLW

SEQ ID NO: 544335 - protein, 9 aa, Homo Sapiens
AFPNPIDPL

SEQ ID NO: 544336 - protein, 9 aa, Homo Sapiens
RQSTAPWCG

SEQ ID NO: 544337 - protein, 9 aa, Homo Sapiens
TVGGLSQGL

SEQ ID NO: 544338 - protein, 9 aa, Homo Sapiens
LQDPNGSST

SEQ ID NO: 544339 - protein, 9 aa, Homo Sapiens
QETAEKDVK

SEQ ID NO: 544340 - protein, 9 aa, Homo Sapiens
CHLLEHDLR

SEQ ID NO: 544341 - protein, 9 aa, Homo Sapiens
SQETAEKDV

SEQ ID NO: 544342 - protein, 9 aa, Homo Sapiens
EFAKSAIRA

SEQ ID NO: 544343 - protein, 9 aa, Homo Sapiens
DLIVIPRSH

SEQ ID NO: 544344 - protein, 9 aa, Homo Sapiens
SAGSSASSP

SEQ ID NO: 544345 - protein, 9 aa, Homo Sapiens
PPQLGPVQA

SEQ ID NO: 544346 - protein, 9 aa, Homo Sapiens
RNRQSTAPW

SEQ ID NO: 544347 - protein, 9 aa, Homo Sapiens
ENNPSVLGL

SEQ ID NO: 544348 - protein, 9 aa, Homo Sapiens
KNGAVFLAV

SEQ ID NO: 544349 - protein, 9 aa, Homo Sapiens
IWQGCGHTD

SEQ ID NO: 544350 - protein, 9 aa, Homo Sapiens
NGRKVLASN

SEQ ID NO: 544351 - protein, 9 aa, Homo Sapiens
PAPPQLGPV

SEQ ID NO: 544352 - protein, 9 aa, Homo Sapiens
YPGAILPQG

SEQ ID NO: 544353 - protein, 9 aa, Homo Sapiens
SASDPSDGQ

SEQ ID NO: 544354 - protein, 9 aa, Homo Sapiens
EVVEVMKGS

SEQ ID NO: 544355 - protein, 9 aa, Homo Sapiens
SGTQTPRSG

SEQ ID NO: 544356 - protein, 9 aa, Homo Sapiens
HSVYEAPKT

SEQ ID NO: 544357 - protein, 9 aa, Homo Sapiens
LTDCHFELC

SEQ ID NO: 544358 - protein, 9 aa, Homo Sapiens
SSTDITERS

SEQ ID NO: 544359 - protein, 9 aa, Homo Sapiens
PWCGPSACR

SEQ ID NO: 544360 - protein, 9 aa, Homo Sapiens
PLTMVVTYD

SEQ ID NO: 544361 - protein, 9 aa, Homo Sapiens
VVAVPCRNG

SEQ ID NO: 544362 - protein, 9 aa, Homo Sapiens
QATSAVLPS

SEQ ID NO: 544363 - protein, 9 aa, Homo Sapiens
RRPQALLRW

SEQ ID NO: 544364 - protein, 9 aa, Homo Sapiens
RPLMDEDML

SEQ ID NO: 544365 - protein, 9 aa, Homo Sapiens
NTEAAGSQE

SEQ ID NO: 544366 - protein, 9 aa, Homo Sapiens
LLQDPNGSS

SEQ ID NO: 544367 - protein, 9 aa, Homo Sapiens
SSSEEEPES

SEQ ID NO: 544368 - protein, 9 aa, Homo Sapiens
FFPELFFAV

SEQ ID NO: 544369 - protein, 9 aa, Homo Sapiens
SSMTSPSTM

SEQ ID NO: 544370 - protein, 9 aa, Homo Sapiens
FEQHMKNSK

SEQ ID NO: 544371 - protein, 9 aa, Homo Sapiens
HALGQATSA

SEQ ID NO: 544372 - protein, 9 aa, Homo Sapiens
VILALLWCW

SEQ ID NO: 544373 - protein, 9 aa, Homo Sapiens
LTMVVTYDA

SEQ ID NO: 544374 - protein, 9 aa, Homo Sapiens
PGRASPARA

SEQ ID NO: 544375 - protein, 9 aa, Homo Sapiens
IDFSRPLMD

SEQ ID NO: 544376 - protein, 9 aa, Homo Sapiens
KLPSVLAVS

SEQ ID NO: 544377 - protein, 9 aa, Homo Sapiens
AEKGMYNEH

SEQ ID NO: 544378 - protein, 9 aa, Homo Sapiens
SAIRAQPQD

SEQ ID NO: 544379 - protein, 9 aa, Homo Sapiens
CWSWRNRQS

SEQ ID NO: 544380 - protein, 9 aa, Homo Sapiens
RNASIWQGC

SEQ ID NO: 544381 - protein, 9 aa, Homo Sapiens
SVLAVSSDK

SEQ ID NO: 544382 - protein, 9 aa, Homo Sapiens
FPNPIDPLN

SEQ ID NO: 544383 - protein, 9 aa, Homo Sapiens
GLKLPSVLA

SEQ ID NO: 544384 - protein, 9 aa, Homo Sapiens
VSASDPSDG

SEQ ID NO: 544385 - protein, 9 aa, Homo Sapiens
KMLGDLLSE

SEQ ID NO: 544386 - protein, 9 aa, Homo Sapiens
RAHWLWALP

SEQ ID NO: 544387 - protein, 9 aa, Homo Sapiens
QSTAPWCGP

SEQ ID NO: 544388 - protein, 9 aa, Homo Sapiens
ETAEKDVKR

SEQ ID NO: 544389 - protein, 9 aa, Homo Sapiens
APWCGPSAC

SEQ ID NO: 544390 - protein, 9 aa, Homo Sapiens
SQGLHLADL

SEQ ID NO: 544391 - protein, 9 aa, Homo Sapiens
FQGMHEGAS

SEQ ID NO: 544392 - protein, 9 aa, Homo Sapiens
RVRGVGGPS

SEQ ID NO: 544393 - protein, 9 aa, Homo Sapiens
MTAKAIAKG

SEQ ID NO: 544394 - protein, 9 aa, Homo Sapiens
MKGSSMTFL

SEQ ID NO: 544395 - protein, 9 aa, Homo Sapiens
RSHEDDAHN

SEQ ID NO: 544396 - protein, 9 aa, Homo Sapiens
QVSGVTHIH

SEQ ID NO: 544397 - protein, 9 aa, Homo Sapiens
GKPLTMVVT

SEQ ID NO: 544398 - protein, 9 aa, Homo Sapiens
AGDITSDTN

SEQ ID NO: 544399 - protein, 9 aa, Homo Sapiens
ACTTRASAA

SEQ ID NO: 544400 - protein, 9 aa, Homo Sapiens
QEVATASLA

SEQ ID NO: 544401 - protein, 9 aa, Homo Sapiens
WACTTRASA

SEQ ID NO: 544402 - protein, 9 aa, Homo Sapiens
PSGSRAGDT

SEQ ID NO: 544403 - protein, 9 aa, Homo Sapiens
PPMSSLPAR

SEQ ID NO: 544404 - protein, 9 aa, Homo Sapiens
SPTPSSMTS

SEQ ID NO: 544405 - protein, 9 aa, Homo Sapiens
IVIPRSHED

SEQ ID NO: 544406 - protein, 9 aa, Homo Sapiens
SFIRAGDIT

SEQ ID NO: 544407 - protein, 9 aa, Homo Sapiens
MSSLPARPS

SEQ ID NO: 544408 - protein, 9 aa, Homo Sapiens
AAELIWCHL

SEQ ID NO: 544409 - protein, 9 aa, Homo Sapiens
VWVEFRDKR

SEQ ID NO: 544410 - protein, 9 aa, Homo Sapiens
SRPLMDEDM

SEQ ID NO: 544411 - protein, 9 aa, Homo Sapiens
GRPSWACTT

SEQ ID NO: 544412 - protein, 9 aa, Homo Sapiens
TGWSLPHTA

SEQ ID NO: 544413 - protein, 9 aa, Homo Sapiens
ILRVVHMQV

SEQ ID NO: 544414 - protein, 9 aa, Homo Sapiens
WLWALPASS

SEQ ID NO: 544415 - protein, 9 aa, Homo Sapiens
TGRCIGFVN

SEQ ID NO: 544416 - protein, 9 aa, Homo Sapiens
PTPSSMTSP

SEQ ID NO: 544417 - protein, 9 aa, Homo Sapiens
PQLLAFPNP

SEQ ID NO: 544418 - protein, 9 aa, Homo Sapiens
EASSESESE

SEQ ID NO: 544419 - protein, 9 aa, Homo Sapiens
TPPMSSLPA

SEQ ID NO: 544420 - protein, 9 aa, Homo Sapiens
VSGVTHIHT

SEQ ID NO: 544421 - protein, 9 aa, Homo Sapiens
FPPMPTPSH

SEQ ID NO: 544422 - protein, 9 aa, Homo Sapiens
KMLKEFAKS

SEQ ID NO: 544423 - protein, 9 aa, Homo Sapiens
CTTRASAAP

SEQ ID NO: 544424 - protein, 9 aa, Homo Sapiens
LPSVLAVSS

SEQ ID NO: 544425 - protein, 9 aa, Homo Sapiens
TATSMTEDS

SEQ ID NO: 544426 - protein, 9 aa, Homo Sapiens
TIDFSRPLM

SEQ ID NO: 544427 - protein, 9 aa, Homo Sapiens
GKQCLPLVE

SEQ ID NO: 544428 - protein, 9 aa, Homo Sapiens
VITSDKNKP

SEQ ID NO: 544429 - protein, 9 aa, Homo Sapiens
TRASAAPLG

SEQ ID NO: 544430 - protein, 9 aa, Homo Sapiens
ADLRAHWLW

SEQ ID NO: 544431 - protein, 9 aa, Homo Sapiens
TLGVLQAGQ

SEQ ID NO: 544432 - protein, 9 aa, Homo Sapiens
VELIQQLLR

SEQ ID NO: 544433 - protein, 9 aa, Homo Sapiens
TQTPRSGRP

SEQ ID NO: 544434 - protein, 9 aa, Homo Sapiens
LLKDIRPEF

SEQ ID NO: 544435 - protein, 9 aa, Homo Sapiens
AFNELTDCH

SEQ ID NO: 544436 - protein, 9 aa, Homo Sapiens
GNVILRVVH

SEQ ID NO: 544437 - protein, 9 aa, Homo Sapiens
VSRAEKGMY

SEQ ID NO: 544438 - protein, 9 aa, Homo Sapiens
SNLLGRNAN

SEQ ID NO: 544439 - protein, 9 aa, Homo Sapiens
NRQSTAPWC

SEQ ID NO: 544440 - protein, 9 aa, Homo Sapiens
AHWLWALPA

SEQ ID NO: 544441 - protein, 9 aa, Homo Sapiens
CGGIVVPAG

SEQ ID NO: 544442 - protein, 9 aa, Homo Sapiens
AAPAPPQLG

SEQ ID NO: 544443 - protein, 9 aa, Homo Sapiens
QLLAFPNPI

SEQ ID NO: 544444 - protein, 9 aa, Homo Sapiens
SGEVVEVMK

SEQ ID NO: 544445 - protein, 9 aa, Homo Sapiens
WVSSSVSAS

SEQ ID NO: 544446 - protein, 9 aa, Homo Sapiens
RFQGMHEGA

SEQ ID NO: 544447 - protein, 9 aa, Homo Sapiens
FTSVVRFPD

SEQ ID NO: 544448 - protein, 9 aa, Homo Sapiens
GMYNEHTVD

SEQ ID NO: 544449 - protein, 9 aa, Homo Sapiens
EKGMYNEHT

SEQ ID NO: 544450 - protein, 9 aa, Homo Sapiens
DAAELIWCH

SEQ ID NO: 544451 - protein, 9 aa, Homo Sapiens
ENKGITYLF

SEQ ID NO: 544452 - protein, 9 aa, Homo Sapiens
LLAFPNPID

SEQ ID NO: 544453 - protein, 9 aa, Homo Sapiens
PELFFAVVA

SEQ ID NO: 544454 - protein, 9 aa, Homo Sapiens
GTTYGRIYM

SEQ ID NO: 544455 - protein, 9 aa, Homo Sapiens
ITSDKNKPL

SEQ ID NO: 544456 - protein, 9 aa, Homo Sapiens
PLVGLVVIL

SEQ ID NO: 544457 - protein, 9 aa, Homo Sapiens
GLFFPVVSL

SEQ ID NO: 544458 - protein, 9 aa, Homo Sapiens
EEEPESKAK

SEQ ID NO: 544459 - protein, 9 aa, Homo Sapiens
SLPHTATSM

SEQ ID NO: 544460 - protein, 9 aa, Homo Sapiens
DLRAHWLWA

SEQ ID NO: 544461 - protein, 9 aa, Homo Sapiens
TTITPKMLG

SEQ ID NO: 544462 - protein, 9 aa, Homo Sapiens
NPSVLGLNG

SEQ ID NO: 544463 - protein, 9 aa, Homo Sapiens
NHTEQNTEA

SEQ ID NO: 544464 - protein, 9 aa, Homo Sapiens
ITPKMLGDL

SEQ ID NO: 544465 - protein, 9 aa, Homo Sapiens
RTFFPELFF

SEQ ID NO: 544466 - protein, 9 aa, Homo Sapiens
SVSASDPSD

SEQ ID NO: 544467 - protein, 9 aa, Homo Sapiens
EYKHEEYQR

SEQ ID NO: 544468 - protein, 9 aa, Homo Sapiens
AAPLGCRSA

SEQ ID NO: 544469 - protein, 9 aa, Homo Sapiens
VIERNLNPK

SEQ ID NO: 544470 - protein, 9 aa, Homo Sapiens
FYENKGITY

SEQ ID NO: 544471 - protein, 9 aa, Homo Sapiens
TTRASAAPL

SEQ ID NO: 544472 - protein, 9 aa, Homo Sapiens
PERLENNPS

SEQ ID NO: 544473 - protein, 9 aa, Homo Sapiens
PHTATSMTE

SEQ ID NO: 544474 - protein, 9 aa, Homo Sapiens
VLAVSSDKG

SEQ ID NO: 544475 - protein, 9 aa, Homo Sapiens
CSANGVASK

SEQ ID NO: 544476 - protein, 9 aa, Homo Sapiens
TVDLSAIRI

SEQ ID NO: 544477 - protein, 9 aa, Homo Sapiens
ANGVASKAK

SEQ ID NO: 544478 - protein, 9 aa, Homo Sapiens
KAENGRKVL

SEQ ID NO: 544479 - protein, 9 aa, Homo Sapiens
LPLVELIQQ

SEQ ID NO: 544480 - protein, 9 aa, Homo Sapiens
EVMKGSSMT

SEQ ID NO: 544481 - protein, 9 aa, Homo Sapiens
LSAGIKVRF

SEQ ID NO: 544482 - protein, 9 aa, Homo Sapiens
IRLLPPTWL

SEQ ID NO: 544483 - protein, 9 aa, Homo Sapiens
VDLSAIRIK

SEQ ID NO: 544484 - protein, 9 aa, Homo Sapiens
NKSISFIGY

SEQ ID NO: 544485 - protein, 9 aa, Homo Sapiens
RASAAPLGC

SEQ ID NO: 544486 - protein, 9 aa, Homo Sapiens
ATASLAWAS

SEQ ID NO: 544487 - protein, 9 aa, Homo Sapiens
VVSLSAGIK

SEQ ID NO: 544488 - protein, 9 aa, Homo Sapiens
NVILRVVHM

SEQ ID NO: 544489 - protein, 9 aa, Homo Sapiens
VATASLAWA

SEQ ID NO: 544490 - protein, 9 aa, Homo Sapiens
DDIYYFRKP

SEQ ID NO: 544491 - protein, 9 aa, Homo Sapiens
QVIFCSRSP

SEQ ID NO: 544492 - protein, 9 aa, Homo Sapiens
NSRNASIWQ

SEQ ID NO: 544493 - protein, 9 aa, Homo Sapiens
PSSLPTGWS

SEQ ID NO: 544494 - protein, 9 aa, Homo Sapiens
ARPSGSRAG

SEQ ID NO: 544495 - protein, 9 aa, Homo Sapiens
PCRNGNVIL

SEQ ID NO: 544496 - protein, 9 aa, Homo Sapiens
SEEEPESKA

SEQ ID NO: 544497 - protein, 9 aa, Homo Sapiens
APSVVLTVD

SEQ ID NO: 544498 - protein, 9 aa, Homo Sapiens
AIFPPMPTP

SEQ ID NO: 544499 - protein, 9 aa, Homo Sapiens
QTPRSGRPS

SEQ ID NO: 544500 - protein, 9 aa, Homo Sapiens
TSMTEDSGT

SEQ ID NO: 544501 - protein, 9 aa, Homo Sapiens
SFLPQLLAF

SEQ ID NO: 544502 - protein, 9 aa, Homo Sapiens
DLSAIRIKK

SEQ ID NO: 544503 - protein, 9 aa, Homo Sapiens
ELTDCHFEL

SEQ ID NO: 544504 - protein, 9 aa, Homo Sapiens
GWSLPHTAT

SEQ ID NO: 544505 - protein, 9 aa, Homo Sapiens
PMPTPSHEL

SEQ ID NO: 544506 - protein, 9 aa, Homo Sapiens
MYNEHTVDR

SEQ ID NO: 544507 - protein, 9 aa, Homo Sapiens
MTSPSTMTS

SEQ ID NO: 544508 - protein, 9 aa, Homo Sapiens
TGDHPMTAK

SEQ ID NO: 544509 - protein, 9 aa, Homo Sapiens
TPSMEALAR

SEQ ID NO: 544510 - protein, 9 aa, Homo Sapiens
NKPLCGGIV

SEQ ID NO: 544511 - protein, 9 aa, Homo Sapiens
SQVIFCSRS

SEQ ID NO: 544512 - protein, 9 aa, Homo Sapiens
TLKAENGRK

SEQ ID NO: 544513 - protein, 9 aa, Homo Sapiens
SRSPRVVLP

SEQ ID NO: 544514 - protein, 9 aa, Homo Sapiens
ATVGGLSQG

SEQ ID NO: 544515 - protein, 9 aa, Homo Sapiens
LAEKWKAHD

SEQ ID NO: 544516 - protein, 9 aa, Homo Sapiens
KPLCGGIVV

SEQ ID NO: 544517 - protein, 9 aa, Homo Sapiens
GRVSCAFNE

SEQ ID NO: 544518 - protein, 9 aa, Homo Sapiens
MDEDMLLFT

SEQ ID NO: 544519 - protein, 9 aa, Homo Sapiens
QRLNQVSAG

SEQ ID NO: 544520 - protein, 9 aa, Homo Sapiens
RCWSWRNRQ

SEQ ID NO: 544521 - protein, 9 aa, Homo Sapiens
PVVSLSAGI

SEQ ID NO: 544522 - protein, 9 aa, Homo Sapiens
RQRLNQVSA

SEQ ID NO: 544523 - protein, 9 aa, Homo Sapiens
RPSGSRAGD

SEQ ID NO: 544524 - protein, 9 aa, Homo Sapiens
ANTIDFSRP

SEQ ID NO: 544525 - protein, 9 aa, Homo Sapiens
MGYQCTLGV

SEQ ID NO: 544526 - protein, 9 aa, Homo Sapiens
SLPARPSGS

SEQ ID NO: 544527 - protein, 9 aa, Homo Sapiens
MTEDSGTQT

SEQ ID NO: 544528 - protein, 9 aa, Homo Sapiens
APPQLGPVQ

SEQ ID NO: 544529 - protein, 9 aa, Homo Sapiens
VRTFFPELF

SEQ ID NO: 544530 - protein, 9 aa, Homo Sapiens
CQRRPQALL

SEQ ID NO: 544531 - protein, 9 aa, Homo Sapiens
CRTPPMSSL

SEQ ID NO: 544532 - protein, 9 aa, Homo Sapiens
TSVVRFPDN

SEQ ID NO: 544533 - protein, 9 aa, Homo Sapiens
AGRVRGVGG

SEQ ID NO: 544534 - protein, 9 aa, Homo Sapiens
GLVVILALL

SEQ ID NO: 544535 - protein, 9 aa, Homo Sapiens
ISYPGAILP

SEQ ID NO: 544536 - protein, 9 aa, Homo Sapiens
MPTPSHELS

SEQ ID NO: 544537 - protein, 9 aa, Homo Sapiens
TPRSGRPSW

SEQ ID NO: 544538 - protein, 9 aa, Homo Sapiens
SGRPSWACT

SEQ ID NO: 544539 - protein, 9 aa, Homo Sapiens
QSTTAIPAF

SEQ ID NO: 544540 - protein, 9 aa, Homo Sapiens
LGCRSAGSS

SEQ ID NO: 544541 - protein, 9 aa, Homo Sapiens
SMTSPSTMT

SEQ ID NO: 544542 - protein, 9 aa, Homo Sapiens
PHSVPQSTT

SEQ ID NO: 544543 - protein, 9 aa, Homo Sapiens
SVPQSTTAI

SEQ ID NO: 544544 - protein, 9 aa, Homo Sapiens
QDLIVRNDT

SEQ ID NO: 544545 - protein, 9 aa, Homo Sapiens
HVVAVPCRN

SEQ ID NO: 544546 - protein, 9 aa, Homo Sapiens
DSQETAEKD

SEQ ID NO: 544547 - protein, 9 aa, Homo Sapiens
KLAEKWKAH

SEQ ID NO: 544548 - protein, 9 aa, Homo Sapiens
ETIWPQVIT

SEQ ID NO: 544549 - protein, 9 aa, Homo Sapiens
HTATSMTED

SEQ ID NO: 544550 - protein, 9 aa, Homo Sapiens
TITPKMLGD

SEQ ID NO: 544551 - protein, 9 aa, Homo Sapiens
TYGRIYMQK

SEQ ID NO: 544552 - protein, 9 aa, Homo Sapiens
VLASNLLGR

SEQ ID NO: 544553 - protein, 9 aa, Homo Sapiens
ARFIRLLPP

SEQ ID NO: 544554 - protein, 9 aa, Homo Sapiens
LGRNANTID

SEQ ID NO: 544555 - protein, 9 aa, Homo Sapiens
PEGRGESRF

SEQ ID NO: 544556 - protein, 9 aa, Homo Sapiens
LALLSICQR

SEQ ID NO: 544557 - protein, 9 aa, Homo Sapiens
PPMPTPSHE

SEQ ID NO: 544558 - protein, 9 aa, Homo Sapiens
PSQVIFCSR

SEQ ID NO: 544559 - protein, 9 aa, Homo Sapiens
FAKSAIRAQ

SEQ ID NO: 544560 - protein, 9 aa, Homo Sapiens
AVPCRNGNV

SEQ ID NO: 544561 - protein, 9 aa, Homo Sapiens
RNANTIDFS

SEQ ID NO: 544562 - protein, 9 aa, Homo Sapiens
ERLENNPSV

SEQ ID NO: 544563 - protein, 9 aa, Homo Sapiens
SICQRRPQA

SEQ ID NO: 544564 - protein, 9 aa, Homo Sapiens
YTEVWVEFR

SEQ ID NO: 544565 - protein, 9 aa, Homo Sapiens
VTGDHPMTA

SEQ ID NO: 544566 - protein, 9 aa, Homo Sapiens
LVELIQQLL

SEQ ID NO: 544567 - protein, 9 aa, Homo Sapiens
VVEVMKGSS

SEQ ID NO: 544568 - protein, 9 aa, Homo Sapiens
MVTGDHPMT

SEQ ID NO: 544569 - protein, 9 aa, Homo Sapiens
KNKPLCGGI

SEQ ID NO: 544570 - protein, 9 aa, Homo Sapiens
FPVVSLSAG

SEQ ID NO: 544571 - protein, 9 aa, Homo Sapiens
VPQSTTAIP

SEQ ID NO: 544572 - protein, 9 aa, Homo Sapiens
PLGCRSAGS

SEQ ID NO: 544573 - protein, 9 aa, Homo Sapiens
AGLAGRVRG

SEQ ID NO: 544574 - protein, 9 aa, Homo Sapiens
RLNQVSAGQ

SEQ ID NO: 544575 - protein, 9 aa, Homo Sapiens
SPSTMTSRC

SEQ ID NO: 544576 - protein, 9 aa, Homo Sapiens
LLVLFLLFL

SEQ ID NO: 544577 - protein, 9 aa, Homo Sapiens
DYTEVWVEF

SEQ ID NO: 544578 - protein, 9 aa, Homo Sapiens
LTLKAENGR

SEQ ID NO: 544579 - protein, 9 aa, Homo Sapiens
DDDIYYFRK

SEQ ID NO: 544580 - protein, 9 aa, Homo Sapiens
KLKNKVHSV

SEQ ID NO: 544581 - protein, 9 aa, Homo Sapiens
VLFLLFLTW

SEQ ID NO: 544582 - protein, 9 aa, Homo Sapiens
LWALPASSE

SEQ ID NO: 544583 - protein, 9 aa, Homo Sapiens
DLIVRNDTP

SEQ ID NO: 544584 - protein, 9 aa, Homo Sapiens
SAVLPSSLP

SEQ ID NO: 544585 - protein, 9 aa, Homo Sapiens
SYPGAILPQ

SEQ ID NO: 544586 - protein, 9 aa, Homo Sapiens
EKDVKRKRS

SEQ ID NO: 544587 - protein, 9 aa, Homo Sapiens
VAVPCRNGN

SEQ ID NO: 544588 - protein, 9 aa, Homo Sapiens
NKSPFEQHM

SEQ ID NO: 544589 - protein, 9 aa, Homo Sapiens
SSEEEPESK

SEQ ID NO: 544590 - protein, 9 aa, Homo Sapiens
GSSASSPTP

SEQ ID NO: 544591 - protein, 9 aa, Homo Sapiens
ESSSSSSSE

SEQ ID NO: 544592 - protein, 9 aa, Homo Sapiens
PSWACTTRA

SEQ ID NO: 544593 - protein, 9 aa, Homo Sapiens
LFFAVVACG

SEQ ID NO: 544594 - protein, 9 aa, Homo Sapiens
LLLLVLFLL

SEQ ID NO: 544595 - protein, 9 aa, Homo Sapiens
PSVLAVSSD

SEQ ID NO: 544596 - protein, 9 aa, Homo Sapiens
EWHLGVCRE

SEQ ID NO: 544597 - protein, 9 aa, Homo Sapiens
SDKNKPLCG

SEQ ID NO: 544598 - protein, 9 aa, Homo Sapiens
LCGGIVVPA

SEQ ID NO: 544599 - protein, 9 aa, Homo Sapiens
LVLFLLFLT

SEQ ID NO: 544600 - protein, 9 aa, Homo Sapiens
PQVITSDKN

SEQ ID NO: 544601 - protein, 9 aa, Homo Sapiens
VPLQDLIVR

SEQ ID NO: 544602 - protein, 9 aa, Homo Sapiens
SYTKDYTEV

SEQ ID NO: 544603 - protein, 9 aa, Homo Sapiens
DKNKPLCGG

SEQ ID NO: 544604 - protein, 9 aa, Homo Sapiens
TSDKNKPLC

SEQ ID NO: 544605 - protein, 9 aa, Homo Sapiens
PAGRVSCAF

SEQ ID NO: 544606 - protein, 9 aa, Homo Sapiens
PMSSLPARP

SEQ ID NO: 544607 - protein, 9 aa, Homo Sapiens
LKLPSVLAV

SEQ ID NO: 544608 - protein, 9 aa, Homo Sapiens
ELIQQLLRN

SEQ ID NO: 544609 - protein, 9 aa, Homo Sapiens
MSDGSSSSE

SEQ ID NO: 544610 - protein, 9 aa, Homo Sapiens
HLADLRAHW

SEQ ID NO: 544611 - protein, 9 aa, Homo Sapiens
WRNRQSTAP

SEQ ID NO: 544612 - protein, 9 aa, Homo Sapiens
PLQDLIVRN

SEQ ID NO: 544613 - protein, 9 aa, Homo Sapiens
IWCHLLEHD

SEQ ID NO: 544614 - protein, 9 aa, Homo Sapiens
LIVRNDTPC

SEQ ID NO: 544615 - protein, 9 aa, Homo Sapiens
SGVTHIHTV

SEQ ID NO: 544616 - protein, 9 aa, Homo Sapiens
PSPPRQRLN

SEQ ID NO: 544617 - protein, 9 aa, Homo Sapiens
LGDLLSEKK

SEQ ID NO: 544618 - protein, 9 aa, Homo Sapiens
ATSMTEDSG

SEQ ID NO: 544619 - protein, 9 aa, Homo Sapiens
GGIVVPAGR

SEQ ID NO: 544620 - protein, 9 aa, Homo Sapiens
IPRSHEDDA

SEQ ID NO: 544621 - protein, 9 aa, Homo Sapiens
ARASPAQAS

SEQ ID NO: 544622 - protein, 9 aa, Homo Sapiens
ELFFAVVAC

SEQ ID NO: 544623 - protein, 9 aa, Homo Sapiens
YGIQSFFFM

SEQ ID NO: 544624 - protein, 9 aa, Homo Sapiens
RAGDITSDT

SEQ ID NO: 544625 - protein, 9 aa, Homo Sapiens
RMGYQCTLG

SEQ ID NO: 544626 - protein, 9 aa, Homo Sapiens
DEDMLLFTS

SEQ ID NO: 544627 - protein, 9 aa, Homo Sapiens
PKMLGDLLS

SEQ ID NO: 544628 - protein, 9 aa, Homo Sapiens
VLPSSLPTG

SEQ ID NO: 544629 - protein, 9 aa, Homo Sapiens
LIWCHLLEH

SEQ ID NO: 544630 - protein, 9 aa, Homo Sapiens
EKWKAHDEA

SEQ ID NO: 544631 - protein, 9 aa, Homo Sapiens
QNKLKNKVH

SEQ ID NO: 544632 - protein, 9 aa, Homo Sapiens
FIGYGIQSF

SEQ ID NO: 544633 - protein, 9 aa, Homo Sapiens
PASSEGVCD

SEQ ID NO: 544634 - protein, 9 aa, Homo Sapiens
IGFVNHHYY

SEQ ID NO: 544635 - protein, 9 aa, Homo Sapiens
HQEVATASL

SEQ ID NO: 544636 - protein, 9 aa, Homo Sapiens
SVVLTVDLS

SEQ ID NO: 544637 - protein, 9 aa, Homo Sapiens
ISFIGYGIQ

SEQ ID NO: 544638 - protein, 9 aa, Homo Sapiens
STMTSRCWS

SEQ ID NO: 544639 - protein, 9 aa, Homo Sapiens
SRNASIWQG

SEQ ID NO: 544640 - protein, 9 aa, Homo Sapiens
TMVVTYDAY

SEQ ID NO: 544641 - protein, 9 aa, Homo Sapiens
HWLWALPAS

SEQ ID NO: 544642 - protein, 9 aa, Homo Sapiens
FELCLTLKA

SEQ ID NO: 544643 - protein, 9 aa, Homo Sapiens
RSAGSSASS

SEQ ID NO: 544644 - protein, 9 aa, Homo Sapiens
VHSVYEAPK

SEQ ID NO: 544645 - protein, 9 aa, Homo Sapiens
FSRPLMDED

SEQ ID NO: 544646 - protein, 9 aa, Homo Sapiens
KEFAKSAIR

SEQ ID NO: 544647 - protein, 9 aa, Homo Sapiens
GRNANTIDF

SEQ ID NO: 544648 - protein, 9 aa, Homo Sapiens
MVVTYDAYP

SEQ ID NO: 544649 - protein, 9 aa, Homo Sapiens
SWACTTRAS

SEQ ID NO: 544650 - protein, 9 aa, Homo Sapiens
SSLPARPSG

SEQ ID NO: 544651 - protein, 9 aa, Homo Sapiens
WCGPSACRT

SEQ ID NO: 544652 - protein, 9 aa, Homo Sapiens
SPFEQHMKN

SEQ ID NO: 544653 - protein, 9 aa, Homo Sapiens
QKNGAVFLA

SEQ ID NO: 544654 - protein, 9 aa, Homo Sapiens
PTPSHELSK

SEQ ID NO: 544655 - protein, 9 aa, Homo Sapiens
KGMYNEHTV

SEQ ID NO: 544656 - protein, 9 aa, Homo Sapiens
QFYENKGIT

SEQ ID NO: 544657 - protein, 9 aa, Homo Sapiens
LSLEQQVIE

SEQ ID NO: 544658 - protein, 9 aa, Homo Sapiens
ESRFQGMHE

SEQ ID NO: 544659 - protein, 9 aa, Homo Sapiens
RASPARASP

SEQ ID NO: 544660 - protein, 9 aa, Homo Sapiens
TMTSRCWSW

SEQ ID NO: 544661 - protein, 9 aa, Homo Sapiens
GDHPMTAKA

SEQ ID NO: 544662 - protein, 9 aa, Homo Sapiens
LLLVLFLLF

SEQ ID NO: 544663 - protein, 9 aa, Homo Sapiens
GLHLADLRA

SEQ ID NO: 544664 - protein, 9 aa, Homo Sapiens
HEEYQRSER

SEQ ID NO: 544665 - protein, 9 aa, Homo Sapiens
LNQVSAGQT

SEQ ID NO: 544666 - protein, 9 aa, Homo Sapiens
FFPVVSLSA

SEQ ID NO: 544667 - protein, 9 aa, Homo Sapiens
LAKLLKDIR

SEQ ID NO: 544668 - protein, 9 aa, Homo Sapiens
VGLVVILAL

SEQ ID NO: 544669 - protein, 9 aa, Homo Sapiens
GCRSAGSSA

SEQ ID NO: 544670 - protein, 9 aa, Homo Sapiens
DIYYFRKPI

SEQ ID NO: 544671 - protein, 9 aa, Homo Sapiens
LHALGQATS

SEQ ID NO: 544672 - protein, 9 aa, Homo Sapiens
VSCAFNELT

SEQ ID NO: 544673 - protein, 9 aa, Homo Sapiens
SLAWASVAI

SEQ ID NO: 544674 - protein, 9 aa, Homo Sapiens
TSRCWSWRN

SEQ ID NO: 544675 - protein, 9 aa, Homo Sapiens
VNYSHAADN

SEQ ID NO: 544676 - protein, 9 aa, Homo Sapiens
DVKRKRSHP

SEQ ID NO: 544677 - protein, 9 aa, Homo Sapiens
VEVMKGSSM

SEQ ID NO: 544678 - protein, 9 aa, Homo Sapiens
LKDIRPEFR

SEQ ID NO: 544679 - protein, 9 aa, Homo Sapiens
PARPSGSRA

SEQ ID NO: 544680 - protein, 9 aa, Homo Sapiens
LKAENGRKV

SEQ ID NO: 544681 - protein, 9 aa, Homo Sapiens
KPLTMVVTY

SEQ ID NO: 544682 - protein, 9 aa, Homo Sapiens
TEVWVEFRD

SEQ ID NO: 544683 - protein, 9 aa, Homo Sapiens
DCTYLKCSA

SEQ ID NO: 544684 - protein, 9 aa, Homo Sapiens
CLTLKAENG

SEQ ID NO: 544685 - protein, 9 aa, Homo Sapiens
GRWVSSSVS

SEQ ID NO: 544686 - protein, 9 aa, Homo Sapiens
WSLPHTATS

SEQ ID NO: 544687 - protein, 9 aa, Homo Sapiens
ALLSICQRR

SEQ ID NO: 544688 - protein, 9 aa, Homo Sapiens
GDLLSEKKT

SEQ ID NO: 544689 - protein, 9 aa, Homo Sapiens
RLLAKLLKD

SEQ ID NO: 544690 - protein, 9 aa, Homo Sapiens
SLPTGWSLP

SEQ ID NO: 544691 - protein, 9 aa, Homo Sapiens
EQNTEAAGS

SEQ ID NO: 544692 - protein, 9 aa, Homo Sapiens
VVDDDIYYF

SEQ ID NO: 544693 - protein, 9 aa, Homo Sapiens
LAFPNPIDP

SEQ ID NO: 544694 - protein, 9 aa, Homo Sapiens
GESRFQGMH

SEQ ID NO: 544695 - protein, 9 aa, Homo Sapiens
IMVTGDHPM

SEQ ID NO: 544696 - protein, 9 aa, Homo Sapiens
ACRTPPMSS

SEQ ID NO: 544697 - protein, 9 aa, Homo Sapiens
SMTEDSGTQ

SEQ ID NO: 544698 - protein, 9 aa, Homo Sapiens
RGQFYENKG

SEQ ID NO: 544699 - protein, 9 aa, Homo Sapiens
QVIERNLNP

SEQ ID NO: 544700 - protein, 9 aa, Homo Sapiens
LPQLLAFPN

SEQ ID NO: 544701 - protein, 9 aa, Homo Sapiens
AQCIQKNGA

SEQ ID NO: 544702 - protein, 9 aa, Homo Sapiens
LADLRAHWL

SEQ ID NO: 544703 - protein, 9 aa, Homo Sapiens
PSSMTSPST

SEQ ID NO: 544704 - protein, 9 aa, Homo Sapiens
IVVPAGRVS

SEQ ID NO: 544705 - protein, 9 aa, Homo Sapiens
APAGLAGRV

SEQ ID NO: 544706 - protein, 9 aa, Homo Sapiens
PRQRLNQVS

SEQ ID NO: 544707 - protein, 9 aa, Homo Sapiens
VPCRNGNVI

SEQ ID NO: 544708 - protein, 9 aa, Homo Sapiens
ASRLLAKLL

SEQ ID NO: 544709 - protein, 9 aa, Homo Sapiens
EVATASLAW

SEQ ID NO: 544710 - protein, 9 aa, Homo Sapiens
KSPFEQHMK

SEQ ID NO: 544711 - protein, 9 aa, Homo Sapiens
TPGIIPPVD

SEQ ID NO: 544712 - protein, 9 aa, Homo Sapiens
TCWGSILHC

SEQ ID NO: 544713 - protein, 9 aa, Homo Sapiens
GPVPAELLP

SEQ ID NO: 544714 - protein, 9 aa, Homo Sapiens
REAKNKRGS

SEQ ID NO: 544715 - protein, 9 aa, Homo Sapiens
LPLDTLPGH

SEQ ID NO: 544716 - protein, 9 aa, Homo Sapiens
YSDYLHWES

SEQ ID NO: 544717 - protein, 9 aa, Homo Sapiens
LPGLQVLGV

SEQ ID NO: 544718 - protein, 9 aa, Homo Sapiens
NLDLRDTLV

SEQ ID NO: 544719 - protein, 9 aa, Homo Sapiens
RERKKGRRR

SEQ ID NO: 544720 - protein, 9 aa, Homo Sapiens
ALILSLTGL

SEQ ID NO: 544721 - protein, 9 aa, Homo Sapiens
SALILSLTG

SEQ ID NO: 544722 - protein, 9 aa, Homo Sapiens
VVLVVKAKW

SEQ ID NO: 544723 - protein, 9 aa, Homo Sapiens
KRARSLNTL

SEQ ID NO: 544724 - protein, 9 aa, Homo Sapiens
AKWVPLAFL

SEQ ID NO: 544725 - protein, 9 aa, Homo Sapiens
SEFYQYLCK

SEQ ID NO: 544726 - protein, 9 aa, Homo Sapiens
KRGSGKNSQ

SEQ ID NO: 544727 - protein, 9 aa, Homo Sapiens
PPGTPDPYG

SEQ ID NO: 544728 - protein, 9 aa, Homo Sapiens
GYSMTRGKM

SEQ ID NO: 544729 - protein, 9 aa, Homo Sapiens
LQRANGAAL

SEQ ID NO: 544730 - protein, 9 aa, Homo Sapiens
SDGDPGHRA

SEQ ID NO: 544731 - protein, 9 aa, Homo Sapiens
TPDPYGTAV

SEQ ID NO: 544732 - protein, 9 aa, Homo Sapiens
TPALVPTTS

SEQ ID NO: 544733 - protein, 9 aa, Homo Sapiens
MTVLEAVMV

SEQ ID NO: 544734 - protein, 9 aa, Homo Sapiens
PQLWHWPCR

SEQ ID NO: 544735 - protein, 9 aa, Homo Sapiens
LQLEKNFDM

SEQ ID NO: 544736 - protein, 9 aa, Homo Sapiens
CADRATGFH

SEQ ID NO: 544737 - protein, 9 aa, Homo Sapiens
LYTESESKI

SEQ ID NO: 544738 - protein, 9 aa, Homo Sapiens
FYQYLCKKP

SEQ ID NO: 544739 - protein, 9 aa, Homo Sapiens
RDTLVLKVL

SEQ ID NO: 544740 - protein, 9 aa, Homo Sapiens
GLPGLQVLG

SEQ ID NO: 544741 - protein, 9 aa, Homo Sapiens
SDYLHWESF

SEQ ID NO: 544742 - protein, 9 aa, Homo Sapiens
YETDHQAVR

SEQ ID NO: 544743 - protein, 9 aa, Homo Sapiens
IHELHDIFT

SEQ ID NO: 544744 - protein, 9 aa, Homo Sapiens
LLRKLLLGT

SEQ ID NO: 544745 - protein, 9 aa, Homo Sapiens
PSLNPMEIR

SEQ ID NO: 544746 - protein, 9 aa, Homo Sapiens
ALVPTTSSA

SEQ ID NO: 544747 - protein, 9 aa, Homo Sapiens
QLERSIHEL

SEQ ID NO: 544748 - protein, 9 aa, Homo Sapiens
LSLTGLQRA

SEQ ID NO: 544749 - protein, 9 aa, Homo Sapiens
ASSGVIQLP

SEQ ID NO: 544750 - protein, 9 aa, Homo Sapiens
LGPLERGDM

SEQ ID NO: 544751 - protein, 9 aa, Homo Sapiens
SLVYDLVGA

SEQ ID NO: 544752 - protein, 9 aa, Homo Sapiens
TSGKLRVNL

SEQ ID NO: 544753 - protein, 9 aa, Homo Sapiens
TQKSLVYDL

SEQ ID NO: 544754 - protein, 9 aa, Homo Sapiens
LESEFYQYL

SEQ ID NO: 544755 - protein, 9 aa, Homo Sapiens
ATYVTCMSD

SEQ ID NO: 544756 - protein, 9 aa, Homo Sapiens
LKVLLALLG

SEQ ID NO: 544757 - protein, 9 aa, Homo Sapiens
LKTSGKLRV

SEQ ID NO: 544758 - protein, 9 aa, Homo Sapiens
LRVKLDLQG

SEQ ID NO: 544759 - protein, 9 aa, Homo Sapiens
MKRARSLNT

SEQ ID NO: 544760 - protein, 9 aa, Homo Sapiens
ETDHQAVRC

SEQ ID NO: 544761 - protein, 9 aa, Homo Sapiens
YCTPTRKCC

SEQ ID NO: 544762 - protein, 9 aa, Homo Sapiens
PGLPGLQVL

SEQ ID NO: 544763 - protein, 9 aa, Homo Sapiens
IKNHWFRPW

SEQ ID NO: 544764 - protein, 9 aa, Homo Sapiens
EKKLKAYSQ

SEQ ID NO: 544765 - protein, 9 aa, Homo Sapiens
RSLNTLNVD

SEQ ID NO: 544766 - protein, 9 aa, Homo Sapiens
VLLELPDSL

SEQ ID NO: 544767 - protein, 9 aa, Homo Sapiens
ANGAALTVR

SEQ ID NO: 544768 - protein, 9 aa, Homo Sapiens
PGHGLHLCL

SEQ ID NO: 544769 - protein, 9 aa, Homo Sapiens
LVPTTSSAL

SEQ ID NO: 544770 - protein, 9 aa, Homo Sapiens
DTLVLKVLL

SEQ ID NO: 544771 - protein, 9 aa, Homo Sapiens
DILEPPTRV

SEQ ID NO: 544772 - protein, 9 aa, Homo Sapiens
GITEHFWKP

SEQ ID NO: 544773 - protein, 9 aa, Homo Sapiens
GRRRRRMIT

SEQ ID NO: 544774 - protein, 9 aa, Homo Sapiens
PPPEHFMRP

SEQ ID NO: 544775 - protein, 9 aa, Homo Sapiens
KEENLDLRD

SEQ ID NO: 544776 - protein, 9 aa, Homo Sapiens
QDLKLDLAG

SEQ ID NO: 544777 - protein, 9 aa, Homo Sapiens
RIRVKTNKS

SEQ ID NO: 544778 - protein, 9 aa, Homo Sapiens
VNQALLVLL

SEQ ID NO: 544779 - protein, 9 aa, Homo Sapiens
SGRPRRKKK

SEQ ID NO: 544780 - protein, 9 aa, Homo Sapiens
PCRSDGDPG

SEQ ID NO: 544781 - protein, 9 aa, Homo Sapiens
GKLFCVTPA

SEQ ID NO: 544782 - protein, 9 aa, Homo Sapiens
LLELPDSLD

SEQ ID NO: 544783 - protein, 9 aa, Homo Sapiens
TTSSALILS

SEQ ID NO: 544784 - protein, 9 aa, Homo Sapiens
DLRDTLVLK

SEQ ID NO: 544785 - protein, 9 aa, Homo Sapiens
GLQRANGAA

SEQ ID NO: 544786 - protein, 9 aa, Homo Sapiens
RPPPEHFMR

SEQ ID NO: 544787 - protein, 9 aa, Homo Sapiens
WFRPWNLNL

SEQ ID NO: 544788 - protein, 9 aa, Homo Sapiens
RRPPPEHFM

SEQ ID NO: 544789 - protein, 9 aa, Homo Sapiens
EAVMVNQAL

SEQ ID NO: 544790 - protein, 9 aa, Homo Sapiens
CTPTRKCCC

SEQ ID NO: 544791 - protein, 9 aa, Homo Sapiens
NSGVIGAKK

SEQ ID NO: 544792 - protein, 9 aa, Homo Sapiens
NTKRRERKK

SEQ ID NO: 544793 - protein, 9 aa, Homo Sapiens
DHQAVRCAS

SEQ ID NO: 544794 - protein, 9 aa, Homo Sapiens
RGSGKNSQE

SEQ ID NO: 544795 - protein, 9 aa, Homo Sapiens
YQYLCKKPQ

SEQ ID NO: 544796 - protein, 9 aa, Homo Sapiens
LELPDSLDP

SEQ ID NO: 544797 - protein, 9 aa, Homo Sapiens
GSSGRPRRK

SEQ ID NO: 544798 - protein, 9 aa, Homo Sapiens
LHPQLWHWP

SEQ ID NO: 544799 - protein, 9 aa, Homo Sapiens
SAFSPGLSK

SEQ ID NO: 544800 - protein, 9 aa, Homo Sapiens
TEPSLNPME

SEQ ID NO: 544801 - protein, 9 aa, Homo Sapiens
FMRPPPEHF

SEQ ID NO: 544802 - protein, 9 aa, Homo Sapiens
ILEPLYTES

SEQ ID NO: 544803 - protein, 9 aa, Homo Sapiens
EAKGITEHF

SEQ ID NO: 544804 - protein, 9 aa, Homo Sapiens
VQMVPLDKE

SEQ ID NO: 544805 - protein, 9 aa, Homo Sapiens
ERSIHELHD

SEQ ID NO: 544806 - protein, 9 aa, Homo Sapiens
ELLPLDTLP

SEQ ID NO: 544807 - protein, 9 aa, Homo Sapiens
TSSALILSL

SEQ ID NO: 544808 - protein, 9 aa, Homo Sapiens
GILVEDATY

SEQ ID NO: 544809 - protein, 9 aa, Homo Sapiens
PGLQVLGVM

SEQ ID NO: 544810 - protein, 9 aa, Homo Sapiens
VPRICGVCA

SEQ ID NO: 544811 - protein, 9 aa, Homo Sapiens
YAMRMTNSG

SEQ ID NO: 544812 - protein, 9 aa, Homo Sapiens
LERGDMLNE

SEQ ID NO: 544813 - protein, 9 aa, Homo Sapiens
MTCWGSILH

SEQ ID NO: 544814 - protein, 9 aa, Homo Sapiens
ERKKGRRRR

SEQ ID NO: 544815 - protein, 9 aa, Homo Sapiens
LPGHGLHLC

SEQ ID NO: 544816 - protein, 9 aa, Homo Sapiens
CGVCADRAT

SEQ ID NO: 544817 - protein, 9 aa, Homo Sapiens
PSLLLRKLL

SEQ ID NO: 544818 - protein, 9 aa, Homo Sapiens
PGTLFQRWH

SEQ ID NO: 544819 - protein, 9 aa, Homo Sapiens
GLQVLGVMT

SEQ ID NO: 544820 - protein, 9 aa, Homo Sapiens
TRASPPTTF

SEQ ID NO: 544821 - protein, 9 aa, Homo Sapiens
DLVGAGVVL

SEQ ID NO: 544822 - protein, 9 aa, Homo Sapiens
RPRSKQEAW

SEQ ID NO: 544823 - protein, 9 aa, Homo Sapiens
RSKQEAWST

SEQ ID NO: 544824 - protein, 9 aa, Homo Sapiens
VKLDLQGLL

SEQ ID NO: 544825 - protein, 9 aa, Homo Sapiens
PQTEKKLKA

SEQ ID NO: 544826 - protein, 9 aa, Homo Sapiens
LGVMTVLEA

SEQ ID NO: 544827 - protein, 9 aa, Homo Sapiens
KKLKAYSQK

SEQ ID NO: 544828 - protein, 9 aa, Homo Sapiens
PLYTESESK

SEQ ID NO: 544829 - protein, 9 aa, Homo Sapiens
VMVNQALLV

SEQ ID NO: 544830 - protein, 9 aa, Homo Sapiens
LDKEENLDL

SEQ ID NO: 544831 - protein, 9 aa, Homo Sapiens
GTDFKGSSD

SEQ ID NO: 544832 - protein, 9 aa, Homo Sapiens
RDPSLLLRK

SEQ ID NO: 544833 - protein, 9 aa, Homo Sapiens
PEHFMRPPP

SEQ ID NO: 544834 - protein, 9 aa, Homo Sapiens
LLVLLELPD

SEQ ID NO: 544835 - protein, 9 aa, Homo Sapiens
KTNKSYAMR

SEQ ID NO: 544836 - protein, 9 aa, Homo Sapiens
VTPALVPTT

SEQ ID NO: 544837 - protein, 9 aa, Homo Sapiens
TPTRKCCCS

SEQ ID NO: 544838 - protein, 9 aa, Homo Sapiens
ESEFYQYLC

SEQ ID NO: 544839 - protein, 9 aa, Homo Sapiens
TLFQRWHVP

SEQ ID NO: 544840 - protein, 9 aa, Homo Sapiens
AVTRASPPT

SEQ ID NO: 544841 - protein, 9 aa, Homo Sapiens
VMTVLEAVM

SEQ ID NO: 544842 - protein, 9 aa, Homo Sapiens
GYETDHQAV

SEQ ID NO: 544843 - protein, 9 aa, Homo Sapiens
GVCADRATG

SEQ ID NO: 544844 - protein, 9 aa, Homo Sapiens
AVMVNQALL

SEQ ID NO: 544845 - protein, 9 aa, Homo Sapiens
QQDLKLDLA

SEQ ID NO: 544846 - protein, 9 aa, Homo Sapiens
ADRATGFHF

SEQ ID NO: 544847 - protein, 9 aa, Homo Sapiens
TYSDYLHWE

SEQ ID NO: 544848 - protein, 9 aa, Homo Sapiens
KLFCVTPAL

SEQ ID NO: 544849 - protein, 9 aa, Homo Sapiens
WSTAAYART

SEQ ID NO: 544850 - protein, 9 aa, Homo Sapiens
TNSGVIGAK

SEQ ID NO: 544851 - protein, 9 aa, Homo Sapiens
RRRRMITWS

SEQ ID NO: 544852 - protein, 9 aa, Homo Sapiens
QDRECYSQP

SEQ ID NO: 544853 - protein, 9 aa, Homo Sapiens
EFYQYLCKK

SEQ ID NO: 544854 - protein, 9 aa, Homo Sapiens
VLQLEKNFD

SEQ ID NO: 544855 - protein, 9 aa, Homo Sapiens
RVPRSAFSP

SEQ ID NO: 544856 - protein, 9 aa, Homo Sapiens
RECYSQPAW

SEQ ID NO: 544857 - protein, 9 aa, Homo Sapiens
VFKSRTPPD

SEQ ID NO: 544858 - protein, 9 aa, Homo Sapiens
HWPCRSDGD

SEQ ID NO: 544859 - protein, 9 aa, Homo Sapiens
CTSDHKIVF

SEQ ID NO: 544860 - protein, 9 aa, Homo Sapiens
RANGAALTV

SEQ ID NO: 544861 - protein, 9 aa, Homo Sapiens
VKTNKSYAM

SEQ ID NO: 544862 - protein, 9 aa, Homo Sapiens
LAYRRSVAT

SEQ ID NO: 544863 - protein, 9 aa, Homo Sapiens
EDFSGGTDF

SEQ ID NO: 544864 - protein, 9 aa, Homo Sapiens
LKAYSQKAV

SEQ ID NO: 544865 - protein, 9 aa, Homo Sapiens
RCASRVGKL

SEQ ID NO: 544866 - protein, 9 aa, Homo Sapiens
LMTCWGSIL

SEQ ID NO: 544867 - protein, 9 aa, Homo Sapiens
VLEAVMVNQ

SEQ ID NO: 544868 - protein, 9 aa, Homo Sapiens
VGASSGVIQ

SEQ ID NO: 544869 - protein, 9 aa, Homo Sapiens
GLLVQMVPL

SEQ ID NO: 544870 - protein, 9 aa, Homo Sapiens
LDTLPGHGL

SEQ ID NO: 544871 - protein, 9 aa, Homo Sapiens
SSATSNDFL

SEQ ID NO: 544872 - protein, 9 aa, Homo Sapiens
LDLRDTLVL

SEQ ID NO: 544873 - protein, 9 aa, Homo Sapiens
CGPVPAELL

SEQ ID NO: 544874 - protein, 9 aa, Homo Sapiens
GLMVVLVVK

SEQ ID NO: 544875 - protein, 9 aa, Homo Sapiens
VPAELLPLD

SEQ ID NO: 544876 - protein, 9 aa, Homo Sapiens
AVVPIIKNH

SEQ ID NO: 544877 - protein, 9 aa, Homo Sapiens
RNRLPGTLF

SEQ ID NO: 544878 - protein, 9 aa, Homo Sapiens
QRDPSLLLR

SEQ ID NO: 544879 - protein, 9 aa, Homo Sapiens
RASPPTTFI

SEQ ID NO: 544880 - protein, 9 aa, Homo Sapiens
MVVLVVKAK

SEQ ID NO: 544881 - protein, 9 aa, Homo Sapiens
DPYGTAVGD

SEQ ID NO: 544882 - protein, 9 aa, Homo Sapiens
QLEKNFDMM

SEQ ID NO: 544883 - protein, 9 aa, Homo Sapiens
SKQEAWSTH

SEQ ID NO: 544884 - protein, 9 aa, Homo Sapiens
VPLAFLELL

SEQ ID NO: 544885 - protein, 9 aa, Homo Sapiens
YTESESKIF

SEQ ID NO: 544886 - protein, 9 aa, Homo Sapiens
RVKTNKSYA

SEQ ID NO: 544887 - protein, 9 aa, Homo Sapiens
SLTGLQRAN

SEQ ID NO: 544888 - protein, 9 aa, Homo Sapiens
WVPLAFLEL

SEQ ID NO: 544889 - protein, 9 aa, Homo Sapiens
ALLGLMVVL

SEQ ID NO: 544890 - protein, 9 aa, Homo Sapiens
NHWFRPWNL

SEQ ID NO: 544891 - protein, 9 aa, Homo Sapiens
LRVNLLHGA

SEQ ID NO: 544892 - protein, 9 aa, Homo Sapiens
IPYQDRECY

SEQ ID NO: 544893 - protein, 9 aa, Homo Sapiens
EPSLNPMEI

SEQ ID NO: 544894 - protein, 9 aa, Homo Sapiens
IIPPVDHPS

SEQ ID NO: 544895 - protein, 9 aa, Homo Sapiens
VCADRATGF

SEQ ID NO: 544896 - protein, 9 aa, Homo Sapiens
KLDLQGLLV

SEQ ID NO: 544897 - protein, 9 aa, Homo Sapiens
RSDGDPGHR

SEQ ID NO: 544898 - protein, 9 aa, Homo Sapiens
MRMTNSGVI

SEQ ID NO: 544899 - protein, 9 aa, Homo Sapiens
TPPDAIALC

SEQ ID NO: 544900 - protein, 9 aa, Homo Sapiens
GRPRSKQEA

SEQ ID NO: 544901 - protein, 9 aa, Homo Sapiens
RQQDLKLDL

SEQ ID NO: 544902 - protein, 9 aa, Homo Sapiens
TAAYARTAG

SEQ ID NO: 544903 - protein, 9 aa, Homo Sapiens
AALTVRRRG

SEQ ID NO: 544904 - protein, 9 aa, Homo Sapiens
GKLRVNLLH

SEQ ID NO: 544905 - protein, 9 aa, Homo Sapiens
PYGTAVGDP

SEQ ID NO: 544906 - protein, 9 aa, Homo Sapiens
YVGASSGVI

SEQ ID NO: 544907 - protein, 9 aa, Homo Sapiens
AAGMKRARS

SEQ ID NO: 544908 - protein, 9 aa, Homo Sapiens
RVGKLFCVT

SEQ ID NO: 544909 - protein, 9 aa, Homo Sapiens
VPLDKEENL

SEQ ID NO: 544910 - protein, 9 aa, Homo Sapiens
LVLEAKGIT

SEQ ID NO: 544911 - protein, 9 aa, Homo Sapiens
PTTSSALIL

SEQ ID NO: 544912 - protein, 9 aa, Homo Sapiens
TSNDFLKIL

SEQ ID NO: 544913 - protein, 9 aa, Homo Sapiens
KQEAWSTHN

SEQ ID NO: 544914 - protein, 9 aa, Homo Sapiens
GLHLCLHPQ

SEQ ID NO: 544915 - protein, 9 aa, Homo Sapiens
GRPRRKKKN

SEQ ID NO: 544916 - protein, 9 aa, Homo Sapiens
QTEKKLKAY

SEQ ID NO: 544917 - protein, 9 aa, Homo Sapiens
LTVRRRGSS

SEQ ID NO: 544918 - protein, 9 aa, Homo Sapiens
KSRTPPDAI

SEQ ID NO: 544919 - protein, 9 aa, Homo Sapiens
RQRNRLPGT

SEQ ID NO: 544920 - protein, 9 aa, Homo Sapiens
PPDAIALCS

SEQ ID NO: 544921 - protein, 9 aa, Homo Sapiens
ILEPPTRVD

SEQ ID NO: 544922 - protein, 9 aa, Homo Sapiens
IAVVPIIKN

SEQ ID NO: 544923 - protein, 9 aa, Homo Sapiens
DGYETDHQA

SEQ ID NO: 544924 - protein, 9 aa, Homo Sapiens
KWVPLAFLE

SEQ ID NO: 544925 - protein, 9 aa, Homo Sapiens
RRRMITWST

SEQ ID NO: 544926 - protein, 9 aa, Homo Sapiens
RKLLLGTSG

SEQ ID NO: 544927 - protein, 9 aa, Homo Sapiens
SSGVIQLPL

SEQ ID NO: 544928 - protein, 9 aa, Homo Sapiens
TNKSYAMRM

SEQ ID NO: 544929 - protein, 9 aa, Homo Sapiens
ELPDSLDPL

SEQ ID NO: 544930 - protein, 9 aa, Homo Sapiens
SRTPPDAIA

SEQ ID NO: 544931 - protein, 9 aa, Homo Sapiens
AKGITEHFW

SEQ ID NO: 544932 - protein, 9 aa, Homo Sapiens
RRRRRMITW

SEQ ID NO: 544933 - protein, 9 aa, Homo Sapiens
PAELLPLDT

SEQ ID NO: 544934 - protein, 9 aa, Homo Sapiens
KRRERKKGR

SEQ ID NO: 544935 - protein, 9 aa, Homo Sapiens
PMEIREKLA

SEQ ID NO: 544936 - protein, 9 aa, Homo Sapiens
QHSLYVGAS

SEQ ID NO: 544937 - protein, 9 aa, Homo Sapiens
PRICGVCAD

SEQ ID NO: 544938 - protein, 9 aa, Homo Sapiens
RKKGRRRRR

SEQ ID NO: 544939 - protein, 9 aa, Homo Sapiens
YGTAVGDPS

SEQ ID NO: 544940 - protein, 9 aa, Homo Sapiens
LNPMEIREK

SEQ ID NO: 544941 - protein, 9 aa, Homo Sapiens
VRCASRVGK

SEQ ID NO: 544942 - protein, 9 aa, Homo Sapiens
KAYSQKAVE

SEQ ID NO: 544943 - protein, 9 aa, Homo Sapiens
LDPLVLRVK

SEQ ID NO: 544944 - protein, 9 aa, Homo Sapiens
SGKLRVNLL

SEQ ID NO: 544945 - protein, 9 aa, Homo Sapiens
KLDLAGRGE

SEQ ID NO: 544946 - protein, 9 aa, Homo Sapiens
NNSPVKTFA

SEQ ID NO: 544947 - protein, 9 aa, Homo Sapiens
SGTILEPLY

SEQ ID NO: 544948 - protein, 9 aa, Homo Sapiens
TSYQEEVIN

SEQ ID NO: 544949 - protein, 9 aa, Homo Sapiens
RPRRKKKNT

SEQ ID NO: 544950 - protein, 9 aa, Homo Sapiens
KLKAYSQKA

SEQ ID NO: 544951 - protein, 9 aa, Homo Sapiens
LDLQGLLVQ

SEQ ID NO: 544952 - protein, 9 aa, Homo Sapiens
TRKCCCSPG

SEQ ID NO: 544953 - protein, 9 aa, Homo Sapiens
PLVLRVKLD

SEQ ID NO: 544954 - protein, 9 aa, Homo Sapiens
VKAKWVPLA

SEQ ID NO: 544955 - protein, 9 aa, Homo Sapiens
PPPGTPDPY

SEQ ID NO: 544956 - protein, 9 aa, Homo Sapiens
LLVQMVPLD

SEQ ID NO: 544957 - protein, 9 aa, Homo Sapiens
SVSKSASKW

SEQ ID NO: 544958 - protein, 9 aa, Homo Sapiens
LLGLMVVLV

SEQ ID NO: 544959 - protein, 9 aa, Homo Sapiens
ASRVGKLFC

SEQ ID NO: 544960 - protein, 9 aa, Homo Sapiens
RKKKNTKRR

SEQ ID NO: 544961 - protein, 9 aa, Homo Sapiens
HSLYVGASS

SEQ ID NO: 544962 - protein, 9 aa, Homo Sapiens
PDPYGTAVG

SEQ ID NO: 544963 - protein, 9 aa, Homo Sapiens
QRNRLPGTL

SEQ ID NO: 544964 - protein, 9 aa, Homo Sapiens
ECYSQPAWH

SEQ ID NO: 544965 - protein, 9 aa, Homo Sapiens
AYARTAGSS

SEQ ID NO: 544966 - protein, 9 aa, Homo Sapiens
HELHDIFTF

SEQ ID NO: 544967 - protein, 9 aa, Homo Sapiens
RVKLDLQGL

SEQ ID NO: 544968 - protein, 9 aa, Homo Sapiens
RICGVCADR

SEQ ID NO: 544969 - protein, 9 aa, Homo Sapiens
TLPGHGLHL

SEQ ID NO: 544970 - protein, 9 aa, Homo Sapiens
VYECTSDHK

SEQ ID NO: 544971 - protein, 9 aa, Homo Sapiens
AELLPLDTL

SEQ ID NO: 544972 - protein, 9 aa, Homo Sapiens
VVKAKWVPL

SEQ ID NO: 544973 - protein, 9 aa, Homo Sapiens
FCVTPALVP

SEQ ID NO: 544974 - protein, 9 aa, Homo Sapiens
NKSYAMRMT

SEQ ID NO: 544975 - protein, 9 aa, Homo Sapiens
PTRKCCCSP

SEQ ID NO: 544976 - protein, 9 aa, Homo Sapiens
PDSLDPLVL

SEQ ID NO: 544977 - protein, 9 aa, Homo Sapiens
YLCKKPQIT

SEQ ID NO: 544978 - protein, 9 aa, Homo Sapiens
GAAGMKRAR

SEQ ID NO: 544979 - protein, 9 aa, Homo Sapiens
ICGVCADRA

SEQ ID NO: 544980 - protein, 9 aa, Homo Sapiens
QRANGAALT

SEQ ID NO: 544981 - protein, 9 aa, Homo Sapiens
MEIREKLAE

SEQ ID NO: 544982 - protein, 9 aa, Homo Sapiens
PRSAFSPGL

SEQ ID NO: 544983 - protein, 9 aa, Homo Sapiens
KTSGKLRVN

SEQ ID NO: 544984 - protein, 9 aa, Homo Sapiens
AKNKRGSGK

SEQ ID NO: 544985 - protein, 9 aa, Homo Sapiens
NGAALTVRR

SEQ ID NO: 544986 - protein, 9 aa, Homo Sapiens
HWESFLQQQ

SEQ ID NO: 544987 - protein, 9 aa, Homo Sapiens
VLLALLGLM

SEQ ID NO: 544988 - protein, 9 aa, Homo Sapiens
TGLQRANGA

SEQ ID NO: 544989 - protein, 9 aa, Homo Sapiens
LQVLGVMTV

SEQ ID NO: 544990 - protein, 9 aa, Homo Sapiens
ATSNDFLKI

SEQ ID NO: 544991 - protein, 9 aa, Homo Sapiens
RSAFSPGLS

SEQ ID NO: 544992 - protein, 9 aa, Homo Sapiens
RRKKKNTKR

SEQ ID NO: 544993 - protein, 9 aa, Homo Sapiens
LFCVTPALV

SEQ ID NO: 544994 - protein, 9 aa, Homo Sapiens
AAYARTAGS

SEQ ID NO: 544995 - protein, 9 aa, Homo Sapiens
PLDKEENLD

SEQ ID NO: 544996 - protein, 9 aa, Homo Sapiens
RGSSGRPRR

SEQ ID NO: 544997 - protein, 9 aa, Homo Sapiens
PREAKNKRG

SEQ ID NO: 544998 - protein, 9 aa, Homo Sapiens
YQEEVINNS

SEQ ID NO: 544999 - protein, 9 aa, Homo Sapiens
DFLKILPDV

SEQ ID NO: 545000 - protein, 9 aa, Homo Sapiens
PALVPTTSS

SEQ ID NO: 545001 - protein, 9 aa, Homo Sapiens
FLKILPDVN

SEQ ID NO: 545002 - protein, 9 aa, Homo Sapiens
RKCCCSPGW

SEQ ID NO: 545003 - protein, 9 aa, Homo Sapiens
DAIALCSSL

SEQ ID NO: 545004 - protein, 9 aa, Homo Sapiens
MTEPSLNPM

SEQ ID NO: 545005 - protein, 9 aa, Homo Sapiens
VRRRGSSGR

SEQ ID NO: 545006 - protein, 9 aa, Homo Sapiens
QTYSDYLHW

SEQ ID NO: 545007 - protein, 9 aa, Homo Sapiens
ASPPTTFIV

SEQ ID NO: 545008 - protein, 9 aa, Homo Sapiens
HFMRPPPEH

SEQ ID NO: 545009 - protein, 9 aa, Homo Sapiens
SLLLRKLLL

SEQ ID NO: 545010 - protein, 9 aa, Homo Sapiens
PLDTLPGHG

SEQ ID NO: 545011 - protein, 9 aa, Homo Sapiens
KLRVNLLHG

SEQ ID NO: 545012 - protein, 9 aa, Homo Sapiens
ECTSDHKIV

SEQ ID NO: 545013 - protein, 9 aa, Homo Sapiens
RRGSSGRPR

SEQ ID NO: 545014 - protein, 9 aa, Homo Sapiens
QGLLVQMVP

SEQ ID NO: 545015 - protein, 9 aa, Homo Sapiens
AYSQKAVEI

SEQ ID NO: 545016 - protein, 9 aa, Homo Sapiens
VPTTSSALI

SEQ ID NO: 545017 - protein, 9 aa, Homo Sapiens
KNKRGSGKN

SEQ ID NO: 545018 - protein, 9 aa, Homo Sapiens
KNHWFRPWN

SEQ ID NO: 545019 - protein, 9 aa, Homo Sapiens
PYQDRECYS

SEQ ID NO: 545020 - protein, 9 aa, Homo Sapiens
TLVLKVLLA

SEQ ID NO: 545021 - protein, 9 aa, Homo Sapiens
SSGRPRRKK

SEQ ID NO: 545022 - protein, 9 aa, Homo Sapiens
PGRPRSKQE

SEQ ID NO: 545023 - protein, 9 aa, Homo Sapiens
GYCTPTRKC

SEQ ID NO: 545024 - protein, 9 aa, Homo Sapiens
EEVINNSPV

SEQ ID NO: 545025 - protein, 9 aa, Homo Sapiens
FLESEFYQY

SEQ ID NO: 545026 - protein, 9 aa, Homo Sapiens
VPIIKNHWF

SEQ ID NO: 545027 - protein, 9 aa, Homo Sapiens
PGLSKPFPP

SEQ ID NO: 545028 - protein, 9 aa, Homo Sapiens
VLRVKLDLQ

SEQ ID NO: 545029 - protein, 9 aa, Homo Sapiens
VEDATYVTC

SEQ ID NO: 545030 - protein, 9 aa, Homo Sapiens
TKRRERKKG

SEQ ID NO: 545031 - protein, 9 aa, Homo Sapiens
DFSGGTDFK

SEQ ID NO: 545032 - protein, 9 aa, Homo Sapiens
PWNLNLGII

SEQ ID NO: 545033 - protein, 9 aa, Homo Sapiens
KVLLALLGL

SEQ ID NO: 545034 - protein, 9 aa, Homo Sapiens
FSGGTDFKG

SEQ ID NO: 545035 - protein, 9 aa, Homo Sapiens
NQALLVLLE

SEQ ID NO: 545036 - protein, 9 aa, Homo Sapiens
LEAVMVNQA

SEQ ID NO: 545037 - protein, 9 aa, Homo Sapiens
KKNTKRRER

SEQ ID NO: 545038 - protein, 9 aa, Homo Sapiens
IVLQLEKNF

SEQ ID NO: 545039 - protein, 9 aa, Homo Sapiens
HLCLHPQLW

SEQ ID NO: 545040 - protein, 9 aa, Homo Sapiens
HWFRPWNLN

SEQ ID NO: 545041 - protein, 9 aa, Homo Sapiens
ITEHFWKPY

SEQ ID NO: 545042 - protein, 9 aa, Homo Sapiens
KSASKWILR

SEQ ID NO: 545043 - protein, 9 aa, Homo Sapiens
LEPPTRVDF

SEQ ID NO: 545044 - protein, 9 aa, Homo Sapiens
KSYAMRMTN

SEQ ID NO: 545045 - protein, 9 aa, Homo Sapiens
SYAMRMTNS

SEQ ID NO: 545046 - protein, 9 aa, Homo Sapiens
RGRPGLPGL

SEQ ID NO: 545047 - protein, 9 aa, Homo Sapiens
ALLVLLELP

SEQ ID NO: 545048 - protein, 9 aa, Homo Sapiens
PLAFLELLD

SEQ ID NO: 545049 - protein, 9 aa, Homo Sapiens
AFSPGLSKP

SEQ ID NO: 545050 - protein, 9 aa, Homo Sapiens
DSVDAVYEC

SEQ ID NO: 545051 - protein, 9 aa, Homo Sapiens
SPGLSKPFP

SEQ ID NO: 545052 - protein, 9 aa, Homo Sapiens
DPLVLRVKL

SEQ ID NO: 545053 - protein, 9 aa, Homo Sapiens
HQAVRCASR

SEQ ID NO: 545054 - protein, 9 aa, Homo Sapiens
DPSLLLRKL

SEQ ID NO: 545055 - protein, 9 aa, Homo Sapiens
TDFKGSSDD

SEQ ID NO: 545056 - protein, 9 aa, Homo Sapiens
RARSLNTLN

SEQ ID NO: 545057 - protein, 9 aa, Homo Sapiens
MITWSTAAY

SEQ ID NO: 545058 - protein, 9 aa, Homo Sapiens
RPWNLNLGI

SEQ ID NO: 545059 - protein, 9 aa, Homo Sapiens
YDLVGAGVV

SEQ ID NO: 545060 - protein, 9 aa, Homo Sapiens
RRSVATSSI

SEQ ID NO: 545061 - protein, 9 aa, Homo Sapiens
ILVEDATYV

SEQ ID NO: 545062 - protein, 9 aa, Homo Sapiens
ITWSTAAYA

SEQ ID NO: 545063 - protein, 9 aa, Homo Sapiens
CLHPQLWHW

SEQ ID NO: 545064 - protein, 9 aa, Homo Sapiens
HCGPVPAEL

SEQ ID NO: 545065 - protein, 9 aa, Homo Sapiens
GASSGVIQL

SEQ ID NO: 545066 - protein, 9 aa, Homo Sapiens
HGLHLCLHP

SEQ ID NO: 545067 - protein, 9 aa, Homo Sapiens
LVYDLVGAG

SEQ ID NO: 545068 - protein, 9 aa, Homo Sapiens
SLNPMEIRE

SEQ ID NO: 545069 - protein, 9 aa, Homo Sapiens
LYVGASSGV

SEQ ID NO: 545070 - protein, 9 aa, Homo Sapiens
PGTPDPYGT

SEQ ID NO: 545071 - protein, 9 aa, Homo Sapiens
CASRVGKLF

SEQ ID NO: 545072 - protein, 9 aa, Homo Sapiens
MVNQALLVL

SEQ ID NO: 545073 - protein, 9 aa, Homo Sapiens
LCLHPQLWH

SEQ ID NO: 545074 - protein, 9 aa, Homo Sapiens
TEKKLKAYS

SEQ ID NO: 545075 - protein, 9 aa, Homo Sapiens
PRSKQEAWS

SEQ ID NO: 545076 - protein, 9 aa, Homo Sapiens
TVRRRGSSG

SEQ ID NO: 545077 - protein, 9 aa, Homo Sapiens
PLERGDMLN

SEQ ID NO: 545078 - protein, 9 aa, Homo Sapiens
LLLRKLLLG

SEQ ID NO: 545079 - protein, 9 aa, Homo Sapiens
IIKNHWFRP

SEQ ID NO: 545080 - protein, 9 aa, Homo Sapiens
YVTCMSDSS

SEQ ID NO: 545081 - protein, 9 aa, Homo Sapiens
GAALTVRRR

SEQ ID NO: 545082 - protein, 9 aa, Homo Sapiens
QAVRCASRV

SEQ ID NO: 545083 - protein, 9 aa, Homo Sapiens
AMRMTNSGV

SEQ ID NO: 545084 - protein, 9 aa, Homo Sapiens
KGRRRRRMI

SEQ ID NO: 545085 - protein, 9 aa, Homo Sapiens
SKSASKWIL

SEQ ID NO: 545086 - protein, 9 aa, Homo Sapiens
SSCAVTRAS

SEQ ID NO: 545087 - protein, 9 aa, Homo Sapiens
RRRGSSGRP

SEQ ID NO: 545088 - protein, 9 aa, Homo Sapiens
FQTYSDYLH

SEQ ID NO: 545089 - protein, 9 aa, Homo Sapiens
RTAGSSCAV

SEQ ID NO: 545090 - protein, 9 aa, Homo Sapiens
LVQMVPLDK

SEQ ID NO: 545091 - protein, 9 aa, Homo Sapiens
DLKLDLAGR

SEQ ID NO: 545092 - protein, 9 aa, Homo Sapiens
VDAVYECTS

SEQ ID NO: 545093 - protein, 9 aa, Homo Sapiens
GTPDPYGTA

SEQ ID NO: 545094 - protein, 9 aa, Homo Sapiens
GVELLGPLE

SEQ ID NO: 545095 - protein, 9 aa, Homo Sapiens
QVLGVMTVL

SEQ ID NO: 545096 - protein, 9 aa, Homo Sapiens
TWSTAAYAR

SEQ ID NO: 545097 - protein, 9 aa, Homo Sapiens
SIHELHDIF

SEQ ID NO: 545098 - protein, 9 aa, Homo Sapiens
KNTKRRERK

SEQ ID NO: 545099 - protein, 9 aa, Homo Sapiens
EENLDLRDT

SEQ ID NO: 545100 - protein, 9 aa, Homo Sapiens
ARTAGSSCA

SEQ ID NO: 545101 - protein, 9 aa, Homo Sapiens
WSSATSNDF

SEQ ID NO: 545102 - protein, 9 aa, Homo Sapiens
DYLHWESFL

SEQ ID NO: 545103 - protein, 9 aa, Homo Sapiens
CAVTRASPP

SEQ ID NO: 545104 - protein, 9 aa, Homo Sapiens
QKSLVYDLV

SEQ ID NO: 545105 - protein, 9 aa, Homo Sapiens
AGMKRARSL

SEQ ID NO: 545106 - protein, 9 aa, Homo Sapiens
YRRSVATSS

SEQ ID NO: 545107 - protein, 9 aa, Homo Sapiens
QLWHWPCRS

SEQ ID NO: 545108 - protein, 9 aa, Homo Sapiens
VPRSAFSPG

SEQ ID NO: 545109 - protein, 9 aa, Homo Sapiens
SATSNDFLK

SEQ ID NO: 545110 - protein, 9 aa, Homo Sapiens
LGLMVVLVV

SEQ ID NO: 545111 - protein, 9 aa, Homo Sapiens
GVMTVLEAV

SEQ ID NO: 545112 - protein, 9 aa, Homo Sapiens
GHGLHLCLH

SEQ ID NO: 545113 - protein, 9 aa, Homo Sapiens
VGKLFCVTP

SEQ ID NO: 545114 - protein, 9 aa, Homo Sapiens
YARTAGSSC

SEQ ID NO: 545115 - protein, 9 aa, Homo Sapiens
INNSPVKTF

SEQ ID NO: 545116 - protein, 9 aa, Homo Sapiens
WFEKRLAYR

SEQ ID NO: 545117 - protein, 9 aa, Homo Sapiens
TDHQAVRCA

SEQ ID NO: 545118 - protein, 9 aa, Homo Sapiens
IPPVDHPSG

SEQ ID NO: 545119 - protein, 9 aa, Homo Sapiens
EAKNKRGSG

SEQ ID NO: 545120 - protein, 9 aa, Homo Sapiens
VLEAKGITE

SEQ ID NO: 545121 - protein, 9 aa, Homo Sapiens
GMKRARSLN

SEQ ID NO: 545122 - protein, 9 aa, Homo Sapiens
FEKRLAYRR

SEQ ID NO: 545123 - protein, 9 aa, Homo Sapiens
GTILEPLYT

SEQ ID NO: 545124 - protein, 9 aa, Homo Sapiens
LVLRVKLDL

SEQ ID NO: 545125 - protein, 9 aa, Homo Sapiens
LRKLLLGTS

SEQ ID NO: 545126 - protein, 9 aa, Homo Sapiens
NRLPGTLFQ

SEQ ID NO: 545127 - protein, 9 aa, Homo Sapiens
VINNSPVKT

SEQ ID NO: 545128 - protein, 9 aa, Homo Sapiens
RIPYQDREC

SEQ ID NO: 545129 - protein, 9 aa, Homo Sapiens
LILSLTGLQ

SEQ ID NO: 545130 - protein, 9 aa, Homo Sapiens
CYSQPAWHH

SEQ ID NO: 545131 - protein, 9 aa, Homo Sapiens
IQQLERSIH

SEQ ID NO: 545132 - protein, 9 aa, Homo Sapiens
LERSIHELH

SEQ ID NO: 545133 - protein, 9 aa, Homo Sapiens
SCAVTRASP

SEQ ID NO: 545134 - protein, 9 aa, Homo Sapiens
QMVPLDKEE

SEQ ID NO: 545135 - protein, 9 aa, Homo Sapiens
CVTPALVPT

SEQ ID NO: 545136 - protein, 9 aa, Homo Sapiens
YQDRECYSQ

SEQ ID NO: 545137 - protein, 9 aa, Homo Sapiens
AYRRSVATS

SEQ ID NO: 545138 - protein, 9 aa, Homo Sapiens
STPGIIPPV

SEQ ID NO: 545139 - protein, 9 aa, Homo Sapiens
QEAWSTHNT

SEQ ID NO: 545140 - protein, 9 aa, Homo Sapiens
YLHWESFLQ

SEQ ID NO: 545141 - protein, 9 aa, Homo Sapiens
LEAKGITEH

SEQ ID NO: 545142 - protein, 9 aa, Homo Sapiens
FRPWNLNLG

SEQ ID NO: 545143 - protein, 9 aa, Homo Sapiens
KSLVYDLVG

SEQ ID NO: 545144 - protein, 9 aa, Homo Sapiens
TEHFWKPYI

SEQ ID NO: 545145 - protein, 9 aa, Homo Sapiens
RLPGTLFQR

SEQ ID NO: 545146 - protein, 9 aa, Homo Sapiens
GPLERGDML

SEQ ID NO: 545147 - protein, 9 aa, Homo Sapiens
LVVKAKWVP

SEQ ID NO: 545148 - protein, 9 aa, Homo Sapiens
WPCRSDGDP

SEQ ID NO: 545149 - protein, 9 aa, Homo Sapiens
KRLAYRRSV

SEQ ID NO: 545150 - protein, 9 aa, Homo Sapiens
EHFMRPPPE

SEQ ID NO: 545151 - protein, 9 aa, Homo Sapiens
AVYECTSDH

SEQ ID NO: 545152 - protein, 9 aa, Homo Sapiens
VLGVMTVLE

SEQ ID NO: 545153 - protein, 9 aa, Homo Sapiens
EAWSTHNTV

SEQ ID NO: 545154 - protein, 9 aa, Homo Sapiens
FKSRTPPDA

SEQ ID NO: 545155 - protein, 9 aa, Homo Sapiens
FSPGLSKPF

SEQ ID NO: 545156 - protein, 9 aa, Homo Sapiens
DLAGRGEGQ

SEQ ID NO: 545157 - protein, 9 aa, Homo Sapiens
PVPAELLPL

SEQ ID NO: 545158 - protein, 9 aa, Homo Sapiens
LVLLELPDS

SEQ ID NO: 545159 - protein, 9 aa, Homo Sapiens
PPEHFMRPP

SEQ ID NO: 545160 - protein, 9 aa, Homo Sapiens
RSIHELHDI

SEQ ID NO: 545161 - protein, 9 aa, Homo Sapiens
RLAYRRSVA

SEQ ID NO: 545162 - protein, 9 aa, Homo Sapiens
EDATYVTCM

SEQ ID NO: 545163 - protein, 9 aa, Homo Sapiens
VYDLVGAGV

SEQ ID NO: 545164 - protein, 9 aa, Homo Sapiens
LVEDATYVT

SEQ ID NO: 545165 - protein, 9 aa, Homo Sapiens
LEPLYTESE

SEQ ID NO: 545166 - protein, 9 aa, Homo Sapiens
AGSSCAVTR

SEQ ID NO: 545167 - protein, 9 aa, Homo Sapiens
GSGKNSQED

SEQ ID NO: 545168 - protein, 9 aa, Homo Sapiens
RVNLLHGAL

SEQ ID NO: 545169 - protein, 9 aa, Homo Sapiens
GIIPPVDHP

SEQ ID NO: 545170 - protein, 9 aa, Homo Sapiens
PVDHPSGYG

SEQ ID NO: 545171 - protein, 9 aa, Homo Sapiens
RRERKKGRR

SEQ ID NO: 545172 - protein, 9 aa, Homo Sapiens
KAKWVPLAF

SEQ ID NO: 545173 - protein, 9 aa, Homo Sapiens
DTLPGHGLH

SEQ ID NO: 545174 - protein, 9 aa, Homo Sapiens
VNLLHGALE

SEQ ID NO: 545175 - protein, 9 aa, Homo Sapiens
RMTNSGVIG

SEQ ID NO: 545176 - protein, 9 aa, Homo Sapiens
LLALLGLMV

SEQ ID NO: 545177 - protein, 9 aa, Homo Sapiens
SILHCGPVP

SEQ ID NO: 545178 - protein, 9 aa, Homo Sapiens
LAGRGEGQL

SEQ ID NO: 545179 - protein, 9 aa, Homo Sapiens
LHLCLHPQL

SEQ ID NO: 545180 - protein, 9 aa, Homo Sapiens
KKGRRRRRM

SEQ ID NO: 545181 - protein, 9 aa, Homo Sapiens
LALLGLMVV

SEQ ID NO: 545182 - protein, 9 aa, Homo Sapiens
GSSCAVTRA

SEQ ID NO: 545183 - protein, 9 aa, Homo Sapiens
HEDFSGGTD

SEQ ID NO: 545184 - protein, 9 aa, Homo Sapiens
GTQKSLVYD

SEQ ID NO: 545185 - protein, 9 aa, Homo Sapiens
SVDAVYECT

SEQ ID NO: 545186 - protein, 9 aa, Homo Sapiens
YSMTRGKMG

SEQ ID NO: 545187 - protein, 9 aa, Homo Sapiens
LKLDLAGRG

SEQ ID NO: 545188 - protein, 9 aa, Homo Sapiens
EKRLAYRRS

SEQ ID NO: 545189 - protein, 9 aa, Homo Sapiens
GSILHCGPV

SEQ ID NO: 545190 - protein, 9 aa, Homo Sapiens
MTNSGVIGA

SEQ ID NO: 545191 - protein, 9 aa, Homo Sapiens
SLYVGASSG

SEQ ID NO: 545192 - protein, 9 aa, Homo Sapiens
LHWESFLQQ

SEQ ID NO: 545193 - protein, 9 aa, Homo Sapiens
VVPIIKNHW

SEQ ID NO: 545194 - protein, 9 aa, Homo Sapiens
GGTDFKGSS

SEQ ID NO: 545195 - protein, 9 aa, Homo Sapiens
SSALILSLT

SEQ ID NO: 545196 - protein, 9 aa, Homo Sapiens
LVLKVLLAL

SEQ ID NO: 545197 - protein, 9 aa, Homo Sapiens
PGIIPPVDH

SEQ ID NO: 545198 - protein, 9 aa, Homo Sapiens
DLQGLLVQM

SEQ ID NO: 545199 - protein, 9 aa, Homo Sapiens
ELLGPLERG

SEQ ID NO: 545200 - protein, 9 aa, Homo Sapiens
VELLGPLER

SEQ ID NO: 545201 - protein, 9 aa, Homo Sapiens
LTGLQRANG

SEQ ID NO: 545202 - protein, 9 aa, Homo Sapiens
SMTRGKMGF

SEQ ID NO: 545203 - protein, 9 aa, Homo Sapiens
MRPPPEHFR

SEQ ID NO: 545204 - protein, 9 aa, Homo Sapiens
ILSLTGLQR

SEQ ID NO: 545205 - protein, 9 aa, Homo Sapiens
FDILEPPTR

SEQ ID NO: 545206 - protein, 9 aa, Homo Sapiens
PIIKNHWFR

SEQ ID NO: 545207 - protein, 9 aa, Homo Sapiens
WGSILHCGP

SEQ ID NO: 545208 - protein, 9 aa, Homo Sapiens
LQGLLVQMV

SEQ ID NO: 545209 - protein, 9 aa, Homo Sapiens
QEEVINNSP

SEQ ID NO: 545210 - protein, 9 aa, Homo Sapiens
RMITWSTAA

SEQ ID NO: 545211 - protein, 9 aa, Homo Sapiens
LLPLDTLPG

SEQ ID NO: 545212 - protein, 9 aa, Homo Sapiens
SGGTDFKGS

SEQ ID NO: 545213 - protein, 9 aa, Homo Sapiens
WHWPCRSDG

SEQ ID NO: 545214 - protein, 9 aa, Homo Sapiens
NPMEIREKL

SEQ ID NO: 545215 - protein, 9 aa, Homo Sapiens
RRMITWSTA

SEQ ID NO: 545216 - protein, 9 aa, Homo Sapiens
GTLFQRWHV

SEQ ID NO: 545217 - protein, 9 aa, Homo Sapiens
LHCGPVPAE

SEQ ID NO: 545218 - protein, 9 aa, Homo Sapiens
LDLAGRGEG

SEQ ID NO: 545219 - protein, 9 aa, Homo Sapiens
SRVGKLFCV

SEQ ID NO: 545220 - protein, 9 aa, Homo Sapiens
ALTVRRRGS

SEQ ID NO: 545221 - protein, 9 aa, Homo Sapiens
QQLERSIHE

SEQ ID NO: 545222 - protein, 9 aa, Homo Sapiens
PPVDHPSGY

SEQ ID NO: 545223 - protein, 9 aa, Homo Sapiens
SYQEEVINN

SEQ ID NO: 545224 - protein, 9 aa, Homo Sapiens
TAGSSCAVT

SEQ ID NO: 545225 - protein, 9 aa, Homo Sapiens
KKKNTKRRE

SEQ ID NO: 545226 - protein, 9 aa, Homo Sapiens
KGITEHFWK

SEQ ID NO: 545227 - protein, 9 aa, Homo Sapiens
RPGLPGLQV

SEQ ID NO: 545228 - protein, 9 aa, Homo Sapiens
YECTSDHKI

SEQ ID NO: 545229 - protein, 9 aa, Homo Sapiens
LLGPLERGD

SEQ ID NO: 545230 - protein, 9 aa, Homo Sapiens
DGDPGHRAV

SEQ ID NO: 545231 - protein, 9 aa, Homo Sapiens
EVINNSPVK

SEQ ID NO: 545232 - protein, 9 aa, Homo Sapiens
QALLVLLEL

SEQ ID NO: 545233 - protein, 9 aa, Homo Sapiens
VTRASPPTT

SEQ ID NO: 545234 - protein, 9 aa, Homo Sapiens
RTPPDAIAL

SEQ ID NO: 545235 - protein, 9 aa, Homo Sapiens
CWGSILHCG

SEQ ID NO: 545236 - protein, 9 aa, Homo Sapiens
SNDFLKILP

SEQ ID NO: 545237 - protein, 9 aa, Homo Sapiens
MVPLDKEEN

SEQ ID NO: 545238 - protein, 9 aa, Homo Sapiens
ERGDMLNEA

SEQ ID NO: 545239 - protein, 9 aa, Homo Sapiens
NDFLKILPD

SEQ ID NO: 545240 - protein, 9 aa, Homo Sapiens
NGYCTPTRK

SEQ ID NO: 545241 - protein, 9 aa, Homo Sapiens
LRDTLVLKV

SEQ ID NO: 545242 - protein, 9 aa, Homo Sapiens
VDHPSGYGA

SEQ ID NO: 545243 - protein, 9 aa, Homo Sapiens
DKEENLDLR

SEQ ID NO: 545244 - protein, 9 aa, Homo Sapiens
LWHWPCRSD

SEQ ID NO: 545245 - protein, 9 aa, Homo Sapiens
DATYVTCMS

SEQ ID NO: 545246 - protein, 9 aa, Homo Sapiens
VSKSASKWI

SEQ ID NO: 545247 - protein, 9 aa, Homo Sapiens
ARSLNTLNV

SEQ ID NO: 545248 - protein, 9 aa, Homo Sapiens
LPDSLDPLV

SEQ ID NO: 545249 - protein, 9 aa, Homo Sapiens
PRRKKKNTK

SEQ ID NO: 545250 - protein, 9 aa, Homo Sapiens
DRECYSQPA

SEQ ID NO: 545251 - protein, 9 aa, Homo Sapiens
VLKVLLALL

SEQ ID NO: 545252 - protein, 9 aa, Homo Sapiens
NKRGSGKNS

SEQ ID NO: 545253 - protein, 9 aa, Homo Sapiens
QYLCKKPQI

SEQ ID NO: 545254 - protein, 9 aa, Homo Sapiens
VLVVKAKWV

SEQ ID NO: 545255 - protein, 9 aa, Homo Sapiens
HPQLWHWPC

SEQ ID NO: 545256 - protein, 9 aa, Homo Sapiens
IRVKTNKSY

SEQ ID NO: 545257 - protein, 9 aa, Homo Sapiens
DAVYECTSD

SEQ ID NO: 545258 - protein, 9 aa, Homo Sapiens
PDAIALCSS

SEQ ID NO: 545259 - protein, 9 aa, Homo Sapiens
DSLDPLVLR

SEQ ID NO: 545260 - protein, 9 aa, Homo Sapiens
CRSDGDPGH

SEQ ID NO: 545261 - protein, 9 aa, Homo Sapiens
STAAYARTA

SEQ ID NO: 545262 - protein, 9 aa, Homo Sapiens
TVLEAVMVN

SEQ ID NO: 545263 - protein, 9 aa, Homo Sapiens
ENLDLRDTL

SEQ ID NO: 545264 - protein, 9 aa, Homo Sapiens
LMVVLVVKA

SEQ ID NO: 545265 - protein, 9 aa, Homo Sapiens
RNGYCTPTR

SEQ ID NO: 545266 - protein, 9 aa, Homo Sapiens
TYVTCMSDS

SEQ ID NO: 545267 - protein, 9 aa, Homo Sapiens
LPGTLFQRW

SEQ ID NO: 545268 - protein, 9 aa, Homo Sapiens
KHEDFSGGT

SEQ ID NO: 545269 - protein, 9 aa, Homo Sapiens
SLDPLVLRV

SEQ ID NO: 545270 - protein, 9 aa, Homo Sapiens
TILEPLYTE

SEQ ID NO: 545271 - protein, 9 aa, Homo Sapiens
EPLYTESES

SEQ ID NO: 545272 - protein, 9 aa, Homo Sapiens
ILHCGPVPA

SEQ ID NO: 545273 - protein, 9 aa, Homo Sapiens
AVRCASRVG

SEQ ID NO: 545274 - protein, 9 aa, Homo Sapiens
LRHSHHLEM

SEQ ID NO: 545275 - protein, 9 aa, Homo Sapiens
IIETGKTNY

SEQ ID NO: 545276 - protein, 9 aa, Homo Sapiens
LEALLSFMN

SEQ ID NO: 545277 - protein, 9 aa, Homo Sapiens
GILTLDILD

SEQ ID NO: 545278 - protein, 9 aa, Homo Sapiens
MQGPPAATE

SEQ ID NO: 545279 - protein, 9 aa, Homo Sapiens
KGLLLLMGI

SEQ ID NO: 545280 - protein, 9 aa, Homo Sapiens
APQETVPQD

SEQ ID NO: 545281 - protein, 9 aa, Homo Sapiens
KCLNKILKN

SEQ ID NO: 545282 - protein, 9 aa, Homo Sapiens
TARALLDRH

SEQ ID NO: 545283 - protein, 9 aa, Homo Sapiens
NPHKARFLK

SEQ ID NO: 545284 - protein, 9 aa, Homo Sapiens
LKNPKKKIL

SEQ ID NO: 545285 - protein, 9 aa, Homo Sapiens
MFAMKNSLE

SEQ ID NO: 545286 - protein, 9 aa, Homo Sapiens
PNELEPTQD

SEQ ID NO: 545287 - protein, 9 aa, Homo Sapiens
MTPAPQETV

SEQ ID NO: 545288 - protein, 9 aa, Homo Sapiens
SVLFLFCYI

SEQ ID NO: 545289 - protein, 9 aa, Homo Sapiens
VAIPNPFIQ

SEQ ID NO: 545290 - protein, 9 aa, Homo Sapiens
REEMTPAPQ

SEQ ID NO: 545291 - protein, 9 aa, Homo Sapiens
LLDRHALKQ

SEQ ID NO: 545292 - protein, 9 aa, Homo Sapiens
SGHQHPQRT

SEQ ID NO: 545293 - protein, 9 aa, Homo Sapiens
NSLETDLLF

SEQ ID NO: 545294 - protein, 9 aa, Homo Sapiens
LKGVREEMT

SEQ ID NO: 545295 - protein, 9 aa, Homo Sapiens
LPGPLPASH

SEQ ID NO: 545296 - protein, 9 aa, Homo Sapiens
GPPNELEPT

SEQ ID NO: 545297 - protein, 9 aa, Homo Sapiens
SKTTITNVK

SEQ ID NO: 545298 - protein, 9 aa, Homo Sapiens
GGPKLTKSG

SEQ ID NO: 545299 - protein, 9 aa, Homo Sapiens
RLTESLCLE

SEQ ID NO: 545300 - protein, 9 aa, Homo Sapiens
DVPSIPSFG

SEQ ID NO: 545301 - protein, 9 aa, Homo Sapiens
PKKKILLKQ

SEQ ID NO: 545302 - protein, 9 aa, Homo Sapiens
SQFSSRSRS

SEQ ID NO: 545303 - protein, 9 aa, Homo Sapiens
EAVGILALV

SEQ ID NO: 545304 - protein, 9 aa, Homo Sapiens
REKENAPES

SEQ ID NO: 545305 - protein, 9 aa, Homo Sapiens
NNKVSKKPT

SEQ ID NO: 545306 - protein, 9 aa, Homo Sapiens
NDPGRLTES

SEQ ID NO: 545307 - protein, 9 aa, Homo Sapiens
MKWRPVWTD

SEQ ID NO: 545308 - protein, 9 aa, Homo Sapiens
NQILKGVRE

SEQ ID NO: 545309 - protein, 9 aa, Homo Sapiens
SAMKKGGIL

SEQ ID NO: 545310 - protein, 9 aa, Homo Sapiens
ESLCLEVRP

SEQ ID NO: 545311 - protein, 9 aa, Homo Sapiens
KFHRGYHHQ

SEQ ID NO: 545312 - protein, 9 aa, Homo Sapiens
VDKVSQQPK

SEQ ID NO: 545313 - protein, 9 aa, Homo Sapiens
PSIPSFGKS

SEQ ID NO: 545314 - protein, 9 aa, Homo Sapiens
QQSLRRILP

SEQ ID NO: 545315 - protein, 9 aa, Homo Sapiens
GPLQPLPSS

SEQ ID NO: 545316 - protein, 9 aa, Homo Sapiens
GKMGLNGQE

SEQ ID NO: 545317 - protein, 9 aa, Homo Sapiens
NGEEHSLDK

SEQ ID NO: 545318 - protein, 9 aa, Homo Sapiens
TKKGILWVW

SEQ ID NO: 545319 - protein, 9 aa, Homo Sapiens
RIIETGKTN

SEQ ID NO: 545320 - protein, 9 aa, Homo Sapiens
YHHQVMDAH

SEQ ID NO: 545321 - protein, 9 aa, Homo Sapiens
QMCRKTWSG

SEQ ID NO: 545322 - protein, 9 aa, Homo Sapiens
CLNKILKNP

SEQ ID NO: 545323 - protein, 9 aa, Homo Sapiens
MGAKSLKSR

SEQ ID NO: 545324 - protein, 9 aa, Homo Sapiens
PESPTQKGL

SEQ ID NO: 545325 - protein, 9 aa, Homo Sapiens
EVLSGTVNI

SEQ ID NO: 545326 - protein, 9 aa, Homo Sapiens
LLLLMGIFL

SEQ ID NO: 545327 - protein, 9 aa, Homo Sapiens
SLDKSTAKT

SEQ ID NO: 545328 - protein, 9 aa, Homo Sapiens
YKGLLLLMG

SEQ ID NO: 545329 - protein, 9 aa, Homo Sapiens
IQQSLRRIL

SEQ ID NO: 545330 - protein, 9 aa, Homo Sapiens
RKLNPLRHS

SEQ ID NO: 545331 - protein, 9 aa, Homo Sapiens
RFLEILEQM

SEQ ID NO: 545332 - protein, 9 aa, Homo Sapiens
FDVVDKVSQ

SEQ ID NO: 545333 - protein, 9 aa, Homo Sapiens
KGGILTLDI

SEQ ID NO: 545334 - protein, 9 aa, Homo Sapiens
DFAKDGGLV

SEQ ID NO: 545335 - protein, 9 aa, Homo Sapiens
PQLIQQSLR

SEQ ID NO: 545336 - protein, 9 aa, Homo Sapiens
IPSFGKSYG

SEQ ID NO: 545337 - protein, 9 aa, Homo Sapiens
QNYKRFLEI

SEQ ID NO: 545338 - protein, 9 aa, Homo Sapiens
KRSDPQLLS

SEQ ID NO: 545339 - protein, 9 aa, Homo Sapiens
PASHPLFGR

SEQ ID NO: 545340 - protein, 9 aa, Homo Sapiens
MNFLSSAAP

SEQ ID NO: 545341 - protein, 9 aa, Homo Sapiens
GLLPSGQHS

SEQ ID NO: 545342 - protein, 9 aa, Homo Sapiens
HLVAEDGSI

SEQ ID NO: 545343 - protein, 9 aa, Homo Sapiens
VVTWPPRPV

SEQ ID NO: 545344 - protein, 9 aa, Homo Sapiens
LSRFYYADE

SEQ ID NO: 545345 - protein, 9 aa, Homo Sapiens
MGIMTEYYH

SEQ ID NO: 545346 - protein, 9 aa, Homo Sapiens
LVNPHKARF

SEQ ID NO: 545347 - protein, 9 aa, Homo Sapiens
HQSAMKKGG

SEQ ID NO: 545348 - protein, 9 aa, Homo Sapiens
TNSKRKDFA

SEQ ID NO: 545349 - protein, 9 aa, Homo Sapiens
IMALGVALL

SEQ ID NO: 545350 - protein, 9 aa, Homo Sapiens
SLCLEVRPT

SEQ ID NO: 545351 - protein, 9 aa, Homo Sapiens
ERQTVESLP

SEQ ID NO: 545352 - protein, 9 aa, Homo Sapiens
NCHQMKPAL

SEQ ID NO: 545353 - protein, 9 aa, Homo Sapiens
IIQKKCLNK

SEQ ID NO: 545354 - protein, 9 aa, Homo Sapiens
KVSTSDQCD

SEQ ID NO: 545355 - protein, 9 aa, Homo Sapiens
NSKRKDFAN

SEQ ID NO: 545356 - protein, 9 aa, Homo Sapiens
SDTMVEPYN

SEQ ID NO: 545357 - protein, 9 aa, Homo Sapiens
CTRIIETGK

SEQ ID NO: 545358 - protein, 9 aa, Homo Sapiens
VALLIIQKK

SEQ ID NO: 545359 - protein, 9 aa, Homo Sapiens
LCSVLFLFC

SEQ ID NO: 545360 - protein, 9 aa, Homo Sapiens
IHFKKIHSS

SEQ ID NO: 545361 - protein, 9 aa, Homo Sapiens
TCLVNQDSE

SEQ ID NO: 545362 - protein, 9 aa, Homo Sapiens
DQCDVLHRH

SEQ ID NO: 545363 - protein, 9 aa, Homo Sapiens
ALLSFMNFL

SEQ ID NO: 545364 - protein, 9 aa, Homo Sapiens
VNNKVSKKP

SEQ ID NO: 545365 - protein, 9 aa, Homo Sapiens
HGVCMFAMK

SEQ ID NO: 545366 - protein, 9 aa, Homo Sapiens
DLEDHQMCR

SEQ ID NO: 545367 - protein, 9 aa, Homo Sapiens
EKAQGIGAW

SEQ ID NO: 545368 - protein, 9 aa, Homo Sapiens
MGYSPINNH

SEQ ID NO: 545369 - protein, 9 aa, Homo Sapiens
LQLACSDTS

SEQ ID NO: 545370 - protein, 9 aa, Homo Sapiens
PKVSDTMVE

SEQ ID NO: 545371 - protein, 9 aa, Homo Sapiens
SKKPTKPPT

SEQ ID NO: 545372 - protein, 9 aa, Homo Sapiens
PCWGPPRPW

SEQ ID NO: 545373 - protein, 9 aa, Homo Sapiens
RSKSRSQFS

SEQ ID NO: 545374 - protein, 9 aa, Homo Sapiens
IPRIGKMGL

SEQ ID NO: 545375 - protein, 9 aa, Homo Sapiens
WRPVWTDLN

SEQ ID NO: 545376 - protein, 9 aa, Homo Sapiens
SLKSRQGNE

SEQ ID NO: 545377 - protein, 9 aa, Homo Sapiens
DSTTMSVSI

SEQ ID NO: 545378 - protein, 9 aa, Homo Sapiens
SHSRLGPMV

SEQ ID NO: 545379 - protein, 9 aa, Homo Sapiens
EDHQMCRKT

SEQ ID NO: 545380 - protein, 9 aa, Homo Sapiens
RSGHPEGPP

SEQ ID NO: 545381 - protein, 9 aa, Homo Sapiens
WGTCEDADA

SEQ ID NO: 545382 - protein, 9 aa, Homo Sapiens
HRGYHHQVM

SEQ ID NO: 545383 - protein, 9 aa, Homo Sapiens
QAMAMGIMT

SEQ ID NO: 545384 - protein, 9 aa, Homo Sapiens
DSEQASTPA

SEQ ID NO: 545385 - protein, 9 aa, Homo Sapiens
IRYIERQTV

SEQ ID NO: 545386 - protein, 9 aa, Homo Sapiens
AQGIGAWQP

SEQ ID NO: 545387 - protein, 9 aa, Homo Sapiens
MINGEEHSL

SEQ ID NO: 545388 - protein, 9 aa, Homo Sapiens
PRIGKMGLN

SEQ ID NO: 545389 - protein, 9 aa, Homo Sapiens
VLCSVLFLF

SEQ ID NO: 545390 - protein, 9 aa, Homo Sapiens
LICPQDGMV

SEQ ID NO: 545391 - protein, 9 aa, Homo Sapiens
INNHHGKFH

SEQ ID NO: 545392 - protein, 9 aa, Homo Sapiens
IERQTVESL

SEQ ID NO: 545393 - protein, 9 aa, Homo Sapiens
ELSLQASLS

SEQ ID NO: 545394 - protein, 9 aa, Homo Sapiens
GILWVWVLS

SEQ ID NO: 545395 - protein, 9 aa, Homo Sapiens
CVEAVGILA

SEQ ID NO: 545396 - protein, 9 aa, Homo Sapiens
SVSIPMEIS

SEQ ID NO: 545397 - protein, 9 aa, Homo Sapiens
KMGLNGQEP

SEQ ID NO: 545398 - protein, 9 aa, Homo Sapiens
KQPYIINLS

SEQ ID NO: 545399 - protein, 9 aa, Homo Sapiens
SHAHLVAED

SEQ ID NO: 545400 - protein, 9 aa, Homo Sapiens
FAMKNSLET

SEQ ID NO: 545401 - protein, 9 aa, Homo Sapiens
VSQQPKSAS

SEQ ID NO: 545402 - protein, 9 aa, Homo Sapiens
HHQVMDAHQ

SEQ ID NO: 545403 - protein, 9 aa, Homo Sapiens
SQGSQQYRA

SEQ ID NO: 545404 - protein, 9 aa, Homo Sapiens
PKLTKSGLA

SEQ ID NO: 545405 - protein, 9 aa, Homo Sapiens
SRSQFSSRS

SEQ ID NO: 545406 - protein, 9 aa, Homo Sapiens
EDECEGIQG

SEQ ID NO: 545407 - protein, 9 aa, Homo Sapiens
GYQVEEENP

SEQ ID NO: 545408 - protein, 9 aa, Homo Sapiens
LNCMVPFRS

SEQ ID NO: 545409 - protein, 9 aa, Homo Sapiens
AFLPCWGPP

SEQ ID NO: 545410 - protein, 9 aa, Homo Sapiens
NPKKKILLK

SEQ ID NO: 545411 - protein, 9 aa, Homo Sapiens
RFFAHSEVK

SEQ ID NO: 545412 - protein, 9 aa, Homo Sapiens
LIQQSLRRI

SEQ ID NO: 545413 - protein, 9 aa, Homo Sapiens
TFLRLYYAS

SEQ ID NO: 545414 - protein, 9 aa, Homo Sapiens
LKQKVQAQN

SEQ ID NO: 545415 - protein, 9 aa, Homo Sapiens
PSPPAFLPC

SEQ ID NO: 545416 - protein, 9 aa, Homo Sapiens
RSPRWQGQR

SEQ ID NO: 545417 - protein, 9 aa, Homo Sapiens
FVALGPTAG

SEQ ID NO: 545418 - protein, 9 aa, Homo Sapiens
LNGQEPVKQ

SEQ ID NO: 545419 - protein, 9 aa, Homo Sapiens
DRHALKQSL

SEQ ID NO: 545420 - protein, 9 aa, Homo Sapiens
YYASQDNDR

SEQ ID NO: 545421 - protein, 9 aa, Homo Sapiens
ELVNPHKAR

SEQ ID NO: 545422 - protein, 9 aa, Homo Sapiens
ILDVISGHQ

SEQ ID NO: 545423 - protein, 9 aa, Homo Sapiens
GHDGSHAHL

SEQ ID NO: 545424 - protein, 9 aa, Homo Sapiens
RIGKMGLNG

SEQ ID NO: 545425 - protein, 9 aa, Homo Sapiens
EMGYSPINN

SEQ ID NO: 545426 - protein, 9 aa, Homo Sapiens
AHQSAMKKG

SEQ ID NO: 545427 - protein, 9 aa, Homo Sapiens
QGIGAWQPI

SEQ ID NO: 545428 - protein, 9 aa, Homo Sapiens
KVSDTMVEP

SEQ ID NO: 545429 - protein, 9 aa, Homo Sapiens
QNPQLIQQS

SEQ ID NO: 545430 - protein, 9 aa, Homo Sapiens
GEEHSLDKS

SEQ ID NO: 545431 - protein, 9 aa, Homo Sapiens
QKRPLKQPY

SEQ ID NO: 545432 - protein, 9 aa, Homo Sapiens
KKCLNKILK

SEQ ID NO: 545433 - protein, 9 aa, Homo Sapiens
LTSQGSQQY

SEQ ID NO: 545434 - protein, 9 aa, Homo Sapiens
VALGPTAGP

SEQ ID NO: 545435 - protein, 9 aa, Homo Sapiens
LVPEKAQGI

SEQ ID NO: 545436 - protein, 9 aa, Homo Sapiens
RWQGQRWIW

SEQ ID NO: 545437 - protein, 9 aa, Homo Sapiens
LTEVTGPPN

SEQ ID NO: 545438 - protein, 9 aa, Homo Sapiens
SNDCLSQAR

SEQ ID NO: 545439 - protein, 9 aa, Homo Sapiens
YIINLSPKR

SEQ ID NO: 545440 - protein, 9 aa, Homo Sapiens
IPMEISTLG

SEQ ID NO: 545441 - protein, 9 aa, Homo Sapiens
IVVTWPPRP

SEQ ID NO: 545442 - protein, 9 aa, Homo Sapiens
LQPLPSSND

SEQ ID NO: 545443 - protein, 9 aa, Homo Sapiens
TGPPNELEP

SEQ ID NO: 545444 - protein, 9 aa, Homo Sapiens
EDLEDHQMC

SEQ ID NO: 545445 - protein, 9 aa, Homo Sapiens
QVMDAHQSA

SEQ ID NO: 545446 - protein, 9 aa, Homo Sapiens
SPPAFLPCW

SEQ ID NO: 545447 - protein, 9 aa, Homo Sapiens
RQTVESLPF

SEQ ID NO: 545448 - protein, 9 aa, Homo Sapiens
RSDPQLLSR

SEQ ID NO: 545449 - protein, 9 aa, Homo Sapiens
LSHPSHSRL

SEQ ID NO: 545450 - protein, 9 aa, Homo Sapiens
SRLGPMVTP

SEQ ID NO: 545451 - protein, 9 aa, Homo Sapiens
CWGPPRPWP

SEQ ID NO: 545452 - protein, 9 aa, Homo Sapiens
KLFVALGPT

SEQ ID NO: 545453 - protein, 9 aa, Homo Sapiens
SILDVISGH

SEQ ID NO: 545454 - protein, 9 aa, Homo Sapiens
PGPLPASHP

SEQ ID NO: 545455 - protein, 9 aa, Homo Sapiens
VREEMTPAP

SEQ ID NO: 545456 - protein, 9 aa, Homo Sapiens
NFVTNSKRK

SEQ ID NO: 545457 - protein, 9 aa, Homo Sapiens
LTESLCLEV

SEQ ID NO: 545458 - protein, 9 aa, Homo Sapiens
PGYGRNWLH

SEQ ID NO: 545459 - protein, 9 aa, Homo Sapiens
WLHRPVSTD

SEQ ID NO: 545460 - protein, 9 aa, Homo Sapiens
QTVESLPFL

SEQ ID NO: 545461 - protein, 9 aa, Homo Sapiens
SLSRPEART

SEQ ID NO: 545462 - protein, 9 aa, Homo Sapiens
SQQPKSASS

SEQ ID NO: 545463 - protein, 9 aa, Homo Sapiens
LIIQKKCLN

SEQ ID NO: 545464 - protein, 9 aa, Homo Sapiens
HKARFLKEI

SEQ ID NO: 545465 - protein, 9 aa, Homo Sapiens
KSGLAAPRT

SEQ ID NO: 545466 - protein, 9 aa, Homo Sapiens
PQDGMVAIP

SEQ ID NO: 545467 - protein, 9 aa, Homo Sapiens
MGIFLAYET

SEQ ID NO: 545468 - protein, 9 aa, Homo Sapiens
DTMVEPYNA

SEQ ID NO: 545469 - protein, 9 aa, Homo Sapiens
TCEDADAPS

SEQ ID NO: 545470 - protein, 9 aa, Homo Sapiens
PLQPLPSSN

SEQ ID NO: 545471 - protein, 9 aa, Homo Sapiens
GPTAGPEEK

SEQ ID NO: 545472 - protein, 9 aa, Homo Sapiens
FKKIHSSMM

SEQ ID NO: 545473 - protein, 9 aa, Homo Sapiens
NPEEDECEG

SEQ ID NO: 545474 - protein, 9 aa, Homo Sapiens
KNIEVLCSV

SEQ ID NO: 545475 - protein, 9 aa, Homo Sapiens
LPASHPLFG

SEQ ID NO: 545476 - protein, 9 aa, Homo Sapiens
PWPAGAPLP

SEQ ID NO: 545477 - protein, 9 aa, Homo Sapiens
DKGYQVEEE

SEQ ID NO: 545478 - protein, 9 aa, Homo Sapiens
GGILTLDIL

SEQ ID NO: 545479 - protein, 9 aa, Homo Sapiens
TMVEPYNAT

SEQ ID NO: 545480 - protein, 9 aa, Homo Sapiens
IHSSMMEKY

SEQ ID NO: 545481 - protein, 9 aa, Homo Sapiens
INGEEHSLD

SEQ ID NO: 545482 - protein, 9 aa, Homo Sapiens
GYKGLLLLM

SEQ ID NO: 545483 - protein, 9 aa, Homo Sapiens
CPGRFFAHS

SEQ ID NO: 545484 - protein, 9 aa, Homo Sapiens
LLIIQKKCL

SEQ ID NO: 545485 - protein, 9 aa, Homo Sapiens
SFGKSYGYH

SEQ ID NO: 545486 - protein, 9 aa, Homo Sapiens
MGLNGQEPV

SEQ ID NO: 545487 - protein, 9 aa, Homo Sapiens
PTAGPEEKK

SEQ ID NO: 545488 - protein, 9 aa, Homo Sapiens
MAMGIMTEY

SEQ ID NO: 545489 - protein, 9 aa, Homo Sapiens
HSHHLEMGY

SEQ ID NO: 545490 - protein, 9 aa, Homo Sapiens
LPSGQHSCQ

SEQ ID NO: 545491 - protein, 9 aa, Homo Sapiens
KTYQIMKWR

SEQ ID NO: 545492 - protein, 9 aa, Homo Sapiens
WGPPRPWPA

SEQ ID NO: 545493 - protein, 9 aa, Homo Sapiens
SIPSFGKSY

SEQ ID NO: 545494 - protein, 9 aa, Homo Sapiens
YIERQTVES

SEQ ID NO: 545495 - protein, 9 aa, Homo Sapiens
PLTSQGSQQ

SEQ ID NO: 545496 - protein, 9 aa, Homo Sapiens
AINFNPEED

SEQ ID NO: 545497 - protein, 9 aa, Homo Sapiens
LQASLSRPE

SEQ ID NO: 545498 - protein, 9 aa, Homo Sapiens
LADNFVTNS

SEQ ID NO: 545499 - protein, 9 aa, Homo Sapiens
LLMGIFLAY

SEQ ID NO: 545500 - protein, 9 aa, Homo Sapiens
RLVPEKAQG

SEQ ID NO: 545501 - protein, 9 aa, Homo Sapiens
SSNDCLSQA

SEQ ID NO: 545502 - protein, 9 aa, Homo Sapiens
SEQASTPAG

SEQ ID NO: 545503 - protein, 9 aa, Homo Sapiens
DAHQSAMKK

SEQ ID NO: 545504 - protein, 9 aa, Homo Sapiens
ASPEEMQGP

SEQ ID NO: 545505 - protein, 9 aa, Homo Sapiens
FAPLTSQGS

SEQ ID NO: 545506 - protein, 9 aa, Homo Sapiens
AHLVAEDGS

SEQ ID NO: 545507 - protein, 9 aa, Homo Sapiens
KILKNPKKK

SEQ ID NO: 545508 - protein, 9 aa, Homo Sapiens
QAYQQCFFG

SEQ ID NO: 545509 - protein, 9 aa, Homo Sapiens
LYEDLEDHQ

SEQ ID NO: 545510 - protein, 9 aa, Homo Sapiens
QPYIINLSP

SEQ ID NO: 545511 - protein, 9 aa, Homo Sapiens
PGFAPLTSQ

SEQ ID NO: 545512 - protein, 9 aa, Homo Sapiens
QGPPAATEE

SEQ ID NO: 545513 - protein, 9 aa, Homo Sapiens
GLNGQEPVK

SEQ ID NO: 545514 - protein, 9 aa, Homo Sapiens
HSSMMEKYE

SEQ ID NO: 545515 - protein, 9 aa, Homo Sapiens
VDVPSIPSF

SEQ ID NO: 545516 - protein, 9 aa, Homo Sapiens
ENAPESPTQ

SEQ ID NO: 545517 - protein, 9 aa, Homo Sapiens
KKGILWVWV

SEQ ID NO: 545518 - protein, 9 aa, Homo Sapiens
SPTQKGLRE

SEQ ID NO: 545519 - protein, 9 aa, Homo Sapiens
SRPEARTLQ

SEQ ID NO: 545520 - protein, 9 aa, Homo Sapiens
SPKVSDTMV

SEQ ID NO: 545521 - protein, 9 aa, Homo Sapiens
GSHAHLVAE

SEQ ID NO: 545522 - protein, 9 aa, Homo Sapiens
KPTKPPTLR

SEQ ID NO: 545523 - protein, 9 aa, Homo Sapiens
VTWPPRPVT

SEQ ID NO: 545524 - protein, 9 aa, Homo Sapiens
GYGRNWLHR

SEQ ID NO: 545525 - protein, 9 aa, Homo Sapiens
HSLDKSTAK

SEQ ID NO: 545526 - protein, 9 aa, Homo Sapiens
HFKKIHSSM

SEQ ID NO: 545527 - protein, 9 aa, Homo Sapiens
YQIMKWRPV

SEQ ID NO: 545528 - protein, 9 aa, Homo Sapiens
LAHIVVTWP

SEQ ID NO: 545529 - protein, 9 aa, Homo Sapiens
SKRKDFANM

SEQ ID NO: 545530 - protein, 9 aa, Homo Sapiens
KWRPVWTDL

SEQ ID NO: 545531 - protein, 9 aa, Homo Sapiens
WSCVEAVGI

SEQ ID NO: 545532 - protein, 9 aa, Homo Sapiens
EEDECEGIQ

SEQ ID NO: 545533 - protein, 9 aa, Homo Sapiens
AKSLKSRQG

SEQ ID NO: 545534 - protein, 9 aa, Homo Sapiens
STTMSVSIP

SEQ ID NO: 545535 - protein, 9 aa, Homo Sapiens
FNPEEDECE

SEQ ID NO: 545536 - protein, 9 aa, Homo Sapiens
QDGMVAIPN

SEQ ID NO: 545537 - protein, 9 aa, Homo Sapiens
GIGAWQPIM

SEQ ID NO: 545538 - protein, 9 aa, Homo Sapiens
SLDSWGTCE

SEQ ID NO: 545539 - protein, 9 aa, Homo Sapiens
ILDIMALGV

SEQ ID NO: 545540 - protein, 9 aa, Homo Sapiens
VSIPMEIST

SEQ ID NO: 545541 - protein, 9 aa, Homo Sapiens
AHIVVTWPP

SEQ ID NO: 545542 - protein, 9 aa, Homo Sapiens
GPKLTKSGL

SEQ ID NO: 545543 - protein, 9 aa, Homo Sapiens
DPQLLSRFY

SEQ ID NO: 545544 - protein, 9 aa, Homo Sapiens
QAQNPQLIQ

SEQ ID NO: 545545 - protein, 9 aa, Homo Sapiens
SIPMEISTL

SEQ ID NO: 545546 - protein, 9 aa, Homo Sapiens
VNPHKARFL

SEQ ID NO: 545547 - protein, 9 aa, Homo Sapiens
FVTNSKRKD

SEQ ID NO: 545548 - protein, 9 aa, Homo Sapiens
LSILDVISG

SEQ ID NO: 545549 - protein, 9 aa, Homo Sapiens
QLIQQSLRR

SEQ ID NO: 545550 - protein, 9 aa, Homo Sapiens
SGLAAPRTL

SEQ ID NO: 545551 - protein, 9 aa, Homo Sapiens
PAGAPLPSS

SEQ ID NO: 545552 - protein, 9 aa, Homo Sapiens
GSLDSWGTC

SEQ ID NO: 545553 - protein, 9 aa, Homo Sapiens
LPGYGRNWL

SEQ ID NO: 545554 - protein, 9 aa, Homo Sapiens
YASQDNDRL

SEQ ID NO: 545555 - protein, 9 aa, Homo Sapiens
KVSQQPKSA

SEQ ID NO: 545556 - protein, 9 aa, Homo Sapiens
PRSPRWQGQ

SEQ ID NO: 545557 - protein, 9 aa, Homo Sapiens
VESLPFLQY

SEQ ID NO: 545558 - protein, 9 aa, Homo Sapiens
CMVPFRSGH

SEQ ID NO: 545559 - protein, 9 aa, Homo Sapiens
PLPSSRRQL

SEQ ID NO: 545560 - protein, 9 aa, Homo Sapiens
NFLSSAAPF

SEQ ID NO: 545561 - protein, 9 aa, Homo Sapiens
YGRNWLHRP

SEQ ID NO: 545562 - protein, 9 aa, Homo Sapiens
LLPSGQHSC

SEQ ID NO: 545563 - protein, 9 aa, Homo Sapiens
SFDVVDKVS

SEQ ID NO: 545564 - protein, 9 aa, Homo Sapiens
ALLIIQKKC

SEQ ID NO: 545565 - protein, 9 aa, Homo Sapiens
IGKMGLNGQ

SEQ ID NO: 545566 - protein, 9 aa, Homo Sapiens
TKSGLAAPR

SEQ ID NO: 545567 - protein, 9 aa, Homo Sapiens
VKIPEGGTG

SEQ ID NO: 545568 - protein, 9 aa, Homo Sapiens
NWLHRPVST

SEQ ID NO: 545569 - protein, 9 aa, Homo Sapiens
LSPKRKLNP

SEQ ID NO: 545570 - protein, 9 aa, Homo Sapiens
KQAMAMGIM

SEQ ID NO: 545571 - protein, 9 aa, Homo Sapiens
AMKKGGILT

SEQ ID NO: 545572 - protein, 9 aa, Homo Sapiens
SPINNHHGK

SEQ ID NO: 545573 - protein, 9 aa, Homo Sapiens
GQHSCQPVS

SEQ ID NO: 545574 - protein, 9 aa, Homo Sapiens
TSDQCDVLH

SEQ ID NO: 545575 - protein, 9 aa, Homo Sapiens
LTKSGLAAP

SEQ ID NO: 545576 - protein, 9 aa, Homo Sapiens
ALLDRHALK

SEQ ID NO: 545577 - protein, 9 aa, Homo Sapiens
VGHDGSHAH

SEQ ID NO: 545578 - protein, 9 aa, Homo Sapiens
LDSWGTCED

SEQ ID NO: 545579 - protein, 9 aa, Homo Sapiens
SFMNFLSSA

SEQ ID NO: 545580 - protein, 9 aa, Homo Sapiens
GTFLRLYYA

SEQ ID NO: 545581 - protein, 9 aa, Homo Sapiens
ILTLDILDI

SEQ ID NO: 545582 - protein, 9 aa, Homo Sapiens
LQCTRIIET

SEQ ID NO: 545583 - protein, 9 aa, Homo Sapiens
KTMGVSHSF

SEQ ID NO: 545584 - protein, 9 aa, Homo Sapiens
NVKIPEGGT

SEQ ID NO: 545585 - protein, 9 aa, Homo Sapiens
VISGHQHPQ

SEQ ID NO: 545586 - protein, 9 aa, Homo Sapiens
MVEPYNATL

SEQ ID NO: 545587 - protein, 9 aa, Homo Sapiens
DMISALCKK

SEQ ID NO: 545588 - protein, 9 aa, Homo Sapiens
RVEGCVSVC

SEQ ID NO: 545589 - protein, 9 aa, Homo Sapiens
LKQPYIINL

SEQ ID NO: 545590 - protein, 9 aa, Homo Sapiens
KHALNCHQM

SEQ ID NO: 545591 - protein, 9 aa, Homo Sapiens
FHGVCMFAM

SEQ ID NO: 545592 - protein, 9 aa, Homo Sapiens
HAHLVAEDG

SEQ ID NO: 545593 - protein, 9 aa, Homo Sapiens
PLRHSHHLE

SEQ ID NO: 545594 - protein, 9 aa, Homo Sapiens
FLRLYYASQ

SEQ ID NO: 545595 - protein, 9 aa, Homo Sapiens
NFNPEEDEC

SEQ ID NO: 545596 - protein, 9 aa, Homo Sapiens
LCQTKKGIL

SEQ ID NO: 545597 - protein, 9 aa, Homo Sapiens
ATYDKGYQV

SEQ ID NO: 545598 - protein, 9 aa, Homo Sapiens
PPAFLPCWG

SEQ ID NO: 545599 - protein, 9 aa, Homo Sapiens
EMTPAPQET

SEQ ID NO: 545600 - protein, 9 aa, Homo Sapiens
DGMVAIPNP

SEQ ID NO: 545601 - protein, 9 aa, Homo Sapiens
NAPESPTQK

SEQ ID NO: 545602 - protein, 9 aa, Homo Sapiens
ELCQTKKGI

SEQ ID NO: 545603 - protein, 9 aa, Homo Sapiens
QIMKWRPVW

SEQ ID NO: 545604 - protein, 9 aa, Homo Sapiens
PAFLPCWGP

SEQ ID NO: 545605 - protein, 9 aa, Homo Sapiens
VVDKVSQQP

SEQ ID NO: 545606 - protein, 9 aa, Homo Sapiens
PLNLAHIVV

SEQ ID NO: 545607 - protein, 9 aa, Homo Sapiens
QHSCQPVST

SEQ ID NO: 545608 - protein, 9 aa, Homo Sapiens
DILDIMALG

SEQ ID NO: 545609 - protein, 9 aa, Homo Sapiens
LEMGYSPIN

SEQ ID NO: 545610 - protein, 9 aa, Homo Sapiens
NPQLIQQSL

SEQ ID NO: 545611 - protein, 9 aa, Homo Sapiens
MKNSLETDL

SEQ ID NO: 545612 - protein, 9 aa, Homo Sapiens
APLPSSRRQ

SEQ ID NO: 545613 - protein, 9 aa, Homo Sapiens
AMKNSLETD

SEQ ID NO: 545614 - protein, 9 aa, Homo Sapiens
QSLRRILPN

SEQ ID NO: 545615 - protein, 9 aa, Homo Sapiens
YQVEEENPL

SEQ ID NO: 545616 - protein, 9 aa, Homo Sapiens
FFAHSEVKL

SEQ ID NO: 545617 - protein, 9 aa, Homo Sapiens
LLPGPLPAS

SEQ ID NO: 545618 - protein, 9 aa, Homo Sapiens
QKVQAQNPQ

SEQ ID NO: 545619 - protein, 9 aa, Homo Sapiens
ILNCMVPFR

SEQ ID NO: 545620 - protein, 9 aa, Homo Sapiens
LQSKTMGVS

SEQ ID NO: 545621 - protein, 9 aa, Homo Sapiens
LEDHQMCRK

SEQ ID NO: 545622 - protein, 9 aa, Homo Sapiens
DSWGTCEDA

SEQ ID NO: 545623 - protein, 9 aa, Homo Sapiens
VSKKPTKPP

SEQ ID NO: 545624 - protein, 9 aa, Homo Sapiens
RPWPAGAPL

SEQ ID NO: 545625 - protein, 9 aa, Homo Sapiens
APESPTQKG

SEQ ID NO: 545626 - protein, 9 aa, Homo Sapiens
GPLPASHPL

SEQ ID NO: 545627 - protein, 9 aa, Homo Sapiens
RYIERQTVE

SEQ ID NO: 545628 - protein, 9 aa, Homo Sapiens
MALGVALLI

SEQ ID NO: 545629 - protein, 9 aa, Homo Sapiens
MDAHQSAMK

SEQ ID NO: 545630 - protein, 9 aa, Homo Sapiens
KGILWVWVL

SEQ ID NO: 545631 - protein, 9 aa, Homo Sapiens
FRSGHPEGP

SEQ ID NO: 545632 - protein, 9 aa, Homo Sapiens
QDFAKDGGL

SEQ ID NO: 545633 - protein, 9 aa, Homo Sapiens
CPQDGMVAI

SEQ ID NO: 545634 - protein, 9 aa, Homo Sapiens
SPKRKLNPL

SEQ ID NO: 545635 - protein, 9 aa, Homo Sapiens
PRWQGQRWI

SEQ ID NO: 545636 - protein, 9 aa, Homo Sapiens
KIHFKKIHS

SEQ ID NO: 545637 - protein, 9 aa, Homo Sapiens
PLPASHPLF

SEQ ID NO: 545638 - protein, 9 aa, Homo Sapiens
CHQMKPALF

SEQ ID NO: 545639 - protein, 9 aa, Homo Sapiens
ALGPTAGPE

SEQ ID NO: 545640 - protein, 9 aa, Homo Sapiens
PKRKLNPLR

SEQ ID NO: 545641 - protein, 9 aa, Homo Sapiens
IINLSPKRK

SEQ ID NO: 545642 - protein, 9 aa, Homo Sapiens
QKKCLNKIL

SEQ ID NO: 545643 - protein, 9 aa, Homo Sapiens
TRIIETGKT

SEQ ID NO: 545644 - protein, 9 aa, Homo Sapiens
VMDAHQSAM

SEQ ID NO: 545645 - protein, 9 aa, Homo Sapiens
AMGIMTEYY

SEQ ID NO: 545646 - protein, 9 aa, Homo Sapiens
AHSEVKLFI

SEQ ID NO: 545647 - protein, 9 aa, Homo Sapiens
TYQIMKWRP

SEQ ID NO: 545648 - protein, 9 aa, Homo Sapiens
PRVEGCVSV

SEQ ID NO: 545649 - protein, 9 aa, Homo Sapiens
TTITNVKIP

SEQ ID NO: 545650 - protein, 9 aa, Homo Sapiens
VSVCPTPQV

SEQ ID NO: 545651 - protein, 9 aa, Homo Sapiens
ILKNPKKKI

SEQ ID NO: 545652 - protein, 9 aa, Homo Sapiens
ECQNYKRFL

SEQ ID NO: 545653 - protein, 9 aa, Homo Sapiens
LGPMVTPHN

SEQ ID NO: 545654 - protein, 9 aa, Homo Sapiens
QMKPALFSV

SEQ ID NO: 545655 - protein, 9 aa, Homo Sapiens
GHEVLSGTV

SEQ ID NO: 545656 - protein, 9 aa, Homo Sapiens
LPCWGPPRP

SEQ ID NO: 545657 - protein, 9 aa, Homo Sapiens
MVAIPNPFI

SEQ ID NO: 545658 - protein, 9 aa, Homo Sapiens
FELVNPHKA

SEQ ID NO: 545659 - protein, 9 aa, Homo Sapiens
NLAHIVVTW

SEQ ID NO: 545660 - protein, 9 aa, Homo Sapiens
NECQNYKRF

SEQ ID NO: 545661 - protein, 9 aa, Homo Sapiens
RSQFSSRSR

SEQ ID NO: 545662 - protein, 9 aa, Homo Sapiens
QPLPSSNDC

SEQ ID NO: 545663 - protein, 9 aa, Homo Sapiens
SWGTCEDAD

SEQ ID NO: 545664 - protein, 9 aa, Homo Sapiens
PGRLTESLC

SEQ ID NO: 545665 - protein, 9 aa, Homo Sapiens
QCTRIIETG

SEQ ID NO: 545666 - protein, 9 aa, Homo Sapiens
DPGRLTESL

SEQ ID NO: 545667 - protein, 9 aa, Homo Sapiens
FLEILEQMN

SEQ ID NO: 545668 - protein, 9 aa, Homo Sapiens
QILKGVREE

SEQ ID NO: 545669 - protein, 9 aa, Homo Sapiens
MVPFRSGHP

SEQ ID NO: 545670 - protein, 9 aa, Homo Sapiens
RLYYASQDN

SEQ ID NO: 545671 - protein, 9 aa, Homo Sapiens
PTCLVNQDS

SEQ ID NO: 545672 - protein, 9 aa, Homo Sapiens
NQDSEQAST

SEQ ID NO: 545673 - protein, 9 aa, Homo Sapiens
TVESLPFLQ

SEQ ID NO: 545674 - protein, 9 aa, Homo Sapiens
STSDQCDVL

SEQ ID NO: 545675 - protein, 9 aa, Homo Sapiens
SHPSHSRLG

SEQ ID NO: 545676 - protein, 9 aa, Homo Sapiens
LSWSCVEAV

SEQ ID NO: 545677 - protein, 9 aa, Homo Sapiens
QCDVLHRHA

SEQ ID NO: 545678 - protein, 9 aa, Homo Sapiens
VEEENPLRD

SEQ ID NO: 545679 - protein, 9 aa, Homo Sapiens
MKKGGILTL

SEQ ID NO: 545680 - protein, 9 aa, Homo Sapiens
ALNCHQMKP

SEQ ID NO: 545681 - protein, 9 aa, Homo Sapiens
KLTKSGLAA

SEQ ID NO: 545682 - protein, 9 aa, Homo Sapiens
DGSHAHLVA

SEQ ID NO: 545683 - protein, 9 aa, Homo Sapiens
KNPKKKILL

SEQ ID NO: 545684 - protein, 9 aa, Homo Sapiens
INFNPEEDE

SEQ ID NO: 545685 - protein, 9 aa, Homo Sapiens
PSPKVSDTM

SEQ ID NO: 545686 - protein, 9 aa, Homo Sapiens
IMINGEEHS

SEQ ID NO: 545687 - protein, 9 aa, Homo Sapiens
YEDLEDHQM

SEQ ID NO: 545688 - protein, 9 aa, Homo Sapiens
GVREEMTPA

SEQ ID NO: 545689 - protein, 9 aa, Homo Sapiens
GPPAATEEE

SEQ ID NO: 545690 - protein, 9 aa, Homo Sapiens
SWSCVEAVG

SEQ ID NO: 545691 - protein, 9 aa, Homo Sapiens
PEEDECEGI

SEQ ID NO: 545692 - protein, 9 aa, Homo Sapiens
LPSSNDCLS

SEQ ID NO: 545693 - protein, 9 aa, Homo Sapiens
TELCQTKKG

SEQ ID NO: 545694 - protein, 9 aa, Homo Sapiens
DGGLVTSQE

SEQ ID NO: 545695 - protein, 9 aa, Homo Sapiens
DHQMCRKTW

SEQ ID NO: 545696 - protein, 9 aa, Homo Sapiens
SHHLEMGYS

SEQ ID NO: 545697 - protein, 9 aa, Homo Sapiens
HDGSHAHLV

SEQ ID NO: 545698 - protein, 9 aa, Homo Sapiens
VTGPPNELE

SEQ ID NO: 545699 - protein, 9 aa, Homo Sapiens
SCVEAVGIL

SEQ ID NO: 545700 - protein, 9 aa, Homo Sapiens
RHALKQSLV

SEQ ID NO: 545701 - protein, 9 aa, Homo Sapiens
EKENAPESP

SEQ ID NO: 545702 - protein, 9 aa, Homo Sapiens
AQLPRSPRW

SEQ ID NO: 545703 - protein, 9 aa, Homo Sapiens
ARALLDRHA

SEQ ID NO: 545704 - protein, 9 aa, Homo Sapiens
EEMQGPPAA

SEQ ID NO: 545705 - protein, 9 aa, Homo Sapiens
CGHEVLSGT

SEQ ID NO: 545706 - protein, 9 aa, Homo Sapiens
LVNQDSEQA

SEQ ID NO: 545707 - protein, 9 aa, Homo Sapiens
GIMTEYYHF

SEQ ID NO: 545708 - protein, 9 aa, Homo Sapiens
DNFVTNSKR

SEQ ID NO: 545709 - protein, 9 aa, Homo Sapiens
QFSSRSRSR

SEQ ID NO: 545710 - protein, 9 aa, Homo Sapiens
KKGGILTLD

SEQ ID NO: 545711 - protein, 9 aa, Homo Sapiens
LLSRFYYAD

SEQ ID NO: 545712 - protein, 9 aa, Homo Sapiens
TAGPEEKKQ

SEQ ID NO: 545713 - protein, 9 aa, Homo Sapiens
NNHHGKFHR

SEQ ID NO: 545714 - protein, 9 aa, Homo Sapiens
KQKVQAQNP

SEQ ID NO: 545715 - protein, 9 aa, Homo Sapiens
KLNPLRHSH

SEQ ID NO: 545716 - protein, 9 aa, Homo Sapiens
TYDKGYQVE

SEQ ID NO: 545717 - protein, 9 aa, Homo Sapiens
IMTEYYHFI

SEQ ID NO: 545718 - protein, 9 aa, Homo Sapiens
KGYQVEEEN

SEQ ID NO: 545719 - protein, 9 aa, Homo Sapiens
ASHPLFGRL

SEQ ID NO: 545720 - protein, 9 aa, Homo Sapiens
LVTSQESGQ

SEQ ID NO: 545721 - protein, 9 aa, Homo Sapiens
GMVAIPNPF

SEQ ID NO: 545722 - protein, 9 aa, Homo Sapiens
PHKARFLKE

SEQ ID NO: 545723 - protein, 9 aa, Homo Sapiens
FCGCGHEVL

SEQ ID NO: 545724 - protein, 9 aa, Homo Sapiens
WPAGAPLPS

SEQ ID NO: 545725 - protein, 9 aa, Homo Sapiens
PNQILKGVR

SEQ ID NO: 545726 - protein, 9 aa, Homo Sapiens
CQTKKGILW

SEQ ID NO: 545727 - protein, 9 aa, Homo Sapiens
LNKILKNPK

SEQ ID NO: 545728 - protein, 9 aa, Homo Sapiens
LTLDILDIM

SEQ ID NO: 545729 - protein, 9 aa, Homo Sapiens
RILPNQILK

SEQ ID NO: 545730 - protein, 9 aa, Homo Sapiens
PPNELEPTQ

SEQ ID NO: 545731 - protein, 9 aa, Homo Sapiens
QLPRSPRWQ

SEQ ID NO: 545732 - protein, 9 aa, Homo Sapiens
NPLRHSHHL

SEQ ID NO: 545733 - protein, 9 aa, Homo Sapiens
CQNYKRFLE

SEQ ID NO: 545734 - protein, 9 aa, Homo Sapiens
NCMVPFRSG

SEQ ID NO: 545735 - protein, 9 aa, Homo Sapiens
PLPSSNDCL

SEQ ID NO: 545736 - protein, 9 aa, Homo Sapiens
VQAQNPQLI

SEQ ID NO: 545737 - protein, 9 aa, Homo Sapiens
GLVTSQESG

SEQ ID NO: 545738 - protein, 9 aa, Homo Sapiens
QVEEENPLR

SEQ ID NO: 545739 - protein, 9 aa, Homo Sapiens
HKTYQIMKW

SEQ ID NO: 545740 - protein, 9 aa, Homo Sapiens
IKVSTSDQC

SEQ ID NO: 545741 - protein, 9 aa, Homo Sapiens
DVISGHQHP

SEQ ID NO: 545742 - protein, 9 aa, Homo Sapiens
NKNIEVLCS

SEQ ID NO: 545743 - protein, 9 aa, Homo Sapiens
VTNSKRKDF

SEQ ID NO: 545744 - protein, 9 aa, Homo Sapiens
SRFYYADEE

SEQ ID NO: 545745 - protein, 9 aa, Homo Sapiens
TLDILDIMA

SEQ ID NO: 545746 - protein, 9 aa, Homo Sapiens
KRPLKQPYI

SEQ ID NO: 545747 - protein, 9 aa, Homo Sapiens
GKFHRGYHH

SEQ ID NO: 545748 - protein, 9 aa, Homo Sapiens
PPRPWPAGA

SEQ ID NO: 545749 - protein, 9 aa, Homo Sapiens
LLQSKTMGV

SEQ ID NO: 545750 - protein, 9 aa, Homo Sapiens
VPRVEGCVS

SEQ ID NO: 545751 - protein, 9 aa, Homo Sapiens
YSPINNHHG

SEQ ID NO: 545752 - protein, 9 aa, Homo Sapiens
PTKPPTLRS

SEQ ID NO: 545753 - protein, 9 aa, Homo Sapiens
LDVISGHQH

SEQ ID NO: 545754 - protein, 9 aa, Homo Sapiens
SHPLFGRLV

SEQ ID NO: 545755 - protein, 9 aa, Homo Sapiens
ASQDNDRLD

SEQ ID NO: 545756 - protein, 9 aa, Homo Sapiens
LDILDIMAL

SEQ ID NO: 545757 - protein, 9 aa, Homo Sapiens
LGPTAGPEE

SEQ ID NO: 545758 - protein, 9 aa, Homo Sapiens
HALKQSLVV

SEQ ID NO: 545759 - protein, 9 aa, Homo Sapiens
IMKWRPVWT

SEQ ID NO: 545760 - protein, 9 aa, Homo Sapiens
ILLKQKVQA

SEQ ID NO: 545761 - protein, 9 aa, Homo Sapiens
GTCEDADAP

SEQ ID NO: 545762 - protein, 9 aa, Homo Sapiens
VPEKAQGIG

SEQ ID NO: 545763 - protein, 9 aa, Homo Sapiens
ALGVALLII

SEQ ID NO: 545764 - protein, 9 aa, Homo Sapiens
FAHSEVKLF

SEQ ID NO: 545765 - protein, 9 aa, Homo Sapiens
HSCQPVSTA

SEQ ID NO: 545766 - protein, 9 aa, Homo Sapiens
PAPQETVPQ

SEQ ID NO: 545767 - protein, 9 aa, Homo Sapiens
KSKTTITNV

SEQ ID NO: 545768 - protein, 9 aa, Homo Sapiens
LRRILPNQI

SEQ ID NO: 545769 - protein, 9 aa, Homo Sapiens
KTTITNVKI

SEQ ID NO: 545770 - protein, 9 aa, Homo Sapiens
KVSKKPTKP

SEQ ID NO: 545771 - protein, 9 aa, Homo Sapiens
HQVMDAHQS

SEQ ID NO: 545772 - protein, 9 aa, Homo Sapiens
PRPWPAGAP

SEQ ID NO: 545773 - protein, 9 aa, Homo Sapiens
TITNVKIPE

SEQ ID NO: 545774 - protein, 9 aa, Homo Sapiens
RHSHHLEMG

SEQ ID NO: 545775 - protein, 9 aa, Homo Sapiens
RPLKQPYII

SEQ ID NO: 545776 - protein, 9 aa, Homo Sapiens
LLSFMNFLS

SEQ ID NO: 545777 - protein, 9 aa, Homo Sapiens
QSAMKKGGI

SEQ ID NO: 545778 - protein, 9 aa, Homo Sapiens
PINNHHGKF

SEQ ID NO: 545779 - protein, 9 aa, Homo Sapiens
KRKLNPLRH

SEQ ID NO: 545780 - protein, 9 aa, Homo Sapiens
PFRSGHPEG

SEQ ID NO: 545781 - protein, 9 aa, Homo Sapiens
VPSIPSFGK

SEQ ID NO: 545782 - protein, 9 aa, Homo Sapiens
HPSHSRLGP

SEQ ID NO: 545783 - protein, 9 aa, Homo Sapiens
LLLMGIFLA

SEQ ID NO: 545784 - protein, 9 aa, Homo Sapiens
KGVREEMTP

SEQ ID NO: 545785 - protein, 9 aa, Homo Sapiens
VLSGTVNIL

SEQ ID NO: 545786 - protein, 9 aa, Homo Sapiens
HQMCRKTWS

SEQ ID NO: 545787 - protein, 9 aa, Homo Sapiens
GAKSLKSRQ

SEQ ID NO: 545788 - protein, 9 aa, Homo Sapiens
SLQASLSRP

SEQ ID NO: 545789 - protein, 9 aa, Homo Sapiens
LNPLRHSHH

SEQ ID NO: 545790 - protein, 9 aa, Homo Sapiens
KAQGIGAWQ

SEQ ID NO: 545791 - protein, 9 aa, Homo Sapiens
QTKKGILWV

SEQ ID NO: 545792 - protein, 9 aa, Homo Sapiens
SVCPTPQVL

SEQ ID NO: 545793 - protein, 9 aa, Homo Sapiens
VSTSDQCDV

SEQ ID NO: 545794 - protein, 9 aa, Homo Sapiens
AKDGGLVTS

SEQ ID NO: 545795 - protein, 9 aa, Homo Sapiens
PYIINLSPK

SEQ ID NO: 545796 - protein, 9 aa, Homo Sapiens
NELEPTQDS

SEQ ID NO: 545797 - protein, 9 aa, Homo Sapiens
LRLYYASQD

SEQ ID NO: 545798 - protein, 9 aa, Homo Sapiens
CMFAMKNSL

SEQ ID NO: 545799 - protein, 9 aa, Homo Sapiens
EEMTPAPQE

SEQ ID NO: 545800 - protein, 9 aa, Homo Sapiens
HIVVTWPPR

SEQ ID NO: 545801 - protein, 9 aa, Homo Sapiens
KENAPESPT

SEQ ID NO: 545802 - protein, 9 aa, Homo Sapiens
ADNFVTNSK

SEQ ID NO: 545803 - protein, 9 aa, Homo Sapiens
QDSEQASTP

SEQ ID NO: 545804 - protein, 9 aa, Homo Sapiens
YKRFLEILE

SEQ ID NO: 545805 - protein, 9 aa, Homo Sapiens
KSLKSRQGN

SEQ ID NO: 545806 - protein, 9 aa, Homo Sapiens
SRSKSRSQF

SEQ ID NO: 545807 - protein, 9 aa, Homo Sapiens
AMAMGIMTE

SEQ ID NO: 545808 - protein, 9 aa, Homo Sapiens
GRLTESLCL

SEQ ID NO: 545809 - protein, 9 aa, Homo Sapiens
RALLDRHAL

SEQ ID NO: 545810 - protein, 9 aa, Homo Sapiens
DIMALGVAL

SEQ ID NO: 545811 - protein, 9 aa, Homo Sapiens
ILPNQILKG

SEQ ID NO: 545812 - protein, 9 aa, Homo Sapiens
PEKAQGIGA

SEQ ID NO: 545813 - protein, 9 aa, Homo Sapiens
PSGQHSCQP

SEQ ID NO: 545814 - protein, 9 aa, Homo Sapiens
ISGHQHPQR

SEQ ID NO: 545815 - protein, 9 aa, Homo Sapiens
CGCGHEVLS

SEQ ID NO: 545816 - protein, 9 aa, Homo Sapiens
LDRHALKQS

SEQ ID NO: 545817 - protein, 9 aa, Homo Sapiens
HLEMGYSPI

SEQ ID NO: 545818 - protein, 9 aa, Homo Sapiens
SLPGYGRNW

SEQ ID NO: 545819 - protein, 9 aa, Homo Sapiens
GYHHQVMDA

SEQ ID NO: 545820 - protein, 9 aa, Homo Sapiens
VEGCVSVCP

SEQ ID NO: 545821 - protein, 9 aa, Homo Sapiens
GLLLLMGIF

SEQ ID NO: 545822 - protein, 9 aa, Homo Sapiens
GVCMFAMKN

SEQ ID NO: 545823 - protein, 9 aa, Homo Sapiens
LMGIFLAYE

SEQ ID NO: 545824 - protein, 9 aa, Homo Sapiens
TEVTGPPNE

SEQ ID NO: 545825 - protein, 9 aa, Homo Sapiens
PSSNDCLSQ

SEQ ID NO: 545826 - protein, 9 aa, Homo Sapiens
KKPTKPPTL

SEQ ID NO: 545827 - protein, 9 aa, Homo Sapiens
GPPRPWPAG

SEQ ID NO: 545828 - protein, 9 aa, Homo Sapiens
KRFLEILEQ

SEQ ID NO: 545829 - protein, 9 aa, Homo Sapiens
PFLQCTRII

SEQ ID NO: 545830 - protein, 9 aa, Homo Sapiens
CLVNQDSEQ

SEQ ID NO: 545831 - protein, 9 aa, Homo Sapiens
EEHSLDKST

SEQ ID NO: 545832 - protein, 9 aa, Homo Sapiens
EVLCSVLFL

SEQ ID NO: 545833 - protein, 9 aa, Homo Sapiens
INLSPKRKL

SEQ ID NO: 545834 - protein, 9 aa, Homo Sapiens
RLGPMVTPH

SEQ ID NO: 545835 - protein, 9 aa, Homo Sapiens
LNLAHIVVT

SEQ ID NO: 545836 - protein, 9 aa, Homo Sapiens
RRILPNQIL

SEQ ID NO: 545837 - protein, 9 aa, Homo Sapiens
LKQAMAMGI

SEQ ID NO: 545838 - protein, 9 aa, Homo Sapiens
DKVSQQPKS

SEQ ID NO: 545839 - protein, 9 aa, Homo Sapiens
ILKGVREEM

SEQ ID NO: 545840 - protein, 9 aa, Homo Sapiens
CEDADAPSK

SEQ ID NO: 545841 - protein, 9 aa, Homo Sapiens
LNCHQMKPA

SEQ ID NO: 545842 - protein, 9 aa, Homo Sapiens
HQMKPALFS

SEQ ID NO: 545843 - protein, 9 aa, Homo Sapiens
SGQHSCQPV

SEQ ID NO: 545844 - protein, 9 aa, Homo Sapiens
HHLEMGYSP

SEQ ID NO: 545845 - protein, 9 aa, Homo Sapiens
QSKTMGVSH

SEQ ID NO: 545846 - protein, 9 aa, Homo Sapiens
PLKQPYIIN

SEQ ID NO: 545847 - protein, 9 aa, Homo Sapiens
APLTSQGSQ

SEQ ID NO: 545848 - protein, 9 aa, Homo Sapiens
PQLLSRFYY

SEQ ID NO: 545849 - protein, 9 aa, Homo Sapiens
SKTMGVSHS

SEQ ID NO: 545850 - protein, 9 aa, Homo Sapiens
GVALLIIQK

SEQ ID NO: 545851 - protein, 9 aa, Homo Sapiens
VSDTMVEPY

SEQ ID NO: 545852 - protein, 9 aa, Homo Sapiens
FAKDGGLVT

SEQ ID NO: 545853 - protein, 9 aa, Homo Sapiens
PGRFFAHSE

SEQ ID NO: 545854 - protein, 9 aa, Homo Sapiens
LSLQASLSR

SEQ ID NO: 545855 - protein, 9 aa, Homo Sapiens
IEVLCSVLF

SEQ ID NO: 545856 - protein, 9 aa, Homo Sapiens
TNVKIPEGG

SEQ ID NO: 545857 - protein, 9 aa, Homo Sapiens
NFHGVCMFA

SEQ ID NO: 545858 - protein, 9 aa, Homo Sapiens
NHHGKFHRG

SEQ ID NO: 545859 - protein, 9 aa, Homo Sapiens
CSVLFLFCY

SEQ ID NO: 545860 - protein, 9 aa, Homo Sapiens
EGCVSVCPT

SEQ ID NO: 545861 - protein, 9 aa, Homo Sapiens
KKIHSSMME

SEQ ID NO: 545862 - protein, 9 aa, Homo Sapiens
KKKILLKQK

SEQ ID NO: 545863 - protein, 9 aa, Homo Sapiens
LPNQILKGV

SEQ ID NO: 545864 - protein, 9 aa, Homo Sapiens
EALLSFMNF

SEQ ID NO: 545865 - protein, 9 aa, Homo Sapiens
LSFMNFLSS

SEQ ID NO: 545866 - protein, 9 aa, Homo Sapiens
HSRLGPMVT

SEQ ID NO: 545867 - protein, 9 aa, Homo Sapiens
PSHSRLGPM

SEQ ID NO: 545868 - protein, 9 aa, Homo Sapiens
VNQDSEQAS

SEQ ID NO: 545869 - protein, 9 aa, Homo Sapiens
TTMSVSIPM

SEQ ID NO: 545870 - protein, 9 aa, Homo Sapiens
LLSILDVIS

SEQ ID NO: 545871 - protein, 9 aa, Homo Sapiens
FLPCWGPPR

SEQ ID NO: 545872 - protein, 9 aa, Homo Sapiens
TESLCLEVR

SEQ ID NO: 545873 - protein, 9 aa, Homo Sapiens
LFVALGPTA

SEQ ID NO: 545874 - protein, 9 aa, Homo Sapiens
KNSLETDLL

SEQ ID NO: 545875 - protein, 9 aa, Homo Sapiens
LPRSPRWQG

SEQ ID NO: 545876 - protein, 9 aa, Homo Sapiens
FAINFNPEE

SEQ ID NO: 545877 - protein, 9 aa, Homo Sapiens
KPFLQCTRI

SEQ ID NO: 545878 - protein, 9 aa, Homo Sapiens
KARFLKEIK

SEQ ID NO: 545879 - protein, 9 aa, Homo Sapiens
ICPQDGMVA

SEQ ID NO: 545880 - protein, 9 aa, Homo Sapiens
FHRGYHHQV

SEQ ID NO: 545881 - protein, 9 aa, Homo Sapiens
GCVSVCPTP

SEQ ID NO: 545882 - protein, 9 aa, Homo Sapiens
ITNVKIPEG

SEQ ID NO: 545883 - protein, 9 aa, Homo Sapiens
GFAPLTSQG

SEQ ID NO: 545884 - protein, 9 aa, Homo Sapiens
GCGHEVLSG

SEQ ID NO: 545885 - protein, 9 aa, Homo Sapiens
LYYASQDND

SEQ ID NO: 545886 - protein, 9 aa, Homo Sapiens
CDVLHRHAL

SEQ ID NO: 545887 - protein, 9 aa, Homo Sapiens
KKHALNCHQ

SEQ ID NO: 545888 - protein, 9 aa, Homo Sapiens
MLLQSKTMG

SEQ ID NO: 545889 - protein, 9 aa, Homo Sapiens
VCMFAMKNS

SEQ ID NO: 545890 - protein, 9 aa, Homo Sapiens
SPEEMQGPP

SEQ ID NO: 545891 - protein, 9 aa, Homo Sapiens
ESPTQKGLR

SEQ ID NO: 545892 - protein, 9 aa, Homo Sapiens
WQGQRWIWF

SEQ ID NO: 545893 - protein, 9 aa, Homo Sapiens
EVTGPPNEL

SEQ ID NO: 545894 - protein, 9 aa, Homo Sapiens
GYSPINNHH

SEQ ID NO: 545895 - protein, 9 aa, Homo Sapiens
SDQCDVLHR

SEQ ID NO: 545896 - protein, 9 aa, Homo Sapiens
AGAPLPSSR

SEQ ID NO: 545897 - protein, 9 aa, Homo Sapiens
PSFGKSYGY

SEQ ID NO: 545898 - protein, 9 aa, Homo Sapiens
HALNCHQMK

SEQ ID NO: 545899 - protein, 9 aa, Homo Sapiens
LLKQKVQAQ

SEQ ID NO: 545900 - protein, 9 aa, Homo Sapiens
QASLSRPEA

SEQ ID NO: 545901 - protein, 9 aa, Homo Sapiens
ICPGRFFAH

SEQ ID NO: 545902 - protein, 9 aa, Homo Sapiens
SPRWQGQRW

SEQ ID NO: 545903 - protein, 9 aa, Homo Sapiens
AQNPQLIQQ

SEQ ID NO: 545904 - protein, 9 aa, Homo Sapiens
SKSRSQFSS

SEQ ID NO: 545905 - protein, 9 aa, Homo Sapiens
NIEVLCSVL

SEQ ID NO: 545906 - protein, 9 aa, Homo Sapiens
PEEMQGPPA

SEQ ID NO: 545907 - protein, 9 aa, Homo Sapiens
TMSVSIPME

SEQ ID NO: 545908 - protein, 9 aa, Homo Sapiens
TPAPQETVP

SEQ ID NO: 545909 - protein, 9 aa, Homo Sapiens
GRNWLHRPV

SEQ ID NO: 545910 - protein, 9 aa, Homo Sapiens
YDKGYQVEE

SEQ ID NO: 545911 - protein, 9 aa, Homo Sapiens
HSEVKLFIL

SEQ ID NO: 545912 - protein, 9 aa, Homo Sapiens
CVSVCPTPQ

SEQ ID NO: 545913 - protein, 9 aa, Homo Sapiens
RNWLHRPVS

SEQ ID NO: 545914 - protein, 9 aa, Homo Sapiens
KKILLKQKV

SEQ ID NO: 545915 - protein, 9 aa, Homo Sapiens
KVQAQNPQL

SEQ ID NO: 545916 - protein, 9 aa, Homo Sapiens
VPFRSGHPE

SEQ ID NO: 545917 - protein, 9 aa, Homo Sapiens
KILLKQKVQ

SEQ ID NO: 545918 - protein, 9 aa, Homo Sapiens
KDGGLVTSQ

SEQ ID NO: 545919 - protein, 9 aa, Homo Sapiens
HHGKFHRGY

SEQ ID NO: 545920 - protein, 9 aa, Homo Sapiens
FSSRSRSRS

SEQ ID NO: 545921 - protein, 9 aa, Homo Sapiens
SCQPVSTAE

SEQ ID NO: 545922 - protein, 9 aa, Homo Sapiens
ASLSRPEAR

SEQ ID NO: 545923 - protein, 9 aa, Homo Sapiens
LGVALLIIQ

SEQ ID NO: 545924 - protein, 9 aa, Homo Sapiens
LFCGCGHEV

SEQ ID NO: 545925 - protein, 9 aa, Homo Sapiens
DVVDKVSQQ

SEQ ID NO: 545926 - protein, 9 aa, Homo Sapiens
VQAYQQCFF

SEQ ID NO: 545927 - protein, 9 aa, Homo Sapiens
VEAVGILAL

SEQ ID NO: 545928 - protein, 9 aa, Homo Sapiens
NKVSKKPTK

SEQ ID NO: 545929 - protein, 9 aa, Homo Sapiens
TSQGSQQYR

SEQ ID NO: 545930 - protein, 9 aa, Homo Sapiens
SDPQLLSRF

SEQ ID NO: 545931 - protein, 9 aa, Homo Sapiens
LKIHFKKIH

SEQ ID NO: 545932 - protein, 9 aa, Homo Sapiens
KSRSQFSSR

SEQ ID NO: 545933 - protein, 9 aa, Homo Sapiens
LDIMALGVA

SEQ ID NO: 545934 - protein, 9 aa, Homo Sapiens
QASPEEMQG

SEQ ID NO: 545935 - protein, 9 aa, Homo Sapiens
DFELVNPHK

SEQ ID NO: 545936 - protein, 9 aa, Homo Sapiens
NKILKNPKK

SEQ ID NO: 545937 - protein, 9 aa, Homo Sapiens
LLSWSCVEA

SEQ ID NO: 545938 - protein, 9 aa, Homo Sapiens
QLLSRFYYA

SEQ ID NO: 545939 - protein, 9 aa, Homo Sapiens
GRFFAHSEV

SEQ ID NO: 545940 - protein, 9 aa, Homo Sapiens
AGGPKLTKS

SEQ ID NO: 545941 - protein, 9 aa, Homo Sapiens
EHSLDKSTA

SEQ ID NO: 545942 - protein, 9 aa, Homo Sapiens
NYKRFLEIL

SEQ ID NO: 545943 - protein, 9 aa, Homo Sapiens
GAPLPSSRR

SEQ ID NO: 545944 - protein, 9 aa, Homo Sapiens
KIHSSMMEK

SEQ ID NO: 545945 - protein, 9 aa, Homo Sapiens
DLLSWSCVE

SEQ ID NO: 545946 - protein, 9 aa, Homo Sapiens
HEVLSGTVN

SEQ ID NO: 545947 - protein, 9 aa, Homo Sapiens
FLQCTRIIE

SEQ ID NO: 545948 - protein, 9 aa, Homo Sapiens
FMNFLSSAA

SEQ ID NO: 545949 - protein, 9 aa, Homo Sapiens
GGLVTSQES

SEQ ID NO: 545950 - protein, 9 aa, Homo Sapiens
MSVSIPMEI

SEQ ID NO: 545951 - protein, 9 aa, Homo Sapiens
HGKFHRGYH

SEQ ID NO: 545952 - protein, 9 aa, Homo Sapiens
NLSPKRKLN

SEQ ID NO: 545953 - protein, 9 aa, Homo Sapiens
FGKSYGYHI

SEQ ID NO: 545954 - protein, 9 aa, Homo Sapiens
EMQGPPAAT

SEQ ID NO: 545955 - protein, 9 aa, Homo Sapiens
IQKKCLNKI

SEQ ID NO: 545956 - protein, 9 aa, Homo Sapiens
SLRRILPNQ

SEQ ID NO: 545957 - protein, 9 aa, Homo Sapiens
RGYHHQVMD

SEQ ID NO: 545958 - protein, 9 aa, Homo Sapiens
LSRPEARTL

SEQ ID NO: 545959 - protein, 9 aa, Homo Sapiens
TEFVLLSFY

SEQ ID NO: 545960 - protein, 9 aa, Homo Sapiens
VVASCFTAV

SEQ ID NO: 545961 - protein, 9 aa, Homo Sapiens
TSMPGVPRT

SEQ ID NO: 545962 - protein, 9 aa, Homo Sapiens
TSSSSSLAY

SEQ ID NO: 545963 - protein, 9 aa, Homo Sapiens
QTNLSPDLR

SEQ ID NO: 545964 - protein, 9 aa, Homo Sapiens
CSGSMEDLK

SEQ ID NO: 545965 - protein, 9 aa, Homo Sapiens
SPPPALPPL

SEQ ID NO: 545966 - protein, 9 aa, Homo Sapiens
PNLRRQLLP

SEQ ID NO: 545967 - protein, 9 aa, Homo Sapiens
KPAAQWQNL

SEQ ID NO: 545968 - protein, 9 aa, Homo Sapiens
STLEFAVQM

SEQ ID NO: 545969 - protein, 9 aa, Homo Sapiens
IRNPTGNFV

SEQ ID NO: 545970 - protein, 9 aa, Homo Sapiens
NAKCKKSWG

SEQ ID NO: 545971 - protein, 9 aa, Homo Sapiens
ELSGSIRVV

SEQ ID NO: 545972 - protein, 9 aa, Homo Sapiens
TTAATIFFG

SEQ ID NO: 545973 - protein, 9 aa, Homo Sapiens
EFVLLSFYD

SEQ ID NO: 545974 - protein, 9 aa, Homo Sapiens
DYLTYGFIK

SEQ ID NO: 545975 - protein, 9 aa, Homo Sapiens
SCFTAVADH

SEQ ID NO: 545976 - protein, 9 aa, Homo Sapiens
FLSAATTSS

SEQ ID NO: 545977 - protein, 9 aa, Homo Sapiens
DPNLRRQLL

SEQ ID NO: 545978 - protein, 9 aa, Homo Sapiens
PPTESSKTT

SEQ ID NO: 545979 - protein, 9 aa, Homo Sapiens
RFPFTSRCL

SEQ ID NO: 545980 - protein, 9 aa, Homo Sapiens
QIHLEGNRF

SEQ ID NO: 545981 - protein, 9 aa, Homo Sapiens
GMGPKNITK

SEQ ID NO: 545982 - protein, 9 aa, Homo Sapiens
DLSHLVAEE

SEQ ID NO: 545983 - protein, 9 aa, Homo Sapiens
PSLHAVSCC

SEQ ID NO: 545984 - protein, 9 aa, Homo Sapiens
FDNVLTMGN

SEQ ID NO: 545985 - protein, 9 aa, Homo Sapiens
LILLVSIQN

SEQ ID NO: 545986 - protein, 9 aa, Homo Sapiens
RRYNEDYLT

SEQ ID NO: 545987 - protein, 9 aa, Homo Sapiens
TRRSTFESV

SEQ ID NO: 545988 - protein, 9 aa, Homo Sapiens
KHIAYKRCI

SEQ ID NO: 545989 - protein, 9 aa, Homo Sapiens
PLLQDPNLR

SEQ ID NO: 545990 - protein, 9 aa, Homo Sapiens
VCSGSMEDL

SEQ ID NO: 545991 - protein, 9 aa, Homo Sapiens
SRDGSSSGI

SEQ ID NO: 545992 - protein, 9 aa, Homo Sapiens
ATTSSSSSL

SEQ ID NO: 545993 - protein, 9 aa, Homo Sapiens
TFESVPHWI

SEQ ID NO: 545994 - protein, 9 aa, Homo Sapiens
LVSIQNLKV

SEQ ID NO: 545995 - protein, 9 aa, Homo Sapiens
RFVLTCLAE

SEQ ID NO: 545996 - protein, 9 aa, Homo Sapiens
CVQGVVLEN

SEQ ID NO: 545997 - protein, 9 aa, Homo Sapiens
LVDVHLEDQ

SEQ ID NO: 545998 - protein, 9 aa, Homo Sapiens
LGCELSGSI

SEQ ID NO: 545999 - protein, 9 aa, Homo Sapiens
SIRVVVGVE

SEQ ID NO: 546000 - protein, 9 aa, Homo Sapiens
VPPQGCYVA

SEQ ID NO: 546001 - protein, 9 aa, Homo Sapiens
LSNAKCKKS

SEQ ID NO: 546002 - protein, 9 aa, Homo Sapiens
QGTLSTLEF

SEQ ID NO: 546003 - protein, 9 aa, Homo Sapiens
GTLSTLEFA

SEQ ID NO: 546004 - protein, 9 aa, Homo Sapiens
GCELSGSIR

SEQ ID NO: 546005 - protein, 9 aa, Homo Sapiens
PLRPSRILR

SEQ ID NO: 546006 - protein, 9 aa, Homo Sapiens
QKPGGIIVR

SEQ ID NO: 546007 - protein, 9 aa, Homo Sapiens
ATSMPGVPR

SEQ ID NO: 546008 - protein, 9 aa, Homo Sapiens
MSPEGARAH

SEQ ID NO: 546009 - protein, 9 aa, Homo Sapiens
RFRGPGAPC

SEQ ID NO: 546010 - protein, 9 aa, Homo Sapiens
GTAWLEWWH

SEQ ID NO: 546011 - protein, 9 aa, Homo Sapiens
VPSPQVPPQ

SEQ ID NO: 546012 - protein, 9 aa, Homo Sapiens
PVQIEELIQ

SEQ ID NO: 546013 - protein, 9 aa, Homo Sapiens
DAGDSSRSP

SEQ ID NO: 546014 - protein, 9 aa, Homo Sapiens
EDVVASCFT

SEQ ID NO: 546015 - protein, 9 aa, Homo Sapiens
FVLTCLAEG

SEQ ID NO: 546016 - protein, 9 aa, Homo Sapiens
PFLILLVSI

SEQ ID NO: 546017 - protein, 9 aa, Homo Sapiens
GSIRVVVGV

SEQ ID NO: 546018 - protein, 9 aa, Homo Sapiens
PSSSYYQKQ

SEQ ID NO: 546019 - protein, 9 aa, Homo Sapiens
FPTHVFPTH

SEQ ID NO: 546020 - protein, 9 aa, Homo Sapiens
GDAGDSSRS

SEQ ID NO: 546021 - protein, 9 aa, Homo Sapiens
ICVAPAMAL

SEQ ID NO: 546022 - protein, 9 aa, Homo Sapiens
CGKPFIKMS

SEQ ID NO: 546023 - protein, 9 aa, Homo Sapiens
SVPHWIHEI

SEQ ID NO: 546024 - protein, 9 aa, Homo Sapiens
QVPPQGCYV

SEQ ID NO: 546025 - protein, 9 aa, Homo Sapiens
LVAEERALR

SEQ ID NO: 546026 - protein, 9 aa, Homo Sapiens
FQNYILTLM

SEQ ID NO: 546027 - protein, 9 aa, Homo Sapiens
THVFPTHDF

SEQ ID NO: 546028 - protein, 9 aa, Homo Sapiens
LIQKPGGII

SEQ ID NO: 546029 - protein, 9 aa, Homo Sapiens
CPAGFRFRG

SEQ ID NO: 546030 - protein, 9 aa, Homo Sapiens
PTHDFPTRD

SEQ ID NO: 546031 - protein, 9 aa, Homo Sapiens
FPFTSRCLA

SEQ ID NO: 546032 - protein, 9 aa, Homo Sapiens
TTTAATIFF

SEQ ID NO: 546033 - protein, 9 aa, Homo Sapiens
LSPDLRHTT

SEQ ID NO: 546034 - protein, 9 aa, Homo Sapiens
TTSSSSSLA

SEQ ID NO: 546035 - protein, 9 aa, Homo Sapiens
DICVAPAMA

SEQ ID NO: 546036 - protein, 9 aa, Homo Sapiens
RNKHIAYKR

SEQ ID NO: 546037 - protein, 9 aa, Homo Sapiens
HSGDAGDSS

SEQ ID NO: 546038 - protein, 9 aa, Homo Sapiens
NEDYLTYGF

SEQ ID NO: 546039 - protein, 9 aa, Homo Sapiens
VAEERALRG

SEQ ID NO: 546040 - protein, 9 aa, Homo Sapiens
PALPPLFLC

SEQ ID NO: 546041 - protein, 9 aa, Homo Sapiens
CRNKHIAYK

SEQ ID NO: 546042 - protein, 9 aa, Homo Sapiens
TGMGPKNIT

SEQ ID NO: 546043 - protein, 9 aa, Homo Sapiens
AEERALRGQ

SEQ ID NO: 546044 - protein, 9 aa, Homo Sapiens
CVAPAMALT

SEQ ID NO: 546045 - protein, 9 aa, Homo Sapiens
AQWQNLKRL

SEQ ID NO: 546046 - protein, 9 aa, Homo Sapiens
ELIQKPGGI

SEQ ID NO: 546047 - protein, 9 aa, Homo Sapiens
RRSTFESVP

SEQ ID NO: 546048 - protein, 9 aa, Homo Sapiens
PLPAVSIAI

SEQ ID NO: 546049 - protein, 9 aa, Homo Sapiens
VFPTHDFPT

SEQ ID NO: 546050 - protein, 9 aa, Homo Sapiens
AATTSSSSS

SEQ ID NO: 546051 - protein, 9 aa, Homo Sapiens
RSPAAPPVS

SEQ ID NO: 546052 - protein, 9 aa, Homo Sapiens
EDLKDSMVL

SEQ ID NO: 546053 - protein, 9 aa, Homo Sapiens
HLVAEERAL

SEQ ID NO: 546054 - protein, 9 aa, Homo Sapiens
EQIRKVYGD

SEQ ID NO: 546055 - protein, 9 aa, Homo Sapiens
HHLVAADIC

SEQ ID NO: 546056 - protein, 9 aa, Homo Sapiens
QWQNLKRLG

SEQ ID NO: 546057 - protein, 9 aa, Homo Sapiens
VSHLELPLH

SEQ ID NO: 546058 - protein, 9 aa, Homo Sapiens
PTGNFVVKD

SEQ ID NO: 546059 - protein, 9 aa, Homo Sapiens
ELSWLDDVM

SEQ ID NO: 546060 - protein, 9 aa, Homo Sapiens
GVVLENGTE

SEQ ID NO: 546061 - protein, 9 aa, Homo Sapiens
VAADICVAP

SEQ ID NO: 546062 - protein, 9 aa, Homo Sapiens
VHLEDQAAG

SEQ ID NO: 546063 - protein, 9 aa, Homo Sapiens
SSRNIGVTT

SEQ ID NO: 546064 - protein, 9 aa, Homo Sapiens
EHFDNVLTM

SEQ ID NO: 546065 - protein, 9 aa, Homo Sapiens
LTYGFIKCE

SEQ ID NO: 546066 - protein, 9 aa, Homo Sapiens
ESWDHSGDA

SEQ ID NO: 546067 - protein, 9 aa, Homo Sapiens
TMGNLVFTG

SEQ ID NO: 546068 - protein, 9 aa, Homo Sapiens
NGTEVRSKM

SEQ ID NO: 546069 - protein, 9 aa, Homo Sapiens
KLTGMGPKN

SEQ ID NO: 546070 - protein, 9 aa, Homo Sapiens
HIAYKRCIT

SEQ ID NO: 546071 - protein, 9 aa, Homo Sapiens
ARELIYNQK

SEQ ID NO: 546072 - protein, 9 aa, Homo Sapiens
PPVSQALSG

SEQ ID NO: 546073 - protein, 9 aa, Homo Sapiens
TYGFIKCEK

SEQ ID NO: 546074 - protein, 9 aa, Homo Sapiens
GSMEDLKDS

SEQ ID NO: 546075 - protein, 9 aa, Homo Sapiens
SCCPLESEA

SEQ ID NO: 546076 - protein, 9 aa, Homo Sapiens
TLSTLEFAV

SEQ ID NO: 546077 - protein, 9 aa, Homo Sapiens
AGPARELIY

SEQ ID NO: 546078 - protein, 9 aa, Homo Sapiens
GSRDGSSSG

SEQ ID NO: 546079 - protein, 9 aa, Homo Sapiens
LSTLEFAVQ

SEQ ID NO: 546080 - protein, 9 aa, Homo Sapiens
NFQNYILTL

SEQ ID NO: 546081 - protein, 9 aa, Homo Sapiens
YHEKNIVLL

SEQ ID NO: 546082 - protein, 9 aa, Homo Sapiens
SWLDDVMPE

SEQ ID NO: 546083 - protein, 9 aa, Homo Sapiens
PTESSKTTT

SEQ ID NO: 546084 - protein, 9 aa, Homo Sapiens
STFESVPHW

SEQ ID NO: 546085 - protein, 9 aa, Homo Sapiens
AWLEWWHVQ

SEQ ID NO: 546086 - protein, 9 aa, Homo Sapiens
GSNFQNYIL

SEQ ID NO: 546087 - protein, 9 aa, Homo Sapiens
RRSPAAPPV

SEQ ID NO: 546088 - protein, 9 aa, Homo Sapiens
TPLRPSRIL

SEQ ID NO: 546089 - protein, 9 aa, Homo Sapiens
LTPLPAVSI

SEQ ID NO: 546090 - protein, 9 aa, Homo Sapiens
LEWAVLTNS

SEQ ID NO: 546091 - protein, 9 aa, Homo Sapiens
SANYHEKNI

SEQ ID NO: 546092 - protein, 9 aa, Homo Sapiens
SSKTTTAAT

SEQ ID NO: 546093 - protein, 9 aa, Homo Sapiens
PEGARAHLP

SEQ ID NO: 546094 - protein, 9 aa, Homo Sapiens
IYKLTGMGP

SEQ ID NO: 546095 - protein, 9 aa, Homo Sapiens
ALEWAVLTN

SEQ ID NO: 546096 - protein, 9 aa, Homo Sapiens
WDHSGDAGD

SEQ ID NO: 546097 - protein, 9 aa, Homo Sapiens
VSCCPLESE

SEQ ID NO: 546098 - protein, 9 aa, Homo Sapiens
ASCFTAVAD

SEQ ID NO: 546099 - protein, 9 aa, Homo Sapiens
NYHEKNIVL

SEQ ID NO: 546100 - protein, 9 aa, Homo Sapiens
PVSQALSGL

SEQ ID NO: 546101 - protein, 9 aa, Homo Sapiens
MRFPFTSRC

SEQ ID NO: 546102 - protein, 9 aa, Homo Sapiens
PAPSLHAVS

SEQ ID NO: 546103 - protein, 9 aa, Homo Sapiens
QDPNLRRQL

SEQ ID NO: 546104 - protein, 9 aa, Homo Sapiens
NKHIAYKRC

SEQ ID NO: 546105 - protein, 9 aa, Homo Sapiens
DDVMPESKK

SEQ ID NO: 546106 - protein, 9 aa, Homo Sapiens
DNVLTMGNL

SEQ ID NO: 546107 - protein, 9 aa, Homo Sapiens
LPPLFLCGW

SEQ ID NO: 546108 - protein, 9 aa, Homo Sapiens
RQRKGSRDG

SEQ ID NO: 546109 - protein, 9 aa, Homo Sapiens
YLTYGFIKC

SEQ ID NO: 546110 - protein, 9 aa, Homo Sapiens
SSYYQKQQP

SEQ ID NO: 546111 - protein, 9 aa, Homo Sapiens
QSPPPALPP

SEQ ID NO: 546112 - protein, 9 aa, Homo Sapiens
ILRATSMPG

SEQ ID NO: 546113 - protein, 9 aa, Homo Sapiens
NIGVTTPLR

SEQ ID NO: 546114 - protein, 9 aa, Homo Sapiens
AADICVAPA

SEQ ID NO: 546115 - protein, 9 aa, Homo Sapiens
LTMGNLVFT

SEQ ID NO: 546116 - protein, 9 aa, Homo Sapiens
ESVENWQSS

SEQ ID NO: 546117 - protein, 9 aa, Homo Sapiens
SLCEQIRKV

SEQ ID NO: 546118 - protein, 9 aa, Homo Sapiens
RRQRKGSRD

SEQ ID NO: 546119 - protein, 9 aa, Homo Sapiens
PDLRHTTLS

SEQ ID NO: 546120 - protein, 9 aa, Homo Sapiens
HLEDQAAGS

SEQ ID NO: 546121 - protein, 9 aa, Homo Sapiens
LENGTEVRS

SEQ ID NO: 546122 - protein, 9 aa, Homo Sapiens
SIRNPTGNF

SEQ ID NO: 546123 - protein, 9 aa, Homo Sapiens
WCTLVDVHL

SEQ ID NO: 546124 - protein, 9 aa, Homo Sapiens
PRRQRKGSR

SEQ ID NO: 546125 - protein, 9 aa, Homo Sapiens
SPQVPPQGC

SEQ ID NO: 546126 - protein, 9 aa, Homo Sapiens
NSTRMWCLS

SEQ ID NO: 546127 - protein, 9 aa, Homo Sapiens
RNPTGNFVV

SEQ ID NO: 546128 - protein, 9 aa, Homo Sapiens
KQQPSANFQ

SEQ ID NO: 546129 - protein, 9 aa, Homo Sapiens
TNLSPDLRH

SEQ ID NO: 546130 - protein, 9 aa, Homo Sapiens
ACPAGFRFR

SEQ ID NO: 546131 - protein, 9 aa, Homo Sapiens
WHVQPTLDL

SEQ ID NO: 546132 - protein, 9 aa, Homo Sapiens
FTAVADHHL

SEQ ID NO: 546133 - protein, 9 aa, Homo Sapiens
CACPAGFRF

SEQ ID NO: 546134 - protein, 9 aa, Homo Sapiens
NFVVKDLAK

SEQ ID NO: 546135 - protein, 9 aa, Homo Sapiens
SNFQNYILT

SEQ ID NO: 546136 - protein, 9 aa, Homo Sapiens
DVHLEDQAA

SEQ ID NO: 546137 - protein, 9 aa, Homo Sapiens
LHAVSCCPL

SEQ ID NO: 546138 - protein, 9 aa, Homo Sapiens
IQKPGGIIV

SEQ ID NO: 546139 - protein, 9 aa, Homo Sapiens
RYNEDYLTY

SEQ ID NO: 546140 - protein, 9 aa, Homo Sapiens
PAGFRFRGP

SEQ ID NO: 546141 - protein, 9 aa, Homo Sapiens
ADICVAPAM

SEQ ID NO: 546142 - protein, 9 aa, Homo Sapiens
RKGSRDGSS

SEQ ID NO: 546143 - protein, 9 aa, Homo Sapiens
ERALRGQLE

SEQ ID NO: 546144 - protein, 9 aa, Homo Sapiens
TPLPAVSIA

SEQ ID NO: 546145 - protein, 9 aa, Homo Sapiens
RGAGPAREL

SEQ ID NO: 546146 - protein, 9 aa, Homo Sapiens
FRGPGAPCQ

SEQ ID NO: 546147 - protein, 9 aa, Homo Sapiens
SPAAPPVSQ

SEQ ID NO: 546148 - protein, 9 aa, Homo Sapiens
VSIQNLKVL

SEQ ID NO: 546149 - protein, 9 aa, Homo Sapiens
GPARELIYN

SEQ ID NO: 546150 - protein, 9 aa, Homo Sapiens
YKLTGMGPK

SEQ ID NO: 546151 - protein, 9 aa, Homo Sapiens
STRMWCLSS

SEQ ID NO: 546152 - protein, 9 aa, Homo Sapiens
LCEQIRKVY

SEQ ID NO: 546153 - protein, 9 aa, Homo Sapiens
TSLCEQIRK

SEQ ID NO: 546154 - protein, 9 aa, Homo Sapiens
PQVPPQGCY

SEQ ID NO: 546155 - protein, 9 aa, Homo Sapiens
LNSTRMWCL

SEQ ID NO: 546156 - protein, 9 aa, Homo Sapiens
CQVCRNKHI

SEQ ID NO: 546157 - protein, 9 aa, Homo Sapiens
AAPPVSQAL

SEQ ID NO: 546158 - protein, 9 aa, Homo Sapiens
PAVSIAIRF

SEQ ID NO: 546159 - protein, 9 aa, Homo Sapiens
GTEPKESVE

SEQ ID NO: 546160 - protein, 9 aa, Homo Sapiens
VQGVVLENG

SEQ ID NO: 546161 - protein, 9 aa, Homo Sapiens
VASCFTAVA

SEQ ID NO: 546162 - protein, 9 aa, Homo Sapiens
TEPKESVEN

SEQ ID NO: 546163 - protein, 9 aa, Homo Sapiens
PTHVFPTHD

SEQ ID NO: 546164 - protein, 9 aa, Homo Sapiens
RPSRILRAT

SEQ ID NO: 546165 - protein, 9 aa, Homo Sapiens
PLFLCGWLC

SEQ ID NO: 546166 - protein, 9 aa, Homo Sapiens
LSGSIRVVV

SEQ ID NO: 546167 - protein, 9 aa, Homo Sapiens
SGSMEDLKD

SEQ ID NO: 546168 - protein, 9 aa, Homo Sapiens
YYQKQQPSA

SEQ ID NO: 546169 - protein, 9 aa, Homo Sapiens
PARELIYNQ

SEQ ID NO: 546170 - protein, 9 aa, Homo Sapiens
RELSWLDDV

SEQ ID NO: 546171 - protein, 9 aa, Homo Sapiens
FLILLVSIQ

SEQ ID NO: 546172 - protein, 9 aa, Homo Sapiens
TGNFVVKDL

SEQ ID NO: 546173 - protein, 9 aa, Homo Sapiens
WCLSSRNIG

SEQ ID NO: 546174 - protein, 9 aa, Homo Sapiens
WAVLTNSFD

SEQ ID NO: 546175 - protein, 9 aa, Homo Sapiens
SYYQKQQPS

SEQ ID NO: 546176 - protein, 9 aa, Homo Sapiens
RATSMPGVP

SEQ ID NO: 546177 - protein, 9 aa, Homo Sapiens
SILLNSTRM

SEQ ID NO: 546178 - protein, 9 aa, Homo Sapiens
KPFIKMSNL

SEQ ID NO: 546179 - protein, 9 aa, Homo Sapiens
PFIKMSNLI

SEQ ID NO: 546180 - protein, 9 aa, Homo Sapiens
KCNECGKPF

SEQ ID NO: 546181 - protein, 9 aa, Homo Sapiens
VMPESKKKK

SEQ ID NO: 546182 - protein, 9 aa, Homo Sapiens
MGPKNITKK

SEQ ID NO: 546183 - protein, 9 aa, Homo Sapiens
KTTTAATIF

SEQ ID NO: 546184 - protein, 9 aa, Homo Sapiens
GNFVVKDLA

SEQ ID NO: 546185 - protein, 9 aa, Homo Sapiens
PSPQVPPQG

SEQ ID NO: 546186 - protein, 9 aa, Homo Sapiens
CTLVDVHLE

SEQ ID NO: 546187 - protein, 9 aa, Homo Sapiens
PQGCYVAKE

SEQ ID NO: 546188 - protein, 9 aa, Homo Sapiens
RRQLLPALQ

SEQ ID NO: 546189 - protein, 9 aa, Homo Sapiens
RNIGVTTPL

SEQ ID NO: 546190 - protein, 9 aa, Homo Sapiens
RILRATSMP

SEQ ID NO: 546191 - protein, 9 aa, Homo Sapiens
LLVSIQNLK

SEQ ID NO: 546192 - protein, 9 aa, Homo Sapiens
MWCLSSRNI

SEQ ID NO: 546193 - protein, 9 aa, Homo Sapiens
SRNIGVTTP

SEQ ID NO: 546194 - protein, 9 aa, Homo Sapiens
SHLVAEERA

SEQ ID NO: 546195 - protein, 9 aa, Homo Sapiens
AGFRFRGPG

SEQ ID NO: 546196 - protein, 9 aa, Homo Sapiens
EWAVLTNSF

SEQ ID NO: 546197 - protein, 9 aa, Homo Sapiens
GFRFRGPGA

SEQ ID NO: 546198 - protein, 9 aa, Homo Sapiens
VDVHLEDQA

SEQ ID NO: 546199 - protein, 9 aa, Homo Sapiens
LSSRNIGVT

SEQ ID NO: 546200 - protein, 9 aa, Homo Sapiens
LPLLSNAKC

SEQ ID NO: 546201 - protein, 9 aa, Homo Sapiens
LSHLVAEER

SEQ ID NO: 546202 - protein, 9 aa, Homo Sapiens
LSSILLNST

SEQ ID NO: 546203 - protein, 9 aa, Homo Sapiens
YKCNECGKP

SEQ ID NO: 546204 - protein, 9 aa, Homo Sapiens
VCRNKHIAY

SEQ ID NO: 546205 - protein, 9 aa, Homo Sapiens
FPTHDFPTR

SEQ ID NO: 546206 - protein, 9 aa, Homo Sapiens
HVFPTHDFP

SEQ ID NO: 546207 - protein, 9 aa, Homo Sapiens
PSIRNPTGN

SEQ ID NO: 546208 - protein, 9 aa, Homo Sapiens
LRATSMPGV

SEQ ID NO: 546209 - protein, 9 aa, Homo Sapiens
PLTPLPAVS

SEQ ID NO: 546210 - protein, 9 aa, Homo Sapiens
NSFDTVWRI

SEQ ID NO: 546211 - protein, 9 aa, Homo Sapiens
SKTTTAATI

SEQ ID NO: 546212 - protein, 9 aa, Homo Sapiens
SPDLRHTTL

SEQ ID NO: 546213 - protein, 9 aa, Homo Sapiens
KGSRDGSSS

SEQ ID NO: 546214 - protein, 9 aa, Homo Sapiens
SLHAVSCCP

SEQ ID NO: 546215 - protein, 9 aa, Homo Sapiens
ENGTEVRSK

SEQ ID NO: 546216 - protein, 9 aa, Homo Sapiens
TPRRQRKGS

SEQ ID NO: 546217 - protein, 9 aa, Homo Sapiens
DLKDSMVLA

SEQ ID NO: 546218 - protein, 9 aa, Homo Sapiens
LSFYDIPEL

SEQ ID NO: 546219 - protein, 9 aa, Homo Sapiens
NQGTLSTLE

SEQ ID NO: 546220 - protein, 9 aa, Homo Sapiens
TAWLEWWHV

SEQ ID NO: 546221 - protein, 9 aa, Homo Sapiens
SVENWQSSK

SEQ ID NO: 546222 - protein, 9 aa, Homo Sapiens
IKPAAQWQN

SEQ ID NO: 546223 - protein, 9 aa, Homo Sapiens
APSLHAVSC

SEQ ID NO: 546224 - protein, 9 aa, Homo Sapiens
SSSSSLAYP

SEQ ID NO: 546225 - protein, 9 aa, Homo Sapiens
LVAADICVA

SEQ ID NO: 546226 - protein, 9 aa, Homo Sapiens
AAQWQNLKR

SEQ ID NO: 546227 - protein, 9 aa, Homo Sapiens
EERALRGQL

SEQ ID NO: 546228 - protein, 9 aa, Homo Sapiens
QGVVLENGT

SEQ ID NO: 546229 - protein, 9 aa, Homo Sapiens
DLRHTTLSP

SEQ ID NO: 546230 - protein, 9 aa, Homo Sapiens
QWFRGAGPA

SEQ ID NO: 546231 - protein, 9 aa, Homo Sapiens
ALPLLSNAK

SEQ ID NO: 546232 - protein, 9 aa, Homo Sapiens
QIRKVYGDL

SEQ ID NO: 546233 - protein, 9 aa, Homo Sapiens
NPTGNFVVK

SEQ ID NO: 546234 - protein, 9 aa, Homo Sapiens
ILLVSIQNL

SEQ ID NO: 546235 - protein, 9 aa, Homo Sapiens
HEKNIVLLK

SEQ ID NO: 546236 - protein, 9 aa, Homo Sapiens
CFTAVADHH

SEQ ID NO: 546237 - protein, 9 aa, Homo Sapiens
VVSAHGSNF

SEQ ID NO: 546238 - protein, 9 aa, Homo Sapiens
AVSIAIRFT

SEQ ID NO: 546239 - protein, 9 aa, Homo Sapiens
SAHGSNFQN

SEQ ID NO: 546240 - protein, 9 aa, Homo Sapiens
LLQDPNLRR

SEQ ID NO: 546241 - protein, 9 aa, Homo Sapiens
SGTEPKESV

SEQ ID NO: 546242 - protein, 9 aa, Homo Sapiens
SRILRATSM

SEQ ID NO: 546243 - protein, 9 aa, Homo Sapiens
PPALPPLFL

SEQ ID NO: 546244 - protein, 9 aa, Homo Sapiens
NTSLCEQIR

SEQ ID NO: 546245 - protein, 9 aa, Homo Sapiens
SIQNLKVLS

SEQ ID NO: 546246 - protein, 9 aa, Homo Sapiens
NLKRLGEER

SEQ ID NO: 546247 - protein, 9 aa, Homo Sapiens
CELSGSIRV

SEQ ID NO: 546248 - protein, 9 aa, Homo Sapiens
MEDLKDSMV

SEQ ID NO: 546249 - protein, 9 aa, Homo Sapiens
APPVSQALS

SEQ ID NO: 546250 - protein, 9 aa, Homo Sapiens
LSWLDDVMP

SEQ ID NO: 546251 - protein, 9 aa, Homo Sapiens
PPQGCYVAK

SEQ ID NO: 546252 - protein, 9 aa, Homo Sapiens
EEIYKLTGM

SEQ ID NO: 546253 - protein, 9 aa, Homo Sapiens
LLNSTRMWC

SEQ ID NO: 546254 - protein, 9 aa, Homo Sapiens
ILLNSTRMW

SEQ ID NO: 546255 - protein, 9 aa, Homo Sapiens
LEDQAAGSV

SEQ ID NO: 546256 - protein, 9 aa, Homo Sapiens
VTTPLRPSR

SEQ ID NO: 546257 - protein, 9 aa, Homo Sapiens
QGCYVAKEA

SEQ ID NO: 546258 - protein, 9 aa, Homo Sapiens
AHGSNFQNY

SEQ ID NO: 546259 - protein, 9 aa, Homo Sapiens
SFYDIPELH

SEQ ID NO: 546260 - protein, 9 aa, Homo Sapiens
DHSGDAGDS

SEQ ID NO: 546261 - protein, 9 aa, Homo Sapiens
CEQIRKVYG

SEQ ID NO: 546262 - protein, 9 aa, Homo Sapiens
TRMWCLSSR

SEQ ID NO: 546263 - protein, 9 aa, Homo Sapiens
LRRQLLPAL

SEQ ID NO: 546264 - protein, 9 aa, Homo Sapiens
SSSYYQKQQ

SEQ ID NO: 546265 - protein, 9 aa, Homo Sapiens
VLTMGNLVF

SEQ ID NO: 546266 - protein, 9 aa, Homo Sapiens
VQIEELIQK

SEQ ID NO: 546267 - protein, 9 aa, Homo Sapiens
EELIQKPGG

SEQ ID NO: 546268 - protein, 9 aa, Homo Sapiens
PAAQWQNLK

SEQ ID NO: 546269 - protein, 9 aa, Homo Sapiens
TLVDVHLED

SEQ ID NO: 546270 - protein, 9 aa, Homo Sapiens
IGVTTPLRP

SEQ ID NO: 546271 - protein, 9 aa, Homo Sapiens
PFTSRCLAL

SEQ ID NO: 546272 - protein, 9 aa, Homo Sapiens
KSANYHEKN

SEQ ID NO: 546273 - protein, 9 aa, Homo Sapiens
YNEDYLTYG

SEQ ID NO: 546274 - protein, 9 aa, Homo Sapiens
EDYLTYGFI

SEQ ID NO: 546275 - protein, 9 aa, Homo Sapiens
HFDNVLTMG

SEQ ID NO: 546276 - protein, 9 aa, Homo Sapiens
NRFVLTCLA

SEQ ID NO: 546277 - protein, 9 aa, Homo Sapiens
SPEGARAHL

SEQ ID NO: 546278 - protein, 9 aa, Homo Sapiens
RSTFESVPH

SEQ ID NO: 546279 - protein, 9 aa, Homo Sapiens
DVVASCFTA

SEQ ID NO: 546280 - protein, 9 aa, Homo Sapiens
KESVENWQS

SEQ ID NO: 546281 - protein, 9 aa, Homo Sapiens
FRGAGPARE

SEQ ID NO: 546282 - protein, 9 aa, Homo Sapiens
EGNRFVLTC

SEQ ID NO: 546283 - protein, 9 aa, Homo Sapiens
AVLTNSFDT

SEQ ID NO: 546284 - protein, 9 aa, Homo Sapiens
ALPPLFLCG

SEQ ID NO: 546285 - protein, 9 aa, Homo Sapiens
NVLTMGNLV

SEQ ID NO: 546286 - protein, 9 aa, Homo Sapiens
LEWWHVQPT

SEQ ID NO: 546287 - protein, 9 aa, Homo Sapiens
RMWCLSSRN

SEQ ID NO: 546288 - protein, 9 aa, Homo Sapiens
AKCKKSWGR

SEQ ID NO: 546289 - protein, 9 aa, Homo Sapiens
CLSSRNIGV

SEQ ID NO: 546290 - protein, 9 aa, Homo Sapiens
PLLSNAKCK

SEQ ID NO: 546291 - protein, 9 aa, Homo Sapiens
PKESVENWQ

SEQ ID NO: 546292 - protein, 9 aa, Homo Sapiens
FVLLSFYDI

SEQ ID NO: 546293 - protein, 9 aa, Homo Sapiens
MGNLVFTGI

SEQ ID NO: 546294 - protein, 9 aa, Homo Sapiens
VLTNSFDTV

SEQ ID NO: 546295 - protein, 9 aa, Homo Sapiens
LEGNRFVLT

SEQ ID NO: 546296 - protein, 9 aa, Homo Sapiens
HLEGNRFVL

SEQ ID NO: 546297 - protein, 9 aa, Homo Sapiens
SWDHSGDAG

SEQ ID NO: 546298 - protein, 9 aa, Homo Sapiens
QRKGSRDGS

SEQ ID NO: 546299 - protein, 9 aa, Homo Sapiens
KSGTEPKES

SEQ ID NO: 546300 - protein, 9 aa, Homo Sapiens
RHTTLSPEL

SEQ ID NO: 546301 - protein, 9 aa, Homo Sapiens
DVMPESKKK

SEQ ID NO: 546302 - protein, 9 aa, Homo Sapiens
LDDVMPESK

SEQ ID NO: 546303 - protein, 9 aa, Homo Sapiens
QNLKRLGEE

SEQ ID NO: 546304 - protein, 9 aa, Homo Sapiens
AVSCCPLES

SEQ ID NO: 546305 - protein, 9 aa, Homo Sapiens
LTGMGPKNI

SEQ ID NO: 546306 - protein, 9 aa, Homo Sapiens
SESWDHSGD

SEQ ID NO: 546307 - protein, 9 aa, Homo Sapiens
LTNSFDTVW

SEQ ID NO: 546308 - protein, 9 aa, Homo Sapiens
TTPLRPSRI

SEQ ID NO: 546309 - protein, 9 aa, Homo Sapiens
SGNQGTLST

SEQ ID NO: 546310 - protein, 9 aa, Homo Sapiens
PSRILRATS

SEQ ID NO: 546311 - protein, 9 aa, Homo Sapiens
KCKKSWGRR

SEQ ID NO: 546312 - protein, 9 aa, Homo Sapiens
TNSFDTVWR

SEQ ID NO: 546313 - protein, 9 aa, Homo Sapiens
YQKQQPSAN

SEQ ID NO: 546314 - protein, 9 aa, Homo Sapiens
MNTSLCEQI

SEQ ID NO: 546315 - protein, 9 aa, Homo Sapiens
FRFRGPGAP

SEQ ID NO: 546316 - protein, 9 aa, Homo Sapiens
SGSIRVVVG

SEQ ID NO: 546317 - protein, 9 aa, Homo Sapiens
WFRGAGPAR

SEQ ID NO: 546318 - protein, 9 aa, Homo Sapiens
SNAKCKKSW

SEQ ID NO: 546319 - protein, 9 aa, Homo Sapiens
LQDPNLRRQ

SEQ ID NO: 546320 - protein, 9 aa, Homo Sapiens
QVCRNKHIA

SEQ ID NO: 546321 - protein, 9 aa, Homo Sapiens
ARRSPAAPP

SEQ ID NO: 546322 - protein, 9 aa, Homo Sapiens
IHLEGNRFV

SEQ ID NO: 546323 - protein, 9 aa, Homo Sapiens
NLSPDLRHT

SEQ ID NO: 546324 - protein, 9 aa, Homo Sapiens
ECGKPFIKM

SEQ ID NO: 546325 - protein, 9 aa, Homo Sapiens
VPHWIHEIE

SEQ ID NO: 546326 - protein, 9 aa, Homo Sapiens
SSILLNSTR

SEQ ID NO: 546327 - protein, 9 aa, Homo Sapiens
GAGPARELI

SEQ ID NO: 546328 - protein, 9 aa, Homo Sapiens
PAAPPVSQA

SEQ ID NO: 546329 - protein, 9 aa, Homo Sapiens
WLDDVMPES

SEQ ID NO: 546330 - protein, 9 aa, Homo Sapiens
LCQVCRNKH

SEQ ID NO: 546331 - protein, 9 aa, Homo Sapiens
SGDAGDSSR

SEQ ID NO: 546332 - protein, 9 aa, Homo Sapiens
LLSFYDIPE

SEQ ID NO: 546333 - protein, 9 aa, Homo Sapiens
SSSSLAYPP

SEQ ID NO: 546334 - protein, 9 aa, Homo Sapiens
PPPALPPLF

SEQ ID NO: 546335 - protein, 9 aa, Homo Sapiens
WWHVQPTLD

SEQ ID NO: 546336 - protein, 9 aa, Homo Sapiens
VLENGTEVR

SEQ ID NO: 546337 - protein, 9 aa, Homo Sapiens
ANYHEKNIV

SEQ ID NO: 546338 - protein, 9 aa, Homo Sapiens
EWWHVQPTL

SEQ ID NO: 546339 - protein, 9 aa, Homo Sapiens
EPKESVENW

SEQ ID NO: 546340 - protein, 9 aa, Homo Sapiens
GKSANYHEK

SEQ ID NO: 546341 - protein, 9 aa, Homo Sapiens
VVLENGTEV

SEQ ID NO: 546342 - protein, 9 aa, Homo Sapiens
EKNIVLLKN

SEQ ID NO: 546343 - protein, 9 aa, Homo Sapiens
TITEFVLLS

SEQ ID NO: 546344 - protein, 9 aa, Homo Sapiens
PPLFLCGWL

SEQ ID NO: 546345 - protein, 9 aa, Homo Sapiens
SMEDLKDSM

SEQ ID NO: 546346 - protein, 9 aa, Homo Sapiens
LRPSRILRA

SEQ ID NO: 546347 - protein, 9 aa, Homo Sapiens
IRVVVGVEA

SEQ ID NO: 546348 - protein, 9 aa, Homo Sapiens
LPFLILLVS

SEQ ID NO: 546349 - protein, 9 aa, Homo Sapiens
HAVSCCPLE

SEQ ID NO: 546350 - protein, 9 aa, Homo Sapiens
GNQGTLSTL

SEQ ID NO: 546351 - protein, 9 aa, Homo Sapiens
NECGKPFIK

SEQ ID NO: 546352 - protein, 9 aa, Homo Sapiens
IEELIQKPG

SEQ ID NO: 546353 - protein, 9 aa, Homo Sapiens
EIYKLTGMG

SEQ ID NO: 546354 - protein, 9 aa, Homo Sapiens
TESSKTTTA

SEQ ID NO: 546355 - protein, 9 aa, Homo Sapiens
QIEELIQKP

SEQ ID NO: 546356 - protein, 9 aa, Homo Sapiens
VLLSFYDIP

SEQ ID NO: 546357 - protein, 9 aa, Homo Sapiens
GGTAWLEWW

SEQ ID NO: 546358 - protein, 9 aa, Homo Sapiens
FESVPHWIH

SEQ ID NO: 546359 - protein, 9 aa, Homo Sapiens
WLEWWHVQP

SEQ ID NO: 546360 - protein, 9 aa, Homo Sapiens
LPAVSIAIR

SEQ ID NO: 546361 - protein, 9 aa, Homo Sapiens
LLSNAKCKK

SEQ ID NO: 546362 - protein, 9 aa, Homo Sapiens
GKPFIKMSN

SEQ ID NO: 546363 - protein, 9 aa, Homo Sapiens
TAVADHHLA

SEQ ID NO: 546364 - protein, 9 aa, Homo Sapiens
NLRRQLLPA

SEQ ID NO: 546365 - protein, 9 aa, Homo Sapiens
QMNTSLCEQ

SEQ ID NO: 546366 - protein, 9 aa, Homo Sapiens
EGKSANYHE

SEQ ID NO: 546367 - protein, 9 aa, Homo Sapiens
VSAHGSNFQ

SEQ ID NO: 546368 - protein, 9 aa, Homo Sapiens
SAATTSSSS

SEQ ID NO: 546369 - protein, 9 aa, Homo Sapiens
ESSKTTTAA

SEQ ID NO: 546370 - protein, 9 aa, Homo Sapiens
PPSSSYYQK

SEQ ID NO: 546371 - protein, 9 aa, Homo Sapiens
ITEFVLLSF

SEQ ID NO: 546372 - protein, 9 aa, Homo Sapiens
HLVAADICV

SEQ ID NO: 546373 - protein, 9 aa, Homo Sapiens
LRHTTLSPE

SEQ ID NO: 546374 - protein, 9 aa, Homo Sapiens
GVTTPLRPS

SEQ ID NO: 546375 - protein, 9 aa, Homo Sapiens
CPLTPLPAV

SEQ ID NO: 546376 - protein, 9 aa, Homo Sapiens
GCPLTPLPA

SEQ ID NO: 546377 - protein, 9 aa, Homo Sapiens
DSGNQGTLS

SEQ ID NO: 546378 - protein, 9 aa, Homo Sapiens
WQNLKRLGE

SEQ ID NO: 546379 - protein, 9 aa, Homo Sapiens
HGSNFQNYI

SEQ ID NO: 546380 - protein, 9 aa, Homo Sapiens
ESVPHWIHE

SEQ ID NO: 546381 - protein, 9 aa, Homo Sapiens
GNRFVLTCL

SEQ ID NO: 546382 - protein, 9 aa, Homo Sapiens
QKQQPSANF

SEQ ID NO: 546383 - protein, 9 aa, Homo Sapiens
FVCSGSMED

SEQ ID NO: 546384 - protein, 9 aa, Homo Sapiens
RPAQGSYFV

SEQ ID NO: 546385 - protein, 9 aa, Homo Sapiens
WHHLLHPRR

SEQ ID NO: 546386 - protein, 9 aa, Homo Sapiens
KCHHMRANQ

SEQ ID NO: 546387 - protein, 9 aa, Homo Sapiens
IRTDYTLLD

SEQ ID NO: 546388 - protein, 9 aa, Homo Sapiens
VETNIPRHP

SEQ ID NO: 546389 - protein, 9 aa, Homo Sapiens
IVYPSATDE

SEQ ID NO: 546390 - protein, 9 aa, Homo Sapiens
QDTHLPSDD

SEQ ID NO: 546391 - protein, 9 aa, Homo Sapiens
YVKAINIWM

SEQ ID NO: 546392 - protein, 9 aa, Homo Sapiens
SHNKAISYL

SEQ ID NO: 546393 - protein, 9 aa, Homo Sapiens
RSLAARRAT

SEQ ID NO: 546394 - protein, 9 aa, Homo Sapiens
FDVSAFNAG

SEQ ID NO: 546395 - protein, 9 aa, Homo Sapiens
DTHLPSDDS

SEQ ID NO: 546396 - protein, 9 aa, Homo Sapiens
YFVNKRAYA

SEQ ID NO: 546397 - protein, 9 aa, Homo Sapiens
LKSQSSFKS

SEQ ID NO: 546398 - protein, 9 aa, Homo Sapiens
TRLQELQSA

SEQ ID NO: 546399 - protein, 9 aa, Homo Sapiens
LCGMREMRA

SEQ ID NO: 546400 - protein, 9 aa, Homo Sapiens
VCDHGTLER

SEQ ID NO: 546401 - protein, 9 aa, Homo Sapiens
KAQAISFLH

SEQ ID NO: 546402 - protein, 9 aa, Homo Sapiens
DEFVAKGHL

SEQ ID NO: 546403 - protein, 9 aa, Homo Sapiens
DNREPRGAV

SEQ ID NO: 546404 - protein, 9 aa, Homo Sapiens
MLQRPTKEL

SEQ ID NO: 546405 - protein, 9 aa, Homo Sapiens
LIGLSHEEA

SEQ ID NO: 546406 - protein, 9 aa, Homo Sapiens
LYGDLRDGH

SEQ ID NO: 546407 - protein, 9 aa, Homo Sapiens
RRATRAKLM

SEQ ID NO: 546408 - protein, 9 aa, Homo Sapiens
QGYGSPRYA

SEQ ID NO: 546409 - protein, 9 aa, Homo Sapiens
TRAKLMIPM

SEQ ID NO: 546410 - protein, 9 aa, Homo Sapiens
LPHNVSSHI

SEQ ID NO: 546411 - protein, 9 aa, Homo Sapiens
TAVEFLAHV

SEQ ID NO: 546412 - protein, 9 aa, Homo Sapiens
MPLSIAEGK

SEQ ID NO: 546413 - protein, 9 aa, Homo Sapiens
SSFSSVGES

SEQ ID NO: 546414 - protein, 9 aa, Homo Sapiens
NFFPSGINF

SEQ ID NO: 546415 - protein, 9 aa, Homo Sapiens
LLIGLSHEE

SEQ ID NO: 546416 - protein, 9 aa, Homo Sapiens
LWSNFWGAM

SEQ ID NO: 546417 - protein, 9 aa, Homo Sapiens
YQRAFFWTA

SEQ ID NO: 546418 - protein, 9 aa, Homo Sapiens
KNNFLKERA

SEQ ID NO: 546419 - protein, 9 aa, Homo Sapiens
VLYQRAFFW

SEQ ID NO: 546420 - protein, 9 aa, Homo Sapiens
DTAFNCYVE

SEQ ID NO: 546421 - protein, 9 aa, Homo Sapiens
LLLAGVSFS

SEQ ID NO: 546422 - protein, 9 aa, Homo Sapiens
QAQAASEEE

SEQ ID NO: 546423 - protein, 9 aa, Homo Sapiens
KLLLAGVSF

SEQ ID NO: 546424 - protein, 9 aa, Homo Sapiens
NIPRHPGFG

SEQ ID NO: 546425 - protein, 9 aa, Homo Sapiens
SRVVKREGS

SEQ ID NO: 546426 - protein, 9 aa, Homo Sapiens
INFSAWGNN

SEQ ID NO: 546427 - protein, 9 aa, Homo Sapiens
LGVYEADLL

SEQ ID NO: 546428 - protein, 9 aa, Homo Sapiens
PVLCVVMNS

SEQ ID NO: 546429 - protein, 9 aa, Homo Sapiens
ANTSNQDAL

SEQ ID NO: 546430 - protein, 9 aa, Homo Sapiens
AVEFLAHVG

SEQ ID NO: 546431 - protein, 9 aa, Homo Sapiens
FNFFPSGIN

SEQ ID NO: 546432 - protein, 9 aa, Homo Sapiens
RGEGLSEEE

SEQ ID NO: 546433 - protein, 9 aa, Homo Sapiens
GGGRGPSAT

SEQ ID NO: 546434 - protein, 9 aa, Homo Sapiens
HHREECHIH

SEQ ID NO: 546435 - protein, 9 aa, Homo Sapiens
RATRAKLMI

SEQ ID NO: 546436 - protein, 9 aa, Homo Sapiens
QFFSWWNSH

SEQ ID NO: 546437 - protein, 9 aa, Homo Sapiens
VYEADLLKT

SEQ ID NO: 546438 - protein, 9 aa, Homo Sapiens
KLLELIGHS

SEQ ID NO: 546439 - protein, 9 aa, Homo Sapiens
PKHKEVHVE

SEQ ID NO: 546440 - protein, 9 aa, Homo Sapiens
IESMPLSIA

SEQ ID NO: 546441 - protein, 9 aa, Homo Sapiens
NLQKLSSDR

SEQ ID NO: 546442 - protein, 9 aa, Homo Sapiens
YLTVMLQRP

SEQ ID NO: 546443 - protein, 9 aa, Homo Sapiens
RVVKREGSR

SEQ ID NO: 546444 - protein, 9 aa, Homo Sapiens
RYIRTDYTL

SEQ ID NO: 546445 - protein, 9 aa, Homo Sapiens
VSDHQPEQR

SEQ ID NO: 546446 - protein, 9 aa, Homo Sapiens
FNAGLFGIY

SEQ ID NO: 546447 - protein, 9 aa, Homo Sapiens
GARYIRTDY

SEQ ID NO: 546448 - protein, 9 aa, Homo Sapiens
AFNAGLFGI

SEQ ID NO: 546449 - protein, 9 aa, Homo Sapiens
ANQLWEYDA

SEQ ID NO: 546450 - protein, 9 aa, Homo Sapiens
KGSAKPSAT

SEQ ID NO: 546451 - protein, 9 aa, Homo Sapiens
RKGRLIVCD

SEQ ID NO: 546452 - protein, 9 aa, Homo Sapiens
NIWMAVCLL

SEQ ID NO: 546453 - protein, 9 aa, Homo Sapiens
LEDPRPSLT

SEQ ID NO: 546454 - protein, 9 aa, Homo Sapiens
REDIGDYVA

SEQ ID NO: 546455 - protein, 9 aa, Homo Sapiens
NGGGRGPSA

SEQ ID NO: 546456 - protein, 9 aa, Homo Sapiens
GGPGGLRKV

SEQ ID NO: 546457 - protein, 9 aa, Homo Sapiens
YKNNFLKER

SEQ ID NO: 546458 - protein, 9 aa, Homo Sapiens
TPPTWLRED

SEQ ID NO: 546459 - protein, 9 aa, Homo Sapiens
SAEEMGAVV

SEQ ID NO: 546460 - protein, 9 aa, Homo Sapiens
ALQVRGEGL

SEQ ID NO: 546461 - protein, 9 aa, Homo Sapiens
YEKHPVLYM

SEQ ID NO: 546462 - protein, 9 aa, Homo Sapiens
GLSEEEIWS

SEQ ID NO: 546463 - protein, 9 aa, Homo Sapiens
EMGFRMDDE

SEQ ID NO: 546464 - protein, 9 aa, Homo Sapiens
VHNPDQTDM

SEQ ID NO: 546465 - protein, 9 aa, Homo Sapiens
MLKCHHMRA

SEQ ID NO: 546466 - protein, 9 aa, Homo Sapiens
HNPDQTDMD

SEQ ID NO: 546467 - protein, 9 aa, Homo Sapiens
EFLAHVGGV

SEQ ID NO: 546468 - protein, 9 aa, Homo Sapiens
EVHVEWDVP

SEQ ID NO: 546469 - protein, 9 aa, Homo Sapiens
LSIAEGKEV

SEQ ID NO: 546470 - protein, 9 aa, Homo Sapiens
SHIDKASVM

SEQ ID NO: 546471 - protein, 9 aa, Homo Sapiens
SATTSSTGV

SEQ ID NO: 546472 - protein, 9 aa, Homo Sapiens
NCYVEVPIG

SEQ ID NO: 546473 - protein, 9 aa, Homo Sapiens
AIGDVLVLS

SEQ ID NO: 546474 - protein, 9 aa, Homo Sapiens
FLHEMMQQT

SEQ ID NO: 546475 - protein, 9 aa, Homo Sapiens
MADNREPRG

SEQ ID NO: 546476 - protein, 9 aa, Homo Sapiens
DPRPSLTRS

SEQ ID NO: 546477 - protein, 9 aa, Homo Sapiens
PAQGSYFVN

SEQ ID NO: 546478 - protein, 9 aa, Homo Sapiens
GSAKPSATS

SEQ ID NO: 546479 - protein, 9 aa, Homo Sapiens
FRPSDTANT

SEQ ID NO: 546480 - protein, 9 aa, Homo Sapiens
AINIWMAVC

SEQ ID NO: 546481 - protein, 9 aa, Homo Sapiens
ISGTSSDQG

SEQ ID NO: 546482 - protein, 9 aa, Homo Sapiens
GFGVPWLPV

SEQ ID NO: 546483 - protein, 9 aa, Homo Sapiens
IAEGKEVLL

SEQ ID NO: 546484 - protein, 9 aa, Homo Sapiens
PRPSLTRSV

SEQ ID NO: 546485 - protein, 9 aa, Homo Sapiens
VNPTLGVYE

SEQ ID NO: 546486 - protein, 9 aa, Homo Sapiens
QTPPTWLRE

SEQ ID NO: 546487 - protein, 9 aa, Homo Sapiens
LKLAGWQCP

SEQ ID NO: 546488 - protein, 9 aa, Homo Sapiens
TVMLQRPTK

SEQ ID NO: 546489 - protein, 9 aa, Homo Sapiens
CYLGHESSQ

SEQ ID NO: 546490 - protein, 9 aa, Homo Sapiens
LFWGARYIR

SEQ ID NO: 546491 - protein, 9 aa, Homo Sapiens
LLLSSNCIT

SEQ ID NO: 546492 - protein, 9 aa, Homo Sapiens
MGAVVPETC

SEQ ID NO: 546493 - protein, 9 aa, Homo Sapiens
PSDTANTSN

SEQ ID NO: 546494 - protein, 9 aa, Homo Sapiens
ESDWLHVKN

SEQ ID NO: 546495 - protein, 9 aa, Homo Sapiens
LFLKLLLAG

SEQ ID NO: 546496 - protein, 9 aa, Homo Sapiens
RPSHTEWHH

SEQ ID NO: 546497 - protein, 9 aa, Homo Sapiens
VLCVVMNSN

SEQ ID NO: 546498 - protein, 9 aa, Homo Sapiens
PRHPGFGVP

SEQ ID NO: 546499 - protein, 9 aa, Homo Sapiens
MREMRAGGC

SEQ ID NO: 546500 - protein, 9 aa, Homo Sapiens
LTRLQELQS

SEQ ID NO: 546501 - protein, 9 aa, Homo Sapiens
KHPVLYMYQ

SEQ ID NO: 546502 - protein, 9 aa, Homo Sapiens
IPRHPGFGV

SEQ ID NO: 546503 - protein, 9 aa, Homo Sapiens
GGLRKVVPA

SEQ ID NO: 546504 - protein, 9 aa, Homo Sapiens
RPKHKEVHV

SEQ ID NO: 546505 - protein, 9 aa, Homo Sapiens
KLSSFSSVG

SEQ ID NO: 546506 - protein, 9 aa, Homo Sapiens
KVVPALSPL

SEQ ID NO: 546507 - protein, 9 aa, Homo Sapiens
SSFKSVPCG

SEQ ID NO: 546508 - protein, 9 aa, Homo Sapiens
YLGHESSQP

SEQ ID NO: 546509 - protein, 9 aa, Homo Sapiens
LHSCVKPYQ

SEQ ID NO: 546510 - protein, 9 aa, Homo Sapiens
KDGGGHEQH

SEQ ID NO: 546511 - protein, 9 aa, Homo Sapiens
RPSDTANTS

SEQ ID NO: 546512 - protein, 9 aa, Homo Sapiens
ALLCGMREM

SEQ ID NO: 546513 - protein, 9 aa, Homo Sapiens
PSATTSSTG

SEQ ID NO: 546514 - protein, 9 aa, Homo Sapiens
HKEVHVEWD

SEQ ID NO: 546515 - protein, 9 aa, Homo Sapiens
TSMNESDWL

SEQ ID NO: 546516 - protein, 9 aa, Homo Sapiens
QAEGAHSFE

SEQ ID NO: 546517 - protein, 9 aa, Homo Sapiens
GQERPSHTE

SEQ ID NO: 546518 - protein, 9 aa, Homo Sapiens
TNIPRHPGF

SEQ ID NO: 546519 - protein, 9 aa, Homo Sapiens
DIGDYVAKV

SEQ ID NO: 546520 - protein, 9 aa, Homo Sapiens
WWNSHNKAI

SEQ ID NO: 546521 - protein, 9 aa, Homo Sapiens
GSYFVNKRA

SEQ ID NO: 546522 - protein, 9 aa, Homo Sapiens
QAASEEELA

SEQ ID NO: 546523 - protein, 9 aa, Homo Sapiens
KSEPKGESF

SEQ ID NO: 546524 - protein, 9 aa, Homo Sapiens
FSWWNSHNK

SEQ ID NO: 546525 - protein, 9 aa, Homo Sapiens
HESSQPITC

SEQ ID NO: 546526 - protein, 9 aa, Homo Sapiens
EHLKLHSCV

SEQ ID NO: 546527 - protein, 9 aa, Homo Sapiens
GVPWLPVGK

SEQ ID NO: 546528 - protein, 9 aa, Homo Sapiens
YITYEKHPV

SEQ ID NO: 546529 - protein, 9 aa, Homo Sapiens
VQAQAASEE

SEQ ID NO: 546530 - protein, 9 aa, Homo Sapiens
YGDLRDGHN

SEQ ID NO: 546531 - protein, 9 aa, Homo Sapiens
SIRPPELGE

SEQ ID NO: 546532 - protein, 9 aa, Homo Sapiens
LRTSGARST

SEQ ID NO: 546533 - protein, 9 aa, Homo Sapiens
SWWNSHNKA

SEQ ID NO: 546534 - protein, 9 aa, Homo Sapiens
ADQAIIFVW

SEQ ID NO: 546535 - protein, 9 aa, Homo Sapiens
KLSSDRIRV

SEQ ID NO: 546536 - protein, 9 aa, Homo Sapiens
KQEKDFLWS

SEQ ID NO: 546537 - protein, 9 aa, Homo Sapiens
WNSHNKAIS

SEQ ID NO: 546538 - protein, 9 aa, Homo Sapiens
FWGAMSPDG

SEQ ID NO: 546539 - protein, 9 aa, Homo Sapiens
FLKERAELA

SEQ ID NO: 546540 - protein, 9 aa, Homo Sapiens
FQKAQAISF

SEQ ID NO: 546541 - protein, 9 aa, Homo Sapiens
LVLSVSTPE

SEQ ID NO: 546542 - protein, 9 aa, Homo Sapiens
SAFNAGLFG

SEQ ID NO: 546543 - protein, 9 aa, Homo Sapiens
QRAFFWTAS

SEQ ID NO: 546544 - protein, 9 aa, Homo Sapiens
TEHLKLHSC

SEQ ID NO: 546545 - protein, 9 aa, Homo Sapiens
IDCGLARRY

SEQ ID NO: 546546 - protein, 9 aa, Homo Sapiens
LVKIIDCGL

SEQ ID NO: 546547 - protein, 9 aa, Homo Sapiens
MSPDGYYAR

SEQ ID NO: 546548 - protein, 9 aa, Homo Sapiens
MRAGGCCHA

SEQ ID NO: 546549 - protein, 9 aa, Homo Sapiens
QLDYKNNFL

SEQ ID NO: 546550 - protein, 9 aa, Homo Sapiens
IFVWAKRPN

SEQ ID NO: 546551 - protein, 9 aa, Homo Sapiens
GTKSEPKGE

SEQ ID NO: 546552 - protein, 9 aa, Homo Sapiens
EAPETEPFY

SEQ ID NO: 546553 - protein, 9 aa, Homo Sapiens
PVGKGSAKP

SEQ ID NO: 546554 - protein, 9 aa, Homo Sapiens
TKQEKDFLW

SEQ ID NO: 546555 - protein, 9 aa, Homo Sapiens
LIGHSVAHL

SEQ ID NO: 546556 - protein, 9 aa, Homo Sapiens
LYKMGQTPP

SEQ ID NO: 546557 - protein, 9 aa, Homo Sapiens
AMSPDGYYA

SEQ ID NO: 546558 - protein, 9 aa, Homo Sapiens
PTLGVYEAD

SEQ ID NO: 546559 - protein, 9 aa, Homo Sapiens
EDIGDYVAK

SEQ ID NO: 546560 - protein, 9 aa, Homo Sapiens
KSQSSFKSV

SEQ ID NO: 546561 - protein, 9 aa, Homo Sapiens
LCVQVIICV

SEQ ID NO: 546562 - protein, 9 aa, Homo Sapiens
TSSDQGYGS

SEQ ID NO: 546563 - protein, 9 aa, Homo Sapiens
GDQVAPVLS

SEQ ID NO: 546564 - protein, 9 aa, Homo Sapiens
GVKLSSFSS

SEQ ID NO: 546565 - protein, 9 aa, Homo Sapiens
ADNREPRGA

SEQ ID NO: 546566 - protein, 9 aa, Homo Sapiens
HEQHHREEC

SEQ ID NO: 546567 - protein, 9 aa, Homo Sapiens
SGTSSDQGY

SEQ ID NO: 546568 - protein, 9 aa, Homo Sapiens
CYVEVPIGC

SEQ ID NO: 546569 - protein, 9 aa, Homo Sapiens
AISGTSSDQ

SEQ ID NO: 546570 - protein, 9 aa, Homo Sapiens
NNFLKERAE

SEQ ID NO: 546571 - protein, 9 aa, Homo Sapiens
KHINDLYGD

SEQ ID NO: 546572 - protein, 9 aa, Homo Sapiens
FYITYEKHP

SEQ ID NO: 546573 - protein, 9 aa, Homo Sapiens
REGSRSPLP

SEQ ID NO: 546574 - protein, 9 aa, Homo Sapiens
GFRMDDEFV

SEQ ID NO: 546575 - protein, 9 aa, Homo Sapiens
THLPSDDSY

SEQ ID NO: 546576 - protein, 9 aa, Homo Sapiens
QSSFKSVPC

SEQ ID NO: 546577 - protein, 9 aa, Homo Sapiens
AFNCYVEVP

SEQ ID NO: 546578 - protein, 9 aa, Homo Sapiens
YGKKGASGA

SEQ ID NO: 546579 - protein, 9 aa, Homo Sapiens
NSNGEQCYS

SEQ ID NO: 546580 - protein, 9 aa, Homo Sapiens
QHHREECHI

SEQ ID NO: 546581 - protein, 9 aa, Homo Sapiens
LTRSVSTAA

SEQ ID NO: 546582 - protein, 9 aa, Homo Sapiens
AFFWTASTF

SEQ ID NO: 546583 - protein, 9 aa, Homo Sapiens
FLAHVGGVG

SEQ ID NO: 546584 - protein, 9 aa, Homo Sapiens
SNCITAIVN

SEQ ID NO: 546585 - protein, 9 aa, Homo Sapiens
VKIIDCGLA

SEQ ID NO: 546586 - protein, 9 aa, Homo Sapiens
VEWDVPASE

SEQ ID NO: 546587 - protein, 9 aa, Homo Sapiens
MQDTHLPSD

SEQ ID NO: 546588 - protein, 9 aa, Homo Sapiens
IQLDYKNNF

SEQ ID NO: 546589 - protein, 9 aa, Homo Sapiens
LAARRATRA

SEQ ID NO: 546590 - protein, 9 aa, Homo Sapiens
CKCLCVQVI

SEQ ID NO: 546591 - protein, 9 aa, Homo Sapiens
DGGGHEQHH

SEQ ID NO: 546592 - protein, 9 aa, Homo Sapiens
ASIRPPELG

SEQ ID NO: 546593 - protein, 9 aa, Homo Sapiens
LMGRYDIFL

SEQ ID NO: 546594 - protein, 9 aa, Homo Sapiens
PETEPFYGK

SEQ ID NO: 546595 - protein, 9 aa, Homo Sapiens
HTEWHHLLH

SEQ ID NO: 546596 - protein, 9 aa, Homo Sapiens
KWVTSMNES

SEQ ID NO: 546597 - protein, 9 aa, Homo Sapiens
FMVGYETLA

SEQ ID NO: 546598 - protein, 9 aa, Homo Sapiens
NSHNKAISY

SEQ ID NO: 546599 - protein, 9 aa, Homo Sapiens
GAMSPDGYY

SEQ ID NO: 546600 - protein, 9 aa, Homo Sapiens
LLELIGHSV

SEQ ID NO: 546601 - protein, 9 aa, Homo Sapiens
HNKAISYLA

SEQ ID NO: 546602 - protein, 9 aa, Homo Sapiens
GHEQHHREE

SEQ ID NO: 546603 - protein, 9 aa, Homo Sapiens
CHIHLGQER

SEQ ID NO: 546604 - protein, 9 aa, Homo Sapiens
RFQASIRPP

SEQ ID NO: 546605 - protein, 9 aa, Homo Sapiens
KEVHVEWDV

SEQ ID NO: 546606 - protein, 9 aa, Homo Sapiens
GWLFLKLLL

SEQ ID NO: 546607 - protein, 9 aa, Homo Sapiens
GHSVAHLKK

SEQ ID NO: 546608 - protein, 9 aa, Homo Sapiens
WGAMSPDGY

SEQ ID NO: 546609 - protein, 9 aa, Homo Sapiens
GVYEADLLK

SEQ ID NO: 546610 - protein, 9 aa, Homo Sapiens
FFWTASTFF

SEQ ID NO: 546611 - protein, 9 aa, Homo Sapiens
LLHPRRCFG

SEQ ID NO: 546612 - protein, 9 aa, Homo Sapiens
IVCDHGTLE

SEQ ID NO: 546613 - protein, 9 aa, Homo Sapiens
EMGAVVPET

SEQ ID NO: 546614 - protein, 9 aa, Homo Sapiens
RKVVPALSP

SEQ ID NO: 546615 - protein, 9 aa, Homo Sapiens
VVKREGSRS

SEQ ID NO: 546616 - protein, 9 aa, Homo Sapiens
SGARSTVIV

SEQ ID NO: 546617 - protein, 9 aa, Homo Sapiens
NPDQTDMDN

SEQ ID NO: 546618 - protein, 9 aa, Homo Sapiens
QKAQAISFL

SEQ ID NO: 546619 - protein, 9 aa, Homo Sapiens
IKVETNIPR

SEQ ID NO: 546620 - protein, 9 aa, Homo Sapiens
EPFYGKKGA

SEQ ID NO: 546621 - protein, 9 aa, Homo Sapiens
ELIGHSVAH

SEQ ID NO: 546622 - protein, 9 aa, Homo Sapiens
VVMNSNGEQ

SEQ ID NO: 546623 - protein, 9 aa, Homo Sapiens
YDSMQDTHL

SEQ ID NO: 546624 - protein, 9 aa, Homo Sapiens
TPLKLAGWQ

SEQ ID NO: 546625 - protein, 9 aa, Homo Sapiens
ATDETKNRG

SEQ ID NO: 546626 - protein, 9 aa, Homo Sapiens
KCLCVQVII

SEQ ID NO: 546627 - protein, 9 aa, Homo Sapiens
NGHLLIGLS

SEQ ID NO: 546628 - protein, 9 aa, Homo Sapiens
GKKGASGAH

SEQ ID NO: 546629 - protein, 9 aa, Homo Sapiens
LVPLMGRYD

SEQ ID NO: 546630 - protein, 9 aa, Homo Sapiens
PSGINFSAW

SEQ ID NO: 546631 - protein, 9 aa, Homo Sapiens
SMPLSIAEG

SEQ ID NO: 546632 - protein, 9 aa, Homo Sapiens
QASIRPPEL

SEQ ID NO: 546633 - protein, 9 aa, Homo Sapiens
KKGASGAHC

SEQ ID NO: 546634 - protein, 9 aa, Homo Sapiens
GYETLAQAQ

SEQ ID NO: 546635 - protein, 9 aa, Homo Sapiens
AGLFGIYTI

SEQ ID NO: 546636 - protein, 9 aa, Homo Sapiens
CGLARRYNP

SEQ ID NO: 546637 - protein, 9 aa, Homo Sapiens
VGKGSAKPS

SEQ ID NO: 546638 - protein, 9 aa, Homo Sapiens
TEWHHLLHP

SEQ ID NO: 546639 - protein, 9 aa, Homo Sapiens
VGYETLAQA

SEQ ID NO: 546640 - protein, 9 aa, Homo Sapiens
MEMGFRMDD

SEQ ID NO: 546641 - protein, 9 aa, Homo Sapiens
RPSLTRSVS

SEQ ID NO: 546642 - protein, 9 aa, Homo Sapiens
LSSNCITAI

SEQ ID NO: 546643 - protein, 9 aa, Homo Sapiens
NFWGAMSPD

SEQ ID NO: 546644 - protein, 9 aa, Homo Sapiens
EITKQEKDF

SEQ ID NO: 546645 - protein, 9 aa, Homo Sapiens
ALWEKTQAE

SEQ ID NO: 546646 - protein, 9 aa, Homo Sapiens
HLLHPRRCF

SEQ ID NO: 546647 - protein, 9 aa, Homo Sapiens
PGFGVPWLP

SEQ ID NO: 546648 - protein, 9 aa, Homo Sapiens
SEEELAVAV

SEQ ID NO: 546649 - protein, 9 aa, Homo Sapiens
GGHEQHHRE

SEQ ID NO: 546650 - protein, 9 aa, Homo Sapiens
KEDTAFNCY

SEQ ID NO: 546651 - protein, 9 aa, Homo Sapiens
GRGPSATTS

SEQ ID NO: 546652 - protein, 9 aa, Homo Sapiens
ILVPLMGRY

SEQ ID NO: 546653 - protein, 9 aa, Homo Sapiens
RPPELGETE

SEQ ID NO: 546654 - protein, 9 aa, Homo Sapiens
AVVPETCEE

SEQ ID NO: 546655 - protein, 9 aa, Homo Sapiens
MGQTPPTWL

SEQ ID NO: 546656 - protein, 9 aa, Homo Sapiens
QQQYLTRLQ

SEQ ID NO: 546657 - protein, 9 aa, Homo Sapiens
EEMGAVVPE

SEQ ID NO: 546658 - protein, 9 aa, Homo Sapiens
RHPGFGVPW

SEQ ID NO: 546659 - protein, 9 aa, Homo Sapiens
VLVLSVSTP

SEQ ID NO: 546660 - protein, 9 aa, Homo Sapiens
QGCYLGHES

SEQ ID NO: 546661 - protein, 9 aa, Homo Sapiens
ETKNRGFAF

SEQ ID NO: 546662 - protein, 9 aa, Homo Sapiens
HPVLYMYQL

SEQ ID NO: 546663 - protein, 9 aa, Homo Sapiens
KREGSRSPL

SEQ ID NO: 546664 - protein, 9 aa, Homo Sapiens
LKCHHMRAN

SEQ ID NO: 546665 - protein, 9 aa, Homo Sapiens
IRFQASIRP

SEQ ID NO: 546666 - protein, 9 aa, Homo Sapiens
RLIVCDHGT

SEQ ID NO: 546667 - protein, 9 aa, Homo Sapiens
GARSTVIVP

SEQ ID NO: 546668 - protein, 9 aa, Homo Sapiens
TSGARSTVI

SEQ ID NO: 546669 - protein, 9 aa, Homo Sapiens
HLLIGLSHE

SEQ ID NO: 546670 - protein, 9 aa, Homo Sapiens
ETLAQAQRD

SEQ ID NO: 546671 - protein, 9 aa, Homo Sapiens
DQGYGSPRY

SEQ ID NO: 546672 - protein, 9 aa, Homo Sapiens
PSHTEWHHL

SEQ ID NO: 546673 - protein, 9 aa, Homo Sapiens
DQTDMDNDL

SEQ ID NO: 546674 - protein, 9 aa, Homo Sapiens
SATDETKNR

SEQ ID NO: 546675 - protein, 9 aa, Homo Sapiens
QVRGEGLSE

SEQ ID NO: 546676 - protein, 9 aa, Homo Sapiens
ITKQEKDFL

SEQ ID NO: 546677 - protein, 9 aa, Homo Sapiens
QTDMDNDLV

SEQ ID NO: 546678 - protein, 9 aa, Homo Sapiens
TSNQDALSS

SEQ ID NO: 546679 - protein, 9 aa, Homo Sapiens
GNHVMGQRQ

SEQ ID NO: 546680 - protein, 9 aa, Homo Sapiens
EAIGDVLVL

SEQ ID NO: 546681 - protein, 9 aa, Homo Sapiens
SAKPSATSQ

SEQ ID NO: 546682 - protein, 9 aa, Homo Sapiens
QAEGTKSEP

SEQ ID NO: 546683 - protein, 9 aa, Homo Sapiens
SDTANTSNQ

SEQ ID NO: 546684 - protein, 9 aa, Homo Sapiens
GHESSQPIT

SEQ ID NO: 546685 - protein, 9 aa, Homo Sapiens
YVAKVNDSW

SEQ ID NO: 546686 - protein, 9 aa, Homo Sapiens
STVIVPFRT

SEQ ID NO: 546687 - protein, 9 aa, Homo Sapiens
HMRANQLWE

SEQ ID NO: 546688 - protein, 9 aa, Homo Sapiens
VRGEGLSEE

SEQ ID NO: 546689 - protein, 9 aa, Homo Sapiens
YIRTDYTLL

SEQ ID NO: 546690 - protein, 9 aa, Homo Sapiens
VPWLPVGKG

SEQ ID NO: 546691 - protein, 9 aa, Homo Sapiens
MVGYETLAQ

SEQ ID NO: 546692 - protein, 9 aa, Homo Sapiens
CGMREMRAG

SEQ ID NO: 546693 - protein, 9 aa, Homo Sapiens
DTANTSNQD

SEQ ID NO: 546694 - protein, 9 aa, Homo Sapiens
FLKLLLAGV

SEQ ID NO: 546695 - protein, 9 aa, Homo Sapiens
YPSATDETK

SEQ ID NO: 546696 - protein, 9 aa, Homo Sapiens
TLGVYEADL

SEQ ID NO: 546697 - protein, 9 aa, Homo Sapiens
FWTASTFFF

SEQ ID NO: 546698 - protein, 9 aa, Homo Sapiens
WSNFWGAMS

SEQ ID NO: 546699 - protein, 9 aa, Homo Sapiens
GGRGPSATT

SEQ ID NO: 546700 - protein, 9 aa, Homo Sapiens
LAHVGGVGI

SEQ ID NO: 546701 - protein, 9 aa, Homo Sapiens
EECHIHLGQ

SEQ ID NO: 546702 - protein, 9 aa, Homo Sapiens
WLFLKLLLA

SEQ ID NO: 546703 - protein, 9 aa, Homo Sapiens
HLKLHSCVK

SEQ ID NO: 546704 - protein, 9 aa, Homo Sapiens
QQYLTRLQE

SEQ ID NO: 546705 - protein, 9 aa, Homo Sapiens
DETKNRGFA

SEQ ID NO: 546706 - protein, 9 aa, Homo Sapiens
AIRFQASIR

SEQ ID NO: 546707 - protein, 9 aa, Homo Sapiens
PVKDGGGHE

SEQ ID NO: 546708 - protein, 9 aa, Homo Sapiens
ARYIRTDYT

SEQ ID NO: 546709 - protein, 9 aa, Homo Sapiens
DTDQAEGTK

SEQ ID NO: 546710 - protein, 9 aa, Homo Sapiens
VHVEWDVPA

SEQ ID NO: 546711 - protein, 9 aa, Homo Sapiens
LLCGMREMR

SEQ ID NO: 546712 - protein, 9 aa, Homo Sapiens
PFYGKKGAS

SEQ ID NO: 546713 - protein, 9 aa, Homo Sapiens
AIIFVWAKR

SEQ ID NO: 546714 - protein, 9 aa, Homo Sapiens
PLKLAGWQC

SEQ ID NO: 546715 - protein, 9 aa, Homo Sapiens
FYGKKGASG

SEQ ID NO: 546716 - protein, 9 aa, Homo Sapiens
KHKEVHVEW

SEQ ID NO: 546717 - protein, 9 aa, Homo Sapiens
RAFFWTAST

SEQ ID NO: 546718 - protein, 9 aa, Homo Sapiens
HNVSSHIDK

SEQ ID NO: 546719 - protein, 9 aa, Homo Sapiens
LQVRGEGLS

SEQ ID NO: 546720 - protein, 9 aa, Homo Sapiens
PVLYQRAFF

SEQ ID NO: 546721 - protein, 9 aa, Homo Sapiens
DQGCYLGHE

SEQ ID NO: 546722 - protein, 9 aa, Homo Sapiens
WAKRPNSIQ

SEQ ID NO: 546723 - protein, 9 aa, Homo Sapiens
LDYKNNFLK

SEQ ID NO: 546724 - protein, 9 aa, Homo Sapiens
PPTWLREDL

SEQ ID NO: 546725 - protein, 9 aa, Homo Sapiens
LIVCDHGTL

SEQ ID NO: 546726 - protein, 9 aa, Homo Sapiens
EGAHSFETA

SEQ ID NO: 546727 - protein, 9 aa, Homo Sapiens
VVPETCEEL

SEQ ID NO: 546728 - protein, 9 aa, Homo Sapiens
NHVMGQRQI

SEQ ID NO: 546729 - protein, 9 aa, Homo Sapiens
GHLLIGLSH

SEQ ID NO: 546730 - protein, 9 aa, Homo Sapiens
SQLKSQSSF

SEQ ID NO: 546731 - protein, 9 aa, Homo Sapiens
HLVKIIDCG

SEQ ID NO: 546732 - protein, 9 aa, Homo Sapiens
GTSSDQGYG

SEQ ID NO: 546733 - protein, 9 aa, Homo Sapiens
VWAKRPNSI

SEQ ID NO: 546734 - protein, 9 aa, Homo Sapiens
RGSYLTVML

SEQ ID NO: 546735 - protein, 9 aa, Homo Sapiens
SMNESDWLH

SEQ ID NO: 546736 - protein, 9 aa, Homo Sapiens
AQGSYFVNK

SEQ ID NO: 546737 - protein, 9 aa, Homo Sapiens
SLTRSVSTA

SEQ ID NO: 546738 - protein, 9 aa, Homo Sapiens
NQGNHVMGQ

SEQ ID NO: 546739 - protein, 9 aa, Homo Sapiens
VTPLKLAGW

SEQ ID NO: 546740 - protein, 9 aa, Homo Sapiens
CKEDTAFNC

SEQ ID NO: 546741 - protein, 9 aa, Homo Sapiens
AEEMGAVVP

SEQ ID NO: 546742 - protein, 9 aa, Homo Sapiens
LGQERPSHT

SEQ ID NO: 546743 - protein, 9 aa, Homo Sapiens
ITYEKHPVL

SEQ ID NO: 546744 - protein, 9 aa, Homo Sapiens
VIICVVTLP

SEQ ID NO: 546745 - protein, 9 aa, Homo Sapiens
SLEDPRPSL

SEQ ID NO: 546746 - protein, 9 aa, Homo Sapiens
TYEKHPVLY

SEQ ID NO: 546747 - protein, 9 aa, Homo Sapiens
TDETKNRGF

SEQ ID NO: 546748 - protein, 9 aa, Homo Sapiens
VKLSSFSSV

SEQ ID NO: 546749 - protein, 9 aa, Homo Sapiens
SFSSVGESL

SEQ ID NO: 546750 - protein, 9 aa, Homo Sapiens
ARRATRAKL

SEQ ID NO: 546751 - protein, 9 aa, Homo Sapiens
FTVSDHQPE

SEQ ID NO: 546752 - protein, 9 aa, Homo Sapiens
DYKNNFLKE

SEQ ID NO: 546753 - protein, 9 aa, Homo Sapiens
PSATDETKN

SEQ ID NO: 546754 - protein, 9 aa, Homo Sapiens
FRMDDEFVA

SEQ ID NO: 546755 - protein, 9 aa, Homo Sapiens
WGARYIRTD

SEQ ID NO: 546756 - protein, 9 aa, Homo Sapiens
SDWLHVKNL

SEQ ID NO: 546757 - protein, 9 aa, Homo Sapiens
PRRCFGGRG

SEQ ID NO: 546758 - protein, 9 aa, Homo Sapiens
TDQAEGTKS

SEQ ID NO: 546759 - protein, 9 aa, Homo Sapiens
MRANQLWEY

SEQ ID NO: 546760 - protein, 9 aa, Homo Sapiens
DPLSEITKQ

SEQ ID NO: 546761 - protein, 9 aa, Homo Sapiens
KVHILVPLM

SEQ ID NO: 546762 - protein, 9 aa, Homo Sapiens
RRCFGGRGG

SEQ ID NO: 546763 - protein, 9 aa, Homo Sapiens
RLQELQSAS

SEQ ID NO: 546764 - protein, 9 aa, Homo Sapiens
AARRATRAK

SEQ ID NO: 546765 - protein, 9 aa, Homo Sapiens
DMDNDLVGD

SEQ ID NO: 546766 - protein, 9 aa, Homo Sapiens
INDLYGDLR

SEQ ID NO: 546767 - protein, 9 aa, Homo Sapiens
RSTVIVPFR

SEQ ID NO: 546768 - protein, 9 aa, Homo Sapiens
HLPSDDSYQ

SEQ ID NO: 546769 - protein, 9 aa, Homo Sapiens
RTSGARSTV

SEQ ID NO: 546770 - protein, 9 aa, Homo Sapiens
EGTKSEPKG

SEQ ID NO: 546771 - protein, 9 aa, Homo Sapiens
TLAQAQRDL

SEQ ID NO: 546772 - protein, 9 aa, Homo Sapiens
LSQPHLEAL

SEQ ID NO: 546773 - protein, 9 aa, Homo Sapiens
EKTQAEGAH

SEQ ID NO: 546774 - protein, 9 aa, Homo Sapiens
VMNSNGEQC

SEQ ID NO: 546775 - protein, 9 aa, Homo Sapiens
EIKVETNIP

SEQ ID NO: 546776 - protein, 9 aa, Homo Sapiens
WVTSMNESD

SEQ ID NO: 546777 - protein, 9 aa, Homo Sapiens
IAVTPLKLA

SEQ ID NO: 546778 - protein, 9 aa, Homo Sapiens
FFPSGINFS

SEQ ID NO: 546779 - protein, 9 aa, Homo Sapiens
HIHLGQERP

SEQ ID NO: 546780 - protein, 9 aa, Homo Sapiens
MDNDLVGDQ

SEQ ID NO: 546781 - protein, 9 aa, Homo Sapiens
YETLAQAQR

SEQ ID NO: 546782 - protein, 9 aa, Homo Sapiens
RKFMVGYET

SEQ ID NO: 546783 - protein, 9 aa, Homo Sapiens
LAGWQCPEC

SEQ ID NO: 546784 - protein, 9 aa, Homo Sapiens
KLHSCVKPY

SEQ ID NO: 546785 - protein, 9 aa, Homo Sapiens
PWLPVGKGS

SEQ ID NO: 546786 - protein, 9 aa, Homo Sapiens
VHILVPLMG

SEQ ID NO: 546787 - protein, 9 aa, Homo Sapiens
LNLQKLSSD

SEQ ID NO: 546788 - protein, 9 aa, Homo Sapiens
AVTPLKLAG

SEQ ID NO: 546789 - protein, 9 aa, Homo Sapiens
DQAIIFVWA

SEQ ID NO: 546790 - protein, 9 aa, Homo Sapiens
TIESMPLSI

SEQ ID NO: 546791 - protein, 9 aa, Homo Sapiens
IGDVLVLSV

SEQ ID NO: 546792 - protein, 9 aa, Homo Sapiens
APETEPFYG

SEQ ID NO: 546793 - protein, 9 aa, Homo Sapiens
SQSSFKSVP

SEQ ID NO: 546794 - protein, 9 aa, Homo Sapiens
LTVMLQRPT

SEQ ID NO: 546795 - protein, 9 aa, Homo Sapiens
LPVGKGSAK

SEQ ID NO: 546796 - protein, 9 aa, Homo Sapiens
FVWAKRPNS

SEQ ID NO: 546797 - protein, 9 aa, Homo Sapiens
YKMGQTPPT

SEQ ID NO: 546798 - protein, 9 aa, Homo Sapiens
LQELQSASE

SEQ ID NO: 546799 - protein, 9 aa, Homo Sapiens
ASEEELAVA

SEQ ID NO: 546800 - protein, 9 aa, Homo Sapiens
RDPLSEITK

SEQ ID NO: 546801 - protein, 9 aa, Homo Sapiens
IIFVWAKRP

SEQ ID NO: 546802 - protein, 9 aa, Homo Sapiens
AHVGGVGID

SEQ ID NO: 546803 - protein, 9 aa, Homo Sapiens
REECHIHLG

SEQ ID NO: 546804 - protein, 9 aa, Homo Sapiens
DQVAPVLSQ

SEQ ID NO: 546805 - protein, 9 aa, Homo Sapiens
GQTPPTWLR

SEQ ID NO: 546806 - protein, 9 aa, Homo Sapiens
TKSEPKGES

SEQ ID NO: 546807 - protein, 9 aa, Homo Sapiens
REMRAGGCC

SEQ ID NO: 546808 - protein, 9 aa, Homo Sapiens
LQKLSSDRI

SEQ ID NO: 546809 - protein, 9 aa, Homo Sapiens
EDTAFNCYV

SEQ ID NO: 546810 - protein, 9 aa, Homo Sapiens
FGVPWLPVG

SEQ ID NO: 546811 - protein, 9 aa, Homo Sapiens
SYFVNKRAY

SEQ ID NO: 546812 - protein, 9 aa, Homo Sapiens
GSRVVKREG

SEQ ID NO: 546813 - protein, 9 aa, Homo Sapiens
KPSATSQER

SEQ ID NO: 546814 - protein, 9 aa, Homo Sapiens
EMRAGGCCH

SEQ ID NO: 546815 - protein, 9 aa, Homo Sapiens
HHLLHPRRC

SEQ ID NO: 546816 - protein, 9 aa, Homo Sapiens
QKLSSDRIR

SEQ ID NO: 546817 - protein, 9 aa, Homo Sapiens
TEPFYGKKG

SEQ ID NO: 546818 - protein, 9 aa, Homo Sapiens
SIAEGKEVL

SEQ ID NO: 546819 - protein, 9 aa, Homo Sapiens
IGHSVAHLK

SEQ ID NO: 546820 - protein, 9 aa, Homo Sapiens
LVINGHLLI

SEQ ID NO: 546821 - protein, 9 aa, Homo Sapiens
SSDRIRVGE

SEQ ID NO: 546822 - protein, 9 aa, Homo Sapiens
CHHMRANQL

SEQ ID NO: 546823 - protein, 9 aa, Homo Sapiens
SEITKQEKD

SEQ ID NO: 546824 - protein, 9 aa, Homo Sapiens
NPTLGVYEA

SEQ ID NO: 546825 - protein, 9 aa, Homo Sapiens
PHNVSSHID

SEQ ID NO: 546826 - protein, 9 aa, Homo Sapiens
NCITAIVNA

SEQ ID NO: 546827 - protein, 9 aa, Homo Sapiens
CVVMNSNGE

SEQ ID NO: 546828 - protein, 9 aa, Homo Sapiens
VTAVEFLAH

SEQ ID NO: 546829 - protein, 9 aa, Homo Sapiens
VSSHIDKAS

SEQ ID NO: 546830 - protein, 9 aa, Homo Sapiens
RGGPGGLRK

SEQ ID NO: 546831 - protein, 9 aa, Homo Sapiens
FWGARYIRT

SEQ ID NO: 546832 - protein, 9 aa, Homo Sapiens
KTQAEGAHS

SEQ ID NO: 546833 - protein, 9 aa, Homo Sapiens
DQAEGTKSE

SEQ ID NO: 546834 - protein, 9 aa, Homo Sapiens
TANTSNQDA

SEQ ID NO: 546835 - protein, 9 aa, Homo Sapiens
GRLIVCDHG

SEQ ID NO: 546836 - protein, 9 aa, Homo Sapiens
YLTRLQELQ

SEQ ID NO: 546837 - protein, 9 aa, Homo Sapiens
QAIIFVWAK

SEQ ID NO: 546838 - protein, 9 aa, Homo Sapiens
HVEWDVPAS

SEQ ID NO: 546839 - protein, 9 aa, Homo Sapiens
HPGFGVPWL

SEQ ID NO: 546840 - protein, 9 aa, Homo Sapiens
FQASIRPPE

SEQ ID NO: 546841 - protein, 9 aa, Homo Sapiens
AQAASEEEL

SEQ ID NO: 546842 - protein, 9 aa, Homo Sapiens
NDLYGDLRD

SEQ ID NO: 546843 - protein, 9 aa, Homo Sapiens
NAGLFGIYT

SEQ ID NO: 546844 - protein, 9 aa, Homo Sapiens
QVIICVVTL

SEQ ID NO: 546845 - protein, 9 aa, Homo Sapiens
SVAHLKKAD

SEQ ID NO: 546846 - protein, 9 aa, Homo Sapiens
AQAISFLHE

SEQ ID NO: 546847 - protein, 9 aa, Homo Sapiens
GDVLVLSVS

SEQ ID NO: 546848 - protein, 9 aa, Homo Sapiens
KVSYVKAIN

SEQ ID NO: 546849 - protein, 9 aa, Homo Sapiens
NTSNQDALS

SEQ ID NO: 546850 - protein, 9 aa, Homo Sapiens
SGINFSAWG

SEQ ID NO: 546851 - protein, 9 aa, Homo Sapiens
DYVAKVNDS

SEQ ID NO: 546852 - protein, 9 aa, Homo Sapiens
GCYLGHESS

SEQ ID NO: 546853 - protein, 9 aa, Homo Sapiens
VKDGGGHEQ

SEQ ID NO: 546854 - protein, 9 aa, Homo Sapiens
LLSSNCITA

SEQ ID NO: 546855 - protein, 9 aa, Homo Sapiens
PLMGRYDIF

SEQ ID NO: 546856 - protein, 9 aa, Homo Sapiens
LSSFSSVGE

SEQ ID NO: 546857 - protein, 9 aa, Homo Sapiens
SLAARRATR

SEQ ID NO: 546858 - protein, 9 aa, Homo Sapiens
VKAINIWMA

SEQ ID NO: 546859 - protein, 9 aa, Homo Sapiens
PDQTDMDND

SEQ ID NO: 546860 - protein, 9 aa, Homo Sapiens
VNQGNHVMG

SEQ ID NO: 546861 - protein, 9 aa, Homo Sapiens
SQPHLEALD

SEQ ID NO: 546862 - protein, 9 aa, Homo Sapiens
QLKSQSSFK

SEQ ID NO: 546863 - protein, 9 aa, Homo Sapiens
RCFGGRGGP

SEQ ID NO: 546864 - protein, 9 aa, Homo Sapiens
LWEKTQAEG

SEQ ID NO: 546865 - protein, 9 aa, Homo Sapiens
GGRGGPGGL

SEQ ID NO: 546866 - protein, 9 aa, Homo Sapiens
INIWMAVCL

SEQ ID NO: 546867 - protein, 9 aa, Homo Sapiens
LTEHLKLHS

SEQ ID NO: 546868 - protein, 9 aa, Homo Sapiens
RGPSATTSS

SEQ ID NO: 546869 - protein, 9 aa, Homo Sapiens
ISFLHEMMQ

SEQ ID NO: 546870 - protein, 9 aa, Homo Sapiens
HSVAHLKKA

SEQ ID NO: 546871 - protein, 9 aa, Homo Sapiens
LHPRRCFGG

SEQ ID NO: 546872 - protein, 9 aa, Homo Sapiens
RANQLWEYD

SEQ ID NO: 546873 - protein, 9 aa, Homo Sapiens
ECHIHLGQE

SEQ ID NO: 546874 - protein, 9 aa, Homo Sapiens
DLYGDLRDG

SEQ ID NO: 546875 - protein, 9 aa, Homo Sapiens
EDPRPSLTR

SEQ ID NO: 546876 - protein, 9 aa, Homo Sapiens
NFSAWGNNS

SEQ ID NO: 546877 - protein, 9 aa, Homo Sapiens
TLFWGARYI

SEQ ID NO: 546878 - protein, 9 aa, Homo Sapiens
WLPVGKGSA

SEQ ID NO: 546879 - protein, 9 aa, Homo Sapiens
MGFRMDDEF

SEQ ID NO: 546880 - protein, 9 aa, Homo Sapiens
DHGTLERDG

SEQ ID NO: 546881 - protein, 9 aa, Homo Sapiens
SSVGESLLY

SEQ ID NO: 546882 - protein, 9 aa, Homo Sapiens
AKPSATSQE

SEQ ID NO: 546883 - protein, 9 aa, Homo Sapiens
GMFTVSDHQ

SEQ ID NO: 546884 - protein, 9 aa, Homo Sapiens
IGLSHEEAV

SEQ ID NO: 546885 - protein, 9 aa, Homo Sapiens
HIDKASVMR

SEQ ID NO: 546886 - protein, 9 aa, Homo Sapiens
LSSDRIRVG

SEQ ID NO: 546887 - protein, 9 aa, Homo Sapiens
SNFWGAMSP

SEQ ID NO: 546888 - protein, 9 aa, Homo Sapiens
QVNQGNHVM

SEQ ID NO: 546889 - protein, 9 aa, Homo Sapiens
RNGGGRGPS

SEQ ID NO: 546890 - protein, 9 aa, Homo Sapiens
RKHINDLYG

SEQ ID NO: 546891 - protein, 9 aa, Homo Sapiens
LELIGHSVA

SEQ ID NO: 546892 - protein, 9 aa, Homo Sapiens
DVTAVEFLA

SEQ ID NO: 546893 - protein, 9 aa, Homo Sapiens
GPSATTSST

SEQ ID NO: 546894 - protein, 9 aa, Homo Sapiens
SSHIDKASV

SEQ ID NO: 546895 - protein, 9 aa, Homo Sapiens
ELNLQKLSS

SEQ ID NO: 546896 - protein, 9 aa, Homo Sapiens
TAFNCYVEV

SEQ ID NO: 546897 - protein, 9 aa, Homo Sapiens
THLTEHLKL

SEQ ID NO: 546898 - protein, 9 aa, Homo Sapiens
SYLTVMLQR

SEQ ID NO: 546899 - protein, 9 aa, Homo Sapiens
GDLRDGHNL

SEQ ID NO: 546900 - protein, 9 aa, Homo Sapiens
VLRTSGARS

SEQ ID NO: 546901 - protein, 9 aa, Homo Sapiens
EGLSEEEIW

SEQ ID NO: 546902 - protein, 9 aa, Homo Sapiens
IIDCGLARR

SEQ ID NO: 546903 - protein, 9 aa, Homo Sapiens
NESDWLHVK

SEQ ID NO: 546904 - protein, 9 aa, Homo Sapiens
QGNHVMGQR

SEQ ID NO: 546905 - protein, 9 aa, Homo Sapiens
IRGSYLTVM

SEQ ID NO: 546906 - protein, 9 aa, Homo Sapiens
FPSGINFSA

SEQ ID NO: 546907 - protein, 9 aa, Homo Sapiens
GSYLTVMLQ

SEQ ID NO: 546908 - protein, 9 aa, Homo Sapiens
QVAPVLSQP

SEQ ID NO: 546909 - protein, 9 aa, Homo Sapiens
EQHHREECH

SEQ ID NO: 546910 - protein, 9 aa, Homo Sapiens
TQAEGAHSF

SEQ ID NO: 546911 - protein, 9 aa, Homo Sapiens
CFGGRGGPG

SEQ ID NO: 546912 - protein, 9 aa, Homo Sapiens
SSDQGYGSP

SEQ ID NO: 546913 - protein, 9 aa, Homo Sapiens
HPRRCFGGR

SEQ ID NO: 546914 - protein, 9 aa, Homo Sapiens
IDKASVMRL

SEQ ID NO: 546915 - protein, 9 aa, Homo Sapiens
SSNCITAIV

SEQ ID NO: 546916 - protein, 9 aa, Homo Sapiens
TDMDNDLVG

SEQ ID NO: 546917 - protein, 9 aa, Homo Sapiens
EKHPVLYMY

SEQ ID NO: 546918 - protein, 9 aa, Homo Sapiens
INGHLLIGL

SEQ ID NO: 546919 - protein, 9 aa, Homo Sapiens
IRPPELGET

SEQ ID NO: 546920 - protein, 9 aa, Homo Sapiens
AASEEELAV

SEQ ID NO: 546921 - protein, 9 aa, Homo Sapiens
AEGAHSFET

SEQ ID NO: 546922 - protein, 9 aa, Homo Sapiens
IICVVTLPT

SEQ ID NO: 546923 - protein, 9 aa, Homo Sapiens
ETNIPRHPG

SEQ ID NO: 546924 - protein, 9 aa, Homo Sapiens
CLCVQVIIC

SEQ ID NO: 546925 - protein, 9 aa, Homo Sapiens
VMLQRPTKE

SEQ ID NO: 546926 - protein, 9 aa, Homo Sapiens
LCVVMNSNG

SEQ ID NO: 546927 - protein, 9 aa, Homo Sapiens
GRGGPGGLR

SEQ ID NO: 546928 - protein, 9 aa, Homo Sapiens
NVSSHIDKA

SEQ ID NO: 546929 - protein, 9 aa, Homo Sapiens
SVGESLLYM

SEQ ID NO: 546930 - protein, 9 aa, Homo Sapiens
ETEPFYGKK

SEQ ID NO: 546931 - protein, 9 aa, Homo Sapiens
HHMRANQLW

SEQ ID NO: 546932 - protein, 9 aa, Homo Sapiens
FFSWWNSHN

SEQ ID NO: 546933 - protein, 9 aa, Homo Sapiens
ESSQPITCK

SEQ ID NO: 546934 - protein, 9 aa, Homo Sapiens
GKGSAKPSA

SEQ ID NO: 546935 - protein, 9 aa, Homo Sapiens
ERPSHTEWH

SEQ ID NO: 546936 - protein, 9 aa, Homo Sapiens
SALQVRGEG

SEQ ID NO: 546937 - protein, 9 aa, Homo Sapiens
ESMPLSIAE

SEQ ID NO: 546938 - protein, 9 aa, Homo Sapiens
SDQGYGSPR

SEQ ID NO: 546939 - protein, 9 aa, Homo Sapiens
SREDIGDYV

SEQ ID NO: 546940 - protein, 9 aa, Homo Sapiens
DVLVLSVST

SEQ ID NO: 546941 - protein, 9 aa, Homo Sapiens
KMGQTPPTW

SEQ ID NO: 546942 - protein, 9 aa, Homo Sapiens
PLSIAEGKE

SEQ ID NO: 546943 - protein, 9 aa, Homo Sapiens
VYPSATDET

SEQ ID NO: 546944 - protein, 9 aa, Homo Sapiens
VKREGSRSP

SEQ ID NO: 546945 - protein, 9 aa, Homo Sapiens
ATRAKLMIP

SEQ ID NO: 546946 - protein, 9 aa, Homo Sapiens
VVPALSPLG

SEQ ID NO: 546947 - protein, 9 aa, Homo Sapiens
DDEFVAKGH

SEQ ID NO: 546948 - protein, 9 aa, Homo Sapiens
QGSYFVNKR

SEQ ID NO: 546949 - protein, 9 aa, Homo Sapiens
WFYITYEKH

SEQ ID NO: 546950 - protein, 9 aa, Homo Sapiens
KIIDCGLAR

SEQ ID NO: 546951 - protein, 9 aa, Homo Sapiens
QELQSASET

SEQ ID NO: 546952 - protein, 9 aa, Homo Sapiens
CVQVIICVV

SEQ ID NO: 546953 - protein, 9 aa, Homo Sapiens
GPVLCVVMN

SEQ ID NO: 546954 - protein, 9 aa, Homo Sapiens
VPETCEELK

SEQ ID NO: 546955 - protein, 9 aa, Homo Sapiens
VNKRAYAEN

SEQ ID NO: 546956 - protein, 9 aa, Homo Sapiens
MGWLFLKLL

SEQ ID NO: 546957 - protein, 9 aa, Homo Sapiens
KLAGWQCPE

SEQ ID NO: 546958 - protein, 9 aa, Homo Sapiens
LSEITKQEK

SEQ ID NO: 546959 - protein, 9 aa, Homo Sapiens
WEKTQAEGA

SEQ ID NO: 546960 - protein, 9 aa, Homo Sapiens
VAPVLSQPH

SEQ ID NO: 546961 - protein, 9 aa, Homo Sapiens
IHLGQERPS

SEQ ID NO: 546962 - protein, 9 aa, Homo Sapiens
ARSTVIVPF

SEQ ID NO: 546963 - protein, 9 aa, Homo Sapiens
GHLVKIIDC

SEQ ID NO: 546964 - protein, 9 aa, Homo Sapiens
FVNKRAYAE

SEQ ID NO: 546965 - protein, 9 aa, Homo Sapiens
MNSNGEQCY

SEQ ID NO: 546966 - protein, 9 aa, Homo Sapiens
VEFLAHVGG

SEQ ID NO: 546967 - protein, 9 aa, Homo Sapiens
GINFSAWGN

SEQ ID NO: 546968 - protein, 9 aa, Homo Sapiens
LRKVVPALS

SEQ ID NO: 546969 - protein, 9 aa, Homo Sapiens
PGGLRKVVP

SEQ ID NO: 546970 - protein, 9 aa, Homo Sapiens
HLTEHLKLH

SEQ ID NO: 546971 - protein, 9 aa, Homo Sapiens
MFTVSDHQP

SEQ ID NO: 546972 - protein, 9 aa, Homo Sapiens
YEADLLKTS

SEQ ID NO: 546973 - protein, 9 aa, Homo Sapiens
HVMGQRQIP

SEQ ID NO: 546974 - protein, 9 aa, Homo Sapiens
QYLTRLQEL

SEQ ID NO: 546975 - protein, 9 aa, Homo Sapiens
DIAVTPLKL

SEQ ID NO: 546976 - protein, 9 aa, Homo Sapiens
HEAIGDVLV

SEQ ID NO: 546977 - protein, 9 aa, Homo Sapiens
VMGQRQIPP

SEQ ID NO: 546978 - protein, 9 aa, Homo Sapiens
AEGTKSEPK

SEQ ID NO: 546979 - protein, 9 aa, Homo Sapiens
LYDSMQDTH

SEQ ID NO: 546980 - protein, 9 aa, Homo Sapiens
EEELAVAVA

SEQ ID NO: 546981 - protein, 9 aa, Homo Sapiens
SSREDIGDY

SEQ ID NO: 546982 - protein, 9 aa, Homo Sapiens
CDHGTLERD

SEQ ID NO: 546983 - protein, 9 aa, Homo Sapiens
MVQAQAASE

SEQ ID NO: 546984 - protein, 9 aa, Homo Sapiens
LGHESSQPI

SEQ ID NO: 546985 - protein, 9 aa, Homo Sapiens
GQVNQGNHV

SEQ ID NO: 546986 - protein, 9 aa, Homo Sapiens
EWHHLLHPR

SEQ ID NO: 546987 - protein, 9 aa, Homo Sapiens
HINDLYGDL

SEQ ID NO: 546988 - protein, 9 aa, Homo Sapiens
FGGRGGPGG

SEQ ID NO: 546989 - protein, 9 aa, Homo Sapiens
KGRLIVCDH

SEQ ID NO: 546990 - protein, 9 aa, Homo Sapiens
VQVIICVVT

SEQ ID NO: 546991 - protein, 9 aa, Homo Sapiens
KLLLSSNCI

SEQ ID NO: 546992 - protein, 9 aa, Homo Sapiens
VPLMGRYDI

SEQ ID NO: 546993 - protein, 9 aa, Homo Sapiens
VSYVKAINI

SEQ ID NO: 546994 - protein, 9 aa, Homo Sapiens
KFMVGYETL

SEQ ID NO: 546995 - protein, 9 aa, Homo Sapiens
GAVVPETCE

SEQ ID NO: 546996 - protein, 9 aa, Homo Sapiens
DCGLARRYN

SEQ ID NO: 546997 - protein, 9 aa, Homo Sapiens
PLSEITKQE

SEQ ID NO: 546998 - protein, 9 aa, Homo Sapiens
RGSRVVKRE

SEQ ID NO: 546999 - protein, 9 aa, Homo Sapiens
VTSMNESDW

SEQ ID NO: 547000 - protein, 9 aa, Homo Sapiens
TVSDHQPEQ

SEQ ID NO: 547001 - protein, 9 aa, Homo Sapiens
KVETNIPRH

SEQ ID NO: 547002 - protein, 9 aa, Homo Sapiens
HTSQLKSQS

SEQ ID NO: 547003 - protein, 9 aa, Homo Sapiens
LKLLLAGVS

SEQ ID NO: 547004 - protein, 9 aa, Homo Sapiens
VLSVSTPEH

SEQ ID NO: 547005 - protein, 9 aa, Homo Sapiens
GLRKVVPAL

SEQ ID NO: 547006 - protein, 9 aa, Homo Sapiens
DKLLLSSNC

SEQ ID NO: 547007 - protein, 9 aa, Homo Sapiens
VRGSRVVKR

SEQ ID NO: 547008 - protein, 9 aa, Homo Sapiens
IGDYVAKVN

SEQ ID NO: 547009 - protein, 9 aa, Homo Sapiens
LLYKMGQTP

SEQ ID NO: 547010 - protein, 9 aa, Homo Sapiens
QERPSHTEW

SEQ ID NO: 547011 - protein, 9 aa, Homo Sapiens
LYQRAFFWT

SEQ ID NO: 547012 - protein, 9 aa, Homo Sapiens
KAINIWMAV

SEQ ID NO: 547013 - protein, 9 aa, Homo Sapiens
HREECHIHL

SEQ ID NO: 547014 - protein, 9 aa, Homo Sapiens
SDRIRVGEV

SEQ ID NO: 547015 - protein, 9 aa, Homo Sapiens
VSAFNAGLF

SEQ ID NO: 547016 - protein, 9 aa, Homo Sapiens
MVNPTLGVY

SEQ ID NO: 547017 - protein, 9 aa, Homo Sapiens
CITAIVNAS

SEQ ID NO: 547018 - protein, 9 aa, Homo Sapiens
MGRYDIFLR

SEQ ID NO: 547019 - protein, 9 aa, Homo Sapiens
TSQLKSQSS

SEQ ID NO: 547020 - protein, 9 aa, Homo Sapiens
MDDEFVAKG

SEQ ID NO: 547021 - protein, 9 aa, Homo Sapiens
DVSAFNAGL

SEQ ID NO: 547022 - protein, 9 aa, Homo Sapiens
HILVPLMGR

SEQ ID NO: 547023 - protein, 9 aa, Homo Sapiens
SYVKAINIW

SEQ ID NO: 547024 - protein, 9 aa, Homo Sapiens
GDYVAKVND

SEQ ID NO: 547025 - protein, 9 aa, Homo Sapiens
GEGLSEEEI

SEQ ID NO: 547026 - protein, 9 aa, Homo Sapiens
AISFLHEMM

SEQ ID NO: 547027 - protein, 9 aa, Homo Sapiens
MNESDWLHV

SEQ ID NO: 547028 - protein, 9 aa, Homo Sapiens
LKLHSCVKP

SEQ ID NO: 547029 - protein, 9 aa, Homo Sapiens
NFLKERAEL

SEQ ID NO: 547030 - protein, 9 aa, Homo Sapiens
SMQDTHLPS

SEQ ID NO: 547031 - protein, 9 aa, Homo Sapiens
FSSVGESLL

SEQ ID NO: 547032 - protein, 9 aa, Homo Sapiens
GPGGLRKVV

SEQ ID NO: 547033 - protein, 9 aa, Homo Sapiens
SHTEWHHLL

SEQ ID NO: 547034 - protein, 9 aa, Homo Sapiens
SFLHEMMQQ

SEQ ID NO: 547035 - protein, 9 aa, Homo Sapiens
QAISFLHEM

SEQ ID NO: 547036 - protein, 9 aa, Homo Sapiens
RPVKDGGGH

SEQ ID NO: 547037 - protein, 9 aa, Homo Sapiens
GMREMRAGG

SEQ ID NO: 547038 - protein, 9 aa, Homo Sapiens
APVLSQPHL

SEQ ID NO: 547039 - protein, 9 aa, Homo Sapiens
FNCYVEVPI

SEQ ID NO: 547040 - protein, 9 aa, Homo Sapiens
VLSQPHLEA

SEQ ID NO: 547041 - protein, 9 aa, Homo Sapiens
PSLTRSVST

SEQ ID NO: 547042 - protein, 9 aa, Homo Sapiens
PVLSQPHLE

SEQ ID NO: 547043 - protein, 9 aa, Homo Sapiens
DSMQDTHLP

SEQ ID NO: 547044 - protein, 9 aa, Homo Sapiens
HLGQERPSH

SEQ ID NO: 547045 - protein, 9 aa, Homo Sapiens
GGGHEQHHR

SEQ ID NO: 547046 - protein, 9 aa, Homo Sapiens
RMDDEFVAK

SEQ ID NO: 547047 - protein, 9 aa, Homo Sapiens
VINGHLLIG

SEQ ID NO: 547048 - protein, 9 aa, Homo Sapiens
ENACGARAT

SEQ ID NO: 547049 - protein, 9 aa, Homo Sapiens
SIGIGQISS

SEQ ID NO: 547050 - protein, 9 aa, Homo Sapiens
HMEVHTGVR

SEQ ID NO: 547051 - protein, 9 aa, Homo Sapiens
NMVNLLGAC

SEQ ID NO: 547052 - protein, 9 aa, Homo Sapiens
ILWGHRFGP

SEQ ID NO: 547053 - protein, 9 aa, Homo Sapiens
VEWYSWSQL

SEQ ID NO: 547054 - protein, 9 aa, Homo Sapiens
FVIPMLNPL

SEQ ID NO: 547055 - protein, 9 aa, Homo Sapiens
ADRSQVEPE

SEQ ID NO: 547056 - protein, 9 aa, Homo Sapiens
VFTLETAYT

SEQ ID NO: 547057 - protein, 9 aa, Homo Sapiens
QRSLFLYVA

SEQ ID NO: 547058 - protein, 9 aa, Homo Sapiens
GLSSLNSHG

SEQ ID NO: 547059 - protein, 9 aa, Homo Sapiens
SFEVGMLVC

SEQ ID NO: 547060 - protein, 9 aa, Homo Sapiens
FWMTGFLNP

SEQ ID NO: 547061 - protein, 9 aa, Homo Sapiens
EEVLCPPST

SEQ ID NO: 547062 - protein, 9 aa, Homo Sapiens
GSLPVSDIY

SEQ ID NO: 547063 - protein, 9 aa, Homo Sapiens
GRIAAAPAG

SEQ ID NO: 547064 - protein, 9 aa, Homo Sapiens
GQRSLSIVE

SEQ ID NO: 547065 - protein, 9 aa, Homo Sapiens
YTFVIPMLN

SEQ ID NO: 547066 - protein, 9 aa, Homo Sapiens
CRHGDRCFR

SEQ ID NO: 547067 - protein, 9 aa, Homo Sapiens
PSEFQQINI

SEQ ID NO: 547068 - protein, 9 aa, Homo Sapiens
IQQSYLLLS

SEQ ID NO: 547069 - protein, 9 aa, Homo Sapiens
GHHLNMVNL

SEQ ID NO: 547070 - protein, 9 aa, Homo Sapiens
FCFFSCCQV

SEQ ID NO: 547071 - protein, 9 aa, Homo Sapiens
KLKFANSYI

SEQ ID NO: 547072 - protein, 9 aa, Homo Sapiens
RLTDIERGE

SEQ ID NO: 547073 - protein, 9 aa, Homo Sapiens
CIGQRSLSI

SEQ ID NO: 547074 - protein, 9 aa, Homo Sapiens
EEWAKTKDR

SEQ ID NO: 547075 - protein, 9 aa, Homo Sapiens
WTMQMGFPV

SEQ ID NO: 547076 - protein, 9 aa, Homo Sapiens
PMPGRIAAA

SEQ ID NO: 547077 - protein, 9 aa, Homo Sapiens
PRDLYDTNT

SEQ ID NO: 547078 - protein, 9 aa, Homo Sapiens
VDHCSLNTS

SEQ ID NO: 547079 - protein, 9 aa, Homo Sapiens
RSLFLYVAF

SEQ ID NO: 547080 - protein, 9 aa, Homo Sapiens
YNGNQGDHF

SEQ ID NO: 547081 - protein, 9 aa, Homo Sapiens
PGPYTPQPR

SEQ ID NO: 547082 - protein, 9 aa, Homo Sapiens
PQRSLFLYV

SEQ ID NO: 547083 - protein, 9 aa, Homo Sapiens
FKVSALECH

SEQ ID NO: 547084 - protein, 9 aa, Homo Sapiens
STVATFNVS

SEQ ID NO: 547085 - protein, 9 aa, Homo Sapiens
AGRLFENAC

SEQ ID NO: 547086 - protein, 9 aa, Homo Sapiens
NYNGNQGDH

SEQ ID NO: 547087 - protein, 9 aa, Homo Sapiens
RDIMNRWTM

SEQ ID NO: 547088 - protein, 9 aa, Homo Sapiens
MVGKFVIGA

SEQ ID NO: 547089 - protein, 9 aa, Homo Sapiens
HGEYRLTDI

SEQ ID NO: 547090 - protein, 9 aa, Homo Sapiens
FSCCQVGEL

SEQ ID NO: 547091 - protein, 9 aa, Homo Sapiens
LNPQGFLTA

SEQ ID NO: 547092 - protein, 9 aa, Homo Sapiens
KDRTAALRK

SEQ ID NO: 547093 - protein, 9 aa, Homo Sapiens
DHFLTPSGL

SEQ ID NO: 547094 - protein, 9 aa, Homo Sapiens
AEFKVSALE

SEQ ID NO: 547095 - protein, 9 aa, Homo Sapiens
FNVSQLSGF

SEQ ID NO: 547096 - protein, 9 aa, Homo Sapiens
IHKLDKVNS

SEQ ID NO: 547097 - protein, 9 aa, Homo Sapiens
MPGRIAAAP

SEQ ID NO: 547098 - protein, 9 aa, Homo Sapiens
QSIQQSYLL

SEQ ID NO: 547099 - protein, 9 aa, Homo Sapiens
TGVRSYICS

SEQ ID NO: 547100 - protein, 9 aa, Homo Sapiens
IQEEIRAYD

SEQ ID NO: 547101 - protein, 9 aa, Homo Sapiens
VFWMTGFLN

SEQ ID NO: 547102 - protein, 9 aa, Homo Sapiens
GNQGDHFLT

SEQ ID NO: 547103 - protein, 9 aa, Homo Sapiens
GEYRLTDIE

SEQ ID NO: 547104 - protein, 9 aa, Homo Sapiens
MVNLLGACT

SEQ ID NO: 547105 - protein, 9 aa, Homo Sapiens
DHCSLNTSP

SEQ ID NO: 547106 - protein, 9 aa, Homo Sapiens
FYVEWYSWS

SEQ ID NO: 547107 - protein, 9 aa, Homo Sapiens
VTAMVGKFV

SEQ ID NO: 547108 - protein, 9 aa, Homo Sapiens
NRWTMQMGF

SEQ ID NO: 547109 - protein, 9 aa, Homo Sapiens
EFQQINITP

SEQ ID NO: 547110 - protein, 9 aa, Homo Sapiens
RIAAAPAGS

SEQ ID NO: 547111 - protein, 9 aa, Homo Sapiens
LLAAAKSVS

SEQ ID NO: 547112 - protein, 9 aa, Homo Sapiens
ASHSPQRSL

SEQ ID NO: 547113 - protein, 9 aa, Homo Sapiens
QINITPSKF

SEQ ID NO: 547114 - protein, 9 aa, Homo Sapiens
VGQALLAAA

SEQ ID NO: 547115 - protein, 9 aa, Homo Sapiens
VFDLGAPGP

SEQ ID NO: 547116 - protein, 9 aa, Homo Sapiens
VHTGVRSYI

SEQ ID NO: 547117 - protein, 9 aa, Homo Sapiens
KATTSKGVP

SEQ ID NO: 547118 - protein, 9 aa, Homo Sapiens
MNRWTMQMG

SEQ ID NO: 547119 - protein, 9 aa, Homo Sapiens
EPNIDHSTV

SEQ ID NO: 547120 - protein, 9 aa, Homo Sapiens
QVEPEDYKA

SEQ ID NO: 547121 - protein, 9 aa, Homo Sapiens
NACGARATE

SEQ ID NO: 547122 - protein, 9 aa, Homo Sapiens
SLPVSDIYS

SEQ ID NO: 547123 - protein, 9 aa, Homo Sapiens
LEEVLCPPS

SEQ ID NO: 547124 - protein, 9 aa, Homo Sapiens
QTIQSIQQS

SEQ ID NO: 547125 - protein, 9 aa, Homo Sapiens
VFYTFVIPM

SEQ ID NO: 547126 - protein, 9 aa, Homo Sapiens
HTGVRSYIC

SEQ ID NO: 547127 - protein, 9 aa, Homo Sapiens
SALECHPDK

SEQ ID NO: 547128 - protein, 9 aa, Homo Sapiens
DDDVPILMV

SEQ ID NO: 547129 - protein, 9 aa, Homo Sapiens
MVDHCSLNT

SEQ ID NO: 547130 - protein, 9 aa, Homo Sapiens
TPQLPPIPI

SEQ ID NO: 547131 - protein, 9 aa, Homo Sapiens
SSSTCPSQS

SEQ ID NO: 547132 - protein, 9 aa, Homo Sapiens
LEGLQTYRF

SEQ ID NO: 547133 - protein, 9 aa, Homo Sapiens
IPIIPEHKK

SEQ ID NO: 547134 - protein, 9 aa, Homo Sapiens
LGAPGPGTM

SEQ ID NO: 547135 - protein, 9 aa, Homo Sapiens
HIGHHLNMV

SEQ ID NO: 547136 - protein, 9 aa, Homo Sapiens
IMEPLKKFQ

SEQ ID NO: 547137 - protein, 9 aa, Homo Sapiens
NQGDHFLTP

SEQ ID NO: 547138 - protein, 9 aa, Homo Sapiens
QPSSKATTS

SEQ ID NO: 547139 - protein, 9 aa, Homo Sapiens
QRSLSIVEY

SEQ ID NO: 547140 - protein, 9 aa, Homo Sapiens
GLQLLFYSI

SEQ ID NO: 547141 - protein, 9 aa, Homo Sapiens
ETAYTIYVP

SEQ ID NO: 547142 - protein, 9 aa, Homo Sapiens
TDIERGEEE

SEQ ID NO: 547143 - protein, 9 aa, Homo Sapiens
QGDHFLTPS

SEQ ID NO: 547144 - protein, 9 aa, Homo Sapiens
FYSIGIGQI

SEQ ID NO: 547145 - protein, 9 aa, Homo Sapiens
PGRIAAAPA

SEQ ID NO: 547146 - protein, 9 aa, Homo Sapiens
LPPIPIIPE

SEQ ID NO: 547147 - protein, 9 aa, Homo Sapiens
RWTMQMGFP

SEQ ID NO: 547148 - protein, 9 aa, Homo Sapiens
GAPGPGTMP

SEQ ID NO: 547149 - protein, 9 aa, Homo Sapiens
EVHTGVRSY

SEQ ID NO: 547150 - protein, 9 aa, Homo Sapiens
HFLTPSGLA

SEQ ID NO: 547151 - protein, 9 aa, Homo Sapiens
EPEDYKADE

SEQ ID NO: 547152 - protein, 9 aa, Homo Sapiens
KLEPFYVEW

SEQ ID NO: 547153 - protein, 9 aa, Homo Sapiens
KFANSYIME

SEQ ID NO: 547154 - protein, 9 aa, Homo Sapiens
KMASVFYTF

SEQ ID NO: 547155 - protein, 9 aa, Homo Sapiens
SDIYSFMKE

SEQ ID NO: 547156 - protein, 9 aa, Homo Sapiens
RAYDYEELH

SEQ ID NO: 547157 - protein, 9 aa, Homo Sapiens
GKFVIGAAF

SEQ ID NO: 547158 - protein, 9 aa, Homo Sapiens
DLPSEFQQI

SEQ ID NO: 547159 - protein, 9 aa, Homo Sapiens
YVEWYSWSQ

SEQ ID NO: 547160 - protein, 9 aa, Homo Sapiens
VCHKHKKYP

SEQ ID NO: 547161 - protein, 9 aa, Homo Sapiens
VGMLVCHKH

SEQ ID NO: 547162 - protein, 9 aa, Homo Sapiens
PEDYKADED

SEQ ID NO: 547163 - protein, 9 aa, Homo Sapiens
CHKHKKYPF

SEQ ID NO: 547164 - protein, 9 aa, Homo Sapiens
IAAAPAGSR

SEQ ID NO: 547165 - protein, 9 aa, Homo Sapiens
LVCHKHKKY

SEQ ID NO: 547166 - protein, 9 aa, Homo Sapiens
WAKTKDRTA

SEQ ID NO: 547167 - protein, 9 aa, Homo Sapiens
KTKDRTAAL

SEQ ID NO: 547168 - protein, 9 aa, Homo Sapiens
GDRCFRLHN

SEQ ID NO: 547169 - protein, 9 aa, Homo Sapiens
FVIGAAFGL

SEQ ID NO: 547170 - protein, 9 aa, Homo Sapiens
QLLFYSIGI

SEQ ID NO: 547171 - protein, 9 aa, Homo Sapiens
PFYVEWYSW

SEQ ID NO: 547172 - protein, 9 aa, Homo Sapiens
AEKERLRGA

SEQ ID NO: 547173 - protein, 9 aa, Homo Sapiens
DTFCFFSCC

SEQ ID NO: 547174 - protein, 9 aa, Homo Sapiens
PSQSSETIP

SEQ ID NO: 547175 - protein, 9 aa, Homo Sapiens
EWAKTKDRT

SEQ ID NO: 547176 - protein, 9 aa, Homo Sapiens
IQSIQQSYL

SEQ ID NO: 547177 - protein, 9 aa, Homo Sapiens
FANSYIMEP

SEQ ID NO: 547178 - protein, 9 aa, Homo Sapiens
LWGHRFGPV

SEQ ID NO: 547179 - protein, 9 aa, Homo Sapiens
LTDIERGEE

SEQ ID NO: 547180 - protein, 9 aa, Homo Sapiens
LQLLFYSIG

SEQ ID NO: 547181 - protein, 9 aa, Homo Sapiens
WMTGFLNPQ

SEQ ID NO: 547182 - protein, 9 aa, Homo Sapiens
YRLTDIERG

SEQ ID NO: 547183 - protein, 9 aa, Homo Sapiens
LFYSIGIGQ

SEQ ID NO: 547184 - protein, 9 aa, Homo Sapiens
DRCFRLHNK

SEQ ID NO: 547185 - protein, 9 aa, Homo Sapiens
HKLDKVNSV

SEQ ID NO: 547186 - protein, 9 aa, Homo Sapiens
VISLVFDLG

SEQ ID NO: 547187 - protein, 9 aa, Homo Sapiens
SHSPQRSLF

SEQ ID NO: 547188 - protein, 9 aa, Homo Sapiens
TSPVSKKMN

SEQ ID NO: 547189 - protein, 9 aa, Homo Sapiens
EVAEEPNID

SEQ ID NO: 547190 - protein, 9 aa, Homo Sapiens
LEPFYVEWY

SEQ ID NO: 547191 - protein, 9 aa, Homo Sapiens
GHRFGPVLF

SEQ ID NO: 547192 - protein, 9 aa, Homo Sapiens
NTSPVSKKM

SEQ ID NO: 547193 - protein, 9 aa, Homo Sapiens
GGSCRPRKG

SEQ ID NO: 547194 - protein, 9 aa, Homo Sapiens
TIQSIQQSY

SEQ ID NO: 547195 - protein, 9 aa, Homo Sapiens
QQINITPSK

SEQ ID NO: 547196 - protein, 9 aa, Homo Sapiens
VEPEDYKAD

SEQ ID NO: 547197 - protein, 9 aa, Homo Sapiens
TFCFFSCCQ

SEQ ID NO: 547198 - protein, 9 aa, Homo Sapiens
GMLVCHKHK

SEQ ID NO: 547199 - protein, 9 aa, Homo Sapiens
GPVLFEEKN

SEQ ID NO: 547200 - protein, 9 aa, Homo Sapiens
MLVCHKHKK

SEQ ID NO: 547201 - protein, 9 aa, Homo Sapiens
WGGLSSLNS

SEQ ID NO: 547202 - protein, 9 aa, Homo Sapiens
TTPEVAEEP

SEQ ID NO: 547203 - protein, 9 aa, Homo Sapiens
NQPSSKATT

SEQ ID NO: 547204 - protein, 9 aa, Homo Sapiens
IGHHLNMVN

SEQ ID NO: 547205 - protein, 9 aa, Homo Sapiens
QALLAAAKS

SEQ ID NO: 547206 - protein, 9 aa, Homo Sapiens
EEIRAYDYE

SEQ ID NO: 547207 - protein, 9 aa, Homo Sapiens
CPSQSSETI

SEQ ID NO: 547208 - protein, 9 aa, Homo Sapiens
FYTFVIPML

SEQ ID NO: 547209 - protein, 9 aa, Homo Sapiens
DRTAALRKL

SEQ ID NO: 547210 - protein, 9 aa, Homo Sapiens
KRLKEFLKR

SEQ ID NO: 547211 - protein, 9 aa, Homo Sapiens
HSPQRSLFL

SEQ ID NO: 547212 - protein, 9 aa, Homo Sapiens
PIPIIPEHK

SEQ ID NO: 547213 - protein, 9 aa, Homo Sapiens
QPRDLYDTN

SEQ ID NO: 547214 - protein, 9 aa, Homo Sapiens
APAGSRTQH

SEQ ID NO: 547215 - protein, 9 aa, Homo Sapiens
LAEFKVSAL

SEQ ID NO: 547216 - protein, 9 aa, Homo Sapiens
GRLFENACG

SEQ ID NO: 547217 - protein, 9 aa, Homo Sapiens
LTPQLPPIP

SEQ ID NO: 547218 - protein, 9 aa, Homo Sapiens
RSQVEPEDY

SEQ ID NO: 547219 - protein, 9 aa, Homo Sapiens
FRLHNKPTF

SEQ ID NO: 547220 - protein, 9 aa, Homo Sapiens
MEVHTGVRS

SEQ ID NO: 547221 - protein, 9 aa, Homo Sapiens
RFGPVLFEE

SEQ ID NO: 547222 - protein, 9 aa, Homo Sapiens
KERLRGAQR

SEQ ID NO: 547223 - protein, 9 aa, Homo Sapiens
EKERLRGAQ

SEQ ID NO: 547224 - protein, 9 aa, Homo Sapiens
PQLPPIPII

SEQ ID NO: 547225 - protein, 9 aa, Homo Sapiens
TANQPSSKA

SEQ ID NO: 547226 - protein, 9 aa, Homo Sapiens
ISLVFDLGA

SEQ ID NO: 547227 - protein, 9 aa, Homo Sapiens
SIQQSYLLL

SEQ ID NO: 547228 - protein, 9 aa, Homo Sapiens
VAEEPNIDH

SEQ ID NO: 547229 - protein, 9 aa, Homo Sapiens
PSSKATTSK

SEQ ID NO: 547230 - protein, 9 aa, Homo Sapiens
PVSDIYSFM

SEQ ID NO: 547231 - protein, 9 aa, Homo Sapiens
QQSYLLLSN

SEQ ID NO: 547232 - protein, 9 aa, Homo Sapiens
QLPPIPIIP

SEQ ID NO: 547233 - protein, 9 aa, Homo Sapiens
LNMVNLLGA

SEQ ID NO: 547234 - protein, 9 aa, Homo Sapiens
PPGWGGLSS

SEQ ID NO: 547235 - protein, 9 aa, Homo Sapiens
NEGPLEEKL

SEQ ID NO: 547236 - protein, 9 aa, Homo Sapiens
VATFNVSQL

SEQ ID NO: 547237 - protein, 9 aa, Homo Sapiens
WYSWSQLKK

SEQ ID NO: 547238 - protein, 9 aa, Homo Sapiens
MTGFLNPQG

SEQ ID NO: 547239 - protein, 9 aa, Homo Sapiens
RHGDRCFRL

SEQ ID NO: 547240 - protein, 9 aa, Homo Sapiens
TMQMGFPVI

SEQ ID NO: 547241 - protein, 9 aa, Homo Sapiens
DIYSFMKEH

SEQ ID NO: 547242 - protein, 9 aa, Homo Sapiens
HCSLNTSPV

SEQ ID NO: 547243 - protein, 9 aa, Homo Sapiens
EPFYVEWYS

SEQ ID NO: 547244 - protein, 9 aa, Homo Sapiens
HLLLMCSVL

SEQ ID NO: 547245 - protein, 9 aa, Homo Sapiens
LASHSPQRS

SEQ ID NO: 547246 - protein, 9 aa, Homo Sapiens
SVLRYMVQW

SEQ ID NO: 547247 - protein, 9 aa, Homo Sapiens
PEVAEEPNI

SEQ ID NO: 547248 - protein, 9 aa, Homo Sapiens
ALLAAAKSV

SEQ ID NO: 547249 - protein, 9 aa, Homo Sapiens
IVGQALLAA

SEQ ID NO: 547250 - protein, 9 aa, Homo Sapiens
VSALECHPD

SEQ ID NO: 547251 - protein, 9 aa, Homo Sapiens
CGARATEPL

SEQ ID NO: 547252 - protein, 9 aa, Homo Sapiens
FLNPQGFLT

SEQ ID NO: 547253 - protein, 9 aa, Homo Sapiens
SLFLYVAFQ

SEQ ID NO: 547254 - protein, 9 aa, Homo Sapiens
TMNEGPLEE

SEQ ID NO: 547255 - protein, 9 aa, Homo Sapiens
RLRGAQRAA

SEQ ID NO: 547256 - protein, 9 aa, Homo Sapiens
YLTPQLPPI

SEQ ID NO: 547257 - protein, 9 aa, Homo Sapiens
SSKATTSKG

SEQ ID NO: 547258 - protein, 9 aa, Homo Sapiens
GSCRPRKGG

SEQ ID NO: 547259 - protein, 9 aa, Homo Sapiens
LSSLNSHGL

SEQ ID NO: 547260 - protein, 9 aa, Homo Sapiens
TGSLPVSDI

SEQ ID NO: 547261 - protein, 9 aa, Homo Sapiens
SCRPRKGGL

SEQ ID NO: 547262 - protein, 9 aa, Homo Sapiens
CSLNTSPVS

SEQ ID NO: 547263 - protein, 9 aa, Homo Sapiens
FTMNEGPLE

SEQ ID NO: 547264 - protein, 9 aa, Homo Sapiens
HAEKERLRG

SEQ ID NO: 547265 - protein, 9 aa, Homo Sapiens
ANSYIMEPL

SEQ ID NO: 547266 - protein, 9 aa, Homo Sapiens
MALEGLQTY

SEQ ID NO: 547267 - protein, 9 aa, Homo Sapiens
LRGAQRAAT

SEQ ID NO: 547268 - protein, 9 aa, Homo Sapiens
PLEEKLNFS

SEQ ID NO: 547269 - protein, 9 aa, Homo Sapiens
WGHRFGPVL

SEQ ID NO: 547270 - protein, 9 aa, Homo Sapiens
PYTPQPRDL

SEQ ID NO: 547271 - protein, 9 aa, Homo Sapiens
MASVFYTFV

SEQ ID NO: 547272 - protein, 9 aa, Homo Sapiens
TFVIPMLNP

SEQ ID NO: 547273 - protein, 9 aa, Homo Sapiens
RGAQRAATH

SEQ ID NO: 547274 - protein, 9 aa, Homo Sapiens
GLQTYRFTT

SEQ ID NO: 547275 - protein, 9 aa, Homo Sapiens
GWGGLSSLN

SEQ ID NO: 547276 - protein, 9 aa, Homo Sapiens
NGNQGDHFL

SEQ ID NO: 547277 - protein, 9 aa, Homo Sapiens
VSQLSGFLE

SEQ ID NO: 547278 - protein, 9 aa, Homo Sapiens
TAYTIYVPF

SEQ ID NO: 547279 - protein, 9 aa, Homo Sapiens
LQQHMEVHT

SEQ ID NO: 547280 - protein, 9 aa, Homo Sapiens
PQPRDLYDT

SEQ ID NO: 547281 - protein, 9 aa, Homo Sapiens
DLGAPGPGT

SEQ ID NO: 547282 - protein, 9 aa, Homo Sapiens
LLLMCSVLR

SEQ ID NO: 547283 - protein, 9 aa, Homo Sapiens
YSIGIGQIS

SEQ ID NO: 547284 - protein, 9 aa, Homo Sapiens
SQSSETIPP

SEQ ID NO: 547285 - protein, 9 aa, Homo Sapiens
FDLGAPGPG

SEQ ID NO: 547286 - protein, 9 aa, Homo Sapiens
LVFDLGAPG

SEQ ID NO: 547287 - protein, 9 aa, Homo Sapiens
EIRAYDYEE

SEQ ID NO: 547288 - protein, 9 aa, Homo Sapiens
GDHFLTPSG

SEQ ID NO: 547289 - protein, 9 aa, Homo Sapiens
FQQINITPS

SEQ ID NO: 547290 - protein, 9 aa, Homo Sapiens
CSVLRYMVQ

SEQ ID NO: 547291 - protein, 9 aa, Homo Sapiens
GQIVGQALL

SEQ ID NO: 547292 - protein, 9 aa, Homo Sapiens
GQALLAAAK

SEQ ID NO: 547293 - protein, 9 aa, Homo Sapiens
VKWMALEGL

SEQ ID NO: 547294 - protein, 9 aa, Homo Sapiens
LLFYSIGIG

SEQ ID NO: 547295 - protein, 9 aa, Homo Sapiens
NVFWMTGFL

SEQ ID NO: 547296 - protein, 9 aa, Homo Sapiens
AEEPNIDHS

SEQ ID NO: 547297 - protein, 9 aa, Homo Sapiens
QSSETIPPA

SEQ ID NO: 547298 - protein, 9 aa, Homo Sapiens
PPIPIIPEH

SEQ ID NO: 547299 - protein, 9 aa, Homo Sapiens
SYIMEPLKK

SEQ ID NO: 547300 - protein, 9 aa, Homo Sapiens
YIMEPLKKF

SEQ ID NO: 547301 - protein, 9 aa, Homo Sapiens
CFRLHNKPT

SEQ ID NO: 547302 - protein, 9 aa, Homo Sapiens
LAAAKSVSE

SEQ ID NO: 547303 - protein, 9 aa, Homo Sapiens
TPEVAEEPN

SEQ ID NO: 547304 - protein, 9 aa, Homo Sapiens
CCQVGELVI

SEQ ID NO: 547305 - protein, 9 aa, Homo Sapiens
MCSVLRYMV

SEQ ID NO: 547306 - protein, 9 aa, Homo Sapiens
RDLYDTNTS

SEQ ID NO: 547307 - protein, 9 aa, Homo Sapiens
ALEGLQTYR

SEQ ID NO: 547308 - protein, 9 aa, Homo Sapiens
SQVEPEDYK

SEQ ID NO: 547309 - protein, 9 aa, Homo Sapiens
DIERGEEEE

SEQ ID NO: 547310 - protein, 9 aa, Homo Sapiens
QQHMEVHTG

SEQ ID NO: 547311 - protein, 9 aa, Homo Sapiens
EILWGHRFG

SEQ ID NO: 547312 - protein, 9 aa, Homo Sapiens
ATFNVSQLS

SEQ ID NO: 547313 - protein, 9 aa, Homo Sapiens
EFKVSALEC

SEQ ID NO: 547314 - protein, 9 aa, Homo Sapiens
SLVFDLGAP

SEQ ID NO: 547315 - protein, 9 aa, Homo Sapiens
LPSEFQQIN

SEQ ID NO: 547316 - protein, 9 aa, Homo Sapiens
ACGARATEP

SEQ ID NO: 547317 - protein, 9 aa, Homo Sapiens
LQKVFTLET

SEQ ID NO: 547318 - protein, 9 aa, Homo Sapiens
PNIDHSTVV

SEQ ID NO: 547319 - protein, 9 aa, Homo Sapiens
KVSALECHP

SEQ ID NO: 547320 - protein, 9 aa, Homo Sapiens
IERGEEEEE

SEQ ID NO: 547321 - protein, 9 aa, Homo Sapiens
LPVSDIYSF

SEQ ID NO: 547322 - protein, 9 aa, Homo Sapiens
LKEFLKRIT

SEQ ID NO: 547323 - protein, 9 aa, Homo Sapiens
QSYLLLSNL

SEQ ID NO: 547324 - protein, 9 aa, Homo Sapiens
INITPSKFI

SEQ ID NO: 547325 - protein, 9 aa, Homo Sapiens
IMNRWTMQM

SEQ ID NO: 547326 - protein, 9 aa, Homo Sapiens
GGLSSLNSH

SEQ ID NO: 547327 - protein, 9 aa, Homo Sapiens
QIVGQALLA

SEQ ID NO: 547328 - protein, 9 aa, Homo Sapiens
AKTKDRTAA

SEQ ID NO: 547329 - protein, 9 aa, Homo Sapiens
THLLLMCSV

SEQ ID NO: 547330 - protein, 9 aa, Homo Sapiens
EDYKADEDP

SEQ ID NO: 547331 - protein, 9 aa, Homo Sapiens
LEEKLNFSQ

SEQ ID NO: 547332 - protein, 9 aa, Homo Sapiens
MQMGFPVIT

SEQ ID NO: 547333 - protein, 9 aa, Homo Sapiens
MNEGPLEEK

SEQ ID NO: 547334 - protein, 9 aa, Homo Sapiens
LKFANSYIM

SEQ ID NO: 547335 - protein, 9 aa, Homo Sapiens
KWMALEGLQ

SEQ ID NO: 547336 - protein, 9 aa, Homo Sapiens
QEEIRAYDY

SEQ ID NO: 547337 - protein, 9 aa, Homo Sapiens
NSYIMEPLK

SEQ ID NO: 547338 - protein, 9 aa, Homo Sapiens
TPQPRDLYD

SEQ ID NO: 547339 - protein, 9 aa, Homo Sapiens
TKDRTAALR

SEQ ID NO: 547340 - protein, 9 aa, Homo Sapiens
EWYSWSQLK

SEQ ID NO: 547341 - protein, 9 aa, Homo Sapiens
EEPNIDHST

SEQ ID NO: 547342 - protein, 9 aa, Homo Sapiens
FGPVLFEEK

SEQ ID NO: 547343 - protein, 9 aa, Homo Sapiens
IGQRSLSIV

SEQ ID NO: 547344 - protein, 9 aa, Homo Sapiens
LTGIQEEIR

SEQ ID NO: 547345 - protein, 9 aa, Homo Sapiens
AAPAGSRTQ

SEQ ID NO: 547346 - protein, 9 aa, Homo Sapiens
DSTVATFNV

SEQ ID NO: 547347 - protein, 9 aa, Homo Sapiens
DRSQVEPED

SEQ ID NO: 547348 - protein, 9 aa, Homo Sapiens
FFSCCQVGE

SEQ ID NO: 547349 - protein, 9 aa, Homo Sapiens
FTLETAYTI

SEQ ID NO: 547350 - protein, 9 aa, Homo Sapiens
TVATFNVSQ

SEQ ID NO: 547351 - protein, 9 aa, Homo Sapiens
ASVFYTFVI

SEQ ID NO: 547352 - protein, 9 aa, Homo Sapiens
GIQEEIRAY

SEQ ID NO: 547353 - protein, 9 aa, Homo Sapiens
SPQRSLFLY

SEQ ID NO: 547354 - protein, 9 aa, Homo Sapiens
QKVFTLETA

SEQ ID NO: 547355 - protein, 9 aa, Homo Sapiens
RLFENACGA

SEQ ID NO: 547356 - protein, 9 aa, Homo Sapiens
LMCSVLRYM

SEQ ID NO: 547357 - protein, 9 aa, Homo Sapiens
LGAGRLFEN

SEQ ID NO: 547358 - protein, 9 aa, Homo Sapiens
EYRLTDIER

SEQ ID NO: 547359 - protein, 9 aa, Homo Sapiens
LTANQPSSK

SEQ ID NO: 547360 - protein, 9 aa, Homo Sapiens
ACRHGDRCF

SEQ ID NO: 547361 - protein, 9 aa, Homo Sapiens
KLDKVNSVI

SEQ ID NO: 547362 - protein, 9 aa, Homo Sapiens
HRFGPVLFE

SEQ ID NO: 547363 - protein, 9 aa, Homo Sapiens
PFTMNEGPL

SEQ ID NO: 547364 - protein, 9 aa, Homo Sapiens
THIGHHLNM

SEQ ID NO: 547365 - protein, 9 aa, Homo Sapiens
LFENACGAR

SEQ ID NO: 547366 - protein, 9 aa, Homo Sapiens
GPYTPQPRD

SEQ ID NO: 547367 - protein, 9 aa, Homo Sapiens
KFVIGAAFG

SEQ ID NO: 547368 - protein, 9 aa, Homo Sapiens
TAMVGKFVI

SEQ ID NO: 547369 - protein, 9 aa, Homo Sapiens
SVFYTFVIP

SEQ ID NO: 547370 - protein, 9 aa, Homo Sapiens
SEFQQINIT

SEQ ID NO: 547371 - protein, 9 aa, Homo Sapiens
EVGMLVCHK

SEQ ID NO: 547372 - protein, 9 aa, Homo Sapiens
QHMEVHTGV

SEQ ID NO: 547373 - protein, 9 aa, Homo Sapiens
AAAPAGSRT

SEQ ID NO: 547374 - protein, 9 aa, Homo Sapiens
KVFTLETAY

SEQ ID NO: 547375 - protein, 9 aa, Homo Sapiens
LNTSPVSKK

SEQ ID NO: 547376 - protein, 9 aa, Homo Sapiens
EGPLEEKLN

SEQ ID NO: 547377 - protein, 9 aa, Homo Sapiens
ERLRGAQRA

SEQ ID NO: 547378 - protein, 9 aa, Homo Sapiens
TGIQEEIRA

SEQ ID NO: 547379 - protein, 9 aa, Homo Sapiens
RLKEFLKRI

SEQ ID NO: 547380 - protein, 9 aa, Homo Sapiens
TFNVSQLSG

SEQ ID NO: 547381 - protein, 9 aa, Homo Sapiens
DIMNRWTMQ

SEQ ID NO: 547382 - protein, 9 aa, Homo Sapiens
SYLLLSNLN

SEQ ID NO: 547383 - protein, 9 aa, Homo Sapiens
TGFLNPQGF

SEQ ID NO: 547384 - protein, 9 aa, Homo Sapiens
HLNMVNLLG

SEQ ID NO: 547385 - protein, 9 aa, Homo Sapiens
SSETIPPAA

SEQ ID NO: 547386 - protein, 9 aa, Homo Sapiens
WMALEGLQT

SEQ ID NO: 547387 - protein, 9 aa, Homo Sapiens
YTPQPRDLY

SEQ ID NO: 547388 - protein, 9 aa, Homo Sapiens
DDVPILMVH

SEQ ID NO: 547389 - protein, 9 aa, Homo Sapiens
SSTCPSQSS

SEQ ID NO: 547390 - protein, 9 aa, Homo Sapiens
PVKWMALEG

SEQ ID NO: 547391 - protein, 9 aa, Homo Sapiens
HHLNMVNLL

SEQ ID NO: 547392 - protein, 9 aa, Homo Sapiens
LETAYTIYV

SEQ ID NO: 547393 - protein, 9 aa, Homo Sapiens
KTGSLPVSD

SEQ ID NO: 547394 - protein, 9 aa, Homo Sapiens
TCPSQSSET

SEQ ID NO: 547395 - protein, 9 aa, Homo Sapiens
SLNTSPVSK

SEQ ID NO: 547396 - protein, 9 aa, Homo Sapiens
GAGRLFENA

SEQ ID NO: 547397 - protein, 9 aa, Homo Sapiens
RCFRLHNKP

SEQ ID NO: 547398 - protein, 9 aa, Homo Sapiens
PGWGGLSSL

SEQ ID NO: 547399 - protein, 9 aa, Homo Sapiens
PTHLLLMCS

SEQ ID NO: 547400 - protein, 9 aa, Homo Sapiens
QILAEFKVS

SEQ ID NO: 547401 - protein, 9 aa, Homo Sapiens
GAQRAATHI

SEQ ID NO: 547402 - protein, 9 aa, Homo Sapiens
RTAALRKLP

SEQ ID NO: 547403 - protein, 9 aa, Homo Sapiens
GPLEEKLNF

SEQ ID NO: 547404 - protein, 9 aa, Homo Sapiens
ANQPSSKAT

SEQ ID NO: 547405 - protein, 9 aa, Homo Sapiens
FEVGMLVCH

SEQ ID NO: 547406 - protein, 9 aa, Homo Sapiens
LDDDVPILM

SEQ ID NO: 547407 - protein, 9 aa, Homo Sapiens
NVSQLSGFL

SEQ ID NO: 547408 - protein, 9 aa, Homo Sapiens
VGKFVIGAA

SEQ ID NO: 547409 - protein, 9 aa, Homo Sapiens
VIGAAFGLI

SEQ ID NO: 547410 - protein, 9 aa, Homo Sapiens
IRAYDYEEL

SEQ ID NO: 547411 - protein, 9 aa, Homo Sapiens
MDTFCFFSC

SEQ ID NO: 547412 - protein, 9 aa, Homo Sapiens
HGDRCFRLH

SEQ ID NO: 547413 - protein, 9 aa, Homo Sapiens
CFFSCCQVG

SEQ ID NO: 547414 - protein, 9 aa, Homo Sapiens
LLMCSVLRY

SEQ ID NO: 547415 - protein, 9 aa, Homo Sapiens
FENACGARA

SEQ ID NO: 547416 - protein, 9 aa, Homo Sapiens
SKATTSKGV

SEQ ID NO: 547417 - protein, 9 aa, Homo Sapiens
AMVGKFVIG

SEQ ID NO: 547418 - protein, 9 aa, Homo Sapiens
VSDIYSFMK

SEQ ID NO: 547419 - protein, 9 aa, Homo Sapiens
GFLNPQGFL

SEQ ID NO: 547420 - protein, 9 aa, Homo Sapiens
STCPSQSSE

SEQ ID NO: 547421 - protein, 9 aa, Homo Sapiens
TLETAYTIY

SEQ ID NO: 547422 - protein, 9 aa, Homo Sapiens
EGLQTYRFT

SEQ ID NO: 547423 - protein, 9 aa, Homo Sapiens
SCCQVGELV

SEQ ID NO: 547424 - protein, 9 aa, Homo Sapiens
IGIGQISSE

SEQ ID NO: 547425 - protein, 9 aa, Homo Sapiens
ILAEFKVSA

SEQ ID NO: 547426 - protein, 9 aa, Homo Sapiens
YDVQAQKFL

SEQ ID NO: 547427 - protein, 9 aa, Homo Sapiens
SIVAKRLEG

SEQ ID NO: 547428 - protein, 9 aa, Homo Sapiens
SAIVTRPLN

SEQ ID NO: 547429 - protein, 9 aa, Homo Sapiens
YTECGRGFT

SEQ ID NO: 547430 - protein, 9 aa, Homo Sapiens
LDITLTCNK

SEQ ID NO: 547431 - protein, 9 aa, Homo Sapiens
QLAFALANG

SEQ ID NO: 547432 - protein, 9 aa, Homo Sapiens
GRQVCTCKA

SEQ ID NO: 547433 - protein, 9 aa, Homo Sapiens
DCDLLMVMV

SEQ ID NO: 547434 - protein, 9 aa, Homo Sapiens
STVISYKCC

SEQ ID NO: 547435 - protein, 9 aa, Homo Sapiens
TPGRQVCTC

SEQ ID NO: 547436 - protein, 9 aa, Homo Sapiens
MLGKYHTPV

SEQ ID NO: 547437 - protein, 9 aa, Homo Sapiens
PQFKYQEPM

SEQ ID NO: 547438 - protein, 9 aa, Homo Sapiens
PGRLRTVPS

SEQ ID NO: 547439 - protein, 9 aa, Homo Sapiens
LPHLLLDIT

SEQ ID NO: 547440 - protein, 9 aa, Homo Sapiens
ESAIVTRPL

SEQ ID NO: 547441 - protein, 9 aa, Homo Sapiens
DVNVPTFSL

SEQ ID NO: 547442 - protein, 9 aa, Homo Sapiens
QAYSNKDKL

SEQ ID NO: 547443 - protein, 9 aa, Homo Sapiens
PELSREYDI

SEQ ID NO: 547444 - protein, 9 aa, Homo Sapiens
KPFVYTECG

SEQ ID NO: 547445 - protein, 9 aa, Homo Sapiens
VMVPGHNFY

SEQ ID NO: 547446 - protein, 9 aa, Homo Sapiens
RQAYSNKDK

SEQ ID NO: 547447 - protein, 9 aa, Homo Sapiens
VAKRLEGLG

SEQ ID NO: 547448 - protein, 9 aa, Homo Sapiens
LLAQGHGIV

SEQ ID NO: 547449 - protein, 9 aa, Homo Sapiens
QFLCVAEDT

SEQ ID NO: 547450 - protein, 9 aa, Homo Sapiens
PGHNFYHNY

SEQ ID NO: 547451 - protein, 9 aa, Homo Sapiens
LIVALHDSS

SEQ ID NO: 547452 - protein, 9 aa, Homo Sapiens
RTVPSTQSQ

SEQ ID NO: 547453 - protein, 9 aa, Homo Sapiens
LVKTAGNYE

SEQ ID NO: 547454 - protein, 9 aa, Homo Sapiens
LAGQLEVGH

SEQ ID NO: 547455 - protein, 9 aa, Homo Sapiens
AFALANGFT

SEQ ID NO: 547456 - protein, 9 aa, Homo Sapiens
LPGLLIQES

SEQ ID NO: 547457 - protein, 9 aa, Homo Sapiens
LLMVMVPGH

SEQ ID NO: 547458 - protein, 9 aa, Homo Sapiens
YTYNPQFKY

SEQ ID NO: 547459 - protein, 9 aa, Homo Sapiens
HRDCDLLMV

SEQ ID NO: 547460 - protein, 9 aa, Homo Sapiens
NGPIGQRGE

SEQ ID NO: 547461 - protein, 9 aa, Homo Sapiens
FSLCGKTFS

SEQ ID NO: 547462 - protein, 9 aa, Homo Sapiens
VKTAGNYES

SEQ ID NO: 547463 - protein, 9 aa, Homo Sapiens
GKSTVISYK

SEQ ID NO: 547464 - protein, 9 aa, Homo Sapiens
KSTVISYKC

SEQ ID NO: 547465 - protein, 9 aa, Homo Sapiens
KMLGKYHTP

SEQ ID NO: 547466 - protein, 9 aa, Homo Sapiens
IGQRGEGDP

SEQ ID NO: 547467 - protein, 9 aa, Homo Sapiens
LANGFTAAG

SEQ ID NO: 547468 - protein, 9 aa, Homo Sapiens
RRLNSSEAL

SEQ ID NO: 547469 - protein, 9 aa, Homo Sapiens
QTPLDPYSQ

SEQ ID NO: 547470 - protein, 9 aa, Homo Sapiens
ISYKCCPGY

SEQ ID NO: 547471 - protein, 9 aa, Homo Sapiens
TAGNYESKR

SEQ ID NO: 547472 - protein, 9 aa, Homo Sapiens
GHRDCDLLM

SEQ ID NO: 547473 - protein, 9 aa, Homo Sapiens
QVQNGPIGQ

SEQ ID NO: 547474 - protein, 9 aa, Homo Sapiens
RRQAYSNKD

SEQ ID NO: 547475 - protein, 9 aa, Homo Sapiens
TVISYKCCP

SEQ ID NO: 547476 - protein, 9 aa, Homo Sapiens
KQDSLHHKN

SEQ ID NO: 547477 - protein, 9 aa, Homo Sapiens
AIVTRPLNP

SEQ ID NO: 547478 - protein, 9 aa, Homo Sapiens
EPKKCRRCV

SEQ ID NO: 547479 - protein, 9 aa, Homo Sapiens
LRTVPSTQS

SEQ ID NO: 547480 - protein, 9 aa, Homo Sapiens
HQPGRLRTV

SEQ ID NO: 547481 - protein, 9 aa, Homo Sapiens
PTFSLCGKT

SEQ ID NO: 547482 - protein, 9 aa, Homo Sapiens
LRAAAEAAL

SEQ ID NO: 547483 - protein, 9 aa, Homo Sapiens
NGFTAAGVL

SEQ ID NO: 547484 - protein, 9 aa, Homo Sapiens
VRFARTVVV

SEQ ID NO: 547485 - protein, 9 aa, Homo Sapiens
IGSPVRFAR

SEQ ID NO: 547486 - protein, 9 aa, Homo Sapiens
QLFESAVSA

SEQ ID NO: 547487 - protein, 9 aa, Homo Sapiens
LLFYDVQAQ

SEQ ID NO: 547488 - protein, 9 aa, Homo Sapiens
VISYKCCPG

SEQ ID NO: 547489 - protein, 9 aa, Homo Sapiens
FLCVAEDTS

SEQ ID NO: 547490 - protein, 9 aa, Homo Sapiens
VQAQKFLEE

SEQ ID NO: 547491 - protein, 9 aa, Homo Sapiens
EGSKQFLCV

SEQ ID NO: 547492 - protein, 9 aa, Homo Sapiens
NGEGEPGQG

SEQ ID NO: 547493 - protein, 9 aa, Homo Sapiens
AVSAVLPGP

SEQ ID NO: 547494 - protein, 9 aa, Homo Sapiens
PFVYTECGR

SEQ ID NO: 547495 - protein, 9 aa, Homo Sapiens
VPGHNFYHN

SEQ ID NO: 547496 - protein, 9 aa, Homo Sapiens
LMVMVPGHN

SEQ ID NO: 547497 - protein, 9 aa, Homo Sapiens
FTKMLKKTC

SEQ ID NO: 547498 - protein, 9 aa, Homo Sapiens
ALANGFTAA

SEQ ID NO: 547499 - protein, 9 aa, Homo Sapiens
HNYTRLWLP

SEQ ID NO: 547500 - protein, 9 aa, Homo Sapiens
PVRFARTVV

SEQ ID NO: 547501 - protein, 9 aa, Homo Sapiens
VALHDSSDY

SEQ ID NO: 547502 - protein, 9 aa, Homo Sapiens
IQESPEKYI

SEQ ID NO: 547503 - protein, 9 aa, Homo Sapiens
GEKPFVYTE

SEQ ID NO: 547504 - protein, 9 aa, Homo Sapiens
NVPTFSLCG

SEQ ID NO: 547505 - protein, 9 aa, Homo Sapiens
CVAEDTSDH

SEQ ID NO: 547506 - protein, 9 aa, Homo Sapiens
LAFALANGF

SEQ ID NO: 547507 - protein, 9 aa, Homo Sapiens
DNPPELSRE

SEQ ID NO: 547508 - protein, 9 aa, Homo Sapiens
AIGSPVRFA

SEQ ID NO: 547509 - protein, 9 aa, Homo Sapiens
GLAGQLEVG

SEQ ID NO: 547510 - protein, 9 aa, Homo Sapiens
LEESNGEGE

SEQ ID NO: 547511 - protein, 9 aa, Homo Sapiens
SREYDIIVC

SEQ ID NO: 547512 - protein, 9 aa, Homo Sapiens
KRTTPGRQV

SEQ ID NO: 547513 - protein, 9 aa, Homo Sapiens
VTRPLNPFT

SEQ ID NO: 547514 - protein, 9 aa, Homo Sapiens
NPPELSREY

SEQ ID NO: 547515 - protein, 9 aa, Homo Sapiens
RAGTLIVAL

SEQ ID NO: 547516 - protein, 9 aa, Homo Sapiens
FARTVVVGK

SEQ ID NO: 547517 - protein, 9 aa, Homo Sapiens
LLIQESPEK

SEQ ID NO: 547518 - protein, 9 aa, Homo Sapiens
QDSLHHKNP

SEQ ID NO: 547519 - protein, 9 aa, Homo Sapiens
ESELLIIAQ

SEQ ID NO: 547520 - protein, 9 aa, Homo Sapiens
SLHHKNPTV

SEQ ID NO: 547521 - protein, 9 aa, Homo Sapiens
GDWKQDSLH

SEQ ID NO: 547522 - protein, 9 aa, Homo Sapiens
GLLEESNGE

SEQ ID NO: 547523 - protein, 9 aa, Homo Sapiens
MVPGHNFYH

SEQ ID NO: 547524 - protein, 9 aa, Homo Sapiens
VNDNPPELS

SEQ ID NO: 547525 - protein, 9 aa, Homo Sapiens
ANGFTAAGV

SEQ ID NO: 547526 - protein, 9 aa, Homo Sapiens
SPVRFARTV

SEQ ID NO: 547527 - protein, 9 aa, Homo Sapiens
CKRTTPGRQ

SEQ ID NO: 547528 - protein, 9 aa, Homo Sapiens
AGQLEVGHR

SEQ ID NO: 547529 - protein, 9 aa, Homo Sapiens
GQLAFALAN

SEQ ID NO: 547530 - protein, 9 aa, Homo Sapiens
LEPRMQTPL

SEQ ID NO: 547531 - protein, 9 aa, Homo Sapiens
RLEGLGALT

SEQ ID NO: 547532 - protein, 9 aa, Homo Sapiens
DKLGTAETG

SEQ ID NO: 547533 - protein, 9 aa, Homo Sapiens
LHHKNPTVT

SEQ ID NO: 547534 - protein, 9 aa, Homo Sapiens
QAQKFLEER

SEQ ID NO: 547535 - protein, 9 aa, Homo Sapiens
DLLMVMVPG

SEQ ID NO: 547536 - protein, 9 aa, Homo Sapiens
LQVPGGGGG

SEQ ID NO: 547537 - protein, 9 aa, Homo Sapiens
SKKMLGKYH

SEQ ID NO: 547538 - protein, 9 aa, Homo Sapiens
GAIGSPVRF

SEQ ID NO: 547539 - protein, 9 aa, Homo Sapiens
GSKQFLCVA

SEQ ID NO: 547540 - protein, 9 aa, Homo Sapiens
EKPFVYTEC

SEQ ID NO: 547541 - protein, 9 aa, Homo Sapiens
GSPVRFART

SEQ ID NO: 547542 - protein, 9 aa, Homo Sapiens
DWKQDSLHH

SEQ ID NO: 547543 - protein, 9 aa, Homo Sapiens
GLGALTHGD

SEQ ID NO: 547544 - protein, 9 aa, Homo Sapiens
HLLLDITLT

SEQ ID NO: 547545 - protein, 9 aa, Homo Sapiens
QVPGGGGGE

SEQ ID NO: 547546 - protein, 9 aa, Homo Sapiens
TGEKPFVYT

SEQ ID NO: 547547 - protein, 9 aa, Homo Sapiens
GIVLSENMN

SEQ ID NO: 547548 - protein, 9 aa, Homo Sapiens
SLLFYDVQA

SEQ ID NO: 547549 - protein, 9 aa, Homo Sapiens
LFYDVQAQK

SEQ ID NO: 547550 - protein, 9 aa, Homo Sapiens
NYTRLWLPR

SEQ ID NO: 547551 - protein, 9 aa, Homo Sapiens
VPGGGGGEW

SEQ ID NO: 547552 - protein, 9 aa, Homo Sapiens
TRPLNPFTA

SEQ ID NO: 547553 - protein, 9 aa, Homo Sapiens
LLEPRMQTP

SEQ ID NO: 547554 - protein, 9 aa, Homo Sapiens
PHLLLDITL

SEQ ID NO: 547555 - protein, 9 aa, Homo Sapiens
LEKESAIVT

SEQ ID NO: 547556 - protein, 9 aa, Homo Sapiens
PMLPHLLLD

SEQ ID NO: 547557 - protein, 9 aa, Homo Sapiens
LAQGHGIVL

SEQ ID NO: 547558 - protein, 9 aa, Homo Sapiens
PGLLIQESP

SEQ ID NO: 547559 - protein, 9 aa, Homo Sapiens
LIIAQELEL

SEQ ID NO: 547560 - protein, 9 aa, Homo Sapiens
MLPHLLLDI

SEQ ID NO: 547561 - protein, 9 aa, Homo Sapiens
PPELSREYD

SEQ ID NO: 547562 - protein, 9 aa, Homo Sapiens
HGIVLSENM

SEQ ID NO: 547563 - protein, 9 aa, Homo Sapiens
ELSREYDII

SEQ ID NO: 547564 - protein, 9 aa, Homo Sapiens
GPIGQRGEG

SEQ ID NO: 547565 - protein, 9 aa, Homo Sapiens
SAVLPGPML

SEQ ID NO: 547566 - protein, 9 aa, Homo Sapiens
FKYQEPMPT

SEQ ID NO: 547567 - protein, 9 aa, Homo Sapiens
YHNYTRLWL

SEQ ID NO: 547568 - protein, 9 aa, Homo Sapiens
ESNGEGEPG

SEQ ID NO: 547569 - protein, 9 aa, Homo Sapiens
EAALSQTGF

SEQ ID NO: 547570 - protein, 9 aa, Homo Sapiens
IVAKRLEGL

SEQ ID NO: 547571 - protein, 9 aa, Homo Sapiens
EPRMQTPLD

SEQ ID NO: 547572 - protein, 9 aa, Homo Sapiens
SNGEGEPGQ

SEQ ID NO: 547573 - protein, 9 aa, Homo Sapiens
VNVPTFSLC

SEQ ID NO: 547574 - protein, 9 aa, Homo Sapiens
LFESAVSAV

SEQ ID NO: 547575 - protein, 9 aa, Homo Sapiens
ADVNVPTFS

SEQ ID NO: 547576 - protein, 9 aa, Homo Sapiens
GQLEVGHRD

SEQ ID NO: 547577 - protein, 9 aa, Homo Sapiens
LSQTGFSYD

SEQ ID NO: 547578 - protein, 9 aa, Homo Sapiens
LLDITLTCN

SEQ ID NO: 547579 - protein, 9 aa, Homo Sapiens
NPQFKYQEP

SEQ ID NO: 547580 - protein, 9 aa, Homo Sapiens
DSLHHKNPT

SEQ ID NO: 547581 - protein, 9 aa, Homo Sapiens
HTPVSYRMA

SEQ ID NO: 547582 - protein, 9 aa, Homo Sapiens
QNGPIGQRG

SEQ ID NO: 547583 - protein, 9 aa, Homo Sapiens
QESPEKYIL

SEQ ID NO: 547584 - protein, 9 aa, Homo Sapiens
PGRQVCTCK

SEQ ID NO: 547585 - protein, 9 aa, Homo Sapiens
RQLFESAVS

SEQ ID NO: 547586 - protein, 9 aa, Homo Sapiens
YKCCPGYEK

SEQ ID NO: 547587 - protein, 9 aa, Homo Sapiens
RGHQPGRLR

SEQ ID NO: 547588 - protein, 9 aa, Homo Sapiens
AQGHGIVLS

SEQ ID NO: 547589 - protein, 9 aa, Homo Sapiens
RDCDLLMVM

SEQ ID NO: 547590 - protein, 9 aa, Homo Sapiens
LLLDITLTC

SEQ ID NO: 547591 - protein, 9 aa, Homo Sapiens
KTAGNYESK

SEQ ID NO: 547592 - protein, 9 aa, Homo Sapiens
LEGLGALTH

SEQ ID NO: 547593 - protein, 9 aa, Homo Sapiens
RLRTVPSTQ

SEQ ID NO: 547594 - protein, 9 aa, Homo Sapiens
VSAVLPGPM

SEQ ID NO: 547595 - protein, 9 aa, Homo Sapiens
VYTECGRGF

SEQ ID NO: 547596 - protein, 9 aa, Homo Sapiens
YNPQFKYQE

SEQ ID NO: 547597 - protein, 9 aa, Homo Sapiens
GHGIVLSEN

SEQ ID NO: 547598 - protein, 9 aa, Homo Sapiens
GRLRTVPST

SEQ ID NO: 547599 - protein, 9 aa, Homo Sapiens
IRAGTLIVA

SEQ ID NO: 547600 - protein, 9 aa, Homo Sapiens
LEVGHRDCD

SEQ ID NO: 547601 - protein, 9 aa, Homo Sapiens
EKESAIVTR

SEQ ID NO: 547602 - protein, 9 aa, Homo Sapiens
IVALHDSSD

SEQ ID NO: 547603 - protein, 9 aa, Homo Sapiens
DVQAQKFLE

SEQ ID NO: 547604 - protein, 9 aa, Homo Sapiens
TFSLCGKTF

SEQ ID NO: 547605 - protein, 9 aa, Homo Sapiens
TLIVALHDS

SEQ ID NO: 547606 - protein, 9 aa, Homo Sapiens
RFARTVVVG

SEQ ID NO: 547607 - protein, 9 aa, Homo Sapiens
CDLLMVMVP

SEQ ID NO: 547608 - protein, 9 aa, Homo Sapiens
YIRAGTLIV

SEQ ID NO: 547609 - protein, 9 aa, Homo Sapiens
GHNFYHNYT

SEQ ID NO: 547610 - protein, 9 aa, Homo Sapiens
ELPGLLIQE

SEQ ID NO: 547611 - protein, 9 aa, Homo Sapiens
FVYTECGRG

SEQ ID NO: 547612 - protein, 9 aa, Homo Sapiens
PGGGGGEWS

SEQ ID NO: 547613 - protein, 9 aa, Homo Sapiens
VQNGPIGQR

SEQ ID NO: 547614 - protein, 9 aa, Homo Sapiens
IAQELELED

SEQ ID NO: 547615 - protein, 9 aa, Homo Sapiens
SNKDKLGTA

SEQ ID NO: 547616 - protein, 9 aa, Homo Sapiens
LGLLEPRMQ

SEQ ID NO: 547617 - protein, 9 aa, Homo Sapiens
LSREYDIIV

SEQ ID NO: 547618 - protein, 9 aa, Homo Sapiens
RQVCTCKAG

SEQ ID NO: 547619 - protein, 9 aa, Homo Sapiens
TTPGRQVCT

SEQ ID NO: 547620 - protein, 9 aa, Homo Sapiens
GSLLFYDVQ

SEQ ID NO: 547621 - protein, 9 aa, Homo Sapiens
SELLIIAQE

SEQ ID NO: 547622 - protein, 9 aa, Homo Sapiens
LEPPEPKKC

SEQ ID NO: 547623 - protein, 9 aa, Homo Sapiens
FYDVQAQKF

SEQ ID NO: 547624 - protein, 9 aa, Homo Sapiens
SKQFLCVAE

SEQ ID NO: 547625 - protein, 9 aa, Homo Sapiens
FALANGFTA

SEQ ID NO: 547626 - protein, 9 aa, Homo Sapiens
LNSSEALAP

SEQ ID NO: 547627 - protein, 9 aa, Homo Sapiens
HTGEKPFVY

SEQ ID NO: 547628 - protein, 9 aa, Homo Sapiens
SEELLVKTA

SEQ ID NO: 547629 - protein, 9 aa, Homo Sapiens
AALSQTGFS

SEQ ID NO: 547630 - protein, 9 aa, Homo Sapiens
LGKYHTPVS

SEQ ID NO: 547631 - protein, 9 aa, Homo Sapiens
GQRGEGDPS

SEQ ID NO: 547632 - protein, 9 aa, Homo Sapiens
TYNPQFKYQ

SEQ ID NO: 547633 - protein, 9 aa, Homo Sapiens
GKYHTPVSY

SEQ ID NO: 547634 - protein, 9 aa, Homo Sapiens
GLLIQESPE

SEQ ID NO: 547635 - protein, 9 aa, Homo Sapiens
EELLVKTAG

SEQ ID NO: 547636 - protein, 9 aa, Homo Sapiens
AAAEAALSQ

SEQ ID NO: 547637 - protein, 9 aa, Homo Sapiens
EESNGEGEP

SEQ ID NO: 547638 - protein, 9 aa, Homo Sapiens
IVTRPLNPF

SEQ ID NO: 547639 - protein, 9 aa, Homo Sapiens
PPEPKKCRR

SEQ ID NO: 547640 - protein, 9 aa, Homo Sapiens
LLEESNGEG

SEQ ID NO: 547641 - protein, 9 aa, Homo Sapiens
ALSQTGFSY

SEQ ID NO: 547642 - protein, 9 aa, Homo Sapiens
SYKCCPGYE

SEQ ID NO: 547643 - protein, 9 aa, Homo Sapiens
YSNKDKLGT

SEQ ID NO: 547644 - protein, 9 aa, Homo Sapiens
VGHRDCDLL

SEQ ID NO: 547645 - protein, 9 aa, Homo Sapiens
FESAVSAVL

SEQ ID NO: 547646 - protein, 9 aa, Homo Sapiens
FYHNYTRLW

SEQ ID NO: 547647 - protein, 9 aa, Homo Sapiens
MQTPLDPYS

SEQ ID NO: 547648 - protein, 9 aa, Homo Sapiens
AYSNKDKLG

SEQ ID NO: 547649 - protein, 9 aa, Homo Sapiens
AKRLEGLGA

SEQ ID NO: 547650 - protein, 9 aa, Homo Sapiens
KQFLCVAED

SEQ ID NO: 547651 - protein, 9 aa, Homo Sapiens
RLNSSEALA

SEQ ID NO: 547652 - protein, 9 aa, Homo Sapiens
HHKNPTVTH

SEQ ID NO: 547653 - protein, 9 aa, Homo Sapiens
PKKCRRCVL

SEQ ID NO: 547654 - protein, 9 aa, Homo Sapiens
NSSEALAPS

SEQ ID NO: 547655 - protein, 9 aa, Homo Sapiens
IVLSENMND

SEQ ID NO: 547656 - protein, 9 aa, Homo Sapiens
GHQPGRLRT

SEQ ID NO: 547657 - protein, 9 aa, Homo Sapiens
LLIIAQELE

SEQ ID NO: 547658 - protein, 9 aa, Homo Sapiens
KKMLGKYHT

SEQ ID NO: 547659 - protein, 9 aa, Homo Sapiens
EGLGALTHG

SEQ ID NO: 547660 - protein, 9 aa, Homo Sapiens
YESELLIIA

SEQ ID NO: 547661 - protein, 9 aa, Homo Sapiens
NDNPPELSR

SEQ ID NO: 547662 - protein, 9 aa, Homo Sapiens
KLLAQGHGI

SEQ ID NO: 547663 - protein, 9 aa, Homo Sapiens
GLLEPRMQT

SEQ ID NO: 547664 - protein, 9 aa, Homo Sapiens
VQTDSPSLR

SEQ ID NO: 547665 - protein, 9 aa, Homo Sapiens
QRGEGDPSG

SEQ ID NO: 547666 - protein, 9 aa, Homo Sapiens
RYESELLII

SEQ ID NO: 547667 - protein, 9 aa, Homo Sapiens
GTLIVALHD

SEQ ID NO: 547668 - protein, 9 aa, Homo Sapiens
QPGRLRTVP

SEQ ID NO: 547669 - protein, 9 aa, Homo Sapiens
PRMQTPLDP

SEQ ID NO: 547670 - protein, 9 aa, Homo Sapiens
KYQEPMPTA

SEQ ID NO: 547671 - protein, 9 aa, Homo Sapiens
KESAIVTRP

SEQ ID NO: 547672 - protein, 9 aa, Homo Sapiens
HYTYNPQFK

SEQ ID NO: 547673 - protein, 9 aa, Homo Sapiens
IIAQELELE

SEQ ID NO: 547674 - protein, 9 aa, Homo Sapiens
HNFYHNYTR

SEQ ID NO: 547675 - protein, 9 aa, Homo Sapiens
QGHGIVLSE

SEQ ID NO: 547676 - protein, 9 aa, Homo Sapiens
WKQDSLHHK

SEQ ID NO: 547677 - protein, 9 aa, Homo Sapiens
IPMLPHLLL

SEQ ID NO: 547678 - protein, 9 aa, Homo Sapiens
MVMVPGHNF

SEQ ID NO: 547679 - protein, 9 aa, Homo Sapiens
YHTPVSYRM

SEQ ID NO: 547680 - protein, 9 aa, Homo Sapiens
ESPEKYILF

SEQ ID NO: 547681 - protein, 9 aa, Homo Sapiens
RTTPGRQVC

SEQ ID NO: 547682 - protein, 9 aa, Homo Sapiens
QFKYQEPMP

SEQ ID NO: 547683 - protein, 9 aa, Homo Sapiens
AGTLIVALH

SEQ ID NO: 547684 - protein, 9 aa, Homo Sapiens
RAAAEAALS

SEQ ID NO: 547685 - protein, 9 aa, Homo Sapiens
CEGLLEESN

SEQ ID NO: 547686 - protein, 9 aa, Homo Sapiens
AGNYESKRQ

SEQ ID NO: 547687 - protein, 9 aa, Homo Sapiens
PEPKKCRRC

SEQ ID NO: 547688 - protein, 9 aa, Homo Sapiens
AAEAALSQT

SEQ ID NO: 547689 - protein, 9 aa, Homo Sapiens
PIGQRGEGD

SEQ ID NO: 547690 - protein, 9 aa, Homo Sapiens
LIQESPEKY

SEQ ID NO: 547691 - protein, 9 aa, Homo Sapiens
EGLLEESNG

SEQ ID NO: 547692 - protein, 9 aa, Homo Sapiens
KYHTPVSYR

SEQ ID NO: 547693 - protein, 9 aa, Homo Sapiens
VPTFSLCGK

SEQ ID NO: 547694 - protein, 9 aa, Homo Sapiens
LLVKTAGNY

SEQ ID NO: 547695 - protein, 9 aa, Homo Sapiens
KCCPGYEKV

SEQ ID NO: 547696 - protein, 9 aa, Homo Sapiens
EVGHRDCDL

SEQ ID NO: 547697 - protein, 9 aa, Homo Sapiens
EPPEPKKCR

SEQ ID NO: 547698 - protein, 9 aa, Homo Sapiens
NKDKLGTAE

SEQ ID NO: 547699 - protein, 9 aa, Homo Sapiens
LCVAEDTSD

SEQ ID NO: 547700 - protein, 9 aa, Homo Sapiens
KRLEGLGAL

SEQ ID NO: 547701 - protein, 9 aa, Homo Sapiens
ELLIIAQEL

SEQ ID NO: 547702 - protein, 9 aa, Homo Sapiens
SFTKMLKKT

SEQ ID NO: 547703 - protein, 9 aa, Homo Sapiens
ELLVKTAGN

SEQ ID NO: 547704 - protein, 9 aa, Homo Sapiens
NFYHNYTRL

SEQ ID NO: 547705 - protein, 9 aa, Homo Sapiens
ESAVSAVLP

SEQ ID NO: 547706 - protein, 9 aa, Homo Sapiens
KKCRRCVLL

SEQ ID NO: 547707 - protein, 9 aa, Homo Sapiens
KDKLGTAET

SEQ ID NO: 547708 - protein, 9 aa, Homo Sapiens
AEAALSQTG

SEQ ID NO: 547709 - protein, 9 aa, Homo Sapiens
QVCTCKAGY

SEQ ID NO: 547710 - protein, 9 aa, Homo Sapiens
AADVNVPTF

SEQ ID NO: 547711 - protein, 9 aa, Homo Sapiens
LEGSKQFLC

SEQ ID NO: 547712 - protein, 9 aa, Homo Sapiens
SAVSAVLPG

SEQ ID NO: 547713 - protein, 9 aa, Homo Sapiens
RMQTPLDPY

SEQ ID NO: 547714 - protein, 9 aa, Homo Sapiens
QLEVGHRDC

SEQ ID NO: 547715 - protein, 9 aa, Homo Sapiens
ETAVPGVED

SEQ ID NO: 547716 - protein, 9 aa, Homo Sapiens
EPLSEPEEE

SEQ ID NO: 547717 - protein, 9 aa, Homo Sapiens
SITPNAPYQ

SEQ ID NO: 547718 - protein, 9 aa, Homo Sapiens
KLNSGGFYI

SEQ ID NO: 547719 - protein, 9 aa, Homo Sapiens
NSITPNAPY

SEQ ID NO: 547720 - protein, 9 aa, Homo Sapiens
LALNVELLL

SEQ ID NO: 547721 - protein, 9 aa, Homo Sapiens
VFLENAIRD

SEQ ID NO: 547722 - protein, 9 aa, Homo Sapiens
LFSLLHSLE

SEQ ID NO: 547723 - protein, 9 aa, Homo Sapiens
TAEFNGLTV

SEQ ID NO: 547724 - protein, 9 aa, Homo Sapiens
VMTQEAAQK

SEQ ID NO: 547725 - protein, 9 aa, Homo Sapiens
YVLEALRKR

SEQ ID NO: 547726 - protein, 9 aa, Homo Sapiens
GLTVTGRPR

SEQ ID NO: 547727 - protein, 9 aa, Homo Sapiens
ADSMQRQGQ

SEQ ID NO: 547728 - protein, 9 aa, Homo Sapiens
EERLGDLAS

SEQ ID NO: 547729 - protein, 9 aa, Homo Sapiens
CGCYLVSWL

SEQ ID NO: 547730 - protein, 9 aa, Homo Sapiens
TIRAPAEKP

SEQ ID NO: 547731 - protein, 9 aa, Homo Sapiens
LGYGCPLIK

SEQ ID NO: 547732 - protein, 9 aa, Homo Sapiens
PVGPAGKQG

SEQ ID NO: 547733 - protein, 9 aa, Homo Sapiens
EAGPEVDLE

SEQ ID NO: 547734 - protein, 9 aa, Homo Sapiens
NGLTVTGRP

SEQ ID NO: 547735 - protein, 9 aa, Homo Sapiens
TLFPQYKSR

SEQ ID NO: 547736 - protein, 9 aa, Homo Sapiens
RKLNSGGFY

SEQ ID NO: 547737 - protein, 9 aa, Homo Sapiens
EINCRLNED

SEQ ID NO: 547738 - protein, 9 aa, Homo Sapiens
LVLTLLLHT

SEQ ID NO: 547739 - protein, 9 aa, Homo Sapiens
MPRTCYVLC

SEQ ID NO: 547740 - protein, 9 aa, Homo Sapiens
INCRLNEDK

SEQ ID NO: 547741 - protein, 9 aa, Homo Sapiens
EFPEVCVPT

SEQ ID NO: 547742 - protein, 9 aa, Homo Sapiens
AIRDAVTYT

SEQ ID NO: 547743 - protein, 9 aa, Homo Sapiens
QYKSRELFN

SEQ ID NO: 547744 - protein, 9 aa, Homo Sapiens
YMIHIIEKW

SEQ ID NO: 547745 - protein, 9 aa, Homo Sapiens
SVTPFYNTL

SEQ ID NO: 547746 - protein, 9 aa, Homo Sapiens
YEWDSEFSG

SEQ ID NO: 547747 - protein, 9 aa, Homo Sapiens
AIDAEQPEK

SEQ ID NO: 547748 - protein, 9 aa, Homo Sapiens
IAGLDDINV

SEQ ID NO: 547749 - protein, 9 aa, Homo Sapiens
PGTLYMYII

SEQ ID NO: 547750 - protein, 9 aa, Homo Sapiens
RFGSKMYYF

SEQ ID NO: 547751 - protein, 9 aa, Homo Sapiens
LNSGGFYIT

SEQ ID NO: 547752 - protein, 9 aa, Homo Sapiens
SQGPRMPRT

SEQ ID NO: 547753 - protein, 9 aa, Homo Sapiens
SPDPRTQHP

SEQ ID NO: 547754 - protein, 9 aa, Homo Sapiens
GVDVGTLLK

SEQ ID NO: 547755 - protein, 9 aa, Homo Sapiens
YRILGQDLI

SEQ ID NO: 547756 - protein, 9 aa, Homo Sapiens
EDYMIHIIE

SEQ ID NO: 547757 - protein, 9 aa, Homo Sapiens
SSIKPDKAN

SEQ ID NO: 547758 - protein, 9 aa, Homo Sapiens
PAMEINCRL

SEQ ID NO: 547759 - protein, 9 aa, Homo Sapiens
PLSRVNEID

SEQ ID NO: 547760 - protein, 9 aa, Homo Sapiens
PYIRALYTK

SEQ ID NO: 547761 - protein, 9 aa, Homo Sapiens
ENFSKTSFD

SEQ ID NO: 547762 - protein, 9 aa, Homo Sapiens
CMWAAKLPG

SEQ ID NO: 547763 - protein, 9 aa, Homo Sapiens
KRNSITPNA

SEQ ID NO: 547764 - protein, 9 aa, Homo Sapiens
FEMAMSSIK

SEQ ID NO: 547765 - protein, 9 aa, Homo Sapiens
CPLIKSVIT

SEQ ID NO: 547766 - protein, 9 aa, Homo Sapiens
GGSQGPRMP

SEQ ID NO: 547767 - protein, 9 aa, Homo Sapiens
GKEDVPLSR

SEQ ID NO: 547768 - protein, 9 aa, Homo Sapiens
DVKCSGNCM

SEQ ID NO: 547769 - protein, 9 aa, Homo Sapiens
DTIRAPAEK

SEQ ID NO: 547770 - protein, 9 aa, Homo Sapiens
SSRNPITWS

SEQ ID NO: 547771 - protein, 9 aa, Homo Sapiens
NRADSMQRQ

SEQ ID NO: 547772 - protein, 9 aa, Homo Sapiens
REAERVAKA

SEQ ID NO: 547773 - protein, 9 aa, Homo Sapiens
DDLADEMIC

SEQ ID NO: 547774 - protein, 9 aa, Homo Sapiens
KGCAFAQVM

SEQ ID NO: 547775 - protein, 9 aa, Homo Sapiens
DEFPEVCVP

SEQ ID NO: 547776 - protein, 9 aa, Homo Sapiens
EELFSLLHS

SEQ ID NO: 547777 - protein, 9 aa, Homo Sapiens
DAEQPEKNV

SEQ ID NO: 547778 - protein, 9 aa, Homo Sapiens
WKPAMEINC

SEQ ID NO: 547779 - protein, 9 aa, Homo Sapiens
PGIFRGDKW

SEQ ID NO: 547780 - protein, 9 aa, Homo Sapiens
KPDYYRVTL

SEQ ID NO: 547781 - protein, 9 aa, Homo Sapiens
AGLDDINVF

SEQ ID NO: 547782 - protein, 9 aa, Homo Sapiens
PRTCYVLCS

SEQ ID NO: 547783 - protein, 9 aa, Homo Sapiens
GDLASDLLL

SEQ ID NO: 547784 - protein, 9 aa, Homo Sapiens
LAVYRLLRS

SEQ ID NO: 547785 - protein, 9 aa, Homo Sapiens
AQEERLGDL

SEQ ID NO: 547786 - protein, 9 aa, Homo Sapiens
AGLRKQFHK

SEQ ID NO: 547787 - protein, 9 aa, Homo Sapiens
PNHPIHLMF

SEQ ID NO: 547788 - protein, 9 aa, Homo Sapiens
GNCMWAAKL

SEQ ID NO: 547789 - protein, 9 aa, Homo Sapiens
QKHQPSILQ

SEQ ID NO: 547790 - protein, 9 aa, Homo Sapiens
CSGNCMWAA

SEQ ID NO: 547791 - protein, 9 aa, Homo Sapiens
PRMPRTCYV

SEQ ID NO: 547792 - protein, 9 aa, Homo Sapiens
PDYYRVTLR

SEQ ID NO: 547793 - protein, 9 aa, Homo Sapiens
YIRALYTKM

SEQ ID NO: 547794 - protein, 9 aa, Homo Sapiens
EEAGPEVDL

SEQ ID NO: 547795 - protein, 9 aa, Homo Sapiens
RILGQDLII

SEQ ID NO: 547796 - protein, 9 aa, Homo Sapiens
HQPSILQAL

SEQ ID NO: 547797 - protein, 9 aa, Homo Sapiens
ILGQDLIIQ

SEQ ID NO: 547798 - protein, 9 aa, Homo Sapiens
PIHLMFETF

SEQ ID NO: 547799 - protein, 9 aa, Homo Sapiens
LFPQYKSRE

SEQ ID NO: 547800 - protein, 9 aa, Homo Sapiens
HTTILQPSY

SEQ ID NO: 547801 - protein, 9 aa, Homo Sapiens
EEPKEYENI

SEQ ID NO: 547802 - protein, 9 aa, Homo Sapiens
KLDTAPENF

SEQ ID NO: 547803 - protein, 9 aa, Homo Sapiens
RLLRSKLVA

SEQ ID NO: 547804 - protein, 9 aa, Homo Sapiens
ELLVGSPYI

SEQ ID NO: 547805 - protein, 9 aa, Homo Sapiens
LDTAPENFS

SEQ ID NO: 547806 - protein, 9 aa, Homo Sapiens
SYHPGIFRG

SEQ ID NO: 547807 - protein, 9 aa, Homo Sapiens
EHTTILQPS

SEQ ID NO: 547808 - protein, 9 aa, Homo Sapiens
SMQRQGQYD

SEQ ID NO: 547809 - protein, 9 aa, Homo Sapiens
LLVGSPYIR

SEQ ID NO: 547810 - protein, 9 aa, Homo Sapiens
GVSNSEEGV

SEQ ID NO: 547811 - protein, 9 aa, Homo Sapiens
PGRDEDDLA

SEQ ID NO: 547812 - protein, 9 aa, Homo Sapiens
LLHSLEPSQ

SEQ ID NO: 547813 - protein, 9 aa, Homo Sapiens
TFCGCYLVS

SEQ ID NO: 547814 - protein, 9 aa, Homo Sapiens
GEQSSLPAM

SEQ ID NO: 547815 - protein, 9 aa, Homo Sapiens
DYYRVTLRP

SEQ ID NO: 547816 - protein, 9 aa, Homo Sapiens
KIRKLNSGG

SEQ ID NO: 547817 - protein, 9 aa, Homo Sapiens
LGQDLIIQV

SEQ ID NO: 547818 - protein, 9 aa, Homo Sapiens
EEAQGEAAG

SEQ ID NO: 547819 - protein, 9 aa, Homo Sapiens
RVSRILKQP

SEQ ID NO: 547820 - protein, 9 aa, Homo Sapiens
VLEALRKRF

SEQ ID NO: 547821 - protein, 9 aa, Homo Sapiens
RVNEIDTTP

SEQ ID NO: 547822 - protein, 9 aa, Homo Sapiens
GPEVDLEEE

SEQ ID NO: 547823 - protein, 9 aa, Homo Sapiens
RDEDDLADE

SEQ ID NO: 547824 - protein, 9 aa, Homo Sapiens
LSAIDAEQP

SEQ ID NO: 547825 - protein, 9 aa, Homo Sapiens
GPAGKQGNR

SEQ ID NO: 547826 - protein, 9 aa, Homo Sapiens
GLDDINVFL

SEQ ID NO: 547827 - protein, 9 aa, Homo Sapiens
VAKASSSAH

SEQ ID NO: 547828 - protein, 9 aa, Homo Sapiens
TLAVYRLLR

SEQ ID NO: 547829 - protein, 9 aa, Homo Sapiens
HPGIFRGDK

SEQ ID NO: 547830 - protein, 9 aa, Homo Sapiens
ITWSVTPFY

SEQ ID NO: 547831 - protein, 9 aa, Homo Sapiens
QFFTEEEPK

SEQ ID NO: 547832 - protein, 9 aa, Homo Sapiens
SGEQSSLPA

SEQ ID NO: 547833 - protein, 9 aa, Homo Sapiens
FCGCYLVSW

SEQ ID NO: 547834 - protein, 9 aa, Homo Sapiens
VGPAGKQGN

SEQ ID NO: 547835 - protein, 9 aa, Homo Sapiens
LNVELLLFR

SEQ ID NO: 547836 - protein, 9 aa, Homo Sapiens
QQQKHQPSI

SEQ ID NO: 547837 - protein, 9 aa, Homo Sapiens
QHPQDLAST

SEQ ID NO: 547838 - protein, 9 aa, Homo Sapiens
ERVAKASSS

SEQ ID NO: 547839 - protein, 9 aa, Homo Sapiens
PTVGSLGLP

SEQ ID NO: 547840 - protein, 9 aa, Homo Sapiens
VPRGPTVGS

SEQ ID NO: 547841 - protein, 9 aa, Homo Sapiens
LEEEEEEPQ

SEQ ID NO: 547842 - protein, 9 aa, Homo Sapiens
HKTIHSGEK

SEQ ID NO: 547843 - protein, 9 aa, Homo Sapiens
TLLLHTALR

SEQ ID NO: 547844 - protein, 9 aa, Homo Sapiens
LDEEAQGEA

SEQ ID NO: 547845 - protein, 9 aa, Homo Sapiens
KHKTIHSGE

SEQ ID NO: 547846 - protein, 9 aa, Homo Sapiens
DVPLSRVNE

SEQ ID NO: 547847 - protein, 9 aa, Homo Sapiens
YMYIIYGMY

SEQ ID NO: 547848 - protein, 9 aa, Homo Sapiens
GCPLIKSVI

SEQ ID NO: 547849 - protein, 9 aa, Homo Sapiens
GIFRGDKWS

SEQ ID NO: 547850 - protein, 9 aa, Homo Sapiens
SAIDAEQPE

SEQ ID NO: 547851 - protein, 9 aa, Homo Sapiens
FAIEHISRV

SEQ ID NO: 547852 - protein, 9 aa, Homo Sapiens
VPGVEDISG

SEQ ID NO: 547853 - protein, 9 aa, Homo Sapiens
DPGRDEDDL

SEQ ID NO: 547854 - protein, 9 aa, Homo Sapiens
VCVPTVFEN

SEQ ID NO: 547855 - protein, 9 aa, Homo Sapiens
WSVTPFYNT

SEQ ID NO: 547856 - protein, 9 aa, Homo Sapiens
VSNSEEGVD

SEQ ID NO: 547857 - protein, 9 aa, Homo Sapiens
EWKPAMEIN

SEQ ID NO: 547858 - protein, 9 aa, Homo Sapiens
SFPKRNSIT

SEQ ID NO: 547859 - protein, 9 aa, Homo Sapiens
TQHPQDLAS

SEQ ID NO: 547860 - protein, 9 aa, Homo Sapiens
GCAFAQVMT

SEQ ID NO: 547861 - protein, 9 aa, Homo Sapiens
RTSVPRGPT

SEQ ID NO: 547862 - protein, 9 aa, Homo Sapiens
EFNGLTVTG

SEQ ID NO: 547863 - protein, 9 aa, Homo Sapiens
EVDLEEEEE

SEQ ID NO: 547864 - protein, 9 aa, Homo Sapiens
RKQFHKASQ

SEQ ID NO: 547865 - protein, 9 aa, Homo Sapiens
VPTEDYMIH

SEQ ID NO: 547866 - protein, 9 aa, Homo Sapiens
DSMQRQGQY

SEQ ID NO: 547867 - protein, 9 aa, Homo Sapiens
IRAPAEKPG

SEQ ID NO: 547868 - protein, 9 aa, Homo Sapiens
EQPEKNVVE

SEQ ID NO: 547869 - protein, 9 aa, Homo Sapiens
FSGDMELLE

SEQ ID NO: 547870 - protein, 9 aa, Homo Sapiens
PGEKKSQAS

SEQ ID NO: 547871 - protein, 9 aa, Homo Sapiens
EALRKRFGS

SEQ ID NO: 547872 - protein, 9 aa, Homo Sapiens
TWSVTPFYN

SEQ ID NO: 547873 - protein, 9 aa, Homo Sapiens
VLTLLLHTA

SEQ ID NO: 547874 - protein, 9 aa, Homo Sapiens
NYRILGQDL

SEQ ID NO: 547875 - protein, 9 aa, Homo Sapiens
GPTVGSLGL

SEQ ID NO: 547876 - protein, 9 aa, Homo Sapiens
RDVKCSGNC

SEQ ID NO: 547877 - protein, 9 aa, Homo Sapiens
IYDTIRAPA

SEQ ID NO: 547878 - protein, 9 aa, Homo Sapiens
NSGGFYITS

SEQ ID NO: 547879 - protein, 9 aa, Homo Sapiens
ENAIRDAVT

SEQ ID NO: 547880 - protein, 9 aa, Homo Sapiens
VDVGTLLKS

SEQ ID NO: 547881 - protein, 9 aa, Homo Sapiens
MAMSSIKPD

SEQ ID NO: 547882 - protein, 9 aa, Homo Sapiens
NISGEQSSL

SEQ ID NO: 547883 - protein, 9 aa, Homo Sapiens
EMAMSSIKP

SEQ ID NO: 547884 - protein, 9 aa, Homo Sapiens
HYKIRKLNS

SEQ ID NO: 547885 - protein, 9 aa, Homo Sapiens
MEINCRLNE

SEQ ID NO: 547886 - protein, 9 aa, Homo Sapiens
AGTFCGCYL

SEQ ID NO: 547887 - protein, 9 aa, Homo Sapiens
PEKNVVEAF

SEQ ID NO: 547888 - protein, 9 aa, Homo Sapiens
AEPLSEPEE

SEQ ID NO: 547889 - protein, 9 aa, Homo Sapiens
ERLGDLASD

SEQ ID NO: 547890 - protein, 9 aa, Homo Sapiens
TEDYMIHII

SEQ ID NO: 547891 - protein, 9 aa, Homo Sapiens
ETLFPQYKS

SEQ ID NO: 547892 - protein, 9 aa, Homo Sapiens
TPIAGLDDI

SEQ ID NO: 547893 - protein, 9 aa, Homo Sapiens
PNTLKPDYY

SEQ ID NO: 547894 - protein, 9 aa, Homo Sapiens
RTQHPQDLA

SEQ ID NO: 547895 - protein, 9 aa, Homo Sapiens
FNGLTVTGR

SEQ ID NO: 547896 - protein, 9 aa, Homo Sapiens
AGPEVDLEE

SEQ ID NO: 547897 - protein, 9 aa, Homo Sapiens
YLVSWLIEV

SEQ ID NO: 547898 - protein, 9 aa, Homo Sapiens
QVMTQEAAQ

SEQ ID NO: 547899 - protein, 9 aa, Homo Sapiens
AAAQEERLG

SEQ ID NO: 547900 - protein, 9 aa, Homo Sapiens
AAEPLSEPE

SEQ ID NO: 547901 - protein, 9 aa, Homo Sapiens
RKRFGSKMY

SEQ ID NO: 547902 - protein, 9 aa, Homo Sapiens
AMSSIKPDK

SEQ ID NO: 547903 - protein, 9 aa, Homo Sapiens
LKVFLENAI

SEQ ID NO: 547904 - protein, 9 aa, Homo Sapiens
ELFSLLHSL

SEQ ID NO: 547905 - protein, 9 aa, Homo Sapiens
IDAEQPEKN

SEQ ID NO: 547906 - protein, 9 aa, Homo Sapiens
TTILQPSYT

SEQ ID NO: 547907 - protein, 9 aa, Homo Sapiens
PENFSKTSF

SEQ ID NO: 547908 - protein, 9 aa, Homo Sapiens
IKSVITIAV

SEQ ID NO: 547909 - protein, 9 aa, Homo Sapiens
SGDMELLET

SEQ ID NO: 547910 - protein, 9 aa, Homo Sapiens
MYIIYGMYF

SEQ ID NO: 547911 - protein, 9 aa, Homo Sapiens
GSYHPGIFR

SEQ ID NO: 547912 - protein, 9 aa, Homo Sapiens
SVAGLRKQF

SEQ ID NO: 547913 - protein, 9 aa, Homo Sapiens
KHQPSILQA

SEQ ID NO: 547914 - protein, 9 aa, Homo Sapiens
KHYKIRKLN

SEQ ID NO: 547915 - protein, 9 aa, Homo Sapiens
RVAKASSSA

SEQ ID NO: 547916 - protein, 9 aa, Homo Sapiens
VLKVFLENA

SEQ ID NO: 547917 - protein, 9 aa, Homo Sapiens
LLLHTALRC

SEQ ID NO: 547918 - protein, 9 aa, Homo Sapiens
QPEKNVVEA

SEQ ID NO: 547919 - protein, 9 aa, Homo Sapiens
STPIAGLDD

SEQ ID NO: 547920 - protein, 9 aa, Homo Sapiens
SSFPKRNSI

SEQ ID NO: 547921 - protein, 9 aa, Homo Sapiens
DLEEEEEEP

SEQ ID NO: 547922 - protein, 9 aa, Homo Sapiens
LTLLLHTAL

SEQ ID NO: 547923 - protein, 9 aa, Homo Sapiens
HILVQPNHP

SEQ ID NO: 547924 - protein, 9 aa, Homo Sapiens
SRVNEIDTT

SEQ ID NO: 547925 - protein, 9 aa, Homo Sapiens
NVELLLFRG

SEQ ID NO: 547926 - protein, 9 aa, Homo Sapiens
SELLVGSPY

SEQ ID NO: 547927 - protein, 9 aa, Homo Sapiens
GCYLVSWLI

SEQ ID NO: 547928 - protein, 9 aa, Homo Sapiens
LENAIRDAV

SEQ ID NO: 547929 - protein, 9 aa, Homo Sapiens
KSVITIAVT

SEQ ID NO: 547930 - protein, 9 aa, Homo Sapiens
SRELFNKLH

SEQ ID NO: 547931 - protein, 9 aa, Homo Sapiens
LYMYIIYGM

SEQ ID NO: 547932 - protein, 9 aa, Homo Sapiens
ELLLFRGPF

SEQ ID NO: 547933 - protein, 9 aa, Homo Sapiens
VPLSRVNEI

SEQ ID NO: 547934 - protein, 9 aa, Homo Sapiens
NTLKPDYYR

SEQ ID NO: 547935 - protein, 9 aa, Homo Sapiens
EDDLADEMI

SEQ ID NO: 547936 - protein, 9 aa, Homo Sapiens
EQFEMAMSS

SEQ ID NO: 547937 - protein, 9 aa, Homo Sapiens
EFSGDMELL

SEQ ID NO: 547938 - protein, 9 aa, Homo Sapiens
PAGKQGNRG

SEQ ID NO: 547939 - protein, 9 aa, Homo Sapiens
EVLETAVPG

SEQ ID NO: 547940 - protein, 9 aa, Homo Sapiens
ASPDPRTQH

SEQ ID NO: 547941 - protein, 9 aa, Homo Sapiens
GPVGPAGKQ

SEQ ID NO: 547942 - protein, 9 aa, Homo Sapiens
KPAMEINCR

SEQ ID NO: 547943 - protein, 9 aa, Homo Sapiens
TLQIQQQKH

SEQ ID NO: 547944 - protein, 9 aa, Homo Sapiens
NYEWDSEFS

SEQ ID NO: 547945 - protein, 9 aa, Homo Sapiens
TAVPGVEDI

SEQ ID NO: 547946 - protein, 9 aa, Homo Sapiens
ALQPGEKKS

SEQ ID NO: 547947 - protein, 9 aa, Homo Sapiens
FPQYKSREL

SEQ ID NO: 547948 - protein, 9 aa, Homo Sapiens
EPDPGRDED

SEQ ID NO: 547949 - protein, 9 aa, Homo Sapiens
SRVSRILKQ

SEQ ID NO: 547950 - protein, 9 aa, Homo Sapiens
KDEFPEVCV

SEQ ID NO: 547951 - protein, 9 aa, Homo Sapiens
SEEGVDVGT

SEQ ID NO: 547952 - protein, 9 aa, Homo Sapiens
EHISRVSRI

SEQ ID NO: 547953 - protein, 9 aa, Homo Sapiens
EWDSEFSGD

SEQ ID NO: 547954 - protein, 9 aa, Homo Sapiens
VGTNYRILG

SEQ ID NO: 547955 - protein, 9 aa, Homo Sapiens
LIKSVITIA

SEQ ID NO: 547956 - protein, 9 aa, Homo Sapiens
QPNHPIHLM

SEQ ID NO: 547957 - protein, 9 aa, Homo Sapiens
TVGSLGLPA

SEQ ID NO: 547958 - protein, 9 aa, Homo Sapiens
LLHTALRCS

SEQ ID NO: 547959 - protein, 9 aa, Homo Sapiens
RADSMQRQG

SEQ ID NO: 547960 - protein, 9 aa, Homo Sapiens
FTEEEPKEY

SEQ ID NO: 547961 - protein, 9 aa, Homo Sapiens
TAPENFSKT

SEQ ID NO: 547962 - protein, 9 aa, Homo Sapiens
IRKLNSGGF

SEQ ID NO: 547963 - protein, 9 aa, Homo Sapiens
PLSEPEEES

SEQ ID NO: 547964 - protein, 9 aa, Homo Sapiens
YNSTLAVYR

SEQ ID NO: 547965 - protein, 9 aa, Homo Sapiens
AAQEERLGD

SEQ ID NO: 547966 - protein, 9 aa, Homo Sapiens
SLEPSQFPS

SEQ ID NO: 547967 - protein, 9 aa, Homo Sapiens
PDPGRDEDD

SEQ ID NO: 547968 - protein, 9 aa, Homo Sapiens
GSPYIRALY

SEQ ID NO: 547969 - protein, 9 aa, Homo Sapiens
PRTQHPQDL

SEQ ID NO: 547970 - protein, 9 aa, Homo Sapiens
KSRELFNKL

SEQ ID NO: 547971 - protein, 9 aa, Homo Sapiens
ITPNAPYQQ

SEQ ID NO: 547972 - protein, 9 aa, Homo Sapiens
GLRKQFHKA

SEQ ID NO: 547973 - protein, 9 aa, Homo Sapiens
EDVPLSRVN

SEQ ID NO: 547974 - protein, 9 aa, Homo Sapiens
STLAVYRLL

SEQ ID NO: 547975 - protein, 9 aa, Homo Sapiens
GRDEDDLAD

SEQ ID NO: 547976 - protein, 9 aa, Homo Sapiens
TVTGRPRLS

SEQ ID NO: 547977 - protein, 9 aa, Homo Sapiens
VQPNHPIHL

SEQ ID NO: 547978 - protein, 9 aa, Homo Sapiens
LTVTGRPRL

SEQ ID NO: 547979 - protein, 9 aa, Homo Sapiens
QVFRNISGE

SEQ ID NO: 547980 - protein, 9 aa, Homo Sapiens
GTLYMYIIY

SEQ ID NO: 547981 - protein, 9 aa, Homo Sapiens
ALRKRFGSK

SEQ ID NO: 547982 - protein, 9 aa, Homo Sapiens
SKDEFPEVC

SEQ ID NO: 547983 - protein, 9 aa, Homo Sapiens
KPGTLYMYI

SEQ ID NO: 547984 - protein, 9 aa, Homo Sapiens
EREREAERV

SEQ ID NO: 547985 - protein, 9 aa, Homo Sapiens
LNKHKTIHS

SEQ ID NO: 547986 - protein, 9 aa, Homo Sapiens
LQPGEKKSQ

SEQ ID NO: 547987 - protein, 9 aa, Homo Sapiens
KVFLENAIR

SEQ ID NO: 547988 - protein, 9 aa, Homo Sapiens
KKLDTAPEN

SEQ ID NO: 547989 - protein, 9 aa, Homo Sapiens
WDSEFSGDM

SEQ ID NO: 547990 - protein, 9 aa, Homo Sapiens
ILQPSYTGL

SEQ ID NO: 547991 - protein, 9 aa, Homo Sapiens
TNYRILGQD

SEQ ID NO: 547992 - protein, 9 aa, Homo Sapiens
FPKRNSITP

SEQ ID NO: 547993 - protein, 9 aa, Homo Sapiens
CVPTVFENY

SEQ ID NO: 547994 - protein, 9 aa, Homo Sapiens
QGPRMPRTC

SEQ ID NO: 547995 - protein, 9 aa, Homo Sapiens
FFTEEEPKE

SEQ ID NO: 547996 - protein, 9 aa, Homo Sapiens
PITWSVTPF

SEQ ID NO: 547997 - protein, 9 aa, Homo Sapiens
VYRLLRSKL

SEQ ID NO: 547998 - protein, 9 aa, Homo Sapiens
VAGLRKQFH

SEQ ID NO: 547999 - protein, 9 aa, Homo Sapiens
DSEFSGDME

SEQ ID NO: 548000 - protein, 9 aa, Homo Sapiens
LETAVPGVE

SEQ ID NO: 548001 - protein, 9 aa, Homo Sapiens
CAFAQVMTQ

SEQ ID NO: 548002 - protein, 9 aa, Homo Sapiens
GTFCGCYLV

SEQ ID NO: 548003 - protein, 9 aa, Homo Sapiens
QQFFTEEEP

SEQ ID NO: 548004 - protein, 9 aa, Homo Sapiens
APAEKPGGA

SEQ ID NO: 548005 - protein, 9 aa, Homo Sapiens
EAERVAKAS

SEQ ID NO: 548006 - protein, 9 aa, Homo Sapiens
TIYDTIRAP

SEQ ID NO: 548007 - protein, 9 aa, Homo Sapiens
NKHKTIHSG

SEQ ID NO: 548008 - protein, 9 aa, Homo Sapiens
AEFNGLTVT

SEQ ID NO: 548009 - protein, 9 aa, Homo Sapiens
AQVMTQEAA

SEQ ID NO: 548010 - protein, 9 aa, Homo Sapiens
HSLEPSQFP

SEQ ID NO: 548011 - protein, 9 aa, Homo Sapiens
RGPTVGSLG

SEQ ID NO: 548012 - protein, 9 aa, Homo Sapiens
AEGGALDEE

SEQ ID NO: 548013 - protein, 9 aa, Homo Sapiens
PAEKPGGAR

SEQ ID NO: 548014 - protein, 9 aa, Homo Sapiens
RVPTEDYMI

SEQ ID NO: 548015 - protein, 9 aa, Homo Sapiens
PRGPTVGSL

SEQ ID NO: 548016 - protein, 9 aa, Homo Sapiens
ILVQPNHPI

SEQ ID NO: 548017 - protein, 9 aa, Homo Sapiens
DYMIHIIEK

SEQ ID NO: 548018 - protein, 9 aa, Homo Sapiens
LASPDPRTQ

SEQ ID NO: 548019 - protein, 9 aa, Homo Sapiens
SGNCMWAAK

SEQ ID NO: 548020 - protein, 9 aa, Homo Sapiens
AMEINCRLN

SEQ ID NO: 548021 - protein, 9 aa, Homo Sapiens
SGEVLETAV

SEQ ID NO: 548022 - protein, 9 aa, Homo Sapiens
VSRILKQPR

SEQ ID NO: 548023 - protein, 9 aa, Homo Sapiens
DTAPENFSK

SEQ ID NO: 548024 - protein, 9 aa, Homo Sapiens
EGVDVGTLL

SEQ ID NO: 548025 - protein, 9 aa, Homo Sapiens
VFRNISGEQ

SEQ ID NO: 548026 - protein, 9 aa, Homo Sapiens
MKPGTLYMY

SEQ ID NO: 548027 - protein, 9 aa, Homo Sapiens
RLVGTNYRI

SEQ ID NO: 548028 - protein, 9 aa, Homo Sapiens
GALDEEAQG

SEQ ID NO: 548029 - protein, 9 aa, Homo Sapiens
ISRVSRILK

SEQ ID NO: 548030 - protein, 9 aa, Homo Sapiens
YKIRKLNSG

SEQ ID NO: 548031 - protein, 9 aa, Homo Sapiens
KCSGNCMWA

SEQ ID NO: 548032 - protein, 9 aa, Homo Sapiens
DLIIQVFKK

SEQ ID NO: 548033 - protein, 9 aa, Homo Sapiens
LQPSYTGLS

SEQ ID NO: 548034 - protein, 9 aa, Homo Sapiens
LDDINVFLK

SEQ ID NO: 548035 - protein, 9 aa, Homo Sapiens
ALNRADSMQ

SEQ ID NO: 548036 - protein, 9 aa, Homo Sapiens
PLIKSVITI

SEQ ID NO: 548037 - protein, 9 aa, Homo Sapiens
RGLALNVEL

SEQ ID NO: 548038 - protein, 9 aa, Homo Sapiens
PTEDYMIHI

SEQ ID NO: 548039 - protein, 9 aa, Homo Sapiens
AIEHISRVS

SEQ ID NO: 548040 - protein, 9 aa, Homo Sapiens
GSQGPRMPR

SEQ ID NO: 548041 - protein, 9 aa, Homo Sapiens
LPNTLKPDY

SEQ ID NO: 548042 - protein, 9 aa, Homo Sapiens
AEQPEKNVV

SEQ ID NO: 548043 - protein, 9 aa, Homo Sapiens
IFRGDKWSC

SEQ ID NO: 548044 - protein, 9 aa, Homo Sapiens
SPYIRALYT

SEQ ID NO: 548045 - protein, 9 aa, Homo Sapiens
EAQGEAAGI

SEQ ID NO: 548046 - protein, 9 aa, Homo Sapiens
HTALRCSAP

SEQ ID NO: 548047 - protein, 9 aa, Homo Sapiens
RNISGEQSS

SEQ ID NO: 548048 - protein, 9 aa, Homo Sapiens
SLLHSLEPS

SEQ ID NO: 548049 - protein, 9 aa, Homo Sapiens
ALNVELLLF

SEQ ID NO: 548050 - protein, 9 aa, Homo Sapiens
AGKQGNRGE

SEQ ID NO: 548051 - protein, 9 aa, Homo Sapiens
ISGEQSSLP

SEQ ID NO: 548052 - protein, 9 aa, Homo Sapiens
RMPRTCYVL

SEQ ID NO: 548053 - protein, 9 aa, Homo Sapiens
FAQVMTQEA

SEQ ID NO: 548054 - protein, 9 aa, Homo Sapiens
GKQGNRGET

SEQ ID NO: 548055 - protein, 9 aa, Homo Sapiens
GYGCPLIKS

SEQ ID NO: 548056 - protein, 9 aa, Homo Sapiens
DDINVFLKA

SEQ ID NO: 548057 - protein, 9 aa, Homo Sapiens
GLALNVELL

SEQ ID NO: 548058 - protein, 9 aa, Homo Sapiens
SVPRGPTVG

SEQ ID NO: 548059 - protein, 9 aa, Homo Sapiens
EEGVDVGTL

SEQ ID NO: 548060 - protein, 9 aa, Homo Sapiens
RAPAEKPGG

SEQ ID NO: 548061 - protein, 9 aa, Homo Sapiens
NSEEGVDVG

SEQ ID NO: 548062 - protein, 9 aa, Homo Sapiens
SEFSGDMEL

SEQ ID NO: 548063 - protein, 9 aa, Homo Sapiens
VGSPYIRAL

SEQ ID NO: 548064 - protein, 9 aa, Homo Sapiens
SALNRADSM

SEQ ID NO: 548065 - protein, 9 aa, Homo Sapiens
MSVAGLRKQ

SEQ ID NO: 548066 - protein, 9 aa, Homo Sapiens
LSRVNEIDT

SEQ ID NO: 548067 - protein, 9 aa, Homo Sapiens
IQQQKHQPS

SEQ ID NO: 548068 - protein, 9 aa, Homo Sapiens
FPEVCVPTV

SEQ ID NO: 548069 - protein, 9 aa, Homo Sapiens
YHPGIFRGD

SEQ ID NO: 548070 - protein, 9 aa, Homo Sapiens
RNPITWSVT

SEQ ID NO: 548071 - protein, 9 aa, Homo Sapiens
FSLLHSLEP

SEQ ID NO: 548072 - protein, 9 aa, Homo Sapiens
EQSSLPAMS

SEQ ID NO: 548073 - protein, 9 aa, Homo Sapiens
PIAGLDDIN

SEQ ID NO: 548074 - protein, 9 aa, Homo Sapiens
LVGSPYIRA

SEQ ID NO: 548075 - protein, 9 aa, Homo Sapiens
EPKEYENII

SEQ ID NO: 548076 - protein, 9 aa, Homo Sapiens
PKEYENIIA

SEQ ID NO: 548077 - protein, 9 aa, Homo Sapiens
YDTIRAPAE

SEQ ID NO: 548078 - protein, 9 aa, Homo Sapiens
YYRVTLRPY

SEQ ID NO: 548079 - protein, 9 aa, Homo Sapiens
NPITWSVTP

SEQ ID NO: 548080 - protein, 9 aa, Homo Sapiens
LKPDYYRVT

SEQ ID NO: 548081 - protein, 9 aa, Homo Sapiens
QFEMAMSSI

SEQ ID NO: 548082 - protein, 9 aa, Homo Sapiens
FLENAIRDA

SEQ ID NO: 548083 - protein, 9 aa, Homo Sapiens
LQIQQQKHQ

SEQ ID NO: 548084 - protein, 9 aa, Homo Sapiens
YKSRELFNK

SEQ ID NO: 548085 - protein, 9 aa, Homo Sapiens
ASALNRADS

SEQ ID NO: 548086 - protein, 9 aa, Homo Sapiens
APENFSKTS

SEQ ID NO: 548087 - protein, 9 aa, Homo Sapiens
TLKPDYYRV

SEQ ID NO: 548088 - protein, 9 aa, Homo Sapiens
NCRLNEDKD

SEQ ID NO: 548089 - protein, 9 aa, Homo Sapiens
DINVFLKAC

SEQ ID NO: 548090 - protein, 9 aa, Homo Sapiens
GGALDEEAQ

SEQ ID NO: 548091 - protein, 9 aa, Homo Sapiens
LRKRFGSKM

SEQ ID NO: 548092 - protein, 9 aa, Homo Sapiens
LHTALRCSA

SEQ ID NO: 548093 - protein, 9 aa, Homo Sapiens
AERVAKASS

SEQ ID NO: 548094 - protein, 9 aa, Homo Sapiens
AVPGVEDIS

SEQ ID NO: 548095 - protein, 9 aa, Homo Sapiens
YRLLRSKLV

SEQ ID NO: 548096 - protein, 9 aa, Homo Sapiens
AFAQVMTQE

SEQ ID NO: 548097 - protein, 9 aa, Homo Sapiens
LGDLASDLL

SEQ ID NO: 548098 - protein, 9 aa, Homo Sapiens
SIKPDKANA

SEQ ID NO: 548099 - protein, 9 aa, Homo Sapiens
MSSIKPDKA

SEQ ID NO: 548100 - protein, 9 aa, Homo Sapiens
QQKHQPSIL

SEQ ID NO: 548101 - protein, 9 aa, Homo Sapiens
DEEAQGEAA

SEQ ID NO: 548102 - protein, 9 aa, Homo Sapiens
PQYKSRELF

SEQ ID NO: 548103 - protein, 9 aa, Homo Sapiens
YGCPLIKSV

SEQ ID NO: 548104 - protein, 9 aa, Homo Sapiens
NSTLAVYRL

SEQ ID NO: 548105 - protein, 9 aa, Homo Sapiens
QDLIIQVFK

SEQ ID NO: 548106 - protein, 9 aa, Homo Sapiens
SRNPITWSV

SEQ ID NO: 548107 - protein, 9 aa, Homo Sapiens
ALDEEAQGE

SEQ ID NO: 548108 - protein, 9 aa, Homo Sapiens
EGGALDEEA

SEQ ID NO: 548109 - protein, 9 aa, Homo Sapiens
NAIRDAVTY

SEQ ID NO: 548110 - protein, 9 aa, Homo Sapiens
LLVLTLLLH

SEQ ID NO: 548111 - protein, 9 aa, Homo Sapiens
RLGDLASDL

SEQ ID NO: 548112 - protein, 9 aa, Homo Sapiens
NHPIHLMFE

SEQ ID NO: 548113 - protein, 9 aa, Homo Sapiens
EVCVPTVFE

SEQ ID NO: 548114 - protein, 9 aa, Homo Sapiens
GQDLIIQVF

SEQ ID NO: 548115 - protein, 9 aa, Homo Sapiens
LRKQFHKAS

SEQ ID NO: 548116 - protein, 9 aa, Homo Sapiens
LNRADSMQR

SEQ ID NO: 548117 - protein, 9 aa, Homo Sapiens
QPGEKKSQA

SEQ ID NO: 548118 - protein, 9 aa, Homo Sapiens
AVYRLLRSK

SEQ ID NO: 548119 - protein, 9 aa, Homo Sapiens
SRGLALNVE

SEQ ID NO: 548120 - protein, 9 aa, Homo Sapiens
HPIHLMFET

SEQ ID NO: 548121 - protein, 9 aa, Homo Sapiens
RNSITPNAP

SEQ ID NO: 548122 - protein, 9 aa, Homo Sapiens
LHSLEPSQF

SEQ ID NO: 548123 - protein, 9 aa, Homo Sapiens
GEVLETAVP

SEQ ID NO: 548124 - protein, 9 aa, Homo Sapiens
FMKPGTLYM

SEQ ID NO: 548125 - protein, 9 aa, Homo Sapiens
QGNRGETGP

SEQ ID NO: 548126 - protein, 9 aa, Homo Sapiens
DPRTQHPQD

SEQ ID NO: 548127 - protein, 9 aa, Homo Sapiens
TEEEPKEYE

SEQ ID NO: 548128 - protein, 9 aa, Homo Sapiens
CYLVSWLIE

SEQ ID NO: 548129 - protein, 9 aa, Homo Sapiens
NFSKTSFDD

SEQ ID NO: 548130 - protein, 9 aa, Homo Sapiens
PEVCVPTVF

SEQ ID NO: 548131 - protein, 9 aa, Homo Sapiens
KEDVPLSRV

SEQ ID NO: 548132 - protein, 9 aa, Homo Sapiens
TEEHTTILQ

SEQ ID NO: 548133 - protein, 9 aa, Homo Sapiens
QIQQQKHQP

SEQ ID NO: 548134 - protein, 9 aa, Homo Sapiens
KRFGSKMYY

SEQ ID NO: 548135 - protein, 9 aa, Homo Sapiens
QEERLGDLA

SEQ ID NO: 548136 - protein, 9 aa, Homo Sapiens
PDPRTQHPQ

SEQ ID NO: 548137 - protein, 9 aa, Homo Sapiens
PKRNSITPN

SEQ ID NO: 548138 - protein, 9 aa, Homo Sapiens
TLYMYIIYG

SEQ ID NO: 548139 - protein, 9 aa, Homo Sapiens
DEDDLADEM

SEQ ID NO: 548140 - protein, 9 aa, Homo Sapiens
EEEPKEYEN

SEQ ID NO: 548141 - protein, 9 aa, Homo Sapiens
TSVPRGPTV

SEQ ID NO: 548142 - protein, 9 aa, Homo Sapiens
KQGNRGETG

SEQ ID NO: 548143 - protein, 9 aa, Homo Sapiens
SAGTFCGCY

SEQ ID NO: 548144 - protein, 9 aa, Homo Sapiens
TILQPSYTG

SEQ ID NO: 548145 - protein, 9 aa, Homo Sapiens
FRNISGEQS

SEQ ID NO: 548146 - protein, 9 aa, Homo Sapiens
PEVDLEEEE

SEQ ID NO: 548147 - protein, 9 aa, Homo Sapiens
NCMWAAKLP

SEQ ID NO: 548148 - protein, 9 aa, Homo Sapiens
LVGTNYRIL

SEQ ID NO: 548149 - protein, 9 aa, Homo Sapiens
REREAERVA

SEQ ID NO: 548150 - protein, 9 aa, Homo Sapiens
LEALRKRFG

SEQ ID NO: 548151 - protein, 9 aa, Homo Sapiens
IEHISRVSR

SEQ ID NO: 548152 - protein, 9 aa, Homo Sapiens
EREAERVAK

SEQ ID NO: 548153 - protein, 9 aa, Homo Sapiens
VLETAVPGV

SEQ ID NO: 548154 - protein, 9 aa, Homo Sapiens
LVQPNHPIH

SEQ ID NO: 548155 - protein, 9 aa, Homo Sapiens
VELLLFRGP

SEQ ID NO: 548156 - protein, 9 aa, Homo Sapiens
VTGRPRLSR

SEQ ID NO: 548157 - protein, 9 aa, Homo Sapiens
GTNYRILGQ

SEQ ID NO: 548158 - protein, 9 aa, Homo Sapiens
HISRVSRIL

SEQ ID NO: 548159 - protein, 9 aa, Homo Sapiens
GPRMPRTCY

SEQ ID NO: 548160 - protein, 9 aa, Homo Sapiens
SNSEEGVDV

SEQ ID NO: 548161 - protein, 9 aa, Homo Sapiens
EEHTTILQP

SEQ ID NO: 548162 - protein, 9 aa, Homo Sapiens
QPSYTGLSS

SEQ ID NO: 548163 - protein, 9 aa, Homo Sapiens
KTIHSGEKP

SEQ ID NO: 548164 - protein, 9 aa, Homo Sapiens
VKCSGNCMW

SEQ ID NO: 548165 - protein, 9 aa, Homo Sapiens
SKGCAFAQV

SEQ ID NO: 548166 - protein, 9 aa, Homo Sapiens
SLEVAGPRR

SEQ ID NO: 548167 - protein, 9 aa, Homo Sapiens
SAVSRLGRW

SEQ ID NO: 548168 - protein, 9 aa, Homo Sapiens
KRLGGIPVL

SEQ ID NO: 548169 - protein, 9 aa, Homo Sapiens
PSADPAAVA

SEQ ID NO: 548170 - protein, 9 aa, Homo Sapiens
QAVQHVEIG

SEQ ID NO: 548171 - protein, 9 aa, Homo Sapiens
LGGAGKHGE

SEQ ID NO: 548172 - protein, 9 aa, Homo Sapiens
LAILKDEET

SEQ ID NO: 548173 - protein, 9 aa, Homo Sapiens
LQISFRIWM

SEQ ID NO: 548174 - protein, 9 aa, Homo Sapiens
SHVCSRTPV

SEQ ID NO: 548175 - protein, 9 aa, Homo Sapiens
VQHVEIGPS

SEQ ID NO: 548176 - protein, 9 aa, Homo Sapiens
EYIHFTLDL

SEQ ID NO: 548177 - protein, 9 aa, Homo Sapiens
VAGPRREPL

SEQ ID NO: 548178 - protein, 9 aa, Homo Sapiens
AYGQAAQRE

SEQ ID NO: 548179 - protein, 9 aa, Homo Sapiens
ERERESLGG

SEQ ID NO: 548180 - protein, 9 aa, Homo Sapiens
LKRYRSLIL

SEQ ID NO: 548181 - protein, 9 aa, Homo Sapiens
IRILPWTFV

SEQ ID NO: 548182 - protein, 9 aa, Homo Sapiens
SMAACPEAP

SEQ ID NO: 548183 - protein, 9 aa, Homo Sapiens
WLLAKGDCQ

SEQ ID NO: 548184 - protein, 9 aa, Homo Sapiens
AECSLHLEV

SEQ ID NO: 548185 - protein, 9 aa, Homo Sapiens
QIQSNTGVR

SEQ ID NO: 548186 - protein, 9 aa, Homo Sapiens
PTSREMFSQ

SEQ ID NO: 548187 - protein, 9 aa, Homo Sapiens
KQSDGEHLV

SEQ ID NO: 548188 - protein, 9 aa, Homo Sapiens
GASGCCHQT

SEQ ID NO: 548189 - protein, 9 aa, Homo Sapiens
ASFAFSGCH

SEQ ID NO: 548190 - protein, 9 aa, Homo Sapiens
LQIQSNTGV

SEQ ID NO: 548191 - protein, 9 aa, Homo Sapiens
CNPNKAILT

SEQ ID NO: 548192 - protein, 9 aa, Homo Sapiens
EERERERES

SEQ ID NO: 548193 - protein, 9 aa, Homo Sapiens
SADPAAVAV

SEQ ID NO: 548194 - protein, 9 aa, Homo Sapiens
LCYLPLNTF

SEQ ID NO: 548195 - protein, 9 aa, Homo Sapiens
GRSAECSLH

SEQ ID NO: 548196 - protein, 9 aa, Homo Sapiens
GEHLVSGWS

SEQ ID NO: 548197 - protein, 9 aa, Homo Sapiens
MFSQHPYAE

SEQ ID NO: 548198 - protein, 9 aa, Homo Sapiens
IKILKEMNA

SEQ ID NO: 548199 - protein, 9 aa, Homo Sapiens
RRVPQEVGD

SEQ ID NO: 548200 - protein, 9 aa, Homo Sapiens
DDHAYTPGV

SEQ ID NO: 548201 - protein, 9 aa, Homo Sapiens
LSHPAYGHM

SEQ ID NO: 548202 - protein, 9 aa, Homo Sapiens
ALHIDSVSA

SEQ ID NO: 548203 - protein, 9 aa, Homo Sapiens
KKQQGEQVC

SEQ ID NO: 548204 - protein, 9 aa, Homo Sapiens
LSKSAKDQK

SEQ ID NO: 548205 - protein, 9 aa, Homo Sapiens
VLSDLTSQV

SEQ ID NO: 548206 - protein, 9 aa, Homo Sapiens
ILYCKTGQS

SEQ ID NO: 548207 - protein, 9 aa, Homo Sapiens
VSALKTAFA

SEQ ID NO: 548208 - protein, 9 aa, Homo Sapiens
EIQSLLPSS

SEQ ID NO: 548209 - protein, 9 aa, Homo Sapiens
AGDVVRLFH

SEQ ID NO: 548210 - protein, 9 aa, Homo Sapiens
AVSRLGRWI

SEQ ID NO: 548211 - protein, 9 aa, Homo Sapiens
LSRIAPAFC

SEQ ID NO: 548212 - protein, 9 aa, Homo Sapiens
YAAEVASPI

SEQ ID NO: 548213 - protein, 9 aa, Homo Sapiens
RMKKVEDYV

SEQ ID NO: 548214 - protein, 9 aa, Homo Sapiens
PQEVGDAAA

SEQ ID NO: 548215 - protein, 9 aa, Homo Sapiens
YVKQLNRQR

SEQ ID NO: 548216 - protein, 9 aa, Homo Sapiens
IRPPLQSWR

SEQ ID NO: 548217 - protein, 9 aa, Homo Sapiens
PWPLFPLLP

SEQ ID NO: 548218 - protein, 9 aa, Homo Sapiens
TNTVSALKT

SEQ ID NO: 548219 - protein, 9 aa, Homo Sapiens
GKSFLNPVI

SEQ ID NO: 548220 - protein, 9 aa, Homo Sapiens
TVGKSFLNP

SEQ ID NO: 548221 - protein, 9 aa, Homo Sapiens
KVGILYCKT

SEQ ID NO: 548222 - protein, 9 aa, Homo Sapiens
HLHGLVPTT

SEQ ID NO: 548223 - protein, 9 aa, Homo Sapiens
TEIQSLLPS

SEQ ID NO: 548224 - protein, 9 aa, Homo Sapiens
KILSRIAPA

SEQ ID NO: 548225 - protein, 9 aa, Homo Sapiens
SPIGYLHSL

SEQ ID NO: 548226 - protein, 9 aa, Homo Sapiens
AAIISRVQV

SEQ ID NO: 548227 - protein, 9 aa, Homo Sapiens
LGRPQGRGE

SEQ ID NO: 548228 - protein, 9 aa, Homo Sapiens
VDWLLAKGD

SEQ ID NO: 548229 - protein, 9 aa, Homo Sapiens
LGGIPVLLE

SEQ ID NO: 548230 - protein, 9 aa, Homo Sapiens
REQRAQDDA

SEQ ID NO: 548231 - protein, 9 aa, Homo Sapiens
QVCWGGSSS

SEQ ID NO: 548232 - protein, 9 aa, Homo Sapiens
ELQKLCYLP

SEQ ID NO: 548233 - protein, 9 aa, Homo Sapiens
GEYIHFTLD

SEQ ID NO: 548234 - protein, 9 aa, Homo Sapiens
RLGGIPVLL

SEQ ID NO: 548235 - protein, 9 aa, Homo Sapiens
TARRTPPWP

SEQ ID NO: 548236 - protein, 9 aa, Homo Sapiens
RARAVLFEK

SEQ ID NO: 548237 - protein, 9 aa, Homo Sapiens
NLQISFRIW

SEQ ID NO: 548238 - protein, 9 aa, Homo Sapiens
RPQGRGEGG

SEQ ID NO: 548239 - protein, 9 aa, Homo Sapiens
LFITEIQSL

SEQ ID NO: 548240 - protein, 9 aa, Homo Sapiens
GGGSGFGGG

SEQ ID NO: 548241 - protein, 9 aa, Homo Sapiens
LPEEILAAS

SEQ ID NO: 548242 - protein, 9 aa, Homo Sapiens
SKSAKDQKA

SEQ ID NO: 548243 - protein, 9 aa, Homo Sapiens
FELQKLCYL

SEQ ID NO: 548244 - protein, 9 aa, Homo Sapiens
FYTVGKSFL

SEQ ID NO: 548245 - protein, 9 aa, Homo Sapiens
RFNLLTVLR

SEQ ID NO: 548246 - protein, 9 aa, Homo Sapiens
AYGHMADRM

SEQ ID NO: 548247 - protein, 9 aa, Homo Sapiens
STKPLFTLD

SEQ ID NO: 548248 - protein, 9 aa, Homo Sapiens
GTAGAASPG

SEQ ID NO: 548249 - protein, 9 aa, Homo Sapiens
VPTTHQGTL

SEQ ID NO: 548250 - protein, 9 aa, Homo Sapiens
GLGRPQGRG

SEQ ID NO: 548251 - protein, 9 aa, Homo Sapiens
CKTGQSSEE

SEQ ID NO: 548252 - protein, 9 aa, Homo Sapiens
CVVQHIKEN

SEQ ID NO: 548253 - protein, 9 aa, Homo Sapiens
WQPYGSSFY

SEQ ID NO: 548254 - protein, 9 aa, Homo Sapiens
GSPGHSPHR

SEQ ID NO: 548255 - protein, 9 aa, Homo Sapiens
DADDHAYTP

SEQ ID NO: 548256 - protein, 9 aa, Homo Sapiens
AALRDVGQQ

SEQ ID NO: 548257 - protein, 9 aa, Homo Sapiens
TGIGRARAV

SEQ ID NO: 548258 - protein, 9 aa, Homo Sapiens
ECSLHLEVI

SEQ ID NO: 548259 - protein, 9 aa, Homo Sapiens
WQGASGCCH

SEQ ID NO: 548260 - protein, 9 aa, Homo Sapiens
GLVPTTHQG

SEQ ID NO: 548261 - protein, 9 aa, Homo Sapiens
ALAMVPGTL

SEQ ID NO: 548262 - protein, 9 aa, Homo Sapiens
EVASPIGYL

SEQ ID NO: 548263 - protein, 9 aa, Homo Sapiens
LDLLLGKKQ

SEQ ID NO: 548264 - protein, 9 aa, Homo Sapiens
STTCVLDEA

SEQ ID NO: 548265 - protein, 9 aa, Homo Sapiens
KKVEDYVKQ

SEQ ID NO: 548266 - protein, 9 aa, Homo Sapiens
ADPAAVAVA

SEQ ID NO: 548267 - protein, 9 aa, Homo Sapiens
GPMGSLAIL

SEQ ID NO: 548268 - protein, 9 aa, Homo Sapiens
KLVDWLLAK

SEQ ID NO: 548269 - protein, 9 aa, Homo Sapiens
EILAASFAF

SEQ ID NO: 548270 - protein, 9 aa, Homo Sapiens
PWTFVQSFK

SEQ ID NO: 548271 - protein, 9 aa, Homo Sapiens
AKRKPDGKF

SEQ ID NO: 548272 - protein, 9 aa, Homo Sapiens
FWVCDGEDN

SEQ ID NO: 548273 - protein, 9 aa, Homo Sapiens
CTARRTPPW

SEQ ID NO: 548274 - protein, 9 aa, Homo Sapiens
SYREDVLKA

SEQ ID NO: 548275 - protein, 9 aa, Homo Sapiens
KRYRSLILR

SEQ ID NO: 548276 - protein, 9 aa, Homo Sapiens
GPRREPLEL

SEQ ID NO: 548277 - protein, 9 aa, Homo Sapiens
RRNIVFLNT

SEQ ID NO: 548278 - protein, 9 aa, Homo Sapiens
VEALSGLRL

SEQ ID NO: 548279 - protein, 9 aa, Homo Sapiens
EPSPPSPLH

SEQ ID NO: 548280 - protein, 9 aa, Homo Sapiens
EMNAELQMT

SEQ ID NO: 548281 - protein, 9 aa, Homo Sapiens
PEAQVFMPT

SEQ ID NO: 548282 - protein, 9 aa, Homo Sapiens
AADEPPDAY

SEQ ID NO: 548283 - protein, 9 aa, Homo Sapiens
QQWLQSEAF

SEQ ID NO: 548284 - protein, 9 aa, Homo Sapiens
PMGSLAILK

SEQ ID NO: 548285 - protein, 9 aa, Homo Sapiens
KRKPDGKFY

SEQ ID NO: 548286 - protein, 9 aa, Homo Sapiens
GILYCKTGQ

SEQ ID NO: 548287 - protein, 9 aa, Homo Sapiens
ERESLGGAG

SEQ ID NO: 548288 - protein, 9 aa, Homo Sapiens
NDFLYDQNR

SEQ ID NO: 548289 - protein, 9 aa, Homo Sapiens
HQVASPQPP

SEQ ID NO: 548290 - protein, 9 aa, Homo Sapiens
ATACESFPE

SEQ ID NO: 548291 - protein, 9 aa, Homo Sapiens
GSGFGGGFG

SEQ ID NO: 548292 - protein, 9 aa, Homo Sapiens
QHVEIGPSS

SEQ ID NO: 548293 - protein, 9 aa, Homo Sapiens
AFSGCHSRV

SEQ ID NO: 548294 - protein, 9 aa, Homo Sapiens
SKGVFGAGP

SEQ ID NO: 548295 - protein, 9 aa, Homo Sapiens
SGFGGGFGG

SEQ ID NO: 548296 - protein, 9 aa, Homo Sapiens
SFQLKRYRS

SEQ ID NO: 548297 - protein, 9 aa, Homo Sapiens
ASQSCCPNC

SEQ ID NO: 548298 - protein, 9 aa, Homo Sapiens
ARCKEVTLH

SEQ ID NO: 548299 - protein, 9 aa, Homo Sapiens
KEKRFNLLT

SEQ ID NO: 548300 - protein, 9 aa, Homo Sapiens
KEMNAELQM

SEQ ID NO: 548301 - protein, 9 aa, Homo Sapiens
ALSQTGFSY

SEQ ID NO: 548302 - protein, 9 aa, Homo Sapiens
LTLQIQSNT

SEQ ID NO: 548303 - protein, 9 aa, Homo Sapiens
EVAGPRREP

SEQ ID NO: 548304 - protein, 9 aa, Homo Sapiens
SHLHGLVPT

SEQ ID NO: 548305 - protein, 9 aa, Homo Sapiens
WRLATFLAT

SEQ ID NO: 548306 - protein, 9 aa, Homo Sapiens
AAAEAALSQ

SEQ ID NO: 548307 - protein, 9 aa, Homo Sapiens
PAEKIGGVF

SEQ ID NO: 548308 - protein, 9 aa, Homo Sapiens
DNCGDNSDE

SEQ ID NO: 548309 - protein, 9 aa, Homo Sapiens
KHGEMSMSM

SEQ ID NO: 548310 - protein, 9 aa, Homo Sapiens
ATFLATTSV

SEQ ID NO: 548311 - protein, 9 aa, Homo Sapiens
IWGGENLQI

SEQ ID NO: 548312 - protein, 9 aa, Homo Sapiens
HVEIGPSSL

SEQ ID NO: 548313 - protein, 9 aa, Homo Sapiens
ILQAINFPF

SEQ ID NO: 548314 - protein, 9 aa, Homo Sapiens
GKHGEMSMS

SEQ ID NO: 548315 - protein, 9 aa, Homo Sapiens
RARCKEVTL

SEQ ID NO: 548316 - protein, 9 aa, Homo Sapiens
LHPGDVLAL

SEQ ID NO: 548317 - protein, 9 aa, Homo Sapiens
EDVLKAGDV

SEQ ID NO: 548318 - protein, 9 aa, Homo Sapiens
QREQRAQDD

SEQ ID NO: 548319 - protein, 9 aa, Homo Sapiens
QGYTIRILP

SEQ ID NO: 548320 - protein, 9 aa, Homo Sapiens
GGKLSITVK

SEQ ID NO: 548321 - protein, 9 aa, Homo Sapiens
PNCTRVGTR

SEQ ID NO: 548322 - protein, 9 aa, Homo Sapiens
GEQVCWGGS

SEQ ID NO: 548323 - protein, 9 aa, Homo Sapiens
PRREPLELE

SEQ ID NO: 548324 - protein, 9 aa, Homo Sapiens
ITEIQSLLP

SEQ ID NO: 548325 - protein, 9 aa, Homo Sapiens
EDYVKQLNR

SEQ ID NO: 548326 - protein, 9 aa, Homo Sapiens
SEKMPTYRN

SEQ ID NO: 548327 - protein, 9 aa, Homo Sapiens
VRARCKEVT

SEQ ID NO: 548328 - protein, 9 aa, Homo Sapiens
RDFELQKLC

SEQ ID NO: 548329 - protein, 9 aa, Homo Sapiens
RAVLFEKQI

SEQ ID NO: 548330 - protein, 9 aa, Homo Sapiens
SKHTPCIMK

SEQ ID NO: 548331 - protein, 9 aa, Homo Sapiens
ILLSCPYEQ

SEQ ID NO: 548332 - protein, 9 aa, Homo Sapiens
QAAQREQRA

SEQ ID NO: 548333 - protein, 9 aa, Homo Sapiens
SAECSLHLE

SEQ ID NO: 548334 - protein, 9 aa, Homo Sapiens
THQGTLPAY

SEQ ID NO: 548335 - protein, 9 aa, Homo Sapiens
NKAILTVDA

SEQ ID NO: 548336 - protein, 9 aa, Homo Sapiens
GAASPGAPA

SEQ ID NO: 548337 - protein, 9 aa, Homo Sapiens
FQLKRYRSL

SEQ ID NO: 548338 - protein, 9 aa, Homo Sapiens
SLAILKDEE

SEQ ID NO: 548339 - protein, 9 aa, Homo Sapiens
LQRPPGSPG

SEQ ID NO: 548340 - protein, 9 aa, Homo Sapiens
RAQDDADDH

SEQ ID NO: 548341 - protein, 9 aa, Homo Sapiens
IDSVSATDR

SEQ ID NO: 548342 - protein, 9 aa, Homo Sapiens
MGSLAILKD

SEQ ID NO: 548343 - protein, 9 aa, Homo Sapiens
RTPPWPLFP

SEQ ID NO: 548344 - protein, 9 aa, Homo Sapiens
GAGKHGEMS

SEQ ID NO: 548345 - protein, 9 aa, Homo Sapiens
CESFPERLP

SEQ ID NO: 548346 - protein, 9 aa, Homo Sapiens
DVGQQYESV

SEQ ID NO: 548347 - protein, 9 aa, Homo Sapiens
GTLPTPTQV

SEQ ID NO: 548348 - protein, 9 aa, Homo Sapiens
GIGRARAVL

SEQ ID NO: 548349 - protein, 9 aa, Homo Sapiens
KVLLAKRKP

SEQ ID NO: 548350 - protein, 9 aa, Homo Sapiens
QRVVKRLGG

SEQ ID NO: 548351 - protein, 9 aa, Homo Sapiens
LEEKDLMDR

SEQ ID NO: 548352 - protein, 9 aa, Homo Sapiens
KHTPCIMKV

SEQ ID NO: 548353 - protein, 9 aa, Homo Sapiens
EYDLLKLQR

SEQ ID NO: 548354 - protein, 9 aa, Homo Sapiens
NPNKAILTV

SEQ ID NO: 548355 - protein, 9 aa, Homo Sapiens
NTVSALKTA

SEQ ID NO: 548356 - protein, 9 aa, Homo Sapiens
LVEALSGLR

SEQ ID NO: 548357 - protein, 9 aa, Homo Sapiens
QGEQVCWGG

SEQ ID NO: 548358 - protein, 9 aa, Homo Sapiens
PGLSGHGEP

SEQ ID NO: 548359 - protein, 9 aa, Homo Sapiens
DWLLAKGDC

SEQ ID NO: 548360 - protein, 9 aa, Homo Sapiens
EQPDSWQPY

SEQ ID NO: 548361 - protein, 9 aa, Homo Sapiens
KLCYLPLNT

SEQ ID NO: 548362 - protein, 9 aa, Homo Sapiens
SFGGGSGFG

SEQ ID NO: 548363 - protein, 9 aa, Homo Sapiens
NCGDNSDEA

SEQ ID NO: 548364 - protein, 9 aa, Homo Sapiens
LYDQNRDKN

SEQ ID NO: 548365 - protein, 9 aa, Homo Sapiens
MSMAACPEA

SEQ ID NO: 548366 - protein, 9 aa, Homo Sapiens
ITVKKRMAL

SEQ ID NO: 548367 - protein, 9 aa, Homo Sapiens
DIWGGENLQ

SEQ ID NO: 548368 - protein, 9 aa, Homo Sapiens
SGPMGSLAI

SEQ ID NO: 548369 - protein, 9 aa, Homo Sapiens
RPPGSPGHS

SEQ ID NO: 548370 - protein, 9 aa, Homo Sapiens
AATWRLATF

SEQ ID NO: 548371 - protein, 9 aa, Homo Sapiens
DAAAAPAGL

SEQ ID NO: 548372 - protein, 9 aa, Homo Sapiens
ARTIGFCYT

SEQ ID NO: 548373 - protein, 9 aa, Homo Sapiens
YCKTGQSSE

SEQ ID NO: 548374 - protein, 9 aa, Homo Sapiens
TLPTPTQVL

SEQ ID NO: 548375 - protein, 9 aa, Homo Sapiens
FTLDLLLGK

SEQ ID NO: 548376 - protein, 9 aa, Homo Sapiens
MVPGTLPTP

SEQ ID NO: 548377 - protein, 9 aa, Homo Sapiens
CGRSAECSL

SEQ ID NO: 548378 - protein, 9 aa, Homo Sapiens
GDAAAAPAG

SEQ ID NO: 548379 - protein, 9 aa, Homo Sapiens
LAASFAFSG

SEQ ID NO: 548380 - protein, 9 aa, Homo Sapiens
IVFLNTHKT

SEQ ID NO: 548381 - protein, 9 aa, Homo Sapiens
LLNDFLYDQ

SEQ ID NO: 548382 - protein, 9 aa, Homo Sapiens
RVPQEVGDA

SEQ ID NO: 548383 - protein, 9 aa, Homo Sapiens
HLVRARCKE

SEQ ID NO: 548384 - protein, 9 aa, Homo Sapiens
KIGGVFAAC

SEQ ID NO: 548385 - protein, 9 aa, Homo Sapiens
AQLLGCSHV

SEQ ID NO: 548386 - protein, 9 aa, Homo Sapiens
CSLHLEVIV

SEQ ID NO: 548387 - protein, 9 aa, Homo Sapiens
QGTLPAYLQ

SEQ ID NO: 548388 - protein, 9 aa, Homo Sapiens
NASLGLSFR

SEQ ID NO: 548389 - protein, 9 aa, Homo Sapiens
GVIPAEKIG

SEQ ID NO: 548390 - protein, 9 aa, Homo Sapiens
AYEEYIRPP

SEQ ID NO: 548391 - protein, 9 aa, Homo Sapiens
HIDSVSATD

SEQ ID NO: 548392 - protein, 9 aa, Homo Sapiens
LATTSVRCT

SEQ ID NO: 548393 - protein, 9 aa, Homo Sapiens
EKRFNLLTV

SEQ ID NO: 548394 - protein, 9 aa, Homo Sapiens
VKKQQGEQV

SEQ ID NO: 548395 - protein, 9 aa, Homo Sapiens
MLLNDFLYD

SEQ ID NO: 548396 - protein, 9 aa, Homo Sapiens
SLGLSFRRQ

SEQ ID NO: 548397 - protein, 9 aa, Homo Sapiens
FMPTSDPAS

SEQ ID NO: 548398 - protein, 9 aa, Homo Sapiens
VGILYCKTG

SEQ ID NO: 548399 - protein, 9 aa, Homo Sapiens
LNDFLYDQN

SEQ ID NO: 548400 - protein, 9 aa, Homo Sapiens
QRPPGSPGH

SEQ ID NO: 548401 - protein, 9 aa, Homo Sapiens
IHFTLDLLL

SEQ ID NO: 548402 - protein, 9 aa, Homo Sapiens
LFTLDSSIS

SEQ ID NO: 548403 - protein, 9 aa, Homo Sapiens
YLQQWLQSE

SEQ ID NO: 548404 - protein, 9 aa, Homo Sapiens
RIAPAFCMS

SEQ ID NO: 548405 - protein, 9 aa, Homo Sapiens
RTIGFCYTL

SEQ ID NO: 548406 - protein, 9 aa, Homo Sapiens
FPLLPPLGP

SEQ ID NO: 548407 - protein, 9 aa, Homo Sapiens
PPLQSWRSK

SEQ ID NO: 548408 - protein, 9 aa, Homo Sapiens
QLKRYRSLI

SEQ ID NO: 548409 - protein, 9 aa, Homo Sapiens
LSCPYEQAI

SEQ ID NO: 548410 - protein, 9 aa, Homo Sapiens
GAPAAAADE

SEQ ID NO: 548411 - protein, 9 aa, Homo Sapiens
APGRHGVLS

SEQ ID NO: 548412 - protein, 9 aa, Homo Sapiens
EEKDLMDRE

SEQ ID NO: 548413 - protein, 9 aa, Homo Sapiens
GLLSHLHGL

SEQ ID NO: 548414 - protein, 9 aa, Homo Sapiens
NFPFLVKLQ

SEQ ID NO: 548415 - protein, 9 aa, Homo Sapiens
AEVASPIGY

SEQ ID NO: 548416 - protein, 9 aa, Homo Sapiens
SFRRQLLYW

SEQ ID NO: 548417 - protein, 9 aa, Homo Sapiens
TACESFPER

SEQ ID NO: 548418 - protein, 9 aa, Homo Sapiens
LLSHLHGLV

SEQ ID NO: 548419 - protein, 9 aa, Homo Sapiens
EGTAGAASP

SEQ ID NO: 548420 - protein, 9 aa, Homo Sapiens
AALSQTGFS

SEQ ID NO: 548421 - protein, 9 aa, Homo Sapiens
EQRAQDDAD

SEQ ID NO: 548422 - protein, 9 aa, Homo Sapiens
DDADDHAYT

SEQ ID NO: 548423 - protein, 9 aa, Homo Sapiens
PEEILAASF

SEQ ID NO: 548424 - protein, 9 aa, Homo Sapiens
VCWGGSSSV

SEQ ID NO: 548425 - protein, 9 aa, Homo Sapiens
FLSHPAYGH

SEQ ID NO: 548426 - protein, 9 aa, Homo Sapiens
AGKHGEMSM

SEQ ID NO: 548427 - protein, 9 aa, Homo Sapiens
WAGGKLSIT

SEQ ID NO: 548428 - protein, 9 aa, Homo Sapiens
PPDAYGQAA

SEQ ID NO: 548429 - protein, 9 aa, Homo Sapiens
PAYGHMADR

SEQ ID NO: 548430 - protein, 9 aa, Homo Sapiens
AQVFMPTSD

SEQ ID NO: 548431 - protein, 9 aa, Homo Sapiens
KRFNLLTVL

SEQ ID NO: 548432 - protein, 9 aa, Homo Sapiens
LAKGDCQTR

SEQ ID NO: 548433 - protein, 9 aa, Homo Sapiens
EIGPSSLIV

SEQ ID NO: 548434 - protein, 9 aa, Homo Sapiens
RAAAEAALS

SEQ ID NO: 548435 - protein, 9 aa, Homo Sapiens
LSLEEKDLM

SEQ ID NO: 548436 - protein, 9 aa, Homo Sapiens
QRAQDDADD

SEQ ID NO: 548437 - protein, 9 aa, Homo Sapiens
VCSRTPVET

SEQ ID NO: 548438 - protein, 9 aa, Homo Sapiens
ARAVLFEKQ

SEQ ID NO: 548439 - protein, 9 aa, Homo Sapiens
AAADEPPDA

SEQ ID NO: 548440 - protein, 9 aa, Homo Sapiens
NTHKTASST

SEQ ID NO: 548441 - protein, 9 aa, Homo Sapiens
GGENLQISF

SEQ ID NO: 548442 - protein, 9 aa, Homo Sapiens
TWRLATFLA

SEQ ID NO: 548443 - protein, 9 aa, Homo Sapiens
TVSALKTAF

SEQ ID NO: 548444 - protein, 9 aa, Homo Sapiens
EISTTCVLD

SEQ ID NO: 548445 - protein, 9 aa, Homo Sapiens
PGHSPHRPG

SEQ ID NO: 548446 - protein, 9 aa, Homo Sapiens
IVLLFITEI

SEQ ID NO: 548447 - protein, 9 aa, Homo Sapiens
GAGPGLSGH

SEQ ID NO: 548448 - protein, 9 aa, Homo Sapiens
GCSHVCSRT

SEQ ID NO: 548449 - protein, 9 aa, Homo Sapiens
GPGLSGHGE

SEQ ID NO: 548450 - protein, 9 aa, Homo Sapiens
WKSAVSRLG

SEQ ID NO: 548451 - protein, 9 aa, Homo Sapiens
LSITVKKRM

SEQ ID NO: 548452 - protein, 9 aa, Homo Sapiens
ESLGGAGKH

SEQ ID NO: 548453 - protein, 9 aa, Homo Sapiens
LKAGDVVRL

SEQ ID NO: 548454 - protein, 9 aa, Homo Sapiens
SAEWKSAVS

SEQ ID NO: 548455 - protein, 9 aa, Homo Sapiens
CLNATACES

SEQ ID NO: 548456 - protein, 9 aa, Homo Sapiens
LTSQVAAGP

SEQ ID NO: 548457 - protein, 9 aa, Homo Sapiens
PGAPAAAAD

SEQ ID NO: 548458 - protein, 9 aa, Homo Sapiens
ERERERESL

SEQ ID NO: 548459 - protein, 9 aa, Homo Sapiens
KMEQKAKQH

SEQ ID NO: 548460 - protein, 9 aa, Homo Sapiens
PLQSWRSKL

SEQ ID NO: 548461 - protein, 9 aa, Homo Sapiens
EMFSQHPYA

SEQ ID NO: 548462 - protein, 9 aa, Homo Sapiens
GFCYTLFLH

SEQ ID NO: 548463 - protein, 9 aa, Homo Sapiens
EDIKILKEM

SEQ ID NO: 548464 - protein, 9 aa, Homo Sapiens
EEYIRPPLQ

SEQ ID NO: 548465 - protein, 9 aa, Homo Sapiens
AEKIGGVFA

SEQ ID NO: 548466 - protein, 9 aa, Homo Sapiens
IGFCYTLFL

SEQ ID NO: 548467 - protein, 9 aa, Homo Sapiens
FPERLPDAL

SEQ ID NO: 548468 - protein, 9 aa, Homo Sapiens
AAEVALSKS

SEQ ID NO: 548469 - protein, 9 aa, Homo Sapiens
QEVGDAAAA

SEQ ID NO: 548470 - protein, 9 aa, Homo Sapiens
LKLQRPPGS

SEQ ID NO: 548471 - protein, 9 aa, Homo Sapiens
PSPPSPLHP

SEQ ID NO: 548472 - protein, 9 aa, Homo Sapiens
TTSVRCTAR

SEQ ID NO: 548473 - protein, 9 aa, Homo Sapiens
RVVKRLGGI

SEQ ID NO: 548474 - protein, 9 aa, Homo Sapiens
SLGGAGKHG

SEQ ID NO: 548475 - protein, 9 aa, Homo Sapiens
FITEIQSLL

SEQ ID NO: 548476 - protein, 9 aa, Homo Sapiens
MPTYRNLTS

SEQ ID NO: 548477 - protein, 9 aa, Homo Sapiens
REMFSQHPY

SEQ ID NO: 548478 - protein, 9 aa, Homo Sapiens
SPGHSPHRP

SEQ ID NO: 548479 - protein, 9 aa, Homo Sapiens
AGPSADPAA

SEQ ID NO: 548480 - protein, 9 aa, Homo Sapiens
PAGLAPGRH

SEQ ID NO: 548481 - protein, 9 aa, Homo Sapiens
ADDHAYTPG

SEQ ID NO: 548482 - protein, 9 aa, Homo Sapiens
TCVLDEADS

SEQ ID NO: 548483 - protein, 9 aa, Homo Sapiens
SPALHIDSV

SEQ ID NO: 548484 - protein, 9 aa, Homo Sapiens
LIEYDLLKL

SEQ ID NO: 548485 - protein, 9 aa, Homo Sapiens
VFGAGPGLS

SEQ ID NO: 548486 - protein, 9 aa, Homo Sapiens
HLVSGWSET

SEQ ID NO: 548487 - protein, 9 aa, Homo Sapiens
FYKEKRFNL

SEQ ID NO: 548488 - protein, 9 aa, Homo Sapiens
YSAEWKSAV

SEQ ID NO: 548489 - protein, 9 aa, Homo Sapiens
PISKHTPCI

SEQ ID NO: 548490 - protein, 9 aa, Homo Sapiens
AVAEGTAGA

SEQ ID NO: 548491 - protein, 9 aa, Homo Sapiens
QVAAGPSAD

SEQ ID NO: 548492 - protein, 9 aa, Homo Sapiens
LLIEYDLLK

SEQ ID NO: 548493 - protein, 9 aa, Homo Sapiens
ACESFPERL

SEQ ID NO: 548494 - protein, 9 aa, Homo Sapiens
GRARAVLFE

SEQ ID NO: 548495 - protein, 9 aa, Homo Sapiens
GEDNCGDNS

SEQ ID NO: 548496 - protein, 9 aa, Homo Sapiens
YQRVVKRLG

SEQ ID NO: 548497 - protein, 9 aa, Homo Sapiens
PSPLHPGDV

SEQ ID NO: 548498 - protein, 9 aa, Homo Sapiens
PPGSPGHSP

SEQ ID NO: 548499 - protein, 9 aa, Homo Sapiens
DSVSATDRD

SEQ ID NO: 548500 - protein, 9 aa, Homo Sapiens
EMSMSMAAC

SEQ ID NO: 548501 - protein, 9 aa, Homo Sapiens
GRHGVLSDL

SEQ ID NO: 548502 - protein, 9 aa, Homo Sapiens
TLPKILSRI

SEQ ID NO: 548503 - protein, 9 aa, Homo Sapiens
APAAAADEP

SEQ ID NO: 548504 - protein, 9 aa, Homo Sapiens
PTYRNLTSL

SEQ ID NO: 548505 - protein, 9 aa, Homo Sapiens
DSWQPYGSS

SEQ ID NO: 548506 - protein, 9 aa, Homo Sapiens
LSGLRLNTL

SEQ ID NO: 548507 - protein, 9 aa, Homo Sapiens
LPWTFVQSF

SEQ ID NO: 548508 - protein, 9 aa, Homo Sapiens
LKDILLSCP

SEQ ID NO: 548509 - protein, 9 aa, Homo Sapiens
AKQHQVASP

SEQ ID NO: 548510 - protein, 9 aa, Homo Sapiens
DAYGQAAQR

SEQ ID NO: 548511 - protein, 9 aa, Homo Sapiens
RCTARRTPP

SEQ ID NO: 548512 - protein, 9 aa, Homo Sapiens
EWKSAVSRL

SEQ ID NO: 548513 - protein, 9 aa, Homo Sapiens
KLSITVKKR

SEQ ID NO: 548514 - protein, 9 aa, Homo Sapiens
FGAGPGLSG

SEQ ID NO: 548515 - protein, 9 aa, Homo Sapiens
PALHIDSVS

SEQ ID NO: 548516 - protein, 9 aa, Homo Sapiens
SLPEEILAA

SEQ ID NO: 548517 - protein, 9 aa, Homo Sapiens
LAKRKPDGK

SEQ ID NO: 548518 - protein, 9 aa, Homo Sapiens
IGRARAVLF

SEQ ID NO: 548519 - protein, 9 aa, Homo Sapiens
VGDAAAAPA

SEQ ID NO: 548520 - protein, 9 aa, Homo Sapiens
AASFAFSGC

SEQ ID NO: 548521 - protein, 9 aa, Homo Sapiens
PAAAADEPP

SEQ ID NO: 548522 - protein, 9 aa, Homo Sapiens
DLLKLQRPP

SEQ ID NO: 548523 - protein, 9 aa, Homo Sapiens
ILSRIAPAF

SEQ ID NO: 548524 - protein, 9 aa, Homo Sapiens
NNSPALHID

SEQ ID NO: 548525 - protein, 9 aa, Homo Sapiens
QISFRIWMC

SEQ ID NO: 548526 - protein, 9 aa, Homo Sapiens
GHMADRMGT

SEQ ID NO: 548527 - protein, 9 aa, Homo Sapiens
MPTSDPASS

SEQ ID NO: 548528 - protein, 9 aa, Homo Sapiens
KAKQHQVAS

SEQ ID NO: 548529 - protein, 9 aa, Homo Sapiens
LQKLCYLPL

SEQ ID NO: 548530 - protein, 9 aa, Homo Sapiens
TIRILPWTF

SEQ ID NO: 548531 - protein, 9 aa, Homo Sapiens
IEYDLLKLQ

SEQ ID NO: 548532 - protein, 9 aa, Homo Sapiens
GVLSDLTSQ

SEQ ID NO: 548533 - protein, 9 aa, Homo Sapiens
AAVAVAEGT

SEQ ID NO: 548534 - protein, 9 aa, Homo Sapiens
GHSPHRPGL

SEQ ID NO: 548535 - protein, 9 aa, Homo Sapiens
RLATFLATT

SEQ ID NO: 548536 - protein, 9 aa, Homo Sapiens
GGVFAACQS

SEQ ID NO: 548537 - protein, 9 aa, Homo Sapiens
ESFPERLPD

SEQ ID NO: 548538 - protein, 9 aa, Homo Sapiens
GTAKVWQGA

SEQ ID NO: 548539 - protein, 9 aa, Homo Sapiens
FGGGSGFGG

SEQ ID NO: 548540 - protein, 9 aa, Homo Sapiens
PAAVAVAEG

SEQ ID NO: 548541 - protein, 9 aa, Homo Sapiens
AAEAALSQT

SEQ ID NO: 548542 - protein, 9 aa, Homo Sapiens
AAGPSADPA

SEQ ID NO: 548543 - protein, 9 aa, Homo Sapiens
TLQIQSNTG

SEQ ID NO: 548544 - protein, 9 aa, Homo Sapiens
GNSTKPLFT

SEQ ID NO: 548545 - protein, 9 aa, Homo Sapiens
RYRSLILRF

SEQ ID NO: 548546 - protein, 9 aa, Homo Sapiens
FLYDQNRDK

SEQ ID NO: 548547 - protein, 9 aa, Homo Sapiens
IPAEKIGGV

SEQ ID NO: 548548 - protein, 9 aa, Homo Sapiens
PGSPGHSPH

SEQ ID NO: 548549 - protein, 9 aa, Homo Sapiens
LGLSFRRQL

SEQ ID NO: 548550 - protein, 9 aa, Homo Sapiens
LLKLQRPPG

SEQ ID NO: 548551 - protein, 9 aa, Homo Sapiens
KGEYIHFTL

SEQ ID NO: 548552 - protein, 9 aa, Homo Sapiens
ASLGLSFRR

SEQ ID NO: 548553 - protein, 9 aa, Homo Sapiens
LSFRRQLLY

SEQ ID NO: 548554 - protein, 9 aa, Homo Sapiens
RGKPTSREM

SEQ ID NO: 548555 - protein, 9 aa, Homo Sapiens
AYLQQWLQS

SEQ ID NO: 548556 - protein, 9 aa, Homo Sapiens
APAGLAPGR

SEQ ID NO: 548557 - protein, 9 aa, Homo Sapiens
RNLTSLPLY

SEQ ID NO: 548558 - protein, 9 aa, Homo Sapiens
SQVAAGPSA

SEQ ID NO: 548559 - protein, 9 aa, Homo Sapiens
AEAALSQTG

SEQ ID NO: 548560 - protein, 9 aa, Homo Sapiens
YGQAAQREQ

SEQ ID NO: 548561 - protein, 9 aa, Homo Sapiens
AASQSCCPN

SEQ ID NO: 548562 - protein, 9 aa, Homo Sapiens
SSTNTVSAL

SEQ ID NO: 548563 - protein, 9 aa, Homo Sapiens
SREMFSQHP

SEQ ID NO: 548564 - protein, 9 aa, Homo Sapiens
TSDPASSVS

SEQ ID NO: 548565 - protein, 9 aa, Homo Sapiens
SPHRPGLLS

SEQ ID NO: 548566 - protein, 9 aa, Homo Sapiens
LHGLVPTTH

SEQ ID NO: 548567 - protein, 9 aa, Homo Sapiens
VALSKSAKD

SEQ ID NO: 548568 - protein, 9 aa, Homo Sapiens
IQSNTGVRA

SEQ ID NO: 548569 - protein, 9 aa, Homo Sapiens
VLLFITEIQ

SEQ ID NO: 548570 - protein, 9 aa, Homo Sapiens
QSDGEHLVS

SEQ ID NO: 548571 - protein, 9 aa, Homo Sapiens
CCPNCTRVG

SEQ ID NO: 548572 - protein, 9 aa, Homo Sapiens
ILAASFAFS

SEQ ID NO: 548573 - protein, 9 aa, Homo Sapiens
TSREMFSQH

SEQ ID NO: 548574 - protein, 9 aa, Homo Sapiens
DGTAKVWQG

SEQ ID NO: 548575 - protein, 9 aa, Homo Sapiens
LKEMNAELQ

SEQ ID NO: 548576 - protein, 9 aa, Homo Sapiens
AILTVDAKT

SEQ ID NO: 548577 - protein, 9 aa, Homo Sapiens
LTVDAKTTE

SEQ ID NO: 548578 - protein, 9 aa, Homo Sapiens
RMLLNDFLY

SEQ ID NO: 548579 - protein, 9 aa, Homo Sapiens
GYTIRILPW

SEQ ID NO: 548580 - protein, 9 aa, Homo Sapiens
GGAGKHGEM

SEQ ID NO: 548581 - protein, 9 aa, Homo Sapiens
RCKEVTLHK

SEQ ID NO: 548582 - protein, 9 aa, Homo Sapiens
TKPLFTLDS

SEQ ID NO: 548583 - protein, 9 aa, Homo Sapiens
GQAAQREQR

SEQ ID NO: 548584 - protein, 9 aa, Homo Sapiens
ARRTPPWPL

SEQ ID NO: 548585 - protein, 9 aa, Homo Sapiens
ASPGAPAAA

SEQ ID NO: 548586 - protein, 9 aa, Homo Sapiens
CRDFELQKL

SEQ ID NO: 548587 - protein, 9 aa, Homo Sapiens
ADEPPDAYG

SEQ ID NO: 548588 - protein, 9 aa, Homo Sapiens
FGGGFGGGG

SEQ ID NO: 548589 - protein, 9 aa, Homo Sapiens
TFLATTSVR

SEQ ID NO: 548590 - protein, 9 aa, Homo Sapiens
PASFQLKRY

SEQ ID NO: 548591 - protein, 9 aa, Homo Sapiens
KAILTVDAK

SEQ ID NO: 548592 - protein, 9 aa, Homo Sapiens
VCNPNKAIL

SEQ ID NO: 548593 - protein, 9 aa, Homo Sapiens
ISTTCVLDE

SEQ ID NO: 548594 - protein, 9 aa, Homo Sapiens
GLAPGRHGV

SEQ ID NO: 548595 - protein, 9 aa, Homo Sapiens
RPGLLSHLH

SEQ ID NO: 548596 - protein, 9 aa, Homo Sapiens
LQQWLQSEA

SEQ ID NO: 548597 - protein, 9 aa, Homo Sapiens
LEQPDSWQP

SEQ ID NO: 548598 - protein, 9 aa, Homo Sapiens
TGQSSEEEM

SEQ ID NO: 548599 - protein, 9 aa, Homo Sapiens
IVNHLVRAR

SEQ ID NO: 548600 - protein, 9 aa, Homo Sapiens
VLFEKQIVQ

SEQ ID NO: 548601 - protein, 9 aa, Homo Sapiens
EPPDAYGQA

SEQ ID NO: 548602 - protein, 9 aa, Homo Sapiens
HSPHRPGLL

SEQ ID NO: 548603 - protein, 9 aa, Homo Sapiens
AGPRREPLE

SEQ ID NO: 548604 - protein, 9 aa, Homo Sapiens
LPPLGPMTW

SEQ ID NO: 548605 - protein, 9 aa, Homo Sapiens
ERLPDALPL

SEQ ID NO: 548606 - protein, 9 aa, Homo Sapiens
KPLFTLDSS

SEQ ID NO: 548607 - protein, 9 aa, Homo Sapiens
HGEMSMSMA

SEQ ID NO: 548608 - protein, 9 aa, Homo Sapiens
EALSGLRLN

SEQ ID NO: 548609 - protein, 9 aa, Homo Sapiens
DVLKAGDVV

SEQ ID NO: 548610 - protein, 9 aa, Homo Sapiens
KMPTYRNLT

SEQ ID NO: 548611 - protein, 9 aa, Homo Sapiens
SNTGVRATL

SEQ ID NO: 548612 - protein, 9 aa, Homo Sapiens
GENLQISFR

SEQ ID NO: 548613 - protein, 9 aa, Homo Sapiens
LEVAGPRRE

SEQ ID NO: 548614 - protein, 9 aa, Homo Sapiens
SPPSPLHPG

SEQ ID NO: 548615 - protein, 9 aa, Homo Sapiens
KAGDVVRLF

SEQ ID NO: 548616 - protein, 9 aa, Homo Sapiens
EKRILQAIN

SEQ ID NO: 548617 - protein, 9 aa, Homo Sapiens
FYAAEVASP

SEQ ID NO: 548618 - protein, 9 aa, Homo Sapiens
GQQYESVAA

SEQ ID NO: 548619 - protein, 9 aa, Homo Sapiens
QVFMPTSDP

SEQ ID NO: 548620 - protein, 9 aa, Homo Sapiens
STNTVSALK

SEQ ID NO: 548621 - protein, 9 aa, Homo Sapiens
RGLGRPQGR

SEQ ID NO: 548622 - protein, 9 aa, Homo Sapiens
FLATTSVRC

SEQ ID NO: 548623 - protein, 9 aa, Homo Sapiens
MDRERRMAN

SEQ ID NO: 548624 - protein, 9 aa, Homo Sapiens
FLNTHKTAS

SEQ ID NO: 548625 - protein, 9 aa, Homo Sapiens
SMSMAACPE

SEQ ID NO: 548626 - protein, 9 aa, Homo Sapiens
HGVLSDLTS

SEQ ID NO: 548627 - protein, 9 aa, Homo Sapiens
SPLHPGDVL

SEQ ID NO: 548628 - protein, 9 aa, Homo Sapiens
IGGVFAACQ

SEQ ID NO: 548629 - protein, 9 aa, Homo Sapiens
NCTRVGTRR

SEQ ID NO: 548630 - protein, 9 aa, Homo Sapiens
AAQREQRAQ

SEQ ID NO: 548631 - protein, 9 aa, Homo Sapiens
GSLAILKDE

SEQ ID NO: 548632 - protein, 9 aa, Homo Sapiens
MAATWRLAT

SEQ ID NO: 548633 - protein, 9 aa, Homo Sapiens
GKPTSREMF

SEQ ID NO: 548634 - protein, 9 aa, Homo Sapiens
DIKILKEMN

SEQ ID NO: 548635 - protein, 9 aa, Homo Sapiens
MNAELQMTL

SEQ ID NO: 548636 - protein, 9 aa, Homo Sapiens
LLSCPYEQA

SEQ ID NO: 548637 - protein, 9 aa, Homo Sapiens
QGRGEGGTR

SEQ ID NO: 548638 - protein, 9 aa, Homo Sapiens
QHQVASPQP

SEQ ID NO: 548639 - protein, 9 aa, Homo Sapiens
AGLAPGRHG

SEQ ID NO: 548640 - protein, 9 aa, Homo Sapiens
VLLAKRKPD

SEQ ID NO: 548641 - protein, 9 aa, Homo Sapiens
FAFSGCHSR

SEQ ID NO: 548642 - protein, 9 aa, Homo Sapiens
VVKRLGGIP

SEQ ID NO: 548643 - protein, 9 aa, Homo Sapiens
LRDVGQQYE

SEQ ID NO: 548644 - protein, 9 aa, Homo Sapiens
GKLSITVKK

SEQ ID NO: 548645 - protein, 9 aa, Homo Sapiens
RILPWTFVQ

SEQ ID NO: 548646 - protein, 9 aa, Homo Sapiens
KDILLSCPY

SEQ ID NO: 548647 - protein, 9 aa, Homo Sapiens
QKLCYLPLN

SEQ ID NO: 548648 - protein, 9 aa, Homo Sapiens
QAINFPFLV

SEQ ID NO: 548649 - protein, 9 aa, Homo Sapiens
KDLMDRERR

SEQ ID NO: 548650 - protein, 9 aa, Homo Sapiens
VGQQYESVA

SEQ ID NO: 548651 - protein, 9 aa, Homo Sapiens
KSFLNPVIY

SEQ ID NO: 548652 - protein, 9 aa, Homo Sapiens
GEISTTCVL

SEQ ID NO: 548653 - protein, 9 aa, Homo Sapiens
LTAALRDVG

SEQ ID NO: 548654 - protein, 9 aa, Homo Sapiens
ALSGLRLNT

SEQ ID NO: 548655 - protein, 9 aa, Homo Sapiens
AAPAGLAPG

SEQ ID NO: 548656 - protein, 9 aa, Homo Sapiens
YREDVLKAG

SEQ ID NO: 548657 - protein, 9 aa, Homo Sapiens
SCPYEQAIS

SEQ ID NO: 548658 - protein, 9 aa, Homo Sapiens
YDQNRDKNS

SEQ ID NO: 548659 - protein, 9 aa, Homo Sapiens
LEPGEPISK

SEQ ID NO: 548660 - protein, 9 aa, Homo Sapiens
SHPAYGHMA

SEQ ID NO: 548661 - protein, 9 aa, Homo Sapiens
LRRVPQEVG

SEQ ID NO: 548662 - protein, 9 aa, Homo Sapiens
TYRNLTSLP

SEQ ID NO: 548663 - protein, 9 aa, Homo Sapiens
SLEEKDLMD

SEQ ID NO: 548664 - protein, 9 aa, Homo Sapiens
ATTSVRCTA

SEQ ID NO: 548665 - protein, 9 aa, Homo Sapiens
HFTLDLLLG

SEQ ID NO: 548666 - protein, 9 aa, Homo Sapiens
AVQHVEIGP

SEQ ID NO: 548667 - protein, 9 aa, Homo Sapiens
LPKILSRIA

SEQ ID NO: 548668 - protein, 9 aa, Homo Sapiens
WGGENLQIS

SEQ ID NO: 548669 - protein, 9 aa, Homo Sapiens
PPLGPMTWY

SEQ ID NO: 548670 - protein, 9 aa, Homo Sapiens
DGEHLVSGW

SEQ ID NO: 548671 - protein, 9 aa, Homo Sapiens
ARGLGRPQG

SEQ ID NO: 548672 - protein, 9 aa, Homo Sapiens
KSAKDQKAA

SEQ ID NO: 548673 - protein, 9 aa, Homo Sapiens
CVLDEADSP

SEQ ID NO: 548674 - protein, 9 aa, Homo Sapiens
AEGTAGAAS

SEQ ID NO: 548675 - protein, 9 aa, Homo Sapiens
SWQPYGSSF

SEQ ID NO: 548676 - protein, 9 aa, Homo Sapiens
VNHLVRARC

SEQ ID NO: 548677 - protein, 9 aa, Homo Sapiens
HPAYGHMAD

SEQ ID NO: 548678 - protein, 9 aa, Homo Sapiens
RLPDALPLQ

SEQ ID NO: 548679 - protein, 9 aa, Homo Sapiens
CPNCTRVGT

SEQ ID NO: 548680 - protein, 9 aa, Homo Sapiens
AASPGAPAA

SEQ ID NO: 548681 - protein, 9 aa, Homo Sapiens
FCYTLFLHC

SEQ ID NO: 548682 - protein, 9 aa, Homo Sapiens
AQDDADDHA

SEQ ID NO: 548683 - protein, 9 aa, Homo Sapiens
RLNTLTIFS

SEQ ID NO: 548684 - protein, 9 aa, Homo Sapiens
LRLNTLTIF

SEQ ID NO: 548685 - protein, 9 aa, Homo Sapiens
LHIDSVSAT

SEQ ID NO: 548686 - protein, 9 aa, Homo Sapiens
VGKSFLNPV

SEQ ID NO: 548687 - protein, 9 aa, Homo Sapiens
LSGHGEPLP

SEQ ID NO: 548688 - protein, 9 aa, Homo Sapiens
EYIRPPLQS

SEQ ID NO: 548689 - protein, 9 aa, Homo Sapiens
KRILQAINF

SEQ ID NO: 548690 - protein, 9 aa, Homo Sapiens
FFLSHPAYG

SEQ ID NO: 548691 - protein, 9 aa, Homo Sapiens
EDNCGDNSD

SEQ ID NO: 548692 - protein, 9 aa, Homo Sapiens
ELTLQIQSN

SEQ ID NO: 548693 - protein, 9 aa, Homo Sapiens
EPISKHTPC

SEQ ID NO: 548694 - protein, 9 aa, Homo Sapiens
TLPAYLQQW

SEQ ID NO: 548695 - protein, 9 aa, Homo Sapiens
LFPLLPPLG

SEQ ID NO: 548696 - protein, 9 aa, Homo Sapiens
WVCDGEDNC

SEQ ID NO: 548697 - protein, 9 aa, Homo Sapiens
TPPWPLFPL

SEQ ID NO: 548698 - protein, 9 aa, Homo Sapiens
VKQSDGEHL

SEQ ID NO: 548699 - protein, 9 aa, Homo Sapiens
PPSPLHPGD

SEQ ID NO: 548700 - protein, 9 aa, Homo Sapiens
RRTPPWPLF

SEQ ID NO: 548701 - protein, 9 aa, Homo Sapiens
TLDLLLGKK

SEQ ID NO: 548702 - protein, 9 aa, Homo Sapiens
KQHQVASPQ

SEQ ID NO: 548703 - protein, 9 aa, Homo Sapiens
YRNLTSLPL

SEQ ID NO: 548704 - protein, 9 aa, Homo Sapiens
QCVVQHIKE

SEQ ID NO: 548705 - protein, 9 aa, Homo Sapiens
LPAYLQQWL

SEQ ID NO: 548706 - protein, 9 aa, Homo Sapiens
RERESLGGA

SEQ ID NO: 548707 - protein, 9 aa, Homo Sapiens
WPLFPLLPP

SEQ ID NO: 548708 - protein, 9 aa, Homo Sapiens
SLHLEVIVD

SEQ ID NO: 548709 - protein, 9 aa, Homo Sapiens
GGIPVLLEK

SEQ ID NO: 548710 - protein, 9 aa, Homo Sapiens
VVQHIKENT

SEQ ID NO: 548711 - protein, 9 aa, Homo Sapiens
QQGEQVCWG

SEQ ID NO: 548712 - protein, 9 aa, Homo Sapiens
IISRVQVGL

SEQ ID NO: 548713 - protein, 9 aa, Homo Sapiens
SFAFSGCHS

SEQ ID NO: 548714 - protein, 9 aa, Homo Sapiens
LGCSHVCSR

SEQ ID NO: 548715 - protein, 9 aa, Homo Sapiens
TVKKRMALL

SEQ ID NO: 548716 - protein, 9 aa, Homo Sapiens
HRPGLLSHL

SEQ ID NO: 548717 - protein, 9 aa, Homo Sapiens
RKPDGKFYA

SEQ ID NO: 548718 - protein, 9 aa, Homo Sapiens
TNASLGLSF

SEQ ID NO: 548719 - protein, 9 aa, Homo Sapiens
YEEYIRPPL

SEQ ID NO: 548720 - protein, 9 aa, Homo Sapiens
AVLFEKQIV

SEQ ID NO: 548721 - protein, 9 aa, Homo Sapiens
KILKEMNAE

SEQ ID NO: 548722 - protein, 9 aa, Homo Sapiens
NSPALHIDS

SEQ ID NO: 548723 - protein, 9 aa, Homo Sapiens
AMVPGTLPT

SEQ ID NO: 548724 - protein, 9 aa, Homo Sapiens
VEIGPSSLI

SEQ ID NO: 548725 - protein, 9 aa, Homo Sapiens
LAPGRHGVL

SEQ ID NO: 548726 - protein, 9 aa, Homo Sapiens
SSLEVAGPR

SEQ ID NO: 548727 - protein, 9 aa, Homo Sapiens
DLTSQVAAG

SEQ ID NO: 548728 - protein, 9 aa, Homo Sapiens
AAAAPAGLA

SEQ ID NO: 548729 - protein, 9 aa, Homo Sapiens
LSDLTSQVA

SEQ ID NO: 548730 - protein, 9 aa, Homo Sapiens
LLAKRKPDG

SEQ ID NO: 548731 - protein, 9 aa, Homo Sapiens
PKILSRIAP

SEQ ID NO: 548732 - protein, 9 aa, Homo Sapiens
YGHMADRMG

SEQ ID NO: 548733 - protein, 9 aa, Homo Sapiens
TIGFCYTLF

SEQ ID NO: 548734 - protein, 9 aa, Homo Sapiens
ASFQLKRYR

SEQ ID NO: 548735 - protein, 9 aa, Homo Sapiens
CLEQPDSWQ

SEQ ID NO: 548736 - protein, 9 aa, Homo Sapiens
TAGAASPGA

SEQ ID NO: 548737 - protein, 9 aa, Homo Sapiens
FIVLLFITE

SEQ ID NO: 548738 - protein, 9 aa, Homo Sapiens
GEMSMSMAA

SEQ ID NO: 548739 - protein, 9 aa, Homo Sapiens
PIGYLHSLN

SEQ ID NO: 548740 - protein, 9 aa, Homo Sapiens
PRRNIVFLN

SEQ ID NO: 548741 - protein, 9 aa, Homo Sapiens
PDSWQPYGS

SEQ ID NO: 548742 - protein, 9 aa, Homo Sapiens
DFELQKLCY

SEQ ID NO: 548743 - protein, 9 aa, Homo Sapiens
VFYTVGKSF

SEQ ID NO: 548744 - protein, 9 aa, Homo Sapiens
PGLLSHLHG

SEQ ID NO: 548745 - protein, 9 aa, Homo Sapiens
VCDGEDNCG

SEQ ID NO: 548746 - protein, 9 aa, Homo Sapiens
LVRARCKEV

SEQ ID NO: 548747 - protein, 9 aa, Homo Sapiens
EKDLMDRER

SEQ ID NO: 548748 - protein, 9 aa, Homo Sapiens
RERERESLG

SEQ ID NO: 548749 - protein, 9 aa, Homo Sapiens
NIVFLNTHK

SEQ ID NO: 548750 - protein, 9 aa, Homo Sapiens
VAAGPSADP

SEQ ID NO: 548751 - protein, 9 aa, Homo Sapiens
KVEDYVKQL

SEQ ID NO: 548752 - protein, 9 aa, Homo Sapiens
QLCQCVVQH

SEQ ID NO: 548753 - protein, 9 aa, Homo Sapiens
ILQLCQCVV

SEQ ID NO: 548754 - protein, 9 aa, Homo Sapiens
KTGQSSEEE

SEQ ID NO: 548755 - protein, 9 aa, Homo Sapiens
PHRPGLLSH

SEQ ID NO: 548756 - protein, 9 aa, Homo Sapiens
HPGDVLALL

SEQ ID NO: 548757 - protein, 9 aa, Homo Sapiens
GVFGAGPGL

SEQ ID NO: 548758 - protein, 9 aa, Homo Sapiens
LAMVPGTLP

SEQ ID NO: 548759 - protein, 9 aa, Homo Sapiens
LLTVLRPIQ

SEQ ID NO: 548760 - protein, 9 aa, Homo Sapiens
EEILAASFA

SEQ ID NO: 548761 - protein, 9 aa, Homo Sapiens
NLTSLPLYQ

SEQ ID NO: 548762 - protein, 9 aa, Homo Sapiens
ILTVDAKTT

SEQ ID NO: 548763 - protein, 9 aa, Homo Sapiens
EVGDAAAAP

SEQ ID NO: 548764 - protein, 9 aa, Homo Sapiens
TLGIPLTPQ

SEQ ID NO: 548765 - protein, 9 aa, Homo Sapiens
MARTIGFCY

SEQ ID NO: 548766 - protein, 9 aa, Homo Sapiens
LCQCVVQHI

SEQ ID NO: 548767 - protein, 9 aa, Homo Sapiens
QGASGCCHQ

SEQ ID NO: 548768 - protein, 9 aa, Homo Sapiens
DPAAVAVAE

SEQ ID NO: 548769 - protein, 9 aa, Homo Sapiens
PGEPISKHT

SEQ ID NO: 548770 - protein, 9 aa, Homo Sapiens
EKIGGVFAA

SEQ ID NO: 548771 - protein, 9 aa, Homo Sapiens
YIRPPLQSW

SEQ ID NO: 548772 - protein, 9 aa, Homo Sapiens
AQREQRAQD

SEQ ID NO: 548773 - protein, 9 aa, Homo Sapiens
VPQEVGDAA

SEQ ID NO: 548774 - protein, 9 aa, Homo Sapiens
GRPQGRGEG

SEQ ID NO: 548775 - protein, 9 aa, Homo Sapiens
QKAKQHQVA

SEQ ID NO: 548776 - protein, 9 aa, Homo Sapiens
GLKDILLSC

SEQ ID NO: 548777 - protein, 9 aa, Homo Sapiens
RHGVLSDLT

SEQ ID NO: 548778 - protein, 9 aa, Homo Sapiens
NSTKPLFTL

SEQ ID NO: 548779 - protein, 9 aa, Homo Sapiens
AEVALSKSA

SEQ ID NO: 548780 - protein, 9 aa, Homo Sapiens
KSAVSRLGR

SEQ ID NO: 548781 - protein, 9 aa, Homo Sapiens
PGRHGVLSD

SEQ ID NO: 548782 - protein, 9 aa, Homo Sapiens
SVRCTARRT

SEQ ID NO: 548783 - protein, 9 aa, Homo Sapiens
TAALRDVGQ

SEQ ID NO: 548784 - protein, 9 aa, Homo Sapiens
FTLDSSISF

SEQ ID NO: 548785 - protein, 9 aa, Homo Sapiens
GLSGHGEPL

SEQ ID NO: 548786 - protein, 9 aa, Homo Sapiens
SQSCCPNCT

SEQ ID NO: 548787 - protein, 9 aa, Homo Sapiens
SDLTSQVAA

SEQ ID NO: 548788 - protein, 9 aa, Homo Sapiens
PERLPDALP

SEQ ID NO: 548789 - protein, 9 aa, Homo Sapiens
DGEDNCGDN

SEQ ID NO: 548790 - protein, 9 aa, Homo Sapiens
AKVWQGASG

SEQ ID NO: 548791 - protein, 9 aa, Homo Sapiens
ISKHTPCIM

SEQ ID NO: 548792 - protein, 9 aa, Homo Sapiens
VAVAEGTAG

SEQ ID NO: 548793 - protein, 9 aa, Homo Sapiens
EKMPTYRNL

SEQ ID NO: 548794 - protein, 9 aa, Homo Sapiens
PLFPLLPPL

SEQ ID NO: 548795 - protein, 9 aa, Homo Sapiens
EPGEPISKH

SEQ ID NO: 548796 - protein, 9 aa, Homo Sapiens
HGLVPTTHQ

SEQ ID NO: 548797 - protein, 9 aa, Homo Sapiens
HVCSRTPVE

SEQ ID NO: 548798 - protein, 9 aa, Homo Sapiens
SGLRLNTLT

SEQ ID NO: 548799 - protein, 9 aa, Homo Sapiens
TAKVWQGAS

SEQ ID NO: 548800 - protein, 9 aa, Homo Sapiens
PLHPGDVLA

SEQ ID NO: 548801 - protein, 9 aa, Homo Sapiens
LPASFQLKR

SEQ ID NO: 548802 - protein, 9 aa, Homo Sapiens
LRAAAEAAL

SEQ ID NO: 548803 - protein, 9 aa, Homo Sapiens
NHLVRARCK

SEQ ID NO: 548804 - protein, 9 aa, Homo Sapiens
QDDADDHAY

SEQ ID NO: 548805 - protein, 9 aa, Homo Sapiens
AGPGLSGHG

SEQ ID NO: 548806 - protein, 9 aa, Homo Sapiens
HQGTLPAYL

SEQ ID NO: 548807 - protein, 9 aa, Homo Sapiens
LMDRERRMA

SEQ ID NO: 548808 - protein, 9 aa, Homo Sapiens
VKRLGGIPV

SEQ ID NO: 548809 - protein, 9 aa, Homo Sapiens
LLPPLGPMT

SEQ ID NO: 548810 - protein, 9 aa, Homo Sapiens
YDLLKLQRP

SEQ ID NO: 548811 - protein, 9 aa, Homo Sapiens
RILQAINFP

SEQ ID NO: 548812 - protein, 9 aa, Homo Sapiens
VAEGTAGAA

SEQ ID NO: 548813 - protein, 9 aa, Homo Sapiens
PNKAILTVD

SEQ ID NO: 548814 - protein, 9 aa, Homo Sapiens
MSMSMAACP

SEQ ID NO: 548815 - protein, 9 aa, Homo Sapiens
LYCKTGQSS

SEQ ID NO: 548816 - protein, 9 aa, Homo Sapiens
QSNTGVRAT

SEQ ID NO: 548817 - protein, 9 aa, Homo Sapiens
ALSKSAKDQ

SEQ ID NO: 548818 - protein, 9 aa, Homo Sapiens
RNIVFLNTH

SEQ ID NO: 548819 - protein, 9 aa, Homo Sapiens
KQQGEQVCW

SEQ ID NO: 548820 - protein, 9 aa, Homo Sapiens
GSSTNTVSA

SEQ ID NO: 548821 - protein, 9 aa, Homo Sapiens
RESLGGAGK

SEQ ID NO: 548822 - protein, 9 aa, Homo Sapiens
YTIRILPWT

SEQ ID NO: 548823 - protein, 9 aa, Homo Sapiens
AVAVAEGTA

SEQ ID NO: 548824 - protein, 9 aa, Homo Sapiens
KIGSSTNTV

SEQ ID NO: 548825 - protein, 9 aa, Homo Sapiens
NLLTVLRPI

SEQ ID NO: 548826 - protein, 9 aa, Homo Sapiens
QPDSWQPYG

SEQ ID NO: 548827 - protein, 9 aa, Homo Sapiens
FNLLTVLRP

SEQ ID NO: 548828 - protein, 9 aa, Homo Sapiens
DFLYDQNRD

SEQ ID NO: 548829 - protein, 9 aa, Homo Sapiens
PDGKFYAVK

SEQ ID NO: 548830 - protein, 9 aa, Homo Sapiens
AAAADEPPD

SEQ ID NO: 548831 - protein, 9 aa, Homo Sapiens
EVALSKSAK

SEQ ID NO: 548832 - protein, 9 aa, Homo Sapiens
ILPWTFVQS

SEQ ID NO: 548833 - protein, 9 aa, Homo Sapiens
CYTLFLHCL

SEQ ID NO: 548834 - protein, 9 aa, Homo Sapiens
VPGTLPTPT

SEQ ID NO: 548835 - protein, 9 aa, Homo Sapiens
EQKAKQHQV

SEQ ID NO: 548836 - protein, 9 aa, Homo Sapiens
ENLQISFRI

SEQ ID NO: 548837 - protein, 9 aa, Homo Sapiens
PTTHQGTLP

SEQ ID NO: 548838 - protein, 9 aa, Homo Sapiens
AGGKLSITV

SEQ ID NO: 548839 - protein, 9 aa, Homo Sapiens
AVFYTVGKS

SEQ ID NO: 548840 - protein, 9 aa, Homo Sapiens
PTSDPASSV

SEQ ID NO: 548841 - protein, 9 aa, Homo Sapiens
SCCPNCTRV

SEQ ID NO: 548842 - protein, 9 aa, Homo Sapiens
EAALSQTGF

SEQ ID NO: 548843 - protein, 9 aa, Homo Sapiens
RDVGQQYES

SEQ ID NO: 548844 - protein, 9 aa, Homo Sapiens
ILKDEETEA

SEQ ID NO: 548845 - protein, 9 aa, Homo Sapiens
SCLEQPDSW

SEQ ID NO: 548846 - protein, 9 aa, Homo Sapiens
TTHQGTLPA

SEQ ID NO: 548847 - protein, 9 aa, Homo Sapiens
INFPFLVKL

SEQ ID NO: 548848 - protein, 9 aa, Homo Sapiens
AEWKSAVSR

SEQ ID NO: 548849 - protein, 9 aa, Homo Sapiens
ALRDVGQQY

SEQ ID NO: 548850 - protein, 9 aa, Homo Sapiens
DYVKQLNRQ

SEQ ID NO: 548851 - protein, 9 aa, Homo Sapiens
GPSADPAAV

SEQ ID NO: 548852 - protein, 9 aa, Homo Sapiens
RREPLELEV

SEQ ID NO: 548853 - protein, 9 aa, Homo Sapiens
RYSAEWKSA

SEQ ID NO: 548854 - protein, 9 aa, Homo Sapiens
RSAECSLHL

SEQ ID NO: 548855 - protein, 9 aa, Homo Sapiens
AKGDCQTRE

SEQ ID NO: 548856 - protein, 9 aa, Homo Sapiens
LATFLATTS

SEQ ID NO: 548857 - protein, 9 aa, Homo Sapiens
PGTLPTPTQ

SEQ ID NO: 548858 - protein, 9 aa, Homo Sapiens
TSQVAAGPS

SEQ ID NO: 548859 - protein, 9 aa, Homo Sapiens
QLLGCSHVC

SEQ ID NO: 548860 - protein, 9 aa, Homo Sapiens
PQGRGEGGT

SEQ ID NO: 548861 - protein, 9 aa, Homo Sapiens
AGAASPGAP

SEQ ID NO: 548862 - protein, 9 aa, Homo Sapiens
ILKEMNAEL

SEQ ID NO: 548863 - protein, 9 aa, Homo Sapiens
GLRLNTLTI

SEQ ID NO: 548864 - protein, 9 aa, Homo Sapiens
LSQTGFSYD

SEQ ID NO: 548865 - protein, 9 aa, Homo Sapiens
YTVGKSFLN

SEQ ID NO: 548866 - protein, 9 aa, Homo Sapiens
KLQRPPGSP

SEQ ID NO: 548867 - protein, 9 aa, Homo Sapiens
LSHLHGLVP

SEQ ID NO: 548868 - protein, 9 aa, Homo Sapiens
VLKAGDVVR

SEQ ID NO: 548869 - protein, 9 aa, Homo Sapiens
EQVCWGGSS

SEQ ID NO: 548870 - protein, 9 aa, Homo Sapiens
LVDWLLAKG

SEQ ID NO: 548871 - protein, 9 aa, Homo Sapiens
EAQVFMPTS

SEQ ID NO: 548872 - protein, 9 aa, Homo Sapiens
CARGLGRPQ

SEQ ID NO: 548873 - protein, 9 aa, Homo Sapiens
SDGEHLVSG

SEQ ID NO: 548874 - protein, 9 aa, Homo Sapiens
VASPIGYLH

SEQ ID NO: 548875 - protein, 9 aa, Homo Sapiens
QSCCPNCTR

SEQ ID NO: 548876 - protein, 9 aa, Homo Sapiens
FGNSTKPLF

SEQ ID NO: 548877 - protein, 9 aa, Homo Sapiens
AILKDEETE

SEQ ID NO: 548878 - protein, 9 aa, Homo Sapiens
LQAINFPFL

SEQ ID NO: 548879 - protein, 9 aa, Homo Sapiens
TTCVLDEAD

SEQ ID NO: 548880 - protein, 9 aa, Homo Sapiens
VWQGASGCC

SEQ ID NO: 548881 - protein, 9 aa, Homo Sapiens
MAAEVALSK

SEQ ID NO: 548882 - protein, 9 aa, Homo Sapiens
RGLKDILLS

SEQ ID NO: 548883 - protein, 9 aa, Homo Sapiens
VKQLNRQRI

SEQ ID NO: 548884 - protein, 9 aa, Homo Sapiens
LLFITEIQS

SEQ ID NO: 548885 - protein, 9 aa, Homo Sapiens
LHLEVIVDR

SEQ ID NO: 548886 - protein, 9 aa, Homo Sapiens
LLGCSHVCS

SEQ ID NO: 548887 - protein, 9 aa, Homo Sapiens
LVPTTHQGT

SEQ ID NO: 548888 - protein, 9 aa, Homo Sapiens
GLSFRRQLL

SEQ ID NO: 548889 - protein, 9 aa, Homo Sapiens
REDVLKAGD

SEQ ID NO: 548890 - protein, 9 aa, Homo Sapiens
KPTSREMFS

SEQ ID NO: 548891 - protein, 9 aa, Homo Sapiens
CSHVCSRTP

SEQ ID NO: 548892 - protein, 9 aa, Homo Sapiens
ITNASLGLS

SEQ ID NO: 548893 - protein, 9 aa, Homo Sapiens
EHLVSGWSE

SEQ ID NO: 548894 - protein, 9 aa, Homo Sapiens
LPTPTQVLF

SEQ ID NO: 548895 - protein, 9 aa, Homo Sapiens
ASPIGYLHS

SEQ ID NO: 548896 - protein, 9 aa, Homo Sapiens
SPGAPAAAA

SEQ ID NO: 548897 - protein, 9 aa, Homo Sapiens
VQHIKENTA

SEQ ID NO: 548898 - protein, 9 aa, Homo Sapiens
NATACESFP

SEQ ID NO: 548899 - protein, 9 aa, Homo Sapiens
DLMDRERRM

SEQ ID NO: 548900 - protein, 9 aa, Homo Sapiens
PAYLQQWLQ

SEQ ID NO: 548901 - protein, 9 aa, Homo Sapiens
LNATACESF

SEQ ID NO: 548902 - protein, 9 aa, Homo Sapiens
AIISRVQVG

SEQ ID NO: 548903 - protein, 9 aa, Homo Sapiens
VEDYVKQLN

SEQ ID NO: 548904 - protein, 9 aa, Homo Sapiens
SFPERLPDA

SEQ ID NO: 548905 - protein, 9 aa, Homo Sapiens
PDAYGQAAQ

SEQ ID NO: 548906 - protein, 9 aa, Homo Sapiens
RPPLQSWRS

SEQ ID NO: 548907 - protein, 9 aa, Homo Sapiens
GGSGFGGGF

SEQ ID NO: 548908 - protein, 9 aa, Homo Sapiens
PLFTLDSSI

SEQ ID NO: 548909 - protein, 9 aa, Homo Sapiens
YIHFTLDLL

SEQ ID NO: 548910 - protein, 9 aa, Homo Sapiens
MEQKAKQHQ

SEQ ID NO: 548911 - protein, 9 aa, Homo Sapiens
AAEVASPIG

SEQ ID NO: 548912 - protein, 9 aa, Homo Sapiens
VRCTARRTP

SEQ ID NO: 548913 - protein, 9 aa, Homo Sapiens
VIPAEKIGG

SEQ ID NO: 548914 - protein, 9 aa, Homo Sapiens
PPWPLFPLL

SEQ ID NO: 548915 - protein, 9 aa, Homo Sapiens
KGDCQTREE

SEQ ID NO: 548916 - protein, 9 aa, Homo Sapiens
GTLPAYLQQ

SEQ ID NO: 548917 - protein, 9 aa, Homo Sapiens
GEPISKHTP

SEQ ID NO: 548918 - protein, 9 aa, Homo Sapiens
MKKVEDYVK

SEQ ID NO: 548919 - protein, 9 aa, Homo Sapiens
LQLCQCVVQ

SEQ ID NO: 548920 - protein, 9 aa, Homo Sapiens
IGSSTNTVS

SEQ ID NO: 548921 - protein, 9 aa, Homo Sapiens
KMARTIGFC

SEQ ID NO: 548922 - protein, 9 aa, Homo Sapiens
RTLPKILSR

SEQ ID NO: 548923 - protein, 9 aa, Homo Sapiens
TSVRCTARR

SEQ ID NO: 548924 - protein, 9 aa, Homo Sapiens
PLLPPLGPM

SEQ ID NO: 548925 - protein, 9 aa, Homo Sapiens
VFLNTHKTA

SEQ ID NO: 548926 - protein, 9 aa, Homo Sapiens
SITVKKRMA

SEQ ID NO: 548927 - protein, 9 aa, Homo Sapiens
YKEKRFNLL

SEQ ID NO: 548928 - protein, 9 aa, Homo Sapiens
YTGEISTTC

SEQ ID NO: 548929 - protein, 9 aa, Homo Sapiens
KPDGKFYAV

SEQ ID NO: 548930 - protein, 9 aa, Homo Sapiens
AAAPAGLAP

SEQ ID NO: 548931 - protein, 9 aa, Homo Sapiens
LPDALPLQH

SEQ ID NO: 548932 - protein, 9 aa, Homo Sapiens
VFMPTSDPA

SEQ ID NO: 548933 - protein, 9 aa, Homo Sapiens
AINFPFLVK

SEQ ID NO: 548934 - protein, 9 aa, Homo Sapiens
KVWQGASGC

SEQ ID NO: 548935 - protein, 9 aa, Homo Sapiens
VQAVQHVEI

SEQ ID NO: 548936 - protein, 9 aa, Homo Sapiens
SRIAPAFCM

SEQ ID NO: 548937 - protein, 9 aa, Homo Sapiens
CQCVVQHIK

SEQ ID NO: 548938 - protein, 9 aa, Homo Sapiens
ATWRLATFL

SEQ ID NO: 548939 - protein, 9 aa, Homo Sapiens
TGEISTTCV

SEQ ID NO: 548940 - protein, 9 aa, Homo Sapiens
LLAKGDCQT

SEQ ID NO: 548941 - protein, 9 aa, Homo Sapiens
DEPPDAYGQ

SEQ ID NO: 548942 - protein, 9 aa, Homo Sapiens
DILLSCPYE

SEQ ID NO: 548943 - protein, 9 aa, Homo Sapiens
LVQAVQHVE

SEQ ID NO: 548944 - protein, 9 aa, Homo Sapiens
AVKQSDGEH

SEQ ID NO: 548945 - protein, 9 aa, Homo Sapiens
LNTHKTASS

SEQ ID NO: 548946 - protein, 9 aa, Homo Sapiens
NTGVRATLK

SEQ ID NO: 548947 - protein, 9 aa, Homo Sapiens
IAVFYTVGK

SEQ ID NO: 548948 - protein, 9 aa, Homo Sapiens
KGVFGAGPG

SEQ ID NO: 548949 - protein, 9 aa, Homo Sapiens
LGVSLVFEY

SEQ ID NO: 548950 - protein, 9 aa, Homo Sapiens
LFNINGVTP

SEQ ID NO: 548951 - protein, 9 aa, Homo Sapiens
EIRGRAYAF

SEQ ID NO: 548952 - protein, 9 aa, Homo Sapiens
YRIPNEAMN

SEQ ID NO: 548953 - protein, 9 aa, Homo Sapiens
PVRCPLYME

SEQ ID NO: 548954 - protein, 9 aa, Homo Sapiens
REALATVLF

SEQ ID NO: 548955 - protein, 9 aa, Homo Sapiens
FYDPKSLDI

SEQ ID NO: 548956 - protein, 9 aa, Homo Sapiens
DRIALQPSV

SEQ ID NO: 548957 - protein, 9 aa, Homo Sapiens
VTPLLVTDA

SEQ ID NO: 548958 - protein, 9 aa, Homo Sapiens
YDTAKGMLR

SEQ ID NO: 548959 - protein, 9 aa, Homo Sapiens
HFSYLEPGS

SEQ ID NO: 548960 - protein, 9 aa, Homo Sapiens
KPKKTSGSH

SEQ ID NO: 548961 - protein, 9 aa, Homo Sapiens
KLFSELEFG

SEQ ID NO: 548962 - protein, 9 aa, Homo Sapiens
YMEIFLQNS

SEQ ID NO: 548963 - protein, 9 aa, Homo Sapiens
SASDTIWLV

SEQ ID NO: 548964 - protein, 9 aa, Homo Sapiens
SGMMLLVAM

SEQ ID NO: 548965 - protein, 9 aa, Homo Sapiens
EALATVLFG

SEQ ID NO: 548966 - protein, 9 aa, Homo Sapiens
MHGSCIFLM

SEQ ID NO: 548967 - protein, 9 aa, Homo Sapiens
SGSHKPTRK

SEQ ID NO: 548968 - protein, 9 aa, Homo Sapiens
GLASASDTI

SEQ ID NO: 548969 - protein, 9 aa, Homo Sapiens
TSQPPSPQL

SEQ ID NO: 548970 - protein, 9 aa, Homo Sapiens
GEFLKIIHI

SEQ ID NO: 548971 - protein, 9 aa, Homo Sapiens
PHSNNNNEL

SEQ ID NO: 548972 - protein, 9 aa, Homo Sapiens
ALQPSVSLL

SEQ ID NO: 548973 - protein, 9 aa, Homo Sapiens
QCTFFFLHK

SEQ ID NO: 548974 - protein, 9 aa, Homo Sapiens
EPPLLSSHK

SEQ ID NO: 548975 - protein, 9 aa, Homo Sapiens
STRERSPLN

SEQ ID NO: 548976 - protein, 9 aa, Homo Sapiens
VGKFSVQNL

SEQ ID NO: 548977 - protein, 9 aa, Homo Sapiens
DRLQLHCAA

SEQ ID NO: 548978 - protein, 9 aa, Homo Sapiens
MQGEFLKII

SEQ ID NO: 548979 - protein, 9 aa, Homo Sapiens
PAREALATV

SEQ ID NO: 548980 - protein, 9 aa, Homo Sapiens
GSCIFLMLL

SEQ ID NO: 548981 - protein, 9 aa, Homo Sapiens
IIHIVMDET

SEQ ID NO: 548982 - protein, 9 aa, Homo Sapiens
PLIGFGATH

SEQ ID NO: 548983 - protein, 9 aa, Homo Sapiens
HSEEERTTE

SEQ ID NO: 548984 - protein, 9 aa, Homo Sapiens
FPQCTFFFL

SEQ ID NO: 548985 - protein, 9 aa, Homo Sapiens
FVGSGMMLL

SEQ ID NO: 548986 - protein, 9 aa, Homo Sapiens
IFLMLLLPL

SEQ ID NO: 548987 - protein, 9 aa, Homo Sapiens
RTKSTSDNK

SEQ ID NO: 548988 - protein, 9 aa, Homo Sapiens
SCIFLMLLL

SEQ ID NO: 548989 - protein, 9 aa, Homo Sapiens
SKPKKTSGS

SEQ ID NO: 548990 - protein, 9 aa, Homo Sapiens
IAPPLIGFG

SEQ ID NO: 548991 - protein, 9 aa, Homo Sapiens
PLLSSHKPR

SEQ ID NO: 548992 - protein, 9 aa, Homo Sapiens
NCDEKTCGP

SEQ ID NO: 548993 - protein, 9 aa, Homo Sapiens
AGTASGGEA

SEQ ID NO: 548994 - protein, 9 aa, Homo Sapiens
RIALQPSVS

SEQ ID NO: 548995 - protein, 9 aa, Homo Sapiens
LALLDKFLI

SEQ ID NO: 548996 - protein, 9 aa, Homo Sapiens
LATVLFGGQ

SEQ ID NO: 548997 - protein, 9 aa, Homo Sapiens
RDPKNVHIF

SEQ ID NO: 548998 - protein, 9 aa, Homo Sapiens
PPSPQLFSP

SEQ ID NO: 548999 - protein, 9 aa, Homo Sapiens
IPNEAMNKE

SEQ ID NO: 549000 - protein, 9 aa, Homo Sapiens
NNNELSAAA

SEQ ID NO: 549001 - protein, 9 aa, Homo Sapiens
TAFYDPKSL

SEQ ID NO: 549002 - protein, 9 aa, Homo Sapiens
KNEPWYKLF

SEQ ID NO: 549003 - protein, 9 aa, Homo Sapiens
ISAKATPPS

SEQ ID NO: 549004 - protein, 9 aa, Homo Sapiens
NALCVGKFS

SEQ ID NO: 549005 - protein, 9 aa, Homo Sapiens
ATPPSSANP

SEQ ID NO: 549006 - protein, 9 aa, Homo Sapiens
GSGMMLLVA

SEQ ID NO: 549007 - protein, 9 aa, Homo Sapiens
TPPSSANPT

SEQ ID NO: 549008 - protein, 9 aa, Homo Sapiens
MTVRNNLAG

SEQ ID NO: 549009 - protein, 9 aa, Homo Sapiens
SQRCRLTRL

SEQ ID NO: 549010 - protein, 9 aa, Homo Sapiens
LRMTVRNNL

SEQ ID NO: 549011 - protein, 9 aa, Homo Sapiens
QEKVNFEPY

SEQ ID NO: 549012 - protein, 9 aa, Homo Sapiens
SQEKVNFEP

SEQ ID NO: 549013 - protein, 9 aa, Homo Sapiens
DTAKGMLRD

SEQ ID NO: 549014 - protein, 9 aa, Homo Sapiens
DQFQLGVSL

SEQ ID NO: 549015 - protein, 9 aa, Homo Sapiens
ASDEANCDE

SEQ ID NO: 549016 - protein, 9 aa, Homo Sapiens
DVLALLDKF

SEQ ID NO: 549017 - protein, 9 aa, Homo Sapiens
FFLHKEFLL

SEQ ID NO: 549018 - protein, 9 aa, Homo Sapiens
QLFSPGSSN

SEQ ID NO: 549019 - protein, 9 aa, Homo Sapiens
ADRLQLHCA

SEQ ID NO: 549020 - protein, 9 aa, Homo Sapiens
AEENYEGSE

SEQ ID NO: 549021 - protein, 9 aa, Homo Sapiens
PISAKATPP

SEQ ID NO: 549022 - protein, 9 aa, Homo Sapiens
VLCGAIGCI

SEQ ID NO: 549023 - protein, 9 aa, Homo Sapiens
SLAHFSYLE

SEQ ID NO: 549024 - protein, 9 aa, Homo Sapiens
ASASDTIWL

SEQ ID NO: 549025 - protein, 9 aa, Homo Sapiens
HSFVGSGMM

SEQ ID NO: 549026 - protein, 9 aa, Homo Sapiens
LFSELEFGK

SEQ ID NO: 549027 - protein, 9 aa, Homo Sapiens
NLKATAVMP

SEQ ID NO: 549028 - protein, 9 aa, Homo Sapiens
SFVGSGMML

SEQ ID NO: 549029 - protein, 9 aa, Homo Sapiens
FLKIIHIVM

SEQ ID NO: 549030 - protein, 9 aa, Homo Sapiens
EVGPLEHEI

SEQ ID NO: 549031 - protein, 9 aa, Homo Sapiens
LVFEYIRSE

SEQ ID NO: 549032 - protein, 9 aa, Homo Sapiens
PDLALRMTV

SEQ ID NO: 549033 - protein, 9 aa, Homo Sapiens
TSDNKTSRK

SEQ ID NO: 549034 - protein, 9 aa, Homo Sapiens
TVLFGGQPQ

SEQ ID NO: 549035 - protein, 9 aa, Homo Sapiens
LFSPGSSNS

SEQ ID NO: 549036 - protein, 9 aa, Homo Sapiens
DPKSLDIVC

SEQ ID NO: 549037 - protein, 9 aa, Homo Sapiens
IRGRAYAFC

SEQ ID NO: 549038 - protein, 9 aa, Homo Sapiens
PQCTFFFLH

SEQ ID NO: 549039 - protein, 9 aa, Homo Sapiens
ERSPLNALC

SEQ ID NO: 549040 - protein, 9 aa, Homo Sapiens
LKYIPICPF

SEQ ID NO: 549041 - protein, 9 aa, Homo Sapiens
MEIFLQNSP

SEQ ID NO: 549042 - protein, 9 aa, Homo Sapiens
FPVRCPLYM

SEQ ID NO: 549043 - protein, 9 aa, Homo Sapiens
VLALLDKFL

SEQ ID NO: 549044 - protein, 9 aa, Homo Sapiens
PQLFSPGSS

SEQ ID NO: 549045 - protein, 9 aa, Homo Sapiens
NINGVTPNR

SEQ ID NO: 549046 - protein, 9 aa, Homo Sapiens
EKLSQEKVN

SEQ ID NO: 549047 - protein, 9 aa, Homo Sapiens
TKSTSDNKT

SEQ ID NO: 549048 - protein, 9 aa, Homo Sapiens
QFQLGVSLV

SEQ ID NO: 549049 - protein, 9 aa, Homo Sapiens
RMTVRNNLA

SEQ ID NO: 549050 - protein, 9 aa, Homo Sapiens
QGEFLKIIH

SEQ ID NO: 549051 - protein, 9 aa, Homo Sapiens
FQLGVSLVF

SEQ ID NO: 549052 - protein, 9 aa, Homo Sapiens
VLHSFVGSG

SEQ ID NO: 549053 - protein, 9 aa, Homo Sapiens
SNNNNELSA

SEQ ID NO: 549054 - protein, 9 aa, Homo Sapiens
IALQPSVSL

SEQ ID NO: 549055 - protein, 9 aa, Homo Sapiens
VCNDVLALL

SEQ ID NO: 549056 - protein, 9 aa, Homo Sapiens
LKNEPWYKL

SEQ ID NO: 549057 - protein, 9 aa, Homo Sapiens
FTADRLQLH

SEQ ID NO: 549058 - protein, 9 aa, Homo Sapiens
RTGQRAEEN

SEQ ID NO: 549059 - protein, 9 aa, Homo Sapiens
TIWLVVAFS

SEQ ID NO: 549060 - protein, 9 aa, Homo Sapiens
EMRSLAHFS

SEQ ID NO: 549061 - protein, 9 aa, Homo Sapiens
PNEAMNKED

SEQ ID NO: 549062 - protein, 9 aa, Homo Sapiens
HTLEGPRFP

SEQ ID NO: 549063 - protein, 9 aa, Homo Sapiens
GPRFPASQC

SEQ ID NO: 549064 - protein, 9 aa, Homo Sapiens
GKFSVQNLL

SEQ ID NO: 549065 - protein, 9 aa, Homo Sapiens
EEPPLLSSH

SEQ ID NO: 549066 - protein, 9 aa, Homo Sapiens
QRAEENYEG

SEQ ID NO: 549067 - protein, 9 aa, Homo Sapiens
GHPAPNLKA

SEQ ID NO: 549068 - protein, 9 aa, Homo Sapiens
TVRNNLAGA

SEQ ID NO: 549069 - protein, 9 aa, Homo Sapiens
ETVCNDVLA

SEQ ID NO: 549070 - protein, 9 aa, Homo Sapiens
YIPICPFFK

SEQ ID NO: 549071 - protein, 9 aa, Homo Sapiens
LADVLCGAI

SEQ ID NO: 549072 - protein, 9 aa, Homo Sapiens
APPLIGFGA

SEQ ID NO: 549073 - protein, 9 aa, Homo Sapiens
GEYRIPNEA

SEQ ID NO: 549074 - protein, 9 aa, Homo Sapiens
AREALATVL

SEQ ID NO: 549075 - protein, 9 aa, Homo Sapiens
RCRLTRLSV

SEQ ID NO: 549076 - protein, 9 aa, Homo Sapiens
MRSLAHFSY

SEQ ID NO: 549077 - protein, 9 aa, Homo Sapiens
PLYMEIFLQ

SEQ ID NO: 549078 - protein, 9 aa, Homo Sapiens
RLQLHCAAF

SEQ ID NO: 549079 - protein, 9 aa, Homo Sapiens
KIIHIVMDE

SEQ ID NO: 549080 - protein, 9 aa, Homo Sapiens
MLADVLCGA

SEQ ID NO: 549081 - protein, 9 aa, Homo Sapiens
LEMRSLAHF

SEQ ID NO: 549082 - protein, 9 aa, Homo Sapiens
PKKTSGSHK

SEQ ID NO: 549083 - protein, 9 aa, Homo Sapiens
AKDHSEEER

SEQ ID NO: 549084 - protein, 9 aa, Homo Sapiens
PWYKLFSEL

SEQ ID NO: 549085 - protein, 9 aa, Homo Sapiens
SVQNLLLFN

SEQ ID NO: 549086 - protein, 9 aa, Homo Sapiens
LEHEIKRLS

SEQ ID NO: 549087 - protein, 9 aa, Homo Sapiens
HVTPLLVTD

SEQ ID NO: 549088 - protein, 9 aa, Homo Sapiens
LPHSNNNNE

SEQ ID NO: 549089 - protein, 9 aa, Homo Sapiens
DIAPPLIGF

SEQ ID NO: 549090 - protein, 9 aa, Homo Sapiens
MLRDPKNVH

SEQ ID NO: 549091 - protein, 9 aa, Homo Sapiens
NPDLALRMT

SEQ ID NO: 549092 - protein, 9 aa, Homo Sapiens
YAFCNSFNW

SEQ ID NO: 549093 - protein, 9 aa, Homo Sapiens
LLFNINGVT

SEQ ID NO: 549094 - protein, 9 aa, Homo Sapiens
SDNKTSRKN

SEQ ID NO: 549095 - protein, 9 aa, Homo Sapiens
LTRLSVSTR

SEQ ID NO: 549096 - protein, 9 aa, Homo Sapiens
EKVNFEPYG

SEQ ID NO: 549097 - protein, 9 aa, Homo Sapiens
VRCPLYMEI

SEQ ID NO: 549098 - protein, 9 aa, Homo Sapiens
SPLNALCVG

SEQ ID NO: 549099 - protein, 9 aa, Homo Sapiens
AHFSYLEPG

SEQ ID NO: 549100 - protein, 9 aa, Homo Sapiens
QRCRLTRLS

SEQ ID NO: 549101 - protein, 9 aa, Homo Sapiens
RADAMAKDH

SEQ ID NO: 549102 - protein, 9 aa, Homo Sapiens
YGEYRIPNE

SEQ ID NO: 549103 - protein, 9 aa, Homo Sapiens
LKATAVMPD

SEQ ID NO: 549104 - protein, 9 aa, Homo Sapiens
RERSPLNAL

SEQ ID NO: 549105 - protein, 9 aa, Homo Sapiens
KKTSGSHKP

SEQ ID NO: 549106 - protein, 9 aa, Homo Sapiens
KATPPSSAN

SEQ ID NO: 549107 - protein, 9 aa, Homo Sapiens
KSTSDNKTS

SEQ ID NO: 549108 - protein, 9 aa, Homo Sapiens
RSLAHFSYL

SEQ ID NO: 549109 - protein, 9 aa, Homo Sapiens
PKSLDIVCK

SEQ ID NO: 549110 - protein, 9 aa, Homo Sapiens
NNNNELSAA

SEQ ID NO: 549111 - protein, 9 aa, Homo Sapiens
DLALRMTVR

SEQ ID NO: 549112 - protein, 9 aa, Homo Sapiens
SLVFEYIRS

SEQ ID NO: 549113 - protein, 9 aa, Homo Sapiens
WYKLFSELE

SEQ ID NO: 549114 - protein, 9 aa, Homo Sapiens
SDEANCDEK

SEQ ID NO: 549115 - protein, 9 aa, Homo Sapiens
SSKPKKTSG

SEQ ID NO: 549116 - protein, 9 aa, Homo Sapiens
NLLLFNING

SEQ ID NO: 549117 - protein, 9 aa, Homo Sapiens
KGMLRDPKN

SEQ ID NO: 549118 - protein, 9 aa, Homo Sapiens
CPLYMEIFL

SEQ ID NO: 549119 - protein, 9 aa, Homo Sapiens
FTFTADRLQ

SEQ ID NO: 549120 - protein, 9 aa, Homo Sapiens
TRERSPLNA

SEQ ID NO: 549121 - protein, 9 aa, Homo Sapiens
STSDNKTSR

SEQ ID NO: 549122 - protein, 9 aa, Homo Sapiens
STGHVTPLL

SEQ ID NO: 549123 - protein, 9 aa, Homo Sapiens
MAKDHSEEE

SEQ ID NO: 549124 - protein, 9 aa, Homo Sapiens
EPWYKLFSE

SEQ ID NO: 549125 - protein, 9 aa, Homo Sapiens
AMLADVLCG

SEQ ID NO: 549126 - protein, 9 aa, Homo Sapiens
TRLSVSTRE

SEQ ID NO: 549127 - protein, 9 aa, Homo Sapiens
RIPNEAMNK

SEQ ID NO: 549128 - protein, 9 aa, Homo Sapiens
LCVGKFSVQ

SEQ ID NO: 549129 - protein, 9 aa, Homo Sapiens
QNLLLFNIN

SEQ ID NO: 549130 - protein, 9 aa, Homo Sapiens
NLPHSNNNN

SEQ ID NO: 549131 - protein, 9 aa, Homo Sapiens
IHIVMDETE

SEQ ID NO: 549132 - protein, 9 aa, Homo Sapiens
SNLPHSNNN

SEQ ID NO: 549133 - protein, 9 aa, Homo Sapiens
RSPLNALCV

SEQ ID NO: 549134 - protein, 9 aa, Homo Sapiens
IGHPAPNLK

SEQ ID NO: 549135 - protein, 9 aa, Homo Sapiens
GHVTPLLVT

SEQ ID NO: 549136 - protein, 9 aa, Homo Sapiens
TEEPPLLSS

SEQ ID NO: 549137 - protein, 9 aa, Homo Sapiens
RCPLYMEIF

SEQ ID NO: 549138 - protein, 9 aa, Homo Sapiens
KDHSEEERT

SEQ ID NO: 549139 - protein, 9 aa, Homo Sapiens
TVCNDVLAL

SEQ ID NO: 549140 - protein, 9 aa, Homo Sapiens
GQRAEENYE

SEQ ID NO: 549141 - protein, 9 aa, Homo Sapiens
KTSRKNEEV

SEQ ID NO: 549142 - protein, 9 aa, Homo Sapiens
TLEGPRFPA

SEQ ID NO: 549143 - protein, 9 aa, Homo Sapiens
ATVLFGGQP

SEQ ID NO: 549144 - protein, 9 aa, Homo Sapiens
ICPFFKGFS

SEQ ID NO: 549145 - protein, 9 aa, Homo Sapiens
LNALCVGKF

SEQ ID NO: 549146 - protein, 9 aa, Homo Sapiens
TGHVTPLLV

SEQ ID NO: 549147 - protein, 9 aa, Homo Sapiens
HEIKRLSKL

SEQ ID NO: 549148 - protein, 9 aa, Homo Sapiens
EENYEGSEE

SEQ ID NO: 549149 - protein, 9 aa, Homo Sapiens
GSHKPTRKA

SEQ ID NO: 549150 - protein, 9 aa, Homo Sapiens
PFFKGFSSS

SEQ ID NO: 549151 - protein, 9 aa, Homo Sapiens
LLSSHKPRG

SEQ ID NO: 549152 - protein, 9 aa, Homo Sapiens
CIFLMLLLP

SEQ ID NO: 549153 - protein, 9 aa, Homo Sapiens
QPISAKATP

SEQ ID NO: 549154 - protein, 9 aa, Homo Sapiens
LYMEIFLQN

SEQ ID NO: 549155 - protein, 9 aa, Homo Sapiens
PRFPASQCI

SEQ ID NO: 549156 - protein, 9 aa, Homo Sapiens
EGPRFPASQ

SEQ ID NO: 549157 - protein, 9 aa, Homo Sapiens
KVNFEPYGL

SEQ ID NO: 549158 - protein, 9 aa, Homo Sapiens
TAKGMLRDP

SEQ ID NO: 549159 - protein, 9 aa, Homo Sapiens
NKTSRKNEE

SEQ ID NO: 549160 - protein, 9 aa, Homo Sapiens
CVGKFSVQN

SEQ ID NO: 549161 - protein, 9 aa, Homo Sapiens
RLSVSTRER

SEQ ID NO: 549162 - protein, 9 aa, Homo Sapiens
ALLDKFLIK

SEQ ID NO: 549163 - protein, 9 aa, Homo Sapiens
VSLVFEYIR

SEQ ID NO: 549164 - protein, 9 aa, Homo Sapiens
ALRMTVRNN

SEQ ID NO: 549165 - protein, 9 aa, Homo Sapiens
HSNNNNELS

SEQ ID NO: 549166 - protein, 9 aa, Homo Sapiens
FSVQNLLLF

SEQ ID NO: 549167 - protein, 9 aa, Homo Sapiens
PLNALCVGK

SEQ ID NO: 549168 - protein, 9 aa, Homo Sapiens
IGFGATHSL

SEQ ID NO: 549169 - protein, 9 aa, Homo Sapiens
PLEHEIKRL

SEQ ID NO: 549170 - protein, 9 aa, Homo Sapiens
PQRTGQRAE

SEQ ID NO: 549171 - protein, 9 aa, Homo Sapiens
EFLKIIHIV

SEQ ID NO: 549172 - protein, 9 aa, Homo Sapiens
TGQRAEENY

SEQ ID NO: 549173 - protein, 9 aa, Homo Sapiens
AKGMLRDPK

SEQ ID NO: 549174 - protein, 9 aa, Homo Sapiens
GEEVGPLEH

SEQ ID NO: 549175 - protein, 9 aa, Homo Sapiens
LALRMTVRN

SEQ ID NO: 549176 - protein, 9 aa, Homo Sapiens
SYPAMLADV

SEQ ID NO: 549177 - protein, 9 aa, Homo Sapiens
LKIIHIVMD

SEQ ID NO: 549178 - protein, 9 aa, Homo Sapiens
EANCDEKTC

SEQ ID NO: 549179 - protein, 9 aa, Homo Sapiens
LIGFGATHS

SEQ ID NO: 549180 - protein, 9 aa, Homo Sapiens
IPICPFFKG

SEQ ID NO: 549181 - protein, 9 aa, Homo Sapiens
LQLHCAAFF

SEQ ID NO: 549182 - protein, 9 aa, Homo Sapiens
DNKTSRKNE

SEQ ID NO: 549183 - protein, 9 aa, Homo Sapiens
PICPFFKGF

SEQ ID NO: 549184 - protein, 9 aa, Homo Sapiens
EKTCGPHEF

SEQ ID NO: 549185 - protein, 9 aa, Homo Sapiens
YPAMLADVL

SEQ ID NO: 549186 - protein, 9 aa, Homo Sapiens
KDIAPPLIG

SEQ ID NO: 549187 - protein, 9 aa, Homo Sapiens
TTAFYDPKS

SEQ ID NO: 549188 - protein, 9 aa, Homo Sapiens
DEKTCGPHE

SEQ ID NO: 549189 - protein, 9 aa, Homo Sapiens
ADAMAKDHS

SEQ ID NO: 549190 - protein, 9 aa, Homo Sapiens
PAMLADVLC

SEQ ID NO: 549191 - protein, 9 aa, Homo Sapiens
ANCDEKTCG

SEQ ID NO: 549192 - protein, 9 aa, Homo Sapiens
GMLRDPKNV

SEQ ID NO: 549193 - protein, 9 aa, Homo Sapiens
PPLIGFGAT

SEQ ID NO: 549194 - protein, 9 aa, Homo Sapiens
SQPPSPQLF

SEQ ID NO: 549195 - protein, 9 aa, Homo Sapiens
LAHFSYLEP

SEQ ID NO: 549196 - protein, 9 aa, Homo Sapiens
PSPQLFSPG

SEQ ID NO: 549197 - protein, 9 aa, Homo Sapiens
LEGPRFPAS

SEQ ID NO: 549198 - protein, 9 aa, Homo Sapiens
LRDPKNVHI

SEQ ID NO: 549199 - protein, 9 aa, Homo Sapiens
VEIRGRAYA

SEQ ID NO: 549200 - protein, 9 aa, Homo Sapiens
FFFLHKEFL

SEQ ID NO: 549201 - protein, 9 aa, Homo Sapiens
SDTIWLVVA

SEQ ID NO: 549202 - protein, 9 aa, Homo Sapiens
CPFFKGFSS

SEQ ID NO: 549203 - protein, 9 aa, Homo Sapiens
ASDTIWLVV

SEQ ID NO: 549204 - protein, 9 aa, Homo Sapiens
DSTEEPPLL

SEQ ID NO: 549205 - protein, 9 aa, Homo Sapiens
EHEIKRLSK

SEQ ID NO: 549206 - protein, 9 aa, Homo Sapiens
EEVGPLEHE

SEQ ID NO: 549207 - protein, 9 aa, Homo Sapiens
SAKATPPSS

SEQ ID NO: 549208 - protein, 9 aa, Homo Sapiens
RFPASQCIY

SEQ ID NO: 549209 - protein, 9 aa, Homo Sapiens
GVSLVFEYI

SEQ ID NO: 549210 - protein, 9 aa, Homo Sapiens
EAMNKEDHY

SEQ ID NO: 549211 - protein, 9 aa, Homo Sapiens
RAEENYEGS

SEQ ID NO: 549212 - protein, 9 aa, Homo Sapiens
LSVSTRERS

SEQ ID NO: 549213 - protein, 9 aa, Homo Sapiens
VTTAFYDPK

SEQ ID NO: 549214 - protein, 9 aa, Homo Sapiens
VNFEPYGLS

SEQ ID NO: 549215 - protein, 9 aa, Homo Sapiens
DHSEEERTT

SEQ ID NO: 549216 - protein, 9 aa, Homo Sapiens
CTFFFLHKE

SEQ ID NO: 549217 - protein, 9 aa, Homo Sapiens
PVEIRGRAY

SEQ ID NO: 549218 - protein, 9 aa, Homo Sapiens
KIGHPAPNL

SEQ ID NO: 549219 - protein, 9 aa, Homo Sapiens
CRLTRLSVS

SEQ ID NO: 549220 - protein, 9 aa, Homo Sapiens
PNLKATAVM

SEQ ID NO: 549221 - protein, 9 aa, Homo Sapiens
VGPLEHEIK

SEQ ID NO: 549222 - protein, 9 aa, Homo Sapiens
KLSQEKVNF

SEQ ID NO: 549223 - protein, 9 aa, Homo Sapiens
QFTFTADRL

SEQ ID NO: 549224 - protein, 9 aa, Homo Sapiens
RLTRLSVST

SEQ ID NO: 549225 - protein, 9 aa, Homo Sapiens
FPASQCIYA

SEQ ID NO: 549226 - protein, 9 aa, Homo Sapiens
SVSTRERSP

SEQ ID NO: 549227 - protein, 9 aa, Homo Sapiens
SPQLFSPGS

SEQ ID NO: 549228 - protein, 9 aa, Homo Sapiens
FNINGVTPN

SEQ ID NO: 549229 - protein, 9 aa, Homo Sapiens
HGSCIFLML

SEQ ID NO: 549230 - protein, 9 aa, Homo Sapiens
GPLEHEIKR

SEQ ID NO: 549231 - protein, 9 aa, Homo Sapiens
HPAPNLKAT

SEQ ID NO: 549232 - protein, 9 aa, Homo Sapiens
INGVTPNRE

SEQ ID NO: 549233 - protein, 9 aa, Homo Sapiens
DTIWLVVAF

SEQ ID NO: 549234 - protein, 9 aa, Homo Sapiens
LSQEKVNFE

SEQ ID NO: 549235 - protein, 9 aa, Homo Sapiens
GRAYAFCNS

SEQ ID NO: 549236 - protein, 9 aa, Homo Sapiens
KTSGSHKPT

SEQ ID NO: 549237 - protein, 9 aa, Homo Sapiens
TSGSHKPTR

SEQ ID NO: 549238 - protein, 9 aa, Homo Sapiens
IWLVVAFSN

SEQ ID NO: 549239 - protein, 9 aa, Homo Sapiens
STEEPPLLS

SEQ ID NO: 549240 - protein, 9 aa, Homo Sapiens
AYAFCNSFN

SEQ ID NO: 549241 - protein, 9 aa, Homo Sapiens
KSLDIVCKP

SEQ ID NO: 549242 - protein, 9 aa, Homo Sapiens
PPAREALAT

SEQ ID NO: 549243 - protein, 9 aa, Homo Sapiens
TFTADRLQL

SEQ ID NO: 549244 - protein, 9 aa, Homo Sapiens
GTASGGEAG

SEQ ID NO: 549245 - protein, 9 aa, Homo Sapiens
DAMAKDHSE

SEQ ID NO: 549246 - protein, 9 aa, Homo Sapiens
FFKGFSSSS

SEQ ID NO: 549247 - protein, 9 aa, Homo Sapiens
EYRIPNEAM

SEQ ID NO: 549248 - protein, 9 aa, Homo Sapiens
CDEKTCGPH

SEQ ID NO: 549249 - protein, 9 aa, Homo Sapiens
TFFFLHKEF

SEQ ID NO: 549250 - protein, 9 aa, Homo Sapiens
APNLKATAV

SEQ ID NO: 549251 - protein, 9 aa, Homo Sapiens
KYIPICPFF

SEQ ID NO: 549252 - protein, 9 aa, Homo Sapiens
ALCVGKFSV

SEQ ID NO: 549253 - protein, 9 aa, Homo Sapiens
YKLFSELEF

SEQ ID NO: 549254 - protein, 9 aa, Homo Sapiens
LASASDTIW

SEQ ID NO: 549255 - protein, 9 aa, Homo Sapiens
VSTRERSPL

SEQ ID NO: 549256 - protein, 9 aa, Homo Sapiens
NEAMNKEDH

SEQ ID NO: 549257 - protein, 9 aa, Homo Sapiens
TADRLQLHC

SEQ ID NO: 549258 - protein, 9 aa, Homo Sapiens
LLLFNINGV

SEQ ID NO: 549259 - protein, 9 aa, Homo Sapiens
HLEMRSLAH

SEQ ID NO: 549260 - protein, 9 aa, Homo Sapiens
PAPNLKATA

SEQ ID NO: 549261 - protein, 9 aa, Homo Sapiens
DVLCGAIGC

SEQ ID NO: 549262 - protein, 9 aa, Homo Sapiens
VGSGMMLLV

SEQ ID NO: 549263 - protein, 9 aa, Homo Sapiens
LSSHKPRGD

SEQ ID NO: 549264 - protein, 9 aa, Homo Sapiens
PPSSANPTQ

SEQ ID NO: 549265 - protein, 9 aa, Homo Sapiens
ALATVLFGG

SEQ ID NO: 549266 - protein, 9 aa, Homo Sapiens
RGRAYAFCN

SEQ ID NO: 549267 - protein, 9 aa, Homo Sapiens
PASQCIYAH

SEQ ID NO: 549268 - protein, 9 aa, Homo Sapiens
DEANCDEKT

SEQ ID NO: 549269 - protein, 9 aa, Homo Sapiens
AKATPPSSA

SEQ ID NO: 549270 - protein, 9 aa, Homo Sapiens
ADVLCGAIG

SEQ ID NO: 549271 - protein, 9 aa, Homo Sapiens
QPPSPQLFS

SEQ ID NO: 549272 - protein, 9 aa, Homo Sapiens
NDVLALLDK

SEQ ID NO: 549273 - protein, 9 aa, Homo Sapiens
QLGVSLVFE

SEQ ID NO: 549274 - protein, 9 aa, Homo Sapiens
NEPWYKLFS

SEQ ID NO: 549275 - protein, 9 aa, Homo Sapiens
PPLLSSHKP

SEQ ID NO: 549276 - protein, 9 aa, Homo Sapiens
VQNLLLFNI

SEQ ID NO: 549277 - protein, 9 aa, Homo Sapiens
AMAKDHSEE

SEQ ID NO: 549278 - protein, 9 aa, Homo Sapiens
KFSVQNLLL

SEQ ID NO: 549279 - protein, 9 aa, Homo Sapiens
CNDVLALLD

SEQ ID NO: 549280 - protein, 9 aa, Homo Sapiens
QSNLPHSNN

SEQ ID NO: 549281 - protein, 9 aa, Homo Sapiens
YDPKSLDIV

SEQ ID NO: 549282 - protein, 9 aa, Homo Sapiens
LHSFVGSGM

SEQ ID NO: 549283 - protein, 9 aa, Homo Sapiens
RAYAFCNSF

SEQ ID NO: 549284 - protein, 9 aa, Homo Sapiens
QRTGQRAEE

SEQ ID NO: 549285 - protein, 9 aa, Homo Sapiens
GMMLLVAMA

SEQ ID NO: 549286 - protein, 9 aa, Homo Sapiens
TASGGEAGT

SEQ ID NO: 549287 - protein, 9 aa, Homo Sapiens
AFYDPKSLD

SEQ ID NO: 549288 - protein, 9 aa, Homo Sapiens
GFGATHSLL

SEQ ID NO: 549289 - protein, 9 aa, Homo Sapiens
GQLRVGSFT

SEQ ID NO: 549290 - protein, 9 aa, Homo Sapiens
WCQRSQMPP

SEQ ID NO: 549291 - protein, 9 aa, Homo Sapiens
QKLSQRNKL

SEQ ID NO: 549292 - protein, 9 aa, Homo Sapiens
AGTLENISV

SEQ ID NO: 549293 - protein, 9 aa, Homo Sapiens
GATSNLTWR

SEQ ID NO: 549294 - protein, 9 aa, Homo Sapiens
LRAGTLENI

SEQ ID NO: 549295 - protein, 9 aa, Homo Sapiens
QAYPEYLLT

SEQ ID NO: 549296 - protein, 9 aa, Homo Sapiens
FHDLHVYLA

SEQ ID NO: 549297 - protein, 9 aa, Homo Sapiens
SDITILTPQ

SEQ ID NO: 549298 - protein, 9 aa, Homo Sapiens
RITEAEWQE

SEQ ID NO: 549299 - protein, 9 aa, Homo Sapiens
PISHCQCIL

SEQ ID NO: 549300 - protein, 9 aa, Homo Sapiens
SCGATSNLT

SEQ ID NO: 549301 - protein, 9 aa, Homo Sapiens
KSMVWCENS

SEQ ID NO: 549302 - protein, 9 aa, Homo Sapiens
LLLLSPLWC

SEQ ID NO: 549303 - protein, 9 aa, Homo Sapiens
ADSLAELDD

SEQ ID NO: 549304 - protein, 9 aa, Homo Sapiens
LSQRNKLQP

SEQ ID NO: 549305 - protein, 9 aa, Homo Sapiens
CSVENAAAT

SEQ ID NO: 549306 - protein, 9 aa, Homo Sapiens
AWATPSRRA

SEQ ID NO: 549307 - protein, 9 aa, Homo Sapiens
TMGFWLTKL

SEQ ID NO: 549308 - protein, 9 aa, Homo Sapiens
GRGDLPLPA

SEQ ID NO: 549309 - protein, 9 aa, Homo Sapiens
QEQRNSIIY

SEQ ID NO: 549310 - protein, 9 aa, Homo Sapiens
HCAKVTNAY

SEQ ID NO: 549311 - protein, 9 aa, Homo Sapiens
SFTTKLVPS

SEQ ID NO: 549312 - protein, 9 aa, Homo Sapiens
AASTLVAGQ

SEQ ID NO: 549313 - protein, 9 aa, Homo Sapiens
DAGQSQSSA

SEQ ID NO: 549314 - protein, 9 aa, Homo Sapiens
TQWPRLLPY

SEQ ID NO: 549315 - protein, 9 aa, Homo Sapiens
SYRGHLGSS

SEQ ID NO: 549316 - protein, 9 aa, Homo Sapiens
SSATGPRNC

SEQ ID NO: 549317 - protein, 9 aa, Homo Sapiens
QRNSIIYSS

SEQ ID NO: 549318 - protein, 9 aa, Homo Sapiens
SGGSCDAHD

SEQ ID NO: 549319 - protein, 9 aa, Homo Sapiens
RASGGISSV

SEQ ID NO: 549320 - protein, 9 aa, Homo Sapiens
VFNKTEFSL

SEQ ID NO: 549321 - protein, 9 aa, Homo Sapiens
MGFWLTKLN

SEQ ID NO: 549322 - protein, 9 aa, Homo Sapiens
SQYTHPCVV

SEQ ID NO: 549323 - protein, 9 aa, Homo Sapiens
CWTHTERRK

SEQ ID NO: 549324 - protein, 9 aa, Homo Sapiens
GEDRPEPLI

SEQ ID NO: 549325 - protein, 9 aa, Homo Sapiens
EVFVLDPFD

SEQ ID NO: 549326 - protein, 9 aa, Homo Sapiens
LPTSRHLPE

SEQ ID NO: 549327 - protein, 9 aa, Homo Sapiens
LPISHCQCI

SEQ ID NO: 549328 - protein, 9 aa, Homo Sapiens
PGELAKKRG

SEQ ID NO: 549329 - protein, 9 aa, Homo Sapiens
ETHTRSELT

SEQ ID NO: 549330 - protein, 9 aa, Homo Sapiens
DLPLPAPPT

SEQ ID NO: 549331 - protein, 9 aa, Homo Sapiens
QRNKLQPRV

SEQ ID NO: 549332 - protein, 9 aa, Homo Sapiens
EEAFHYLVF

SEQ ID NO: 549333 - protein, 9 aa, Homo Sapiens
ATSNLTWRT

SEQ ID NO: 549334 - protein, 9 aa, Homo Sapiens
FMVVFQSIM

SEQ ID NO: 549335 - protein, 9 aa, Homo Sapiens
HRVQLPTSR

SEQ ID NO: 549336 - protein, 9 aa, Homo Sapiens
QASVHLAHA

SEQ ID NO: 549337 - protein, 9 aa, Homo Sapiens
SQRNKLQPR

SEQ ID NO: 549338 - protein, 9 aa, Homo Sapiens
NGEDELLFT

SEQ ID NO: 549339 - protein, 9 aa, Homo Sapiens
NRGVYPPVQ

SEQ ID NO: 549340 - protein, 9 aa, Homo Sapiens
SATGPRNCK

SEQ ID NO: 549341 - protein, 9 aa, Homo Sapiens
LLLLLSPLW

SEQ ID NO: 549342 - protein, 9 aa, Homo Sapiens
TERRKSPPP

SEQ ID NO: 549343 - protein, 9 aa, Homo Sapiens
QHSLAFSAF

SEQ ID NO: 549344 - protein, 9 aa, Homo Sapiens
GELAKKRGP

SEQ ID NO: 549345 - protein, 9 aa, Homo Sapiens
CHLSMLTDS

SEQ ID NO: 549346 - protein, 9 aa, Homo Sapiens
DITILTPQA

SEQ ID NO: 549347 - protein, 9 aa, Homo Sapiens
ISSVTGLRH

SEQ ID NO: 549348 - protein, 9 aa, Homo Sapiens
LTDSLFLPI

SEQ ID NO: 549349 - protein, 9 aa, Homo Sapiens
PPSCGATSN

SEQ ID NO: 549350 - protein, 9 aa, Homo Sapiens
LGSSEMQGH

SEQ ID NO: 549351 - protein, 9 aa, Homo Sapiens
HDSISEEAF

SEQ ID NO: 549352 - protein, 9 aa, Homo Sapiens
EERNEKEES

SEQ ID NO: 549353 - protein, 9 aa, Homo Sapiens
MDYSLDVNP

SEQ ID NO: 549354 - protein, 9 aa, Homo Sapiens
PSVAVLTRW

SEQ ID NO: 549355 - protein, 9 aa, Homo Sapiens
SLEVPQSFC

SEQ ID NO: 549356 - protein, 9 aa, Homo Sapiens
SPEYVDYES

SEQ ID NO: 549357 - protein, 9 aa, Homo Sapiens
RKKQTGKKH

SEQ ID NO: 549358 - protein, 9 aa, Homo Sapiens
IDTARLWPF

SEQ ID NO: 549359 - protein, 9 aa, Homo Sapiens
QLHDSTQLN

SEQ ID NO: 549360 - protein, 9 aa, Homo Sapiens
GQDVPSNKG

SEQ ID NO: 549361 - protein, 9 aa, Homo Sapiens
LVSLTVDAD

SEQ ID NO: 549362 - protein, 9 aa, Homo Sapiens
VAWATPSRR

SEQ ID NO: 549363 - protein, 9 aa, Homo Sapiens
LPLPAPPTP

SEQ ID NO: 549364 - protein, 9 aa, Homo Sapiens
RRASGGISS

SEQ ID NO: 549365 - protein, 9 aa, Homo Sapiens
THPCVVDLK

SEQ ID NO: 549366 - protein, 9 aa, Homo Sapiens
MQGHTMGFW

SEQ ID NO: 549367 - protein, 9 aa, Homo Sapiens
AVLTRWPPS

SEQ ID NO: 549368 - protein, 9 aa, Homo Sapiens
GYELWPDRR

SEQ ID NO: 549369 - protein, 9 aa, Homo Sapiens
SSVTGLRHP

SEQ ID NO: 549370 - protein, 9 aa, Homo Sapiens
CFSGGSCDA

SEQ ID NO: 549371 - protein, 9 aa, Homo Sapiens
ESLLLFEGE

SEQ ID NO: 549372 - protein, 9 aa, Homo Sapiens
LTPQASVHL

SEQ ID NO: 549373 - protein, 9 aa, Homo Sapiens
TRWPPSCGA

SEQ ID NO: 549374 - protein, 9 aa, Homo Sapiens
LLGCSVENA

SEQ ID NO: 549375 - protein, 9 aa, Homo Sapiens
EKEESDAKH

SEQ ID NO: 549376 - protein, 9 aa, Homo Sapiens
PDVPKSMVW

SEQ ID NO: 549377 - protein, 9 aa, Homo Sapiens
PQHSLAFSA

SEQ ID NO: 549378 - protein, 9 aa, Homo Sapiens
PCFSGGSCD

SEQ ID NO: 549379 - protein, 9 aa, Homo Sapiens
VPSNKGVTS

SEQ ID NO: 549380 - protein, 9 aa, Homo Sapiens
SRRASGGIS

SEQ ID NO: 549381 - protein, 9 aa, Homo Sapiens
VDLKMGTRQ

SEQ ID NO: 549382 - protein, 9 aa, Homo Sapiens
RPEPLIPKE

SEQ ID NO: 549383 - protein, 9 aa, Homo Sapiens
ITILTPQAS

SEQ ID NO: 549384 - protein, 9 aa, Homo Sapiens
NYLCHLSML

SEQ ID NO: 549385 - protein, 9 aa, Homo Sapiens
GKRLFEKLL

SEQ ID NO: 549386 - protein, 9 aa, Homo Sapiens
VYPPVQVHV

SEQ ID NO: 549387 - protein, 9 aa, Homo Sapiens
QRSQMPPPA

SEQ ID NO: 549388 - protein, 9 aa, Homo Sapiens
GQSQSSATG

SEQ ID NO: 549389 - protein, 9 aa, Homo Sapiens
LLLFEGEKI

SEQ ID NO: 549390 - protein, 9 aa, Homo Sapiens
TTHEVFVLD

SEQ ID NO: 549391 - protein, 9 aa, Homo Sapiens
ETGYELWPD

SEQ ID NO: 549392 - protein, 9 aa, Homo Sapiens
MVWCENSIC

SEQ ID NO: 549393 - protein, 9 aa, Homo Sapiens
SPPPGMLLR

SEQ ID NO: 549394 - protein, 9 aa, Homo Sapiens
EIYPQHSLA

SEQ ID NO: 549395 - protein, 9 aa, Homo Sapiens
FLPISHCQC

SEQ ID NO: 549396 - protein, 9 aa, Homo Sapiens
KEESDAKHL

SEQ ID NO: 549397 - protein, 9 aa, Homo Sapiens
SVTGLRHPA

SEQ ID NO: 549398 - protein, 9 aa, Homo Sapiens
SDPCFSGGS

SEQ ID NO: 549399 - protein, 9 aa, Homo Sapiens
GMLLRSPFQ

SEQ ID NO: 549400 - protein, 9 aa, Homo Sapiens
QMTLTEGMD

SEQ ID NO: 549401 - protein, 9 aa, Homo Sapiens
HAHRVQLPT

SEQ ID NO: 549402 - protein, 9 aa, Homo Sapiens
SQKEKLRGK

SEQ ID NO: 549403 - protein, 9 aa, Homo Sapiens
YSSLESVSS

SEQ ID NO: 549404 - protein, 9 aa, Homo Sapiens
WQEHIQEVL

SEQ ID NO: 549405 - protein, 9 aa, Homo Sapiens
AEWQEHIQE

SEQ ID NO: 549406 - protein, 9 aa, Homo Sapiens
SLLLFEGEK

SEQ ID NO: 549407 - protein, 9 aa, Homo Sapiens
HSAASTLVA

SEQ ID NO: 549408 - protein, 9 aa, Homo Sapiens
SAASTLVAG

SEQ ID NO: 549409 - protein, 9 aa, Homo Sapiens
VNGQLRVGS

SEQ ID NO: 549410 - protein, 9 aa, Homo Sapiens
GQVLGFHQP

SEQ ID NO: 549411 - protein, 9 aa, Homo Sapiens
LWPDRRSCK

SEQ ID NO: 549412 - protein, 9 aa, Homo Sapiens
AESSLEVPQ

SEQ ID NO: 549413 - protein, 9 aa, Homo Sapiens
PLCLLLLLS

SEQ ID NO: 549414 - protein, 9 aa, Homo Sapiens
WPDRRSCKA

SEQ ID NO: 549415 - protein, 9 aa, Homo Sapiens
SETHTRSEL

SEQ ID NO: 549416 - protein, 9 aa, Homo Sapiens
QKARRSALW

SEQ ID NO: 549417 - protein, 9 aa, Homo Sapiens
SPNVFNKTE

SEQ ID NO: 549418 - protein, 9 aa, Homo Sapiens
EPLIPKESK

SEQ ID NO: 549419 - protein, 9 aa, Homo Sapiens
NWQKLSQRN

SEQ ID NO: 549420 - protein, 9 aa, Homo Sapiens
SPTAAPPVA

SEQ ID NO: 549421 - protein, 9 aa, Homo Sapiens
QLRVGSFTT

SEQ ID NO: 549422 - protein, 9 aa, Homo Sapiens
TGYELWPDR

SEQ ID NO: 549423 - protein, 9 aa, Homo Sapiens
TFHDLHVYL

SEQ ID NO: 549424 - protein, 9 aa, Homo Sapiens
CQGKRLFEK

SEQ ID NO: 549425 - protein, 9 aa, Homo Sapiens
LSMLTDSLF

SEQ ID NO: 549426 - protein, 9 aa, Homo Sapiens
GSFTTKLVP

SEQ ID NO: 549427 - protein, 9 aa, Homo Sapiens
ELWPDRRSC

SEQ ID NO: 549428 - protein, 9 aa, Homo Sapiens
SACTPERGP

SEQ ID NO: 549429 - protein, 9 aa, Homo Sapiens
SGGISSVTG

SEQ ID NO: 549430 - protein, 9 aa, Homo Sapiens
KIMDYSLDV

SEQ ID NO: 549431 - protein, 9 aa, Homo Sapiens
RRSALWCQR

SEQ ID NO: 549432 - protein, 9 aa, Homo Sapiens
LRGKMSPKH

SEQ ID NO: 549433 - protein, 9 aa, Homo Sapiens
YLCHLSMLT

SEQ ID NO: 549434 - protein, 9 aa, Homo Sapiens
EESDAKHLQ

SEQ ID NO: 549435 - protein, 9 aa, Homo Sapiens
HEVFVLDPF

SEQ ID NO: 549436 - protein, 9 aa, Homo Sapiens
REYRLHERA

SEQ ID NO: 549437 - protein, 9 aa, Homo Sapiens
HPLCLLLLL

SEQ ID NO: 549438 - protein, 9 aa, Homo Sapiens
ETFHDLHVY

SEQ ID NO: 549439 - protein, 9 aa, Homo Sapiens
MGVGRQHRG

SEQ ID NO: 549440 - protein, 9 aa, Homo Sapiens
AHLCPGVAR

SEQ ID NO: 549441 - protein, 9 aa, Homo Sapiens
FGKETQWPR

SEQ ID NO: 549442 - protein, 9 aa, Homo Sapiens
DLQMQLHDS

SEQ ID NO: 549443 - protein, 9 aa, Homo Sapiens
SLTIGTTHE

SEQ ID NO: 549444 - protein, 9 aa, Homo Sapiens
ARLWPFKET

SEQ ID NO: 549445 - protein, 9 aa, Homo Sapiens
DVPSNKGVT

SEQ ID NO: 549446 - protein, 9 aa, Homo Sapiens
IYSSLESVS

SEQ ID NO: 549447 - protein, 9 aa, Homo Sapiens
SDIDFTPTS

SEQ ID NO: 549448 - protein, 9 aa, Homo Sapiens
SCRLSHNCW

SEQ ID NO: 549449 - protein, 9 aa, Homo Sapiens
WQKLSQRNK

SEQ ID NO: 549450 - protein, 9 aa, Homo Sapiens
RHLPEEALR

SEQ ID NO: 549451 - protein, 9 aa, Homo Sapiens
DVPKSMVWC

SEQ ID NO: 549452 - protein, 9 aa, Homo Sapiens
SISEEAFHY

SEQ ID NO: 549453 - protein, 9 aa, Homo Sapiens
RNSIIYSSL

SEQ ID NO: 549454 - protein, 9 aa, Homo Sapiens
ACTPERGPF

SEQ ID NO: 549455 - protein, 9 aa, Homo Sapiens
GGISSVTGL

SEQ ID NO: 549456 - protein, 9 aa, Homo Sapiens
VGRQHRGPF

SEQ ID NO: 549457 - protein, 9 aa, Homo Sapiens
LEEETGQVL

SEQ ID NO: 549458 - protein, 9 aa, Homo Sapiens
PKSMVWCEN

SEQ ID NO: 549459 - protein, 9 aa, Homo Sapiens
ASGGISSVT

SEQ ID NO: 549460 - protein, 9 aa, Homo Sapiens
FQKARRSAL

SEQ ID NO: 549461 - protein, 9 aa, Homo Sapiens
TPERGPFPV

SEQ ID NO: 549462 - protein, 9 aa, Homo Sapiens
GHLGSSEMQ

SEQ ID NO: 549463 - protein, 9 aa, Homo Sapiens
VCTVREYRL

SEQ ID NO: 549464 - protein, 9 aa, Homo Sapiens
CTPERGPFP

SEQ ID NO: 549465 - protein, 9 aa, Homo Sapiens
SSEMQGHTM

SEQ ID NO: 549466 - protein, 9 aa, Homo Sapiens
LLLSPLWCS

SEQ ID NO: 549467 - protein, 9 aa, Homo Sapiens
TGEAHLCPG

SEQ ID NO: 549468 - protein, 9 aa, Homo Sapiens
CVVDLKMGT

SEQ ID NO: 549469 - protein, 9 aa, Homo Sapiens
LTWRTSPTA

SEQ ID NO: 549470 - protein, 9 aa, Homo Sapiens
PYLRAGTLE

SEQ ID NO: 549471 - protein, 9 aa, Homo Sapiens
GVYPPVQVH

SEQ ID NO: 549472 - protein, 9 aa, Homo Sapiens
IPKESKKRK

SEQ ID NO: 549473 - protein, 9 aa, Homo Sapiens
TEAEWQEHI

SEQ ID NO: 549474 - protein, 9 aa, Homo Sapiens
LNYLCHLSM

SEQ ID NO: 549475 - protein, 9 aa, Homo Sapiens
KLNYLCHLS

SEQ ID NO: 549476 - protein, 9 aa, Homo Sapiens
RHPAAHPLC

SEQ ID NO: 549477 - protein, 9 aa, Homo Sapiens
WPPSCGATS

SEQ ID NO: 549478 - protein, 9 aa, Homo Sapiens
TLVAGQASN

SEQ ID NO: 549479 - protein, 9 aa, Homo Sapiens
RKSPPPGML

SEQ ID NO: 549480 - protein, 9 aa, Homo Sapiens
SDTRKRKKQ

SEQ ID NO: 549481 - protein, 9 aa, Homo Sapiens
CDSDPCFSG

SEQ ID NO: 549482 - protein, 9 aa, Homo Sapiens
DREIYPQHS

SEQ ID NO: 549483 - protein, 9 aa, Homo Sapiens
EAEWQEHIQ

SEQ ID NO: 549484 - protein, 9 aa, Homo Sapiens
LTKLNYLCH

SEQ ID NO: 549485 - protein, 9 aa, Homo Sapiens
LDSQKEKLR

SEQ ID NO: 549486 - protein, 9 aa, Homo Sapiens
QYTHPCVVD

SEQ ID NO: 549487 - protein, 9 aa, Homo Sapiens
IDFTPTSRE

SEQ ID NO: 549488 - protein, 9 aa, Homo Sapiens
NKTEFSLNV

SEQ ID NO: 549489 - protein, 9 aa, Homo Sapiens
PCDSDPCFS

SEQ ID NO: 549490 - protein, 9 aa, Homo Sapiens
PPVQVHVTL

SEQ ID NO: 549491 - protein, 9 aa, Homo Sapiens
KTEFSLNVT

SEQ ID NO: 549492 - protein, 9 aa, Homo Sapiens
QMQLHDSTQ

SEQ ID NO: 549493 - protein, 9 aa, Homo Sapiens
PAPPTPTTP

SEQ ID NO: 549494 - protein, 9 aa, Homo Sapiens
VSLTVDADS

SEQ ID NO: 549495 - protein, 9 aa, Homo Sapiens
NAPPAFESL

SEQ ID NO: 549496 - protein, 9 aa, Homo Sapiens
VTGLRHPAA

SEQ ID NO: 549497 - protein, 9 aa, Homo Sapiens
LCHLSMLTD

SEQ ID NO: 549498 - protein, 9 aa, Homo Sapiens
PPGMLLRSP

SEQ ID NO: 549499 - protein, 9 aa, Homo Sapiens
VLTRWPPSC

SEQ ID NO: 549500 - protein, 9 aa, Homo Sapiens
ERGPFPVPS

SEQ ID NO: 549501 - protein, 9 aa, Homo Sapiens
GVARPSETH

SEQ ID NO: 549502 - protein, 9 aa, Homo Sapiens
FKIMDYSLD

SEQ ID NO: 549503 - protein, 9 aa, Homo Sapiens
TVDADSLAE

SEQ ID NO: 549504 - protein, 9 aa, Homo Sapiens
APPAFESLL

SEQ ID NO: 549505 - protein, 9 aa, Homo Sapiens
PSNKGVTSL

SEQ ID NO: 549506 - protein, 9 aa, Homo Sapiens
VVFQSIMGC

SEQ ID NO: 549507 - protein, 9 aa, Homo Sapiens
ALWCQRSQM

SEQ ID NO: 549508 - protein, 9 aa, Homo Sapiens
AHLEIKPGE

SEQ ID NO: 549509 - protein, 9 aa, Homo Sapiens
RRKSPPPGM

SEQ ID NO: 549510 - protein, 9 aa, Homo Sapiens
KEKLRGKMS

SEQ ID NO: 549511 - protein, 9 aa, Homo Sapiens
YPEYLLTFR

SEQ ID NO: 549512 - protein, 9 aa, Homo Sapiens
VFQSIMGCI

SEQ ID NO: 549513 - protein, 9 aa, Homo Sapiens
HPSACQGKR

SEQ ID NO: 549514 - protein, 9 aa, Homo Sapiens
QHRGPFQGV

SEQ ID NO: 549515 - protein, 9 aa, Homo Sapiens
CHIDTARLW

SEQ ID NO: 549516 - protein, 9 aa, Homo Sapiens
VDRITEAEW

SEQ ID NO: 549517 - protein, 9 aa, Homo Sapiens
HRGPFQGVR

SEQ ID NO: 549518 - protein, 9 aa, Homo Sapiens
IKDLQMQLH

SEQ ID NO: 549519 - protein, 9 aa, Homo Sapiens
LPAPPTPTT

SEQ ID NO: 549520 - protein, 9 aa, Homo Sapiens
AFESLLLFE

SEQ ID NO: 549521 - protein, 9 aa, Homo Sapiens
TSPTAAPPV

SEQ ID NO: 549522 - protein, 9 aa, Homo Sapiens
MLLRSPFQK

SEQ ID NO: 549523 - protein, 9 aa, Homo Sapiens
PGMLLRSPF

SEQ ID NO: 549524 - protein, 9 aa, Homo Sapiens
IIYSSLESV

SEQ ID NO: 549525 - protein, 9 aa, Homo Sapiens
PPVAWATPS

SEQ ID NO: 549526 - protein, 9 aa, Homo Sapiens
YVDYESLSP

SEQ ID NO: 549527 - protein, 9 aa, Homo Sapiens
PLPAPPTPT

SEQ ID NO: 549528 - protein, 9 aa, Homo Sapiens
QGKRLFEKL

SEQ ID NO: 549529 - protein, 9 aa, Homo Sapiens
FPVPSVAVL

SEQ ID NO: 549530 - protein, 9 aa, Homo Sapiens
REIYPQHSL

SEQ ID NO: 549531 - protein, 9 aa, Homo Sapiens
VPDVPKSMV

SEQ ID NO: 549532 - protein, 9 aa, Homo Sapiens
LRVGSFTTK

SEQ ID NO: 549533 - protein, 9 aa, Homo Sapiens
EALLGCSVE

SEQ ID NO: 549534 - protein, 9 aa, Homo Sapiens
VPSVAVLTR

SEQ ID NO: 549535 - protein, 9 aa, Homo Sapiens
CSVCTVREY

SEQ ID NO: 549536 - protein, 9 aa, Homo Sapiens
ATPSRRASG

SEQ ID NO: 549537 - protein, 9 aa, Homo Sapiens
EAFHYLVFD

SEQ ID NO: 549538 - protein, 9 aa, Homo Sapiens
RGDLPLPAP

SEQ ID NO: 549539 - protein, 9 aa, Homo Sapiens
SIIYSSLES

SEQ ID NO: 549540 - protein, 9 aa, Homo Sapiens
TARLWPFKE

SEQ ID NO: 549541 - protein, 9 aa, Homo Sapiens
YTHPCVVDL

SEQ ID NO: 549542 - protein, 9 aa, Homo Sapiens
QKEKLRGKM

SEQ ID NO: 549543 - protein, 9 aa, Homo Sapiens
YPQHSLAFS

SEQ ID NO: 549544 - protein, 9 aa, Homo Sapiens
SDRETFHDL

SEQ ID NO: 549545 - protein, 9 aa, Homo Sapiens
CTVREYRLH

SEQ ID NO: 549546 - protein, 9 aa, Homo Sapiens
TRKRKKQTG

SEQ ID NO: 549547 - protein, 9 aa, Homo Sapiens
LWCQRSQMP

SEQ ID NO: 549548 - protein, 9 aa, Homo Sapiens
PAFESLLLF

SEQ ID NO: 549549 - protein, 9 aa, Homo Sapiens
WTHTERRKS

SEQ ID NO: 549550 - protein, 9 aa, Homo Sapiens
WLTKLNYLC

SEQ ID NO: 549551 - protein, 9 aa, Homo Sapiens
ESDAKHLQR

SEQ ID NO: 549552 - protein, 9 aa, Homo Sapiens
NKGVTSLDW

SEQ ID NO: 549553 - protein, 9 aa, Homo Sapiens
DRETFHDLH

SEQ ID NO: 549554 - protein, 9 aa, Homo Sapiens
TSRHLPEEA

SEQ ID NO: 549555 - protein, 9 aa, Homo Sapiens
MTLTEGMDP

SEQ ID NO: 549556 - protein, 9 aa, Homo Sapiens
TSACTPERG

SEQ ID NO: 549557 - protein, 9 aa, Homo Sapiens
AYPEYLLTF

SEQ ID NO: 549558 - protein, 9 aa, Homo Sapiens
LQMQLHDST

SEQ ID NO: 549559 - protein, 9 aa, Homo Sapiens
TEGMDPARL

SEQ ID NO: 549560 - protein, 9 aa, Homo Sapiens
PTSRHLPEE

SEQ ID NO: 549561 - protein, 9 aa, Homo Sapiens
WATPSRRAS

SEQ ID NO: 549562 - protein, 9 aa, Homo Sapiens
MLTDSLFLP

SEQ ID NO: 549563 - protein, 9 aa, Homo Sapiens
RSALWCQRS

SEQ ID NO: 549564 - protein, 9 aa, Homo Sapiens
SELTSACTP

SEQ ID NO: 549565 - protein, 9 aa, Homo Sapiens
DIDFTPTSR

SEQ ID NO: 549566 - protein, 9 aa, Homo Sapiens
HLCPGVARP

SEQ ID NO: 549567 - protein, 9 aa, Homo Sapiens
FQSIMGCII

SEQ ID NO: 549568 - protein, 9 aa, Homo Sapiens
HLEIKPGEL

SEQ ID NO: 549569 - protein, 9 aa, Homo Sapiens
EEERNEKEE

SEQ ID NO: 549570 - protein, 9 aa, Homo Sapiens
NSIIYSSLE

SEQ ID NO: 549571 - protein, 9 aa, Homo Sapiens
ALLGCSVEN

SEQ ID NO: 549572 - protein, 9 aa, Homo Sapiens
GPFPVPSVA

SEQ ID NO: 549573 - protein, 9 aa, Homo Sapiens
HCHIDTARL

SEQ ID NO: 549574 - protein, 9 aa, Homo Sapiens
THTRSELTS

SEQ ID NO: 549575 - protein, 9 aa, Homo Sapiens
RGVYPPVQV

SEQ ID NO: 549576 - protein, 9 aa, Homo Sapiens
QSSATGPRN

SEQ ID NO: 549577 - protein, 9 aa, Homo Sapiens
EWQEHIQEV

SEQ ID NO: 549578 - protein, 9 aa, Homo Sapiens
HTMGFWLTK

SEQ ID NO: 549579 - protein, 9 aa, Homo Sapiens
PSRRASGGI

SEQ ID NO: 549580 - protein, 9 aa, Homo Sapiens
TPSRRASGG

SEQ ID NO: 549581 - protein, 9 aa, Homo Sapiens
GFWLTKLNY

SEQ ID NO: 549582 - protein, 9 aa, Homo Sapiens
QVLGFHQPG

SEQ ID NO: 549583 - protein, 9 aa, Homo Sapiens
PEYVDYESL

SEQ ID NO: 549584 - protein, 9 aa, Homo Sapiens
GHCHIDTAR

SEQ ID NO: 549585 - protein, 9 aa, Homo Sapiens
LFTVVEELS

SEQ ID NO: 549586 - protein, 9 aa, Homo Sapiens
PEYLLTFRK

SEQ ID NO: 549587 - protein, 9 aa, Homo Sapiens
KSPPPGMLL

SEQ ID NO: 549588 - protein, 9 aa, Homo Sapiens
SNIHLSDID

SEQ ID NO: 549589 - protein, 9 aa, Homo Sapiens
LSDIDFTPT

SEQ ID NO: 549590 - protein, 9 aa, Homo Sapiens
SEEAFHYLV

SEQ ID NO: 549591 - protein, 9 aa, Homo Sapiens
AFHYLVFDL

SEQ ID NO: 549592 - protein, 9 aa, Homo Sapiens
CETGYELWP

SEQ ID NO: 549593 - protein, 9 aa, Homo Sapiens
PVQVHVTLG

SEQ ID NO: 549594 - protein, 9 aa, Homo Sapiens
YELWPDRRS

SEQ ID NO: 549595 - protein, 9 aa, Homo Sapiens
MDPARLLDS

SEQ ID NO: 549596 - protein, 9 aa, Homo Sapiens
RLWPFKETV

SEQ ID NO: 549597 - protein, 9 aa, Homo Sapiens
EQRNSIIYS

SEQ ID NO: 549598 - protein, 9 aa, Homo Sapiens
LVAGQASNG

SEQ ID NO: 549599 - protein, 9 aa, Homo Sapiens
GISSVTGLR

SEQ ID NO: 549600 - protein, 9 aa, Homo Sapiens
AKVTNAYEE

SEQ ID NO: 549601 - protein, 9 aa, Homo Sapiens
EYRLHERAL

SEQ ID NO: 549602 - protein, 9 aa, Homo Sapiens
RGHLGSSEM

SEQ ID NO: 549603 - protein, 9 aa, Homo Sapiens
APPVAWATP

SEQ ID NO: 549604 - protein, 9 aa, Homo Sapiens
KLSQRNKLQ

SEQ ID NO: 549605 - protein, 9 aa, Homo Sapiens
EDRPEPLIP

SEQ ID NO: 549606 - protein, 9 aa, Homo Sapiens
RLSHNCWTH

SEQ ID NO: 549607 - protein, 9 aa, Homo Sapiens
RSPEYVDYE

SEQ ID NO: 549608 - protein, 9 aa, Homo Sapiens
TSNLTWRTS

SEQ ID NO: 549609 - protein, 9 aa, Homo Sapiens
SQMPPPAWC

SEQ ID NO: 549610 - protein, 9 aa, Homo Sapiens
ARRSALWCQ

SEQ ID NO: 549611 - protein, 9 aa, Homo Sapiens
LIPKESKKR

SEQ ID NO: 549612 - protein, 9 aa, Homo Sapiens
HLAHAHRVQ

SEQ ID NO: 549613 - protein, 9 aa, Homo Sapiens
RLLPYSNYR

SEQ ID NO: 549614 - protein, 9 aa, Homo Sapiens
GLRHPAAHP

SEQ ID NO: 549615 - protein, 9 aa, Homo Sapiens
IHSYRGHLG

SEQ ID NO: 549616 - protein, 9 aa, Homo Sapiens
APPTPTTPL

SEQ ID NO: 549617 - protein, 9 aa, Homo Sapiens
VWCENSICV

SEQ ID NO: 549618 - protein, 9 aa, Homo Sapiens
FWLTKLNYL

SEQ ID NO: 549619 - protein, 9 aa, Homo Sapiens
VARPSETHT

SEQ ID NO: 549620 - protein, 9 aa, Homo Sapiens
TRSELTSAC

SEQ ID NO: 549621 - protein, 9 aa, Homo Sapiens
IMGCIIDAF

SEQ ID NO: 549622 - protein, 9 aa, Homo Sapiens
QGHTMGFWL

SEQ ID NO: 549623 - protein, 9 aa, Homo Sapiens
RTSPTAAPP

SEQ ID NO: 549624 - protein, 9 aa, Homo Sapiens
GTTHEVFVL

SEQ ID NO: 549625 - protein, 9 aa, Homo Sapiens
CQRSQMPPP

SEQ ID NO: 549626 - protein, 9 aa, Homo Sapiens
EAHLCPGVA

SEQ ID NO: 549627 - protein, 9 aa, Homo Sapiens
DSISEEAFH

SEQ ID NO: 549628 - protein, 9 aa, Homo Sapiens
DSLFLPISH

SEQ ID NO: 549629 - protein, 9 aa, Homo Sapiens
FSGGSCDAH

SEQ ID NO: 549630 - protein, 9 aa, Homo Sapiens
YPPVQVHVT

SEQ ID NO: 549631 - protein, 9 aa, Homo Sapiens
HSLAFSAFT

SEQ ID NO: 549632 - protein, 9 aa, Homo Sapiens
PAAKAESSL

SEQ ID NO: 549633 - protein, 9 aa, Homo Sapiens
KETQWPRLL

SEQ ID NO: 549634 - protein, 9 aa, Homo Sapiens
AAHPLCLLL

SEQ ID NO: 549635 - protein, 9 aa, Homo Sapiens
IHLSDIDFT

SEQ ID NO: 549636 - protein, 9 aa, Homo Sapiens
EDYHCAKVT

SEQ ID NO: 549637 - protein, 9 aa, Homo Sapiens
KRKKQTGKK

SEQ ID NO: 549638 - protein, 9 aa, Homo Sapiens
VDADSLAEL

SEQ ID NO: 549639 - protein, 9 aa, Homo Sapiens
GTLENISVT

SEQ ID NO: 549640 - protein, 9 aa, Homo Sapiens
PPAFESLLL

SEQ ID NO: 549641 - protein, 9 aa, Homo Sapiens
PLIPKESKK

SEQ ID NO: 549642 - protein, 9 aa, Homo Sapiens
RVGSFTTKL

SEQ ID NO: 549643 - protein, 9 aa, Homo Sapiens
AAPPVAWAT

SEQ ID NO: 549644 - protein, 9 aa, Homo Sapiens
ILTPQASVH

SEQ ID NO: 549645 - protein, 9 aa, Homo Sapiens
SSLEVPQSF

SEQ ID NO: 549646 - protein, 9 aa, Homo Sapiens
DPARLLDSI

SEQ ID NO: 549647 - protein, 9 aa, Homo Sapiens
EEETGQVLG

SEQ ID NO: 549648 - protein, 9 aa, Homo Sapiens
GVTSLDWNS

SEQ ID NO: 549649 - protein, 9 aa, Homo Sapiens
ASTLVAGQA

SEQ ID NO: 549650 - protein, 9 aa, Homo Sapiens
ACQGKRLFE

SEQ ID NO: 549651 - protein, 9 aa, Homo Sapiens
ESDRETFHD

SEQ ID NO: 549652 - protein, 9 aa, Homo Sapiens
HDLHVYLAP

SEQ ID NO: 549653 - protein, 9 aa, Homo Sapiens
YRGHLGSSE

SEQ ID NO: 549654 - protein, 9 aa, Homo Sapiens
EMQGHTMGF

SEQ ID NO: 549655 - protein, 9 aa, Homo Sapiens
TPQASVHLA

SEQ ID NO: 549656 - protein, 9 aa, Homo Sapiens
ESSLEVPQS

SEQ ID NO: 549657 - protein, 9 aa, Homo Sapiens
KVTNAYEEQ

SEQ ID NO: 549658 - protein, 9 aa, Homo Sapiens
HLSDIDFTP

SEQ ID NO: 549659 - protein, 9 aa, Homo Sapiens
RSELTSACT

SEQ ID NO: 549660 - protein, 9 aa, Homo Sapiens
TLENISVTL

SEQ ID NO: 549661 - protein, 9 aa, Homo Sapiens
LCPGVARPS

SEQ ID NO: 549662 - protein, 9 aa, Homo Sapiens
KLRGKMSPK

SEQ ID NO: 549663 - protein, 9 aa, Homo Sapiens
PNVFNKTEF

SEQ ID NO: 549664 - protein, 9 aa, Homo Sapiens
TIGTTHEVF

SEQ ID NO: 549665 - protein, 9 aa, Homo Sapiens
HMGVGRQHR

SEQ ID NO: 549666 - protein, 9 aa, Homo Sapiens
RKRKKQTGK

SEQ ID NO: 549667 - protein, 9 aa, Homo Sapiens
NIHLSDIDF

SEQ ID NO: 549668 - protein, 9 aa, Homo Sapiens
WPRLLPYSN

SEQ ID NO: 549669 - protein, 9 aa, Homo Sapiens
RWPPSCGAT

SEQ ID NO: 549670 - protein, 9 aa, Homo Sapiens
TAAPPVAWA

SEQ ID NO: 549671 - protein, 9 aa, Homo Sapiens
GKETQWPRL

SEQ ID NO: 549672 - protein, 9 aa, Homo Sapiens
THEVFVLDP

SEQ ID NO: 549673 - protein, 9 aa, Homo Sapiens
DPCFSGGSC

SEQ ID NO: 549674 - protein, 9 aa, Homo Sapiens
NGQLRVGSF

SEQ ID NO: 549675 - protein, 9 aa, Homo Sapiens
YRLHERALL

SEQ ID NO: 549676 - protein, 9 aa, Homo Sapiens
EETGQVLGF

SEQ ID NO: 549677 - protein, 9 aa, Homo Sapiens
DRPEPLIPK

SEQ ID NO: 549678 - protein, 9 aa, Homo Sapiens
KRLFEKLLQ

SEQ ID NO: 549679 - protein, 9 aa, Homo Sapiens
GSSEMQGHT

SEQ ID NO: 549680 - protein, 9 aa, Homo Sapiens
SVCTVREYR

SEQ ID NO: 549681 - protein, 9 aa, Homo Sapiens
DGYRSPEYV

SEQ ID NO: 549682 - protein, 9 aa, Homo Sapiens
CLLLLLSPL

SEQ ID NO: 549683 - protein, 9 aa, Homo Sapiens
VVDLKMGTR

SEQ ID NO: 549684 - protein, 9 aa, Homo Sapiens
CRLSHNCWT

SEQ ID NO: 549685 - protein, 9 aa, Homo Sapiens
DADSLAELD

SEQ ID NO: 549686 - protein, 9 aa, Homo Sapiens
VTNAYEEQS

SEQ ID NO: 549687 - protein, 9 aa, Homo Sapiens
DYHCAKVTN

SEQ ID NO: 549688 - protein, 9 aa, Homo Sapiens
PPPGMLLRS

SEQ ID NO: 549689 - protein, 9 aa, Homo Sapiens
FESLLLFEG

SEQ ID NO: 549690 - protein, 9 aa, Homo Sapiens
NEKEESDAK

SEQ ID NO: 549691 - protein, 9 aa, Homo Sapiens
AKAESSLEV

SEQ ID NO: 549692 - protein, 9 aa, Homo Sapiens
LLSPLWCSC

SEQ ID NO: 549693 - protein, 9 aa, Homo Sapiens
PFPVPSVAV

SEQ ID NO: 549694 - protein, 9 aa, Homo Sapiens
IGTTHEVFV

SEQ ID NO: 549695 - protein, 9 aa, Homo Sapiens
RPSETHTRS

SEQ ID NO: 549696 - protein, 9 aa, Homo Sapiens
ARPSETHTR

SEQ ID NO: 549697 - protein, 9 aa, Homo Sapiens
LEIKPGELA

SEQ ID NO: 549698 - protein, 9 aa, Homo Sapiens
SMVWCENSI

SEQ ID NO: 549699 - protein, 9 aa, Homo Sapiens
AAHLEIKPG

SEQ ID NO: 549700 - protein, 9 aa, Homo Sapiens
LPEEALRSS

SEQ ID NO: 549701 - protein, 9 aa, Homo Sapiens
SIMGCIIDA

SEQ ID NO: 549702 - protein, 9 aa, Homo Sapiens
LGFHQPGSI

SEQ ID NO: 549703 - protein, 9 aa, Homo Sapiens
TDSLFLPIS

SEQ ID NO: 549704 - protein, 9 aa, Homo Sapiens
SLSDTRKRK

SEQ ID NO: 549705 - protein, 9 aa, Homo Sapiens
CSCRLSHNC

SEQ ID NO: 549706 - protein, 9 aa, Homo Sapiens
CAKVTNAYE

SEQ ID NO: 549707 - protein, 9 aa, Homo Sapiens
TGQVLGFHQ

SEQ ID NO: 549708 - protein, 9 aa, Homo Sapiens
SVHLAHAHR

SEQ ID NO: 549709 - protein, 9 aa, Homo Sapiens
PQASVHLAH

SEQ ID NO: 549710 - protein, 9 aa, Homo Sapiens
PHMGVGRQH

SEQ ID NO: 549711 - protein, 9 aa, Homo Sapiens
IKPGELAKK

SEQ ID NO: 549712 - protein, 9 aa, Homo Sapiens
ELTSACTPE

SEQ ID NO: 549713 - protein, 9 aa, Homo Sapiens
RVQLPTSRH

SEQ ID NO: 549714 - protein, 9 aa, Homo Sapiens
RNKLQPRVI

SEQ ID NO: 549715 - protein, 9 aa, Homo Sapiens
KGVTSLDWN

SEQ ID NO: 549716 - protein, 9 aa, Homo Sapiens
AHRVQLPTS

SEQ ID NO: 549717 - protein, 9 aa, Homo Sapiens
LRSPFQKAR

SEQ ID NO: 549718 - protein, 9 aa, Homo Sapiens
KDLQMQLHD

SEQ ID NO: 549719 - protein, 9 aa, Homo Sapiens
TVSPNVFNK

SEQ ID NO: 549720 - protein, 9 aa, Homo Sapiens
CGATSNLTW

SEQ ID NO: 549721 - protein, 9 aa, Homo Sapiens
VAVLTRWPP

SEQ ID NO: 549722 - protein, 9 aa, Homo Sapiens
RSQMPPPAW

SEQ ID NO: 549723 - protein, 9 aa, Homo Sapiens
DLVSLTVDA

SEQ ID NO: 549724 - protein, 9 aa, Homo Sapiens
VHLAHAHRV

SEQ ID NO: 549725 - protein, 9 aa, Homo Sapiens
LWCSCRLSH

SEQ ID NO: 549726 - protein, 9 aa, Homo Sapiens
VLGFHQPGS

SEQ ID NO: 549727 - protein, 9 aa, Homo Sapiens
GCSVENAAA

SEQ ID NO: 549728 - protein, 9 aa, Homo Sapiens
ETGQVLGFH

SEQ ID NO: 549729 - protein, 9 aa, Homo Sapiens
RKSEALLGC

SEQ ID NO: 549730 - protein, 9 aa, Homo Sapiens
LNGEDELLF

SEQ ID NO: 549731 - protein, 9 aa, Homo Sapiens
PVPSVAVLT

SEQ ID NO: 549732 - protein, 9 aa, Homo Sapiens
YHCAKVTNA

SEQ ID NO: 549733 - protein, 9 aa, Homo Sapiens
TILTPQASV

SEQ ID NO: 549734 - protein, 9 aa, Homo Sapiens
LTVDADSLA

SEQ ID NO: 549735 - protein, 9 aa, Homo Sapiens
SALWCQRSQ

SEQ ID NO: 549736 - protein, 9 aa, Homo Sapiens
HNCWTHTER

SEQ ID NO: 549737 - protein, 9 aa, Homo Sapiens
LSDTRKRKK

SEQ ID NO: 549738 - protein, 9 aa, Homo Sapiens
HLSMLTDSL

SEQ ID NO: 549739 - protein, 9 aa, Homo Sapiens
APAAKAESS

SEQ ID NO: 549740 - protein, 9 aa, Homo Sapiens
HTERRKSPP

SEQ ID NO: 549741 - protein, 9 aa, Homo Sapiens
ANRGVYPPV

SEQ ID NO: 549742 - protein, 9 aa, Homo Sapiens
MVVFQSIMG

SEQ ID NO: 549743 - protein, 9 aa, Homo Sapiens
KARRSALWC

SEQ ID NO: 549744 - protein, 9 aa, Homo Sapiens
RETFHDLHV

SEQ ID NO: 549745 - protein, 9 aa, Homo Sapiens
SHNCWTHTE

SEQ ID NO: 549746 - protein, 9 aa, Homo Sapiens
IYPQHSLAF

SEQ ID NO: 549747 - protein, 9 aa, Homo Sapiens
ASVHLAHAH

SEQ ID NO: 549748 - protein, 9 aa, Homo Sapiens
EYVDYESLS

SEQ ID NO: 549749 - protein, 9 aa, Homo Sapiens
DSQKEKLRG

SEQ ID NO: 549750 - protein, 9 aa, Homo Sapiens
LHDSISEEA

SEQ ID NO: 549751 - protein, 9 aa, Homo Sapiens
GYRSPEYVD

SEQ ID NO: 549752 - protein, 9 aa, Homo Sapiens
QWPRLLPYS

SEQ ID NO: 549753 - protein, 9 aa, Homo Sapiens
DTRKRKKQT

SEQ ID NO: 549754 - protein, 9 aa, Homo Sapiens
HLPEEALRS

SEQ ID NO: 549755 - protein, 9 aa, Homo Sapiens
GMDPARLLD

SEQ ID NO: 549756 - protein, 9 aa, Homo Sapiens
ELNGEDELL

SEQ ID NO: 549757 - protein, 9 aa, Homo Sapiens
QSIMGCIID

SEQ ID NO: 549758 - protein, 9 aa, Homo Sapiens
TVREYRLHE

SEQ ID NO: 549759 - protein, 9 aa, Homo Sapiens
LTRWPPSCG

SEQ ID NO: 549760 - protein, 9 aa, Homo Sapiens
YRSPEYVDY

SEQ ID NO: 549761 - protein, 9 aa, Homo Sapiens
LTSACTPER

SEQ ID NO: 549762 - protein, 9 aa, Homo Sapiens
PLWCSCRLS

SEQ ID NO: 549763 - protein, 9 aa, Homo Sapiens
GEAHLCPGV

SEQ ID NO: 549764 - protein, 9 aa, Homo Sapiens
HDGYRSPEY

SEQ ID NO: 549765 - protein, 9 aa, Homo Sapiens
SQSSATGPR

SEQ ID NO: 549766 - protein, 9 aa, Homo Sapiens
TGLRHPAAH

SEQ ID NO: 549767 - protein, 9 aa, Homo Sapiens
GRQHRGPFQ

SEQ ID NO: 549768 - protein, 9 aa, Homo Sapiens
VQVHVTLGN

SEQ ID NO: 549769 - protein, 9 aa, Homo Sapiens
DSDPCFSGG

SEQ ID NO: 549770 - protein, 9 aa, Homo Sapiens
EIKPGELAK

SEQ ID NO: 549771 - protein, 9 aa, Homo Sapiens
LFLPISHCQ

SEQ ID NO: 549772 - protein, 9 aa, Homo Sapiens
ERNEKEESD

SEQ ID NO: 549773 - protein, 9 aa, Homo Sapiens
LENISVTLV

SEQ ID NO: 549774 - protein, 9 aa, Homo Sapiens
LCLLLLLSP

SEQ ID NO: 549775 - protein, 9 aa, Homo Sapiens
WCSCRLSHN

SEQ ID NO: 549776 - protein, 9 aa, Homo Sapiens
AHAHRVQLP

SEQ ID NO: 549777 - protein, 9 aa, Homo Sapiens
NVFNKTEFS

SEQ ID NO: 549778 - protein, 9 aa, Homo Sapiens
NKLQPRVIK

SEQ ID NO: 549779 - protein, 9 aa, Homo Sapiens
ITEAEWQEH

SEQ ID NO: 549780 - protein, 9 aa, Homo Sapiens
HLGSSEMQG

SEQ ID NO: 549781 - protein, 9 aa, Homo Sapiens
LGCSVENAA

SEQ ID NO: 549782 - protein, 9 aa, Homo Sapiens
PEPLIPKES

SEQ ID NO: 549783 - protein, 9 aa, Homo Sapiens
AHPLCLLLL

SEQ ID NO: 549784 - protein, 9 aa, Homo Sapiens
YQAYPEYLL

SEQ ID NO: 549785 - protein, 9 aa, Homo Sapiens
PSHSAASTL

SEQ ID NO: 549786 - protein, 9 aa, Homo Sapiens
MGCIIDAFI

SEQ ID NO: 549787 - protein, 9 aa, Homo Sapiens
SNKGVTSLD

SEQ ID NO: 549788 - protein, 9 aa, Homo Sapiens
VSPNVFNKT

SEQ ID NO: 549789 - protein, 9 aa, Homo Sapiens
PAAHPLCLL

SEQ ID NO: 549790 - protein, 9 aa, Homo Sapiens
PTAAPPVAW

SEQ ID NO: 549791 - protein, 9 aa, Homo Sapiens
PFQKARRSA

SEQ ID NO: 549792 - protein, 9 aa, Homo Sapiens
WRTSPTAAP

SEQ ID NO: 549793 - protein, 9 aa, Homo Sapiens
DRITEAEWQ

SEQ ID NO: 549794 - protein, 9 aa, Homo Sapiens
PSACQGKRL

SEQ ID NO: 549795 - protein, 9 aa, Homo Sapiens
GDAGQSQSS

SEQ ID NO: 549796 - protein, 9 aa, Homo Sapiens
HTRSELTSA

SEQ ID NO: 549797 - protein, 9 aa, Homo Sapiens
LHDSTQLNS

SEQ ID NO: 549798 - protein, 9 aa, Homo Sapiens
RNEKEESDA

SEQ ID NO: 549799 - protein, 9 aa, Homo Sapiens
SRHLPEEAL

SEQ ID NO: 549800 - protein, 9 aa, Homo Sapiens
AGQSQSSAT

SEQ ID NO: 549801 - protein, 9 aa, Homo Sapiens
PGVARPSET

SEQ ID NO: 549802 - protein, 9 aa, Homo Sapiens
LTEGMDPAR

SEQ ID NO: 549803 - protein, 9 aa, Homo Sapiens
SPLWCSCRL

SEQ ID NO: 549804 - protein, 9 aa, Homo Sapiens
AAKAESSLE

SEQ ID NO: 549805 - protein, 9 aa, Homo Sapiens
YLRAGTLEN

SEQ ID NO: 549806 - protein, 9 aa, Homo Sapiens
HDSTQLNSD

SEQ ID NO: 549807 - protein, 9 aa, Homo Sapiens
RAGTLENIS

SEQ ID NO: 549808 - protein, 9 aa, Homo Sapiens
ENISVTLVG

SEQ ID NO: 549809 - protein, 9 aa, Homo Sapiens
RGKMSPKHD

SEQ ID NO: 549810 - protein, 9 aa, Homo Sapiens
TNAYEEQSK

SEQ ID NO: 549811 - protein, 9 aa, Homo Sapiens
ETQWPRLLP

SEQ ID NO: 549812 - protein, 9 aa, Homo Sapiens
SMLTDSLFL

SEQ ID NO: 549813 - protein, 9 aa, Homo Sapiens
NLTWRTSPT

SEQ ID NO: 549814 - protein, 9 aa, Homo Sapiens
STLVAGQAS

SEQ ID NO: 549815 - protein, 9 aa, Homo Sapiens
GDLPLPAPP

SEQ ID NO: 549816 - protein, 9 aa, Homo Sapiens
SEMQGHTMG

SEQ ID NO: 549817 - protein, 9 aa, Homo Sapiens
PERGPFPVP

SEQ ID NO: 549818 - protein, 9 aa, Homo Sapiens
THPSACQGK

SEQ ID NO: 549819 - protein, 9 aa, Homo Sapiens
LRHPAAHPL

SEQ ID NO: 549820 - protein, 9 aa, Homo Sapiens
MQLHDSTQL

SEQ ID NO: 549821 - protein, 9 aa, Homo Sapiens
PVAWATPSR

SEQ ID NO: 549822 - protein, 9 aa, Homo Sapiens
HPAAHPLCL

SEQ ID NO: 549823 - protein, 9 aa, Homo Sapiens
GEDELLFTV

SEQ ID NO: 549824 - protein, 9 aa, Homo Sapiens
SEALLGCSV

SEQ ID NO: 549825 - protein, 9 aa, Homo Sapiens
LSPLWCSCR

SEQ ID NO: 549826 - protein, 9 aa, Homo Sapiens
TKLNYLCHL

SEQ ID NO: 549827 - protein, 9 aa, Homo Sapiens
VGSFTTKLV

SEQ ID NO: 549828 - protein, 9 aa, Homo Sapiens
SVAVLTRWP

SEQ ID NO: 549829 - protein, 9 aa, Homo Sapiens
SPFQKARRS

SEQ ID NO: 549830 - protein, 9 aa, Homo Sapiens
LSHNCWTHT

SEQ ID NO: 549831 - protein, 9 aa, Homo Sapiens
TWRTSPTAA

SEQ ID NO: 549832 - protein, 9 aa, Homo Sapiens
PSCGATSNL

SEQ ID NO: 549833 - protein, 9 aa, Homo Sapiens
IMDYSLDVN

SEQ ID NO: 549834 - protein, 9 aa, Homo Sapiens
SNLTWRTSP

SEQ ID NO: 549835 - protein, 9 aa, Homo Sapiens
QLPTSRHLP

SEQ ID NO: 549836 - protein, 9 aa, Homo Sapiens
WCETGYELW

SEQ ID NO: 549837 - protein, 9 aa, Homo Sapiens
SLFLPISHC

SEQ ID NO: 549838 - protein, 9 aa, Homo Sapiens
HSLSDTRKR

SEQ ID NO: 549839 - protein, 9 aa, Homo Sapiens
EGMDPARLL

SEQ ID NO: 549840 - protein, 9 aa, Homo Sapiens
VQLPTSRHL

SEQ ID NO: 549841 - protein, 9 aa, Homo Sapiens
KSEALLGCS

SEQ ID NO: 549842 - protein, 9 aa, Homo Sapiens
GVGRQHRGP

SEQ ID NO: 549843 - protein, 9 aa, Homo Sapiens
TLTEGMDPA

SEQ ID NO: 549844 - protein, 9 aa, Homo Sapiens
QSQSSATGP

SEQ ID NO: 549845 - protein, 9 aa, Homo Sapiens
RGPFPVPSV

SEQ ID NO: 549846 - protein, 9 aa, Homo Sapiens
LTIGTTHEV

SEQ ID NO: 549847 - protein, 9 aa, Homo Sapiens
THTERRKSP

SEQ ID NO: 549848 - protein, 9 aa, Homo Sapiens
EKLRGKMSP

SEQ ID NO: 549849 - protein, 9 aa, Homo Sapiens
DELLFTVVE

SEQ ID NO: 549850 - protein, 9 aa, Homo Sapiens
PRLLPYSNY

SEQ ID NO: 549851 - protein, 9 aa, Homo Sapiens
ERRKSPPPG

SEQ ID NO: 549852 - protein, 9 aa, Homo Sapiens
QDVPSNKGV

SEQ ID NO: 549853 - protein, 9 aa, Homo Sapiens
FNKTEFSLN

SEQ ID NO: 549854 - protein, 9 aa, Homo Sapiens
VREYRLHER

SEQ ID NO: 549855 - protein, 9 aa, Homo Sapiens
SLTVDADSL

SEQ ID NO: 549856 - protein, 9 aa, Homo Sapiens
PCVVDLKMG

SEQ ID NO: 549857 - protein, 9 aa, Homo Sapiens
GHTMGFWLT

SEQ ID NO: 549858 - protein, 9 aa, Homo Sapiens
KSNIHLSDI

SEQ ID NO: 549859 - protein, 9 aa, Homo Sapiens
PSETHTRSE

SEQ ID NO: 549860 - protein, 9 aa, Homo Sapiens
KPGELAKKR

SEQ ID NO: 549861 - protein, 9 aa, Homo Sapiens
HSYRGHLGS

SEQ ID NO: 549862 - protein, 9 aa, Homo Sapiens
EDELLFTVV

SEQ ID NO: 549863 - protein, 9 aa, Homo Sapiens
LLRSPFQKA

SEQ ID NO: 549864 - protein, 9 aa, Homo Sapiens
SACQGKRLF

SEQ ID NO: 549865 - protein, 9 aa, Homo Sapiens
LLFTVVEEL

SEQ ID NO: 549866 - protein, 9 aa, Homo Sapiens
CPGVARPSE

SEQ ID NO: 549867 - protein, 9 aa, Homo Sapiens
LAHAHRVQL

SEQ ID NO: 549868 - protein, 9 aa, Homo Sapiens
KAESSLEVP

SEQ ID NO: 549869 - protein, 9 aa, Homo Sapiens
RQHRGPFQG

SEQ ID NO: 549870 - protein, 9 aa, Homo Sapiens
NCWTHTERR

SEQ ID NO: 549871 - protein, 9 aa, Homo Sapiens
HPCVVDLKM

SEQ ID NO: 549872 - protein, 9 aa, Homo Sapiens
ELLFTVVEE

SEQ ID NO: 549873 - protein, 9 aa, Homo Sapiens
VPKSMVWCE

SEQ ID NO: 549874 - protein, 9 aa, Homo Sapiens
DTARLWPFK

SEQ ID NO: 549875 - protein, 9 aa, Homo Sapiens
ISEEAFHYL

SEQ ID NO: 549876 - protein, 9 aa, Homo Sapiens
RSPFQKARR

SEQ ID NO: 549877 - protein, 9 aa, Homo Sapiens
SHSAASTLV

SEQ ID NO: 549878 - protein, 9 aa, Homo Sapiens
GESDRETFH

SEQ ID NO: 549879 - protein, 9 aa, Homo Sapiens
HIDTARLWP

SEQ ID NO: 549880 - protein, 9 aa, Homo Sapiens
FIKLLGSPE

SEQ ID NO: 549881 - protein, 9 aa, Homo Sapiens
SIQDDLPFL

SEQ ID NO: 549882 - protein, 9 aa, Homo Sapiens
LLSSHHLLH

SEQ ID NO: 549883 - protein, 9 aa, Homo Sapiens
ATPYPTEQG

SEQ ID NO: 549884 - protein, 9 aa, Homo Sapiens
REGFSCQVF

SEQ ID NO: 549885 - protein, 9 aa, Homo Sapiens
QLGAQLAGM

SEQ ID NO: 549886 - protein, 9 aa, Homo Sapiens
HNDYGRAVD

SEQ ID NO: 549887 - protein, 9 aa, Homo Sapiens
KNRQLTLPE

SEQ ID NO: 549888 - protein, 9 aa, Homo Sapiens
PEEQLGAQL

SEQ ID NO: 549889 - protein, 9 aa, Homo Sapiens
LPRLECMVR

SEQ ID NO: 549890 - protein, 9 aa, Homo Sapiens
GCGKSFTVY

SEQ ID NO: 549891 - protein, 9 aa, Homo Sapiens
YFIKLLGSP

SEQ ID NO: 549892 - protein, 9 aa, Homo Sapiens
PPKFLNPHQ

SEQ ID NO: 549893 - protein, 9 aa, Homo Sapiens
AWWCLQPQP

SEQ ID NO: 549894 - protein, 9 aa, Homo Sapiens
ISAWWCLQP

SEQ ID NO: 549895 - protein, 9 aa, Homo Sapiens
KTSMSLLWK

SEQ ID NO: 549896 - protein, 9 aa, Homo Sapiens
DVVNVDKTN

SEQ ID NO: 549897 - protein, 9 aa, Homo Sapiens
LCDDALFLR

SEQ ID NO: 549898 - protein, 9 aa, Homo Sapiens
GKSFTVYNL

SEQ ID NO: 549899 - protein, 9 aa, Homo Sapiens
QQHQHQHQQ

SEQ ID NO: 549900 - protein, 9 aa, Homo Sapiens
PEIFILSTP

SEQ ID NO: 549901 - protein, 9 aa, Homo Sapiens
SCSIQDDLP

SEQ ID NO: 549902 - protein, 9 aa, Homo Sapiens
GGADENDCQ

SEQ ID NO: 549903 - protein, 9 aa, Homo Sapiens
APEVLEHND

SEQ ID NO: 549904 - protein, 9 aa, Homo Sapiens
TERGPCFPA

SEQ ID NO: 549905 - protein, 9 aa, Homo Sapiens
IFILSTPSP

SEQ ID NO: 549906 - protein, 9 aa, Homo Sapiens
SPRSFCLLS

SEQ ID NO: 549907 - protein, 9 aa, Homo Sapiens
GKISCSIQD

SEQ ID NO: 549908 - protein, 9 aa, Homo Sapiens
QPQPRLLCG

SEQ ID NO: 549909 - protein, 9 aa, Homo Sapiens
VVNVDKTNT

SEQ ID NO: 549910 - protein, 9 aa, Homo Sapiens
NPPKFLNPH

SEQ ID NO: 549911 - protein, 9 aa, Homo Sapiens
YSLVLDSSL

SEQ ID NO: 549912 - protein, 9 aa, Homo Sapiens
SAKYPVPER

SEQ ID NO: 549913 - protein, 9 aa, Homo Sapiens
PHSTGSSEQ

SEQ ID NO: 549914 - protein, 9 aa, Homo Sapiens
LSTPSPILC

SEQ ID NO: 549915 - protein, 9 aa, Homo Sapiens
PNSRQRSGW

SEQ ID NO: 549916 - protein, 9 aa, Homo Sapiens
TSMSLLWKS

SEQ ID NO: 549917 - protein, 9 aa, Homo Sapiens
TQESHLPSP

SEQ ID NO: 549918 - protein, 9 aa, Homo Sapiens
GSSEQIQLS

SEQ ID NO: 549919 - protein, 9 aa, Homo Sapiens
KESCELWRR

SEQ ID NO: 549920 - protein, 9 aa, Homo Sapiens
MGLSRAPWM

SEQ ID NO: 549921 - protein, 9 aa, Homo Sapiens
DCPGGADEN

SEQ ID NO: 549922 - protein, 9 aa, Homo Sapiens
IHTGEKFCK

SEQ ID NO: 549923 - protein, 9 aa, Homo Sapiens
SHLPSPRSF

SEQ ID NO: 549924 - protein, 9 aa, Homo Sapiens
CAPLCDDAL

SEQ ID NO: 549925 - protein, 9 aa, Homo Sapiens
PSRNTEILT

SEQ ID NO: 549926 - protein, 9 aa, Homo Sapiens
LGAQLAGMH

SEQ ID NO: 549927 - protein, 9 aa, Homo Sapiens
VTVASINDS

SEQ ID NO: 549928 - protein, 9 aa, Homo Sapiens
NVQTQESHL

SEQ ID NO: 549929 - protein, 9 aa, Homo Sapiens
CNLFSKKSV

SEQ ID NO: 549930 - protein, 9 aa, Homo Sapiens
PVPERLQEY

SEQ ID NO: 549931 - protein, 9 aa, Homo Sapiens
SPNNPPKFL

SEQ ID NO: 549932 - protein, 9 aa, Homo Sapiens
SFCLLSSHH

SEQ ID NO: 549933 - protein, 9 aa, Homo Sapiens
KENCAPLCD

SEQ ID NO: 549934 - protein, 9 aa, Homo Sapiens
CFPAKENVQ

SEQ ID NO: 549935 - protein, 9 aa, Homo Sapiens
GLSRAPWMG

SEQ ID NO: 549936 - protein, 9 aa, Homo Sapiens
IKLLGSPES

SEQ ID NO: 549937 - protein, 9 aa, Homo Sapiens
SPNSRQRSG

SEQ ID NO: 549938 - protein, 9 aa, Homo Sapiens
TDSGAIMAN

SEQ ID NO: 549939 - protein, 9 aa, Homo Sapiens
GVYHVTFIY

SEQ ID NO: 549940 - protein, 9 aa, Homo Sapiens
SEQIQLSGM

SEQ ID NO: 549941 - protein, 9 aa, Homo Sapiens
YPTEQGPQG

SEQ ID NO: 549942 - protein, 9 aa, Homo Sapiens
CPGPVTPCS

SEQ ID NO: 549943 - protein, 9 aa, Homo Sapiens
FSSAKYPVP

SEQ ID NO: 549944 - protein, 9 aa, Homo Sapiens
AKYPVPERL

SEQ ID NO: 549945 - protein, 9 aa, Homo Sapiens
QDDKNRQLT

SEQ ID NO: 549946 - protein, 9 aa, Homo Sapiens
YPVPERLQE

SEQ ID NO: 549947 - protein, 9 aa, Homo Sapiens
QLAGMHTLL

SEQ ID NO: 549948 - protein, 9 aa, Homo Sapiens
KHNRPHRDC

SEQ ID NO: 549949 - protein, 9 aa, Homo Sapiens
AKLWACNLF

SEQ ID NO: 549950 - protein, 9 aa, Homo Sapiens
ARRGAKVKF

SEQ ID NO: 549951 - protein, 9 aa, Homo Sapiens
ALSQTGFSY

SEQ ID NO: 549952 - protein, 9 aa, Homo Sapiens
PGPVTPCSD

SEQ ID NO: 549953 - protein, 9 aa, Homo Sapiens
QMTRDSTGV

SEQ ID NO: 549954 - protein, 9 aa, Homo Sapiens
SLDRERVSA

SEQ ID NO: 549955 - protein, 9 aa, Homo Sapiens
LTQMTRDST

SEQ ID NO: 549956 - protein, 9 aa, Homo Sapiens
GPCFPAKEN

SEQ ID NO: 549957 - protein, 9 aa, Homo Sapiens
AAAEAALSQ

SEQ ID NO: 549958 - protein, 9 aa, Homo Sapiens
LAPEVLEHN

SEQ ID NO: 549959 - protein, 9 aa, Homo Sapiens
DCNELPPSR

SEQ ID NO: 549960 - protein, 9 aa, Homo Sapiens
VTPCSDLES

SEQ ID NO: 549961 - protein, 9 aa, Homo Sapiens
DGNTSPNSR

SEQ ID NO: 549962 - protein, 9 aa, Homo Sapiens
DHVRDCPGG

SEQ ID NO: 549963 - protein, 9 aa, Homo Sapiens
WWCLQPQPR

SEQ ID NO: 549964 - protein, 9 aa, Homo Sapiens
EEQLGAQLA

SEQ ID NO: 549965 - protein, 9 aa, Homo Sapiens
RTGKKKMSK

SEQ ID NO: 549966 - protein, 9 aa, Homo Sapiens
MSGRTGKKK

SEQ ID NO: 549967 - protein, 9 aa, Homo Sapiens
RDSTGVEST

SEQ ID NO: 549968 - protein, 9 aa, Homo Sapiens
PTEQGPQGK

SEQ ID NO: 549969 - protein, 9 aa, Homo Sapiens
PGVYHVTFI

SEQ ID NO: 549970 - protein, 9 aa, Homo Sapiens
CQGMEGDYH

SEQ ID NO: 549971 - protein, 9 aa, Homo Sapiens
LDQKTSMSL

SEQ ID NO: 549972 - protein, 9 aa, Homo Sapiens
YHVTFIYCA

SEQ ID NO: 549973 - protein, 9 aa, Homo Sapiens
APLCDDALF

SEQ ID NO: 549974 - protein, 9 aa, Homo Sapiens
LPEIFILST

SEQ ID NO: 549975 - protein, 9 aa, Homo Sapiens
LYVTGGRCQ

SEQ ID NO: 549976 - protein, 9 aa, Homo Sapiens
VPGVYHVTF

SEQ ID NO: 549977 - protein, 9 aa, Homo Sapiens
KRKARRGAK

SEQ ID NO: 549978 - protein, 9 aa, Homo Sapiens
TMIQLTQMT

SEQ ID NO: 549979 - protein, 9 aa, Homo Sapiens
EVLEHNDYG

SEQ ID NO: 549980 - protein, 9 aa, Homo Sapiens
SEKESCELW

SEQ ID NO: 549981 - protein, 9 aa, Homo Sapiens
PEVLEHNDY

SEQ ID NO: 549982 - protein, 9 aa, Homo Sapiens
EDCNELPPS

SEQ ID NO: 549983 - protein, 9 aa, Homo Sapiens
DKTNTDICF

SEQ ID NO: 549984 - protein, 9 aa, Homo Sapiens
IQLTQMTRD

SEQ ID NO: 549985 - protein, 9 aa, Homo Sapiens
EIFILSTPS

SEQ ID NO: 549986 - protein, 9 aa, Homo Sapiens
LSSHHLLHP

SEQ ID NO: 549987 - protein, 9 aa, Homo Sapiens
PYPTEQGPQ

SEQ ID NO: 549988 - protein, 9 aa, Homo Sapiens
DSGAIMANR

SEQ ID NO: 549989 - protein, 9 aa, Homo Sapiens
LPEEQLGAQ

SEQ ID NO: 549990 - protein, 9 aa, Homo Sapiens
EYYDGNTSP

SEQ ID NO: 549991 - protein, 9 aa, Homo Sapiens
RGPCFPAKE

SEQ ID NO: 549992 - protein, 9 aa, Homo Sapiens
SSEQIQLSG

SEQ ID NO: 549993 - protein, 9 aa, Homo Sapiens
PCSDLESHS

SEQ ID NO: 549994 - protein, 9 aa, Homo Sapiens
KYPVPERLQ

SEQ ID NO: 549995 - protein, 9 aa, Homo Sapiens
TGKKKMSKL

SEQ ID NO: 549996 - protein, 9 aa, Homo Sapiens
SKKSVSSSL

SEQ ID NO: 549997 - protein, 9 aa, Homo Sapiens
LNPHQPPKH

SEQ ID NO: 549998 - protein, 9 aa, Homo Sapiens
ENCAPLCDD

SEQ ID NO: 549999 - protein, 9 aa, Homo Sapiens
LECMVRSGL

SEQ ID NO: 550000 - protein, 9 aa, Homo Sapiens
NNPPKFLNP

SEQ ID NO: 550001 - protein, 9 aa, Homo Sapiens
IYFIKLLGS

SEQ ID NO: 550002 - protein, 9 aa, Homo Sapiens
HRDCVAEGK

SEQ ID NO: 550003 - protein, 9 aa, Homo Sapiens
CPGGADEND

SEQ ID NO: 550004 - protein, 9 aa, Homo Sapiens
TRDSTGVES

SEQ ID NO: 550005 - protein, 9 aa, Homo Sapiens
YVTGGRCQG

SEQ ID NO: 550006 - protein, 9 aa, Homo Sapiens
DDLPFLLKS

SEQ ID NO: 550007 - protein, 9 aa, Homo Sapiens
YVIYFIKLL

SEQ ID NO: 550008 - protein, 9 aa, Homo Sapiens
FLEISAWWC

SEQ ID NO: 550009 - protein, 9 aa, Homo Sapiens
AATPYPTEQ

SEQ ID NO: 550010 - protein, 9 aa, Homo Sapiens
QQQHQHQHQ

SEQ ID NO: 550011 - protein, 9 aa, Homo Sapiens
AVLPRLECM

SEQ ID NO: 550012 - protein, 9 aa, Homo Sapiens
VLCYVIYFI

SEQ ID NO: 550013 - protein, 9 aa, Homo Sapiens
QDDLPFLLK

SEQ ID NO: 550014 - protein, 9 aa, Homo Sapiens
HVRDCPGGA

SEQ ID NO: 550015 - protein, 9 aa, Homo Sapiens
ELWRRKGAK

SEQ ID NO: 550016 - protein, 9 aa, Homo Sapiens
GEVTVASIN

SEQ ID NO: 550017 - protein, 9 aa, Homo Sapiens
SSLDRERVS

SEQ ID NO: 550018 - protein, 9 aa, Homo Sapiens
SSLFLEISA

SEQ ID NO: 550019 - protein, 9 aa, Homo Sapiens
FFIQMKVIL

SEQ ID NO: 550020 - protein, 9 aa, Homo Sapiens
STGSSEQIQ

SEQ ID NO: 550021 - protein, 9 aa, Homo Sapiens
HLPSPRSFC

SEQ ID NO: 550022 - protein, 9 aa, Homo Sapiens
TQMTRDSTG

SEQ ID NO: 550023 - protein, 9 aa, Homo Sapiens
VPERLQEYG

SEQ ID NO: 550024 - protein, 9 aa, Homo Sapiens
KTNTDICFE

SEQ ID NO: 550025 - protein, 9 aa, Homo Sapiens
RGAKVKFEE

SEQ ID NO: 550026 - protein, 9 aa, Homo Sapiens
INDSEELLA

SEQ ID NO: 550027 - protein, 9 aa, Homo Sapiens
SINDSEELL

SEQ ID NO: 550028 - protein, 9 aa, Homo Sapiens
SVSSSLWRH

SEQ ID NO: 550029 - protein, 9 aa, Homo Sapiens
CDHVRDCPG

SEQ ID NO: 550030 - protein, 9 aa, Homo Sapiens
RDCPGGADE

SEQ ID NO: 550031 - protein, 9 aa, Homo Sapiens
NVDKTNTDI

SEQ ID NO: 550032 - protein, 9 aa, Homo Sapiens
GGRCQGMEG

SEQ ID NO: 550033 - protein, 9 aa, Homo Sapiens
NRPHRDCVA

SEQ ID NO: 550034 - protein, 9 aa, Homo Sapiens
RAKLWACNL

SEQ ID NO: 550035 - protein, 9 aa, Homo Sapiens
ELTDSGAIM

SEQ ID NO: 550036 - protein, 9 aa, Homo Sapiens
TNTDICFEN

SEQ ID NO: 550037 - protein, 9 aa, Homo Sapiens
CGLFPGSQQ

SEQ ID NO: 550038 - protein, 9 aa, Homo Sapiens
GFSCQVFHL

SEQ ID NO: 550039 - protein, 9 aa, Homo Sapiens
SYQDDKNRQ

SEQ ID NO: 550040 - protein, 9 aa, Homo Sapiens
FSKKSVSSS

SEQ ID NO: 550041 - protein, 9 aa, Homo Sapiens
EGFSCQVFH

SEQ ID NO: 550042 - protein, 9 aa, Homo Sapiens
LHPLLIVRH

SEQ ID NO: 550043 - protein, 9 aa, Homo Sapiens
IQDDLPFLL

SEQ ID NO: 550044 - protein, 9 aa, Homo Sapiens
VIYFIKLLG

SEQ ID NO: 550045 - protein, 9 aa, Homo Sapiens
VQTQESHLP

SEQ ID NO: 550046 - protein, 9 aa, Homo Sapiens
KVILRNKTS

SEQ ID NO: 550047 - protein, 9 aa, Homo Sapiens
PNNPPKFLN

SEQ ID NO: 550048 - protein, 9 aa, Homo Sapiens
VDKTNTDIC

SEQ ID NO: 550049 - protein, 9 aa, Homo Sapiens
LLCGLFPGS

SEQ ID NO: 550050 - protein, 9 aa, Homo Sapiens
CELWRRKGA

SEQ ID NO: 550051 - protein, 9 aa, Homo Sapiens
TPCSDLESH

SEQ ID NO: 550052 - protein, 9 aa, Homo Sapiens
GAIMANRFV

SEQ ID NO: 550053 - protein, 9 aa, Homo Sapiens
PKFLNPHQP

SEQ ID NO: 550054 - protein, 9 aa, Homo Sapiens
TFIYCAVKG

SEQ ID NO: 550055 - protein, 9 aa, Homo Sapiens
DDKNRQLTL

SEQ ID NO: 550056 - protein, 9 aa, Homo Sapiens
EQLGAQLAG

SEQ ID NO: 550057 - protein, 9 aa, Homo Sapiens
GAKVKFEER

SEQ ID NO: 550058 - protein, 9 aa, Homo Sapiens
QMKVILRNK

SEQ ID NO: 550059 - protein, 9 aa, Homo Sapiens
TEQGPQGKA

SEQ ID NO: 550060 - protein, 9 aa, Homo Sapiens
IKHNRPHRD

SEQ ID NO: 550061 - protein, 9 aa, Homo Sapiens
KARRGAKVK

SEQ ID NO: 550062 - protein, 9 aa, Homo Sapiens
LSRAPWMGR

SEQ ID NO: 550063 - protein, 9 aa, Homo Sapiens
NTSPNSRQR

SEQ ID NO: 550064 - protein, 9 aa, Homo Sapiens
YDGNTSPNS

SEQ ID NO: 550065 - protein, 9 aa, Homo Sapiens
WACNLFSKK

SEQ ID NO: 550066 - protein, 9 aa, Homo Sapiens
LEISAWWCL

SEQ ID NO: 550067 - protein, 9 aa, Homo Sapiens
PLCDDALFL

SEQ ID NO: 550068 - protein, 9 aa, Homo Sapiens
FPGSQQAQF

SEQ ID NO: 550069 - protein, 9 aa, Homo Sapiens
SFCPGPVTP

SEQ ID NO: 550070 - protein, 9 aa, Homo Sapiens
GQLDQKTSM

SEQ ID NO: 550071 - protein, 9 aa, Homo Sapiens
MLSYQDDKN

SEQ ID NO: 550072 - protein, 9 aa, Homo Sapiens
HPLLIVRHY

SEQ ID NO: 550073 - protein, 9 aa, Homo Sapiens
SHHLLHPLL

SEQ ID NO: 550074 - protein, 9 aa, Homo Sapiens
AAEAALSQT

SEQ ID NO: 550075 - protein, 9 aa, Homo Sapiens
AKENVQLMS

SEQ ID NO: 550076 - protein, 9 aa, Homo Sapiens
ALKRKARRG

SEQ ID NO: 550077 - protein, 9 aa, Homo Sapiens
KKSVSSSLW

SEQ ID NO: 550078 - protein, 9 aa, Homo Sapiens
LFPGSQQAQ

SEQ ID NO: 550079 - protein, 9 aa, Homo Sapiens
RLECMVRSG

SEQ ID NO: 550080 - protein, 9 aa, Homo Sapiens
PKTSSLFLE

SEQ ID NO: 550081 - protein, 9 aa, Homo Sapiens
VNVDKTNTD

SEQ ID NO: 550082 - protein, 9 aa, Homo Sapiens
VTGGRCQGM

SEQ ID NO: 550083 - protein, 9 aa, Homo Sapiens
AEAALSQTG

SEQ ID NO: 550084 - protein, 9 aa, Homo Sapiens
TGSSEQIQL

SEQ ID NO: 550085 - protein, 9 aa, Homo Sapiens
EKFCKCEEC

SEQ ID NO: 550086 - protein, 9 aa, Homo Sapiens
IIHTGEKFC

SEQ ID NO: 550087 - protein, 9 aa, Homo Sapiens
LPRPQEDDE

SEQ ID NO: 550088 - protein, 9 aa, Homo Sapiens
IQMKVILRN

SEQ ID NO: 550089 - protein, 9 aa, Homo Sapiens
GVESTTLPK

SEQ ID NO: 550090 - protein, 9 aa, Homo Sapiens
YLAPEVLEH

SEQ ID NO: 550091 - protein, 9 aa, Homo Sapiens
HLLHPLLIV

SEQ ID NO: 550092 - protein, 9 aa, Homo Sapiens
KISCSIQDD

SEQ ID NO: 550093 - protein, 9 aa, Homo Sapiens
KTSSLFLEI

SEQ ID NO: 550094 - protein, 9 aa, Homo Sapiens
GNTSPNSRQ

SEQ ID NO: 550095 - protein, 9 aa, Homo Sapiens
DQKTSMSLL

SEQ ID NO: 550096 - protein, 9 aa, Homo Sapiens
PHRDCVAEG

SEQ ID NO: 550097 - protein, 9 aa, Homo Sapiens
EHNDYGRAV

SEQ ID NO: 550098 - protein, 9 aa, Homo Sapiens
CYVIYFIKL

SEQ ID NO: 550099 - protein, 9 aa, Homo Sapiens
GEKFCKCEE

SEQ ID NO: 550100 - protein, 9 aa, Homo Sapiens
ELPPSRNTE

SEQ ID NO: 550101 - protein, 9 aa, Homo Sapiens
VASINDSEE

SEQ ID NO: 550102 - protein, 9 aa, Homo Sapiens
PCFPAKENV

SEQ ID NO: 550103 - protein, 9 aa, Homo Sapiens
RLLCGLFPG

SEQ ID NO: 550104 - protein, 9 aa, Homo Sapiens
TGVESTTLP

SEQ ID NO: 550105 - protein, 9 aa, Homo Sapiens
STGVESTTL

SEQ ID NO: 550106 - protein, 9 aa, Homo Sapiens
PVTPCSDLE

SEQ ID NO: 550107 - protein, 9 aa, Homo Sapiens
ILSTPSPIL

SEQ ID NO: 550108 - protein, 9 aa, Homo Sapiens
LTDSGAIMA

SEQ ID NO: 550109 - protein, 9 aa, Homo Sapiens
SRNTEILTG

SEQ ID NO: 550110 - protein, 9 aa, Homo Sapiens
KQQDMPGSP

SEQ ID NO: 550111 - protein, 9 aa, Homo Sapiens
IKENCAPLC

SEQ ID NO: 550112 - protein, 9 aa, Homo Sapiens
RRGAKVKFE

SEQ ID NO: 550113 - protein, 9 aa, Homo Sapiens
TVASINDSE

SEQ ID NO: 550114 - protein, 9 aa, Homo Sapiens
LDIKHNRPH

SEQ ID NO: 550115 - protein, 9 aa, Homo Sapiens
KLWACNLFS

SEQ ID NO: 550116 - protein, 9 aa, Homo Sapiens
QVFHLTMAQ

SEQ ID NO: 550117 - protein, 9 aa, Homo Sapiens
LDSSLDRER

SEQ ID NO: 550118 - protein, 9 aa, Homo Sapiens
KFCKCEECG

SEQ ID NO: 550119 - protein, 9 aa, Homo Sapiens
DMPGSPDHR

SEQ ID NO: 550120 - protein, 9 aa, Homo Sapiens
FPAKENVQL

SEQ ID NO: 550121 - protein, 9 aa, Homo Sapiens
QESHLPSPR

SEQ ID NO: 550122 - protein, 9 aa, Homo Sapiens
CGKSFTVYN

SEQ ID NO: 550123 - protein, 9 aa, Homo Sapiens
FTVYNLKAH

SEQ ID NO: 550124 - protein, 9 aa, Homo Sapiens
EGCGKSFTV

SEQ ID NO: 550125 - protein, 9 aa, Homo Sapiens
IMANRFVSS

SEQ ID NO: 550126 - protein, 9 aa, Homo Sapiens
SMSLLWKSY

SEQ ID NO: 550127 - protein, 9 aa, Homo Sapiens
SAWWCLQPQ

SEQ ID NO: 550128 - protein, 9 aa, Homo Sapiens
QLTQMTRDS

SEQ ID NO: 550129 - protein, 9 aa, Homo Sapiens
QLDQKTSMS

SEQ ID NO: 550130 - protein, 9 aa, Homo Sapiens
FSCQVFHLT

SEQ ID NO: 550131 - protein, 9 aa, Homo Sapiens
PPSRNTEIL

SEQ ID NO: 550132 - protein, 9 aa, Homo Sapiens
HQHQHQQQQ

SEQ ID NO: 550133 - protein, 9 aa, Homo Sapiens
WCLQPQPRL

SEQ ID NO: 550134 - protein, 9 aa, Homo Sapiens
LQPQPRLLC

SEQ ID NO: 550135 - protein, 9 aa, Homo Sapiens
HHLLHPLLI

SEQ ID NO: 550136 - protein, 9 aa, Homo Sapiens
PRLECMVRS

SEQ ID NO: 550137 - protein, 9 aa, Homo Sapiens
CQVFHLTMA

SEQ ID NO: 550138 - protein, 9 aa, Homo Sapiens
FCLLSSHHL

SEQ ID NO: 550139 - protein, 9 aa, Homo Sapiens
SGAIMANRF

SEQ ID NO: 550140 - protein, 9 aa, Homo Sapiens
LSYQDDKNR

SEQ ID NO: 550141 - protein, 9 aa, Homo Sapiens
RSFCLLSSH

SEQ ID NO: 550142 - protein, 9 aa, Homo Sapiens
TPPPPGKPQ

SEQ ID NO: 550143 - protein, 9 aa, Homo Sapiens
ESHLPSPRS

SEQ ID NO: 550144 - protein, 9 aa, Homo Sapiens
STTLPKTSS

SEQ ID NO: 550145 - protein, 9 aa, Homo Sapiens
TPQQAQTLG

SEQ ID NO: 550146 - protein, 9 aa, Homo Sapiens
CLLSSHHLL

SEQ ID NO: 550147 - protein, 9 aa, Homo Sapiens
KRKQQDMPG

SEQ ID NO: 550148 - protein, 9 aa, Homo Sapiens
SLFLEISAW

SEQ ID NO: 550149 - protein, 9 aa, Homo Sapiens
SCELWRRKG

SEQ ID NO: 550150 - protein, 9 aa, Homo Sapiens
PLPEIFILS

SEQ ID NO: 550151 - protein, 9 aa, Homo Sapiens
FLNPHQPPK

SEQ ID NO: 550152 - protein, 9 aa, Homo Sapiens
LFSKKSVSS

SEQ ID NO: 550153 - protein, 9 aa, Homo Sapiens
GRCQGMEGD

SEQ ID NO: 550154 - protein, 9 aa, Homo Sapiens
FILSTPSPI

SEQ ID NO: 550155 - protein, 9 aa, Homo Sapiens
LFLEISAWW

SEQ ID NO: 550156 - protein, 9 aa, Homo Sapiens
DSSLDRERV

SEQ ID NO: 550157 - protein, 9 aa, Homo Sapiens
TTLPKTSSL

SEQ ID NO: 550158 - protein, 9 aa, Homo Sapiens
MKVILRNKT

SEQ ID NO: 550159 - protein, 9 aa, Homo Sapiens
MPGSPDHRD

SEQ ID NO: 550160 - protein, 9 aa, Homo Sapiens
TPYPTEQGP

SEQ ID NO: 550161 - protein, 9 aa, Homo Sapiens
LWRRKGAKI

SEQ ID NO: 550162 - protein, 9 aa, Homo Sapiens
SSHHLLHPL

SEQ ID NO: 550163 - protein, 9 aa, Homo Sapiens
RAAAEAALS

SEQ ID NO: 550164 - protein, 9 aa, Homo Sapiens
EVTVASIND

SEQ ID NO: 550165 - protein, 9 aa, Homo Sapiens
NTDICFENV

SEQ ID NO: 550166 - protein, 9 aa, Homo Sapiens
CDDALFLRT

SEQ ID NO: 550167 - protein, 9 aa, Homo Sapiens
VESTTLPKT

SEQ ID NO: 550168 - protein, 9 aa, Homo Sapiens
ACNLFSKKS

SEQ ID NO: 550169 - protein, 9 aa, Homo Sapiens
LPPSRNTEI

SEQ ID NO: 550170 - protein, 9 aa, Homo Sapiens
TSEKESCEL

SEQ ID NO: 550171 - protein, 9 aa, Homo Sapiens
AIMANRFVS

SEQ ID NO: 550172 - protein, 9 aa, Homo Sapiens
PRSFCLLSS

SEQ ID NO: 550173 - protein, 9 aa, Homo Sapiens
GLFPGSQQA

SEQ ID NO: 550174 - protein, 9 aa, Homo Sapiens
YYDGNTSPN

SEQ ID NO: 550175 - protein, 9 aa, Homo Sapiens
RCQGMEGDY

SEQ ID NO: 550176 - protein, 9 aa, Homo Sapiens
HSTGSSEQI

SEQ ID NO: 550177 - protein, 9 aa, Homo Sapiens
LVPGVYHVT

SEQ ID NO: 550178 - protein, 9 aa, Homo Sapiens
AQLAGMHTL

SEQ ID NO: 550179 - protein, 9 aa, Homo Sapiens
LWACNLFSK

SEQ ID NO: 550180 - protein, 9 aa, Homo Sapiens
NCAPLCDDA

SEQ ID NO: 550181 - protein, 9 aa, Homo Sapiens
VLPRLECMV

SEQ ID NO: 550182 - protein, 9 aa, Homo Sapiens
EMLSYQDDK

SEQ ID NO: 550183 - protein, 9 aa, Homo Sapiens
PQPRLLCGL

SEQ ID NO: 550184 - protein, 9 aa, Homo Sapiens
RPHRDCVAE

SEQ ID NO: 550185 - protein, 9 aa, Homo Sapiens
HTGEKFCKC

SEQ ID NO: 550186 - protein, 9 aa, Homo Sapiens
LPKTSSLFL

SEQ ID NO: 550187 - protein, 9 aa, Homo Sapiens
LCGLFPGSQ

SEQ ID NO: 550188 - protein, 9 aa, Homo Sapiens
KFLNPHQPP

SEQ ID NO: 550189 - protein, 9 aa, Homo Sapiens
QQQQHQHQH

SEQ ID NO: 550190 - protein, 9 aa, Homo Sapiens
QNVQTQESH

SEQ ID NO: 550191 - protein, 9 aa, Homo Sapiens
KSVSSSLWR

SEQ ID NO: 550192 - protein, 9 aa, Homo Sapiens
ERGPCFPAK

SEQ ID NO: 550193 - protein, 9 aa, Homo Sapiens
SCQVFHLTM

SEQ ID NO: 550194 - protein, 9 aa, Homo Sapiens
ESTTLPKTS

SEQ ID NO: 550195 - protein, 9 aa, Homo Sapiens
FCPGPVTPC

SEQ ID NO: 550196 - protein, 9 aa, Homo Sapiens
DKNRQLTLP

SEQ ID NO: 550197 - protein, 9 aa, Homo Sapiens
SFTVYNLKA

SEQ ID NO: 550198 - protein, 9 aa, Homo Sapiens
LEHNDYGRA

SEQ ID NO: 550199 - protein, 9 aa, Homo Sapiens
QQDMPGSPD

SEQ ID NO: 550200 - protein, 9 aa, Homo Sapiens
MTRDSTGVE

SEQ ID NO: 550201 - protein, 9 aa, Homo Sapiens
LKRKARRGA

SEQ ID NO: 550202 - protein, 9 aa, Homo Sapiens
LRAAAEAAL

SEQ ID NO: 550203 - protein, 9 aa, Homo Sapiens
VRDCPGGAD

SEQ ID NO: 550204 - protein, 9 aa, Homo Sapiens
VYHVTFIYC

SEQ ID NO: 550205 - protein, 9 aa, Homo Sapiens
FIQMKVILR

SEQ ID NO: 550206 - protein, 9 aa, Homo Sapiens
HVTFIYCAV

SEQ ID NO: 550207 - protein, 9 aa, Homo Sapiens
HNRPHRDCV

SEQ ID NO: 550208 - protein, 9 aa, Homo Sapiens
VTFIYCAVK

SEQ ID NO: 550209 - protein, 9 aa, Homo Sapiens
VSSSLWRHI

SEQ ID NO: 550210 - protein, 9 aa, Homo Sapiens
PGGADENDC

SEQ ID NO: 550211 - protein, 9 aa, Homo Sapiens
PAKENVQLM

SEQ ID NO: 550212 - protein, 9 aa, Homo Sapiens
FCKCEECGK

SEQ ID NO: 550213 - protein, 9 aa, Homo Sapiens
TLPKTSSLF

SEQ ID NO: 550214 - protein, 9 aa, Homo Sapiens
TGEKFCKCE

SEQ ID NO: 550215 - protein, 9 aa, Homo Sapiens
PLLIVRHYK

SEQ ID NO: 550216 - protein, 9 aa, Homo Sapiens
ITMIQLTQM

SEQ ID NO: 550217 - protein, 9 aa, Homo Sapiens
QGPQGKAAD

SEQ ID NO: 550218 - protein, 9 aa, Homo Sapiens
LVLDSSLDR

SEQ ID NO: 550219 - protein, 9 aa, Homo Sapiens
TSSLFLEIS

SEQ ID NO: 550220 - protein, 9 aa, Homo Sapiens
MIQLTQMTR

SEQ ID NO: 550221 - protein, 9 aa, Homo Sapiens
VLDSSLDRE

SEQ ID NO: 550222 - protein, 9 aa, Homo Sapiens
EAALSQTGF

SEQ ID NO: 550223 - protein, 9 aa, Homo Sapiens
QTQESHLPS

SEQ ID NO: 550224 - protein, 9 aa, Homo Sapiens
TGGRCQGME

SEQ ID NO: 550225 - protein, 9 aa, Homo Sapiens
RKQQDMPGS

SEQ ID NO: 550226 - protein, 9 aa, Homo Sapiens
QPRLLCGLF

SEQ ID NO: 550227 - protein, 9 aa, Homo Sapiens
IKRKQQDMP

SEQ ID NO: 550228 - protein, 9 aa, Homo Sapiens
LLIVRHYKI

SEQ ID NO: 550229 - protein, 9 aa, Homo Sapiens
PSPRSFCLL

SEQ ID NO: 550230 - protein, 9 aa, Homo Sapiens
NIKRKQQDM

SEQ ID NO: 550231 - protein, 9 aa, Homo Sapiens
EKESCELWR

SEQ ID NO: 550232 - protein, 9 aa, Homo Sapiens
LSQTGFSYD

SEQ ID NO: 550233 - protein, 9 aa, Homo Sapiens
ASINDSEEL

SEQ ID NO: 550234 - protein, 9 aa, Homo Sapiens
DSTGVESTT

SEQ ID NO: 550235 - protein, 9 aa, Homo Sapiens
NDSEELLAT

SEQ ID NO: 550236 - protein, 9 aa, Homo Sapiens
ESCELWRRK

SEQ ID NO: 550237 - protein, 9 aa, Homo Sapiens
LFFIQMKVI

SEQ ID NO: 550238 - protein, 9 aa, Homo Sapiens
KSFTVYNLK

SEQ ID NO: 550239 - protein, 9 aa, Homo Sapiens
PRLLCGLFP

SEQ ID NO: 550240 - protein, 9 aa, Homo Sapiens
LTPQQAQTL

SEQ ID NO: 550241 - protein, 9 aa, Homo Sapiens
CNELPPSRN

SEQ ID NO: 550242 - protein, 9 aa, Homo Sapiens
IREGFSCQV

SEQ ID NO: 550243 - protein, 9 aa, Homo Sapiens
RKARRGAKV

SEQ ID NO: 550244 - protein, 9 aa, Homo Sapiens
LPSPRSFCL

SEQ ID NO: 550245 - protein, 9 aa, Homo Sapiens
MLFFIQMKV

SEQ ID NO: 550246 - protein, 9 aa, Homo Sapiens
DIKHNRPHR

SEQ ID NO: 550247 - protein, 9 aa, Homo Sapiens
SGRTGKKKM

SEQ ID NO: 550248 - protein, 9 aa, Homo Sapiens
VFSSAKYPV

SEQ ID NO: 550249 - protein, 9 aa, Homo Sapiens
LLHPLLIVR

SEQ ID NO: 550250 - protein, 9 aa, Homo Sapiens
EISAWWCLQ

SEQ ID NO: 550251 - protein, 9 aa, Homo Sapiens
QDMPGSPDH

SEQ ID NO: 550252 - protein, 9 aa, Homo Sapiens
GRTGKKKMS

SEQ ID NO: 550253 - protein, 9 aa, Homo Sapiens
AALSQTGFS

SEQ ID NO: 550254 - protein, 9 aa, Homo Sapiens
SLVLDSSLD

SEQ ID NO: 550255 - protein, 9 aa, Homo Sapiens
QIQLSGMYN

SEQ ID NO: 550256 - protein, 9 aa, Homo Sapiens
TSPNSRQRS

SEQ ID NO: 550257 - protein, 9 aa, Homo Sapiens
ISCSIQDDL

SEQ ID NO: 550258 - protein, 9 aa, Homo Sapiens
EPLPEIFIL

SEQ ID NO: 550259 - protein, 9 aa, Homo Sapiens
EQIQLSGMY

SEQ ID NO: 550260 - protein, 9 aa, Homo Sapiens
NELPPSRNT

SEQ ID NO: 550261 - protein, 9 aa, Homo Sapiens
YYSLVLDSS

SEQ ID NO: 550262 - protein, 9 aa, Homo Sapiens
LELTDSGAI

SEQ ID NO: 550263 - protein, 9 aa, Homo Sapiens
CLQPQPRLL

SEQ ID NO: 550264 - protein, 9 aa, Homo Sapiens
LIVRHYKIT

SEQ ID NO: 550265 - protein, 9 aa, Homo Sapiens
VLEHNDYGR

SEQ ID NO: 550266 - protein, 9 aa, Homo Sapiens
GAQLAGMHT

SEQ ID NO: 550267 - protein, 9 aa, Homo Sapiens
QHQHQHQQQ

SEQ ID NO: 550268 - protein, 9 aa, Homo Sapiens
VILRNKTSI

SEQ ID NO: 550269 - protein, 9 aa, Homo Sapiens
ALPRPQEDD

SEQ ID NO: 550270 - protein, 9 aa, Homo Sapiens
NLFSKKSVS

SEQ ID NO: 550271 - protein, 9 aa, Homo Sapiens
SSAKYPVPE

SEQ ID NO: 550272 - protein, 9 aa, Homo Sapiens
YQDDKNRQL

SEQ ID NO: 550273 - protein, 9 aa, Homo Sapiens
LCYVIYFIK

SEQ ID NO: 550274 - protein, 9 aa, Homo Sapiens
ALYVTGGRC

SEQ ID NO: 550275 - protein, 9 aa, Homo Sapiens
GPVTPCSDL

SEQ ID NO: 550276 - protein, 9 aa, Homo Sapiens
QKTSMSLLW

SEQ ID NO: 550277 - protein, 9 aa, Homo Sapiens
EGQLDQKTS

SEQ ID NO: 550278 - protein, 9 aa, Homo Sapiens
EQGPQGKAA

SEQ ID NO: 550279 - protein, 9 aa, Homo Sapiens
TLPIAYARS

SEQ ID NO: 550280 - protein, 9 aa, Homo Sapiens
YVFTLPIAY

SEQ ID NO: 550281 - protein, 9 aa, Homo Sapiens
GRTGAGQPG

SEQ ID NO: 550282 - protein, 9 aa, Homo Sapiens
RAPACGLSA

SEQ ID NO: 550283 - protein, 9 aa, Homo Sapiens
RCVDLELSI

SEQ ID NO: 550284 - protein, 9 aa, Homo Sapiens
DSSSLEETG

SEQ ID NO: 550285 - protein, 9 aa, Homo Sapiens
ARNATCSHY

SEQ ID NO: 550286 - protein, 9 aa, Homo Sapiens
WPQGAPPSH

SEQ ID NO: 550287 - protein, 9 aa, Homo Sapiens
ALRPRLFTH

SEQ ID NO: 550288 - protein, 9 aa, Homo Sapiens
PISHCQCIL

SEQ ID NO: 550289 - protein, 9 aa, Homo Sapiens
HRGGRLSDF

SEQ ID NO: 550290 - protein, 9 aa, Homo Sapiens
LSEGCCSCS

SEQ ID NO: 550291 - protein, 9 aa, Homo Sapiens
ADSRKGMEE

SEQ ID NO: 550292 - protein, 9 aa, Homo Sapiens
SADHLFFKS

SEQ ID NO: 550293 - protein, 9 aa, Homo Sapiens
SEQTTADSR

SEQ ID NO: 550294 - protein, 9 aa, Homo Sapiens
PTVRRDGGE

SEQ ID NO: 550295 - protein, 9 aa, Homo Sapiens
ELNGITLLG

SEQ ID NO: 550296 - protein, 9 aa, Homo Sapiens
AWAGRTGAG

SEQ ID NO: 550297 - protein, 9 aa, Homo Sapiens
GAPPSHREA

SEQ ID NO: 550298 - protein, 9 aa, Homo Sapiens
RDWKCRYDV

SEQ ID NO: 550299 - protein, 9 aa, Homo Sapiens
QPRQPGPQG

SEQ ID NO: 550300 - protein, 9 aa, Homo Sapiens
SSLEETGAS

SEQ ID NO: 550301 - protein, 9 aa, Homo Sapiens
EPCGRSWST

SEQ ID NO: 550302 - protein, 9 aa, Homo Sapiens
YIHTHTFYV

SEQ ID NO: 550303 - protein, 9 aa, Homo Sapiens
ACFTQGLAE

SEQ ID NO: 550304 - protein, 9 aa, Homo Sapiens
DVTQQDRSQ

SEQ ID NO: 550305 - protein, 9 aa, Homo Sapiens
GRSWSTCHR

SEQ ID NO: 550306 - protein, 9 aa, Homo Sapiens
TPASKPQSD

SEQ ID NO: 550307 - protein, 9 aa, Homo Sapiens
VSTPASKPQ

SEQ ID NO: 550308 - protein, 9 aa, Homo Sapiens
VTSPRIETA

SEQ ID NO: 550309 - protein, 9 aa, Homo Sapiens
FYTEPCGRS

SEQ ID NO: 550310 - protein, 9 aa, Homo Sapiens
AILLQISKD

SEQ ID NO: 550311 - protein, 9 aa, Homo Sapiens
MAAAAAQCR

SEQ ID NO: 550312 - protein, 9 aa, Homo Sapiens
TALRPRLFT

SEQ ID NO: 550313 - protein, 9 aa, Homo Sapiens
SSRPLPLQP

SEQ ID NO: 550314 - protein, 9 aa, Homo Sapiens
RRDSSSLEE

SEQ ID NO: 550315 - protein, 9 aa, Homo Sapiens
LPISHCQCI

SEQ ID NO: 550316 - protein, 9 aa, Homo Sapiens
PPTVRRDGG

SEQ ID NO: 550317 - protein, 9 aa, Homo Sapiens
DEEADQPTT

SEQ ID NO: 550318 - protein, 9 aa, Homo Sapiens
KCRYDVGIS

SEQ ID NO: 550319 - protein, 9 aa, Homo Sapiens
ILREGQLAV

SEQ ID NO: 550320 - protein, 9 aa, Homo Sapiens
ATCSHYTQL

SEQ ID NO: 550321 - protein, 9 aa, Homo Sapiens
QIRCCTDDV

SEQ ID NO: 550322 - protein, 9 aa, Homo Sapiens
EEYVFTLPI

SEQ ID NO: 550323 - protein, 9 aa, Homo Sapiens
VGLFSCFLY

SEQ ID NO: 550324 - protein, 9 aa, Homo Sapiens
PLETPAQLL

SEQ ID NO: 550325 - protein, 9 aa, Homo Sapiens
CHLSMLTDS

SEQ ID NO: 550326 - protein, 9 aa, Homo Sapiens
SGDELLELN

SEQ ID NO: 550327 - protein, 9 aa, Homo Sapiens
PGPQGSSRP

SEQ ID NO: 550328 - protein, 9 aa, Homo Sapiens
LKEPPVDIF

SEQ ID NO: 550329 - protein, 9 aa, Homo Sapiens
PEFSFNVPR

SEQ ID NO: 550330 - protein, 9 aa, Homo Sapiens
SCSTQWRPW

SEQ ID NO: 550331 - protein, 9 aa, Homo Sapiens
PTALRPRLF

SEQ ID NO: 550332 - protein, 9 aa, Homo Sapiens
LTDSLFLPI

SEQ ID NO: 550333 - protein, 9 aa, Homo Sapiens
RARDWKCRY

SEQ ID NO: 550334 - protein, 9 aa, Homo Sapiens
LPGSSVQLL

SEQ ID NO: 550335 - protein, 9 aa, Homo Sapiens
VFTLPIAYA

SEQ ID NO: 550336 - protein, 9 aa, Homo Sapiens
IRCCTDDVR

SEQ ID NO: 550337 - protein, 9 aa, Homo Sapiens
LSAQPWRLR

SEQ ID NO: 550338 - protein, 9 aa, Homo Sapiens
RRAAVETLG

SEQ ID NO: 550339 - protein, 9 aa, Homo Sapiens
CCTDDVRPQ

SEQ ID NO: 550340 - protein, 9 aa, Homo Sapiens
GARPSQPRA

SEQ ID NO: 550341 - protein, 9 aa, Homo Sapiens
MAVSTPASK

SEQ ID NO: 550342 - protein, 9 aa, Homo Sapiens
EAWAGRTGA

SEQ ID NO: 550343 - protein, 9 aa, Homo Sapiens
KRRAAVETL

SEQ ID NO: 550344 - protein, 9 aa, Homo Sapiens
YYCSWTHSQ

SEQ ID NO: 550345 - protein, 9 aa, Homo Sapiens
PAQLLLRDI

SEQ ID NO: 550346 - protein, 9 aa, Homo Sapiens
DSRKGMEEI

SEQ ID NO: 550347 - protein, 9 aa, Homo Sapiens
HGARPSQPR

SEQ ID NO: 550348 - protein, 9 aa, Homo Sapiens
GQEMYILRE

SEQ ID NO: 550349 - protein, 9 aa, Homo Sapiens
PSRPPTVRR

SEQ ID NO: 550350 - protein, 9 aa, Homo Sapiens
LTPTSADKR

SEQ ID NO: 550351 - protein, 9 aa, Homo Sapiens
WPSELDLRL

SEQ ID NO: 550352 - protein, 9 aa, Homo Sapiens
HTVDFYTEP

SEQ ID NO: 550353 - protein, 9 aa, Homo Sapiens
EKTICHQTF

SEQ ID NO: 550354 - protein, 9 aa, Homo Sapiens
TATDSGSLP

SEQ ID NO: 550355 - protein, 9 aa, Homo Sapiens
NYLCHLSML

SEQ ID NO: 550356 - protein, 9 aa, Homo Sapiens
GACFTQGLA

SEQ ID NO: 550357 - protein, 9 aa, Homo Sapiens
SQPEPNWPS

SEQ ID NO: 550358 - protein, 9 aa, Homo Sapiens
LPIERERSG

SEQ ID NO: 550359 - protein, 9 aa, Homo Sapiens
ENLVEMHNK

SEQ ID NO: 550360 - protein, 9 aa, Homo Sapiens
YCSWTHSQL

SEQ ID NO: 550361 - protein, 9 aa, Homo Sapiens
KTIDGILLP

SEQ ID NO: 550362 - protein, 9 aa, Homo Sapiens
FFKSLNSAS

SEQ ID NO: 550363 - protein, 9 aa, Homo Sapiens
DHLFFKSLN

SEQ ID NO: 550364 - protein, 9 aa, Homo Sapiens
SHYTQLVWA

SEQ ID NO: 550365 - protein, 9 aa, Homo Sapiens
FSFNVPRAK

SEQ ID NO: 550366 - protein, 9 aa, Homo Sapiens
SSSSLTPRL

SEQ ID NO: 550367 - protein, 9 aa, Homo Sapiens
ALYTEIMSS

SEQ ID NO: 550368 - protein, 9 aa, Homo Sapiens
GGRLSDFYD

SEQ ID NO: 550369 - protein, 9 aa, Homo Sapiens
KHMPKDSIL

SEQ ID NO: 550370 - protein, 9 aa, Homo Sapiens
PIAYARSIL

SEQ ID NO: 550371 - protein, 9 aa, Homo Sapiens
CRYDVGISA

SEQ ID NO: 550372 - protein, 9 aa, Homo Sapiens
SWTHSQLAQ

SEQ ID NO: 550373 - protein, 9 aa, Homo Sapiens
DWKCRYDVG

SEQ ID NO: 550374 - protein, 9 aa, Homo Sapiens
RPPTVRRDG

SEQ ID NO: 550375 - protein, 9 aa, Homo Sapiens
QWRPWEKTI

SEQ ID NO: 550376 - protein, 9 aa, Homo Sapiens
GLLVTKLNY

SEQ ID NO: 550377 - protein, 9 aa, Homo Sapiens
DSKDVTQQD

SEQ ID NO: 550378 - protein, 9 aa, Homo Sapiens
LREGQLAVV

SEQ ID NO: 550379 - protein, 9 aa, Homo Sapiens
TSPRIETAS

SEQ ID NO: 550380 - protein, 9 aa, Homo Sapiens
SADIKHYYV

SEQ ID NO: 550381 - protein, 9 aa, Homo Sapiens
QPGPQGSSR

SEQ ID NO: 550382 - protein, 9 aa, Homo Sapiens
SLEETGASH

SEQ ID NO: 550383 - protein, 9 aa, Homo Sapiens
DSKFSQSTG

SEQ ID NO: 550384 - protein, 9 aa, Homo Sapiens
RLPDCSWPQ

SEQ ID NO: 550385 - protein, 9 aa, Homo Sapiens
TEIMSSFRS

SEQ ID NO: 550386 - protein, 9 aa, Homo Sapiens
FRARDWKCR

SEQ ID NO: 550387 - protein, 9 aa, Homo Sapiens
GSSVWPAPW

SEQ ID NO: 550388 - protein, 9 aa, Homo Sapiens
VDFYTEPCG

SEQ ID NO: 550389 - protein, 9 aa, Homo Sapiens
QGTDSKDVT

SEQ ID NO: 550390 - protein, 9 aa, Homo Sapiens
LLRRGFGYC

SEQ ID NO: 550391 - protein, 9 aa, Homo Sapiens
PEPNWPSEL

SEQ ID NO: 550392 - protein, 9 aa, Homo Sapiens
LSMLTDSLF

SEQ ID NO: 550393 - protein, 9 aa, Homo Sapiens
HSWLSEGCC

SEQ ID NO: 550394 - protein, 9 aa, Homo Sapiens
DHRGGRLSD

SEQ ID NO: 550395 - protein, 9 aa, Homo Sapiens
KHQLELMDT

SEQ ID NO: 550396 - protein, 9 aa, Homo Sapiens
THDGLLVTK

SEQ ID NO: 550397 - protein, 9 aa, Homo Sapiens
ILLLEDVTW

SEQ ID NO: 550398 - protein, 9 aa, Homo Sapiens
FTQGLAEVA

SEQ ID NO: 550399 - protein, 9 aa, Homo Sapiens
AEPTENRET

SEQ ID NO: 550400 - protein, 9 aa, Homo Sapiens
YLCHLSMLT

SEQ ID NO: 550401 - protein, 9 aa, Homo Sapiens
LEETGASHT

SEQ ID NO: 550402 - protein, 9 aa, Homo Sapiens
CCSCSTQWR

SEQ ID NO: 550403 - protein, 9 aa, Homo Sapiens
FKSLNSASY

SEQ ID NO: 550404 - protein, 9 aa, Homo Sapiens
CVDLELSIM

SEQ ID NO: 550405 - protein, 9 aa, Homo Sapiens
EMYILREGQ

SEQ ID NO: 550406 - protein, 9 aa, Homo Sapiens
ERSITMTKS

SEQ ID NO: 550407 - protein, 9 aa, Homo Sapiens
LLSSRYAIL

SEQ ID NO: 550408 - protein, 9 aa, Homo Sapiens
LGACFTQGL

SEQ ID NO: 550409 - protein, 9 aa, Homo Sapiens
PDCSWPQGA

SEQ ID NO: 550410 - protein, 9 aa, Homo Sapiens
MSLLRRGFG

SEQ ID NO: 550411 - protein, 9 aa, Homo Sapiens
SRTGSLPGS

SEQ ID NO: 550412 - protein, 9 aa, Homo Sapiens
LRWPSEEFL

SEQ ID NO: 550413 - protein, 9 aa, Homo Sapiens
LFFKSLNSA

SEQ ID NO: 550414 - protein, 9 aa, Homo Sapiens
ERMAAAAAQ

SEQ ID NO: 550415 - protein, 9 aa, Homo Sapiens
IDGILLPIE

SEQ ID NO: 550416 - protein, 9 aa, Homo Sapiens
DGILLPIER

SEQ ID NO: 550417 - protein, 9 aa, Homo Sapiens
FKVGLFSCF

SEQ ID NO: 550418 - protein, 9 aa, Homo Sapiens
SWPQGAPPS

SEQ ID NO: 550419 - protein, 9 aa, Homo Sapiens
RPSQPRAPA

SEQ ID NO: 550420 - protein, 9 aa, Homo Sapiens
FSGDELLEL

SEQ ID NO: 550421 - protein, 9 aa, Homo Sapiens
DSILLLEDV

SEQ ID NO: 550422 - protein, 9 aa, Homo Sapiens
NATCSHYTQ

SEQ ID NO: 550423 - protein, 9 aa, Homo Sapiens
SAQPWRLRL

SEQ ID NO: 550424 - protein, 9 aa, Homo Sapiens
SRPPTVRRD

SEQ ID NO: 550425 - protein, 9 aa, Homo Sapiens
IYLEPGPSS

SEQ ID NO: 550426 - protein, 9 aa, Homo Sapiens
PRAPACGLS

SEQ ID NO: 550427 - protein, 9 aa, Homo Sapiens
PLQPSRPPT

SEQ ID NO: 550428 - protein, 9 aa, Homo Sapiens
RMAAAAAQC

SEQ ID NO: 550429 - protein, 9 aa, Homo Sapiens
SEEFLVQED

SEQ ID NO: 550430 - protein, 9 aa, Homo Sapiens
GELRWPSEE

SEQ ID NO: 550431 - protein, 9 aa, Homo Sapiens
YTEIMSSFR

SEQ ID NO: 550432 - protein, 9 aa, Homo Sapiens
KLNYLCHLS

SEQ ID NO: 550433 - protein, 9 aa, Homo Sapiens
PKDSILLLE

SEQ ID NO: 550434 - protein, 9 aa, Homo Sapiens
HLGACFTQG

SEQ ID NO: 550435 - protein, 9 aa, Homo Sapiens
QPEPNWPSE

SEQ ID NO: 550436 - protein, 9 aa, Homo Sapiens
PVDSKFSQS

SEQ ID NO: 550437 - protein, 9 aa, Homo Sapiens
SEGCCSCST

SEQ ID NO: 550438 - protein, 9 aa, Homo Sapiens
SSRYAILLQ

SEQ ID NO: 550439 - protein, 9 aa, Homo Sapiens
TASQKRTEV

SEQ ID NO: 550440 - protein, 9 aa, Homo Sapiens
FNVPRAKRE

SEQ ID NO: 550441 - protein, 9 aa, Homo Sapiens
NGLPIEEGL

SEQ ID NO: 550442 - protein, 9 aa, Homo Sapiens
TSADKRRAA

SEQ ID NO: 550443 - protein, 9 aa, Homo Sapiens
AMSLLRRGF

SEQ ID NO: 550444 - protein, 9 aa, Homo Sapiens
TKIYYCSWT

SEQ ID NO: 550445 - protein, 9 aa, Homo Sapiens
GQPGQPRQP

SEQ ID NO: 550446 - protein, 9 aa, Homo Sapiens
NLVEMHNKA

SEQ ID NO: 550447 - protein, 9 aa, Homo Sapiens
CSWPQGAPP

SEQ ID NO: 550448 - protein, 9 aa, Homo Sapiens
PPSHREAWA

SEQ ID NO: 550449 - protein, 9 aa, Homo Sapiens
CPTSYCTAL

SEQ ID NO: 550450 - protein, 9 aa, Homo Sapiens
WTHSQLAQF

SEQ ID NO: 550451 - protein, 9 aa, Homo Sapiens
WAGRTGAGQ

SEQ ID NO: 550452 - protein, 9 aa, Homo Sapiens
SLLRRGFGY

SEQ ID NO: 550453 - protein, 9 aa, Homo Sapiens
PRQPGPQGS

SEQ ID NO: 550454 - protein, 9 aa, Homo Sapiens
ADKRRAAVE

SEQ ID NO: 550455 - protein, 9 aa, Homo Sapiens
PGQPRQPGP

SEQ ID NO: 550456 - protein, 9 aa, Homo Sapiens
LSADHLFFK

SEQ ID NO: 550457 - protein, 9 aa, Homo Sapiens
LCHLSMLTD

SEQ ID NO: 550458 - protein, 9 aa, Homo Sapiens
ARRDSSSLE

SEQ ID NO: 550459 - protein, 9 aa, Homo Sapiens
TVDFYTEPC

SEQ ID NO: 550460 - protein, 9 aa, Homo Sapiens
STQWRPWEK

SEQ ID NO: 550461 - protein, 9 aa, Homo Sapiens
SSSVDLWET

SEQ ID NO: 550462 - protein, 9 aa, Homo Sapiens
PSHREAWAG

SEQ ID NO: 550463 - protein, 9 aa, Homo Sapiens
QPRAPACGL

SEQ ID NO: 550464 - protein, 9 aa, Homo Sapiens
LETPAQLLL

SEQ ID NO: 550465 - protein, 9 aa, Homo Sapiens
SRYAILLQI

SEQ ID NO: 550466 - protein, 9 aa, Homo Sapiens
RIWGLPHSW

SEQ ID NO: 550467 - protein, 9 aa, Homo Sapiens
RQPGPQGSS

SEQ ID NO: 550468 - protein, 9 aa, Homo Sapiens
PACGLSAQP

SEQ ID NO: 550469 - protein, 9 aa, Homo Sapiens
NYQLIPPVP

SEQ ID NO: 550470 - protein, 9 aa, Homo Sapiens
SSVDLWETA

SEQ ID NO: 550471 - protein, 9 aa, Homo Sapiens
VCENGLPIE

SEQ ID NO: 550472 - protein, 9 aa, Homo Sapiens
TDLLSSRYA

SEQ ID NO: 550473 - protein, 9 aa, Homo Sapiens
MEDEEADQP

SEQ ID NO: 550474 - protein, 9 aa, Homo Sapiens
MENLVEMHN

SEQ ID NO: 550475 - protein, 9 aa, Homo Sapiens
GEESRCVDL

SEQ ID NO: 550476 - protein, 9 aa, Homo Sapiens
YYVSEVLAM

SEQ ID NO: 550477 - protein, 9 aa, Homo Sapiens
HIYIHTHTF

SEQ ID NO: 550478 - protein, 9 aa, Homo Sapiens
VTQQDRSQC

SEQ ID NO: 550479 - protein, 9 aa, Homo Sapiens
PCGRSWSTC

SEQ ID NO: 550480 - protein, 9 aa, Homo Sapiens
VHLLDDNIS

SEQ ID NO: 550481 - protein, 9 aa, Homo Sapiens
EPNWPSELD

SEQ ID NO: 550482 - protein, 9 aa, Homo Sapiens
SVWPAPWHS

SEQ ID NO: 550483 - protein, 9 aa, Homo Sapiens
CENGLPIEE

SEQ ID NO: 550484 - protein, 9 aa, Homo Sapiens
ILALYTEIM

SEQ ID NO: 550485 - protein, 9 aa, Homo Sapiens
PGSSVQLLQ

SEQ ID NO: 550486 - protein, 9 aa, Homo Sapiens
STPASKPQS

SEQ ID NO: 550487 - protein, 9 aa, Homo Sapiens
LRLPDCSWP

SEQ ID NO: 550488 - protein, 9 aa, Homo Sapiens
CARNATCSH

SEQ ID NO: 550489 - protein, 9 aa, Homo Sapiens
VDSKFSQST

SEQ ID NO: 550490 - protein, 9 aa, Homo Sapiens
KIYYCSWTH

SEQ ID NO: 550491 - protein, 9 aa, Homo Sapiens
PQGAPPSHR

SEQ ID NO: 550492 - protein, 9 aa, Homo Sapiens
LQKHLGACF

SEQ ID NO: 550493 - protein, 9 aa, Homo Sapiens
PAPWHSPRI

SEQ ID NO: 550494 - protein, 9 aa, Homo Sapiens
RDSSSLEET

SEQ ID NO: 550495 - protein, 9 aa, Homo Sapiens
IYYCSWTHS

SEQ ID NO: 550496 - protein, 9 aa, Homo Sapiens
GTDLLSSRY

SEQ ID NO: 550497 - protein, 9 aa, Homo Sapiens
SSSLEETGA

SEQ ID NO: 550498 - protein, 9 aa, Homo Sapiens
SFNVPRAKR

SEQ ID NO: 550499 - protein, 9 aa, Homo Sapiens
EIMSSFRSV

SEQ ID NO: 550500 - protein, 9 aa, Homo Sapiens
LVTKLNYLC

SEQ ID NO: 550501 - protein, 9 aa, Homo Sapiens
ADIKHYYVS

SEQ ID NO: 550502 - protein, 9 aa, Homo Sapiens
RIYLEPGPS

SEQ ID NO: 550503 - protein, 9 aa, Homo Sapiens
SRCVDLELS

SEQ ID NO: 550504 - protein, 9 aa, Homo Sapiens
IYTHIYIHT

SEQ ID NO: 550505 - protein, 9 aa, Homo Sapiens
KKHMPKDSI

SEQ ID NO: 550506 - protein, 9 aa, Homo Sapiens
QPGQPRQPG

SEQ ID NO: 550507 - protein, 9 aa, Homo Sapiens
WRPWEKTIC

SEQ ID NO: 550508 - protein, 9 aa, Homo Sapiens
AQPWRLRLP

SEQ ID NO: 550509 - protein, 9 aa, Homo Sapiens
TNILALYTE

SEQ ID NO: 550510 - protein, 9 aa, Homo Sapiens
LLPIERERS

SEQ ID NO: 550511 - protein, 9 aa, Homo Sapiens
LRRGFGYCG

SEQ ID NO: 550512 - protein, 9 aa, Homo Sapiens
ITATDSGSL

SEQ ID NO: 550513 - protein, 9 aa, Homo Sapiens
ITKIYYCSW

SEQ ID NO: 550514 - protein, 9 aa, Homo Sapiens
AVSTPASKP

SEQ ID NO: 550515 - protein, 9 aa, Homo Sapiens
EDEEADQPT

SEQ ID NO: 550516 - protein, 9 aa, Homo Sapiens
GSSRPLPLQ

SEQ ID NO: 550517 - protein, 9 aa, Homo Sapiens
RLRLPDCSW

SEQ ID NO: 550518 - protein, 9 aa, Homo Sapiens
PFRARDWKC

SEQ ID NO: 550519 - protein, 9 aa, Homo Sapiens
QKHQLELMD

SEQ ID NO: 550520 - protein, 9 aa, Homo Sapiens
CSWTHSQLA

SEQ ID NO: 550521 - protein, 9 aa, Homo Sapiens
SVLQKHQLE

SEQ ID NO: 550522 - protein, 9 aa, Homo Sapiens
TMMVPVDSK

SEQ ID NO: 550523 - protein, 9 aa, Homo Sapiens
TPTSADKRR

SEQ ID NO: 550524 - protein, 9 aa, Homo Sapiens
CTALTYYLD

SEQ ID NO: 550525 - protein, 9 aa, Homo Sapiens
YTHIYIHTH

SEQ ID NO: 550526 - protein, 9 aa, Homo Sapiens
EFSSSVDLW

SEQ ID NO: 550527 - protein, 9 aa, Homo Sapiens
HMPKDSILL

SEQ ID NO: 550528 - protein, 9 aa, Homo Sapiens
ESGELRWPS

SEQ ID NO: 550529 - protein, 9 aa, Homo Sapiens
WLSEGCCSC

SEQ ID NO: 550530 - protein, 9 aa, Homo Sapiens
MLTDSLFLP

SEQ ID NO: 550531 - protein, 9 aa, Homo Sapiens
PCPTSYCTA

SEQ ID NO: 550532 - protein, 9 aa, Homo Sapiens
PSSSSLTPR

SEQ ID NO: 550533 - protein, 9 aa, Homo Sapiens
SSPTALRPR

SEQ ID NO: 550534 - protein, 9 aa, Homo Sapiens
LPIAYARSI

SEQ ID NO: 550535 - protein, 9 aa, Homo Sapiens
PSQPRAPAC

SEQ ID NO: 550536 - protein, 9 aa, Homo Sapiens
TNNSVLQKH

SEQ ID NO: 550537 - protein, 9 aa, Homo Sapiens
PQGSSRPLP

SEQ ID NO: 550538 - protein, 9 aa, Homo Sapiens
TSQPEPNWP

SEQ ID NO: 550539 - protein, 9 aa, Homo Sapiens
FTLPIAYAR

SEQ ID NO: 550540 - protein, 9 aa, Homo Sapiens
APWHSPRIW

SEQ ID NO: 550541 - protein, 9 aa, Homo Sapiens
ESRCVDLEL

SEQ ID NO: 550542 - protein, 9 aa, Homo Sapiens
YAILLQISK

SEQ ID NO: 550543 - protein, 9 aa, Homo Sapiens
PRIETASQK

SEQ ID NO: 550544 - protein, 9 aa, Homo Sapiens
MMVPVDSKF

SEQ ID NO: 550545 - protein, 9 aa, Homo Sapiens
RPWEKTICH

SEQ ID NO: 550546 - protein, 9 aa, Homo Sapiens
GDELLELNG

SEQ ID NO: 550547 - protein, 9 aa, Homo Sapiens
MHNKAPVWN

SEQ ID NO: 550548 - protein, 9 aa, Homo Sapiens
SVDLWETAL

SEQ ID NO: 550549 - protein, 9 aa, Homo Sapiens
ADHLFFKSL

SEQ ID NO: 550550 - protein, 9 aa, Homo Sapiens
VLQKHQLEL

SEQ ID NO: 550551 - protein, 9 aa, Homo Sapiens
VEMHNKAPV

SEQ ID NO: 550552 - protein, 9 aa, Homo Sapiens
NNSVLQKHQ

SEQ ID NO: 550553 - protein, 9 aa, Homo Sapiens
LPLQPSRPP

SEQ ID NO: 550554 - protein, 9 aa, Homo Sapiens
CHRRQCWLR

SEQ ID NO: 550555 - protein, 9 aa, Homo Sapiens
DCSWPQGAP

SEQ ID NO: 550556 - protein, 9 aa, Homo Sapiens
LIPPVPGIS

SEQ ID NO: 550557 - protein, 9 aa, Homo Sapiens
CYQIRCCTD

SEQ ID NO: 550558 - protein, 9 aa, Homo Sapiens
EDEDHRGGR

SEQ ID NO: 550559 - protein, 9 aa, Homo Sapiens
PTSADKRRA

SEQ ID NO: 550560 - protein, 9 aa, Homo Sapiens
LPHSWLSEG

SEQ ID NO: 550561 - protein, 9 aa, Homo Sapiens
VWPAPWHSP

SEQ ID NO: 550562 - protein, 9 aa, Homo Sapiens
RIETASQKR

SEQ ID NO: 550563 - protein, 9 aa, Homo Sapiens
GSSVQLLQD

SEQ ID NO: 550564 - protein, 9 aa, Homo Sapiens
DKRRAAVET

SEQ ID NO: 550565 - protein, 9 aa, Homo Sapiens
WPAPWHSPR

SEQ ID NO: 550566 - protein, 9 aa, Homo Sapiens
CGRSWSTCH

SEQ ID NO: 550567 - protein, 9 aa, Homo Sapiens
EQTTADSRK

SEQ ID NO: 550568 - protein, 9 aa, Homo Sapiens
PWRLRLPDC

SEQ ID NO: 550569 - protein, 9 aa, Homo Sapiens
WKCRYDVGI

SEQ ID NO: 550570 - protein, 9 aa, Homo Sapiens
CRGEESRCV

SEQ ID NO: 550571 - protein, 9 aa, Homo Sapiens
WPSEEFLVQ

SEQ ID NO: 550572 - protein, 9 aa, Homo Sapiens
YIYTHIYIH

SEQ ID NO: 550573 - protein, 9 aa, Homo Sapiens
KESERSITM

SEQ ID NO: 550574 - protein, 9 aa, Homo Sapiens
EESRCVDLE

SEQ ID NO: 550575 - protein, 9 aa, Homo Sapiens
HYYVSEVLA

SEQ ID NO: 550576 - protein, 9 aa, Homo Sapiens
GFGYCGGSS

SEQ ID NO: 550577 - protein, 9 aa, Homo Sapiens
IYIHTHTFY

SEQ ID NO: 550578 - protein, 9 aa, Homo Sapiens
FGKESERSI

SEQ ID NO: 550579 - protein, 9 aa, Homo Sapiens
SHREAWAGR

SEQ ID NO: 550580 - protein, 9 aa, Homo Sapiens
LFSCFLYLY

SEQ ID NO: 550581 - protein, 9 aa, Homo Sapiens
VSEVLAMNF

SEQ ID NO: 550582 - protein, 9 aa, Homo Sapiens
LELNGITLL

SEQ ID NO: 550583 - protein, 9 aa, Homo Sapiens
VKPEFSFNV

SEQ ID NO: 550584 - protein, 9 aa, Homo Sapiens
YCTALTYYL

SEQ ID NO: 550585 - protein, 9 aa, Homo Sapiens
QEMYILREG

SEQ ID NO: 550586 - protein, 9 aa, Homo Sapiens
LALYTEIMS

SEQ ID NO: 550587 - protein, 9 aa, Homo Sapiens
LQKHQLELM

SEQ ID NO: 550588 - protein, 9 aa, Homo Sapiens
QLIPPVPGI

SEQ ID NO: 550589 - protein, 9 aa, Homo Sapiens
CGGSSVWPA

SEQ ID NO: 550590 - protein, 9 aa, Homo Sapiens
LNGITLLGE

SEQ ID NO: 550591 - protein, 9 aa, Homo Sapiens
SARRDSSSL

SEQ ID NO: 550592 - protein, 9 aa, Homo Sapiens
HREAWAGRT

SEQ ID NO: 550593 - protein, 9 aa, Homo Sapiens
VGFCYQIRC

SEQ ID NO: 550594 - protein, 9 aa, Homo Sapiens
EITMMVPVD

SEQ ID NO: 550595 - protein, 9 aa, Homo Sapiens
ESERSITMT

SEQ ID NO: 550596 - protein, 9 aa, Homo Sapiens
KDVTQQDRS

SEQ ID NO: 550597 - protein, 9 aa, Homo Sapiens
LPDCSWPQG

SEQ ID NO: 550598 - protein, 9 aa, Homo Sapiens
GTDSKDVTQ

SEQ ID NO: 550599 - protein, 9 aa, Homo Sapiens
YILREGQLA

SEQ ID NO: 550600 - protein, 9 aa, Homo Sapiens
WHSPRIWGL

SEQ ID NO: 550601 - protein, 9 aa, Homo Sapiens
TCHRRQCWL

SEQ ID NO: 550602 - protein, 9 aa, Homo Sapiens
YTEPCGRSW

SEQ ID NO: 550603 - protein, 9 aa, Homo Sapiens
EYVFTLPIA

SEQ ID NO: 550604 - protein, 9 aa, Homo Sapiens
WRLRLPDCS

SEQ ID NO: 550605 - protein, 9 aa, Homo Sapiens
RNATCSHYT

SEQ ID NO: 550606 - protein, 9 aa, Homo Sapiens
DSLFLPISH

SEQ ID NO: 550607 - protein, 9 aa, Homo Sapiens
PLPLQPSRP

SEQ ID NO: 550608 - protein, 9 aa, Homo Sapiens
LPIEEGLSC

SEQ ID NO: 550609 - protein, 9 aa, Homo Sapiens
AGRTGAGQP

SEQ ID NO: 550610 - protein, 9 aa, Homo Sapiens
ECRGEESRC

SEQ ID NO: 550611 - protein, 9 aa, Homo Sapiens
YVSEVLAMN

SEQ ID NO: 550612 - protein, 9 aa, Homo Sapiens
PIEEGLSCN

SEQ ID NO: 550613 - protein, 9 aa, Homo Sapiens
HQLELMDTV

SEQ ID NO: 550614 - protein, 9 aa, Homo Sapiens
RGGRLSDFY

SEQ ID NO: 550615 - protein, 9 aa, Homo Sapiens
FSSSVDLWE

SEQ ID NO: 550616 - protein, 9 aa, Homo Sapiens
CSHYTQLVW

SEQ ID NO: 550617 - protein, 9 aa, Homo Sapiens
ACGLSAQPW

SEQ ID NO: 550618 - protein, 9 aa, Homo Sapiens
LEPGPSSSS

SEQ ID NO: 550619 - protein, 9 aa, Homo Sapiens
KPEFSFNVP

SEQ ID NO: 550620 - protein, 9 aa, Homo Sapiens
LRPRLFTHG

SEQ ID NO: 550621 - protein, 9 aa, Homo Sapiens
AAMSLLRRG

SEQ ID NO: 550622 - protein, 9 aa, Homo Sapiens
HDGLLVTKL

SEQ ID NO: 550623 - protein, 9 aa, Homo Sapiens
SLPGSSVQL

SEQ ID NO: 550624 - protein, 9 aa, Homo Sapiens
SPTALRPRL

SEQ ID NO: 550625 - protein, 9 aa, Homo Sapiens
EPGPSSSSL

SEQ ID NO: 550626 - protein, 9 aa, Homo Sapiens
STCHRRQCW

SEQ ID NO: 550627 - protein, 9 aa, Homo Sapiens
FLPISHCQC

SEQ ID NO: 550628 - protein, 9 aa, Homo Sapiens
SWSTCHRRQ

SEQ ID NO: 550629 - protein, 9 aa, Homo Sapiens
TGSLPGSSV

SEQ ID NO: 550630 - protein, 9 aa, Homo Sapiens
MYILREGQL

SEQ ID NO: 550631 - protein, 9 aa, Homo Sapiens
GKESERSIT

SEQ ID NO: 550632 - protein, 9 aa, Homo Sapiens
RVTSPRIET

SEQ ID NO: 550633 - protein, 9 aa, Homo Sapiens
GGSSVWPAP

SEQ ID NO: 550634 - protein, 9 aa, Homo Sapiens
TEPCGRSWS

SEQ ID NO: 550635 - protein, 9 aa, Homo Sapiens
HSPRIWGLP

SEQ ID NO: 550636 - protein, 9 aa, Homo Sapiens
DIGQEMYIL

SEQ ID NO: 550637 - protein, 9 aa, Homo Sapiens
RTMENLVEM

SEQ ID NO: 550638 - protein, 9 aa, Homo Sapiens
SRPLPLQPS

SEQ ID NO: 550639 - protein, 9 aa, Homo Sapiens
PIERERSGE

SEQ ID NO: 550640 - protein, 9 aa, Homo Sapiens
LLELNGITL

SEQ ID NO: 550641 - protein, 9 aa, Homo Sapiens
DELLELNGI

SEQ ID NO: 550642 - protein, 9 aa, Homo Sapiens
ECARNATCS

SEQ ID NO: 550643 - protein, 9 aa, Homo Sapiens
SADKRRAAV

SEQ ID NO: 550644 - protein, 9 aa, Homo Sapiens
VLSADHLFF

SEQ ID NO: 550645 - protein, 9 aa, Homo Sapiens
SITMTKSIR

SEQ ID NO: 550646 - protein, 9 aa, Homo Sapiens
EFSFNVPRA

SEQ ID NO: 550647 - protein, 9 aa, Homo Sapiens
ETPAQLLLR

SEQ ID NO: 550648 - protein, 9 aa, Homo Sapiens
NVPRAKREL

SEQ ID NO: 550649 - protein, 9 aa, Homo Sapiens
NWPSELDLR

SEQ ID NO: 550650 - protein, 9 aa, Homo Sapiens
ETSQPEPNW

SEQ ID NO: 550651 - protein, 9 aa, Homo Sapiens
CSTQWRPWE

SEQ ID NO: 550652 - protein, 9 aa, Homo Sapiens
MPKDSILLL

SEQ ID NO: 550653 - protein, 9 aa, Homo Sapiens
GLPIEEGLS

SEQ ID NO: 550654 - protein, 9 aa, Homo Sapiens
QKHLGACFT

SEQ ID NO: 550655 - protein, 9 aa, Homo Sapiens
LQPSRPPTV

SEQ ID NO: 550656 - protein, 9 aa, Homo Sapiens
FPCPTSYCT

SEQ ID NO: 550657 - protein, 9 aa, Homo Sapiens
GAGQPGQPR

SEQ ID NO: 550658 - protein, 9 aa, Homo Sapiens
RPRLFTHGP

SEQ ID NO: 550659 - protein, 9 aa, Homo Sapiens
AGQPGQPRQ

SEQ ID NO: 550660 - protein, 9 aa, Homo Sapiens
DIKHYYVSE

SEQ ID NO: 550661 - protein, 9 aa, Homo Sapiens
GPSSSSLTP

SEQ ID NO: 550662 - protein, 9 aa, Homo Sapiens
GYCGGSSVW

SEQ ID NO: 550663 - protein, 9 aa, Homo Sapiens
QGAPPSHRE

SEQ ID NO: 550664 - protein, 9 aa, Homo Sapiens
RSWSTCHRR

SEQ ID NO: 550665 - protein, 9 aa, Homo Sapiens
PHSWLSEGC

SEQ ID NO: 550666 - protein, 9 aa, Homo Sapiens
AQLLLRDIQ

SEQ ID NO: 550667 - protein, 9 aa, Homo Sapiens
EEGLSCNGP

SEQ ID NO: 550668 - protein, 9 aa, Homo Sapiens
DGLLVTKLN

SEQ ID NO: 550669 - protein, 9 aa, Homo Sapiens
TDSLFLPIS

SEQ ID NO: 550670 - protein, 9 aa, Homo Sapiens
ELLELNGIT

SEQ ID NO: 550671 - protein, 9 aa, Homo Sapiens
LVEMHNKAP

SEQ ID NO: 550672 - protein, 9 aa, Homo Sapiens
GIHGARPSQ

SEQ ID NO: 550673 - protein, 9 aa, Homo Sapiens
YQLIPPVPG

SEQ ID NO: 550674 - protein, 9 aa, Homo Sapiens
SCFLYLYQL

SEQ ID NO: 550675 - protein, 9 aa, Homo Sapiens
PNWPSELDL

SEQ ID NO: 550676 - protein, 9 aa, Homo Sapiens
PCNYQLIPP

SEQ ID NO: 550677 - protein, 9 aa, Homo Sapiens
PTSYCTALT

SEQ ID NO: 550678 - protein, 9 aa, Homo Sapiens
IKHYYVSEV

SEQ ID NO: 550679 - protein, 9 aa, Homo Sapiens
PFPCPTSYC

SEQ ID NO: 550680 - protein, 9 aa, Homo Sapiens
IGQEMYILR

SEQ ID NO: 550681 - protein, 9 aa, Homo Sapiens
SIQEFSSSV

SEQ ID NO: 550682 - protein, 9 aa, Homo Sapiens
SRKGMEEIY

SEQ ID NO: 550683 - protein, 9 aa, Homo Sapiens
TGAGQPGQP

SEQ ID NO: 550684 - protein, 9 aa, Homo Sapiens
GTHDGLLVT

SEQ ID NO: 550685 - protein, 9 aa, Homo Sapiens
PPVPGISPN

SEQ ID NO: 550686 - protein, 9 aa, Homo Sapiens
GCCSCSTQW

SEQ ID NO: 550687 - protein, 9 aa, Homo Sapiens
PVPGISPNS

SEQ ID NO: 550688 - protein, 9 aa, Homo Sapiens
SQPRAPACG

SEQ ID NO: 550689 - protein, 9 aa, Homo Sapiens
IHTHTFYVS

SEQ ID NO: 550690 - protein, 9 aa, Homo Sapiens
PGPSSSSLT

SEQ ID NO: 550691 - protein, 9 aa, Homo Sapiens
HLSMLTDSL

SEQ ID NO: 550692 - protein, 9 aa, Homo Sapiens
ELRWPSEEF

SEQ ID NO: 550693 - protein, 9 aa, Homo Sapiens
WEKTICHQT

SEQ ID NO: 550694 - protein, 9 aa, Homo Sapiens
KAPLETPAQ

SEQ ID NO: 550695 - protein, 9 aa, Homo Sapiens
QGSSRPLPL

SEQ ID NO: 550696 - protein, 9 aa, Homo Sapiens
ETASQKRTE

SEQ ID NO: 550697 - protein, 9 aa, Homo Sapiens
SERSITMTK

SEQ ID NO: 550698 - protein, 9 aa, Homo Sapiens
YLEPGPSSS

SEQ ID NO: 550699 - protein, 9 aa, Homo Sapiens
HLFFKSLNS

SEQ ID NO: 550700 - protein, 9 aa, Homo Sapiens
LYTEIMSSF

SEQ ID NO: 550701 - protein, 9 aa, Homo Sapiens
TCSHYTQLV

SEQ ID NO: 550702 - protein, 9 aa, Homo Sapiens
SKAPLETPA

SEQ ID NO: 550703 - protein, 9 aa, Homo Sapiens
CSCSTQWRP

SEQ ID NO: 550704 - protein, 9 aa, Homo Sapiens
DFYTEPCGR

SEQ ID NO: 550705 - protein, 9 aa, Homo Sapiens
IYIYTHIYI

SEQ ID NO: 550706 - protein, 9 aa, Homo Sapiens
TSYCTALTY

SEQ ID NO: 550707 - protein, 9 aa, Homo Sapiens
DLLSSRYAI

SEQ ID NO: 550708 - protein, 9 aa, Homo Sapiens
DEDHRGGRL

SEQ ID NO: 550709 - protein, 9 aa, Homo Sapiens
KDSILLLED

SEQ ID NO: 550710 - protein, 9 aa, Homo Sapiens
FSCFLYLYQ

SEQ ID NO: 550711 - protein, 9 aa, Homo Sapiens
EDHRGGRLS

SEQ ID NO: 550712 - protein, 9 aa, Homo Sapiens
GEDEDHRGG

SEQ ID NO: 550713 - protein, 9 aa, Homo Sapiens
TMENLVEMH

SEQ ID NO: 550714 - protein, 9 aa, Homo Sapiens
RTGAGQPGQ

SEQ ID NO: 550715 - protein, 9 aa, Homo Sapiens
PWEKTICHQ

SEQ ID NO: 550716 - protein, 9 aa, Homo Sapiens
LFLPISHCQ

SEQ ID NO: 550717 - protein, 9 aa, Homo Sapiens
TPAQLLLRD

SEQ ID NO: 550718 - protein, 9 aa, Homo Sapiens
EMHNKAPVW

SEQ ID NO: 550719 - protein, 9 aa, Homo Sapiens
IHGARPSQP

SEQ ID NO: 550720 - protein, 9 aa, Homo Sapiens
GILLPIERE

SEQ ID NO: 550721 - protein, 9 aa, Homo Sapiens
GSRTGSLPG

SEQ ID NO: 550722 - protein, 9 aa, Homo Sapiens
APLETPAQL

SEQ ID NO: 550723 - protein, 9 aa, Homo Sapiens
RSITMTKSI

SEQ ID NO: 550724 - protein, 9 aa, Homo Sapiens
IPPVPGISP

SEQ ID NO: 550725 - protein, 9 aa, Homo Sapiens
YQIRCCTDD

SEQ ID NO: 550726 - protein, 9 aa, Homo Sapiens
GSLPGSSVQ

SEQ ID NO: 550727 - protein, 9 aa, Homo Sapiens
YCGGSSVWP

SEQ ID NO: 550728 - protein, 9 aa, Homo Sapiens
TIDGILLPI

SEQ ID NO: 550729 - protein, 9 aa, Homo Sapiens
WSTCHRRQC

SEQ ID NO: 550730 - protein, 9 aa, Homo Sapiens
NSVLQKHQL

SEQ ID NO: 550731 - protein, 9 aa, Homo Sapiens
WGLPHSWLS

SEQ ID NO: 550732 - protein, 9 aa, Homo Sapiens
TDSKDVTQQ

SEQ ID NO: 550733 - protein, 9 aa, Homo Sapiens
SKDVTQQDR

SEQ ID NO: 550734 - protein, 9 aa, Homo Sapiens
GLSAQPWRL

SEQ ID NO: 550735 - protein, 9 aa, Homo Sapiens
GRLSDFYDI

SEQ ID NO: 550736 - protein, 9 aa, Homo Sapiens
KHLGACFTQ

SEQ ID NO: 550737 - protein, 9 aa, Homo Sapiens
REAWAGRTG

SEQ ID NO: 550738 - protein, 9 aa, Homo Sapiens
RWPSEEFLV

SEQ ID NO: 550739 - protein, 9 aa, Homo Sapiens
RKGMEEIYN

SEQ ID NO: 550740 - protein, 9 aa, Homo Sapiens
QTTADSRKG

SEQ ID NO: 550741 - protein, 9 aa, Homo Sapiens
RTGSLPGSS

SEQ ID NO: 550742 - protein, 9 aa, Homo Sapiens
RPLPLQPSR

SEQ ID NO: 550743 - protein, 9 aa, Homo Sapiens
LNYLCHLSM

SEQ ID NO: 550744 - protein, 9 aa, Homo Sapiens
TQWRPWEKT

SEQ ID NO: 550745 - protein, 9 aa, Homo Sapiens
GQPRQPGPQ

SEQ ID NO: 550746 - protein, 9 aa, Homo Sapiens
ARPSQPRAP

SEQ ID NO: 550747 - protein, 9 aa, Homo Sapiens
CFTQGLAEV

SEQ ID NO: 550748 - protein, 9 aa, Homo Sapiens
SMLTDSLFL

SEQ ID NO: 550749 - protein, 9 aa, Homo Sapiens
GPQGSSRPL

SEQ ID NO: 550750 - protein, 9 aa, Homo Sapiens
VQGTDSKDV

SEQ ID NO: 550751 - protein, 9 aa, Homo Sapiens
QPSRPPTVR

SEQ ID NO: 550752 - protein, 9 aa, Homo Sapiens
SILLLEDVT

SEQ ID NO: 550753 - protein, 9 aa, Homo Sapiens
FGYCGGSSV

SEQ ID NO: 550754 - protein, 9 aa, Homo Sapiens
FCYQIRCCT

SEQ ID NO: 550755 - protein, 9 aa, Homo Sapiens
APPSHREAW

SEQ ID NO: 550756 - protein, 9 aa, Homo Sapiens
SGELRWPSE

SEQ ID NO: 550757 - protein, 9 aa, Homo Sapiens
TKLNYLCHL

SEQ ID NO: 550758 - protein, 9 aa, Homo Sapiens
RGEESRCVD

SEQ ID NO: 550759 - protein, 9 aa, Homo Sapiens
ENGLPIEEG

SEQ ID NO: 550760 - protein, 9 aa, Homo Sapiens
ITMTKSIRD

SEQ ID NO: 550761 - protein, 9 aa, Homo Sapiens
VPRAKRELA

SEQ ID NO: 550762 - protein, 9 aa, Homo Sapiens
IETASQKRT

SEQ ID NO: 550763 - protein, 9 aa, Homo Sapiens
PWHSPRIWG

SEQ ID NO: 550764 - protein, 9 aa, Homo Sapiens
SLFLPISHC

SEQ ID NO: 550765 - protein, 9 aa, Homo Sapiens
GLPHSWLSE

SEQ ID NO: 550766 - protein, 9 aa, Homo Sapiens
CNYQLIPPV

SEQ ID NO: 550767 - protein, 9 aa, Homo Sapiens
IAYARSILT

SEQ ID NO: 550768 - protein, 9 aa, Homo Sapiens
TADSRKGME

SEQ ID NO: 550769 - protein, 9 aa, Homo Sapiens
QEFSSSVDL

SEQ ID NO: 550770 - protein, 9 aa, Homo Sapiens
CGLSAQPWR

SEQ ID NO: 550771 - protein, 9 aa, Homo Sapiens
LLVTKLNYL

SEQ ID NO: 550772 - protein, 9 aa, Homo Sapiens
GFCYQIRCC

SEQ ID NO: 550773 - protein, 9 aa, Homo Sapiens
RRGFGYCGG

SEQ ID NO: 550774 - protein, 9 aa, Homo Sapiens
NILALYTEI

SEQ ID NO: 550775 - protein, 9 aa, Homo Sapiens
SYCTALTYY

SEQ ID NO: 550776 - protein, 9 aa, Homo Sapiens
IQEFSSSVD

SEQ ID NO: 550777 - protein, 9 aa, Homo Sapiens
SPRIWGLPH

SEQ ID NO: 550778 - protein, 9 aa, Homo Sapiens
PSEEFLVQE

SEQ ID NO: 550779 - protein, 9 aa, Homo Sapiens
ITMMVPVDS

SEQ ID NO: 550780 - protein, 9 aa, Homo Sapiens
KVGLFSCFL

SEQ ID NO: 550781 - protein, 9 aa, Homo Sapiens
RGFGYCGGS

SEQ ID NO: 550782 - protein, 9 aa, Homo Sapiens
TTADSRKGM

SEQ ID NO: 550783 - protein, 9 aa, Homo Sapiens
THIYIHTHT

SEQ ID NO: 550784 - protein, 9 aa, Homo Sapiens
MVPVDSKFS

SEQ ID NO: 550785 - protein, 9 aa, Homo Sapiens
VTKLNYLCH

SEQ ID NO: 550786 - protein, 9 aa, Homo Sapiens
SSVWPAPWH

SEQ ID NO: 550787 - protein, 9 aa, Homo Sapiens
QPWRLRLPD

SEQ ID NO: 550788 - protein, 9 aa, Homo Sapiens
LSSRYAILL

SEQ ID NO: 550789 - protein, 9 aa, Homo Sapiens
APACGLSAQ

SEQ ID NO: 550790 - protein, 9 aa, Homo Sapiens
ILLPIERER

SEQ ID NO: 550791 - protein, 9 aa, Homo Sapiens
SPRIETASQ

SEQ ID NO: 550792 - protein, 9 aa, Homo Sapiens
IWGLPHSWL

SEQ ID NO: 550793 - protein, 9 aa, Homo Sapiens
IEEGLSCNG

SEQ ID NO: 550794 - protein, 9 aa, Homo Sapiens
RYAILLQIS

SEQ ID NO: 550795 - protein, 9 aa, Homo Sapiens
VPVDSKFSQ

SEQ ID NO: 550796 - protein, 9 aa, Homo Sapiens
KHYYVSEVL

SEQ ID NO: 550797 - protein, 9 aa, Homo Sapiens
EGCCSCSTQ

SEQ ID NO: 550798 - protein, 9 aa, Homo Sapiens
GLFSCFLYL

SEQ ID NO: 550799 - protein, 9 aa, Homo Sapiens
RCCTDDVRP

SEQ ID NO: 550800 - protein, 9 aa, Homo Sapiens
ARDWKCRYD

SEQ ID NO: 550801 - protein, 9 aa, Homo Sapiens
PRIWGLPHS

SEQ ID NO: 550802 - protein, 9 aa, Homo Sapiens
SWLSEGCCS

SEQ ID NO: 550803 - protein, 9 aa, Homo Sapiens
PKIHRRRSR

SEQ ID NO: 550804 - protein, 9 aa, Homo Sapiens
MPHQPSATR

SEQ ID NO: 550805 - protein, 9 aa, Homo Sapiens
QQKIECKLF

SEQ ID NO: 550806 - protein, 9 aa, Homo Sapiens
EFQCTSGRC

SEQ ID NO: 550807 - protein, 9 aa, Homo Sapiens
HASRESNVV

SEQ ID NO: 550808 - protein, 9 aa, Homo Sapiens
SPGTRKRPR

SEQ ID NO: 550809 - protein, 9 aa, Homo Sapiens
TTSSGGCHS

SEQ ID NO: 550810 - protein, 9 aa, Homo Sapiens
PLGMRNTIC

SEQ ID NO: 550811 - protein, 9 aa, Homo Sapiens
LIQIKKSTS

SEQ ID NO: 550812 - protein, 9 aa, Homo Sapiens
LKHNKSGGA

SEQ ID NO: 550813 - protein, 9 aa, Homo Sapiens
FSAALHLLL

SEQ ID NO: 550814 - protein, 9 aa, Homo Sapiens
TYIFGTNCD

SEQ ID NO: 550815 - protein, 9 aa, Homo Sapiens
PSCCSVDSA

SEQ ID NO: 550816 - protein, 9 aa, Homo Sapiens
GLYLFGVDV

SEQ ID NO: 550817 - protein, 9 aa, Homo Sapiens
CKLFTSEEE

SEQ ID NO: 550818 - protein, 9 aa, Homo Sapiens
IPNGRDQHL

SEQ ID NO: 550819 - protein, 9 aa, Homo Sapiens
AGCDQRRKG

SEQ ID NO: 550820 - protein, 9 aa, Homo Sapiens
HHGTPSSTK

SEQ ID NO: 550821 - protein, 9 aa, Homo Sapiens
PEPSMSPKI

SEQ ID NO: 550822 - protein, 9 aa, Homo Sapiens
GEEEKWAEK

SEQ ID NO: 550823 - protein, 9 aa, Homo Sapiens
TRKRPRAPP

SEQ ID NO: 550824 - protein, 9 aa, Homo Sapiens
YGKAFIQSF

SEQ ID NO: 550825 - protein, 9 aa, Homo Sapiens
NGQYRCLFE

SEQ ID NO: 550826 - protein, 9 aa, Homo Sapiens
GAGGMRQGS

SEQ ID NO: 550827 - protein, 9 aa, Homo Sapiens
RDLSNRHSY

SEQ ID NO: 550828 - protein, 9 aa, Homo Sapiens
ASRDVFSGP

SEQ ID NO: 550829 - protein, 9 aa, Homo Sapiens
IGTEGILTR

SEQ ID NO: 550830 - protein, 9 aa, Homo Sapiens
LYPVLSVLV

SEQ ID NO: 550831 - protein, 9 aa, Homo Sapiens
FLYLQPANR

SEQ ID NO: 550832 - protein, 9 aa, Homo Sapiens
QWLKHNKSG

SEQ ID NO: 550833 - protein, 9 aa, Homo Sapiens
NLGSDIAVE

SEQ ID NO: 550834 - protein, 9 aa, Homo Sapiens
AINQNEYHS

SEQ ID NO: 550835 - protein, 9 aa, Homo Sapiens
TTYYTVRMF

SEQ ID NO: 550836 - protein, 9 aa, Homo Sapiens
LIGVRVILW

SEQ ID NO: 550837 - protein, 9 aa, Homo Sapiens
ATTSSTSLS

SEQ ID NO: 550838 - protein, 9 aa, Homo Sapiens
DQHLGVDPT

SEQ ID NO: 550839 - protein, 9 aa, Homo Sapiens
EPCQPKIPE

SEQ ID NO: 550840 - protein, 9 aa, Homo Sapiens
SNVVVISLQ

SEQ ID NO: 550841 - protein, 9 aa, Homo Sapiens
YNNIQDSEN

SEQ ID NO: 550842 - protein, 9 aa, Homo Sapiens
DAGYRVTLW

SEQ ID NO: 550843 - protein, 9 aa, Homo Sapiens
PDIHPALPL

SEQ ID NO: 550844 - protein, 9 aa, Homo Sapiens
EAMKEIIAG

SEQ ID NO: 550845 - protein, 9 aa, Homo Sapiens
CDKPRTEAC

SEQ ID NO: 550846 - protein, 9 aa, Homo Sapiens
GSSERSEQP

SEQ ID NO: 550847 - protein, 9 aa, Homo Sapiens
LNSVIYSFR

SEQ ID NO: 550848 - protein, 9 aa, Homo Sapiens
SNRVSNGLH

SEQ ID NO: 550849 - protein, 9 aa, Homo Sapiens
HSISQTVLT

SEQ ID NO: 550850 - protein, 9 aa, Homo Sapiens
RKLISEVDG

SEQ ID NO: 550851 - protein, 9 aa, Homo Sapiens
WEELAASRD

SEQ ID NO: 550852 - protein, 9 aa, Homo Sapiens
ANLRAAVNV

SEQ ID NO: 550853 - protein, 9 aa, Homo Sapiens
PCGLSTHIE

SEQ ID NO: 550854 - protein, 9 aa, Homo Sapiens
SYRHYSIRP

SEQ ID NO: 550855 - protein, 9 aa, Homo Sapiens
LKALSENAV

SEQ ID NO: 550856 - protein, 9 aa, Homo Sapiens
IFLYLQPAN

SEQ ID NO: 550857 - protein, 9 aa, Homo Sapiens
VGLYLFGVD

SEQ ID NO: 550858 - protein, 9 aa, Homo Sapiens
IKKSTSSSS

SEQ ID NO: 550859 - protein, 9 aa, Homo Sapiens
GGEEEKWAE

SEQ ID NO: 550860 - protein, 9 aa, Homo Sapiens
YSGFQATTY

SEQ ID NO: 550861 - protein, 9 aa, Homo Sapiens
AYPTAFASP

SEQ ID NO: 550862 - protein, 9 aa, Homo Sapiens
VPEPCQPKI

SEQ ID NO: 550863 - protein, 9 aa, Homo Sapiens
SMSPKIHRR

SEQ ID NO: 550864 - protein, 9 aa, Homo Sapiens
KILHDCVQL

SEQ ID NO: 550865 - protein, 9 aa, Homo Sapiens
RPDCDKPRT

SEQ ID NO: 550866 - protein, 9 aa, Homo Sapiens
CFMEVLAKQ

SEQ ID NO: 550867 - protein, 9 aa, Homo Sapiens
EDPQMSMSQ

SEQ ID NO: 550868 - protein, 9 aa, Homo Sapiens
LRAAVNVNV

SEQ ID NO: 550869 - protein, 9 aa, Homo Sapiens
LVETLKFAR

SEQ ID NO: 550870 - protein, 9 aa, Homo Sapiens
VTMKILHDC

SEQ ID NO: 550871 - protein, 9 aa, Homo Sapiens
KTYIFGTNC

SEQ ID NO: 550872 - protein, 9 aa, Homo Sapiens
NLRAAVNVN

SEQ ID NO: 550873 - protein, 9 aa, Homo Sapiens
GAQNKEHPR

SEQ ID NO: 550874 - protein, 9 aa, Homo Sapiens
PQDSAKTNT

SEQ ID NO: 550875 - protein, 9 aa, Homo Sapiens
PVLSVLVFG

SEQ ID NO: 550876 - protein, 9 aa, Homo Sapiens
PEGTLRDSD

SEQ ID NO: 550877 - protein, 9 aa, Homo Sapiens
TATSRQSIR

SEQ ID NO: 550878 - protein, 9 aa, Homo Sapiens
ELESREDQP

SEQ ID NO: 550879 - protein, 9 aa, Homo Sapiens
LNTNIRALQ

SEQ ID NO: 550880 - protein, 9 aa, Homo Sapiens
HRRSHHEDR

SEQ ID NO: 550881 - protein, 9 aa, Homo Sapiens
VFQIGIMVA

SEQ ID NO: 550882 - protein, 9 aa, Homo Sapiens
PCALPVSGR

SEQ ID NO: 550883 - protein, 9 aa, Homo Sapiens
TLRDSDTSI

SEQ ID NO: 550884 - protein, 9 aa, Homo Sapiens
LGLSIRDLP

SEQ ID NO: 550885 - protein, 9 aa, Homo Sapiens
KQDTEAAIQ

SEQ ID NO: 550886 - protein, 9 aa, Homo Sapiens
NSVIYSFRN

SEQ ID NO: 550887 - protein, 9 aa, Homo Sapiens
AQWLKHNKS

SEQ ID NO: 550888 - protein, 9 aa, Homo Sapiens
PEPCQPKIP

SEQ ID NO: 550889 - protein, 9 aa, Homo Sapiens
KYSTGIGWI

SEQ ID NO: 550890 - protein, 9 aa, Homo Sapiens
QDRTIAPQP

SEQ ID NO: 550891 - protein, 9 aa, Homo Sapiens
TEKIEYNES

SEQ ID NO: 550892 - protein, 9 aa, Homo Sapiens
ATEASLDSF

SEQ ID NO: 550893 - protein, 9 aa, Homo Sapiens
PSERPYSLK

SEQ ID NO: 550894 - protein, 9 aa, Homo Sapiens
SEEDGSLEV

SEQ ID NO: 550895 - protein, 9 aa, Homo Sapiens
PCLLVTMTS

SEQ ID NO: 550896 - protein, 9 aa, Homo Sapiens
TNIRALQGS

SEQ ID NO: 550897 - protein, 9 aa, Homo Sapiens
QKRAQDAVI

SEQ ID NO: 550898 - protein, 9 aa, Homo Sapiens
TGIGWIWLA

SEQ ID NO: 550899 - protein, 9 aa, Homo Sapiens
DLLTCRDPE

SEQ ID NO: 550900 - protein, 9 aa, Homo Sapiens
KVTTKGLHP

SEQ ID NO: 550901 - protein, 9 aa, Homo Sapiens
RTFSDTLED

SEQ ID NO: 550902 - protein, 9 aa, Homo Sapiens
TIIFLYLQP

SEQ ID NO: 550903 - protein, 9 aa, Homo Sapiens
TPLLNSVIY

SEQ ID NO: 550904 - protein, 9 aa, Homo Sapiens
LGWKQGGEE

SEQ ID NO: 550905 - protein, 9 aa, Homo Sapiens
GSQKHRAPQ

SEQ ID NO: 550906 - protein, 9 aa, Homo Sapiens
DTDNAEEEP

SEQ ID NO: 550907 - protein, 9 aa, Homo Sapiens
SFPESSVGA

SEQ ID NO: 550908 - protein, 9 aa, Homo Sapiens
LHDCVQLST

SEQ ID NO: 550909 - protein, 9 aa, Homo Sapiens
PPPWRSTPR

SEQ ID NO: 550910 - protein, 9 aa, Homo Sapiens
SSPSFNNLQ

SEQ ID NO: 550911 - protein, 9 aa, Homo Sapiens
IAPQPGEKK

SEQ ID NO: 550912 - protein, 9 aa, Homo Sapiens
EEEPVGRKE

SEQ ID NO: 550913 - protein, 9 aa, Homo Sapiens
SSERSEQPL

SEQ ID NO: 550914 - protein, 9 aa, Homo Sapiens
MPNEDQNEA

SEQ ID NO: 550915 - protein, 9 aa, Homo Sapiens
SPRSGDGKL

SEQ ID NO: 550916 - protein, 9 aa, Homo Sapiens
EKASALNTN

SEQ ID NO: 550917 - protein, 9 aa, Homo Sapiens
RTIAPQPGE

SEQ ID NO: 550918 - protein, 9 aa, Homo Sapiens
NPSAHAVPT

SEQ ID NO: 550919 - protein, 9 aa, Homo Sapiens
LQRRQWRKT

SEQ ID NO: 550920 - protein, 9 aa, Homo Sapiens
NDIYLIFAK

SEQ ID NO: 550921 - protein, 9 aa, Homo Sapiens
YVAMASWPL

SEQ ID NO: 550922 - protein, 9 aa, Homo Sapiens
LLEWKQKVE

SEQ ID NO: 550923 - protein, 9 aa, Homo Sapiens
EEGGGPEGP

SEQ ID NO: 550924 - protein, 9 aa, Homo Sapiens
QELSLEKLK

SEQ ID NO: 550925 - protein, 9 aa, Homo Sapiens
SARPSDNGQ

SEQ ID NO: 550926 - protein, 9 aa, Homo Sapiens
NTNIRALQG

SEQ ID NO: 550927 - protein, 9 aa, Homo Sapiens
LGSDIAVEL

SEQ ID NO: 550928 - protein, 9 aa, Homo Sapiens
KSHRDLSNR

SEQ ID NO: 550929 - protein, 9 aa, Homo Sapiens
TFGGVGSSG

SEQ ID NO: 550930 - protein, 9 aa, Homo Sapiens
VNKYSTGIG

SEQ ID NO: 550931 - protein, 9 aa, Homo Sapiens
RDAGTRWAS

SEQ ID NO: 550932 - protein, 9 aa, Homo Sapiens
RRMFRFSAA

SEQ ID NO: 550933 - protein, 9 aa, Homo Sapiens
MPGSQHFPT

SEQ ID NO: 550934 - protein, 9 aa, Homo Sapiens
EQRQQESPE

SEQ ID NO: 550935 - protein, 9 aa, Homo Sapiens
REPHSCMAK

SEQ ID NO: 550936 - protein, 9 aa, Homo Sapiens
ATSRQSIRR

SEQ ID NO: 550937 - protein, 9 aa, Homo Sapiens
DYNNIQDSE

SEQ ID NO: 550938 - protein, 9 aa, Homo Sapiens
RRSHHEDRA

SEQ ID NO: 550939 - protein, 9 aa, Homo Sapiens
IHTGEKFCK

SEQ ID NO: 550940 - protein, 9 aa, Homo Sapiens
QDSAKTNTQ

SEQ ID NO: 550941 - protein, 9 aa, Homo Sapiens
AGEVIERNG

SEQ ID NO: 550942 - protein, 9 aa, Homo Sapiens
IQWQKHCYP

SEQ ID NO: 550943 - protein, 9 aa, Homo Sapiens
TSPETTSSG

SEQ ID NO: 550944 - protein, 9 aa, Homo Sapiens
CIFMYTCPA

SEQ ID NO: 550945 - protein, 9 aa, Homo Sapiens
VSREPHSCM

SEQ ID NO: 550946 - protein, 9 aa, Homo Sapiens
PSRTPLIQI

SEQ ID NO: 550947 - protein, 9 aa, Homo Sapiens
TKIEVPTAI

SEQ ID NO: 550948 - protein, 9 aa, Homo Sapiens
MPTMINPKP

SEQ ID NO: 550949 - protein, 9 aa, Homo Sapiens
VSLLLRSPV

SEQ ID NO: 550950 - protein, 9 aa, Homo Sapiens
LFGVDVNPE

SEQ ID NO: 550951 - protein, 9 aa, Homo Sapiens
YSTGIGWIW

SEQ ID NO: 550952 - protein, 9 aa, Homo Sapiens
ASWPLEPEG

SEQ ID NO: 550953 - protein, 9 aa, Homo Sapiens
YLRHFGLRF

SEQ ID NO: 550954 - protein, 9 aa, Homo Sapiens
HPLVAETQL

SEQ ID NO: 550955 - protein, 9 aa, Homo Sapiens
AAAEEEGGG

SEQ ID NO: 550956 - protein, 9 aa, Homo Sapiens
SCCSVDSAG

SEQ ID NO: 550957 - protein, 9 aa, Homo Sapiens
QSRHGSRHR

SEQ ID NO: 550958 - protein, 9 aa, Homo Sapiens
GTSPETTSS

SEQ ID NO: 550959 - protein, 9 aa, Homo Sapiens
MAKSVYWAE

SEQ ID NO: 550960 - protein, 9 aa, Homo Sapiens
CDTFGNEDY

SEQ ID NO: 550961 - protein, 9 aa, Homo Sapiens
LGFTKEDGI

SEQ ID NO: 550962 - protein, 9 aa, Homo Sapiens
FPYLRHFGL

SEQ ID NO: 550963 - protein, 9 aa, Homo Sapiens
NQNEYHSGN

SEQ ID NO: 550964 - protein, 9 aa, Homo Sapiens
SGGAMVWAI

SEQ ID NO: 550965 - protein, 9 aa, Homo Sapiens
VETELFPYL

SEQ ID NO: 550966 - protein, 9 aa, Homo Sapiens
EEIKENIKT

SEQ ID NO: 550967 - protein, 9 aa, Homo Sapiens
GTLRDSDTS

SEQ ID NO: 550968 - protein, 9 aa, Homo Sapiens
IGIMVAGFA

SEQ ID NO: 550969 - protein, 9 aa, Homo Sapiens
HSLTGPRSY

SEQ ID NO: 550970 - protein, 9 aa, Homo Sapiens
KTSSVPRRT

SEQ ID NO: 550971 - protein, 9 aa, Homo Sapiens
FPELESRED

SEQ ID NO: 550972 - protein, 9 aa, Homo Sapiens
APSCCSVDS

SEQ ID NO: 550973 - protein, 9 aa, Homo Sapiens
RIEYVAMAS

SEQ ID NO: 550974 - protein, 9 aa, Homo Sapiens
QGDVPLGMR

SEQ ID NO: 550975 - protein, 9 aa, Homo Sapiens
TICSLFFLL

SEQ ID NO: 550976 - protein, 9 aa, Homo Sapiens
SPCGLSTHI

SEQ ID NO: 550977 - protein, 9 aa, Homo Sapiens
HFIAVAIFY

SEQ ID NO: 550978 - protein, 9 aa, Homo Sapiens
SLPSPFSCP

SEQ ID NO: 550979 - protein, 9 aa, Homo Sapiens
LAWNSIKYK

SEQ ID NO: 550980 - protein, 9 aa, Homo Sapiens
GLSYRHYSI

SEQ ID NO: 550981 - protein, 9 aa, Homo Sapiens
WANLRAAVN

SEQ ID NO: 550982 - protein, 9 aa, Homo Sapiens
SRESNVVVI

SEQ ID NO: 550983 - protein, 9 aa, Homo Sapiens
FKWGSLKSS

SEQ ID NO: 550984 - protein, 9 aa, Homo Sapiens
RESNVVVIS

SEQ ID NO: 550985 - protein, 9 aa, Homo Sapiens
SSTKKTLKP

SEQ ID NO: 550986 - protein, 9 aa, Homo Sapiens
SISQTVLTM

SEQ ID NO: 550987 - protein, 9 aa, Homo Sapiens
TTHKLTHTR

SEQ ID NO: 550988 - protein, 9 aa, Homo Sapiens
LTGSSERSE

SEQ ID NO: 550989 - protein, 9 aa, Homo Sapiens
KGRSSPSLL

SEQ ID NO: 550990 - protein, 9 aa, Homo Sapiens
SSQRMPHQP

SEQ ID NO: 550991 - protein, 9 aa, Homo Sapiens
QLGEAEVAL

SEQ ID NO: 550992 - protein, 9 aa, Homo Sapiens
AVLTTEVIA

SEQ ID NO: 550993 - protein, 9 aa, Homo Sapiens
SPSFNNLQR

SEQ ID NO: 550994 - protein, 9 aa, Homo Sapiens
SLEVGIKQL

SEQ ID NO: 550995 - protein, 9 aa, Homo Sapiens
YISRDTLYV

SEQ ID NO: 550996 - protein, 9 aa, Homo Sapiens
LNEYETEKI

SEQ ID NO: 550997 - protein, 9 aa, Homo Sapiens
AAPGKCQKR

SEQ ID NO: 550998 - protein, 9 aa, Homo Sapiens
TLNSFTFGG

SEQ ID NO: 550999 - protein, 9 aa, Homo Sapiens
LYLQPANRR

SEQ ID NO: 551000 - protein, 9 aa, Homo Sapiens
SVLHLDHSA

SEQ ID NO: 551001 - protein, 9 aa, Homo Sapiens
PSDNGQYRC

SEQ ID NO: 551002 - protein, 9 aa, Homo Sapiens
AKDLGLSIR

SEQ ID NO: 551003 - protein, 9 aa, Homo Sapiens
ETLKFARGQ

SEQ ID NO: 551004 - protein, 9 aa, Homo Sapiens
FHTGEQEDA

SEQ ID NO: 551005 - protein, 9 aa, Homo Sapiens
SSALIGVRV

SEQ ID NO: 551006 - protein, 9 aa, Homo Sapiens
ETQLGEAEV

SEQ ID NO: 551007 - protein, 9 aa, Homo Sapiens
GVSNRVSNG

SEQ ID NO: 551008 - protein, 9 aa, Homo Sapiens
FTLNSFTFG

SEQ ID NO: 551009 - protein, 9 aa, Homo Sapiens
SENAVLILL

SEQ ID NO: 551010 - protein, 9 aa, Homo Sapiens
MNSSKEEMR

SEQ ID NO: 551011 - protein, 9 aa, Homo Sapiens
VHASRESNV

SEQ ID NO: 551012 - protein, 9 aa, Homo Sapiens
SELRDSDFS

SEQ ID NO: 551013 - protein, 9 aa, Homo Sapiens
ASLDSFPES

SEQ ID NO: 551014 - protein, 9 aa, Homo Sapiens
SREDQPFSR

SEQ ID NO: 551015 - protein, 9 aa, Homo Sapiens
LSFSPDSPG

SEQ ID NO: 551016 - protein, 9 aa, Homo Sapiens
AVNVNVLAT

SEQ ID NO: 551017 - protein, 9 aa, Homo Sapiens
FPTCSPPKR

SEQ ID NO: 551018 - protein, 9 aa, Homo Sapiens
RYNSYYISR

SEQ ID NO: 551019 - protein, 9 aa, Homo Sapiens
SDCQRCCDS

SEQ ID NO: 551020 - protein, 9 aa, Homo Sapiens
CASHFIAVA

SEQ ID NO: 551021 - protein, 9 aa, Homo Sapiens
AQMTTYYTV

SEQ ID NO: 551022 - protein, 9 aa, Homo Sapiens
MRNTICRMQ

SEQ ID NO: 551023 - protein, 9 aa, Homo Sapiens
NINIQWQKH

SEQ ID NO: 551024 - protein, 9 aa, Homo Sapiens
DMQKKEDHL

SEQ ID NO: 551025 - protein, 9 aa, Homo Sapiens
LDSFPESSV

SEQ ID NO: 551026 - protein, 9 aa, Homo Sapiens
MSQPYTMTT

SEQ ID NO: 551027 - protein, 9 aa, Homo Sapiens
PLYNITKIE

SEQ ID NO: 551028 - protein, 9 aa, Homo Sapiens
YSIRPTAGA

SEQ ID NO: 551029 - protein, 9 aa, Homo Sapiens
ALPGLHFMP

SEQ ID NO: 551030 - protein, 9 aa, Homo Sapiens
GTATSRQSI

SEQ ID NO: 551031 - protein, 9 aa, Homo Sapiens
GRVRRMFRF

SEQ ID NO: 551032 - protein, 9 aa, Homo Sapiens
ALNTNIRAL

SEQ ID NO: 551033 - protein, 9 aa, Homo Sapiens
LQELQSSTS

SEQ ID NO: 551034 - protein, 9 aa, Homo Sapiens
TSSVLHLDH

SEQ ID NO: 551035 - protein, 9 aa, Homo Sapiens
LQSSTSNSP

SEQ ID NO: 551036 - protein, 9 aa, Homo Sapiens
TPRTDVLRL

SEQ ID NO: 551037 - protein, 9 aa, Homo Sapiens
RAPGVQPCL

SEQ ID NO: 551038 - protein, 9 aa, Homo Sapiens
IPLGVTTPD

SEQ ID NO: 551039 - protein, 9 aa, Homo Sapiens
QTVLTMNLP

SEQ ID NO: 551040 - protein, 9 aa, Homo Sapiens
TAFASPNCG

SEQ ID NO: 551041 - protein, 9 aa, Homo Sapiens
ASHFIAVAI

SEQ ID NO: 551042 - protein, 9 aa, Homo Sapiens
CRDPEENKM

SEQ ID NO: 551043 - protein, 9 aa, Homo Sapiens
RGQRWRLGD

SEQ ID NO: 551044 - protein, 9 aa, Homo Sapiens
EVLAKQDTE

SEQ ID NO: 551045 - protein, 9 aa, Homo Sapiens
IQIKKSTSS

SEQ ID NO: 551046 - protein, 9 aa, Homo Sapiens
GFPELESRE

SEQ ID NO: 551047 - protein, 9 aa, Homo Sapiens
EASLDSFPE

SEQ ID NO: 551048 - protein, 9 aa, Homo Sapiens
INQNEYHSG

SEQ ID NO: 551049 - protein, 9 aa, Homo Sapiens
LSLEKLKSW

SEQ ID NO: 551050 - protein, 9 aa, Homo Sapiens
SGFQATTYA

SEQ ID NO: 551051 - protein, 9 aa, Homo Sapiens
VLEEDVMPH

SEQ ID NO: 551052 - protein, 9 aa, Homo Sapiens
QKIECKLFT

SEQ ID NO: 551053 - protein, 9 aa, Homo Sapiens
AFPHHPRHS

SEQ ID NO: 551054 - protein, 9 aa, Homo Sapiens
DVGLYLFGV

SEQ ID NO: 551055 - protein, 9 aa, Homo Sapiens
MPGRGPIHR

SEQ ID NO: 551056 - protein, 9 aa, Homo Sapiens
CSVLDVASP

SEQ ID NO: 551057 - protein, 9 aa, Homo Sapiens
SYLRVNVLI

SEQ ID NO: 551058 - protein, 9 aa, Homo Sapiens
KLQRYNSYY

SEQ ID NO: 551059 - protein, 9 aa, Homo Sapiens
LVAETQLGE

SEQ ID NO: 551060 - protein, 9 aa, Homo Sapiens
VMESPAEDS

SEQ ID NO: 551061 - protein, 9 aa, Homo Sapiens
TECAGEVIE

SEQ ID NO: 551062 - protein, 9 aa, Homo Sapiens
TSRQSIRRV

SEQ ID NO: 551063 - protein, 9 aa, Homo Sapiens
MHFTLNSFT

SEQ ID NO: 551064 - protein, 9 aa, Homo Sapiens
SYYISRDTL

SEQ ID NO: 551065 - protein, 9 aa, Homo Sapiens
SKAQMTTYY

SEQ ID NO: 551066 - protein, 9 aa, Homo Sapiens
TDNAEEEPV

SEQ ID NO: 551067 - protein, 9 aa, Homo Sapiens
LKIRQRIVC

SEQ ID NO: 551068 - protein, 9 aa, Homo Sapiens
KPRTEACPM

SEQ ID NO: 551069 - protein, 9 aa, Homo Sapiens
RKRPRAPPV

SEQ ID NO: 551070 - protein, 9 aa, Homo Sapiens
APGKCQKRK

SEQ ID NO: 551071 - protein, 9 aa, Homo Sapiens
TPCALPVSG

SEQ ID NO: 551072 - protein, 9 aa, Homo Sapiens
RKKCVKVTT

SEQ ID NO: 551073 - protein, 9 aa, Homo Sapiens
LYNITKIEV

SEQ ID NO: 551074 - protein, 9 aa, Homo Sapiens
GLHFMPGRG

SEQ ID NO: 551075 - protein, 9 aa, Homo Sapiens
HYSIRPTAG

SEQ ID NO: 551076 - protein, 9 aa, Homo Sapiens
SCPCRRCRA

SEQ ID NO: 551077 - protein, 9 aa, Homo Sapiens
ESREDQPFS

SEQ ID NO: 551078 - protein, 9 aa, Homo Sapiens
LADVNEAGA

SEQ ID NO: 551079 - protein, 9 aa, Homo Sapiens
LSNRHSYPQ

SEQ ID NO: 551080 - protein, 9 aa, Homo Sapiens
YRHYSIRPT

SEQ ID NO: 551081 - protein, 9 aa, Homo Sapiens
RFHMASGEA

SEQ ID NO: 551082 - protein, 9 aa, Homo Sapiens
AGLQKIWGT

SEQ ID NO: 551083 - protein, 9 aa, Homo Sapiens
VSALQELQS

SEQ ID NO: 551084 - protein, 9 aa, Homo Sapiens
NLQSKENMP

SEQ ID NO: 551085 - protein, 9 aa, Homo Sapiens
GMGNLGSDI

SEQ ID NO: 551086 - protein, 9 aa, Homo Sapiens
THIEIGHRA

SEQ ID NO: 551087 - protein, 9 aa, Homo Sapiens
PLIQIKKST

SEQ ID NO: 551088 - protein, 9 aa, Homo Sapiens
LGIGMLGYS

SEQ ID NO: 551089 - protein, 9 aa, Homo Sapiens
LDAAPGKCQ

SEQ ID NO: 551090 - protein, 9 aa, Homo Sapiens
AAVLTTEVI

SEQ ID NO: 551091 - protein, 9 aa, Homo Sapiens
VLAPSCCSV

SEQ ID NO: 551092 - protein, 9 aa, Homo Sapiens
PAIGTEGIL

SEQ ID NO: 551093 - protein, 9 aa, Homo Sapiens
GWKQGGEEE

SEQ ID NO: 551094 - protein, 9 aa, Homo Sapiens
NKDLLTCRD

SEQ ID NO: 551095 - protein, 9 aa, Homo Sapiens
AIFYGTIIF

SEQ ID NO: 551096 - protein, 9 aa, Homo Sapiens
PRAPPVPKC

SEQ ID NO: 551097 - protein, 9 aa, Homo Sapiens
QKEPNGEGL

SEQ ID NO: 551098 - protein, 9 aa, Homo Sapiens
SSVAEFSEA

SEQ ID NO: 551099 - protein, 9 aa, Homo Sapiens
KKGMAAPYF

SEQ ID NO: 551100 - protein, 9 aa, Homo Sapiens
NEYETEKIE

SEQ ID NO: 551101 - protein, 9 aa, Homo Sapiens
LVIGMGNLG

SEQ ID NO: 551102 - protein, 9 aa, Homo Sapiens
KLTPVSAQF

SEQ ID NO: 551103 - protein, 9 aa, Homo Sapiens
RRKGGLSLN

SEQ ID NO: 551104 - protein, 9 aa, Homo Sapiens
NMPTMINPK

SEQ ID NO: 551105 - protein, 9 aa, Homo Sapiens
FTACKTYIF

SEQ ID NO: 551106 - protein, 9 aa, Homo Sapiens
GQGCEHTSR

SEQ ID NO: 551107 - protein, 9 aa, Homo Sapiens
PEYKELYTL

SEQ ID NO: 551108 - protein, 9 aa, Homo Sapiens
GIGMLGYSG

SEQ ID NO: 551109 - protein, 9 aa, Homo Sapiens
PNCGSGVVG

SEQ ID NO: 551110 - protein, 9 aa, Homo Sapiens
RPPEGTLRD

SEQ ID NO: 551111 - protein, 9 aa, Homo Sapiens
MFRFSAALH

SEQ ID NO: 551112 - protein, 9 aa, Homo Sapiens
SHRDLSNRH

SEQ ID NO: 551113 - protein, 9 aa, Homo Sapiens
LPGLHFMPG

SEQ ID NO: 551114 - protein, 9 aa, Homo Sapiens
ASRESNVVV

SEQ ID NO: 551115 - protein, 9 aa, Homo Sapiens
LGVLPYPST

SEQ ID NO: 551116 - protein, 9 aa, Homo Sapiens
MAAPYFNEA

SEQ ID NO: 551117 - protein, 9 aa, Homo Sapiens
LEWKQKVEK

SEQ ID NO: 551118 - protein, 9 aa, Homo Sapiens
FNKDLLTCR

SEQ ID NO: 551119 - protein, 9 aa, Homo Sapiens
TLKFARGQR

SEQ ID NO: 551120 - protein, 9 aa, Homo Sapiens
EYKELYTLK

SEQ ID NO: 551121 - protein, 9 aa, Homo Sapiens
PGLSYRHYS

SEQ ID NO: 551122 - protein, 9 aa, Homo Sapiens
AKNVFLGDQ

SEQ ID NO: 551123 - protein, 9 aa, Homo Sapiens
PKIPEPCQP

SEQ ID NO: 551124 - protein, 9 aa, Homo Sapiens
VSVCAFNKG

SEQ ID NO: 551125 - protein, 9 aa, Homo Sapiens
AKIEDKALI

SEQ ID NO: 551126 - protein, 9 aa, Homo Sapiens
HGNRTFSDT

SEQ ID NO: 551127 - protein, 9 aa, Homo Sapiens
GPAIGTEGI

SEQ ID NO: 551128 - protein, 9 aa, Homo Sapiens
GNRTFSDTL

SEQ ID NO: 551129 - protein, 9 aa, Homo Sapiens
KHNKSGGAM

SEQ ID NO: 551130 - protein, 9 aa, Homo Sapiens
LTTHKLTHT

SEQ ID NO: 551131 - protein, 9 aa, Homo Sapiens
FTFGGVGSS

SEQ ID NO: 551132 - protein, 9 aa, Homo Sapiens
HQPSATRLP

SEQ ID NO: 551133 - protein, 9 aa, Homo Sapiens
WIKSLMNSS

SEQ ID NO: 551134 - protein, 9 aa, Homo Sapiens
DPLRYAAVL

SEQ ID NO: 551135 - protein, 9 aa, Homo Sapiens
QPQELSLEK

SEQ ID NO: 551136 - protein, 9 aa, Homo Sapiens
YIFGTNCDT

SEQ ID NO: 551137 - protein, 9 aa, Homo Sapiens
LAHMDGQGC

SEQ ID NO: 551138 - protein, 9 aa, Homo Sapiens
KLTHTREKP

SEQ ID NO: 551139 - protein, 9 aa, Homo Sapiens
SVAEFSEAT

SEQ ID NO: 551140 - protein, 9 aa, Homo Sapiens
TKEDGILGT

SEQ ID NO: 551141 - protein, 9 aa, Homo Sapiens
SLLKIRQRI

SEQ ID NO: 551142 - protein, 9 aa, Homo Sapiens
RCGAQNKEH

SEQ ID NO: 551143 - protein, 9 aa, Homo Sapiens
EPPSSVAEF

SEQ ID NO: 551144 - protein, 9 aa, Homo Sapiens
LQKVAFSVQ

SEQ ID NO: 551145 - protein, 9 aa, Homo Sapiens
GTIIFLYLQ

SEQ ID NO: 551146 - protein, 9 aa, Homo Sapiens
IEVPTAIWN

SEQ ID NO: 551147 - protein, 9 aa, Homo Sapiens
GNEDYNNIQ

SEQ ID NO: 551148 - protein, 9 aa, Homo Sapiens
KTSPSSALI

SEQ ID NO: 551149 - protein, 9 aa, Homo Sapiens
RHYSIRPTA

SEQ ID NO: 551150 - protein, 9 aa, Homo Sapiens
HIEIGHRAL

SEQ ID NO: 551151 - protein, 9 aa, Homo Sapiens
IKENIKTSS

SEQ ID NO: 551152 - protein, 9 aa, Homo Sapiens
YQGDVPLGM

SEQ ID NO: 551153 - protein, 9 aa, Homo Sapiens
TKKGMAAPY

SEQ ID NO: 551154 - protein, 9 aa, Homo Sapiens
QRMPHQPSA

SEQ ID NO: 551155 - protein, 9 aa, Homo Sapiens
ICSLFFLLW

SEQ ID NO: 551156 - protein, 9 aa, Homo Sapiens
VIWTDVFQI

SEQ ID NO: 551157 - protein, 9 aa, Homo Sapiens
IFFYLTLIG

SEQ ID NO: 551158 - protein, 9 aa, Homo Sapiens
GYRVTLWVH

SEQ ID NO: 551159 - protein, 9 aa, Homo Sapiens
AEEEGGGPE

SEQ ID NO: 551160 - protein, 9 aa, Homo Sapiens
NSYYISRDT

SEQ ID NO: 551161 - protein, 9 aa, Homo Sapiens
EAGASTTPA

SEQ ID NO: 551162 - protein, 9 aa, Homo Sapiens
GTPSSTKKT

SEQ ID NO: 551163 - protein, 9 aa, Homo Sapiens
PSSALIGVR

SEQ ID NO: 551164 - protein, 9 aa, Homo Sapiens
DGDGDGEIS

SEQ ID NO: 551165 - protein, 9 aa, Homo Sapiens
AETQLGEAE

SEQ ID NO: 551166 - protein, 9 aa, Homo Sapiens
RHLQKRAQD

SEQ ID NO: 551167 - protein, 9 aa, Homo Sapiens
ELTGSSERS

SEQ ID NO: 551168 - protein, 9 aa, Homo Sapiens
FPHHPRHSL

SEQ ID NO: 551169 - protein, 9 aa, Homo Sapiens
NIRALQGSL

SEQ ID NO: 551170 - protein, 9 aa, Homo Sapiens
QVSLLLRSP

SEQ ID NO: 551171 - protein, 9 aa, Homo Sapiens
ELQSSTSNS

SEQ ID NO: 551172 - protein, 9 aa, Homo Sapiens
ETELFPYLR

SEQ ID NO: 551173 - protein, 9 aa, Homo Sapiens
IRDLPARKL

SEQ ID NO: 551174 - protein, 9 aa, Homo Sapiens
HSLVTMKIL

SEQ ID NO: 551175 - protein, 9 aa, Homo Sapiens
NGVSNRVSN

SEQ ID NO: 551176 - protein, 9 aa, Homo Sapiens
RLLGWKQGG

SEQ ID NO: 551177 - protein, 9 aa, Homo Sapiens
QNGSFDAPS

SEQ ID NO: 551178 - protein, 9 aa, Homo Sapiens
AGGMRQGSS

SEQ ID NO: 551179 - protein, 9 aa, Homo Sapiens
DAAPGKCQK

SEQ ID NO: 551180 - protein, 9 aa, Homo Sapiens
TIAPQPGEK

SEQ ID NO: 551181 - protein, 9 aa, Homo Sapiens
VQPCLLVTM

SEQ ID NO: 551182 - protein, 9 aa, Homo Sapiens
RPRAPPVPK

SEQ ID NO: 551183 - protein, 9 aa, Homo Sapiens
LPYPSTSLD

SEQ ID NO: 551184 - protein, 9 aa, Homo Sapiens
KDLGLSIRD

SEQ ID NO: 551185 - protein, 9 aa, Homo Sapiens
STHIEIGHR

SEQ ID NO: 551186 - protein, 9 aa, Homo Sapiens
CQPKIPEPC

SEQ ID NO: 551187 - protein, 9 aa, Homo Sapiens
YLNEYETEK

SEQ ID NO: 551188 - protein, 9 aa, Homo Sapiens
ASDCQRCCD

SEQ ID NO: 551189 - protein, 9 aa, Homo Sapiens
SMSQPYTMT

SEQ ID NO: 551190 - protein, 9 aa, Homo Sapiens
TNLQSKENM

SEQ ID NO: 551191 - protein, 9 aa, Homo Sapiens
GCRPPEGTL

SEQ ID NO: 551192 - protein, 9 aa, Homo Sapiens
AIPLGVTTP

SEQ ID NO: 551193 - protein, 9 aa, Homo Sapiens
VSKPYVMES

SEQ ID NO: 551194 - protein, 9 aa, Homo Sapiens
PGKCQKRKY

SEQ ID NO: 551195 - protein, 9 aa, Homo Sapiens
LARRSPRSG

SEQ ID NO: 551196 - protein, 9 aa, Homo Sapiens
AMASWPLEP

SEQ ID NO: 551197 - protein, 9 aa, Homo Sapiens
MQKKEDHLE

SEQ ID NO: 551198 - protein, 9 aa, Homo Sapiens
LAASRDVFS

SEQ ID NO: 551199 - protein, 9 aa, Homo Sapiens
VAFPHHPRH

SEQ ID NO: 551200 - protein, 9 aa, Homo Sapiens
LSFQVSLLL

SEQ ID NO: 551201 - protein, 9 aa, Homo Sapiens
IFAKNVFLG

SEQ ID NO: 551202 - protein, 9 aa, Homo Sapiens
SSHLTTHKL

SEQ ID NO: 551203 - protein, 9 aa, Homo Sapiens
ISQTVLTMN

SEQ ID NO: 551204 - protein, 9 aa, Homo Sapiens
RRCRACSGP

SEQ ID NO: 551205 - protein, 9 aa, Homo Sapiens
LGCAVQIFF

SEQ ID NO: 551206 - protein, 9 aa, Homo Sapiens
EDQLACSVL

SEQ ID NO: 551207 - protein, 9 aa, Homo Sapiens
SRHRRSHHE

SEQ ID NO: 551208 - protein, 9 aa, Homo Sapiens
EDMQKKEDH

SEQ ID NO: 551209 - protein, 9 aa, Homo Sapiens
QHKEQRQQE

SEQ ID NO: 551210 - protein, 9 aa, Homo Sapiens
PPWRSTPRT

SEQ ID NO: 551211 - protein, 9 aa, Homo Sapiens
ENMPTMINP

SEQ ID NO: 551212 - protein, 9 aa, Homo Sapiens
PCRRCRACS

SEQ ID NO: 551213 - protein, 9 aa, Homo Sapiens
LNSFTFGGV

SEQ ID NO: 551214 - protein, 9 aa, Homo Sapiens
EYETEKIEY

SEQ ID NO: 551215 - protein, 9 aa, Homo Sapiens
PDCDKPRTE

SEQ ID NO: 551216 - protein, 9 aa, Homo Sapiens
DSFPESSVG

SEQ ID NO: 551217 - protein, 9 aa, Homo Sapiens
QRYNSYYIS

SEQ ID NO: 551218 - protein, 9 aa, Homo Sapiens
SDTDNAEEE

SEQ ID NO: 551219 - protein, 9 aa, Homo Sapiens
SIPNGRDQH

SEQ ID NO: 551220 - protein, 9 aa, Homo Sapiens
DAGCDQRRK

SEQ ID NO: 551221 - protein, 9 aa, Homo Sapiens
TSSTSLSFS

SEQ ID NO: 551222 - protein, 9 aa, Homo Sapiens
RRLRDAGYR

SEQ ID NO: 551223 - protein, 9 aa, Homo Sapiens
KKCVKVTTK

SEQ ID NO: 551224 - protein, 9 aa, Homo Sapiens
LVYTLRNAE

SEQ ID NO: 551225 - protein, 9 aa, Homo Sapiens
FSLLKIRQR

SEQ ID NO: 551226 - protein, 9 aa, Homo Sapiens
PSDLALLVL

SEQ ID NO: 551227 - protein, 9 aa, Homo Sapiens
EIKENIKTS

SEQ ID NO: 551228 - protein, 9 aa, Homo Sapiens
FGNEDYNNI

SEQ ID NO: 551229 - protein, 9 aa, Homo Sapiens
EDYNNIQDS

SEQ ID NO: 551230 - protein, 9 aa, Homo Sapiens
PHSCMAKSV

SEQ ID NO: 551231 - protein, 9 aa, Homo Sapiens
NRKKCVKVT

SEQ ID NO: 551232 - protein, 9 aa, Homo Sapiens
PLVAETQLG

SEQ ID NO: 551233 - protein, 9 aa, Homo Sapiens
ILVIGMGNL

SEQ ID NO: 551234 - protein, 9 aa, Homo Sapiens
LHFMPGRGP

SEQ ID NO: 551235 - protein, 9 aa, Homo Sapiens
EQMEDMQKK

SEQ ID NO: 551236 - protein, 9 aa, Homo Sapiens
VETLKFARG

SEQ ID NO: 551237 - protein, 9 aa, Homo Sapiens
VIERNGRKL

SEQ ID NO: 551238 - protein, 9 aa, Homo Sapiens
RVNVLIGLL

SEQ ID NO: 551239 - protein, 9 aa, Homo Sapiens
EGSSQRMPH

SEQ ID NO: 551240 - protein, 9 aa, Homo Sapiens
IGVRVILWA

SEQ ID NO: 551241 - protein, 9 aa, Homo Sapiens
PRHSLTGPR

SEQ ID NO: 551242 - protein, 9 aa, Homo Sapiens
MAGPAIGTE

SEQ ID NO: 551243 - protein, 9 aa, Homo Sapiens
AGPAIGTEG

SEQ ID NO: 551244 - protein, 9 aa, Homo Sapiens
VVASKAQMT

SEQ ID NO: 551245 - protein, 9 aa, Homo Sapiens
KSGGAMVWA

SEQ ID NO: 551246 - protein, 9 aa, Homo Sapiens
ELAASRDVF

SEQ ID NO: 551247 - protein, 9 aa, Homo Sapiens
VLIGLLVVG

SEQ ID NO: 551248 - protein, 9 aa, Homo Sapiens
SFCMLSQLH

SEQ ID NO: 551249 - protein, 9 aa, Homo Sapiens
RTPLIQIKK

SEQ ID NO: 551250 - protein, 9 aa, Homo Sapiens
PGLSAQAGL

SEQ ID NO: 551251 - protein, 9 aa, Homo Sapiens
VTPCALPVS

SEQ ID NO: 551252 - protein, 9 aa, Homo Sapiens
THKLTHTRE

SEQ ID NO: 551253 - protein, 9 aa, Homo Sapiens
WRHLQKRAQ

SEQ ID NO: 551254 - protein, 9 aa, Homo Sapiens
EVDGDGDGE

SEQ ID NO: 551255 - protein, 9 aa, Homo Sapiens
DIHPALPLL

SEQ ID NO: 551256 - protein, 9 aa, Homo Sapiens
NSLQKEPNG

SEQ ID NO: 551257 - protein, 9 aa, Homo Sapiens
GKCQKRKYI

SEQ ID NO: 551258 - protein, 9 aa, Homo Sapiens
RQGSSPAPD

SEQ ID NO: 551259 - protein, 9 aa, Homo Sapiens
QGSQKHRAP

SEQ ID NO: 551260 - protein, 9 aa, Homo Sapiens
VSGRQLCPA

SEQ ID NO: 551261 - protein, 9 aa, Homo Sapiens
AFASPNCGS

SEQ ID NO: 551262 - protein, 9 aa, Homo Sapiens
QNEAKCLGA

SEQ ID NO: 551263 - protein, 9 aa, Homo Sapiens
SERSEQPLS

SEQ ID NO: 551264 - protein, 9 aa, Homo Sapiens
SQTVLTMNL

SEQ ID NO: 551265 - protein, 9 aa, Homo Sapiens
VLDVASPTE

SEQ ID NO: 551266 - protein, 9 aa, Homo Sapiens
DHGQAAYRA

SEQ ID NO: 551267 - protein, 9 aa, Homo Sapiens
YKCHQYGKA

SEQ ID NO: 551268 - protein, 9 aa, Homo Sapiens
ARGQRWRLG

SEQ ID NO: 551269 - protein, 9 aa, Homo Sapiens
FMYTCPATV

SEQ ID NO: 551270 - protein, 9 aa, Homo Sapiens
IYLIFAKNV

SEQ ID NO: 551271 - protein, 9 aa, Homo Sapiens
TNGVSNRVS

SEQ ID NO: 551272 - protein, 9 aa, Homo Sapiens
SLVTMKILH

SEQ ID NO: 551273 - protein, 9 aa, Homo Sapiens
SLQKEPNGE

SEQ ID NO: 551274 - protein, 9 aa, Homo Sapiens
VDSAGPRPE

SEQ ID NO: 551275 - protein, 9 aa, Homo Sapiens
HFMPGRGPI

SEQ ID NO: 551276 - protein, 9 aa, Homo Sapiens
ASSLPSPFS

SEQ ID NO: 551277 - protein, 9 aa, Homo Sapiens
HLTTHKLTH

SEQ ID NO: 551278 - protein, 9 aa, Homo Sapiens
VTPLLNSVI

SEQ ID NO: 551279 - protein, 9 aa, Homo Sapiens
NAEEEPVGR

SEQ ID NO: 551280 - protein, 9 aa, Homo Sapiens
IQQKIECKL

SEQ ID NO: 551281 - protein, 9 aa, Homo Sapiens
SPGLSAQAG

SEQ ID NO: 551282 - protein, 9 aa, Homo Sapiens
SNKLKGRSS

SEQ ID NO: 551283 - protein, 9 aa, Homo Sapiens
HKLTHTREK

SEQ ID NO: 551284 - protein, 9 aa, Homo Sapiens
KELYTLKVD

SEQ ID NO: 551285 - protein, 9 aa, Homo Sapiens
LKFARGQRW

SEQ ID NO: 551286 - protein, 9 aa, Homo Sapiens
SILSFQVSL

SEQ ID NO: 551287 - protein, 9 aa, Homo Sapiens
ARPSDNGQY

SEQ ID NO: 551288 - protein, 9 aa, Homo Sapiens
ENTTTGIAE

SEQ ID NO: 551289 - protein, 9 aa, Homo Sapiens
KTNTQLSPA

SEQ ID NO: 551290 - protein, 9 aa, Homo Sapiens
SEQPLSVGR

SEQ ID NO: 551291 - protein, 9 aa, Homo Sapiens
TNTQLSPAT

SEQ ID NO: 551292 - protein, 9 aa, Homo Sapiens
MTTYYTVRM

SEQ ID NO: 551293 - protein, 9 aa, Homo Sapiens
SQDRTIAPQ

SEQ ID NO: 551294 - protein, 9 aa, Homo Sapiens
QVETELFPY

SEQ ID NO: 551295 - protein, 9 aa, Homo Sapiens
SKHPGTATS

SEQ ID NO: 551296 - protein, 9 aa, Homo Sapiens
VPCSAVYVR

SEQ ID NO: 551297 - protein, 9 aa, Homo Sapiens
LACSVLDVA

SEQ ID NO: 551298 - protein, 9 aa, Homo Sapiens
GNLGSDIAV

SEQ ID NO: 551299 - protein, 9 aa, Homo Sapiens
DLGLSIRDL

SEQ ID NO: 551300 - protein, 9 aa, Homo Sapiens
LAAGFHTGE

SEQ ID NO: 551301 - protein, 9 aa, Homo Sapiens
LRVNVLIGL

SEQ ID NO: 551302 - protein, 9 aa, Homo Sapiens
KTSRVLQKV

SEQ ID NO: 551303 - protein, 9 aa, Homo Sapiens
LRYAAVLTT

SEQ ID NO: 551304 - protein, 9 aa, Homo Sapiens
CMAKSVYWA

SEQ ID NO: 551305 - protein, 9 aa, Homo Sapiens
QELQSSTSN

SEQ ID NO: 551306 - protein, 9 aa, Homo Sapiens
CAVQIFFYL

SEQ ID NO: 551307 - protein, 9 aa, Homo Sapiens
QYGKAFIQS

SEQ ID NO: 551308 - protein, 9 aa, Homo Sapiens
NTQLSPATL

SEQ ID NO: 551309 - protein, 9 aa, Homo Sapiens
PVSGRQLCP

SEQ ID NO: 551310 - protein, 9 aa, Homo Sapiens
GRDQHLGVD

SEQ ID NO: 551311 - protein, 9 aa, Homo Sapiens
YETEKIEYN

SEQ ID NO: 551312 - protein, 9 aa, Homo Sapiens
PSPFSCPHS

SEQ ID NO: 551313 - protein, 9 aa, Homo Sapiens
TATKKGMAA

SEQ ID NO: 551314 - protein, 9 aa, Homo Sapiens
CVKVTTKGL

SEQ ID NO: 551315 - protein, 9 aa, Homo Sapiens
EGGAGTESK

SEQ ID NO: 551316 - protein, 9 aa, Homo Sapiens
PDTSYSDMA

SEQ ID NO: 551317 - protein, 9 aa, Homo Sapiens
MLNPLVYTL

SEQ ID NO: 551318 - protein, 9 aa, Homo Sapiens
WTDVFQIGI

SEQ ID NO: 551319 - protein, 9 aa, Homo Sapiens
RCRACSGPG

SEQ ID NO: 551320 - protein, 9 aa, Homo Sapiens
GIGWIWLAV

SEQ ID NO: 551321 - protein, 9 aa, Homo Sapiens
CDPLRYAAV

SEQ ID NO: 551322 - protein, 9 aa, Homo Sapiens
VEEAINQNE

SEQ ID NO: 551323 - protein, 9 aa, Homo Sapiens
SLAHMDGQG

SEQ ID NO: 551324 - protein, 9 aa, Homo Sapiens
RGGAGGMRQ

SEQ ID NO: 551325 - protein, 9 aa, Homo Sapiens
RLRDAGYRV

SEQ ID NO: 551326 - protein, 9 aa, Homo Sapiens
FRRLRDAGY

SEQ ID NO: 551327 - protein, 9 aa, Homo Sapiens
MEDMQKKED

SEQ ID NO: 551328 - protein, 9 aa, Homo Sapiens
FLAWNSIKY

SEQ ID NO: 551329 - protein, 9 aa, Homo Sapiens
LQRYNSYYI

SEQ ID NO: 551330 - protein, 9 aa, Homo Sapiens
GVDVNPEEF

SEQ ID NO: 551331 - protein, 9 aa, Homo Sapiens
VVVISLQTT

SEQ ID NO: 551332 - protein, 9 aa, Homo Sapiens
NKLKGRSSP

SEQ ID NO: 551333 - protein, 9 aa, Homo Sapiens
SVLDVASPT

SEQ ID NO: 551334 - protein, 9 aa, Homo Sapiens
ALPVSGRQL

SEQ ID NO: 551335 - protein, 9 aa, Homo Sapiens
IAGLPVKVV

SEQ ID NO: 551336 - protein, 9 aa, Homo Sapiens
VSNRVSNGL

SEQ ID NO: 551337 - protein, 9 aa, Homo Sapiens
GVNKYSTGI

SEQ ID NO: 551338 - protein, 9 aa, Homo Sapiens
WGSLKSSTS

SEQ ID NO: 551339 - protein, 9 aa, Homo Sapiens
RAVASDCQR

SEQ ID NO: 551340 - protein, 9 aa, Homo Sapiens
QRRQWRKTR

SEQ ID NO: 551341 - protein, 9 aa, Homo Sapiens
MLDPLEVPL

SEQ ID NO: 551342 - protein, 9 aa, Homo Sapiens
SQRMPHQPS

SEQ ID NO: 551343 - protein, 9 aa, Homo Sapiens
KPHCDRNRV

SEQ ID NO: 551344 - protein, 9 aa, Homo Sapiens
AEEEPVGRK

SEQ ID NO: 551345 - protein, 9 aa, Homo Sapiens
VAMASWPLE

SEQ ID NO: 551346 - protein, 9 aa, Homo Sapiens
IWTDVFQIG

SEQ ID NO: 551347 - protein, 9 aa, Homo Sapiens
FHMASGEAL

SEQ ID NO: 551348 - protein, 9 aa, Homo Sapiens
RSTPRTDVL

SEQ ID NO: 551349 - protein, 9 aa, Homo Sapiens
LGFPELESR

SEQ ID NO: 551350 - protein, 9 aa, Homo Sapiens
TSRVLQKVA

SEQ ID NO: 551351 - protein, 9 aa, Homo Sapiens
IEIGHRALE

SEQ ID NO: 551352 - protein, 9 aa, Homo Sapiens
TGSSERSEQ

SEQ ID NO: 551353 - protein, 9 aa, Homo Sapiens
KIRQRIVCL

SEQ ID NO: 551354 - protein, 9 aa, Homo Sapiens
YPVLSVLVF

SEQ ID NO: 551355 - protein, 9 aa, Homo Sapiens
GFRFHMASG

SEQ ID NO: 551356 - protein, 9 aa, Homo Sapiens
SLDSFPESS

SEQ ID NO: 551357 - protein, 9 aa, Homo Sapiens
PQPGEKKKP

SEQ ID NO: 551358 - protein, 9 aa, Homo Sapiens
MLSQLHQHQ

SEQ ID NO: 551359 - protein, 9 aa, Homo Sapiens
VAETQLGEA

SEQ ID NO: 551360 - protein, 9 aa, Homo Sapiens
VASKAQMTT

SEQ ID NO: 551361 - protein, 9 aa, Homo Sapiens
ISEVDGDGD

SEQ ID NO: 551362 - protein, 9 aa, Homo Sapiens
PWRSTPRTD

SEQ ID NO: 551363 - protein, 9 aa, Homo Sapiens
QKNRKKCVK

SEQ ID NO: 551364 - protein, 9 aa, Homo Sapiens
TSELRDSDF

SEQ ID NO: 551365 - protein, 9 aa, Homo Sapiens
FFYLTLIGG

SEQ ID NO: 551366 - protein, 9 aa, Homo Sapiens
CPCRRCRAC

SEQ ID NO: 551367 - protein, 9 aa, Homo Sapiens
GFTKEDGIL

SEQ ID NO: 551368 - protein, 9 aa, Homo Sapiens
FDRAVASDC

SEQ ID NO: 551369 - protein, 9 aa, Homo Sapiens
QKHCYPLIG

SEQ ID NO: 551370 - protein, 9 aa, Homo Sapiens
VVFLKALSE

SEQ ID NO: 551371 - protein, 9 aa, Homo Sapiens
RDPEENKMA

SEQ ID NO: 551372 - protein, 9 aa, Homo Sapiens
PLRYAAVLT

SEQ ID NO: 551373 - protein, 9 aa, Homo Sapiens
FSPQGSQKH

SEQ ID NO: 551374 - protein, 9 aa, Homo Sapiens
EPQDSAKTN

SEQ ID NO: 551375 - protein, 9 aa, Homo Sapiens
SPETTSSGG

SEQ ID NO: 551376 - protein, 9 aa, Homo Sapiens
GMRNTICRM

SEQ ID NO: 551377 - protein, 9 aa, Homo Sapiens
DAKIEDKAL

SEQ ID NO: 551378 - protein, 9 aa, Homo Sapiens
KTATKKGMA

SEQ ID NO: 551379 - protein, 9 aa, Homo Sapiens
GDVPLGMRN

SEQ ID NO: 551380 - protein, 9 aa, Homo Sapiens
ALLVLEEDV

SEQ ID NO: 551381 - protein, 9 aa, Homo Sapiens
QIKKSTSSS

SEQ ID NO: 551382 - protein, 9 aa, Homo Sapiens
QAAYRAYSL

SEQ ID NO: 551383 - protein, 9 aa, Homo Sapiens
GFHTGEQED

SEQ ID NO: 551384 - protein, 9 aa, Homo Sapiens
HKEQRQQES

SEQ ID NO: 551385 - protein, 9 aa, Homo Sapiens
AVAIFYGTI

SEQ ID NO: 551386 - protein, 9 aa, Homo Sapiens
LKESSVQVD

SEQ ID NO: 551387 - protein, 9 aa, Homo Sapiens
RVLQKVAFS

SEQ ID NO: 551388 - protein, 9 aa, Homo Sapiens
KVSNKLKGR

SEQ ID NO: 551389 - protein, 9 aa, Homo Sapiens
QWTPEYKEL

SEQ ID NO: 551390 - protein, 9 aa, Homo Sapiens
LQKRAQDAV

SEQ ID NO: 551391 - protein, 9 aa, Homo Sapiens
CIEAMKEII

SEQ ID NO: 551392 - protein, 9 aa, Homo Sapiens
QHLGVDPTE

SEQ ID NO: 551393 - protein, 9 aa, Homo Sapiens
KNRKKCVKV

SEQ ID NO: 551394 - protein, 9 aa, Homo Sapiens
LHSISQTVL

SEQ ID NO: 551395 - protein, 9 aa, Homo Sapiens
SDTLEDHTK

SEQ ID NO: 551396 - protein, 9 aa, Homo Sapiens
VLQKVAFSV

SEQ ID NO: 551397 - protein, 9 aa, Homo Sapiens
APGVQPCLL

SEQ ID NO: 551398 - protein, 9 aa, Homo Sapiens
KIECKLFTS

SEQ ID NO: 551399 - protein, 9 aa, Homo Sapiens
QVSVCAFNK

SEQ ID NO: 551400 - protein, 9 aa, Homo Sapiens
LAKQDTEAA

SEQ ID NO: 551401 - protein, 9 aa, Homo Sapiens
EEPVGRKET

SEQ ID NO: 551402 - protein, 9 aa, Homo Sapiens
ILHDCVQLS

SEQ ID NO: 551403 - protein, 9 aa, Homo Sapiens
YLIFAKNVF

SEQ ID NO: 551404 - protein, 9 aa, Homo Sapiens
PQELSLEKL

SEQ ID NO: 551405 - protein, 9 aa, Homo Sapiens
NLGFRFHMA

SEQ ID NO: 551406 - protein, 9 aa, Homo Sapiens
NRVSNGLHL

SEQ ID NO: 551407 - protein, 9 aa, Homo Sapiens
IERNGRKLK

SEQ ID NO: 551408 - protein, 9 aa, Homo Sapiens
LGMRNTICR

SEQ ID NO: 551409 - protein, 9 aa, Homo Sapiens
SFTFGGVGS

SEQ ID NO: 551410 - protein, 9 aa, Homo Sapiens
IFLAWNSIK

SEQ ID NO: 551411 - protein, 9 aa, Homo Sapiens
RTEACPMKR

SEQ ID NO: 551412 - protein, 9 aa, Homo Sapiens
DLALLVLEE

SEQ ID NO: 551413 - protein, 9 aa, Homo Sapiens
GEGGAGTES

SEQ ID NO: 551414 - protein, 9 aa, Homo Sapiens
NIQWQKHCY

SEQ ID NO: 551415 - protein, 9 aa, Homo Sapiens
CSRRCGAQN

SEQ ID NO: 551416 - protein, 9 aa, Homo Sapiens
VQVDNESCC

SEQ ID NO: 551417 - protein, 9 aa, Homo Sapiens
HPGTATSRQ

SEQ ID NO: 551418 - protein, 9 aa, Homo Sapiens
LESREDQPF

SEQ ID NO: 551419 - protein, 9 aa, Homo Sapiens
CRPPEGTLR

SEQ ID NO: 551420 - protein, 9 aa, Homo Sapiens
EEELGVLPY

SEQ ID NO: 551421 - protein, 9 aa, Homo Sapiens
YKELYTLKV

SEQ ID NO: 551422 - protein, 9 aa, Homo Sapiens
GMAGPAIGT

SEQ ID NO: 551423 - protein, 9 aa, Homo Sapiens
MKEIIAGLP

SEQ ID NO: 551424 - protein, 9 aa, Homo Sapiens
KHCYPLIGS

SEQ ID NO: 551425 - protein, 9 aa, Homo Sapiens
LFRDAGTRW

SEQ ID NO: 551426 - protein, 9 aa, Homo Sapiens
NEDYNNIQD

SEQ ID NO: 551427 - protein, 9 aa, Homo Sapiens
GYSGFQATT

SEQ ID NO: 551428 - protein, 9 aa, Homo Sapiens
AQAGLQKIW

SEQ ID NO: 551429 - protein, 9 aa, Homo Sapiens
QKVAFSVQK

SEQ ID NO: 551430 - protein, 9 aa, Homo Sapiens
AWRHLQKRA

SEQ ID NO: 551431 - protein, 9 aa, Homo Sapiens
NVLIGLLVV

SEQ ID NO: 551432 - protein, 9 aa, Homo Sapiens
DNAEEEPVG

SEQ ID NO: 551433 - protein, 9 aa, Homo Sapiens
WNSIKYKED

SEQ ID NO: 551434 - protein, 9 aa, Homo Sapiens
ADVNEAGAS

SEQ ID NO: 551435 - protein, 9 aa, Homo Sapiens
YRVTLWVHP

SEQ ID NO: 551436 - protein, 9 aa, Homo Sapiens
VAIFYGTII

SEQ ID NO: 551437 - protein, 9 aa, Homo Sapiens
TPVSAQFQD

SEQ ID NO: 551438 - protein, 9 aa, Homo Sapiens
CHQYGKAFI

SEQ ID NO: 551439 - protein, 9 aa, Homo Sapiens
DLSNRHSYP

SEQ ID NO: 551440 - protein, 9 aa, Homo Sapiens
QWQKHCYPL

SEQ ID NO: 551441 - protein, 9 aa, Homo Sapiens
RQRIVCLVL

SEQ ID NO: 551442 - protein, 9 aa, Homo Sapiens
VPLGMRNTI

SEQ ID NO: 551443 - protein, 9 aa, Homo Sapiens
SALNTNIRA

SEQ ID NO: 551444 - protein, 9 aa, Homo Sapiens
FDAPSERPY

SEQ ID NO: 551445 - protein, 9 aa, Homo Sapiens
EYVAMASWP

SEQ ID NO: 551446 - protein, 9 aa, Homo Sapiens
DKTSELRDS

SEQ ID NO: 551447 - protein, 9 aa, Homo Sapiens
IIAGLPVKV

SEQ ID NO: 551448 - protein, 9 aa, Homo Sapiens
DGQGCEHTS

SEQ ID NO: 551449 - protein, 9 aa, Homo Sapiens
EKFCKCEEC

SEQ ID NO: 551450 - protein, 9 aa, Homo Sapiens
EIIAGLPVK

SEQ ID NO: 551451 - protein, 9 aa, Homo Sapiens
IIHTGEKFC

SEQ ID NO: 551452 - protein, 9 aa, Homo Sapiens
YPSTSLDGE

SEQ ID NO: 551453 - protein, 9 aa, Homo Sapiens
VKVTTKGLH

SEQ ID NO: 551454 - protein, 9 aa, Homo Sapiens
VSQDRTIAP

SEQ ID NO: 551455 - protein, 9 aa, Homo Sapiens
SSKEEMREL

SEQ ID NO: 551456 - protein, 9 aa, Homo Sapiens
LNSLQKEPN

SEQ ID NO: 551457 - protein, 9 aa, Homo Sapiens
KSLMNSSKE

SEQ ID NO: 551458 - protein, 9 aa, Homo Sapiens
KFARGQRWR

SEQ ID NO: 551459 - protein, 9 aa, Homo Sapiens
TMKILHDCV

SEQ ID NO: 551460 - protein, 9 aa, Homo Sapiens
VPLLDFPNI

SEQ ID NO: 551461 - protein, 9 aa, Homo Sapiens
LLKIRQRIV

SEQ ID NO: 551462 - protein, 9 aa, Homo Sapiens
FDDEADKTS

SEQ ID NO: 551463 - protein, 9 aa, Homo Sapiens
VFSLLKIRQ

SEQ ID NO: 551464 - protein, 9 aa, Homo Sapiens
PRAKTICSL

SEQ ID NO: 551465 - protein, 9 aa, Homo Sapiens
NITKIEVPT

SEQ ID NO: 551466 - protein, 9 aa, Homo Sapiens
VVTPLLNSV

SEQ ID NO: 551467 - protein, 9 aa, Homo Sapiens
EDPKSHRDL

SEQ ID NO: 551468 - protein, 9 aa, Homo Sapiens
SSGGCHSPE

SEQ ID NO: 551469 - protein, 9 aa, Homo Sapiens
RVSNGLHLH

SEQ ID NO: 551470 - protein, 9 aa, Homo Sapiens
CLLVTMTSV

SEQ ID NO: 551471 - protein, 9 aa, Homo Sapiens
NGRDQHLGV

SEQ ID NO: 551472 - protein, 9 aa, Homo Sapiens
TCRDPEENK

SEQ ID NO: 551473 - protein, 9 aa, Homo Sapiens
AFIQSFNLQ

SEQ ID NO: 551474 - protein, 9 aa, Homo Sapiens
SIRPTAGAQ

SEQ ID NO: 551475 - protein, 9 aa, Homo Sapiens
GPETSSVLH

SEQ ID NO: 551476 - protein, 9 aa, Homo Sapiens
DQRRKGGLS

SEQ ID NO: 551477 - protein, 9 aa, Homo Sapiens
CPATVFPMD

SEQ ID NO: 551478 - protein, 9 aa, Homo Sapiens
GEKFCKCEE

SEQ ID NO: 551479 - protein, 9 aa, Homo Sapiens
QDTEAAIQS

SEQ ID NO: 551480 - protein, 9 aa, Homo Sapiens
AIGTEGILT

SEQ ID NO: 551481 - protein, 9 aa, Homo Sapiens
NLKESSVQV

SEQ ID NO: 551482 - protein, 9 aa, Homo Sapiens
HAVPTYAPA

SEQ ID NO: 551483 - protein, 9 aa, Homo Sapiens
ISSEEDGSL

SEQ ID NO: 551484 - protein, 9 aa, Homo Sapiens
GKRHHGTPS

SEQ ID NO: 551485 - protein, 9 aa, Homo Sapiens
EELAASRDV

SEQ ID NO: 551486 - protein, 9 aa, Homo Sapiens
GGAGGMRQG

SEQ ID NO: 551487 - protein, 9 aa, Homo Sapiens
IEAMKEIIA

SEQ ID NO: 551488 - protein, 9 aa, Homo Sapiens
SLSFSPDSP

SEQ ID NO: 551489 - protein, 9 aa, Homo Sapiens
LLTCRDPEE

SEQ ID NO: 551490 - protein, 9 aa, Homo Sapiens
ANPSAHAVP

SEQ ID NO: 551491 - protein, 9 aa, Homo Sapiens
FQVSLLLRS

SEQ ID NO: 551492 - protein, 9 aa, Homo Sapiens
DVPLGMRNT

SEQ ID NO: 551493 - protein, 9 aa, Homo Sapiens
HGTPSSTKK

SEQ ID NO: 551494 - protein, 9 aa, Homo Sapiens
ADKTSELRD

SEQ ID NO: 551495 - protein, 9 aa, Homo Sapiens
PGVQPCLLV

SEQ ID NO: 551496 - protein, 9 aa, Homo Sapiens
TQLGEAEVA

SEQ ID NO: 551497 - protein, 9 aa, Homo Sapiens
QHGNRTFSD

SEQ ID NO: 551498 - protein, 9 aa, Homo Sapiens
RGLEQHKEQ

SEQ ID NO: 551499 - protein, 9 aa, Homo Sapiens
ELGVLPYPS

SEQ ID NO: 551500 - protein, 9 aa, Homo Sapiens
HCDRNRVHP

SEQ ID NO: 551501 - protein, 9 aa, Homo Sapiens
LSQLHQHQI

SEQ ID NO: 551502 - protein, 9 aa, Homo Sapiens
EEDGSLEVG

SEQ ID NO: 551503 - protein, 9 aa, Homo Sapiens
TEPPSSVAE

SEQ ID NO: 551504 - protein, 9 aa, Homo Sapiens
FLHSISQTV

SEQ ID NO: 551505 - protein, 9 aa, Homo Sapiens
LSYRHYSIR

SEQ ID NO: 551506 - protein, 9 aa, Homo Sapiens
EAILGFTKE

SEQ ID NO: 551507 - protein, 9 aa, Homo Sapiens
DAGTRWASG

SEQ ID NO: 551508 - protein, 9 aa, Homo Sapiens
SWPLEPEGP

SEQ ID NO: 551509 - protein, 9 aa, Homo Sapiens
GCAVQIFFY

SEQ ID NO: 551510 - protein, 9 aa, Homo Sapiens
DCDKPRTEA

SEQ ID NO: 551511 - protein, 9 aa, Homo Sapiens
ILGFTKEDG

SEQ ID NO: 551512 - protein, 9 aa, Homo Sapiens
KCVKVTTKG

SEQ ID NO: 551513 - protein, 9 aa, Homo Sapiens
IFGTNCDTG

SEQ ID NO: 551514 - protein, 9 aa, Homo Sapiens
KCQKRKYIE

SEQ ID NO: 551515 - protein, 9 aa, Homo Sapiens
MKILHDCVQ

SEQ ID NO: 551516 - protein, 9 aa, Homo Sapiens
SPFSCPHSH

SEQ ID NO: 551517 - protein, 9 aa, Homo Sapiens
IPEPCQPKV

SEQ ID NO: 551518 - protein, 9 aa, Homo Sapiens
NGSFDAPSE

SEQ ID NO: 551519 - protein, 9 aa, Homo Sapiens
TSSVPRRTL

SEQ ID NO: 551520 - protein, 9 aa, Homo Sapiens
NKYSTGIGW

SEQ ID NO: 551521 - protein, 9 aa, Homo Sapiens
MRQGSSPAP

SEQ ID NO: 551522 - protein, 9 aa, Homo Sapiens
DFGPETSSV

SEQ ID NO: 551523 - protein, 9 aa, Homo Sapiens
GVQPCLLVT

SEQ ID NO: 551524 - protein, 9 aa, Homo Sapiens
QKVEKKGHG

SEQ ID NO: 551525 - protein, 9 aa, Homo Sapiens
FRFHMASGE

SEQ ID NO: 551526 - protein, 9 aa, Homo Sapiens
KFCKCEECG

SEQ ID NO: 551527 - protein, 9 aa, Homo Sapiens
GGMRQGSSP

SEQ ID NO: 551528 - protein, 9 aa, Homo Sapiens
KKKYYDAKI

SEQ ID NO: 551529 - protein, 9 aa, Homo Sapiens
PSTSPDIHP

SEQ ID NO: 551530 - protein, 9 aa, Homo Sapiens
NNLQRRQWR

SEQ ID NO: 551531 - protein, 9 aa, Homo Sapiens
PLVYTLRNA

SEQ ID NO: 551532 - protein, 9 aa, Homo Sapiens
GPRAKTICS

SEQ ID NO: 551533 - protein, 9 aa, Homo Sapiens
HLQKRAQDA

SEQ ID NO: 551534 - protein, 9 aa, Homo Sapiens
YYDAKIEDK

SEQ ID NO: 551535 - protein, 9 aa, Homo Sapiens
REDQPFSRL

SEQ ID NO: 551536 - protein, 9 aa, Homo Sapiens
TPLIQIKKS

SEQ ID NO: 551537 - protein, 9 aa, Homo Sapiens
TTTGIAETH

SEQ ID NO: 551538 - protein, 9 aa, Homo Sapiens
PPEGTLRDS

SEQ ID NO: 551539 - protein, 9 aa, Homo Sapiens
NEAGASTTP

SEQ ID NO: 551540 - protein, 9 aa, Homo Sapiens
IGLLVVGAI

SEQ ID NO: 551541 - protein, 9 aa, Homo Sapiens
AIQQKIECK

SEQ ID NO: 551542 - protein, 9 aa, Homo Sapiens
VNEAGASTT

SEQ ID NO: 551543 - protein, 9 aa, Homo Sapiens
GMRQGSSPA

SEQ ID NO: 551544 - protein, 9 aa, Homo Sapiens
FCMLSQLHQ

SEQ ID NO: 551545 - protein, 9 aa, Homo Sapiens
AQFQDIEGK

SEQ ID NO: 551546 - protein, 9 aa, Homo Sapiens
EDQNEAKCL

SEQ ID NO: 551547 - protein, 9 aa, Homo Sapiens
SSFKWGSLK

SEQ ID NO: 551548 - protein, 9 aa, Homo Sapiens
RDQHLGVDP

SEQ ID NO: 551549 - protein, 9 aa, Homo Sapiens
PLLDFPNIV

SEQ ID NO: 551550 - protein, 9 aa, Homo Sapiens
CMLSQLHQH

SEQ ID NO: 551551 - protein, 9 aa, Homo Sapiens
KQGGEEEKW

SEQ ID NO: 551552 - protein, 9 aa, Homo Sapiens
TTSSTSLSF

SEQ ID NO: 551553 - protein, 9 aa, Homo Sapiens
IIFLYLQPA

SEQ ID NO: 551554 - protein, 9 aa, Homo Sapiens
AKTNTQLSP

SEQ ID NO: 551555 - protein, 9 aa, Homo Sapiens
MLYPVLSVL

SEQ ID NO: 551556 - protein, 9 aa, Homo Sapiens
GSSQRMPHQ

SEQ ID NO: 551557 - protein, 9 aa, Homo Sapiens
IGMGNLGSD

SEQ ID NO: 551558 - protein, 9 aa, Homo Sapiens
SSEEDGSLE

SEQ ID NO: 551559 - protein, 9 aa, Homo Sapiens
KWMPGSQHF

SEQ ID NO: 551560 - protein, 9 aa, Homo Sapiens
FMEVLAKQD

SEQ ID NO: 551561 - protein, 9 aa, Homo Sapiens
CCSVDSAGP

SEQ ID NO: 551562 - protein, 9 aa, Homo Sapiens
SLEKLKSWG

SEQ ID NO: 551563 - protein, 9 aa, Homo Sapiens
IAVAIFYGT

SEQ ID NO: 551564 - protein, 9 aa, Homo Sapiens
RLLEWKQKV

SEQ ID NO: 551565 - protein, 9 aa, Homo Sapiens
ERSEQPLSV

SEQ ID NO: 551566 - protein, 9 aa, Homo Sapiens
NVVVISLQT

SEQ ID NO: 551567 - protein, 9 aa, Homo Sapiens
FIAVAIFYG

SEQ ID NO: 551568 - protein, 9 aa, Homo Sapiens
KDLLTCRDP

SEQ ID NO: 551569 - protein, 9 aa, Homo Sapiens
SVQVDNESC

SEQ ID NO: 551570 - protein, 9 aa, Homo Sapiens
CRRCRACSG

SEQ ID NO: 551571 - protein, 9 aa, Homo Sapiens
FGVDVNPEE

SEQ ID NO: 551572 - protein, 9 aa, Homo Sapiens
DTLEDHTKQ

SEQ ID NO: 551573 - protein, 9 aa, Homo Sapiens
MEVLAKQDT

SEQ ID NO: 551574 - protein, 9 aa, Homo Sapiens
AASRDVFSG

SEQ ID NO: 551575 - protein, 9 aa, Homo Sapiens
KGMAAPYFN

SEQ ID NO: 551576 - protein, 9 aa, Homo Sapiens
APSERPYSL

SEQ ID NO: 551577 - protein, 9 aa, Homo Sapiens
SERPYSLKI

SEQ ID NO: 551578 - protein, 9 aa, Homo Sapiens
VLPYPSTSL

SEQ ID NO: 551579 - protein, 9 aa, Homo Sapiens
TSPSSALIG

SEQ ID NO: 551580 - protein, 9 aa, Homo Sapiens
PVSAQFQDI

SEQ ID NO: 551581 - protein, 9 aa, Homo Sapiens
AKTICSLFF

SEQ ID NO: 551582 - protein, 9 aa, Homo Sapiens
SQKHRAPQA

SEQ ID NO: 551583 - protein, 9 aa, Homo Sapiens
PETSSVLHL

SEQ ID NO: 551584 - protein, 9 aa, Homo Sapiens
RFSAALHLL

SEQ ID NO: 551585 - protein, 9 aa, Homo Sapiens
RHSLTGPRS

SEQ ID NO: 551586 - protein, 9 aa, Homo Sapiens
LLNSVIYSF

SEQ ID NO: 551587 - protein, 9 aa, Homo Sapiens
CKTYIFGTN

SEQ ID NO: 551588 - protein, 9 aa, Homo Sapiens
YLRVNVLIG

SEQ ID NO: 551589 - protein, 9 aa, Homo Sapiens
PPSSVAEFS

SEQ ID NO: 551590 - protein, 9 aa, Homo Sapiens
TELFPYLRH

SEQ ID NO: 551591 - protein, 9 aa, Homo Sapiens
FAKNVFLGD

SEQ ID NO: 551592 - protein, 9 aa, Homo Sapiens
HSCMAKSVY

SEQ ID NO: 551593 - protein, 9 aa, Homo Sapiens
APQPGEKKK

SEQ ID NO: 551594 - protein, 9 aa, Homo Sapiens
LGYSGFQAT

SEQ ID NO: 551595 - protein, 9 aa, Homo Sapiens
SAQFQDIEG

SEQ ID NO: 551596 - protein, 9 aa, Homo Sapiens
KESSVQVDN

SEQ ID NO: 551597 - protein, 9 aa, Homo Sapiens
QSSTSNSPS

SEQ ID NO: 551598 - protein, 9 aa, Homo Sapiens
NEDQNEAKC

SEQ ID NO: 551599 - protein, 9 aa, Homo Sapiens
LRDAGYRVT

SEQ ID NO: 551600 - protein, 9 aa, Homo Sapiens
LGFRFHMAS

SEQ ID NO: 551601 - protein, 9 aa, Homo Sapiens
SFQVSLLLR

SEQ ID NO: 551602 - protein, 9 aa, Homo Sapiens
GGGPEGPNR

SEQ ID NO: 551603 - protein, 9 aa, Homo Sapiens
QMTTYYTVR

SEQ ID NO: 551604 - protein, 9 aa, Homo Sapiens
KIPEPCQPK

SEQ ID NO: 551605 - protein, 9 aa, Homo Sapiens
PPLYNITKI

SEQ ID NO: 551606 - protein, 9 aa, Homo Sapiens
PRTEACPMK

SEQ ID NO: 551607 - protein, 9 aa, Homo Sapiens
PSSVAEFSE

SEQ ID NO: 551608 - protein, 9 aa, Homo Sapiens
LMNSSKEEM

SEQ ID NO: 551609 - protein, 9 aa, Homo Sapiens
TACKTYIFG

SEQ ID NO: 551610 - protein, 9 aa, Homo Sapiens
PSAHAVPTY

SEQ ID NO: 551611 - protein, 9 aa, Homo Sapiens
LSIRDLPAR

SEQ ID NO: 551612 - protein, 9 aa, Homo Sapiens
EDGSLEVGI

SEQ ID NO: 551613 - protein, 9 aa, Homo Sapiens
WPSTSPDIH

SEQ ID NO: 551614 - protein, 9 aa, Homo Sapiens
SLMNSSKEE

SEQ ID NO: 551615 - protein, 9 aa, Homo Sapiens
LFPYLRHFG

SEQ ID NO: 551616 - protein, 9 aa, Homo Sapiens
LTPVSAQFQ

SEQ ID NO: 551617 - protein, 9 aa, Homo Sapiens
GASTTPALQ

SEQ ID NO: 551618 - protein, 9 aa, Homo Sapiens
QMSMSQPYT

SEQ ID NO: 551619 - protein, 9 aa, Homo Sapiens
HTGEKFCKC

SEQ ID NO: 551620 - protein, 9 aa, Homo Sapiens
PQPQELSLE

SEQ ID NO: 551621 - protein, 9 aa, Homo Sapiens
WKQKVEKKG

SEQ ID NO: 551622 - protein, 9 aa, Homo Sapiens
KRHHGTPSS

SEQ ID NO: 551623 - protein, 9 aa, Homo Sapiens
QPCLLVTMT

SEQ ID NO: 551624 - protein, 9 aa, Homo Sapiens
EGTLRDSDT

SEQ ID NO: 551625 - protein, 9 aa, Homo Sapiens
RPSDNGQYR

SEQ ID NO: 551626 - protein, 9 aa, Homo Sapiens
DKPRTEACP

SEQ ID NO: 551627 - protein, 9 aa, Homo Sapiens
TVSKPYVME

SEQ ID NO: 551628 - protein, 9 aa, Homo Sapiens
PVTPCALPV

SEQ ID NO: 551629 - protein, 9 aa, Homo Sapiens
VYVRRKQSD

SEQ ID NO: 551630 - protein, 9 aa, Homo Sapiens
PKSHRDLSN

SEQ ID NO: 551631 - protein, 9 aa, Homo Sapiens
CSVDSAGPR

SEQ ID NO: 551632 - protein, 9 aa, Homo Sapiens
AHMDGQGCE

SEQ ID NO: 551633 - protein, 9 aa, Homo Sapiens
SEFQCTSGR

SEQ ID NO: 551634 - protein, 9 aa, Homo Sapiens
PYPSTSLDG

SEQ ID NO: 551635 - protein, 9 aa, Homo Sapiens
KAQMTTYYT

SEQ ID NO: 551636 - protein, 9 aa, Homo Sapiens
PYVMESPAE

SEQ ID NO: 551637 - protein, 9 aa, Homo Sapiens
ESSVQVDNE

SEQ ID NO: 551638 - protein, 9 aa, Homo Sapiens
RAAVNVNVL

SEQ ID NO: 551639 - protein, 9 aa, Homo Sapiens
TTPDTSYSD

SEQ ID NO: 551640 - protein, 9 aa, Homo Sapiens
CAGEVIERN

SEQ ID NO: 551641 - protein, 9 aa, Homo Sapiens
TVLTMNLPF

SEQ ID NO: 551642 - protein, 9 aa, Homo Sapiens
ASILSFQVS

SEQ ID NO: 551643 - protein, 9 aa, Homo Sapiens
GTEGILTRE

SEQ ID NO: 551644 - protein, 9 aa, Homo Sapiens
EPNGEGLLC

SEQ ID NO: 551645 - protein, 9 aa, Homo Sapiens
AQNKEHPRY

SEQ ID NO: 551646 - protein, 9 aa, Homo Sapiens
VENTTTGIA

SEQ ID NO: 551647 - protein, 9 aa, Homo Sapiens
TSLSFSPDS

SEQ ID NO: 551648 - protein, 9 aa, Homo Sapiens
MVVPMLNPL

SEQ ID NO: 551649 - protein, 9 aa, Homo Sapiens
AVPTYAPAR

SEQ ID NO: 551650 - protein, 9 aa, Homo Sapiens
VVPMLNPLV

SEQ ID NO: 551651 - protein, 9 aa, Homo Sapiens
AAGFHTGEQ

SEQ ID NO: 551652 - protein, 9 aa, Homo Sapiens
MAAAEEEGG

SEQ ID NO: 551653 - protein, 9 aa, Homo Sapiens
RMFRFSAAL

SEQ ID NO: 551654 - protein, 9 aa, Homo Sapiens
RKGGLSLNW

SEQ ID NO: 551655 - protein, 9 aa, Homo Sapiens
LPTEPPSSV

SEQ ID NO: 551656 - protein, 9 aa, Homo Sapiens
DNGQYRCLF

SEQ ID NO: 551657 - protein, 9 aa, Homo Sapiens
LAWEELAAS

SEQ ID NO: 551658 - protein, 9 aa, Homo Sapiens
GDGDGEISF

SEQ ID NO: 551659 - protein, 9 aa, Homo Sapiens
QSKENMPTM

SEQ ID NO: 551660 - protein, 9 aa, Homo Sapiens
VSNKLKGRS

SEQ ID NO: 551661 - protein, 9 aa, Homo Sapiens
QALPGLHFM

SEQ ID NO: 551662 - protein, 9 aa, Homo Sapiens
MESPAEDSN

SEQ ID NO: 551663 - protein, 9 aa, Homo Sapiens
PHCDRNRVH

SEQ ID NO: 551664 - protein, 9 aa, Homo Sapiens
LYLFGVDVN

SEQ ID NO: 551665 - protein, 9 aa, Homo Sapiens
NSSKEEMRE

SEQ ID NO: 551666 - protein, 9 aa, Homo Sapiens
ESPGTRKRP

SEQ ID NO: 551667 - protein, 9 aa, Homo Sapiens
KQKVEKKGH

SEQ ID NO: 551668 - protein, 9 aa, Homo Sapiens
GLSAQAGLQ

SEQ ID NO: 551669 - protein, 9 aa, Homo Sapiens
SQWTPEYKE

SEQ ID NO: 551670 - protein, 9 aa, Homo Sapiens
EYLNEYETE

SEQ ID NO: 551671 - protein, 9 aa, Homo Sapiens
STPRTDVLR

SEQ ID NO: 551672 - protein, 9 aa, Homo Sapiens
PCIFMYTCP

SEQ ID NO: 551673 - protein, 9 aa, Homo Sapiens
YVRRKQSDS

SEQ ID NO: 551674 - protein, 9 aa, Homo Sapiens
KHPGTATSR

SEQ ID NO: 551675 - protein, 9 aa, Homo Sapiens
QVLAAGFHT

SEQ ID NO: 551676 - protein, 9 aa, Homo Sapiens
GMLDPLEVP

SEQ ID NO: 551677 - protein, 9 aa, Homo Sapiens
CDQRRKGGL

SEQ ID NO: 551678 - protein, 9 aa, Homo Sapiens
ITKIEVPTA

SEQ ID NO: 551679 - protein, 9 aa, Homo Sapiens
VLVFSPQGS

SEQ ID NO: 551680 - protein, 9 aa, Homo Sapiens
IKSLMNSSK

SEQ ID NO: 551681 - protein, 9 aa, Homo Sapiens
DSAKTNTQL

SEQ ID NO: 551682 - protein, 9 aa, Homo Sapiens
FGTNCDTGH

SEQ ID NO: 551683 - protein, 9 aa, Homo Sapiens
PMLNPLVYT

SEQ ID NO: 551684 - protein, 9 aa, Homo Sapiens
DAPSERPYS

SEQ ID NO: 551685 - protein, 9 aa, Homo Sapiens
FIFIFLAWN

SEQ ID NO: 551686 - protein, 9 aa, Homo Sapiens
PPNLGFRFH

SEQ ID NO: 551687 - protein, 9 aa, Homo Sapiens
QIGIMVAGF

SEQ ID NO: 551688 - protein, 9 aa, Homo Sapiens
SHLTTHKLT

SEQ ID NO: 551689 - protein, 9 aa, Homo Sapiens
RSEQPLSVG

SEQ ID NO: 551690 - protein, 9 aa, Homo Sapiens
QAGLQKIWG

SEQ ID NO: 551691 - protein, 9 aa, Homo Sapiens
KALSENAVL

SEQ ID NO: 551692 - protein, 9 aa, Homo Sapiens
RSCPCRRCR

SEQ ID NO: 551693 - protein, 9 aa, Homo Sapiens
GSFDAPSER

SEQ ID NO: 551694 - protein, 9 aa, Homo Sapiens
PVPCSAVYV

SEQ ID NO: 551695 - protein, 9 aa, Homo Sapiens
YYISRDTLY

SEQ ID NO: 551696 - protein, 9 aa, Homo Sapiens
DVFQIGIMV

SEQ ID NO: 551697 - protein, 9 aa, Homo Sapiens
SKTSRVLQK

SEQ ID NO: 551698 - protein, 9 aa, Homo Sapiens
HTECAGEVI

SEQ ID NO: 551699 - protein, 9 aa, Homo Sapiens
PNEDQNEAK

SEQ ID NO: 551700 - protein, 9 aa, Homo Sapiens
SALQELQSS

SEQ ID NO: 551701 - protein, 9 aa, Homo Sapiens
EWKQKVEKK

SEQ ID NO: 551702 - protein, 9 aa, Homo Sapiens
CLGTADHGQ

SEQ ID NO: 551703 - protein, 9 aa, Homo Sapiens
CGLSTHIEI

SEQ ID NO: 551704 - protein, 9 aa, Homo Sapiens
VFSPQGSQK

SEQ ID NO: 551705 - protein, 9 aa, Homo Sapiens
PSSTKKTLK

SEQ ID NO: 551706 - protein, 9 aa, Homo Sapiens
PCQPKIPEP

SEQ ID NO: 551707 - protein, 9 aa, Homo Sapiens
WRSTPRTDV

SEQ ID NO: 551708 - protein, 9 aa, Homo Sapiens
SALIGVRVI

SEQ ID NO: 551709 - protein, 9 aa, Homo Sapiens
SVIYSFRNA

SEQ ID NO: 551710 - protein, 9 aa, Homo Sapiens
DQNEAKCLG

SEQ ID NO: 551711 - protein, 9 aa, Homo Sapiens
PGTRKRPRA

SEQ ID NO: 551712 - protein, 9 aa, Homo Sapiens
MLGYSGFQA

SEQ ID NO: 551713 - protein, 9 aa, Homo Sapiens
KENMPTMIN

SEQ ID NO: 551714 - protein, 9 aa, Homo Sapiens
GMAAPYFNE

SEQ ID NO: 551715 - protein, 9 aa, Homo Sapiens
KLISEVDGD

SEQ ID NO: 551716 - protein, 9 aa, Homo Sapiens
QEYLNEYET

SEQ ID NO: 551717 - protein, 9 aa, Homo Sapiens
HPRHSLTGP

SEQ ID NO: 551718 - protein, 9 aa, Homo Sapiens
SRTPLIQIK

SEQ ID NO: 551719 - protein, 9 aa, Homo Sapiens
TEGILTREC

SEQ ID NO: 551720 - protein, 9 aa, Homo Sapiens
QMEDMQKKE

SEQ ID NO: 551721 - protein, 9 aa, Homo Sapiens
GLSTHIEIG

SEQ ID NO: 551722 - protein, 9 aa, Homo Sapiens
TSPDIHPAL

SEQ ID NO: 551723 - protein, 9 aa, Homo Sapiens
ECAGEVIER

SEQ ID NO: 551724 - protein, 9 aa, Homo Sapiens
IEYVAMASW

SEQ ID NO: 551725 - protein, 9 aa, Homo Sapiens
HTGEQEDAH

SEQ ID NO: 551726 - protein, 9 aa, Homo Sapiens
ETTSSGGCH

SEQ ID NO: 551727 - protein, 9 aa, Homo Sapiens
HNKSGGAMV

SEQ ID NO: 551728 - protein, 9 aa, Homo Sapiens
LISEVDGDG

SEQ ID NO: 551729 - protein, 9 aa, Homo Sapiens
KLKGRSSPS

SEQ ID NO: 551730 - protein, 9 aa, Homo Sapiens
HFPTCSPPK

SEQ ID NO: 551731 - protein, 9 aa, Homo Sapiens
RSPRSGDGK

SEQ ID NO: 551732 - protein, 9 aa, Homo Sapiens
FIFLAWNSI

SEQ ID NO: 551733 - protein, 9 aa, Homo Sapiens
VDGDGDGEI

SEQ ID NO: 551734 - protein, 9 aa, Homo Sapiens
LEQHKEQRQ

SEQ ID NO: 551735 - protein, 9 aa, Homo Sapiens
LVEEAINQN

SEQ ID NO: 551736 - protein, 9 aa, Homo Sapiens
GVLPYPSTS

SEQ ID NO: 551737 - protein, 9 aa, Homo Sapiens
MASWPLEPE

SEQ ID NO: 551738 - protein, 9 aa, Homo Sapiens
DCQRCCDSE

SEQ ID NO: 551739 - protein, 9 aa, Homo Sapiens
PSLAHMDGQ

SEQ ID NO: 551740 - protein, 9 aa, Homo Sapiens
MSSFKWGSL

SEQ ID NO: 551741 - protein, 9 aa, Homo Sapiens
PELESREDQ

SEQ ID NO: 551742 - protein, 9 aa, Homo Sapiens
LEKLKSWGG

SEQ ID NO: 551743 - protein, 9 aa, Homo Sapiens
MSMSQPYTM

SEQ ID NO: 551744 - protein, 9 aa, Homo Sapiens
YNSYYISRD

SEQ ID NO: 551745 - protein, 9 aa, Homo Sapiens
TGIAETHRR

SEQ ID NO: 551746 - protein, 9 aa, Homo Sapiens
LLVTMTSVV

SEQ ID NO: 551747 - protein, 9 aa, Homo Sapiens
QKKEDHLER

SEQ ID NO: 551748 - protein, 9 aa, Homo Sapiens
RLPTEPPSS

SEQ ID NO: 551749 - protein, 9 aa, Homo Sapiens
LSENAVLIL

SEQ ID NO: 551750 - protein, 9 aa, Homo Sapiens
KTICSLFFL

SEQ ID NO: 551751 - protein, 9 aa, Homo Sapiens
WLKHNKSGG

SEQ ID NO: 551752 - protein, 9 aa, Homo Sapiens
PETTSSGGC

SEQ ID NO: 551753 - protein, 9 aa, Homo Sapiens
FGPETSSVL

SEQ ID NO: 551754 - protein, 9 aa, Homo Sapiens
LVTMKILHD

SEQ ID NO: 551755 - protein, 9 aa, Homo Sapiens
SFNNLQRRQ

SEQ ID NO: 551756 - protein, 9 aa, Homo Sapiens
NSIKYKEDG

SEQ ID NO: 551757 - protein, 9 aa, Homo Sapiens
HHPRHSLTG

SEQ ID NO: 551758 - protein, 9 aa, Homo Sapiens
ELSLEKLKS

SEQ ID NO: 551759 - protein, 9 aa, Homo Sapiens
RHGSRHRRS

SEQ ID NO: 551760 - protein, 9 aa, Homo Sapiens
IKTSSVPRR

SEQ ID NO: 551761 - protein, 9 aa, Homo Sapiens
WQKHCYPLI

SEQ ID NO: 551762 - protein, 9 aa, Homo Sapiens
DPLEVPLLD

SEQ ID NO: 551763 - protein, 9 aa, Homo Sapiens
LIFAKNVFL

SEQ ID NO: 551764 - protein, 9 aa, Homo Sapiens
KEQMEDMQK

SEQ ID NO: 551765 - protein, 9 aa, Homo Sapiens
NSFTFGGVG

SEQ ID NO: 551766 - protein, 9 aa, Homo Sapiens
IRQRIVCLV

SEQ ID NO: 551767 - protein, 9 aa, Homo Sapiens
CSAVYVRRK

SEQ ID NO: 551768 - protein, 9 aa, Homo Sapiens
PSFNNLQRR

SEQ ID NO: 551769 - protein, 9 aa, Homo Sapiens
DRAVASDCQ

SEQ ID NO: 551770 - protein, 9 aa, Homo Sapiens
DEADKTSEL

SEQ ID NO: 551771 - protein, 9 aa, Homo Sapiens
MSPKIHRRR

SEQ ID NO: 551772 - protein, 9 aa, Homo Sapiens
WDAGCDQRR

SEQ ID NO: 551773 - protein, 9 aa, Homo Sapiens
ALIGVRVIL

SEQ ID NO: 551774 - protein, 9 aa, Homo Sapiens
AAEEEGGGP

SEQ ID NO: 551775 - protein, 9 aa, Homo Sapiens
SVCAFNKGK

SEQ ID NO: 551776 - protein, 9 aa, Homo Sapiens
SDFGPETSS

SEQ ID NO: 551777 - protein, 9 aa, Homo Sapiens
RHRRSHHED

SEQ ID NO: 551778 - protein, 9 aa, Homo Sapiens
PYLRHFGLR

SEQ ID NO: 551779 - protein, 9 aa, Homo Sapiens
TSGRCIPQH

SEQ ID NO: 551780 - protein, 9 aa, Homo Sapiens
HGSRHRRSH

SEQ ID NO: 551781 - protein, 9 aa, Homo Sapiens
KVEKKGHGR

SEQ ID NO: 551782 - protein, 9 aa, Homo Sapiens
WKQGGEEEK

SEQ ID NO: 551783 - protein, 9 aa, Homo Sapiens
APSLAHMDG

SEQ ID NO: 551784 - protein, 9 aa, Homo Sapiens
PNGRDQHLG

SEQ ID NO: 551785 - protein, 9 aa, Homo Sapiens
PCSAVYVRR

SEQ ID NO: 551786 - protein, 9 aa, Homo Sapiens
GSRHRRSHH

SEQ ID NO: 551787 - protein, 9 aa, Homo Sapiens
PSANPSAHA

SEQ ID NO: 551788 - protein, 9 aa, Homo Sapiens
VTTPDTSYS

SEQ ID NO: 551789 - protein, 9 aa, Homo Sapiens
PVFSLLKIR

SEQ ID NO: 551790 - protein, 9 aa, Homo Sapiens
EDGILGTFP

SEQ ID NO: 551791 - protein, 9 aa, Homo Sapiens
QGGEEEKWA

SEQ ID NO: 551792 - protein, 9 aa, Homo Sapiens
PGLHFMPGR

SEQ ID NO: 551793 - protein, 9 aa, Homo Sapiens
ELDAAPGKC

SEQ ID NO: 551794 - protein, 9 aa, Homo Sapiens
ASKAQMTTY

SEQ ID NO: 551795 - protein, 9 aa, Homo Sapiens
AVASDCQRC

SEQ ID NO: 551796 - protein, 9 aa, Homo Sapiens
PLLNSVIYS

SEQ ID NO: 551797 - protein, 9 aa, Homo Sapiens
SAQAGLQKI

SEQ ID NO: 551798 - protein, 9 aa, Homo Sapiens
SWPSTSPDI

SEQ ID NO: 551799 - protein, 9 aa, Homo Sapiens
AWNSIKYKE

SEQ ID NO: 551800 - protein, 9 aa, Homo Sapiens
SLADVNEAG

SEQ ID NO: 551801 - protein, 9 aa, Homo Sapiens
RAKTICSLF

SEQ ID NO: 551802 - protein, 9 aa, Homo Sapiens
KENIKTSSV

SEQ ID NO: 551803 - protein, 9 aa, Homo Sapiens
FYGTIIFLY

SEQ ID NO: 551804 - protein, 9 aa, Homo Sapiens
IECKLFTSE

SEQ ID NO: 551805 - protein, 9 aa, Homo Sapiens
YNITKIEVP

SEQ ID NO: 551806 - protein, 9 aa, Homo Sapiens
PGSQHFPTC

SEQ ID NO: 551807 - protein, 9 aa, Homo Sapiens
GFLHSISQT

SEQ ID NO: 551808 - protein, 9 aa, Homo Sapiens
LLGWKQGGE

SEQ ID NO: 551809 - protein, 9 aa, Homo Sapiens
DIYLIFAKN

SEQ ID NO: 551810 - protein, 9 aa, Homo Sapiens
ENAVLILLI

SEQ ID NO: 551811 - protein, 9 aa, Homo Sapiens
FQIGIMVAG

SEQ ID NO: 551812 - protein, 9 aa, Homo Sapiens
FNNLQRRQW

SEQ ID NO: 551813 - protein, 9 aa, Homo Sapiens
DTFGNEDYN

SEQ ID NO: 551814 - protein, 9 aa, Homo Sapiens
TEASLDSFP

SEQ ID NO: 551815 - protein, 9 aa, Homo Sapiens
FMPGRGPIH

SEQ ID NO: 551816 - protein, 9 aa, Homo Sapiens
GVTTPDTSY

SEQ ID NO: 551817 - protein, 9 aa, Homo Sapiens
PLGVTTPDT

SEQ ID NO: 551818 - protein, 9 aa, Homo Sapiens
SFKWGSLKS

SEQ ID NO: 551819 - protein, 9 aa, Homo Sapiens
SSSEFQCTS

SEQ ID NO: 551820 - protein, 9 aa, Homo Sapiens
IGWIWLAVV

SEQ ID NO: 551821 - protein, 9 aa, Homo Sapiens
NIKTSSVPR

SEQ ID NO: 551822 - protein, 9 aa, Homo Sapiens
SAVYVRRKQ

SEQ ID NO: 551823 - protein, 9 aa, Homo Sapiens
LQKEPNGEG

SEQ ID NO: 551824 - protein, 9 aa, Homo Sapiens
LGVTTPDTS

SEQ ID NO: 551825 - protein, 9 aa, Homo Sapiens
DVNEAGAST

SEQ ID NO: 551826 - protein, 9 aa, Homo Sapiens
DQLACSVLD

SEQ ID NO: 551827 - protein, 9 aa, Homo Sapiens
CDRNRVHPV

SEQ ID NO: 551828 - protein, 9 aa, Homo Sapiens
PQMSMSQPY

SEQ ID NO: 551829 - protein, 9 aa, Homo Sapiens
HRDLSNRHS

SEQ ID NO: 551830 - protein, 9 aa, Homo Sapiens
YGTIIFLYL

SEQ ID NO: 551831 - protein, 9 aa, Homo Sapiens
SSVQVDNES

SEQ ID NO: 551832 - protein, 9 aa, Homo Sapiens
PNGEGLLCR

SEQ ID NO: 551833 - protein, 9 aa, Homo Sapiens
GRSSPSLLE

SEQ ID NO: 551834 - protein, 9 aa, Homo Sapiens
PPQPQELSL

SEQ ID NO: 551835 - protein, 9 aa, Homo Sapiens
TCPATVFPM

SEQ ID NO: 551836 - protein, 9 aa, Homo Sapiens
RRSCPCRRC

SEQ ID NO: 551837 - protein, 9 aa, Homo Sapiens
HFTLNSFTF

SEQ ID NO: 551838 - protein, 9 aa, Homo Sapiens
IHRRRSRTS

SEQ ID NO: 551839 - protein, 9 aa, Homo Sapiens
SLLLRSPVL

SEQ ID NO: 551840 - protein, 9 aa, Homo Sapiens
TEACPMKRL

SEQ ID NO: 551841 - protein, 9 aa, Homo Sapiens
SKPYVMESP

SEQ ID NO: 551842 - protein, 9 aa, Homo Sapiens
KEIIAGLPV

SEQ ID NO: 551843 - protein, 9 aa, Homo Sapiens
WLFRDAGTR

SEQ ID NO: 551844 - protein, 9 aa, Homo Sapiens
KWGSLKSST

SEQ ID NO: 551845 - protein, 9 aa, Homo Sapiens
VSAQFQDIE

SEQ ID NO: 551846 - protein, 9 aa, Homo Sapiens
YDAKIEDKA

SEQ ID NO: 551847 - protein, 9 aa, Homo Sapiens
RMPHQPSAT

SEQ ID NO: 551848 - protein, 9 aa, Homo Sapiens
SSLPSPFSC

SEQ ID NO: 551849 - protein, 9 aa, Homo Sapiens
EPSMSPKIH

SEQ ID NO: 551850 - protein, 9 aa, Homo Sapiens
NKSGGAMVW

SEQ ID NO: 551851 - protein, 9 aa, Homo Sapiens
TFGNEDYNN

SEQ ID NO: 551852 - protein, 9 aa, Homo Sapiens
SSVLHLDHS

SEQ ID NO: 551853 - protein, 9 aa, Homo Sapiens
VNVNVLATR

SEQ ID NO: 551854 - protein, 9 aa, Homo Sapiens
EAINQNEYH

SEQ ID NO: 551855 - protein, 9 aa, Homo Sapiens
HQYGKAFIQ

SEQ ID NO: 551856 - protein, 9 aa, Homo Sapiens
ASALNTNIR

SEQ ID NO: 551857 - protein, 9 aa, Homo Sapiens
SGDGKLEAL

SEQ ID NO: 551858 - protein, 9 aa, Homo Sapiens
CSSSEFQCT

SEQ ID NO: 551859 - protein, 9 aa, Homo Sapiens
EEEGGGPEG

SEQ ID NO: 551860 - protein, 9 aa, Homo Sapiens
GEVIERNGR

SEQ ID NO: 551861 - protein, 9 aa, Homo Sapiens
EGGGPEGPN

SEQ ID NO: 551862 - protein, 9 aa, Homo Sapiens
SAHAVPTYA

SEQ ID NO: 551863 - protein, 9 aa, Homo Sapiens
ADHGQAAYR

SEQ ID NO: 551864 - protein, 9 aa, Homo Sapiens
FLKALSENA

SEQ ID NO: 551865 - protein, 9 aa, Homo Sapiens
SRRCGAQNK

SEQ ID NO: 551866 - protein, 9 aa, Homo Sapiens
LSTHIEIGH

SEQ ID NO: 551867 - protein, 9 aa, Homo Sapiens
SPNCGSGVV

SEQ ID NO: 551868 - protein, 9 aa, Homo Sapiens
GTADHGQAA

SEQ ID NO: 551869 - protein, 9 aa, Homo Sapiens
EPHSCMAKS

SEQ ID NO: 551870 - protein, 9 aa, Homo Sapiens
LALLVLEED

SEQ ID NO: 551871 - protein, 9 aa, Homo Sapiens
ETSSVLHLD

SEQ ID NO: 551872 - protein, 9 aa, Homo Sapiens
ETVSKPYVM

SEQ ID NO: 551873 - protein, 9 aa, Homo Sapiens
FCKCEECGK

SEQ ID NO: 551874 - protein, 9 aa, Homo Sapiens
ILSFQVSLL

SEQ ID NO: 551875 - protein, 9 aa, Homo Sapiens
ENIKTSSVP

SEQ ID NO: 551876 - protein, 9 aa, Homo Sapiens
QNLKESSVQ

SEQ ID NO: 551877 - protein, 9 aa, Homo Sapiens
FASPNCGSG

SEQ ID NO: 551878 - protein, 9 aa, Homo Sapiens
APPNLGFRF

SEQ ID NO: 551879 - protein, 9 aa, Homo Sapiens
LGTADHGQA

SEQ ID NO: 551880 - protein, 9 aa, Homo Sapiens
HLGVDPTEH

SEQ ID NO: 551881 - protein, 9 aa, Homo Sapiens
TGEKFCKCE

SEQ ID NO: 551882 - protein, 9 aa, Homo Sapiens
QHFPTCSPP

SEQ ID NO: 551883 - protein, 9 aa, Homo Sapiens
TPDTSYSDM

SEQ ID NO: 551884 - protein, 9 aa, Homo Sapiens
YLFGVDVNP

SEQ ID NO: 551885 - protein, 9 aa, Homo Sapiens
KYYDAKIED

SEQ ID NO: 551886 - protein, 9 aa, Homo Sapiens
QNEYHSGNL

SEQ ID NO: 551887 - protein, 9 aa, Homo Sapiens
KNVFLGDQN

SEQ ID NO: 551888 - protein, 9 aa, Homo Sapiens
AVYVRRKQS

SEQ ID NO: 551889 - protein, 9 aa, Homo Sapiens
KTSELRDSD

SEQ ID NO: 551890 - protein, 9 aa, Homo Sapiens
ERGGAGGMR

SEQ ID NO: 551891 - protein, 9 aa, Homo Sapiens
GDGKLEALY

SEQ ID NO: 551892 - protein, 9 aa, Homo Sapiens
GQAAYRAYS

SEQ ID NO: 551893 - protein, 9 aa, Homo Sapiens
PRSGDGKLE

SEQ ID NO: 551894 - protein, 9 aa, Homo Sapiens
ETEKIEYNE

SEQ ID NO: 551895 - protein, 9 aa, Homo Sapiens
MAWRHLQKR

SEQ ID NO: 551896 - protein, 9 aa, Homo Sapiens
NLQRRQWRK

SEQ ID NO: 551897 - protein, 9 aa, Homo Sapiens
VLAKQDTEA

SEQ ID NO: 551898 - protein, 9 aa, Homo Sapiens
VQIFFYLTL

SEQ ID NO: 551899 - protein, 9 aa, Homo Sapiens
AGASTTPAL

SEQ ID NO: 551900 - protein, 9 aa, Homo Sapiens
MGNLGSDIA

SEQ ID NO: 551901 - protein, 9 aa, Homo Sapiens
LEVPLLDFP

SEQ ID NO: 551902 - protein, 9 aa, Homo Sapiens
PHQPSATRL

SEQ ID NO: 551903 - protein, 9 aa, Homo Sapiens
CTSGRCIPQ

SEQ ID NO: 551904 - protein, 9 aa, Homo Sapiens
RKTATKKGM

SEQ ID NO: 551905 - protein, 9 aa, Homo Sapiens
NGEGLLCRF

SEQ ID NO: 551906 - protein, 9 aa, Homo Sapiens
DRTIAPQPG

SEQ ID NO: 551907 - protein, 9 aa, Homo Sapiens
AILGFTKED

SEQ ID NO: 551908 - protein, 9 aa, Homo Sapiens
SCMAKSVYW

SEQ ID NO: 551909 - protein, 9 aa, Homo Sapiens
RRLLEWKQK

SEQ ID NO: 551910 - protein, 9 aa, Homo Sapiens
TSSGGCHSP

SEQ ID NO: 551911 - protein, 9 aa, Homo Sapiens
LVFSPQGSQ

SEQ ID NO: 551912 - protein, 9 aa, Homo Sapiens
VNVLIGLLV

SEQ ID NO: 551913 - protein, 9 aa, Homo Sapiens
IFYGTIIFL

SEQ ID NO: 551914 - protein, 9 aa, Homo Sapiens
CQKRKYIEI

SEQ ID NO: 551915 - protein, 9 aa, Homo Sapiens
IFIFLAWNS

SEQ ID NO: 551916 - protein, 9 aa, Homo Sapiens
PTEPPSSVA

SEQ ID NO: 551917 - protein, 9 aa, Homo Sapiens
NGTSPETTS

SEQ ID NO: 551918 - protein, 9 aa, Homo Sapiens
GLSIRDLPA

SEQ ID NO: 551919 - protein, 9 aa, Homo Sapiens
HMDGQGCEH

SEQ ID NO: 551920 - protein, 9 aa, Homo Sapiens
EELGVLPYP

SEQ ID NO: 551921 - protein, 9 aa, Homo Sapiens
SFDAPSERP

SEQ ID NO: 551922 - protein, 9 aa, Homo Sapiens
KEPNGEGLL

SEQ ID NO: 551923 - protein, 9 aa, Homo Sapiens
PSMSPKIHR

SEQ ID NO: 551924 - protein, 9 aa, Homo Sapiens
QIFFYLTLI

SEQ ID NO: 551925 - protein, 9 aa, Homo Sapiens
FPESSVGAV

SEQ ID NO: 551926 - protein, 9 aa, Homo Sapiens
PNLGFRFHM

SEQ ID NO: 551927 - protein, 9 aa, Homo Sapiens
KKYYDAKIE

SEQ ID NO: 551928 - protein, 9 aa, Homo Sapiens
YPTAFASPN

SEQ ID NO: 551929 - protein, 9 aa, Homo Sapiens
EWIKSLMNS

SEQ ID NO: 551930 - protein, 9 aa, Homo Sapiens
VPMLNPLVY

SEQ ID NO: 551931 - protein, 9 aa, Homo Sapiens
STGIGWIWL

SEQ ID NO: 551932 - protein, 9 aa, Homo Sapiens
AGYRVTLWV

SEQ ID NO: 551933 - protein, 9 aa, Homo Sapiens
FARGQRWRL

SEQ ID NO: 551934 - protein, 9 aa, Homo Sapiens
VFLKALSEN

SEQ ID NO: 551935 - protein, 9 aa, Homo Sapiens
DPQMSMSQP

SEQ ID NO: 551936 - protein, 9 aa, Homo Sapiens
LKGRSSPSL

SEQ ID NO: 551937 - protein, 9 aa, Homo Sapiens
SPKIHRRRS

SEQ ID NO: 551938 - protein, 9 aa, Homo Sapiens
VASDCQRCC

SEQ ID NO: 551939 - protein, 9 aa, Homo Sapiens
QRQQESPEA

SEQ ID NO: 551940 - protein, 9 aa, Homo Sapiens
AKVSNKLKG

SEQ ID NO: 551941 - protein, 9 aa, Homo Sapiens
DGSLEVGIK

SEQ ID NO: 551942 - protein, 9 aa, Homo Sapiens
SRHGSRHRR

SEQ ID NO: 551943 - protein, 9 aa, Homo Sapiens
SSEFQCTSG

SEQ ID NO: 551944 - protein, 9 aa, Homo Sapiens
TFSDTLEDH

SEQ ID NO: 551945 - protein, 9 aa, Homo Sapiens
IGMLGYSGF

SEQ ID NO: 551946 - protein, 9 aa, Homo Sapiens
ACKTYIFGT

SEQ ID NO: 551947 - protein, 9 aa, Homo Sapiens
YVMESPAED

SEQ ID NO: 551948 - protein, 9 aa, Homo Sapiens
EPVPCSAVY

SEQ ID NO: 551949 - protein, 9 aa, Homo Sapiens
IHPALPLLE

SEQ ID NO: 551950 - protein, 9 aa, Homo Sapiens
ECKLFTSEE

SEQ ID NO: 551951 - protein, 9 aa, Homo Sapiens
QPKIPEPCQ

SEQ ID NO: 551952 - protein, 9 aa, Homo Sapiens
SSTSLSFSP

SEQ ID NO: 551953 - protein, 9 aa, Homo Sapiens
LKEQMEDMQ

SEQ ID NO: 551954 - protein, 9 aa, Homo Sapiens
SKENMPTMI

SEQ ID NO: 551955 - protein, 9 aa, Homo Sapiens
SPSDLALLV

SEQ ID NO: 551956 - protein, 9 aa, Homo Sapiens
SREPHSCMA

SEQ ID NO: 551957 - protein, 9 aa, Homo Sapiens
SQPYTMTTP

SEQ ID NO: 551958 - protein, 9 aa, Homo Sapiens
LQSKENMPT

SEQ ID NO: 551959 - protein, 9 aa, Homo Sapiens
ATKKGMAAP

SEQ ID NO: 551960 - protein, 9 aa, Homo Sapiens
EAIQQKIEC

SEQ ID NO: 551961 - protein, 9 aa, Homo Sapiens
AMKEIIAGL

SEQ ID NO: 551962 - protein, 9 aa, Homo Sapiens
GTRKRPRAP

SEQ ID NO: 551963 - protein, 9 aa, Homo Sapiens
SVDSAGPRP

SEQ ID NO: 551964 - protein, 9 aa, Homo Sapiens
ARRSPRSGD

SEQ ID NO: 551965 - protein, 9 aa, Homo Sapiens
GSLEVGIKQ

SEQ ID NO: 551966 - protein, 9 aa, Homo Sapiens
VLAAGFHTG

SEQ ID NO: 551967 - protein, 9 aa, Homo Sapiens
PGTATSRQS

SEQ ID NO: 551968 - protein, 9 aa, Homo Sapiens
AAVNVNVLA

SEQ ID NO: 551969 - protein, 9 aa, Homo Sapiens
YTCPATVFP

SEQ ID NO: 551970 - protein, 9 aa, Homo Sapiens
TGEQEDAHE

SEQ ID NO: 551971 - protein, 9 aa, Homo Sapiens
MSQWTPEYK

SEQ ID NO: 551972 - protein, 9 aa, Homo Sapiens
QCTSGRCIP

SEQ ID NO: 551973 - protein, 9 aa, Homo Sapiens
PRTDVLRLV

SEQ ID NO: 551974 - protein, 9 aa, Homo Sapiens
LVSALQELQ

SEQ ID NO: 551975 - protein, 9 aa, Homo Sapiens
KRPRAPPVP

SEQ ID NO: 551976 - protein, 9 aa, Homo Sapiens
SAKTNTQLS

SEQ ID NO: 551977 - protein, 9 aa, Homo Sapiens
PTAFASPNC

SEQ ID NO: 551978 - protein, 9 aa, Homo Sapiens
KEQRQQESP

SEQ ID NO: 551979 - protein, 9 aa, Homo Sapiens
PGCRPPEGT

SEQ ID NO: 551980 - protein, 9 aa, Homo Sapiens
LEDQLACSV

SEQ ID NO: 551981 - protein, 9 aa, Homo Sapiens
FRFSAALHL

SEQ ID NO: 551982 - protein, 9 aa, Homo Sapiens
LPSPFSCPH

SEQ ID NO: 551983 - protein, 9 aa, Homo Sapiens
LSAQAGLQK

SEQ ID NO: 551984 - protein, 9 aa, Homo Sapiens
LAKDLGLSI

SEQ ID NO: 551985 - protein, 9 aa, Homo Sapiens
LTCRDPEEN

SEQ ID NO: 551986 - protein, 9 aa, Homo Sapiens
LHPLVAETQ

SEQ ID NO: 551987 - protein, 9 aa, Homo Sapiens
GCDQRRKGG

SEQ ID NO: 551988 - protein, 9 aa, Homo Sapiens
SPDIHPALP

SEQ ID NO: 551989 - protein, 9 aa, Homo Sapiens
AVQIFFYLT

SEQ ID NO: 551990 - protein, 9 aa, Homo Sapiens
TVVTPLLNS

SEQ ID NO: 551991 - protein, 9 aa, Homo Sapiens
SPQGSQKHR

SEQ ID NO: 551992 - protein, 9 aa, Homo Sapiens
SHFIAVAIF

SEQ ID NO: 551993 - protein, 9 aa, Homo Sapiens
LAPSCCSVD

SEQ ID NO: 551994 - protein, 9 aa, Homo Sapiens
YAAVLTTEV

SEQ ID NO: 551995 - protein, 9 aa, Homo Sapiens
PSPGLSAQA

SEQ ID NO: 551996 - protein, 9 aa, Homo Sapiens
LEVGIKQLP

SEQ ID NO: 551997 - protein, 9 aa, Homo Sapiens
VLSVLVFGN

SEQ ID NO: 551998 - protein, 9 aa, Homo Sapiens
IFMYTCPAT

SEQ ID NO: 551999 - protein, 9 aa, Homo Sapiens
SPSSALIGV

SEQ ID NO: 552000 - protein, 9 aa, Homo Sapiens
LLVEEAINQ

SEQ ID NO: 552001 - protein, 9 aa, Homo Sapiens
GLEQHKEQR

SEQ ID NO: 552002 - protein, 9 aa, Homo Sapiens
SRDVFSGPA

SEQ ID NO: 552003 - protein, 9 aa, Homo Sapiens
MGPRAKTIC

SEQ ID NO: 552004 - protein, 9 aa, Homo Sapiens
QFQDIEGKI

SEQ ID NO: 552005 - protein, 9 aa, Homo Sapiens
EQHKEQRQQ

SEQ ID NO: 552006 - protein, 9 aa, Homo Sapiens
PHHPRHSLT

SEQ ID NO: 552007 - protein, 9 aa, Homo Sapiens
RVRRMFRFS

SEQ ID NO: 552008 - protein, 9 aa, Homo Sapiens
EEAINQNEY

SEQ ID NO: 552009 - protein, 9 aa, Homo Sapiens
VDVNPEEFV

SEQ ID NO: 552010 - protein, 9 aa, Homo Sapiens
AKQDTEAAI

SEQ ID NO: 552011 - protein, 9 aa, Homo Sapiens
LIGLLVVGA

SEQ ID NO: 552012 - protein, 9 aa, Homo Sapiens
STSPDIHPA

SEQ ID NO: 552013 - protein, 9 aa, Homo Sapiens
NRTFSDTLE

SEQ ID NO: 552014 - protein, 9 aa, Homo Sapiens
EVPLLDFPN

SEQ ID NO: 552015 - protein, 9 aa, Homo Sapiens
TPSSTKKTL

SEQ ID NO: 552016 - protein, 9 aa, Homo Sapiens
ASPNCGSGV

SEQ ID NO: 552017 - protein, 9 aa, Homo Sapiens
EADKTSELR

SEQ ID NO: 552018 - protein, 9 aa, Homo Sapiens
FQCTSGRCI

SEQ ID NO: 552019 - protein, 9 aa, Homo Sapiens
ICDPLRYAA

SEQ ID NO: 552020 - protein, 9 aa, Homo Sapiens
LTHTREKPY

SEQ ID NO: 552021 - protein, 9 aa, Homo Sapiens
ALQELQSST

SEQ ID NO: 552022 - protein, 9 aa, Homo Sapiens
PFSCPHSHS

SEQ ID NO: 552023 - protein, 9 aa, Homo Sapiens
ALSENAVLI

SEQ ID NO: 552024 - protein, 9 aa, Homo Sapiens
QLACSVLDV

SEQ ID NO: 552025 - protein, 9 aa, Homo Sapiens
PRRSCPCRR

SEQ ID NO: 552026 - protein, 9 aa, Homo Sapiens
TDVFQIGIM

SEQ ID NO: 552027 - protein, 9 aa, Homo Sapiens
RSGDGKLEA

SEQ ID NO: 552028 - protein, 9 aa, Homo Sapiens
NTTTGIAET

SEQ ID NO: 552029 - protein, 9 aa, Homo Sapiens
LVLEEDVMP

SEQ ID NO: 552030 - protein, 9 aa, Homo Sapiens
KCHQYGKAF

SEQ ID NO: 552031 - protein, 9 aa, Homo Sapiens
STNGVSNRV

SEQ ID NO: 552032 - protein, 9 aa, Homo Sapiens
TTGIAETHR

SEQ ID NO: 552033 - protein, 9 aa, Homo Sapiens
RTDVLRLVL

SEQ ID NO: 552034 - protein, 9 aa, Homo Sapiens
SSDTDNAEE

SEQ ID NO: 552035 - protein, 9 aa, Homo Sapiens
LDPLEVPLL

SEQ ID NO: 552036 - protein, 9 aa, Homo Sapiens
GSQHFPTCS

SEQ ID NO: 552037 - protein, 9 aa, Homo Sapiens
ILSARPSDN

SEQ ID NO: 552038 - protein, 9 aa, Homo Sapiens
FTKEDGILG

SEQ ID NO: 552039 - protein, 9 aa, Homo Sapiens
WMPGSQHFP

SEQ ID NO: 552040 - protein, 9 aa, Homo Sapiens
QNKEHPRYL

SEQ ID NO: 552041 - protein, 9 aa, Homo Sapiens
PLEVPLLDF

SEQ ID NO: 552042 - protein, 9 aa, Homo Sapiens
KIEVPTAIW

SEQ ID NO: 552043 - protein, 9 aa, Homo Sapiens
DDEADKTSE

SEQ ID NO: 552044 - protein, 9 aa, Homo Sapiens
RHHGTPSST

SEQ ID NO: 552045 - protein, 9 aa, Homo Sapiens
RYAAVLTTE

SEQ ID NO: 552046 - protein, 9 aa, Homo Sapiens
TFDRAVASD

SEQ ID NO: 552047 - protein, 9 aa, Homo Sapiens
CGAQNKEHP

SEQ ID NO: 552048 - protein, 9 aa, Homo Sapiens
ELFPYLRHF

SEQ ID NO: 552049 - protein, 9 aa, Homo Sapiens
MDGQGCEHT

SEQ ID NO: 552050 - protein, 9 aa, Homo Sapiens
GMLGYSGFQ

SEQ ID NO: 552051 - protein, 9 aa, Homo Sapiens
NKEHPRYLI

SEQ ID NO: 552052 - protein, 9 aa, Homo Sapiens
STSLSFSPD

SEQ ID NO: 552053 - protein, 9 aa, Homo Sapiens
VRRMFRFSA

SEQ ID NO: 552054 - protein, 9 aa, Homo Sapiens
TADHGQAAY

SEQ ID NO: 552055 - protein, 9 aa, Homo Sapiens
INIQWQKHC

SEQ ID NO: 552056 - protein, 9 aa, Homo Sapiens
QPYTMTTPY

SEQ ID NO: 552057 - protein, 9 aa, Homo Sapiens
VIGMGNLGS

SEQ ID NO: 552058 - protein, 9 aa, Homo Sapiens
SIRDLPARK

SEQ ID NO: 552059 - protein, 9 aa, Homo Sapiens
RDAGYRVTL

SEQ ID NO: 552060 - protein, 9 aa, Homo Sapiens
QRRKGGLSL

SEQ ID NO: 552061 - protein, 9 aa, Homo Sapiens
FRDAGTRWA

SEQ ID NO: 552062 - protein, 9 aa, Homo Sapiens
CSLFFLLWV

SEQ ID NO: 552063 - protein, 9 aa, Homo Sapiens
ACSVLDVAS

SEQ ID NO: 552064 - protein, 9 aa, Homo Sapiens
KVAFSVQKE

SEQ ID NO: 552065 - protein, 9 aa, Homo Sapiens
ISKHPGTAT

SEQ ID NO: 552066 - protein, 9 aa, Homo Sapiens
LLVLEEDVM

SEQ ID NO: 552067 - protein, 9 aa, Homo Sapiens
MSTNGVSNR

SEQ ID NO: 552068 - protein, 9 aa, Homo Sapiens
AHAVPTYAP

SEQ ID NO: 552069 - protein, 9 aa, Homo Sapiens
FQDIEGKID

SEQ ID NO: 552070 - protein, 9 aa, Homo Sapiens
AGFHTGEQE

SEQ ID NO: 552071 - protein, 9 aa, Homo Sapiens
QVDNESCCS

SEQ ID NO: 552072 - protein, 9 aa, Homo Sapiens
KIHRRRSRT

SEQ ID NO: 552073 - protein, 9 aa, Homo Sapiens
ESNVVVISL

SEQ ID NO: 552074 - protein, 9 aa, Homo Sapiens
TPEYKELYT

SEQ ID NO: 552075 - protein, 9 aa, Homo Sapiens
LSARPSDNG

SEQ ID NO: 552076 - protein, 9 aa, Homo Sapiens
KEDGILGTF

SEQ ID NO: 552077 - protein, 9 aa, Homo Sapiens
EVIERNGRK

SEQ ID NO: 552078 - protein, 9 aa, Homo Sapiens
HGQAAYRAY

SEQ ID NO: 552079 - protein, 9 aa, Homo Sapiens
LPVSGRQLC

SEQ ID NO: 552080 - protein, 9 aa, Homo Sapiens
DPKSHRDLS

SEQ ID NO: 552081 - protein, 9 aa, Homo Sapiens
SFSPDSPGL

SEQ ID NO: 552082 - protein, 9 aa, Homo Sapiens
FWANLRAAV

SEQ ID NO: 552083 - protein, 9 aa, Homo Sapiens
FSCPHSHSG

SEQ ID NO: 552084 - protein, 9 aa, Homo Sapiens
SDLALLVLE

SEQ ID NO: 552085 - protein, 9 aa, Homo Sapiens
MYTCPATVF

SEQ ID NO: 552086 - protein, 9 aa, Homo Sapiens
KASALNTNI

SEQ ID NO: 552087 - protein, 9 aa, Homo Sapiens
RRSPRSGDG

SEQ ID NO: 552088 - protein, 9 aa, Homo Sapiens
AWEELAASR

SEQ ID NO: 552089 - protein, 9 aa, Homo Sapiens
SDNGQYRCL

SEQ ID NO: 552090 - protein, 9 aa, Homo Sapiens
WTPEYKELY

SEQ ID NO: 552091 - protein, 9 aa, Homo Sapiens
CASSLPSPF

SEQ ID NO: 552092 - protein, 9 aa, Homo Sapiens
RRCGAQNKE

SEQ ID NO: 552093 - protein, 9 aa, Homo Sapiens
SRVLQKVAF

SEQ ID NO: 552094 - protein, 9 aa, Homo Sapiens
SQHFPTCSP

SEQ ID NO: 552095 - protein, 9 aa, Homo Sapiens
FSDTLEDHT

SEQ ID NO: 552096 - protein, 9 aa, Homo Sapiens
CALPVSGRQ

SEQ ID NO: 552097 - protein, 9 aa, Homo Sapiens
SANPSAHAV

SEQ ID NO: 552098 - protein, 9 aa, Homo Sapiens
PQGSQKHRA

SEQ ID NO: 552099 - protein, 9 aa, Homo Sapiens
PATVFPMDK

SEQ ID NO: 552100 - protein, 9 aa, Homo Sapiens
KPYVMESPA

SEQ ID NO: 552101 - protein, 9 aa, Homo Sapiens
HCYPLIGSM

SEQ ID NO: 552102 - protein, 9 aa, Homo Sapiens
TLAPGLKAV

SEQ ID NO: 552103 - protein, 9 aa, Homo Sapiens
QKTLSKFLT

SEQ ID NO: 552104 - protein, 9 aa, Homo Sapiens
CPNIIKRSS

SEQ ID NO: 552105 - protein, 9 aa, Homo Sapiens
VLKKDIYQK

SEQ ID NO: 552106 - protein, 9 aa, Homo Sapiens
KQEDWNEHL

SEQ ID NO: 552107 - protein, 9 aa, Homo Sapiens
LPVTIGALT

SEQ ID NO: 552108 - protein, 9 aa, Homo Sapiens
ERRQSRSRS

SEQ ID NO: 552109 - protein, 9 aa, Homo Sapiens
YFLFFSYAI

SEQ ID NO: 552110 - protein, 9 aa, Homo Sapiens
RSECFKVEK

SEQ ID NO: 552111 - protein, 9 aa, Homo Sapiens
SKERRQSRS

SEQ ID NO: 552112 - protein, 9 aa, Homo Sapiens
SFCELCYST

SEQ ID NO: 552113 - protein, 9 aa, Homo Sapiens
PNIIKRSSW

SEQ ID NO: 552114 - protein, 9 aa, Homo Sapiens
PQEHPGLGG

SEQ ID NO: 552115 - protein, 9 aa, Homo Sapiens
SSWEARETH

SEQ ID NO: 552116 - protein, 9 aa, Homo Sapiens
DKPKLKKTE

SEQ ID NO: 552117 - protein, 9 aa, Homo Sapiens
KRSSWEARE

SEQ ID NO: 552118 - protein, 9 aa, Homo Sapiens
WKQEDWNEH

SEQ ID NO: 552119 - protein, 9 aa, Homo Sapiens
IEKFDKPKL

SEQ ID NO: 552120 - protein, 9 aa, Homo Sapiens
SAAALSSLT

SEQ ID NO: 552121 - protein, 9 aa, Homo Sapiens
PEKLMVITV

SEQ ID NO: 552122 - protein, 9 aa, Homo Sapiens
GRPPENKRG

SEQ ID NO: 552123 - protein, 9 aa, Homo Sapiens
LFFSYAIVV

SEQ ID NO: 552124 - protein, 9 aa, Homo Sapiens
FLQKEKDQL

SEQ ID NO: 552125 - protein, 9 aa, Homo Sapiens
PENKRGRKP

SEQ ID NO: 552126 - protein, 9 aa, Homo Sapiens
FFNVLYWLF

SEQ ID NO: 552127 - protein, 9 aa, Homo Sapiens
RYHYEPHST

SEQ ID NO: 552128 - protein, 9 aa, Homo Sapiens
YEPHSTVCT

SEQ ID NO: 552129 - protein, 9 aa, Homo Sapiens
IKRSSWEAR

SEQ ID NO: 552130 - protein, 9 aa, Homo Sapiens
SECFKVEKN

SEQ ID NO: 552131 - protein, 9 aa, Homo Sapiens
KERRQSRSR

SEQ ID NO: 552132 - protein, 9 aa, Homo Sapiens
ASVIKELRK

SEQ ID NO: 552133 - protein, 9 aa, Homo Sapiens
RGRKPAHPV

SEQ ID NO: 552134 - protein, 9 aa, Homo Sapiens
SGSNNNLFI

SEQ ID NO: 552135 - protein, 9 aa, Homo Sapiens
RRQSRSRSR

SEQ ID NO: 552136 - protein, 9 aa, Homo Sapiens
AALSSLTSP

SEQ ID NO: 552137 - protein, 9 aa, Homo Sapiens
EQVEFLQKE

SEQ ID NO: 552138 - protein, 9 aa, Homo Sapiens
PSAAALSSL

SEQ ID NO: 552139 - protein, 9 aa, Homo Sapiens
SWEARETHC

SEQ ID NO: 552140 - protein, 9 aa, Homo Sapiens
KISEQVEFL

SEQ ID NO: 552141 - protein, 9 aa, Homo Sapiens
VTIGALTLT

SEQ ID NO: 552142 - protein, 9 aa, Homo Sapiens
AALSHSLWK

SEQ ID NO: 552143 - protein, 9 aa, Homo Sapiens
KTLSKFLTK

SEQ ID NO: 552144 - protein, 9 aa, Homo Sapiens
FNVLYWLFC

SEQ ID NO: 552145 - protein, 9 aa, Homo Sapiens
VQKTLSKFL

SEQ ID NO: 552146 - protein, 9 aa, Homo Sapiens
KTLGLLCGK

SEQ ID NO: 552147 - protein, 9 aa, Homo Sapiens
APSSNDKTL

SEQ ID NO: 552148 - protein, 9 aa, Homo Sapiens
MVITVATAE

SEQ ID NO: 552149 - protein, 9 aa, Homo Sapiens
FDKPKLKKT

SEQ ID NO: 552150 - protein, 9 aa, Homo Sapiens
DPVNPEKLM

SEQ ID NO: 552151 - protein, 9 aa, Homo Sapiens
LYWLFCLNL

SEQ ID NO: 552152 - protein, 9 aa, Homo Sapiens
EIEKFDKPK

SEQ ID NO: 552153 - protein, 9 aa, Homo Sapiens
INPEALASV

SEQ ID NO: 552154 - protein, 9 aa, Homo Sapiens
LSFCELCYS

SEQ ID NO: 552155 - protein, 9 aa, Homo Sapiens
CLNSQPHAH

SEQ ID NO: 552156 - protein, 9 aa, Homo Sapiens
ECFKVEKNL

SEQ ID NO: 552157 - protein, 9 aa, Homo Sapiens
AHGSSRAIF

SEQ ID NO: 552158 - protein, 9 aa, Homo Sapiens
YAIVVGLGC

SEQ ID NO: 552159 - protein, 9 aa, Homo Sapiens
HSLWKQEDW

SEQ ID NO: 552160 - protein, 9 aa, Homo Sapiens
LGGEAVGTG

SEQ ID NO: 552161 - protein, 9 aa, Homo Sapiens
PGLKAVLKK

SEQ ID NO: 552162 - protein, 9 aa, Homo Sapiens
LNSQPHAHG

SEQ ID NO: 552163 - protein, 9 aa, Homo Sapiens
GGEAVGTGE

SEQ ID NO: 552164 - protein, 9 aa, Homo Sapiens
GPLPSAAAL

SEQ ID NO: 552165 - protein, 9 aa, Homo Sapiens
RSKERRQSR

SEQ ID NO: 552166 - protein, 9 aa, Homo Sapiens
NPEALASVI

SEQ ID NO: 552167 - protein, 9 aa, Homo Sapiens
HGSSRAIFS

SEQ ID NO: 552168 - protein, 9 aa, Homo Sapiens
SQPHAHGSS

SEQ ID NO: 552169 - protein, 9 aa, Homo Sapiens
LPSAAALSS

SEQ ID NO: 552170 - protein, 9 aa, Homo Sapiens
GLKAVLKKD

SEQ ID NO: 552171 - protein, 9 aa, Homo Sapiens
NNLFISNEE

SEQ ID NO: 552172 - protein, 9 aa, Homo Sapiens
FLFFSYAIV

SEQ ID NO: 552173 - protein, 9 aa, Homo Sapiens
EKLMVITVA

SEQ ID NO: 552174 - protein, 9 aa, Homo Sapiens
KVEKNLLVY

SEQ ID NO: 552175 - protein, 9 aa, Homo Sapiens
NVLYWLFCL

SEQ ID NO: 552176 - protein, 9 aa, Homo Sapiens
NDKTLGLLC

SEQ ID NO: 552177 - protein, 9 aa, Homo Sapiens
CFKVEKNLL

SEQ ID NO: 552178 - protein, 9 aa, Homo Sapiens
ISEQVEFLQ

SEQ ID NO: 552179 - protein, 9 aa, Homo Sapiens
KPKLKKTET

SEQ ID NO: 552180 - protein, 9 aa, Homo Sapiens
AVLKKDIYQ

SEQ ID NO: 552181 - protein, 9 aa, Homo Sapiens
NNNLFISNE

SEQ ID NO: 552182 - protein, 9 aa, Homo Sapiens
GLGGEAVGT

SEQ ID NO: 552183 - protein, 9 aa, Homo Sapiens
TVCTGPLPS

SEQ ID NO: 552184 - protein, 9 aa, Homo Sapiens
LMVITVATA

SEQ ID NO: 552185 - protein, 9 aa, Homo Sapiens
HPGLGGEAV

SEQ ID NO: 552186 - protein, 9 aa, Homo Sapiens
DKTLGLLCG

SEQ ID NO: 552187 - protein, 9 aa, Homo Sapiens
PVTIGALTL

SEQ ID NO: 552188 - protein, 9 aa, Homo Sapiens
PGLGGEAVG

SEQ ID NO: 552189 - protein, 9 aa, Homo Sapiens
QPHAHGSSR

SEQ ID NO: 552190 - protein, 9 aa, Homo Sapiens
NKRGRKPAH

SEQ ID NO: 552191 - protein, 9 aa, Homo Sapiens
VSLPVTIGA

SEQ ID NO: 552192 - protein, 9 aa, Homo Sapiens
YHYEPHSTV

SEQ ID NO: 552193 - protein, 9 aa, Homo Sapiens
PEALASVIK

SEQ ID NO: 552194 - protein, 9 aa, Homo Sapiens
PSSNDKTLG

SEQ ID NO: 552195 - protein, 9 aa, Homo Sapiens
STVCTGPLP

SEQ ID NO: 552196 - protein, 9 aa, Homo Sapiens
FSYAIVVGL

SEQ ID NO: 552197 - protein, 9 aa, Homo Sapiens
ELCYSTATG

SEQ ID NO: 552198 - protein, 9 aa, Homo Sapiens
SSNDKTLGL

SEQ ID NO: 552199 - protein, 9 aa, Homo Sapiens
HAHGSSRAI

SEQ ID NO: 552200 - protein, 9 aa, Homo Sapiens
LSHLSFCEL

SEQ ID NO: 552201 - protein, 9 aa, Homo Sapiens
PKLKKTETQ

SEQ ID NO: 552202 - protein, 9 aa, Homo Sapiens
LFISNEEPT

SEQ ID NO: 552203 - protein, 9 aa, Homo Sapiens
LKAVLKKDI

SEQ ID NO: 552204 - protein, 9 aa, Homo Sapiens
LSKFLTKAT

SEQ ID NO: 552205 - protein, 9 aa, Homo Sapiens
EEVQKTLSK

SEQ ID NO: 552206 - protein, 9 aa, Homo Sapiens
SHSLWKQED

SEQ ID NO: 552207 - protein, 9 aa, Homo Sapiens
LWKQEDWNE

SEQ ID NO: 552208 - protein, 9 aa, Homo Sapiens
FLSHLSFCE

SEQ ID NO: 552209 - protein, 9 aa, Homo Sapiens
SKFLTKATS

SEQ ID NO: 552210 - protein, 9 aa, Homo Sapiens
SSGSNNNLF

SEQ ID NO: 552211 - protein, 9 aa, Homo Sapiens
EAPSSNDKT

SEQ ID NO: 552212 - protein, 9 aa, Homo Sapiens
KRGRKPAHP

SEQ ID NO: 552213 - protein, 9 aa, Homo Sapiens
TKISEQVEF

SEQ ID NO: 552214 - protein, 9 aa, Homo Sapiens
FKVEKNLLV

SEQ ID NO: 552215 - protein, 9 aa, Homo Sapiens
TIGALTLTG

SEQ ID NO: 552216 - protein, 9 aa, Homo Sapiens
SRSKERRQS

SEQ ID NO: 552217 - protein, 9 aa, Homo Sapiens
TLSKFLTKA

SEQ ID NO: 552218 - protein, 9 aa, Homo Sapiens
AEIEKFDKP

SEQ ID NO: 552219 - protein, 9 aa, Homo Sapiens
PVNPEKLMV

SEQ ID NO: 552220 - protein, 9 aa, Homo Sapiens
TPQEHPGLG

SEQ ID NO: 552221 - protein, 9 aa, Homo Sapiens
VNPEKLMVI

SEQ ID NO: 552222 - protein, 9 aa, Homo Sapiens
TLGLLCGKD

SEQ ID NO: 552223 - protein, 9 aa, Homo Sapiens
AAALSSLTS

SEQ ID NO: 552224 - protein, 9 aa, Homo Sapiens
EFLQKEKDQ

SEQ ID NO: 552225 - protein, 9 aa, Homo Sapiens
RSRSKERRQ

SEQ ID NO: 552226 - protein, 9 aa, Homo Sapiens
VEFLQKEKD

SEQ ID NO: 552227 - protein, 9 aa, Homo Sapiens
NIIKRSSWE

SEQ ID NO: 552228 - protein, 9 aa, Homo Sapiens
EKFDKPKLK

SEQ ID NO: 552229 - protein, 9 aa, Homo Sapiens
EVSLPVTIG

SEQ ID NO: 552230 - protein, 9 aa, Homo Sapiens
SHLSFCELC

SEQ ID NO: 552231 - protein, 9 aa, Homo Sapiens
SNDKTLGLL

SEQ ID NO: 552232 - protein, 9 aa, Homo Sapiens
VEEVQKTLS

SEQ ID NO: 552233 - protein, 9 aa, Homo Sapiens
EHPGLGGEA

SEQ ID NO: 552234 - protein, 9 aa, Homo Sapiens
GINPEALAS

SEQ ID NO: 552235 - protein, 9 aa, Homo Sapiens
GYARSECFK

SEQ ID NO: 552236 - protein, 9 aa, Homo Sapiens
LAPGLKAVL

SEQ ID NO: 552237 - protein, 9 aa, Homo Sapiens
GSNNNLFIS

SEQ ID NO: 552238 - protein, 9 aa, Homo Sapiens
YARSECFKV

SEQ ID NO: 552239 - protein, 9 aa, Homo Sapiens
QVEFLQKEK

SEQ ID NO: 552240 - protein, 9 aa, Homo Sapiens
GRKPAHPVK

SEQ ID NO: 552241 - protein, 9 aa, Homo Sapiens
HLSFCELCY

SEQ ID NO: 552242 - protein, 9 aa, Homo Sapiens
PHAHGSSRA

SEQ ID NO: 552243 - protein, 9 aa, Homo Sapiens
PLPSAAALS

SEQ ID NO: 552244 - protein, 9 aa, Homo Sapiens
AIVVGLGCG

SEQ ID NO: 552245 - protein, 9 aa, Homo Sapiens
ARSECFKVE

SEQ ID NO: 552246 - protein, 9 aa, Homo Sapiens
IIKRSSWEA

SEQ ID NO: 552247 - protein, 9 aa, Homo Sapiens
EPHSTVCTG

SEQ ID NO: 552248 - protein, 9 aa, Homo Sapiens
SNNNLFISN

SEQ ID NO: 552249 - protein, 9 aa, Homo Sapiens
PPENKRGRK

SEQ ID NO: 552250 - protein, 9 aa, Homo Sapiens
CTGPLPSAA

SEQ ID NO: 552251 - protein, 9 aa, Homo Sapiens
LSHSLWKQE

SEQ ID NO: 552252 - protein, 9 aa, Homo Sapiens
APGLKAVLK

SEQ ID NO: 552253 - protein, 9 aa, Homo Sapiens
QEHPGLGGE

SEQ ID NO: 552254 - protein, 9 aa, Homo Sapiens
IGALTLTGT

SEQ ID NO: 552255 - protein, 9 aa, Homo Sapiens
FCELCYSTA

SEQ ID NO: 552256 - protein, 9 aa, Homo Sapiens
SEQVEFLQK

SEQ ID NO: 552257 - protein, 9 aa, Homo Sapiens
NSQPHAHGS

SEQ ID NO: 552258 - protein, 9 aa, Homo Sapiens
SLPVTIGAL

SEQ ID NO: 552259 - protein, 9 aa, Homo Sapiens
RQSRSRSRD

SEQ ID NO: 552260 - protein, 9 aa, Homo Sapiens
HYEPHSTVC

SEQ ID NO: 552261 - protein, 9 aa, Homo Sapiens
KAVLKKDIY

SEQ ID NO: 552262 - protein, 9 aa, Homo Sapiens
IYFLFFSYA

SEQ ID NO: 552263 - protein, 9 aa, Homo Sapiens
KFDKPKLKK

SEQ ID NO: 552264 - protein, 9 aa, Homo Sapiens
SYAIVVGLG

SEQ ID NO: 552265 - protein, 9 aa, Homo Sapiens
PHSTVCTGP

SEQ ID NO: 552266 - protein, 9 aa, Homo Sapiens
ENKRGRKPA

SEQ ID NO: 552267 - protein, 9 aa, Homo Sapiens
RSSWEARET

SEQ ID NO: 552268 - protein, 9 aa, Homo Sapiens
EVQKTLSKF

SEQ ID NO: 552269 - protein, 9 aa, Homo Sapiens
QGINPEALA

SEQ ID NO: 552270 - protein, 9 aa, Homo Sapiens
EALASVIKE

SEQ ID NO: 552271 - protein, 9 aa, Homo Sapiens
PEVSLPVTI

SEQ ID NO: 552272 - protein, 9 aa, Homo Sapiens
RPPENKRGR

SEQ ID NO: 552273 - protein, 9 aa, Homo Sapiens
CELCYSTAT

SEQ ID NO: 552274 - protein, 9 aa, Homo Sapiens
NPEKLMVIT

SEQ ID NO: 552275 - protein, 9 aa, Homo Sapiens
ALSHSLWKQ

SEQ ID NO: 552276 - protein, 9 aa, Homo Sapiens
SLWKQEDWN

SEQ ID NO: 552277 - protein, 9 aa, Homo Sapiens
VLYWLFCLN

SEQ ID NO: 552278 - protein, 9 aa, Homo Sapiens
NLFISNEEP

SEQ ID NO: 552279 - protein, 9 aa, Homo Sapiens
FFSYAIVVG

SEQ ID NO: 552280 - protein, 9 aa, Homo Sapiens
TGPLPSAAA

SEQ ID NO: 552281 - protein, 9 aa, Homo Sapiens
VCTGPLPSA

SEQ ID NO: 552282 - protein, 9 aa, Homo Sapiens
QSRSRSRDR

SEQ ID NO: 552283 - protein, 9 aa, Homo Sapiens
FISNEEPTF

SEQ ID NO: 552284 - protein, 9 aa, Homo Sapiens
HSTVCTGPL

SEQ ID NO: 552285 - protein, 9 aa, Homo Sapiens
KLMVITVAT

SEQ ID NO: 552286 - protein, 9 aa, Homo Sapiens
IWLLILSYV

SEQ ID NO: 552287 - protein, 9 aa, Homo Sapiens
DGFCDDSHI

SEQ ID NO: 552288 - protein, 9 aa, Homo Sapiens
EEVRQLNAI

SEQ ID NO: 552289 - protein, 9 aa, Homo Sapiens
PSGHQSGYR

SEQ ID NO: 552290 - protein, 9 aa, Homo Sapiens
WTRPTEFLV

SEQ ID NO: 552291 - protein, 9 aa, Homo Sapiens
RFSSLLSKQ

SEQ ID NO: 552292 - protein, 9 aa, Homo Sapiens
QMDHFVGRN

SEQ ID NO: 552293 - protein, 9 aa, Homo Sapiens
VGMNLEAVR

SEQ ID NO: 552294 - protein, 9 aa, Homo Sapiens
DGTDFYGDV

SEQ ID NO: 552295 - protein, 9 aa, Homo Sapiens
EGPQVSLHP

SEQ ID NO: 552296 - protein, 9 aa, Homo Sapiens
TTNMYMKGV

SEQ ID NO: 552297 - protein, 9 aa, Homo Sapiens
AASDPLDIL

SEQ ID NO: 552298 - protein, 9 aa, Homo Sapiens
KENHIYSAD

SEQ ID NO: 552299 - protein, 9 aa, Homo Sapiens
KSSTQEATE

SEQ ID NO: 552300 - protein, 9 aa, Homo Sapiens
AQSKSMADS

SEQ ID NO: 552301 - protein, 9 aa, Homo Sapiens
FNNSSISVK

SEQ ID NO: 552302 - protein, 9 aa, Homo Sapiens
IIGQAFGTK

SEQ ID NO: 552303 - protein, 9 aa, Homo Sapiens
NLEAVRADR

SEQ ID NO: 552304 - protein, 9 aa, Homo Sapiens
DTESGDAKN

SEQ ID NO: 552305 - protein, 9 aa, Homo Sapiens
DGIPLRGGP

SEQ ID NO: 552306 - protein, 9 aa, Homo Sapiens
QNVPVYGST

SEQ ID NO: 552307 - protein, 9 aa, Homo Sapiens
TRPALGSTP

SEQ ID NO: 552308 - protein, 9 aa, Homo Sapiens
QLNAILGGD

SEQ ID NO: 552309 - protein, 9 aa, Homo Sapiens
KWVVKLYYS

SEQ ID NO: 552310 - protein, 9 aa, Homo Sapiens
LKIPKECDL

SEQ ID NO: 552311 - protein, 9 aa, Homo Sapiens
FSGVEEVRQ

SEQ ID NO: 552312 - protein, 9 aa, Homo Sapiens
KRVLTTDFC

SEQ ID NO: 552313 - protein, 9 aa, Homo Sapiens
HDCGKCFSN

SEQ ID NO: 552314 - protein, 9 aa, Homo Sapiens
SIQNVPVYG

SEQ ID NO: 552315 - protein, 9 aa, Homo Sapiens
FRDVKIEFC

SEQ ID NO: 552316 - protein, 9 aa, Homo Sapiens
GHLDQLLSS

SEQ ID NO: 552317 - protein, 9 aa, Homo Sapiens
FGCTECGKG

SEQ ID NO: 552318 - protein, 9 aa, Homo Sapiens
KLLSYFLVS

SEQ ID NO: 552319 - protein, 9 aa, Homo Sapiens
RTLYREMML

SEQ ID NO: 552320 - protein, 9 aa, Homo Sapiens
QKCLSVGMN

SEQ ID NO: 552321 - protein, 9 aa, Homo Sapiens
RQLNAILGG

SEQ ID NO: 552322 - protein, 9 aa, Homo Sapiens
SATFLVSWL

SEQ ID NO: 552323 - protein, 9 aa, Homo Sapiens
SREPSLCNR

SEQ ID NO: 552324 - protein, 9 aa, Homo Sapiens
YRITTAATL

SEQ ID NO: 552325 - protein, 9 aa, Homo Sapiens
SSKRVLTTD

SEQ ID NO: 552326 - protein, 9 aa, Homo Sapiens
GSVIRINDF

SEQ ID NO: 552327 - protein, 9 aa, Homo Sapiens
IKTTQQRNL

SEQ ID NO: 552328 - protein, 9 aa, Homo Sapiens
PTLTSHIKN

SEQ ID NO: 552329 - protein, 9 aa, Homo Sapiens
TRPTEFLVQ

SEQ ID NO: 552330 - protein, 9 aa, Homo Sapiens
VRQLNAILG

SEQ ID NO: 552331 - protein, 9 aa, Homo Sapiens
DQLLSSLKT

SEQ ID NO: 552332 - protein, 9 aa, Homo Sapiens
QGVASVLMP

SEQ ID NO: 552333 - protein, 9 aa, Homo Sapiens
VYGSTLPVC

SEQ ID NO: 552334 - protein, 9 aa, Homo Sapiens
MADSGSVQH

SEQ ID NO: 552335 - protein, 9 aa, Homo Sapiens
MMLETCGLL

SEQ ID NO: 552336 - protein, 9 aa, Homo Sapiens
TNGLCIWLL

SEQ ID NO: 552337 - protein, 9 aa, Homo Sapiens
ILGGDHQSF

SEQ ID NO: 552338 - protein, 9 aa, Homo Sapiens
NQSVNLFLG

SEQ ID NO: 552339 - protein, 9 aa, Homo Sapiens
GMEWNGMKW

SEQ ID NO: 552340 - protein, 9 aa, Homo Sapiens
KLRVSFHKL

SEQ ID NO: 552341 - protein, 9 aa, Homo Sapiens
VYRITTAAT

SEQ ID NO: 552342 - protein, 9 aa, Homo Sapiens
GVASVLMPH

SEQ ID NO: 552343 - protein, 9 aa, Homo Sapiens
FYGDVLFPG

SEQ ID NO: 552344 - protein, 9 aa, Homo Sapiens
MLMIFSATF

SEQ ID NO: 552345 - protein, 9 aa, Homo Sapiens
LRAGDSWTR

SEQ ID NO: 552346 - protein, 9 aa, Homo Sapiens
SKRVLTTDF

SEQ ID NO: 552347 - protein, 9 aa, Homo Sapiens
LRGGPTLTG

SEQ ID NO: 552348 - protein, 9 aa, Homo Sapiens
VSFHKLLSY

SEQ ID NO: 552349 - protein, 9 aa, Homo Sapiens
CLSVGMNLE

SEQ ID NO: 552350 - protein, 9 aa, Homo Sapiens
GRNFNSNFN

SEQ ID NO: 552351 - protein, 9 aa, Homo Sapiens
DSNKLRVSF

SEQ ID NO: 552352 - protein, 9 aa, Homo Sapiens
PCHDCGKCF

SEQ ID NO: 552353 - protein, 9 aa, Homo Sapiens
VLMPHQVKP

SEQ ID NO: 552354 - protein, 9 aa, Homo Sapiens
CDDSHIFGS

SEQ ID NO: 552355 - protein, 9 aa, Homo Sapiens
TTSKYGEGS

SEQ ID NO: 552356 - protein, 9 aa, Homo Sapiens
FEGPQVSLH

SEQ ID NO: 552357 - protein, 9 aa, Homo Sapiens
DIVSRQEAV

SEQ ID NO: 552358 - protein, 9 aa, Homo Sapiens
HQSFLVVMQ

SEQ ID NO: 552359 - protein, 9 aa, Homo Sapiens
PALGSTPPP

SEQ ID NO: 552360 - protein, 9 aa, Homo Sapiens
LFLGHTAID

SEQ ID NO: 552361 - protein, 9 aa, Homo Sapiens
KLQVWSVTE

SEQ ID NO: 552362 - protein, 9 aa, Homo Sapiens
AGLTWERGL

SEQ ID NO: 552363 - protein, 9 aa, Homo Sapiens
YRNNIDDVR

SEQ ID NO: 552364 - protein, 9 aa, Homo Sapiens
SVIRINDFD

SEQ ID NO: 552365 - protein, 9 aa, Homo Sapiens
DCGVFAQSK

SEQ ID NO: 552366 - protein, 9 aa, Homo Sapiens
NSSISVKEF

SEQ ID NO: 552367 - protein, 9 aa, Homo Sapiens
AVEPSDDVV

SEQ ID NO: 552368 - protein, 9 aa, Homo Sapiens
PDCGVFAQS

SEQ ID NO: 552369 - protein, 9 aa, Homo Sapiens
SRIRLIFND

SEQ ID NO: 552370 - protein, 9 aa, Homo Sapiens
LRVSFHKLL

SEQ ID NO: 552371 - protein, 9 aa, Homo Sapiens
KIPKECDLV

SEQ ID NO: 552372 - protein, 9 aa, Homo Sapiens
RDIVSRQEA

SEQ ID NO: 552373 - protein, 9 aa, Homo Sapiens
HKLLSYFLV

SEQ ID NO: 552374 - protein, 9 aa, Homo Sapiens
NRMEWNGME

SEQ ID NO: 552375 - protein, 9 aa, Homo Sapiens
VWSLDGIPL

SEQ ID NO: 552376 - protein, 9 aa, Homo Sapiens
KNARNDSRN

SEQ ID NO: 552377 - protein, 9 aa, Homo Sapiens
QVRHQFQHL

SEQ ID NO: 552378 - protein, 9 aa, Homo Sapiens
EWSAASDPL

SEQ ID NO: 552379 - protein, 9 aa, Homo Sapiens
GQAFGTKHS

SEQ ID NO: 552380 - protein, 9 aa, Homo Sapiens
DSWTRPTEF

SEQ ID NO: 552381 - protein, 9 aa, Homo Sapiens
KIEFCLEEW

SEQ ID NO: 552382 - protein, 9 aa, Homo Sapiens
KHSWVIRAD

SEQ ID NO: 552383 - protein, 9 aa, Homo Sapiens
GSRIRLIFN

SEQ ID NO: 552384 - protein, 9 aa, Homo Sapiens
SKQLAPRVP

SEQ ID NO: 552385 - protein, 9 aa, Homo Sapiens
VVMQGVASV

SEQ ID NO: 552386 - protein, 9 aa, Homo Sapiens
YWGRTCKRE

SEQ ID NO: 552387 - protein, 9 aa, Homo Sapiens
PQVSLHPPN

SEQ ID NO: 552388 - protein, 9 aa, Homo Sapiens
MQGVASVLM

SEQ ID NO: 552389 - protein, 9 aa, Homo Sapiens
HSDGFCDDS

SEQ ID NO: 552390 - protein, 9 aa, Homo Sapiens
KCLQRNADG

SEQ ID NO: 552391 - protein, 9 aa, Homo Sapiens
FGSVIRIND

SEQ ID NO: 552392 - protein, 9 aa, Homo Sapiens
SSTQEATEQ

SEQ ID NO: 552393 - protein, 9 aa, Homo Sapiens
PEKVTSANK

SEQ ID NO: 552394 - protein, 9 aa, Homo Sapiens
DAKNARNDS

SEQ ID NO: 552395 - protein, 9 aa, Homo Sapiens
LCIWLLILS

SEQ ID NO: 552396 - protein, 9 aa, Homo Sapiens
CGKCFSNRS

SEQ ID NO: 552397 - protein, 9 aa, Homo Sapiens
HFVGRNFNS

SEQ ID NO: 552398 - protein, 9 aa, Homo Sapiens
CGVFAQSKS

SEQ ID NO: 552399 - protein, 9 aa, Homo Sapiens
HLDQLLSSL

SEQ ID NO: 552400 - protein, 9 aa, Homo Sapiens
RTCKREASI

SEQ ID NO: 552401 - protein, 9 aa, Homo Sapiens
NAILGGDHQ

SEQ ID NO: 552402 - protein, 9 aa, Homo Sapiens
CIKTTQQRN

SEQ ID NO: 552403 - protein, 9 aa, Homo Sapiens
VTEVTAPQG

SEQ ID NO: 552404 - protein, 9 aa, Homo Sapiens
GTFFPETWI

SEQ ID NO: 552405 - protein, 9 aa, Homo Sapiens
SVKEFDTKA

SEQ ID NO: 552406 - protein, 9 aa, Homo Sapiens
SSLLSKQLA

SEQ ID NO: 552407 - protein, 9 aa, Homo Sapiens
HSWVIRADH

SEQ ID NO: 552408 - protein, 9 aa, Homo Sapiens
AVRLRKENH

SEQ ID NO: 552409 - protein, 9 aa, Homo Sapiens
YRVVPQVRH

SEQ ID NO: 552410 - protein, 9 aa, Homo Sapiens
LCNRSPRVV

SEQ ID NO: 552411 - protein, 9 aa, Homo Sapiens
ADNKWVVKL

SEQ ID NO: 552412 - protein, 9 aa, Homo Sapiens
MTNGLCIWL

SEQ ID NO: 552413 - protein, 9 aa, Homo Sapiens
KREASILSY

SEQ ID NO: 552414 - protein, 9 aa, Homo Sapiens
ENHIYSADE

SEQ ID NO: 552415 - protein, 9 aa, Homo Sapiens
RGELDSEPH

SEQ ID NO: 552416 - protein, 9 aa, Homo Sapiens
RPTEFLVQV

SEQ ID NO: 552417 - protein, 9 aa, Homo Sapiens
INDFDSNKL

SEQ ID NO: 552418 - protein, 9 aa, Homo Sapiens
HHRGELDSE

SEQ ID NO: 552419 - protein, 9 aa, Homo Sapiens
PLRGGPTLT

SEQ ID NO: 552420 - protein, 9 aa, Homo Sapiens
EDLIEIIGQ

SEQ ID NO: 552421 - protein, 9 aa, Homo Sapiens
TFSTTSKYG

SEQ ID NO: 552422 - protein, 9 aa, Homo Sapiens
VASVLMPHQ

SEQ ID NO: 552423 - protein, 9 aa, Homo Sapiens
LSAKCLQRN

SEQ ID NO: 552424 - protein, 9 aa, Homo Sapiens
STLPVCFSG

SEQ ID NO: 552425 - protein, 9 aa, Homo Sapiens
QSVNLFLGH

SEQ ID NO: 552426 - protein, 9 aa, Homo Sapiens
HEDLIEIIG

SEQ ID NO: 552427 - protein, 9 aa, Homo Sapiens
DSGSVQHQS

SEQ ID NO: 552428 - protein, 9 aa, Homo Sapiens
NARNDSRNL

SEQ ID NO: 552429 - protein, 9 aa, Homo Sapiens
DDVVVPGQP

SEQ ID NO: 552430 - protein, 9 aa, Homo Sapiens
LVVMQGVAS

SEQ ID NO: 552431 - protein, 9 aa, Homo Sapiens
QEIVETTNM

SEQ ID NO: 552432 - protein, 9 aa, Homo Sapiens
LNAILGGDH

SEQ ID NO: 552433 - protein, 9 aa, Homo Sapiens
SANKTNKQT

SEQ ID NO: 552434 - protein, 9 aa, Homo Sapiens
NDFDSNKLR

SEQ ID NO: 552435 - protein, 9 aa, Homo Sapiens
SWVIRADHH

SEQ ID NO: 552436 - protein, 9 aa, Homo Sapiens
LEQSTVDRD

SEQ ID NO: 552437 - protein, 9 aa, Homo Sapiens
QKVSFSEEG

SEQ ID NO: 552438 - protein, 9 aa, Homo Sapiens
KECDLVLLF

SEQ ID NO: 552439 - protein, 9 aa, Homo Sapiens
GLTWERGLL

SEQ ID NO: 552440 - protein, 9 aa, Homo Sapiens
GFSQKSQLI

SEQ ID NO: 552441 - protein, 9 aa, Homo Sapiens
NKWVVKLYY

SEQ ID NO: 552442 - protein, 9 aa, Homo Sapiens
EVRQLNAIL

SEQ ID NO: 552443 - protein, 9 aa, Homo Sapiens
TLTSHIKNS

SEQ ID NO: 552444 - protein, 9 aa, Homo Sapiens
TWERGLLHS

SEQ ID NO: 552445 - protein, 9 aa, Homo Sapiens
ECIKTTQQR

SEQ ID NO: 552446 - protein, 9 aa, Homo Sapiens
PKECDLVLL

SEQ ID NO: 552447 - protein, 9 aa, Homo Sapiens
KQLAPRVPV

SEQ ID NO: 552448 - protein, 9 aa, Homo Sapiens
VDRDIVSRQ

SEQ ID NO: 552449 - protein, 9 aa, Homo Sapiens
VGRGLQPKR

SEQ ID NO: 552450 - protein, 9 aa, Homo Sapiens
KSMADSGSV

SEQ ID NO: 552451 - protein, 9 aa, Homo Sapiens
VKIEFCLEE

SEQ ID NO: 552452 - protein, 9 aa, Homo Sapiens
LTSHIKNST

SEQ ID NO: 552453 - protein, 9 aa, Homo Sapiens
SMADSGSVQ

SEQ ID NO: 552454 - protein, 9 aa, Homo Sapiens
GYRVVPQVR

SEQ ID NO: 552455 - protein, 9 aa, Homo Sapiens
ADSGSVQHQ

SEQ ID NO: 552456 - protein, 9 aa, Homo Sapiens
PVYGSTLPV

SEQ ID NO: 552457 - protein, 9 aa, Homo Sapiens
LANLQAKSR

SEQ ID NO: 552458 - protein, 9 aa, Homo Sapiens
LLSKQLAPR

SEQ ID NO: 552459 - protein, 9 aa, Homo Sapiens
QHLVRDGTD

SEQ ID NO: 552460 - protein, 9 aa, Homo Sapiens
QRNADGDGG

SEQ ID NO: 552461 - protein, 9 aa, Homo Sapiens
RLIFNDFDV

SEQ ID NO: 552462 - protein, 9 aa, Homo Sapiens
SLLSKQLAP

SEQ ID NO: 552463 - protein, 9 aa, Homo Sapiens
SHIKNSTGL

SEQ ID NO: 552464 - protein, 9 aa, Homo Sapiens
RNADGDGGG

SEQ ID NO: 552465 - protein, 9 aa, Homo Sapiens
IQNVPVYGS

SEQ ID NO: 552466 - protein, 9 aa, Homo Sapiens
RVVPQVRHQ

SEQ ID NO: 552467 - protein, 9 aa, Homo Sapiens
TDFCAGCKV

SEQ ID NO: 552468 - protein, 9 aa, Homo Sapiens
TDFYGDVLF

SEQ ID NO: 552469 - protein, 9 aa, Homo Sapiens
VQHQSIQNV

SEQ ID NO: 552470 - protein, 9 aa, Homo Sapiens
LLKIPKECD

SEQ ID NO: 552471 - protein, 9 aa, Homo Sapiens
LHPPNAHED

SEQ ID NO: 552472 - protein, 9 aa, Homo Sapiens
LIAGLTWER

SEQ ID NO: 552473 - protein, 9 aa, Homo Sapiens
GRTCKREAS

SEQ ID NO: 552474 - protein, 9 aa, Homo Sapiens
QAFGTKHSW

SEQ ID NO: 552475 - protein, 9 aa, Homo Sapiens
LGGDHQSFL

SEQ ID NO: 552476 - protein, 9 aa, Homo Sapiens
GGDHQSFLV

SEQ ID NO: 552477 - protein, 9 aa, Homo Sapiens
FQHLVRDGT

SEQ ID NO: 552478 - protein, 9 aa, Homo Sapiens
MPHQVKPCH

SEQ ID NO: 552479 - protein, 9 aa, Homo Sapiens
LMPHQVKPC

SEQ ID NO: 552480 - protein, 9 aa, Homo Sapiens
EPSDDVVVP

SEQ ID NO: 552481 - protein, 9 aa, Homo Sapiens
SSLKTSLKV

SEQ ID NO: 552482 - protein, 9 aa, Homo Sapiens
ALGSTPPPA

SEQ ID NO: 552483 - protein, 9 aa, Homo Sapiens
ESGDAKNAR

SEQ ID NO: 552484 - protein, 9 aa, Homo Sapiens
GPQVSLHPP

SEQ ID NO: 552485 - protein, 9 aa, Homo Sapiens
WQLAQLEAR

SEQ ID NO: 552486 - protein, 9 aa, Homo Sapiens
IRADHHGVP

SEQ ID NO: 552487 - protein, 9 aa, Homo Sapiens
TEQAVSTAH

SEQ ID NO: 552488 - protein, 9 aa, Homo Sapiens
IRLIFNDFD

SEQ ID NO: 552489 - protein, 9 aa, Homo Sapiens
LGSTPPPAH

SEQ ID NO: 552490 - protein, 9 aa, Homo Sapiens
RGLQPKRVR

SEQ ID NO: 552491 - protein, 9 aa, Homo Sapiens
FHKLLSYFL

SEQ ID NO: 552492 - protein, 9 aa, Homo Sapiens
LLIAGLTWE

SEQ ID NO: 552493 - protein, 9 aa, Homo Sapiens
GMNLEAVRA

SEQ ID NO: 552494 - protein, 9 aa, Homo Sapiens
SGSVQHQSI

SEQ ID NO: 552495 - protein, 9 aa, Homo Sapiens
EPHGHSDGF

SEQ ID NO: 552496 - protein, 9 aa, Homo Sapiens
LVRDGTDFY

SEQ ID NO: 552497 - protein, 9 aa, Homo Sapiens
ETTNMYMKG

SEQ ID NO: 552498 - protein, 9 aa, Homo Sapiens
LLLKIPKEC

SEQ ID NO: 552499 - protein, 9 aa, Homo Sapiens
MIFSATFLV

SEQ ID NO: 552500 - protein, 9 aa, Homo Sapiens
LSVGMNLEA

SEQ ID NO: 552501 - protein, 9 aa, Homo Sapiens
PSDDVVVPG

SEQ ID NO: 552502 - protein, 9 aa, Homo Sapiens
RDGTDFYGD

SEQ ID NO: 552503 - protein, 9 aa, Homo Sapiens
GFCDDSHIF

SEQ ID NO: 552504 - protein, 9 aa, Homo Sapiens
RVSFHKLLS

SEQ ID NO: 552505 - protein, 9 aa, Homo Sapiens
RADHHGVPS

SEQ ID NO: 552506 - protein, 9 aa, Homo Sapiens
TTDFCAGCK

SEQ ID NO: 552507 - protein, 9 aa, Homo Sapiens
SSISVKEFD

SEQ ID NO: 552508 - protein, 9 aa, Homo Sapiens
FLSAKCLQR

SEQ ID NO: 552509 - protein, 9 aa, Homo Sapiens
FSATFLVSW

SEQ ID NO: 552510 - protein, 9 aa, Homo Sapiens
ELDSEPHGH

SEQ ID NO: 552511 - protein, 9 aa, Homo Sapiens
ANKTNKQTT

SEQ ID NO: 552512 - protein, 9 aa, Homo Sapiens
GCTECGKGF

SEQ ID NO: 552513 - protein, 9 aa, Homo Sapiens
EADNKWVVK

SEQ ID NO: 552514 - protein, 9 aa, Homo Sapiens
SGYRVVPQV

SEQ ID NO: 552515 - protein, 9 aa, Homo Sapiens
EIVETTNMY

SEQ ID NO: 552516 - protein, 9 aa, Homo Sapiens
REPSLCNRS

SEQ ID NO: 552517 - protein, 9 aa, Homo Sapiens
VRDGTDFYG

SEQ ID NO: 552518 - protein, 9 aa, Homo Sapiens
NLQAKSRQV

SEQ ID NO: 552519 - protein, 9 aa, Homo Sapiens
DSHIFGSVI

SEQ ID NO: 552520 - protein, 9 aa, Homo Sapiens
LTWERGLLH

SEQ ID NO: 552521 - protein, 9 aa, Homo Sapiens
IYLANLQAK

SEQ ID NO: 552522 - protein, 9 aa, Homo Sapiens
SLHLVDFLL

SEQ ID NO: 552523 - protein, 9 aa, Homo Sapiens
TESGDAKNA

SEQ ID NO: 552524 - protein, 9 aa, Homo Sapiens
QVSLHPPNA

SEQ ID NO: 552525 - protein, 9 aa, Homo Sapiens
LFEVQWQLA

SEQ ID NO: 552526 - protein, 9 aa, Homo Sapiens
DILAEADNK

SEQ ID NO: 552527 - protein, 9 aa, Homo Sapiens
KSSKRVLTT

SEQ ID NO: 552528 - protein, 9 aa, Homo Sapiens
QPKRVRVKE

SEQ ID NO: 552529 - protein, 9 aa, Homo Sapiens
HQVKPCHHR

SEQ ID NO: 552530 - protein, 9 aa, Homo Sapiens
STTSKYGEG

SEQ ID NO: 552531 - protein, 9 aa, Homo Sapiens
LYREMMLET

SEQ ID NO: 552532 - protein, 9 aa, Homo Sapiens
SGVEEVRQL

SEQ ID NO: 552533 - protein, 9 aa, Homo Sapiens
GKCFSNRSH

SEQ ID NO: 552534 - protein, 9 aa, Homo Sapiens
DFDSNKLRV

SEQ ID NO: 552535 - protein, 9 aa, Homo Sapiens
VLTTDFCAG

SEQ ID NO: 552536 - protein, 9 aa, Homo Sapiens
MDHFVGRNF

SEQ ID NO: 552537 - protein, 9 aa, Homo Sapiens
VVVPGQPIV

SEQ ID NO: 552538 - protein, 9 aa, Homo Sapiens
VTSANKTNK

SEQ ID NO: 552539 - protein, 9 aa, Homo Sapiens
VRLRKENHI

SEQ ID NO: 552540 - protein, 9 aa, Homo Sapiens
FPGVSPDCG

SEQ ID NO: 552541 - protein, 9 aa, Homo Sapiens
HIFGSVIRI

SEQ ID NO: 552542 - protein, 9 aa, Homo Sapiens
SNKLRVSFH

SEQ ID NO: 552543 - protein, 9 aa, Homo Sapiens
KGTFFPETW

SEQ ID NO: 552544 - protein, 9 aa, Homo Sapiens
KNQSVNLFL

SEQ ID NO: 552545 - protein, 9 aa, Homo Sapiens
VEPSDDVVV

SEQ ID NO: 552546 - protein, 9 aa, Homo Sapiens
GHQSGYRVV

SEQ ID NO: 552547 - protein, 9 aa, Homo Sapiens
PLKLQVWSV

SEQ ID NO: 552548 - protein, 9 aa, Homo Sapiens
NSREPSLCN

SEQ ID NO: 552549 - protein, 9 aa, Homo Sapiens
GDAKNARND

SEQ ID NO: 552550 - protein, 9 aa, Homo Sapiens
AHEDLIEII

SEQ ID NO: 552551 - protein, 9 aa, Homo Sapiens
FLLQNCGNL

SEQ ID NO: 552552 - protein, 9 aa, Homo Sapiens
LLIYLANLQ

SEQ ID NO: 552553 - protein, 9 aa, Homo Sapiens
RINDFDSNK

SEQ ID NO: 552554 - protein, 9 aa, Homo Sapiens
KRVRVKETA

SEQ ID NO: 552555 - protein, 9 aa, Homo Sapiens
DHFVGRNFN

SEQ ID NO: 552556 - protein, 9 aa, Homo Sapiens
AKCLQRNAD

SEQ ID NO: 552557 - protein, 9 aa, Homo Sapiens
GVEEVRQLN

SEQ ID NO: 552558 - protein, 9 aa, Homo Sapiens
LFPGVSPDC

SEQ ID NO: 552559 - protein, 9 aa, Homo Sapiens
ATEQAVSTA

SEQ ID NO: 552560 - protein, 9 aa, Homo Sapiens
VSFSEEGET

SEQ ID NO: 552561 - protein, 9 aa, Homo Sapiens
DRDIVSRQE

SEQ ID NO: 552562 - protein, 9 aa, Homo Sapiens
LLSSLKTSL

SEQ ID NO: 552563 - protein, 9 aa, Homo Sapiens
RLRKENHIY

SEQ ID NO: 552564 - protein, 9 aa, Homo Sapiens
FAQSKSMAD

SEQ ID NO: 552565 - protein, 9 aa, Homo Sapiens
LSSLKTSLK

SEQ ID NO: 552566 - protein, 9 aa, Homo Sapiens
PQVRHQFQH

SEQ ID NO: 552567 - protein, 9 aa, Homo Sapiens
IFSATFLVS

SEQ ID NO: 552568 - protein, 9 aa, Homo Sapiens
SGDAKNARN

SEQ ID NO: 552569 - protein, 9 aa, Homo Sapiens
DFYGDVLFP

SEQ ID NO: 552570 - protein, 9 aa, Homo Sapiens
DDSHIFGSV

SEQ ID NO: 552571 - protein, 9 aa, Homo Sapiens
LQRNADGDG

SEQ ID NO: 552572 - protein, 9 aa, Homo Sapiens
LRKENHIYS

SEQ ID NO: 552573 - protein, 9 aa, Homo Sapiens
VETTNMYMK

SEQ ID NO: 552574 - protein, 9 aa, Homo Sapiens
HQSIQNVPV

SEQ ID NO: 552575 - protein, 9 aa, Homo Sapiens
WLLILSYVG

SEQ ID NO: 552576 - protein, 9 aa, Homo Sapiens
QRTLYREMM

SEQ ID NO: 552577 - protein, 9 aa, Homo Sapiens
VFAQSKSMA

SEQ ID NO: 552578 - protein, 9 aa, Homo Sapiens
WSAASDPLD

SEQ ID NO: 552579 - protein, 9 aa, Homo Sapiens
GSLFEVQWQ

SEQ ID NO: 552580 - protein, 9 aa, Homo Sapiens
HGHSDGFCD

SEQ ID NO: 552581 - protein, 9 aa, Homo Sapiens
NIDDVRFLD

SEQ ID NO: 552582 - protein, 9 aa, Homo Sapiens
HQFQHLVRD

SEQ ID NO: 552583 - protein, 9 aa, Homo Sapiens
NAHEDLIEI

SEQ ID NO: 552584 - protein, 9 aa, Homo Sapiens
SEPGSRIRL

SEQ ID NO: 552585 - protein, 9 aa, Homo Sapiens
LLQNCGNLD

SEQ ID NO: 552586 - protein, 9 aa, Homo Sapiens
VQQKVSFSE

SEQ ID NO: 552587 - protein, 9 aa, Homo Sapiens
DVKIEFCLE

SEQ ID NO: 552588 - protein, 9 aa, Homo Sapiens
SVTEVTAPQ

SEQ ID NO: 552589 - protein, 9 aa, Homo Sapiens
RVRVKETAD

SEQ ID NO: 552590 - protein, 9 aa, Homo Sapiens
AILGGDHQS

SEQ ID NO: 552591 - protein, 9 aa, Homo Sapiens
PGVSPDCGV

SEQ ID NO: 552592 - protein, 9 aa, Homo Sapiens
AQRTLYREM

SEQ ID NO: 552593 - protein, 9 aa, Homo Sapiens
EKRKGTFFP

SEQ ID NO: 552594 - protein, 9 aa, Homo Sapiens
CIWLLILSY

SEQ ID NO: 552595 - protein, 9 aa, Homo Sapiens
TSKYGEGSC

SEQ ID NO: 552596 - protein, 9 aa, Homo Sapiens
SEPHGHSDG

SEQ ID NO: 552597 - protein, 9 aa, Homo Sapiens
GSVQHQSIQ

SEQ ID NO: 552598 - protein, 9 aa, Homo Sapiens
AGDSWTRPT

SEQ ID NO: 552599 - protein, 9 aa, Homo Sapiens
LPVCFSGVE

SEQ ID NO: 552600 - protein, 9 aa, Homo Sapiens
SDDVVVPGQ

SEQ ID NO: 552601 - protein, 9 aa, Homo Sapiens
RMEWNGMEW

SEQ ID NO: 552602 - protein, 9 aa, Homo Sapiens
PCHHRGELD

SEQ ID NO: 552603 - protein, 9 aa, Homo Sapiens
VEEVRQLNA

SEQ ID NO: 552604 - protein, 9 aa, Homo Sapiens
RDVKIEFCL

SEQ ID NO: 552605 - protein, 9 aa, Homo Sapiens
GLQPKRVRV

SEQ ID NO: 552606 - protein, 9 aa, Homo Sapiens
RKGTFFPET

SEQ ID NO: 552607 - protein, 9 aa, Homo Sapiens
SGHQSGYRV

SEQ ID NO: 552608 - protein, 9 aa, Homo Sapiens
LDQLLSSLK

SEQ ID NO: 552609 - protein, 9 aa, Homo Sapiens
YLANLQAKS

SEQ ID NO: 552610 - protein, 9 aa, Homo Sapiens
EQAVSTAHP

SEQ ID NO: 552611 - protein, 9 aa, Homo Sapiens
EWNGMEWNG

SEQ ID NO: 552612 - protein, 9 aa, Homo Sapiens
PGSRIRLIF

SEQ ID NO: 552613 - protein, 9 aa, Homo Sapiens
NGMEWNGMK

SEQ ID NO: 552614 - protein, 9 aa, Homo Sapiens
EPGSRIRLI

SEQ ID NO: 552615 - protein, 9 aa, Homo Sapiens
VKPCHHRGE

SEQ ID NO: 552616 - protein, 9 aa, Homo Sapiens
ISPTLTSHI

SEQ ID NO: 552617 - protein, 9 aa, Homo Sapiens
DHHGVPSGH

SEQ ID NO: 552618 - protein, 9 aa, Homo Sapiens
PRTEKRKGT

SEQ ID NO: 552619 - protein, 9 aa, Homo Sapiens
SAASDPLDI

SEQ ID NO: 552620 - protein, 9 aa, Homo Sapiens
SVGMNLEAV

SEQ ID NO: 552621 - protein, 9 aa, Homo Sapiens
TLYREMMLE

SEQ ID NO: 552622 - protein, 9 aa, Homo Sapiens
QSTVDRDIV

SEQ ID NO: 552623 - protein, 9 aa, Homo Sapiens
TSVQQKVSF

SEQ ID NO: 552624 - protein, 9 aa, Homo Sapiens
SFSEEGETE

SEQ ID NO: 552625 - protein, 9 aa, Homo Sapiens
CHHRGELDS

SEQ ID NO: 552626 - protein, 9 aa, Homo Sapiens
YMLMIFSAT

SEQ ID NO: 552627 - protein, 9 aa, Homo Sapiens
IPLRGGPTL

SEQ ID NO: 552628 - protein, 9 aa, Homo Sapiens
AFNNSSISV

SEQ ID NO: 552629 - protein, 9 aa, Homo Sapiens
VDFLLQNCG

SEQ ID NO: 552630 - protein, 9 aa, Homo Sapiens
LQPKRVRVK

SEQ ID NO: 552631 - protein, 9 aa, Homo Sapiens
TCKREASIL

SEQ ID NO: 552632 - protein, 9 aa, Homo Sapiens
TTAATLSLN

SEQ ID NO: 552633 - protein, 9 aa, Homo Sapiens
QAKSRQVAA

SEQ ID NO: 552634 - protein, 9 aa, Homo Sapiens
VPQVRHQFQ

SEQ ID NO: 552635 - protein, 9 aa, Homo Sapiens
FSTTSKYGE

SEQ ID NO: 552636 - protein, 9 aa, Homo Sapiens
PHGHSDGFC

SEQ ID NO: 552637 - protein, 9 aa, Homo Sapiens
QSKSMADSG

SEQ ID NO: 552638 - protein, 9 aa, Homo Sapiens
SVQQKVSFS

SEQ ID NO: 552639 - protein, 9 aa, Homo Sapiens
VLFPGVSPD

SEQ ID NO: 552640 - protein, 9 aa, Homo Sapiens
NHIYSADEK

SEQ ID NO: 552641 - protein, 9 aa, Homo Sapiens
IFGSVIRIN

SEQ ID NO: 552642 - protein, 9 aa, Homo Sapiens
ILAEADNKW

SEQ ID NO: 552643 - protein, 9 aa, Homo Sapiens
LLLIAGLTW

SEQ ID NO: 552644 - protein, 9 aa, Homo Sapiens
VIRADHHGV

SEQ ID NO: 552645 - protein, 9 aa, Homo Sapiens
RKENHIYSA

SEQ ID NO: 552646 - protein, 9 aa, Homo Sapiens
YQEIVETTN

SEQ ID NO: 552647 - protein, 9 aa, Homo Sapiens
MNLEAVRAD

SEQ ID NO: 552648 - protein, 9 aa, Homo Sapiens
CFSNRSHLL

SEQ ID NO: 552649 - protein, 9 aa, Homo Sapiens
FVGRNFNSN

SEQ ID NO: 552650 - protein, 9 aa, Homo Sapiens
FECIKTTQQ

SEQ ID NO: 552651 - protein, 9 aa, Homo Sapiens
TLSLNKATR

SEQ ID NO: 552652 - protein, 9 aa, Homo Sapiens
HGVPSGHQS

SEQ ID NO: 552653 - protein, 9 aa, Homo Sapiens
PHQVKPCHH

SEQ ID NO: 552654 - protein, 9 aa, Homo Sapiens
VQWQLAQLE

SEQ ID NO: 552655 - protein, 9 aa, Homo Sapiens
LAEADNKWV

SEQ ID NO: 552656 - protein, 9 aa, Homo Sapiens
GIPLRGGPT

SEQ ID NO: 552657 - protein, 9 aa, Homo Sapiens
IEIIGQAFG

SEQ ID NO: 552658 - protein, 9 aa, Homo Sapiens
VPVYGSTLP

SEQ ID NO: 552659 - protein, 9 aa, Homo Sapiens
WVIRADHHG

SEQ ID NO: 552660 - protein, 9 aa, Homo Sapiens
CLQRNADGD

SEQ ID NO: 552661 - protein, 9 aa, Homo Sapiens
LSKQLAPRV

SEQ ID NO: 552662 - protein, 9 aa, Homo Sapiens
IAGLTWERG

SEQ ID NO: 552663 - protein, 9 aa, Homo Sapiens
PKRVRVKET

SEQ ID NO: 552664 - protein, 9 aa, Homo Sapiens
NLSSEWSAA

SEQ ID NO: 552665 - protein, 9 aa, Homo Sapiens
HIKNSTGLA

SEQ ID NO: 552666 - protein, 9 aa, Homo Sapiens
QSGYRVVPQ

SEQ ID NO: 552667 - protein, 9 aa, Homo Sapiens
TAATLSLNK

SEQ ID NO: 552668 - protein, 9 aa, Homo Sapiens
HLVRDGTDF

SEQ ID NO: 552669 - protein, 9 aa, Homo Sapiens
KPCHHRGEL

SEQ ID NO: 552670 - protein, 9 aa, Homo Sapiens
GTKHSWVIR

SEQ ID NO: 552671 - protein, 9 aa, Homo Sapiens
VNLFLGHTA

SEQ ID NO: 552672 - protein, 9 aa, Homo Sapiens
QLAPRVPVE

SEQ ID NO: 552673 - protein, 9 aa, Homo Sapiens
QVKPCHHRG

SEQ ID NO: 552674 - protein, 9 aa, Homo Sapiens
VPSGHQSGY

SEQ ID NO: 552675 - protein, 9 aa, Homo Sapiens
VVPGQPIVL

SEQ ID NO: 552676 - protein, 9 aa, Homo Sapiens
RAGDSWTRP

SEQ ID NO: 552677 - protein, 9 aa, Homo Sapiens
FCDDSHIFG

SEQ ID NO: 552678 - protein, 9 aa, Homo Sapiens
SVNSREPSL

SEQ ID NO: 552679 - protein, 9 aa, Homo Sapiens
NMYMKGVSS

SEQ ID NO: 552680 - protein, 9 aa, Homo Sapiens
SLCNRSPRV

SEQ ID NO: 552681 - protein, 9 aa, Homo Sapiens
IPKECDLVL

SEQ ID NO: 552682 - protein, 9 aa, Homo Sapiens
KCFSNRSHL

SEQ ID NO: 552683 - protein, 9 aa, Homo Sapiens
NGLCIWLLI

SEQ ID NO: 552684 - protein, 9 aa, Homo Sapiens
SDGFCDDSH

SEQ ID NO: 552685 - protein, 9 aa, Homo Sapiens
HRGELDSEP

SEQ ID NO: 552686 - protein, 9 aa, Homo Sapiens
NVPVYGSTL

SEQ ID NO: 552687 - protein, 9 aa, Homo Sapiens
DHQSFLVVM

SEQ ID NO: 552688 - protein, 9 aa, Homo Sapiens
DDVRFLDSK

SEQ ID NO: 552689 - protein, 9 aa, Homo Sapiens
EQSTVDRDI

SEQ ID NO: 552690 - protein, 9 aa, Homo Sapiens
QWQLAQLEA

SEQ ID NO: 552691 - protein, 9 aa, Homo Sapiens
FDSNKLRVS

SEQ ID NO: 552692 - protein, 9 aa, Homo Sapiens
SLKTSLKVL

SEQ ID NO: 552693 - protein, 9 aa, Homo Sapiens
SVNLFLGHT

SEQ ID NO: 552694 - protein, 9 aa, Homo Sapiens
IRINDFDSN

SEQ ID NO: 552695 - protein, 9 aa, Homo Sapiens
ADHHGVPSG

SEQ ID NO: 552696 - protein, 9 aa, Homo Sapiens
CFSGVEEVR

SEQ ID NO: 552697 - protein, 9 aa, Homo Sapiens
GDSWTRPTE

SEQ ID NO: 552698 - protein, 9 aa, Homo Sapiens
SVQHQSIQN

SEQ ID NO: 552699 - protein, 9 aa, Homo Sapiens
AFGTKHSWV

SEQ ID NO: 552700 - protein, 9 aa, Homo Sapiens
RHQFQHLVR

SEQ ID NO: 552701 - protein, 9 aa, Homo Sapiens
TECGKGFSQ

SEQ ID NO: 552702 - protein, 9 aa, Homo Sapiens
PPNAHEDLI

SEQ ID NO: 552703 - protein, 9 aa, Homo Sapiens
ASVLMPHQV

SEQ ID NO: 552704 - protein, 9 aa, Homo Sapiens
VRHQFQHLV

SEQ ID NO: 552705 - protein, 9 aa, Homo Sapiens
NKLRVSFHK

SEQ ID NO: 552706 - protein, 9 aa, Homo Sapiens
QVWSVTEVT

SEQ ID NO: 552707 - protein, 9 aa, Homo Sapiens
GELDSEPHG

SEQ ID NO: 552708 - protein, 9 aa, Homo Sapiens
LLSYFLVSL

SEQ ID NO: 552709 - protein, 9 aa, Homo Sapiens
LQVWSVTEV

SEQ ID NO: 552710 - protein, 9 aa, Homo Sapiens
LDGIPLRGG

SEQ ID NO: 552711 - protein, 9 aa, Homo Sapiens
LVDFLLQNC

SEQ ID NO: 552712 - protein, 9 aa, Homo Sapiens
AEADNKWVV

SEQ ID NO: 552713 - protein, 9 aa, Homo Sapiens
GTDFYGDVL

SEQ ID NO: 552714 - protein, 9 aa, Homo Sapiens
RIRLIFNDF

SEQ ID NO: 552715 - protein, 9 aa, Homo Sapiens
YGEGSCYTS

SEQ ID NO: 552716 - protein, 9 aa, Homo Sapiens
RKNQSVNLF

SEQ ID NO: 552717 - protein, 9 aa, Homo Sapiens
RNFNSNFNF

SEQ ID NO: 552718 - protein, 9 aa, Homo Sapiens
PVCFSGVEE

SEQ ID NO: 552719 - protein, 9 aa, Homo Sapiens
DVVVPGQPI

SEQ ID NO: 552720 - protein, 9 aa, Homo Sapiens
GHSDGFCDD

SEQ ID NO: 552721 - protein, 9 aa, Homo Sapiens
LIEIIGQAF

SEQ ID NO: 552722 - protein, 9 aa, Homo Sapiens
ATLSLNKAT

SEQ ID NO: 552723 - protein, 9 aa, Homo Sapiens
GYWGRTCKR

SEQ ID NO: 552724 - protein, 9 aa, Homo Sapiens
GLCIWLLIL

SEQ ID NO: 552725 - protein, 9 aa, Homo Sapiens
TKHSWVIRA

SEQ ID NO: 552726 - protein, 9 aa, Homo Sapiens
PPRTEKRKG

SEQ ID NO: 552727 - protein, 9 aa, Homo Sapiens
QSFLVVMQG

SEQ ID NO: 552728 - protein, 9 aa, Homo Sapiens
SKSMADSGS

SEQ ID NO: 552729 - protein, 9 aa, Homo Sapiens
KCLSVGMNL

SEQ ID NO: 552730 - protein, 9 aa, Homo Sapiens
STQEATEQA

SEQ ID NO: 552731 - protein, 9 aa, Homo Sapiens
VMQGVASVL

SEQ ID NO: 552732 - protein, 9 aa, Homo Sapiens
LKLQVWSVT

SEQ ID NO: 552733 - protein, 9 aa, Homo Sapiens
LIYLANLQA

SEQ ID NO: 552734 - protein, 9 aa, Homo Sapiens
VCFSGVEEV

SEQ ID NO: 552735 - protein, 9 aa, Homo Sapiens
GKGFSQKSQ

SEQ ID NO: 552736 - protein, 9 aa, Homo Sapiens
GSTPPPAHD

SEQ ID NO: 552737 - protein, 9 aa, Homo Sapiens
REMMLETCG

SEQ ID NO: 552738 - protein, 9 aa, Homo Sapiens
TSHIKNSTG

SEQ ID NO: 552739 - protein, 9 aa, Homo Sapiens
AKNARNDSR

SEQ ID NO: 552740 - protein, 9 aa, Homo Sapiens
EATEQAVST

SEQ ID NO: 552741 - protein, 9 aa, Homo Sapiens
SAKCLQRNA

SEQ ID NO: 552742 - protein, 9 aa, Homo Sapiens
SLDGIPLRG

SEQ ID NO: 552743 - protein, 9 aa, Homo Sapiens
HLVDFLLQN

SEQ ID NO: 552744 - protein, 9 aa, Homo Sapiens
HHGVPSGHQ

SEQ ID NO: 552745 - protein, 9 aa, Homo Sapiens
QHQSIQNVP

SEQ ID NO: 552746 - protein, 9 aa, Homo Sapiens
ECDLVLLFN

SEQ ID NO: 552747 - protein, 9 aa, Homo Sapiens
VGRNFNSNF

SEQ ID NO: 552748 - protein, 9 aa, Homo Sapiens
GDHQSFLVV

SEQ ID NO: 552749 - protein, 9 aa, Homo Sapiens
ASDPLDILI

SEQ ID NO: 552750 - protein, 9 aa, Homo Sapiens
YREMMLETC

SEQ ID NO: 552751 - protein, 9 aa, Homo Sapiens
PPPAHDVTS

SEQ ID NO: 552752 - protein, 9 aa, Homo Sapiens
QSIQNVPVY

SEQ ID NO: 552753 - protein, 9 aa, Homo Sapiens
WERGLLHSS

SEQ ID NO: 552754 - protein, 9 aa, Homo Sapiens
AATLSLNKA

SEQ ID NO: 552755 - protein, 9 aa, Homo Sapiens
YGSTLPVCF

SEQ ID NO: 552756 - protein, 9 aa, Homo Sapiens
IKNSTGLAE

SEQ ID NO: 552757 - protein, 9 aa, Homo Sapiens
LHLVDFLLQ

SEQ ID NO: 552758 - protein, 9 aa, Homo Sapiens
EMMLETCGL

SEQ ID NO: 552759 - protein, 9 aa, Homo Sapiens
YGDVLFPGV

SEQ ID NO: 552760 - protein, 9 aa, Homo Sapiens
EKVTSANKT

SEQ ID NO: 552761 - protein, 9 aa, Homo Sapiens
TFLVSWLFF

SEQ ID NO: 552762 - protein, 9 aa, Homo Sapiens
LRKNQSVNL

SEQ ID NO: 552763 - protein, 9 aa, Homo Sapiens
TVDRDIVSR

SEQ ID NO: 552764 - protein, 9 aa, Homo Sapiens
NKTNKQTTT

SEQ ID NO: 552765 - protein, 9 aa, Homo Sapiens
VSPDCGVFA

SEQ ID NO: 552766 - protein, 9 aa, Homo Sapiens
QCFECIKTT

SEQ ID NO: 552767 - protein, 9 aa, Homo Sapiens
TLPVCFSGV

SEQ ID NO: 552768 - protein, 9 aa, Homo Sapiens
SPTLTSHIK

SEQ ID NO: 552769 - protein, 9 aa, Homo Sapiens
HTFSTTSKY

SEQ ID NO: 552770 - protein, 9 aa, Homo Sapiens
SEWSAASDP

SEQ ID NO: 552771 - protein, 9 aa, Homo Sapiens
KYGEGSCYT

SEQ ID NO: 552772 - protein, 9 aa, Homo Sapiens
QQKVSFSEE

SEQ ID NO: 552773 - protein, 9 aa, Homo Sapiens
LQAKSRQVA

SEQ ID NO: 552774 - protein, 9 aa, Homo Sapiens
NNSSISVKE

SEQ ID NO: 552775 - protein, 9 aa, Homo Sapiens
TQEATEQAV

SEQ ID NO: 552776 - protein, 9 aa, Homo Sapiens
EGSLFEVQW

SEQ ID NO: 552777 - protein, 9 aa, Homo Sapiens
CDLVLLFNL

SEQ ID NO: 552778 - protein, 9 aa, Homo Sapiens
LTTDFCAGC

SEQ ID NO: 552779 - protein, 9 aa, Homo Sapiens
IDDVRFLDS

SEQ ID NO: 552780 - protein, 9 aa, Homo Sapiens
TNMYMKGVS

SEQ ID NO: 552781 - protein, 9 aa, Homo Sapiens
GSTLPVCFS

SEQ ID NO: 552782 - protein, 9 aa, Homo Sapiens
VSLHPPNAH

SEQ ID NO: 552783 - protein, 9 aa, Homo Sapiens
SISVKEFDT

SEQ ID NO: 552784 - protein, 9 aa, Homo Sapiens
SHIFGSVIR

SEQ ID NO: 552785 - protein, 9 aa, Homo Sapiens
QLLSSLKTS

SEQ ID NO: 552786 - protein, 9 aa, Homo Sapiens
GVPSGHQSG

SEQ ID NO: 552787 - protein, 9 aa, Homo Sapiens
RTEKRKGTF

SEQ ID NO: 552788 - protein, 9 aa, Homo Sapiens
EIIGQAFGT

SEQ ID NO: 552789 - protein, 9 aa, Homo Sapiens
GRGLQPKRV

SEQ ID NO: 552790 - protein, 9 aa, Homo Sapiens
DVLFPGVSP

SEQ ID NO: 552791 - protein, 9 aa, Homo Sapiens
TSANKTNKQ

SEQ ID NO: 552792 - protein, 9 aa, Homo Sapiens
KRKGTFFPE

SEQ ID NO: 552793 - protein, 9 aa, Homo Sapiens
KVSFSEEGE

SEQ ID NO: 552794 - protein, 9 aa, Homo Sapiens
FLVVMQGVA

SEQ ID NO: 552795 - protein, 9 aa, Homo Sapiens
LSYFLVSLH

SEQ ID NO: 552796 - protein, 9 aa, Homo Sapiens
RNNIDDVRF

SEQ ID NO: 552797 - protein, 9 aa, Homo Sapiens
WSLDGIPLR

SEQ ID NO: 552798 - protein, 9 aa, Homo Sapiens
STVDRDIVS

SEQ ID NO: 552799 - protein, 9 aa, Homo Sapiens
RPALGSTPP

SEQ ID NO: 552800 - protein, 9 aa, Homo Sapiens
CKREASILS

SEQ ID NO: 552801 - protein, 9 aa, Homo Sapiens
SLFEVQWQL

SEQ ID NO: 552802 - protein, 9 aa, Homo Sapiens
DLIEIIGQA

SEQ ID NO: 552803 - protein, 9 aa, Homo Sapiens
WSVTEVTAP

SEQ ID NO: 552804 - protein, 9 aa, Homo Sapiens
IVETTNMYM

SEQ ID NO: 552805 - protein, 9 aa, Homo Sapiens
KVTSANKTN

SEQ ID NO: 552806 - protein, 9 aa, Homo Sapiens
FSSLLSKQL

SEQ ID NO: 552807 - protein, 9 aa, Homo Sapiens
SLHPPNAHE

SEQ ID NO: 552808 - protein, 9 aa, Homo Sapiens
VIRINDFDS

SEQ ID NO: 552809 - protein, 9 aa, Homo Sapiens
SVLMPHQVK

SEQ ID NO: 552810 - protein, 9 aa, Homo Sapiens
VNSREPSLC

SEQ ID NO: 552811 - protein, 9 aa, Homo Sapiens
HPPNAHEDL

SEQ ID NO: 552812 - protein, 9 aa, Homo Sapiens
HQSGYRVVP

SEQ ID NO: 552813 - protein, 9 aa, Homo Sapiens
ANLQAKSRQ

SEQ ID NO: 552814 - protein, 9 aa, Homo Sapiens
SPEKVTSAN

SEQ ID NO: 552815 - protein, 9 aa, Homo Sapiens
KGFSQKSQL

SEQ ID NO: 552816 - protein, 9 aa, Homo Sapiens
DNKWVVKLY

SEQ ID NO: 552817 - protein, 9 aa, Homo Sapiens
STPPPAHDV

SEQ ID NO: 552818 - protein, 9 aa, Homo Sapiens
LDSEPHGHS

SEQ ID NO: 552819 - protein, 9 aa, Homo Sapiens
NNIDDVRFL

SEQ ID NO: 552820 - protein, 9 aa, Homo Sapiens
QEATEQAVS

SEQ ID NO: 552821 - protein, 9 aa, Homo Sapiens
DVRFLDSKH

SEQ ID NO: 552822 - protein, 9 aa, Homo Sapiens
ITTAATLSL

SEQ ID NO: 552823 - protein, 9 aa, Homo Sapiens
NLFLGHTAI

SEQ ID NO: 552824 - protein, 9 aa, Homo Sapiens
SWTRPTEFL

SEQ ID NO: 552825 - protein, 9 aa, Homo Sapiens
RITTAATLS

SEQ ID NO: 552826 - protein, 9 aa, Homo Sapiens
KQMDHFVGR

SEQ ID NO: 552827 - protein, 9 aa, Homo Sapiens
DCGKCFSNR

SEQ ID NO: 552828 - protein, 9 aa, Homo Sapiens
SSEWSAASD

SEQ ID NO: 552829 - protein, 9 aa, Homo Sapiens
DSEPHGHSD

SEQ ID NO: 552830 - protein, 9 aa, Homo Sapiens
VKEFDTKAS

SEQ ID NO: 552831 - protein, 9 aa, Homo Sapiens
LQNCGNLDK

SEQ ID NO: 552832 - protein, 9 aa, Homo Sapiens
LMIFSATFL

SEQ ID NO: 552833 - protein, 9 aa, Homo Sapiens
EPSLCNRSP

SEQ ID NO: 552834 - protein, 9 aa, Homo Sapiens
SPDCGVFAQ

SEQ ID NO: 552835 - protein, 9 aa, Homo Sapiens
IGQAFGTKH

SEQ ID NO: 552836 - protein, 9 aa, Homo Sapiens
GVSPDCGVF

SEQ ID NO: 552837 - protein, 9 aa, Homo Sapiens
WGRTCKREA

SEQ ID NO: 552838 - protein, 9 aa, Homo Sapiens
SKYGEGSCY

SEQ ID NO: 552839 - protein, 9 aa, Homo Sapiens
SFHKLLSYF

SEQ ID NO: 552840 - protein, 9 aa, Homo Sapiens
VVPQVRHQF

SEQ ID NO: 552841 - protein, 9 aa, Homo Sapiens
FGTKHSWVI

SEQ ID NO: 552842 - protein, 9 aa, Homo Sapiens
CFECIKTTQ

SEQ ID NO: 552843 - protein, 9 aa, Homo Sapiens
TPPPAHDVT

SEQ ID NO: 552844 - protein, 9 aa, Homo Sapiens
SFLVVMQGV

SEQ ID NO: 552845 - protein, 9 aa, Homo Sapiens
ATFLVSWLF

SEQ ID NO: 552846 - protein, 9 aa, Homo Sapiens
GVFAQSKSM

SEQ ID NO: 552847 - protein, 9 aa, Homo Sapiens
HIYSADEKR

SEQ ID NO: 552848 - protein, 9 aa, Homo Sapiens
FEVQWQLAQ

SEQ ID NO: 552849 - protein, 9 aa, Homo Sapiens
PSLCNRSPR

SEQ ID NO: 552850 - protein, 9 aa, Homo Sapiens
ISEPGSRIR

SEQ ID NO: 552851 - protein, 9 aa, Homo Sapiens
EVQWQLAQL

SEQ ID NO: 552852 - protein, 9 aa, Homo Sapiens
LSSEWSAAS

SEQ ID NO: 552853 - protein, 9 aa, Homo Sapiens
ISVKEFDTK

SEQ ID NO: 552854 - protein, 9 aa, Homo Sapiens
DFLLQNCGN

SEQ ID NO: 552855 - protein, 9 aa, Homo Sapiens
QFQHLVRDG

SEQ ID NO: 552856 - protein, 9 aa, Homo Sapiens
RVLTTDFCA

SEQ ID NO: 552857 - protein, 9 aa, Homo Sapiens
YPCHDCGKC

SEQ ID NO: 552858 - protein, 9 aa, Homo Sapiens
GDVLFPGVS

SEQ ID NO: 552859 - protein, 9 aa, Homo Sapiens
PNAHEDLIE

SEQ ID NO: 552860 - protein, 9 aa, Homo Sapiens
TEKRKGTFF

SEQ ID NO: 552861 - protein, 9 aa, Homo Sapiens
VWSVTEVTA

SEQ ID NO: 552862 - protein, 9 aa, Homo Sapiens
IMTNGLCIW

SEQ ID NO: 552863 - protein, 9 aa, Homo Sapiens
TGYWGRTCK

SEQ ID NO: 552864 - protein, 9 aa, Homo Sapiens
ATSVQQKVS

SEQ ID NO: 552865 - protein, 9 aa, Homo Sapiens
SFKQSCSFS

SEQ ID NO: 552866 - protein, 9 aa, Homo Sapiens
ALEKKYKEK

SEQ ID NO: 552867 - protein, 9 aa, Homo Sapiens
YVCKVADEW

SEQ ID NO: 552868 - protein, 9 aa, Homo Sapiens
RACAQGTCK

SEQ ID NO: 552869 - protein, 9 aa, Homo Sapiens
GTCKPLSGE

SEQ ID NO: 552870 - protein, 9 aa, Homo Sapiens
PAWSTFWGP

SEQ ID NO: 552871 - protein, 9 aa, Homo Sapiens
YFCNEVMYP

SEQ ID NO: 552872 - protein, 9 aa, Homo Sapiens
DRLETVTYT

SEQ ID NO: 552873 - protein, 9 aa, Homo Sapiens
SELLENDPS

SEQ ID NO: 552874 - protein, 9 aa, Homo Sapiens
EGAQYFMQA

SEQ ID NO: 552875 - protein, 9 aa, Homo Sapiens
VTRKQVTFL

SEQ ID NO: 552876 - protein, 9 aa, Homo Sapiens
LHETAAPSD

SEQ ID NO: 552877 - protein, 9 aa, Homo Sapiens
MYHASKHSI

SEQ ID NO: 552878 - protein, 9 aa, Homo Sapiens
DFWGMVWQE

SEQ ID NO: 552879 - protein, 9 aa, Homo Sapiens
NFSESGHSE

SEQ ID NO: 552880 - protein, 9 aa, Homo Sapiens
EEQLANITV

SEQ ID NO: 552881 - protein, 9 aa, Homo Sapiens
FEDLMLAIV

SEQ ID NO: 552882 - protein, 9 aa, Homo Sapiens
ICYSTPLMY

SEQ ID NO: 552883 - protein, 9 aa, Homo Sapiens
DGTFNSTYS

SEQ ID NO: 552884 - protein, 9 aa, Homo Sapiens
PIPEDIALE

SEQ ID NO: 552885 - protein, 9 aa, Homo Sapiens
FGNQVSEYI

SEQ ID NO: 552886 - protein, 9 aa, Homo Sapiens
RDCEEADSL

SEQ ID NO: 552887 - protein, 9 aa, Homo Sapiens
PLVKRHKLA

SEQ ID NO: 552888 - protein, 9 aa, Homo Sapiens
PPIGSHLDM

SEQ ID NO: 552889 - protein, 9 aa, Homo Sapiens
GFGDILHRI

SEQ ID NO: 552890 - protein, 9 aa, Homo Sapiens
NQTDIYFCN

SEQ ID NO: 552891 - protein, 9 aa, Homo Sapiens
PEQVQRLSE

SEQ ID NO: 552892 - protein, 9 aa, Homo Sapiens
GVVEPEVAT

SEQ ID NO: 552893 - protein, 9 aa, Homo Sapiens
IPEDIALEK

SEQ ID NO: 552894 - protein, 9 aa, Homo Sapiens
LEREEYGRL

SEQ ID NO: 552895 - protein, 9 aa, Homo Sapiens
FGDILHRIE

SEQ ID NO: 552896 - protein, 9 aa, Homo Sapiens
VKKLDPGQL

SEQ ID NO: 552897 - protein, 9 aa, Homo Sapiens
VLGTSVGPC

SEQ ID NO: 552898 - protein, 9 aa, Homo Sapiens
KMGKKYTST

SEQ ID NO: 552899 - protein, 9 aa, Homo Sapiens
LSGICLGYL

SEQ ID NO: 552900 - protein, 9 aa, Homo Sapiens
EMVYDFWGM

SEQ ID NO: 552901 - protein, 9 aa, Homo Sapiens
VAGDARKRA

SEQ ID NO: 552902 - protein, 9 aa, Homo Sapiens
MLHETAAPS

SEQ ID NO: 552903 - protein, 9 aa, Homo Sapiens
QCKCVFRTR

SEQ ID NO: 552904 - protein, 9 aa, Homo Sapiens
PILNVCQKS

SEQ ID NO: 552905 - protein, 9 aa, Homo Sapiens
RQCKCVFRT

SEQ ID NO: 552906 - protein, 9 aa, Homo Sapiens
YHKKKVRVV

SEQ ID NO: 552907 - protein, 9 aa, Homo Sapiens
DFAKDGGLV

SEQ ID NO: 552908 - protein, 9 aa, Homo Sapiens
KDKMGKKYT

SEQ ID NO: 552909 - protein, 9 aa, Homo Sapiens
LVRPRPSDA

SEQ ID NO: 552910 - protein, 9 aa, Homo Sapiens
ILSGICLGY

SEQ ID NO: 552911 - protein, 9 aa, Homo Sapiens
LDICYSTPL

SEQ ID NO: 552912 - protein, 9 aa, Homo Sapiens
SDADPPAGA

SEQ ID NO: 552913 - protein, 9 aa, Homo Sapiens
DSQGNGSSQ

SEQ ID NO: 552914 - protein, 9 aa, Homo Sapiens
IERMGSAIQ

SEQ ID NO: 552915 - protein, 9 aa, Homo Sapiens
DKVQAKFVA

SEQ ID NO: 552916 - protein, 9 aa, Homo Sapiens
LLVRPRPSD

SEQ ID NO: 552917 - protein, 9 aa, Homo Sapiens
HSLGKSEAA

SEQ ID NO: 552918 - protein, 9 aa, Homo Sapiens
NSKRALGAP

SEQ ID NO: 552919 - protein, 9 aa, Homo Sapiens
KQEYHKKKV

SEQ ID NO: 552920 - protein, 9 aa, Homo Sapiens
AIFRKSDVN

SEQ ID NO: 552921 - protein, 9 aa, Homo Sapiens
ESPEKNLFS

SEQ ID NO: 552922 - protein, 9 aa, Homo Sapiens
SQERAAFRF

SEQ ID NO: 552923 - protein, 9 aa, Homo Sapiens
DICRQCKCV

SEQ ID NO: 552924 - protein, 9 aa, Homo Sapiens
SQGNGSSQP

SEQ ID NO: 552925 - protein, 9 aa, Homo Sapiens
VQRLSELLE

SEQ ID NO: 552926 - protein, 9 aa, Homo Sapiens
TQQFSKLFD

SEQ ID NO: 552927 - protein, 9 aa, Homo Sapiens
ETQQFSKLF

SEQ ID NO: 552928 - protein, 9 aa, Homo Sapiens
VAAMNEKMD

SEQ ID NO: 552929 - protein, 9 aa, Homo Sapiens
TESPEKNLF

SEQ ID NO: 552930 - protein, 9 aa, Homo Sapiens
PEKNLFSSE

SEQ ID NO: 552931 - protein, 9 aa, Homo Sapiens
LMLAIVNCV

SEQ ID NO: 552932 - protein, 9 aa, Homo Sapiens
STGELVVQG

SEQ ID NO: 552933 - protein, 9 aa, Homo Sapiens
VYDFWGMVW

SEQ ID NO: 552934 - protein, 9 aa, Homo Sapiens
LSETSRFGN

SEQ ID NO: 552935 - protein, 9 aa, Homo Sapiens
VQGHLKPVE

SEQ ID NO: 552936 - protein, 9 aa, Homo Sapiens
LSGHFEDLM

SEQ ID NO: 552937 - protein, 9 aa, Homo Sapiens
DICEVKKLD

SEQ ID NO: 552938 - protein, 9 aa, Homo Sapiens
ILHRIESVL

SEQ ID NO: 552939 - protein, 9 aa, Homo Sapiens
VEEQLANIT

SEQ ID NO: 552940 - protein, 9 aa, Homo Sapiens
CKVADEWRS

SEQ ID NO: 552941 - protein, 9 aa, Homo Sapiens
VLLTFLMLF

SEQ ID NO: 552942 - protein, 9 aa, Homo Sapiens
ACAQGTCKP

SEQ ID NO: 552943 - protein, 9 aa, Homo Sapiens
CSQMTASGN

SEQ ID NO: 552944 - protein, 9 aa, Homo Sapiens
TDIYFCNEV

SEQ ID NO: 552945 - protein, 9 aa, Homo Sapiens
EKISHATEK

SEQ ID NO: 552946 - protein, 9 aa, Homo Sapiens
SHYTQLVWA

SEQ ID NO: 552947 - protein, 9 aa, Homo Sapiens
LAWPSVTRK

SEQ ID NO: 552948 - protein, 9 aa, Homo Sapiens
DIDSQGNGS

SEQ ID NO: 552949 - protein, 9 aa, Homo Sapiens
ARNATCSHY

SEQ ID NO: 552950 - protein, 9 aa, Homo Sapiens
SHRRDGEEV

SEQ ID NO: 552951 - protein, 9 aa, Homo Sapiens
LEKKYKEKY

SEQ ID NO: 552952 - protein, 9 aa, Homo Sapiens
SKHSIDEEV

SEQ ID NO: 552953 - protein, 9 aa, Homo Sapiens
SHATEKLET

SEQ ID NO: 552954 - protein, 9 aa, Homo Sapiens
RRDGEEVLY

SEQ ID NO: 552955 - protein, 9 aa, Homo Sapiens
IILSGICLG

SEQ ID NO: 552956 - protein, 9 aa, Homo Sapiens
IMYHASKHS

SEQ ID NO: 552957 - protein, 9 aa, Homo Sapiens
SGTVDNFSE

SEQ ID NO: 552958 - protein, 9 aa, Homo Sapiens
KISHATEKL

SEQ ID NO: 552959 - protein, 9 aa, Homo Sapiens
NEVMYPPPY

SEQ ID NO: 552960 - protein, 9 aa, Homo Sapiens
GTAWLEWWH

SEQ ID NO: 552961 - protein, 9 aa, Homo Sapiens
VCKVADEWR

SEQ ID NO: 552962 - protein, 9 aa, Homo Sapiens
YHASKHSID

SEQ ID NO: 552963 - protein, 9 aa, Homo Sapiens
LDKVQAKFV

SEQ ID NO: 552964 - protein, 9 aa, Homo Sapiens
EDRLPRETQ

SEQ ID NO: 552965 - protein, 9 aa, Homo Sapiens
KCVFRTRKE

SEQ ID NO: 552966 - protein, 9 aa, Homo Sapiens
ALGAPATPT

SEQ ID NO: 552967 - protein, 9 aa, Homo Sapiens
VIFMLLNVA

SEQ ID NO: 552968 - protein, 9 aa, Homo Sapiens
AKFVAAMNE

SEQ ID NO: 552969 - protein, 9 aa, Homo Sapiens
GKKYTSTPR

SEQ ID NO: 552970 - protein, 9 aa, Homo Sapiens
EKKYKEKYK

SEQ ID NO: 552971 - protein, 9 aa, Homo Sapiens
EDLMLAIVN

SEQ ID NO: 552972 - protein, 9 aa, Homo Sapiens
QDPLGDSYF

SEQ ID NO: 552973 - protein, 9 aa, Homo Sapiens
PLGDSYFSL

SEQ ID NO: 552974 - protein, 9 aa, Homo Sapiens
DIYFCNEVM

SEQ ID NO: 552975 - protein, 9 aa, Homo Sapiens
QGNGSSQPD

SEQ ID NO: 552976 - protein, 9 aa, Homo Sapiens
ARKRALLSH

SEQ ID NO: 552977 - protein, 9 aa, Homo Sapiens
DTEVASCHQ

SEQ ID NO: 552978 - protein, 9 aa, Homo Sapiens
DNFSESGHS

SEQ ID NO: 552979 - protein, 9 aa, Homo Sapiens
FLCSQMTAS

SEQ ID NO: 552980 - protein, 9 aa, Homo Sapiens
QVEEQLANI

SEQ ID NO: 552981 - protein, 9 aa, Homo Sapiens
APSQASELI

SEQ ID NO: 552982 - protein, 9 aa, Homo Sapiens
NSTYSLFSE

SEQ ID NO: 552983 - protein, 9 aa, Homo Sapiens
LPRETQQFS

SEQ ID NO: 552984 - protein, 9 aa, Homo Sapiens
WDYYIERMG

SEQ ID NO: 552985 - protein, 9 aa, Homo Sapiens
AVLLTFLML

SEQ ID NO: 552986 - protein, 9 aa, Homo Sapiens
ESGHSEISS

SEQ ID NO: 552987 - protein, 9 aa, Homo Sapiens
ADEWRSTFH

SEQ ID NO: 552988 - protein, 9 aa, Homo Sapiens
AGAVAGDAR

SEQ ID NO: 552989 - protein, 9 aa, Homo Sapiens
TFNSTYSLF

SEQ ID NO: 552990 - protein, 9 aa, Homo Sapiens
YLEREEYGR

SEQ ID NO: 552991 - protein, 9 aa, Homo Sapiens
CGKSFKQSC

SEQ ID NO: 552992 - protein, 9 aa, Homo Sapiens
SKRALGAPA

SEQ ID NO: 552993 - protein, 9 aa, Homo Sapiens
EAAYLTFPS

SEQ ID NO: 552994 - protein, 9 aa, Homo Sapiens
VAVLLTFLM

SEQ ID NO: 552995 - protein, 9 aa, Homo Sapiens
WLLGDRQSL

SEQ ID NO: 552996 - protein, 9 aa, Homo Sapiens
DSYFSLTDC

SEQ ID NO: 552997 - protein, 9 aa, Homo Sapiens
CRQCKCVFR

SEQ ID NO: 552998 - protein, 9 aa, Homo Sapiens
YMLHETAAP

SEQ ID NO: 552999 - protein, 9 aa, Homo Sapiens
QYFMQAAGL

SEQ ID NO: 553000 - protein, 9 aa, Homo Sapiens
FYMVAVLLT

SEQ ID NO: 553001 - protein, 9 aa, Homo Sapiens
ERMGSAIQK

SEQ ID NO: 553002 - protein, 9 aa, Homo Sapiens
VEDIDSQGN

SEQ ID NO: 553003 - protein, 9 aa, Homo Sapiens
EKNLFSSEI

SEQ ID NO: 553004 - protein, 9 aa, Homo Sapiens
QPEQVQRLS

SEQ ID NO: 553005 - protein, 9 aa, Homo Sapiens
ASKHSIDEE

SEQ ID NO: 553006 - protein, 9 aa, Homo Sapiens
AQGTCKPLS

SEQ ID NO: 553007 - protein, 9 aa, Homo Sapiens
RQDPLGDSY

SEQ ID NO: 553008 - protein, 9 aa, Homo Sapiens
TVLEVPAWS

SEQ ID NO: 553009 - protein, 9 aa, Homo Sapiens
RETQQFSKL

SEQ ID NO: 553010 - protein, 9 aa, Homo Sapiens
PEMVYDFWG

SEQ ID NO: 553011 - protein, 9 aa, Homo Sapiens
LCSQMTASG

SEQ ID NO: 553012 - protein, 9 aa, Homo Sapiens
FAIFRKSDV

SEQ ID NO: 553013 - protein, 9 aa, Homo Sapiens
DARKRALLS

SEQ ID NO: 553014 - protein, 9 aa, Homo Sapiens
YIERMGSAI

SEQ ID NO: 553015 - protein, 9 aa, Homo Sapiens
FMISASVIF

SEQ ID NO: 553016 - protein, 9 aa, Homo Sapiens
NATCSHYTQ

SEQ ID NO: 553017 - protein, 9 aa, Homo Sapiens
QSQERAAFR

SEQ ID NO: 553018 - protein, 9 aa, Homo Sapiens
GDRQSLPAS

SEQ ID NO: 553019 - protein, 9 aa, Homo Sapiens
STPLMYFEL

SEQ ID NO: 553020 - protein, 9 aa, Homo Sapiens
KQSCSFSSH

SEQ ID NO: 553021 - protein, 9 aa, Homo Sapiens
DRLPRETQQ

SEQ ID NO: 553022 - protein, 9 aa, Homo Sapiens
LSLAWPSVT

SEQ ID NO: 553023 - protein, 9 aa, Homo Sapiens
WPSVTRKQV

SEQ ID NO: 553024 - protein, 9 aa, Homo Sapiens
LHRIESVLL

SEQ ID NO: 553025 - protein, 9 aa, Homo Sapiens
KFVAAMNEK

SEQ ID NO: 553026 - protein, 9 aa, Homo Sapiens
TCSHYTQLV

SEQ ID NO: 553027 - protein, 9 aa, Homo Sapiens
TSVGPCCFT

SEQ ID NO: 553028 - protein, 9 aa, Homo Sapiens
AIAKDKMGK

SEQ ID NO: 553029 - protein, 9 aa, Homo Sapiens
RIESVLLHM

SEQ ID NO: 553030 - protein, 9 aa, Homo Sapiens
LGAPATPTE

SEQ ID NO: 553031 - protein, 9 aa, Homo Sapiens
RLETVTYTI

SEQ ID NO: 553032 - protein, 9 aa, Homo Sapiens
DDGTFNSTY

SEQ ID NO: 553033 - protein, 9 aa, Homo Sapiens
DIALEKKYK

SEQ ID NO: 553034 - protein, 9 aa, Homo Sapiens
HATEKLETY

SEQ ID NO: 553035 - protein, 9 aa, Homo Sapiens
DSKIGKKPI

SEQ ID NO: 553036 - protein, 9 aa, Homo Sapiens
AWLEWWHVQ

SEQ ID NO: 553037 - protein, 9 aa, Homo Sapiens
EVASCHQGL

SEQ ID NO: 553038 - protein, 9 aa, Homo Sapiens
TIKPDPNSS

SEQ ID NO: 553039 - protein, 9 aa, Homo Sapiens
AAPSDIVGA

SEQ ID NO: 553040 - protein, 9 aa, Homo Sapiens
DIVVVLGTS

SEQ ID NO: 553041 - protein, 9 aa, Homo Sapiens
KKNIMETIK

SEQ ID NO: 553042 - protein, 9 aa, Homo Sapiens
QEILQVEEQ

SEQ ID NO: 553043 - protein, 9 aa, Homo Sapiens
QLATELQKV

SEQ ID NO: 553044 - protein, 9 aa, Homo Sapiens
RITCPLVKR

SEQ ID NO: 553045 - protein, 9 aa, Homo Sapiens
RPRPSDADP

SEQ ID NO: 553046 - protein, 9 aa, Homo Sapiens
EHGPGVVEP

SEQ ID NO: 553047 - protein, 9 aa, Homo Sapiens
AVLWLLGDR

SEQ ID NO: 553048 - protein, 9 aa, Homo Sapiens
AWPSVTRKQ

SEQ ID NO: 553049 - protein, 9 aa, Homo Sapiens
LGDRQSLPA

SEQ ID NO: 553050 - protein, 9 aa, Homo Sapiens
ERAAFRFAL

SEQ ID NO: 553051 - protein, 9 aa, Homo Sapiens
PIGSHLDMW

SEQ ID NO: 553052 - protein, 9 aa, Homo Sapiens
SQKAPSQAS

SEQ ID NO: 553053 - protein, 9 aa, Homo Sapiens
DMWMLEMTE

SEQ ID NO: 553054 - protein, 9 aa, Homo Sapiens
GKSFKQSCS

SEQ ID NO: 553055 - protein, 9 aa, Homo Sapiens
MTASGNQTM

SEQ ID NO: 553056 - protein, 9 aa, Homo Sapiens
TVPKPPPQT

SEQ ID NO: 553057 - protein, 9 aa, Homo Sapiens
ETIKPDPNS

SEQ ID NO: 553058 - protein, 9 aa, Homo Sapiens
VPKPPPQTP

SEQ ID NO: 553059 - protein, 9 aa, Homo Sapiens
QDDGTFNST

SEQ ID NO: 553060 - protein, 9 aa, Homo Sapiens
FRKSDVNTS

SEQ ID NO: 553061 - protein, 9 aa, Homo Sapiens
TCPLVKRHK

SEQ ID NO: 553062 - protein, 9 aa, Homo Sapiens
QYYMLHETA

SEQ ID NO: 553063 - protein, 9 aa, Homo Sapiens
SGHFEDLML

SEQ ID NO: 553064 - protein, 9 aa, Homo Sapiens
LGTSVGPCC

SEQ ID NO: 553065 - protein, 9 aa, Homo Sapiens
GAPATPTEG

SEQ ID NO: 553066 - protein, 9 aa, Homo Sapiens
LDTEVASCH

SEQ ID NO: 553067 - protein, 9 aa, Homo Sapiens
KVADEWRST

SEQ ID NO: 553068 - protein, 9 aa, Homo Sapiens
AVAGDARKR

SEQ ID NO: 553069 - protein, 9 aa, Homo Sapiens
TTESPEKNL

SEQ ID NO: 553070 - protein, 9 aa, Homo Sapiens
SEAAYLTFP

SEQ ID NO: 553071 - protein, 9 aa, Homo Sapiens
SQMTASGNQ

SEQ ID NO: 553072 - protein, 9 aa, Homo Sapiens
DILHRIESV

SEQ ID NO: 553073 - protein, 9 aa, Homo Sapiens
WSTFWGPQP

SEQ ID NO: 553074 - protein, 9 aa, Homo Sapiens
CARNATCSH

SEQ ID NO: 553075 - protein, 9 aa, Homo Sapiens
PLMYFELPD

SEQ ID NO: 553076 - protein, 9 aa, Homo Sapiens
YSTPLMYFE

SEQ ID NO: 553077 - protein, 9 aa, Homo Sapiens
AQYFMQAAG

SEQ ID NO: 553078 - protein, 9 aa, Homo Sapiens
ATELQKVSL

SEQ ID NO: 553079 - protein, 9 aa, Homo Sapiens
TAAPSDIVG

SEQ ID NO: 553080 - protein, 9 aa, Homo Sapiens
ELCYIILSG

SEQ ID NO: 553081 - protein, 9 aa, Homo Sapiens
ASRTDICEV

SEQ ID NO: 553082 - protein, 9 aa, Homo Sapiens
WHVQPTLDL

SEQ ID NO: 553083 - protein, 9 aa, Homo Sapiens
TGELVVQGH

SEQ ID NO: 553084 - protein, 9 aa, Homo Sapiens
LGKSEAAYL

SEQ ID NO: 553085 - protein, 9 aa, Homo Sapiens
EREEYGRLQ

SEQ ID NO: 553086 - protein, 9 aa, Homo Sapiens
GTSVGPCCF

SEQ ID NO: 553087 - protein, 9 aa, Homo Sapiens
IFMLLNVAE

SEQ ID NO: 553088 - protein, 9 aa, Homo Sapiens
IFRKSDVNT

SEQ ID NO: 553089 - protein, 9 aa, Homo Sapiens
GKKNIMETI

SEQ ID NO: 553090 - protein, 9 aa, Homo Sapiens
QSCSFSSHR

SEQ ID NO: 553091 - protein, 9 aa, Homo Sapiens
ITTESPEKN

SEQ ID NO: 553092 - protein, 9 aa, Homo Sapiens
HKKKVRVVA

SEQ ID NO: 553093 - protein, 9 aa, Homo Sapiens
LLGDRQSLP

SEQ ID NO: 553094 - protein, 9 aa, Homo Sapiens
FNSTYSLFS

SEQ ID NO: 553095 - protein, 9 aa, Homo Sapiens
PAGAVAGDA

SEQ ID NO: 553096 - protein, 9 aa, Homo Sapiens
ICEVKKLDP

SEQ ID NO: 553097 - protein, 9 aa, Homo Sapiens
HRRDGEEVL

SEQ ID NO: 553098 - protein, 9 aa, Homo Sapiens
GDSYFSLTD

SEQ ID NO: 553099 - protein, 9 aa, Homo Sapiens
SLAWPSVTR

SEQ ID NO: 553100 - protein, 9 aa, Homo Sapiens
GMVWQEHCS

SEQ ID NO: 553101 - protein, 9 aa, Homo Sapiens
FSESGHSEI

SEQ ID NO: 553102 - protein, 9 aa, Homo Sapiens
ILQVEEQLA

SEQ ID NO: 553103 - protein, 9 aa, Homo Sapiens
YDFWGMVWQ

SEQ ID NO: 553104 - protein, 9 aa, Homo Sapiens
LLTFLMLFR

SEQ ID NO: 553105 - protein, 9 aa, Homo Sapiens
EQLANITVS

SEQ ID NO: 553106 - protein, 9 aa, Homo Sapiens
EYHKKKVRV

SEQ ID NO: 553107 - protein, 9 aa, Homo Sapiens
QKAPSQASE

SEQ ID NO: 553108 - protein, 9 aa, Homo Sapiens
VADEWRSTF

SEQ ID NO: 553109 - protein, 9 aa, Homo Sapiens
KNLFSSEIF

SEQ ID NO: 553110 - protein, 9 aa, Homo Sapiens
LQVEEQLAN

SEQ ID NO: 553111 - protein, 9 aa, Homo Sapiens
ASVIFMLLN

SEQ ID NO: 553112 - protein, 9 aa, Homo Sapiens
AFAIFRKSD

SEQ ID NO: 553113 - protein, 9 aa, Homo Sapiens
QKKQEYHKK

SEQ ID NO: 553114 - protein, 9 aa, Homo Sapiens
HLDMWMLEM

SEQ ID NO: 553115 - protein, 9 aa, Homo Sapiens
PRPSDADPP

SEQ ID NO: 553116 - protein, 9 aa, Homo Sapiens
NIMETIKPD

SEQ ID NO: 553117 - protein, 9 aa, Homo Sapiens
PRSQKAPSQ

SEQ ID NO: 553118 - protein, 9 aa, Homo Sapiens
SGICLGYLC

SEQ ID NO: 553119 - protein, 9 aa, Homo Sapiens
CYIILSGIC

SEQ ID NO: 553120 - protein, 9 aa, Homo Sapiens
GKKPILNVC

SEQ ID NO: 553121 - protein, 9 aa, Homo Sapiens
GDARKRALL

SEQ ID NO: 553122 - protein, 9 aa, Homo Sapiens
CKPLSGEGS

SEQ ID NO: 553123 - protein, 9 aa, Homo Sapiens
IVVVLGTSV

SEQ ID NO: 553124 - protein, 9 aa, Homo Sapiens
ETAAPSDIV

SEQ ID NO: 553125 - protein, 9 aa, Homo Sapiens
EQVQRLSEL

SEQ ID NO: 553126 - protein, 9 aa, Homo Sapiens
RSQKAPSQA

SEQ ID NO: 553127 - protein, 9 aa, Homo Sapiens
HFEDLMLAI

SEQ ID NO: 553128 - protein, 9 aa, Homo Sapiens
QTDIYFCNE

SEQ ID NO: 553129 - protein, 9 aa, Homo Sapiens
ILNVCQKSE

SEQ ID NO: 553130 - protein, 9 aa, Homo Sapiens
SVTRKQVTF

SEQ ID NO: 553131 - protein, 9 aa, Homo Sapiens
SVIFMLLNV

SEQ ID NO: 553132 - protein, 9 aa, Homo Sapiens
KIGKKPILN

SEQ ID NO: 553133 - protein, 9 aa, Homo Sapiens
ALDTEVASC

SEQ ID NO: 553134 - protein, 9 aa, Homo Sapiens
ATCSHYTQL

SEQ ID NO: 553135 - protein, 9 aa, Homo Sapiens
EVPAWSTFW

SEQ ID NO: 553136 - protein, 9 aa, Homo Sapiens
QAKFVAAMN

SEQ ID NO: 553137 - protein, 9 aa, Homo Sapiens
GDILHRIES

SEQ ID NO: 553138 - protein, 9 aa, Homo Sapiens
FKQSCSFSS

SEQ ID NO: 553139 - protein, 9 aa, Homo Sapiens
KSPRSQKAP

SEQ ID NO: 553140 - protein, 9 aa, Homo Sapiens
SHLDMWMLE

SEQ ID NO: 553141 - protein, 9 aa, Homo Sapiens
KSFKQSCSF

SEQ ID NO: 553142 - protein, 9 aa, Homo Sapiens
FVAAMNEKM

SEQ ID NO: 553143 - protein, 9 aa, Homo Sapiens
QDFAKDGGL

SEQ ID NO: 553144 - protein, 9 aa, Homo Sapiens
SESGHSEIS

SEQ ID NO: 553145 - protein, 9 aa, Homo Sapiens
CSFSSHRKV

SEQ ID NO: 553146 - protein, 9 aa, Homo Sapiens
LWAVLWLLG

SEQ ID NO: 553147 - protein, 9 aa, Homo Sapiens
TRITCPLVK

SEQ ID NO: 553148 - protein, 9 aa, Homo Sapiens
LVVQGHLKP

SEQ ID NO: 553149 - protein, 9 aa, Homo Sapiens
GTVDNFSES

SEQ ID NO: 553150 - protein, 9 aa, Homo Sapiens
QTVLEVPAW

SEQ ID NO: 553151 - protein, 9 aa, Homo Sapiens
VVLGTSVGP

SEQ ID NO: 553152 - protein, 9 aa, Homo Sapiens
GELVVQGHL

SEQ ID NO: 553153 - protein, 9 aa, Homo Sapiens
STYSLFSEP

SEQ ID NO: 553154 - protein, 9 aa, Homo Sapiens
MISASVIFM

SEQ ID NO: 553155 - protein, 9 aa, Homo Sapiens
PPAGAVAGD

SEQ ID NO: 553156 - protein, 9 aa, Homo Sapiens
SASVIFMLL

SEQ ID NO: 553157 - protein, 9 aa, Homo Sapiens
IVFYMVAVL

SEQ ID NO: 553158 - protein, 9 aa, Homo Sapiens
LETVTYTIV

SEQ ID NO: 553159 - protein, 9 aa, Homo Sapiens
APATPTEGP

SEQ ID NO: 553160 - protein, 9 aa, Homo Sapiens
PEDIALEKK

SEQ ID NO: 553161 - protein, 9 aa, Homo Sapiens
GAQYFMQAA

SEQ ID NO: 553162 - protein, 9 aa, Homo Sapiens
REGAQYFMQ

SEQ ID NO: 553163 - protein, 9 aa, Homo Sapiens
KKPILNVCQ

SEQ ID NO: 553164 - protein, 9 aa, Homo Sapiens
FPNQQSQER

SEQ ID NO: 553165 - protein, 9 aa, Homo Sapiens
EIRDCEEAD

SEQ ID NO: 553166 - protein, 9 aa, Homo Sapiens
ETSRFGNQV

SEQ ID NO: 553167 - protein, 9 aa, Homo Sapiens
MGSAIQKII

SEQ ID NO: 553168 - protein, 9 aa, Homo Sapiens
GPGVVEPEV

SEQ ID NO: 553169 - protein, 9 aa, Homo Sapiens
LREGAQYFM

SEQ ID NO: 553170 - protein, 9 aa, Homo Sapiens
GRLQKILRQ

SEQ ID NO: 553171 - protein, 9 aa, Homo Sapiens
CAQGTCKPL

SEQ ID NO: 553172 - protein, 9 aa, Homo Sapiens
KSDVNTSAV

SEQ ID NO: 553173 - protein, 9 aa, Homo Sapiens
ETVTYTIVT

SEQ ID NO: 553174 - protein, 9 aa, Homo Sapiens
EAFAIFRKS

SEQ ID NO: 553175 - protein, 9 aa, Homo Sapiens
CRACAQGTC

SEQ ID NO: 553176 - protein, 9 aa, Homo Sapiens
ICRQCKCVF

SEQ ID NO: 553177 - protein, 9 aa, Homo Sapiens
EDIALEKKY

SEQ ID NO: 553178 - protein, 9 aa, Homo Sapiens
GVDPKQLAT

SEQ ID NO: 553179 - protein, 9 aa, Homo Sapiens
HLSETSRFG

SEQ ID NO: 553180 - protein, 9 aa, Homo Sapiens
KDRLETVTY

SEQ ID NO: 553181 - protein, 9 aa, Homo Sapiens
SPRSQKAPS

SEQ ID NO: 553182 - protein, 9 aa, Homo Sapiens
TELQKVSLQ

SEQ ID NO: 553183 - protein, 9 aa, Homo Sapiens
LWLLGDRQS

SEQ ID NO: 553184 - protein, 9 aa, Homo Sapiens
RNATCSHYT

SEQ ID NO: 553185 - protein, 9 aa, Homo Sapiens
KLETYRKRA

SEQ ID NO: 553186 - protein, 9 aa, Homo Sapiens
VASCHQGLE

SEQ ID NO: 553187 - protein, 9 aa, Homo Sapiens
YYMLHETAA

SEQ ID NO: 553188 - protein, 9 aa, Homo Sapiens
KRALLSHRR

SEQ ID NO: 553189 - protein, 9 aa, Homo Sapiens
QVQRLSELL

SEQ ID NO: 553190 - protein, 9 aa, Homo Sapiens
CKCVFRTRK

SEQ ID NO: 553191 - protein, 9 aa, Homo Sapiens
EDIDSQGNG

SEQ ID NO: 553192 - protein, 9 aa, Homo Sapiens
DGGLVTSQE

SEQ ID NO: 553193 - protein, 9 aa, Homo Sapiens
FCNEVMYPP

SEQ ID NO: 553194 - protein, 9 aa, Homo Sapiens
KPILNVCQK

SEQ ID NO: 553195 - protein, 9 aa, Homo Sapiens
HRIESVLLH

SEQ ID NO: 553196 - protein, 9 aa, Homo Sapiens
TVDNFSESG

SEQ ID NO: 553197 - protein, 9 aa, Homo Sapiens
IAKDKMGKK

SEQ ID NO: 553198 - protein, 9 aa, Homo Sapiens
CSHYTQLVW

SEQ ID NO: 553199 - protein, 9 aa, Homo Sapiens
AKDKMGKKY

SEQ ID NO: 553200 - protein, 9 aa, Homo Sapiens
IDSQGNGSS

SEQ ID NO: 553201 - protein, 9 aa, Homo Sapiens
CPLVKRHKL

SEQ ID NO: 553202 - protein, 9 aa, Homo Sapiens
ELVVQGHLK

SEQ ID NO: 553203 - protein, 9 aa, Homo Sapiens
TAWLEWWHV

SEQ ID NO: 553204 - protein, 9 aa, Homo Sapiens
AQEILQVEE

SEQ ID NO: 553205 - protein, 9 aa, Homo Sapiens
DPLGDSYFS

SEQ ID NO: 553206 - protein, 9 aa, Homo Sapiens
SYFSLTDCQ

SEQ ID NO: 553207 - protein, 9 aa, Homo Sapiens
QEYHKKKVR

SEQ ID NO: 553208 - protein, 9 aa, Homo Sapiens
REEYGRLQK

SEQ ID NO: 553209 - protein, 9 aa, Homo Sapiens
WGMVWQEHC

SEQ ID NO: 553210 - protein, 9 aa, Homo Sapiens
KHSIDEEVY

SEQ ID NO: 553211 - protein, 9 aa, Homo Sapiens
LVTSQESGQ

SEQ ID NO: 553212 - protein, 9 aa, Homo Sapiens
PKQLATELQ

SEQ ID NO: 553213 - protein, 9 aa, Homo Sapiens
ADPPAGAVA

SEQ ID NO: 553214 - protein, 9 aa, Homo Sapiens
VPAWSTFWG

SEQ ID NO: 553215 - protein, 9 aa, Homo Sapiens
ISHATEKLE

SEQ ID NO: 553216 - protein, 9 aa, Homo Sapiens
MWMLEMTEG

SEQ ID NO: 553217 - protein, 9 aa, Homo Sapiens
VEPEVATAP

SEQ ID NO: 553218 - protein, 9 aa, Homo Sapiens
NLFSSEIFI

SEQ ID NO: 553219 - protein, 9 aa, Homo Sapiens
YGRLQKILR

SEQ ID NO: 553220 - protein, 9 aa, Homo Sapiens
LMYFELPDS

SEQ ID NO: 553221 - protein, 9 aa, Homo Sapiens
RLSELLEND

SEQ ID NO: 553222 - protein, 9 aa, Homo Sapiens
RKSDVNTSA

SEQ ID NO: 553223 - protein, 9 aa, Homo Sapiens
GLVTSQESG

SEQ ID NO: 553224 - protein, 9 aa, Homo Sapiens
KVQAKFVAA

SEQ ID NO: 553225 - protein, 9 aa, Homo Sapiens
ECARNATCS

SEQ ID NO: 553226 - protein, 9 aa, Homo Sapiens
WAVLWLLGD

SEQ ID NO: 553227 - protein, 9 aa, Homo Sapiens
PTRITCPLV

SEQ ID NO: 553228 - protein, 9 aa, Homo Sapiens
HASKHSIDE

SEQ ID NO: 553229 - protein, 9 aa, Homo Sapiens
IMETIKPDP

SEQ ID NO: 553230 - protein, 9 aa, Homo Sapiens
FMLLNVAEL

SEQ ID NO: 553231 - protein, 9 aa, Homo Sapiens
IGSHLDMWM

SEQ ID NO: 553232 - protein, 9 aa, Homo Sapiens
KAPSQASEL

SEQ ID NO: 553233 - protein, 9 aa, Homo Sapiens
SPEKNLFSS

SEQ ID NO: 553234 - protein, 9 aa, Homo Sapiens
DLREGAQYF

SEQ ID NO: 553235 - protein, 9 aa, Homo Sapiens
KKQEYHKKK

SEQ ID NO: 553236 - protein, 9 aa, Homo Sapiens
ASCHQGLEN

SEQ ID NO: 553237 - protein, 9 aa, Homo Sapiens
CHQGLENGV

SEQ ID NO: 553238 - protein, 9 aa, Homo Sapiens
SREHGPGVV

SEQ ID NO: 553239 - protein, 9 aa, Homo Sapiens
VVVLGTSVG

SEQ ID NO: 553240 - protein, 9 aa, Homo Sapiens
RLPRETQQF

SEQ ID NO: 553241 - protein, 9 aa, Homo Sapiens
IYFCNEVMY

SEQ ID NO: 553242 - protein, 9 aa, Homo Sapiens
KQLATELQK

SEQ ID NO: 553243 - protein, 9 aa, Homo Sapiens
LSELLENDP

SEQ ID NO: 553244 - protein, 9 aa, Homo Sapiens
IKPDPNSSS

SEQ ID NO: 553245 - protein, 9 aa, Homo Sapiens
FMQAAGLGR

SEQ ID NO: 553246 - protein, 9 aa, Homo Sapiens
VVEIRDCEE

SEQ ID NO: 553247 - protein, 9 aa, Homo Sapiens
QGTCKPLSG

SEQ ID NO: 553248 - protein, 9 aa, Homo Sapiens
TAPTRITCP

SEQ ID NO: 553249 - protein, 9 aa, Homo Sapiens
EDIVVVLGT

SEQ ID NO: 553250 - protein, 9 aa, Homo Sapiens
NGSSQPDTI

SEQ ID NO: 553251 - protein, 9 aa, Homo Sapiens
NDVVEIRDC

SEQ ID NO: 553252 - protein, 9 aa, Homo Sapiens
HGPGVVEPE

SEQ ID NO: 553253 - protein, 9 aa, Homo Sapiens
MLAIVNCVR

SEQ ID NO: 553254 - protein, 9 aa, Homo Sapiens
NQQSQERAA

SEQ ID NO: 553255 - protein, 9 aa, Homo Sapiens
TEVASCHQG

SEQ ID NO: 553256 - protein, 9 aa, Homo Sapiens
AWSTFWGPQ

SEQ ID NO: 553257 - protein, 9 aa, Homo Sapiens
KRALGAPAT

SEQ ID NO: 553258 - protein, 9 aa, Homo Sapiens
QQSQERAAF

SEQ ID NO: 553259 - protein, 9 aa, Homo Sapiens
VRPRPSDAD

SEQ ID NO: 553260 - protein, 9 aa, Homo Sapiens
DVVEIRDCE

SEQ ID NO: 553261 - protein, 9 aa, Homo Sapiens
TYSLFSEPY

SEQ ID NO: 553262 - protein, 9 aa, Homo Sapiens
AKDGGLVTS

SEQ ID NO: 553263 - protein, 9 aa, Homo Sapiens
SETSRFGNQ

SEQ ID NO: 553264 - protein, 9 aa, Homo Sapiens
TCKPLSGEG

SEQ ID NO: 553265 - protein, 9 aa, Homo Sapiens
PRETQQFSK

SEQ ID NO: 553266 - protein, 9 aa, Homo Sapiens
CDICRQCKC

SEQ ID NO: 553267 - protein, 9 aa, Homo Sapiens
PSVTRKQVT

SEQ ID NO: 553268 - protein, 9 aa, Homo Sapiens
PLSLAWPSV

SEQ ID NO: 553269 - protein, 9 aa, Homo Sapiens
LEWWHVQPT

SEQ ID NO: 553270 - protein, 9 aa, Homo Sapiens
FWGMVWQEH

SEQ ID NO: 553271 - protein, 9 aa, Homo Sapiens
KSEAAYLTF

SEQ ID NO: 553272 - protein, 9 aa, Homo Sapiens
SLGKSEAAY

SEQ ID NO: 553273 - protein, 9 aa, Homo Sapiens
RELCYIILS

SEQ ID NO: 553274 - protein, 9 aa, Homo Sapiens
QGHLKPVEQ

SEQ ID NO: 553275 - protein, 9 aa, Homo Sapiens
PTVPKPPPQ

SEQ ID NO: 553276 - protein, 9 aa, Homo Sapiens
GKSPRSQKA

SEQ ID NO: 553277 - protein, 9 aa, Homo Sapiens
QQFSKLFDA

SEQ ID NO: 553278 - protein, 9 aa, Homo Sapiens
TSRFGNQVS

SEQ ID NO: 553279 - protein, 9 aa, Homo Sapiens
AYLTFPSGE

SEQ ID NO: 553280 - protein, 9 aa, Homo Sapiens
ATEKLETYR

SEQ ID NO: 553281 - protein, 9 aa, Homo Sapiens
DYYIERMGS

SEQ ID NO: 553282 - protein, 9 aa, Homo Sapiens
PFLCSQMTA

SEQ ID NO: 553283 - protein, 9 aa, Homo Sapiens
PNQQSQERA

SEQ ID NO: 553284 - protein, 9 aa, Homo Sapiens
RKRALLSHR

SEQ ID NO: 553285 - protein, 9 aa, Homo Sapiens
RAAFRFALS

SEQ ID NO: 553286 - protein, 9 aa, Homo Sapiens
SKIGKKPIL

SEQ ID NO: 553287 - protein, 9 aa, Homo Sapiens
VQAKFVAAM

SEQ ID NO: 553288 - protein, 9 aa, Homo Sapiens
SRFGNQVSE

SEQ ID NO: 553289 - protein, 9 aa, Homo Sapiens
GTFNSTYSL

SEQ ID NO: 553290 - protein, 9 aa, Homo Sapiens
CEVKKLDPG

SEQ ID NO: 553291 - protein, 9 aa, Homo Sapiens
EEYGRLQKI

SEQ ID NO: 553292 - protein, 9 aa, Homo Sapiens
DPKQLATEL

SEQ ID NO: 553293 - protein, 9 aa, Homo Sapiens
RIMYHASKH

SEQ ID NO: 553294 - protein, 9 aa, Homo Sapiens
MGKKYTSTP

SEQ ID NO: 553295 - protein, 9 aa, Homo Sapiens
YYIERMGSA

SEQ ID NO: 553296 - protein, 9 aa, Homo Sapiens
IGKKPILNV

SEQ ID NO: 553297 - protein, 9 aa, Homo Sapiens
RTDICEVKK

SEQ ID NO: 553298 - protein, 9 aa, Homo Sapiens
VEIRDCEEA

SEQ ID NO: 553299 - protein, 9 aa, Homo Sapiens
DADPPAGAV

SEQ ID NO: 553300 - protein, 9 aa, Homo Sapiens
DPPAGAVAG

SEQ ID NO: 553301 - protein, 9 aa, Homo Sapiens
ISASVIFML

SEQ ID NO: 553302 - protein, 9 aa, Homo Sapiens
SDVNTSAVQ

SEQ ID NO: 553303 - protein, 9 aa, Homo Sapiens
DKMGKKYTS

SEQ ID NO: 553304 - protein, 9 aa, Homo Sapiens
RALGAPATP

SEQ ID NO: 553305 - protein, 9 aa, Homo Sapiens
YFSLTDCQE

SEQ ID NO: 553306 - protein, 9 aa, Homo Sapiens
LDMWMLEMT

SEQ ID NO: 553307 - protein, 9 aa, Homo Sapiens
YMVAVLLTF

SEQ ID NO: 553308 - protein, 9 aa, Homo Sapiens
IALEKKYKE

SEQ ID NO: 553309 - protein, 9 aa, Homo Sapiens
CNEVMYPPP

SEQ ID NO: 553310 - protein, 9 aa, Homo Sapiens
VVQGHLKPV

SEQ ID NO: 553311 - protein, 9 aa, Homo Sapiens
SCSFSSHRK

SEQ ID NO: 553312 - protein, 9 aa, Homo Sapiens
RALLSHRRD

SEQ ID NO: 553313 - protein, 9 aa, Homo Sapiens
GNSKRALGA

SEQ ID NO: 553314 - protein, 9 aa, Homo Sapiens
GSHLDMWML

SEQ ID NO: 553315 - protein, 9 aa, Homo Sapiens
SRTDICEVK

SEQ ID NO: 553316 - protein, 9 aa, Homo Sapiens
LCYIILSGI

SEQ ID NO: 553317 - protein, 9 aa, Homo Sapiens
MYVCKVADE

SEQ ID NO: 553318 - protein, 9 aa, Homo Sapiens
FAKDGGLVT

SEQ ID NO: 553319 - protein, 9 aa, Homo Sapiens
TEKLETYRK

SEQ ID NO: 553320 - protein, 9 aa, Homo Sapiens
VDPKQLATE

SEQ ID NO: 553321 - protein, 9 aa, Homo Sapiens
PSDADPPAG

SEQ ID NO: 553322 - protein, 9 aa, Homo Sapiens
VMYVCKVAD

SEQ ID NO: 553323 - protein, 9 aa, Homo Sapiens
GAVAGDARK

SEQ ID NO: 553324 - protein, 9 aa, Homo Sapiens
HSIDEEVYF

SEQ ID NO: 553325 - protein, 9 aa, Homo Sapiens
VLLVRPRPS

SEQ ID NO: 553326 - protein, 9 aa, Homo Sapiens
RMGSAIQKI

SEQ ID NO: 553327 - protein, 9 aa, Homo Sapiens
RLQKILRQL

SEQ ID NO: 553328 - protein, 9 aa, Homo Sapiens
GHFEDLMLA

SEQ ID NO: 553329 - protein, 9 aa, Homo Sapiens
YFMQAAGLG

SEQ ID NO: 553330 - protein, 9 aa, Homo Sapiens
SNKDRLETV

SEQ ID NO: 553331 - protein, 9 aa, Homo Sapiens
IRDCEEADS

SEQ ID NO: 553332 - protein, 9 aa, Homo Sapiens
DCEEADSLL

SEQ ID NO: 553333 - protein, 9 aa, Homo Sapiens
DEWRSTFHK

SEQ ID NO: 553334 - protein, 9 aa, Homo Sapiens
METIKPDPN

SEQ ID NO: 553335 - protein, 9 aa, Homo Sapiens
WWHVQPTLD

SEQ ID NO: 553336 - protein, 9 aa, Homo Sapiens
QMTASGNQT

SEQ ID NO: 553337 - protein, 9 aa, Homo Sapiens
APTRITCPL

SEQ ID NO: 553338 - protein, 9 aa, Homo Sapiens
EWWHVQPTL

SEQ ID NO: 553339 - protein, 9 aa, Homo Sapiens
SCHQGLENG

SEQ ID NO: 553340 - protein, 9 aa, Homo Sapiens
YIILSGICL

SEQ ID NO: 553341 - protein, 9 aa, Homo Sapiens
GNGSSQPDT

SEQ ID NO: 553342 - protein, 9 aa, Homo Sapiens
EYGRLQKIL

SEQ ID NO: 553343 - protein, 9 aa, Homo Sapiens
RPSDADPPA

SEQ ID NO: 553344 - protein, 9 aa, Homo Sapiens
VDNFSESGH

SEQ ID NO: 553345 - protein, 9 aa, Homo Sapiens
LLSHRRDGE

SEQ ID NO: 553346 - protein, 9 aa, Homo Sapiens
TDICEVKKL

SEQ ID NO: 553347 - protein, 9 aa, Homo Sapiens
GGLVTSQES

SEQ ID NO: 553348 - protein, 9 aa, Homo Sapiens
VSNKDRLET

SEQ ID NO: 553349 - protein, 9 aa, Homo Sapiens
DWDYYIERM

SEQ ID NO: 553350 - protein, 9 aa, Homo Sapiens
VVEPEVATA

SEQ ID NO: 553351 - protein, 9 aa, Homo Sapiens
CYSTPLMYF

SEQ ID NO: 553352 - protein, 9 aa, Homo Sapiens
AAYLTFPSG

SEQ ID NO: 553353 - protein, 9 aa, Homo Sapiens
YVSNKDRLE

SEQ ID NO: 553354 - protein, 9 aa, Homo Sapiens
ITCPLVKRH

SEQ ID NO: 553355 - protein, 9 aa, Homo Sapiens
PGVVEPEVA

SEQ ID NO: 553356 - protein, 9 aa, Homo Sapiens
GGTAWLEWW

SEQ ID NO: 553357 - protein, 9 aa, Homo Sapiens
DICYSTPLM

SEQ ID NO: 553358 - protein, 9 aa, Homo Sapiens
KKYTSTPRH

SEQ ID NO: 553359 - protein, 9 aa, Homo Sapiens
WLEWWHVQP

SEQ ID NO: 553360 - protein, 9 aa, Homo Sapiens
GHLKPVEQK

SEQ ID NO: 553361 - protein, 9 aa, Homo Sapiens
EVKKLDPGQ

SEQ ID NO: 553362 - protein, 9 aa, Homo Sapiens
HETAAPSDI

SEQ ID NO: 553363 - protein, 9 aa, Homo Sapiens
QRLSELLEN

SEQ ID NO: 553364 - protein, 9 aa, Homo Sapiens
IESVLLHMP

SEQ ID NO: 553365 - protein, 9 aa, Homo Sapiens
VFYMVAVLL

SEQ ID NO: 553366 - protein, 9 aa, Homo Sapiens
KDGGLVTSQ

SEQ ID NO: 553367 - protein, 9 aa, Homo Sapiens
THLSETSRF

SEQ ID NO: 553368 - protein, 9 aa, Homo Sapiens
EKLETYRKR

SEQ ID NO: 553369 - protein, 9 aa, Homo Sapiens
LEVPAWSTF

SEQ ID NO: 553370 - protein, 9 aa, Homo Sapiens
KKKVRVVAM

SEQ ID NO: 553371 - protein, 9 aa, Homo Sapiens
TPLMYFELP

SEQ ID NO: 553372 - protein, 9 aa, Homo Sapiens
GKSEAAYLT

SEQ ID NO: 553373 - protein, 9 aa, Homo Sapiens
VLEVPAWST

SEQ ID NO: 553374 - protein, 9 aa, Homo Sapiens
ALLSHRRDG

SEQ ID NO: 553375 - protein, 9 aa, Homo Sapiens
EILQVEEQL

SEQ ID NO: 553376 - protein, 9 aa, Homo Sapiens
LGDSYFSLT

SEQ ID NO: 553377 - protein, 9 aa, Homo Sapiens
RFGNQVSEY

SEQ ID NO: 553378 - protein, 9 aa, Homo Sapiens
MVYDFWGMV

SEQ ID NO: 553379 - protein, 9 aa, Homo Sapiens
KKVRVVAMA

SEQ ID NO: 553380 - protein, 9 aa, Homo Sapiens
REHGPGVVE

SEQ ID NO: 553381 - protein, 9 aa, Homo Sapiens
VLWLLGDRQ

SEQ ID NO: 553382 - protein, 9 aa, Homo Sapiens
KNIMETIKP

SEQ ID NO: 553383 - protein, 9 aa, Homo Sapiens
CEEADSLLL

SEQ ID NO: 553384 - protein, 9 aa, Homo Sapiens
AGDARKRAL

SEQ ID NO: 553385 - protein, 9 aa, Homo Sapiens
LATELQKVS

SEQ ID NO: 553386 - protein, 9 aa, Homo Sapiens
MVAVLLTFL

SEQ ID NO: 553387 - protein, 9 aa, Homo Sapiens
CVFRTRKEC

SEQ ID NO: 553388 - protein, 9 aa, Homo Sapiens
QERAAFRFA

SEQ ID NO: 553389 - protein, 9 aa, Homo Sapiens
DLMLAIVNC

SEQ ID NO: 553390 - protein, 9 aa, Homo Sapiens
NKDRLETVT

SEQ ID NO: 553391 - protein, 9 aa, Homo Sapiens
LSHRRDGEE

SEQ ID NO: 553392 - protein, 9 aa, Homo Sapiens
DFEKKCIPL

SEQ ID NO: 553393 - protein, 9 aa, Homo Sapiens
SSGRSTKIW

SEQ ID NO: 553394 - protein, 9 aa, Homo Sapiens
RDADAEIEE

SEQ ID NO: 553395 - protein, 9 aa, Homo Sapiens
PQPPPPSVL

SEQ ID NO: 553396 - protein, 9 aa, Homo Sapiens
AERVLKLVS

SEQ ID NO: 553397 - protein, 9 aa, Homo Sapiens
KSGEIDHHR

SEQ ID NO: 553398 - protein, 9 aa, Homo Sapiens
DKFEGYCLD

SEQ ID NO: 553399 - protein, 9 aa, Homo Sapiens
LLLKQLGEG

SEQ ID NO: 553400 - protein, 9 aa, Homo Sapiens
PYECKRMRR

SEQ ID NO: 553401 - protein, 9 aa, Homo Sapiens
PRGGAQGGR

SEQ ID NO: 553402 - protein, 9 aa, Homo Sapiens
KVTYSILLG

SEQ ID NO: 553403 - protein, 9 aa, Homo Sapiens
RKMIVVLSP

SEQ ID NO: 553404 - protein, 9 aa, Homo Sapiens
EKRKFKIDD

SEQ ID NO: 553405 - protein, 9 aa, Homo Sapiens
RETKLDVQR

SEQ ID NO: 553406 - protein, 9 aa, Homo Sapiens
GAQGGRGRG

SEQ ID NO: 553407 - protein, 9 aa, Homo Sapiens
LSKELSAEL

SEQ ID NO: 553408 - protein, 9 aa, Homo Sapiens
ATVLLKPLT

SEQ ID NO: 553409 - protein, 9 aa, Homo Sapiens
LVSAEPDGA

SEQ ID NO: 553410 - protein, 9 aa, Homo Sapiens
SADSKYHIT

SEQ ID NO: 553411 - protein, 9 aa, Homo Sapiens
IPPLQSDKE

SEQ ID NO: 553412 - protein, 9 aa, Homo Sapiens
VNEKIETPI

SEQ ID NO: 553413 - protein, 9 aa, Homo Sapiens
FLGILYPLS

SEQ ID NO: 553414 - protein, 9 aa, Homo Sapiens
MADLFLSLV

SEQ ID NO: 553415 - protein, 9 aa, Homo Sapiens
DTLLSSTTI

SEQ ID NO: 553416 - protein, 9 aa, Homo Sapiens
KPLYGNDKF

SEQ ID NO: 553417 - protein, 9 aa, Homo Sapiens
LLCYLQLDF

SEQ ID NO: 553418 - protein, 9 aa, Homo Sapiens
LLGASLGGI

SEQ ID NO: 553419 - protein, 9 aa, Homo Sapiens
DDSENLLTE

SEQ ID NO: 553420 - protein, 9 aa, Homo Sapiens
QKYSKLLPT

SEQ ID NO: 553421 - protein, 9 aa, Homo Sapiens
KEICSHLVC

SEQ ID NO: 553422 - protein, 9 aa, Homo Sapiens
SKKRTENRV

SEQ ID NO: 553423 - protein, 9 aa, Homo Sapiens
LLGNENMTF

SEQ ID NO: 553424 - protein, 9 aa, Homo Sapiens
VSLLVLPMA

SEQ ID NO: 553425 - protein, 9 aa, Homo Sapiens
LMLSHDFST

SEQ ID NO: 553426 - protein, 9 aa, Homo Sapiens
VAKPSGHPP

SEQ ID NO: 553427 - protein, 9 aa, Homo Sapiens
IICKELWVF

SEQ ID NO: 553428 - protein, 9 aa, Homo Sapiens
DADAEIEEA

SEQ ID NO: 553429 - protein, 9 aa, Homo Sapiens
RGRSPNAHS

SEQ ID NO: 553430 - protein, 9 aa, Homo Sapiens
YLMADLFLS

SEQ ID NO: 553431 - protein, 9 aa, Homo Sapiens
LLSSTTIPK

SEQ ID NO: 553432 - protein, 9 aa, Homo Sapiens
YHITFINKV

SEQ ID NO: 553433 - protein, 9 aa, Homo Sapiens
SEIICKELW

SEQ ID NO: 553434 - protein, 9 aa, Homo Sapiens
DAEIEEAPA

SEQ ID NO: 553435 - protein, 9 aa, Homo Sapiens
MVSLLVLPM

SEQ ID NO: 553436 - protein, 9 aa, Homo Sapiens
VYNLTHLDP

SEQ ID NO: 553437 - protein, 9 aa, Homo Sapiens
SGPQPPPPS

SEQ ID NO: 553438 - protein, 9 aa, Homo Sapiens
PYERPKDSM

SEQ ID NO: 553439 - protein, 9 aa, Homo Sapiens
LQQQPRKRL

SEQ ID NO: 553440 - protein, 9 aa, Homo Sapiens
PINLAWTAG

SEQ ID NO: 553441 - protein, 9 aa, Homo Sapiens
GASLGGIIY

SEQ ID NO: 553442 - protein, 9 aa, Homo Sapiens
PPPFTSFWH

SEQ ID NO: 553443 - protein, 9 aa, Homo Sapiens
LVAYAQDGV

SEQ ID NO: 553444 - protein, 9 aa, Homo Sapiens
FPRRRPTTR

SEQ ID NO: 553445 - protein, 9 aa, Homo Sapiens
CYLQLDFEG

SEQ ID NO: 553446 - protein, 9 aa, Homo Sapiens
ILNRGLGNT

SEQ ID NO: 553447 - protein, 9 aa, Homo Sapiens
FDFIQRSRK

SEQ ID NO: 553448 - protein, 9 aa, Homo Sapiens
STKIWKTTQ

SEQ ID NO: 553449 - protein, 9 aa, Homo Sapiens
IPQQAQELG

SEQ ID NO: 553450 - protein, 9 aa, Homo Sapiens
GVKSLSKEL

SEQ ID NO: 553451 - protein, 9 aa, Homo Sapiens
EVGARLKIP

SEQ ID NO: 553452 - protein, 9 aa, Homo Sapiens
FAFSSLEFF

SEQ ID NO: 553453 - protein, 9 aa, Homo Sapiens
IKVHVVYPS

SEQ ID NO: 553454 - protein, 9 aa, Homo Sapiens
RLVAYAQDG

SEQ ID NO: 553455 - protein, 9 aa, Homo Sapiens
GGGSGFGGG

SEQ ID NO: 553456 - protein, 9 aa, Homo Sapiens
DFIQRSRKM

SEQ ID NO: 553457 - protein, 9 aa, Homo Sapiens
FLAKNKITK

SEQ ID NO: 553458 - protein, 9 aa, Homo Sapiens
TTQMCRKTW

SEQ ID NO: 553459 - protein, 9 aa, Homo Sapiens
SFWHVMSVI

SEQ ID NO: 553460 - protein, 9 aa, Homo Sapiens
NGKLFHKQK

SEQ ID NO: 553461 - protein, 9 aa, Homo Sapiens
RVEHLTIFV

SEQ ID NO: 553462 - protein, 9 aa, Homo Sapiens
LLGVAVGHI

SEQ ID NO: 553463 - protein, 9 aa, Homo Sapiens
ALGIPLIPQ

SEQ ID NO: 553464 - protein, 9 aa, Homo Sapiens
SIKTQIFLA

SEQ ID NO: 553465 - protein, 9 aa, Homo Sapiens
AYAQDGVMH

SEQ ID NO: 553466 - protein, 9 aa, Homo Sapiens
TPINLAWTA

SEQ ID NO: 553467 - protein, 9 aa, Homo Sapiens
EERELPKEF

SEQ ID NO: 553468 - protein, 9 aa, Homo Sapiens
DWTSSGRST

SEQ ID NO: 553469 - protein, 9 aa, Homo Sapiens
TKIWKTTQM

SEQ ID NO: 553470 - protein, 9 aa, Homo Sapiens
TEDFRLHFR

SEQ ID NO: 553471 - protein, 9 aa, Homo Sapiens
RILNRGLGN

SEQ ID NO: 553472 - protein, 9 aa, Homo Sapiens
HLTIFVLDR

SEQ ID NO: 553473 - protein, 9 aa, Homo Sapiens
PLLGASLGG

SEQ ID NO: 553474 - protein, 9 aa, Homo Sapiens
HIRKEGRIY

SEQ ID NO: 553475 - protein, 9 aa, Homo Sapiens
IKLLMEWVN

SEQ ID NO: 553476 - protein, 9 aa, Homo Sapiens
GEGRQAQVG

SEQ ID NO: 553477 - protein, 9 aa, Homo Sapiens
PLYGNDKFE

SEQ ID NO: 553478 - protein, 9 aa, Homo Sapiens
CLSHLCANG

SEQ ID NO: 553479 - protein, 9 aa, Homo Sapiens
ICKELWVFI

SEQ ID NO: 553480 - protein, 9 aa, Homo Sapiens
WKTTQMCRK

SEQ ID NO: 553481 - protein, 9 aa, Homo Sapiens
VTYSILLGN

SEQ ID NO: 553482 - protein, 9 aa, Homo Sapiens
IVNKEICSH

SEQ ID NO: 553483 - protein, 9 aa, Homo Sapiens
WKPPILMLS

SEQ ID NO: 553484 - protein, 9 aa, Homo Sapiens
KLFHKQKLF

SEQ ID NO: 553485 - protein, 9 aa, Homo Sapiens
KMIVVLSPD

SEQ ID NO: 553486 - protein, 9 aa, Homo Sapiens
RLLCYLQLD

SEQ ID NO: 553487 - protein, 9 aa, Homo Sapiens
LGNENMTFM

SEQ ID NO: 553488 - protein, 9 aa, Homo Sapiens
YNLTHLDPS

SEQ ID NO: 553489 - protein, 9 aa, Homo Sapiens
EEVEKRKFK

SEQ ID NO: 553490 - protein, 9 aa, Homo Sapiens
EKAINPLLY

SEQ ID NO: 553491 - protein, 9 aa, Homo Sapiens
LSSTTIPKM

SEQ ID NO: 553492 - protein, 9 aa, Homo Sapiens
PRKRLEKMK

SEQ ID NO: 553493 - protein, 9 aa, Homo Sapiens
GNTYRVGDP

SEQ ID NO: 553494 - protein, 9 aa, Homo Sapiens
TSIKTQIFL

SEQ ID NO: 553495 - protein, 9 aa, Homo Sapiens
FTSFWHVMS

SEQ ID NO: 553496 - protein, 9 aa, Homo Sapiens
CIPLKWKPP

SEQ ID NO: 553497 - protein, 9 aa, Homo Sapiens
FFPHIRKEG

SEQ ID NO: 553498 - protein, 9 aa, Homo Sapiens
RELSADSKY

SEQ ID NO: 553499 - protein, 9 aa, Homo Sapiens
GSGFGGGFG

SEQ ID NO: 553500 - protein, 9 aa, Homo Sapiens
HLCANGSTC

SEQ ID NO: 553501 - protein, 9 aa, Homo Sapiens
SGFGGGFGG

SEQ ID NO: 553502 - protein, 9 aa, Homo Sapiens
SKELSAELL

SEQ ID NO: 553503 - protein, 9 aa, Homo Sapiens
RVSFADPLY

SEQ ID NO: 553504 - protein, 9 aa, Homo Sapiens
EPHPEPFAN

SEQ ID NO: 553505 - protein, 9 aa, Homo Sapiens
TENRVGVET

SEQ ID NO: 553506 - protein, 9 aa, Homo Sapiens
QELADDSEN

SEQ ID NO: 553507 - protein, 9 aa, Homo Sapiens
SLLVLPMAA

SEQ ID NO: 553508 - protein, 9 aa, Homo Sapiens
KRTENRVGV

SEQ ID NO: 553509 - protein, 9 aa, Homo Sapiens
EKLQQQPRK

SEQ ID NO: 553510 - protein, 9 aa, Homo Sapiens
KELSAELLH

SEQ ID NO: 553511 - protein, 9 aa, Homo Sapiens
ENIKLLMEW

SEQ ID NO: 553512 - protein, 9 aa, Homo Sapiens
SSLEFFSEI

SEQ ID NO: 553513 - protein, 9 aa, Homo Sapiens
EKVKPKQDT

SEQ ID NO: 553514 - protein, 9 aa, Homo Sapiens
DGLVSAEPD

SEQ ID NO: 553515 - protein, 9 aa, Homo Sapiens
KVNEKIETP

SEQ ID NO: 553516 - protein, 9 aa, Homo Sapiens
KRKFKIDDQ

SEQ ID NO: 553517 - protein, 9 aa, Homo Sapiens
IETPINLAW

SEQ ID NO: 553518 - protein, 9 aa, Homo Sapiens
HKLTEDFRL

SEQ ID NO: 553519 - protein, 9 aa, Homo Sapiens
ITGDWTSSG

SEQ ID NO: 553520 - protein, 9 aa, Homo Sapiens
RICFQTAHF

SEQ ID NO: 553521 - protein, 9 aa, Homo Sapiens
EEAPAAPLD

SEQ ID NO: 553522 - protein, 9 aa, Homo Sapiens
NFLAPKLQF

SEQ ID NO: 553523 - protein, 9 aa, Homo Sapiens
ICFQTAHFY

SEQ ID NO: 553524 - protein, 9 aa, Homo Sapiens
KKRTENRVG

SEQ ID NO: 553525 - protein, 9 aa, Homo Sapiens
SGEIDHHRE

SEQ ID NO: 553526 - protein, 9 aa, Homo Sapiens
NAHSGGRNS

SEQ ID NO: 553527 - protein, 9 aa, Homo Sapiens
KFFFPHIRK

SEQ ID NO: 553528 - protein, 9 aa, Homo Sapiens
LIRLVAYAQ

SEQ ID NO: 553529 - protein, 9 aa, Homo Sapiens
ASLGGIIYL

SEQ ID NO: 553530 - protein, 9 aa, Homo Sapiens
SSSTSSPST

SEQ ID NO: 553531 - protein, 9 aa, Homo Sapiens
PIKVHVVYP

SEQ ID NO: 553532 - protein, 9 aa, Homo Sapiens
SHDFSTWGL

SEQ ID NO: 553533 - protein, 9 aa, Homo Sapiens
FEKKCIPLK

SEQ ID NO: 553534 - protein, 9 aa, Homo Sapiens
FSEIICKEL

SEQ ID NO: 553535 - protein, 9 aa, Homo Sapiens
PPNLVLKEK

SEQ ID NO: 553536 - protein, 9 aa, Homo Sapiens
APLLGASLG

SEQ ID NO: 553537 - protein, 9 aa, Homo Sapiens
RPPPQTNFL

SEQ ID NO: 553538 - protein, 9 aa, Homo Sapiens
YDDDQVAFS

SEQ ID NO: 553539 - protein, 9 aa, Homo Sapiens
TVARCATSS

SEQ ID NO: 553540 - protein, 9 aa, Homo Sapiens
LGASLGGII

SEQ ID NO: 553541 - protein, 9 aa, Homo Sapiens
LNGKLFHKQ

SEQ ID NO: 553542 - protein, 9 aa, Homo Sapiens
SHLCANGST

SEQ ID NO: 553543 - protein, 9 aa, Homo Sapiens
PKKDCQNVQ

SEQ ID NO: 553544 - protein, 9 aa, Homo Sapiens
PLKWKPPIL

SEQ ID NO: 553545 - protein, 9 aa, Homo Sapiens
KLQQQPRKR

SEQ ID NO: 553546 - protein, 9 aa, Homo Sapiens
SEYLMADLF

SEQ ID NO: 553547 - protein, 9 aa, Homo Sapiens
PPIKVHVVY

SEQ ID NO: 553548 - protein, 9 aa, Homo Sapiens
PTPVLPTGQ

SEQ ID NO: 553549 - protein, 9 aa, Homo Sapiens
SVYITEALK

SEQ ID NO: 553550 - protein, 9 aa, Homo Sapiens
EICSHLVCK

SEQ ID NO: 553551 - protein, 9 aa, Homo Sapiens
RRRPRGGAQ

SEQ ID NO: 553552 - protein, 9 aa, Homo Sapiens
EPGLVLTQG

SEQ ID NO: 553553 - protein, 9 aa, Homo Sapiens
VSEYLMADL

SEQ ID NO: 553554 - protein, 9 aa, Homo Sapiens
VGILIYWRI

SEQ ID NO: 553555 - protein, 9 aa, Homo Sapiens
IEEAPAAPL

SEQ ID NO: 553556 - protein, 9 aa, Homo Sapiens
QQQPRKRLE

SEQ ID NO: 553557 - protein, 9 aa, Homo Sapiens
GDPYERPKD

SEQ ID NO: 553558 - protein, 9 aa, Homo Sapiens
ADDSENLLT

SEQ ID NO: 553559 - protein, 9 aa, Homo Sapiens
VLLKPLTTK

SEQ ID NO: 553560 - protein, 9 aa, Homo Sapiens
HLDPSTEYK

SEQ ID NO: 553561 - protein, 9 aa, Homo Sapiens
QSDKEDPIS

SEQ ID NO: 553562 - protein, 9 aa, Homo Sapiens
SFGGGSGFG

SEQ ID NO: 553563 - protein, 9 aa, Homo Sapiens
ILYPLSSKR

SEQ ID NO: 553564 - protein, 9 aa, Homo Sapiens
AMDGLVSAE

SEQ ID NO: 553565 - protein, 9 aa, Homo Sapiens
GIPLIPQQA

SEQ ID NO: 553566 - protein, 9 aa, Homo Sapiens
KPPNLVLKE

SEQ ID NO: 553567 - protein, 9 aa, Homo Sapiens
DLMVSLLVL

SEQ ID NO: 553568 - protein, 9 aa, Homo Sapiens
SDKEDPISK

SEQ ID NO: 553569 - protein, 9 aa, Homo Sapiens
LQSDKEDPI

SEQ ID NO: 553570 - protein, 9 aa, Homo Sapiens
VRILNRGLG

SEQ ID NO: 553571 - protein, 9 aa, Homo Sapiens
ENWAMDGLV

SEQ ID NO: 553572 - protein, 9 aa, Homo Sapiens
WTDACLSHL

SEQ ID NO: 553573 - protein, 9 aa, Homo Sapiens
RVGVETSNR

SEQ ID NO: 553574 - protein, 9 aa, Homo Sapiens
VAPLLGASL

SEQ ID NO: 553575 - protein, 9 aa, Homo Sapiens
ICSHLVCKE

SEQ ID NO: 553576 - protein, 9 aa, Homo Sapiens
TNLESLFLA

SEQ ID NO: 553577 - protein, 9 aa, Homo Sapiens
AHKLTEDFR

SEQ ID NO: 553578 - protein, 9 aa, Homo Sapiens
SVERFLGIL

SEQ ID NO: 553579 - protein, 9 aa, Homo Sapiens
LCANGSTCT

SEQ ID NO: 553580 - protein, 9 aa, Homo Sapiens
HKQKLFVNT

SEQ ID NO: 553581 - protein, 9 aa, Homo Sapiens
KIWKTTQMC

SEQ ID NO: 553582 - protein, 9 aa, Homo Sapiens
LTIFVLDRK

SEQ ID NO: 553583 - protein, 9 aa, Homo Sapiens
YWRICFQTA

SEQ ID NO: 553584 - protein, 9 aa, Homo Sapiens
GEPHPEPFA

SEQ ID NO: 553585 - protein, 9 aa, Homo Sapiens
HSDKSGEID

SEQ ID NO: 553586 - protein, 9 aa, Homo Sapiens
TYSILLGNE

SEQ ID NO: 553587 - protein, 9 aa, Homo Sapiens
SKLLPTHTL

SEQ ID NO: 553588 - protein, 9 aa, Homo Sapiens
NTYRVGDPY

SEQ ID NO: 553589 - protein, 9 aa, Homo Sapiens
FSTWGLSKI

SEQ ID NO: 553590 - protein, 9 aa, Homo Sapiens
VGARLKIPI

SEQ ID NO: 553591 - protein, 9 aa, Homo Sapiens
TYRVGDPYE

SEQ ID NO: 553592 - protein, 9 aa, Homo Sapiens
SPSPGGEPH

SEQ ID NO: 553593 - protein, 9 aa, Homo Sapiens
EEVGARLKI

SEQ ID NO: 553594 - protein, 9 aa, Homo Sapiens
RKLQELADD

SEQ ID NO: 553595 - protein, 9 aa, Homo Sapiens
RPRGGAQGG

SEQ ID NO: 553596 - protein, 9 aa, Homo Sapiens
LLDFEKKCI

SEQ ID NO: 553597 - protein, 9 aa, Homo Sapiens
VILFFFFIF

SEQ ID NO: 553598 - protein, 9 aa, Homo Sapiens
TDLMVSLLV

SEQ ID NO: 553599 - protein, 9 aa, Homo Sapiens
KLQELADDS

SEQ ID NO: 553600 - protein, 9 aa, Homo Sapiens
ETPINLAWT

SEQ ID NO: 553601 - protein, 9 aa, Homo Sapiens
IQRSRKMIV

SEQ ID NO: 553602 - protein, 9 aa, Homo Sapiens
KRITGDWTS

SEQ ID NO: 553603 - protein, 9 aa, Homo Sapiens
DSKYHITFI

SEQ ID NO: 553604 - protein, 9 aa, Homo Sapiens
PLLYDDDQV

SEQ ID NO: 553605 - protein, 9 aa, Homo Sapiens
LSADSKYHI

SEQ ID NO: 553606 - protein, 9 aa, Homo Sapiens
KLLMEWVNA

SEQ ID NO: 553607 - protein, 9 aa, Homo Sapiens
IYWRICFQT

SEQ ID NO: 553608 - protein, 9 aa, Homo Sapiens
ETAEEVGAR

SEQ ID NO: 553609 - protein, 9 aa, Homo Sapiens
FITHFSVYI

SEQ ID NO: 553610 - protein, 9 aa, Homo Sapiens
EWVNAVCAF

SEQ ID NO: 553611 - protein, 9 aa, Homo Sapiens
VLKEKVKPK

SEQ ID NO: 553612 - protein, 9 aa, Homo Sapiens
SLFLAKNKI

SEQ ID NO: 553613 - protein, 9 aa, Homo Sapiens
TSFWHVMSV

SEQ ID NO: 553614 - protein, 9 aa, Homo Sapiens
LPLPPRLLC

SEQ ID NO: 553615 - protein, 9 aa, Homo Sapiens
AVAKPSGHP

SEQ ID NO: 553616 - protein, 9 aa, Homo Sapiens
EAPAAPLDV

SEQ ID NO: 553617 - protein, 9 aa, Homo Sapiens
GDWTSSGRS

SEQ ID NO: 553618 - protein, 9 aa, Homo Sapiens
CKELWVFIT

SEQ ID NO: 553619 - protein, 9 aa, Homo Sapiens
VEKRKFKID

SEQ ID NO: 553620 - protein, 9 aa, Homo Sapiens
NEVKPKKDC

SEQ ID NO: 553621 - protein, 9 aa, Homo Sapiens
PNAHSGGRN

SEQ ID NO: 553622 - protein, 9 aa, Homo Sapiens
QTNFLAPKL

SEQ ID NO: 553623 - protein, 9 aa, Homo Sapiens
PILMLSHDF

SEQ ID NO: 553624 - protein, 9 aa, Homo Sapiens
QQPRKRLEK

SEQ ID NO: 553625 - protein, 9 aa, Homo Sapiens
WTSSGRSTK

SEQ ID NO: 553626 - protein, 9 aa, Homo Sapiens
VRRPSAVAK

SEQ ID NO: 553627 - protein, 9 aa, Homo Sapiens
PSPGGEPHP

SEQ ID NO: 553628 - protein, 9 aa, Homo Sapiens
ADSKYHITF

SEQ ID NO: 553629 - protein, 9 aa, Homo Sapiens
QPRLELWWR

SEQ ID NO: 553630 - protein, 9 aa, Homo Sapiens
DSEGIVRIL

SEQ ID NO: 553631 - protein, 9 aa, Homo Sapiens
IWKTTQMCR

SEQ ID NO: 553632 - protein, 9 aa, Homo Sapiens
ILIYWRICF

SEQ ID NO: 553633 - protein, 9 aa, Homo Sapiens
AQDGVMHPR

SEQ ID NO: 553634 - protein, 9 aa, Homo Sapiens
PSAVAKPSG

SEQ ID NO: 553635 - protein, 9 aa, Homo Sapiens
PSSAPSGPQ

SEQ ID NO: 553636 - protein, 9 aa, Homo Sapiens
PPPPFTSFW

SEQ ID NO: 553637 - protein, 9 aa, Homo Sapiens
AQGGRGRGR

SEQ ID NO: 553638 - protein, 9 aa, Homo Sapiens
ERELPKEFP

SEQ ID NO: 553639 - protein, 9 aa, Homo Sapiens
NIKLLMEWV

SEQ ID NO: 553640 - protein, 9 aa, Homo Sapiens
RFLGILYPL

SEQ ID NO: 553641 - protein, 9 aa, Homo Sapiens
PRLELWWRM

SEQ ID NO: 553642 - protein, 9 aa, Homo Sapiens
EIEEAPAAP

SEQ ID NO: 553643 - protein, 9 aa, Homo Sapiens
NRVGVETSN

SEQ ID NO: 553644 - protein, 9 aa, Homo Sapiens
SHLVCKEHE

SEQ ID NO: 553645 - protein, 9 aa, Homo Sapiens
PQTNFLAPK

SEQ ID NO: 553646 - protein, 9 aa, Homo Sapiens
SSTSSPSTS

SEQ ID NO: 553647 - protein, 9 aa, Homo Sapiens
ACLSHLCAN

SEQ ID NO: 553648 - protein, 9 aa, Homo Sapiens
ARAERVLKL

SEQ ID NO: 553649 - protein, 9 aa, Homo Sapiens
LVLTQGQGD

SEQ ID NO: 553650 - protein, 9 aa, Homo Sapiens
PPPQTNFLA

SEQ ID NO: 553651 - protein, 9 aa, Homo Sapiens
DFSTWGLSK

SEQ ID NO: 553652 - protein, 9 aa, Homo Sapiens
VDLLGVAVG

SEQ ID NO: 553653 - protein, 9 aa, Homo Sapiens
SPGGEPHPE

SEQ ID NO: 553654 - protein, 9 aa, Homo Sapiens
LSHDFSTWG

SEQ ID NO: 553655 - protein, 9 aa, Homo Sapiens
PPILMLSHD

SEQ ID NO: 553656 - protein, 9 aa, Homo Sapiens
GARLKIPIS

SEQ ID NO: 553657 - protein, 9 aa, Homo Sapiens
TAEEVGARL

SEQ ID NO: 553658 - protein, 9 aa, Homo Sapiens
LLPPIKVHV

SEQ ID NO: 553659 - protein, 9 aa, Homo Sapiens
IPKMLANIQ

SEQ ID NO: 553660 - protein, 9 aa, Homo Sapiens
ILMLSHDFS

SEQ ID NO: 553661 - protein, 9 aa, Homo Sapiens
ISVERFLGI

SEQ ID NO: 553662 - protein, 9 aa, Homo Sapiens
KLTEDFRLH

SEQ ID NO: 553663 - protein, 9 aa, Homo Sapiens
GLVSAEPDG

SEQ ID NO: 553664 - protein, 9 aa, Homo Sapiens
FFFPHIRKE

SEQ ID NO: 553665 - protein, 9 aa, Homo Sapiens
LPTHTLRLG

SEQ ID NO: 553666 - protein, 9 aa, Homo Sapiens
LLMEWVNAV

SEQ ID NO: 553667 - protein, 9 aa, Homo Sapiens
VNKEICSHL

SEQ ID NO: 553668 - protein, 9 aa, Homo Sapiens
ETKLDVQRV

SEQ ID NO: 553669 - protein, 9 aa, Homo Sapiens
QMCRKTWSG

SEQ ID NO: 553670 - protein, 9 aa, Homo Sapiens
LALGLVDPR

SEQ ID NO: 553671 - protein, 9 aa, Homo Sapiens
LIPQQAQEL

SEQ ID NO: 553672 - protein, 9 aa, Homo Sapiens
SEGIVRILN

SEQ ID NO: 553673 - protein, 9 aa, Homo Sapiens
LPKEFPLHP

SEQ ID NO: 553674 - protein, 9 aa, Homo Sapiens
GPQPPPPSV

SEQ ID NO: 553675 - protein, 9 aa, Homo Sapiens
SLVKRITGD

SEQ ID NO: 553676 - protein, 9 aa, Homo Sapiens
VVSEYLMAD

SEQ ID NO: 553677 - protein, 9 aa, Homo Sapiens
QELLLKQLG

SEQ ID NO: 553678 - protein, 9 aa, Homo Sapiens
GRSTKIWKT

SEQ ID NO: 553679 - protein, 9 aa, Homo Sapiens
LSHLCANGS

SEQ ID NO: 553680 - protein, 9 aa, Homo Sapiens
QYRVEHLTI

SEQ ID NO: 553681 - protein, 9 aa, Homo Sapiens
HPEPFANSV

SEQ ID NO: 553682 - protein, 9 aa, Homo Sapiens
SDKSGEIDH

SEQ ID NO: 553683 - protein, 9 aa, Homo Sapiens
EEYRGRSPN

SEQ ID NO: 553684 - protein, 9 aa, Homo Sapiens
DVQRVPRNY

SEQ ID NO: 553685 - protein, 9 aa, Homo Sapiens
TKLDVQRVP

SEQ ID NO: 553686 - protein, 9 aa, Homo Sapiens
WGLSKIQPR

SEQ ID NO: 553687 - protein, 9 aa, Homo Sapiens
FGGGSGFGG

SEQ ID NO: 553688 - protein, 9 aa, Homo Sapiens
AFPRRRPTT

SEQ ID NO: 553689 - protein, 9 aa, Homo Sapiens
PHIRKEGRI

SEQ ID NO: 553690 - protein, 9 aa, Homo Sapiens
LKLVSITAN

SEQ ID NO: 553691 - protein, 9 aa, Homo Sapiens
EEGPTPVLP

SEQ ID NO: 553692 - protein, 9 aa, Homo Sapiens
KEAHKLTED

SEQ ID NO: 553693 - protein, 9 aa, Homo Sapiens
RSTKIWKTT

SEQ ID NO: 553694 - protein, 9 aa, Homo Sapiens
IVKIPPLQS

SEQ ID NO: 553695 - protein, 9 aa, Homo Sapiens
FIQRSRKMI

SEQ ID NO: 553696 - protein, 9 aa, Homo Sapiens
DPSTEYKIC

SEQ ID NO: 553697 - protein, 9 aa, Homo Sapiens
PLQSDKEDP

SEQ ID NO: 553698 - protein, 9 aa, Homo Sapiens
DACLSHLCA

SEQ ID NO: 553699 - protein, 9 aa, Homo Sapiens
KEKVKPKQD

SEQ ID NO: 553700 - protein, 9 aa, Homo Sapiens
RSPNAHSGG

SEQ ID NO: 553701 - protein, 9 aa, Homo Sapiens
FSVYITEAL

SEQ ID NO: 553702 - protein, 9 aa, Homo Sapiens
KELWVFITH

SEQ ID NO: 553703 - protein, 9 aa, Homo Sapiens
ESLFLAKNK

SEQ ID NO: 553704 - protein, 9 aa, Homo Sapiens
PPFTSFWHV

SEQ ID NO: 553705 - protein, 9 aa, Homo Sapiens
EYRGRSPNA

SEQ ID NO: 553706 - protein, 9 aa, Homo Sapiens
KSLSKELSA

SEQ ID NO: 553707 - protein, 9 aa, Homo Sapiens
TLLPPIKVH

SEQ ID NO: 553708 - protein, 9 aa, Homo Sapiens
KKDCQNVQQ

SEQ ID NO: 553709 - protein, 9 aa, Homo Sapiens
LTQGQGDVG

SEQ ID NO: 553710 - protein, 9 aa, Homo Sapiens
LKACTVARC

SEQ ID NO: 553711 - protein, 9 aa, Homo Sapiens
VTDLMVSLL

SEQ ID NO: 553712 - protein, 9 aa, Homo Sapiens
LKQLGEGRQ

SEQ ID NO: 553713 - protein, 9 aa, Homo Sapiens
PFTSFWHVM

SEQ ID NO: 553714 - protein, 9 aa, Homo Sapiens
PSTSSPSSS

SEQ ID NO: 553715 - protein, 9 aa, Homo Sapiens
KWKPPILML

SEQ ID NO: 553716 - protein, 9 aa, Homo Sapiens
EYLMADLFL

SEQ ID NO: 553717 - protein, 9 aa, Homo Sapiens
PGLVLTQGQ

SEQ ID NO: 553718 - protein, 9 aa, Homo Sapiens
PTHTLRLGV

SEQ ID NO: 553719 - protein, 9 aa, Homo Sapiens
SSKKRTENR

SEQ ID NO: 553720 - protein, 9 aa, Homo Sapiens
GPTPVLPTG

SEQ ID NO: 553721 - protein, 9 aa, Homo Sapiens
ARCATSSKV

SEQ ID NO: 553722 - protein, 9 aa, Homo Sapiens
STWGLSKIQ

SEQ ID NO: 553723 - protein, 9 aa, Homo Sapiens
LYDDDQVAF

SEQ ID NO: 553724 - protein, 9 aa, Homo Sapiens
RPSAVAKPS

SEQ ID NO: 553725 - protein, 9 aa, Homo Sapiens
GLSKIQPRL

SEQ ID NO: 553726 - protein, 9 aa, Homo Sapiens
QIFLALGLV

SEQ ID NO: 553727 - protein, 9 aa, Homo Sapiens
FWHVMSVIF

SEQ ID NO: 553728 - protein, 9 aa, Homo Sapiens
SLEFFSEII

SEQ ID NO: 553729 - protein, 9 aa, Homo Sapiens
RVGDPYERP

SEQ ID NO: 553730 - protein, 9 aa, Homo Sapiens
KLDVQRVPR

SEQ ID NO: 553731 - protein, 9 aa, Homo Sapiens
NWAMDGLVS

SEQ ID NO: 553732 - protein, 9 aa, Homo Sapiens
HLVCKEHEA

SEQ ID NO: 553733 - protein, 9 aa, Homo Sapiens
PSGPQPPPP

SEQ ID NO: 553734 - protein, 9 aa, Homo Sapiens
LKWKPPILM

SEQ ID NO: 553735 - protein, 9 aa, Homo Sapiens
APSGPQPPP

SEQ ID NO: 553736 - protein, 9 aa, Homo Sapiens
KTTQMCRKT

SEQ ID NO: 553737 - protein, 9 aa, Homo Sapiens
KGLEEGPTP

SEQ ID NO: 553738 - protein, 9 aa, Homo Sapiens
TVLLKPLTT

SEQ ID NO: 553739 - protein, 9 aa, Homo Sapiens
LGEGRQAQV

SEQ ID NO: 553740 - protein, 9 aa, Homo Sapiens
RSRKMIVVL

SEQ ID NO: 553741 - protein, 9 aa, Homo Sapiens
LSKIQPRLE

SEQ ID NO: 553742 - protein, 9 aa, Homo Sapiens
EVKPKKDCQ

SEQ ID NO: 553743 - protein, 9 aa, Homo Sapiens
QVVRSLVKR

SEQ ID NO: 553744 - protein, 9 aa, Homo Sapiens
SGRSTKIWK

SEQ ID NO: 553745 - protein, 9 aa, Homo Sapiens
VLTQGQGDV

SEQ ID NO: 553746 - protein, 9 aa, Homo Sapiens
LLPTHTLRL

SEQ ID NO: 553747 - protein, 9 aa, Homo Sapiens
TQGQGDVGQ

SEQ ID NO: 553748 - protein, 9 aa, Homo Sapiens
QRSRKMIVV

SEQ ID NO: 553749 - protein, 9 aa, Homo Sapiens
LKFFFPHIR

SEQ ID NO: 553750 - protein, 9 aa, Homo Sapiens
SILVDLLGV

SEQ ID NO: 553751 - protein, 9 aa, Homo Sapiens
SSAPSGPQP

SEQ ID NO: 553752 - protein, 9 aa, Homo Sapiens
LGILYPLSS

SEQ ID NO: 553753 - protein, 9 aa, Homo Sapiens
IPLIPQQAQ

SEQ ID NO: 553754 - protein, 9 aa, Homo Sapiens
PNLVLKEKV

SEQ ID NO: 553755 - protein, 9 aa, Homo Sapiens
TNFLAPKLQ

SEQ ID NO: 553756 - protein, 9 aa, Homo Sapiens
YECKRMRRK

SEQ ID NO: 553757 - protein, 9 aa, Homo Sapiens
GLVLTQGQG

SEQ ID NO: 553758 - protein, 9 aa, Homo Sapiens
LMADLFLSL

SEQ ID NO: 553759 - protein, 9 aa, Homo Sapiens
TGDWTSSGR

SEQ ID NO: 553760 - protein, 9 aa, Homo Sapiens
THTLRLGVE

SEQ ID NO: 553761 - protein, 9 aa, Homo Sapiens
VPPPPFTSF

SEQ ID NO: 553762 - protein, 9 aa, Homo Sapiens
ELWVFITHF

SEQ ID NO: 553763 - protein, 9 aa, Homo Sapiens
FPHIRKEGR

SEQ ID NO: 553764 - protein, 9 aa, Homo Sapiens
LIYWRICFQ

SEQ ID NO: 553765 - protein, 9 aa, Homo Sapiens
DKPLYGNDK

SEQ ID NO: 553766 - protein, 9 aa, Homo Sapiens
KIETPINLA

SEQ ID NO: 553767 - protein, 9 aa, Homo Sapiens
ELLLKQLGE

SEQ ID NO: 553768 - protein, 9 aa, Homo Sapiens
HVVYPSEIC

SEQ ID NO: 553769 - protein, 9 aa, Homo Sapiens
STTIPKMLA

SEQ ID NO: 553770 - protein, 9 aa, Homo Sapiens
SLSKELSAE

SEQ ID NO: 553771 - protein, 9 aa, Homo Sapiens
KLVSITANK

SEQ ID NO: 553772 - protein, 9 aa, Homo Sapiens
QLKACTVAR

SEQ ID NO: 553773 - protein, 9 aa, Homo Sapiens
TQIFLALGL

SEQ ID NO: 553774 - protein, 9 aa, Homo Sapiens
TWGLSKIQP

SEQ ID NO: 553775 - protein, 9 aa, Homo Sapiens
VEHLTIFVL

SEQ ID NO: 553776 - protein, 9 aa, Homo Sapiens
CSHLVCKEH

SEQ ID NO: 553777 - protein, 9 aa, Homo Sapiens
VRSLVKRIT

SEQ ID NO: 553778 - protein, 9 aa, Homo Sapiens
RVHSDKSGE

SEQ ID NO: 553779 - protein, 9 aa, Homo Sapiens
LGVAVGHIY

SEQ ID NO: 553780 - protein, 9 aa, Homo Sapiens
LLKQLGEGR

SEQ ID NO: 553781 - protein, 9 aa, Homo Sapiens
YRVGDPYER

SEQ ID NO: 553782 - protein, 9 aa, Homo Sapiens
GKLFHKQKL

SEQ ID NO: 553783 - protein, 9 aa, Homo Sapiens
QKLFVNTSK

SEQ ID NO: 553784 - protein, 9 aa, Homo Sapiens
RSLVKRITG

SEQ ID NO: 553785 - protein, 9 aa, Homo Sapiens
LGIPLIPQQ

SEQ ID NO: 553786 - protein, 9 aa, Homo Sapiens
WRICFQTAH

SEQ ID NO: 553787 - protein, 9 aa, Homo Sapiens
LTEDFRLHF

SEQ ID NO: 553788 - protein, 9 aa, Homo Sapiens
TVRRPSAVA

SEQ ID NO: 553789 - protein, 9 aa, Homo Sapiens
EVEKRKFKI

SEQ ID NO: 553790 - protein, 9 aa, Homo Sapiens
LFLAKNKIT

SEQ ID NO: 553791 - protein, 9 aa, Homo Sapiens
TIPKMLANI

SEQ ID NO: 553792 - protein, 9 aa, Homo Sapiens
RITGDWTSS

SEQ ID NO: 553793 - protein, 9 aa, Homo Sapiens
VYITEALKV

SEQ ID NO: 553794 - protein, 9 aa, Homo Sapiens
FLALGLVDP

SEQ ID NO: 553795 - protein, 9 aa, Homo Sapiens
LLYDDDQVA

SEQ ID NO: 553796 - protein, 9 aa, Homo Sapiens
GKVTYSILL

SEQ ID NO: 553797 - protein, 9 aa, Homo Sapiens
FKGLEEGPT

SEQ ID NO: 553798 - protein, 9 aa, Homo Sapiens
RKFKIDDQR

SEQ ID NO: 553799 - protein, 9 aa, Homo Sapiens
GRSPNAHSG

SEQ ID NO: 553800 - protein, 9 aa, Homo Sapiens
STSSPSTSS

SEQ ID NO: 553801 - protein, 9 aa, Homo Sapiens
VAVGHIYYF

SEQ ID NO: 553802 - protein, 9 aa, Homo Sapiens
ITHFSVYIT

SEQ ID NO: 553803 - protein, 9 aa, Homo Sapiens
QLGEGRQAQ

SEQ ID NO: 553804 - protein, 9 aa, Homo Sapiens
TTVRRPSAV

SEQ ID NO: 553805 - protein, 9 aa, Homo Sapiens
VFITHFSVY

SEQ ID NO: 553806 - protein, 9 aa, Homo Sapiens
SILLGNENM

SEQ ID NO: 553807 - protein, 9 aa, Homo Sapiens
DLLGVAVGH

SEQ ID NO: 553808 - protein, 9 aa, Homo Sapiens
VLKLVSITA

SEQ ID NO: 553809 - protein, 9 aa, Homo Sapiens
KDCQNVQQN

SEQ ID NO: 553810 - protein, 9 aa, Homo Sapiens
GIVRILNRG

SEQ ID NO: 553811 - protein, 9 aa, Homo Sapiens
YWPYLTAEA

SEQ ID NO: 553812 - protein, 9 aa, Homo Sapiens
IQPRLELWW

SEQ ID NO: 553813 - protein, 9 aa, Homo Sapiens
FHKQKLFVN

SEQ ID NO: 553814 - protein, 9 aa, Homo Sapiens
SAVAKPSGH

SEQ ID NO: 553815 - protein, 9 aa, Homo Sapiens
SFADPLYQA

SEQ ID NO: 553816 - protein, 9 aa, Homo Sapiens
LERVHSDKS

SEQ ID NO: 553817 - protein, 9 aa, Homo Sapiens
LDFEKKCIP

SEQ ID NO: 553818 - protein, 9 aa, Homo Sapiens
ADAEIEEAP

SEQ ID NO: 553819 - protein, 9 aa, Homo Sapiens
ELSADSKYH

SEQ ID NO: 553820 - protein, 9 aa, Homo Sapiens
TEPGLVLTQ

SEQ ID NO: 553821 - protein, 9 aa, Homo Sapiens
THFSVYITE

SEQ ID NO: 553822 - protein, 9 aa, Homo Sapiens
KLLPTHTLR

SEQ ID NO: 553823 - protein, 9 aa, Homo Sapiens
KQLGEGRQA

SEQ ID NO: 553824 - protein, 9 aa, Homo Sapiens
EGIVRILNR

SEQ ID NO: 553825 - protein, 9 aa, Homo Sapiens
QPRKRLEKM

SEQ ID NO: 553826 - protein, 9 aa, Homo Sapiens
ERVHSDKSG

SEQ ID NO: 553827 - protein, 9 aa, Homo Sapiens
HDFSTWGLS

SEQ ID NO: 553828 - protein, 9 aa, Homo Sapiens
LLVLPMAAL

SEQ ID NO: 553829 - protein, 9 aa, Homo Sapiens
DLFLSLVAF

SEQ ID NO: 553830 - protein, 9 aa, Homo Sapiens
DCQNVQQNE

SEQ ID NO: 553831 - protein, 9 aa, Homo Sapiens
TDACLSHLC

SEQ ID NO: 553832 - protein, 9 aa, Homo Sapiens
IFLALGLVD

SEQ ID NO: 553833 - protein, 9 aa, Homo Sapiens
FIFAFSSLE

SEQ ID NO: 553834 - protein, 9 aa, Homo Sapiens
TSSPSTSSP

SEQ ID NO: 553835 - protein, 9 aa, Homo Sapiens
KQKLFVNTS

SEQ ID NO: 553836 - protein, 9 aa, Homo Sapiens
LYGNDKFEG

SEQ ID NO: 553837 - protein, 9 aa, Homo Sapiens
ERVLKLVSI

SEQ ID NO: 553838 - protein, 9 aa, Homo Sapiens
GNDKFEGYC

SEQ ID NO: 553839 - protein, 9 aa, Homo Sapiens
YSKLLPTHT

SEQ ID NO: 553840 - protein, 9 aa, Homo Sapiens
ERFLGILYP

SEQ ID NO: 553841 - protein, 9 aa, Homo Sapiens
EAHKLTEDF

SEQ ID NO: 553842 - protein, 9 aa, Homo Sapiens
AVTDLMVSL

SEQ ID NO: 553843 - protein, 9 aa, Homo Sapiens
LESLFLAKN

SEQ ID NO: 553844 - protein, 9 aa, Homo Sapiens
SAPSGPQPP

SEQ ID NO: 553845 - protein, 9 aa, Homo Sapiens
DLIRLVAYA

SEQ ID NO: 553846 - protein, 9 aa, Homo Sapiens
EKKCIPLKW

SEQ ID NO: 553847 - protein, 9 aa, Homo Sapiens
VHSDKSGEI

SEQ ID NO: 553848 - protein, 9 aa, Homo Sapiens
IRKEGRIYP

SEQ ID NO: 553849 - protein, 9 aa, Homo Sapiens
FFSEIICKE

SEQ ID NO: 553850 - protein, 9 aa, Homo Sapiens
PLPPRLLCY

SEQ ID NO: 553851 - protein, 9 aa, Homo Sapiens
EFFSEIICK

SEQ ID NO: 553852 - protein, 9 aa, Homo Sapiens
AKNKITKLQ

SEQ ID NO: 553853 - protein, 9 aa, Homo Sapiens
CTVARCATS

SEQ ID NO: 553854 - protein, 9 aa, Homo Sapiens
GGAQGGRGR

SEQ ID NO: 553855 - protein, 9 aa, Homo Sapiens
ECKRMRRKL

SEQ ID NO: 553856 - protein, 9 aa, Homo Sapiens
KVHVVYPSE

SEQ ID NO: 553857 - protein, 9 aa, Homo Sapiens
DPLYQAGLA

SEQ ID NO: 553858 - protein, 9 aa, Homo Sapiens
VGDPYERPK

SEQ ID NO: 553859 - protein, 9 aa, Homo Sapiens
GILIYWRIC

SEQ ID NO: 553860 - protein, 9 aa, Homo Sapiens
NLTHLDPST

SEQ ID NO: 553861 - protein, 9 aa, Homo Sapiens
ITEERELPK

SEQ ID NO: 553862 - protein, 9 aa, Homo Sapiens
YSILLGNEN

SEQ ID NO: 553863 - protein, 9 aa, Homo Sapiens
KFEGYCLDL

SEQ ID NO: 553864 - protein, 9 aa, Homo Sapiens
NDKFEGYCL

SEQ ID NO: 553865 - protein, 9 aa, Homo Sapiens
LWVFITHFS

SEQ ID NO: 553866 - protein, 9 aa, Homo Sapiens
LVDLLGVAV

SEQ ID NO: 553867 - protein, 9 aa, Homo Sapiens
TEERELPKE

SEQ ID NO: 553868 - protein, 9 aa, Homo Sapiens
ADPLYQAGL

SEQ ID NO: 553869 - protein, 9 aa, Homo Sapiens
LYQAGLADD

SEQ ID NO: 553870 - protein, 9 aa, Homo Sapiens
TPVLPTGQG

SEQ ID NO: 553871 - protein, 9 aa, Homo Sapiens
LQELADDSE

SEQ ID NO: 553872 - protein, 9 aa, Homo Sapiens
KKEAHKLTE

SEQ ID NO: 553873 - protein, 9 aa, Homo Sapiens
GGEPHPEPF

SEQ ID NO: 553874 - protein, 9 aa, Homo Sapiens
KEEVEKRKF

SEQ ID NO: 553875 - protein, 9 aa, Homo Sapiens
SPSTSSPSS

SEQ ID NO: 553876 - protein, 9 aa, Homo Sapiens
IKTQIFLAL

SEQ ID NO: 553877 - protein, 9 aa, Homo Sapiens
VKSLSKELS

SEQ ID NO: 553878 - protein, 9 aa, Homo Sapiens
FFIFAFSSL

SEQ ID NO: 553879 - protein, 9 aa, Homo Sapiens
ELPKEFPLH

SEQ ID NO: 553880 - protein, 9 aa, Homo Sapiens
TLLSSTTIP

SEQ ID NO: 553881 - protein, 9 aa, Homo Sapiens
KTQIFLALG

SEQ ID NO: 553882 - protein, 9 aa, Homo Sapiens
SKYHITFIN

SEQ ID NO: 553883 - protein, 9 aa, Homo Sapiens
QPPPPSVLG

SEQ ID NO: 553884 - protein, 9 aa, Homo Sapiens
AINPLLYDD

SEQ ID NO: 553885 - protein, 9 aa, Homo Sapiens
RRPSAVAKP

SEQ ID NO: 553886 - protein, 9 aa, Homo Sapiens
AFSSLEFFS

SEQ ID NO: 553887 - protein, 9 aa, Homo Sapiens
ILLGNENMT

SEQ ID NO: 553888 - protein, 9 aa, Homo Sapiens
DKSGEIDHH

SEQ ID NO: 553889 - protein, 9 aa, Homo Sapiens
VARCATSSK

SEQ ID NO: 553890 - protein, 9 aa, Homo Sapiens
SSPSTSSPS

SEQ ID NO: 553891 - protein, 9 aa, Homo Sapiens
IVRILNRGL

SEQ ID NO: 553892 - protein, 9 aa, Homo Sapiens
LTHLDPSTE

SEQ ID NO: 553893 - protein, 9 aa, Homo Sapiens
KPKKDCQNV

SEQ ID NO: 553894 - protein, 9 aa, Homo Sapiens
GILYPLSSK

SEQ ID NO: 553895 - protein, 9 aa, Homo Sapiens
PLYQAGLAD

SEQ ID NO: 553896 - protein, 9 aa, Homo Sapiens
LPPIKVHVV

SEQ ID NO: 553897 - protein, 9 aa, Homo Sapiens
VERFLGILY

SEQ ID NO: 553898 - protein, 9 aa, Homo Sapiens
ILFFFFIFA

SEQ ID NO: 553899 - protein, 9 aa, Homo Sapiens
QGGRGRGRA

SEQ ID NO: 553900 - protein, 9 aa, Homo Sapiens
YVRETKLDV

SEQ ID NO: 553901 - protein, 9 aa, Homo Sapiens
LVLKEKVKP

SEQ ID NO: 553902 - protein, 9 aa, Homo Sapiens
DKKEAHKLT

SEQ ID NO: 553903 - protein, 9 aa, Homo Sapiens
RRPRGGAQG

SEQ ID NO: 553904 - protein, 9 aa, Homo Sapiens
YRPPPQTNF

SEQ ID NO: 553905 - protein, 9 aa, Homo Sapiens
THLDPSTEY

SEQ ID NO: 553906 - protein, 9 aa, Homo Sapiens
EIICKELWV

SEQ ID NO: 553907 - protein, 9 aa, Homo Sapiens
VHVVYPSEI

SEQ ID NO: 553908 - protein, 9 aa, Homo Sapiens
GARAERVLK

SEQ ID NO: 553909 - protein, 9 aa, Homo Sapiens
ELADDSENL

SEQ ID NO: 553910 - protein, 9 aa, Homo Sapiens
ACTVARCAT

SEQ ID NO: 553911 - protein, 9 aa, Homo Sapiens
KYHITFINK

SEQ ID NO: 553912 - protein, 9 aa, Homo Sapiens
TSSGRSTKI

SEQ ID NO: 553913 - protein, 9 aa, Homo Sapiens
PPRLLCYLQ

SEQ ID NO: 553914 - protein, 9 aa, Homo Sapiens
LEEGPTPVL

SEQ ID NO: 553915 - protein, 9 aa, Homo Sapiens
VKPKKDCQN

SEQ ID NO: 553916 - protein, 9 aa, Homo Sapiens
WAMDGLVSA

SEQ ID NO: 553917 - protein, 9 aa, Homo Sapiens
YRGRSPNAH

SEQ ID NO: 553918 - protein, 9 aa, Homo Sapiens
EKPYECKRM

SEQ ID NO: 553919 - protein, 9 aa, Homo Sapiens
RGGAQGGRG

SEQ ID NO: 553920 - protein, 9 aa, Homo Sapiens
YAQDGVMHP

SEQ ID NO: 553921 - protein, 9 aa, Homo Sapiens
KIPPLQSDK

SEQ ID NO: 553922 - protein, 9 aa, Homo Sapiens
NLVLKEKVK

SEQ ID NO: 553923 - protein, 9 aa, Homo Sapiens
VSFADPLYQ

SEQ ID NO: 553924 - protein, 9 aa, Homo Sapiens
LAKNKITKL

SEQ ID NO: 553925 - protein, 9 aa, Homo Sapiens
PPLQSDKED

SEQ ID NO: 553926 - protein, 9 aa, Homo Sapiens
LPPRLLCYL

SEQ ID NO: 553927 - protein, 9 aa, Homo Sapiens
AEIEEAPAA

SEQ ID NO: 553928 - protein, 9 aa, Homo Sapiens
ENRVGVETS

SEQ ID NO: 553929 - protein, 9 aa, Homo Sapiens
LADDSENLL

SEQ ID NO: 553930 - protein, 9 aa, Homo Sapiens
NKEICSHLV

SEQ ID NO: 553931 - protein, 9 aa, Homo Sapiens
VDSEGIVRI

SEQ ID NO: 553932 - protein, 9 aa, Homo Sapiens
LKEKVKPKQ

SEQ ID NO: 553933 - protein, 9 aa, Homo Sapiens
DPYERPKDS

SEQ ID NO: 553934 - protein, 9 aa, Homo Sapiens
ILVDLLGVA

SEQ ID NO: 553935 - protein, 9 aa, Homo Sapiens
LCYLQLDFE

SEQ ID NO: 553936 - protein, 9 aa, Homo Sapiens
TQMCRKTWS

SEQ ID NO: 553937 - protein, 9 aa, Homo Sapiens
KVYNLTHLD

SEQ ID NO: 553938 - protein, 9 aa, Homo Sapiens
LDPSTEYKI

SEQ ID NO: 553939 - protein, 9 aa, Homo Sapiens
TTIPKMLAN

SEQ ID NO: 553940 - protein, 9 aa, Homo Sapiens
SSTTIPKML

SEQ ID NO: 553941 - protein, 9 aa, Homo Sapiens
RRVSFADPL

SEQ ID NO: 553942 - protein, 9 aa, Homo Sapiens
PHPEPFANS

SEQ ID NO: 553943 - protein, 9 aa, Homo Sapiens
KYSKLLPTH

SEQ ID NO: 553944 - protein, 9 aa, Homo Sapiens
VVAPLLGAS

SEQ ID NO: 553945 - protein, 9 aa, Homo Sapiens
SKIQPRLEL

SEQ ID NO: 553946 - protein, 9 aa, Homo Sapiens
GLEEGPTPV

SEQ ID NO: 553947 - protein, 9 aa, Homo Sapiens
FLAPKLQFQ

SEQ ID NO: 553948 - protein, 9 aa, Homo Sapiens
VKRITGDWT

SEQ ID NO: 553949 - protein, 9 aa, Homo Sapiens
FFFFIFAFS

SEQ ID NO: 553950 - protein, 9 aa, Homo Sapiens
LVKRITGDW

SEQ ID NO: 553951 - protein, 9 aa, Homo Sapiens
FFFIFAFSS

SEQ ID NO: 553952 - protein, 9 aa, Homo Sapiens
TETAEEVGA

SEQ ID NO: 553953 - protein, 9 aa, Homo Sapiens
QGQGDVGQL

SEQ ID NO: 553954 - protein, 9 aa, Homo Sapiens
VVRSLVKRI

SEQ ID NO: 553955 - protein, 9 aa, Homo Sapiens
ADLFLSLVA

SEQ ID NO: 553956 - protein, 9 aa, Homo Sapiens
KKCIPLKWK

SEQ ID NO: 553957 - protein, 9 aa, Homo Sapiens
GVAVGHIYY

SEQ ID NO: 553958 - protein, 9 aa, Homo Sapiens
KACTVARCA

SEQ ID NO: 553959 - protein, 9 aa, Homo Sapiens
KIQPRLELW

SEQ ID NO: 553960 - protein, 9 aa, Homo Sapiens
KCIPLKWKP

SEQ ID NO: 553961 - protein, 9 aa, Homo Sapiens
RVLKLVSIT

SEQ ID NO: 553962 - protein, 9 aa, Homo Sapiens
NPLLYDDDQ

SEQ ID NO: 553963 - protein, 9 aa, Homo Sapiens
FGGGFGGGG

SEQ ID NO: 553964 - protein, 9 aa, Homo Sapiens
RCATSSKVV

SEQ ID NO: 553965 - protein, 9 aa, Homo Sapiens
EENWAMDGL

SEQ ID NO: 553966 - protein, 9 aa, Homo Sapiens
INPLLYDDD

SEQ ID NO: 553967 - protein, 9 aa, Homo Sapiens
EGPTPVLPT

SEQ ID NO: 553968 - protein, 9 aa, Homo Sapiens
LFFFFIFAF

SEQ ID NO: 553969 - protein, 9 aa, Homo Sapiens
KAINPLLYD

SEQ ID NO: 553970 - protein, 9 aa, Homo Sapiens
KPYECKRMR

SEQ ID NO: 553971 - protein, 9 aa, Homo Sapiens
VQRVPRNYD

SEQ ID NO: 553972 - protein, 9 aa, Homo Sapiens
GTETAEEVG

SEQ ID NO: 553973 - protein, 9 aa, Homo Sapiens
KLLDFEKKC

SEQ ID NO: 553974 - protein, 9 aa, Homo Sapiens
PRLLCYLQL

SEQ ID NO: 553975 - protein, 9 aa, Homo Sapiens
GGSGFGGGF

SEQ ID NO: 553976 - protein, 9 aa, Homo Sapiens
PPQTNFLAP

SEQ ID NO: 553977 - protein, 9 aa, Homo Sapiens
WVFITHFSV

SEQ ID NO: 553978 - protein, 9 aa, Homo Sapiens
YRVEHLTIF

SEQ ID NO: 553979 - protein, 9 aa, Homo Sapiens
DSENLLTEN

SEQ ID NO: 553980 - protein, 9 aa, Homo Sapiens
LEFFSEIIC

SEQ ID NO: 553981 - protein, 9 aa, Homo Sapiens
SLGGIIYLV

SEQ ID NO: 553982 - protein, 9 aa, Homo Sapiens
LMEWVNAVC

SEQ ID NO: 553983 - protein, 9 aa, Homo Sapiens
VKIPPLQSD

SEQ ID NO: 553984 - protein, 9 aa, Homo Sapiens
SRKMIVVLS

SEQ ID NO: 553985 - protein, 9 aa, Homo Sapiens
SPNAHSGGR

SEQ ID NO: 553986 - protein, 9 aa, Homo Sapiens
KRLEKMKKE

SEQ ID NO: 553987 - protein, 9 aa, Homo Sapiens
TIFVLDRKD

SEQ ID NO: 553988 - protein, 9 aa, Homo Sapiens
MDGLVSAEP

SEQ ID NO: 553989 - protein, 9 aa, Homo Sapiens
LMVSLLVLP

SEQ ID NO: 553990 - protein, 9 aa, Homo Sapiens
AEEVGARLK

SEQ ID NO: 553991 - protein, 9 aa, Homo Sapiens
IFVLDRKDA

SEQ ID NO: 553992 - protein, 9 aa, Homo Sapiens
VRETKLDVQ

SEQ ID NO: 553993 - protein, 9 aa, Homo Sapiens
LFHKQKLFV

SEQ ID NO: 553994 - protein, 9 aa, Homo Sapiens
VAYAQDGVM

SEQ ID NO: 553995 - protein, 9 aa, Homo Sapiens
RKRLEKMKK

SEQ ID NO: 553996 - protein, 9 aa, Homo Sapiens
EHLTIFVLD

SEQ ID NO: 553997 - protein, 9 aa, Homo Sapiens
DLKFFFPHI

SEQ ID NO: 553998 - protein, 9 aa, Homo Sapiens
MEWVNAVCA

SEQ ID NO: 553999 - protein, 9 aa, Homo Sapiens
PGGEPHPEP

SEQ ID NO: 554000 - protein, 9 aa, Homo Sapiens
NEKIETPIN

SEQ ID NO: 554001 - protein, 9 aa, Homo Sapiens
RELPKEFPL

SEQ ID NO: 554002 - protein, 9 aa, Homo Sapiens
RTENRVGVE

SEQ ID NO: 554003 - protein, 9 aa, Homo Sapiens
SENIKLLME

SEQ ID NO: 554004 - protein, 9 aa, Homo Sapiens
RAERVLKLV

SEQ ID NO: 554005 - protein, 9 aa, Homo Sapiens
LDVQRVPRN

SEQ ID NO: 554006 - protein, 9 aa, Homo Sapiens
KPPILMLSH

SEQ ID NO: 554007 - protein, 9 aa, Homo Sapiens
FSSLEFFSE

SEQ ID NO: 554008 - protein, 9 aa, Homo Sapiens
IPLKWKPPI

SEQ ID NO: 554009 - protein, 9 aa, Homo Sapiens
YGNDKFEGY

SEQ ID NO: 554010 - protein, 9 aa, Homo Sapiens
NLESLFLAK

SEQ ID NO: 554011 - protein, 9 aa, Homo Sapiens
IFAFSSLEF

SEQ ID NO: 554012 - protein, 9 aa, Homo Sapiens
HFSVYITEA

SEQ ID NO: 554013 - protein, 9 aa, Homo Sapiens
EKIETPINL

SEQ ID NO: 554014 - protein, 9 aa, Homo Sapiens
FADPLYQAG

SEQ ID NO: 554015 - protein, 9 aa, Homo Sapiens
IRLVAYAQD

SEQ ID NO: 554016 - protein, 9 aa, Homo Sapiens
PLIPQQAQE

SEQ ID NO: 554017 - protein, 9 aa, Homo Sapiens
MLSHDFSTW

SEQ ID NO: 554018 - protein, 9 aa, Homo Sapiens
CQNVQQNED

SEQ ID NO: 554019 - protein, 9 aa, Homo Sapiens
PGAASLMSC

SEQ ID NO: 554020 - protein, 9 aa, Homo Sapiens
KVLILNYPQ

SEQ ID NO: 554021 - protein, 9 aa, Homo Sapiens
HKVITKMTK

SEQ ID NO: 554022 - protein, 9 aa, Homo Sapiens
PGLKLWLHM

SEQ ID NO: 554023 - protein, 9 aa, Homo Sapiens
EDDKYNTGI

SEQ ID NO: 554024 - protein, 9 aa, Homo Sapiens
QLRSREQSR

SEQ ID NO: 554025 - protein, 9 aa, Homo Sapiens
PCLQGQRPT

SEQ ID NO: 554026 - protein, 9 aa, Homo Sapiens
SRLQPVVQP

SEQ ID NO: 554027 - protein, 9 aa, Homo Sapiens
QGVCRPNGP

SEQ ID NO: 554028 - protein, 9 aa, Homo Sapiens
SRPVLSRLL

SEQ ID NO: 554029 - protein, 9 aa, Homo Sapiens
ILHRPEDNI

SEQ ID NO: 554030 - protein, 9 aa, Homo Sapiens
MEAHKVITK

SEQ ID NO: 554031 - protein, 9 aa, Homo Sapiens
ARGRTRAKP

SEQ ID NO: 554032 - protein, 9 aa, Homo Sapiens
SRQIYDPKY

SEQ ID NO: 554033 - protein, 9 aa, Homo Sapiens
GVCRPNGPK

SEQ ID NO: 554034 - protein, 9 aa, Homo Sapiens
GIKRREEFD

SEQ ID NO: 554035 - protein, 9 aa, Homo Sapiens
TVIRGMAGS

SEQ ID NO: 554036 - protein, 9 aa, Homo Sapiens
TLLAQHPAR

SEQ ID NO: 554037 - protein, 9 aa, Homo Sapiens
QRRMGPSKQ

SEQ ID NO: 554038 - protein, 9 aa, Homo Sapiens
KPGLKLWLH

SEQ ID NO: 554039 - protein, 9 aa, Homo Sapiens
ILNYPQTAV

SEQ ID NO: 554040 - protein, 9 aa, Homo Sapiens
VPEGAWNDT

SEQ ID NO: 554041 - protein, 9 aa, Homo Sapiens
FTPCLQGQR

SEQ ID NO: 554042 - protein, 9 aa, Homo Sapiens
AVRVTLNIN

SEQ ID NO: 554043 - protein, 9 aa, Homo Sapiens
SGQVFGLSR

SEQ ID NO: 554044 - protein, 9 aa, Homo Sapiens
QAVRVTLNI

SEQ ID NO: 554045 - protein, 9 aa, Homo Sapiens
RAEDFISNM

SEQ ID NO: 554046 - protein, 9 aa, Homo Sapiens
VRVTLNINR

SEQ ID NO: 554047 - protein, 9 aa, Homo Sapiens
FGVVRTSTS

SEQ ID NO: 554048 - protein, 9 aa, Homo Sapiens
ERITFSFAF

SEQ ID NO: 554049 - protein, 9 aa, Homo Sapiens
DLGDNYNSM

SEQ ID NO: 554050 - protein, 9 aa, Homo Sapiens
KYNTGIIEE

SEQ ID NO: 554051 - protein, 9 aa, Homo Sapiens
NTGIIEENW

SEQ ID NO: 554052 - protein, 9 aa, Homo Sapiens
ECDVMTDVR

SEQ ID NO: 554053 - protein, 9 aa, Homo Sapiens
GIIVFFKSK

SEQ ID NO: 554054 - protein, 9 aa, Homo Sapiens
AEIVPGSCC

SEQ ID NO: 554055 - protein, 9 aa, Homo Sapiens
RLLLKAELW

SEQ ID NO: 554056 - protein, 9 aa, Homo Sapiens
MSTSKTCKH

SEQ ID NO: 554057 - protein, 9 aa, Homo Sapiens
NFQAVRVTL

SEQ ID NO: 554058 - protein, 9 aa, Homo Sapiens
LAAMGYDGY

SEQ ID NO: 554059 - protein, 9 aa, Homo Sapiens
PNELAIKSW

SEQ ID NO: 554060 - protein, 9 aa, Homo Sapiens
GNLPDRQNS

SEQ ID NO: 554061 - protein, 9 aa, Homo Sapiens
RMGPSKQHL

SEQ ID NO: 554062 - protein, 9 aa, Homo Sapiens
GSCCGATVL

SEQ ID NO: 554063 - protein, 9 aa, Homo Sapiens
AWNDTAQLH

SEQ ID NO: 554064 - protein, 9 aa, Homo Sapiens
DEDCSDQSD

SEQ ID NO: 554065 - protein, 9 aa, Homo Sapiens
LTSNFQAVR

SEQ ID NO: 554066 - protein, 9 aa, Homo Sapiens
RITFSFAFN

SEQ ID NO: 554067 - protein, 9 aa, Homo Sapiens
GVVRTSTSD

SEQ ID NO: 554068 - protein, 9 aa, Homo Sapiens
GAVPEGAWN

SEQ ID NO: 554069 - protein, 9 aa, Homo Sapiens
IERITFSFA

SEQ ID NO: 554070 - protein, 9 aa, Homo Sapiens
KVITKMTKE

SEQ ID NO: 554071 - protein, 9 aa, Homo Sapiens
GLRVRAGPR

SEQ ID NO: 554072 - protein, 9 aa, Homo Sapiens
RPVLSRLLL

SEQ ID NO: 554073 - protein, 9 aa, Homo Sapiens
VRTSTSDRL

SEQ ID NO: 554074 - protein, 9 aa, Homo Sapiens
GDNYNSMED

SEQ ID NO: 554075 - protein, 9 aa, Homo Sapiens
LSRQIYDPK

SEQ ID NO: 554076 - protein, 9 aa, Homo Sapiens
NSNPNELAI

SEQ ID NO: 554077 - protein, 9 aa, Homo Sapiens
VVQPLPSPG

SEQ ID NO: 554078 - protein, 9 aa, Homo Sapiens
HMINVQAQL

SEQ ID NO: 554079 - protein, 9 aa, Homo Sapiens
QAKQVERHT

SEQ ID NO: 554080 - protein, 9 aa, Homo Sapiens
STSKTCKHG

SEQ ID NO: 554081 - protein, 9 aa, Homo Sapiens
TECDVMTDV

SEQ ID NO: 554082 - protein, 9 aa, Homo Sapiens
VERHTQHQL

SEQ ID NO: 554083 - protein, 9 aa, Homo Sapiens
RLQPVVQPL

SEQ ID NO: 554084 - protein, 9 aa, Homo Sapiens
FQRAEDFIS

SEQ ID NO: 554085 - protein, 9 aa, Homo Sapiens
RKVLILNYP

SEQ ID NO: 554086 - protein, 9 aa, Homo Sapiens
TTEKKPPLP

SEQ ID NO: 554087 - protein, 9 aa, Homo Sapiens
LLAPGAASL

SEQ ID NO: 554088 - protein, 9 aa, Homo Sapiens
LGDNYNSME

SEQ ID NO: 554089 - protein, 9 aa, Homo Sapiens
YNTGIIEEN

SEQ ID NO: 554090 - protein, 9 aa, Homo Sapiens
FQAVRVTLN

SEQ ID NO: 554091 - protein, 9 aa, Homo Sapiens
KQPSDTAKG

SEQ ID NO: 554092 - protein, 9 aa, Homo Sapiens
TKVIAPWRM

SEQ ID NO: 554093 - protein, 9 aa, Homo Sapiens
NPITVIRGM

SEQ ID NO: 554094 - protein, 9 aa, Homo Sapiens
VIVVSIAYG

SEQ ID NO: 554095 - protein, 9 aa, Homo Sapiens
INVQAQLRS

SEQ ID NO: 554096 - protein, 9 aa, Homo Sapiens
KTCKHGHAK

SEQ ID NO: 554097 - protein, 9 aa, Homo Sapiens
PEEGYRQAQ

SEQ ID NO: 554098 - protein, 9 aa, Homo Sapiens
RAKSSGLRV

SEQ ID NO: 554099 - protein, 9 aa, Homo Sapiens
TQHQLGGFL

SEQ ID NO: 554100 - protein, 9 aa, Homo Sapiens
HPARGRTRA

SEQ ID NO: 554101 - protein, 9 aa, Homo Sapiens
AQLRSREQS

SEQ ID NO: 554102 - protein, 9 aa, Homo Sapiens
SRPASFLLL

SEQ ID NO: 554103 - protein, 9 aa, Homo Sapiens
VVRTSTSDR

SEQ ID NO: 554104 - protein, 9 aa, Homo Sapiens
EAHKVITKM

SEQ ID NO: 554105 - protein, 9 aa, Homo Sapiens
CLQGQRPTT

SEQ ID NO: 554106 - protein, 9 aa, Homo Sapiens
VLTSNFQAV

SEQ ID NO: 554107 - protein, 9 aa, Homo Sapiens
LLAQHPARG

SEQ ID NO: 554108 - protein, 9 aa, Homo Sapiens
LLRDGIKRR

SEQ ID NO: 554109 - protein, 9 aa, Homo Sapiens
HRPEDNIRL

SEQ ID NO: 554110 - protein, 9 aa, Homo Sapiens
KPPLPELDM

SEQ ID NO: 554111 - protein, 9 aa, Homo Sapiens
TCKHGHAKV

SEQ ID NO: 554112 - protein, 9 aa, Homo Sapiens
CKHGHAKVH

SEQ ID NO: 554113 - protein, 9 aa, Homo Sapiens
AASLMSCSQ

SEQ ID NO: 554114 - protein, 9 aa, Homo Sapiens
HDEDCSDQS

SEQ ID NO: 554115 - protein, 9 aa, Homo Sapiens
MGIIVFFKS

SEQ ID NO: 554116 - protein, 9 aa, Homo Sapiens
STSDRLTLA

SEQ ID NO: 554117 - protein, 9 aa, Homo Sapiens
SLMSCSQPG

SEQ ID NO: 554118 - protein, 9 aa, Homo Sapiens
LMSCSQPGQ

SEQ ID NO: 554119 - protein, 9 aa, Homo Sapiens
PPLPELDMA

SEQ ID NO: 554120 - protein, 9 aa, Homo Sapiens
LKLWLHMED

SEQ ID NO: 554121 - protein, 9 aa, Homo Sapiens
DDKYNTGII

SEQ ID NO: 554122 - protein, 9 aa, Homo Sapiens
IINSNPNEL

SEQ ID NO: 554123 - protein, 9 aa, Homo Sapiens
GPKLNLPGL

SEQ ID NO: 554124 - protein, 9 aa, Homo Sapiens
EECIERITF

SEQ ID NO: 554125 - protein, 9 aa, Homo Sapiens
WNDTAQLHK

SEQ ID NO: 554126 - protein, 9 aa, Homo Sapiens
PTWNDLGDN

SEQ ID NO: 554127 - protein, 9 aa, Homo Sapiens
SPGNLPDRQ

SEQ ID NO: 554128 - protein, 9 aa, Homo Sapiens
SGEEGQLHY

SEQ ID NO: 554129 - protein, 9 aa, Homo Sapiens
AHKVITKMT

SEQ ID NO: 554130 - protein, 9 aa, Homo Sapiens
APGAASLMS

SEQ ID NO: 554131 - protein, 9 aa, Homo Sapiens
TSTSDRLTL

SEQ ID NO: 554132 - protein, 9 aa, Homo Sapiens
QRAEDFISN

SEQ ID NO: 554133 - protein, 9 aa, Homo Sapiens
PQTKVIAPW

SEQ ID NO: 554134 - protein, 9 aa, Homo Sapiens
GLKLWLHME

SEQ ID NO: 554135 - protein, 9 aa, Homo Sapiens
SSQRRMGPS

SEQ ID NO: 554136 - protein, 9 aa, Homo Sapiens
YDGYMAICN

SEQ ID NO: 554137 - protein, 9 aa, Homo Sapiens
NDLGDNYNS

SEQ ID NO: 554138 - protein, 9 aa, Homo Sapiens
RGRTRAKPG

SEQ ID NO: 554139 - protein, 9 aa, Homo Sapiens
ALCGVVMGI

SEQ ID NO: 554140 - protein, 9 aa, Homo Sapiens
PGSCCGATV

SEQ ID NO: 554141 - protein, 9 aa, Homo Sapiens
RGMAGSLRL

SEQ ID NO: 554142 - protein, 9 aa, Homo Sapiens
QSGQVFGLS

SEQ ID NO: 554143 - protein, 9 aa, Homo Sapiens
RHTQHQLGG

SEQ ID NO: 554144 - protein, 9 aa, Homo Sapiens
NVQAQLRSR

SEQ ID NO: 554145 - protein, 9 aa, Homo Sapiens
VEMSTSKTC

SEQ ID NO: 554146 - protein, 9 aa, Homo Sapiens
VFGLSRQIY

SEQ ID NO: 554147 - protein, 9 aa, Homo Sapiens
WLHMEDARR

SEQ ID NO: 554148 - protein, 9 aa, Homo Sapiens
SCYSLAPQT

SEQ ID NO: 554149 - protein, 9 aa, Homo Sapiens
SSGLRVRAG

SEQ ID NO: 554150 - protein, 9 aa, Homo Sapiens
LCGVVMGII

SEQ ID NO: 554151 - protein, 9 aa, Homo Sapiens
QVFGLSRQI

SEQ ID NO: 554152 - protein, 9 aa, Homo Sapiens
INSNPNELA

SEQ ID NO: 554153 - protein, 9 aa, Homo Sapiens
RVRAGPRLG

SEQ ID NO: 554154 - protein, 9 aa, Homo Sapiens
AMGYDGYMA

SEQ ID NO: 554155 - protein, 9 aa, Homo Sapiens
VPGSCCGAT

SEQ ID NO: 554156 - protein, 9 aa, Homo Sapiens
EGAWNDTAQ

SEQ ID NO: 554157 - protein, 9 aa, Homo Sapiens
KKPPLPELD

SEQ ID NO: 554158 - protein, 9 aa, Homo Sapiens
DVEASPGNL

SEQ ID NO: 554159 - protein, 9 aa, Homo Sapiens
VCRPNGPKL

SEQ ID NO: 554160 - protein, 9 aa, Homo Sapiens
VIRGMAGSL

SEQ ID NO: 554161 - protein, 9 aa, Homo Sapiens
DCSDQSDLS

SEQ ID NO: 554162 - protein, 9 aa, Homo Sapiens
TGIIEENWQ

SEQ ID NO: 554163 - protein, 9 aa, Homo Sapiens
FAIINSNPN

SEQ ID NO: 554164 - protein, 9 aa, Homo Sapiens
YRQAQAPIA

SEQ ID NO: 554165 - protein, 9 aa, Homo Sapiens
GYRQAQAPI

SEQ ID NO: 554166 - protein, 9 aa, Homo Sapiens
ASLMSCSQP

SEQ ID NO: 554167 - protein, 9 aa, Homo Sapiens
TEKKPPLPE

SEQ ID NO: 554168 - protein, 9 aa, Homo Sapiens
TSKTCKHGH

SEQ ID NO: 554169 - protein, 9 aa, Homo Sapiens
LRVRAGPRL

SEQ ID NO: 554170 - protein, 9 aa, Homo Sapiens
VEASPGNLP

SEQ ID NO: 554171 - protein, 9 aa, Homo Sapiens
TPCLQGQRP

SEQ ID NO: 554172 - protein, 9 aa, Homo Sapiens
PKLNLPGLR

SEQ ID NO: 554173 - protein, 9 aa, Homo Sapiens
IMEAHKVIT

SEQ ID NO: 554174 - protein, 9 aa, Homo Sapiens
DVVTLLRDG

SEQ ID NO: 554175 - protein, 9 aa, Homo Sapiens
RMGSSQRRM

SEQ ID NO: 554176 - protein, 9 aa, Homo Sapiens
SLAPQTKVI

SEQ ID NO: 554177 - protein, 9 aa, Homo Sapiens
QPVVQPLPS

SEQ ID NO: 554178 - protein, 9 aa, Homo Sapiens
PASFLLLLS

SEQ ID NO: 554179 - protein, 9 aa, Homo Sapiens
RQAQAPIAA

SEQ ID NO: 554180 - protein, 9 aa, Homo Sapiens
EGSRPVLSR

SEQ ID NO: 554181 - protein, 9 aa, Homo Sapiens
NPALSLGTA

SEQ ID NO: 554182 - protein, 9 aa, Homo Sapiens
FILHRPEDN

SEQ ID NO: 554183 - protein, 9 aa, Homo Sapiens
ITFSFAFNH

SEQ ID NO: 554184 - protein, 9 aa, Homo Sapiens
QVERHTQHQ

SEQ ID NO: 554185 - protein, 9 aa, Homo Sapiens
PGNLPDRQN

SEQ ID NO: 554186 - protein, 9 aa, Homo Sapiens
ASPGNLPDR

SEQ ID NO: 554187 - protein, 9 aa, Homo Sapiens
FSRPASFLL

SEQ ID NO: 554188 - protein, 9 aa, Homo Sapiens
SCCGATVLF

SEQ ID NO: 554189 - protein, 9 aa, Homo Sapiens
NYPQTAVSG

SEQ ID NO: 554190 - protein, 9 aa, Homo Sapiens
KQVERHTQH

SEQ ID NO: 554191 - protein, 9 aa, Homo Sapiens
LPDRQNSKL

SEQ ID NO: 554192 - protein, 9 aa, Homo Sapiens
GVVMGIIVF

SEQ ID NO: 554193 - protein, 9 aa, Homo Sapiens
LLAAMGYDG

SEQ ID NO: 554194 - protein, 9 aa, Homo Sapiens
LPELDMAIK

SEQ ID NO: 554195 - protein, 9 aa, Homo Sapiens
RPNGPKLNL

SEQ ID NO: 554196 - protein, 9 aa, Homo Sapiens
VLSRLLLKA

SEQ ID NO: 554197 - protein, 9 aa, Homo Sapiens
GSSQRRMGP

SEQ ID NO: 554198 - protein, 9 aa, Homo Sapiens
TGEKPNICN

SEQ ID NO: 554199 - protein, 9 aa, Homo Sapiens
VQPLPSPGV

SEQ ID NO: 554200 - protein, 9 aa, Homo Sapiens
HFSRPASFL

SEQ ID NO: 554201 - protein, 9 aa, Homo Sapiens
VVTLLRDGI

SEQ ID NO: 554202 - protein, 9 aa, Homo Sapiens
NVFKNPALS

SEQ ID NO: 554203 - protein, 9 aa, Homo Sapiens
CNFGVVRTS

SEQ ID NO: 554204 - protein, 9 aa, Homo Sapiens
SNPNELAIK

SEQ ID NO: 554205 - protein, 9 aa, Homo Sapiens
PQTAVSGTC

SEQ ID NO: 554206 - protein, 9 aa, Homo Sapiens
LRDGIKRRE

SEQ ID NO: 554207 - protein, 9 aa, Homo Sapiens
YTTEKKPPL

SEQ ID NO: 554208 - protein, 9 aa, Homo Sapiens
EIVPGSCCG

SEQ ID NO: 554209 - protein, 9 aa, Homo Sapiens
APSSGEEGQ

SEQ ID NO: 554210 - protein, 9 aa, Homo Sapiens
KSSGLRVRA

SEQ ID NO: 554211 - protein, 9 aa, Homo Sapiens
HVIVVSIAY

SEQ ID NO: 554212 - protein, 9 aa, Homo Sapiens
QAQLRSREQ

SEQ ID NO: 554213 - protein, 9 aa, Homo Sapiens
NLPDRQNSK

SEQ ID NO: 554214 - protein, 9 aa, Homo Sapiens
QAMFILHRP

SEQ ID NO: 554215 - protein, 9 aa, Homo Sapiens
AEDFISNMM

SEQ ID NO: 554216 - protein, 9 aa, Homo Sapiens
EGYRQAQAP

SEQ ID NO: 554217 - protein, 9 aa, Homo Sapiens
TDVRETCGC

SEQ ID NO: 554218 - protein, 9 aa, Homo Sapiens
LAPQTKVIA

SEQ ID NO: 554219 - protein, 9 aa, Homo Sapiens
SHVIVVSIA

SEQ ID NO: 554220 - protein, 9 aa, Homo Sapiens
EASPGNLPD

SEQ ID NO: 554221 - protein, 9 aa, Homo Sapiens
YPQTAVSGT

SEQ ID NO: 554222 - protein, 9 aa, Homo Sapiens
GAWNDTAQL

SEQ ID NO: 554223 - protein, 9 aa, Homo Sapiens
MGYDGYMAI

SEQ ID NO: 554224 - protein, 9 aa, Homo Sapiens
RPFTPCLQG

SEQ ID NO: 554225 - protein, 9 aa, Homo Sapiens
NYNSMEDAK

SEQ ID NO: 554226 - protein, 9 aa, Homo Sapiens
PLPELDMAI

SEQ ID NO: 554227 - protein, 9 aa, Homo Sapiens
EKPNICNEC

SEQ ID NO: 554228 - protein, 9 aa, Homo Sapiens
LSLGTAPWT

SEQ ID NO: 554229 - protein, 9 aa, Homo Sapiens
SARPFTPCL

SEQ ID NO: 554230 - protein, 9 aa, Homo Sapiens
RTSTSDRLT

SEQ ID NO: 554231 - protein, 9 aa, Homo Sapiens
FCHDEDCSD

SEQ ID NO: 554232 - protein, 9 aa, Homo Sapiens
TSNFQAVRV

SEQ ID NO: 554233 - protein, 9 aa, Homo Sapiens
HLQAMFILH

SEQ ID NO: 554234 - protein, 9 aa, Homo Sapiens
VITKMTKEE

SEQ ID NO: 554235 - protein, 9 aa, Homo Sapiens
NPNELAIKS

SEQ ID NO: 554236 - protein, 9 aa, Homo Sapiens
QLHYATLSF

SEQ ID NO: 554237 - protein, 9 aa, Homo Sapiens
GEEGQLHYA

SEQ ID NO: 554238 - protein, 9 aa, Homo Sapiens
EDFISNMMR

SEQ ID NO: 554239 - protein, 9 aa, Homo Sapiens
GQLHYATLS

SEQ ID NO: 554240 - protein, 9 aa, Homo Sapiens
NDTAQLHKS

SEQ ID NO: 554241 - protein, 9 aa, Homo Sapiens
PVVQPLPSP

SEQ ID NO: 554242 - protein, 9 aa, Homo Sapiens
HMEDARRGG

SEQ ID NO: 554243 - protein, 9 aa, Homo Sapiens
PNGPKLNLP

SEQ ID NO: 554244 - protein, 9 aa, Homo Sapiens
DPPDFQRAE

SEQ ID NO: 554245 - protein, 9 aa, Homo Sapiens
DVRETCGCC

SEQ ID NO: 554246 - protein, 9 aa, Homo Sapiens
DVMTDVRET

SEQ ID NO: 554247 - protein, 9 aa, Homo Sapiens
SFLLLLSLC

SEQ ID NO: 554248 - protein, 9 aa, Homo Sapiens
MFILHRPED

SEQ ID NO: 554249 - protein, 9 aa, Homo Sapiens
SQRRMGPSK

SEQ ID NO: 554250 - protein, 9 aa, Homo Sapiens
RPASFLLLL

SEQ ID NO: 554251 - protein, 9 aa, Homo Sapiens
KLWLHMEDA

SEQ ID NO: 554252 - protein, 9 aa, Homo Sapiens
SKTCKHGHA

SEQ ID NO: 554253 - protein, 9 aa, Homo Sapiens
PARGRTRAK

SEQ ID NO: 554254 - protein, 9 aa, Homo Sapiens
NICNECGKA

SEQ ID NO: 554255 - protein, 9 aa, Homo Sapiens
LNYPQTAVS

SEQ ID NO: 554256 - protein, 9 aa, Homo Sapiens
QHPARGRTR

SEQ ID NO: 554257 - protein, 9 aa, Homo Sapiens
AIFCHDEDC

SEQ ID NO: 554258 - protein, 9 aa, Homo Sapiens
EEGQLHYAT

SEQ ID NO: 554259 - protein, 9 aa, Homo Sapiens
CGVVMGIIV

SEQ ID NO: 554260 - protein, 9 aa, Homo Sapiens
FGLSRQIYD

SEQ ID NO: 554261 - protein, 9 aa, Homo Sapiens
AIINSNPNE

SEQ ID NO: 554262 - protein, 9 aa, Homo Sapiens
VFKNPALSL

SEQ ID NO: 554263 - protein, 9 aa, Homo Sapiens
PEGAWNDTA

SEQ ID NO: 554264 - protein, 9 aa, Homo Sapiens
TWNDLGDNY

SEQ ID NO: 554265 - protein, 9 aa, Homo Sapiens
ASFLLLLSL

SEQ ID NO: 554266 - protein, 9 aa, Homo Sapiens
HTQHQLGGF

SEQ ID NO: 554267 - protein, 9 aa, Homo Sapiens
SIMEAHKVI

SEQ ID NO: 554268 - protein, 9 aa, Homo Sapiens
PITVIRGMA

SEQ ID NO: 554269 - protein, 9 aa, Homo Sapiens
PVLSRLLLK

SEQ ID NO: 554270 - protein, 9 aa, Homo Sapiens
LAPGAASLM

SEQ ID NO: 554271 - protein, 9 aa, Homo Sapiens
EKKPPLPEL

SEQ ID NO: 554272 - protein, 9 aa, Homo Sapiens
PFTPCLQGQ

SEQ ID NO: 554273 - protein, 9 aa, Homo Sapiens
AAMGYDGYM

SEQ ID NO: 554274 - protein, 9 aa, Homo Sapiens
DFQRAEDFI

SEQ ID NO: 554275 - protein, 9 aa, Homo Sapiens
GQVFGLSRQ

SEQ ID NO: 554276 - protein, 9 aa, Homo Sapiens
DNYNSMEDA

SEQ ID NO: 554277 - protein, 9 aa, Homo Sapiens
SLGTAPWTS

SEQ ID NO: 554278 - protein, 9 aa, Homo Sapiens
GLSRQIYDP

SEQ ID NO: 554279 - protein, 9 aa, Homo Sapiens
PDFQRAEDF

SEQ ID NO: 554280 - protein, 9 aa, Homo Sapiens
LSRLQPVVQ

SEQ ID NO: 554281 - protein, 9 aa, Homo Sapiens
LSRLLLKAE

SEQ ID NO: 554282 - protein, 9 aa, Homo Sapiens
MGPSKQHLA

SEQ ID NO: 554283 - protein, 9 aa, Homo Sapiens
AKSSGLRVR

SEQ ID NO: 554284 - protein, 9 aa, Homo Sapiens
TLLRDGIKR

SEQ ID NO: 554285 - protein, 9 aa, Homo Sapiens
ERHTQHQLG

SEQ ID NO: 554286 - protein, 9 aa, Homo Sapiens
CHDEDCSDQ

SEQ ID NO: 554287 - protein, 9 aa, Homo Sapiens
FKNPALSLG

SEQ ID NO: 554288 - protein, 9 aa, Homo Sapiens
CDVMTDVRE

SEQ ID NO: 554289 - protein, 9 aa, Homo Sapiens
PNICNECGK

SEQ ID NO: 554290 - protein, 9 aa, Homo Sapiens
ARPFTPCLQ

SEQ ID NO: 554291 - protein, 9 aa, Homo Sapiens
DKYNTGIIE

SEQ ID NO: 554292 - protein, 9 aa, Homo Sapiens
KNPALSLGT

SEQ ID NO: 554293 - protein, 9 aa, Homo Sapiens
MGSSQRRMG

SEQ ID NO: 554294 - protein, 9 aa, Homo Sapiens
CRPNGPKLN

SEQ ID NO: 554295 - protein, 9 aa, Homo Sapiens
IRGMAGSLR

SEQ ID NO: 554296 - protein, 9 aa, Homo Sapiens
KPNICNECG

SEQ ID NO: 554297 - protein, 9 aa, Homo Sapiens
NELAIKSWH

SEQ ID NO: 554298 - protein, 9 aa, Homo Sapiens
VVMGIIVFF

SEQ ID NO: 554299 - protein, 9 aa, Homo Sapiens
YSLAPQTKV

SEQ ID NO: 554300 - protein, 9 aa, Homo Sapiens
NGPKLNLPG

SEQ ID NO: 554301 - protein, 9 aa, Homo Sapiens
EMSTSKTCK

SEQ ID NO: 554302 - protein, 9 aa, Homo Sapiens
LQPVVQPLP

SEQ ID NO: 554303 - protein, 9 aa, Homo Sapiens
GEECIERIT

SEQ ID NO: 554304 - protein, 9 aa, Homo Sapiens
PPDFQRAED

SEQ ID NO: 554305 - protein, 9 aa, Homo Sapiens
SSGEEGQLH

SEQ ID NO: 554306 - protein, 9 aa, Homo Sapiens
LILNYPQTA

SEQ ID NO: 554307 - protein, 9 aa, Homo Sapiens
CIERITFSF

SEQ ID NO: 554308 - protein, 9 aa, Homo Sapiens
WNDLGDNYN

SEQ ID NO: 554309 - protein, 9 aa, Homo Sapiens
MINVQAQLR

SEQ ID NO: 554310 - protein, 9 aa, Homo Sapiens
LQAMFILHR

SEQ ID NO: 554311 - protein, 9 aa, Homo Sapiens
VQAQLRSRE

SEQ ID NO: 554312 - protein, 9 aa, Homo Sapiens
RPEEGYRQA

SEQ ID NO: 554313 - protein, 9 aa, Homo Sapiens
RSARPFTPC

SEQ ID NO: 554314 - protein, 9 aa, Homo Sapiens
NFGVVRTST

SEQ ID NO: 554315 - protein, 9 aa, Homo Sapiens
DSIMEAHKV

SEQ ID NO: 554316 - protein, 9 aa, Homo Sapiens
APQTKVIAP

SEQ ID NO: 554317 - protein, 9 aa, Homo Sapiens
IVPGSCCGA

SEQ ID NO: 554318 - protein, 9 aa, Homo Sapiens
GMAGSLRLN

SEQ ID NO: 554319 - protein, 9 aa, Homo Sapiens
SGLRVRAGP

SEQ ID NO: 554320 - protein, 9 aa, Homo Sapiens
VTLLRDGIK

SEQ ID NO: 554321 - protein, 9 aa, Homo Sapiens
SRLLLKAEL

SEQ ID NO: 554322 - protein, 9 aa, Homo Sapiens
VLILNYPQT

SEQ ID NO: 554323 - protein, 9 aa, Homo Sapiens
LHRPEDNIR

SEQ ID NO: 554324 - protein, 9 aa, Homo Sapiens
FLLLLSLCA

SEQ ID NO: 554325 - protein, 9 aa, Homo Sapiens
GAASLMSCS

SEQ ID NO: 554326 - protein, 9 aa, Homo Sapiens
AMFILHRPE

SEQ ID NO: 554327 - protein, 9 aa, Homo Sapiens
NGEECIERI

SEQ ID NO: 554328 - protein, 9 aa, Homo Sapiens
SAEIVPGSC

SEQ ID NO: 554329 - protein, 9 aa, Homo Sapiens
GSRPVLSRL

SEQ ID NO: 554330 - protein, 9 aa, Homo Sapiens
RRMGPSKQH

SEQ ID NO: 554331 - protein, 9 aa, Homo Sapiens
LRSREQSRS

SEQ ID NO: 554332 - protein, 9 aa, Homo Sapiens
LYRPEEGYR

SEQ ID NO: 554333 - protein, 9 aa, Homo Sapiens
LWLHMEDAR

SEQ ID NO: 554334 - protein, 9 aa, Homo Sapiens
CCGATVLFC

SEQ ID NO: 554335 - protein, 9 aa, Homo Sapiens
RDGIKRREE

SEQ ID NO: 554336 - protein, 9 aa, Homo Sapiens
GYMAICNPL

SEQ ID NO: 554337 - protein, 9 aa, Homo Sapiens
CSDQSDLSR

SEQ ID NO: 554338 - protein, 9 aa, Homo Sapiens
RIHTGEKPN

SEQ ID NO: 554339 - protein, 9 aa, Homo Sapiens
ELSRLQPVV

SEQ ID NO: 554340 - protein, 9 aa, Homo Sapiens
AVPEGAWND

SEQ ID NO: 554341 - protein, 9 aa, Homo Sapiens
LHMEDARRG

SEQ ID NO: 554342 - protein, 9 aa, Homo Sapiens
IFCHDEDCS

SEQ ID NO: 554343 - protein, 9 aa, Homo Sapiens
SNFQAVRVT

SEQ ID NO: 554344 - protein, 9 aa, Homo Sapiens
DGYMAICNP

SEQ ID NO: 554345 - protein, 9 aa, Homo Sapiens
EGQLHYATL

SEQ ID NO: 554346 - protein, 9 aa, Homo Sapiens
QPSDTAKGV

SEQ ID NO: 554347 - protein, 9 aa, Homo Sapiens
PSSGEEGQL

SEQ ID NO: 554348 - protein, 9 aa, Homo Sapiens
AQHPARGRT

SEQ ID NO: 554349 - protein, 9 aa, Homo Sapiens
VMGIIVFFK

SEQ ID NO: 554350 - protein, 9 aa, Homo Sapiens
GEDDKYNTG

SEQ ID NO: 554351 - protein, 9 aa, Homo Sapiens
QTKVIAPWR

SEQ ID NO: 554352 - protein, 9 aa, Homo Sapiens
MTDVRETCG

SEQ ID NO: 554353 - protein, 9 aa, Homo Sapiens
CYSLAPQTK

SEQ ID NO: 554354 - protein, 9 aa, Homo Sapiens
VMTDVRETC

SEQ ID NO: 554355 - protein, 9 aa, Homo Sapiens
ALSLGTAPW

SEQ ID NO: 554356 - protein, 9 aa, Homo Sapiens
AKQVERHTQ

SEQ ID NO: 554357 - protein, 9 aa, Homo Sapiens
ITVIRGMAG

SEQ ID NO: 554358 - protein, 9 aa, Homo Sapiens
EDCSDQSDL

SEQ ID NO: 554359 - protein, 9 aa, Homo Sapiens
PGEDDKYNT

SEQ ID NO: 554360 - protein, 9 aa, Homo Sapiens
PALSLGTAP

SEQ ID NO: 554361 - protein, 9 aa, Homo Sapiens
GYDGYMAIC

SEQ ID NO: 554362 - protein, 9 aa, Homo Sapiens
DGIKRREEF

SEQ ID NO: 554363 - protein, 9 aa, Homo Sapiens
LAQHPARGR

SEQ ID NO: 554364 - protein, 9 aa, Homo Sapiens
GRAKSSGLR

SEQ ID NO: 554365 - protein, 9 aa, Homo Sapiens
MAGSLRLNL

SEQ ID NO: 554366 - protein, 9 aa, Homo Sapiens
EEGYRQAQA

SEQ ID NO: 554367 - protein, 9 aa, Homo Sapiens
GEKPNICNE

SEQ ID NO: 554368 - protein, 9 aa, Homo Sapiens
LTECDVMTD

SEQ ID NO: 554369 - protein, 9 aa, Homo Sapiens
YRPEEGYRQ

SEQ ID NO: 554370 - protein, 9 aa, Homo Sapiens
LHFSRPASF

SEQ ID NO: 554371 - protein, 9 aa, Homo Sapiens
TGEDAACIA

SEQ ID NO: 554372 - protein, 9 aa, Homo Sapiens
TGHGKYEKL

SEQ ID NO: 554373 - protein, 9 aa, Homo Sapiens
VIQERFGSR

SEQ ID NO: 554374 - protein, 9 aa, Homo Sapiens
ADNVMNQCP

SEQ ID NO: 554375 - protein, 9 aa, Homo Sapiens
QLRQVVQNG

SEQ ID NO: 554376 - protein, 9 aa, Homo Sapiens
KATSKKMYY

SEQ ID NO: 554377 - protein, 9 aa, Homo Sapiens
FLAPELPAA

SEQ ID NO: 554378 - protein, 9 aa, Homo Sapiens
DAMQAHITG

SEQ ID NO: 554379 - protein, 9 aa, Homo Sapiens
NRQRELTDR

SEQ ID NO: 554380 - protein, 9 aa, Homo Sapiens
PNGMQRFIP

SEQ ID NO: 554381 - protein, 9 aa, Homo Sapiens
LMGFPFNEV

SEQ ID NO: 554382 - protein, 9 aa, Homo Sapiens
CVISATDGP

SEQ ID NO: 554383 - protein, 9 aa, Homo Sapiens
NNKPWRWMP

SEQ ID NO: 554384 - protein, 9 aa, Homo Sapiens
RNKVGCTPA

SEQ ID NO: 554385 - protein, 9 aa, Homo Sapiens
SVALSPRSP

SEQ ID NO: 554386 - protein, 9 aa, Homo Sapiens
EPKAKHARM

SEQ ID NO: 554387 - protein, 9 aa, Homo Sapiens
GAECGVNAN

SEQ ID NO: 554388 - protein, 9 aa, Homo Sapiens
VAEYPEWLF

SEQ ID NO: 554389 - protein, 9 aa, Homo Sapiens
EHQPLPESP

SEQ ID NO: 554390 - protein, 9 aa, Homo Sapiens
EEEPKAKHA

SEQ ID NO: 554391 - protein, 9 aa, Homo Sapiens
CGFAQPAAI

SEQ ID NO: 554392 - protein, 9 aa, Homo Sapiens
QFNAQIWTK

SEQ ID NO: 554393 - protein, 9 aa, Homo Sapiens
WSLLCTCCR

SEQ ID NO: 554394 - protein, 9 aa, Homo Sapiens
QAPGDGIAP

SEQ ID NO: 554395 - protein, 9 aa, Homo Sapiens
RQRELTDRL

SEQ ID NO: 554396 - protein, 9 aa, Homo Sapiens
ICELAITLI

SEQ ID NO: 554397 - protein, 9 aa, Homo Sapiens
PCGFAQPAA

SEQ ID NO: 554398 - protein, 9 aa, Homo Sapiens
TSKKMYYRR

SEQ ID NO: 554399 - protein, 9 aa, Homo Sapiens
SCPFLLPSK

SEQ ID NO: 554400 - protein, 9 aa, Homo Sapiens
IIAGMPVIE

SEQ ID NO: 554401 - protein, 9 aa, Homo Sapiens
QESKEEKFH

SEQ ID NO: 554402 - protein, 9 aa, Homo Sapiens
TVSGDAMQA

SEQ ID NO: 554403 - protein, 9 aa, Homo Sapiens
MPAHPGCPA

SEQ ID NO: 554404 - protein, 9 aa, Homo Sapiens
PFVYSLLQH

SEQ ID NO: 554405 - protein, 9 aa, Homo Sapiens
EESLQSCMH

SEQ ID NO: 554406 - protein, 9 aa, Homo Sapiens
LAWPCGFAQ

SEQ ID NO: 554407 - protein, 9 aa, Homo Sapiens
VGLAAYILG

SEQ ID NO: 554408 - protein, 9 aa, Homo Sapiens
GSLCSTLSF

SEQ ID NO: 554409 - protein, 9 aa, Homo Sapiens
TNPYRKSKF

SEQ ID NO: 554410 - protein, 9 aa, Homo Sapiens
DQAPGDGIA

SEQ ID NO: 554411 - protein, 9 aa, Homo Sapiens
IEVWKSKQV

SEQ ID NO: 554412 - protein, 9 aa, Homo Sapiens
VALSPRSPA

SEQ ID NO: 554413 - protein, 9 aa, Homo Sapiens
FFSHAWNIC

SEQ ID NO: 554414 - protein, 9 aa, Homo Sapiens
RARSPWLPP

SEQ ID NO: 554415 - protein, 9 aa, Homo Sapiens
RCAVAATTL

SEQ ID NO: 554416 - protein, 9 aa, Homo Sapiens
LFNFASCPF

SEQ ID NO: 554417 - protein, 9 aa, Homo Sapiens
VGPRVHINE

SEQ ID NO: 554418 - protein, 9 aa, Homo Sapiens
FILGFAGYI

SEQ ID NO: 554419 - protein, 9 aa, Homo Sapiens
PNQHCIRRW

SEQ ID NO: 554420 - protein, 9 aa, Homo Sapiens
MGFPFNEVG

SEQ ID NO: 554421 - protein, 9 aa, Homo Sapiens
LAPELPAAS

SEQ ID NO: 554422 - protein, 9 aa, Homo Sapiens
AQPAAIQES

SEQ ID NO: 554423 - protein, 9 aa, Homo Sapiens
PAALAWPCG

SEQ ID NO: 554424 - protein, 9 aa, Homo Sapiens
AAAKCRNRQ

SEQ ID NO: 554425 - protein, 9 aa, Homo Sapiens
APGDGIAPP

SEQ ID NO: 554426 - protein, 9 aa, Homo Sapiens
HMMPAHPGC

SEQ ID NO: 554427 - protein, 9 aa, Homo Sapiens
TLNESITTK

SEQ ID NO: 554428 - protein, 9 aa, Homo Sapiens
LKPVAEYPE

SEQ ID NO: 554429 - protein, 9 aa, Homo Sapiens
LRSLPPPQS

SEQ ID NO: 554430 - protein, 9 aa, Homo Sapiens
ALVLLGLEV

SEQ ID NO: 554431 - protein, 9 aa, Homo Sapiens
SGRRAGGRA

SEQ ID NO: 554432 - protein, 9 aa, Homo Sapiens
LLGEEREKR

SEQ ID NO: 554433 - protein, 9 aa, Homo Sapiens
QPAFALPTS

SEQ ID NO: 554434 - protein, 9 aa, Homo Sapiens
GSFVGMVDN

SEQ ID NO: 554435 - protein, 9 aa, Homo Sapiens
PVIEVWKSK

SEQ ID NO: 554436 - protein, 9 aa, Homo Sapiens
PDIHMMPAH

SEQ ID NO: 554437 - protein, 9 aa, Homo Sapiens
SLLCTCCRT

SEQ ID NO: 554438 - protein, 9 aa, Homo Sapiens
KVGCTPAHL

SEQ ID NO: 554439 - protein, 9 aa, Homo Sapiens
SQAYLEPES

SEQ ID NO: 554440 - protein, 9 aa, Homo Sapiens
QPAAIQESK

SEQ ID NO: 554441 - protein, 9 aa, Homo Sapiens
ATLESVIQE

SEQ ID NO: 554442 - protein, 9 aa, Homo Sapiens
QRFIPNISW

SEQ ID NO: 554443 - protein, 9 aa, Homo Sapiens
HFQPNSPAS

SEQ ID NO: 554444 - protein, 9 aa, Homo Sapiens
LQSCMHFQP

SEQ ID NO: 554445 - protein, 9 aa, Homo Sapiens
NPHVHVTGE

SEQ ID NO: 554446 - protein, 9 aa, Homo Sapiens
KMKCTENNQ

SEQ ID NO: 554447 - protein, 9 aa, Homo Sapiens
LQILHLRIP

SEQ ID NO: 554448 - protein, 9 aa, Homo Sapiens
LPAASEFST

SEQ ID NO: 554449 - protein, 9 aa, Homo Sapiens
LYRTEKDYA

SEQ ID NO: 554450 - protein, 9 aa, Homo Sapiens
FWARFTTLN

SEQ ID NO: 554451 - protein, 9 aa, Homo Sapiens
VHVTGEDAA

SEQ ID NO: 554452 - protein, 9 aa, Homo Sapiens
EEYEQQPRP

SEQ ID NO: 554453 - protein, 9 aa, Homo Sapiens
CSTLSFCTS

SEQ ID NO: 554454 - protein, 9 aa, Homo Sapiens
KKSSGHMQT

SEQ ID NO: 554455 - protein, 9 aa, Homo Sapiens
RRHLNLCPI

SEQ ID NO: 554456 - protein, 9 aa, Homo Sapiens
GKYEKLLVE

SEQ ID NO: 554457 - protein, 9 aa, Homo Sapiens
PLKATSKKM

SEQ ID NO: 554458 - protein, 9 aa, Homo Sapiens
GFPFNEVGG

SEQ ID NO: 554459 - protein, 9 aa, Homo Sapiens
LGLEVLLFS

SEQ ID NO: 554460 - protein, 9 aa, Homo Sapiens
VMNQCPVHF

SEQ ID NO: 554461 - protein, 9 aa, Homo Sapiens
ALRQQEEEP

SEQ ID NO: 554462 - protein, 9 aa, Homo Sapiens
MQRFIPNIS

SEQ ID NO: 554463 - protein, 9 aa, Homo Sapiens
NVEKHLELG

SEQ ID NO: 554464 - protein, 9 aa, Homo Sapiens
NWGSLCSTL

SEQ ID NO: 554465 - protein, 9 aa, Homo Sapiens
AECGVNANV

SEQ ID NO: 554466 - protein, 9 aa, Homo Sapiens
DPLQGSVAL

SEQ ID NO: 554467 - protein, 9 aa, Homo Sapiens
AAKKSSGHM

SEQ ID NO: 554468 - protein, 9 aa, Homo Sapiens
MYYRRQNSF

SEQ ID NO: 554469 - protein, 9 aa, Homo Sapiens
VIEVWKSKQ

SEQ ID NO: 554470 - protein, 9 aa, Homo Sapiens
AKCRNRQRE

SEQ ID NO: 554471 - protein, 9 aa, Homo Sapiens
RSLPPPQSQ

SEQ ID NO: 554472 - protein, 9 aa, Homo Sapiens
TLESVIQER

SEQ ID NO: 554473 - protein, 9 aa, Homo Sapiens
LAAYILGKF

SEQ ID NO: 554474 - protein, 9 aa, Homo Sapiens
GFPRRNIEF

SEQ ID NO: 554475 - protein, 9 aa, Homo Sapiens
GEEREKRRR

SEQ ID NO: 554476 - protein, 9 aa, Homo Sapiens
KPVAEYPEW

SEQ ID NO: 554477 - protein, 9 aa, Homo Sapiens
SFKIKNIFQ

SEQ ID NO: 554478 - protein, 9 aa, Homo Sapiens
GALVLLGLE

SEQ ID NO: 554479 - protein, 9 aa, Homo Sapiens
YRRQNSFKI

SEQ ID NO: 554480 - protein, 9 aa, Homo Sapiens
APAALAWPC

SEQ ID NO: 554481 - protein, 9 aa, Homo Sapiens
ESDPLQGSV

SEQ ID NO: 554482 - protein, 9 aa, Homo Sapiens
FKIKNIFQE

SEQ ID NO: 554483 - protein, 9 aa, Homo Sapiens
YSLLQHQYR

SEQ ID NO: 554484 - protein, 9 aa, Homo Sapiens
PAASEFSTS

SEQ ID NO: 554485 - protein, 9 aa, Homo Sapiens
GASNSKLFR

SEQ ID NO: 554486 - protein, 9 aa, Homo Sapiens
ASNSKLFRR

SEQ ID NO: 554487 - protein, 9 aa, Homo Sapiens
HGKYEKLLV

SEQ ID NO: 554488 - protein, 9 aa, Homo Sapiens
GRRAGGRAG

SEQ ID NO: 554489 - protein, 9 aa, Homo Sapiens
NLEDAAKKS

SEQ ID NO: 554490 - protein, 9 aa, Homo Sapiens
SCMHFQPNS

SEQ ID NO: 554491 - protein, 9 aa, Homo Sapiens
HLNLCPICL

SEQ ID NO: 554492 - protein, 9 aa, Homo Sapiens
SDIWSLLCT

SEQ ID NO: 554493 - protein, 9 aa, Homo Sapiens
CPASAPAAL

SEQ ID NO: 554494 - protein, 9 aa, Homo Sapiens
VPLKPVAEY

SEQ ID NO: 554495 - protein, 9 aa, Homo Sapiens
IQESKEEKF

SEQ ID NO: 554496 - protein, 9 aa, Homo Sapiens
FGGPDACCV

SEQ ID NO: 554497 - protein, 9 aa, Homo Sapiens
AQKQKSQAY

SEQ ID NO: 554498 - protein, 9 aa, Homo Sapiens
TTLADPRGL

SEQ ID NO: 554499 - protein, 9 aa, Homo Sapiens
QLMEMGFPR

SEQ ID NO: 554500 - protein, 9 aa, Homo Sapiens
PVLLRPFYQ

SEQ ID NO: 554501 - protein, 9 aa, Homo Sapiens
ARFTTLNES

SEQ ID NO: 554502 - protein, 9 aa, Homo Sapiens
LCSTLSFCT

SEQ ID NO: 554503 - protein, 9 aa, Homo Sapiens
ARNKVGCTP

SEQ ID NO: 554504 - protein, 9 aa, Homo Sapiens
ATRSDSRLY

SEQ ID NO: 554505 - protein, 9 aa, Homo Sapiens
SKKMYYRRQ

SEQ ID NO: 554506 - protein, 9 aa, Homo Sapiens
PVAEYPEWL

SEQ ID NO: 554507 - protein, 9 aa, Homo Sapiens
LEEGSGRRA

SEQ ID NO: 554508 - protein, 9 aa, Homo Sapiens
ATSKKMYYR

SEQ ID NO: 554509 - protein, 9 aa, Homo Sapiens
PRRNIEFAL

SEQ ID NO: 554510 - protein, 9 aa, Homo Sapiens
RSPWLPPSQ

SEQ ID NO: 554511 - protein, 9 aa, Homo Sapiens
LEALLRSLP

SEQ ID NO: 554512 - protein, 9 aa, Homo Sapiens
HLEEADRRH

SEQ ID NO: 554513 - protein, 9 aa, Homo Sapiens
NQHCIRRWT

SEQ ID NO: 554514 - protein, 9 aa, Homo Sapiens
TLLTQPAFA

SEQ ID NO: 554515 - protein, 9 aa, Homo Sapiens
EGASNSKLF

SEQ ID NO: 554516 - protein, 9 aa, Homo Sapiens
YEKLLVEGG

SEQ ID NO: 554517 - protein, 9 aa, Homo Sapiens
GPRVHINEE

SEQ ID NO: 554518 - protein, 9 aa, Homo Sapiens
APELPAASE

SEQ ID NO: 554519 - protein, 9 aa, Homo Sapiens
FVYSLLQHQ

SEQ ID NO: 554520 - protein, 9 aa, Homo Sapiens
FPRRNIEFA

SEQ ID NO: 554521 - protein, 9 aa, Homo Sapiens
PGDGIAPPQ

SEQ ID NO: 554522 - protein, 9 aa, Homo Sapiens
SKLFRRHSF

SEQ ID NO: 554523 - protein, 9 aa, Homo Sapiens
QHQYRKSCK

SEQ ID NO: 554524 - protein, 9 aa, Homo Sapiens
PELPAASEF

SEQ ID NO: 554525 - protein, 9 aa, Homo Sapiens
AFALPTSLS

SEQ ID NO: 554526 - protein, 9 aa, Homo Sapiens
VTGEDAACI

SEQ ID NO: 554527 - protein, 9 aa, Homo Sapiens
ADRRHLNLC

SEQ ID NO: 554528 - protein, 9 aa, Homo Sapiens
LSDIWSLLC

SEQ ID NO: 554529 - protein, 9 aa, Homo Sapiens
PWLPPSQPS

SEQ ID NO: 554530 - protein, 9 aa, Homo Sapiens
ESKEEKFHG

SEQ ID NO: 554531 - protein, 9 aa, Homo Sapiens
QLLGEEREK

SEQ ID NO: 554532 - protein, 9 aa, Homo Sapiens
GGCTNPYRK

SEQ ID NO: 554533 - protein, 9 aa, Homo Sapiens
GHGKYEKLL

SEQ ID NO: 554534 - protein, 9 aa, Homo Sapiens
LKATSKKMY

SEQ ID NO: 554535 - protein, 9 aa, Homo Sapiens
HVHVTGEDA

SEQ ID NO: 554536 - protein, 9 aa, Homo Sapiens
LLQHQYRKS

SEQ ID NO: 554537 - protein, 9 aa, Homo Sapiens
RQVVQNGDM

SEQ ID NO: 554538 - protein, 9 aa, Homo Sapiens
EALLRSLPP

SEQ ID NO: 554539 - protein, 9 aa, Homo Sapiens
ANRAHLSLE

SEQ ID NO: 554540 - protein, 9 aa, Homo Sapiens
FGEEYEQQP

SEQ ID NO: 554541 - protein, 9 aa, Homo Sapiens
EEADRRHLN

SEQ ID NO: 554542 - protein, 9 aa, Homo Sapiens
LEEADRRHL

SEQ ID NO: 554543 - protein, 9 aa, Homo Sapiens
YAALARETD

SEQ ID NO: 554544 - protein, 9 aa, Homo Sapiens
IAGMPVIEV

SEQ ID NO: 554545 - protein, 9 aa, Homo Sapiens
VAATTLADP

SEQ ID NO: 554546 - protein, 9 aa, Homo Sapiens
LRQVVQNGD

SEQ ID NO: 554547 - protein, 9 aa, Homo Sapiens
LAQKQKSQA

SEQ ID NO: 554548 - protein, 9 aa, Homo Sapiens
DPFVYSLLQ

SEQ ID NO: 554549 - protein, 9 aa, Homo Sapiens
PLKPVAEYP

SEQ ID NO: 554550 - protein, 9 aa, Homo Sapiens
LRHKADNVM

SEQ ID NO: 554551 - protein, 9 aa, Homo Sapiens
LADPRGLLH

SEQ ID NO: 554552 - protein, 9 aa, Homo Sapiens
DPVLLRPFY

SEQ ID NO: 554553 - protein, 9 aa, Homo Sapiens
RQQEEEPKA

SEQ ID NO: 554554 - protein, 9 aa, Homo Sapiens
CGVNANVEK

SEQ ID NO: 554555 - protein, 9 aa, Homo Sapiens
LVLLGLEVL

SEQ ID NO: 554556 - protein, 9 aa, Homo Sapiens
HARNKVGCT

SEQ ID NO: 554557 - protein, 9 aa, Homo Sapiens
FVGMVDNLR

SEQ ID NO: 554558 - protein, 9 aa, Homo Sapiens
CELAITLIG

SEQ ID NO: 554559 - protein, 9 aa, Homo Sapiens
TLLFNFASC

SEQ ID NO: 554560 - protein, 9 aa, Homo Sapiens
NEELQIFSS

SEQ ID NO: 554561 - protein, 9 aa, Homo Sapiens
QDVPLKPVA

SEQ ID NO: 554562 - protein, 9 aa, Homo Sapiens
AMQAHITGL

SEQ ID NO: 554563 - protein, 9 aa, Homo Sapiens
TYVLQILHL

SEQ ID NO: 554564 - protein, 9 aa, Homo Sapiens
AATTLADPR

SEQ ID NO: 554565 - protein, 9 aa, Homo Sapiens
DSDLVVLSG

SEQ ID NO: 554566 - protein, 9 aa, Homo Sapiens
NFASCPFLL

SEQ ID NO: 554567 - protein, 9 aa, Homo Sapiens
PAHPGCPAS

SEQ ID NO: 554568 - protein, 9 aa, Homo Sapiens
IPDIHMMPA

SEQ ID NO: 554569 - protein, 9 aa, Homo Sapiens
LQHQYRKSC

SEQ ID NO: 554570 - protein, 9 aa, Homo Sapiens
KDYAALARE

SEQ ID NO: 554571 - protein, 9 aa, Homo Sapiens
TRSDSRLYA

SEQ ID NO: 554572 - protein, 9 aa, Homo Sapiens
GPDACCVIS

SEQ ID NO: 554573 - protein, 9 aa, Homo Sapiens
EGLEEGSGR

SEQ ID NO: 554574 - protein, 9 aa, Homo Sapiens
VNANVEKHL

SEQ ID NO: 554575 - protein, 9 aa, Homo Sapiens
GMPVIEVWK

SEQ ID NO: 554576 - protein, 9 aa, Homo Sapiens
PYRKSKFFI

SEQ ID NO: 554577 - protein, 9 aa, Homo Sapiens
GLQEQLRQV

SEQ ID NO: 554578 - protein, 9 aa, Homo Sapiens
ARSPWLPPS

SEQ ID NO: 554579 - protein, 9 aa, Homo Sapiens
LILAQKQKS

SEQ ID NO: 554580 - protein, 9 aa, Homo Sapiens
YILGKFSTW

SEQ ID NO: 554581 - protein, 9 aa, Homo Sapiens
TTYVLQILH

SEQ ID NO: 554582 - protein, 9 aa, Homo Sapiens
GEEYEQQPR

SEQ ID NO: 554583 - protein, 9 aa, Homo Sapiens
TEKDYAALA

SEQ ID NO: 554584 - protein, 9 aa, Homo Sapiens
QKLEHQPLP

SEQ ID NO: 554585 - protein, 9 aa, Homo Sapiens
HVTGEDAAC

SEQ ID NO: 554586 - protein, 9 aa, Homo Sapiens
LRPFYQVAE

SEQ ID NO: 554587 - protein, 9 aa, Homo Sapiens
FTVSGDAMQ

SEQ ID NO: 554588 - protein, 9 aa, Homo Sapiens
LGFAGYIGA

SEQ ID NO: 554589 - protein, 9 aa, Homo Sapiens
QQPRPRSKK

SEQ ID NO: 554590 - protein, 9 aa, Homo Sapiens
QTLLTQPAF

SEQ ID NO: 554591 - protein, 9 aa, Homo Sapiens
AHLSLEEQL

SEQ ID NO: 554592 - protein, 9 aa, Homo Sapiens
SAPAALAWP

SEQ ID NO: 554593 - protein, 9 aa, Homo Sapiens
AQIWTKSKF

SEQ ID NO: 554594 - protein, 9 aa, Homo Sapiens
GRRGSFVGM

SEQ ID NO: 554595 - protein, 9 aa, Homo Sapiens
KKIQFNAQI

SEQ ID NO: 554596 - protein, 9 aa, Homo Sapiens
SGDAMQAHI

SEQ ID NO: 554597 - protein, 9 aa, Homo Sapiens
QQEEEPKAK

SEQ ID NO: 554598 - protein, 9 aa, Homo Sapiens
LGKFSTWTN

SEQ ID NO: 554599 - protein, 9 aa, Homo Sapiens
IHMMPAHPG

SEQ ID NO: 554600 - protein, 9 aa, Homo Sapiens
FAQPAAIQE

SEQ ID NO: 554601 - protein, 9 aa, Homo Sapiens
DFWARFTTL

SEQ ID NO: 554602 - protein, 9 aa, Homo Sapiens
WPCGFAQPA

SEQ ID NO: 554603 - protein, 9 aa, Homo Sapiens
HPGCPASAP

SEQ ID NO: 554604 - protein, 9 aa, Homo Sapiens
EMGFPRRNI

SEQ ID NO: 554605 - protein, 9 aa, Homo Sapiens
VSGDAMQAH

SEQ ID NO: 554606 - protein, 9 aa, Homo Sapiens
FAGYIGALR

SEQ ID NO: 554607 - protein, 9 aa, Homo Sapiens
DACCVISAT

SEQ ID NO: 554608 - protein, 9 aa, Homo Sapiens
NGMQRFIPN

SEQ ID NO: 554609 - protein, 9 aa, Homo Sapiens
LLTQPAFAL

SEQ ID NO: 554610 - protein, 9 aa, Homo Sapiens
LLFNFASCP

SEQ ID NO: 554611 - protein, 9 aa, Homo Sapiens
EDAAKKSSG

SEQ ID NO: 554612 - protein, 9 aa, Homo Sapiens
GDPVLLRPF

SEQ ID NO: 554613 - protein, 9 aa, Homo Sapiens
ILMGFPFNE

SEQ ID NO: 554614 - protein, 9 aa, Homo Sapiens
AIQESKEEK

SEQ ID NO: 554615 - protein, 9 aa, Homo Sapiens
AWNICELAI

SEQ ID NO: 554616 - protein, 9 aa, Homo Sapiens
STLSFCTSA

SEQ ID NO: 554617 - protein, 9 aa, Homo Sapiens
KQKSQAYLE

SEQ ID NO: 554618 - protein, 9 aa, Homo Sapiens
AAYILGKFS

SEQ ID NO: 554619 - protein, 9 aa, Homo Sapiens
KYEKLLVEG

SEQ ID NO: 554620 - protein, 9 aa, Homo Sapiens
LLRPFYQVA

SEQ ID NO: 554621 - protein, 9 aa, Homo Sapiens
GDAMQAHIT

SEQ ID NO: 554622 - protein, 9 aa, Homo Sapiens
MAGPNQHCI

SEQ ID NO: 554623 - protein, 9 aa, Homo Sapiens
NSFKIKNIF

SEQ ID NO: 554624 - protein, 9 aa, Homo Sapiens
MQTTYVLQI

SEQ ID NO: 554625 - protein, 9 aa, Homo Sapiens
AVAATTLAD

SEQ ID NO: 554626 - protein, 9 aa, Homo Sapiens
RNRQRELTD

SEQ ID NO: 554627 - protein, 9 aa, Homo Sapiens
IPNISWQPI

SEQ ID NO: 554628 - protein, 9 aa, Homo Sapiens
ATTLADPRG

SEQ ID NO: 554629 - protein, 9 aa, Homo Sapiens
QTTYVLQIL

SEQ ID NO: 554630 - protein, 9 aa, Homo Sapiens
AHPGCPASA

SEQ ID NO: 554631 - protein, 9 aa, Homo Sapiens
RWMPMLAAL

SEQ ID NO: 554632 - protein, 9 aa, Homo Sapiens
HLSLEEQLR

SEQ ID NO: 554633 - protein, 9 aa, Homo Sapiens
ILGKFSTWT

SEQ ID NO: 554634 - protein, 9 aa, Homo Sapiens
KIQFNAQIW

SEQ ID NO: 554635 - protein, 9 aa, Homo Sapiens
LATRSDSRL

SEQ ID NO: 554636 - protein, 9 aa, Homo Sapiens
LVVLSGTDS

SEQ ID NO: 554637 - protein, 9 aa, Homo Sapiens
GLAAYILGK

SEQ ID NO: 554638 - protein, 9 aa, Homo Sapiens
DRRHLNLCP

SEQ ID NO: 554639 - protein, 9 aa, Homo Sapiens
VLLGLEVLL

SEQ ID NO: 554640 - protein, 9 aa, Homo Sapiens
VQLMEMGFP

SEQ ID NO: 554641 - protein, 9 aa, Homo Sapiens
QLEALLRSL

SEQ ID NO: 554642 - protein, 9 aa, Homo Sapiens
PFPNQDSDL

SEQ ID NO: 554643 - protein, 9 aa, Homo Sapiens
LLVEGGPAP

SEQ ID NO: 554644 - protein, 9 aa, Homo Sapiens
DAAKKSSGH

SEQ ID NO: 554645 - protein, 9 aa, Homo Sapiens
KLFRRHSFM

SEQ ID NO: 554646 - protein, 9 aa, Homo Sapiens
NKKIQFNAQ

SEQ ID NO: 554647 - protein, 9 aa, Homo Sapiens
RTEKDYAAL

SEQ ID NO: 554648 - protein, 9 aa, Homo Sapiens
PGPLKATSK

SEQ ID NO: 554649 - protein, 9 aa, Homo Sapiens
RVHINEELQ

SEQ ID NO: 554650 - protein, 9 aa, Homo Sapiens
LELATRSDS

SEQ ID NO: 554651 - protein, 9 aa, Homo Sapiens
QIWTKSKFL

SEQ ID NO: 554652 - protein, 9 aa, Homo Sapiens
SVIQERFGS

SEQ ID NO: 554653 - protein, 9 aa, Homo Sapiens
YYRRQNSFK

SEQ ID NO: 554654 - protein, 9 aa, Homo Sapiens
PKAKHARME

SEQ ID NO: 554655 - protein, 9 aa, Homo Sapiens
KDKMKCTEN

SEQ ID NO: 554656 - protein, 9 aa, Homo Sapiens
KCRNRQREL

SEQ ID NO: 554657 - protein, 9 aa, Homo Sapiens
ALLRSLPPP

SEQ ID NO: 554658 - protein, 9 aa, Homo Sapiens
IWSLLCTCC

SEQ ID NO: 554659 - protein, 9 aa, Homo Sapiens
DYAALARET

SEQ ID NO: 554660 - protein, 9 aa, Homo Sapiens
EGSGRRAGG

SEQ ID NO: 554661 - protein, 9 aa, Homo Sapiens
GVNANVEKH

SEQ ID NO: 554662 - protein, 9 aa, Homo Sapiens
QSCMHFQPN

SEQ ID NO: 554663 - protein, 9 aa, Homo Sapiens
MHFQPNSPA

SEQ ID NO: 554664 - protein, 9 aa, Homo Sapiens
KELSDIWSL

SEQ ID NO: 554665 - protein, 9 aa, Homo Sapiens
YIGALRENT

SEQ ID NO: 554666 - protein, 9 aa, Homo Sapiens
GFAGYIGAL

SEQ ID NO: 554667 - protein, 9 aa, Homo Sapiens
EKGNNKPWR

SEQ ID NO: 554668 - protein, 9 aa, Homo Sapiens
SFVGMVDNL

SEQ ID NO: 554669 - protein, 9 aa, Homo Sapiens
AENLEDAAK

SEQ ID NO: 554670 - protein, 9 aa, Homo Sapiens
QKSQAYLEP

SEQ ID NO: 554671 - protein, 9 aa, Homo Sapiens
WRWMPMLAA

SEQ ID NO: 554672 - protein, 9 aa, Homo Sapiens
RAHLSLEEQ

SEQ ID NO: 554673 - protein, 9 aa, Homo Sapiens
PNQDSDLVV

SEQ ID NO: 554674 - protein, 9 aa, Homo Sapiens
VGMVDNLRG

SEQ ID NO: 554675 - protein, 9 aa, Homo Sapiens
GMQRFIPNI

SEQ ID NO: 554676 - protein, 9 aa, Homo Sapiens
NKVGCTPAH

SEQ ID NO: 554677 - protein, 9 aa, Homo Sapiens
RRGSFVGMV

SEQ ID NO: 554678 - protein, 9 aa, Homo Sapiens
VVQNGDMET

SEQ ID NO: 554679 - protein, 9 aa, Homo Sapiens
NANVEKHLE

SEQ ID NO: 554680 - protein, 9 aa, Homo Sapiens
IQFNAQIWT

SEQ ID NO: 554681 - protein, 9 aa, Homo Sapiens
SLLQHQYRK

SEQ ID NO: 554682 - protein, 9 aa, Homo Sapiens
EQLRQVVQN

SEQ ID NO: 554683 - protein, 9 aa, Homo Sapiens
ENNQQSKKI

SEQ ID NO: 554684 - protein, 9 aa, Homo Sapiens
GQDVPLKPV

SEQ ID NO: 554685 - protein, 9 aa, Homo Sapiens
PVFGEEYEQ

SEQ ID NO: 554686 - protein, 9 aa, Homo Sapiens
ILGFAGYIG

SEQ ID NO: 554687 - protein, 9 aa, Homo Sapiens
QLYRTEKDY

SEQ ID NO: 554688 - protein, 9 aa, Homo Sapiens
QNWGSLCST

SEQ ID NO: 554689 - protein, 9 aa, Homo Sapiens
NICELAITL

SEQ ID NO: 554690 - protein, 9 aa, Homo Sapiens
RQNSFKIKN

SEQ ID NO: 554691 - protein, 9 aa, Homo Sapiens
TDFWARFTT

SEQ ID NO: 554692 - protein, 9 aa, Homo Sapiens
QEEEPKAKH

SEQ ID NO: 554693 - protein, 9 aa, Homo Sapiens
KKMYYRRQN

SEQ ID NO: 554694 - protein, 9 aa, Homo Sapiens
YRKSKFFIE

SEQ ID NO: 554695 - protein, 9 aa, Homo Sapiens
RRQNSFKIK

SEQ ID NO: 554696 - protein, 9 aa, Homo Sapiens
SNSKLFRRH

SEQ ID NO: 554697 - protein, 9 aa, Homo Sapiens
AKKSSGHMQ

SEQ ID NO: 554698 - protein, 9 aa, Homo Sapiens
VFGEEYEQQ

SEQ ID NO: 554699 - protein, 9 aa, Homo Sapiens
CMHFQPNSP

SEQ ID NO: 554700 - protein, 9 aa, Homo Sapiens
TQPAFALPT

SEQ ID NO: 554701 - protein, 9 aa, Homo Sapiens
IQERFGSRC

SEQ ID NO: 554702 - protein, 9 aa, Homo Sapiens
WSLELATRS

SEQ ID NO: 554703 - protein, 9 aa, Homo Sapiens
DLVVLSGTD

SEQ ID NO: 554704 - protein, 9 aa, Homo Sapiens
FNAQIWTKS

SEQ ID NO: 554705 - protein, 9 aa, Homo Sapiens
EEGSGRRAG

SEQ ID NO: 554706 - protein, 9 aa, Homo Sapiens
SLCSTLSFC

SEQ ID NO: 554707 - protein, 9 aa, Homo Sapiens
EKDYAALAR

SEQ ID NO: 554708 - protein, 9 aa, Homo Sapiens
PSPQKDQAP

SEQ ID NO: 554709 - protein, 9 aa, Homo Sapiens
HCIRRWTTK

SEQ ID NO: 554710 - protein, 9 aa, Homo Sapiens
VHARNKVGC

SEQ ID NO: 554711 - protein, 9 aa, Homo Sapiens
PHVHVTGED

SEQ ID NO: 554712 - protein, 9 aa, Homo Sapiens
FNFASCPFL

SEQ ID NO: 554713 - protein, 9 aa, Homo Sapiens
KADNVMNQC

SEQ ID NO: 554714 - protein, 9 aa, Homo Sapiens
LLCTCCRTP

SEQ ID NO: 554715 - protein, 9 aa, Homo Sapiens
ACCVISATD

SEQ ID NO: 554716 - protein, 9 aa, Homo Sapiens
LQEQLRQVV

SEQ ID NO: 554717 - protein, 9 aa, Homo Sapiens
AAIQESKEE

SEQ ID NO: 554718 - protein, 9 aa, Homo Sapiens
LEHQPLPES

SEQ ID NO: 554719 - protein, 9 aa, Homo Sapiens
DPANRAHLS

SEQ ID NO: 554720 - protein, 9 aa, Homo Sapiens
PDACCVISA

SEQ ID NO: 554721 - protein, 9 aa, Homo Sapiens
GIPDIHMMP

SEQ ID NO: 554722 - protein, 9 aa, Homo Sapiens
TTLNESITT

SEQ ID NO: 554723 - protein, 9 aa, Homo Sapiens
LEDAAKKSS

SEQ ID NO: 554724 - protein, 9 aa, Homo Sapiens
ENLEDAAKK

SEQ ID NO: 554725 - protein, 9 aa, Homo Sapiens
CTPAHLAAL

SEQ ID NO: 554726 - protein, 9 aa, Homo Sapiens
NVMNQCPVH

SEQ ID NO: 554727 - protein, 9 aa, Homo Sapiens
GFAQPAAIQ

SEQ ID NO: 554728 - protein, 9 aa, Homo Sapiens
WLRHKADNV

SEQ ID NO: 554729 - protein, 9 aa, Homo Sapiens
KDQAPGDGI

SEQ ID NO: 554730 - protein, 9 aa, Homo Sapiens
ECGVNANVE

SEQ ID NO: 554731 - protein, 9 aa, Homo Sapiens
NKPWRWMPM

SEQ ID NO: 554732 - protein, 9 aa, Homo Sapiens
EVLLFSGGL

SEQ ID NO: 554733 - protein, 9 aa, Homo Sapiens
GPNQHCIRR

SEQ ID NO: 554734 - protein, 9 aa, Homo Sapiens
ANVEKHLEL

SEQ ID NO: 554735 - protein, 9 aa, Homo Sapiens
AGYIGALRE

SEQ ID NO: 554736 - protein, 9 aa, Homo Sapiens
DIHMMPAHP

SEQ ID NO: 554737 - protein, 9 aa, Homo Sapiens
SLQSCMHFQ

SEQ ID NO: 554738 - protein, 9 aa, Homo Sapiens
QGSVALSPR

SEQ ID NO: 554739 - protein, 9 aa, Homo Sapiens
FIPNISWQP

SEQ ID NO: 554740 - protein, 9 aa, Homo Sapiens
NPYRKSKFF

SEQ ID NO: 554741 - protein, 9 aa, Homo Sapiens
LGEEREKRR

SEQ ID NO: 554742 - protein, 9 aa, Homo Sapiens
NQDSDLVVL

SEQ ID NO: 554743 - protein, 9 aa, Homo Sapiens
HINEELQIF

SEQ ID NO: 554744 - protein, 9 aa, Homo Sapiens
YRTEKDYAA

SEQ ID NO: 554745 - protein, 9 aa, Homo Sapiens
AWPCGFAQP

SEQ ID NO: 554746 - protein, 9 aa, Homo Sapiens
RHKADNVMN

SEQ ID NO: 554747 - protein, 9 aa, Homo Sapiens
KMYYRRQNS

SEQ ID NO: 554748 - protein, 9 aa, Homo Sapiens
PQKDQAPGD

SEQ ID NO: 554749 - protein, 9 aa, Homo Sapiens
ILHLRIPEI

SEQ ID NO: 554750 - protein, 9 aa, Homo Sapiens
RHLNLCPIC

SEQ ID NO: 554751 - protein, 9 aa, Homo Sapiens
QVVQNGDME

SEQ ID NO: 554752 - protein, 9 aa, Homo Sapiens
KLLVEGGPA

SEQ ID NO: 554753 - protein, 9 aa, Homo Sapiens
GSFILMGFP

SEQ ID NO: 554754 - protein, 9 aa, Homo Sapiens
VIAQKLEHQ

SEQ ID NO: 554755 - protein, 9 aa, Homo Sapiens
PRVHINEEL

SEQ ID NO: 554756 - protein, 9 aa, Homo Sapiens
SLELATRSD

SEQ ID NO: 554757 - protein, 9 aa, Homo Sapiens
QDSDLVVLS

SEQ ID NO: 554758 - protein, 9 aa, Homo Sapiens
KCTENNQQS

SEQ ID NO: 554759 - protein, 9 aa, Homo Sapiens
SHAWNICEL

SEQ ID NO: 554760 - protein, 9 aa, Homo Sapiens
CTNPYRKSK

SEQ ID NO: 554761 - protein, 9 aa, Homo Sapiens
GLEEGSGRR

SEQ ID NO: 554762 - protein, 9 aa, Homo Sapiens
PPNGMQRFI

SEQ ID NO: 554763 - protein, 9 aa, Homo Sapiens
MPVIEVWKS

SEQ ID NO: 554764 - protein, 9 aa, Homo Sapiens
AGMPVIEVW

SEQ ID NO: 554765 - protein, 9 aa, Homo Sapiens
VHINEELQI

SEQ ID NO: 554766 - protein, 9 aa, Homo Sapiens
LTQPAFALP

SEQ ID NO: 554767 - protein, 9 aa, Homo Sapiens
VLLRPFYQV

SEQ ID NO: 554768 - protein, 9 aa, Homo Sapiens
QEQLRQVVQ

SEQ ID NO: 554769 - protein, 9 aa, Homo Sapiens
RKSKFFIEE

SEQ ID NO: 554770 - protein, 9 aa, Homo Sapiens
FKDKMKCTE

SEQ ID NO: 554771 - protein, 9 aa, Homo Sapiens
PAAIQESKE

SEQ ID NO: 554772 - protein, 9 aa, Homo Sapiens
QKQKSQAYL

SEQ ID NO: 554773 - protein, 9 aa, Homo Sapiens
RDGGIPDIH

SEQ ID NO: 554774 - protein, 9 aa, Homo Sapiens
SFILMGFPF

SEQ ID NO: 554775 - protein, 9 aa, Homo Sapiens
QNSFKIKNI

SEQ ID NO: 554776 - protein, 9 aa, Homo Sapiens
PANRAHLSL

SEQ ID NO: 554777 - protein, 9 aa, Homo Sapiens
HAWNICELA

SEQ ID NO: 554778 - protein, 9 aa, Homo Sapiens
QFTVSGDAM

SEQ ID NO: 554779 - protein, 9 aa, Homo Sapiens
MFILGFAGY

SEQ ID NO: 554780 - protein, 9 aa, Homo Sapiens
LFRRHSFMS

SEQ ID NO: 554781 - protein, 9 aa, Homo Sapiens
SDSRLYALW

SEQ ID NO: 554782 - protein, 9 aa, Homo Sapiens
GSGRRAGGR

SEQ ID NO: 554783 - protein, 9 aa, Homo Sapiens
VGCTPAHLA

SEQ ID NO: 554784 - protein, 9 aa, Homo Sapiens
LESVIQERF

SEQ ID NO: 554785 - protein, 9 aa, Homo Sapiens
PGRRGSFVG

SEQ ID NO: 554786 - protein, 9 aa, Homo Sapiens
YVLQILHLR

SEQ ID NO: 554787 - protein, 9 aa, Homo Sapiens
GYIGALREN

SEQ ID NO: 554788 - protein, 9 aa, Homo Sapiens
LEVLLFSGG

SEQ ID NO: 554789 - protein, 9 aa, Homo Sapiens
EEQLRARSP

SEQ ID NO: 554790 - protein, 9 aa, Homo Sapiens
TGGCTNPYR

SEQ ID NO: 554791 - protein, 9 aa, Homo Sapiens
GCTPAHLAA

SEQ ID NO: 554792 - protein, 9 aa, Homo Sapiens
ESLQSCMHF

SEQ ID NO: 554793 - protein, 9 aa, Homo Sapiens
EKLLVEGGP

SEQ ID NO: 554794 - protein, 9 aa, Homo Sapiens
SIIAGMPVI

SEQ ID NO: 554795 - protein, 9 aa, Homo Sapiens
CPFLLPSKI

SEQ ID NO: 554796 - protein, 9 aa, Homo Sapiens
AGPNQHCIR

SEQ ID NO: 554797 - protein, 9 aa, Homo Sapiens
GLEVLLFSG

SEQ ID NO: 554798 - protein, 9 aa, Homo Sapiens
LSLEEQLRE

SEQ ID NO: 554799 - protein, 9 aa, Homo Sapiens
PGCPASAPA

SEQ ID NO: 554800 - protein, 9 aa, Homo Sapiens
ELATRSDSR

SEQ ID NO: 554801 - protein, 9 aa, Homo Sapiens
SVGPRVHIN

SEQ ID NO: 554802 - protein, 9 aa, Homo Sapiens
AAKCRNRQR

SEQ ID NO: 554803 - protein, 9 aa, Homo Sapiens
QILHLRIPE

SEQ ID NO: 554804 - protein, 9 aa, Homo Sapiens
KSQAYLEPE

SEQ ID NO: 554805 - protein, 9 aa, Homo Sapiens
GPLKATSKK

SEQ ID NO: 554806 - protein, 9 aa, Homo Sapiens
ILAQKQKSQ

SEQ ID NO: 554807 - protein, 9 aa, Homo Sapiens
ELPAASEFS

SEQ ID NO: 554808 - protein, 9 aa, Homo Sapiens
FRRHSFMST

SEQ ID NO: 554809 - protein, 9 aa, Homo Sapiens
FTTLNESIT

SEQ ID NO: 554810 - protein, 9 aa, Homo Sapiens
SLEEQLREL

SEQ ID NO: 554811 - protein, 9 aa, Homo Sapiens
RQLEALLRS

SEQ ID NO: 554812 - protein, 9 aa, Homo Sapiens
AASEFSTSE

SEQ ID NO: 554813 - protein, 9 aa, Homo Sapiens
AYILGKFST

SEQ ID NO: 554814 - protein, 9 aa, Homo Sapiens
WNICELAIT

SEQ ID NO: 554815 - protein, 9 aa, Homo Sapiens
VLQILHLRI

SEQ ID NO: 554816 - protein, 9 aa, Homo Sapiens
DNVMNQCPV

SEQ ID NO: 554817 - protein, 9 aa, Homo Sapiens
LLGLEVLLF

SEQ ID NO: 554818 - protein, 9 aa, Homo Sapiens
LMEMGFPRR

SEQ ID NO: 554819 - protein, 9 aa, Homo Sapiens
FPFNEVGGY

SEQ ID NO: 554820 - protein, 9 aa, Homo Sapiens
DVPLKPVAE

SEQ ID NO: 554821 - protein, 9 aa, Homo Sapiens
SVIAQKLEH

SEQ ID NO: 554822 - protein, 9 aa, Homo Sapiens
VYSLLQHQY

SEQ ID NO: 554823 - protein, 9 aa, Homo Sapiens
ALAWPCGFA

SEQ ID NO: 554824 - protein, 9 aa, Homo Sapiens
MMPAHPGCP

SEQ ID NO: 554825 - protein, 9 aa, Homo Sapiens
LRQLEALLR

SEQ ID NO: 554826 - protein, 9 aa, Homo Sapiens
GSVALSPRS

SEQ ID NO: 554827 - protein, 9 aa, Homo Sapiens
GGIPDIHMM

SEQ ID NO: 554828 - protein, 9 aa, Homo Sapiens
FASCPFLLP

SEQ ID NO: 554829 - protein, 9 aa, Homo Sapiens
TENNQQSKK

SEQ ID NO: 554830 - protein, 9 aa, Homo Sapiens
PFYQVAEYT

SEQ ID NO: 554831 - protein, 9 aa, Homo Sapiens
ILNPHVHVT

SEQ ID NO: 554832 - protein, 9 aa, Homo Sapiens
KPWRWMPML

SEQ ID NO: 554833 - protein, 9 aa, Homo Sapiens
PLQGSVALS

SEQ ID NO: 554834 - protein, 9 aa, Homo Sapiens
KLEHQPLPE

SEQ ID NO: 554835 - protein, 9 aa, Homo Sapiens
QLRARSPWL

SEQ ID NO: 554836 - protein, 9 aa, Homo Sapiens
LRARSPWLP

SEQ ID NO: 554837 - protein, 9 aa, Homo Sapiens
MEMGFPRRN

SEQ ID NO: 554838 - protein, 9 aa, Homo Sapiens
FALPTSLSL

SEQ ID NO: 554839 - protein, 9 aa, Homo Sapiens
EADRRHLNL

SEQ ID NO: 554840 - protein, 9 aa, Homo Sapiens
EQLRARSPW

SEQ ID NO: 554841 - protein, 9 aa, Homo Sapiens
GMVDNLRGK

SEQ ID NO: 554842 - protein, 9 aa, Homo Sapiens
HKADNVMNQ

SEQ ID NO: 554843 - protein, 9 aa, Homo Sapiens
FPNQDSDLV

SEQ ID NO: 554844 - protein, 9 aa, Homo Sapiens
RFTTLNESI

SEQ ID NO: 554845 - protein, 9 aa, Homo Sapiens
ASEFSTSET

SEQ ID NO: 554846 - protein, 9 aa, Homo Sapiens
FSHAWNICE

SEQ ID NO: 554847 - protein, 9 aa, Homo Sapiens
MGFPRRNIE

SEQ ID NO: 554848 - protein, 9 aa, Homo Sapiens
AALAWPCGF

SEQ ID NO: 554849 - protein, 9 aa, Homo Sapiens
PWRWMPMLA

SEQ ID NO: 554850 - protein, 9 aa, Homo Sapiens
DGGIPDIHM

SEQ ID NO: 554851 - protein, 9 aa, Homo Sapiens
CTENNQQSK

SEQ ID NO: 554852 - protein, 9 aa, Homo Sapiens
GCPASAPAA

SEQ ID NO: 554853 - protein, 9 aa, Homo Sapiens
SPQKDQAPG

SEQ ID NO: 554854 - protein, 9 aa, Homo Sapiens
QRELTDRLQ

SEQ ID NO: 554855 - protein, 9 aa, Homo Sapiens
RRAGGRAGG

SEQ ID NO: 554856 - protein, 9 aa, Homo Sapiens
ESVIQERFG

SEQ ID NO: 554857 - protein, 9 aa, Homo Sapiens
IAQKLEHQP

SEQ ID NO: 554858 - protein, 9 aa, Homo Sapiens
DIWSLLCTC

SEQ ID NO: 554859 - protein, 9 aa, Homo Sapiens
ASCPFLLPS

SEQ ID NO: 554860 - protein, 9 aa, Homo Sapiens
LQGSVALSP

SEQ ID NO: 554861 - protein, 9 aa, Homo Sapiens
QHCIRRWTT

SEQ ID NO: 554862 - protein, 9 aa, Homo Sapiens
NRAHLSLEE

SEQ ID NO: 554863 - protein, 9 aa, Homo Sapiens
NSKLFRRHS

SEQ ID NO: 554864 - protein, 9 aa, Homo Sapiens
EEPKAKHAR

SEQ ID NO: 554865 - protein, 9 aa, Homo Sapiens
GCTNPYRKS

SEQ ID NO: 554866 - protein, 9 aa, Homo Sapiens
CRNRQRELT

SEQ ID NO: 554867 - protein, 9 aa, Homo Sapiens
PASAPAALA

SEQ ID NO: 554868 - protein, 9 aa, Homo Sapiens
RPFYQVAEY

SEQ ID NO: 554869 - protein, 9 aa, Homo Sapiens
NAQIWTKSK

SEQ ID NO: 554870 - protein, 9 aa, Homo Sapiens
TATLESVIQ

SEQ ID NO: 554871 - protein, 9 aa, Homo Sapiens
FILMGFPFN

SEQ ID NO: 554872 - protein, 9 aa, Homo Sapiens
TLADPRGLL

SEQ ID NO: 554873 - protein, 9 aa, Homo Sapiens
QKDQAPGDG

SEQ ID NO: 554874 - protein, 9 aa, Homo Sapiens
LNPHVHVTG

SEQ ID NO: 554875 - protein, 9 aa, Homo Sapiens
MKCTENNQQ

SEQ ID NO: 554876 - protein, 9 aa, Homo Sapiens
GNNKPWRWM

SEQ ID NO: 554877 - protein, 9 aa, Homo Sapiens
TLSFCTSAI

SEQ ID NO: 554878 - protein, 9 aa, Homo Sapiens
CAVAATTLA

SEQ ID NO: 554879 - protein, 9 aa, Homo Sapiens
WGSLCSTLS

SEQ ID NO: 554880 - protein, 9 aa, Homo Sapiens
WARFTTLNE

SEQ ID NO: 554881 - protein, 9 aa, Homo Sapiens
LRQQEEEPK

SEQ ID NO: 554882 - protein, 9 aa, Homo Sapiens
DKMKCTENN

SEQ ID NO: 554883 - protein, 9 aa, Homo Sapiens
GGPDACCVI

SEQ ID NO: 554884 - protein, 9 aa, Homo Sapiens
ATATLESVI

SEQ ID NO: 554885 - protein, 9 aa, Homo Sapiens
ELSDIWSLL

SEQ ID NO: 554886 - protein, 9 aa, Homo Sapiens
PFNEVGGYE

SEQ ID NO: 554887 - protein, 9 aa, Homo Sapiens
EQQPRPRSK

SEQ ID NO: 554888 - protein, 9 aa, Homo Sapiens
PAFALPTSL

SEQ ID NO: 554889 - protein, 9 aa, Homo Sapiens
RSDSRLYAL

SEQ ID NO: 554890 - protein, 9 aa, Homo Sapiens
AQKLEHQPL

SEQ ID NO: 554891 - protein, 9 aa, Homo Sapiens
SDPLQGSVA

SEQ ID NO: 554892 - protein, 9 aa, Homo Sapiens
VPGPLKATS

SEQ ID NO: 554893 - protein, 9 aa, Homo Sapiens
SDLVVLSGT

SEQ ID NO: 554894 - protein, 9 aa, Homo Sapiens
SPWLPPSQP

SEQ ID NO: 554895 - protein, 9 aa, Homo Sapiens
INEELQIFS

SEQ ID NO: 554896 - protein, 9 aa, Homo Sapiens
LLRSLPPPQ

SEQ ID NO: 554897 - protein, 9 aa, Homo Sapiens
EYEQQPRPR

SEQ ID NO: 554898 - protein, 9 aa, Homo Sapiens
RFIPNISWQ

SEQ ID NO: 554899 - protein, 9 aa, Homo Sapiens
KGNNKPWRW

SEQ ID NO: 554900 - protein, 9 aa, Homo Sapiens
ASAPAALAW

SEQ ID NO: 554901 - protein, 9 aa, Homo Sapiens
RGSFVGMVD

SEQ ID NO: 554902 - protein, 8 aa, Homo Sapiens
ASRLLLNN

SEQ ID NO: 554903 - protein, 9 aa, Homo Sapiens
MQAHITGLV

SEQ ID NO: 554904 - protein, 9 aa, Homo Sapiens
CCVISATDG

SEQ ID NO: 554905 - protein, 9 aa, Homo Sapiens
SFGGPDACC

SEQ ID NO: 554906 - protein, 9 aa, Homo Sapiens
GKFSTWTNT

SEQ ID NO: 554907 - protein, 9 aa, Homo Sapiens
YEQQPRPRS

SEQ ID NO: 554908 - protein, 9 aa, Homo Sapiens
SGDPVLLRP

SEQ ID NO: 554909 - protein, 9 aa, Homo Sapiens
GPGWEYARQ

SEQ ID NO: 554910 - protein, 9 aa, Homo Sapiens
DLIEKKVNP

SEQ ID NO: 554911 - protein, 9 aa, Homo Sapiens
DKLYKCEHF

SEQ ID NO: 554912 - protein, 9 aa, Homo Sapiens
CKESVRTVI

SEQ ID NO: 554913 - protein, 9 aa, Homo Sapiens
HLRLSPRGV

SEQ ID NO: 554914 - protein, 9 aa, Homo Sapiens
PWPRRGSWR

SEQ ID NO: 554915 - protein, 9 aa, Homo Sapiens
DLVWTLTDF

SEQ ID NO: 554916 - protein, 9 aa, Homo Sapiens
PLDSNDDNT

SEQ ID NO: 554917 - protein, 9 aa, Homo Sapiens
SELENKERN

SEQ ID NO: 554918 - protein, 9 aa, Homo Sapiens
ESPMALLSD

SEQ ID NO: 554919 - protein, 9 aa, Homo Sapiens
GKTTDISRI

SEQ ID NO: 554920 - protein, 9 aa, Homo Sapiens
YEEQHPETA

SEQ ID NO: 554921 - protein, 9 aa, Homo Sapiens
FGVLDFAEC

SEQ ID NO: 554922 - protein, 9 aa, Homo Sapiens
VATWRQRSS

SEQ ID NO: 554923 - protein, 9 aa, Homo Sapiens
IPQGIVATW

SEQ ID NO: 554924 - protein, 9 aa, Homo Sapiens
TIHSICKAS

SEQ ID NO: 554925 - protein, 9 aa, Homo Sapiens
CPWPRRGSW

SEQ ID NO: 554926 - protein, 9 aa, Homo Sapiens
ECTKNITAW

SEQ ID NO: 554927 - protein, 9 aa, Homo Sapiens
SNTAVCVCK

SEQ ID NO: 554928 - protein, 9 aa, Homo Sapiens
DHLLGLRAT

SEQ ID NO: 554929 - protein, 9 aa, Homo Sapiens
YLFQIIPRS

SEQ ID NO: 554930 - protein, 9 aa, Homo Sapiens
SWRALRLST

SEQ ID NO: 554931 - protein, 9 aa, Homo Sapiens
FPDGSLEDD

SEQ ID NO: 554932 - protein, 9 aa, Homo Sapiens
GIVATWRQR

SEQ ID NO: 554933 - protein, 9 aa, Homo Sapiens
ISLEPESCS

SEQ ID NO: 554934 - protein, 9 aa, Homo Sapiens
LRLSTWCPR

SEQ ID NO: 554935 - protein, 9 aa, Homo Sapiens
VQVISLEPE

SEQ ID NO: 554936 - protein, 9 aa, Homo Sapiens
SYFIKGKRT

SEQ ID NO: 554937 - protein, 9 aa, Homo Sapiens
IVATWRQRS

SEQ ID NO: 554938 - protein, 9 aa, Homo Sapiens
AGSSKFPTS

SEQ ID NO: 554939 - protein, 9 aa, Homo Sapiens
GSSKFPTSL

SEQ ID NO: 554940 - protein, 9 aa, Homo Sapiens
AVRVAEEVL

SEQ ID NO: 554941 - protein, 9 aa, Homo Sapiens
KKVNPPGIM

SEQ ID NO: 554942 - protein, 9 aa, Homo Sapiens
SPMALLSDP

SEQ ID NO: 554943 - protein, 9 aa, Homo Sapiens
GFEVCDIHP

SEQ ID NO: 554944 - protein, 9 aa, Homo Sapiens
TPYEEQHPE

SEQ ID NO: 554945 - protein, 9 aa, Homo Sapiens
RSFEDAHWR

SEQ ID NO: 554946 - protein, 9 aa, Homo Sapiens
CFGVCDWHS

SEQ ID NO: 554947 - protein, 9 aa, Homo Sapiens
GPRMHTNDG

SEQ ID NO: 554948 - protein, 9 aa, Homo Sapiens
QADGPKGTL

SEQ ID NO: 554949 - protein, 9 aa, Homo Sapiens
LNDCLASYL

SEQ ID NO: 554950 - protein, 9 aa, Homo Sapiens
SGRWASPDP

SEQ ID NO: 554951 - protein, 9 aa, Homo Sapiens
ELENKERNT

SEQ ID NO: 554952 - protein, 9 aa, Homo Sapiens
TWQMIENAT

SEQ ID NO: 554953 - protein, 9 aa, Homo Sapiens
QVEVDETLT

SEQ ID NO: 554954 - protein, 9 aa, Homo Sapiens
DGSLEDDFD

SEQ ID NO: 554955 - protein, 9 aa, Homo Sapiens
LTDVALACR

SEQ ID NO: 554956 - protein, 9 aa, Homo Sapiens
AASSAVRVA

SEQ ID NO: 554957 - protein, 9 aa, Homo Sapiens
YTRKERCLQ

SEQ ID NO: 554958 - protein, 9 aa, Homo Sapiens
FEDAHWRET

SEQ ID NO: 554959 - protein, 9 aa, Homo Sapiens
VYTRKERCL

SEQ ID NO: 554960 - protein, 9 aa, Homo Sapiens
LHVLGPNRR

SEQ ID NO: 554961 - protein, 9 aa, Homo Sapiens
AVCVCKESV

SEQ ID NO: 554962 - protein, 9 aa, Homo Sapiens
LIVMQTGNS

SEQ ID NO: 554963 - protein, 9 aa, Homo Sapiens
CEHFYLFQI

SEQ ID NO: 554964 - protein, 9 aa, Homo Sapiens
FLKARPGNG

SEQ ID NO: 554965 - protein, 9 aa, Homo Sapiens
TPPNLEIDP

SEQ ID NO: 554966 - protein, 9 aa, Homo Sapiens
VHVHHPVFS

SEQ ID NO: 554967 - protein, 9 aa, Homo Sapiens
PVDFFPHTP

SEQ ID NO: 554968 - protein, 9 aa, Homo Sapiens
SPDPAWASR

SEQ ID NO: 554969 - protein, 9 aa, Homo Sapiens
VNHNLCSNA

SEQ ID NO: 554970 - protein, 9 aa, Homo Sapiens
LHLRLSPRG

SEQ ID NO: 554971 - protein, 9 aa, Homo Sapiens
ILFSNELHL

SEQ ID NO: 554972 - protein, 9 aa, Homo Sapiens
NELHLRLSP

SEQ ID NO: 554973 - protein, 9 aa, Homo Sapiens
TGNSHISWE

SEQ ID NO: 554974 - protein, 9 aa, Homo Sapiens
NHNLCSNAC

SEQ ID NO: 554975 - protein, 9 aa, Homo Sapiens
SVTPSFLVP

SEQ ID NO: 554976 - protein, 9 aa, Homo Sapiens
PLDHLLGLR

SEQ ID NO: 554977 - protein, 9 aa, Homo Sapiens
GQLLAERYD

SEQ ID NO: 554978 - protein, 9 aa, Homo Sapiens
DHRARACFP

SEQ ID NO: 554979 - protein, 9 aa, Homo Sapiens
LAAPRGVCY

SEQ ID NO: 554980 - protein, 9 aa, Homo Sapiens
LGKTTDISR

SEQ ID NO: 554981 - protein, 9 aa, Homo Sapiens
GTMTSSDPG

SEQ ID NO: 554982 - protein, 9 aa, Homo Sapiens
LHEDTLSLH

SEQ ID NO: 554983 - protein, 9 aa, Homo Sapiens
EHFYLFQII

SEQ ID NO: 554984 - protein, 9 aa, Homo Sapiens
GCLRVFHLD

SEQ ID NO: 554985 - protein, 9 aa, Homo Sapiens
FPTSLGPEN

SEQ ID NO: 554986 - protein, 9 aa, Homo Sapiens
GRASPGQAS

SEQ ID NO: 554987 - protein, 9 aa, Homo Sapiens
ELHLRLSPR

SEQ ID NO: 554988 - protein, 9 aa, Homo Sapiens
LGQLLAERY

SEQ ID NO: 554989 - protein, 9 aa, Homo Sapiens
AQPSTSGKR

SEQ ID NO: 554990 - protein, 9 aa, Homo Sapiens
EHTGPGWEY

SEQ ID NO: 554991 - protein, 9 aa, Homo Sapiens
TLTSALHED

SEQ ID NO: 554992 - protein, 9 aa, Homo Sapiens
FHPIGFEVC

SEQ ID NO: 554993 - protein, 9 aa, Homo Sapiens
PFTLTSALH

SEQ ID NO: 554994 - protein, 9 aa, Homo Sapiens
VCYGADHDL

SEQ ID NO: 554995 - protein, 9 aa, Homo Sapiens
ALHEDTLSL

SEQ ID NO: 554996 - protein, 9 aa, Homo Sapiens
ACFPNMVNM

SEQ ID NO: 554997 - protein, 9 aa, Homo Sapiens
KTYLRDFMY

SEQ ID NO: 554998 - protein, 9 aa, Homo Sapiens
LSTWCPRGS

SEQ ID NO: 554999 - protein, 9 aa, Homo Sapiens
PPKERSCFG

SEQ ID NO: 555000 - protein, 9 aa, Homo Sapiens
VLDFAECTK

SEQ ID NO: 555001 - protein, 9 aa, Homo Sapiens
LFQIIPRSF

SEQ ID NO: 555002 - protein, 9 aa, Homo Sapiens
LDFAECTKN

SEQ ID NO: 555003 - protein, 9 aa, Homo Sapiens
SIPQGIVAT

SEQ ID NO: 555004 - protein, 9 aa, Homo Sapiens
DVALACRWQ

SEQ ID NO: 555005 - protein, 9 aa, Homo Sapiens
AERYDPDRR

SEQ ID NO: 555006 - protein, 9 aa, Homo Sapiens
PTSLGPENS

SEQ ID NO: 555007 - protein, 9 aa, Homo Sapiens
EKKVNPPGI

SEQ ID NO: 555008 - protein, 9 aa, Homo Sapiens
TDVALACRW

SEQ ID NO: 555009 - protein, 9 aa, Homo Sapiens
ILSVTPSFL

SEQ ID NO: 555010 - protein, 9 aa, Homo Sapiens
IKGKRTGLG

SEQ ID NO: 555011 - protein, 9 aa, Homo Sapiens
ALACRWQRT

SEQ ID NO: 555012 - protein, 9 aa, Homo Sapiens
SAVRVAEEV

SEQ ID NO: 555013 - protein, 9 aa, Homo Sapiens
VCDIHPGSD

SEQ ID NO: 555014 - protein, 9 aa, Homo Sapiens
RWASPDPAW

SEQ ID NO: 555015 - protein, 9 aa, Homo Sapiens
ESSCCRPSC

SEQ ID NO: 555016 - protein, 9 aa, Homo Sapiens
TPSFLVPES

SEQ ID NO: 555017 - protein, 9 aa, Homo Sapiens
QIIPRSFED

SEQ ID NO: 555018 - protein, 9 aa, Homo Sapiens
TSALHEDTL

SEQ ID NO: 555019 - protein, 9 aa, Homo Sapiens
GIPSAEEEL

SEQ ID NO: 555020 - protein, 9 aa, Homo Sapiens
FDLLIVMQT

SEQ ID NO: 555021 - protein, 9 aa, Homo Sapiens
KLYKCEHFY

SEQ ID NO: 555022 - protein, 9 aa, Homo Sapiens
VEVDETLTD

SEQ ID NO: 555023 - protein, 9 aa, Homo Sapiens
AMGYKPKTY

SEQ ID NO: 555024 - protein, 9 aa, Homo Sapiens
ATMQNLNDC

SEQ ID NO: 555025 - protein, 9 aa, Homo Sapiens
CVCKESVRT

SEQ ID NO: 555026 - protein, 9 aa, Homo Sapiens
NDCLASYLD

SEQ ID NO: 555027 - protein, 9 aa, Homo Sapiens
RALRLSTWC

SEQ ID NO: 555028 - protein, 9 aa, Homo Sapiens
VTPSFLVPE

SEQ ID NO: 555029 - protein, 9 aa, Homo Sapiens
FHLDSMLLR

SEQ ID NO: 555030 - protein, 9 aa, Homo Sapiens
PKTYLRDFM

SEQ ID NO: 555031 - protein, 9 aa, Homo Sapiens
PDLVWTLTD

SEQ ID NO: 555032 - protein, 9 aa, Homo Sapiens
DLLIVMQTG

SEQ ID NO: 555033 - protein, 9 aa, Homo Sapiens
HTNDGRVVS

SEQ ID NO: 555034 - protein, 9 aa, Homo Sapiens
WEYARQMQQ

SEQ ID NO: 555035 - protein, 9 aa, Homo Sapiens
LTDFCLGLE

SEQ ID NO: 555036 - protein, 9 aa, Homo Sapiens
WRALRLSTW

SEQ ID NO: 555037 - protein, 9 aa, Homo Sapiens
HRARACFPN

SEQ ID NO: 555038 - protein, 9 aa, Homo Sapiens
SALHEDTLS

SEQ ID NO: 555039 - protein, 9 aa, Homo Sapiens
HLLGLRATD

SEQ ID NO: 555040 - protein, 9 aa, Homo Sapiens
VERIWGYCT

SEQ ID NO: 555041 - protein, 9 aa, Homo Sapiens
NSHISWEML

SEQ ID NO: 555042 - protein, 9 aa, Homo Sapiens
IHSICKASG

SEQ ID NO: 555043 - protein, 9 aa, Homo Sapiens
SLEDDFDAN

SEQ ID NO: 555044 - protein, 9 aa, Homo Sapiens
NTAVCVCKE

SEQ ID NO: 555045 - protein, 9 aa, Homo Sapiens
FTLTSALHE

SEQ ID NO: 555046 - protein, 9 aa, Homo Sapiens
ADGPKGTLR

SEQ ID NO: 555047 - protein, 9 aa, Homo Sapiens
TGPGWEYAR

SEQ ID NO: 555048 - protein, 9 aa, Homo Sapiens
LQQAVPVDF

SEQ ID NO: 555049 - protein, 9 aa, Homo Sapiens
GSWRALRLS

SEQ ID NO: 555050 - protein, 9 aa, Homo Sapiens
EVCDIHPGS

SEQ ID NO: 555051 - protein, 9 aa, Homo Sapiens
ACRWQRTAR

SEQ ID NO: 555052 - protein, 9 aa, Homo Sapiens
WCPRGSHTP

SEQ ID NO: 555053 - protein, 9 aa, Homo Sapiens
FQIIPRSFE

SEQ ID NO: 555054 - protein, 9 aa, Homo Sapiens
DSHSDERPT

SEQ ID NO: 555055 - protein, 9 aa, Homo Sapiens
VMQTGNSHI

SEQ ID NO: 555056 - protein, 9 aa, Homo Sapiens
AAPRGVCYG

SEQ ID NO: 555057 - protein, 9 aa, Homo Sapiens
IVCDLIEKK

SEQ ID NO: 555058 - protein, 9 aa, Homo Sapiens
IEKKVNPPG

SEQ ID NO: 555059 - protein, 9 aa, Homo Sapiens
EHIIHLEWN

SEQ ID NO: 555060 - protein, 9 aa, Homo Sapiens
ISRISLEPG

SEQ ID NO: 555061 - protein, 9 aa, Homo Sapiens
TQVEVDETL

SEQ ID NO: 555062 - protein, 9 aa, Homo Sapiens
QLLAERYDP

SEQ ID NO: 555063 - protein, 9 aa, Homo Sapiens
SNDDNTEKH

SEQ ID NO: 555064 - protein, 9 aa, Homo Sapiens
CLASYLDKV

SEQ ID NO: 555065 - protein, 9 aa, Homo Sapiens
EDHRARACF

SEQ ID NO: 555066 - protein, 9 aa, Homo Sapiens
CDLIEKKVN

SEQ ID NO: 555067 - protein, 9 aa, Homo Sapiens
LRLSPRGVT

SEQ ID NO: 555068 - protein, 9 aa, Homo Sapiens
GKRPREGEA

SEQ ID NO: 555069 - protein, 9 aa, Homo Sapiens
RVFHLDSML

SEQ ID NO: 555070 - protein, 9 aa, Homo Sapiens
LQSCPWPRR

SEQ ID NO: 555071 - protein, 9 aa, Homo Sapiens
DGPKGTLRG

SEQ ID NO: 555072 - protein, 9 aa, Homo Sapiens
PGWEYARQM

SEQ ID NO: 555073 - protein, 9 aa, Homo Sapiens
SHSDERPTR

SEQ ID NO: 555074 - protein, 9 aa, Homo Sapiens
LRATDLQIL

SEQ ID NO: 555075 - protein, 9 aa, Homo Sapiens
DSNDDNTEK

SEQ ID NO: 555076 - protein, 9 aa, Homo Sapiens
GRGGETIHS

SEQ ID NO: 555077 - protein, 9 aa, Homo Sapiens
HPFTLTSAL

SEQ ID NO: 555078 - protein, 9 aa, Homo Sapiens
IGRGGETIH

SEQ ID NO: 555079 - protein, 9 aa, Homo Sapiens
IGFEVCDIH

SEQ ID NO: 555080 - protein, 9 aa, Homo Sapiens
SGKRPREGE

SEQ ID NO: 555081 - protein, 9 aa, Homo Sapiens
VPVDFFPHT

SEQ ID NO: 555082 - protein, 9 aa, Homo Sapiens
YARQMQQKM

SEQ ID NO: 555083 - protein, 9 aa, Homo Sapiens
EVDETLTDV

SEQ ID NO: 555084 - protein, 9 aa, Homo Sapiens
WTLTDFCLG

SEQ ID NO: 555085 - protein, 9 aa, Homo Sapiens
VDETLTDVA

SEQ ID NO: 555086 - protein, 9 aa, Homo Sapiens
VLAQPSTSG

SEQ ID NO: 555087 - protein, 9 aa, Homo Sapiens
FSDPNLDPK

SEQ ID NO: 555088 - protein, 9 aa, Homo Sapiens
STWCPRGSH

SEQ ID NO: 555089 - protein, 9 aa, Homo Sapiens
LAQGTWQMI

SEQ ID NO: 555090 - protein, 9 aa, Homo Sapiens
DCLASYLDK

SEQ ID NO: 555091 - protein, 9 aa, Homo Sapiens
MQTGNSHIS

SEQ ID NO: 555092 - protein, 9 aa, Homo Sapiens
GNGFSCMET

SEQ ID NO: 555093 - protein, 9 aa, Homo Sapiens
HSICKASGA

SEQ ID NO: 555094 - protein, 9 aa, Homo Sapiens
SLEPESCSP

SEQ ID NO: 555095 - protein, 9 aa, Homo Sapiens
PRSFEDAHW

SEQ ID NO: 555096 - protein, 9 aa, Homo Sapiens
GQASPAQAS

SEQ ID NO: 555097 - protein, 9 aa, Homo Sapiens
VTQVEVDET

SEQ ID NO: 555098 - protein, 9 aa, Homo Sapiens
IVGGCLHVL

SEQ ID NO: 555099 - protein, 9 aa, Homo Sapiens
QSCPWPRRG

SEQ ID NO: 555100 - protein, 9 aa, Homo Sapiens
GHQKPLDSN

SEQ ID NO: 555101 - protein, 9 aa, Homo Sapiens
DMFNEMEYE

SEQ ID NO: 555102 - protein, 9 aa, Homo Sapiens
CFPNMVNMI

SEQ ID NO: 555103 - protein, 9 aa, Homo Sapiens
VDRDNKGSS

SEQ ID NO: 555104 - protein, 9 aa, Homo Sapiens
PMALLSDPA

SEQ ID NO: 555105 - protein, 9 aa, Homo Sapiens
LDSHSDERP

SEQ ID NO: 555106 - protein, 9 aa, Homo Sapiens
SLLTPPNLE

SEQ ID NO: 555107 - protein, 9 aa, Homo Sapiens
IIHLEWNKD

SEQ ID NO: 555108 - protein, 9 aa, Homo Sapiens
SDMFNEMEY

SEQ ID NO: 555109 - protein, 9 aa, Homo Sapiens
LLIVMQTGN

SEQ ID NO: 555110 - protein, 9 aa, Homo Sapiens
FFPHTPHCE

SEQ ID NO: 555111 - protein, 9 aa, Homo Sapiens
QNVNHNLCS

SEQ ID NO: 555112 - protein, 9 aa, Homo Sapiens
GPKGTLRGD

SEQ ID NO: 555113 - protein, 8 aa, Homo Sapiens
DKFLDTYT

SEQ ID NO: 555114 - protein, 9 aa, Homo Sapiens
RASPGQASP

SEQ ID NO: 555115 - protein, 9 aa, Homo Sapiens
EEQHPETAD

SEQ ID NO: 555116 - protein, 9 aa, Homo Sapiens
CLAQGTWQM

SEQ ID NO: 555117 - protein, 9 aa, Homo Sapiens
RTLGQLLAE

SEQ ID NO: 555118 - protein, 9 aa, Homo Sapiens
FSELDSHSD

SEQ ID NO: 555119 - protein, 9 aa, Homo Sapiens
EEELSSIAK

SEQ ID NO: 555120 - protein, 9 aa, Homo Sapiens
CDIHPGSDP

SEQ ID NO: 555121 - protein, 9 aa, Homo Sapiens
KPKTYLRDF

SEQ ID NO: 555122 - protein, 9 aa, Homo Sapiens
QFLADNHRC

SEQ ID NO: 555123 - protein, 9 aa, Homo Sapiens
TQFLADNHR

SEQ ID NO: 555124 - protein, 9 aa, Homo Sapiens
TNDGRVVSN

SEQ ID NO: 555125 - protein, 9 aa, Homo Sapiens
SNELHLRLS

SEQ ID NO: 555126 - protein, 9 aa, Homo Sapiens
KPFLKARPG

SEQ ID NO: 555127 - protein, 9 aa, Homo Sapiens
YCTVRKKYS

SEQ ID NO: 555128 - protein, 9 aa, Homo Sapiens
ALRLSTWCP

SEQ ID NO: 555129 - protein, 9 aa, Homo Sapiens
SESLPTLSE

SEQ ID NO: 555130 - protein, 9 aa, Homo Sapiens
RGVCYGADH

SEQ ID NO: 555131 - protein, 9 aa, Homo Sapiens
LSDPAPAAD

SEQ ID NO: 555132 - protein, 9 aa, Homo Sapiens
RLSTWCPRG

SEQ ID NO: 555133 - protein, 9 aa, Homo Sapiens
LAQPSTSGK

SEQ ID NO: 555134 - protein, 9 aa, Homo Sapiens
DTPYEEQHP

SEQ ID NO: 555135 - protein, 9 aa, Homo Sapiens
VCDLIEKKV

SEQ ID NO: 555136 - protein, 9 aa, Homo Sapiens
RMHTNDGRV

SEQ ID NO: 555137 - protein, 9 aa, Homo Sapiens
SSTAMVSWH

SEQ ID NO: 555138 - protein, 9 aa, Homo Sapiens
EFSELDSHS

SEQ ID NO: 555139 - protein, 9 aa, Homo Sapiens
RRGSWRALR

SEQ ID NO: 555140 - protein, 9 aa, Homo Sapiens
NKVERIWGY

SEQ ID NO: 555141 - protein, 9 aa, Homo Sapiens
SSKFPTSLG

SEQ ID NO: 555142 - protein, 9 aa, Homo Sapiens
DISRISLEP

SEQ ID NO: 555143 - protein, 9 aa, Homo Sapiens
MEYEGGGIE

SEQ ID NO: 555144 - protein, 9 aa, Homo Sapiens
DGCLRVFHL

SEQ ID NO: 555145 - protein, 9 aa, Homo Sapiens
ASPDPAWAS

SEQ ID NO: 555146 - protein, 9 aa, Homo Sapiens
KTTDISRIS

SEQ ID NO: 555147 - protein, 9 aa, Homo Sapiens
LEDDFDAND

SEQ ID NO: 555148 - protein, 9 aa, Homo Sapiens
GSSTAMVSW

SEQ ID NO: 555149 - protein, 9 aa, Homo Sapiens
ERIWGYCTV

SEQ ID NO: 555150 - protein, 9 aa, Homo Sapiens
ETIHSICKA

SEQ ID NO: 555151 - protein, 9 aa, Homo Sapiens
GEVGAPSMQ

SEQ ID NO: 555152 - protein, 9 aa, Homo Sapiens
GGETIHSIC

SEQ ID NO: 555153 - protein, 9 aa, Homo Sapiens
LTSALHEDT

SEQ ID NO: 555154 - protein, 9 aa, Homo Sapiens
TLTDFCLGL

SEQ ID NO: 555155 - protein, 9 aa, Homo Sapiens
KARPGNGFS

SEQ ID NO: 555156 - protein, 9 aa, Homo Sapiens
STSGKRPRE

SEQ ID NO: 555157 - protein, 9 aa, Homo Sapiens
RPGNGFSCM

SEQ ID NO: 555158 - protein, 9 aa, Homo Sapiens
LTPPNLEID

SEQ ID NO: 555159 - protein, 9 aa, Homo Sapiens
PGQASPAQA

SEQ ID NO: 555160 - protein, 9 aa, Homo Sapiens
AEEELSSIA

SEQ ID NO: 555161 - protein, 9 aa, Homo Sapiens
VLGPNRRSS

SEQ ID NO: 555162 - protein, 9 aa, Homo Sapiens
FGVCDWHSD

SEQ ID NO: 555163 - protein, 9 aa, Homo Sapiens
EDAHWRETL

SEQ ID NO: 555164 - protein, 9 aa, Homo Sapiens
SLPTLSESD

SEQ ID NO: 555165 - protein, 9 aa, Homo Sapiens
HPETADGPP

SEQ ID NO: 555166 - protein, 9 aa, Homo Sapiens
MEFSELDSH

SEQ ID NO: 555167 - protein, 9 aa, Homo Sapiens
LIEKKVNPP

SEQ ID NO: 555168 - protein, 9 aa, Homo Sapiens
QHPETADGP

SEQ ID NO: 555169 - protein, 9 aa, Homo Sapiens
RACFPNMVN

SEQ ID NO: 555170 - protein, 9 aa, Homo Sapiens
LEPESCSPK

SEQ ID NO: 555171 - protein, 9 aa, Homo Sapiens
IHLEWNKDL

SEQ ID NO: 555172 - protein, 9 aa, Homo Sapiens
KESVRTVIV

SEQ ID NO: 555173 - protein, 9 aa, Homo Sapiens
WASPDPAWA

SEQ ID NO: 555174 - protein, 9 aa, Homo Sapiens
VISLEPESC

SEQ ID NO: 555175 - protein, 9 aa, Homo Sapiens
RDNKGSSTA

SEQ ID NO: 555176 - protein, 9 aa, Homo Sapiens
GLRATDLQI

SEQ ID NO: 555177 - protein, 9 aa, Homo Sapiens
RSCFGVCDW

SEQ ID NO: 555178 - protein, 9 aa, Homo Sapiens
DNHRCRVNQ

SEQ ID NO: 555179 - protein, 9 aa, Homo Sapiens
YDTPYEEQH

SEQ ID NO: 555180 - protein, 9 aa, Homo Sapiens
KERSCFGVC

SEQ ID NO: 555181 - protein, 9 aa, Homo Sapiens
TMQNLNDCL

SEQ ID NO: 555182 - protein, 9 aa, Homo Sapiens
TTDISRISL

SEQ ID NO: 555183 - protein, 9 aa, Homo Sapiens
RKERCLQVV

SEQ ID NO: 555184 - protein, 9 aa, Homo Sapiens
MALLSDPAP

SEQ ID NO: 555185 - protein, 9 aa, Homo Sapiens
YEGGGIETY

SEQ ID NO: 555186 - protein, 9 aa, Homo Sapiens
SSTDGTMTS

SEQ ID NO: 555187 - protein, 9 aa, Homo Sapiens
SDPNLDPKQ

SEQ ID NO: 555188 - protein, 9 aa, Homo Sapiens
VGAPSMQGS

SEQ ID NO: 555189 - protein, 9 aa, Homo Sapiens
TLGQLLAER

SEQ ID NO: 555190 - protein, 9 aa, Homo Sapiens
FIKGKRTGL

SEQ ID NO: 555191 - protein, 9 aa, Homo Sapiens
CLRVFHLDS

SEQ ID NO: 555192 - protein, 9 aa, Homo Sapiens
ARPGNGFSC

SEQ ID NO: 555193 - protein, 9 aa, Homo Sapiens
ASGRWASPD

SEQ ID NO: 555194 - protein, 9 aa, Homo Sapiens
TDGTMTSSD

SEQ ID NO: 555195 - protein, 9 aa, Homo Sapiens
EMEYEGGGI

SEQ ID NO: 555196 - protein, 9 aa, Homo Sapiens
FYLFQIIPR

SEQ ID NO: 555197 - protein, 9 aa, Homo Sapiens
LSESDPVPL

SEQ ID NO: 555198 - protein, 9 aa, Homo Sapiens
DFAECTKNI

SEQ ID NO: 555199 - protein, 9 aa, Homo Sapiens
PVYTRKERC

SEQ ID NO: 555200 - protein, 9 aa, Homo Sapiens
STDGTMTSS

SEQ ID NO: 555201 - protein, 9 aa, Homo Sapiens
HPVFSDPNL

SEQ ID NO: 555202 - protein, 9 aa, Homo Sapiens
QTGNSHISW

SEQ ID NO: 555203 - protein, 9 aa, Homo Sapiens
KGSSTAMVS

SEQ ID NO: 555204 - protein, 9 aa, Homo Sapiens
EWNKDLLPE

SEQ ID NO: 555205 - protein, 9 aa, Homo Sapiens
EVKYQNVNH

SEQ ID NO: 555206 - protein, 9 aa, Homo Sapiens
GGCLHVLGP

SEQ ID NO: 555207 - protein, 9 aa, Homo Sapiens
LLSDPAPAA

SEQ ID NO: 555208 - protein, 9 aa, Homo Sapiens
LDHLLGLRA

SEQ ID NO: 555209 - protein, 9 aa, Homo Sapiens
GCLHVLGPN

SEQ ID NO: 555210 - protein, 9 aa, Homo Sapiens
HHPVFSDPN

SEQ ID NO: 555211 - protein, 9 aa, Homo Sapiens
VGGCLHVLG

SEQ ID NO: 555212 - protein, 9 aa, Homo Sapiens
PFLKARPGN

SEQ ID NO: 555213 - protein, 9 aa, Homo Sapiens
MTSSDPGLE

SEQ ID NO: 555214 - protein, 9 aa, Homo Sapiens
GAPSMQGSA

SEQ ID NO: 555215 - protein, 9 aa, Homo Sapiens
ADNHRCRVN

SEQ ID NO: 555216 - protein, 9 aa, Homo Sapiens
TSLGPENSG

SEQ ID NO: 555217 - protein, 9 aa, Homo Sapiens
ESLPTLSES

SEQ ID NO: 555218 - protein, 9 aa, Homo Sapiens
HQKPLDSND

SEQ ID NO: 555219 - protein, 9 aa, Homo Sapiens
LYKCEHFYL

SEQ ID NO: 555220 - protein, 9 aa, Homo Sapiens
QQAVPVDFF

SEQ ID NO: 555221 - protein, 9 aa, Homo Sapiens
LLGLRATDL

SEQ ID NO: 555222 - protein, 9 aa, Homo Sapiens
SSAVRVAEE

SEQ ID NO: 555223 - protein, 9 aa, Homo Sapiens
HVLGPNRRS

SEQ ID NO: 555224 - protein, 9 aa, Homo Sapiens
IPRSFEDAH

SEQ ID NO: 555225 - protein, 9 aa, Homo Sapiens
SELDSHSDE

SEQ ID NO: 555226 - protein, 9 aa, Homo Sapiens
LFSNELHLR

SEQ ID NO: 555227 - protein, 9 aa, Homo Sapiens
NITLPVYTR

SEQ ID NO: 555228 - protein, 9 aa, Homo Sapiens
EALAASSAV

SEQ ID NO: 555229 - protein, 9 aa, Homo Sapiens
GVCYGADHD

SEQ ID NO: 555230 - protein, 9 aa, Homo Sapiens
TSGKRPREG

SEQ ID NO: 555231 - protein, 9 aa, Homo Sapiens
TDFCLGLEI

SEQ ID NO: 555232 - protein, 9 aa, Homo Sapiens
TPLILSVTP

SEQ ID NO: 555233 - protein, 9 aa, Homo Sapiens
PRMHTNDGR

SEQ ID NO: 555234 - protein, 9 aa, Homo Sapiens
NEMEYEGGG

SEQ ID NO: 555235 - protein, 9 aa, Homo Sapiens
LKARPGNGF

SEQ ID NO: 555236 - protein, 9 aa, Homo Sapiens
QTPLILSVT

SEQ ID NO: 555237 - protein, 9 aa, Homo Sapiens
ASPGRASPG

SEQ ID NO: 555238 - protein, 9 aa, Homo Sapiens
KEHIIHLEW

SEQ ID NO: 555239 - protein, 9 aa, Homo Sapiens
VFSDPNLDP

SEQ ID NO: 555240 - protein, 9 aa, Homo Sapiens
ELDSHSDER

SEQ ID NO: 555241 - protein, 9 aa, Homo Sapiens
LPTLSESDP

SEQ ID NO: 555242 - protein, 9 aa, Homo Sapiens
GRWASPDPA

SEQ ID NO: 555243 - protein, 9 aa, Homo Sapiens
NKGSSTAMV

SEQ ID NO: 555244 - protein, 9 aa, Homo Sapiens
HIIHLEWNK

SEQ ID NO: 555245 - protein, 9 aa, Homo Sapiens
SHISWEMLM

SEQ ID NO: 555246 - protein, 9 aa, Homo Sapiens
SCPWPRRGS

SEQ ID NO: 555247 - protein, 9 aa, Homo Sapiens
VCKESVRTV

SEQ ID NO: 555248 - protein, 9 aa, Homo Sapiens
ERSCFGVCD

SEQ ID NO: 555249 - protein, 9 aa, Homo Sapiens
ETLTDVALA

SEQ ID NO: 555250 - protein, 9 aa, Homo Sapiens
QAVPVDFFP

SEQ ID NO: 555251 - protein, 9 aa, Homo Sapiens
WPRRGSWRA

SEQ ID NO: 555252 - protein, 9 aa, Homo Sapiens
GWEYARQMQ

SEQ ID NO: 555253 - protein, 9 aa, Homo Sapiens
YIVGGCLHV

SEQ ID NO: 555254 - protein, 9 aa, Homo Sapiens
HFYLFQIIP

SEQ ID NO: 555255 - protein, 9 aa, Homo Sapiens
PSAEEELSS

SEQ ID NO: 555256 - protein, 9 aa, Homo Sapiens
LAMGYKPKT

SEQ ID NO: 555257 - protein, 9 aa, Homo Sapiens
EQHPETADG

SEQ ID NO: 555258 - protein, 9 aa, Homo Sapiens
GSLEDDFDA

SEQ ID NO: 555259 - protein, 9 aa, Homo Sapiens
TLIKPFLKA

SEQ ID NO: 555260 - protein, 9 aa, Homo Sapiens
QVISLEPES

SEQ ID NO: 555261 - protein, 9 aa, Homo Sapiens
HTGPGWEYA

SEQ ID NO: 555262 - protein, 9 aa, Homo Sapiens
LADNHRCRV

SEQ ID NO: 555263 - protein, 9 aa, Homo Sapiens
ALLSDPAPA

SEQ ID NO: 555264 - protein, 9 aa, Homo Sapiens
PYEEQHPET

SEQ ID NO: 555265 - protein, 9 aa, Homo Sapiens
GTLRGDSFP

SEQ ID NO: 555266 - protein, 9 aa, Homo Sapiens
TMTSSDPGL

SEQ ID NO: 555267 - protein, 9 aa, Homo Sapiens
LPVYTRKER

SEQ ID NO: 555268 - protein, 9 aa, Homo Sapiens
GYSVQVISL

SEQ ID NO: 555269 - protein, 9 aa, Homo Sapiens
ATWRQRSSR

SEQ ID NO: 555270 - protein, 9 aa, Homo Sapiens
PGIPSAEEE

SEQ ID NO: 555271 - protein, 9 aa, Homo Sapiens
TFGPRMHTN

SEQ ID NO: 555272 - protein, 9 aa, Homo Sapiens
MFNEMEYEG

SEQ ID NO: 555273 - protein, 9 aa, Homo Sapiens
GVLDFAECT

SEQ ID NO: 555274 - protein, 9 aa, Homo Sapiens
DEDHRARAC

SEQ ID NO: 555275 - protein, 9 aa, Homo Sapiens
FEVCDIHPG

SEQ ID NO: 555276 - protein, 9 aa, Homo Sapiens
QNLNDCLAS

SEQ ID NO: 555277 - protein, 9 aa, Homo Sapiens
GNSHISWEM

SEQ ID NO: 555278 - protein, 9 aa, Homo Sapiens
QMIENATDI

SEQ ID NO: 555279 - protein, 9 aa, Homo Sapiens
VWTLTDFCL

SEQ ID NO: 555280 - protein, 9 aa, Homo Sapiens
PIGFEVCDI

SEQ ID NO: 555281 - protein, 9 aa, Homo Sapiens
VKYQNVNHN

SEQ ID NO: 555282 - protein, 9 aa, Homo Sapiens
SPGRASPGQ

SEQ ID NO: 555283 - protein, 9 aa, Homo Sapiens
FGPRMHTND

SEQ ID NO: 555284 - protein, 9 aa, Homo Sapiens
VALACRWQR

SEQ ID NO: 555285 - protein, 9 aa, Homo Sapiens
PKERSCFGV

SEQ ID NO: 555286 - protein, 9 aa, Homo Sapiens
PVFSDPNLD

SEQ ID NO: 555287 - protein, 9 aa, Homo Sapiens
YRTLGQLLA

SEQ ID NO: 555288 - protein, 9 aa, Homo Sapiens
EELSSIAKG

SEQ ID NO: 555289 - protein, 9 aa, Homo Sapiens
LDSMLLRGL

SEQ ID NO: 555290 - protein, 9 aa, Homo Sapiens
PGRASPGQA

SEQ ID NO: 555291 - protein, 9 aa, Homo Sapiens
YQNVNHNLC

SEQ ID NO: 555292 - protein, 9 aa, Homo Sapiens
TWRQRSSRD

SEQ ID NO: 555293 - protein, 9 aa, Homo Sapiens
EPLDHLLGL

SEQ ID NO: 555294 - protein, 9 aa, Homo Sapiens
HRSLQSCPW

SEQ ID NO: 555295 - protein, 9 aa, Homo Sapiens
GVCDWHSDL

SEQ ID NO: 555296 - protein, 9 aa, Homo Sapiens
RIWGYCTVR

SEQ ID NO: 555297 - protein, 9 aa, Homo Sapiens
DETLTDVAL

SEQ ID NO: 555298 - protein, 9 aa, Homo Sapiens
CRWQRTARA

SEQ ID NO: 555299 - protein, 9 aa, Homo Sapiens
INFTVSYFI

SEQ ID NO: 555300 - protein, 9 aa, Homo Sapiens
VNKSLLTPP

SEQ ID NO: 555301 - protein, 9 aa, Homo Sapiens
IIPRSFEDA

SEQ ID NO: 555302 - protein, 9 aa, Homo Sapiens
TDISRISLE

SEQ ID NO: 555303 - protein, 9 aa, Homo Sapiens
YEALAASSA

SEQ ID NO: 555304 - protein, 9 aa, Homo Sapiens
YEVKYQNVN

SEQ ID NO: 555305 - protein, 9 aa, Homo Sapiens
ESDPVPLAP

SEQ ID NO: 555306 - protein, 9 aa, Homo Sapiens
DGTMTSSDP

SEQ ID NO: 555307 - protein, 9 aa, Homo Sapiens
LFGVLDFAE

SEQ ID NO: 555308 - protein, 9 aa, Homo Sapiens
NGFSCMETI

SEQ ID NO: 555309 - protein, 9 aa, Homo Sapiens
TRKERCLQV

SEQ ID NO: 555310 - protein, 9 aa, Homo Sapiens
FAECTKNIT

SEQ ID NO: 555311 - protein, 9 aa, Homo Sapiens
GYKPKTYLR

SEQ ID NO: 555312 - protein, 9 aa, Homo Sapiens
DFPDGSLED

SEQ ID NO: 555313 - protein, 9 aa, Homo Sapiens
NKSLLTPPN

SEQ ID NO: 555314 - protein, 9 aa, Homo Sapiens
KPLDSNDDN

SEQ ID NO: 555315 - protein, 9 aa, Homo Sapiens
LLTPPNLEI

SEQ ID NO: 555316 - protein, 9 aa, Homo Sapiens
GLGKTTDIS

SEQ ID NO: 555317 - protein, 9 aa, Homo Sapiens
WQMIENATD

SEQ ID NO: 555318 - protein, 9 aa, Homo Sapiens
HVHHPVFSD

SEQ ID NO: 555319 - protein, 9 aa, Homo Sapiens
LIKPFLKAR

SEQ ID NO: 555320 - protein, 9 aa, Homo Sapiens
LVWTLTDFC

SEQ ID NO: 555321 - protein, 9 aa, Homo Sapiens
NVNHNLCSN

SEQ ID NO: 555322 - protein, 9 aa, Homo Sapiens
QGIVATWRQ

SEQ ID NO: 555323 - protein, 9 aa, Homo Sapiens
FNEMEYEGG

SEQ ID NO: 555324 - protein, 9 aa, Homo Sapiens
AQGTWQMIE

SEQ ID NO: 555325 - protein, 9 aa, Homo Sapiens
KIVCDLIEK

SEQ ID NO: 555326 - protein, 9 aa, Homo Sapiens
PSTSGKRPR

SEQ ID NO: 555327 - protein, 9 aa, Homo Sapiens
PDGSLEDDF

SEQ ID NO: 555328 - protein, 9 aa, Homo Sapiens
TLPVYTRKE

SEQ ID NO: 555329 - protein, 9 aa, Homo Sapiens
HLEWNKDLL

SEQ ID NO: 555330 - protein, 9 aa, Homo Sapiens
PRRGSWRAL

SEQ ID NO: 555331 - protein, 9 aa, Homo Sapiens
PRGVCYGAD

SEQ ID NO: 555332 - protein, 9 aa, Homo Sapiens
IKPFLKARP

SEQ ID NO: 555333 - protein, 9 aa, Homo Sapiens
KVERIWGYC

SEQ ID NO: 555334 - protein, 9 aa, Homo Sapiens
HPIGFEVCD

SEQ ID NO: 555335 - protein, 9 aa, Homo Sapiens
PQGIVATWR

SEQ ID NO: 555336 - protein, 9 aa, Homo Sapiens
RGGETIHSI

SEQ ID NO: 555337 - protein, 9 aa, Homo Sapiens
NDDNTEKHC

SEQ ID NO: 555338 - protein, 9 aa, Homo Sapiens
ARACFPNMV

SEQ ID NO: 555339 - protein, 9 aa, Homo Sapiens
EYEGGGIET

SEQ ID NO: 555340 - protein, 9 aa, Homo Sapiens
GETIHSICK

SEQ ID NO: 555341 - protein, 9 aa, Homo Sapiens
SAEEELSSI

SEQ ID NO: 555342 - protein, 9 aa, Homo Sapiens
PGNGFSCME

SEQ ID NO: 555343 - protein, 9 aa, Homo Sapiens
ASSAVRVAE

SEQ ID NO: 555344 - protein, 9 aa, Homo Sapiens
LGLRATDLQ

SEQ ID NO: 555345 - protein, 9 aa, Homo Sapiens
TAVCVCKES

SEQ ID NO: 555346 - protein, 9 aa, Homo Sapiens
QGTWQMIEN

SEQ ID NO: 555347 - protein, 9 aa, Homo Sapiens
TLSESDPVP

SEQ ID NO: 555348 - protein, 9 aa, Homo Sapiens
KCEHFYLFQ

SEQ ID NO: 555349 - protein, 9 aa, Homo Sapiens
EVGAPSMQG

SEQ ID NO: 555350 - protein, 9 aa, Homo Sapiens
LDSNDDNTE

SEQ ID NO: 555351 - protein, 9 aa, Homo Sapiens
CESSCCRPS

SEQ ID NO: 555352 - protein, 9 aa, Homo Sapiens
PKGEVGAPS

SEQ ID NO: 555353 - protein, 9 aa, Homo Sapiens
QPSTSGKRP

SEQ ID NO: 555354 - protein, 9 aa, Homo Sapiens
DVDRDNKGS

SEQ ID NO: 555355 - protein, 9 aa, Homo Sapiens
YSVQVISLE

SEQ ID NO: 555356 - protein, 9 aa, Homo Sapiens
EYARQMQQK

SEQ ID NO: 555357 - protein, 9 aa, Homo Sapiens
PESPMALLS

SEQ ID NO: 555358 - protein, 9 aa, Homo Sapiens
FLADNHRCR

SEQ ID NO: 555359 - protein, 9 aa, Homo Sapiens
FYLAAPRGV

SEQ ID NO: 555360 - protein, 9 aa, Homo Sapiens
VCVCKESVR

SEQ ID NO: 555361 - protein, 9 aa, Homo Sapiens
SLGPENSGN

SEQ ID NO: 555362 - protein, 9 aa, Homo Sapiens
KSLLTPPNL

SEQ ID NO: 555363 - protein, 9 aa, Homo Sapiens
LAASSAVRV

SEQ ID NO: 555364 - protein, 9 aa, Homo Sapiens
VDFFPHTPH

SEQ ID NO: 555365 - protein, 9 aa, Homo Sapiens
ELSSIAKGV

SEQ ID NO: 555366 - protein, 9 aa, Homo Sapiens
MGYKPKTYL

SEQ ID NO: 555367 - protein, 9 aa, Homo Sapiens
ASPGQASPA

SEQ ID NO: 555368 - protein, 9 aa, Homo Sapiens
GTWQMIENA

SEQ ID NO: 555369 - protein, 9 aa, Homo Sapiens
RARACFPNM

SEQ ID NO: 555370 - protein, 9 aa, Homo Sapiens
RSLQSCPWP

SEQ ID NO: 555371 - protein, 9 aa, Homo Sapiens
WNKDLLPED

SEQ ID NO: 555372 - protein, 9 aa, Homo Sapiens
APRGVCYGA

SEQ ID NO: 555373 - protein, 9 aa, Homo Sapiens
LRVFHLDSM

SEQ ID NO: 555374 - protein, 9 aa, Homo Sapiens
PNLEIDPNA

SEQ ID NO: 555375 - protein, 9 aa, Homo Sapiens
TWCPRGSHT

SEQ ID NO: 555376 - protein, 9 aa, Homo Sapiens
DPAWASRRP

SEQ ID NO: 555377 - protein, 9 aa, Homo Sapiens
DFFPHTPHC

SEQ ID NO: 555378 - protein, 9 aa, Homo Sapiens
SKFPTSLGP

SEQ ID NO: 555379 - protein, 9 aa, Homo Sapiens
GEQADGPKG

SEQ ID NO: 555380 - protein, 9 aa, Homo Sapiens
APSMQGSAG

SEQ ID NO: 555381 - protein, 9 aa, Homo Sapiens
NFTVSYFIK

SEQ ID NO: 555382 - protein, 9 aa, Homo Sapiens
PSMQGSAGA

SEQ ID NO: 555383 - protein, 9 aa, Homo Sapiens
DNKGSSTAM

SEQ ID NO: 555384 - protein, 9 aa, Homo Sapiens
SPGQASPAQ

SEQ ID NO: 555385 - protein, 9 aa, Homo Sapiens
WGYCTVRKK

SEQ ID NO: 555386 - protein, 9 aa, Homo Sapiens
VFHLDSMLL

SEQ ID NO: 555387 - protein, 9 aa, Homo Sapiens
SCFGVCDWH
